United States Patent 7,888,497 (BIOINFORMATICALLY DETECTABLE GROUP OF NOVEL REGULATORY OLIGONUCLEOTIDES AND USES THEREOF) - sequence listing, part 156

SEQ ID NO: 6616382 - DNA, 22 bp, Homo sapiens
actcaaggaggtggtgaatttt

SEQ ID NO: 6616383 - DNA, 18 bp, Homo sapiens
actcaaggcggtgcttga

SEQ ID NO: 6616384 - DNA, 19 bp, Homo sapiens
actcaagggaaaggcaagc

SEQ ID NO: 6616385 - DNA, 21 bp, Homo sapiens
actcaagggaaaggcaagctt

SEQ ID NO: 6616386 - DNA, 22 bp, Homo sapiens
actcaagggaaaggcaagcttg

SEQ ID NO: 6616387 - DNA, 17 bp, Homo sapiens
actcaagggtccagaag

SEQ ID NO: 6616388 - DNA, 20 bp, Homo sapiens
actcaaggtttaaccttaaa

SEQ ID NO: 6616389 - DNA, 15 bp, Homo sapiens
actcaagtagcattt

SEQ ID NO: 6616390 - DNA, 19 bp, Homo sapiens
actcaagtgccattcatcc

SEQ ID NO: 6616391 - DNA, 15 bp, Homo sapiens
actcaagtgtcacct

SEQ ID NO: 6616392 - DNA, 22 bp, Homo sapiens
actcaagtgtcacctccttccc

SEQ ID NO: 6616393 - DNA, 22 bp, Homo sapiens
actcaagtgtctcagtccacct

SEQ ID NO: 6616394 - DNA, 17 bp, Homo sapiens
actcaagttcaaggacc

SEQ ID NO: 6616395 - DNA, 18 bp, Homo sapiens
actcaagttgattagaaa

SEQ ID NO: 6616396 - DNA, 13 bp, Homo sapiens
actcaataaaaga

SEQ ID NO: 6616397 - DNA, 14 bp, Homo sapiens
actcaataaaagaa

SEQ ID NO: 6616398 - DNA, 18 bp, Homo sapiens
actcaataaaatcatgta

SEQ ID NO: 6616399 - DNA, 18 bp, Homo sapiens
actcaataaattgcaaca

SEQ ID NO: 6616400 - DNA, 23 bp, Homo sapiens
actcaataaattgcaacatatta

SEQ ID NO: 6616401 - DNA, 23 bp, Homo sapiens
actcaatatatagttagctttat

SEQ ID NO: 6616402 - DNA, 22 bp, Homo sapiens
actcaatatgtgatttttgtga

SEQ ID NO: 6616403 - DNA, 18 bp, Homo sapiens
actcaatattttccatga

SEQ ID NO: 6616404 - DNA, 23 bp, Homo sapiens
actcaatattttccatgaaaatg

SEQ ID NO: 6616405 - DNA, 15 bp, Homo sapiens
actcaatcaagcaaa

SEQ ID NO: 6616406 - DNA, 22 bp, Homo sapiens
actcaatcaagcaaaatttctg

SEQ ID NO: 6616407 - DNA, 14 bp, Homo sapiens
actcaatgcactga

SEQ ID NO: 6616408 - DNA, 19 bp, Homo sapiens
actcaatggtatcattaca

SEQ ID NO: 6616409 - DNA, 23 bp, Homo sapiens
actcaatgtgcaagttgtactgt

SEQ ID NO: 6616410 - DNA, 19 bp, Homo sapiens
actcaatgtggaaaaaata

SEQ ID NO: 6616411 - DNA, 22 bp, Homo sapiens
actcaatgtggaaaaaatattt

SEQ ID NO: 6616412 - DNA, 13 bp, Homo sapiens
actcaatgtttct

SEQ ID NO: 6616413 - DNA, 14 bp, Homo sapiens
actcaatgtttctg

SEQ ID NO: 6616414 - DNA, 20 bp, Homo sapiens
actcaatgtttctggacatt

SEQ ID NO: 6616415 - DNA, 21 bp, Homo sapiens
actcaatgtttctggacattc

SEQ ID NO: 6616416 - DNA, 22 bp, Homo sapiens
actcaatgtttctggacattct

SEQ ID NO: 6616417 - DNA, 23 bp, Homo sapiens
actcaatgtttctggacattctc

SEQ ID NO: 6616418 - DNA, 15 bp, Homo sapiens
actcaattgataaac

SEQ ID NO: 6616419 - DNA, 16 bp, Homo sapiens
actcaatttctcccca

SEQ ID NO: 6616420 - DNA, 17 bp, Homo sapiens
actcaatttctccccag

SEQ ID NO: 6616421 - DNA, 12 bp, Homo sapiens
actcaattttaa

SEQ ID NO: 6616422 - DNA, 13 bp, Homo sapiens
actcacaaaaggc

SEQ ID NO: 6616423 - DNA, 22 bp, Homo sapiens
actcacaatttaaaatatttcc

SEQ ID NO: 6616424 - DNA, 15 bp, Homo sapiens
actcacacagccagg

SEQ ID NO: 6616425 - DNA, 14 bp, Homo sapiens
actcacacaggacc

SEQ ID NO: 6616426 - DNA, 12 bp, Homo sapiens
actcacacaggc

SEQ ID NO: 6616427 - DNA, 22 bp, Homo sapiens
actcacacaggcatttcctggg

SEQ ID NO: 6616428 - DNA, 17 bp, Homo sapiens
actcacaccactagcct

SEQ ID NO: 6616429 - DNA, 14 bp, Homo sapiens
actcacacctcctt

SEQ ID NO: 6616430 - DNA, 16 bp, Homo sapiens
actcacacctcctttt

SEQ ID NO: 6616431 - DNA, 17 bp, Homo sapiens
actcacacctccttttc

SEQ ID NO: 6616432 - DNA, 14 bp, Homo sapiens
actcacactggcca

SEQ ID NO: 6616433 - DNA, 14 bp, Homo sapiens
actcacagacctgg

SEQ ID NO: 6616434 - DNA, 18 bp, Homo sapiens
actcacagagacacaggg

SEQ ID NO: 6616435 - DNA, 18 bp, Homo sapiens
actcacagagtcaaggcc

SEQ ID NO: 6616436 - DNA, 19 bp, Homo sapiens
actcacagagtcaaggcct

SEQ ID NO: 6616437 - DNA, 22 bp, Homo sapiens
actcacagcacttgttttcagg

SEQ ID NO: 6616438 - DNA, 22 bp, Homo sapiens
actcacagccgcattggtgact

SEQ ID NO: 6616439 - DNA, 15 bp, Homo sapiens
actcacagcttctcc

SEQ ID NO: 6616440 - DNA, 22 bp, Homo sapiens
actcacagcttctccaagcatc

SEQ ID NO: 6616441 - DNA, 11 bp, Homo sapiens
actcacaggcc

SEQ ID NO: 6616442 - DNA, 16 bp, Homo sapiens
actcacagtgctttta

SEQ ID NO: 6616443 - DNA, 19 bp, Homo sapiens
actcacatggctatgtttt

SEQ ID NO: 6616444 - DNA, 20 bp, Homo sapiens
actcacatggctatgtttta

SEQ ID NO: 6616445 - DNA, 19 bp, Homo sapiens
actcacattgagagtaagc

SEQ ID NO: 6616446 - DNA, 18 bp, Homo sapiens
actcacattgccttgagc

SEQ ID NO: 6616447 - DNA, 20 bp, Homo sapiens
actcacattgttcaactccc

SEQ ID NO: 6616448 - DNA, 20 bp, Homo sapiens
actcacatttattctgctca

SEQ ID NO: 6616449 - DNA, 21 bp, Homo sapiens
actcacatttattctgctcac

SEQ ID NO: 6616450 - DNA, 16 bp, Homo sapiens
actcaccaacttgcca

SEQ ID NO: 6616451 - DNA, 17 bp, Homo sapiens
actcaccacaagctgag

SEQ ID NO: 6616452 - DNA, 20 bp, Homo sapiens
actcaccacaagctgagcag

SEQ ID NO: 6616453 - DNA, 22 bp, Homo sapiens
actcaccacaagctgagcagga

SEQ ID NO: 6616454 - DNA, 12 bp, Homo sapiens
actcaccagccc

SEQ ID NO: 6616455 - DNA, 20 bp, Homo sapiens
actcaccagccccactgcca

SEQ ID NO: 6616456 - DNA, 13 bp, Homo sapiens
actcaccagccct

SEQ ID NO: 6616457 - DNA, 16 bp, Homo sapiens
actcaccagcctctgc

SEQ ID NO: 6616458 - DNA, 13 bp, Homo sapiens
actcaccagggtc

SEQ ID NO: 6616459 - DNA, 14 bp, Homo sapiens
actcaccagggtcc

SEQ ID NO: 6616460 - DNA, 15 bp, Homo sapiens
actcaccagggtccg

SEQ ID NO: 6616461 - DNA, 21 bp, Homo sapiens
actcaccagggtccgcaccag

SEQ ID NO: 6616462 - DNA, 16 bp, Homo sapiens
actcaccagtggcctt

SEQ ID NO: 6616463 - DNA, 17 bp, Homo sapiens
actcaccagtgtcccct

SEQ ID NO: 6616464 - DNA, 16 bp, Homo sapiens
actcaccatatttgaa

SEQ ID NO: 6616465 - DNA, 22 bp, Homo sapiens
actcaccatatttgaattggcc

SEQ ID NO: 6616466 - DNA, 15 bp, Homo sapiens
actcaccatgtaaaa

SEQ ID NO: 6616467 - DNA, 14 bp, Homo sapiens
actcaccatttcat

SEQ ID NO: 6616468 - DNA, 18 bp, Homo sapiens
actcacccatgtgccaag

SEQ ID NO: 6616469 - DNA, 23 bp, Homo sapiens
actcaccccaaacccagaacatg

SEQ ID NO: 6616470 - DNA, 14 bp, Homo sapiens
actcaccccagccc

SEQ ID NO: 6616471 - DNA, 17 bp, Homo sapiens
actcaccccagccccaa

SEQ ID NO: 6616472 - DNA, 16 bp, Homo sapiens
actcaccccagcctca

SEQ ID NO: 6616473 - DNA, 19 bp, Homo sapiens
actcaccccggcagacgcc

SEQ ID NO: 6616474 - DNA, 15 bp, Homo sapiens
actcacccctagccc

SEQ ID NO: 6616475 - DNA, 19 bp, Homo sapiens
actcacccctagccctggt

SEQ ID NO: 6616476 - DNA, 15 bp, Homo sapiens
actcacccttcctgg

SEQ ID NO: 6616477 - DNA, 22 bp, Homo sapiens
actcacccttcctggcccaggc

SEQ ID NO: 6616478 - DNA, 17 bp, Homo sapiens
actcaccgaagccactt

SEQ ID NO: 6616479 - DNA, 20 bp, Homo sapiens
actcaccgtgctgtcttctg

SEQ ID NO: 6616480 - DNA, 23 bp, Homo sapiens
actcaccgtgctgtcttctggtc

SEQ ID NO: 6616481 - DNA, 19 bp, Homo sapiens
actcacctcccccatctct

SEQ ID NO: 6616482 - DNA, 12 bp, Homo sapiens
actcacctcctc

SEQ ID NO: 6616483 - DNA, 15 bp, Homo sapiens
actcacctctctcta

SEQ ID NO: 6616484 - DNA, 11 bp, Homo sapiens
actcacctctg

SEQ ID NO: 6616485 - DNA, 13 bp, Homo sapiens
actcacctctgcc

SEQ ID NO: 6616486 - DNA, 14 bp, Homo sapiens
actcacctctgcct

SEQ ID NO: 6616487 - DNA, 16 bp, Homo sapiens
actcacctctgcctca

SEQ ID NO: 6616488 - DNA, 11 bp, Homo sapiens
actcacctgcg

SEQ ID NO: 6616489 - DNA, 22 bp, Homo sapiens
actcacctgcgcaagtgcctgg

SEQ ID NO: 6616490 - DNA, 12 bp, Homo sapiens
actcacctgggg

SEQ ID NO: 6616491 - DNA, 12 bp, Homo sapiens
actcaccttcta

SEQ ID NO: 6616492 - DNA, 23 bp, Homo sapiens
actcacgataaataatcggccca

SEQ ID NO: 6616493 - DNA, 16 bp, Homo sapiens
actcacgatgaaattg

SEQ ID NO: 6616494 - DNA, 20 bp, Homo sapiens
actcacggctgcacctgcag

SEQ ID NO: 6616495 - DNA, 22 bp, Homo sapiens
actcacggctgcacctgcaggg

SEQ ID NO: 6616496 - DNA, 17 bp, Homo sapiens
actcactaacagggaga

SEQ ID NO: 6616497 - DNA, 15 bp, Homo sapiens
actcactaggccccc

SEQ ID NO: 6616498 - DNA, 22 bp, Homo sapiens
actcactaggcccccacttgcc

SEQ ID NO: 6616499 - DNA, 19 bp, Homo sapiens
actcactcaagttcaagga

SEQ ID NO: 6616500 - DNA, 14 bp, Homo sapiens
actcactcactcca

SEQ ID NO: 6616501 - DNA, 16 bp, Homo sapiens
actcactcactcccca

SEQ ID NO: 6616502 - DNA, 17 bp, Homo sapiens
actcactcactccccac

SEQ ID NO: 6616503 - DNA, 12 bp, Homo sapiens
actcactccaag

SEQ ID NO: 6616504 - DNA, 13 bp, Homo sapiens
actcactccaaga

SEQ ID NO: 6616505 - DNA, 15 bp, Homo sapiens
actcactccaagacc

SEQ ID NO: 6616506 - DNA, 13 bp, Homo sapiens
actcactcctgag

SEQ ID NO: 6616507 - DNA, 16 bp, Homo sapiens
actcactcctgagacc

SEQ ID NO: 6616508 - DNA, 16 bp, Homo sapiens
actcactctgggctgt

SEQ ID NO: 6616509 - DNA, 13 bp, Homo sapiens
actcactgaagcc

SEQ ID NO: 6616510 - DNA, 21 bp, Homo sapiens
actcactgaggccatcagggc

SEQ ID NO: 6616511 - DNA, 13 bp, Homo sapiens
actcactgcctag

SEQ ID NO: 6616512 - DNA, 17 bp, Homo sapiens
actcactgcctgcagct

SEQ ID NO: 6616513 - DNA, 15 bp, Homo sapiens
actcactgctcaaga

SEQ ID NO: 6616514 - DNA, 22 bp, Homo sapiens
actcactgctcaagaagacatg

SEQ ID NO: 6616515 - DNA, 12 bp, Homo sapiens
actcactggaat

SEQ ID NO: 6616516 - DNA, 15 bp, Homo sapiens
actcactggcagccc

SEQ ID NO: 6616517 - DNA, 17 bp, Homo sapiens
actcactggcagcccca

SEQ ID NO: 6616518 - DNA, 20 bp, Homo sapiens
actcactggcagccccagca

SEQ ID NO: 6616519 - DNA, 21 bp, Homo sapiens
actcactgggaagctcccacc

SEQ ID NO: 6616520 - DNA, 19 bp, Homo sapiens
actcactggtggttttccg

SEQ ID NO: 6616521 - DNA, 14 bp, Homo sapiens
actcactgtcaatg

SEQ ID NO: 6616522 - DNA, 11 bp, Homo sapiens
actcactgtgc

SEQ ID NO: 6616523 - DNA, 23 bp, Homo sapiens
actcacttcaatgtgtcatttcc

SEQ ID NO: 6616524 - DNA, 14 bp, Homo sapiens
actcacttcatgtt

SEQ ID NO: 6616525 - DNA, 14 bp, Homo sapiens
actcacttctcagc

SEQ ID NO: 6616526 - DNA, 22 bp, Homo sapiens
actcacttgatgtttcctggaa

SEQ ID NO: 6616527 - DNA, 12 bp, Homo sapiens
actcacttgcca

SEQ ID NO: 6616528 - DNA, 13 bp, Homo sapiens
actcacttttcac

SEQ ID NO: 6616529 - DNA, 15 bp, Homo sapiens
actcacttttcactt

SEQ ID NO: 6616530 - DNA, 19 bp, Homo sapiens
actcacttttcacttgtct

SEQ ID NO: 6616531 - DNA, 17 bp, Homo sapiens
actcacttttcccactc

SEQ ID NO: 6616532 - DNA, 18 bp, Homo sapiens
actcagaaaattccctgg

SEQ ID NO: 6616533 - DNA, 19 bp, Homo sapiens
actcagaaacagaagaaaa

SEQ ID NO: 6616534 - DNA, 22 bp, Homo sapiens
actcagaaacagaagaaaaaca

SEQ ID NO: 6616535 - DNA, 14 bp, Homo sapiens
actcagaaacatca

SEQ ID NO: 6616536 - DNA, 15 bp, Homo sapiens
actcagaaacatcag

SEQ ID NO: 6616537 - DNA, 18 bp, Homo sapiens
actcagaaactccatgat

SEQ ID NO: 6616538 - DNA, 14 bp, Homo sapiens
actcagaaattttt

SEQ ID NO: 6616539 - DNA, 19 bp, Homo sapiens
actcagaactctccaggga

SEQ ID NO: 6616540 - DNA, 23 bp, Homo sapiens
actcagaactgtcggaggaaaga

SEQ ID NO: 6616541 - DNA, 15 bp, Homo sapiens
actcagaagacactg

SEQ ID NO: 6616542 - DNA, 16 bp, Homo sapiens
actcagaagacactga

SEQ ID NO: 6616543 - DNA, 13 bp, Homo sapiens
actcagaagcctg

SEQ ID NO: 6616544 - DNA, 15 bp, Homo sapiens
actcagaagcctgag

SEQ ID NO: 6616545 - DNA, 15 bp, Homo sapiens
actcagaagcctggg

SEQ ID NO: 6616546 - DNA, 22 bp, Homo sapiens
actcagaagcctgggggcctgg

SEQ ID NO: 6616547 - DNA, 23 bp, Homo sapiens
actcagaagcctgggggcctggc

SEQ ID NO: 6616548 - DNA, 14 bp, Homo sapiens
actcagaatattgc

SEQ ID NO: 6616549 - DNA, 14 bp, Homo sapiens
actcagaattctct

SEQ ID NO: 6616550 - DNA, 22 bp, Homo sapiens
actcagaattctctagtttgat

SEQ ID NO: 6616551 - DNA, 19 bp, Homo sapiens
actcagacaggaaagggaa

SEQ ID NO: 6616552 - DNA, 19 bp, Homo sapiens
actcagactcctggcttca

SEQ ID NO: 6616553 - DNA, 22 bp, Homo sapiens
actcagagaaaaatgctcccca

SEQ ID NO: 6616554 - DNA, 20 bp, Homo sapiens
actcagagaaccagtgcaga

SEQ ID NO: 6616555 - DNA, 11 bp, Homo sapiens
actcagagcag

SEQ ID NO: 6616556 - DNA, 13 bp, Homo sapiens
actcagagctgcg

SEQ ID NO: 6616557 - DNA, 15 bp, Homo sapiens
actcagagctgcggg

SEQ ID NO: 6616558 - DNA, 17 bp, Homo sapiens
actcagagctgcgggct

SEQ ID NO: 6616559 - DNA, 18 bp, Homo sapiens
actcagaggcccccagtg

SEQ ID NO: 6616560 - DNA, 22 bp, Homo sapiens
actcagaggcccccagtgggga

SEQ ID NO: 6616561 - DNA, 14 bp, Homo sapiens
actcagagggagga

SEQ ID NO: 6616562 - DNA, 15 bp, Homo sapiens
actcagaggtccagg

SEQ ID NO: 6616563 - DNA, 22 bp, Homo sapiens
actcagagttctatactgtaaa

SEQ ID NO: 6616564 - DNA, 15 bp, Homo sapiens
actcagatcactact

SEQ ID NO: 6616565 - DNA, 11 bp, Homo sapiens
actcagatcca

SEQ ID NO: 6616566 - DNA, 17 bp, Homo sapiens
actcagatccagggaca

SEQ ID NO: 6616567 - DNA, 16 bp, Homo sapiens
actcagatcctcctca

SEQ ID NO: 6616568 - DNA, 23 bp, Homo sapiens
actcagatctgatcaagagtccg

SEQ ID NO: 6616569 - DNA, 16 bp, Homo sapiens
actcagatgaggacag

SEQ ID NO: 6616570 - DNA, 19 bp, Homo sapiens
actcagatgatgccagctg

SEQ ID NO: 6616571 - DNA, 22 bp, Homo sapiens
actcagatggaaccgcaggaag

SEQ ID NO: 6616572 - DNA, 23 bp, Homo sapiens
actcagatggaaccgcaggaagc

SEQ ID NO: 6616573 - DNA, 18 bp, Homo sapiens
actcagatttaaaacaag

SEQ ID NO: 6616574 - DNA, 18 bp, Homo sapiens
actcagatttaagcctta

SEQ ID NO: 6616575 - DNA, 21 bp, Homo sapiens
actcagatttaagccttacaa

SEQ ID NO: 6616576 - DNA, 22 bp, Homo sapiens
actcagatttaagccttacaaa

SEQ ID NO: 6616577 - DNA, 17 bp, Homo sapiens
actcagcaccactcaag

SEQ ID NO: 6616578 - DNA, 21 bp, Homo sapiens
actcagcagacatttatcttt

SEQ ID NO: 6616579 - DNA, 14 bp, Homo sapiens
actcagcagccctc

SEQ ID NO: 6616580 - DNA, 20 bp, Homo sapiens
actcagcagccctcctcacc

SEQ ID NO: 6616581 - DNA, 23 bp, Homo sapiens
actcagcagccctcctcaccccg

SEQ ID NO: 6616582 - DNA, 19 bp, Homo sapiens
actcagcagtaagcaggcc

SEQ ID NO: 6616583 - DNA, 15 bp, Homo sapiens
actcagccaagcaca

SEQ ID NO: 6616584 - DNA, 23 bp, Homo sapiens
actcagccaagcacagtggtggc

SEQ ID NO: 6616585 - DNA, 17 bp, Homo sapiens
actcagccacaaagccc

SEQ ID NO: 6616586 - DNA, 11 bp, Homo sapiens
actcagccacg

SEQ ID NO: 6616587 - DNA, 17 bp, Homo sapiens
actcagccacgaccagc

SEQ ID NO: 6616588 - DNA, 15 bp, Homo sapiens
actcagccactgtca

SEQ ID NO: 6616589 - DNA, 18 bp, Homo sapiens
actcagccatttccccct

SEQ ID NO: 6616590 - DNA, 21 bp, Homo sapiens
actcagccatttccccctcct

SEQ ID NO: 6616591 - DNA, 22 bp, Homo sapiens
actcagccatttccccctcctc

SEQ ID NO: 6616592 - DNA, 15 bp, Homo sapiens
actcagcccctaccc

SEQ ID NO: 6616593 - DNA, 21 bp, Homo sapiens
actcagcccctacccctgccc

SEQ ID NO: 6616594 - DNA, 14 bp, Homo sapiens
actcagcccctagg

SEQ ID NO: 6616595 - DNA, 16 bp, Homo sapiens
actcagccccttcccg

SEQ ID NO: 6616596 - DNA, 14 bp, Homo sapiens
actcagccctgagg

SEQ ID NO: 6616597 - DNA, 15 bp, Homo sapiens
actcagccctgaggt

SEQ ID NO: 6616598 - DNA, 12 bp, Homo sapiens
actcagccctgg

SEQ ID NO: 6616599 - DNA, 14 bp, Homo sapiens
actcagccctgggc

SEQ ID NO: 6616600 - DNA, 13 bp, Homo sapiens
actcagcctctgc

SEQ ID NO: 6616601 - DNA, 12 bp, Homo sapiens
actcagcctgca

SEQ ID NO: 6616602 - DNA, 15 bp, Homo sapiens
actcagcctgcagtt

SEQ ID NO: 6616603 - DNA, 15 bp, Homo sapiens
actcagcctgctgcc

SEQ ID NO: 6616604 - DNA, 22 bp, Homo sapiens
actcagcctgctgcccaggctg

SEQ ID NO: 6616605 - DNA, 23 bp, Homo sapiens
actcagcctgttccttcctgcag

SEQ ID NO: 6616606 - DNA, 12 bp, Homo sapiens
actcagccttaa

SEQ ID NO: 6616607 - DNA, 12 bp, Homo sapiens
actcagccttgc

SEQ ID NO: 6616608 - DNA, 13 bp, Homo sapiens
actcagccttgca

SEQ ID NO: 6616609 - DNA, 20 bp, Homo sapiens
actcagccttgcaaatagcc

SEQ ID NO: 6616610 - DNA, 12 bp, Homo sapiens
actcagcctttt

SEQ ID NO: 6616611 - DNA, 14 bp, Homo sapiens
actcagctccagaa

SEQ ID NO: 6616612 - DNA, 14 bp, Homo sapiens
actcagctccgtga

SEQ ID NO: 6616613 - DNA, 19 bp, Homo sapiens
actcagctctcctgctgca

SEQ ID NO: 6616614 - DNA, 20 bp, Homo sapiens
actcagctctcctgctgcag

SEQ ID NO: 6616615 - DNA, 14 bp, Homo sapiens
actcagctctgtct

SEQ ID NO: 6616616 - DNA, 20 bp, Homo sapiens
actcagctgagaaggccagc

SEQ ID NO: 6616617 - DNA, 17 bp, Homo sapiens
actcagctgctatactt

SEQ ID NO: 6616618 - DNA, 21 bp, Homo sapiens
actcagctggaagtctacctg

SEQ ID NO: 6616619 - DNA, 18 bp, Homo sapiens
actcagcttaattctcct

SEQ ID NO: 6616620 - DNA, 19 bp, Homo sapiens
actcagcttaattctcctt

SEQ ID NO: 6616621 - DNA, 19 bp, Homo sapiens
actcagcttcggggccggt

SEQ ID NO: 6616622 - DNA, 16 bp, Homo sapiens
actcaggaaagaggag

SEQ ID NO: 6616623 - DNA, 15 bp, Homo sapiens
actcaggaaccctgg

SEQ ID NO: 6616624 - DNA, 17 bp, Homo sapiens
actcaggacagaacagt

SEQ ID NO: 6616625 - DNA, 14 bp, Homo sapiens
actcaggactccag

SEQ ID NO: 6616626 - DNA, 13 bp, Homo sapiens
actcaggagcaca

SEQ ID NO: 6616627 - DNA, 16 bp, Homo sapiens
actcaggagcacagcc

SEQ ID NO: 6616628 - DNA, 13 bp, Homo sapiens
actcaggaggctg

SEQ ID NO: 6616629 - DNA, 19 bp, Homo sapiens
actcaggaggctgagacag

SEQ ID NO: 6616630 - DNA, 21 bp, Homo sapiens
actcaggaggctgagacagga

SEQ ID NO: 6616631 - DNA, 20 bp, Homo sapiens
actcaggaggctgaggcaca

SEQ ID NO: 6616632 - DNA, 19 bp, Homo sapiens
actcaggaggctgaggcag

SEQ ID NO: 6616633 - DNA, 20 bp, Homo sapiens
actcaggaggctgaggcagg

SEQ ID NO: 6616634 - DNA, 17 bp, Homo sapiens
actcaggaggctgaggg

SEQ ID NO: 6616635 - DNA, 12 bp, Homo sapiens
actcaggatcca

SEQ ID NO: 6616636 - DNA, 17 bp, Homo sapiens
actcaggatgccaagtg

SEQ ID NO: 6616637 - DNA, 15 bp, Homo sapiens
actcaggatgcccag

SEQ ID NO: 6616638 - DNA, 16 bp, Homo sapiens
actcaggatgcccagg

SEQ ID NO: 6616639 - DNA, 22 bp, Homo sapiens
actcaggatttaaaaactggaa

SEQ ID NO: 6616640 - DNA, 11 bp, Homo sapiens
actcaggcaga

SEQ ID NO: 6616641 - DNA, 17 bp, Homo sapiens
actcaggcagcctgtgg

SEQ ID NO: 6616642 - DNA, 22 bp, Homo sapiens
actcaggcagcctgtgggtcct

SEQ ID NO: 6616643 - DNA, 24 bp, Homo sapiens
actcaggccacagtggggctgcag

SEQ ID NO: 6616644 - DNA, 12 bp, Homo sapiens
actcaggcccac

SEQ ID NO: 6616645 - DNA, 14 bp, Homo sapiens
actcaggcccacat

SEQ ID NO: 6616646 - DNA, 15 bp, Homo sapiens
actcaggcccacatt

SEQ ID NO: 6616647 - DNA, 19 bp, Homo sapiens
actcaggcctctgcagaag

SEQ ID NO: 6616648 - DNA, 15 bp, Homo sapiens
actcaggcctgccaa

SEQ ID NO: 6616649 - DNA, 16 bp, Homo sapiens
actcaggcctgccaat

SEQ ID NO: 6616650 - DNA, 14 bp, Homo sapiens
actcaggctttcta

SEQ ID NO: 6616651 - DNA, 15 bp, Homo sapiens
actcaggctttctat

SEQ ID NO: 6616652 - DNA, 15 bp, Homo sapiens
actcagggacagagc

SEQ ID NO: 6616653 - DNA, 17 bp, Homo sapiens
actcagggacagagcca

SEQ ID NO: 6616654 - DNA, 18 bp, Homo sapiens
actcagggacagagccat

SEQ ID NO: 6616655 - DNA, 12 bp, Homo sapiens
actcagggacct

SEQ ID NO: 6616656 - DNA, 21 bp, Homo sapiens
actcagggaggctaaatcagt

SEQ ID NO: 6616657 - DNA, 17 bp, Homo sapiens
actcagggcagcgccag

SEQ ID NO: 6616658 - DNA, 22 bp, Homo sapiens
actcagggcagcgccaggctga

SEQ ID NO: 6616659 - DNA, 17 bp, Homo sapiens
actcagggcagctgcct

SEQ ID NO: 6616660 - DNA, 22 bp, Homo sapiens
actcagggcagctgcctggcca

SEQ ID NO: 6616661 - DNA, 23 bp, Homo sapiens
actcagggcagctgcctggccat

SEQ ID NO: 6616662 - DNA, 16 bp, Homo sapiens
actcagggcattctgt

SEQ ID NO: 6616663 - DNA, 18 bp, Homo sapiens
actcagggccatgcctgc

SEQ ID NO: 6616664 - DNA, 13 bp, Homo sapiens
actcagggcccca

SEQ ID NO: 6616665 - DNA, 22 bp, Homo sapiens
actcagggccccagcactaaag

SEQ ID NO: 6616666 - DNA, 14 bp, Homo sapiens
actcagggctcctc

SEQ ID NO: 6616667 - DNA, 18 bp, Homo sapiens
actcagggctcctcccag

SEQ ID NO: 6616668 - DNA, 16 bp, Homo sapiens
actcagggctgccact

SEQ ID NO: 6616669 - DNA, 23 bp, Homo sapiens
actcagggctggggccaagagga

SEQ ID NO: 6616670 - DNA, 19 bp, Homo sapiens
actcagggtctgggatgaa

SEQ ID NO: 6616671 - DNA, 19 bp, Homo sapiens
actcagggttcatctgtcc

SEQ ID NO: 6616672 - DNA, 20 bp, Homo sapiens
actcagggttcatctgtcca

SEQ ID NO: 6616673 - DNA, 15 bp, Homo sapiens
actcaggtctgtaac

SEQ ID NO: 6616674 - DNA, 16 bp, Homo sapiens
actcaggtctgtaact

SEQ ID NO: 6616675 - DNA, 17 bp, Homo sapiens
actcaggtctgtaactg

SEQ ID NO: 6616676 - DNA, 23 bp, Homo sapiens
actcaggtctgtaactgcccagc

SEQ ID NO: 6616677 - DNA, 22 bp, Homo sapiens
actcaggtgcacacatcaccag

SEQ ID NO: 6616678 - DNA, 15 bp, Homo sapiens
actcaggtggcccta

SEQ ID NO: 6616679 - DNA, 23 bp, Homo sapiens
actcaggtggtgtccttcttcct

SEQ ID NO: 6616680 - DNA, 21 bp, Homo sapiens
actcaggttcttcagggccag

SEQ ID NO: 6616681 - DNA, 20 bp, Homo sapiens
actcaggttgtagtaaagaa

SEQ ID NO: 6616682 - DNA, 21 bp, Homo sapiens
actcaggttgtagtaaagaaa

SEQ ID NO: 6616683 - DNA, 22 bp, Homo sapiens
actcaggttgtagtaaagaaat

SEQ ID NO: 6616684 - DNA, 18 bp, Homo sapiens
actcaggttgtctgtaga

SEQ ID NO: 6616685 - DNA, 22 bp, Homo sapiens
actcaggttgtctgtagagaat

SEQ ID NO: 6616686 - DNA, 23 bp, Homo sapiens
actcaggtttccggctactgaca

SEQ ID NO: 6616687 - DNA, 23 bp, Homo sapiens
actcaggtttgagaaaaaggaaa

SEQ ID NO: 6616688 - DNA, 20 bp, Homo sapiens
actcagtaaatcagtgcagt

SEQ ID NO: 6616689 - DNA, 18 bp, Homo sapiens
actcagtcagcccagtgg

SEQ ID NO: 6616690 - DNA, 16 bp, Homo sapiens
actcagtcccccacca

SEQ ID NO: 6616691 - DNA, 19 bp, Homo sapiens
actcagtgaaatcatatta

SEQ ID NO: 6616692 - DNA, 12 bp, Homo sapiens
actcagtgcaga

SEQ ID NO: 6616693 - DNA, 23 bp, Homo sapiens
actcagtgggccaattgttctta

SEQ ID NO: 6616694 - DNA, 19 bp, Homo sapiens
actcagtgggctgtttctg

SEQ ID NO: 6616695 - DNA, 14 bp, Homo sapiens
actcagtggggagg

SEQ ID NO: 6616696 - DNA, 15 bp, Homo sapiens
actcagtgtatttta

SEQ ID NO: 6616697 - DNA, 23 bp, Homo sapiens
actcagtgtgtgatccggtttct

SEQ ID NO: 6616698 - DNA, 20 bp, Homo sapiens
actcagttaaatctttgaag

SEQ ID NO: 6616699 - DNA, 20 bp, Homo sapiens
actcagttaggcagtgcagt

SEQ ID NO: 6616700 - DNA, 22 bp, Homo sapiens
actcagttccaggcctgatctt

SEQ ID NO: 6616701 - DNA, 17 bp, Homo sapiens
actcagttcttggcctg

SEQ ID NO: 6616702 - DNA, 19 bp, Homo sapiens
actcagtttgtcagacttt

SEQ ID NO: 6616703 - DNA, 22 bp, Homo sapiens
actcagttttaactagaattta

SEQ ID NO: 6616704 - DNA, 17 bp, Homo sapiens
actcagttttttgtaac

SEQ ID NO: 6616705 - DNA, 16 bp, Homo sapiens
actcataaaggacact

SEQ ID NO: 6616706 - DNA, 18 bp, Homo sapiens
actcataaaggtttttgt

SEQ ID NO: 6616707 - DNA, 19 bp, Homo sapiens
actcataagagtttagcac

SEQ ID NO: 6616708 - DNA, 17 bp, Homo sapiens
actcatacagtggtatt

SEQ ID NO: 6616709 - DNA, 14 bp, Homo sapiens
actcatacatctgg

SEQ ID NO: 6616710 - DNA, 23 bp, Homo sapiens
actcatactgtgctggagccact

SEQ ID NO: 6616711 - DNA, 16 bp, Homo sapiens
actcatagggtgctct

SEQ ID NO: 6616712 - DNA, 20 bp, Homo sapiens
actcatagggtgctctgagg

SEQ ID NO: 6616713 - DNA, 14 bp, Homo sapiens
actcataggtccct

SEQ ID NO: 6616714 - DNA, 17 bp, Homo sapiens
actcataggtccctgac

SEQ ID NO: 6616715 - DNA, 19 bp, Homo sapiens
actcatataattatatgtt

SEQ ID NO: 6616716 - DNA, 23 bp, Homo sapiens
actcatataattatatgttgtaa

SEQ ID NO: 6616717 - DNA, 21 bp, Homo sapiens
actcatatgagtatctttaaa

SEQ ID NO: 6616718 - DNA, 19 bp, Homo sapiens
actcatattacaaaaacaa

SEQ ID NO: 6616719 - DNA, 16 bp, Homo sapiens
actcatattgccctaa

SEQ ID NO: 6616720 - DNA, 21 bp, Homo sapiens
actcatattgccctaattaaa

SEQ ID NO: 6616721 - DNA, 23 bp, Homo sapiens
actcatcagagcagctagctctt

SEQ ID NO: 6616722 - DNA, 13 bp, Homo sapiens
actcatcataaaa

SEQ ID NO: 6616723 - DNA, 15 bp, Homo sapiens
actcatcataaaata

SEQ ID NO: 6616724 - DNA, 12 bp, Homo sapiens
actcatccacac

SEQ ID NO: 6616725 - DNA, 17 bp, Homo sapiens
actcatccagaactgtc

SEQ ID NO: 6616726 - DNA, 19 bp, Homo sapiens
actcatccctaatgctgca

SEQ ID NO: 6616727 - DNA, 13 bp, Homo sapiens
actcatcccttgt

SEQ ID NO: 6616728 - DNA, 16 bp, Homo sapiens
actcatcctgaacagc

SEQ ID NO: 6616729 - DNA, 23 bp, Homo sapiens
actcatcctgtgtggggaggcag

SEQ ID NO: 6616730 - DNA, 17 bp, Homo sapiens
actcatcgggagtgaat

SEQ ID NO: 6616731 - DNA, 16 bp, Homo sapiens
actcatcgttctaaaa

SEQ ID NO: 6616732 - DNA, 16 bp, Homo sapiens
actcatctaggtaaat

SEQ ID NO: 6616733 - DNA, 18 bp, Homo sapiens
actcatctaggtaaatta

SEQ ID NO: 6616734 - DNA, 23 bp, Homo sapiens
actcatctgaaatgttacaaaaa

SEQ ID NO: 6616735 - DNA, 22 bp, Homo sapiens
actcatctggagttctcaaaga

SEQ ID NO: 6616736 - DNA, 14 bp, Homo sapiens
actcatctgtaaac

SEQ ID NO: 6616737 - DNA, 19 bp, Homo sapiens
actcatcttactgtacctg

SEQ ID NO: 6616738 - DNA, 21 bp, Homo sapiens
actcatcttggccctcctcag

SEQ ID NO: 6616739 - DNA, 21 bp, Homo sapiens
actcatctttcattaaaggct

SEQ ID NO: 6616740 - DNA, 14 bp, Homo sapiens
actcatgaacaaaa

SEQ ID NO: 6616741 - DNA, 17 bp, Homo sapiens
actcatgacggcctgcc

SEQ ID NO: 6616742 - DNA, 20 bp, Homo sapiens
actcatgacggcctgcctgc

SEQ ID NO: 6616743 - DNA, 19 bp, Homo sapiens
actcatgactgaagggaaa

SEQ ID NO: 6616744 - DNA, 14 bp, Homo sapiens
actcatgagaagtt

SEQ ID NO: 6616745 - DNA, 21 bp, Homo sapiens
actcatgatcaagatatatgt

SEQ ID NO: 6616746 - DNA, 21 bp, Homo sapiens
actcatgatcttgtgacatat

SEQ ID NO: 6616747 - DNA, 20 bp, Homo sapiens
actcatgcaaactgctttat

SEQ ID NO: 6616748 - DNA, 17 bp, Homo sapiens
actcatgcattgtcctc

SEQ ID NO: 6616749 - DNA, 14 bp, Homo sapiens
actcatgcctctga

SEQ ID NO: 6616750 - DNA, 16 bp, Homo sapiens
actcatgcggcccagc

SEQ ID NO: 6616751 - DNA, 13 bp, Homo sapiens
actcatgctgaaa

SEQ ID NO: 6616752 - DNA, 19 bp, Homo sapiens
actcatggaaatagaatga

SEQ ID NO: 6616753 - DNA, 17 bp, Homo sapiens
actcatggaacactcat

SEQ ID NO: 6616754 - DNA, 13 bp, Homo sapiens
actcatggcaggc

SEQ ID NO: 6616755 - DNA, 14 bp, Homo sapiens
actcatgtacattg

SEQ ID NO: 6616756 - DNA, 18 bp, Homo sapiens
actcatgtgactctttcc

SEQ ID NO: 6616757 - DNA, 19 bp, Homo sapiens
actcatgtgactctttcca

SEQ ID NO: 6616758 - DNA, 22 bp, Homo sapiens
actcatgtgcgtttcatgtgtt

SEQ ID NO: 6616759 - DNA, 23 bp, Homo sapiens
actcatgtgcgtttcatgtgttt

SEQ ID NO: 6616760 - DNA, 12 bp, Homo sapiens
actcatgtgtat

SEQ ID NO: 6616761 - DNA, 14 bp, Homo sapiens
actcattaattcaa

SEQ ID NO: 6616762 - DNA, 23 bp, Homo sapiens
actcattagaattaccatttgtt

SEQ ID NO: 6616763 - DNA, 13 bp, Homo sapiens
actcattcaaaag

SEQ ID NO: 6616764 - DNA, 16 bp, Homo sapiens
actcattcattagtca

SEQ ID NO: 6616765 - DNA, 15 bp, Homo sapiens
actcattccttcact

SEQ ID NO: 6616766 - DNA, 19 bp, Homo sapiens
actcattctcttcttgcta

SEQ ID NO: 6616767 - DNA, 23 bp, Homo sapiens
actcattctcttcttgctatatg

SEQ ID NO: 6616768 - DNA, 15 bp, Homo sapiens
actcattctgaatta

SEQ ID NO: 6616769 - DNA, 17 bp, Homo sapiens
actcattcttttttcta

SEQ ID NO: 6616770 - DNA, 15 bp, Homo sapiens
actcattgaaatgta

SEQ ID NO: 6616771 - DNA, 15 bp, Homo sapiens
actcattgaaatgtc

SEQ ID NO: 6616772 - DNA, 16 bp, Homo sapiens
actcattgacctgagg

SEQ ID NO: 6616773 - DNA, 17 bp, Homo sapiens
actcattgacctgaggc

SEQ ID NO: 6616774 - DNA, 18 bp, Homo sapiens
actcattgacctgaggcc

SEQ ID NO: 6616775 - DNA, 21 bp, Homo sapiens
actcattgcagatcccagccc

SEQ ID NO: 6616776 - DNA, 23 bp, Homo sapiens
actcattgcagatcccagcccac

SEQ ID NO: 6616777 - DNA, 15 bp, Homo sapiens
actcattgcagcaga

SEQ ID NO: 6616778 - DNA, 19 bp, Homo sapiens
actcattgcccccacctct

SEQ ID NO: 6616779 - DNA, 20 bp, Homo sapiens
actcattgcccccacctctg

SEQ ID NO: 6616780 - DNA, 15 bp, Homo sapiens
actcattgctgagcc

SEQ ID NO: 6616781 - DNA, 20 bp, Homo sapiens
actcattgctgagcctctgc

SEQ ID NO: 6616782 - DNA, 23 bp, Homo sapiens
actcattgcttcacaacccatct

SEQ ID NO: 6616783 - DNA, 13 bp, Homo sapiens
actcatttacaac

SEQ ID NO: 6616784 - DNA, 18 bp, Homo sapiens
actcatttatctcctctt

SEQ ID NO: 6616785 - DNA, 22 bp, Homo sapiens
actcatttatttccatattaaa

SEQ ID NO: 6616786 - DNA, 19 bp, Homo sapiens
actcatttcaagttatgat

SEQ ID NO: 6616787 - DNA, 12 bp, Homo sapiens
actcatttcatc

SEQ ID NO: 6616788 - DNA, 17 bp, Homo sapiens
actcatttcatctcatt

SEQ ID NO: 6616789 - DNA, 16 bp, Homo sapiens
actcatttcctatgta

SEQ ID NO: 6616790 - DNA, 18 bp, Homo sapiens
actcatttctaaaagaat

SEQ ID NO: 6616791 - DNA, 14 bp, Homo sapiens
actcatttgaatgc

SEQ ID NO: 6616792 - DNA, 23 bp, Homo sapiens
actcatttgaatgcttaattcaa

SEQ ID NO: 6616793 - DNA, 22 bp, Homo sapiens
actcatttgctgacacatcagt

SEQ ID NO: 6616794 - DNA, 18 bp, Homo sapiens
actcatttggatataaat

SEQ ID NO: 6616795 - DNA, 21 bp, Homo sapiens
actcatttggatataaatctt

SEQ ID NO: 6616796 - DNA, 21 bp, Homo sapiens
actcatttttcattagataca

SEQ ID NO: 6616797 - DNA, 15 bp, Homo sapiens
actcatttttctata

SEQ ID NO: 6616798 - DNA, 14 bp, Homo sapiens
actccaaaaagaca

SEQ ID NO: 6616799 - DNA, 18 bp, Homo sapiens
actccaaaatctggcttt

SEQ ID NO: 6616800 - DNA, 13 bp, Homo sapiens
actccaaaatgtt

SEQ ID NO: 6616801 - DNA, 22 bp, Homo sapiens
actccaaacagacccctgttca

SEQ ID NO: 6616802 - DNA, 21 bp, Homo sapiens
actccaaacctcctgttagct

SEQ ID NO: 6616803 - DNA, 21 bp, Homo sapiens
actccaaaccttactctgagc

SEQ ID NO: 6616804 - DNA, 23 bp, Homo sapiens
actccaaaccttactctgagctc

SEQ ID NO: 6616805 - DNA, 18 bp, Homo sapiens
actccaaagaaatgtaag

SEQ ID NO: 6616806 - DNA, 17 bp, Homo sapiens
actccaaagagaaacct

SEQ ID NO: 6616807 - DNA, 11 bp, Homo sapiens
actccaaagat

SEQ ID NO: 6616808 - DNA, 13 bp, Homo sapiens
actccaaagatga

SEQ ID NO: 6616809 - DNA, 15 bp, Homo sapiens
actccaaagatgact

SEQ ID NO: 6616810 - DNA, 17 bp, Homo sapiens
actccaaagtccacaca

SEQ ID NO: 6616811 - DNA, 23 bp, Homo sapiens
actccaaagtccacacaaagatt

SEQ ID NO: 6616812 - DNA, 19 bp, Homo sapiens
actccaacagaagaactgt

SEQ ID NO: 6616813 - DNA, 15 bp, Homo sapiens
actccaacatccact

SEQ ID NO: 6616814 - DNA, 17 bp, Homo sapiens
actccaacatccactct

SEQ ID NO: 6616815 - DNA, 18 bp, Homo sapiens
actccaacctaacctgtg

SEQ ID NO: 6616816 - DNA, 20 bp, Homo sapiens
actccaacctaacctgtgtc

SEQ ID NO: 6616817 - DNA, 18 bp, Homo sapiens
actccaagaccaccaggg

SEQ ID NO: 6616818 - DNA, 16 bp, Homo sapiens
actccaagccccctgg

SEQ ID NO: 6616819 - DNA, 16 bp, Homo sapiens
actccaagccctgggg

SEQ ID NO: 6616820 - DNA, 22 bp, Homo sapiens
actccaaggcaaatgtccaagc

SEQ ID NO: 6616821 - DNA, 22 bp, Homo sapiens
actccaagggtttctgacccaa

SEQ ID NO: 6616822 - DNA, 14 bp, Homo sapiens
actccaaggtggca

SEQ ID NO: 6616823 - DNA, 20 bp, Homo sapiens
actccaaggtggcatagcca

SEQ ID NO: 6616824 - DNA, 22 bp, Homo sapiens
actccaaggtggcatagccatt

SEQ ID NO: 6616825 - DNA, 17 bp, Homo sapiens
actccaaggttcccttg

SEQ ID NO: 6616826 - DNA, 20 bp, Homo sapiens
actccacacatctttcttga

SEQ ID NO: 6616827 - DNA, 12 bp, Homo sapiens
actccacaccag

SEQ ID NO: 6616828 - DNA, 12 bp, Homo sapiens
actccacactgc

SEQ ID NO: 6616829 - DNA, 21 bp, Homo sapiens
actccacagcggaggagacca

SEQ ID NO: 6616830 - DNA, 16 bp, Homo sapiens
actccacatctgcctt

SEQ ID NO: 6616831 - DNA, 20 bp, Homo sapiens
actccaccaacccatcagaa

SEQ ID NO: 6616832 - DNA, 21 bp, Homo sapiens
actccaccccctccagctcca

SEQ ID NO: 6616833 - DNA, 16 bp, Homo sapiens
actccaccctgttagt

SEQ ID NO: 6616834 - DNA, 22 bp, Homo sapiens
actccaccctgttagttttgta

SEQ ID NO: 6616835 - DNA, 23 bp, Homo sapiens
actccaccctgttagttttgtaa

SEQ ID NO: 6616836 - DNA, 14 bp, Homo sapiens
actccaccgaccaa

SEQ ID NO: 6616837 - DNA, 12 bp, Homo sapiens
actccacctcaa

SEQ ID NO: 6616838 - DNA, 18 bp, Homo sapiens
actccacctccagcacgc

SEQ ID NO: 6616839 - DNA, 18 bp, Homo sapiens
actccacgatcctgccac

SEQ ID NO: 6616840 - DNA, 18 bp, Homo sapiens
actccacgcagctggcag

SEQ ID NO: 6616841 - DNA, 20 bp, Homo sapiens
actccacggatgcgtgggca

SEQ ID NO: 6616842 - DNA, 20 bp, Homo sapiens
actccactactctcttcctc

SEQ ID NO: 6616843 - DNA, 21 bp, Homo sapiens
actccactactctcttcctcc

SEQ ID NO: 6616844 - DNA, 22 bp, Homo sapiens
actccactactctcttcctcca

SEQ ID NO: 6616845 - DNA, 13 bp, Homo sapiens
actccactcagca

SEQ ID NO: 6616846 - DNA, 13 bp, Homo sapiens
actccactcccag

SEQ ID NO: 6616847 - DNA, 16 bp, Homo sapiens
actccactcccagcag

SEQ ID NO: 6616848 - DNA, 16 bp, Homo sapiens
actccactctccttcg

SEQ ID NO: 6616849 - DNA, 14 bp, Homo sapiens
actccactgacaaa

SEQ ID NO: 6616850 - DNA, 19 bp, Homo sapiens
actccactgacctggaaga

SEQ ID NO: 6616851 - DNA, 13 bp, Homo sapiens
actccactgccct

SEQ ID NO: 6616852 - DNA, 15 bp, Homo sapiens
actccactgccctgg

SEQ ID NO: 6616853 - DNA, 22 bp, Homo sapiens
actccactgccctggcagcagc

SEQ ID NO: 6616854 - DNA, 17 bp, Homo sapiens
actccactggacagacc

SEQ ID NO: 6616855 - DNA, 17 bp, Homo sapiens
actccactgtggaaaat

SEQ ID NO: 6616856 - DNA, 19 bp, Homo sapiens
actccactgtggaaaatgc

SEQ ID NO: 6616857 - DNA, 23 bp, Homo sapiens
actccagaatctgctgttgccat

SEQ ID NO: 6616858 - DNA, 19 bp, Homo sapiens
actccagaattacccttcc

SEQ ID NO: 6616859 - DNA, 22 bp, Homo sapiens
actccagaattacccttcctca

SEQ ID NO: 6616860 - DNA, 15 bp, Homo sapiens
actccagacccctgg

SEQ ID NO: 6616861 - DNA, 21 bp, Homo sapiens
actccagacccctggcttttc

SEQ ID NO: 6616862 - DNA, 17 bp, Homo sapiens
actccagactctctgtg

SEQ ID NO: 6616863 - DNA, 12 bp, Homo sapiens
actccagagaca

SEQ ID NO: 6616864 - DNA, 17 bp, Homo sapiens
actccagagtctgagcc

SEQ ID NO: 6616865 - DNA, 14 bp, Homo sapiens
actccagatagaga

SEQ ID NO: 6616866 - DNA, 16 bp, Homo sapiens
actccagatagagaaa

SEQ ID NO: 6616867 - DNA, 15 bp, Homo sapiens
actccagcaacttct

SEQ ID NO: 6616868 - DNA, 22 bp, Homo sapiens
actccagcacgttttctggctt

SEQ ID NO: 6616869 - DNA, 14 bp, Homo sapiens
actccagccaaaga

SEQ ID NO: 6616870 - DNA, 22 bp, Homo sapiens
actccagccaaagaaatgggcc

SEQ ID NO: 6616871 - DNA, 12 bp, Homo sapiens
actccagccagc

SEQ ID NO: 6616872 - DNA, 14 bp, Homo sapiens
actccagccagcgc

SEQ ID NO: 6616873 - DNA, 10 bp, Homo sapiens
actccagccc

SEQ ID NO: 6616874 - DNA, 14 bp, Homo sapiens
actccagcccctgg

SEQ ID NO: 6616875 - DNA, 16 bp, Homo sapiens
actccagcccctggac

SEQ ID NO: 6616876 - DNA, 19 bp, Homo sapiens
actccagccccttcaatta

SEQ ID NO: 6616877 - DNA, 14 bp, Homo sapiens
actccagccctgtc

SEQ ID NO: 6616878 - DNA, 22 bp, Homo sapiens
actccagccctgtcccctgaaa

SEQ ID NO: 6616879 - DNA, 11 bp, Homo sapiens
actccagcctg

SEQ ID NO: 6616880 - DNA, 14 bp, Homo sapiens
actccagcctgagc

SEQ ID NO: 6616881 - DNA, 15 bp, Homo sapiens
actccagcctgggca

SEQ ID NO: 6616882 - DNA, 21 bp, Homo sapiens
actccagcctgggcaacagag

SEQ ID NO: 6616883 - DNA, 23 bp, Homo sapiens
actccagcctgggcaacagagca

SEQ ID NO: 6616884 - DNA, 21 bp, Homo sapiens
actccagcctgggcgacagag

SEQ ID NO: 6616885 - DNA, 16 bp, Homo sapiens
actccagcctgggtga

SEQ ID NO: 6616886 - DNA, 21 bp, Homo sapiens
actccagcctgggtgacagag

SEQ ID NO: 6616887 - DNA, 16 bp, Homo sapiens
actccagcgcctgccc

SEQ ID NO: 6616888 - DNA, 17 bp, Homo sapiens
actccagctggtgcccc

SEQ ID NO: 6616889 - DNA, 14 bp, Homo sapiens
actccaggaagaag

SEQ ID NO: 6616890 - DNA, 19 bp, Homo sapiens
actccaggaaggggctgga

SEQ ID NO: 6616891 - DNA, 18 bp, Homo sapiens
actccaggacgaggagga

SEQ ID NO: 6616892 - DNA, 18 bp, Homo sapiens
actccaggatcctcctgg

SEQ ID NO: 6616893 - DNA, 24 bp, Homo sapiens
actccaggatggaattcttcctcc

SEQ ID NO: 6616894 - DNA, 17 bp, Homo sapiens
actccaggcagcagaca

SEQ ID NO: 6616895 - DNA, 22 bp, Homo sapiens
actccaggcagcagacacatgc

SEQ ID NO: 6616896 - DNA, 15 bp, Homo sapiens
actccaggcatgtgt

SEQ ID NO: 6616897 - DNA, 22 bp, Homo sapiens
actccaggcatgtgtctggccc

SEQ ID NO: 6616898 - DNA, 14 bp, Homo sapiens
actccaggccagct

SEQ ID NO: 6616899 - DNA, 14 bp, Homo sapiens
actccaggcccaag

SEQ ID NO: 6616900 - DNA, 17 bp, Homo sapiens
actccaggcccaaggct

SEQ ID NO: 6616901 - DNA, 16 bp, Homo sapiens
actccaggcctgacca

SEQ ID NO: 6616902 - DNA, 22 bp, Homo sapiens
actccaggcctgaccagggggc

SEQ ID NO: 6616903 - DNA, 13 bp, Homo sapiens
actccaggctggg

SEQ ID NO: 6616904 - DNA, 14 bp, Homo sapiens
actccaggctgggc

SEQ ID NO: 6616905 - DNA, 20 bp, Homo sapiens
actccaggctgggctgagcc

SEQ ID NO: 6616906 - DNA, 23 bp, Homo sapiens
actccaggcttgattccaacagg

SEQ ID NO: 6616907 - DNA, 16 bp, Homo sapiens
actccaggctttctgg

SEQ ID NO: 6616908 - DNA, 21 bp, Homo sapiens
actccagggaagattttatat

SEQ ID NO: 6616909 - DNA, 19 bp, Homo sapiens
actccagggtcccctgcca

SEQ ID NO: 6616910 - DNA, 20 bp, Homo sapiens
actccagggtcccctgccac

SEQ ID NO: 6616911 - DNA, 21 bp, Homo sapiens
actccagggtcccctgccacc

SEQ ID NO: 6616912 - DNA, 20 bp, Homo sapiens
actccaggtgtggaccggcc

SEQ ID NO: 6616913 - DNA, 22 bp, Homo sapiens
actccaggttcgtatagaaaaa

SEQ ID NO: 6616914 - DNA, 17 bp, Homo sapiens
actccagtagctcctgg

SEQ ID NO: 6616915 - DNA, 22 bp, Homo sapiens
actccagtatgacagaggagga

SEQ ID NO: 6616916 - DNA, 15 bp, Homo sapiens
actccagtcaacaga

SEQ ID NO: 6616917 - DNA, 17 bp, Homo sapiens
actccagtcaacagatt

SEQ ID NO: 6616918 - DNA, 18 bp, Homo sapiens
actccagtcaacagattc

SEQ ID NO: 6616919 - DNA, 13 bp, Homo sapiens
actccagtcctgc

SEQ ID NO: 6616920 - DNA, 16 bp, Homo sapiens
actccagtctcctgac

SEQ ID NO: 6616921 - DNA, 16 bp, Homo sapiens
actccagtgagctgga

SEQ ID NO: 6616922 - DNA, 14 bp, Homo sapiens
actccagtgccagc

SEQ ID NO: 6616923 - DNA, 14 bp, Homo sapiens
actccagtgctcag

SEQ ID NO: 6616924 - DNA, 23 bp, Homo sapiens
actccagtgctcagctgtggctg

SEQ ID NO: 6616925 - DNA, 22 bp, Homo sapiens
actccagtttgcccaccacaac

SEQ ID NO: 6616926 - DNA, 15 bp, Homo sapiens
actccataaaaagaa

SEQ ID NO: 6616927 - DNA, 14 bp, Homo sapiens
actccatacagcct

SEQ ID NO: 6616928 - DNA, 16 bp, Homo sapiens
actccatacagcctct

SEQ ID NO: 6616929 - DNA, 17 bp, Homo sapiens
actccatacagcctcta

SEQ ID NO: 6616930 - DNA, 15 bp, Homo sapiens
actccatactccact

SEQ ID NO: 6616931 - DNA, 19 bp, Homo sapiens
actccatagaccttttcat

SEQ ID NO: 6616932 - DNA, 20 bp, Homo sapiens
actccatatcccgggagcag

SEQ ID NO: 6616933 - DNA, 14 bp, Homo sapiens
actccatcagctta

SEQ ID NO: 6616934 - DNA, 17 bp, Homo sapiens
actccatcattcatcca

SEQ ID NO: 6616935 - DNA, 21 bp, Homo sapiens
actccatcgccatcttcttcc

SEQ ID NO: 6616936 - DNA, 18 bp, Homo sapiens
actccatctcaaaacaaa

SEQ ID NO: 6616937 - DNA, 20 bp, Homo sapiens
actccatctcctgctcacca

SEQ ID NO: 6616938 - DNA, 16 bp, Homo sapiens
actccatctctcatcc

SEQ ID NO: 6616939 - DNA, 13 bp, Homo sapiens
actccatggccac

SEQ ID NO: 6616940 - DNA, 22 bp, Homo sapiens
actccatggccaccccgtgcca

SEQ ID NO: 6616941 - DNA, 23 bp, Homo sapiens
actccatggccaccccgtgccac

SEQ ID NO: 6616942 - DNA, 16 bp, Homo sapiens
actccatggggtgggg

SEQ ID NO: 6616943 - DNA, 20 bp, Homo sapiens
actccatggggttcgagact

SEQ ID NO: 6616944 - DNA, 20 bp, Homo sapiens
actccatgtgtgctgtcctc

SEQ ID NO: 6616945 - DNA, 20 bp, Homo sapiens
actccatgtttggtgtttgt

SEQ ID NO: 6616946 - DNA, 18 bp, Homo sapiens
actccattactaaagaca

SEQ ID NO: 6616947 - DNA, 14 bp, Homo sapiens
actccattactgtg

SEQ ID NO: 6616948 - DNA, 15 bp, Homo sapiens
actccattactgtga

SEQ ID NO: 6616949 - DNA, 18 bp, Homo sapiens
actccattattcctctca

SEQ ID NO: 6616950 - DNA, 14 bp, Homo sapiens
actccattatttta

SEQ ID NO: 6616951 - DNA, 14 bp, Homo sapiens
actccattcccaac

SEQ ID NO: 6616952 - DNA, 22 bp, Homo sapiens
actccattcccaactagacatt

SEQ ID NO: 6616953 - DNA, 12 bp, Homo sapiens
actccattctcc

SEQ ID NO: 6616954 - DNA, 12 bp, Homo sapiens
actccattgtcg

SEQ ID NO: 6616955 - DNA, 21 bp, Homo sapiens
actccatttcccacttccacc

SEQ ID NO: 6616956 - DNA, 20 bp, Homo sapiens
actccatttggtcctttctc

SEQ ID NO: 6616957 - DNA, 21 bp, Homo sapiens
actccatttggtcctttctcc

SEQ ID NO: 6616958 - DNA, 13 bp, Homo sapiens
actcccaaactga

SEQ ID NO: 6616959 - DNA, 17 bp, Homo sapiens
actcccaacttcttcct

SEQ ID NO: 6616960 - DNA, 22 bp, Homo sapiens
actcccaagaacagcaggccca

SEQ ID NO: 6616961 - DNA, 12 bp, Homo sapiens
actcccaagcca

SEQ ID NO: 6616962 - DNA, 17 bp, Homo sapiens
actcccacccttggggt

SEQ ID NO: 6616963 - DNA, 11 bp, Homo sapiens
actcccacctc

SEQ ID NO: 6616964 - DNA, 22 bp, Homo sapiens
actcccacctcacccggcctct

SEQ ID NO: 6616965 - DNA, 14 bp, Homo sapiens
actcccactcctaa

SEQ ID NO: 6616966 - DNA, 20 bp, Homo sapiens
actcccacttccctgacact

SEQ ID NO: 6616967 - DNA, 14 bp, Homo sapiens
actcccagaacctc

SEQ ID NO: 6616968 - DNA, 14 bp, Homo sapiens
actcccagcagagc

SEQ ID NO: 6616969 - DNA, 22 bp, Homo sapiens
actcccagcagagcccaccagc

SEQ ID NO: 6616970 - DNA, 18 bp, Homo sapiens
actcccagcagctcaacc

SEQ ID NO: 6616971 - DNA, 14 bp, Homo sapiens
actcccagccacca

SEQ ID NO: 6616972 - DNA, 15 bp, Homo sapiens
actcccagccaccac

SEQ ID NO: 6616973 - DNA, 12 bp, Homo sapiens
actcccagcgct

SEQ ID NO: 6616974 - DNA, 19 bp, Homo sapiens
actcccaggaccctgtgcc

SEQ ID NO: 6616975 - DNA, 14 bp, Homo sapiens
actcccaggacctg

SEQ ID NO: 6616976 - DNA, 13 bp, Homo sapiens
actcccaggcagc

SEQ ID NO: 6616977 - DNA, 11 bp, Homo sapiens
actcccagggc

SEQ ID NO: 6616978 - DNA, 13 bp, Homo sapiens
actcccagggccc

SEQ ID NO: 6616979 - DNA, 17 bp, Homo sapiens
actcccagggcccgagc

SEQ ID NO: 6616980 - DNA, 13 bp, Homo sapiens
actcccatctcct

SEQ ID NO: 6616981 - DNA, 18 bp, Homo sapiens
actcccatctccttacct

SEQ ID NO: 6616982 - DNA, 14 bp, Homo sapiens
actcccatgaagcc

SEQ ID NO: 6616983 - DNA, 15 bp, Homo sapiens
actcccatgaagcct

SEQ ID NO: 6616984 - DNA, 18 bp, Homo sapiens
actcccatgaagcctttt

SEQ ID NO: 6616985 - DNA, 23 bp, Homo sapiens
actcccatgagggagatgccatg

SEQ ID NO: 6616986 - DNA, 18 bp, Homo sapiens
actcccatggctctgggc

SEQ ID NO: 6616987 - DNA, 13 bp, Homo sapiens
actcccattcctg

SEQ ID NO: 6616988 - DNA, 15 bp, Homo sapiens
actccccaaccccca

SEQ ID NO: 6616989 - DNA, 17 bp, Homo sapiens
actccccaacccctctc

SEQ ID NO: 6616990 - DNA, 14 bp, Homo sapiens
actccccacgggaa

SEQ ID NO: 6616991 - DNA, 17 bp, Homo sapiens
actccccactcccccac

SEQ ID NO: 6616992 - DNA, 20 bp, Homo sapiens
actccccactcccccaccca

SEQ ID NO: 6616993 - DNA, 21 bp, Homo sapiens
actccccagccagcctggctg

SEQ ID NO: 6616994 - DNA, 21 bp, Homo sapiens
actccccagcccagcacccct

SEQ ID NO: 6616995 - DNA, 12 bp, Homo sapiens
actccccaggcc

SEQ ID NO: 6616996 - DNA, 15 bp, Homo sapiens
actccccaggccagg

SEQ ID NO: 6616997 - DNA, 20 bp, Homo sapiens
actccccagggcctccagga

SEQ ID NO: 6616998 - DNA, 13 bp, Homo sapiens
actccccagtgct

SEQ ID NO: 6616999 - DNA, 20 bp, Homo sapiens
actccccagtgctcctgtgc

SEQ ID NO: 6617000 - DNA, 19 bp, Homo sapiens
actccccagttggcccttc

SEQ ID NO: 6617001 - DNA, 17 bp, Homo sapiens
actcccccaaccaagga

SEQ ID NO: 6617002 - DNA, 16 bp, Homo sapiens
actcccccaccgccca

SEQ ID NO: 6617003 - DNA, 17 bp, Homo sapiens
actcccccaccgcccac

SEQ ID NO: 6617004 - DNA, 16 bp, Homo sapiens
actcccccagaggtgg

SEQ ID NO: 6617005 - DNA, 13 bp, Homo sapiens
actcccccagccc

SEQ ID NO: 6617006 - DNA, 14 bp, Homo sapiens
actcccccagccct

SEQ ID NO: 6617007 - DNA, 15 bp, Homo sapiens
actcccccaggagca

SEQ ID NO: 6617008 - DNA, 16 bp, Homo sapiens
actcccccaggagcag

SEQ ID NO: 6617009 - DNA, 20 bp, Homo sapiens
actcccccaggagcagctgg

SEQ ID NO: 6617010 - DNA, 14 bp, Homo sapiens
actcccccaggtgg

SEQ ID NO: 6617011 - DNA, 14 bp, Homo sapiens
actcccccctggcc

SEQ ID NO: 6617012 - DNA, 22 bp, Homo sapiens
actccccctaaacccctgtccc

SEQ ID NO: 6617013 - DNA, 22 bp, Homo sapiens
actcccccttcccttggaggga

SEQ ID NO: 6617014 - DNA, 14 bp, Homo sapiens
actccccgcctgtc

SEQ ID NO: 6617015 - DNA, 20 bp, Homo sapiens
actccccgcctgtcctgcct

SEQ ID NO: 6617016 - DNA, 21 bp, Homo sapiens
actccccgcctgtcctgcctc

SEQ ID NO: 6617017 - DNA, 23 bp, Homo sapiens
actcccctctcctccccttcctg

SEQ ID NO: 6617018 - DNA, 14 bp, Homo sapiens
actcccctgatccc

SEQ ID NO: 6617019 - DNA, 17 bp, Homo sapiens
actcccctgctgggtgt

SEQ ID NO: 6617020 - DNA, 11 bp, Homo sapiens
actccccttcc

SEQ ID NO: 6617021 - DNA, 13 bp, Homo sapiens
actccccttccct

SEQ ID NO: 6617022 - DNA, 17 bp, Homo sapiens
actccccttgagctgag

SEQ ID NO: 6617023 - DNA, 17 bp, Homo sapiens
actcccctttcttccaa

SEQ ID NO: 6617024 - DNA, 17 bp, Homo sapiens
actcccgccacacgctc

SEQ ID NO: 6617025 - DNA, 20 bp, Homo sapiens
actcccgccccgggctggcc

SEQ ID NO: 6617026 - DNA, 23 bp, Homo sapiens
actcccgccccgggctggccctg

SEQ ID NO: 6617027 - DNA, 14 bp, Homo sapiens
actcccgcctcagg

SEQ ID NO: 6617028 - DNA, 19 bp, Homo sapiens
actcccgctgagcccactc

SEQ ID NO: 6617029 - DNA, 23 bp, Homo sapiens
actcccgctgcacacagacggcc

SEQ ID NO: 6617030 - DNA, 21 bp, Homo sapiens
actcccggcctaggcacctcc

SEQ ID NO: 6617031 - DNA, 16 bp, Homo sapiens
actcccgggccaagac

SEQ ID NO: 6617032 - DNA, 23 bp, Homo sapiens
actcccgggccaagacagatgga

SEQ ID NO: 6617033 - DNA, 21 bp, Homo sapiens
actcccgggccacgccccagc

SEQ ID NO: 6617034 - DNA, 22 bp, Homo sapiens
actcccgggttcacgccattct

SEQ ID NO: 6617035 - DNA, 22 bp, Homo sapiens
actcccgtgtaggaacctgcac

SEQ ID NO: 6617036 - DNA, 20 bp, Homo sapiens
actccctaaagccctcttca

SEQ ID NO: 6617037 - DNA, 19 bp, Homo sapiens
actccctaagaaaccccag

SEQ ID NO: 6617038 - DNA, 20 bp, Homo sapiens
actccctaagaaaccccagg

SEQ ID NO: 6617039 - DNA, 19 bp, Homo sapiens
actccctaatttatgtgct

SEQ ID NO: 6617040 - DNA, 22 bp, Homo sapiens
actccctaatttatgtgctata

SEQ ID NO: 6617041 - DNA, 14 bp, Homo sapiens
actccctacactga

SEQ ID NO: 6617042 - DNA, 17 bp, Homo sapiens
actccctacactgatgc

SEQ ID NO: 6617043 - DNA, 19 bp, Homo sapiens
actccctacactgatgcaa

SEQ ID NO: 6617044 - DNA, 11 bp, Homo sapiens
actccctaggc

SEQ ID NO: 6617045 - DNA, 17 bp, Homo sapiens
actccctaggcccaagt

SEQ ID NO: 6617046 - DNA, 18 bp, Homo sapiens
actccctaggcccaagtc

SEQ ID NO: 6617047 - DNA, 16 bp, Homo sapiens
actccctaggcctgag

SEQ ID NO: 6617048 - DNA, 17 bp, Homo sapiens
actccctaggcctgagt

SEQ ID NO: 6617049 - DNA, 19 bp, Homo sapiens
actccctagttacccaccc

SEQ ID NO: 6617050 - DNA, 14 bp, Homo sapiens
actccctatctcct

SEQ ID NO: 6617051 - DNA, 14 bp, Homo sapiens
actccctccaccag

SEQ ID NO: 6617052 - DNA, 15 bp, Homo sapiens
actccctccaccagc

SEQ ID NO: 6617053 - DNA, 22 bp, Homo sapiens
actccctccaccagcctgctga

SEQ ID NO: 6617054 - DNA, 13 bp, Homo sapiens
actccctccagca

SEQ ID NO: 6617055 - DNA, 21 bp, Homo sapiens
actccctccatagcgacaccc

SEQ ID NO: 6617056 - DNA, 12 bp, Homo sapiens
actccctcccca

SEQ ID NO: 6617057 - DNA, 16 bp, Homo sapiens
actccctccccaccca

SEQ ID NO: 6617058 - DNA, 20 bp, Homo sapiens
actccctccccacccaagag

SEQ ID NO: 6617059 - DNA, 13 bp, Homo sapiens
actccctccctgg

SEQ ID NO: 6617060 - DNA, 10 bp, Homo sapiens
actccctcct

SEQ ID NO: 6617061 - DNA, 15 bp, Homo sapiens
actccctcctcacac

SEQ ID NO: 6617062 - DNA, 20 bp, Homo sapiens
actccctcctcacactccag

SEQ ID NO: 6617063 - DNA, 16 bp, Homo sapiens
actccctcctcacctc

SEQ ID NO: 6617064 - DNA, 19 bp, Homo sapiens
actccctcctcacctctgg

SEQ ID NO: 6617065 - DNA, 22 bp, Homo sapiens
actccctcctcacctctggact

SEQ ID NO: 6617066 - DNA, 16 bp, Homo sapiens
actccctctccctccc

SEQ ID NO: 6617067 - DNA, 22 bp, Homo sapiens
actccctctgcagaatcccttt

SEQ ID NO: 6617068 - DNA, 22 bp, Homo sapiens
actccctcttcactgtggccac

SEQ ID NO: 6617069 - DNA, 14 bp, Homo sapiens
actccctcttccaa

SEQ ID NO: 6617070 - DNA, 15 bp, Homo sapiens
actccctcttgtcag

SEQ ID NO: 6617071 - DNA, 18 bp, Homo sapiens
actccctgaacctcagtt

SEQ ID NO: 6617072 - DNA, 22 bp, Homo sapiens
actccctgaacctcagtttcct

SEQ ID NO: 6617073 - DNA, 12 bp, Homo sapiens
actccctgagct

SEQ ID NO: 6617074 - DNA, 16 bp, Homo sapiens
actccctgcaccgtct

SEQ ID NO: 6617075 - DNA, 14 bp, Homo sapiens
actccctgcagatg

SEQ ID NO: 6617076 - DNA, 18 bp, Homo sapiens
actccctgccccccagcc

SEQ ID NO: 6617077 - DNA, 18 bp, Homo sapiens
actccctgcccttccccc

SEQ ID NO: 6617078 - DNA, 13 bp, Homo sapiens
actccctgctcta

SEQ ID NO: 6617079 - DNA, 12 bp, Homo sapiens
actccctgcttg

SEQ ID NO: 6617080 - DNA, 21 bp, Homo sapiens
actccctggatgtgtggggca

SEQ ID NO: 6617081 - DNA, 12 bp, Homo sapiens
actccctggcct

SEQ ID NO: 6617082 - DNA, 18 bp, Homo sapiens
actccctggctctcagaa

SEQ ID NO: 6617083 - DNA, 15 bp, Homo sapiens
actccctgggaaagg

SEQ ID NO: 6617084 - DNA, 23 bp, Homo sapiens
actccctgtagtgaatcctctgt

SEQ ID NO: 6617085 - DNA, 12 bp, Homo sapiens
actccctgtcca

SEQ ID NO: 6617086 - DNA, 13 bp, Homo sapiens
actccctgttatt

SEQ ID NO: 6617087 - DNA, 15 bp, Homo sapiens
actccctgttttagt

SEQ ID NO: 6617088 - DNA, 20 bp, Homo sapiens
actccctgttttagtttctg

SEQ ID NO: 6617089 - DNA, 19 bp, Homo sapiens
actcccttaggcattattt

SEQ ID NO: 6617090 - DNA, 23 bp, Homo sapiens
actcccttccctctctcccattt

SEQ ID NO: 6617091 - DNA, 15 bp, Homo sapiens
actcccttcctggcc

SEQ ID NO: 6617092 - DNA, 21 bp, Homo sapiens
actcccttctacctgccactc

SEQ ID NO: 6617093 - DNA, 20 bp, Homo sapiens
actcccttctcgtgtttgct

SEQ ID NO: 6617094 - DNA, 13 bp, Homo sapiens
actcccttctgct

SEQ ID NO: 6617095 - DNA, 16 bp, Homo sapiens
actcccttctgtagtt

SEQ ID NO: 6617096 - DNA, 20 bp, Homo sapiens
actcccttgaagttgtggag

SEQ ID NO: 6617097 - DNA, 23 bp, Homo sapiens
actcccttgaggatggagagcag

SEQ ID NO: 6617098 - DNA, 21 bp, Homo sapiens
actcccttgctggccccagcc

SEQ ID NO: 6617099 - DNA, 19 bp, Homo sapiens
actcccttggtggcaagag

SEQ ID NO: 6617100 - DNA, 22 bp, Homo sapiens
actcccttggtggcaagagccc

SEQ ID NO: 6617101 - DNA, 15 bp, Homo sapiens
actcccttgtgttcc

SEQ ID NO: 6617102 - DNA, 16 bp, Homo sapiens
actcccttgtgttcct

SEQ ID NO: 6617103 - DNA, 20 bp, Homo sapiens
actcccttgtgttccttctg

SEQ ID NO: 6617104 - DNA, 17 bp, Homo sapiens
actccctttaaagagag

SEQ ID NO: 6617105 - DNA, 14 bp, Homo sapiens
actccctttcaaca

SEQ ID NO: 6617106 - DNA, 14 bp, Homo sapiens
actccctttcatgt

SEQ ID NO: 6617107 - DNA, 21 bp, Homo sapiens
actccctttgcgtcaggagca

SEQ ID NO: 6617108 - DNA, 21 bp, Homo sapiens
actccctttgtggactttatt

SEQ ID NO: 6617109 - DNA, 17 bp, Homo sapiens
actccctttttacactt

SEQ ID NO: 6617110 - DNA, 19 bp, Homo sapiens
actccgaaacaagtagaaa

SEQ ID NO: 6617111 - DNA, 23 bp, Homo sapiens
actccgaaagtctgaatctccca

SEQ ID NO: 6617112 - DNA, 14 bp, Homo sapiens
actccgaagaaaag

SEQ ID NO: 6617113 - DNA, 16 bp, Homo sapiens
actccgaagaaaagaa

SEQ ID NO: 6617114 - DNA, 16 bp, Homo sapiens
actccgagtgaactgg

SEQ ID NO: 6617115 - DNA, 15 bp, Homo sapiens
actccgcatcacctc

SEQ ID NO: 6617116 - DNA, 13 bp, Homo sapiens
actccgccagcca

SEQ ID NO: 6617117 - DNA, 14 bp, Homo sapiens
actccgccagccac

SEQ ID NO: 6617118 - DNA, 18 bp, Homo sapiens
actccgccagccacagga

SEQ ID NO: 6617119 - DNA, 20 bp, Homo sapiens
actccgccagccacaggacc

SEQ ID NO: 6617120 - DNA, 15 bp, Homo sapiens
actccgcccagcctc

SEQ ID NO: 6617121 - DNA, 16 bp, Homo sapiens
actccgcccagcctct

SEQ ID NO: 6617122 - DNA, 12 bp, Homo sapiens
actccgccccca

SEQ ID NO: 6617123 - DNA, 15 bp, Homo sapiens
actccgcccccagcc

SEQ ID NO: 6617124 - DNA, 21 bp, Homo sapiens
actccgcccccagcctatgag

SEQ ID NO: 6617125 - DNA, 17 bp, Homo sapiens
actccgccctcctcggg

SEQ ID NO: 6617126 - DNA, 19 bp, Homo sapiens
actccgccctcctcgggcc

SEQ ID NO: 6617127 - DNA, 17 bp, Homo sapiens
actccgcgccgatgcca

SEQ ID NO: 6617128 - DNA, 19 bp, Homo sapiens
actccgcgccgatgccacc

SEQ ID NO: 6617129 - DNA, 22 bp, Homo sapiens
actccgctggatggggagtctc

SEQ ID NO: 6617130 - DNA, 18 bp, Homo sapiens
actccggaatgaccagca

SEQ ID NO: 6617131 - DNA, 14 bp, Homo sapiens
actccggagacagg

SEQ ID NO: 6617132 - DNA, 19 bp, Homo sapiens
actccggaggactgagccc

SEQ ID NO: 6617133 - DNA, 20 bp, Homo sapiens
actccggaggactgagcccc

SEQ ID NO: 6617134 - DNA, 21 bp, Homo sapiens
actccggaggactgagccccc

SEQ ID NO: 6617135 - DNA, 23 bp, Homo sapiens
actccggattgcgttcctccccg

SEQ ID NO: 6617136 - DNA, 13 bp, Homo sapiens
actccggccctcc

SEQ ID NO: 6617137 - DNA, 16 bp, Homo sapiens
actccggccctccaga

SEQ ID NO: 6617138 - DNA, 14 bp, Homo sapiens
actccggccctcct

SEQ ID NO: 6617139 - DNA, 17 bp, Homo sapiens
actccggcctgtaatca

SEQ ID NO: 6617140 - DNA, 15 bp, Homo sapiens
actccggctgtgctg

SEQ ID NO: 6617141 - DNA, 17 bp, Homo sapiens
actccggctgtgctggg

SEQ ID NO: 6617142 - DNA, 20 bp, Homo sapiens
actccgggaccattgacctc

SEQ ID NO: 6617143 - DNA, 17 bp, Homo sapiens
actccggggagcgcccg

SEQ ID NO: 6617144 - DNA, 21 bp, Homo sapiens
actccggggccccactggctg

SEQ ID NO: 6617145 - DNA, 16 bp, Homo sapiens
actccgggtcaagttg

SEQ ID NO: 6617146 - DNA, 20 bp, Homo sapiens
actccggtcagcccctggca

SEQ ID NO: 6617147 - DNA, 21 bp, Homo sapiens
actccggtgtgcctgcagccc

SEQ ID NO: 6617148 - DNA, 15 bp, Homo sapiens
actccgtcaagctgg

SEQ ID NO: 6617149 - DNA, 20 bp, Homo sapiens
actccgtgaggctgctgcca

SEQ ID NO: 6617150 - DNA, 16 bp, Homo sapiens
actccgtgtgcctggg

SEQ ID NO: 6617151 - DNA, 15 bp, Homo sapiens
actccgttggccact

SEQ ID NO: 6617152 - DNA, 19 bp, Homo sapiens
actcctaaacctttgcccc

SEQ ID NO: 6617153 - DNA, 18 bp, Homo sapiens
actcctaaataaactagt

SEQ ID NO: 6617154 - DNA, 20 bp, Homo sapiens
actcctaatagcttttcctg

SEQ ID NO: 6617155 - DNA, 16 bp, Homo sapiens
actcctaatcaagagt

SEQ ID NO: 6617156 - DNA, 24 bp, Homo sapiens
actcctaatcaagagtctctccag

SEQ ID NO: 6617157 - DNA, 23 bp, Homo sapiens
actcctaattaagggacatgtat

SEQ ID NO: 6617158 - DNA, 21 bp, Homo sapiens
actcctaattttaaataattt

SEQ ID NO: 6617159 - DNA, 22 bp, Homo sapiens
actcctaattttaaataatttc

SEQ ID NO: 6617160 - DNA, 22 bp, Homo sapiens
actcctacaagatttagaaaaa

SEQ ID NO: 6617161 - DNA, 16 bp, Homo sapiens
actcctacctcagcct

SEQ ID NO: 6617162 - DNA, 17 bp, Homo sapiens
actcctacctcagccta

SEQ ID NO: 6617163 - DNA, 22 bp, Homo sapiens
actcctacctgaaggcagggct

SEQ ID NO: 6617164 - DNA, 23 bp, Homo sapiens
actcctacctgaaggcagggctc

SEQ ID NO: 6617165 - DNA, 17 bp, Homo sapiens
actcctacctgccctgg

SEQ ID NO: 6617166 - DNA, 18 bp, Homo sapiens
actcctacctgccctgga

SEQ ID NO: 6617167 - DNA, 14 bp, Homo sapiens
actcctacctggta

SEQ ID NO: 6617168 - DNA, 14 bp, Homo sapiens
actcctactgcttc

SEQ ID NO: 6617169 - DNA, 20 bp, Homo sapiens
actcctagaagaaccaaata

SEQ ID NO: 6617170 - DNA, 23 bp, Homo sapiens
actcctagaagaaccaaatacct

SEQ ID NO: 6617171 - DNA, 20 bp, Homo sapiens
actcctagactttgggatca

SEQ ID NO: 6617172 - DNA, 20 bp, Homo sapiens
actcctagagaacgcagccc

SEQ ID NO: 6617173 - DNA, 23 bp, Homo sapiens
actcctagctgtcctttttcctc

SEQ ID NO: 6617174 - DNA, 20 bp, Homo sapiens
actcctaggagagccaacct

SEQ ID NO: 6617175 - DNA, 21 bp, Homo sapiens
actcctaggagagccaacctc

SEQ ID NO: 6617176 - DNA, 13 bp, Homo sapiens
actcctaggcagg

SEQ ID NO: 6617177 - DNA, 18 bp, Homo sapiens
actcctaggcaggacatg

SEQ ID NO: 6617178 - DNA, 23 bp, Homo sapiens
actcctaggcccttggggtggcg

SEQ ID NO: 6617179 - DNA, 20 bp, Homo sapiens
actcctataaagtgcctcgg

SEQ ID NO: 6617180 - DNA, 21 bp, Homo sapiens
actcctataaagtgcctcgga

SEQ ID NO: 6617181 - DNA, 17 bp, Homo sapiens
actcctataaggagagt

SEQ ID NO: 6617182 - DNA, 15 bp, Homo sapiens
actcctcaaaccact

SEQ ID NO: 6617183 - DNA, 19 bp, Homo sapiens
actcctcaaaccacttgcc

SEQ ID NO: 6617184 - DNA, 21 bp, Homo sapiens
actcctcaagggcagagaact

SEQ ID NO: 6617185 - DNA, 21 bp, Homo sapiens
actcctcacagcatctctatg

SEQ ID NO: 6617186 - DNA, 15 bp, Homo sapiens
actcctcactgcccc

SEQ ID NO: 6617187 - DNA, 20 bp, Homo sapiens
actcctcactgccccaccag

SEQ ID NO: 6617188 - DNA, 21 bp, Homo sapiens
actcctcagacgggctgagag

SEQ ID NO: 6617189 - DNA, 18 bp, Homo sapiens
actcctcagatctgaaca

SEQ ID NO: 6617190 - DNA, 17 bp, Homo sapiens
actcctcagcacccctc

SEQ ID NO: 6617191 - DNA, 16 bp, Homo sapiens
actcctcaggagagac

SEQ ID NO: 6617192 - DNA, 18 bp, Homo sapiens
actcctcaggagagaccc

SEQ ID NO: 6617193 - DNA, 17 bp, Homo sapiens
actcctcagttcttgcc

SEQ ID NO: 6617194 - DNA, 22 bp, Homo sapiens
actcctcagttcttgccacttt

SEQ ID NO: 6617195 - DNA, 13 bp, Homo sapiens
actcctcccaggg

SEQ ID NO: 6617196 - DNA, 15 bp, Homo sapiens
actcctccccaccct

SEQ ID NO: 6617197 - DNA, 14 bp, Homo sapiens
actcctccccctcc

SEQ ID NO: 6617198 - DNA, 17 bp, Homo sapiens
actcctccccctcctcc

SEQ ID NO: 6617199 - DNA, 23 bp, Homo sapiens
actcctcccctcttctcttttgc

SEQ ID NO: 6617200 - DNA, 11 bp, Homo sapiens
actcctccctc

SEQ ID NO: 6617201 - DNA, 12 bp, Homo sapiens
actcctccctcc

SEQ ID NO: 6617202 - DNA, 17 bp, Homo sapiens
actcctccctgatgtac

SEQ ID NO: 6617203 - DNA, 18 bp, Homo sapiens
actcctccgagacccagg

SEQ ID NO: 6617204 - DNA, 20 bp, Homo sapiens
actcctccgagacccaggag

SEQ ID NO: 6617205 - DNA, 14 bp, Homo sapiens
actcctcctagcca

SEQ ID NO: 6617206 - DNA, 18 bp, Homo sapiens
actcctcctagccaccca

SEQ ID NO: 6617207 - DNA, 23 bp, Homo sapiens
actcctcctccaaaggcccccta

SEQ ID NO: 6617208 - DNA, 14 bp, Homo sapiens
actcctcctccttt

SEQ ID NO: 6617209 - DNA, 15 bp, Homo sapiens
actcctcctcctttc

SEQ ID NO: 6617210 - DNA, 11 bp, Homo sapiens
actcctcctct

SEQ ID NO: 6617211 - DNA, 15 bp, Homo sapiens
actcctcctctttct

SEQ ID NO: 6617212 - DNA, 18 bp, Homo sapiens
actcctcctctttctctc

SEQ ID NO: 6617213 - DNA, 21 bp, Homo sapiens
actcctcctctttctctcccc

SEQ ID NO: 6617214 - DNA, 22 bp, Homo sapiens
actcctcctctttctctcccca

SEQ ID NO: 6617215 - DNA, 12 bp, Homo sapiens
actcctcctgcc

SEQ ID NO: 6617216 - DNA, 16 bp, Homo sapiens
actcctcctgccagct

SEQ ID NO: 6617217 - DNA, 18 bp, Homo sapiens
actcctcctgccagctct

SEQ ID NO: 6617218 - DNA, 22 bp, Homo sapiens
actcctcctgccagctctgtca

SEQ ID NO: 6617219 - DNA, 15 bp, Homo sapiens
actcctcctgctcct

SEQ ID NO: 6617220 - DNA, 22 bp, Homo sapiens
actcctcctgggggctggctcc

SEQ ID NO: 6617221 - DNA, 17 bp, Homo sapiens
actcctcggcctggctc

SEQ ID NO: 6617222 - DNA, 23 bp, Homo sapiens
actcctcggcctggctcctaccc

SEQ ID NO: 6617223 - DNA, 18 bp, Homo sapiens
actcctcgggcaagggcc

SEQ ID NO: 6617224 - DNA, 19 bp, Homo sapiens
actcctctagaagaagcca

SEQ ID NO: 6617225 - DNA, 21 bp, Homo sapiens
actcctctcaactgcctcagc

SEQ ID NO: 6617226 - DNA, 14 bp, Homo sapiens
actcctctgactca

SEQ ID NO: 6617227 - DNA, 20 bp, Homo sapiens
actcctctgactcagggctc

SEQ ID NO: 6617228 - DNA, 12 bp, Homo sapiens
actcctctgcag

SEQ ID NO: 6617229 - DNA, 17 bp, Homo sapiens
actcctctgcagtgcct

SEQ ID NO: 6617230 - DNA, 16 bp, Homo sapiens
actcctctgctgacct

SEQ ID NO: 6617231 - DNA, 14 bp, Homo sapiens
actcctctggcttt

SEQ ID NO: 6617232 - DNA, 16 bp, Homo sapiens
actcctcttatttgct

SEQ ID NO: 6617233 - DNA, 13 bp, Homo sapiens
actcctcttccca

SEQ ID NO: 6617234 - DNA, 13 bp, Homo sapiens
actcctgaaaaaa

SEQ ID NO: 6617235 - DNA, 14 bp, Homo sapiens
actcctgaaaaaaa

SEQ ID NO: 6617236 - DNA, 19 bp, Homo sapiens
actcctgaaaaaaaacctg

SEQ ID NO: 6617237 - DNA, 15 bp, Homo sapiens
actcctgacagtctt

SEQ ID NO: 6617238 - DNA, 19 bp, Homo sapiens
actcctgacagtcttgtgc

SEQ ID NO: 6617239 - DNA, 18 bp, Homo sapiens
actcctgacatcaggtga

SEQ ID NO: 6617240 - DNA, 22 bp, Homo sapiens
actcctgaccataatcctagcc

SEQ ID NO: 6617241 - DNA, 20 bp, Homo sapiens
actcctgacccctctcctca

SEQ ID NO: 6617242 - DNA, 13 bp, Homo sapiens
actcctgacctcg

SEQ ID NO: 6617243 - DNA, 23 bp, Homo sapiens
actcctgacgtctgaagcttgac

SEQ ID NO: 6617244 - DNA, 18 bp, Homo sapiens
actcctgagacccctggc

SEQ ID NO: 6617245 - DNA, 17 bp, Homo sapiens
actcctgaggacagctg

SEQ ID NO: 6617246 - DNA, 17 bp, Homo sapiens
actcctgagtggggcca

SEQ ID NO: 6617247 - DNA, 17 bp, Homo sapiens
actcctgatgccctctt

SEQ ID NO: 6617248 - DNA, 22 bp, Homo sapiens
actcctgattgctctggaagcc

SEQ ID NO: 6617249 - DNA, 12 bp, Homo sapiens
actcctgatttt

SEQ ID NO: 6617250 - DNA, 21 bp, Homo sapiens
actcctgattttgtagttaat

SEQ ID NO: 6617251 - DNA, 15 bp, Homo sapiens
actcctgcaaaattt

SEQ ID NO: 6617252 - DNA, 18 bp, Homo sapiens
actcctgcaaaattttat

SEQ ID NO: 6617253 - DNA, 17 bp, Homo sapiens
actcctgcaggcagcca

SEQ ID NO: 6617254 - DNA, 19 bp, Homo sapiens
actcctgcaggcagccagg

SEQ ID NO: 6617255 - DNA, 11 bp, Homo sapiens
actcctgccag

SEQ ID NO: 6617256 - DNA, 12 bp, Homo sapiens
actcctgccagc

SEQ ID NO: 6617257 - DNA, 13 bp, Homo sapiens
actcctgccagcc

SEQ ID NO: 6617258 - DNA, 16 bp, Homo sapiens
actcctgccagcccgg

SEQ ID NO: 6617259 - DNA, 23 bp, Homo sapiens
actcctgccaggcacacacagcc

SEQ ID NO: 6617260 - DNA, 23 bp, Homo sapiens
actcctgccagggaactggcctg

SEQ ID NO: 6617261 - DNA, 23 bp, Homo sapiens
actcctgccagttgaaaatggat

SEQ ID NO: 6617262 - DNA, 21 bp, Homo sapiens
actcctgccattcttctggtg

SEQ ID NO: 6617263 - DNA, 21 bp, Homo sapiens
actcctgcccctgttctcttc

SEQ ID NO: 6617264 - DNA, 14 bp, Homo sapiens
actcctgccctgtt

SEQ ID NO: 6617265 - DNA, 22 bp, Homo sapiens
actcctgccctgttgtgtatag

SEQ ID NO: 6617266 - DNA, 16 bp, Homo sapiens
actcctgcctccgctg

SEQ ID NO: 6617267 - DNA, 16 bp, Homo sapiens
actcctgcctgagaat

SEQ ID NO: 6617268 - DNA, 19 bp, Homo sapiens
actcctgcctgagtttcca

SEQ ID NO: 6617269 - DNA, 20 bp, Homo sapiens
actcctgcctgagtttccag

SEQ ID NO: 6617270 - DNA, 21 bp, Homo sapiens
actcctgcctgcccccacacc

SEQ ID NO: 6617271 - DNA, 17 bp, Homo sapiens
actcctgcctgtgtttg

SEQ ID NO: 6617272 - DNA, 10 bp, Homo sapiens
actcctgctc

SEQ ID NO: 6617273 - DNA, 11 bp, Homo sapiens
actcctgctgc

SEQ ID NO: 6617274 - DNA, 20 bp, Homo sapiens
actcctgctgcacaggccct

SEQ ID NO: 6617275 - DNA, 15 bp, Homo sapiens
actcctgctggtacc

SEQ ID NO: 6617276 - DNA, 21 bp, Homo sapiens
actcctgctggtacctgccct

SEQ ID NO: 6617277 - DNA, 14 bp, Homo sapiens
actcctgctgtaaa

SEQ ID NO: 6617278 - DNA, 16 bp, Homo sapiens
actcctggaagctgtg

SEQ ID NO: 6617279 - DNA, 12 bp, Homo sapiens
actcctggagca

SEQ ID NO: 6617280 - DNA, 14 bp, Homo sapiens
actcctggaggctg

SEQ ID NO: 6617281 - DNA, 16 bp, Homo sapiens
actcctggcagggcca

SEQ ID NO: 6617282 - DNA, 19 bp, Homo sapiens
actcctggcagggccacct

SEQ ID NO: 6617283 - DNA, 22 bp, Homo sapiens
actcctggcagggccacctgca

SEQ ID NO: 6617284 - DNA, 17 bp, Homo sapiens
actcctggcctcaagca

SEQ ID NO: 6617285 - DNA, 17 bp, Homo sapiens
actcctggcctcaagcc

SEQ ID NO: 6617286 - DNA, 10 bp, Homo sapiens
actcctggct

SEQ ID NO: 6617287 - DNA, 12 bp, Homo sapiens
actcctggctcc

SEQ ID NO: 6617288 - DNA, 13 bp, Homo sapiens
actcctggctccg

SEQ ID NO: 6617289 - DNA, 16 bp, Homo sapiens
actcctggctccgcag

SEQ ID NO: 6617290 - DNA, 20 bp, Homo sapiens
actcctggctccgcaggggt

SEQ ID NO: 6617291 - DNA, 11 bp, Homo sapiens
actcctggctt

SEQ ID NO: 6617292 - DNA, 16 bp, Homo sapiens
actcctggcttcatgt

SEQ ID NO: 6617293 - DNA, 22 bp, Homo sapiens
actcctgggctcaagtgatctt

SEQ ID NO: 6617294 - DNA, 13 bp, Homo sapiens
actcctgggctct

SEQ ID NO: 6617295 - DNA, 19 bp, Homo sapiens
actcctgggctctgaacac

SEQ ID NO: 6617296 - DNA, 17 bp, Homo sapiens
actcctggggggcctga

SEQ ID NO: 6617297 - DNA, 15 bp, Homo sapiens
actcctgggtcagga

SEQ ID NO: 6617298 - DNA, 14 bp, Homo sapiens
actcctgggttgag

SEQ ID NO: 6617299 - DNA, 17 bp, Homo sapiens
actcctgggttgagctg

SEQ ID NO: 6617300 - DNA, 13 bp, Homo sapiens
actcctggtctgt

SEQ ID NO: 6617301 - DNA, 20 bp, Homo sapiens
actcctggtgcaggtctcca

SEQ ID NO: 6617302 - DNA, 13 bp, Homo sapiens
actcctggtgccc

SEQ ID NO: 6617303 - DNA, 15 bp, Homo sapiens
actcctggtgcccct

SEQ ID NO: 6617304 - DNA, 18 bp, Homo sapiens
actcctgtacactgaata

SEQ ID NO: 6617305 - DNA, 12 bp, Homo sapiens
actcctgtcccg

SEQ ID NO: 6617306 - DNA, 13 bp, Homo sapiens
actcctgtccctt

SEQ ID NO: 6617307 - DNA, 19 bp, Homo sapiens
actcctgtcccttttccct

SEQ ID NO: 6617308 - DNA, 21 bp, Homo sapiens
actcctgtctcttgggaagca

SEQ ID NO: 6617309 - DNA, 16 bp, Homo sapiens
actcctgtcttctgct

SEQ ID NO: 6617310 - DNA, 24 bp, Homo sapiens
actcctgtcttctttctccatgga

SEQ ID NO: 6617311 - DNA, 20 bp, Homo sapiens
actcctgtgctctggaggct

SEQ ID NO: 6617312 - DNA, 19 bp, Homo sapiens
actcctgtgggagcctcgc

SEQ ID NO: 6617313 - DNA, 20 bp, Homo sapiens
actcctgtgggagcctcgca

SEQ ID NO: 6617314 - DNA, 14 bp, Homo sapiens
actcctgtgtgtgg

SEQ ID NO: 6617315 - DNA, 16 bp, Homo sapiens
actcctgtgtgtggaa

SEQ ID NO: 6617316 - DNA, 17 bp, Homo sapiens
actcctgttacttacct

SEQ ID NO: 6617317 - DNA, 23 bp, Homo sapiens
actcctgttagtagcagaaatat

SEQ ID NO: 6617318 - DNA, 14 bp, Homo sapiens
actcctgtttctcc

SEQ ID NO: 6617319 - DNA, 14 bp, Homo sapiens
actccttaaaaatg

SEQ ID NO: 6617320 - DNA, 17 bp, Homo sapiens
actccttaaaaatgtat

SEQ ID NO: 6617321 - DNA, 14 bp, Homo sapiens
actccttaatatga

SEQ ID NO: 6617322 - DNA, 22 bp, Homo sapiens
actccttaatatgatctgtgga

SEQ ID NO: 6617323 - DNA, 16 bp, Homo sapiens
actccttatcccttgg

SEQ ID NO: 6617324 - DNA, 22 bp, Homo sapiens
actccttcaacaattctaaaat

SEQ ID NO: 6617325 - DNA, 18 bp, Homo sapiens
actccttcatgtttggaa

SEQ ID NO: 6617326 - DNA, 13 bp, Homo sapiens
actccttccagct

SEQ ID NO: 6617327 - DNA, 18 bp, Homo sapiens
actccttccatctcttcc

SEQ ID NO: 6617328 - DNA, 21 bp, Homo sapiens
actccttccccttgtccctgg

SEQ ID NO: 6617329 - DNA, 22 bp, Homo sapiens
actccttccctaatagcttttt

SEQ ID NO: 6617330 - DNA, 11 bp, Homo sapiens
actccttcctc

SEQ ID NO: 6617331 - DNA, 18 bp, Homo sapiens
actccttcctctttgctt

SEQ ID NO: 6617332 - DNA, 21 bp, Homo sapiens
actccttcctgccacctgctg

SEQ ID NO: 6617333 - DNA, 14 bp, Homo sapiens
actccttcctgccc

SEQ ID NO: 6617334 - DNA, 13 bp, Homo sapiens
actccttcctggc

SEQ ID NO: 6617335 - DNA, 19 bp, Homo sapiens
actccttccttcaggactc

SEQ ID NO: 6617336 - DNA, 15 bp, Homo sapiens
actccttctccccaa

SEQ ID NO: 6617337 - DNA, 24 bp, Homo sapiens
actccttgaaaacactgttctctg

SEQ ID NO: 6617338 - DNA, 17 bp, Homo sapiens
actccttgagagaccag

SEQ ID NO: 6617339 - DNA, 23 bp, Homo sapiens
actccttgagagaccaggcaaag

SEQ ID NO: 6617340 - DNA, 19 bp, Homo sapiens
actccttgcatcaaggggt

SEQ ID NO: 6617341 - DNA, 22 bp, Homo sapiens
actccttggatttgcatttttg

SEQ ID NO: 6617342 - DNA, 23 bp, Homo sapiens
actccttggatttgcatttttgt

SEQ ID NO: 6617343 - DNA, 16 bp, Homo sapiens
actccttggcctagcc

SEQ ID NO: 6617344 - DNA, 18 bp, Homo sapiens
actccttggcctagccca

SEQ ID NO: 6617345 - DNA, 20 bp, Homo sapiens
actccttgtggtttatgtca

SEQ ID NO: 6617346 - DNA, 22 bp, Homo sapiens
actccttgttagcccttcagat

SEQ ID NO: 6617347 - DNA, 17 bp, Homo sapiens
actccttgttctgctct

SEQ ID NO: 6617348 - DNA, 15 bp, Homo sapiens
actcctttatctgta

SEQ ID NO: 6617349 - DNA, 16 bp, Homo sapiens
actcctttcagccaca

SEQ ID NO: 6617350 - DNA, 17 bp, Homo sapiens
actcctttcagccacat

SEQ ID NO: 6617351 - DNA, 23 bp, Homo sapiens
actcctttcttatcttgaccata

SEQ ID NO: 6617352 - DNA, 18 bp, Homo sapiens
actcctttggtatttcac

SEQ ID NO: 6617353 - DNA, 20 bp, Homo sapiens
actcctttttcaaatgagtt

SEQ ID NO: 6617354 - DNA, 14 bp, Homo sapiens
actcgaaaataagg

SEQ ID NO: 6617355 - DNA, 17 bp, Homo sapiens
actcgaagcccttccag

SEQ ID NO: 6617356 - DNA, 22 bp, Homo sapiens
actcgaagcccttccagtggta

SEQ ID NO: 6617357 - DNA, 20 bp, Homo sapiens
actcgacaaaggccacaggc

SEQ ID NO: 6617358 - DNA, 16 bp, Homo sapiens
actcgactctgctgct

SEQ ID NO: 6617359 - DNA, 17 bp, Homo sapiens
actcgactctgctgctc

SEQ ID NO: 6617360 - DNA, 17 bp, Homo sapiens
actcgagaactttcatt

SEQ ID NO: 6617361 - DNA, 21 bp, Homo sapiens
actcgagaccatcctggcccc

SEQ ID NO: 6617362 - DNA, 22 bp, Homo sapiens
actcgagaccatcctggcccct

SEQ ID NO: 6617363 - DNA, 21 bp, Homo sapiens
actcgagagggctgagcccct

SEQ ID NO: 6617364 - DNA, 23 bp, Homo sapiens
actcgagagggctgagcccctcc

SEQ ID NO: 6617365 - DNA, 21 bp, Homo sapiens
actcgaggactgtatttgtga

SEQ ID NO: 6617366 - DNA, 18 bp, Homo sapiens
actcgagtcacactcaag

SEQ ID NO: 6617367 - DNA, 13 bp, Homo sapiens
actcgagtgttta

SEQ ID NO: 6617368 - DNA, 21 bp, Homo sapiens
actcgatcaaaaccttccttc

SEQ ID NO: 6617369 - DNA, 15 bp, Homo sapiens
actcgatgaatgtgt

SEQ ID NO: 6617370 - DNA, 23 bp, Homo sapiens
actcgatgcaagtgtttctgttc

SEQ ID NO: 6617371 - DNA, 13 bp, Homo sapiens
actcgatgcactg

SEQ ID NO: 6617372 - DNA, 19 bp, Homo sapiens
actcgattcatattgaata

SEQ ID NO: 6617373 - DNA, 22 bp, Homo sapiens
actcgatttaaactccagcatt

SEQ ID NO: 6617374 - DNA, 19 bp, Homo sapiens
actcgcacctcttggcttt

SEQ ID NO: 6617375 - DNA, 20 bp, Homo sapiens
actcgcacctcttggctttg

SEQ ID NO: 6617376 - DNA, 16 bp, Homo sapiens
actcgcagtcgcagga

SEQ ID NO: 6617377 - DNA, 17 bp, Homo sapiens
actcgcccgcccactgt

SEQ ID NO: 6617378 - DNA, 21 bp, Homo sapiens
actcgcccgcccactgtcctg

SEQ ID NO: 6617379 - DNA, 22 bp, Homo sapiens
actcgcccgcccactgtcctgg

SEQ ID NO: 6617380 - DNA, 22 bp, Homo sapiens
actcgcctactaagtacccttg

SEQ ID NO: 6617381 - DNA, 12 bp, Homo sapiens
actcgcctcagc

SEQ ID NO: 6617382 - DNA, 13 bp, Homo sapiens
actcgcctcagcc

SEQ ID NO: 6617383 - DNA, 13 bp, Homo sapiens
actcgccttctta

SEQ ID NO: 6617384 - DNA, 18 bp, Homo sapiens
actcgcgacaatgcaaac

SEQ ID NO: 6617385 - DNA, 23 bp, Homo sapiens
actcgctagcagtggcaggcaga

SEQ ID NO: 6617386 - DNA, 18 bp, Homo sapiens
actcgcttgccgggcctg

SEQ ID NO: 6617387 - DNA, 12 bp, Homo sapiens
actcgcttgtaa

SEQ ID NO: 6617388 - DNA, 14 bp, Homo sapiens
actcgcttgtaaat

SEQ ID NO: 6617389 - DNA, 17 bp, Homo sapiens
actcgcttgtaaatacc

SEQ ID NO: 6617390 - DNA, 20 bp, Homo sapiens
actcggagactatggcctcg

SEQ ID NO: 6617391 - DNA, 21 bp, Homo sapiens
actcggatgtgtcctttctga

SEQ ID NO: 6617392 - DNA, 21 bp, Homo sapiens
actcggccactgtgtctctgt

SEQ ID NO: 6617393 - DNA, 14 bp, Homo sapiens
actcggcttcctgt

SEQ ID NO: 6617394 - DNA, 22 bp, Homo sapiens
actcggctttggagactttctt

SEQ ID NO: 6617395 - DNA, 18 bp, Homo sapiens
actcgggagctgcacaca

SEQ ID NO: 6617396 - DNA, 20 bp, Homo sapiens
actcgggaggctgaggcaca

SEQ ID NO: 6617397 - DNA, 21 bp, Homo sapiens
actcgggaggctgaggcagga

SEQ ID NO: 6617398 - DNA, 14 bp, Homo sapiens
actcgggctcctgt

SEQ ID NO: 6617399 - DNA, 15 bp, Homo sapiens
actcggggtccctgg

SEQ ID NO: 6617400 - DNA, 17 bp, Homo sapiens
actcgggtctgcagacc

SEQ ID NO: 6617401 - DNA, 14 bp, Homo sapiens
actcggtgtcccca

SEQ ID NO: 6617402 - DNA, 22 bp, Homo sapiens
actcggtgtccccaccatctgc

SEQ ID NO: 6617403 - DNA, 23 bp, Homo sapiens
actcggtgtccccaccatctgct

SEQ ID NO: 6617404 - DNA, 13 bp, Homo sapiens
actcgtctgatgt

SEQ ID NO: 6617405 - DNA, 14 bp, Homo sapiens
actcgtctgatgtt

SEQ ID NO: 6617406 - DNA, 19 bp, Homo sapiens
actcgtctgatgttttgat

SEQ ID NO: 6617407 - DNA, 18 bp, Homo sapiens
actcgtgacagcctctga

SEQ ID NO: 6617408 - DNA, 22 bp, Homo sapiens
actcgtgaccgcaggtgatcct

SEQ ID NO: 6617409 - DNA, 22 bp, Homo sapiens
actcgtgcattaaaatttctta

SEQ ID NO: 6617410 - DNA, 22 bp, Homo sapiens
actcgtgtctggcacagcctgg

SEQ ID NO: 6617411 - DNA, 15 bp, Homo sapiens
actcgtgtgtttcta

SEQ ID NO: 6617412 - DNA, 14 bp, Homo sapiens
actcgttaatttgt

SEQ ID NO: 6617413 - DNA, 19 bp, Homo sapiens
actcgttaatttgtagtgt

SEQ ID NO: 6617414 - DNA, 14 bp, Homo sapiens
actcgttacctgcc

SEQ ID NO: 6617415 - DNA, 15 bp, Homo sapiens
actcgttacctgccg

SEQ ID NO: 6617416 - DNA, 14 bp, Homo sapiens
actcgttctcgtga

SEQ ID NO: 6617417 - DNA, 16 bp, Homo sapiens
actcgttgcagtctgt

SEQ ID NO: 6617418 - DNA, 14 bp, Homo sapiens
actcgttttttaca

SEQ ID NO: 6617419 - DNA, 17 bp, Homo sapiens
actctaaaaaacatttt

SEQ ID NO: 6617420 - DNA, 18 bp, Homo sapiens
actctaaaaaacattttt

SEQ ID NO: 6617421 - DNA, 12 bp, Homo sapiens
actctaaaagat

SEQ ID NO: 6617422 - DNA, 14 bp, Homo sapiens
actctaaaagatcc

SEQ ID NO: 6617423 - DNA, 16 bp, Homo sapiens
actctaaaaggttcag

SEQ ID NO: 6617424 - DNA, 18 bp, Homo sapiens
actctaaaaggttcaggg

SEQ ID NO: 6617425 - DNA, 23 bp, Homo sapiens
actctaaaatggacattttcttt

SEQ ID NO: 6617426 - DNA, 15 bp, Homo sapiens
actctaaaattataa

SEQ ID NO: 6617427 - DNA, 21 bp, Homo sapiens
actctaaaattataaatgaca

SEQ ID NO: 6617428 - DNA, 15 bp, Homo sapiens
actctaaactgcaaa

SEQ ID NO: 6617429 - DNA, 23 bp, Homo sapiens
actctaaactgcaaacagaaatc

SEQ ID NO: 6617430 - DNA, 13 bp, Homo sapiens
actctaaagaaaa

SEQ ID NO: 6617431 - DNA, 15 bp, Homo sapiens
actctaaagaaaaat

SEQ ID NO: 6617432 - DNA, 16 bp, Homo sapiens
actctaaagaaacaga

SEQ ID NO: 6617433 - DNA, 14 bp, Homo sapiens
actctaaagaccaa

SEQ ID NO: 6617434 - DNA, 14 bp, Homo sapiens
actctaaagcaaat

SEQ ID NO: 6617435 - DNA, 14 bp, Homo sapiens
actctaaagtctgt

SEQ ID NO: 6617436 - DNA, 16 bp, Homo sapiens
actctaaataaatttg

SEQ ID NO: 6617437 - DNA, 23 bp, Homo sapiens
actctaaataaatttgcttttat

SEQ ID NO: 6617438 - DNA, 13 bp, Homo sapiens
actctaaatattt

SEQ ID NO: 6617439 - DNA, 21 bp, Homo sapiens
actctaaatgcagttttaaga

SEQ ID NO: 6617440 - DNA, 22 bp, Homo sapiens
actctaaattctttatttctgt

SEQ ID NO: 6617441 - DNA, 14 bp, Homo sapiens
actctaaccagtgt

SEQ ID NO: 6617442 - DNA, 19 bp, Homo sapiens
actctaaccagtgtacagg

SEQ ID NO: 6617443 - DNA, 15 bp, Homo sapiens
actctaaccctgtgg

SEQ ID NO: 6617444 - DNA, 18 bp, Homo sapiens
actctaactgtatatttg

SEQ ID NO: 6617445 - DNA, 21 bp, Homo sapiens
actctaactgtgacaaagaag

SEQ ID NO: 6617446 - DNA, 23 bp, Homo sapiens
actctaactgtgacaaagaagac

SEQ ID NO: 6617447 - DNA, 23 bp, Homo sapiens
actctaagaaatggctttccaca

SEQ ID NO: 6617448 - DNA, 20 bp, Homo sapiens
actctaagatcttagattct

SEQ ID NO: 6617449 - DNA, 14 bp, Homo sapiens
actctaagatgtta

SEQ ID NO: 6617450 - DNA, 15 bp, Homo sapiens
actctaagcagaaga

SEQ ID NO: 6617451 - DNA, 16 bp, Homo sapiens
actctaagctggagct

SEQ ID NO: 6617452 - DNA, 13 bp, Homo sapiens
actctaagctgtg

SEQ ID NO: 6617453 - DNA, 15 bp, Homo sapiens
actctaagctgtgtg

SEQ ID NO: 6617454 - DNA, 17 bp, Homo sapiens
actctaagctgtgtgca

SEQ ID NO: 6617455 - DNA, 19 bp, Homo sapiens
actctaagctgtgtgcagg

SEQ ID NO: 6617456 - DNA, 22 bp, Homo sapiens
actctaagtcatgtatgtttct

SEQ ID NO: 6617457 - DNA, 23 bp, Homo sapiens
actctaagtcatgtatgtttctc

SEQ ID NO: 6617458 - DNA, 16 bp, Homo sapiens
actctaagtgtttgct

SEQ ID NO: 6617459 - DNA, 15 bp, Homo sapiens
actctaatatacagt

SEQ ID NO: 6617460 - DNA, 17 bp, Homo sapiens
actctaatatgattata

SEQ ID NO: 6617461 - DNA, 13 bp, Homo sapiens
actctaattagag

SEQ ID NO: 6617462 - DNA, 15 bp, Homo sapiens
actctaattagagaa

SEQ ID NO: 6617463 - DNA, 22 bp, Homo sapiens
actctaattcccattttgcaaa

SEQ ID NO: 6617464 - DNA, 13 bp, Homo sapiens
actctaattctaa

SEQ ID NO: 6617465 - DNA, 15 bp, Homo sapiens
actctaattctaacc

SEQ ID NO: 6617466 - DNA, 17 bp, Homo sapiens
actctacaattcctctg

SEQ ID NO: 6617467 - DNA, 15 bp, Homo sapiens
actctacacagctca

SEQ ID NO: 6617468 - DNA, 23 bp, Homo sapiens
actctacacggactgaggtgcct

SEQ ID NO: 6617469 - DNA, 13 bp, Homo sapiens
actctacactgaa

SEQ ID NO: 6617470 - DNA, 15 bp, Homo sapiens
actctacagaggcca

SEQ ID NO: 6617471 - DNA, 13 bp, Homo sapiens
actctacataatt

SEQ ID NO: 6617472 - DNA, 16 bp, Homo sapiens
actctacatgcttgtt

SEQ ID NO: 6617473 - DNA, 17 bp, Homo sapiens
actctaccagtgcaggc

SEQ ID NO: 6617474 - DNA, 23 bp, Homo sapiens
actctaccatggttctgcctcct

SEQ ID NO: 6617475 - DNA, 19 bp, Homo sapiens
actctacccatattacaga

SEQ ID NO: 6617476 - DNA, 15 bp, Homo sapiens
actctacccctgctc

SEQ ID NO: 6617477 - DNA, 18 bp, Homo sapiens
actctacccctgctccca

SEQ ID NO: 6617478 - DNA, 23 bp, Homo sapiens
actctacccctgctcccattcct

SEQ ID NO: 6617479 - DNA, 13 bp, Homo sapiens
actctaccctccc

SEQ ID NO: 6617480 - DNA, 15 bp, Homo sapiens
actctaccctcccac

SEQ ID NO: 6617481 - DNA, 16 bp, Homo sapiens
actctaccctcccacc

SEQ ID NO: 6617482 - DNA, 18 bp, Homo sapiens
actctaccctcccacccc

SEQ ID NO: 6617483 - DNA, 23 bp, Homo sapiens
actctaccctggtaggaaagcac

SEQ ID NO: 6617484 - DNA, 23 bp, Homo sapiens
actctacctaatgtctcactgtt

SEQ ID NO: 6617485 - DNA, 15 bp, Homo sapiens
actctacgccaaagt

SEQ ID NO: 6617486 - DNA, 16 bp, Homo sapiens
actctacgccaaagtg

SEQ ID NO: 6617487 - DNA, 17 bp, Homo sapiens
actctacgccaaagtgc

SEQ ID NO: 6617488 - DNA, 13 bp, Homo sapiens
actctactgcccc

SEQ ID NO: 6617489 - DNA, 12 bp, Homo sapiens
actctactgctg

SEQ ID NO: 6617490 - DNA, 14 bp, Homo sapiens
actctactgtgtaa

SEQ ID NO: 6617491 - DNA, 19 bp, Homo sapiens
actctacttaatccaatgg

SEQ ID NO: 6617492 - DNA, 17 bp, Homo sapiens
actctagaacatgcaca

SEQ ID NO: 6617493 - DNA, 18 bp, Homo sapiens
actctagaacatgcacat

SEQ ID NO: 6617494 - DNA, 20 bp, Homo sapiens
actctagaagctcaggttcc

SEQ ID NO: 6617495 - DNA, 17 bp, Homo sapiens
actctagacaagatatt

SEQ ID NO: 6617496 - DNA, 13 bp, Homo sapiens
actctagactgca

SEQ ID NO: 6617497 - DNA, 16 bp, Homo sapiens
actctagagagcctta

SEQ ID NO: 6617498 - DNA, 18 bp, Homo sapiens
actctagagagccttaac

SEQ ID NO: 6617499 - DNA, 19 bp, Homo sapiens
actctagagagccttaact

SEQ ID NO: 6617500 - DNA, 13 bp, Homo sapiens
actctagattcca

SEQ ID NO: 6617501 - DNA, 16 bp, Homo sapiens
actctagcctggcaac

SEQ ID NO: 6617502 - DNA, 22 bp, Homo sapiens
actctagcctggcaacagagca

SEQ ID NO: 6617503 - DNA, 18 bp, Homo sapiens
actctaggatgtatattt

SEQ ID NO: 6617504 - DNA, 20 bp, Homo sapiens
actctaggatgtatatttta

SEQ ID NO: 6617505 - DNA, 17 bp, Homo sapiens
actctagggaaaaacca

SEQ ID NO: 6617506 - DNA, 13 bp, Homo sapiens
actctagggcagt

SEQ ID NO: 6617507 - DNA, 17 bp, Homo sapiens
actctaggtgcccttgg

SEQ ID NO: 6617508 - DNA, 16 bp, Homo sapiens
actctaggttatacaa

SEQ ID NO: 6617509 - DNA, 17 bp, Homo sapiens
actctaggttatacaat

SEQ ID NO: 6617510 - DNA, 17 bp, Homo sapiens
actctagtactgtgaat

SEQ ID NO: 6617511 - DNA, 15 bp, Homo sapiens
actctagtcaatgac

SEQ ID NO: 6617512 - DNA, 20 bp, Homo sapiens
actctagtcaatgacatgaa

SEQ ID NO: 6617513 - DNA, 23 bp, Homo sapiens
actctagtgacttcctggtgagg

SEQ ID NO: 6617514 - DNA, 13 bp, Homo sapiens
actctagttctgt

SEQ ID NO: 6617515 - DNA, 19 bp, Homo sapiens
actctataaagaaactttt

SEQ ID NO: 6617516 - DNA, 22 bp, Homo sapiens
actctataagcaaattgctttt

SEQ ID NO: 6617517 - DNA, 18 bp, Homo sapiens
actctatactaccctggg

SEQ ID NO: 6617518 - DNA, 20 bp, Homo sapiens
actctatactaccctgggct

SEQ ID NO: 6617519 - DNA, 17 bp, Homo sapiens
actctatactcaatcaa

SEQ ID NO: 6617520 - DNA, 18 bp, Homo sapiens
actctatagactctagga

SEQ ID NO: 6617521 - DNA, 20 bp, Homo sapiens
actctatatgtagtgcattt

SEQ ID NO: 6617522 - DNA, 16 bp, Homo sapiens
actctatcaagtatta

SEQ ID NO: 6617523 - DNA, 23 bp, Homo sapiens
actctatcaagtattataccttt

SEQ ID NO: 6617524 - DNA, 16 bp, Homo sapiens
actctatcagcattgt

SEQ ID NO: 6617525 - DNA, 16 bp, Homo sapiens
actctatctgggcctg

SEQ ID NO: 6617526 - DNA, 17 bp, Homo sapiens
actctatctgggcctgg

SEQ ID NO: 6617527 - DNA, 18 bp, Homo sapiens
actctatctgggcctggg

SEQ ID NO: 6617528 - DNA, 15 bp, Homo sapiens
actctatgctctgga

SEQ ID NO: 6617529 - DNA, 22 bp, Homo sapiens
actctatgctctggaaaacctg

SEQ ID NO: 6617530 - DNA, 23 bp, Homo sapiens
actctattaatgaggtctttaaa

SEQ ID NO: 6617531 - DNA, 15 bp, Homo sapiens
actctattgatacaa

SEQ ID NO: 6617532 - DNA, 15 bp, Homo sapiens
actctattttaatgt

SEQ ID NO: 6617533 - DNA, 20 bp, Homo sapiens
actctatttttacatttaaa

SEQ ID NO: 6617534 - DNA, 18 bp, Homo sapiens
actctcaaaatctttgta

SEQ ID NO: 6617535 - DNA, 12 bp, Homo sapiens
actctcaagcta

SEQ ID NO: 6617536 - DNA, 20 bp, Homo sapiens
actctcaattccctgaaaaa

SEQ ID NO: 6617537 - DNA, 21 bp, Homo sapiens
actctcacactggttctcaat

SEQ ID NO: 6617538 - DNA, 22 bp, Homo sapiens
actctcacactggttctcaatg

SEQ ID NO: 6617539 - DNA, 14 bp, Homo sapiens
actctcacatgtgg

SEQ ID NO: 6617540 - DNA, 21 bp, Homo sapiens
actctcacccataaacagtaa

SEQ ID NO: 6617541 - DNA, 21 bp, Homo sapiens
actctcacctcgtgatatcca

SEQ ID NO: 6617542 - DNA, 18 bp, Homo sapiens
actctcactatgctgcta

SEQ ID NO: 6617543 - DNA, 22 bp, Homo sapiens
actctcactatgctgctatgga

SEQ ID NO: 6617544 - DNA, 14 bp, Homo sapiens
actctcactcctga

SEQ ID NO: 6617545 - DNA, 21 bp, Homo sapiens
actctcactcctgaattcagt

SEQ ID NO: 6617546 - DNA, 12 bp, Homo sapiens
actctcagaaat

SEQ ID NO: 6617547 - DNA, 15 bp, Homo sapiens
actctcagaaataaa

SEQ ID NO: 6617548 - DNA, 14 bp, Homo sapiens
actctcagaggccc

SEQ ID NO: 6617549 - DNA, 16 bp, Homo sapiens
actctcagaggcccca

SEQ ID NO: 6617550 - DNA, 17 bp, Homo sapiens
actctcagaggccccaa

SEQ ID NO: 6617551 - DNA, 12 bp, Homo sapiens
actctcagagtg

SEQ ID NO: 6617552 - DNA, 22 bp, Homo sapiens
actctcagcccagaagaaaatt

SEQ ID NO: 6617553 - DNA, 21 bp, Homo sapiens
actctcaggaaatgctgaccc

SEQ ID NO: 6617554 - DNA, 21 bp, Homo sapiens
actctcaggaccaccctgcca

SEQ ID NO: 6617555 - DNA, 22 bp, Homo sapiens
actctcaggaccaccctgccaa

SEQ ID NO: 6617556 - DNA, 13 bp, Homo sapiens
actctcaggaggc

SEQ ID NO: 6617557 - DNA, 17 bp, Homo sapiens
actctcaggaggcgcag

SEQ ID NO: 6617558 - DNA, 19 bp, Homo sapiens
actctcaggatcaagaaag

SEQ ID NO: 6617559 - DNA, 14 bp, Homo sapiens
actctcagtctctg

SEQ ID NO: 6617560 - DNA, 16 bp, Homo sapiens
actctcagtctctgag

SEQ ID NO: 6617561 - DNA, 15 bp, Homo sapiens
actctcagtgcttct

SEQ ID NO: 6617562 - DNA, 22 bp, Homo sapiens
actctcagtgcttcttactatt

SEQ ID NO: 6617563 - DNA, 17 bp, Homo sapiens
actctcatcactacagt

SEQ ID NO: 6617564 - DNA, 18 bp, Homo sapiens
actctcatcactacagta

SEQ ID NO: 6617565 - DNA, 15 bp, Homo sapiens
actctcattccccag

SEQ ID NO: 6617566 - DNA, 17 bp, Homo sapiens
actctccaccctggctg

SEQ ID NO: 6617567 - DNA, 13 bp, Homo sapiens
actctccacctca

SEQ ID NO: 6617568 - DNA, 14 bp, Homo sapiens
actctccacctcac

SEQ ID NO: 6617569 - DNA, 20 bp, Homo sapiens
actctccacctcactagctc

SEQ ID NO: 6617570 - DNA, 17 bp, Homo sapiens
actctccagcagttagg

SEQ ID NO: 6617571 - DNA, 11 bp, Homo sapiens
actctccaggc

SEQ ID NO: 6617572 - DNA, 23 bp, Homo sapiens
actctccaggggtcctaggcctc

SEQ ID NO: 6617573 - DNA, 15 bp, Homo sapiens
actctccatatgtga

SEQ ID NO: 6617574 - DNA, 22 bp, Homo sapiens
actctccatttaataattatat

SEQ ID NO: 6617575 - DNA, 12 bp, Homo sapiens
actctcccagat

SEQ ID NO: 6617576 - DNA, 20 bp, Homo sapiens
actctcccaggcctgcctgc

SEQ ID NO: 6617577 - DNA, 14 bp, Homo sapiens
actctcccatggct

SEQ ID NO: 6617578 - DNA, 12 bp, Homo sapiens
actctccccaca

SEQ ID NO: 6617579 - DNA, 15 bp, Homo sapiens
actctccccacacta

SEQ ID NO: 6617580 - DNA, 20 bp, Homo sapiens
actctccccagtgcctgcca

SEQ ID NO: 6617581 - DNA, 18 bp, Homo sapiens
actctccccctttcaagg

SEQ ID NO: 6617582 - DNA, 19 bp, Homo sapiens
actctccccctttcaagga

SEQ ID NO: 6617583 - DNA, 23 bp, Homo sapiens
actctcccctccccatctgtgtt

SEQ ID NO: 6617584 - DNA, 17 bp, Homo sapiens
actctcccctccctctt

SEQ ID NO: 6617585 - DNA, 19 bp, Homo sapiens
actctcccctccctcttcc

SEQ ID NO: 6617586 - DNA, 22 bp, Homo sapiens
actctcccctccctcttccttc

SEQ ID NO: 6617587 - DNA, 15 bp, Homo sapiens
actctcctatgcctt

SEQ ID NO: 6617588 - DNA, 11 bp, Homo sapiens
actctcctccc

SEQ ID NO: 6617589 - DNA, 12 bp, Homo sapiens
actctcctcctc

SEQ ID NO: 6617590 - DNA, 14 bp, Homo sapiens
actctcctcctccc

SEQ ID NO: 6617591 - DNA, 16 bp, Homo sapiens
actctcctcctcccct

SEQ ID NO: 6617592 - DNA, 17 bp, Homo sapiens
actctcctcctcccctc

SEQ ID NO: 6617593 - DNA, 18 bp, Homo sapiens
actctcctcctcccctcc

SEQ ID NO: 6617594 - DNA, 20 bp, Homo sapiens
actctcctcctcccctcctc

SEQ ID NO: 6617595 - DNA, 19 bp, Homo sapiens
actctcctcggccccctcc

SEQ ID NO: 6617596 - DNA, 20 bp, Homo sapiens
actctcctcggccccctcca

SEQ ID NO: 6617597 - DNA, 14 bp, Homo sapiens
actctcctctgcct

SEQ ID NO: 6617598 - DNA, 13 bp, Homo sapiens
actctcctctgct

SEQ ID NO: 6617599 - DNA, 18 bp, Homo sapiens
actctcctctgctgctgg

SEQ ID NO: 6617600 - DNA, 21 bp, Homo sapiens
actctcctctgctgctggctg

SEQ ID NO: 6617601 - DNA, 22 bp, Homo sapiens
actctcctgaggagcagcccac

SEQ ID NO: 6617602 - DNA, 13 bp, Homo sapiens
actctcctgcctc

SEQ ID NO: 6617603 - DNA, 17 bp, Homo sapiens
actctcctgctcctcag

SEQ ID NO: 6617604 - DNA, 13 bp, Homo sapiens
actctcctggcct

SEQ ID NO: 6617605 - DNA, 22 bp, Homo sapiens
actctccttcgtgtctctccca

SEQ ID NO: 6617606 - DNA, 15 bp, Homo sapiens
actctccttgcagtt

SEQ ID NO: 6617607 - DNA, 16 bp, Homo sapiens
actctccttgcagttc

SEQ ID NO: 6617608 - DNA, 13 bp, Homo sapiens
actctccttttga

SEQ ID NO: 6617609 - DNA, 19 bp, Homo sapiens
actctcgcacacacagtga

SEQ ID NO: 6617610 - DNA, 18 bp, Homo sapiens
actctcgcatcttcccaa

SEQ ID NO: 6617611 - DNA, 14 bp, Homo sapiens
actctcggggccct

SEQ ID NO: 6617612 - DNA, 17 bp, Homo sapiens
actctcggggcccttgg

SEQ ID NO: 6617613 - DNA, 22 bp, Homo sapiens
actctcggggcccttggggcct

SEQ ID NO: 6617614 - DNA, 21 bp, Homo sapiens
actctcgtgatatgctgcttg

SEQ ID NO: 6617615 - DNA, 22 bp, Homo sapiens
actctcgtgatatgctgcttgt

SEQ ID NO: 6617616 - DNA, 11 bp, Homo sapiens
actctctacag

SEQ ID NO: 6617617 - DNA, 20 bp, Homo sapiens
actctctactacacaggcct

SEQ ID NO: 6617618 - DNA, 22 bp, Homo sapiens
actctctactggtaggaagagg

SEQ ID NO: 6617619 - DNA, 22 bp, Homo sapiens
actctctagttccctcagtgtg

SEQ ID NO: 6617620 - DNA, 20 bp, Homo sapiens
actctctataagtgttcagt

SEQ ID NO: 6617621 - DNA, 22 bp, Homo sapiens
actctctataagtgttcagtgt

SEQ ID NO: 6617622 - DNA, 24 bp, Homo sapiens
actctctataagtgttcagtgttg

SEQ ID NO: 6617623 - DNA, 21 bp, Homo sapiens
actctctattgaccaccagtt

SEQ ID NO: 6617624 - DNA, 20 bp, Homo sapiens
actctctcacccaccagctc

SEQ ID NO: 6617625 - DNA, 21 bp, Homo sapiens
actctctcacccaccagctcc

SEQ ID NO: 6617626 - DNA, 20 bp, Homo sapiens
actctctccaccctatatgt

SEQ ID NO: 6617627 - DNA, 14 bp, Homo sapiens
actctctccctggt

SEQ ID NO: 6617628 - DNA, 22 bp, Homo sapiens
actctctcccttggcagagaag

SEQ ID NO: 6617629 - DNA, 17 bp, Homo sapiens
actctctctctgttaaa

SEQ ID NO: 6617630 - DNA, 12 bp, Homo sapiens
actctctctgcc

SEQ ID NO: 6617631 - DNA, 14 bp, Homo sapiens
actctctctgcccc

SEQ ID NO: 6617632 - DNA, 15 bp, Homo sapiens
actctctctgccccc

SEQ ID NO: 6617633 - DNA, 19 bp, Homo sapiens
actctctcttgttcttact

SEQ ID NO: 6617634 - DNA, 18 bp, Homo sapiens
actctctgaacccctccc

SEQ ID NO: 6617635 - DNA, 13 bp, Homo sapiens
actctctgacaaa

SEQ ID NO: 6617636 - DNA, 17 bp, Homo sapiens
actctctgacaaagtgg

SEQ ID NO: 6617637 - DNA, 17 bp, Homo sapiens
actctctgagatgtgtt

SEQ ID NO: 6617638 - DNA, 18 bp, Homo sapiens
actctctgagctggggag

SEQ ID NO: 6617639 - DNA, 19 bp, Homo sapiens
actctctgcagcccagcct

SEQ ID NO: 6617640 - DNA, 22 bp, Homo sapiens
actctctgccagctccacaggg

SEQ ID NO: 6617641 - DNA, 21 bp, Homo sapiens
actctctgccattctgtgcag

SEQ ID NO: 6617642 - DNA, 12 bp, Homo sapiens
actctctgcctg

SEQ ID NO: 6617643 - DNA, 18 bp, Homo sapiens
actctctgctctagccag

SEQ ID NO: 6617644 - DNA, 19 bp, Homo sapiens
actctctgctctagccagg

SEQ ID NO: 6617645 - DNA, 22 bp, Homo sapiens
actctctggaagcccctgggcc

SEQ ID NO: 6617646 - DNA, 17 bp, Homo sapiens
actctctgggactctcc

SEQ ID NO: 6617647 - DNA, 21 bp, Homo sapiens
actctctgggactctcctcct

SEQ ID NO: 6617648 - DNA, 16 bp, Homo sapiens
actctctgtcttctct

SEQ ID NO: 6617649 - DNA, 15 bp, Homo sapiens
actctcttatgcatt

SEQ ID NO: 6617650 - DNA, 20 bp, Homo sapiens
actctcttattgcctcactt

SEQ ID NO: 6617651 - DNA, 23 bp, Homo sapiens
actctcttattgcctcacttcag

SEQ ID NO: 6617652 - DNA, 21 bp, Homo sapiens
actctcttccctttccccagc

SEQ ID NO: 6617653 - DNA, 17 bp, Homo sapiens
actctcttcctccactt

SEQ ID NO: 6617654 - DNA, 14 bp, Homo sapiens
actctcttctccat

SEQ ID NO: 6617655 - DNA, 12 bp, Homo sapiens
actctcttctct

SEQ ID NO: 6617656 - DNA, 14 bp, Homo sapiens
actctcttctcttt

SEQ ID NO: 6617657 - DNA, 15 bp, Homo sapiens
actctcttcttccat

SEQ ID NO: 6617658 - DNA, 23 bp, Homo sapiens
actctcttcttccattagaatgc

SEQ ID NO: 6617659 - DNA, 18 bp, Homo sapiens
actctctttcttccacta

SEQ ID NO: 6617660 - DNA, 22 bp, Homo sapiens
actctcttttgaggtccctgta

SEQ ID NO: 6617661 - DNA, 23 bp, Homo sapiens
actctcttttgaggtccctgtat

SEQ ID NO: 6617662 - DNA, 10 bp, Homo sapiens
actctgaaaa

SEQ ID NO: 6617663 - DNA, 22 bp, Homo sapiens
actctgaaaagcaattgccctg

SEQ ID NO: 6617664 - DNA, 22 bp, Homo sapiens
actctgaaaaggaacggcttcc

SEQ ID NO: 6617665 - DNA, 20 bp, Homo sapiens
actctgaaacacactgaaag

SEQ ID NO: 6617666 - DNA, 15 bp, Homo sapiens
actctgaaagagcaa

SEQ ID NO: 6617667 - DNA, 18 bp, Homo sapiens
actctgaaatatcccggg

SEQ ID NO: 6617668 - DNA, 16 bp, Homo sapiens
actctgaaatgaagat

SEQ ID NO: 6617669 - DNA, 17 bp, Homo sapiens
actctgaactttggaga

SEQ ID NO: 6617670 - DNA, 14 bp, Homo sapiens
actctgaagcctct

SEQ ID NO: 6617671 - DNA, 15 bp, Homo sapiens
actctgaagctaatt

SEQ ID NO: 6617672 - DNA, 12 bp, Homo sapiens
actctgaagctg

SEQ ID NO: 6617673 - DNA, 21 bp, Homo sapiens
actctgaagggcatcatgcat

SEQ ID NO: 6617674 - DNA, 23 bp, Homo sapiens
actctgaataagcactttttaaa

SEQ ID NO: 6617675 - DNA, 13 bp, Homo sapiens
actctgacaacag

SEQ ID NO: 6617676 - DNA, 17 bp, Homo sapiens
actctgacaacagactt

SEQ ID NO: 6617677 - DNA, 13 bp, Homo sapiens
actctgacaagct

SEQ ID NO: 6617678 - DNA, 21 bp, Homo sapiens
actctgacaagctggccaaag

SEQ ID NO: 6617679 - DNA, 14 bp, Homo sapiens
actctgacataaac

SEQ ID NO: 6617680 - DNA, 16 bp, Homo sapiens
actctgaccgggcttc

SEQ ID NO: 6617681 - DNA, 19 bp, Homo sapiens
actctgagacaaaagaaaa

SEQ ID NO: 6617682 - DNA, 20 bp, Homo sapiens
actctgagacaaaagaaaaa

SEQ ID NO: 6617683 - DNA, 14 bp, Homo sapiens
actctgagccaagg

SEQ ID NO: 6617684 - DNA, 19 bp, Homo sapiens
actctgagccaagggaggg

SEQ ID NO: 6617685 - DNA, 12 bp, Homo sapiens
actctgagccca

SEQ ID NO: 6617686 - DNA, 13 bp, Homo sapiens
actctgagctcat

SEQ ID NO: 6617687 - DNA, 18 bp, Homo sapiens
actctgagctgctaggaa

SEQ ID NO: 6617688 - DNA, 22 bp, Homo sapiens
actctgaggacatggagagaga

SEQ ID NO: 6617689 - DNA, 18 bp, Homo sapiens
actctgagtcacaggtgt

SEQ ID NO: 6617690 - DNA, 19 bp, Homo sapiens
actctgagtcacaggtgtg

SEQ ID NO: 6617691 - DNA, 18 bp, Homo sapiens
actctgagtccactgctc

SEQ ID NO: 6617692 - DNA, 20 bp, Homo sapiens
actctgagtccactgctcca

SEQ ID NO: 6617693 - DNA, 14 bp, Homo sapiens
actctgagtgtttt

SEQ ID NO: 6617694 - DNA, 17 bp, Homo sapiens
actctgatccctctggg

SEQ ID NO: 6617695 - DNA, 18 bp, Homo sapiens
actctgatgtaaatgaag

SEQ ID NO: 6617696 - DNA, 21 bp, Homo sapiens
actctgattcacctcttcctc

SEQ ID NO: 6617697 - DNA, 16 bp, Homo sapiens
actctgcaactgaata

SEQ ID NO: 6617698 - DNA, 19 bp, Homo sapiens
actctgcaagtgtctggag

SEQ ID NO: 6617699 - DNA, 16 bp, Homo sapiens
actctgcacagcaact

SEQ ID NO: 6617700 - DNA, 11 bp, Homo sapiens
actctgcacat

SEQ ID NO: 6617701 - DNA, 13 bp, Homo sapiens
actctgcacatgt

SEQ ID NO: 6617702 - DNA, 15 bp, Homo sapiens
actctgcactactcc

SEQ ID NO: 6617703 - DNA, 19 bp, Homo sapiens
actctgcactactcctctg

SEQ ID NO: 6617704 - DNA, 14 bp, Homo sapiens
actctgcactccat

SEQ ID NO: 6617705 - DNA, 21 bp, Homo sapiens
actctgcactccatggccacc

SEQ ID NO: 6617706 - DNA, 21 bp, Homo sapiens
actctgcactctccaccctgg

SEQ ID NO: 6617707 - DNA, 23 bp, Homo sapiens
actctgcactgaatggctgacct

SEQ ID NO: 6617708 - DNA, 21 bp, Homo sapiens
actctgcactggggcgtttcc

SEQ ID NO: 6617709 - DNA, 24 bp, Homo sapiens
actctgcagactgctagtgttctg

SEQ ID NO: 6617710 - DNA, 14 bp, Homo sapiens
actctgcagcctca

SEQ ID NO: 6617711 - DNA, 18 bp, Homo sapiens
actctgcatagacaaagg

SEQ ID NO: 6617712 - DNA, 22 bp, Homo sapiens
actctgcatagacaaaggcctt

SEQ ID NO: 6617713 - DNA, 20 bp, Homo sapiens
actctgccaatcggctaccc

SEQ ID NO: 6617714 - DNA, 17 bp, Homo sapiens
actctgccactttattt

SEQ ID NO: 6617715 - DNA, 14 bp, Homo sapiens
actctgccagcaaa

SEQ ID NO: 6617716 - DNA, 13 bp, Homo sapiens
actctgccagcca

SEQ ID NO: 6617717 - DNA, 16 bp, Homo sapiens
actctgccagccacat

SEQ ID NO: 6617718 - DNA, 20 bp, Homo sapiens
actctgccagggcagtgcta

SEQ ID NO: 6617719 - DNA, 14 bp, Homo sapiens
actctgcccaccct

SEQ ID NO: 6617720 - DNA, 20 bp, Homo sapiens
actctgccccacgctgtggc

SEQ ID NO: 6617721 - DNA, 21 bp, Homo sapiens
actctgcccccatttccccga

SEQ ID NO: 6617722 - DNA, 19 bp, Homo sapiens
actctgccccctgctggct

SEQ ID NO: 6617723 - DNA, 11 bp, Homo sapiens
actctgccctc

SEQ ID NO: 6617724 - DNA, 14 bp, Homo sapiens
actctgccctctgc

SEQ ID NO: 6617725 - DNA, 18 bp, Homo sapiens
actctgccctctgctgct

SEQ ID NO: 6617726 - DNA, 23 bp, Homo sapiens
actctgccctctgctgctgcccg

SEQ ID NO: 6617727 - DNA, 20 bp, Homo sapiens
actctgccgatctaattaca

SEQ ID NO: 6617728 - DNA, 13 bp, Homo sapiens
actctgccgctgt

SEQ ID NO: 6617729 - DNA, 15 bp, Homo sapiens
actctgcctcctggt

SEQ ID NO: 6617730 - DNA, 16 bp, Homo sapiens
actctgcctcctggtt

SEQ ID NO: 6617731 - DNA, 17 bp, Homo sapiens
actctgcctctaaggcc

SEQ ID NO: 6617732 - DNA, 19 bp, Homo sapiens
actctgcctctaaggccaa

SEQ ID NO: 6617733 - DNA, 12 bp, Homo sapiens
actctgcctctg

SEQ ID NO: 6617734 - DNA, 16 bp, Homo sapiens
actctgcctctgcctg

SEQ ID NO: 6617735 - DNA, 14 bp, Homo sapiens
actctgcctgccct

SEQ ID NO: 6617736 - DNA, 23 bp, Homo sapiens
actctgcctgtcaagtttttata

SEQ ID NO: 6617737 - DNA, 15 bp, Homo sapiens
actctgccttaattt

SEQ ID NO: 6617738 - DNA, 21 bp, Homo sapiens
actctgccttaatttttgaaa

SEQ ID NO: 6617739 - DNA, 16 bp, Homo sapiens
actctgccttccaggc

SEQ ID NO: 6617740 - DNA, 18 bp, Homo sapiens
actctgccttccaggcgt

SEQ ID NO: 6617741 - DNA, 15 bp, Homo sapiens
actctgcctttatga

SEQ ID NO: 6617742 - DNA, 16 bp, Homo sapiens
actctgcctttatgat

SEQ ID NO: 6617743 - DNA, 21 bp, Homo sapiens
actctgccttttttcacagcc

SEQ ID NO: 6617744 - DNA, 16 bp, Homo sapiens
actctgcgacgatccc

SEQ ID NO: 6617745 - DNA, 20 bp, Homo sapiens
actctgctatttctcttgct

SEQ ID NO: 6617746 - DNA, 13 bp, Homo sapiens
actctgctcaggg

SEQ ID NO: 6617747 - DNA, 18 bp, Homo sapiens
actctgctcgccttagca

SEQ ID NO: 6617748 - DNA, 14 bp, Homo sapiens
actctgctctcctc

SEQ ID NO: 6617749 - DNA, 16 bp, Homo sapiens
actctgctctcctcgg

SEQ ID NO: 6617750 - DNA, 20 bp, Homo sapiens
actctgctctcctcgggccc

SEQ ID NO: 6617751 - DNA, 21 bp, Homo sapiens
actctgctctcctcgggccct

SEQ ID NO: 6617752 - DNA, 9 bp, Homo sapiens
actctgctg

SEQ ID NO: 6617753 - DNA, 22 bp, Homo sapiens
actctgctgaatgtaaaagaaa

SEQ ID NO: 6617754 - DNA, 13 bp, Homo sapiens
actctgctgaggc

SEQ ID NO: 6617755 - DNA, 16 bp, Homo sapiens
actctgctgaggccag

SEQ ID NO: 6617756 - DNA, 23 bp, Homo sapiens
actctgctgctcatgggaagaac

SEQ ID NO: 6617757 - DNA, 15 bp, Homo sapiens
actctgctgcttaga

SEQ ID NO: 6617758 - DNA, 18 bp, Homo sapiens
actctgcttctctgactt

SEQ ID NO: 6617759 - DNA, 21 bp, Homo sapiens
actctgcttctctgacttctg

SEQ ID NO: 6617760 - DNA, 18 bp, Homo sapiens
actctgcttgatttttgc

SEQ ID NO: 6617761 - DNA, 23 bp, Homo sapiens
actctgcttggctgtcccctcca

SEQ ID NO: 6617762 - DNA, 14 bp, Homo sapiens
actctgctttgact

SEQ ID NO: 6617763 - DNA, 13 bp, Homo sapiens
actctgctttgca

SEQ ID NO: 6617764 - DNA, 12 bp, Homo sapiens
actctggaaaag

SEQ ID NO: 6617765 - DNA, 11 bp, Homo sapiens
actctggaagt

SEQ ID NO: 6617766 - DNA, 15 bp, Homo sapiens
actctggaccatgct

SEQ ID NO: 6617767 - DNA, 19 bp, Homo sapiens
actctggaccatgctgaga

SEQ ID NO: 6617768 - DNA, 21 bp, Homo sapiens
actctggacccctgggcctca

SEQ ID NO: 6617769 - DNA, 16 bp, Homo sapiens
actctggactccacga

SEQ ID NO: 6617770 - DNA, 13 bp, Homo sapiens
actctggactggg

SEQ ID NO: 6617771 - DNA, 18 bp, Homo sapiens
actctggatatttgcact

SEQ ID NO: 6617772 - DNA, 19 bp, Homo sapiens
actctggatatttgcactt

SEQ ID NO: 6617773 - DNA, 22 bp, Homo sapiens
actctggatatttgcacttatg

SEQ ID NO: 6617774 - DNA, 22 bp, Homo sapiens
actctggatgattcttccagat

SEQ ID NO: 6617775 - DNA, 16 bp, Homo sapiens
actctggattttgaat

SEQ ID NO: 6617776 - DNA, 18 bp, Homo sapiens
actctggattttgaatta

SEQ ID NO: 6617777 - DNA, 14 bp, Homo sapiens
actctggcaaagct

SEQ ID NO: 6617778 - DNA, 15 bp, Homo sapiens
actctggcaaagctt

SEQ ID NO: 6617779 - DNA, 20 bp, Homo sapiens
actctggcagcaccgcctct

SEQ ID NO: 6617780 - DNA, 13 bp, Homo sapiens
actctggcagcca

SEQ ID NO: 6617781 - DNA, 15 bp, Homo sapiens
actctggcagccaca

SEQ ID NO: 6617782 - DNA, 16 bp, Homo sapiens
actctggcagccacac

SEQ ID NO: 6617783 - DNA, 15 bp, Homo sapiens
actctggcagcctca

SEQ ID NO: 6617784 - DNA, 18 bp, Homo sapiens
actctggcagcctcagag

SEQ ID NO: 6617785 - DNA, 22 bp, Homo sapiens
actctggccccctattgtctcc

SEQ ID NO: 6617786 - DNA, 14 bp, Homo sapiens
actctggccctggc

SEQ ID NO: 6617787 - DNA, 16 bp, Homo sapiens
actctggccctggccc

SEQ ID NO: 6617788 - DNA, 22 bp, Homo sapiens
actctggccttggttcctccag

SEQ ID NO: 6617789 - DNA, 20 bp, Homo sapiens
actctggctcagcctgtctc

SEQ ID NO: 6617790 - DNA, 15 bp, Homo sapiens
actctggcttccagg

SEQ ID NO: 6617791 - DNA, 16 bp, Homo sapiens
actctggcttggccta

SEQ ID NO: 6617792 - DNA, 13 bp, Homo sapiens
actctgggaaata

SEQ ID NO: 6617793 - DNA, 19 bp, Homo sapiens
actctgggcaaagcccctc

SEQ ID NO: 6617794 - DNA, 20 bp, Homo sapiens
actctgggcacactctgcca

SEQ ID NO: 6617795 - DNA, 22 bp, Homo sapiens
actctgggcagaagtgagcccc

SEQ ID NO: 6617796 - DNA, 14 bp, Homo sapiens
actctgggcctggg

SEQ ID NO: 6617797 - DNA, 22 bp, Homo sapiens
actctggggctggcaccagcag

SEQ ID NO: 6617798 - DNA, 21 bp, Homo sapiens
actctgggggtggacatctga

SEQ ID NO: 6617799 - DNA, 16 bp, Homo sapiens
actctggggtgcagct

SEQ ID NO: 6617800 - DNA, 17 bp, Homo sapiens
actctggggtttttact

SEQ ID NO: 6617801 - DNA, 19 bp, Homo sapiens
actctgggtccctcggagc

SEQ ID NO: 6617802 - DNA, 19 bp, Homo sapiens
actctgggttcgttgggga

SEQ ID NO: 6617803 - DNA, 21 bp, Homo sapiens
actctgggttcgttggggaca

SEQ ID NO: 6617804 - DNA, 19 bp, Homo sapiens
actctgggtttcatatcca

SEQ ID NO: 6617805 - DNA, 14 bp, Homo sapiens
actctggtgcctcc

SEQ ID NO: 6617806 - DNA, 16 bp, Homo sapiens
actctggtgcctccag

SEQ ID NO: 6617807 - DNA, 15 bp, Homo sapiens
actctggtgctcctg

SEQ ID NO: 6617808 - DNA, 17 bp, Homo sapiens
actctggtggtgctttt

SEQ ID NO: 6617809 - DNA, 21 bp, Homo sapiens
actctggtggtgcttttgtat

SEQ ID NO: 6617810 - DNA, 22 bp, Homo sapiens
actctggttcttttaaaattaa

SEQ ID NO: 6617811 - DNA, 16 bp, Homo sapiens
actctgtaaaacgcac

SEQ ID NO: 6617812 - DNA, 12 bp, Homo sapiens
actctgtaaaat

SEQ ID NO: 6617813 - DNA, 16 bp, Homo sapiens
actctgtaaaatgcac

SEQ ID NO: 6617814 - DNA, 18 bp, Homo sapiens
actctgtaatagttcagt

SEQ ID NO: 6617815 - DNA, 13 bp, Homo sapiens
actctgtaattgc

SEQ ID NO: 6617816 - DNA, 14 bp, Homo sapiens
actctgtaattgca

SEQ ID NO: 6617817 - DNA, 22 bp, Homo sapiens
actctgtaattgcactttttaa

SEQ ID NO: 6617818 - DNA, 21 bp, Homo sapiens
actctgtagcaaatttgttta

SEQ ID NO: 6617819 - DNA, 15 bp, Homo sapiens
actctgtataataga

SEQ ID NO: 6617820 - DNA, 13 bp, Homo sapiens
actctgtattaca

SEQ ID NO: 6617821 - DNA, 23 bp, Homo sapiens
actctgtcaatttccctgactcc

SEQ ID NO: 6617822 - DNA, 16 bp, Homo sapiens
actctgtcagatggga

SEQ ID NO: 6617823 - DNA, 17 bp, Homo sapiens
actctgtcagccagccg

SEQ ID NO: 6617824 - DNA, 22 bp, Homo sapiens
actctgtccaactctgtattta

SEQ ID NO: 6617825 - DNA, 14 bp, Homo sapiens
actctgtccactct

SEQ ID NO: 6617826 - DNA, 11 bp, Homo sapiens
actctgtccag

SEQ ID NO: 6617827 - DNA, 13 bp, Homo sapiens
actctgtccaggc

SEQ ID NO: 6617828 - DNA, 14 bp, Homo sapiens
actctgtccaggcc

SEQ ID NO: 6617829 - DNA, 17 bp, Homo sapiens
actctgtccctgtcctt

SEQ ID NO: 6617830 - DNA, 19 bp, Homo sapiens
actctgtccctgtccttcc

SEQ ID NO: 6617831 - DNA, 11 bp, Homo sapiens
actctgtcctg

SEQ ID NO: 6617832 - DNA, 23 bp, Homo sapiens
actctgtcctgaaggcctgaggt

SEQ ID NO: 6617833 - DNA, 19 bp, Homo sapiens
actctgtcgcccagtctgg

SEQ ID NO: 6617834 - DNA, 20 bp, Homo sapiens
actctgtcgctcaggctgga

SEQ ID NO: 6617835 - DNA, 22 bp, Homo sapiens
actctgtcgctcaggctggagt

SEQ ID NO: 6617836 - DNA, 15 bp, Homo sapiens
actctgtctaaaaaa

SEQ ID NO: 6617837 - DNA, 14 bp, Homo sapiens
actctgtcttaaat

SEQ ID NO: 6617838 - DNA, 22 bp, Homo sapiens
actctgtcttcacctgattcaa

SEQ ID NO: 6617839 - DNA, 20 bp, Homo sapiens
actctgtgcaggtgctgcct

SEQ ID NO: 6617840 - DNA, 19 bp, Homo sapiens
actctgtgccagagcctgg

SEQ ID NO: 6617841 - DNA, 21 bp, Homo sapiens
actctgtgccagagcctgggg

SEQ ID NO: 6617842 - DNA, 15 bp, Homo sapiens
actctgtgcccatgg

SEQ ID NO: 6617843 - DNA, 11 bp, Homo sapiens
actctgtgctc

SEQ ID NO: 6617844 - DNA, 14 bp, Homo sapiens
actctgtgctcacc

SEQ ID NO: 6617845 - DNA, 11 bp, Homo sapiens
actctgtggcc

SEQ ID NO: 6617846 - DNA, 15 bp, Homo sapiens
actctgtggccagcc

SEQ ID NO: 6617847 - DNA, 19 bp, Homo sapiens
actctgtggccagcctggc

SEQ ID NO: 6617848 - DNA, 20 bp, Homo sapiens
actctgtggccagcctggca

SEQ ID NO: 6617849 - DNA, 21 bp, Homo sapiens
actctgtggccagcctggcat

SEQ ID NO: 6617850 - DNA, 22 bp, Homo sapiens
actctgtggccagcctggcatc

SEQ ID NO: 6617851 - DNA, 14 bp, Homo sapiens
actctgtggggcca

SEQ ID NO: 6617852 - DNA, 16 bp, Homo sapiens
actctgtggggccaca

SEQ ID NO: 6617853 - DNA, 14 bp, Homo sapiens
actctgtgtaatct

SEQ ID NO: 6617854 - DNA, 18 bp, Homo sapiens
actctgtgtaatctctga

SEQ ID NO: 6617855 - DNA, 21 bp, Homo sapiens
actctgtgtaatctctgatta

SEQ ID NO: 6617856 - DNA, 21 bp, Homo sapiens
actctgtgtcaggtggggcag

SEQ ID NO: 6617857 - DNA, 22 bp, Homo sapiens
actctgtgtctgagtggcttca

SEQ ID NO: 6617858 - DNA, 23 bp, Homo sapiens
actctgtgtggctgtgcaatttc

SEQ ID NO: 6617859 - DNA, 13 bp, Homo sapiens
actctgtgtttaa

SEQ ID NO: 6617860 - DNA, 18 bp, Homo sapiens
actctgttcattcctcca

SEQ ID NO: 6617861 - DNA, 15 bp, Homo sapiens
actctgttcccctcc

SEQ ID NO: 6617862 - DNA, 16 bp, Homo sapiens
actctgttcccctccc

SEQ ID NO: 6617863 - DNA, 17 bp, Homo sapiens
actctgttcccctcccc

SEQ ID NO: 6617864 - DNA, 18 bp, Homo sapiens
actctgttcccctccccc

SEQ ID NO: 6617865 - DNA, 19 bp, Homo sapiens
actctgttcccctccccct

SEQ ID NO: 6617866 - DNA, 16 bp, Homo sapiens
actctgttcctggctc

SEQ ID NO: 6617867 - DNA, 20 bp, Homo sapiens
actctgttgcaagtgcaata

SEQ ID NO: 6617868 - DNA, 18 bp, Homo sapiens
actctgttgcctcctctc

SEQ ID NO: 6617869 - DNA, 13 bp, Homo sapiens
actctgttgtact

SEQ ID NO: 6617870 - DNA, 19 bp, Homo sapiens
actctgttgtactatggaa

SEQ ID NO: 6617871 - DNA, 15 bp, Homo sapiens
actctgtttgcttgt

SEQ ID NO: 6617872 - DNA, 11 bp, Homo sapiens
actcttaaaac

SEQ ID NO: 6617873 - DNA, 13 bp, Homo sapiens
actcttaaagcaa

SEQ ID NO: 6617874 - DNA, 16 bp, Homo sapiens
actcttaaatactttt

SEQ ID NO: 6617875 - DNA, 13 bp, Homo sapiens
actcttaaatata

SEQ ID NO: 6617876 - DNA, 20 bp, Homo sapiens
actcttaaatatacaacttt

SEQ ID NO: 6617877 - DNA, 20 bp, Homo sapiens
actcttaaatcatttggtta

SEQ ID NO: 6617878 - DNA, 15 bp, Homo sapiens
actcttaagaagact

SEQ ID NO: 6617879 - DNA, 20 bp, Homo sapiens
actcttaagaagactgcatt

SEQ ID NO: 6617880 - DNA, 21 bp, Homo sapiens
actcttaagaagactgcatta

SEQ ID NO: 6617881 - DNA, 22 bp, Homo sapiens
actcttaagccatcttggtaaa

SEQ ID NO: 6617882 - DNA, 19 bp, Homo sapiens
actcttaagtcctaaaagt

SEQ ID NO: 6617883 - DNA, 15 bp, Homo sapiens
actcttaagtgtaaa

SEQ ID NO: 6617884 - DNA, 14 bp, Homo sapiens
actcttaagtttct

SEQ ID NO: 6617885 - DNA, 15 bp, Homo sapiens
actcttaatctgtgt

SEQ ID NO: 6617886 - DNA, 17 bp, Homo sapiens
actcttacatgtataaa

SEQ ID NO: 6617887 - DNA, 23 bp, Homo sapiens
actcttaccatcccggtgcatgc

SEQ ID NO: 6617888 - DNA, 15 bp, Homo sapiens
actcttacgtggaga

SEQ ID NO: 6617889 - DNA, 14 bp, Homo sapiens
actcttactcctta

SEQ ID NO: 6617890 - DNA, 14 bp, Homo sapiens
actcttagaaatga

SEQ ID NO: 6617891 - DNA, 19 bp, Homo sapiens
actcttagaggtaggtgta

SEQ ID NO: 6617892 - DNA, 17 bp, Homo sapiens
actcttaggaagagaaa

SEQ ID NO: 6617893 - DNA, 17 bp, Homo sapiens
actcttaggatatttga

SEQ ID NO: 6617894 - DNA, 21 bp, Homo sapiens
actcttaggcactttgggggt

SEQ ID NO: 6617895 - DNA, 22 bp, Homo sapiens
actcttatatctatattttaca

SEQ ID NO: 6617896 - DNA, 23 bp, Homo sapiens
actcttatatctatattttacat

SEQ ID NO: 6617897 - DNA, 23 bp, Homo sapiens
actcttatctcagtcatgcataa

SEQ ID NO: 6617898 - DNA, 15 bp, Homo sapiens
actcttatgaaatgg

SEQ ID NO: 6617899 - DNA, 19 bp, Homo sapiens
actcttatggccaaattca

SEQ ID NO: 6617900 - DNA, 15 bp, Homo sapiens
actcttatttataga

SEQ ID NO: 6617901 - DNA, 22 bp, Homo sapiens
actcttatttctttcctttaaa

SEQ ID NO: 6617902 - DNA, 16 bp, Homo sapiens
actcttattttttaaa

SEQ ID NO: 6617903 - DNA, 23 bp, Homo sapiens
actcttcaaatgggagactcttt

SEQ ID NO: 6617904 - DNA, 20 bp, Homo sapiens
actcttcaaggtctgctttt

SEQ ID NO: 6617905 - DNA, 15 bp, Homo sapiens
actcttcactcttca

SEQ ID NO: 6617906 - DNA, 16 bp, Homo sapiens
actcttcactcttcaa

SEQ ID NO: 6617907 - DNA, 19 bp, Homo sapiens
actcttcagaacacacaga

SEQ ID NO: 6617908 - DNA, 22 bp, Homo sapiens
actcttcagcctcattcactgt

SEQ ID NO: 6617909 - DNA, 23 bp, Homo sapiens
actcttcagtgactcctgctggt

SEQ ID NO: 6617910 - DNA, 16 bp, Homo sapiens
actcttcatatatgct

SEQ ID NO: 6617911 - DNA, 17 bp, Homo sapiens
actcttcatatatgctt

SEQ ID NO: 6617912 - DNA, 14 bp, Homo sapiens
actcttcatgtaat

SEQ ID NO: 6617913 - DNA, 17 bp, Homo sapiens
actcttcatgtaatcac

SEQ ID NO: 6617914 - DNA, 23 bp, Homo sapiens
actcttcattttgagtctcaggc

SEQ ID NO: 6617915 - DNA, 15 bp, Homo sapiens
actcttccacctctg

SEQ ID NO: 6617916 - DNA, 22 bp, Homo sapiens
actcttccctctcgctcccctc

SEQ ID NO: 6617917 - DNA, 14 bp, Homo sapiens
actcttccctctct

SEQ ID NO: 6617918 - DNA, 21 bp, Homo sapiens
actcttccgaaaaatcctctt

SEQ ID NO: 6617919 - DNA, 17 bp, Homo sapiens
actcttccgatgtttgt

SEQ ID NO: 6617920 - DNA, 20 bp, Homo sapiens
actcttcctcatcctgcttc

SEQ ID NO: 6617921 - DNA, 17 bp, Homo sapiens
actcttcctccaaggac

SEQ ID NO: 6617922 - DNA, 16 bp, Homo sapiens
actcttcctcccctct

SEQ ID NO: 6617923 - DNA, 20 bp, Homo sapiens
actcttcgaagccttgccta

SEQ ID NO: 6617924 - DNA, 16 bp, Homo sapiens
actcttctactttcat

SEQ ID NO: 6617925 - DNA, 18 bp, Homo sapiens
actcttctatgacccagc

SEQ ID NO: 6617926 - DNA, 12 bp, Homo sapiens
actcttctcagc

SEQ ID NO: 6617927 - DNA, 23 bp, Homo sapiens
actcttctcatcttgacagagcc

SEQ ID NO: 6617928 - DNA, 18 bp, Homo sapiens
actcttctcattacttgt

SEQ ID NO: 6617929 - DNA, 14 bp, Homo sapiens
actcttctcggctc

SEQ ID NO: 6617930 - DNA, 15 bp, Homo sapiens
actcttctcggctca

SEQ ID NO: 6617931 - DNA, 17 bp, Homo sapiens
actcttctcggctcagg

SEQ ID NO: 6617932 - DNA, 23 bp, Homo sapiens
actcttctctcaaccttggcctt

SEQ ID NO: 6617933 - DNA, 21 bp, Homo sapiens
actcttctctccaaggaaatc

SEQ ID NO: 6617934 - DNA, 13 bp, Homo sapiens
actcttctctcct

SEQ ID NO: 6617935 - DNA, 21 bp, Homo sapiens
actcttctctcctttctccct

SEQ ID NO: 6617936 - DNA, 22 bp, Homo sapiens
actcttctctcctttctccctg

SEQ ID NO: 6617937 - DNA, 18 bp, Homo sapiens
actcttctctctgctctg

SEQ ID NO: 6617938 - DNA, 23 bp, Homo sapiens
actcttcttatcacacttgcaaa

SEQ ID NO: 6617939 - DNA, 15 bp, Homo sapiens
actcttcttgaaatt

SEQ ID NO: 6617940 - DNA, 19 bp, Homo sapiens
actcttcttgaaattttaa

SEQ ID NO: 6617941 - DNA, 19 bp, Homo sapiens
actcttcttgattaaaagt

SEQ ID NO: 6617942 - DNA, 20 bp, Homo sapiens
actcttcttgattaaaagtt

SEQ ID NO: 6617943 - DNA, 18 bp, Homo sapiens
actcttctttaagccata

SEQ ID NO: 6617944 - DNA, 15 bp, Homo sapiens
actcttgaaatgtag

SEQ ID NO: 6617945 - DNA, 12 bp, Homo sapiens
actcttgaagag

SEQ ID NO: 6617946 - DNA, 15 bp, Homo sapiens
actcttgaagaggag

SEQ ID NO: 6617947 - DNA, 12 bp, Homo sapiens
actcttgacagc

SEQ ID NO: 6617948 - DNA, 15 bp, Homo sapiens
actcttgacctcagg

SEQ ID NO: 6617949 - DNA, 16 bp, Homo sapiens
actcttgacctcaggt

SEQ ID NO: 6617950 - DNA, 15 bp, Homo sapiens
actcttgactcttgc

SEQ ID NO: 6617951 - DNA, 17 bp, Homo sapiens
actcttgagagctcagg

SEQ ID NO: 6617952 - DNA, 16 bp, Homo sapiens
actcttgatctctctt

SEQ ID NO: 6617953 - DNA, 16 bp, Homo sapiens
actcttgatgtgaaga

SEQ ID NO: 6617954 - DNA, 18 bp, Homo sapiens
actcttgcctgtttccca

SEQ ID NO: 6617955 - DNA, 17 bp, Homo sapiens
actcttgcctttccacc

SEQ ID NO: 6617956 - DNA, 22 bp, Homo sapiens
actcttgcctttccacctgctt

SEQ ID NO: 6617957 - DNA, 16 bp, Homo sapiens
actcttggagcctgca

SEQ ID NO: 6617958 - DNA, 22 bp, Homo sapiens
actcttggagcctgcagagctg

SEQ ID NO: 6617959 - DNA, 13 bp, Homo sapiens
actcttggccaga

SEQ ID NO: 6617960 - DNA, 14 bp, Homo sapiens
actcttggcctctg

SEQ ID NO: 6617961 - DNA, 19 bp, Homo sapiens
actcttggctattgaagat

SEQ ID NO: 6617962 - DNA, 15 bp, Homo sapiens
actcttggctcgttt

SEQ ID NO: 6617963 - DNA, 23 bp, Homo sapiens
actcttggttcgatacctggagc

SEQ ID NO: 6617964 - DNA, 13 bp, Homo sapiens
actcttgtaagat

SEQ ID NO: 6617965 - DNA, 15 bp, Homo sapiens
actcttgtaagattt

SEQ ID NO: 6617966 - DNA, 16 bp, Homo sapiens
actcttgtaagatttt

SEQ ID NO: 6617967 - DNA, 18 bp, Homo sapiens
actcttgtaagattttga

SEQ ID NO: 6617968 - DNA, 21 bp, Homo sapiens
actcttgtaagattttgaaaa

SEQ ID NO: 6617969 - DNA, 22 bp, Homo sapiens
actcttgtaagattttgaaaac

SEQ ID NO: 6617970 - DNA, 16 bp, Homo sapiens
actcttgtcacccagg

SEQ ID NO: 6617971 - DNA, 19 bp, Homo sapiens
actcttgtcacccaggctg

SEQ ID NO: 6617972 - DNA, 19 bp, Homo sapiens
actcttgtcatttttaata

SEQ ID NO: 6617973 - DNA, 21 bp, Homo sapiens
actcttgtctcctcctccagg

SEQ ID NO: 6617974 - DNA, 18 bp, Homo sapiens
actcttgtggatgtttta

SEQ ID NO: 6617975 - DNA, 23 bp, Homo sapiens
actcttgtggtacctagtcagat

SEQ ID NO: 6617976 - DNA, 16 bp, Homo sapiens
actcttgttgagttct

SEQ ID NO: 6617977 - DNA, 20 bp, Homo sapiens
actcttgtttgctttgaaaa

SEQ ID NO: 6617978 - DNA, 21 bp, Homo sapiens
actcttgtttgctttgaaaat

SEQ ID NO: 6617979 - DNA, 15 bp, Homo sapiens
actctttaacttgta

SEQ ID NO: 6617980 - DNA, 19 bp, Homo sapiens
actctttaacttgtaataa

SEQ ID NO: 6617981 - DNA, 20 bp, Homo sapiens
actctttaataaattgctta

SEQ ID NO: 6617982 - DNA, 17 bp, Homo sapiens
actctttacatggtggt

SEQ ID NO: 6617983 - DNA, 18 bp, Homo sapiens
actctttagatatttaca

SEQ ID NO: 6617984 - DNA, 19 bp, Homo sapiens
actctttagatatttacat

SEQ ID NO: 6617985 - DNA, 18 bp, Homo sapiens
actctttagttgatttaa

SEQ ID NO: 6617986 - DNA, 20 bp, Homo sapiens
actctttagttttattttaa

SEQ ID NO: 6617987 - DNA, 16 bp, Homo sapiens
actctttattgtctgt

SEQ ID NO: 6617988 - DNA, 20 bp, Homo sapiens
actctttatttctagcagag

SEQ ID NO: 6617989 - DNA, 21 bp, Homo sapiens
actctttatttctagcagagt

SEQ ID NO: 6617990 - DNA, 22 bp, Homo sapiens
actctttatttttctctttctc

SEQ ID NO: 6617991 - DNA, 18 bp, Homo sapiens
actctttcattcttctca

SEQ ID NO: 6617992 - DNA, 13 bp, Homo sapiens
actctttccccag

SEQ ID NO: 6617993 - DNA, 14 bp, Homo sapiens
actctttccccagc

SEQ ID NO: 6617994 - DNA, 19 bp, Homo sapiens
actctttccgactgcccag

SEQ ID NO: 6617995 - DNA, 19 bp, Homo sapiens
actctttcctaaagccaaa

SEQ ID NO: 6617996 - DNA, 16 bp, Homo sapiens
actctttctaatgctg

SEQ ID NO: 6617997 - DNA, 19 bp, Homo sapiens
actctttctattgtttctt

SEQ ID NO: 6617998 - DNA, 19 bp, Homo sapiens
actctttctctcccctcct

SEQ ID NO: 6617999 - DNA, 19 bp, Homo sapiens
actctttctgaaggaagag

SEQ ID NO: 6618000 - DNA, 21 bp, Homo sapiens
actctttctgaaggaagagaa

SEQ ID NO: 6618001 - DNA, 22 bp, Homo sapiens
actctttctgaaggaagagaag

SEQ ID NO: 6618002 - DNA, 17 bp, Homo sapiens
actctttctgagtgcct

SEQ ID NO: 6618003 - DNA, 20 bp, Homo sapiens
actctttctgagtgccttct

SEQ ID NO: 6618004 - DNA, 21 bp, Homo sapiens
actctttctgagtgccttctg

SEQ ID NO: 6618005 - DNA, 22 bp, Homo sapiens
actctttctgagtgccttctgt

SEQ ID NO: 6618006 - DNA, 14 bp, Homo sapiens
actctttctgtata

SEQ ID NO: 6618007 - DNA, 21 bp, Homo sapiens
actctttctgtatatactttt

SEQ ID NO: 6618008 - DNA, 21 bp, Homo sapiens
actctttcttctctctttgtc

SEQ ID NO: 6618009 - DNA, 16 bp, Homo sapiens
actctttgaaagcttt

SEQ ID NO: 6618010 - DNA, 13 bp, Homo sapiens
actctttgagaaa

SEQ ID NO: 6618011 - DNA, 16 bp, Homo sapiens
actctttgagaaacaa

SEQ ID NO: 6618012 - DNA, 15 bp, Homo sapiens
actctttgctacaat

SEQ ID NO: 6618013 - DNA, 19 bp, Homo sapiens
actctttgctacaataaat

SEQ ID NO: 6618014 - DNA, 20 bp, Homo sapiens
actctttgctacaataaatg

SEQ ID NO: 6618015 - DNA, 15 bp, Homo sapiens
actctttgctgctgc

SEQ ID NO: 6618016 - DNA, 12 bp, Homo sapiens
actctttgctgt

SEQ ID NO: 6618017 - DNA, 16 bp, Homo sapiens
actctttgctttgtag

SEQ ID NO: 6618018 - DNA, 14 bp, Homo sapiens
actctttggctatt

SEQ ID NO: 6618019 - DNA, 16 bp, Homo sapiens
actctttggctattgt

SEQ ID NO: 6618020 - DNA, 21 bp, Homo sapiens
actctttgggtccattcagat

SEQ ID NO: 6618021 - DNA, 13 bp, Homo sapiens
actctttgtaaga

SEQ ID NO: 6618022 - DNA, 14 bp, Homo sapiens
actctttgtaagag

SEQ ID NO: 6618023 - DNA, 23 bp, Homo sapiens
actctttgtggggaagaggggct

SEQ ID NO: 6618024 - DNA, 18 bp, Homo sapiens
actcttttccttcccttt

SEQ ID NO: 6618025 - DNA, 16 bp, Homo sapiens
actcttttctattttg

SEQ ID NO: 6618026 - DNA, 21 bp, Homo sapiens
actcttttgctttattccaga

SEQ ID NO: 6618027 - DNA, 19 bp, Homo sapiens
actcttttgggatctaact

SEQ ID NO: 6618028 - DNA, 21 bp, Homo sapiens
actcttttgggatctaactgt

SEQ ID NO: 6618029 - DNA, 19 bp, Homo sapiens
actctttttagggccaggc

SEQ ID NO: 6618030 - DNA, 17 bp, Homo sapiens
actctttttcaataaat

SEQ ID NO: 6618031 - DNA, 23 bp, Homo sapiens
actctttttcagagcttctcaca

SEQ ID NO: 6618032 - DNA, 14 bp, Homo sapiens
actctttttctaaa

SEQ ID NO: 6618033 - DNA, 23 bp, Homo sapiens
actctttttctaaagtgttggtc

SEQ ID NO: 6618034 - DNA, 18 bp, Homo sapiens
actctttttgttttttgt

SEQ ID NO: 6618035 - DNA, 19 bp, Homo sapiens
actgaaaaaaaaaaaagaa

SEQ ID NO: 6618036 - DNA, 16 bp, Homo sapiens
actgaaaaaaaattcc

SEQ ID NO: 6618037 - DNA, 16 bp, Homo sapiens
actgaaaaaaatggag

SEQ ID NO: 6618038 - DNA, 13 bp, Homo sapiens
actgaaaaaatac

SEQ ID NO: 6618039 - DNA, 15 bp, Homo sapiens
actgaaaaaatacta

SEQ ID NO: 6618040 - DNA, 18 bp, Homo sapiens
actgaaaaaatactacct

SEQ ID NO: 6618041 - DNA, 18 bp, Homo sapiens
actgaaaaaatgctgagc

SEQ ID NO: 6618042 - DNA, 20 bp, Homo sapiens
actgaaaaaatgctgagcca

SEQ ID NO: 6618043 - DNA, 21 bp, Homo sapiens
actgaaaaaatgctgagccag

SEQ ID NO: 6618044 - DNA, 14 bp, Homo sapiens
actgaaaaactgtt

SEQ ID NO: 6618045 - DNA, 13 bp, Homo sapiens
actgaaaaagcaa

SEQ ID NO: 6618046 - DNA, 16 bp, Homo sapiens
actgaaaaatctagac

SEQ ID NO: 6618047 - DNA, 22 bp, Homo sapiens
actgaaaacatttcaaagctga

SEQ ID NO: 6618048 - DNA, 13 bp, Homo sapiens
actgaaaaccagt

SEQ ID NO: 6618049 - DNA, 21 bp, Homo sapiens
actgaaaactatgcaagagaa

SEQ ID NO: 6618050 - DNA, 15 bp, Homo sapiens
actgaaaactgtaaa

SEQ ID NO: 6618051 - DNA, 16 bp, Homo sapiens
actgaaaactgtaaat

SEQ ID NO: 6618052 - DNA, 20 bp, Homo sapiens
actgaaaactgtaaatacaa

SEQ ID NO: 6618053 - DNA, 23 bp, Homo sapiens
actgaaaagagagcagagaatat

SEQ ID NO: 6618054 - DNA, 11 bp, Homo sapiens
actgaaaatga

SEQ ID NO: 6618055 - DNA, 14 bp, Homo sapiens
actgaaaatgaact

SEQ ID NO: 6618056 - DNA, 21 bp, Homo sapiens
actgaaaatgaactgtaaatg

SEQ ID NO: 6618057 - DNA, 14 bp, Homo sapiens
actgaaaatggcat

SEQ ID NO: 6618058 - DNA, 15 bp, Homo sapiens
actgaaaatgtgcta

SEQ ID NO: 6618059 - DNA, 17 bp, Homo sapiens
actgaaacaaaaattgt

SEQ ID NO: 6618060 - DNA, 13 bp, Homo sapiens
actgaaacagatt

SEQ ID NO: 6618061 - DNA, 22 bp, Homo sapiens
actgaaacatgcacattttgta

SEQ ID NO: 6618062 - DNA, 22 bp, Homo sapiens
actgaaacatttgacacataaa

SEQ ID NO: 6618063 - DNA, 13 bp, Homo sapiens
actgaaaccaaaa

SEQ ID NO: 6618064 - DNA, 17 bp, Homo sapiens
actgaaaccaaaacata

SEQ ID NO: 6618065 - DNA, 18 bp, Homo sapiens
actgaaacctctgccttc

SEQ ID NO: 6618066 - DNA, 15 bp, Homo sapiens
actgaaacctctgtt

SEQ ID NO: 6618067 - DNA, 13 bp, Homo sapiens
actgaaacttccc

SEQ ID NO: 6618068 - DNA, 17 bp, Homo sapiens
actgaaacttttctaaa

SEQ ID NO: 6618069 - DNA, 21 bp, Homo sapiens
actgaaagaaactaagattta

SEQ ID NO: 6618070 - DNA, 13 bp, Homo sapiens
actgaaagaagaa

SEQ ID NO: 6618071 - DNA, 13 bp, Homo sapiens
actgaaagacagg

SEQ ID NO: 6618072 - DNA, 20 bp, Homo sapiens
actgaaagatctctgtcaca

SEQ ID NO: 6618073 - DNA, 16 bp, Homo sapiens
actgaaagcagcagct

SEQ ID NO: 6618074 - DNA, 21 bp, Homo sapiens
actgaaagctgaatccttcca

SEQ ID NO: 6618075 - DNA, 17 bp, Homo sapiens
actgaaaggaaaaatgt

SEQ ID NO: 6618076 - DNA, 15 bp, Homo sapiens
actgaaaggactgtg

SEQ ID NO: 6618077 - DNA, 13 bp, Homo sapiens
actgaaaggttac

SEQ ID NO: 6618078 - DNA, 14 bp, Homo sapiens
actgaaagtgtttc

SEQ ID NO: 6618079 - DNA, 15 bp, Homo sapiens
actgaaagttttgta

SEQ ID NO: 6618080 - DNA, 19 bp, Homo sapiens
actgaaataaacctgcact

SEQ ID NO: 6618081 - DNA, 16 bp, Homo sapiens
actgaaatatacacac

SEQ ID NO: 6618082 - DNA, 17 bp, Homo sapiens
actgaaatatacacaca

SEQ ID NO: 6618083 - DNA, 14 bp, Homo sapiens
actgaaatctgtca

SEQ ID NO: 6618084 - DNA, 21 bp, Homo sapiens
actgaaatgtgaaaagagcaa

SEQ ID NO: 6618085 - DNA, 17 bp, Homo sapiens
actgaaattacatattg

SEQ ID NO: 6618086 - DNA, 14 bp, Homo sapiens
actgaaattacttt

SEQ ID NO: 6618087 - DNA, 19 bp, Homo sapiens
actgaaattactttaacat

SEQ ID NO: 6618088 - DNA, 15 bp, Homo sapiens
actgaaattagtgtt

SEQ ID NO: 6618089 - DNA, 21 bp, Homo sapiens
actgaaattagtgttttcatt

SEQ ID NO: 6618090 - DNA, 15 bp, Homo sapiens
actgaaattctaaat

SEQ ID NO: 6618091 - DNA, 14 bp, Homo sapiens
actgaaattgcctg

SEQ ID NO: 6618092 - DNA, 15 bp, Homo sapiens
actgaaattgcctga

SEQ ID NO: 6618093 - DNA, 18 bp, Homo sapiens
actgaaattgcctgaaac

SEQ ID NO: 6618094 - DNA, 16 bp, Homo sapiens
actgaaatttaagaaa

SEQ ID NO: 6618095 - DNA, 12 bp, Homo sapiens
actgaaatttac

SEQ ID NO: 6618096 - DNA, 13 bp, Homo sapiens
actgaaatttaca

SEQ ID NO: 6618097 - DNA, 14 bp, Homo sapiens
actgaacaaaaaaa

SEQ ID NO: 6618098 - DNA, 12 bp, Homo sapiens
actgaacaaaac

SEQ ID NO: 6618099 - DNA, 22 bp, Homo sapiens
actgaacaaactatcagaggaa

SEQ ID NO: 6618100 - DNA, 20 bp, Homo sapiens
actgaacacatgtgtatgat

SEQ ID NO: 6618101 - DNA, 19 bp, Homo sapiens
actgaacaccattgaaggc

SEQ ID NO: 6618102 - DNA, 10 bp, Homo sapiens
actgaacagg

SEQ ID NO: 6618103 - DNA, 15 bp, Homo sapiens
actgaacagtaacat

SEQ ID NO: 6618104 - DNA, 23 bp, Homo sapiens
actgaacatctgagtcctggatg

SEQ ID NO: 6618105 - DNA, 19 bp, Homo sapiens
actgaacatgtacactggt

SEQ ID NO: 6618106 - DNA, 20 bp, Homo sapiens
actgaacattagttgcacta

SEQ ID NO: 6618107 - DNA, 16 bp, Homo sapiens
actgaacattccagag

SEQ ID NO: 6618108 - DNA, 12 bp, Homo sapiens
actgaaccaaat

SEQ ID NO: 6618109 - DNA, 24 bp, Homo sapiens
actgaaccaaattgcactgaagtt

SEQ ID NO: 6618110 - DNA, 14 bp, Homo sapiens
actgaaccactgct

SEQ ID NO: 6618111 - DNA, 21 bp, Homo sapiens
actgaaccacttgtagatttg

SEQ ID NO: 6618112 - DNA, 22 bp, Homo sapiens
actgaaccagagctggaacaca

SEQ ID NO: 6618113 - DNA, 19 bp, Homo sapiens
actgaacccagagtcagga

SEQ ID NO: 6618114 - DNA, 16 bp, Homo sapiens
actgaaccctgcctct

SEQ ID NO: 6618115 - DNA, 19 bp, Homo sapiens
actgaaccgctacaagagg

SEQ ID NO: 6618116 - DNA, 21 bp, Homo sapiens
actgaaccttgttgatgccag

SEQ ID NO: 6618117 - DNA, 22 bp, Homo sapiens
actgaactattttaaataaaat

SEQ ID NO: 6618118 - DNA, 16 bp, Homo sapiens
actgaactcaggatgg

SEQ ID NO: 6618119 - DNA, 10 bp, Homo sapiens
actgaactcc

SEQ ID NO: 6618120 - DNA, 13 bp, Homo sapiens
actgaactgcttt

SEQ ID NO: 6618121 - DNA, 15 bp, Homo sapiens
actgaactgtaactt

SEQ ID NO: 6618122 - DNA, 21 bp, Homo sapiens
actgaactgtgtgtaattgtt

SEQ ID NO: 6618123 - DNA, 13 bp, Homo sapiens
actgaactgttac

SEQ ID NO: 6618124 - DNA, 16 bp, Homo sapiens
actgaactttcttatc

SEQ ID NO: 6618125 - DNA, 19 bp, Homo sapiens
actgaactttgctgagcct

SEQ ID NO: 6618126 - DNA, 19 bp, Homo sapiens
actgaagaaatctttccag

SEQ ID NO: 6618127 - DNA, 13 bp, Homo sapiens
actgaagaacagt

SEQ ID NO: 6618128 - DNA, 12 bp, Homo sapiens
actgaagaagca

SEQ ID NO: 6618129 - DNA, 17 bp, Homo sapiens
actgaagacaggcacaa

SEQ ID NO: 6618130 - DNA, 21 bp, Homo sapiens
actgaagacaggcacaaaatg

SEQ ID NO: 6618131 - DNA, 22 bp, Homo sapiens
actgaagacaggcacaaaatgt

SEQ ID NO: 6618132 - DNA, 23 bp, Homo sapiens
actgaagacaggcacaaaatgtg

SEQ ID NO: 6618133 - DNA, 20 bp, Homo sapiens
actgaagagaccacagcaat

SEQ ID NO: 6618134 - DNA, 13 bp, Homo sapiens
actgaagagctct

SEQ ID NO: 6618135 - DNA, 15 bp, Homo sapiens
actgaagagctcttg

SEQ ID NO: 6618136 - DNA, 15 bp, Homo sapiens
actgaagaggaggag

SEQ ID NO: 6618137 - DNA, 22 bp, Homo sapiens
actgaagataatgaaatagtta

SEQ ID NO: 6618138 - DNA, 18 bp, Homo sapiens
actgaagatagaagaaaa

SEQ ID NO: 6618139 - DNA, 11 bp, Homo sapiens
actgaagattg

SEQ ID NO: 6618140 - DNA, 20 bp, Homo sapiens
actgaagcaaataccaaagc

SEQ ID NO: 6618141 - DNA, 15 bp, Homo sapiens
actgaagcacagcac

SEQ ID NO: 6618142 - DNA, 14 bp, Homo sapiens
actgaagcacgtga

SEQ ID NO: 6618143 - DNA, 12 bp, Homo sapiens
actgaagcagag

SEQ ID NO: 6618144 - DNA, 12 bp, Homo sapiens
actgaagcataa

SEQ ID NO: 6618145 - DNA, 13 bp, Homo sapiens
actgaagcataaa

SEQ ID NO: 6618146 - DNA, 17 bp, Homo sapiens
actgaagcataaacatc

SEQ ID NO: 6618147 - DNA, 23 bp, Homo sapiens
actgaagcataaacatcacatgg

SEQ ID NO: 6618148 - DNA, 17 bp, Homo sapiens
actgaagccaaatgaaa

SEQ ID NO: 6618149 - DNA, 18 bp, Homo sapiens
actgaagccaaatgaaac

SEQ ID NO: 6618150 - DNA, 19 bp, Homo sapiens
actgaagccacttggccca

SEQ ID NO: 6618151 - DNA, 20 bp, Homo sapiens
actgaagccacttggcccag

SEQ ID NO: 6618152 - DNA, 17 bp, Homo sapiens
actgaagcccagacctc

SEQ ID NO: 6618153 - DNA, 12 bp, Homo sapiens
actgaagcctgc

SEQ ID NO: 6618154 - DNA, 16 bp, Homo sapiens
actgaagcctgcagga

SEQ ID NO: 6618155 - DNA, 21 bp, Homo sapiens
actgaagccttacaaggttat

SEQ ID NO: 6618156 - DNA, 21 bp, Homo sapiens
actgaagccttcttctgccac

SEQ ID NO: 6618157 - DNA, 19 bp, Homo sapiens
actgaagcgaacatcttca

SEQ ID NO: 6618158 - DNA, 20 bp, Homo sapiens
actgaagcgaacatcttcat

SEQ ID NO: 6618159 - DNA, 14 bp, Homo sapiens
actgaagctgctgt

SEQ ID NO: 6618160 - DNA, 15 bp, Homo sapiens
actgaagctgctgta

SEQ ID NO: 6618161 - DNA, 12 bp, Homo sapiens
actgaagctggg

SEQ ID NO: 6618162 - DNA, 20 bp, Homo sapiens
actgaagcttcaaaaagcca

SEQ ID NO: 6618163 - DNA, 14 bp, Homo sapiens
actgaagcttttta

SEQ ID NO: 6618164 - DNA, 22 bp, Homo sapiens
actgaaggaaaaacacaagcaa

SEQ ID NO: 6618165 - DNA, 19 bp, Homo sapiens
actgaaggaaaagcaagaa

SEQ ID NO: 6618166 - DNA, 20 bp, Homo sapiens
actgaaggaaaagcaagaaa

SEQ ID NO: 6618167 - DNA, 23 bp, Homo sapiens
actgaaggaaaagcaagaaacag

SEQ ID NO: 6618168 - DNA, 14 bp, Homo sapiens
actgaaggagaagg

SEQ ID NO: 6618169 - DNA, 21 bp, Homo sapiens
actgaaggatattttcaacaa

SEQ ID NO: 6618170 - DNA, 12 bp, Homo sapiens
actgaaggcaaa

SEQ ID NO: 6618171 - DNA, 17 bp, Homo sapiens
actgaaggcctggccca

SEQ ID NO: 6618172 - DNA, 15 bp, Homo sapiens
actgaaggcttctgc

SEQ ID NO: 6618173 - DNA, 22 bp, Homo sapiens
actgaaggcttctgcagctttg

SEQ ID NO: 6618174 - DNA, 22 bp, Homo sapiens
actgaaggggtgcacccacctg

SEQ ID NO: 6618175 - DNA, 13 bp, Homo sapiens
actgaaggtgcag

SEQ ID NO: 6618176 - DNA, 18 bp, Homo sapiens
actgaagtaaacagctgt

SEQ ID NO: 6618177 - DNA, 19 bp, Homo sapiens
actgaagtaaacagctgtg

SEQ ID NO: 6618178 - DNA, 18 bp, Homo sapiens
actgaagtatacatttag

SEQ ID NO: 6618179 - DNA, 13 bp, Homo sapiens
actgaagtctgaa

SEQ ID NO: 6618180 - DNA, 15 bp, Homo sapiens
actgaagtctgaaat

SEQ ID NO: 6618181 - DNA, 14 bp, Homo sapiens
actgaagtgaatac

SEQ ID NO: 6618182 - DNA, 17 bp, Homo sapiens
actgaagtgaatacatg

SEQ ID NO: 6618183 - DNA, 20 bp, Homo sapiens
actgaagtgaatacatggta

SEQ ID NO: 6618184 - DNA, 16 bp, Homo sapiens
actgaagtgcagctca

SEQ ID NO: 6618185 - DNA, 15 bp, Homo sapiens
actgaagtttcacat

SEQ ID NO: 6618186 - DNA, 21 bp, Homo sapiens
actgaagtttgataaatagtg

SEQ ID NO: 6618187 - DNA, 16 bp, Homo sapiens
actgaagtttttgaaa

SEQ ID NO: 6618188 - DNA, 20 bp, Homo sapiens
actgaagtttttgaaatacc

SEQ ID NO: 6618189 - DNA, 23 bp, Homo sapiens
actgaagtttttgaaataccttt

SEQ ID NO: 6618190 - DNA, 19 bp, Homo sapiens
actgaataaaaaataaata

SEQ ID NO: 6618191 - DNA, 22 bp, Homo sapiens
actgaataaattgtacagccgg

SEQ ID NO: 6618192 - DNA, 23 bp, Homo sapiens
actgaataaattgtacagccggc

SEQ ID NO: 6618193 - DNA, 18 bp, Homo sapiens
actgaataatatcaaata

SEQ ID NO: 6618194 - DNA, 14 bp, Homo sapiens
actgaataccactc

SEQ ID NO: 6618195 - DNA, 21 bp, Homo sapiens
actgaataccactctgtaatt

SEQ ID NO: 6618196 - DNA, 17 bp, Homo sapiens
actgaataggaaaatgt

SEQ ID NO: 6618197 - DNA, 22 bp, Homo sapiens
actgaataggaaaatgtacata

SEQ ID NO: 6618198 - DNA, 18 bp, Homo sapiens
actgaatatataaacact

SEQ ID NO: 6618199 - DNA, 16 bp, Homo sapiens
actgaatatcaactct

SEQ ID NO: 6618200 - DNA, 23 bp, Homo sapiens
actgaatattgacaagtgtcttt

SEQ ID NO: 6618201 - DNA, 22 bp, Homo sapiens
actgaatatttatatttcacta

SEQ ID NO: 6618202 - DNA, 15 bp, Homo sapiens
actgaatattttgga

SEQ ID NO: 6618203 - DNA, 18 bp, Homo sapiens
actgaatattttggaaac

SEQ ID NO: 6618204 - DNA, 19 bp, Homo sapiens
actgaatattttggaaact

SEQ ID NO: 6618205 - DNA, 16 bp, Homo sapiens
actgaatcaggaaact

SEQ ID NO: 6618206 - DNA, 18 bp, Homo sapiens
actgaatcaggaaactca

SEQ ID NO: 6618207 - DNA, 14 bp, Homo sapiens
actgaatcatgtta

SEQ ID NO: 6618208 - DNA, 16 bp, Homo sapiens
actgaatctgagaaag

SEQ ID NO: 6618209 - DNA, 14 bp, Homo sapiens
actgaatctgtaca

SEQ ID NO: 6618210 - DNA, 14 bp, Homo sapiens
actgaatcttcacg

SEQ ID NO: 6618211 - DNA, 23 bp, Homo sapiens
actgaatgaaacccccacacaca

SEQ ID NO: 6618212 - DNA, 17 bp, Homo sapiens
actgaatgaacaacctc

SEQ ID NO: 6618213 - DNA, 20 bp, Homo sapiens
actgaatgaagcagtatttt

SEQ ID NO: 6618214 - DNA, 12 bp, Homo sapiens
actgaatgaggt

SEQ ID NO: 6618215 - DNA, 20 bp, Homo sapiens
actgaatgaggtcagcatgt

SEQ ID NO: 6618216 - DNA, 16 bp, Homo sapiens
actgaatgatctattc

SEQ ID NO: 6618217 - DNA, 11 bp, Homo sapiens
actgaatgcag

SEQ ID NO: 6618218 - DNA, 16 bp, Homo sapiens
actgaatgctctgtgc

SEQ ID NO: 6618219 - DNA, 17 bp, Homo sapiens
actgaatggactttgca

SEQ ID NO: 6618220 - DNA, 12 bp, Homo sapiens
actgaatgtaag

SEQ ID NO: 6618221 - DNA, 13 bp, Homo sapiens
actgaatgtttta

SEQ ID NO: 6618222 - DNA, 14 bp, Homo sapiens
actgaatgttttat

SEQ ID NO: 6618223 - DNA, 20 bp, Homo sapiens
actgaattagccaaaacact

SEQ ID NO: 6618224 - DNA, 13 bp, Homo sapiens
actgaattatgaa

SEQ ID NO: 6618225 - DNA, 14 bp, Homo sapiens
actgaattatgaaa

SEQ ID NO: 6618226 - DNA, 15 bp, Homo sapiens
actgaattctgcctt

SEQ ID NO: 6618227 - DNA, 18 bp, Homo sapiens
actgaattctgccttggt

SEQ ID NO: 6618228 - DNA, 18 bp, Homo sapiens
actgaattggcttccaga

SEQ ID NO: 6618229 - DNA, 19 bp, Homo sapiens
actgaattggcttccagat

SEQ ID NO: 6618230 - DNA, 21 bp, Homo sapiens
actgaattgtatcaatttgtt

SEQ ID NO: 6618231 - DNA, 13 bp, Homo sapiens
actgaatttaact

SEQ ID NO: 6618232 - DNA, 14 bp, Homo sapiens
actgaatttaacta

SEQ ID NO: 6618233 - DNA, 16 bp, Homo sapiens
actgaatttctttgat

SEQ ID NO: 6618234 - DNA, 18 bp, Homo sapiens
actgaattttgggacttc

SEQ ID NO: 6618235 - DNA, 19 bp, Homo sapiens
actgaattttgggacttct

SEQ ID NO: 6618236 - DNA, 20 bp, Homo sapiens
actgaattttgggacttcta

SEQ ID NO: 6618237 - DNA, 18 bp, Homo sapiens
actgaatttttaaaatgc

SEQ ID NO: 6618238 - DNA, 17 bp, Homo sapiens
actgaatttttttgtaa

SEQ ID NO: 6618239 - DNA, 16 bp, Homo sapiens
actgaattttttttaa

SEQ ID NO: 6618240 - DNA, 19 bp, Homo sapiens
actgaattttttttaaaaa

SEQ ID NO: 6618241 - DNA, 12 bp, Homo sapiens
actgacaaagat

SEQ ID NO: 6618242 - DNA, 17 bp, Homo sapiens
actgacaaagtcatccc

SEQ ID NO: 6618243 - DNA, 19 bp, Homo sapiens
actgacaaatcaagtttcc

SEQ ID NO: 6618244 - DNA, 20 bp, Homo sapiens
actgacaagaagctcccaga

SEQ ID NO: 6618245 - DNA, 12 bp, Homo sapiens
actgacaagatg

SEQ ID NO: 6618246 - DNA, 14 bp, Homo sapiens
actgacaagatgga

SEQ ID NO: 6618247 - DNA, 12 bp, Homo sapiens
actgacaatttt

SEQ ID NO: 6618248 - DNA, 23 bp, Homo sapiens
actgacaattttacctattctga

SEQ ID NO: 6618249 - DNA, 23 bp, Homo sapiens
actgacacaaaaagtagattaag

SEQ ID NO: 6618250 - DNA, 13 bp, Homo sapiens
actgacacacacg

SEQ ID NO: 6618251 - DNA, 13 bp, Homo sapiens
actgacacaggaa

SEQ ID NO: 6618252 - DNA, 16 bp, Homo sapiens
actgacacaggccagc

SEQ ID NO: 6618253 - DNA, 12 bp, Homo sapiens
actgacacaggg

SEQ ID NO: 6618254 - DNA, 14 bp, Homo sapiens
actgacacatcagc

SEQ ID NO: 6618255 - DNA, 13 bp, Homo sapiens
actgacacatgct

SEQ ID NO: 6618256 - DNA, 22 bp, Homo sapiens
actgacacccatgtttctctgg

SEQ ID NO: 6618257 - DNA, 14 bp, Homo sapiens
actgacaccctggg

SEQ ID NO: 6618258 - DNA, 14 bp, Homo sapiens
actgacaccctggt

SEQ ID NO: 6618259 - DNA, 21 bp, Homo sapiens
actgacaccctggtcctgact

SEQ ID NO: 6618260 - DNA, 21 bp, Homo sapiens
actgacacctcactgaggaag

SEQ ID NO: 6618261 - DNA, 20 bp, Homo sapiens
actgacacctttgcaggcat

SEQ ID NO: 6618262 - DNA, 15 bp, Homo sapiens
actgacacttcctgt

SEQ ID NO: 6618263 - DNA, 21 bp, Homo sapiens
actgacacttcctgtccttgt

SEQ ID NO: 6618264 - DNA, 14 bp, Homo sapiens
actgacagatgctt

SEQ ID NO: 6618265 - DNA, 13 bp, Homo sapiens
actgacagcatgt

SEQ ID NO: 6618266 - DNA, 14 bp, Homo sapiens
actgacagcctcca

SEQ ID NO: 6618267 - DNA, 15 bp, Homo sapiens
actgacagcctgggg

SEQ ID NO: 6618268 - DNA, 17 bp, Homo sapiens
actgacagccttgccca

SEQ ID NO: 6618269 - DNA, 18 bp, Homo sapiens
actgacagccttgcccac

SEQ ID NO: 6618270 - DNA, 20 bp, Homo sapiens
actgacagggagcagccccc

SEQ ID NO: 6618271 - DNA, 11 bp, Homo sapiens
actgacatcag

SEQ ID NO: 6618272 - DNA, 16 bp, Homo sapiens
actgacatcagcactg

SEQ ID NO: 6618273 - DNA, 16 bp, Homo sapiens
actgacatgccctccc

SEQ ID NO: 6618274 - DNA, 21 bp, Homo sapiens
actgacatgccctcccttctc

SEQ ID NO: 6618275 - DNA, 14 bp, Homo sapiens
actgacatggtgct

SEQ ID NO: 6618276 - DNA, 13 bp, Homo sapiens
actgacatttctt

SEQ ID NO: 6618277 - DNA, 20 bp, Homo sapiens
actgacattttttcctaagg

SEQ ID NO: 6618278 - DNA, 18 bp, Homo sapiens
actgaccaaagactgcag

SEQ ID NO: 6618279 - DNA, 19 bp, Homo sapiens
actgaccaataccccgact

SEQ ID NO: 6618280 - DNA, 14 bp, Homo sapiens
actgaccagacaag

SEQ ID NO: 6618281 - DNA, 15 bp, Homo sapiens
actgaccagcctcca

SEQ ID NO: 6618282 - DNA, 14 bp, Homo sapiens
actgaccatcatgc

SEQ ID NO: 6618283 - DNA, 12 bp, Homo sapiens
actgacccaact

SEQ ID NO: 6618284 - DNA, 20 bp, Homo sapiens
actgacccacagcctctgcc

SEQ ID NO: 6618285 - DNA, 12 bp, Homo sapiens
actgacccagag

SEQ ID NO: 6618286 - DNA, 13 bp, Homo sapiens
actgacccagagg

SEQ ID NO: 6618287 - DNA, 19 bp, Homo sapiens
actgacccattcacatttt

SEQ ID NO: 6618288 - DNA, 20 bp, Homo sapiens
actgacccccatctgagctg

SEQ ID NO: 6618289 - DNA, 21 bp, Homo sapiens
actgacccccatctgagctgg

SEQ ID NO: 6618290 - DNA, 17 bp, Homo sapiens
actgaccccctcccctg

SEQ ID NO: 6618291 - DNA, 18 bp, Homo sapiens
actgaccccctcccctga

SEQ ID NO: 6618292 - DNA, 14 bp, Homo sapiens
actgaccctcaggc

SEQ ID NO: 6618293 - DNA, 21 bp, Homo sapiens
actgaccctcaggcacacctt

SEQ ID NO: 6618294 - DNA, 22 bp, Homo sapiens
actgaccctcaggcacaccttg

SEQ ID NO: 6618295 - DNA, 18 bp, Homo sapiens
actgaccctcccttcctg

SEQ ID NO: 6618296 - DNA, 13 bp, Homo sapiens
actgaccctgagg

SEQ ID NO: 6618297 - DNA, 18 bp, Homo sapiens
actgaccctgaggaggcc

SEQ ID NO: 6618298 - DNA, 15 bp, Homo sapiens
actgacccttccaga

SEQ ID NO: 6618299 - DNA, 15 bp, Homo sapiens
actgacccttgaacc

SEQ ID NO: 6618300 - DNA, 20 bp, Homo sapiens
actgaccgggatccagttcc

SEQ ID NO: 6618301 - DNA, 17 bp, Homo sapiens
actgaccggtgctttta

SEQ ID NO: 6618302 - DNA, 19 bp, Homo sapiens
actgaccggtgcttttatt

SEQ ID NO: 6618303 - DNA, 13 bp, Homo sapiens
actgacctacctc

SEQ ID NO: 6618304 - DNA, 22 bp, Homo sapiens
actgacctgaccccattcctga

SEQ ID NO: 6618305 - DNA, 14 bp, Homo sapiens
actgacctgcccat

SEQ ID NO: 6618306 - DNA, 20 bp, Homo sapiens
actgacctgctccgccagga

SEQ ID NO: 6618307 - DNA, 14 bp, Homo sapiens
actgacctggaaga

SEQ ID NO: 6618308 - DNA, 14 bp, Homo sapiens
actgaccttaaaac

SEQ ID NO: 6618309 - DNA, 23 bp, Homo sapiens
actgaccttcggcagtggctggg

SEQ ID NO: 6618310 - DNA, 21 bp, Homo sapiens
actgaccttggagagacacag

SEQ ID NO: 6618311 - DNA, 22 bp, Homo sapiens
actgaccttggagagacacagc

SEQ ID NO: 6618312 - DNA, 23 bp, Homo sapiens
actgacggctgtgtatttctgta

SEQ ID NO: 6618313 - DNA, 22 bp, Homo sapiens
actgactataccaactgggcct

SEQ ID NO: 6618314 - DNA, 18 bp, Homo sapiens
actgactatcataaaatc

SEQ ID NO: 6618315 - DNA, 23 bp, Homo sapiens
actgactattcttgatgtaaaat

SEQ ID NO: 6618316 - DNA, 24 bp, Homo sapiens
actgactattcttgatgtaaaatc

SEQ ID NO: 6618317 - DNA, 21 bp, Homo sapiens
actgactcctcagtccctctt

SEQ ID NO: 6618318 - DNA, 14 bp, Homo sapiens
actgactccttaga

SEQ ID NO: 6618319 - DNA, 23 bp, Homo sapiens
actgactcggcagtgtgcagtgg

SEQ ID NO: 6618320 - DNA, 14 bp, Homo sapiens
actgactcttaaga

SEQ ID NO: 6618321 - DNA, 15 bp, Homo sapiens
actgactcttaagaa

SEQ ID NO: 6618322 - DNA, 20 bp, Homo sapiens
actgactcttaagaagactg

SEQ ID NO: 6618323 - DNA, 13 bp, Homo sapiens
actgactgaaatc

SEQ ID NO: 6618324 - DNA, 18 bp, Homo sapiens
actgactgagacacgatg

SEQ ID NO: 6618325 - DNA, 18 bp, Homo sapiens
actgactgagataagaaa

SEQ ID NO: 6618326 - DNA, 15 bp, Homo sapiens
actgactgcttataa

SEQ ID NO: 6618327 - DNA, 13 bp, Homo sapiens
actgactgtgttg

SEQ ID NO: 6618328 - DNA, 22 bp, Homo sapiens
actgacttcactaggcattgtg

SEQ ID NO: 6618329 - DNA, 21 bp, Homo sapiens
actgacttcagtgggactcgg

SEQ ID NO: 6618330 - DNA, 20 bp, Homo sapiens
actgacttcatttgtgccac

SEQ ID NO: 6618331 - DNA, 22 bp, Homo sapiens
actgacttctaagtaaaaccac

SEQ ID NO: 6618332 - DNA, 14 bp, Homo sapiens
actgacttctgcta

SEQ ID NO: 6618333 - DNA, 15 bp, Homo sapiens
actgacttctgctag

SEQ ID NO: 6618334 - DNA, 13 bp, Homo sapiens
actgacttgctca

SEQ ID NO: 6618335 - DNA, 13 bp, Homo sapiens
actgacttgctgt

SEQ ID NO: 6618336 - DNA, 15 bp, Homo sapiens
actgacttgctgtgt

SEQ ID NO: 6618337 - DNA, 20 bp, Homo sapiens
actgacttggatcccaaagc

SEQ ID NO: 6618338 - DNA, 24 bp, Homo sapiens
actgacttgtttgtcttccattcc

SEQ ID NO: 6618339 - DNA, 12 bp, Homo sapiens
actgactttctc

SEQ ID NO: 6618340 - DNA, 15 bp, Homo sapiens
actgactttctgatt

SEQ ID NO: 6618341 - DNA, 15 bp, Homo sapiens
actgactttgcttgc

SEQ ID NO: 6618342 - DNA, 17 bp, Homo sapiens
actgactttgcttgctt

SEQ ID NO: 6618343 - DNA, 23 bp, Homo sapiens
actgactttgcttgctttgaagt

SEQ ID NO: 6618344 - DNA, 19 bp, Homo sapiens
actgacttttctttttaat

SEQ ID NO: 6618345 - DNA, 20 bp, Homo sapiens
actgacttttctttttaatt

SEQ ID NO: 6618346 - DNA, 18 bp, Homo sapiens
actgactttttccatttt

SEQ ID NO: 6618347 - DNA, 21 bp, Homo sapiens
actgagaaaaagcattaaaaa

SEQ ID NO: 6618348 - DNA, 15 bp, Homo sapiens
actgagaaaacctgt

SEQ ID NO: 6618349 - DNA, 15 bp, Homo sapiens
actgagaaagaggca

SEQ ID NO: 6618350 - DNA, 16 bp, Homo sapiens
actgagaaatgaatgc

SEQ ID NO: 6618351 - DNA, 17 bp, Homo sapiens
actgagaaatttataaa

SEQ ID NO: 6618352 - DNA, 19 bp, Homo sapiens
actgagaacattaaaaaag

SEQ ID NO: 6618353 - DNA, 18 bp, Homo sapiens
actgagaagatggcactg

SEQ ID NO: 6618354 - DNA, 22 bp, Homo sapiens
actgagaagatggcactgtcca

SEQ ID NO: 6618355 - DNA, 21 bp, Homo sapiens
actgagaagccaagcctggag

SEQ ID NO: 6618356 - DNA, 18 bp, Homo sapiens
actgagaaggcaggcctc

SEQ ID NO: 6618357 - DNA, 20 bp, Homo sapiens
actgagaaggcaggcctccg

SEQ ID NO: 6618358 - DNA, 21 bp, Homo sapiens
actgagaaggcaggcctccgt

SEQ ID NO: 6618359 - DNA, 23 bp, Homo sapiens
actgagaaggcaggcctccgtct

SEQ ID NO: 6618360 - DNA, 22 bp, Homo sapiens
actgagacaaaaaggaaacata

SEQ ID NO: 6618361 - DNA, 15 bp, Homo sapiens
actgagacagcccgg

SEQ ID NO: 6618362 - DNA, 21 bp, Homo sapiens
actgagacagcccgggctctg

SEQ ID NO: 6618363 - DNA, 14 bp, Homo sapiens
actgagacaggcag

SEQ ID NO: 6618364 - DNA, 16 bp, Homo sapiens
actgagaccaaggctt

SEQ ID NO: 6618365 - DNA, 19 bp, Homo sapiens
actgagaccaagtctctct

SEQ ID NO: 6618366 - DNA, 23 bp, Homo sapiens
actgagacttgttcttggttcct

SEQ ID NO: 6618367 - DNA, 15 bp, Homo sapiens
actgagactttcccc

SEQ ID NO: 6618368 - DNA, 18 bp, Homo sapiens
actgagactttcccctct

SEQ ID NO: 6618369 - DNA, 19 bp, Homo sapiens
actgagactttcccctctc

SEQ ID NO: 6618370 - DNA, 14 bp, Homo sapiens
actgagagaaagat

SEQ ID NO: 6618371 - DNA, 20 bp, Homo sapiens
actgagagatgcagaaatat

SEQ ID NO: 6618372 - DNA, 18 bp, Homo sapiens
actgagagctgctccttt

SEQ ID NO: 6618373 - DNA, 21 bp, Homo sapiens
actgagaggaggggtaaatat

SEQ ID NO: 6618374 - DNA, 18 bp, Homo sapiens
actgagagtgaacaaatt

SEQ ID NO: 6618375 - DNA, 19 bp, Homo sapiens
actgagataagaaaagcct

SEQ ID NO: 6618376 - DNA, 19 bp, Homo sapiens
actgagataccagcgagga

SEQ ID NO: 6618377 - DNA, 20 bp, Homo sapiens
actgagatagcttagtgtct

SEQ ID NO: 6618378 - DNA, 16 bp, Homo sapiens
actgagatcaaaaaaa

SEQ ID NO: 6618379 - DNA, 14 bp, Homo sapiens
actgagatcactga

SEQ ID NO: 6618380 - DNA, 20 bp, Homo sapiens
actgagatccttccttttga

SEQ ID NO: 6618381 - DNA, 15 bp, Homo sapiens
actgagatgctgggc

SEQ ID NO: 6618382 - DNA, 22 bp, Homo sapiens
actgagatgtgaacacatcagc

SEQ ID NO: 6618383 - DNA, 12 bp, Homo sapiens
actgagatgttt

SEQ ID NO: 6618384 - DNA, 16 bp, Homo sapiens
actgagatttgtaaat

SEQ ID NO: 6618385 - DNA, 17 bp, Homo sapiens
actgagattttggtatt

SEQ ID NO: 6618386 - DNA, 21 bp, Homo sapiens
actgagcaacgctattccagc

SEQ ID NO: 6618387 - DNA, 13 bp, Homo sapiens
actgagcaagatc

SEQ ID NO: 6618388 - DNA, 20 bp, Homo sapiens
actgagcacagtcaggggct

SEQ ID NO: 6618389 - DNA, 13 bp, Homo sapiens
actgagcactgaa

SEQ ID NO: 6618390 - DNA, 16 bp, Homo sapiens
actgagcactgttttc

SEQ ID NO: 6618391 - DNA, 14 bp, Homo sapiens
actgagcagagtct

SEQ ID NO: 6618392 - DNA, 15 bp, Homo sapiens
actgagcagccgcca

SEQ ID NO: 6618393 - DNA, 12 bp, Homo sapiens
actgagcaggga

SEQ ID NO: 6618394 - DNA, 15 bp, Homo sapiens
actgagcataagtcc

SEQ ID NO: 6618395 - DNA, 18 bp, Homo sapiens
actgagcatagtggtggg

SEQ ID NO: 6618396 - DNA, 13 bp, Homo sapiens
actgagcatctcc

SEQ ID NO: 6618397 - DNA, 20 bp, Homo sapiens
actgagccaaggaggcctgg

SEQ ID NO: 6618398 - DNA, 13 bp, Homo sapiens
actgagccagatt

SEQ ID NO: 6618399 - DNA, 20 bp, Homo sapiens
actgagccagtcccaggggc

SEQ ID NO: 6618400 - DNA, 14 bp, Homo sapiens
actgagccccacct

SEQ ID NO: 6618401 - DNA, 21 bp, Homo sapiens
actgagccccagcgggctggc

SEQ ID NO: 6618402 - DNA, 14 bp, Homo sapiens
actgagcccccacc

SEQ ID NO: 6618403 - DNA, 13 bp, Homo sapiens
actgagccccccc

SEQ ID NO: 6618404 - DNA, 22 bp, Homo sapiens
actgagcccccccaacactgtg

SEQ ID NO: 6618405 - DNA, 18 bp, Homo sapiens
actgagccccgcagacct

SEQ ID NO: 6618406 - DNA, 23 bp, Homo sapiens
actgagccccgcagacctcccca

SEQ ID NO: 6618407 - DNA, 13 bp, Homo sapiens
actgagccctctc

SEQ ID NO: 6618408 - DNA, 18 bp, Homo sapiens
actgagccgtgcagctgg

SEQ ID NO: 6618409 - DNA, 22 bp, Homo sapiens
actgagcgaggaaaaacaacaa

SEQ ID NO: 6618410 - DNA, 20 bp, Homo sapiens
actgagcgcaagccacagcc

SEQ ID NO: 6618411 - DNA, 23 bp, Homo sapiens
actgagcgcaagccacagcctgt

SEQ ID NO: 6618412 - DNA, 15 bp, Homo sapiens
actgagcgcctgcag

SEQ ID NO: 6618413 - DNA, 22 bp, Homo sapiens
actgagctcacatgggactggg

SEQ ID NO: 6618414 - DNA, 19 bp, Homo sapiens
actgagctccccagatctc

SEQ ID NO: 6618415 - DNA, 16 bp, Homo sapiens
actgagctcgcagccc

SEQ ID NO: 6618416 - DNA, 16 bp, Homo sapiens
actgagctctccaggc

SEQ ID NO: 6618417 - DNA, 19 bp, Homo sapiens
actgagctctccaggccag

SEQ ID NO: 6618418 - DNA, 14 bp, Homo sapiens
actgagctgccagt

SEQ ID NO: 6618419 - DNA, 16 bp, Homo sapiens
actgagctgccagtgg

SEQ ID NO: 6618420 - DNA, 13 bp, Homo sapiens
actgagctggctg

SEQ ID NO: 6618421 - DNA, 15 bp, Homo sapiens
actgagctgggggaa

SEQ ID NO: 6618422 - DNA, 16 bp, Homo sapiens
actgagcttagagtat

SEQ ID NO: 6618423 - DNA, 23 bp, Homo sapiens
actgagctttagacagcagagca

SEQ ID NO: 6618424 - DNA, 24 bp, Homo sapiens
actgaggaagggagacatattctt

SEQ ID NO: 6618425 - DNA, 18 bp, Homo sapiens
actgaggaatgatgaagc

SEQ ID NO: 6618426 - DNA, 17 bp, Homo sapiens
actgaggaatttcacct

SEQ ID NO: 6618427 - DNA, 19 bp, Homo sapiens
actgaggaatttcacctgt

SEQ ID NO: 6618428 - DNA, 20 bp, Homo sapiens
actgaggaattttctttgtg

SEQ ID NO: 6618429 - DNA, 22 bp, Homo sapiens
actgaggagaagctgatccagt

SEQ ID NO: 6618430 - DNA, 21 bp, Homo sapiens
actgaggagacagaaagcctc

SEQ ID NO: 6618431 - DNA, 16 bp, Homo sapiens
actgaggagcaaagca

SEQ ID NO: 6618432 - DNA, 15 bp, Homo sapiens
actgaggagctagtg

SEQ ID NO: 6618433 - DNA, 14 bp, Homo sapiens
actgaggatgtgag

SEQ ID NO: 6618434 - DNA, 22 bp, Homo sapiens
actgaggatttctttttggttt

SEQ ID NO: 6618435 - DNA, 13 bp, Homo sapiens
actgaggcagcct

SEQ ID NO: 6618436 - DNA, 16 bp, Homo sapiens
actgaggcagccttgg

SEQ ID NO: 6618437 - DNA, 19 bp, Homo sapiens
actgaggcagcgacctcaa

SEQ ID NO: 6618438 - DNA, 20 bp, Homo sapiens
actgaggcagcgacctcaag

SEQ ID NO: 6618439 - DNA, 15 bp, Homo sapiens
actgaggcagggaag

SEQ ID NO: 6618440 - DNA, 15 bp, Homo sapiens
actgaggccattatt

SEQ ID NO: 6618441 - DNA, 12 bp, Homo sapiens
actgaggcccag

SEQ ID NO: 6618442 - DNA, 13 bp, Homo sapiens
actgaggcccaga

SEQ ID NO: 6618443 - DNA, 14 bp, Homo sapiens
actgaggcccagag

SEQ ID NO: 6618444 - DNA, 17 bp, Homo sapiens
actgaggcccagagagg

SEQ ID NO: 6618445 - DNA, 19 bp, Homo sapiens
actgaggcccagagaggga

SEQ ID NO: 6618446 - DNA, 21 bp, Homo sapiens
actgaggcctaaaagtaaaca

SEQ ID NO: 6618447 - DNA, 14 bp, Homo sapiens
actgaggcctgagc

SEQ ID NO: 6618448 - DNA, 13 bp, Homo sapiens
actgaggcctgct

SEQ ID NO: 6618449 - DNA, 23 bp, Homo sapiens
actgaggcctgcttccccctccc

SEQ ID NO: 6618450 - DNA, 16 bp, Homo sapiens
actgaggccttctcaa

SEQ ID NO: 6618451 - DNA, 14 bp, Homo sapiens
actgaggccttgtg

SEQ ID NO: 6618452 - DNA, 15 bp, Homo sapiens
actgaggccttgtgt

SEQ ID NO: 6618453 - DNA, 23 bp, Homo sapiens
actgaggcttagagagaggaggc

SEQ ID NO: 6618454 - DNA, 21 bp, Homo sapiens
actgagggaccaactgggccc

SEQ ID NO: 6618455 - DNA, 14 bp, Homo sapiens
actgagggactctg

SEQ ID NO: 6618456 - DNA, 17 bp, Homo sapiens
actgagggactctgaag

SEQ ID NO: 6618457 - DNA, 15 bp, Homo sapiens
actgagggcagagag

SEQ ID NO: 6618458 - DNA, 22 bp, Homo sapiens
actgagggccacactattacca

SEQ ID NO: 6618459 - DNA, 17 bp, Homo sapiens
actgagggctgatcttt

SEQ ID NO: 6618460 - DNA, 17 bp, Homo sapiens
actgaggggaggggagc

SEQ ID NO: 6618461 - DNA, 22 bp, Homo sapiens
actgaggggccagggaggaagg

SEQ ID NO: 6618462 - DNA, 16 bp, Homo sapiens
actgagggggcctgga

SEQ ID NO: 6618463 - DNA, 17 bp, Homo sapiens
actgagggggcctggat

SEQ ID NO: 6618464 - DNA, 18 bp, Homo sapiens
actgagggggcctggatg

SEQ ID NO: 6618465 - DNA, 24 bp, Homo sapiens
actgagggtgagttggcttacctg

SEQ ID NO: 6618466 - DNA, 15 bp, Homo sapiens
actgaggtaaaatgt

SEQ ID NO: 6618467 - DNA, 17 bp, Homo sapiens
actgaggtataaagaca

SEQ ID NO: 6618468 - DNA, 19 bp, Homo sapiens
actgaggtataaagacaag

SEQ ID NO: 6618469 - DNA, 16 bp, Homo sapiens
actgaggtatggccat

SEQ ID NO: 6618470 - DNA, 18 bp, Homo sapiens
actgaggtatggccatgc

SEQ ID NO: 6618471 - DNA, 13 bp, Homo sapiens
actgaggtgcctg

SEQ ID NO: 6618472 - DNA, 15 bp, Homo sapiens
actgaggtgcctgct

SEQ ID NO: 6618473 - DNA, 22 bp, Homo sapiens
actgaggtgcctgctcaggtgc

SEQ ID NO: 6618474 - DNA, 18 bp, Homo sapiens
actgaggtgctatgaagc

SEQ ID NO: 6618475 - DNA, 16 bp, Homo sapiens
actgagtaaagtgtta

SEQ ID NO: 6618476 - DNA, 15 bp, Homo sapiens
actgagtacaaatgt

SEQ ID NO: 6618477 - DNA, 17 bp, Homo sapiens
actgagtacaattgtta

SEQ ID NO: 6618478 - DNA, 17 bp, Homo sapiens
actgagtaccaggggct

SEQ ID NO: 6618479 - DNA, 22 bp, Homo sapiens
actgagtagctttcatttactg

SEQ ID NO: 6618480 - DNA, 11 bp, Homo sapiens
actgagtcacg

SEQ ID NO: 6618481 - DNA, 20 bp, Homo sapiens
actgagtcatcttgtgagtg

SEQ ID NO: 6618482 - DNA, 17 bp, Homo sapiens
actgagtccatgaaaat

SEQ ID NO: 6618483 - DNA, 17 bp, Homo sapiens
actgagtcccctccagg

SEQ ID NO: 6618484 - DNA, 20 bp, Homo sapiens
actgagtcccctccaggaag

SEQ ID NO: 6618485 - DNA, 21 bp, Homo sapiens
actgagtcccctccaggaaga

SEQ ID NO: 6618486 - DNA, 16 bp, Homo sapiens
actgagtccttaaaca

SEQ ID NO: 6618487 - DNA, 22 bp, Homo sapiens
actgagtctcattcctctgtcc

SEQ ID NO: 6618488 - DNA, 15 bp, Homo sapiens
actgagtctgtggac

SEQ ID NO: 6618489 - DNA, 22 bp, Homo sapiens
actgagtctgtggacactgtgg

SEQ ID NO: 6618490 - DNA, 23 bp, Homo sapiens
actgagtgactctatatagctga

SEQ ID NO: 6618491 - DNA, 20 bp, Homo sapiens
actgagtgcctgcagcatct

SEQ ID NO: 6618492 - DNA, 16 bp, Homo sapiens
actgagtgggaagccc

SEQ ID NO: 6618493 - DNA, 23 bp, Homo sapiens
actgagtgtgggagtgcagagaa

SEQ ID NO: 6618494 - DNA, 19 bp, Homo sapiens
actgagttagaatgttgaa

SEQ ID NO: 6618495 - DNA, 14 bp, Homo sapiens
actgagttgcacat

SEQ ID NO: 6618496 - DNA, 15 bp, Homo sapiens
actgagttgcacata

SEQ ID NO: 6618497 - DNA, 13 bp, Homo sapiens
actgagttttcca

SEQ ID NO: 6618498 - DNA, 21 bp, Homo sapiens
actgagttttgtttcactttg

SEQ ID NO: 6618499 - DNA, 15 bp, Homo sapiens
actgataaacctaat

SEQ ID NO: 6618500 - DNA, 15 bp, Homo sapiens
actgataaagaaaga

SEQ ID NO: 6618501 - DNA, 21 bp, Homo sapiens
actgataaagatgagtgagca

SEQ ID NO: 6618502 - DNA, 21 bp, Homo sapiens
actgataacaaccttttacat

SEQ ID NO: 6618503 - DNA, 19 bp, Homo sapiens
actgataacgtattttgat

SEQ ID NO: 6618504 - DNA, 16 bp, Homo sapiens
actgataagactgttt

SEQ ID NO: 6618505 - DNA, 17 bp, Homo sapiens
actgataatcacactgc

SEQ ID NO: 6618506 - DNA, 15 bp, Homo sapiens
actgataattttaaa

SEQ ID NO: 6618507 - DNA, 19 bp, Homo sapiens
actgatactattcaatgca

SEQ ID NO: 6618508 - DNA, 21 bp, Homo sapiens
actgatactattcaatgcaat

SEQ ID NO: 6618509 - DNA, 14 bp, Homo sapiens
actgatagacacca

SEQ ID NO: 6618510 - DNA, 18 bp, Homo sapiens
actgatagcttacactga

SEQ ID NO: 6618511 - DNA, 22 bp, Homo sapiens
actgatagcttacactgaggac

SEQ ID NO: 6618512 - DNA, 16 bp, Homo sapiens
actgatagtgtccaaa

SEQ ID NO: 6618513 - DNA, 23 bp, Homo sapiens
actgatagttactgttgtgacct

SEQ ID NO: 6618514 - DNA, 21 bp, Homo sapiens
actgatatcacgggcccgctc

SEQ ID NO: 6618515 - DNA, 22 bp, Homo sapiens
actgatatcacgggcccgctca

SEQ ID NO: 6618516 - DNA, 15 bp, Homo sapiens
actgatattcagaat

SEQ ID NO: 6618517 - DNA, 16 bp, Homo sapiens
actgatattcagaatt

SEQ ID NO: 6618518 - DNA, 16 bp, Homo sapiens
actgatcaaaaataaa

SEQ ID NO: 6618519 - DNA, 19 bp, Homo sapiens
actgatcaatccttcttat

SEQ ID NO: 6618520 - DNA, 18 bp, Homo sapiens
actgatcatttgcagctg

SEQ ID NO: 6618521 - DNA, 22 bp, Homo sapiens
actgatcatttgcagctgctgg

SEQ ID NO: 6618522 - DNA, 18 bp, Homo sapiens
actgatccaaaaattata

SEQ ID NO: 6618523 - DNA, 18 bp, Homo sapiens
actgatcccccagatgca

SEQ ID NO: 6618524 - DNA, 19 bp, Homo sapiens
actgatcccccagatgcag

SEQ ID NO: 6618525 - DNA, 17 bp, Homo sapiens
actgatcctgctccagc

SEQ ID NO: 6618526 - DNA, 19 bp, Homo sapiens
actgatcctgctccagcag

SEQ ID NO: 6618527 - DNA, 20 bp, Homo sapiens
actgatcctgctccagcagc

SEQ ID NO: 6618528 - DNA, 22 bp, Homo sapiens
actgatcctgctccagcagcac

SEQ ID NO: 6618529 - DNA, 18 bp, Homo sapiens
actgatcttactctactg

SEQ ID NO: 6618530 - DNA, 13 bp, Homo sapiens
actgatcttcctt

SEQ ID NO: 6618531 - DNA, 14 bp, Homo sapiens
actgatctttgcaa

SEQ ID NO: 6618532 - DNA, 20 bp, Homo sapiens
actgatctttgtatattaca

SEQ ID NO: 6618533 - DNA, 21 bp, Homo sapiens
actgatgaaatctgctagaaa

SEQ ID NO: 6618534 - DNA, 23 bp, Homo sapiens
actgatgaaatctgctagaaagt

SEQ ID NO: 6618535 - DNA, 21 bp, Homo sapiens
actgatgagacaacacacaca

SEQ ID NO: 6618536 - DNA, 17 bp, Homo sapiens
actgatgagatacattt

SEQ ID NO: 6618537 - DNA, 22 bp, Homo sapiens
actgatgagtaaactgaggccc

SEQ ID NO: 6618538 - DNA, 20 bp, Homo sapiens
actgatgatagacttcgaaa

SEQ ID NO: 6618539 - DNA, 20 bp, Homo sapiens
actgatgcgaaaacttgaat

SEQ ID NO: 6618540 - DNA, 23 bp, Homo sapiens
actgatgcgaaaacttgaatctg

SEQ ID NO: 6618541 - DNA, 15 bp, Homo sapiens
actgatgctgagatt

SEQ ID NO: 6618542 - DNA, 18 bp, Homo sapiens
actgatgctgagattctt

SEQ ID NO: 6618543 - DNA, 12 bp, Homo sapiens
actgatgctgcc

SEQ ID NO: 6618544 - DNA, 14 bp, Homo sapiens
actgatgctgcccc

SEQ ID NO: 6618545 - DNA, 15 bp, Homo sapiens
actgatgctgttctc

SEQ ID NO: 6618546 - DNA, 16 bp, Homo sapiens
actgatggaaaatacc

SEQ ID NO: 6618547 - DNA, 20 bp, Homo sapiens
actgatggaccgggtgggcc

SEQ ID NO: 6618548 - DNA, 21 bp, Homo sapiens
actgatggaccgggtgggcct

SEQ ID NO: 6618549 - DNA, 22 bp, Homo sapiens
actgatggctaatgtactgcat

SEQ ID NO: 6618550 - DNA, 15 bp, Homo sapiens
actgatgggaataaa

SEQ ID NO: 6618551 - DNA, 19 bp, Homo sapiens
actgatgggaataaaagta

SEQ ID NO: 6618552 - DNA, 12 bp, Homo sapiens
actgatgggcaa

SEQ ID NO: 6618553 - DNA, 21 bp, Homo sapiens
actgatgggctggggcagggg

SEQ ID NO: 6618554 - DNA, 15 bp, Homo sapiens
actgatgggtcctgc

SEQ ID NO: 6618555 - DNA, 15 bp, Homo sapiens
actgatggttgcttt

SEQ ID NO: 6618556 - DNA, 16 bp, Homo sapiens
actgatggttgctttg

SEQ ID NO: 6618557 - DNA, 17 bp, Homo sapiens
actgatggttgctttga

SEQ ID NO: 6618558 - DNA, 16 bp, Homo sapiens
actgatggtttggaaa

SEQ ID NO: 6618559 - DNA, 18 bp, Homo sapiens
actgatggtttggaaaat

SEQ ID NO: 6618560 - DNA, 19 bp, Homo sapiens
actgatggtttggaaaata

SEQ ID NO: 6618561 - DNA, 21 bp, Homo sapiens
actgatggtttggaaaataac

SEQ ID NO: 6618562 - DNA, 18 bp, Homo sapiens
actgatgtacaattaaaa

SEQ ID NO: 6618563 - DNA, 22 bp, Homo sapiens
actgatgtagaaggcaggattt

SEQ ID NO: 6618564 - DNA, 14 bp, Homo sapiens
actgatgtcatctt

SEQ ID NO: 6618565 - DNA, 15 bp, Homo sapiens
actgatgtcatcttg

SEQ ID NO: 6618566 - DNA, 16 bp, Homo sapiens
actgatgtccctcctt

SEQ ID NO: 6618567 - DNA, 19 bp, Homo sapiens
actgatgtgatattctgtt

SEQ ID NO: 6618568 - DNA, 20 bp, Homo sapiens
actgatgtgtgaagtgagaa

SEQ ID NO: 6618569 - DNA, 23 bp, Homo sapiens
actgatgtgtgaagtgagaactc

SEQ ID NO: 6618570 - DNA, 22 bp, Homo sapiens
actgatgttacatcacagtgtt

SEQ ID NO: 6618571 - DNA, 19 bp, Homo sapiens
actgatgttaggctgggcc

SEQ ID NO: 6618572 - DNA, 22 bp, Homo sapiens
actgatgttaggctgggcccag

SEQ ID NO: 6618573 - DNA, 14 bp, Homo sapiens
actgatgttcatga

SEQ ID NO: 6618574 - DNA, 13 bp, Homo sapiens
actgatgttgtgt

SEQ ID NO: 6618575 - DNA, 21 bp, Homo sapiens
actgatgttgtgttagttaag

SEQ ID NO: 6618576 - DNA, 16 bp, Homo sapiens
actgatgtttgtgcag

SEQ ID NO: 6618577 - DNA, 16 bp, Homo sapiens
actgattaaaaatacc

SEQ ID NO: 6618578 - DNA, 13 bp, Homo sapiens
actgattaaatat

SEQ ID NO: 6618579 - DNA, 14 bp, Homo sapiens
actgattaaatatt

SEQ ID NO: 6618580 - DNA, 17 bp, Homo sapiens
actgattaaatatttga

SEQ ID NO: 6618581 - DNA, 14 bp, Homo sapiens
actgattactgcct

SEQ ID NO: 6618582 - DNA, 15 bp, Homo sapiens
actgattagtattca

SEQ ID NO: 6618583 - DNA, 20 bp, Homo sapiens
actgattatgtcttttatat

SEQ ID NO: 6618584 - DNA, 17 bp, Homo sapiens
actgattattcttctta

SEQ ID NO: 6618585 - DNA, 20 bp, Homo sapiens
actgattattcttcttacat

SEQ ID NO: 6618586 - DNA, 20 bp, Homo sapiens
actgattcacatctcatttt

SEQ ID NO: 6618587 - DNA, 15 bp, Homo sapiens
actgattccagcaag

SEQ ID NO: 6618588 - DNA, 19 bp, Homo sapiens
actgattccctctcccacc

SEQ ID NO: 6618589 - DNA, 17 bp, Homo sapiens
actgattctgtggctta

SEQ ID NO: 6618590 - DNA, 13 bp, Homo sapiens
actgattctgttg

SEQ ID NO: 6618591 - DNA, 14 bp, Homo sapiens
actgattctgttgt

SEQ ID NO: 6618592 - DNA, 19 bp, Homo sapiens
actgattgctcccaggatc

SEQ ID NO: 6618593 - DNA, 21 bp, Homo sapiens
actgattgctcccaggatctc

SEQ ID NO: 6618594 - DNA, 21 bp, Homo sapiens
actgatttacaggacttctct

SEQ ID NO: 6618595 - DNA, 19 bp, Homo sapiens
actgatttagaagcaaaga

SEQ ID NO: 6618596 - DNA, 12 bp, Homo sapiens
actgatttcaga

SEQ ID NO: 6618597 - DNA, 19 bp, Homo sapiens
actgatttccccttttgca

SEQ ID NO: 6618598 - DNA, 22 bp, Homo sapiens
actgatttccccttttgcattc

SEQ ID NO: 6618599 - DNA, 13 bp, Homo sapiens
actgatttccttt

SEQ ID NO: 6618600 - DNA, 12 bp, Homo sapiens
actgatttctat

SEQ ID NO: 6618601 - DNA, 22 bp, Homo sapiens
actgatttgcaataaaaatgat

SEQ ID NO: 6618602 - DNA, 23 bp, Homo sapiens
actgatttgggctgaatgtatgt

SEQ ID NO: 6618603 - DNA, 15 bp, Homo sapiens
actgatttgtggaaa

SEQ ID NO: 6618604 - DNA, 14 bp, Homo sapiens
actgattttaaaat

SEQ ID NO: 6618605 - DNA, 17 bp, Homo sapiens
actgattttaaaatgaa

SEQ ID NO: 6618606 - DNA, 19 bp, Homo sapiens
actgattttaaaatgaata

SEQ ID NO: 6618607 - DNA, 21 bp, Homo sapiens
actgattttaaaatgaataat

SEQ ID NO: 6618608 - DNA, 14 bp, Homo sapiens
actgattttatgga

SEQ ID NO: 6618609 - DNA, 13 bp, Homo sapiens
actgattttgaaa

SEQ ID NO: 6618610 - DNA, 18 bp, Homo sapiens
actgattttgtaaagttg

SEQ ID NO: 6618611 - DNA, 14 bp, Homo sapiens
actgattttgtatg

SEQ ID NO: 6618612 - DNA, 22 bp, Homo sapiens
actgattttgttatttttatat

SEQ ID NO: 6618613 - DNA, 13 bp, Homo sapiens
actgatttttaag

SEQ ID NO: 6618614 - DNA, 15 bp, Homo sapiens
actgatttttaagtc

SEQ ID NO: 6618615 - DNA, 14 bp, Homo sapiens
actgatttttgtaa

SEQ ID NO: 6618616 - DNA, 15 bp, Homo sapiens
actgatttttgtgat

SEQ ID NO: 6618617 - DNA, 16 bp, Homo sapiens
actgatttttttttcc

SEQ ID NO: 6618618 - DNA, 20 bp, Homo sapiens
actgcaaaaaaagcctccaa

SEQ ID NO: 6618619 - DNA, 19 bp, Homo sapiens
actgcaaacaataaacatc

SEQ ID NO: 6618620 - DNA, 15 bp, Homo sapiens
actgcaaacacacct

SEQ ID NO: 6618621 - DNA, 14 bp, Homo sapiens
actgcaaagagacg

SEQ ID NO: 6618622 - DNA, 15 bp, Homo sapiens
actgcaaaggcgcag

SEQ ID NO: 6618623 - DNA, 18 bp, Homo sapiens
actgcaaataaagccttt

SEQ ID NO: 6618624 - DNA, 15 bp, Homo sapiens
actgcaaatggcagt

SEQ ID NO: 6618625 - DNA, 12 bp, Homo sapiens
actgcaacagga

SEQ ID NO: 6618626 - DNA, 19 bp, Homo sapiens
actgcaacctcacctcccg

SEQ ID NO: 6618627 - DNA, 20 bp, Homo sapiens
actgcaacctccacctcccg

SEQ ID NO: 6618628 - DNA, 20 bp, Homo sapiens
actgcaacctccacctcctg

SEQ ID NO: 6618629 - DNA, 16 bp, Homo sapiens
actgcaacctccgcct

SEQ ID NO: 6618630 - DNA, 18 bp, Homo sapiens
actgcaacctccgcctct

SEQ ID NO: 6618631 - DNA, 19 bp, Homo sapiens
actgcaacctccgcctctc

SEQ ID NO: 6618632 - DNA, 22 bp, Homo sapiens
actgcaacctccgcctcttggg

SEQ ID NO: 6618633 - DNA, 14 bp, Homo sapiens
actgcaacctctgc

SEQ ID NO: 6618634 - DNA, 20 bp, Homo sapiens
actgcaacctctgcctcctg

SEQ ID NO: 6618635 - DNA, 21 bp, Homo sapiens
actgcaacctctgcctcctgg

SEQ ID NO: 6618636 - DNA, 22 bp, Homo sapiens
actgcaacctctgcctcctggg

SEQ ID NO: 6618637 - DNA, 23 bp, Homo sapiens
actgcaacctctgcctcctgggt

SEQ ID NO: 6618638 - DNA, 20 bp, Homo sapiens
actgcaacctcttcctcctg

SEQ ID NO: 6618639 - DNA, 22 bp, Homo sapiens
actgcaacctcttcctcctggt

SEQ ID NO: 6618640 - DNA, 20 bp, Homo sapiens
actgcaaccttcgccacctg

SEQ ID NO: 6618641 - DNA, 14 bp, Homo sapiens
actgcaaccttgtt

SEQ ID NO: 6618642 - DNA, 17 bp, Homo sapiens
actgcaaccttgtttat

SEQ ID NO: 6618643 - DNA, 23 bp, Homo sapiens
actgcaactccagcgtcctcagc

SEQ ID NO: 6618644 - DNA, 20 bp, Homo sapiens
actgcaacttgtaaatgtgg

SEQ ID NO: 6618645 - DNA, 16 bp, Homo sapiens
actgcaacttgtgaac

SEQ ID NO: 6618646 - DNA, 18 bp, Homo sapiens
actgcaacttgtgaactc

SEQ ID NO: 6618647 - DNA, 21 bp, Homo sapiens
actgcaacttgtgaactccat

SEQ ID NO: 6618648 - DNA, 23 bp, Homo sapiens
actgcaagaaaggggacccaaga

SEQ ID NO: 6618649 - DNA, 22 bp, Homo sapiens
actgcaagagccaagttccaaa

SEQ ID NO: 6618650 - DNA, 15 bp, Homo sapiens
actgcaagagggggg

SEQ ID NO: 6618651 - DNA, 17 bp, Homo sapiens
actgcaagcatttttcc

SEQ ID NO: 6618652 - DNA, 18 bp, Homo sapiens
actgcaagcatttttcca

SEQ ID NO: 6618653 - DNA, 19 bp, Homo sapiens
actgcaagcatttttccat

SEQ ID NO: 6618654 - DNA, 17 bp, Homo sapiens
actgcaagctccaactc

SEQ ID NO: 6618655 - DNA, 17 bp, Homo sapiens
actgcaagctctgcctc

SEQ ID NO: 6618656 - DNA, 17 bp, Homo sapiens
actgcaagtcacaaagg

SEQ ID NO: 6618657 - DNA, 19 bp, Homo sapiens
actgcaagtccttttgtaa

SEQ ID NO: 6618658 - DNA, 23 bp, Homo sapiens
actgcaagtgtttcttctggctt

SEQ ID NO: 6618659 - DNA, 13 bp, Homo sapiens
actgcaatactaa

SEQ ID NO: 6618660 - DNA, 17 bp, Homo sapiens
actgcaatagagactgt

SEQ ID NO: 6618661 - DNA, 19 bp, Homo sapiens
actgcaatagagactgtag

SEQ ID NO: 6618662 - DNA, 21 bp, Homo sapiens
actgcaatagagactgtagat

SEQ ID NO: 6618663 - DNA, 13 bp, Homo sapiens
actgcaatatcaa

SEQ ID NO: 6618664 - DNA, 14 bp, Homo sapiens
actgcaatcactgt

SEQ ID NO: 6618665 - DNA, 17 bp, Homo sapiens
actgcacacacagctcc

SEQ ID NO: 6618666 - DNA, 15 bp, Homo sapiens
actgcacaccagccc

SEQ ID NO: 6618667 - DNA, 17 bp, Homo sapiens
actgcacagagctctcc

SEQ ID NO: 6618668 - DNA, 14 bp, Homo sapiens
actgcacaggcagc

SEQ ID NO: 6618669 - DNA, 15 bp, Homo sapiens
actgcacagtggcac

SEQ ID NO: 6618670 - DNA, 16 bp, Homo sapiens
actgcacataatttgc

SEQ ID NO: 6618671 - DNA, 21 bp, Homo sapiens
actgcacataatttgcataaa

SEQ ID NO: 6618672 - DNA, 21 bp, Homo sapiens
actgcacatgatttcacaaat

SEQ ID NO: 6618673 - DNA, 22 bp, Homo sapiens
actgcacatgatttcacaaata

SEQ ID NO: 6618674 - DNA, 14 bp, Homo sapiens
actgcaccagcgcc

SEQ ID NO: 6618675 - DNA, 21 bp, Homo sapiens
actgcaccagcgcccccagaa

SEQ ID NO: 6618676 - DNA, 15 bp, Homo sapiens
actgcaccctccaca

SEQ ID NO: 6618677 - DNA, 17 bp, Homo sapiens
actgcaccgcctcaggg

SEQ ID NO: 6618678 - DNA, 14 bp, Homo sapiens
actgcacctgcctc

SEQ ID NO: 6618679 - DNA, 18 bp, Homo sapiens
actgcacctgcctccagc

SEQ ID NO: 6618680 - DNA, 21 bp, Homo sapiens
actgcacctgcctccagccgc

SEQ ID NO: 6618681 - DNA, 16 bp, Homo sapiens
actgcaccttgtgaag

SEQ ID NO: 6618682 - DNA, 14 bp, Homo sapiens
actgcacgttttca

SEQ ID NO: 6618683 - DNA, 13 bp, Homo sapiens
actgcactccagc

SEQ ID NO: 6618684 - DNA, 14 bp, Homo sapiens
actgcactccagcc

SEQ ID NO: 6618685 - DNA, 16 bp, Homo sapiens
actgcactccagcctg

SEQ ID NO: 6618686 - DNA, 17 bp, Homo sapiens
actgcactccagcctgg

SEQ ID NO: 6618687 - DNA, 19 bp, Homo sapiens
actgcactccagcctgggc

SEQ ID NO: 6618688 - DNA, 19 bp, Homo sapiens
actgcactccagcctgggt

SEQ ID NO: 6618689 - DNA, 13 bp, Homo sapiens
actgcactccagt

SEQ ID NO: 6618690 - DNA, 17 bp, Homo sapiens
actgcactctagccgga

SEQ ID NO: 6618691 - DNA, 12 bp, Homo sapiens
actgcactgagt

SEQ ID NO: 6618692 - DNA, 16 bp, Homo sapiens
actgcactgctgtttg

SEQ ID NO: 6618693 - DNA, 13 bp, Homo sapiens
actgcactgtttt

SEQ ID NO: 6618694 - DNA, 16 bp, Homo sapiens
actgcacttagctgtt

SEQ ID NO: 6618695 - DNA, 20 bp, Homo sapiens
actgcacttggtgctgcttt

SEQ ID NO: 6618696 - DNA, 23 bp, Homo sapiens
actgcactttccaatgccacaga

SEQ ID NO: 6618697 - DNA, 16 bp, Homo sapiens
actgcactttccccct

SEQ ID NO: 6618698 - DNA, 19 bp, Homo sapiens
actgcactttgtttagaaa

SEQ ID NO: 6618699 - DNA, 13 bp, Homo sapiens
actgcacttttag

SEQ ID NO: 6618700 - DNA, 19 bp, Homo sapiens
actgcactttttttacttc

SEQ ID NO: 6618701 - DNA, 22 bp, Homo sapiens
actgcagaaacctttaaaaaaa

SEQ ID NO: 6618702 - DNA, 18 bp, Homo sapiens
actgcagaacccccaggt

SEQ ID NO: 6618703 - DNA, 19 bp, Homo sapiens
actgcagaacccccaggtg

SEQ ID NO: 6618704 - DNA, 22 bp, Homo sapiens
actgcagaacccccaggtggcc

SEQ ID NO: 6618705 - DNA, 21 bp, Homo sapiens
actgcagaatacagtaagctg

SEQ ID NO: 6618706 - DNA, 20 bp, Homo sapiens
actgcagacattctcaaagc

SEQ ID NO: 6618707 - DNA, 16 bp, Homo sapiens
actgcagacctgtcct

SEQ ID NO: 6618708 - DNA, 23 bp, Homo sapiens
actgcagacgggaatgcctaggt

SEQ ID NO: 6618709 - DNA, 18 bp, Homo sapiens
actgcagactataaaatc

SEQ ID NO: 6618710 - DNA, 12 bp, Homo sapiens
actgcagagcag

SEQ ID NO: 6618711 - DNA, 13 bp, Homo sapiens
actgcagagcaga

SEQ ID NO: 6618712 - DNA, 15 bp, Homo sapiens
actgcagaggggaaa

SEQ ID NO: 6618713 - DNA, 19 bp, Homo sapiens
actgcagaggggaaagact

SEQ ID NO: 6618714 - DNA, 22 bp, Homo sapiens
actgcagagtaaattgctctgt

SEQ ID NO: 6618715 - DNA, 18 bp, Homo sapiens
actgcagatagcccagga

SEQ ID NO: 6618716 - DNA, 23 bp, Homo sapiens
actgcagatagcccaggagcaac

SEQ ID NO: 6618717 - DNA, 23 bp, Homo sapiens
actgcagattgagacctacaggc

SEQ ID NO: 6618718 - DNA, 15 bp, Homo sapiens
actgcagcacctcca

SEQ ID NO: 6618719 - DNA, 15 bp, Homo sapiens
actgcagcacctgcc

SEQ ID NO: 6618720 - DNA, 14 bp, Homo sapiens
actgcagcagaaaa

SEQ ID NO: 6618721 - DNA, 22 bp, Homo sapiens
actgcagcagaaaggctctgaa

SEQ ID NO: 6618722 - DNA, 15 bp, Homo sapiens
actgcagcatgccca

SEQ ID NO: 6618723 - DNA, 20 bp, Homo sapiens
actgcagccactgattctct

SEQ ID NO: 6618724 - DNA, 12 bp, Homo sapiens
actgcagcccag

SEQ ID NO: 6618725 - DNA, 15 bp, Homo sapiens
actgcagccccctat

SEQ ID NO: 6618726 - DNA, 14 bp, Homo sapiens
actgcagccctctc

SEQ ID NO: 6618727 - DNA, 22 bp, Homo sapiens
actgcagcctcgacctccctgg

SEQ ID NO: 6618728 - DNA, 22 bp, Homo sapiens
actgcagcctgggctccctctt

SEQ ID NO: 6618729 - DNA, 18 bp, Homo sapiens
actgcagcgcgctcctga

SEQ ID NO: 6618730 - DNA, 12 bp, Homo sapiens
actgcagctgct

SEQ ID NO: 6618731 - DNA, 13 bp, Homo sapiens
actgcagctgctg

SEQ ID NO: 6618732 - DNA, 20 bp, Homo sapiens
actgcaggacagtcaaggtg

SEQ ID NO: 6618733 - DNA, 19 bp, Homo sapiens
actgcaggagcagtttgcc

SEQ ID NO: 6618734 - DNA, 19 bp, Homo sapiens
actgcaggcatcacagcta

SEQ ID NO: 6618735 - DNA, 19 bp, Homo sapiens
actgcaggccctggcctcc

SEQ ID NO: 6618736 - DNA, 13 bp, Homo sapiens
actgcagggagga

SEQ ID NO: 6618737 - DNA, 22 bp, Homo sapiens
actgcagggccaggactgagcc

SEQ ID NO: 6618738 - DNA, 17 bp, Homo sapiens
actgcagggctgctgtg

SEQ ID NO: 6618739 - DNA, 18 bp, Homo sapiens
actgcagggctgctgtgg

SEQ ID NO: 6618740 - DNA, 15 bp, Homo sapiens
actgcaggtggcctc

SEQ ID NO: 6618741 - DNA, 18 bp, Homo sapiens
actgcaggtggcctccct

SEQ ID NO: 6618742 - DNA, 20 bp, Homo sapiens
actgcaggtggcctccctcc

SEQ ID NO: 6618743 - DNA, 22 bp, Homo sapiens
actgcaggtggcctccctccag

SEQ ID NO: 6618744 - DNA, 18 bp, Homo sapiens
actgcaggttggacccca

SEQ ID NO: 6618745 - DNA, 19 bp, Homo sapiens
actgcaggttggaccccag

SEQ ID NO: 6618746 - DNA, 20 bp, Homo sapiens
actgcagtcacccctgtctg

SEQ ID NO: 6618747 - DNA, 19 bp, Homo sapiens
actgcagtcacctcttcta

SEQ ID NO: 6618748 - DNA, 19 bp, Homo sapiens
actgcagtcatcaacaatg

SEQ ID NO: 6618749 - DNA, 20 bp, Homo sapiens
actgcagtcatcaacaatga

SEQ ID NO: 6618750 - DNA, 23 bp, Homo sapiens
actgcagtcatcaacaatgatta

SEQ ID NO: 6618751 - DNA, 22 bp, Homo sapiens
actgcagtgaaagacaagctgc

SEQ ID NO: 6618752 - DNA, 15 bp, Homo sapiens
actgcagtttcctgg

SEQ ID NO: 6618753 - DNA, 14 bp, Homo sapiens
actgcatacaatct

SEQ ID NO: 6618754 - DNA, 21 bp, Homo sapiens
actgcatacgttttggtgttg

SEQ ID NO: 6618755 - DNA, 15 bp, Homo sapiens
actgcatactgatcc

SEQ ID NO: 6618756 - DNA, 13 bp, Homo sapiens
actgcatactttt

SEQ ID NO: 6618757 - DNA, 17 bp, Homo sapiens
actgcatactttttaaa

SEQ ID NO: 6618758 - DNA, 18 bp, Homo sapiens
actgcatactttttaaat

SEQ ID NO: 6618759 - DNA, 20 bp, Homo sapiens
actgcatactttttaaatgt

SEQ ID NO: 6618760 - DNA, 19 bp, Homo sapiens
actgcatatagataattat

SEQ ID NO: 6618761 - DNA, 16 bp, Homo sapiens
actgcatcatatattt

SEQ ID NO: 6618762 - DNA, 16 bp, Homo sapiens
actgcatcatctgttt

SEQ ID NO: 6618763 - DNA, 23 bp, Homo sapiens
actgcatcatctgtttgtaatca

SEQ ID NO: 6618764 - DNA, 15 bp, Homo sapiens
actgcatccagcctg

SEQ ID NO: 6618765 - DNA, 14 bp, Homo sapiens
actgcatccaggcc

SEQ ID NO: 6618766 - DNA, 16 bp, Homo sapiens
actgcatccaggcctg

SEQ ID NO: 6618767 - DNA, 20 bp, Homo sapiens
actgcatccaggcctgaggc

SEQ ID NO: 6618768 - DNA, 23 bp, Homo sapiens
actgcatccaggcctgaggctgc

SEQ ID NO: 6618769 - DNA, 22 bp, Homo sapiens
actgcatcctactcctacctgg

SEQ ID NO: 6618770 - DNA, 23 bp, Homo sapiens
actgcatcctccgcctcccgggt

SEQ ID NO: 6618771 - DNA, 15 bp, Homo sapiens
actgcatctcaaaaa

SEQ ID NO: 6618772 - DNA, 17 bp, Homo sapiens
actgcatctcaaaaaaa

SEQ ID NO: 6618773 - DNA, 15 bp, Homo sapiens
actgcatcttagttt

SEQ ID NO: 6618774 - DNA, 20 bp, Homo sapiens
actgcatcttagtttactgg

SEQ ID NO: 6618775 - DNA, 15 bp, Homo sapiens
actgcatgatcttac

SEQ ID NO: 6618776 - DNA, 13 bp, Homo sapiens
actgcatgcaagc

SEQ ID NO: 6618777 - DNA, 16 bp, Homo sapiens
actgcatgcaagctca

SEQ ID NO: 6618778 - DNA, 17 bp, Homo sapiens
actgcatgcaagctcag

SEQ ID NO: 6618779 - DNA, 14 bp, Homo sapiens
actgcatgcacttc

SEQ ID NO: 6618780 - DNA, 18 bp, Homo sapiens
actgcatgcacttcttac

SEQ ID NO: 6618781 - DNA, 22 bp, Homo sapiens
actgcatgcccagagacccagc

SEQ ID NO: 6618782 - DNA, 13 bp, Homo sapiens
actgcatgctgct

SEQ ID NO: 6618783 - DNA, 14 bp, Homo sapiens
actgcatggaccta

SEQ ID NO: 6618784 - DNA, 16 bp, Homo sapiens
actgcatggggaggca

SEQ ID NO: 6618785 - DNA, 15 bp, Homo sapiens
actgcatgtataaat

SEQ ID NO: 6618786 - DNA, 14 bp, Homo sapiens
actgcatgtgactt

SEQ ID NO: 6618787 - DNA, 15 bp, Homo sapiens
actgcatgtgacttc

SEQ ID NO: 6618788 - DNA, 21 bp, Homo sapiens
actgcatgtggcttctctgtc

SEQ ID NO: 6618789 - DNA, 22 bp, Homo sapiens
actgcatgtggcttctctgtct

SEQ ID NO: 6618790 - DNA, 16 bp, Homo sapiens
actgcatgtttgtgat

SEQ ID NO: 6618791 - DNA, 21 bp, Homo sapiens
actgcattaccgcgttgtaaa

SEQ ID NO: 6618792 - DNA, 16 bp, Homo sapiens
actgcattagaaatga

SEQ ID NO: 6618793 - DNA, 16 bp, Homo sapiens
actgcattatcttgct

SEQ ID NO: 6618794 - DNA, 15 bp, Homo sapiens
actgcattattctct

SEQ ID NO: 6618795 - DNA, 20 bp, Homo sapiens
actgcattattctcttttat

SEQ ID NO: 6618796 - DNA, 18 bp, Homo sapiens
actgcattcattctgagc

SEQ ID NO: 6618797 - DNA, 17 bp, Homo sapiens
actgcattcctgtgccc

SEQ ID NO: 6618798 - DNA, 16 bp, Homo sapiens
actgcattcgttgctc

SEQ ID NO: 6618799 - DNA, 18 bp, Homo sapiens
actgcattcgttgctcca

SEQ ID NO: 6618800 - DNA, 20 bp, Homo sapiens
actgcattctctcccatcct

SEQ ID NO: 6618801 - DNA, 16 bp, Homo sapiens
actgcattcttctgat

SEQ ID NO: 6618802 - DNA, 15 bp, Homo sapiens
actgcattgagaact

SEQ ID NO: 6618803 - DNA, 20 bp, Homo sapiens
actgcatttaaatttgattt

SEQ ID NO: 6618804 - DNA, 17 bp, Homo sapiens
actgcatttgcctgctt

SEQ ID NO: 6618805 - DNA, 12 bp, Homo sapiens
actgcatttgtg

SEQ ID NO: 6618806 - DNA, 13 bp, Homo sapiens
actgcatttgtgt

SEQ ID NO: 6618807 - DNA, 15 bp, Homo sapiens
actgcattttcacaa

SEQ ID NO: 6618808 - DNA, 16 bp, Homo sapiens
actgccaaaacaatgc

SEQ ID NO: 6618809 - DNA, 19 bp, Homo sapiens
actgccaaaaccaaattga

SEQ ID NO: 6618810 - DNA, 13 bp, Homo sapiens
actgccaaacatc

SEQ ID NO: 6618811 - DNA, 14 bp, Homo sapiens
actgccaaacctcc

SEQ ID NO: 6618812 - DNA, 17 bp, Homo sapiens
actgccaaacctcctgt

SEQ ID NO: 6618813 - DNA, 19 bp, Homo sapiens
actgccaaacctcctgtca

SEQ ID NO: 6618814 - DNA, 21 bp, Homo sapiens
actgccaaagggaaatatcat

SEQ ID NO: 6618815 - DNA, 15 bp, Homo sapiens
actgccaaataaaat

SEQ ID NO: 6618816 - DNA, 19 bp, Homo sapiens
actgccaaataaaatgttt

SEQ ID NO: 6618817 - DNA, 16 bp, Homo sapiens
actgccaaataaacag

SEQ ID NO: 6618818 - DNA, 19 bp, Homo sapiens
actgccaactgatctgtta

SEQ ID NO: 6618819 - DNA, 20 bp, Homo sapiens
actgccaagaaaaggcatgg

SEQ ID NO: 6618820 - DNA, 18 bp, Homo sapiens
actgccaagactgctgtg

SEQ ID NO: 6618821 - DNA, 15 bp, Homo sapiens
actgccaagccatgg

SEQ ID NO: 6618822 - DNA, 18 bp, Homo sapiens
actgccaagcttcctgtg

SEQ ID NO: 6618823 - DNA, 21 bp, Homo sapiens
actgccaagcttcctgtgccc

SEQ ID NO: 6618824 - DNA, 19 bp, Homo sapiens
actgccaagggcaggacca

SEQ ID NO: 6618825 - DNA, 23 bp, Homo sapiens
actgccaatatagaaaaataaaa

SEQ ID NO: 6618826 - DNA, 12 bp, Homo sapiens
actgccacaagc

SEQ ID NO: 6618827 - DNA, 16 bp, Homo sapiens
actgccacaagcacaa

SEQ ID NO: 6618828 - DNA, 15 bp, Homo sapiens
actgccacaaggaag

SEQ ID NO: 6618829 - DNA, 19 bp, Homo sapiens
actgccacaccctccccat

SEQ ID NO: 6618830 - DNA, 21 bp, Homo sapiens
actgccacactctccatcacc

SEQ ID NO: 6618831 - DNA, 21 bp, Homo sapiens
actgccaccagcaatgccctg

SEQ ID NO: 6618832 - DNA, 12 bp, Homo sapiens
actgccacctcc

SEQ ID NO: 6618833 - DNA, 13 bp, Homo sapiens
actgccacctccc

SEQ ID NO: 6618834 - DNA, 21 bp, Homo sapiens
actgccaccttgggtctgtgt

SEQ ID NO: 6618835 - DNA, 23 bp, Homo sapiens
actgccaccttgtggccgcctga

SEQ ID NO: 6618836 - DNA, 21 bp, Homo sapiens
actgccacgtgccttaggaat

SEQ ID NO: 6618837 - DNA, 17 bp, Homo sapiens
actgccactaaaatcca

SEQ ID NO: 6618838 - DNA, 19 bp, Homo sapiens
actgccactaaaatccacc

SEQ ID NO: 6618839 - DNA, 17 bp, Homo sapiens
actgccactccagtcct

SEQ ID NO: 6618840 - DNA, 14 bp, Homo sapiens
actgccactgtgtg

SEQ ID NO: 6618841 - DNA, 15 bp, Homo sapiens
actgccactgtgtgc

SEQ ID NO: 6618842 - DNA, 15 bp, Homo sapiens
actgccagaagagaa

SEQ ID NO: 6618843 - DNA, 23 bp, Homo sapiens
actgccagaagagaattcagtat

SEQ ID NO: 6618844 - DNA, 22 bp, Homo sapiens
actgccagactgaaccagagct

SEQ ID NO: 6618845 - DNA, 14 bp, Homo sapiens
actgccagatgctg

SEQ ID NO: 6618846 - DNA, 13 bp, Homo sapiens
actgccagcaacg

SEQ ID NO: 6618847 - DNA, 12 bp, Homo sapiens
actgccagcagc

SEQ ID NO: 6618848 - DNA, 14 bp, Homo sapiens
actgccagcagcag

SEQ ID NO: 6618849 - DNA, 16 bp, Homo sapiens
actgccagcagcagca

SEQ ID NO: 6618850 - DNA, 12 bp, Homo sapiens
actgccagcctt

SEQ ID NO: 6618851 - DNA, 17 bp, Homo sapiens
actgccagctcttccta

SEQ ID NO: 6618852 - DNA, 15 bp, Homo sapiens
actgccaggacccca

SEQ ID NO: 6618853 - DNA, 20 bp, Homo sapiens
actgccaggaccccaggtca

SEQ ID NO: 6618854 - DNA, 21 bp, Homo sapiens
actgccaggaccccaggtcag

SEQ ID NO: 6618855 - DNA, 15 bp, Homo sapiens
actgccaggagggac

SEQ ID NO: 6618856 - DNA, 21 bp, Homo sapiens
actgccaggagggacaaagga

SEQ ID NO: 6618857 - DNA, 17 bp, Homo sapiens
actgccaggattttgta

SEQ ID NO: 6618858 - DNA, 18 bp, Homo sapiens
actgccaggattttgtat

SEQ ID NO: 6618859 - DNA, 13 bp, Homo sapiens
actgccaggcacc

SEQ ID NO: 6618860 - DNA, 14 bp, Homo sapiens
actgccaggcacct

SEQ ID NO: 6618861 - DNA, 17 bp, Homo sapiens
actgccaggcacctggc

SEQ ID NO: 6618862 - DNA, 20 bp, Homo sapiens
actgccaggcacctggcctg

SEQ ID NO: 6618863 - DNA, 18 bp, Homo sapiens
actgccaggccagcctcc

SEQ ID NO: 6618864 - DNA, 23 bp, Homo sapiens
actgccaggccagcctccgagag

SEQ ID NO: 6618865 - DNA, 17 bp, Homo sapiens
actgccaggctctcttt

SEQ ID NO: 6618866 - DNA, 15 bp, Homo sapiens
actgccaggctgcct

SEQ ID NO: 6618867 - DNA, 16 bp, Homo sapiens
actgccaggctgcctc

SEQ ID NO: 6618868 - DNA, 21 bp, Homo sapiens
actgccaggctgcctcctgcc

SEQ ID NO: 6618869 - DNA, 13 bp, Homo sapiens
actgccaggctgt

SEQ ID NO: 6618870 - DNA, 22 bp, Homo sapiens
actgccataaaacattaagaaa

SEQ ID NO: 6618871 - DNA, 19 bp, Homo sapiens
actgccataaaatctcacg

SEQ ID NO: 6618872 - DNA, 14 bp, Homo sapiens
actgccatacataa

SEQ ID NO: 6618873 - DNA, 13 bp, Homo sapiens
actgccatatgat

SEQ ID NO: 6618874 - DNA, 19 bp, Homo sapiens
actgccatatgatttacat

SEQ ID NO: 6618875 - DNA, 15 bp, Homo sapiens
actgccatcaaactg

SEQ ID NO: 6618876 - DNA, 14 bp, Homo sapiens
actgccatgccagc

SEQ ID NO: 6618877 - DNA, 21 bp, Homo sapiens
actgccatggaggcacacagc

SEQ ID NO: 6618878 - DNA, 20 bp, Homo sapiens
actgccattagactgaattt

SEQ ID NO: 6618879 - DNA, 17 bp, Homo sapiens
actgccattattttctg

SEQ ID NO: 6618880 - DNA, 22 bp, Homo sapiens
actgccattattttctgtcaga

SEQ ID NO: 6618881 - DNA, 19 bp, Homo sapiens
actgccatttcctcctggg

SEQ ID NO: 6618882 - DNA, 22 bp, Homo sapiens
actgcccacatttgggctcagg

SEQ ID NO: 6618883 - DNA, 16 bp, Homo sapiens
actgcccaccccctca

SEQ ID NO: 6618884 - DNA, 14 bp, Homo sapiens
actgcccaccctgg

SEQ ID NO: 6618885 - DNA, 18 bp, Homo sapiens
actgcccaccctgggcct

SEQ ID NO: 6618886 - DNA, 21 bp, Homo sapiens
actgcccaccctgggcctccc

SEQ ID NO: 6618887 - DNA, 15 bp, Homo sapiens
actgcccacctgcca

SEQ ID NO: 6618888 - DNA, 16 bp, Homo sapiens
actgcccacctgccag

SEQ ID NO: 6618889 - DNA, 17 bp, Homo sapiens
actgcccacctgccagg

SEQ ID NO: 6618890 - DNA, 16 bp, Homo sapiens
actgcccactctgcaa

SEQ ID NO: 6618891 - DNA, 11 bp, Homo sapiens
actgcccagcc

SEQ ID NO: 6618892 - DNA, 23 bp, Homo sapiens
actgcccagcggacagtggcagg

SEQ ID NO: 6618893 - DNA, 16 bp, Homo sapiens
actgcccagtttcttt

SEQ ID NO: 6618894 - DNA, 18 bp, Homo sapiens
actgcccatcccacccca

SEQ ID NO: 6618895 - DNA, 16 bp, Homo sapiens
actgcccatggacagg

SEQ ID NO: 6618896 - DNA, 13 bp, Homo sapiens
actgccccacatg

SEQ ID NO: 6618897 - DNA, 16 bp, Homo sapiens
actgccccacatgcat

SEQ ID NO: 6618898 - DNA, 12 bp, Homo sapiens
actgccccacca

SEQ ID NO: 6618899 - DNA, 17 bp, Homo sapiens
actgccccaccagccac

SEQ ID NO: 6618900 - DNA, 20 bp, Homo sapiens
actgccccacggagacagag

SEQ ID NO: 6618901 - DNA, 18 bp, Homo sapiens
actgccccacggccctgt

SEQ ID NO: 6618902 - DNA, 20 bp, Homo sapiens
actgccccacggccctgtca

SEQ ID NO: 6618903 - DNA, 21 bp, Homo sapiens
actgccccacgttgtccctga

SEQ ID NO: 6618904 - DNA, 16 bp, Homo sapiens
actgccccactatttt

SEQ ID NO: 6618905 - DNA, 14 bp, Homo sapiens
actgccccacttct

SEQ ID NO: 6618906 - DNA, 22 bp, Homo sapiens
actgcccccactgtccccctac

SEQ ID NO: 6618907 - DNA, 16 bp, Homo sapiens
actgcccccagaaagc

SEQ ID NO: 6618908 - DNA, 13 bp, Homo sapiens
actgccccccgag

SEQ ID NO: 6618909 - DNA, 18 bp, Homo sapiens
actgccccccgaggctgc

SEQ ID NO: 6618910 - DNA, 16 bp, Homo sapiens
actgccccctcctgtg

SEQ ID NO: 6618911 - DNA, 17 bp, Homo sapiens
actgccccctcctgtgt

SEQ ID NO: 6618912 - DNA, 18 bp, Homo sapiens
actgccccctctgccctg

SEQ ID NO: 6618913 - DNA, 18 bp, Homo sapiens
actgccccctgctgccat

SEQ ID NO: 6618914 - DNA, 22 bp, Homo sapiens
actgccccgggtgcctcagagc

SEQ ID NO: 6618915 - DNA, 18 bp, Homo sapiens
actgccccgtgcagactg

SEQ ID NO: 6618916 - DNA, 21 bp, Homo sapiens
actgcccctgcacctgcttct

SEQ ID NO: 6618917 - DNA, 14 bp, Homo sapiens
actgcccctgccct

SEQ ID NO: 6618918 - DNA, 15 bp, Homo sapiens
actgcccctgctgtg

SEQ ID NO: 6618919 - DNA, 14 bp, Homo sapiens
actgcccgagctgg

SEQ ID NO: 6618920 - DNA, 20 bp, Homo sapiens
actgcccgagctggtgcatt

SEQ ID NO: 6618921 - DNA, 21 bp, Homo sapiens
actgcccgagctggtgcatta

SEQ ID NO: 6618922 - DNA, 15 bp, Homo sapiens
actgcccggcagggt

SEQ ID NO: 6618923 - DNA, 19 bp, Homo sapiens
actgccctaactgtacatt

SEQ ID NO: 6618924 - DNA, 20 bp, Homo sapiens
actgccctccagctctttcc

SEQ ID NO: 6618925 - DNA, 13 bp, Homo sapiens
actgccctccagg

SEQ ID NO: 6618926 - DNA, 16 bp, Homo sapiens
actgccctccagggcc

SEQ ID NO: 6618927 - DNA, 19 bp, Homo sapiens
actgccctccagggccagg

SEQ ID NO: 6618928 - DNA, 13 bp, Homo sapiens
actgccctcccct

SEQ ID NO: 6618929 - DNA, 15 bp, Homo sapiens
actgccctgcccagg

SEQ ID NO: 6618930 - DNA, 16 bp, Homo sapiens
actgccctgcccaggt

SEQ ID NO: 6618931 - DNA, 13 bp, Homo sapiens
actgccctgcctg

SEQ ID NO: 6618932 - DNA, 15 bp, Homo sapiens
actgccctgcctgcc

SEQ ID NO: 6618933 - DNA, 16 bp, Homo sapiens
actgccctgcctgccc

SEQ ID NO: 6618934 - DNA, 16 bp, Homo sapiens
actgccctggcagcag

SEQ ID NO: 6618935 - DNA, 19 bp, Homo sapiens
actgccctggcagcagcag

SEQ ID NO: 6618936 - DNA, 18 bp, Homo sapiens
actgcccttgctgcccgc

SEQ ID NO: 6618937 - DNA, 18 bp, Homo sapiens
actgccgaccgaggctgg

SEQ ID NO: 6618938 - DNA, 22 bp, Homo sapiens
actgccgaccgaggctggagct

SEQ ID NO: 6618939 - DNA, 23 bp, Homo sapiens
actgccgaccgaggctggagctg

SEQ ID NO: 6618940 - DNA, 15 bp, Homo sapiens
actgccgccttctcg

SEQ ID NO: 6618941 - DNA, 20 bp, Homo sapiens
actgccgctgcccccaccct

SEQ ID NO: 6618942 - DNA, 21 bp, Homo sapiens
actgccggctctagtaccttt

SEQ ID NO: 6618943 - DNA, 15 bp, Homo sapiens
actgcctaagccctc

SEQ ID NO: 6618944 - DNA, 14 bp, Homo sapiens
actgcctactgcat

SEQ ID NO: 6618945 - DNA, 14 bp, Homo sapiens
actgcctagaaaca

SEQ ID NO: 6618946 - DNA, 15 bp, Homo sapiens
actgcctagaaacaa

SEQ ID NO: 6618947 - DNA, 16 bp, Homo sapiens
actgcctagaaacaac

SEQ ID NO: 6618948 - DNA, 19 bp, Homo sapiens
actgcctagaaacaacact

SEQ ID NO: 6618949 - DNA, 23 bp, Homo sapiens
actgcctagaaacaacactgtag

SEQ ID NO: 6618950 - DNA, 20 bp, Homo sapiens
actgcctataatcttataca

SEQ ID NO: 6618951 - DNA, 17 bp, Homo sapiens
actgcctatacccctca

SEQ ID NO: 6618952 - DNA, 16 bp, Homo sapiens
actgcctatatatgta

SEQ ID NO: 6618953 - DNA, 15 bp, Homo sapiens
actgcctattttaat

SEQ ID NO: 6618954 - DNA, 15 bp, Homo sapiens
actgcctcaggttcc

SEQ ID NO: 6618955 - DNA, 16 bp, Homo sapiens
actgcctcaggttcct

SEQ ID NO: 6618956 - DNA, 17 bp, Homo sapiens
actgcctcccatccttc

SEQ ID NO: 6618957 - DNA, 21 bp, Homo sapiens
actgcctccccaaggccccct

SEQ ID NO: 6618958 - DNA, 14 bp, Homo sapiens
actgcctccctctc

SEQ ID NO: 6618959 - DNA, 13 bp, Homo sapiens
actgcctcctccc

SEQ ID NO: 6618960 - DNA, 19 bp, Homo sapiens
actgcctcctccctggctg

SEQ ID NO: 6618961 - DNA, 21 bp, Homo sapiens
actgcctcctccctggctgca

SEQ ID NO: 6618962 - DNA, 22 bp, Homo sapiens
actgcctcctccctggctgcag

SEQ ID NO: 6618963 - DNA, 23 bp, Homo sapiens
actgcctcctgttttctccctct

SEQ ID NO: 6618964 - DNA, 17 bp, Homo sapiens
actgcctcgaaacacag

SEQ ID NO: 6618965 - DNA, 19 bp, Homo sapiens
actgcctcgaaacacagaa

SEQ ID NO: 6618966 - DNA, 16 bp, Homo sapiens
actgcctctatgccct

SEQ ID NO: 6618967 - DNA, 22 bp, Homo sapiens
actgcctctcacagctgagttg

SEQ ID NO: 6618968 - DNA, 19 bp, Homo sapiens
actgcctctccctggccct

SEQ ID NO: 6618969 - DNA, 23 bp, Homo sapiens
actgcctctcggtgacctccgtc

SEQ ID NO: 6618970 - DNA, 12 bp, Homo sapiens
actgcctctgcc

SEQ ID NO: 6618971 - DNA, 14 bp, Homo sapiens
actgcctctgccac

SEQ ID NO: 6618972 - DNA, 14 bp, Homo sapiens
actgcctcttcctc

SEQ ID NO: 6618973 - DNA, 14 bp, Homo sapiens
actgcctgaataaa

SEQ ID NO: 6618974 - DNA, 17 bp, Homo sapiens
actgcctgaataaagag

SEQ ID NO: 6618975 - DNA, 19 bp, Homo sapiens
actgcctgacaattatgaa

SEQ ID NO: 6618976 - DNA, 22 bp, Homo sapiens
actgcctgacaattatgaaaaa

SEQ ID NO: 6618977 - DNA, 17 bp, Homo sapiens
actgcctgatggacctg

SEQ ID NO: 6618978 - DNA, 9 bp, Homo sapiens
actgcctgc

SEQ ID NO: 6618979 - DNA, 15 bp, Homo sapiens
actgcctgcaccttt

SEQ ID NO: 6618980 - DNA, 24 bp, Homo sapiens
actgcctgcagaggtctgtgctga

SEQ ID NO: 6618981 - DNA, 14 bp, Homo sapiens
actgcctgcagctg

SEQ ID NO: 6618982 - DNA, 15 bp, Homo sapiens
actgcctgcagctga

SEQ ID NO: 6618983 - DNA, 19 bp, Homo sapiens
actgcctgcatgagctggc

SEQ ID NO: 6618984 - DNA, 21 bp, Homo sapiens
actgcctgcatgagctggcaa

SEQ ID NO: 6618985 - DNA, 13 bp, Homo sapiens
actgcctgccaag

SEQ ID NO: 6618986 - DNA, 19 bp, Homo sapiens
actgcctgcccacccgtgg

SEQ ID NO: 6618987 - DNA, 20 bp, Homo sapiens
actgcctgcctcccctccgc

SEQ ID NO: 6618988 - DNA, 16 bp, Homo sapiens
actgcctggaggatag

SEQ ID NO: 6618989 - DNA, 16 bp, Homo sapiens
actgcctggcctggca

SEQ ID NO: 6618990 - DNA, 17 bp, Homo sapiens
actgcctggcctggcac

SEQ ID NO: 6618991 - DNA, 11 bp, Homo sapiens
actgcctgggc

SEQ ID NO: 6618992 - DNA, 14 bp, Homo sapiens
actgcctgggctcc

SEQ ID NO: 6618993 - DNA, 14 bp, Homo sapiens
actgcctgtatact

SEQ ID NO: 6618994 - DNA, 17 bp, Homo sapiens
actgcctgtatacttta

SEQ ID NO: 6618995 - DNA, 19 bp, Homo sapiens
actgcctgtatactttagt

SEQ ID NO: 6618996 - DNA, 11 bp, Homo sapiens
actgccttcca

SEQ ID NO: 6618997 - DNA, 12 bp, Homo sapiens
actgccttccag

SEQ ID NO: 6618998 - DNA, 15 bp, Homo sapiens
actgccttcgcttct

SEQ ID NO: 6618999 - DNA, 13 bp, Homo sapiens
actgccttctcaa

SEQ ID NO: 6619000 - DNA, 23 bp, Homo sapiens
actgccttctcctctctgggcct

SEQ ID NO: 6619001 - DNA, 14 bp, Homo sapiens
actgccttgaaaaa

SEQ ID NO: 6619002 - DNA, 18 bp, Homo sapiens
actgccttgaaaaatgac

SEQ ID NO: 6619003 - DNA, 21 bp, Homo sapiens
actgccttgaaaaatgacaat

SEQ ID NO: 6619004 - DNA, 21 bp, Homo sapiens
actgccttgaacctgtgagta

SEQ ID NO: 6619005 - DNA, 21 bp, Homo sapiens
actgccttgaatatcccctcc

SEQ ID NO: 6619006 - DNA, 22 bp, Homo sapiens
actgccttgaatatcccctccc

SEQ ID NO: 6619007 - DNA, 21 bp, Homo sapiens
actgccttgctagaaacataa

SEQ ID NO: 6619008 - DNA, 15 bp, Homo sapiens
actgccttggcccct

SEQ ID NO: 6619009 - DNA, 18 bp, Homo sapiens
actgccttggcttcaggg

SEQ ID NO: 6619010 - DNA, 20 bp, Homo sapiens
actgccttgggcaaggacac

SEQ ID NO: 6619011 - DNA, 14 bp, Homo sapiens
actgccttgtactt

SEQ ID NO: 6619012 - DNA, 13 bp, Homo sapiens
actgcctttagaa

SEQ ID NO: 6619013 - DNA, 21 bp, Homo sapiens
actgcctttcaaagtgcacac

SEQ ID NO: 6619014 - DNA, 23 bp, Homo sapiens
actgcctttcaaagtgcacacac

SEQ ID NO: 6619015 - DNA, 14 bp, Homo sapiens
actgcctttctgct

SEQ ID NO: 6619016 - DNA, 12 bp, Homo sapiens
actgcctttgga

SEQ ID NO: 6619017 - DNA, 20 bp, Homo sapiens
actgcctttttatttatatg

SEQ ID NO: 6619018 - DNA, 19 bp, Homo sapiens
actgcgaggacatcaaagt

SEQ ID NO: 6619019 - DNA, 17 bp, Homo sapiens
actgcgaggttgtttta

SEQ ID NO: 6619020 - DNA, 14 bp, Homo sapiens
actgcgataactga

SEQ ID NO: 6619021 - DNA, 16 bp, Homo sapiens
actgcgataactgaga

SEQ ID NO: 6619022 - DNA, 13 bp, Homo sapiens
actgcgcaggtct

SEQ ID NO: 6619023 - DNA, 17 bp, Homo sapiens
actgcgcaggtctcttc

SEQ ID NO: 6619024 - DNA, 19 bp, Homo sapiens
actgcgcaggtctcttctg

SEQ ID NO: 6619025 - DNA, 19 bp, Homo sapiens
actgcgccccgcctgacct

SEQ ID NO: 6619026 - DNA, 16 bp, Homo sapiens
actgcgcccggcccaa

SEQ ID NO: 6619027 - DNA, 17 bp, Homo sapiens
actgcgcccgggcaaga

SEQ ID NO: 6619028 - DNA, 15 bp, Homo sapiens
actgcggaagccaaa

SEQ ID NO: 6619029 - DNA, 23 bp, Homo sapiens
actgcggagaaccttgtgcctgg

SEQ ID NO: 6619030 - DNA, 15 bp, Homo sapiens
actgcggagcagcct

SEQ ID NO: 6619031 - DNA, 21 bp, Homo sapiens
actgcggggagacagaagcct

SEQ ID NO: 6619032 - DNA, 15 bp, Homo sapiens
actgcgtccaccctg

SEQ ID NO: 6619033 - DNA, 16 bp, Homo sapiens
actgcgtccaccctga

SEQ ID NO: 6619034 - DNA, 19 bp, Homo sapiens
actgcgtccaccctgagct

SEQ ID NO: 6619035 - DNA, 14 bp, Homo sapiens
actgcgttagatgg

SEQ ID NO: 6619036 - DNA, 15 bp, Homo sapiens
actgctaaataaaat

SEQ ID NO: 6619037 - DNA, 19 bp, Homo sapiens
actgctaaataaaatttgt

SEQ ID NO: 6619038 - DNA, 22 bp, Homo sapiens
actgctaaatactgtacataga

SEQ ID NO: 6619039 - DNA, 15 bp, Homo sapiens
actgctaaatcctca

SEQ ID NO: 6619040 - DNA, 14 bp, Homo sapiens
actgctaaggctgc

SEQ ID NO: 6619041 - DNA, 21 bp, Homo sapiens
actgctaaggctgctggcttc

SEQ ID NO: 6619042 - DNA, 17 bp, Homo sapiens
actgctaagtatttccc

SEQ ID NO: 6619043 - DNA, 19 bp, Homo sapiens
actgctaataaatgaccag

SEQ ID NO: 6619044 - DNA, 21 bp, Homo sapiens
actgctaataaatgaccagtt

SEQ ID NO: 6619045 - DNA, 10 bp, Homo sapiens
actgctacac

SEQ ID NO: 6619046 - DNA, 14 bp, Homo sapiens
actgctacctctga

SEQ ID NO: 6619047 - DNA, 16 bp, Homo sapiens
actgctaccttcctag

SEQ ID NO: 6619048 - DNA, 19 bp, Homo sapiens
actgctacctttcaaagct

SEQ ID NO: 6619049 - DNA, 16 bp, Homo sapiens
actgctacttgctctg

SEQ ID NO: 6619050 - DNA, 19 bp, Homo sapiens
actgctacttgctctgctc

SEQ ID NO: 6619051 - DNA, 18 bp, Homo sapiens
actgctagagacgctgat

SEQ ID NO: 6619052 - DNA, 20 bp, Homo sapiens
actgctaggcgagtgccagg

SEQ ID NO: 6619053 - DNA, 23 bp, Homo sapiens
actgctaggtgggccagcccctc

SEQ ID NO: 6619054 - DNA, 19 bp, Homo sapiens
actgctagtcttaagaact

SEQ ID NO: 6619055 - DNA, 16 bp, Homo sapiens
actgctatcagtctct

SEQ ID NO: 6619056 - DNA, 19 bp, Homo sapiens
actgctatctactaagttt

SEQ ID NO: 6619057 - DNA, 22 bp, Homo sapiens
actgctattctagagcttttat

SEQ ID NO: 6619058 - DNA, 12 bp, Homo sapiens
actgctattttt

SEQ ID NO: 6619059 - DNA, 18 bp, Homo sapiens
actgctattttttttaaa

SEQ ID NO: 6619060 - DNA, 21 bp, Homo sapiens
actgctattttttttaaatca

SEQ ID NO: 6619061 - DNA, 15 bp, Homo sapiens
actgctcacgtctct

SEQ ID NO: 6619062 - DNA, 17 bp, Homo sapiens
actgctcagctctggtc

SEQ ID NO: 6619063 - DNA, 21 bp, Homo sapiens
actgctcaggctccccaagac

SEQ ID NO: 6619064 - DNA, 18 bp, Homo sapiens
actgctcaggctgcagct

SEQ ID NO: 6619065 - DNA, 23 bp, Homo sapiens
actgctcatcattccttgagaaa

SEQ ID NO: 6619066 - DNA, 20 bp, Homo sapiens
actgctcatctgtacatact

SEQ ID NO: 6619067 - DNA, 16 bp, Homo sapiens
actgctccaagggaca

SEQ ID NO: 6619068 - DNA, 12 bp, Homo sapiens
actgctccaagt

SEQ ID NO: 6619069 - DNA, 20 bp, Homo sapiens
actgctccagcctctgccgc

SEQ ID NO: 6619070 - DNA, 22 bp, Homo sapiens
actgctccagcctctgccgctg

SEQ ID NO: 6619071 - DNA, 22 bp, Homo sapiens
actgctccagtttcacctcttt

SEQ ID NO: 6619072 - DNA, 15 bp, Homo sapiens
actgctcccacctcc

SEQ ID NO: 6619073 - DNA, 20 bp, Homo sapiens
actgctccccagccctggct

SEQ ID NO: 6619074 - DNA, 20 bp, Homo sapiens
actgctcccggcccgcctgc

SEQ ID NO: 6619075 - DNA, 22 bp, Homo sapiens
actgctcccggcccgcctgccc

SEQ ID NO: 6619076 - DNA, 23 bp, Homo sapiens
actgctccctaagccagcctggt

SEQ ID NO: 6619077 - DNA, 16 bp, Homo sapiens
actgctccctacccca

SEQ ID NO: 6619078 - DNA, 22 bp, Homo sapiens
actgctccctgaagccagcctt

SEQ ID NO: 6619079 - DNA, 14 bp, Homo sapiens
actgctccgtggag

SEQ ID NO: 6619080 - DNA, 12 bp, Homo sapiens
actgctcctcct

SEQ ID NO: 6619081 - DNA, 13 bp, Homo sapiens
actgctcctcctc

SEQ ID NO: 6619082 - DNA, 18 bp, Homo sapiens
actgctcctgagccccca

SEQ ID NO: 6619083 - DNA, 21 bp, Homo sapiens
actgctcctgagcccccagct

SEQ ID NO: 6619084 - DNA, 12 bp, Homo sapiens
actgctcctggg

SEQ ID NO: 6619085 - DNA, 14 bp, Homo sapiens
actgctcctgggca

SEQ ID NO: 6619086 - DNA, 13 bp, Homo sapiens
actgctcctgtgg

SEQ ID NO: 6619087 - DNA, 15 bp, Homo sapiens
actgctcctgtggca

SEQ ID NO: 6619088 - DNA, 17 bp, Homo sapiens
actgctcctgtggcagg

SEQ ID NO: 6619089 - DNA, 22 bp, Homo sapiens
actgctctactttgagaagatg

SEQ ID NO: 6619090 - DNA, 14 bp, Homo sapiens
actgctctcaaaat

SEQ ID NO: 6619091 - DNA, 14 bp, Homo sapiens
actgctctcagcct

SEQ ID NO: 6619092 - DNA, 15 bp, Homo sapiens
actgctcttgtttct

SEQ ID NO: 6619093 - DNA, 17 bp, Homo sapiens
actgctgaaaaagaaaa

SEQ ID NO: 6619094 - DNA, 22 bp, Homo sapiens
actgctgaaaaagaaaaaaatg

SEQ ID NO: 6619095 - DNA, 17 bp, Homo sapiens
actgctgaagccagttg

SEQ ID NO: 6619096 - DNA, 13 bp, Homo sapiens
actgctgagccac

SEQ ID NO: 6619097 - DNA, 14 bp, Homo sapiens
actgctgagccact

SEQ ID NO: 6619098 - DNA, 12 bp, Homo sapiens
actgctgagctg

SEQ ID NO: 6619099 - DNA, 19 bp, Homo sapiens
actgctgaggagtctgagg

SEQ ID NO: 6619100 - DNA, 15 bp, Homo sapiens
actgctgaggtcccg

SEQ ID NO: 6619101 - DNA, 19 bp, Homo sapiens
actgctgaggtcccgggct

SEQ ID NO: 6619102 - DNA, 18 bp, Homo sapiens
actgctgatcaatgaaat

SEQ ID NO: 6619103 - DNA, 19 bp, Homo sapiens
actgctgatcgtagaaaat

SEQ ID NO: 6619104 - DNA, 14 bp, Homo sapiens
actgctgattcttg

SEQ ID NO: 6619105 - DNA, 23 bp, Homo sapiens
actgctgattcttgtaaatcttt

SEQ ID NO: 6619106 - DNA, 16 bp, Homo sapiens
actgctgcaaagcttt

SEQ ID NO: 6619107 - DNA, 15 bp, Homo sapiens
actgctgcaaggtgg

SEQ ID NO: 6619108 - DNA, 12 bp, Homo sapiens
actgctgcacca

SEQ ID NO: 6619109 - DNA, 17 bp, Homo sapiens
actgctgccactgaggg

SEQ ID NO: 6619110 - DNA, 20 bp, Homo sapiens
actgctgccatttttgcaaa

SEQ ID NO: 6619111 - DNA, 19 bp, Homo sapiens
actgctgccccaaaggaag

SEQ ID NO: 6619112 - DNA, 17 bp, Homo sapiens
actgctgcgctgtgctg

SEQ ID NO: 6619113 - DNA, 22 bp, Homo sapiens
actgctgcgtcattacagggca

SEQ ID NO: 6619114 - DNA, 13 bp, Homo sapiens
actgctgctactg

SEQ ID NO: 6619115 - DNA, 22 bp, Homo sapiens
actgctgctactgcccctctcc

SEQ ID NO: 6619116 - DNA, 16 bp, Homo sapiens
actgctgctccccacc

SEQ ID NO: 6619117 - DNA, 15 bp, Homo sapiens
actgctgctcctctt

SEQ ID NO: 6619118 - DNA, 18 bp, Homo sapiens
actgctgctctcccaagg

SEQ ID NO: 6619119 - DNA, 22 bp, Homo sapiens
actgctgctgacccctgtgtga

SEQ ID NO: 6619120 - DNA, 15 bp, Homo sapiens
actgctgctgtgctt

SEQ ID NO: 6619121 - DNA, 17 bp, Homo sapiens
actgctgcttaaaatgc

SEQ ID NO: 6619122 - DNA, 15 bp, Homo sapiens
actgctgcttgtcaa

SEQ ID NO: 6619123 - DNA, 20 bp, Homo sapiens
actgctggacgtctttcttt

SEQ ID NO: 6619124 - DNA, 22 bp, Homo sapiens
actgctggagaggccccagccg

SEQ ID NO: 6619125 - DNA, 16 bp, Homo sapiens
actgctggaggcagcg

SEQ ID NO: 6619126 - DNA, 21 bp, Homo sapiens
actgctggaggcagcgctggt

SEQ ID NO: 6619127 - DNA, 22 bp, Homo sapiens
actgctggaggcagcgctggtc

SEQ ID NO: 6619128 - DNA, 20 bp, Homo sapiens
actgctggagtctggcttta

SEQ ID NO: 6619129 - DNA, 21 bp, Homo sapiens
actgctggagtctggctttac

SEQ ID NO: 6619130 - DNA, 11 bp, Homo sapiens
actgctggctc

SEQ ID NO: 6619131 - DNA, 12 bp, Homo sapiens
actgctggctgc

SEQ ID NO: 6619132 - DNA, 18 bp, Homo sapiens
actgctggggctggtgag

SEQ ID NO: 6619133 - DNA, 17 bp, Homo sapiens
actgctgggtggcccat

SEQ ID NO: 6619134 - DNA, 15 bp, Homo sapiens
actgctgtaaaatta

SEQ ID NO: 6619135 - DNA, 13 bp, Homo sapiens
actgctgtaccca

SEQ ID NO: 6619136 - DNA, 20 bp, Homo sapiens
actgctgtcaataaatgaca

SEQ ID NO: 6619137 - DNA, 14 bp, Homo sapiens
actgctgtcagcca

SEQ ID NO: 6619138 - DNA, 22 bp, Homo sapiens
actgctgtcattgtccatgcct

SEQ ID NO: 6619139 - DNA, 23 bp, Homo sapiens
actgctgtccacatgacctccat

SEQ ID NO: 6619140 - DNA, 22 bp, Homo sapiens
actgctgtcctctcccccttca

SEQ ID NO: 6619141 - DNA, 23 bp, Homo sapiens
actgctgtcctctcccccttcag

SEQ ID NO: 6619142 - DNA, 15 bp, Homo sapiens
actgctgtcttccaa

SEQ ID NO: 6619143 - DNA, 16 bp, Homo sapiens
actgctgtgaacaagt

SEQ ID NO: 6619144 - DNA, 15 bp, Homo sapiens
actgctgtgaacatg

SEQ ID NO: 6619145 - DNA, 18 bp, Homo sapiens
actgctgtgaacatgcct

SEQ ID NO: 6619146 - DNA, 23 bp, Homo sapiens
actgctgtgaacatgcctcctcc

SEQ ID NO: 6619147 - DNA, 18 bp, Homo sapiens
actgctgtgagtgcgcct

SEQ ID NO: 6619148 - DNA, 15 bp, Homo sapiens
actgctgtggccagg

SEQ ID NO: 6619149 - DNA, 18 bp, Homo sapiens
actgctgtggccaggagg

SEQ ID NO: 6619150 - DNA, 15 bp, Homo sapiens
actgctgtggccccc

SEQ ID NO: 6619151 - DNA, 18 bp, Homo sapiens
actgctgttatatttcat

SEQ ID NO: 6619152 - DNA, 16 bp, Homo sapiens
actgctgttcccctct

SEQ ID NO: 6619153 - DNA, 13 bp, Homo sapiens
actgctgttcctg

SEQ ID NO: 6619154 - DNA, 20 bp, Homo sapiens
actgctgttcctgctccatg

SEQ ID NO: 6619155 - DNA, 14 bp, Homo sapiens
actgctgtttcacg

SEQ ID NO: 6619156 - DNA, 13 bp, Homo sapiens
actgctgttttat

SEQ ID NO: 6619157 - DNA, 16 bp, Homo sapiens
actgcttaattgctga

SEQ ID NO: 6619158 - DNA, 17 bp, Homo sapiens
actgcttatgaaaagta

SEQ ID NO: 6619159 - DNA, 18 bp, Homo sapiens
actgcttattttatgata

SEQ ID NO: 6619160 - DNA, 22 bp, Homo sapiens
actgcttcacggactctttgct

SEQ ID NO: 6619161 - DNA, 13 bp, Homo sapiens
actgcttcatgta

SEQ ID NO: 6619162 - DNA, 19 bp, Homo sapiens
actgcttcccatcctaccc

SEQ ID NO: 6619163 - DNA, 21 bp, Homo sapiens
actgcttcccttactttgctg

SEQ ID NO: 6619164 - DNA, 21 bp, Homo sapiens
actgcttcctataattttgat

SEQ ID NO: 6619165 - DNA, 22 bp, Homo sapiens
actgcttcctataattttgata

SEQ ID NO: 6619166 - DNA, 19 bp, Homo sapiens
actgcttctaagatgccag

SEQ ID NO: 6619167 - DNA, 22 bp, Homo sapiens
actgcttctagaaactctggct

SEQ ID NO: 6619168 - DNA, 23 bp, Homo sapiens
actgcttctcggaggccaggccc

SEQ ID NO: 6619169 - DNA, 17 bp, Homo sapiens
actgcttctcggccagc

SEQ ID NO: 6619170 - DNA, 14 bp, Homo sapiens
actgcttctctgca

SEQ ID NO: 6619171 - DNA, 21 bp, Homo sapiens
actgcttctctttgtgcagtg

SEQ ID NO: 6619172 - DNA, 16 bp, Homo sapiens
actgcttctcttttga

SEQ ID NO: 6619173 - DNA, 14 bp, Homo sapiens
actgcttctgcttt

SEQ ID NO: 6619174 - DNA, 16 bp, Homo sapiens
actgcttcttggagct

SEQ ID NO: 6619175 - DNA, 21 bp, Homo sapiens
actgcttcttggagctttgga

SEQ ID NO: 6619176 - DNA, 13 bp, Homo sapiens
actgcttgaataa

SEQ ID NO: 6619177 - DNA, 14 bp, Homo sapiens
actgcttgacaaag

SEQ ID NO: 6619178 - DNA, 15 bp, Homo sapiens
actgcttgacaaagg

SEQ ID NO: 6619179 - DNA, 16 bp, Homo sapiens
actgcttgacaaagga

SEQ ID NO: 6619180 - DNA, 15 bp, Homo sapiens
actgcttgaggaaaa

SEQ ID NO: 6619181 - DNA, 22 bp, Homo sapiens
actgcttgaggaggggcacctg

SEQ ID NO: 6619182 - DNA, 16 bp, Homo sapiens
actgcttgatgaagca

SEQ ID NO: 6619183 - DNA, 18 bp, Homo sapiens
actgcttgatgaagcaag

SEQ ID NO: 6619184 - DNA, 16 bp, Homo sapiens
actgcttgcatttctt

SEQ ID NO: 6619185 - DNA, 19 bp, Homo sapiens
actgcttgcatttctttat

SEQ ID NO: 6619186 - DNA, 23 bp, Homo sapiens
actgcttggatccatacaaaact

SEQ ID NO: 6619187 - DNA, 16 bp, Homo sapiens
actgcttgtgttttta

SEQ ID NO: 6619188 - DNA, 18 bp, Homo sapiens
actgcttgtgtttttaac

SEQ ID NO: 6619189 - DNA, 14 bp, Homo sapiens
actgctttatccag

SEQ ID NO: 6619190 - DNA, 16 bp, Homo sapiens
actgctttcaacttaa

SEQ ID NO: 6619191 - DNA, 14 bp, Homo sapiens
actgctttcagtgc

SEQ ID NO: 6619192 - DNA, 17 bp, Homo sapiens
actgctttcagtgcctg

SEQ ID NO: 6619193 - DNA, 18 bp, Homo sapiens
actgctttcagtgcctgc

SEQ ID NO: 6619194 - DNA, 20 bp, Homo sapiens
actgctttcagtgcctgctg

SEQ ID NO: 6619195 - DNA, 17 bp, Homo sapiens
actgctttccagcctgg

SEQ ID NO: 6619196 - DNA, 14 bp, Homo sapiens
actgctttctgttc

SEQ ID NO: 6619197 - DNA, 22 bp, Homo sapiens
actgctttgggatttaatttcc

SEQ ID NO: 6619198 - DNA, 23 bp, Homo sapiens
actgctttgggatttaatttcca

SEQ ID NO: 6619199 - DNA, 19 bp, Homo sapiens
actgctttggtctcttctt

SEQ ID NO: 6619200 - DNA, 12 bp, Homo sapiens
actgctttgtag

SEQ ID NO: 6619201 - DNA, 16 bp, Homo sapiens
actgcttttaaatgac

SEQ ID NO: 6619202 - DNA, 19 bp, Homo sapiens
actgcttttcattagcagt

SEQ ID NO: 6619203 - DNA, 15 bp, Homo sapiens
actgcttttggtctg

SEQ ID NO: 6619204 - DNA, 18 bp, Homo sapiens
actgcttttttttttcca

SEQ ID NO: 6619205 - DNA, 13 bp, Homo sapiens
actggaaaaatga

SEQ ID NO: 6619206 - DNA, 18 bp, Homo sapiens
actggaaaaatgaactgt

SEQ ID NO: 6619207 - DNA, 12 bp, Homo sapiens
actggaaaacat

SEQ ID NO: 6619208 - DNA, 22 bp, Homo sapiens
actggaaaaggtgaaaatgttt

SEQ ID NO: 6619209 - DNA, 12 bp, Homo sapiens
actggaaaagtt

SEQ ID NO: 6619210 - DNA, 16 bp, Homo sapiens
actggaaacaaggaag

SEQ ID NO: 6619211 - DNA, 15 bp, Homo sapiens
actggaaacatctga

SEQ ID NO: 6619212 - DNA, 15 bp, Homo sapiens
actggaaacctgtta

SEQ ID NO: 6619213 - DNA, 21 bp, Homo sapiens
actggaaacctgttatgccaa

SEQ ID NO: 6619214 - DNA, 18 bp, Homo sapiens
actggaaaggatctgtga

SEQ ID NO: 6619215 - DNA, 23 bp, Homo sapiens
actggaaaggatctgtgattggc

SEQ ID NO: 6619216 - DNA, 22 bp, Homo sapiens
actggaaaggggagagcctgct

SEQ ID NO: 6619217 - DNA, 18 bp, Homo sapiens
actggaaatgtagcactt

SEQ ID NO: 6619218 - DNA, 22 bp, Homo sapiens
actggaaatgtttgtccttgca

SEQ ID NO: 6619219 - DNA, 16 bp, Homo sapiens
actggaacactagaca

SEQ ID NO: 6619220 - DNA, 15 bp, Homo sapiens
actggaacagcccat

SEQ ID NO: 6619221 - DNA, 17 bp, Homo sapiens
actggaacatggctagc

SEQ ID NO: 6619222 - DNA, 16 bp, Homo sapiens
actggaaccagggaga

SEQ ID NO: 6619223 - DNA, 22 bp, Homo sapiens
actggaacccttttaaagttga

SEQ ID NO: 6619224 - DNA, 16 bp, Homo sapiens
actggaacctccctgg

SEQ ID NO: 6619225 - DNA, 21 bp, Homo sapiens
actggaacggtgaaggtgaca

SEQ ID NO: 6619226 - DNA, 20 bp, Homo sapiens
actggaactgcaactccagc

SEQ ID NO: 6619227 - DNA, 21 bp, Homo sapiens
actggaactgcaactccagcg

SEQ ID NO: 6619228 - DNA, 18 bp, Homo sapiens
actggaacttgaactgat

SEQ ID NO: 6619229 - DNA, 13 bp, Homo sapiens
actggaagaaagc

SEQ ID NO: 6619230 - DNA, 16 bp, Homo sapiens
actggaagacacttca

SEQ ID NO: 6619231 - DNA, 15 bp, Homo sapiens
actggaagcacagct

SEQ ID NO: 6619232 - DNA, 16 bp, Homo sapiens
actggaagcacagctt

SEQ ID NO: 6619233 - DNA, 17 bp, Homo sapiens
actggaagcacagcttc

SEQ ID NO: 6619234 - DNA, 17 bp, Homo sapiens
actggaaggctgctttc

SEQ ID NO: 6619235 - DNA, 19 bp, Homo sapiens
actggaagttcatacctaa

SEQ ID NO: 6619236 - DNA, 23 bp, Homo sapiens
actggaataagaagcaaataaat

SEQ ID NO: 6619237 - DNA, 13 bp, Homo sapiens
actggaataatat

SEQ ID NO: 6619238 - DNA, 16 bp, Homo sapiens
actggaatttattatg

SEQ ID NO: 6619239 - DNA, 20 bp, Homo sapiens
actggacaacactgattcct

SEQ ID NO: 6619240 - DNA, 12 bp, Homo sapiens
actggacagacc

SEQ ID NO: 6619241 - DNA, 13 bp, Homo sapiens
actggacagaccc

SEQ ID NO: 6619242 - DNA, 21 bp, Homo sapiens
actggacagacccaggtcttc

SEQ ID NO: 6619243 - DNA, 13 bp, Homo sapiens
actggacagcatc

SEQ ID NO: 6619244 - DNA, 13 bp, Homo sapiens
actggacagccag

SEQ ID NO: 6619245 - DNA, 13 bp, Homo sapiens
actggacagcctc

SEQ ID NO: 6619246 - DNA, 13 bp, Homo sapiens
actggacagcggt

SEQ ID NO: 6619247 - DNA, 14 bp, Homo sapiens
actggacagcttgt

SEQ ID NO: 6619248 - DNA, 13 bp, Homo sapiens
actggacatcaca

SEQ ID NO: 6619249 - DNA, 20 bp, Homo sapiens
actggacatcacagcagaat

SEQ ID NO: 6619250 - DNA, 13 bp, Homo sapiens
actggacatgaag

SEQ ID NO: 6619251 - DNA, 15 bp, Homo sapiens
actggacatgaagga

SEQ ID NO: 6619252 - DNA, 21 bp, Homo sapiens
actggacatttaacttttcta

SEQ ID NO: 6619253 - DNA, 20 bp, Homo sapiens
actggaccactgggcaatga

SEQ ID NO: 6619254 - DNA, 15 bp, Homo sapiens
actggaccccactgg

SEQ ID NO: 6619255 - DNA, 13 bp, Homo sapiens
actggaccccagc

SEQ ID NO: 6619256 - DNA, 17 bp, Homo sapiens
actggaccctgttgcta

SEQ ID NO: 6619257 - DNA, 15 bp, Homo sapiens
actggacctgggggt

SEQ ID NO: 6619258 - DNA, 17 bp, Homo sapiens
actggacgcccagctga

SEQ ID NO: 6619259 - DNA, 22 bp, Homo sapiens
actggacgcccagctgaggctg

SEQ ID NO: 6619260 - DNA, 16 bp, Homo sapiens
actggactaagtggaa

SEQ ID NO: 6619261 - DNA, 15 bp, Homo sapiens
actggactcacattc

SEQ ID NO: 6619262 - DNA, 23 bp, Homo sapiens
actggactcaggatgcccagggc

SEQ ID NO: 6619263 - DNA, 19 bp, Homo sapiens
actggactccggccctcct

SEQ ID NO: 6619264 - DNA, 21 bp, Homo sapiens
actggactgggttttgtctct

SEQ ID NO: 6619265 - DNA, 14 bp, Homo sapiens
actggactgtctga

SEQ ID NO: 6619266 - DNA, 21 bp, Homo sapiens
actggacttcccaagataaat

SEQ ID NO: 6619267 - DNA, 14 bp, Homo sapiens
actggagaaaatgg

SEQ ID NO: 6619268 - DNA, 17 bp, Homo sapiens
actggagaagtcttaga

SEQ ID NO: 6619269 - DNA, 17 bp, Homo sapiens
actggagaggctagaac

SEQ ID NO: 6619270 - DNA, 23 bp, Homo sapiens
actggagagtggcaaaagtctga

SEQ ID NO: 6619271 - DNA, 23 bp, Homo sapiens
actggagatgcatcgggaaagaa

SEQ ID NO: 6619272 - DNA, 19 bp, Homo sapiens
actggagcaccaggcacga

SEQ ID NO: 6619273 - DNA, 18 bp, Homo sapiens
actggagcatctgactca

SEQ ID NO: 6619274 - DNA, 20 bp, Homo sapiens
actggagccacaggcagggg

SEQ ID NO: 6619275 - DNA, 13 bp, Homo sapiens
actggagcccagg

SEQ ID NO: 6619276 - DNA, 14 bp, Homo sapiens
actggagcccagga

SEQ ID NO: 6619277 - DNA, 19 bp, Homo sapiens
actggagcctgcattatgc

SEQ ID NO: 6619278 - DNA, 12 bp, Homo sapiens
actggagctgct

SEQ ID NO: 6619279 - DNA, 16 bp, Homo sapiens
actggagctgggaggt

SEQ ID NO: 6619280 - DNA, 13 bp, Homo sapiens
actggagctttta

SEQ ID NO: 6619281 - DNA, 22 bp, Homo sapiens
actggagcttttaaaaatgttt

SEQ ID NO: 6619282 - DNA, 24 bp, Homo sapiens
actggaggaaccacatataacact

SEQ ID NO: 6619283 - DNA, 18 bp, Homo sapiens
actggaggaccacactca

SEQ ID NO: 6619284 - DNA, 17 bp, Homo sapiens
actggaggagagaagaa

SEQ ID NO: 6619285 - DNA, 20 bp, Homo sapiens
actggaggagagaagaatga

SEQ ID NO: 6619286 - DNA, 15 bp, Homo sapiens
actggaggaggcctg

SEQ ID NO: 6619287 - DNA, 11 bp, Homo sapiens
actggaggcag

SEQ ID NO: 6619288 - DNA, 17 bp, Homo sapiens
actggaggcaggactcc

SEQ ID NO: 6619289 - DNA, 19 bp, Homo sapiens
actggaggcaggactcctg

SEQ ID NO: 6619290 - DNA, 21 bp, Homo sapiens
actggaggcccctggagccag

SEQ ID NO: 6619291 - DNA, 22 bp, Homo sapiens
actggaggcccctggagccaga

SEQ ID NO: 6619292 - DNA, 15 bp, Homo sapiens
actggaggcctctgc

SEQ ID NO: 6619293 - DNA, 20 bp, Homo sapiens
actggaggtacaaataattt

SEQ ID NO: 6619294 - DNA, 23 bp, Homo sapiens
actggaggtgggcatgccaccct

SEQ ID NO: 6619295 - DNA, 16 bp, Homo sapiens
actggaggttgaagcc

SEQ ID NO: 6619296 - DNA, 17 bp, Homo sapiens
actggaggttgaagcca

SEQ ID NO: 6619297 - DNA, 13 bp, Homo sapiens
actggagtagttg

SEQ ID NO: 6619298 - DNA, 16 bp, Homo sapiens
actggagtagttgcta

SEQ ID NO: 6619299 - DNA, 13 bp, Homo sapiens
actggagtcagat

SEQ ID NO: 6619300 - DNA, 15 bp, Homo sapiens
actggagtcagatga

SEQ ID NO: 6619301 - DNA, 18 bp, Homo sapiens
actggagtcagatgagca

SEQ ID NO: 6619302 - DNA, 12 bp, Homo sapiens
actggagtccag

SEQ ID NO: 6619303 - DNA, 12 bp, Homo sapiens
actggagtcccg

SEQ ID NO: 6619304 - DNA, 15 bp, Homo sapiens
actggagtctctctc

SEQ ID NO: 6619305 - DNA, 16 bp, Homo sapiens
actggagtctctctct

SEQ ID NO: 6619306 - DNA, 21 bp, Homo sapiens
actggagtctctctctctcca

SEQ ID NO: 6619307 - DNA, 21 bp, Homo sapiens
actggagttgggggcggcttg

SEQ ID NO: 6619308 - DNA, 17 bp, Homo sapiens
actggataaatttaaaa

SEQ ID NO: 6619309 - DNA, 21 bp, Homo sapiens
actggataaatttaaaacaca

SEQ ID NO: 6619310 - DNA, 16 bp, Homo sapiens
actggatactgtactg

SEQ ID NO: 6619311 - DNA, 23 bp, Homo sapiens
actggatactgtactgatactat

SEQ ID NO: 6619312 - DNA, 14 bp, Homo sapiens
actggatagtgagt

SEQ ID NO: 6619313 - DNA, 15 bp, Homo sapiens
actggatatttcaat

SEQ ID NO: 6619314 - DNA, 16 bp, Homo sapiens
actggatatttcaatc

SEQ ID NO: 6619315 - DNA, 19 bp, Homo sapiens
actggatcaagttcagcca

SEQ ID NO: 6619316 - DNA, 21 bp, Homo sapiens
actggatcaagttcagccacc

SEQ ID NO: 6619317 - DNA, 17 bp, Homo sapiens
actggatccagaagcta

SEQ ID NO: 6619318 - DNA, 21 bp, Homo sapiens
actggatccatccgtccagcc

SEQ ID NO: 6619319 - DNA, 16 bp, Homo sapiens
actggatcctgctgct

SEQ ID NO: 6619320 - DNA, 19 bp, Homo sapiens
actggatcttcagaaggct

SEQ ID NO: 6619321 - DNA, 13 bp, Homo sapiens
actggatgaagat

SEQ ID NO: 6619322 - DNA, 18 bp, Homo sapiens
actggatgcagaaacagt

SEQ ID NO: 6619323 - DNA, 14 bp, Homo sapiens
actggatggaaact

SEQ ID NO: 6619324 - DNA, 22 bp, Homo sapiens
actggattaaacttaatctaaa

SEQ ID NO: 6619325 - DNA, 15 bp, Homo sapiens
actggattattcagg

SEQ ID NO: 6619326 - DNA, 13 bp, Homo sapiens
actggattgcaga

SEQ ID NO: 6619327 - DNA, 13 bp, Homo sapiens
actggattgtact

SEQ ID NO: 6619328 - DNA, 16 bp, Homo sapiens
actggattgtactttg

SEQ ID NO: 6619329 - DNA, 22 bp, Homo sapiens
actggcaaaaggatctttgtgg

SEQ ID NO: 6619330 - DNA, 20 bp, Homo sapiens
actggcaaacagggcctctg

SEQ ID NO: 6619331 - DNA, 21 bp, Homo sapiens
actggcaaacagggcctctgc

SEQ ID NO: 6619332 - DNA, 16 bp, Homo sapiens
actggcaaaggaccag

SEQ ID NO: 6619333 - DNA, 14 bp, Homo sapiens
actggcaagaaaag

SEQ ID NO: 6619334 - DNA, 15 bp, Homo sapiens
actggcaataaactc

SEQ ID NO: 6619335 - DNA, 16 bp, Homo sapiens
actggcaataaactcc

SEQ ID NO: 6619336 - DNA, 14 bp, Homo sapiens
actggcaatatttg

SEQ ID NO: 6619337 - DNA, 18 bp, Homo sapiens
actggcaatatttgttct

SEQ ID NO: 6619338 - DNA, 16 bp, Homo sapiens
actggcaatggtagtt

SEQ ID NO: 6619339 - DNA, 23 bp, Homo sapiens
actggcaatggtagtttctgtgg

SEQ ID NO: 6619340 - DNA, 16 bp, Homo sapiens
actggcacacacccct

SEQ ID NO: 6619341 - DNA, 19 bp, Homo sapiens
actggcacagttttctgag

SEQ ID NO: 6619342 - DNA, 23 bp, Homo sapiens
actggcactggtggtttttgctc

SEQ ID NO: 6619343 - DNA, 13 bp, Homo sapiens
actggcactgtgg

SEQ ID NO: 6619344 - DNA, 14 bp, Homo sapiens
actggcactgtggc

SEQ ID NO: 6619345 - DNA, 17 bp, Homo sapiens
actggcagactcaaggg

SEQ ID NO: 6619346 - DNA, 12 bp, Homo sapiens
actggcagccag

SEQ ID NO: 6619347 - DNA, 12 bp, Homo sapiens
actggcagcctg

SEQ ID NO: 6619348 - DNA, 13 bp, Homo sapiens
actggcagcctgc

SEQ ID NO: 6619349 - DNA, 20 bp, Homo sapiens
actggcagcctgcacctggt

SEQ ID NO: 6619350 - DNA, 18 bp, Homo sapiens
actggcaggagcctcgtg

SEQ ID NO: 6619351 - DNA, 22 bp, Homo sapiens
actggcaggagggtgaggaggt

SEQ ID NO: 6619352 - DNA, 11 bp, Homo sapiens
actggcaggcg

SEQ ID NO: 6619353 - DNA, 18 bp, Homo sapiens
actggcagggataacaaa

SEQ ID NO: 6619354 - DNA, 13 bp, Homo sapiens
actggcaggtgca

SEQ ID NO: 6619355 - DNA, 14 bp, Homo sapiens
actggcaggtgcag

SEQ ID NO: 6619356 - DNA, 21 bp, Homo sapiens
actggcaggtgcagatgggct

SEQ ID NO: 6619357 - DNA, 23 bp, Homo sapiens
actggcaggtgcagatgggctgt

SEQ ID NO: 6619358 - DNA, 21 bp, Homo sapiens
actggcagtaacctagtgaat

SEQ ID NO: 6619359 - DNA, 22 bp, Homo sapiens
actggcagttttccattggttt

SEQ ID NO: 6619360 - DNA, 16 bp, Homo sapiens
actggcatagtttcat

SEQ ID NO: 6619361 - DNA, 17 bp, Homo sapiens
actggcatagtttcata

SEQ ID NO: 6619362 - DNA, 17 bp, Homo sapiens
actggcatctctggagt

SEQ ID NO: 6619363 - DNA, 22 bp, Homo sapiens
actggcatgagccactgtgccc

SEQ ID NO: 6619364 - DNA, 12 bp, Homo sapiens
actggcatggat

SEQ ID NO: 6619365 - DNA, 21 bp, Homo sapiens
actggcatggatatagtttta

SEQ ID NO: 6619366 - DNA, 14 bp, Homo sapiens
actggcatgtcatt

SEQ ID NO: 6619367 - DNA, 20 bp, Homo sapiens
actggcattaattattaata

SEQ ID NO: 6619368 - DNA, 13 bp, Homo sapiens
actggcattttat

SEQ ID NO: 6619369 - DNA, 14 bp, Homo sapiens
actggcattttata

SEQ ID NO: 6619370 - DNA, 14 bp, Homo sapiens
actggccaagctga

SEQ ID NO: 6619371 - DNA, 19 bp, Homo sapiens
actggccaagctgaggtgc

SEQ ID NO: 6619372 - DNA, 16 bp, Homo sapiens
actggccacagttgtt

SEQ ID NO: 6619373 - DNA, 14 bp, Homo sapiens
actggccaccaggc

SEQ ID NO: 6619374 - DNA, 15 bp, Homo sapiens
actggccactcccca

SEQ ID NO: 6619375 - DNA, 13 bp, Homo sapiens
actggccagagag

SEQ ID NO: 6619376 - DNA, 17 bp, Homo sapiens
actggccagagagggcc

SEQ ID NO: 6619377 - DNA, 21 bp, Homo sapiens
actggccagagagggcccagc

SEQ ID NO: 6619378 - DNA, 22 bp, Homo sapiens
actggccagagagggcccagct

SEQ ID NO: 6619379 - DNA, 18 bp, Homo sapiens
actggccagtagctgcca

SEQ ID NO: 6619380 - DNA, 19 bp, Homo sapiens
actggccagttgcccagag

SEQ ID NO: 6619381 - DNA, 15 bp, Homo sapiens
actggccatgcaagt

SEQ ID NO: 6619382 - DNA, 22 bp, Homo sapiens
actggccatttgccaattttcc

SEQ ID NO: 6619383 - DNA, 18 bp, Homo sapiens
actggcccaaccagaact

SEQ ID NO: 6619384 - DNA, 16 bp, Homo sapiens
actggcccacccctct

SEQ ID NO: 6619385 - DNA, 20 bp, Homo sapiens
actggcccacccctcttccc

SEQ ID NO: 6619386 - DNA, 14 bp, Homo sapiens
actggcccagaagc

SEQ ID NO: 6619387 - DNA, 10 bp, Homo sapiens
actggcccca

SEQ ID NO: 6619388 - DNA, 12 bp, Homo sapiens
actggccccagg

SEQ ID NO: 6619389 - DNA, 13 bp, Homo sapiens
actggccccaggc

SEQ ID NO: 6619390 - DNA, 21 bp, Homo sapiens
actggccccggatcagagcag

SEQ ID NO: 6619391 - DNA, 13 bp, Homo sapiens
actggcccctggg

SEQ ID NO: 6619392 - DNA, 15 bp, Homo sapiens
actggcccctgggtc

SEQ ID NO: 6619393 - DNA, 13 bp, Homo sapiens
actggccctcggg

SEQ ID NO: 6619394 - DNA, 21 bp, Homo sapiens
actggccctcgggccctctct

SEQ ID NO: 6619395 - DNA, 15 bp, Homo sapiens
actggccctcttctt

SEQ ID NO: 6619396 - DNA, 16 bp, Homo sapiens
actggccctcttctta

SEQ ID NO: 6619397 - DNA, 12 bp, Homo sapiens
actggccctgtt

SEQ ID NO: 6619398 - DNA, 17 bp, Homo sapiens
actggccgcgggggcag

SEQ ID NO: 6619399 - DNA, 14 bp, Homo sapiens
actggccgctgagc

SEQ ID NO: 6619400 - DNA, 18 bp, Homo sapiens
actggccgctgagcgccc

SEQ ID NO: 6619401 - DNA, 19 bp, Homo sapiens
actggccggagtcagtgcc

SEQ ID NO: 6619402 - DNA, 22 bp, Homo sapiens
actggccggtctgcaagtcaga

SEQ ID NO: 6619403 - DNA, 23 bp, Homo sapiens
actggccggtctgcaagtcagag

SEQ ID NO: 6619404 - DNA, 23 bp, Homo sapiens
actggcctacccctttctccagc

SEQ ID NO: 6619405 - DNA, 21 bp, Homo sapiens
actggcctaggggccagggct

SEQ ID NO: 6619406 - DNA, 17 bp, Homo sapiens
actggcctcaaagcaag

SEQ ID NO: 6619407 - DNA, 22 bp, Homo sapiens
actggcctcaaagcaagcattc

SEQ ID NO: 6619408 - DNA, 16 bp, Homo sapiens
actggcctcgcctggc

SEQ ID NO: 6619409 - DNA, 13 bp, Homo sapiens
actggcctctccc

SEQ ID NO: 6619410 - DNA, 20 bp, Homo sapiens
actggcctctccccaggaag

SEQ ID NO: 6619411 - DNA, 15 bp, Homo sapiens
actggcctctgtgat

SEQ ID NO: 6619412 - DNA, 17 bp, Homo sapiens
actggcctgaggagcag

SEQ ID NO: 6619413 - DNA, 16 bp, Homo sapiens
actggcctgctggatg

SEQ ID NO: 6619414 - DNA, 22 bp, Homo sapiens
actggcctgttctgtaggagag

SEQ ID NO: 6619415 - DNA, 23 bp, Homo sapiens
actggccttctgatgaaatgtta

SEQ ID NO: 6619416 - DNA, 14 bp, Homo sapiens
actggccttgcctc

SEQ ID NO: 6619417 - DNA, 19 bp, Homo sapiens
actggccttgcctccagga

SEQ ID NO: 6619418 - DNA, 14 bp, Homo sapiens
actggcgaagcctg

SEQ ID NO: 6619419 - DNA, 21 bp, Homo sapiens
actggcgaagcctgagcaggc

SEQ ID NO: 6619420 - DNA, 17 bp, Homo sapiens
actggcgatctcccagg

SEQ ID NO: 6619421 - DNA, 14 bp, Homo sapiens
actggcgccttctc

SEQ ID NO: 6619422 - DNA, 21 bp, Homo sapiens
actggcgccttctcggagctg

SEQ ID NO: 6619423 - DNA, 21 bp, Homo sapiens
actggcgtgaacccaggaggc

SEQ ID NO: 6619424 - DNA, 20 bp, Homo sapiens
actggcgttcacctccctgc

SEQ ID NO: 6619425 - DNA, 18 bp, Homo sapiens
actggctagagtcctcac

SEQ ID NO: 6619426 - DNA, 22 bp, Homo sapiens
actggctcatattcctgcagcc

SEQ ID NO: 6619427 - DNA, 21 bp, Homo sapiens
actggctcatgcctcagcccg

SEQ ID NO: 6619428 - DNA, 22 bp, Homo sapiens
actggctccatgattctctgag

SEQ ID NO: 6619429 - DNA, 13 bp, Homo sapiens
actggctcctgga

SEQ ID NO: 6619430 - DNA, 13 bp, Homo sapiens
actggctctccaa

SEQ ID NO: 6619431 - DNA, 17 bp, Homo sapiens
actggctctccaagtgc

SEQ ID NO: 6619432 - DNA, 14 bp, Homo sapiens
actggctctctcca

SEQ ID NO: 6619433 - DNA, 23 bp, Homo sapiens
actggctctctccaggatccaga

SEQ ID NO: 6619434 - DNA, 19 bp, Homo sapiens
actggctctttgtgtgtct

SEQ ID NO: 6619435 - DNA, 19 bp, Homo sapiens
actggctgacccctccttg

SEQ ID NO: 6619436 - DNA, 19 bp, Homo sapiens
actggctgccagctatttt

SEQ ID NO: 6619437 - DNA, 12 bp, Homo sapiens
actggctgcctc

SEQ ID NO: 6619438 - DNA, 16 bp, Homo sapiens
actggctgcctccact

SEQ ID NO: 6619439 - DNA, 19 bp, Homo sapiens
actggctgcctccactccc

SEQ ID NO: 6619440 - DNA, 20 bp, Homo sapiens
actggctgctccctgctccc

SEQ ID NO: 6619441 - DNA, 22 bp, Homo sapiens
actggctgctccctgctcccag

SEQ ID NO: 6619442 - DNA, 16 bp, Homo sapiens
actggctggcctgagc

SEQ ID NO: 6619443 - DNA, 16 bp, Homo sapiens
actggctggctcctag

SEQ ID NO: 6619444 - DNA, 23 bp, Homo sapiens
actggctgggagtccttacctcg

SEQ ID NO: 6619445 - DNA, 13 bp, Homo sapiens
actggctgggccc

SEQ ID NO: 6619446 - DNA, 17 bp, Homo sapiens
actggctgggcccctgg

SEQ ID NO: 6619447 - DNA, 14 bp, Homo sapiens
actggctggggcag

SEQ ID NO: 6619448 - DNA, 17 bp, Homo sapiens
actggctggggcagagg

SEQ ID NO: 6619449 - DNA, 16 bp, Homo sapiens
actggctgtctgcctg

SEQ ID NO: 6619450 - DNA, 13 bp, Homo sapiens
actggctgtgaga

SEQ ID NO: 6619451 - DNA, 19 bp, Homo sapiens
actggctgtgcccctgatg

SEQ ID NO: 6619452 - DNA, 16 bp, Homo sapiens
actggctgtgggctcc

SEQ ID NO: 6619453 - DNA, 19 bp, Homo sapiens
actggctgtgggctccctt

SEQ ID NO: 6619454 - DNA, 17 bp, Homo sapiens
actggctgtgtgacttt

SEQ ID NO: 6619455 - DNA, 20 bp, Homo sapiens
actggcttctgcttgtcatc

SEQ ID NO: 6619456 - DNA, 23 bp, Homo sapiens
actggcttctgtgcactagcctg

SEQ ID NO: 6619457 - DNA, 21 bp, Homo sapiens
actggcttgaaggactgcaga

SEQ ID NO: 6619458 - DNA, 14 bp, Homo sapiens
actggcttgtacat

SEQ ID NO: 6619459 - DNA, 16 bp, Homo sapiens
actggcttgtacattt

SEQ ID NO: 6619460 - DNA, 20 bp, Homo sapiens
actggcttgtacatttttaa

SEQ ID NO: 6619461 - DNA, 19 bp, Homo sapiens
actggctttcctgctggtc

SEQ ID NO: 6619462 - DNA, 16 bp, Homo sapiens
actggctttgtcccac

SEQ ID NO: 6619463 - DNA, 19 bp, Homo sapiens
actggctttgtcccacagc

SEQ ID NO: 6619464 - DNA, 21 bp, Homo sapiens
actggctttgtcccacagctt

SEQ ID NO: 6619465 - DNA, 18 bp, Homo sapiens
actggcttttattaatgc

SEQ ID NO: 6619466 - DNA, 19 bp, Homo sapiens
actggcttttattaatgca

SEQ ID NO: 6619467 - DNA, 21 bp, Homo sapiens
actggcttttattaatgcact

SEQ ID NO: 6619468 - DNA, 14 bp, Homo sapiens
actggctttttccc

SEQ ID NO: 6619469 - DNA, 10 bp, Homo sapiens
actgggaaac

SEQ ID NO: 6619470 - DNA, 16 bp, Homo sapiens
actgggaaccaagggc

SEQ ID NO: 6619471 - DNA, 14 bp, Homo sapiens
actgggaacccctt

SEQ ID NO: 6619472 - DNA, 20 bp, Homo sapiens
actgggaacccctttcccac

SEQ ID NO: 6619473 - DNA, 12 bp, Homo sapiens
actgggaagaac

SEQ ID NO: 6619474 - DNA, 23 bp, Homo sapiens
actgggaagataggctctgcaca

SEQ ID NO: 6619475 - DNA, 15 bp, Homo sapiens
actgggaagatgctg

SEQ ID NO: 6619476 - DNA, 19 bp, Homo sapiens
actgggaagatgctggccc

SEQ ID NO: 6619477 - DNA, 14 bp, Homo sapiens
actgggaagcatta

SEQ ID NO: 6619478 - DNA, 22 bp, Homo sapiens
actgggaagctggagtgctgct

SEQ ID NO: 6619479 - DNA, 12 bp, Homo sapiens
actgggaaggct

SEQ ID NO: 6619480 - DNA, 18 bp, Homo sapiens
actgggaagggggcaggc

SEQ ID NO: 6619481 - DNA, 16 bp, Homo sapiens
actgggaagtgactta

SEQ ID NO: 6619482 - DNA, 13 bp, Homo sapiens
actgggaatttat

SEQ ID NO: 6619483 - DNA, 18 bp, Homo sapiens
actgggacaggggagaac

SEQ ID NO: 6619484 - DNA, 20 bp, Homo sapiens
actgggaccgtgcgagctgc

SEQ ID NO: 6619485 - DNA, 21 bp, Homo sapiens
actgggaccgtgcgagctgcc

SEQ ID NO: 6619486 - DNA, 21 bp, Homo sapiens
actgggacctttagtggtggc

SEQ ID NO: 6619487 - DNA, 15 bp, Homo sapiens
actgggacggctcct

SEQ ID NO: 6619488 - DNA, 18 bp, Homo sapiens
actgggacggctcctgct

SEQ ID NO: 6619489 - DNA, 17 bp, Homo sapiens
actgggagaaatgaaaa

SEQ ID NO: 6619490 - DNA, 14 bp, Homo sapiens
actgggagactggg

SEQ ID NO: 6619491 - DNA, 22 bp, Homo sapiens
actgggagagtccttagcctgg

SEQ ID NO: 6619492 - DNA, 23 bp, Homo sapiens
actgggagagtccttagcctggg

SEQ ID NO: 6619493 - DNA, 18 bp, Homo sapiens
actgggagggggtggggg

SEQ ID NO: 6619494 - DNA, 19 bp, Homo sapiens
actgggagtcagagccctg

SEQ ID NO: 6619495 - DNA, 16 bp, Homo sapiens
actgggagtgtgggct

SEQ ID NO: 6619496 - DNA, 19 bp, Homo sapiens
actgggagtgtgggctgcc

SEQ ID NO: 6619497 - DNA, 22 bp, Homo sapiens
actgggagtgtgggctgccctt

SEQ ID NO: 6619498 - DNA, 13 bp, Homo sapiens
actgggataactg

SEQ ID NO: 6619499 - DNA, 15 bp, Homo sapiens
actgggataactgat

SEQ ID NO: 6619500 - DNA, 15 bp, Homo sapiens
actgggatcgcacct

SEQ ID NO: 6619501 - DNA, 19 bp, Homo sapiens
actgggatggaatggcagc

SEQ ID NO: 6619502 - DNA, 23 bp, Homo sapiens
actgggattaagaaaccttgctc

SEQ ID NO: 6619503 - DNA, 18 bp, Homo sapiens
actgggcaatgatggcaa

SEQ ID NO: 6619504 - DNA, 22 bp, Homo sapiens
actgggcacagattgaagaatc

SEQ ID NO: 6619505 - DNA, 19 bp, Homo sapiens
actgggcacccctgcctcc

SEQ ID NO: 6619506 - DNA, 18 bp, Homo sapiens
actgggcactagctagat

SEQ ID NO: 6619507 - DNA, 18 bp, Homo sapiens
actgggcaggttcctggg

SEQ ID NO: 6619508 - DNA, 15 bp, Homo sapiens
actgggcatgagggg

SEQ ID NO: 6619509 - DNA, 23 bp, Homo sapiens
actgggcatgaggggttcctccc

SEQ ID NO: 6619510 - DNA, 15 bp, Homo sapiens
actgggcatttcaat

SEQ ID NO: 6619511 - DNA, 16 bp, Homo sapiens
actgggcatttcaatc

SEQ ID NO: 6619512 - DNA, 16 bp, Homo sapiens
actgggccacggagga

SEQ ID NO: 6619513 - DNA, 17 bp, Homo sapiens
actgggccagccctgca

SEQ ID NO: 6619514 - DNA, 20 bp, Homo sapiens
actgggccagccctgcagcc

SEQ ID NO: 6619515 - DNA, 21 bp, Homo sapiens
actgggccagccctgcagccc

SEQ ID NO: 6619516 - DNA, 23 bp, Homo sapiens
actgggccataatgttgcttctc

SEQ ID NO: 6619517 - DNA, 14 bp, Homo sapiens
actgggccatgggt

SEQ ID NO: 6619518 - DNA, 12 bp, Homo sapiens
actgggcccaga

SEQ ID NO: 6619519 - DNA, 13 bp, Homo sapiens
actgggcccagag

SEQ ID NO: 6619520 - DNA, 16 bp, Homo sapiens
actgggcccaggcagg

SEQ ID NO: 6619521 - DNA, 15 bp, Homo sapiens
actgggcccctcagg

SEQ ID NO: 6619522 - DNA, 18 bp, Homo sapiens
actgggcccctgtcccca

SEQ ID NO: 6619523 - DNA, 22 bp, Homo sapiens
actgggcccctgtccccagtcc

SEQ ID NO: 6619524 - DNA, 22 bp, Homo sapiens
actgggcccgagggtggtttac

SEQ ID NO: 6619525 - DNA, 11 bp, Homo sapiens
actgggccctg

SEQ ID NO: 6619526 - DNA, 18 bp, Homo sapiens
actgggccctgagccaga

SEQ ID NO: 6619527 - DNA, 16 bp, Homo sapiens
actgggccctgcctct

SEQ ID NO: 6619528 - DNA, 13 bp, Homo sapiens
actgggccctggg

SEQ ID NO: 6619529 - DNA, 15 bp, Homo sapiens
actgggccctgggga

SEQ ID NO: 6619530 - DNA, 19 bp, Homo sapiens
actgggccggcagcctggt

SEQ ID NO: 6619531 - DNA, 17 bp, Homo sapiens
actgggccgggcccagg

SEQ ID NO: 6619532 - DNA, 20 bp, Homo sapiens
actgggcctaggccaggagt

SEQ ID NO: 6619533 - DNA, 17 bp, Homo sapiens
actgggcctgtagctca

SEQ ID NO: 6619534 - DNA, 20 bp, Homo sapiens
actgggccttagtgggccag

SEQ ID NO: 6619535 - DNA, 17 bp, Homo sapiens
actgggccttgtgtgct

SEQ ID NO: 6619536 - DNA, 21 bp, Homo sapiens
actgggctaaggaagtatcag

SEQ ID NO: 6619537 - DNA, 14 bp, Homo sapiens
actgggctaatttg

SEQ ID NO: 6619538 - DNA, 22 bp, Homo sapiens
actgggctcccgggccccacag

SEQ ID NO: 6619539 - DNA, 19 bp, Homo sapiens
actgggctctccctgcacg

SEQ ID NO: 6619540 - DNA, 16 bp, Homo sapiens
actgggctctgaggag

SEQ ID NO: 6619541 - DNA, 22 bp, Homo sapiens
actgggctctgaggagtggagt

SEQ ID NO: 6619542 - DNA, 16 bp, Homo sapiens
actgggctctggacct

SEQ ID NO: 6619543 - DNA, 19 bp, Homo sapiens
actgggctctggacctcag

SEQ ID NO: 6619544 - DNA, 14 bp, Homo sapiens
actgggctctggct

SEQ ID NO: 6619545 - DNA, 16 bp, Homo sapiens
actgggctgaacactc

SEQ ID NO: 6619546 - DNA, 12 bp, Homo sapiens
actgggctggct

SEQ ID NO: 6619547 - DNA, 17 bp, Homo sapiens
actgggctggctgcctt

SEQ ID NO: 6619548 - DNA, 21 bp, Homo sapiens
actgggctggctgccttctgc

SEQ ID NO: 6619549 - DNA, 19 bp, Homo sapiens
actggggaaaaggatgatg

SEQ ID NO: 6619550 - DNA, 19 bp, Homo sapiens
actggggacttggcctctc

SEQ ID NO: 6619551 - DNA, 18 bp, Homo sapiens
actggggaggctgaggca

SEQ ID NO: 6619552 - DNA, 19 bp, Homo sapiens
actggggaggctgaggcag

SEQ ID NO: 6619553 - DNA, 22 bp, Homo sapiens
actggggagggctgcagtcaca

SEQ ID NO: 6619554 - DNA, 22 bp, Homo sapiens
actggggagtaaacggcccagg

SEQ ID NO: 6619555 - DNA, 23 bp, Homo sapiens
actggggagtaaacggcccaggc

SEQ ID NO: 6619556 - DNA, 15 bp, Homo sapiens
actggggagtctttg

SEQ ID NO: 6619557 - DNA, 20 bp, Homo sapiens
actggggagttataaaaata

SEQ ID NO: 6619558 - DNA, 21 bp, Homo sapiens
actggggagttataaaaatac

SEQ ID NO: 6619559 - DNA, 16 bp, Homo sapiens
actggggatgtgggag

SEQ ID NO: 6619560 - DNA, 17 bp, Homo sapiens
actggggatgtgggagg

SEQ ID NO: 6619561 - DNA, 22 bp, Homo sapiens
actggggattcttgaacttgaa

SEQ ID NO: 6619562 - DNA, 17 bp, Homo sapiens
actggggattgggtggg

SEQ ID NO: 6619563 - DNA, 16 bp, Homo sapiens
actggggcagacaata

SEQ ID NO: 6619564 - DNA, 19 bp, Homo sapiens
actggggcagggcagcagg

SEQ ID NO: 6619565 - DNA, 14 bp, Homo sapiens
actggggcaggggc

SEQ ID NO: 6619566 - DNA, 15 bp, Homo sapiens
actggggcatcctgt

SEQ ID NO: 6619567 - DNA, 21 bp, Homo sapiens
actggggcctacagctttgat

SEQ ID NO: 6619568 - DNA, 14 bp, Homo sapiens
actggggcctggac

SEQ ID NO: 6619569 - DNA, 13 bp, Homo sapiens
actggggctcaga

SEQ ID NO: 6619570 - DNA, 14 bp, Homo sapiens
actggggctgaagg

SEQ ID NO: 6619571 - DNA, 16 bp, Homo sapiens
actggggctggcacaa

SEQ ID NO: 6619572 - DNA, 21 bp, Homo sapiens
actggggctggggaaggaagc

SEQ ID NO: 6619573 - DNA, 15 bp, Homo sapiens
actggggcttgccag

SEQ ID NO: 6619574 - DNA, 23 bp, Homo sapiens
actggggctttgccttgcagcca

SEQ ID NO: 6619575 - DNA, 21 bp, Homo sapiens
actgggggacactgtggcagc

SEQ ID NO: 6619576 - DNA, 22 bp, Homo sapiens
actgggggacactgtggcagca

SEQ ID NO: 6619577 - DNA, 23 bp, Homo sapiens
actgggggacactgtggcagcag

SEQ ID NO: 6619578 - DNA, 14 bp, Homo sapiens
actgggggcctctg

SEQ ID NO: 6619579 - DNA, 16 bp, Homo sapiens
actgggggcctctgcc

SEQ ID NO: 6619580 - DNA, 17 bp, Homo sapiens
actgggggcctctgcct

SEQ ID NO: 6619581 - DNA, 19 bp, Homo sapiens
actgggggcctctgcctcc

SEQ ID NO: 6619582 - DNA, 20 bp, Homo sapiens
actgggggcggggcctgggc

SEQ ID NO: 6619583 - DNA, 22 bp, Homo sapiens
actggggggaaaaagaccaggt

SEQ ID NO: 6619584 - DNA, 13 bp, Homo sapiens
actggggggcagg

SEQ ID NO: 6619585 - DNA, 22 bp, Homo sapiens
actggggggcaggcctcccaag

SEQ ID NO: 6619586 - DNA, 13 bp, Homo sapiens
actggggggccac

SEQ ID NO: 6619587 - DNA, 16 bp, Homo sapiens
actggggggccaccat

SEQ ID NO: 6619588 - DNA, 16 bp, Homo sapiens
actggggtgatgtttt

SEQ ID NO: 6619589 - DNA, 14 bp, Homo sapiens
actggggtgccttc

SEQ ID NO: 6619590 - DNA, 22 bp, Homo sapiens
actggggtgccttcactgggcc

SEQ ID NO: 6619591 - DNA, 14 bp, Homo sapiens
actggggtgcgaga

SEQ ID NO: 6619592 - DNA, 16 bp, Homo sapiens
actggggtggcctcaa

SEQ ID NO: 6619593 - DNA, 23 bp, Homo sapiens
actggggtgggagggggcagggg

SEQ ID NO: 6619594 - DNA, 21 bp, Homo sapiens
actggggttcaagcccaggct

SEQ ID NO: 6619595 - DNA, 19 bp, Homo sapiens
actggggttcacgtcactg

SEQ ID NO: 6619596 - DNA, 21 bp, Homo sapiens
actggggttcacgtcactgcc

SEQ ID NO: 6619597 - DNA, 15 bp, Homo sapiens
actggggttgagggc

SEQ ID NO: 6619598 - DNA, 15 bp, Homo sapiens
actgggtacttgtgg

SEQ ID NO: 6619599 - DNA, 17 bp, Homo sapiens
actgggtacttgtggac

SEQ ID NO: 6619600 - DNA, 18 bp, Homo sapiens
actgggtacttgtggaca

SEQ ID NO: 6619601 - DNA, 19 bp, Homo sapiens
actgggtacttgtggacac

SEQ ID NO: 6619602 - DNA, 20 bp, Homo sapiens
actgggtacttgtggacaca

SEQ ID NO: 6619603 - DNA, 20 bp, Homo sapiens
actgggtatgaggctggggc

SEQ ID NO: 6619604 - DNA, 17 bp, Homo sapiens
actgggtatgcgtttca

SEQ ID NO: 6619605 - DNA, 14 bp, Homo sapiens
actgggtcttcagc

SEQ ID NO: 6619606 - DNA, 20 bp, Homo sapiens
actgggtgactggaggcctc

SEQ ID NO: 6619607 - DNA, 19 bp, Homo sapiens
actgggtgaggaaatccat

SEQ ID NO: 6619608 - DNA, 16 bp, Homo sapiens
actgggtgcgtctcca

SEQ ID NO: 6619609 - DNA, 23 bp, Homo sapiens
actgggtgggatggatgctgggg

SEQ ID NO: 6619610 - DNA, 20 bp, Homo sapiens
actgggtggggtgaggacca

SEQ ID NO: 6619611 - DNA, 16 bp, Homo sapiens
actgggtgtaaacaca

SEQ ID NO: 6619612 - DNA, 14 bp, Homo sapiens
actgggtgttgatc

SEQ ID NO: 6619613 - DNA, 21 bp, Homo sapiens
actgggtgttgatcttacaag

SEQ ID NO: 6619614 - DNA, 21 bp, Homo sapiens
actgggttatttttgtccctg

SEQ ID NO: 6619615 - DNA, 22 bp, Homo sapiens
actgggttatttttgtccctgc

SEQ ID NO: 6619616 - DNA, 23 bp, Homo sapiens
actgggttcttaaccagatggtt

SEQ ID NO: 6619617 - DNA, 16 bp, Homo sapiens
actgggtttcaagaaa

SEQ ID NO: 6619618 - DNA, 15 bp, Homo sapiens
actgggtttctagcc

SEQ ID NO: 6619619 - DNA, 20 bp, Homo sapiens
actgggtttctctgtatagt

SEQ ID NO: 6619620 - DNA, 23 bp, Homo sapiens
actgggtttggcaaaactcaggc

SEQ ID NO: 6619621 - DNA, 23 bp, Homo sapiens
actggtaaaaagatccagggatg

SEQ ID NO: 6619622 - DNA, 24 bp, Homo sapiens
actggtaaaaagatccagggatgg

SEQ ID NO: 6619623 - DNA, 19 bp, Homo sapiens
actggtaaaatacatataa

SEQ ID NO: 6619624 - DNA, 16 bp, Homo sapiens
actggtaagattgtta

SEQ ID NO: 6619625 - DNA, 18 bp, Homo sapiens
actggtaagattgttatt

SEQ ID NO: 6619626 - DNA, 15 bp, Homo sapiens
actggtaattgtaca

SEQ ID NO: 6619627 - DNA, 20 bp, Homo sapiens
actggtaattgtacaatact

SEQ ID NO: 6619628 - DNA, 11 bp, Homo sapiens
actggtaccat

SEQ ID NO: 6619629 - DNA, 16 bp, Homo sapiens
actggtaccttccccc

SEQ ID NO: 6619630 - DNA, 21 bp, Homo sapiens
actggtaccttcccccagctt

SEQ ID NO: 6619631 - DNA, 17 bp, Homo sapiens
actggtacttagagttt

SEQ ID NO: 6619632 - DNA, 14 bp, Homo sapiens
actggtagaaaaac

SEQ ID NO: 6619633 - DNA, 20 bp, Homo sapiens
actggtaggaacttgagaac

SEQ ID NO: 6619634 - DNA, 12 bp, Homo sapiens
actggtagtgtt

SEQ ID NO: 6619635 - DNA, 15 bp, Homo sapiens
actggtatacacact

SEQ ID NO: 6619636 - DNA, 22 bp, Homo sapiens
actggtatatacgtgtggttca

SEQ ID NO: 6619637 - DNA, 14 bp, Homo sapiens
actggtatatattt

SEQ ID NO: 6619638 - DNA, 20 bp, Homo sapiens
actggtatattattgcttca

SEQ ID NO: 6619639 - DNA, 17 bp, Homo sapiens
actggtatgaataattg

SEQ ID NO: 6619640 - DNA, 23 bp, Homo sapiens
actggtattagttaaaacacata

SEQ ID NO: 6619641 - DNA, 16 bp, Homo sapiens
actggtattctgttct

SEQ ID NO: 6619642 - DNA, 14 bp, Homo sapiens
actggtatttatat

SEQ ID NO: 6619643 - DNA, 14 bp, Homo sapiens
actggtattttatc

SEQ ID NO: 6619644 - DNA, 22 bp, Homo sapiens
actggtcacggatttgtgtctg

SEQ ID NO: 6619645 - DNA, 14 bp, Homo sapiens
actggtcagggcag

SEQ ID NO: 6619646 - DNA, 15 bp, Homo sapiens
actggtcagggcagt

SEQ ID NO: 6619647 - DNA, 22 bp, Homo sapiens
actggtccaaaagattgctgaa

SEQ ID NO: 6619648 - DNA, 17 bp, Homo sapiens
actggtccactcagggc

SEQ ID NO: 6619649 - DNA, 15 bp, Homo sapiens
actggtccagctctg

SEQ ID NO: 6619650 - DNA, 16 bp, Homo sapiens
actggtccagctctga

SEQ ID NO: 6619651 - DNA, 19 bp, Homo sapiens
actggtccagctctgacat

SEQ ID NO: 6619652 - DNA, 19 bp, Homo sapiens
actggtccaggccaggcct

SEQ ID NO: 6619653 - DNA, 13 bp, Homo sapiens
actggtccatctg

SEQ ID NO: 6619654 - DNA, 20 bp, Homo sapiens
actggtcccccatgggctgc

SEQ ID NO: 6619655 - DNA, 20 bp, Homo sapiens
actggtctacactggttgcc

SEQ ID NO: 6619656 - DNA, 12 bp, Homo sapiens
actggtctcaga

SEQ ID NO: 6619657 - DNA, 12 bp, Homo sapiens
actggtctctct

SEQ ID NO: 6619658 - DNA, 13 bp, Homo sapiens
actggtctgtact

SEQ ID NO: 6619659 - DNA, 19 bp, Homo sapiens
actggtgaatataaatgat

SEQ ID NO: 6619660 - DNA, 18 bp, Homo sapiens
actggtgactgattcttc

SEQ ID NO: 6619661 - DNA, 12 bp, Homo sapiens
actggtgactgc

SEQ ID NO: 6619662 - DNA, 21 bp, Homo sapiens
actggtgagacaatgaaacaa

SEQ ID NO: 6619663 - DNA, 20 bp, Homo sapiens
actggtgagagaagaaaaca

SEQ ID NO: 6619664 - DNA, 22 bp, Homo sapiens
actggtgagagaagaaaacatt

SEQ ID NO: 6619665 - DNA, 19 bp, Homo sapiens
actggtgatataaagaatg

SEQ ID NO: 6619666 - DNA, 22 bp, Homo sapiens
actggtgatgttgaaatatgca

SEQ ID NO: 6619667 - DNA, 16 bp, Homo sapiens
actggtgatttctgag

SEQ ID NO: 6619668 - DNA, 22 bp, Homo sapiens
actggtgatttctgagatttta

SEQ ID NO: 6619669 - DNA, 17 bp, Homo sapiens
actggtgcacttcttac

SEQ ID NO: 6619670 - DNA, 20 bp, Homo sapiens
actggtgcactttgtaaatt

SEQ ID NO: 6619671 - DNA, 20 bp, Homo sapiens
actggtgcatttaaaatgga

SEQ ID NO: 6619672 - DNA, 21 bp, Homo sapiens
actggtgcatttaaaatggac

SEQ ID NO: 6619673 - DNA, 19 bp, Homo sapiens
actggtgccaaaaccaggc

SEQ ID NO: 6619674 - DNA, 20 bp, Homo sapiens
actggtgccaaaaccaggcc

SEQ ID NO: 6619675 - DNA, 13 bp, Homo sapiens
actggtgccctcc

SEQ ID NO: 6619676 - DNA, 19 bp, Homo sapiens
actggtgcgaccccccacc

SEQ ID NO: 6619677 - DNA, 22 bp, Homo sapiens
actggtggcccgacagcctggc

SEQ ID NO: 6619678 - DNA, 23 bp, Homo sapiens
actggtggcccgacagcctggca

SEQ ID NO: 6619679 - DNA, 12 bp, Homo sapiens
actggtgggcca

SEQ ID NO: 6619680 - DNA, 18 bp, Homo sapiens
actggtgggtctttaata

SEQ ID NO: 6619681 - DNA, 23 bp, Homo sapiens
actggtgggtctttaataaaaca

SEQ ID NO: 6619682 - DNA, 18 bp, Homo sapiens
actggtgttaagatatat

SEQ ID NO: 6619683 - DNA, 16 bp, Homo sapiens
actggtgttaatgagt

SEQ ID NO: 6619684 - DNA, 15 bp, Homo sapiens
actggttactttcaa

SEQ ID NO: 6619685 - DNA, 17 bp, Homo sapiens
actggttactttcaaaa

SEQ ID NO: 6619686 - DNA, 14 bp, Homo sapiens
actggttatcctgt

SEQ ID NO: 6619687 - DNA, 15 bp, Homo sapiens
actggttatcctgtg

SEQ ID NO: 6619688 - DNA, 21 bp, Homo sapiens
actggttatcctgtgctacag

SEQ ID NO: 6619689 - DNA, 13 bp, Homo sapiens
actggttatcttg

SEQ ID NO: 6619690 - DNA, 16 bp, Homo sapiens
actggttatcttgtta

SEQ ID NO: 6619691 - DNA, 22 bp, Homo sapiens
actggttatcttgttattattg

SEQ ID NO: 6619692 - DNA, 14 bp, Homo sapiens
actggttatttaaa

SEQ ID NO: 6619693 - DNA, 12 bp, Homo sapiens
actggttcaggc

SEQ ID NO: 6619694 - DNA, 17 bp, Homo sapiens
actggttctcaatgaaa

SEQ ID NO: 6619695 - DNA, 21 bp, Homo sapiens
actggttctgaggccagaaag

SEQ ID NO: 6619696 - DNA, 13 bp, Homo sapiens
actggttcttgcc

SEQ ID NO: 6619697 - DNA, 13 bp, Homo sapiens
actggttgcatgg

SEQ ID NO: 6619698 - DNA, 17 bp, Homo sapiens
actggttgcatggaaat

SEQ ID NO: 6619699 - DNA, 18 bp, Homo sapiens
actggttgcatggaaatc

SEQ ID NO: 6619700 - DNA, 13 bp, Homo sapiens
actggttgctgtg

SEQ ID NO: 6619701 - DNA, 22 bp, Homo sapiens
actggtttacaggccctgctcc

SEQ ID NO: 6619702 - DNA, 20 bp, Homo sapiens
actggtttatccacccacaa

SEQ ID NO: 6619703 - DNA, 15 bp, Homo sapiens
actggtttctcagaa

SEQ ID NO: 6619704 - DNA, 22 bp, Homo sapiens
actggtttctcagaatccaaag

SEQ ID NO: 6619705 - DNA, 19 bp, Homo sapiens
actggtttctcctggtaga

SEQ ID NO: 6619706 - DNA, 18 bp, Homo sapiens
actggtttgactctgtcc

SEQ ID NO: 6619707 - DNA, 16 bp, Homo sapiens
actggtttgtttgctt

SEQ ID NO: 6619708 - DNA, 19 bp, Homo sapiens
actggtttgtttgcttaat

SEQ ID NO: 6619709 - DNA, 14 bp, Homo sapiens
actggttttaaata

SEQ ID NO: 6619710 - DNA, 15 bp, Homo sapiens
actggttttctgcca

SEQ ID NO: 6619711 - DNA, 23 bp, Homo sapiens
actggttttggccaccccttgct

SEQ ID NO: 6619712 - DNA, 23 bp, Homo sapiens
actggtttttctgttccctgctg

SEQ ID NO: 6619713 - DNA, 18 bp, Homo sapiens
actgtaaaaaatgtgtgt

SEQ ID NO: 6619714 - DNA, 20 bp, Homo sapiens
actgtaaaagtgtacagact

SEQ ID NO: 6619715 - DNA, 23 bp, Homo sapiens
actgtaaaagtgtacagactctt

SEQ ID NO: 6619716 - DNA, 12 bp, Homo sapiens
actgtaaaagtt

SEQ ID NO: 6619717 - DNA, 15 bp, Homo sapiens
actgtaaaagttata

SEQ ID NO: 6619718 - DNA, 20 bp, Homo sapiens
actgtaaaagttataataac

SEQ ID NO: 6619719 - DNA, 21 bp, Homo sapiens
actgtaaaagttataataact

SEQ ID NO: 6619720 - DNA, 17 bp, Homo sapiens
actgtaaaataataact

SEQ ID NO: 6619721 - DNA, 12 bp, Homo sapiens
actgtaaaatag

SEQ ID NO: 6619722 - DNA, 16 bp, Homo sapiens
actgtaaaatgcaaaa

SEQ ID NO: 6619723 - DNA, 21 bp, Homo sapiens
actgtaaaatgtgggattatg

SEQ ID NO: 6619724 - DNA, 22 bp, Homo sapiens
actgtaaaatgtgggattatgg

SEQ ID NO: 6619725 - DNA, 15 bp, Homo sapiens
actgtaaacagttct

SEQ ID NO: 6619726 - DNA, 13 bp, Homo sapiens
actgtaaactaat

SEQ ID NO: 6619727 - DNA, 23 bp, Homo sapiens
actgtaaagaaagagagaaaata

SEQ ID NO: 6619728 - DNA, 20 bp, Homo sapiens
actgtaaagagaagtaattt

SEQ ID NO: 6619729 - DNA, 17 bp, Homo sapiens
actgtaaagatgaatgt

SEQ ID NO: 6619730 - DNA, 20 bp, Homo sapiens
actgtaaagatttgttgaca

SEQ ID NO: 6619731 - DNA, 13 bp, Homo sapiens
actgtaaagcaaa

SEQ ID NO: 6619732 - DNA, 19 bp, Homo sapiens
actgtaaataaaatgtgta

SEQ ID NO: 6619733 - DNA, 22 bp, Homo sapiens
actgtaaataaaatgtgtacag

SEQ ID NO: 6619734 - DNA, 20 bp, Homo sapiens
actgtaaatatccacagact

SEQ ID NO: 6619735 - DNA, 14 bp, Homo sapiens
actgtaaatatccc

SEQ ID NO: 6619736 - DNA, 15 bp, Homo sapiens
actgtaaatatccct

SEQ ID NO: 6619737 - DNA, 22 bp, Homo sapiens
actgtaaatatccctcccctct

SEQ ID NO: 6619738 - DNA, 17 bp, Homo sapiens
actgtaaatatgaatct

SEQ ID NO: 6619739 - DNA, 20 bp, Homo sapiens
actgtaaatatttttttaac

SEQ ID NO: 6619740 - DNA, 13 bp, Homo sapiens
actgtaaatcact

SEQ ID NO: 6619741 - DNA, 16 bp, Homo sapiens
actgtaaatcacttgt

SEQ ID NO: 6619742 - DNA, 18 bp, Homo sapiens
actgtaaatcacttgtaa

SEQ ID NO: 6619743 - DNA, 16 bp, Homo sapiens
actgtaaattccaaag

SEQ ID NO: 6619744 - DNA, 23 bp, Homo sapiens
actgtaaattgctggcagatgct

SEQ ID NO: 6619745 - DNA, 16 bp, Homo sapiens
actgtaaatttaatag

SEQ ID NO: 6619746 - DNA, 10 bp, Homo sapiens
actgtaacac

SEQ ID NO: 6619747 - DNA, 20 bp, Homo sapiens
actgtaacactttacaatgt

SEQ ID NO: 6619748 - DNA, 18 bp, Homo sapiens
actgtaacatatatgaaa

SEQ ID NO: 6619749 - DNA, 17 bp, Homo sapiens
actgtaacatattctgt

SEQ ID NO: 6619750 - DNA, 14 bp, Homo sapiens
actgtaacctgatt

SEQ ID NO: 6619751 - DNA, 16 bp, Homo sapiens
actgtaacctgattca

SEQ ID NO: 6619752 - DNA, 16 bp, Homo sapiens
actgtaactgctcaga

SEQ ID NO: 6619753 - DNA, 14 bp, Homo sapiens
actgtaactgtcag

SEQ ID NO: 6619754 - DNA, 22 bp, Homo sapiens
actgtaacttccaaataaataa

SEQ ID NO: 6619755 - DNA, 14 bp, Homo sapiens
actgtaactttttt

SEQ ID NO: 6619756 - DNA, 18 bp, Homo sapiens
actgtaactttttttcag

SEQ ID NO: 6619757 - DNA, 13 bp, Homo sapiens
actgtaagaaaat

SEQ ID NO: 6619758 - DNA, 22 bp, Homo sapiens
actgtaagaaaatatcacttgt

SEQ ID NO: 6619759 - DNA, 15 bp, Homo sapiens
actgtaagaaatgta

SEQ ID NO: 6619760 - DNA, 17 bp, Homo sapiens
actgtaagaagagccat

SEQ ID NO: 6619761 - DNA, 22 bp, Homo sapiens
actgtaagaataatttatagta

SEQ ID NO: 6619762 - DNA, 21 bp, Homo sapiens
actgtaagacgtatgtaacat

SEQ ID NO: 6619763 - DNA, 21 bp, Homo sapiens
actgtaagactcattccctag

SEQ ID NO: 6619764 - DNA, 19 bp, Homo sapiens
actgtaagagacatgaatg

SEQ ID NO: 6619765 - DNA, 19 bp, Homo sapiens
actgtaagctccatgatta

SEQ ID NO: 6619766 - DNA, 19 bp, Homo sapiens
actgtaagctttgttctgg

SEQ ID NO: 6619767 - DNA, 21 bp, Homo sapiens
actgtaagcttttaagaaaaa

SEQ ID NO: 6619768 - DNA, 22 bp, Homo sapiens
actgtaagtttattttttctac

SEQ ID NO: 6619769 - DNA, 16 bp, Homo sapiens
actgtaataaagatga

SEQ ID NO: 6619770 - DNA, 15 bp, Homo sapiens
actgtaataacttct

SEQ ID NO: 6619771 - DNA, 22 bp, Homo sapiens
actgtaatacgtagctctctta

SEQ ID NO: 6619772 - DNA, 16 bp, Homo sapiens
actgtaatacttcttt

SEQ ID NO: 6619773 - DNA, 22 bp, Homo sapiens
actgtaatatctttaaatgatg

SEQ ID NO: 6619774 - DNA, 15 bp, Homo sapiens
actgtaatatgtaca

SEQ ID NO: 6619775 - DNA, 15 bp, Homo sapiens
actgtaatcttaaaa

SEQ ID NO: 6619776 - DNA, 19 bp, Homo sapiens
actgtaatcttatttagga

SEQ ID NO: 6619777 - DNA, 22 bp, Homo sapiens
actgtaatcttatttaggaagt

SEQ ID NO: 6619778 - DNA, 10 bp, Homo sapiens
actgtaatga

SEQ ID NO: 6619779 - DNA, 21 bp, Homo sapiens
actgtaatgaggaaaaaatgg

SEQ ID NO: 6619780 - DNA, 13 bp, Homo sapiens
actgtaatgcagg

SEQ ID NO: 6619781 - DNA, 19 bp, Homo sapiens
actgtaatgggtaattctg

SEQ ID NO: 6619782 - DNA, 17 bp, Homo sapiens
actgtaattatttgaat

SEQ ID NO: 6619783 - DNA, 23 bp, Homo sapiens
actgtaattgacagagtaaaagt

SEQ ID NO: 6619784 - DNA, 16 bp, Homo sapiens
actgtaatttctttga

SEQ ID NO: 6619785 - DNA, 19 bp, Homo sapiens
actgtaatttgtgatacaa

SEQ ID NO: 6619786 - DNA, 21 bp, Homo sapiens
actgtaattttgtttgtaatc

SEQ ID NO: 6619787 - DNA, 19 bp, Homo sapiens
actgtacaaaaaaatcttc

SEQ ID NO: 6619788 - DNA, 16 bp, Homo sapiens
actgtacaaagtagaa

SEQ ID NO: 6619789 - DNA, 11 bp, Homo sapiens
actgtacaata

SEQ ID NO: 6619790 - DNA, 13 bp, Homo sapiens
actgtacacattt

SEQ ID NO: 6619791 - DNA, 15 bp, Homo sapiens
actgtacacatttct

SEQ ID NO: 6619792 - DNA, 16 bp, Homo sapiens
actgtacacatttctt

SEQ ID NO: 6619793 - DNA, 23 bp, Homo sapiens
actgtacacatttcttaaaacac

SEQ ID NO: 6619794 - DNA, 20 bp, Homo sapiens
actgtacaccatagtttaca

SEQ ID NO: 6619795 - DNA, 17 bp, Homo sapiens
actgtacagaatttcca

SEQ ID NO: 6619796 - DNA, 18 bp, Homo sapiens
actgtacagacagaaaaa

SEQ ID NO: 6619797 - DNA, 22 bp, Homo sapiens
actgtacagattgctgcttctg

SEQ ID NO: 6619798 - DNA, 12 bp, Homo sapiens
actgtacataaa

SEQ ID NO: 6619799 - DNA, 15 bp, Homo sapiens
actgtacataaacaa

SEQ ID NO: 6619800 - DNA, 19 bp, Homo sapiens
actgtacataaattccaga

SEQ ID NO: 6619801 - DNA, 19 bp, Homo sapiens
actgtacataattgcatga

SEQ ID NO: 6619802 - DNA, 21 bp, Homo sapiens
actgtacataattgcatgaaa

SEQ ID NO: 6619803 - DNA, 20 bp, Homo sapiens
actgtacatagatgtatcat

SEQ ID NO: 6619804 - DNA, 16 bp, Homo sapiens
actgtacatgaaaaca

SEQ ID NO: 6619805 - DNA, 17 bp, Homo sapiens
actgtacattgtgagct

SEQ ID NO: 6619806 - DNA, 15 bp, Homo sapiens
actgtacatttaaaa

SEQ ID NO: 6619807 - DNA, 16 bp, Homo sapiens
actgtacccaaatgga

SEQ ID NO: 6619808 - DNA, 15 bp, Homo sapiens
actgtaccttttgcg

SEQ ID NO: 6619809 - DNA, 19 bp, Homo sapiens
actgtaccttttgcgattt

SEQ ID NO: 6619810 - DNA, 12 bp, Homo sapiens
actgtactaatt

SEQ ID NO: 6619811 - DNA, 22 bp, Homo sapiens
actgtactaattcttacactgc

SEQ ID NO: 6619812 - DNA, 17 bp, Homo sapiens
actgtactccagcctgg

SEQ ID NO: 6619813 - DNA, 15 bp, Homo sapiens
actgtactcctccca

SEQ ID NO: 6619814 - DNA, 20 bp, Homo sapiens
actgtactcctcccaggcgc

SEQ ID NO: 6619815 - DNA, 17 bp, Homo sapiens
actgtactgaagaacag

SEQ ID NO: 6619816 - DNA, 17 bp, Homo sapiens
actgtactgacttgagg

SEQ ID NO: 6619817 - DNA, 22 bp, Homo sapiens
actgtactgagacattacagtt

SEQ ID NO: 6619818 - DNA, 19 bp, Homo sapiens
actgtactgcatgtgactt

SEQ ID NO: 6619819 - DNA, 15 bp, Homo sapiens
actgtactgggccat

SEQ ID NO: 6619820 - DNA, 18 bp, Homo sapiens
actgtacttaataaattc

SEQ ID NO: 6619821 - DNA, 17 bp, Homo sapiens
actgtacttattttcca

SEQ ID NO: 6619822 - DNA, 23 bp, Homo sapiens
actgtacttattttccaataaaa

SEQ ID NO: 6619823 - DNA, 16 bp, Homo sapiens
actgtacttcactgtc

SEQ ID NO: 6619824 - DNA, 22 bp, Homo sapiens
actgtacttctgtgtgcaattg

SEQ ID NO: 6619825 - DNA, 15 bp, Homo sapiens
actgtacttgctctt

SEQ ID NO: 6619826 - DNA, 15 bp, Homo sapiens
actgtactttcccag

SEQ ID NO: 6619827 - DNA, 20 bp, Homo sapiens
actgtactttgattcacatg

SEQ ID NO: 6619828 - DNA, 22 bp, Homo sapiens
actgtactttgattcacatgtt

SEQ ID NO: 6619829 - DNA, 17 bp, Homo sapiens
actgtactttgccattt

SEQ ID NO: 6619830 - DNA, 19 bp, Homo sapiens
actgtactttgccattttt

SEQ ID NO: 6619831 - DNA, 22 bp, Homo sapiens
actgtactttgccatttttcta

SEQ ID NO: 6619832 - DNA, 15 bp, Homo sapiens
actgtagaaacaaag

SEQ ID NO: 6619833 - DNA, 15 bp, Homo sapiens
actgtagaaaggaaa

SEQ ID NO: 6619834 - DNA, 16 bp, Homo sapiens
actgtagaaaggaaat

SEQ ID NO: 6619835 - DNA, 16 bp, Homo sapiens
actgtagaactgattt

SEQ ID NO: 6619836 - DNA, 17 bp, Homo sapiens
actgtagaactgatttt

SEQ ID NO: 6619837 - DNA, 20 bp, Homo sapiens
actgtagaactgattttaca

SEQ ID NO: 6619838 - DNA, 15 bp, Homo sapiens
actgtagacactctg

SEQ ID NO: 6619839 - DNA, 19 bp, Homo sapiens
actgtagagatttttatgt

SEQ ID NO: 6619840 - DNA, 20 bp, Homo sapiens
actgtagagtcctatttcag

SEQ ID NO: 6619841 - DNA, 15 bp, Homo sapiens
actgtagatatgtat

SEQ ID NO: 6619842 - DNA, 21 bp, Homo sapiens
actgtagattgcttctgtagt

SEQ ID NO: 6619843 - DNA, 22 bp, Homo sapiens
actgtagattgcttctgtagta

SEQ ID NO: 6619844 - DNA, 22 bp, Homo sapiens
actgtagcaagatgcaaatgca

SEQ ID NO: 6619845 - DNA, 13 bp, Homo sapiens
actgtagcaatat

SEQ ID NO: 6619846 - DNA, 21 bp, Homo sapiens
actgtagcaatatatttgtag

SEQ ID NO: 6619847 - DNA, 15 bp, Homo sapiens
actgtagccacagct

SEQ ID NO: 6619848 - DNA, 15 bp, Homo sapiens
actgtagcgacccca

SEQ ID NO: 6619849 - DNA, 15 bp, Homo sapiens
actgtagctacattt

SEQ ID NO: 6619850 - DNA, 23 bp, Homo sapiens
actgtagctattagcggctcctc

SEQ ID NO: 6619851 - DNA, 16 bp, Homo sapiens
actgtagctcaagttt

SEQ ID NO: 6619852 - DNA, 20 bp, Homo sapiens
actgtagctcaagtttaaaa

SEQ ID NO: 6619853 - DNA, 22 bp, Homo sapiens
actgtagctcaagtttaaaagc

SEQ ID NO: 6619854 - DNA, 15 bp, Homo sapiens
actgtagctttggaa

SEQ ID NO: 6619855 - DNA, 15 bp, Homo sapiens
actgtaggcacactt

SEQ ID NO: 6619856 - DNA, 21 bp, Homo sapiens
actgtaggcgcccctggggtg

SEQ ID NO: 6619857 - DNA, 21 bp, Homo sapiens
actgtagggaaaaaaatgctt

SEQ ID NO: 6619858 - DNA, 15 bp, Homo sapiens
actgtaggtcatttt

SEQ ID NO: 6619859 - DNA, 16 bp, Homo sapiens
actgtaggtgttatgt

SEQ ID NO: 6619860 - DNA, 13 bp, Homo sapiens
actgtagtctcag

SEQ ID NO: 6619861 - DNA, 14 bp, Homo sapiens
actgtagtgtagtc

SEQ ID NO: 6619862 - DNA, 21 bp, Homo sapiens
actgtagtgtagtcaggtgct

SEQ ID NO: 6619863 - DNA, 18 bp, Homo sapiens
actgtagttcagatagag

SEQ ID NO: 6619864 - DNA, 13 bp, Homo sapiens
actgtagttctaa

SEQ ID NO: 6619865 - DNA, 16 bp, Homo sapiens
actgtagtttaatact

SEQ ID NO: 6619866 - DNA, 19 bp, Homo sapiens
actgtagtttagttctgtt

SEQ ID NO: 6619867 - DNA, 14 bp, Homo sapiens
actgtagttttgag

SEQ ID NO: 6619868 - DNA, 20 bp, Homo sapiens
actgtagtttttgaaaatta

SEQ ID NO: 6619869 - DNA, 15 bp, Homo sapiens
actgtataaacaaat

SEQ ID NO: 6619870 - DNA, 20 bp, Homo sapiens
actgtataaacaaattagca

SEQ ID NO: 6619871 - DNA, 21 bp, Homo sapiens
actgtataaataggagaggat

SEQ ID NO: 6619872 - DNA, 20 bp, Homo sapiens
actgtataactgttcttcaa

SEQ ID NO: 6619873 - DNA, 19 bp, Homo sapiens
actgtataaggagattctg

SEQ ID NO: 6619874 - DNA, 15 bp, Homo sapiens
actgtatactggtgt

SEQ ID NO: 6619875 - DNA, 18 bp, Homo sapiens
actgtatagacagtttgt

SEQ ID NO: 6619876 - DNA, 15 bp, Homo sapiens
actgtatagacatgc

SEQ ID NO: 6619877 - DNA, 20 bp, Homo sapiens
actgtataggtagatccaga

SEQ ID NO: 6619878 - DNA, 13 bp, Homo sapiens
actgtatagtaat

SEQ ID NO: 6619879 - DNA, 16 bp, Homo sapiens
actgtatataaacata

SEQ ID NO: 6619880 - DNA, 14 bp, Homo sapiens
actgtatatgtcaa

SEQ ID NO: 6619881 - DNA, 17 bp, Homo sapiens
actgtatatgtcaaaaa

SEQ ID NO: 6619882 - DNA, 21 bp, Homo sapiens
actgtatatgtcaaaaatatt

SEQ ID NO: 6619883 - DNA, 14 bp, Homo sapiens
actgtatatttgta

SEQ ID NO: 6619884 - DNA, 19 bp, Homo sapiens
actgtatatttgtatgata

SEQ ID NO: 6619885 - DNA, 16 bp, Homo sapiens
actgtatcaaatctgt

SEQ ID NO: 6619886 - DNA, 22 bp, Homo sapiens
actgtatcaaatctgtatatgt

SEQ ID NO: 6619887 - DNA, 19 bp, Homo sapiens
actgtatcaataaaattct

SEQ ID NO: 6619888 - DNA, 13 bp, Homo sapiens
actgtatcaattt

SEQ ID NO: 6619889 - DNA, 21 bp, Homo sapiens
actgtatcaatttctaatgtt

SEQ ID NO: 6619890 - DNA, 14 bp, Homo sapiens
actgtatcatgaca

SEQ ID NO: 6619891 - DNA, 19 bp, Homo sapiens
actgtatcctgaaaggcaa

SEQ ID NO: 6619892 - DNA, 15 bp, Homo sapiens
actgtatctaggcaa

SEQ ID NO: 6619893 - DNA, 15 bp, Homo sapiens
actgtatctattctt

SEQ ID NO: 6619894 - DNA, 22 bp, Homo sapiens
actgtatctctaatacagtgtg

SEQ ID NO: 6619895 - DNA, 13 bp, Homo sapiens
actgtatctgtgt

SEQ ID NO: 6619896 - DNA, 14 bp, Homo sapiens
actgtatctgtgta

SEQ ID NO: 6619897 - DNA, 15 bp, Homo sapiens
actgtatctgtgtag

SEQ ID NO: 6619898 - DNA, 13 bp, Homo sapiens
actgtatcttcct

SEQ ID NO: 6619899 - DNA, 14 bp, Homo sapiens
actgtatgatcaaa

SEQ ID NO: 6619900 - DNA, 15 bp, Homo sapiens
actgtatgatcaaat

SEQ ID NO: 6619901 - DNA, 16 bp, Homo sapiens
actgtatgatcaaatg

SEQ ID NO: 6619902 - DNA, 20 bp, Homo sapiens
actgtatgatcaaatgttta

SEQ ID NO: 6619903 - DNA, 22 bp, Homo sapiens
actgtatgatcaaatgtttaat

SEQ ID NO: 6619904 - DNA, 17 bp, Homo sapiens
actgtatgccttctgta

SEQ ID NO: 6619905 - DNA, 13 bp, Homo sapiens
actgtatgctgga

SEQ ID NO: 6619906 - DNA, 11 bp, Homo sapiens
actgtatggaa

SEQ ID NO: 6619907 - DNA, 22 bp, Homo sapiens
actgtatggaaacactgatttt

SEQ ID NO: 6619908 - DNA, 22 bp, Homo sapiens
actgtatgggggagattgaact

SEQ ID NO: 6619909 - DNA, 23 bp, Homo sapiens
actgtatgtaatatttacataaa

SEQ ID NO: 6619910 - DNA, 15 bp, Homo sapiens
actgtatgtataaat

SEQ ID NO: 6619911 - DNA, 21 bp, Homo sapiens
actgtatgttatagaacttca

SEQ ID NO: 6619912 - DNA, 22 bp, Homo sapiens
actgtatgtttttactgaatga

SEQ ID NO: 6619913 - DNA, 18 bp, Homo sapiens
actgtattaaagaaaaat

SEQ ID NO: 6619914 - DNA, 23 bp, Homo sapiens
actgtattaaagatgcaggtttt

SEQ ID NO: 6619915 - DNA, 16 bp, Homo sapiens
actgtattaaatctta

SEQ ID NO: 6619916 - DNA, 20 bp, Homo sapiens
actgtattaaatcttaaaca

SEQ ID NO: 6619917 - DNA, 20 bp, Homo sapiens
actgtattagagcgccagct

SEQ ID NO: 6619918 - DNA, 20 bp, Homo sapiens
actgtattcgtgcatttttg

SEQ ID NO: 6619919 - DNA, 18 bp, Homo sapiens
actgtattctagtggctg

SEQ ID NO: 6619920 - DNA, 22 bp, Homo sapiens
actgtattctagtggctgttca

SEQ ID NO: 6619921 - DNA, 15 bp, Homo sapiens
actgtattgaatatt

SEQ ID NO: 6619922 - DNA, 23 bp, Homo sapiens
actgtattgggaagttactgtta

SEQ ID NO: 6619923 - DNA, 14 bp, Homo sapiens
actgtatttcagta

SEQ ID NO: 6619924 - DNA, 20 bp, Homo sapiens
actgtatttcagtattttcc

SEQ ID NO: 6619925 - DNA, 23 bp, Homo sapiens
actgtatttcattatctgtactg

SEQ ID NO: 6619926 - DNA, 16 bp, Homo sapiens
actgtatttctgtgga

SEQ ID NO: 6619927 - DNA, 13 bp, Homo sapiens
actgtatttgtat

SEQ ID NO: 6619928 - DNA, 13 bp, Homo sapiens
actgtatttgtga

SEQ ID NO: 6619929 - DNA, 16 bp, Homo sapiens
actgtatttgtgacta

SEQ ID NO: 6619930 - DNA, 20 bp, Homo sapiens
actgtatttgtgactaattg

SEQ ID NO: 6619931 - DNA, 17 bp, Homo sapiens
actgtatttgttaattt

SEQ ID NO: 6619932 - DNA, 14 bp, Homo sapiens
actgtattttatgt

SEQ ID NO: 6619933 - DNA, 18 bp, Homo sapiens
actgtattttctttcact

SEQ ID NO: 6619934 - DNA, 22 bp, Homo sapiens
actgtattttgaaccaaaacat

SEQ ID NO: 6619935 - DNA, 20 bp, Homo sapiens
actgtattttgttttccttt

SEQ ID NO: 6619936 - DNA, 18 bp, Homo sapiens
actgtatttttcagaaat

SEQ ID NO: 6619937 - DNA, 20 bp, Homo sapiens
actgtatttttgaagactat

SEQ ID NO: 6619938 - DNA, 23 bp, Homo sapiens
actgtcaaaaagtttggttctgt

SEQ ID NO: 6619939 - DNA, 20 bp, Homo sapiens
actgtcaaagaatcaatcca

SEQ ID NO: 6619940 - DNA, 19 bp, Homo sapiens
actgtcaaatgaactttta

SEQ ID NO: 6619941 - DNA, 20 bp, Homo sapiens
actgtcaaatgatgtgcaaa

SEQ ID NO: 6619942 - DNA, 19 bp, Homo sapiens
actgtcaaattttcaaata

SEQ ID NO: 6619943 - DNA, 14 bp, Homo sapiens
actgtcaataaaca

SEQ ID NO: 6619944 - DNA, 17 bp, Homo sapiens
actgtcaataaacagct

SEQ ID NO: 6619945 - DNA, 14 bp, Homo sapiens
actgtcaatgaggt

SEQ ID NO: 6619946 - DNA, 14 bp, Homo sapiens
actgtcaccctcca

SEQ ID NO: 6619947 - DNA, 15 bp, Homo sapiens
actgtcaccctccac

SEQ ID NO: 6619948 - DNA, 13 bp, Homo sapiens
actgtcaccctga

SEQ ID NO: 6619949 - DNA, 14 bp, Homo sapiens
actgtcactcattg

SEQ ID NO: 6619950 - DNA, 23 bp, Homo sapiens
actgtcactcattgctgagcctc

SEQ ID NO: 6619951 - DNA, 22 bp, Homo sapiens
actgtcactgccgacatccctc

SEQ ID NO: 6619952 - DNA, 21 bp, Homo sapiens
actgtcactgtttctctgctg

SEQ ID NO: 6619953 - DNA, 13 bp, Homo sapiens
actgtcacttgct

SEQ ID NO: 6619954 - DNA, 16 bp, Homo sapiens
actgtcagatctggat

SEQ ID NO: 6619955 - DNA, 16 bp, Homo sapiens
actgtcagccgggccc

SEQ ID NO: 6619956 - DNA, 21 bp, Homo sapiens
actgtcagctcccctcggaga

SEQ ID NO: 6619957 - DNA, 22 bp, Homo sapiens
actgtcagctcccctcggagaa

SEQ ID NO: 6619958 - DNA, 12 bp, Homo sapiens
actgtcaggaag

SEQ ID NO: 6619959 - DNA, 22 bp, Homo sapiens
actgtcaggcctctgagcccaa

SEQ ID NO: 6619960 - DNA, 20 bp, Homo sapiens
actgtcaggctgaaaacaat

SEQ ID NO: 6619961 - DNA, 12 bp, Homo sapiens
actgtcagggag

SEQ ID NO: 6619962 - DNA, 18 bp, Homo sapiens
actgtcagggagggccag

SEQ ID NO: 6619963 - DNA, 19 bp, Homo sapiens
actgtcagtcccactgcac

SEQ ID NO: 6619964 - DNA, 23 bp, Homo sapiens
actgtcagttctctgggaagtgg

SEQ ID NO: 6619965 - DNA, 22 bp, Homo sapiens
actgtcagttgtacttctgctc

SEQ ID NO: 6619966 - DNA, 15 bp, Homo sapiens
actgtcatataatgc

SEQ ID NO: 6619967 - DNA, 15 bp, Homo sapiens
actgtcatcaatgtt

SEQ ID NO: 6619968 - DNA, 15 bp, Homo sapiens
actgtcatgcttcat

SEQ ID NO: 6619969 - DNA, 20 bp, Homo sapiens
actgtcatgtgcgaacacag

SEQ ID NO: 6619970 - DNA, 18 bp, Homo sapiens
actgtcatgtggcttggt

SEQ ID NO: 6619971 - DNA, 16 bp, Homo sapiens
actgtcattgcccctc

SEQ ID NO: 6619972 - DNA, 18 bp, Homo sapiens
actgtccaatatgaaaac

SEQ ID NO: 6619973 - DNA, 15 bp, Homo sapiens
actgtccagagagca

SEQ ID NO: 6619974 - DNA, 14 bp, Homo sapiens
actgtccaggagct

SEQ ID NO: 6619975 - DNA, 13 bp, Homo sapiens
actgtccagggaa

SEQ ID NO: 6619976 - DNA, 21 bp, Homo sapiens
actgtccagggaaacagcctc

SEQ ID NO: 6619977 - DNA, 17 bp, Homo sapiens
actgtccagtccagtga

SEQ ID NO: 6619978 - DNA, 22 bp, Homo sapiens
actgtcccacaaaatatttcta

SEQ ID NO: 6619979 - DNA, 12 bp, Homo sapiens
actgtcccagct

SEQ ID NO: 6619980 - DNA, 14 bp, Homo sapiens
actgtcccaggagc

SEQ ID NO: 6619981 - DNA, 18 bp, Homo sapiens
actgtcccatccccaggt

SEQ ID NO: 6619982 - DNA, 18 bp, Homo sapiens
actgtccccctacccacc

SEQ ID NO: 6619983 - DNA, 18 bp, Homo sapiens
actgtccccttgaaggag

SEQ ID NO: 6619984 - DNA, 16 bp, Homo sapiens
actgtcccgacacagc

SEQ ID NO: 6619985 - DNA, 17 bp, Homo sapiens
actgtccctaccactga

SEQ ID NO: 6619986 - DNA, 23 bp, Homo sapiens
actgtccctatctattaaagtga

SEQ ID NO: 6619987 - DNA, 14 bp, Homo sapiens
actgtccctcaaat

SEQ ID NO: 6619988 - DNA, 17 bp, Homo sapiens
actgtccctcccttgct

SEQ ID NO: 6619989 - DNA, 13 bp, Homo sapiens
actgtccctcctg

SEQ ID NO: 6619990 - DNA, 16 bp, Homo sapiens
actgtccctcctggtg

SEQ ID NO: 6619991 - DNA, 21 bp, Homo sapiens
actgtccctcctggtgtcacc

SEQ ID NO: 6619992 - DNA, 12 bp, Homo sapiens
actgtccctgcc

SEQ ID NO: 6619993 - DNA, 17 bp, Homo sapiens
actgtccctgctttctg

SEQ ID NO: 6619994 - DNA, 21 bp, Homo sapiens
actgtccctgctttctggtat

SEQ ID NO: 6619995 - DNA, 15 bp, Homo sapiens
actgtccctgtcctt

SEQ ID NO: 6619996 - DNA, 19 bp, Homo sapiens
actgtccctgtccttctac

SEQ ID NO: 6619997 - DNA, 22 bp, Homo sapiens
actgtccgcctctgcccgcaga

SEQ ID NO: 6619998 - DNA, 22 bp, Homo sapiens
actgtccgctgtctccctcctg

SEQ ID NO: 6619999 - DNA, 15 bp, Homo sapiens
actgtcctaacatgg

SEQ ID NO: 6620000 - DNA, 20 bp, Homo sapiens
actgtcctaccagttgccct

SEQ ID NO: 6620001 - DNA, 18 bp, Homo sapiens
actgtcctacccaccctc

SEQ ID NO: 6620002 - DNA, 23 bp, Homo sapiens
actgtcctagccaggtctcctgg

SEQ ID NO: 6620003 - DNA, 18 bp, Homo sapiens
actgtcctattatattca

SEQ ID NO: 6620004 - DNA, 15 bp, Homo sapiens
actgtcctcaaataa

SEQ ID NO: 6620005 - DNA, 16 bp, Homo sapiens
actgtcctccaagcca

SEQ ID NO: 6620006 - DNA, 17 bp, Homo sapiens
actgtcctcccacagac

SEQ ID NO: 6620007 - DNA, 13 bp, Homo sapiens
actgtcctctaca

SEQ ID NO: 6620008 - DNA, 20 bp, Homo sapiens
actgtcctctcccctccagc

SEQ ID NO: 6620009 - DNA, 18 bp, Homo sapiens
actgtcctctttcagaaa

SEQ ID NO: 6620010 - DNA, 23 bp, Homo sapiens
actgtcctctttcagaaaacaga

SEQ ID NO: 6620011 - DNA, 17 bp, Homo sapiens
actgtcctgctccacag

SEQ ID NO: 6620012 - DNA, 10 bp, Homo sapiens
actgtcctgg

SEQ ID NO: 6620013 - DNA, 18 bp, Homo sapiens
actgtcctgggcgccctg

SEQ ID NO: 6620014 - DNA, 19 bp, Homo sapiens
actgtcctgggcgccctgg

SEQ ID NO: 6620015 - DNA, 17 bp, Homo sapiens
actgtcctgtccggagc

SEQ ID NO: 6620016 - DNA, 13 bp, Homo sapiens
actgtcctgtcct

SEQ ID NO: 6620017 - DNA, 21 bp, Homo sapiens
actgtcctttccttggcttta

SEQ ID NO: 6620018 - DNA, 21 bp, Homo sapiens
actgtcgcatctttttaacat

SEQ ID NO: 6620019 - DNA, 23 bp, Homo sapiens
actgtcgccacacgcctctgtgt

SEQ ID NO: 6620020 - DNA, 14 bp, Homo sapiens
actgtcggagaggc

SEQ ID NO: 6620021 - DNA, 16 bp, Homo sapiens
actgtcggagaggctg

SEQ ID NO: 6620022 - DNA, 19 bp, Homo sapiens
actgtcggaggaaagacaa

SEQ ID NO: 6620023 - DNA, 22 bp, Homo sapiens
actgtcgtctttttccaaacaa

SEQ ID NO: 6620024 - DNA, 16 bp, Homo sapiens
actgtctaactttaga

SEQ ID NO: 6620025 - DNA, 14 bp, Homo sapiens
actgtctaagaata

SEQ ID NO: 6620026 - DNA, 21 bp, Homo sapiens
actgtctaagattaatagcat

SEQ ID NO: 6620027 - DNA, 21 bp, Homo sapiens
actgtctagatggatgaatta

SEQ ID NO: 6620028 - DNA, 17 bp, Homo sapiens
actgtctagcacttcct

SEQ ID NO: 6620029 - DNA, 19 bp, Homo sapiens
actgtctagcacttccttg

SEQ ID NO: 6620030 - DNA, 24 bp, Homo sapiens
actgtctagcacttccttgccagt

SEQ ID NO: 6620031 - DNA, 21 bp, Homo sapiens
actgtctagccactccctccc

SEQ ID NO: 6620032 - DNA, 15 bp, Homo sapiens
actgtctaggctaca

SEQ ID NO: 6620033 - DNA, 21 bp, Homo sapiens
actgtctatatcataactata

SEQ ID NO: 6620034 - DNA, 16 bp, Homo sapiens
actgtctatggatttg

SEQ ID NO: 6620035 - DNA, 15 bp, Homo sapiens
actgtctatttaagt

SEQ ID NO: 6620036 - DNA, 13 bp, Homo sapiens
actgtctatttct

SEQ ID NO: 6620037 - DNA, 16 bp, Homo sapiens
actgtctatttctgct

SEQ ID NO: 6620038 - DNA, 18 bp, Homo sapiens
actgtctatttctgctga

SEQ ID NO: 6620039 - DNA, 19 bp, Homo sapiens
actgtctcactcgttctgt

SEQ ID NO: 6620040 - DNA, 15 bp, Homo sapiens
actgtctcagccaac

SEQ ID NO: 6620041 - DNA, 17 bp, Homo sapiens
actgtctcctccctggg

SEQ ID NO: 6620042 - DNA, 18 bp, Homo sapiens
actgtctcctccctgggc

SEQ ID NO: 6620043 - DNA, 20 bp, Homo sapiens
actgtctcctccctgggcta

SEQ ID NO: 6620044 - DNA, 20 bp, Homo sapiens
actgtctcctggtctgtgct

SEQ ID NO: 6620045 - DNA, 16 bp, Homo sapiens
actgtctccttcccac

SEQ ID NO: 6620046 - DNA, 17 bp, Homo sapiens
actgtctccttcccact

SEQ ID NO: 6620047 - DNA, 21 bp, Homo sapiens
actgtctcgatgcaatgaaca

SEQ ID NO: 6620048 - DNA, 18 bp, Homo sapiens
actgtctctcatgaacct

SEQ ID NO: 6620049 - DNA, 18 bp, Homo sapiens
actgtctctccagtgaaa

SEQ ID NO: 6620050 - DNA, 20 bp, Homo sapiens
actgtctctcttctcagagt

SEQ ID NO: 6620051 - DNA, 21 bp, Homo sapiens
actgtctctcttgtcacatgg

SEQ ID NO: 6620052 - DNA, 14 bp, Homo sapiens
actgtctctggagt

SEQ ID NO: 6620053 - DNA, 20 bp, Homo sapiens
actgtctgaatattctagaa

SEQ ID NO: 6620054 - DNA, 21 bp, Homo sapiens
actgtctgaatattctagaac

SEQ ID NO: 6620055 - DNA, 15 bp, Homo sapiens
actgtctgagagttt

SEQ ID NO: 6620056 - DNA, 20 bp, Homo sapiens
actgtctgagagtttagttg

SEQ ID NO: 6620057 - DNA, 22 bp, Homo sapiens
actgtctgctgatataatatca

SEQ ID NO: 6620058 - DNA, 16 bp, Homo sapiens
actgtctgcttctctc

SEQ ID NO: 6620059 - DNA, 23 bp, Homo sapiens
actgtctgcttctctctctctca

SEQ ID NO: 6620060 - DNA, 17 bp, Homo sapiens
actgtctggttttaaca

SEQ ID NO: 6620061 - DNA, 18 bp, Homo sapiens
actgtctggttttaacaa

SEQ ID NO: 6620062 - DNA, 16 bp, Homo sapiens
actgtctgtagtgttt

SEQ ID NO: 6620063 - DNA, 14 bp, Homo sapiens
actgtctgtatctt

SEQ ID NO: 6620064 - DNA, 15 bp, Homo sapiens
actgtctgtgaacag

SEQ ID NO: 6620065 - DNA, 16 bp, Homo sapiens
actgtctgtgtccttg

SEQ ID NO: 6620066 - DNA, 22 bp, Homo sapiens
actgtctgttctgcacaataaa

SEQ ID NO: 6620067 - DNA, 21 bp, Homo sapiens
actgtctgttgtttacctacc

SEQ ID NO: 6620068 - DNA, 16 bp, Homo sapiens
actgtcttaaatcagt

SEQ ID NO: 6620069 - DNA, 19 bp, Homo sapiens
actgtcttacctggcagca

SEQ ID NO: 6620070 - DNA, 17 bp, Homo sapiens
actgtcttactcaagat

SEQ ID NO: 6620071 - DNA, 18 bp, Homo sapiens
actgtcttactcaagata

SEQ ID NO: 6620072 - DNA, 20 bp, Homo sapiens
actgtcttcaaccctgccct

SEQ ID NO: 6620073 - DNA, 14 bp, Homo sapiens
actgtcttcacaac

SEQ ID NO: 6620074 - DNA, 14 bp, Homo sapiens
actgtcttcctcaa

SEQ ID NO: 6620075 - DNA, 18 bp, Homo sapiens
actgtcttcctcaaaata

SEQ ID NO: 6620076 - DNA, 16 bp, Homo sapiens
actgtcttcttcaggg

SEQ ID NO: 6620077 - DNA, 23 bp, Homo sapiens
actgtcttgcagtggacggagag

SEQ ID NO: 6620078 - DNA, 23 bp, Homo sapiens
actgtcttgcctgccagggcccc

SEQ ID NO: 6620079 - DNA, 15 bp, Homo sapiens
actgtcttgtctcac

SEQ ID NO: 6620080 - DNA, 17 bp, Homo sapiens
actgtctttaaaagaga

SEQ ID NO: 6620081 - DNA, 22 bp, Homo sapiens
actgtctttataacccatattt

SEQ ID NO: 6620082 - DNA, 15 bp, Homo sapiens
actgtctttattctt

SEQ ID NO: 6620083 - DNA, 13 bp, Homo sapiens
actgtctttccta

SEQ ID NO: 6620084 - DNA, 21 bp, Homo sapiens
actgtctttggaaaaatgttt

SEQ ID NO: 6620085 - DNA, 22 bp, Homo sapiens
actgtctttggaaaaatgtttg

SEQ ID NO: 6620086 - DNA, 15 bp, Homo sapiens
actgtcttttgaaga

SEQ ID NO: 6620087 - DNA, 18 bp, Homo sapiens
actgtgaaaaaaaatttg

SEQ ID NO: 6620088 - DNA, 15 bp, Homo sapiens
actgtgaaaatagtg

SEQ ID NO: 6620089 - DNA, 20 bp, Homo sapiens
actgtgaaagtatgtgatat

SEQ ID NO: 6620090 - DNA, 16 bp, Homo sapiens
actgtgaaagttggaa

SEQ ID NO: 6620091 - DNA, 16 bp, Homo sapiens
actgtgaaatacacta

SEQ ID NO: 6620092 - DNA, 20 bp, Homo sapiens
actgtgaaataccacaagcc

SEQ ID NO: 6620093 - DNA, 21 bp, Homo sapiens
actgtgaaataccacaagcct

SEQ ID NO: 6620094 - DNA, 22 bp, Homo sapiens
actgtgaaatttacaaatcaaa

SEQ ID NO: 6620095 - DNA, 17 bp, Homo sapiens
actgtgaaatttcatga

SEQ ID NO: 6620096 - DNA, 23 bp, Homo sapiens
actgtgaaatttcatgattggct

SEQ ID NO: 6620097 - DNA, 20 bp, Homo sapiens
actgtgaacagcttgctgtc

SEQ ID NO: 6620098 - DNA, 15 bp, Homo sapiens
actgtgaactatttt

SEQ ID NO: 6620099 - DNA, 16 bp, Homo sapiens
actgtgaactattttg

SEQ ID NO: 6620100 - DNA, 16 bp, Homo sapiens
actgtgaactgggcat

SEQ ID NO: 6620101 - DNA, 22 bp, Homo sapiens
actgtgaacttgactgggtgag

SEQ ID NO: 6620102 - DNA, 20 bp, Homo sapiens
actgtgaagagaatgtattc

SEQ ID NO: 6620103 - DNA, 23 bp, Homo sapiens
actgtgaagagaatgtattctgt

SEQ ID NO: 6620104 - DNA, 12 bp, Homo sapiens
actgtgaagagc

SEQ ID NO: 6620105 - DNA, 15 bp, Homo sapiens
actgtgaagagctgg

SEQ ID NO: 6620106 - DNA, 21 bp, Homo sapiens
actgtgaagttacatgcataa

SEQ ID NO: 6620107 - DNA, 22 bp, Homo sapiens
actgtgaagttacatgcataaa

SEQ ID NO: 6620108 - DNA, 23 bp, Homo sapiens
actgtgaagttacatgcataaaa

SEQ ID NO: 6620109 - DNA, 20 bp, Homo sapiens
actgtgaataataaatacac

SEQ ID NO: 6620110 - DNA, 18 bp, Homo sapiens
actgtgaatatgagaaat

SEQ ID NO: 6620111 - DNA, 20 bp, Homo sapiens
actgtgaatgcttctgattt

SEQ ID NO: 6620112 - DNA, 21 bp, Homo sapiens
actgtgaattcattctggagg

SEQ ID NO: 6620113 - DNA, 21 bp, Homo sapiens
actgtgaattgtttttgtaca

SEQ ID NO: 6620114 - DNA, 15 bp, Homo sapiens
actgtgaatttcaaa

SEQ ID NO: 6620115 - DNA, 16 bp, Homo sapiens
actgtgacaaagaaga

SEQ ID NO: 6620116 - DNA, 20 bp, Homo sapiens
actgtgacaatgactaagcc

SEQ ID NO: 6620117 - DNA, 13 bp, Homo sapiens
actgtgacagact

SEQ ID NO: 6620118 - DNA, 11 bp, Homo sapiens
actgtgacagg

SEQ ID NO: 6620119 - DNA, 14 bp, Homo sapiens
actgtgacaggcag

SEQ ID NO: 6620120 - DNA, 17 bp, Homo sapiens
actgtgacaggcagcag

SEQ ID NO: 6620121 - DNA, 12 bp, Homo sapiens
actgtgacattc

SEQ ID NO: 6620122 - DNA, 19 bp, Homo sapiens
actgtgacattccacagag

SEQ ID NO: 6620123 - DNA, 13 bp, Homo sapiens
actgtgaccaaag

SEQ ID NO: 6620124 - DNA, 13 bp, Homo sapiens
actgtgaccacct

SEQ ID NO: 6620125 - DNA, 21 bp, Homo sapiens
actgtgaccaccttctgtccc

SEQ ID NO: 6620126 - DNA, 22 bp, Homo sapiens
actgtgacccaaagaagtttaa

SEQ ID NO: 6620127 - DNA, 19 bp, Homo sapiens
actgtgacccccagctccg

SEQ ID NO: 6620128 - DNA, 18 bp, Homo sapiens
actgtgacctaagaacaa

SEQ ID NO: 6620129 - DNA, 22 bp, Homo sapiens
actgtgacctccgcctcctggg

SEQ ID NO: 6620130 - DNA, 17 bp, Homo sapiens
actgtgacctgctcctg

SEQ ID NO: 6620131 - DNA, 21 bp, Homo sapiens
actgtgacctgctcctgccca

SEQ ID NO: 6620132 - DNA, 21 bp, Homo sapiens
actgtgagaactgtgaatatg

SEQ ID NO: 6620133 - DNA, 16 bp, Homo sapiens
actgtgagagttgtct

SEQ ID NO: 6620134 - DNA, 18 bp, Homo sapiens
actgtgagagttgtctct

SEQ ID NO: 6620135 - DNA, 17 bp, Homo sapiens
actgtgagataaatatc

SEQ ID NO: 6620136 - DNA, 22 bp, Homo sapiens
actgtgaggaagtgtggaaaaa

SEQ ID NO: 6620137 - DNA, 22 bp, Homo sapiens
actgtgaggccatacttgtgaa

SEQ ID NO: 6620138 - DNA, 22 bp, Homo sapiens
actgtgaggcggcagctggggc

SEQ ID NO: 6620139 - DNA, 20 bp, Homo sapiens
actgtgaggtgggcctttga

SEQ ID NO: 6620140 - DNA, 20 bp, Homo sapiens
actgtgagtcctgatcctaa

SEQ ID NO: 6620141 - DNA, 21 bp, Homo sapiens
actgtgataaaaagaggagct

SEQ ID NO: 6620142 - DNA, 17 bp, Homo sapiens
actgtgataatcagaag

SEQ ID NO: 6620143 - DNA, 19 bp, Homo sapiens
actgtgataatcagaagct

SEQ ID NO: 6620144 - DNA, 21 bp, Homo sapiens
actgtgatgaagccgacctta

SEQ ID NO: 6620145 - DNA, 23 bp, Homo sapiens
actgtgatgaagccgaccttaga

SEQ ID NO: 6620146 - DNA, 20 bp, Homo sapiens
actgtgatgccacacagagt

SEQ ID NO: 6620147 - DNA, 18 bp, Homo sapiens
actgtgatgccctgccct

SEQ ID NO: 6620148 - DNA, 21 bp, Homo sapiens
actgtgatggggtgggcaggg

SEQ ID NO: 6620149 - DNA, 23 bp, Homo sapiens
actgtgatggggtgggcagggct

SEQ ID NO: 6620150 - DNA, 15 bp, Homo sapiens
actgtgattagatca

SEQ ID NO: 6620151 - DNA, 20 bp, Homo sapiens
actgtgattagatcacatct

SEQ ID NO: 6620152 - DNA, 22 bp, Homo sapiens
actgtgattcagaaaatgttct

SEQ ID NO: 6620153 - DNA, 13 bp, Homo sapiens
actgtgatttgaa

SEQ ID NO: 6620154 - DNA, 20 bp, Homo sapiens
actgtgattttatgtttaaa

SEQ ID NO: 6620155 - DNA, 22 bp, Homo sapiens
actgtgattttgccctcctgcc

SEQ ID NO: 6620156 - DNA, 16 bp, Homo sapiens
actgtgcaaagcagag

SEQ ID NO: 6620157 - DNA, 16 bp, Homo sapiens
actgtgcaatacttag

SEQ ID NO: 6620158 - DNA, 13 bp, Homo sapiens
actgtgcacaccc

SEQ ID NO: 6620159 - DNA, 16 bp, Homo sapiens
actgtgcaccaggcac

SEQ ID NO: 6620160 - DNA, 12 bp, Homo sapiens
actgtgcaccta

SEQ ID NO: 6620161 - DNA, 16 bp, Homo sapiens
actgtgcactgccctg

SEQ ID NO: 6620162 - DNA, 12 bp, Homo sapiens
actgtgcagaat

SEQ ID NO: 6620163 - DNA, 22 bp, Homo sapiens
actgtgcagaataatggaaaca

SEQ ID NO: 6620164 - DNA, 15 bp, Homo sapiens
actgtgcagacccag

SEQ ID NO: 6620165 - DNA, 14 bp, Homo sapiens
actgtgcagagact

SEQ ID NO: 6620166 - DNA, 18 bp, Homo sapiens
actgtgcaggcccaggca

SEQ ID NO: 6620167 - DNA, 12 bp, Homo sapiens
actgtgcagtga

SEQ ID NO: 6620168 - DNA, 16 bp, Homo sapiens
actgtgcatagtgctg

SEQ ID NO: 6620169 - DNA, 17 bp, Homo sapiens
actgtgcatcaaccagg

SEQ ID NO: 6620170 - DNA, 16 bp, Homo sapiens
actgtgcattacaaag

SEQ ID NO: 6620171 - DNA, 23 bp, Homo sapiens
actgtgccacaatgcagttctga

SEQ ID NO: 6620172 - DNA, 14 bp, Homo sapiens
actgtgccagaggc

SEQ ID NO: 6620173 - DNA, 19 bp, Homo sapiens
actgtgcccggcctgtgta

SEQ ID NO: 6620174 - DNA, 15 bp, Homo sapiens
actgtgccctgcctt

SEQ ID NO: 6620175 - DNA, 16 bp, Homo sapiens
actgtgccctgccttc

SEQ ID NO: 6620176 - DNA, 17 bp, Homo sapiens
actgtgccctgccttca

SEQ ID NO: 6620177 - DNA, 13 bp, Homo sapiens
actgtgccctggt

SEQ ID NO: 6620178 - DNA, 15 bp, Homo sapiens
actgtgcctcagaga

SEQ ID NO: 6620179 - DNA, 22 bp, Homo sapiens
actgtgcctcagagaccagggc

SEQ ID NO: 6620180 - DNA, 15 bp, Homo sapiens
actgtgcctcaggcc

SEQ ID NO: 6620181 - DNA, 12 bp, Homo sapiens
actgtgcctggc

SEQ ID NO: 6620182 - DNA, 17 bp, Homo sapiens
actgtgcctggctccct

SEQ ID NO: 6620183 - DNA, 12 bp, Homo sapiens
actgtgcctggt

SEQ ID NO: 6620184 - DNA, 11 bp, Homo sapiens
actgtgccttt

SEQ ID NO: 6620185 - DNA, 23 bp, Homo sapiens
actgtgcctttgcaaatcagtgt

SEQ ID NO: 6620186 - DNA, 23 bp, Homo sapiens
actgtgcctttttttctttccta

SEQ ID NO: 6620187 - DNA, 17 bp, Homo sapiens
actgtgcgttttagagt

SEQ ID NO: 6620188 - DNA, 18 bp, Homo sapiens
actgtgcgttttagagta

SEQ ID NO: 6620189 - DNA, 18 bp, Homo sapiens
actgtgctaataacagtg

SEQ ID NO: 6620190 - DNA, 21 bp, Homo sapiens
actgtgctaatgggctgctgt

SEQ ID NO: 6620191 - DNA, 21 bp, Homo sapiens
actgtgctcaaccagacagat

SEQ ID NO: 6620192 - DNA, 16 bp, Homo sapiens
actgtgctcagataca

SEQ ID NO: 6620193 - DNA, 14 bp, Homo sapiens
actgtgctcccacg

SEQ ID NO: 6620194 - DNA, 20 bp, Homo sapiens
actgtgctcccacggggacc

SEQ ID NO: 6620195 - DNA, 20 bp, Homo sapiens
actgtgctgtcctttaacat

SEQ ID NO: 6620196 - DNA, 13 bp, Homo sapiens
actgtgctgttgt

SEQ ID NO: 6620197 - DNA, 18 bp, Homo sapiens
actgtgctgttgttatga

SEQ ID NO: 6620198 - DNA, 23 bp, Homo sapiens
actgtgcttacagtgactgtcgt

SEQ ID NO: 6620199 - DNA, 20 bp, Homo sapiens
actgtgcttatttttttaag

SEQ ID NO: 6620200 - DNA, 16 bp, Homo sapiens
actgtgcttcgagcca

SEQ ID NO: 6620201 - DNA, 21 bp, Homo sapiens
actgtgcttcgagccaactct

SEQ ID NO: 6620202 - DNA, 12 bp, Homo sapiens
actgtgctttct

SEQ ID NO: 6620203 - DNA, 13 bp, Homo sapiens
actgtgctttcta

SEQ ID NO: 6620204 - DNA, 21 bp, Homo sapiens
actgtgctttctattgtacag

SEQ ID NO: 6620205 - DNA, 22 bp, Homo sapiens
actgtgctttctattgtacaga

SEQ ID NO: 6620206 - DNA, 17 bp, Homo sapiens
actgtggaaaaatattt

SEQ ID NO: 6620207 - DNA, 15 bp, Homo sapiens
actgtggaaaatgct

SEQ ID NO: 6620208 - DNA, 12 bp, Homo sapiens
actgtggaaaga

SEQ ID NO: 6620209 - DNA, 14 bp, Homo sapiens
actgtggaaagaca

SEQ ID NO: 6620210 - DNA, 17 bp, Homo sapiens
actgtggaactgccacc

SEQ ID NO: 6620211 - DNA, 17 bp, Homo sapiens
actgtggaatataaata

SEQ ID NO: 6620212 - DNA, 19 bp, Homo sapiens
actgtggaatataaatagc

SEQ ID NO: 6620213 - DNA, 18 bp, Homo sapiens
actgtggaatttattggc

SEQ ID NO: 6620214 - DNA, 15 bp, Homo sapiens
actgtggagactgct

SEQ ID NO: 6620215 - DNA, 16 bp, Homo sapiens
actgtggagactttct

SEQ ID NO: 6620216 - DNA, 22 bp, Homo sapiens
actgtggagactttctgttact

SEQ ID NO: 6620217 - DNA, 16 bp, Homo sapiens
actgtggaggaaggat

SEQ ID NO: 6620218 - DNA, 17 bp, Homo sapiens
actgtggaggaaggatt

SEQ ID NO: 6620219 - DNA, 20 bp, Homo sapiens
actgtggagggagtgttcaa

SEQ ID NO: 6620220 - DNA, 22 bp, Homo sapiens
actgtggcactgccaccagcaa

SEQ ID NO: 6620221 - DNA, 20 bp, Homo sapiens
actgtggcacttgcctgggt

SEQ ID NO: 6620222 - DNA, 22 bp, Homo sapiens
actgtggcacttgcctgggtca

SEQ ID NO: 6620223 - DNA, 18 bp, Homo sapiens
actgtggcagcaggaggg

SEQ ID NO: 6620224 - DNA, 19 bp, Homo sapiens
actgtggcagcaggaggga

SEQ ID NO: 6620225 - DNA, 18 bp, Homo sapiens
actgtggccacagccccc

SEQ ID NO: 6620226 - DNA, 15 bp, Homo sapiens
actgtggccagagct

SEQ ID NO: 6620227 - DNA, 14 bp, Homo sapiens
actgtggccccaag

SEQ ID NO: 6620228 - DNA, 12 bp, Homo sapiens
actgtggccctg

SEQ ID NO: 6620229 - DNA, 20 bp, Homo sapiens
actgtggcccttctgtccac

SEQ ID NO: 6620230 - DNA, 14 bp, Homo sapiens
actgtggcctcagg

SEQ ID NO: 6620231 - DNA, 15 bp, Homo sapiens
actgtggcctcagga

SEQ ID NO: 6620232 - DNA, 17 bp, Homo sapiens
actgtggcctgcaggag

SEQ ID NO: 6620233 - DNA, 18 bp, Homo sapiens
actgtggcctgcaggagg

SEQ ID NO: 6620234 - DNA, 19 bp, Homo sapiens
actgtggcgactctgcaga

SEQ ID NO: 6620235 - DNA, 16 bp, Homo sapiens
actgtggctcttgcct

SEQ ID NO: 6620236 - DNA, 12 bp, Homo sapiens
actgtggctgca

SEQ ID NO: 6620237 - DNA, 12 bp, Homo sapiens
actgtggctgtc

SEQ ID NO: 6620238 - DNA, 14 bp, Homo sapiens
actgtggctgtctg

SEQ ID NO: 6620239 - DNA, 21 bp, Homo sapiens
actgtggcttctccgtcactc

SEQ ID NO: 6620240 - DNA, 17 bp, Homo sapiens
actgtggctttggcaga

SEQ ID NO: 6620241 - DNA, 13 bp, Homo sapiens
actgtgggaaaga

SEQ ID NO: 6620242 - DNA, 19 bp, Homo sapiens
actgtgggcaaagtcctcc

SEQ ID NO: 6620243 - DNA, 18 bp, Homo sapiens
actgtgggcaatttagaa

SEQ ID NO: 6620244 - DNA, 18 bp, Homo sapiens
actgtgggtagacacaca

SEQ ID NO: 6620245 - DNA, 24 bp, Homo sapiens
actgtgggtccgagagggaagctg

SEQ ID NO: 6620246 - DNA, 23 bp, Homo sapiens
actgtgggtcgtagagccttgac

SEQ ID NO: 6620247 - DNA, 14 bp, Homo sapiens
actgtgggtgggga

SEQ ID NO: 6620248 - DNA, 17 bp, Homo sapiens
actgtgggtggggaggc

SEQ ID NO: 6620249 - DNA, 21 bp, Homo sapiens
actgtgggtggggaggccctg

SEQ ID NO: 6620250 - DNA, 17 bp, Homo sapiens
actgtggtaggggcagg

SEQ ID NO: 6620251 - DNA, 19 bp, Homo sapiens
actgtggtaggggcaggga

SEQ ID NO: 6620252 - DNA, 20 bp, Homo sapiens
actgtggtaggggcagggag

SEQ ID NO: 6620253 - DNA, 19 bp, Homo sapiens
actgtggtaggtgtttgaa

SEQ ID NO: 6620254 - DNA, 20 bp, Homo sapiens
actgtggtcaggcccagcct

SEQ ID NO: 6620255 - DNA, 21 bp, Homo sapiens
actgtggtcccagctacaggg

SEQ ID NO: 6620256 - DNA, 21 bp, Homo sapiens
actgtggtgacttctgctgct

SEQ ID NO: 6620257 - DNA, 12 bp, Homo sapiens
actgtgtaaact

SEQ ID NO: 6620258 - DNA, 17 bp, Homo sapiens
actgtgtaaatatatgt

SEQ ID NO: 6620259 - DNA, 21 bp, Homo sapiens
actgtgtaagggccagaaata

SEQ ID NO: 6620260 - DNA, 22 bp, Homo sapiens
actgtgtaatataaaagatctt

SEQ ID NO: 6620261 - DNA, 23 bp, Homo sapiens
actgtgtacagtaaatggcttat

SEQ ID NO: 6620262 - DNA, 12 bp, Homo sapiens
actgtgtacata

SEQ ID NO: 6620263 - DNA, 22 bp, Homo sapiens
actgtgtactgtatagacagtt

SEQ ID NO: 6620264 - DNA, 14 bp, Homo sapiens
actgtgtactgttc

SEQ ID NO: 6620265 - DNA, 13 bp, Homo sapiens
actgtgtatattt

SEQ ID NO: 6620266 - DNA, 14 bp, Homo sapiens
actgtgtatcatta

SEQ ID NO: 6620267 - DNA, 16 bp, Homo sapiens
actgtgtatcattaaa

SEQ ID NO: 6620268 - DNA, 17 bp, Homo sapiens
actgtgtatcattaaaa

SEQ ID NO: 6620269 - DNA, 22 bp, Homo sapiens
actgtgtatttatttaaaactc

SEQ ID NO: 6620270 - DNA, 23 bp, Homo sapiens
actgtgtcacagtttcaggcttt

SEQ ID NO: 6620271 - DNA, 20 bp, Homo sapiens
actgtgtcatggtgatgcaa

SEQ ID NO: 6620272 - DNA, 20 bp, Homo sapiens
actgtgtcccagtgtctggc

SEQ ID NO: 6620273 - DNA, 21 bp, Homo sapiens
actgtgtcccagtgtctggcc

SEQ ID NO: 6620274 - DNA, 19 bp, Homo sapiens
actgtgtccctctctctgg

SEQ ID NO: 6620275 - DNA, 14 bp, Homo sapiens
actgtgtcctggtg

SEQ ID NO: 6620276 - DNA, 23 bp, Homo sapiens
actgtgtctcatggtcccacttc

SEQ ID NO: 6620277 - DNA, 16 bp, Homo sapiens
actgtgtctctatgtg

SEQ ID NO: 6620278 - DNA, 20 bp, Homo sapiens
actgtgtctctatgtgaata

SEQ ID NO: 6620279 - DNA, 12 bp, Homo sapiens
actgtgtctctg

SEQ ID NO: 6620280 - DNA, 15 bp, Homo sapiens
actgtgtctctgttt

SEQ ID NO: 6620281 - DNA, 22 bp, Homo sapiens
actgtgtctctgtttcctgaaa

SEQ ID NO: 6620282 - DNA, 20 bp, Homo sapiens
actgtgtctgaatcatgtct

SEQ ID NO: 6620283 - DNA, 12 bp, Homo sapiens
actgtgtgaaga

SEQ ID NO: 6620284 - DNA, 20 bp, Homo sapiens
actgtgtgaggctgtgtctc

SEQ ID NO: 6620285 - DNA, 20 bp, Homo sapiens
actgtgtgccttctgccaac

SEQ ID NO: 6620286 - DNA, 12 bp, Homo sapiens
actgtgtgctca

SEQ ID NO: 6620287 - DNA, 18 bp, Homo sapiens
actgtgtgctgactgaac

SEQ ID NO: 6620288 - DNA, 17 bp, Homo sapiens
actgtgtggactgtgat

SEQ ID NO: 6620289 - DNA, 13 bp, Homo sapiens
actgtgtgtgaat

SEQ ID NO: 6620290 - DNA, 20 bp, Homo sapiens
actgtgtgtgccctctgggc

SEQ ID NO: 6620291 - DNA, 21 bp, Homo sapiens
actgtgtgtgccctctgggct

SEQ ID NO: 6620292 - DNA, 16 bp, Homo sapiens
actgtgtgtgtgaatg

SEQ ID NO: 6620293 - DNA, 16 bp, Homo sapiens
actgtgtgtgtgtgtg

SEQ ID NO: 6620294 - DNA, 14 bp, Homo sapiens
actgtgtgttgcca

SEQ ID NO: 6620295 - DNA, 19 bp, Homo sapiens
actgtgtgttgccacagga

SEQ ID NO: 6620296 - DNA, 15 bp, Homo sapiens
actgtgttaaaattt

SEQ ID NO: 6620297 - DNA, 17 bp, Homo sapiens
actgtgttaaaattttt

SEQ ID NO: 6620298 - DNA, 21 bp, Homo sapiens
actgtgttactgctttgcaaa

SEQ ID NO: 6620299 - DNA, 16 bp, Homo sapiens
actgtgttgcccaggc

SEQ ID NO: 6620300 - DNA, 19 bp, Homo sapiens
actgtgttggccaggctgg

SEQ ID NO: 6620301 - DNA, 15 bp, Homo sapiens
actgtgttgtattaa

SEQ ID NO: 6620302 - DNA, 22 bp, Homo sapiens
actgtgtttaactgctgcaggg

SEQ ID NO: 6620303 - DNA, 20 bp, Homo sapiens
actgtgtttatatgtcttgc

SEQ ID NO: 6620304 - DNA, 17 bp, Homo sapiens
actgtgtttcaaatgga

SEQ ID NO: 6620305 - DNA, 14 bp, Homo sapiens
actgtgtttcaagt

SEQ ID NO: 6620306 - DNA, 21 bp, Homo sapiens
actgtgtttctagttgcattt

SEQ ID NO: 6620307 - DNA, 18 bp, Homo sapiens
actgtgtttctgtgctcc

SEQ ID NO: 6620308 - DNA, 22 bp, Homo sapiens
actgtgtttctgtgctccaagt

SEQ ID NO: 6620309 - DNA, 21 bp, Homo sapiens
actgtgtttgatttgtctcat

SEQ ID NO: 6620310 - DNA, 13 bp, Homo sapiens
actgtgtttgcat

SEQ ID NO: 6620311 - DNA, 19 bp, Homo sapiens
actgtgttttataaaatag

SEQ ID NO: 6620312 - DNA, 11 bp, Homo sapiens
actgtgttttt

SEQ ID NO: 6620313 - DNA, 21 bp, Homo sapiens
actgtgtttttaaattttgta

SEQ ID NO: 6620314 - DNA, 14 bp, Homo sapiens
actgttaaaactgt

SEQ ID NO: 6620315 - DNA, 16 bp, Homo sapiens
actgttaacttattca

SEQ ID NO: 6620316 - DNA, 19 bp, Homo sapiens
actgttaagaaatctgttt

SEQ ID NO: 6620317 - DNA, 20 bp, Homo sapiens
actgttaagggaagctgata

SEQ ID NO: 6620318 - DNA, 17 bp, Homo sapiens
actgttaatacacagta

SEQ ID NO: 6620319 - DNA, 23 bp, Homo sapiens
actgttacaacttgtatttccaa

SEQ ID NO: 6620320 - DNA, 17 bp, Homo sapiens
actgttacagactgaaa

SEQ ID NO: 6620321 - DNA, 18 bp, Homo sapiens
actgttacagactgaaag

SEQ ID NO: 6620322 - DNA, 20 bp, Homo sapiens
actgttacagtaatgtcata

SEQ ID NO: 6620323 - DNA, 21 bp, Homo sapiens
actgttaccattggaaatttc

SEQ ID NO: 6620324 - DNA, 23 bp, Homo sapiens
actgttacctgatcaatgacaga

SEQ ID NO: 6620325 - DNA, 17 bp, Homo sapiens
actgttactccacagcg

SEQ ID NO: 6620326 - DNA, 15 bp, Homo sapiens
actgttactgggccc

SEQ ID NO: 6620327 - DNA, 17 bp, Homo sapiens
actgttactttggcaat

SEQ ID NO: 6620328 - DNA, 14 bp, Homo sapiens
actgttacttttta

SEQ ID NO: 6620329 - DNA, 16 bp, Homo sapiens
actgttagaacactat

SEQ ID NO: 6620330 - DNA, 17 bp, Homo sapiens
actgttagaacactatt

SEQ ID NO: 6620331 - DNA, 14 bp, Homo sapiens
actgttagatgctg

SEQ ID NO: 6620332 - DNA, 17 bp, Homo sapiens
actgttagcactgttga

SEQ ID NO: 6620333 - DNA, 18 bp, Homo sapiens
actgttagcactgttgat

SEQ ID NO: 6620334 - DNA, 13 bp, Homo sapiens
actgttagctttt

SEQ ID NO: 6620335 - DNA, 18 bp, Homo sapiens
actgttagcttttacctt

SEQ ID NO: 6620336 - DNA, 20 bp, Homo sapiens
actgttagctttttaaaaca

SEQ ID NO: 6620337 - DNA, 14 bp, Homo sapiens
actgttagtgacag

SEQ ID NO: 6620338 - DNA, 14 bp, Homo sapiens
actgttataaattt

SEQ ID NO: 6620339 - DNA, 16 bp, Homo sapiens
actgttataaattttg

SEQ ID NO: 6620340 - DNA, 18 bp, Homo sapiens
actgttataaattttgta

SEQ ID NO: 6620341 - DNA, 23 bp, Homo sapiens
actgttataaattttgtacattt

SEQ ID NO: 6620342 - DNA, 19 bp, Homo sapiens
actgttatcctatttagat

SEQ ID NO: 6620343 - DNA, 12 bp, Homo sapiens
actgttatctcg

SEQ ID NO: 6620344 - DNA, 23 bp, Homo sapiens
actgttatgaaataaagaaattg

SEQ ID NO: 6620345 - DNA, 19 bp, Homo sapiens
actgttatgtgagaacatt

SEQ ID NO: 6620346 - DNA, 20 bp, Homo sapiens
actgttatgtgagaacatta

SEQ ID NO: 6620347 - DNA, 12 bp, Homo sapiens
actgttattctt

SEQ ID NO: 6620348 - DNA, 15 bp, Homo sapiens
actgttattctttgc

SEQ ID NO: 6620349 - DNA, 16 bp, Homo sapiens
actgttattgaaaata

SEQ ID NO: 6620350 - DNA, 19 bp, Homo sapiens
actgttattgaaaatatat

SEQ ID NO: 6620351 - DNA, 13 bp, Homo sapiens
actgttatttata

SEQ ID NO: 6620352 - DNA, 16 bp, Homo sapiens
actgttcactcactct

SEQ ID NO: 6620353 - DNA, 15 bp, Homo sapiens
actgttcatacagtt

SEQ ID NO: 6620354 - DNA, 17 bp, Homo sapiens
actgttcatacagtttt

SEQ ID NO: 6620355 - DNA, 20 bp, Homo sapiens
actgttcatgaatacgtaaa

SEQ ID NO: 6620356 - DNA, 15 bp, Homo sapiens
actgttcatttgaaa

SEQ ID NO: 6620357 - DNA, 20 bp, Homo sapiens
actgttccaggccctccagt

SEQ ID NO: 6620358 - DNA, 20 bp, Homo sapiens
actgttcccagcaaagtttt

SEQ ID NO: 6620359 - DNA, 18 bp, Homo sapiens
actgttccccctgtgcag

SEQ ID NO: 6620360 - DNA, 16 bp, Homo sapiens
actgttccctccaagg

SEQ ID NO: 6620361 - DNA, 19 bp, Homo sapiens
actgttccctgaggtggga

SEQ ID NO: 6620362 - DNA, 21 bp, Homo sapiens
actgttcctcatgttgctgaa

SEQ ID NO: 6620363 - DNA, 18 bp, Homo sapiens
actgttcctgagccttca

SEQ ID NO: 6620364 - DNA, 20 bp, Homo sapiens
actgttccttatttctctct

SEQ ID NO: 6620365 - DNA, 23 bp, Homo sapiens
actgttccttatttctctctcct

SEQ ID NO: 6620366 - DNA, 24 bp, Homo sapiens
actgttccttatttctctctcctg

SEQ ID NO: 6620367 - DNA, 18 bp, Homo sapiens
actgttctaaagctctga

SEQ ID NO: 6620368 - DNA, 19 bp, Homo sapiens
actgttctcaacatactgt

SEQ ID NO: 6620369 - DNA, 17 bp, Homo sapiens
actgttctcttactgcc

SEQ ID NO: 6620370 - DNA, 18 bp, Homo sapiens
actgttctcttcttgaac

SEQ ID NO: 6620371 - DNA, 15 bp, Homo sapiens
actgttctgaaatta

SEQ ID NO: 6620372 - DNA, 18 bp, Homo sapiens
actgttctgggactccag

SEQ ID NO: 6620373 - DNA, 22 bp, Homo sapiens
actgttctgggactccaggtct

SEQ ID NO: 6620374 - DNA, 13 bp, Homo sapiens
actgttctgtgtc

SEQ ID NO: 6620375 - DNA, 17 bp, Homo sapiens
actgttctgtgtctttc

SEQ ID NO: 6620376 - DNA, 15 bp, Homo sapiens
actgttctgttctca

SEQ ID NO: 6620377 - DNA, 13 bp, Homo sapiens
actgttcttagct

SEQ ID NO: 6620378 - DNA, 21 bp, Homo sapiens
actgttcttagctcaatgagc

SEQ ID NO: 6620379 - DNA, 13 bp, Homo sapiens
actgttcttgctg

SEQ ID NO: 6620380 - DNA, 16 bp, Homo sapiens
actgttcttgctgcta

SEQ ID NO: 6620381 - DNA, 22 bp, Homo sapiens
actgttcttgctgctagaactt

SEQ ID NO: 6620382 - DNA, 15 bp, Homo sapiens
actgttcttttgcat

SEQ ID NO: 6620383 - DNA, 14 bp, Homo sapiens
actgttgaaaatta

SEQ ID NO: 6620384 - DNA, 21 bp, Homo sapiens
actgttgaaaattattttaaa

SEQ ID NO: 6620385 - DNA, 13 bp, Homo sapiens
actgttgaaagga

SEQ ID NO: 6620386 - DNA, 20 bp, Homo sapiens
actgttgaacttagaactat

SEQ ID NO: 6620387 - DNA, 17 bp, Homo sapiens
actgttgagccccagtg

SEQ ID NO: 6620388 - DNA, 18 bp, Homo sapiens
actgttgagccccagtgc

SEQ ID NO: 6620389 - DNA, 18 bp, Homo sapiens
actgttgagttggacaca

SEQ ID NO: 6620390 - DNA, 20 bp, Homo sapiens
actgttgatacaaaccactg

SEQ ID NO: 6620391 - DNA, 17 bp, Homo sapiens
actgttgatccatctca

SEQ ID NO: 6620392 - DNA, 16 bp, Homo sapiens
actgttgatgaagtat

SEQ ID NO: 6620393 - DNA, 13 bp, Homo sapiens
actgttgatgtat

SEQ ID NO: 6620394 - DNA, 16 bp, Homo sapiens
actgttgatgtatctg

SEQ ID NO: 6620395 - DNA, 17 bp, Homo sapiens
actgttgcaaagcttcc

SEQ ID NO: 6620396 - DNA, 14 bp, Homo sapiens
actgttgcacgtgt

SEQ ID NO: 6620397 - DNA, 15 bp, Homo sapiens
actgttgcacgtgtg

SEQ ID NO: 6620398 - DNA, 16 bp, Homo sapiens
actgttgcacgtgtgt

SEQ ID NO: 6620399 - DNA, 22 bp, Homo sapiens
actgttgcacgtgtgtttttct

SEQ ID NO: 6620400 - DNA, 13 bp, Homo sapiens
actgttgcagtgg

SEQ ID NO: 6620401 - DNA, 21 bp, Homo sapiens
actgttgcagtggcctggccg

SEQ ID NO: 6620402 - DNA, 12 bp, Homo sapiens
actgttgcattt

SEQ ID NO: 6620403 - DNA, 16 bp, Homo sapiens
actgttgcatttactt

SEQ ID NO: 6620404 - DNA, 14 bp, Homo sapiens
actgttgcccccca

SEQ ID NO: 6620405 - DNA, 16 bp, Homo sapiens
actgttgcccttttcc

SEQ ID NO: 6620406 - DNA, 19 bp, Homo sapiens
actgttgcctaattggaaa

SEQ ID NO: 6620407 - DNA, 21 bp, Homo sapiens
actgttgcctaattggaaagt

SEQ ID NO: 6620408 - DNA, 19 bp, Homo sapiens
actgttgctgactactact

SEQ ID NO: 6620409 - DNA, 18 bp, Homo sapiens
actgttgcttaattgtga

SEQ ID NO: 6620410 - DNA, 15 bp, Homo sapiens
actgttgctttaata

SEQ ID NO: 6620411 - DNA, 19 bp, Homo sapiens
actgttgctttaatatgag

SEQ ID NO: 6620412 - DNA, 22 bp, Homo sapiens
actgttgctttgaaaaatctca

SEQ ID NO: 6620413 - DNA, 21 bp, Homo sapiens
actgttggaatggatttttct

SEQ ID NO: 6620414 - DNA, 21 bp, Homo sapiens
actgttggaattcactttatt

SEQ ID NO: 6620415 - DNA, 18 bp, Homo sapiens
actgttggattcagaaat

SEQ ID NO: 6620416 - DNA, 15 bp, Homo sapiens
actgttggcacttat

SEQ ID NO: 6620417 - DNA, 17 bp, Homo sapiens
actgttggcacttatag

SEQ ID NO: 6620418 - DNA, 16 bp, Homo sapiens
actgttggctctctga

SEQ ID NO: 6620419 - DNA, 17 bp, Homo sapiens
actgttggctctctgac

SEQ ID NO: 6620420 - DNA, 18 bp, Homo sapiens
actgttggctgattggaa

SEQ ID NO: 6620421 - DNA, 23 bp, Homo sapiens
actgttggctgattggaaaataa

SEQ ID NO: 6620422 - DNA, 16 bp, Homo sapiens
actgttgggacagcca

SEQ ID NO: 6620423 - DNA, 18 bp, Homo sapiens
actgttgggacagccatt

SEQ ID NO: 6620424 - DNA, 22 bp, Homo sapiens
actgttgggacagccattttcc

SEQ ID NO: 6620425 - DNA, 21 bp, Homo sapiens
actgttgggtgggtgggccct

SEQ ID NO: 6620426 - DNA, 15 bp, Homo sapiens
actgttggtggcaaa

SEQ ID NO: 6620427 - DNA, 17 bp, Homo sapiens
actgttggttcatccag

SEQ ID NO: 6620428 - DNA, 14 bp, Homo sapiens
actgttgtaagaat

SEQ ID NO: 6620429 - DNA, 16 bp, Homo sapiens
actgttgtacaatcat

SEQ ID NO: 6620430 - DNA, 19 bp, Homo sapiens
actgttgtacaatcatgtt

SEQ ID NO: 6620431 - DNA, 21 bp, Homo sapiens
actgttgtacaatcatgttct

SEQ ID NO: 6620432 - DNA, 17 bp, Homo sapiens
actgttgtagcattttc

SEQ ID NO: 6620433 - DNA, 19 bp, Homo sapiens
actgttgtagcattttcct

SEQ ID NO: 6620434 - DNA, 20 bp, Homo sapiens
actgttgtagcattttcctg

SEQ ID NO: 6620435 - DNA, 19 bp, Homo sapiens
actgttgtcatttccaaat

SEQ ID NO: 6620436 - DNA, 19 bp, Homo sapiens
actgttgtccttaaaattc

SEQ ID NO: 6620437 - DNA, 16 bp, Homo sapiens
actgttgtgacctgaa

SEQ ID NO: 6620438 - DNA, 18 bp, Homo sapiens
actgttgtgatcttgcat

SEQ ID NO: 6620439 - DNA, 22 bp, Homo sapiens
actgttgtgatcttgcattcat

SEQ ID NO: 6620440 - DNA, 19 bp, Homo sapiens
actgttgtgctccatagag

SEQ ID NO: 6620441 - DNA, 22 bp, Homo sapiens
actgttgtgctccatagagcag

SEQ ID NO: 6620442 - DNA, 12 bp, Homo sapiens
actgttgttact

SEQ ID NO: 6620443 - DNA, 15 bp, Homo sapiens
actgttgttactgga

SEQ ID NO: 6620444 - DNA, 16 bp, Homo sapiens
actgtttaagacactt

SEQ ID NO: 6620445 - DNA, 17 bp, Homo sapiens
actgtttaatatttata

SEQ ID NO: 6620446 - DNA, 20 bp, Homo sapiens
actgtttaatgttctgtgat

SEQ ID NO: 6620447 - DNA, 20 bp, Homo sapiens
actgtttacaagaaaaaatg

SEQ ID NO: 6620448 - DNA, 19 bp, Homo sapiens
actgtttacatatctgtcc

SEQ ID NO: 6620449 - DNA, 20 bp, Homo sapiens
actgtttactcacattgtcc

SEQ ID NO: 6620450 - DNA, 13 bp, Homo sapiens
actgtttagattt

SEQ ID NO: 6620451 - DNA, 20 bp, Homo sapiens
actgtttagatttgccatag

SEQ ID NO: 6620452 - DNA, 12 bp, Homo sapiens
actgtttataat

SEQ ID NO: 6620453 - DNA, 18 bp, Homo sapiens
actgtttatatcttcacc

SEQ ID NO: 6620454 - DNA, 17 bp, Homo sapiens
actgtttatttaaggat

SEQ ID NO: 6620455 - DNA, 18 bp, Homo sapiens
actgtttatttaaggatg

SEQ ID NO: 6620456 - DNA, 21 bp, Homo sapiens
actgtttatttaaggatggat

SEQ ID NO: 6620457 - DNA, 11 bp, Homo sapiens
actgtttcaaa

SEQ ID NO: 6620458 - DNA, 14 bp, Homo sapiens
actgtttcaaggtc

SEQ ID NO: 6620459 - DNA, 20 bp, Homo sapiens
actgtttcactactcagcat

SEQ ID NO: 6620460 - DNA, 20 bp, Homo sapiens
actgtttcactgaaatgttt

SEQ ID NO: 6620461 - DNA, 18 bp, Homo sapiens
actgtttcaggggtgact

SEQ ID NO: 6620462 - DNA, 18 bp, Homo sapiens
actgtttcatagttttct

SEQ ID NO: 6620463 - DNA, 17 bp, Homo sapiens
actgtttcatgagccca

SEQ ID NO: 6620464 - DNA, 13 bp, Homo sapiens
actgtttcattca

SEQ ID NO: 6620465 - DNA, 13 bp, Homo sapiens
actgtttccttca

SEQ ID NO: 6620466 - DNA, 12 bp, Homo sapiens
actgtttctaaa

SEQ ID NO: 6620467 - DNA, 13 bp, Homo sapiens
actgtttctcaag

SEQ ID NO: 6620468 - DNA, 15 bp, Homo sapiens
actgtttctctgctg

SEQ ID NO: 6620469 - DNA, 19 bp, Homo sapiens
actgtttctcttgagctgg

SEQ ID NO: 6620470 - DNA, 20 bp, Homo sapiens
actgtttctcttgagctggc

SEQ ID NO: 6620471 - DNA, 21 bp, Homo sapiens
actgtttctcttgagctggcc

SEQ ID NO: 6620472 - DNA, 23 bp, Homo sapiens
actgtttctcttgagctggcctc

SEQ ID NO: 6620473 - DNA, 15 bp, Homo sapiens
actgtttctgtcagg

SEQ ID NO: 6620474 - DNA, 23 bp, Homo sapiens
actgtttcttagctgcactgttt

SEQ ID NO: 6620475 - DNA, 16 bp, Homo sapiens
actgtttcttgcttgt

SEQ ID NO: 6620476 - DNA, 14 bp, Homo sapiens
actgtttctttaaa

SEQ ID NO: 6620477 - DNA, 21 bp, Homo sapiens
actgtttgaaaacttcagaag

SEQ ID NO: 6620478 - DNA, 22 bp, Homo sapiens
actgtttgatataccaaattaa

SEQ ID NO: 6620479 - DNA, 23 bp, Homo sapiens
actgtttgcacttacagcttttt

SEQ ID NO: 6620480 - DNA, 22 bp, Homo sapiens
actgtttgccttctacttttaa

SEQ ID NO: 6620481 - DNA, 19 bp, Homo sapiens
actgtttggaaataaatct

SEQ ID NO: 6620482 - DNA, 13 bp, Homo sapiens
actgtttgtaata

SEQ ID NO: 6620483 - DNA, 17 bp, Homo sapiens
actgtttgtaatataca

SEQ ID NO: 6620484 - DNA, 18 bp, Homo sapiens
actgtttgtaatatacag

SEQ ID NO: 6620485 - DNA, 18 bp, Homo sapiens
actgtttgttactatgta

SEQ ID NO: 6620486 - DNA, 16 bp, Homo sapiens
actgtttgtttttaaa

SEQ ID NO: 6620487 - DNA, 15 bp, Homo sapiens
actgttttactgttt

SEQ ID NO: 6620488 - DNA, 14 bp, Homo sapiens
actgttttatagaa

SEQ ID NO: 6620489 - DNA, 17 bp, Homo sapiens
actgttttatctctgtg

SEQ ID NO: 6620490 - DNA, 23 bp, Homo sapiens
actgttttatgttgatctgcata

SEQ ID NO: 6620491 - DNA, 13 bp, Homo sapiens
actgttttcaaat

SEQ ID NO: 6620492 - DNA, 14 bp, Homo sapiens
actgttttcaagtc

SEQ ID NO: 6620493 - DNA, 20 bp, Homo sapiens
actgttttcaataacaaagc

SEQ ID NO: 6620494 - DNA, 13 bp, Homo sapiens
actgttttcctta

SEQ ID NO: 6620495 - DNA, 21 bp, Homo sapiens
actgttttctagtgtatcaaa

SEQ ID NO: 6620496 - DNA, 22 bp, Homo sapiens
actgttttctctcggctcccca

SEQ ID NO: 6620497 - DNA, 20 bp, Homo sapiens
actgttttctttatgtcttt

SEQ ID NO: 6620498 - DNA, 15 bp, Homo sapiens
actgttttgaggaat

SEQ ID NO: 6620499 - DNA, 16 bp, Homo sapiens
actgttttgccaagaa

SEQ ID NO: 6620500 - DNA, 22 bp, Homo sapiens
actgttttgccaagaatatagt

SEQ ID NO: 6620501 - DNA, 22 bp, Homo sapiens
actgttttggaatgttggctgt

SEQ ID NO: 6620502 - DNA, 13 bp, Homo sapiens
actgttttgggcc

SEQ ID NO: 6620503 - DNA, 15 bp, Homo sapiens
actgttttgggcctc

SEQ ID NO: 6620504 - DNA, 17 bp, Homo sapiens
actgttttgggcctcca

SEQ ID NO: 6620505 - DNA, 20 bp, Homo sapiens
actgttttgtatatgctgca

SEQ ID NO: 6620506 - DNA, 21 bp, Homo sapiens
actgttttgtgcggtgtgtct

SEQ ID NO: 6620507 - DNA, 17 bp, Homo sapiens
actgtttttaagtaact

SEQ ID NO: 6620508 - DNA, 13 bp, Homo sapiens
actgtttttaatg

SEQ ID NO: 6620509 - DNA, 15 bp, Homo sapiens
actgtttttacccat

SEQ ID NO: 6620510 - DNA, 17 bp, Homo sapiens
actgtttttacccatat

SEQ ID NO: 6620511 - DNA, 21 bp, Homo sapiens
actgtttttacccatatcccc

SEQ ID NO: 6620512 - DNA, 21 bp, Homo sapiens
actgtttttccatagttttga

SEQ ID NO: 6620513 - DNA, 19 bp, Homo sapiens
actgtttttgaaaaattac

SEQ ID NO: 6620514 - DNA, 23 bp, Homo sapiens
actgtttttgaaaaattacagct

SEQ ID NO: 6620515 - DNA, 13 bp, Homo sapiens
actgttttttaag

SEQ ID NO: 6620516 - DNA, 14 bp, Homo sapiens
actgttttttcctg

SEQ ID NO: 6620517 - DNA, 19 bp, Homo sapiens
actgttttttcctgagctt

SEQ ID NO: 6620518 - DNA, 20 bp, Homo sapiens
actgttttttggcttgctta

SEQ ID NO: 6620519 - DNA, 23 bp, Homo sapiens
actgttttttgttttttgtttga

SEQ ID NO: 6620520 - DNA, 21 bp, Homo sapiens
actgttttttttgcaggggtt

SEQ ID NO: 6620521 - DNA, 14 bp, Homo sapiens
acttaaaaaaatga

SEQ ID NO: 6620522 - DNA, 17 bp, Homo sapiens
acttaaaaaaatgacag

SEQ ID NO: 6620523 - DNA, 23 bp, Homo sapiens
acttaaaaaacttgtaaatgctg

SEQ ID NO: 6620524 - DNA, 15 bp, Homo sapiens
acttaaaaaatgtcc

SEQ ID NO: 6620525 - DNA, 16 bp, Homo sapiens
acttaaaaaatgtcca

SEQ ID NO: 6620526 - DNA, 21 bp, Homo sapiens
acttaaaaagtagttagccaa

SEQ ID NO: 6620527 - DNA, 20 bp, Homo sapiens
acttaaaaagtctgcattac

SEQ ID NO: 6620528 - DNA, 15 bp, Homo sapiens
acttaaaaatatgtg

SEQ ID NO: 6620529 - DNA, 22 bp, Homo sapiens
acttaaaaatggtttaaatggt

SEQ ID NO: 6620530 - DNA, 18 bp, Homo sapiens
acttaaaaatgtaaatat

SEQ ID NO: 6620531 - DNA, 19 bp, Homo sapiens
acttaaaaatgtaaatatt

SEQ ID NO: 6620532 - DNA, 13 bp, Homo sapiens
acttaaaaattaa

SEQ ID NO: 6620533 - DNA, 16 bp, Homo sapiens
acttaaaaatttatta

SEQ ID NO: 6620534 - DNA, 12 bp, Homo sapiens
acttaaaacacg

SEQ ID NO: 6620535 - DNA, 18 bp, Homo sapiens
acttaaaacacgttttaa

SEQ ID NO: 6620536 - DNA, 24 bp, Homo sapiens
acttaaaacatggtgcctatatct

SEQ ID NO: 6620537 - DNA, 18 bp, Homo sapiens
acttaaaagaacatagga

SEQ ID NO: 6620538 - DNA, 20 bp, Homo sapiens
acttaaaagaacataggaat

SEQ ID NO: 6620539 - DNA, 21 bp, Homo sapiens
acttaaaagaacataggaatt

SEQ ID NO: 6620540 - DNA, 13 bp, Homo sapiens
acttaaaagagct

SEQ ID NO: 6620541 - DNA, 20 bp, Homo sapiens
acttaaaagagctcagacat

SEQ ID NO: 6620542 - DNA, 14 bp, Homo sapiens
acttaaaagattca

SEQ ID NO: 6620543 - DNA, 21 bp, Homo sapiens
acttaaaagcaagatctacta

SEQ ID NO: 6620544 - DNA, 14 bp, Homo sapiens
acttaaaagtattc

SEQ ID NO: 6620545 - DNA, 15 bp, Homo sapiens
acttaaaagtattca

SEQ ID NO: 6620546 - DNA, 14 bp, Homo sapiens
acttaaaatacatg

SEQ ID NO: 6620547 - DNA, 22 bp, Homo sapiens
acttaaaatattcctgcatttg

SEQ ID NO: 6620548 - DNA, 21 bp, Homo sapiens
acttaaaatgatcaaggcact

SEQ ID NO: 6620549 - DNA, 14 bp, Homo sapiens
acttaaaatgtgca

SEQ ID NO: 6620550 - DNA, 18 bp, Homo sapiens
acttaaaatgtgcagtaa

SEQ ID NO: 6620551 - DNA, 18 bp, Homo sapiens
acttaaaattagtctttt

SEQ ID NO: 6620552 - DNA, 13 bp, Homo sapiens
acttaaacaaaaa

SEQ ID NO: 6620553 - DNA, 17 bp, Homo sapiens
acttaaacaaaaaacta

SEQ ID NO: 6620554 - DNA, 15 bp, Homo sapiens
acttaaacaaaaact

SEQ ID NO: 6620555 - DNA, 16 bp, Homo sapiens
acttaaacaaaaactt

SEQ ID NO: 6620556 - DNA, 17 bp, Homo sapiens
acttaaacaaaaacttt

SEQ ID NO: 6620557 - DNA, 18 bp, Homo sapiens
acttaaacaaaaactttc

SEQ ID NO: 6620558 - DNA, 15 bp, Homo sapiens
acttaaacctgtgct

SEQ ID NO: 6620559 - DNA, 15 bp, Homo sapiens
acttaaactttgtca

SEQ ID NO: 6620560 - DNA, 11 bp, Homo sapiens
acttaaagatt

SEQ ID NO: 6620561 - DNA, 12 bp, Homo sapiens
acttaaagcaaa

SEQ ID NO: 6620562 - DNA, 18 bp, Homo sapiens
acttaaagcaaaatagta

SEQ ID NO: 6620563 - DNA, 16 bp, Homo sapiens
acttaaagcttgtttg

SEQ ID NO: 6620564 - DNA, 21 bp, Homo sapiens
acttaaagggcccaatgaatt

SEQ ID NO: 6620565 - DNA, 19 bp, Homo sapiens
acttaaagttgattttgaa

SEQ ID NO: 6620566 - DNA, 11 bp, Homo sapiens
acttaaagttt

SEQ ID NO: 6620567 - DNA, 19 bp, Homo sapiens
acttaaataaatgtcatta

SEQ ID NO: 6620568 - DNA, 15 bp, Homo sapiens
acttaaataatgtga

SEQ ID NO: 6620569 - DNA, 16 bp, Homo sapiens
acttaaataatgtgaa

SEQ ID NO: 6620570 - DNA, 18 bp, Homo sapiens
acttaaataatgtgaaac

SEQ ID NO: 6620571 - DNA, 16 bp, Homo sapiens
acttaaatagtatttc

SEQ ID NO: 6620572 - DNA, 20 bp, Homo sapiens
acttaaatattgtaatatga

SEQ ID NO: 6620573 - DNA, 21 bp, Homo sapiens
acttaaatattgtaatatgac

SEQ ID NO: 6620574 - DNA, 13 bp, Homo sapiens
acttaaatcactg

SEQ ID NO: 6620575 - DNA, 19 bp, Homo sapiens
acttaaatgaacacagctc

SEQ ID NO: 6620576 - DNA, 19 bp, Homo sapiens
acttaaatggaaaaaatga

SEQ ID NO: 6620577 - DNA, 18 bp, Homo sapiens
acttaaatgttaatgaga

SEQ ID NO: 6620578 - DNA, 19 bp, Homo sapiens
acttaaatgttaatgagaa

SEQ ID NO: 6620579 - DNA, 13 bp, Homo sapiens
acttaaattttag

SEQ ID NO: 6620580 - DNA, 15 bp, Homo sapiens
acttaacaaatacat

SEQ ID NO: 6620581 - DNA, 15 bp, Homo sapiens
acttaacaagctccc

SEQ ID NO: 6620582 - DNA, 15 bp, Homo sapiens
acttaacacatgaat

SEQ ID NO: 6620583 - DNA, 20 bp, Homo sapiens
acttaacacgtgaatatttt

SEQ ID NO: 6620584 - DNA, 14 bp, Homo sapiens
acttaacagatgca

SEQ ID NO: 6620585 - DNA, 20 bp, Homo sapiens
acttaacatagccaaaatgt

SEQ ID NO: 6620586 - DNA, 18 bp, Homo sapiens
acttaacatgctgtgtaa

SEQ ID NO: 6620587 - DNA, 15 bp, Homo sapiens
acttaacattgcatc

SEQ ID NO: 6620588 - DNA, 12 bp, Homo sapiens
acttaacatttc

SEQ ID NO: 6620589 - DNA, 17 bp, Homo sapiens
acttaacatttcattgt

SEQ ID NO: 6620590 - DNA, 23 bp, Homo sapiens
acttaaccctgacaaattttaat

SEQ ID NO: 6620591 - DNA, 16 bp, Homo sapiens
acttaaccggagttcg

SEQ ID NO: 6620592 - DNA, 13 bp, Homo sapiens
acttaaccttgaa

SEQ ID NO: 6620593 - DNA, 15 bp, Homo sapiens
acttaacggctccag

SEQ ID NO: 6620594 - DNA, 17 bp, Homo sapiens
acttaacggctccagga

SEQ ID NO: 6620595 - DNA, 22 bp, Homo sapiens
acttaactatcatcttattcag

SEQ ID NO: 6620596 - DNA, 23 bp, Homo sapiens
acttaactatctgttcccttcct

SEQ ID NO: 6620597 - DNA, 12 bp, Homo sapiens
acttaactgaag

SEQ ID NO: 6620598 - DNA, 17 bp, Homo sapiens
acttaactggcccagaa

SEQ ID NO: 6620599 - DNA, 21 bp, Homo sapiens
acttaactgtgtgaagaaatg

SEQ ID NO: 6620600 - DNA, 16 bp, Homo sapiens
acttaagaaacactga

SEQ ID NO: 6620601 - DNA, 14 bp, Homo sapiens
acttaagaaagcaa

SEQ ID NO: 6620602 - DNA, 20 bp, Homo sapiens
acttaagacaaatgggactg

SEQ ID NO: 6620603 - DNA, 19 bp, Homo sapiens
acttaagcaaaagaaaaag

SEQ ID NO: 6620604 - DNA, 21 bp, Homo sapiens
acttaagcccaggagtctgag

SEQ ID NO: 6620605 - DNA, 17 bp, Homo sapiens
acttaagctcccctgcc

SEQ ID NO: 6620606 - DNA, 18 bp, Homo sapiens
acttaagctcccctgcct

SEQ ID NO: 6620607 - DNA, 20 bp, Homo sapiens
acttaaggaagtttgatttt

SEQ ID NO: 6620608 - DNA, 21 bp, Homo sapiens
acttaaggacctttttaaaga

SEQ ID NO: 6620609 - DNA, 19 bp, Homo sapiens
acttaaggagaaatagctg

SEQ ID NO: 6620610 - DNA, 17 bp, Homo sapiens
acttaagggagaaaaaa

SEQ ID NO: 6620611 - DNA, 19 bp, Homo sapiens
acttaaggggccaaggcag

SEQ ID NO: 6620612 - DNA, 21 bp, Homo sapiens
acttaagggttttttagaaaa

SEQ ID NO: 6620613 - DNA, 21 bp, Homo sapiens
acttaaggtgaagtgaggaca

SEQ ID NO: 6620614 - DNA, 15 bp, Homo sapiens
acttaagtattgtca

SEQ ID NO: 6620615 - DNA, 16 bp, Homo sapiens
acttaagtcttcctta

SEQ ID NO: 6620616 - DNA, 17 bp, Homo sapiens
acttaagtcttccttaa

SEQ ID NO: 6620617 - DNA, 17 bp, Homo sapiens
acttaagtgcacttttt

SEQ ID NO: 6620618 - DNA, 18 bp, Homo sapiens
acttaagtgttcatttta

SEQ ID NO: 6620619 - DNA, 23 bp, Homo sapiens
acttaagtgttcattttaagtaa

SEQ ID NO: 6620620 - DNA, 13 bp, Homo sapiens
acttaagttcttt

SEQ ID NO: 6620621 - DNA, 18 bp, Homo sapiens
acttaagtttagaaatta

SEQ ID NO: 6620622 - DNA, 15 bp, Homo sapiens
acttaagtttttcca

SEQ ID NO: 6620623 - DNA, 17 bp, Homo sapiens
acttaagtttttccaaa

SEQ ID NO: 6620624 - DNA, 15 bp, Homo sapiens
acttaataaaacatt

SEQ ID NO: 6620625 - DNA, 18 bp, Homo sapiens
acttaataaaacatttta

SEQ ID NO: 6620626 - DNA, 15 bp, Homo sapiens
acttaataaatctgc

SEQ ID NO: 6620627 - DNA, 15 bp, Homo sapiens
acttaataactgtgt

SEQ ID NO: 6620628 - DNA, 17 bp, Homo sapiens
acttaataatgtgtaca

SEQ ID NO: 6620629 - DNA, 23 bp, Homo sapiens
acttaataatttttacctaatct

SEQ ID NO: 6620630 - DNA, 17 bp, Homo sapiens
acttaatactaccttga

SEQ ID NO: 6620631 - DNA, 18 bp, Homo sapiens
acttaatactaccttgaa

SEQ ID NO: 6620632 - DNA, 19 bp, Homo sapiens
acttaatactcaaatgagt

SEQ ID NO: 6620633 - DNA, 18 bp, Homo sapiens
acttaatactcatgcatt

SEQ ID NO: 6620634 - DNA, 18 bp, Homo sapiens
acttaatactgaatttct

SEQ ID NO: 6620635 - DNA, 14 bp, Homo sapiens
acttaatagaaaca

SEQ ID NO: 6620636 - DNA, 14 bp, Homo sapiens
acttaatagacatt

SEQ ID NO: 6620637 - DNA, 17 bp, Homo sapiens
acttaatagacattttt

SEQ ID NO: 6620638 - DNA, 16 bp, Homo sapiens
acttaatatgttttat

SEQ ID NO: 6620639 - DNA, 16 bp, Homo sapiens
acttaatcaaaactca

SEQ ID NO: 6620640 - DNA, 13 bp, Homo sapiens
acttaatctaaat

SEQ ID NO: 6620641 - DNA, 15 bp, Homo sapiens
acttaatctaaatgg

SEQ ID NO: 6620642 - DNA, 17 bp, Homo sapiens
acttaatctaagaaaca

SEQ ID NO: 6620643 - DNA, 10 bp, Homo sapiens
acttaatctt

SEQ ID NO: 6620644 - DNA, 20 bp, Homo sapiens
acttaatcttctctcttgat

SEQ ID NO: 6620645 - DNA, 14 bp, Homo sapiens
acttaatctttcta

SEQ ID NO: 6620646 - DNA, 14 bp, Homo sapiens
acttaatctttgct

SEQ ID NO: 6620647 - DNA, 16 bp, Homo sapiens
acttaatgaaaacaat

SEQ ID NO: 6620648 - DNA, 18 bp, Homo sapiens
acttaatgaaaacaatgc

SEQ ID NO: 6620649 - DNA, 22 bp, Homo sapiens
acttaatggctgttgagggcca

SEQ ID NO: 6620650 - DNA, 14 bp, Homo sapiens
acttaatgtaattc

SEQ ID NO: 6620651 - DNA, 21 bp, Homo sapiens
acttaatgtaattcaggactc

SEQ ID NO: 6620652 - DNA, 16 bp, Homo sapiens
acttaatgtatgttac

SEQ ID NO: 6620653 - DNA, 13 bp, Homo sapiens
acttaatgtttct

SEQ ID NO: 6620654 - DNA, 16 bp, Homo sapiens
acttaattagaaacgt

SEQ ID NO: 6620655 - DNA, 19 bp, Homo sapiens
acttaattcagtctcagct

SEQ ID NO: 6620656 - DNA, 13 bp, Homo sapiens
acttaattctcat

SEQ ID NO: 6620657 - DNA, 18 bp, Homo sapiens
acttaattgccagcaaat

SEQ ID NO: 6620658 - DNA, 19 bp, Homo sapiens
acttaattgccagcaaata

SEQ ID NO: 6620659 - DNA, 14 bp, Homo sapiens
acttaattgctttc

SEQ ID NO: 6620660 - DNA, 14 bp, Homo sapiens
acttaatttactta

SEQ ID NO: 6620661 - DNA, 20 bp, Homo sapiens
acttaatttacttaagtgtt

SEQ ID NO: 6620662 - DNA, 21 bp, Homo sapiens
acttaatttctttatgtaatc

SEQ ID NO: 6620663 - DNA, 13 bp, Homo sapiens
acttaatttgtaa

SEQ ID NO: 6620664 - DNA, 20 bp, Homo sapiens
acttaatttgtaaacttctg

SEQ ID NO: 6620665 - DNA, 19 bp, Homo sapiens
acttaattttagaaagaaa

SEQ ID NO: 6620666 - DNA, 22 bp, Homo sapiens
acttaattttagaaagaaaatt

SEQ ID NO: 6620667 - DNA, 20 bp, Homo sapiens
acttacaaaaatgggaaaaa

SEQ ID NO: 6620668 - DNA, 17 bp, Homo sapiens
acttacaaaagcagctt

SEQ ID NO: 6620669 - DNA, 23 bp, Homo sapiens
acttacaaaatgccaagggggtg

SEQ ID NO: 6620670 - DNA, 18 bp, Homo sapiens
acttacaaactggtttga

SEQ ID NO: 6620671 - DNA, 23 bp, Homo sapiens
acttacaaactttgtttgtcaca

SEQ ID NO: 6620672 - DNA, 23 bp, Homo sapiens
acttacaaagggtctatcttgta

SEQ ID NO: 6620673 - DNA, 15 bp, Homo sapiens
acttacaaccttgtc

SEQ ID NO: 6620674 - DNA, 16 bp, Homo sapiens
acttacaagactgtaa

SEQ ID NO: 6620675 - DNA, 22 bp, Homo sapiens
acttacaagactgtaaattcca

SEQ ID NO: 6620676 - DNA, 15 bp, Homo sapiens
acttacaagtaatga

SEQ ID NO: 6620677 - DNA, 23 bp, Homo sapiens
acttacaagtaatgaattttatg

SEQ ID NO: 6620678 - DNA, 20 bp, Homo sapiens
acttacaagtggtgaccaaa

SEQ ID NO: 6620679 - DNA, 15 bp, Homo sapiens
acttacaatttgcac

SEQ ID NO: 6620680 - DNA, 16 bp, Homo sapiens
acttacaatttgcaca

SEQ ID NO: 6620681 - DNA, 22 bp, Homo sapiens
acttacaatttgcacaatattt

SEQ ID NO: 6620682 - DNA, 17 bp, Homo sapiens
acttacacacctgagaa

SEQ ID NO: 6620683 - DNA, 20 bp, Homo sapiens
acttacacacctgagaatgt

SEQ ID NO: 6620684 - DNA, 20 bp, Homo sapiens
acttacacctggaatgttag

SEQ ID NO: 6620685 - DNA, 15 bp, Homo sapiens
acttacacttggagc

SEQ ID NO: 6620686 - DNA, 20 bp, Homo sapiens
acttacagaaccaattcact

SEQ ID NO: 6620687 - DNA, 17 bp, Homo sapiens
acttacagctctggcca

SEQ ID NO: 6620688 - DNA, 22 bp, Homo sapiens
acttacataaagctcccttgaa

SEQ ID NO: 6620689 - DNA, 15 bp, Homo sapiens
acttacatcttctgt

SEQ ID NO: 6620690 - DNA, 12 bp, Homo sapiens
acttacatgatt

SEQ ID NO: 6620691 - DNA, 19 bp, Homo sapiens
acttacatgattcatttta

SEQ ID NO: 6620692 - DNA, 19 bp, Homo sapiens
acttacatgggtgttttga

SEQ ID NO: 6620693 - DNA, 20 bp, Homo sapiens
acttacatgttcccaaaaca

SEQ ID NO: 6620694 - DNA, 22 bp, Homo sapiens
acttacatgttcccaaaacaat

SEQ ID NO: 6620695 - DNA, 15 bp, Homo sapiens
acttacatttacaaa

SEQ ID NO: 6620696 - DNA, 13 bp, Homo sapiens
acttacatttcag

SEQ ID NO: 6620697 - DNA, 15 bp, Homo sapiens
acttacatttccatt

SEQ ID NO: 6620698 - DNA, 14 bp, Homo sapiens
acttacatttgtac

SEQ ID NO: 6620699 - DNA, 15 bp, Homo sapiens
acttacatttgtact

SEQ ID NO: 6620700 - DNA, 17 bp, Homo sapiens
acttacatttgtacttt

SEQ ID NO: 6620701 - DNA, 21 bp, Homo sapiens
acttaccaggcaccaaaagaa

SEQ ID NO: 6620702 - DNA, 22 bp, Homo sapiens
acttaccaggcaccaaaagaag

SEQ ID NO: 6620703 - DNA, 18 bp, Homo sapiens
acttaccccgagacctca

SEQ ID NO: 6620704 - DNA, 16 bp, Homo sapiens
acttaccgccctgcgg

SEQ ID NO: 6620705 - DNA, 16 bp, Homo sapiens
acttacctctgcttct

SEQ ID NO: 6620706 - DNA, 13 bp, Homo sapiens
acttacctgaaaa

SEQ ID NO: 6620707 - DNA, 23 bp, Homo sapiens
acttacctgaaaagtagagaaat

SEQ ID NO: 6620708 - DNA, 23 bp, Homo sapiens
acttacctgaaggggttttcttg

SEQ ID NO: 6620709 - DNA, 16 bp, Homo sapiens
acttacctgcttgagc

SEQ ID NO: 6620710 - DNA, 15 bp, Homo sapiens
acttaccttcaataa

SEQ ID NO: 6620711 - DNA, 17 bp, Homo sapiens
acttaccttcaataaag

SEQ ID NO: 6620712 - DNA, 17 bp, Homo sapiens
acttactaataaaatgt

SEQ ID NO: 6620713 - DNA, 18 bp, Homo sapiens
acttactaataaaatgtg

SEQ ID NO: 6620714 - DNA, 20 bp, Homo sapiens
acttactaataaaatgtgaa

SEQ ID NO: 6620715 - DNA, 21 bp, Homo sapiens
acttactaataaaatgtgaag

SEQ ID NO: 6620716 - DNA, 14 bp, Homo sapiens
acttactagcttta

SEQ ID NO: 6620717 - DNA, 17 bp, Homo sapiens
acttactataatggttg

SEQ ID NO: 6620718 - DNA, 12 bp, Homo sapiens
acttactatttt

SEQ ID NO: 6620719 - DNA, 16 bp, Homo sapiens
acttactctaagatct

SEQ ID NO: 6620720 - DNA, 22 bp, Homo sapiens
acttactgctatctactaagtt

SEQ ID NO: 6620721 - DNA, 13 bp, Homo sapiens
acttactgtacat

SEQ ID NO: 6620722 - DNA, 22 bp, Homo sapiens
acttactgtacatgaaaacaca

SEQ ID NO: 6620723 - DNA, 17 bp, Homo sapiens
acttactgttaaaactg

SEQ ID NO: 6620724 - DNA, 19 bp, Homo sapiens
acttactgttaaaactgta

SEQ ID NO: 6620725 - DNA, 16 bp, Homo sapiens
acttactgtttctgtc

SEQ ID NO: 6620726 - DNA, 20 bp, Homo sapiens
acttactgtttctgtcagga

SEQ ID NO: 6620727 - DNA, 24 bp, Homo sapiens
acttacttagagatgctactgtca

SEQ ID NO: 6620728 - DNA, 19 bp, Homo sapiens
acttacttgatgattttta

SEQ ID NO: 6620729 - DNA, 22 bp, Homo sapiens
acttacttgggaggccgaggca

SEQ ID NO: 6620730 - DNA, 17 bp, Homo sapiens
acttactttaatgcgaa

SEQ ID NO: 6620731 - DNA, 15 bp, Homo sapiens
acttacttttgtaaa

SEQ ID NO: 6620732 - DNA, 15 bp, Homo sapiens
acttagaaaccaaat

SEQ ID NO: 6620733 - DNA, 12 bp, Homo sapiens
acttagaaggat

SEQ ID NO: 6620734 - DNA, 22 bp, Homo sapiens
acttagaaggattgaacttctt

SEQ ID NO: 6620735 - DNA, 22 bp, Homo sapiens
acttagaagtagtatgttattc

SEQ ID NO: 6620736 - DNA, 22 bp, Homo sapiens
acttagaataaaattgtaaaat

SEQ ID NO: 6620737 - DNA, 13 bp, Homo sapiens
acttagaatacta

SEQ ID NO: 6620738 - DNA, 19 bp, Homo sapiens
acttagaatccctgtgtta

SEQ ID NO: 6620739 - DNA, 20 bp, Homo sapiens
acttagaatccctgtgttaa

SEQ ID NO: 6620740 - DNA, 21 bp, Homo sapiens
acttagaatccctgtgttaat

SEQ ID NO: 6620741 - DNA, 22 bp, Homo sapiens
acttagaatccgaagggaatta

SEQ ID NO: 6620742 - DNA, 14 bp, Homo sapiens
acttagaatgccat

SEQ ID NO: 6620743 - DNA, 19 bp, Homo sapiens
acttagaatgcttcaagtt

SEQ ID NO: 6620744 - DNA, 20 bp, Homo sapiens
acttagacccatgctggtca

SEQ ID NO: 6620745 - DNA, 19 bp, Homo sapiens
acttagacctgccagccac

SEQ ID NO: 6620746 - DNA, 21 bp, Homo sapiens
acttagacctgccagccactg

SEQ ID NO: 6620747 - DNA, 23 bp, Homo sapiens
acttagagctttttttttttaat

SEQ ID NO: 6620748 - DNA, 15 bp, Homo sapiens
acttagaggaaaagg

SEQ ID NO: 6620749 - DNA, 15 bp, Homo sapiens
acttagaggaaaatg

SEQ ID NO: 6620750 - DNA, 22 bp, Homo sapiens
acttagaggcaacaggattgat

SEQ ID NO: 6620751 - DNA, 21 bp, Homo sapiens
acttagagtttctgtttgatt

SEQ ID NO: 6620752 - DNA, 17 bp, Homo sapiens
acttagatattaaaatt

SEQ ID NO: 6620753 - DNA, 19 bp, Homo sapiens
acttagatatttcatgtgc

SEQ ID NO: 6620754 - DNA, 15 bp, Homo sapiens
acttagatctgagcc

SEQ ID NO: 6620755 - DNA, 17 bp, Homo sapiens
acttagatctgagccct

SEQ ID NO: 6620756 - DNA, 19 bp, Homo sapiens
acttagatgggcatggtgg

SEQ ID NO: 6620757 - DNA, 17 bp, Homo sapiens
acttagatgttaaatgt

SEQ ID NO: 6620758 - DNA, 15 bp, Homo sapiens
acttagattaagatt

SEQ ID NO: 6620759 - DNA, 14 bp, Homo sapiens
acttagattcatta

SEQ ID NO: 6620760 - DNA, 16 bp, Homo sapiens
acttagattttacatg

SEQ ID NO: 6620761 - DNA, 18 bp, Homo sapiens
acttagattttacatgaa

SEQ ID NO: 6620762 - DNA, 21 bp, Homo sapiens
acttagcattttctgcatctc

SEQ ID NO: 6620763 - DNA, 22 bp, Homo sapiens
acttagccatgatggcaacaga

SEQ ID NO: 6620764 - DNA, 17 bp, Homo sapiens
acttagccgactgcgct

SEQ ID NO: 6620765 - DNA, 20 bp, Homo sapiens
acttagcctcctcccaaagt

SEQ ID NO: 6620766 - DNA, 20 bp, Homo sapiens
acttagcctttacctgtgaa

SEQ ID NO: 6620767 - DNA, 17 bp, Homo sapiens
acttagcgaacccttta

SEQ ID NO: 6620768 - DNA, 17 bp, Homo sapiens
acttagctcaggtgcct

SEQ ID NO: 6620769 - DNA, 15 bp, Homo sapiens
acttagctctgagga

SEQ ID NO: 6620770 - DNA, 15 bp, Homo sapiens
acttagctggagaac

SEQ ID NO: 6620771 - DNA, 18 bp, Homo sapiens
acttagctggagaactag

SEQ ID NO: 6620772 - DNA, 12 bp, Homo sapiens
acttagctggcc

SEQ ID NO: 6620773 - DNA, 20 bp, Homo sapiens
acttagctgtactataagta

SEQ ID NO: 6620774 - DNA, 19 bp, Homo sapiens
acttagcttatcaatttgt

SEQ ID NO: 6620775 - DNA, 18 bp, Homo sapiens
acttagcttgcacatgaa

SEQ ID NO: 6620776 - DNA, 20 bp, Homo sapiens
acttaggactacattttgct

SEQ ID NO: 6620777 - DNA, 22 bp, Homo sapiens
acttaggactacattttgctct

SEQ ID NO: 6620778 - DNA, 18 bp, Homo sapiens
acttaggactagaagatt

SEQ ID NO: 6620779 - DNA, 20 bp, Homo sapiens
acttaggactagaagattag

SEQ ID NO: 6620780 - DNA, 21 bp, Homo sapiens
acttaggagaagtcttctatt

SEQ ID NO: 6620781 - DNA, 11 bp, Homo sapiens
acttaggccag

SEQ ID NO: 6620782 - DNA, 12 bp, Homo sapiens
acttaggccaga

SEQ ID NO: 6620783 - DNA, 14 bp, Homo sapiens
acttaggctacaga

SEQ ID NO: 6620784 - DNA, 16 bp, Homo sapiens
acttaggctttgtagc

SEQ ID NO: 6620785 - DNA, 22 bp, Homo sapiens
acttaggtaaaataaaagacta

SEQ ID NO: 6620786 - DNA, 15 bp, Homo sapiens
acttaggtgtggggg

SEQ ID NO: 6620787 - DNA, 19 bp, Homo sapiens
acttaggttattttgcttt

SEQ ID NO: 6620788 - DNA, 22 bp, Homo sapiens
acttaggttattttgctttggt

SEQ ID NO: 6620789 - DNA, 18 bp, Homo sapiens
acttaggtttcaggaagt

SEQ ID NO: 6620790 - DNA, 16 bp, Homo sapiens
acttagtaacttttta

SEQ ID NO: 6620791 - DNA, 19 bp, Homo sapiens
acttagtagtttttacaaa

SEQ ID NO: 6620792 - DNA, 22 bp, Homo sapiens
acttagtagtttttacaaaact

SEQ ID NO: 6620793 - DNA, 20 bp, Homo sapiens
acttagtgcggacaagtttt

SEQ ID NO: 6620794 - DNA, 16 bp, Homo sapiens
acttagtggtatgtct

SEQ ID NO: 6620795 - DNA, 15 bp, Homo sapiens
acttagtgtctctat

SEQ ID NO: 6620796 - DNA, 17 bp, Homo sapiens
acttagttttgcatagt

SEQ ID NO: 6620797 - DNA, 19 bp, Homo sapiens
acttagttttgggagggga

SEQ ID NO: 6620798 - DNA, 14 bp, Homo sapiens
acttagtttttata

SEQ ID NO: 6620799 - DNA, 17 bp, Homo sapiens
acttagtttttataaaa

SEQ ID NO: 6620800 - DNA, 21 bp, Homo sapiens
acttagtttttatctttgacc

SEQ ID NO: 6620801 - DNA, 19 bp, Homo sapiens
acttataaatcatattgat

SEQ ID NO: 6620802 - DNA, 13 bp, Homo sapiens
acttataaggtgt

SEQ ID NO: 6620803 - DNA, 23 bp, Homo sapiens
acttataagtgaagtgatactat

SEQ ID NO: 6620804 - DNA, 16 bp, Homo sapiens
acttataccaaaggga

SEQ ID NO: 6620805 - DNA, 11 bp, Homo sapiens
acttatacctg

SEQ ID NO: 6620806 - DNA, 15 bp, Homo sapiens
acttatactcttgag

SEQ ID NO: 6620807 - DNA, 15 bp, Homo sapiens
acttatagattgaaa

SEQ ID NO: 6620808 - DNA, 13 bp, Homo sapiens
acttatagcctct

SEQ ID NO: 6620809 - DNA, 15 bp, Homo sapiens
acttatagcctctgt

SEQ ID NO: 6620810 - DNA, 23 bp, Homo sapiens
acttataggtaacgtgattgatt

SEQ ID NO: 6620811 - DNA, 15 bp, Homo sapiens
acttatagtacatga

SEQ ID NO: 6620812 - DNA, 17 bp, Homo sapiens
acttatagtacatgata

SEQ ID NO: 6620813 - DNA, 17 bp, Homo sapiens
acttatagttaatattt

SEQ ID NO: 6620814 - DNA, 20 bp, Homo sapiens
acttatatatttgatacata

SEQ ID NO: 6620815 - DNA, 15 bp, Homo sapiens
acttatatcaactta

SEQ ID NO: 6620816 - DNA, 22 bp, Homo sapiens
acttatatcatcagcatacctt

SEQ ID NO: 6620817 - DNA, 19 bp, Homo sapiens
acttatatgctgaattgaa

SEQ ID NO: 6620818 - DNA, 22 bp, Homo sapiens
acttatatgctgaattgaacat

SEQ ID NO: 6620819 - DNA, 21 bp, Homo sapiens
acttatattagagtcagagat

SEQ ID NO: 6620820 - DNA, 16 bp, Homo sapiens
acttatattgaagaca

SEQ ID NO: 6620821 - DNA, 19 bp, Homo sapiens
acttatattgtaagaaata

SEQ ID NO: 6620822 - DNA, 20 bp, Homo sapiens
acttatatttctgctttcaa

SEQ ID NO: 6620823 - DNA, 12 bp, Homo sapiens
acttatatttta

SEQ ID NO: 6620824 - DNA, 22 bp, Homo sapiens
acttatattttataatcagaat

SEQ ID NO: 6620825 - DNA, 18 bp, Homo sapiens
acttatattttatgaaca

SEQ ID NO: 6620826 - DNA, 19 bp, Homo sapiens
acttatattttcgtatgaa

SEQ ID NO: 6620827 - DNA, 16 bp, Homo sapiens
acttatattttgattt

SEQ ID NO: 6620828 - DNA, 15 bp, Homo sapiens
acttatcaacactat

SEQ ID NO: 6620829 - DNA, 13 bp, Homo sapiens
acttatcagatgc

SEQ ID NO: 6620830 - DNA, 21 bp, Homo sapiens
acttatcagtttgctaatgtt

SEQ ID NO: 6620831 - DNA, 20 bp, Homo sapiens
acttatcatccacattgttt

SEQ ID NO: 6620832 - DNA, 19 bp, Homo sapiens
acttatcatttttgtataa

SEQ ID NO: 6620833 - DNA, 22 bp, Homo sapiens
acttatcatttttgtataaaaa

SEQ ID NO: 6620834 - DNA, 14 bp, Homo sapiens
acttatccctctcc

SEQ ID NO: 6620835 - DNA, 16 bp, Homo sapiens
acttatccctgcccat

SEQ ID NO: 6620836 - DNA, 18 bp, Homo sapiens
acttatctaccattgaag

SEQ ID NO: 6620837 - DNA, 18 bp, Homo sapiens
acttatctagaaagaaaa

SEQ ID NO: 6620838 - DNA, 21 bp, Homo sapiens
acttatctagaaagaaaagac

SEQ ID NO: 6620839 - DNA, 21 bp, Homo sapiens
acttatctcgaatttgaagag

SEQ ID NO: 6620840 - DNA, 18 bp, Homo sapiens
acttatctctcaaaacaa

SEQ ID NO: 6620841 - DNA, 17 bp, Homo sapiens
acttatctctctgtgct

SEQ ID NO: 6620842 - DNA, 18 bp, Homo sapiens
acttatcttacaaagtgt

SEQ ID NO: 6620843 - DNA, 22 bp, Homo sapiens
acttatcttacaaagtgtattt

SEQ ID NO: 6620844 - DNA, 14 bp, Homo sapiens
acttatgaaatctc

SEQ ID NO: 6620845 - DNA, 22 bp, Homo sapiens
acttatgaaatgtgcactttat

SEQ ID NO: 6620846 - DNA, 16 bp, Homo sapiens
acttatgatttcatgt

SEQ ID NO: 6620847 - DNA, 20 bp, Homo sapiens
acttatgccgtctcatattt

SEQ ID NO: 6620848 - DNA, 19 bp, Homo sapiens
acttatgctagtttattgg

SEQ ID NO: 6620849 - DNA, 14 bp, Homo sapiens
acttatgctgattt

SEQ ID NO: 6620850 - DNA, 14 bp, Homo sapiens
acttatgctgctgt

SEQ ID NO: 6620851 - DNA, 15 bp, Homo sapiens
acttatgctgctgtg

SEQ ID NO: 6620852 - DNA, 17 bp, Homo sapiens
acttatggacactgcct

SEQ ID NO: 6620853 - DNA, 20 bp, Homo sapiens
acttatggacactgccttag

SEQ ID NO: 6620854 - DNA, 16 bp, Homo sapiens
acttatggactgtttt

SEQ ID NO: 6620855 - DNA, 12 bp, Homo sapiens
acttatgtactt

SEQ ID NO: 6620856 - DNA, 16 bp, Homo sapiens
acttatgtacttgata

SEQ ID NO: 6620857 - DNA, 22 bp, Homo sapiens
acttatgtacttgatactgaat

SEQ ID NO: 6620858 - DNA, 16 bp, Homo sapiens
acttatgtagaaactg

SEQ ID NO: 6620859 - DNA, 15 bp, Homo sapiens
acttatgtagacaaa

SEQ ID NO: 6620860 - DNA, 21 bp, Homo sapiens
acttatgtagatatttggctt

SEQ ID NO: 6620861 - DNA, 14 bp, Homo sapiens
acttatgtttttaa

SEQ ID NO: 6620862 - DNA, 22 bp, Homo sapiens
acttattaacaactgtgaatat

SEQ ID NO: 6620863 - DNA, 21 bp, Homo sapiens
acttattaacaattaggcaga

SEQ ID NO: 6620864 - DNA, 13 bp, Homo sapiens
acttattacaatt

SEQ ID NO: 6620865 - DNA, 16 bp, Homo sapiens
acttattacaatttgt

SEQ ID NO: 6620866 - DNA, 19 bp, Homo sapiens
acttattacctaattaact

SEQ ID NO: 6620867 - DNA, 16 bp, Homo sapiens
acttattactgctaag

SEQ ID NO: 6620868 - DNA, 20 bp, Homo sapiens
acttattactgctaagtatt

SEQ ID NO: 6620869 - DNA, 12 bp, Homo sapiens
acttattagcag

SEQ ID NO: 6620870 - DNA, 12 bp, Homo sapiens
acttattatatc

SEQ ID NO: 6620871 - DNA, 16 bp, Homo sapiens
acttattatcttcagg

SEQ ID NO: 6620872 - DNA, 15 bp, Homo sapiens
acttattatgcataa

SEQ ID NO: 6620873 - DNA, 19 bp, Homo sapiens
acttattattaataatgaa

SEQ ID NO: 6620874 - DNA, 20 bp, Homo sapiens
acttattattaataatgaag

SEQ ID NO: 6620875 - DNA, 22 bp, Homo sapiens
acttattattaataatgaagta

SEQ ID NO: 6620876 - DNA, 16 bp, Homo sapiens
acttattattttgcaa

SEQ ID NO: 6620877 - DNA, 14 bp, Homo sapiens
acttattcattcct

SEQ ID NO: 6620878 - DNA, 18 bp, Homo sapiens
acttattccctcatcctt

SEQ ID NO: 6620879 - DNA, 16 bp, Homo sapiens
acttattctcaagaag

SEQ ID NO: 6620880 - DNA, 19 bp, Homo sapiens
acttattcttttataataa

SEQ ID NO: 6620881 - DNA, 20 bp, Homo sapiens
acttattcttttataataat

SEQ ID NO: 6620882 - DNA, 15 bp, Homo sapiens
acttattgaatatat

SEQ ID NO: 6620883 - DNA, 17 bp, Homo sapiens
acttattgaatatatga

SEQ ID NO: 6620884 - DNA, 18 bp, Homo sapiens
acttattgaatatatgat

SEQ ID NO: 6620885 - DNA, 16 bp, Homo sapiens
acttattgcctgggca

SEQ ID NO: 6620886 - DNA, 22 bp, Homo sapiens
acttattgcctgggcagtgccc

SEQ ID NO: 6620887 - DNA, 15 bp, Homo sapiens
acttattgctgattt

SEQ ID NO: 6620888 - DNA, 14 bp, Homo sapiens
acttattgctttga

SEQ ID NO: 6620889 - DNA, 15 bp, Homo sapiens
acttattgctttgaa

SEQ ID NO: 6620890 - DNA, 20 bp, Homo sapiens
acttattggaactctgcttg

SEQ ID NO: 6620891 - DNA, 13 bp, Homo sapiens
acttattgtaaat

SEQ ID NO: 6620892 - DNA, 19 bp, Homo sapiens
acttattgtggataacaaa

SEQ ID NO: 6620893 - DNA, 20 bp, Homo sapiens
acttattgtggataacaaag

SEQ ID NO: 6620894 - DNA, 22 bp, Homo sapiens
acttattgtggataacaaagat

SEQ ID NO: 6620895 - DNA, 15 bp, Homo sapiens
acttatttaaaaata

SEQ ID NO: 6620896 - DNA, 18 bp, Homo sapiens
acttatttaaaaatattt

SEQ ID NO: 6620897 - DNA, 17 bp, Homo sapiens
acttatttaaaaatgca

SEQ ID NO: 6620898 - DNA, 15 bp, Homo sapiens
acttatttatataaa

SEQ ID NO: 6620899 - DNA, 15 bp, Homo sapiens
acttatttatatgaa

SEQ ID NO: 6620900 - DNA, 16 bp, Homo sapiens
acttatttatatgaag

SEQ ID NO: 6620901 - DNA, 12 bp, Homo sapiens
acttatttatga

SEQ ID NO: 6620902 - DNA, 16 bp, Homo sapiens
acttatttcactttag

SEQ ID NO: 6620903 - DNA, 13 bp, Homo sapiens
acttatttccatg

SEQ ID NO: 6620904 - DNA, 14 bp, Homo sapiens
acttatttccttat

SEQ ID NO: 6620905 - DNA, 13 bp, Homo sapiens
acttatttctaaa

SEQ ID NO: 6620906 - DNA, 14 bp, Homo sapiens
acttatttctaaat

SEQ ID NO: 6620907 - DNA, 13 bp, Homo sapiens
acttatttctgct

SEQ ID NO: 6620908 - DNA, 12 bp, Homo sapiens
acttatttgagt

SEQ ID NO: 6620909 - DNA, 13 bp, Homo sapiens
acttatttggggt

SEQ ID NO: 6620910 - DNA, 16 bp, Homo sapiens
acttattttatttcca

SEQ ID NO: 6620911 - DNA, 20 bp, Homo sapiens
acttattttcagtgcatcat

SEQ ID NO: 6620912 - DNA, 15 bp, Homo sapiens
acttattttctctgt

SEQ ID NO: 6620913 - DNA, 21 bp, Homo sapiens
acttattttctgaattcataa

SEQ ID NO: 6620914 - DNA, 12 bp, Homo sapiens
acttattttgat

SEQ ID NO: 6620915 - DNA, 15 bp, Homo sapiens
acttattttgcttta

SEQ ID NO: 6620916 - DNA, 19 bp, Homo sapiens
acttattttgtcttattct

SEQ ID NO: 6620917 - DNA, 21 bp, Homo sapiens
acttattttgtcttattctta

SEQ ID NO: 6620918 - DNA, 12 bp, Homo sapiens
acttatttttct

SEQ ID NO: 6620919 - DNA, 16 bp, Homo sapiens
acttatttttgacagt

SEQ ID NO: 6620920 - DNA, 15 bp, Homo sapiens
acttatttttttctg

SEQ ID NO: 6620921 - DNA, 17 bp, Homo sapiens
acttatttttttctgat

SEQ ID NO: 6620922 - DNA, 16 bp, Homo sapiens
acttcaaaaactaaaa

SEQ ID NO: 6620923 - DNA, 21 bp, Homo sapiens
acttcaaaaactaaaatcatt

SEQ ID NO: 6620924 - DNA, 21 bp, Homo sapiens
acttcaaaaactgtcaaagaa

SEQ ID NO: 6620925 - DNA, 21 bp, Homo sapiens
acttcaaaaataaaaaatctg

SEQ ID NO: 6620926 - DNA, 20 bp, Homo sapiens
acttcaaaagctttttgatg

SEQ ID NO: 6620927 - DNA, 18 bp, Homo sapiens
acttcaaaaggaatgaac

SEQ ID NO: 6620928 - DNA, 19 bp, Homo sapiens
acttcaaaaggaatgaact

SEQ ID NO: 6620929 - DNA, 14 bp, Homo sapiens
acttcaaaaggtga

SEQ ID NO: 6620930 - DNA, 15 bp, Homo sapiens
acttcaaaagtattt

SEQ ID NO: 6620931 - DNA, 19 bp, Homo sapiens
acttcaaaagtattttcct

SEQ ID NO: 6620932 - DNA, 16 bp, Homo sapiens
acttcaaaatattgag

SEQ ID NO: 6620933 - DNA, 18 bp, Homo sapiens
acttcaaactactttgct

SEQ ID NO: 6620934 - DNA, 14 bp, Homo sapiens
acttcaaagaagct

SEQ ID NO: 6620935 - DNA, 19 bp, Homo sapiens
acttcaaagctgaatattt

SEQ ID NO: 6620936 - DNA, 18 bp, Homo sapiens
acttcaaagtgcctgggc

SEQ ID NO: 6620937 - DNA, 20 bp, Homo sapiens
acttcaaagtgcctgggctc

SEQ ID NO: 6620938 - DNA, 17 bp, Homo sapiens
acttcaaatatagagat

SEQ ID NO: 6620939 - DNA, 20 bp, Homo sapiens
acttcaaatcagagcagtga

SEQ ID NO: 6620940 - DNA, 23 bp, Homo sapiens
acttcaaatcagagcagtgattc

SEQ ID NO: 6620941 - DNA, 19 bp, Homo sapiens
acttcaaatccttgaagat

SEQ ID NO: 6620942 - DNA, 20 bp, Homo sapiens
acttcaaatccttgaagatt

SEQ ID NO: 6620943 - DNA, 18 bp, Homo sapiens
acttcaaatgtgtaactt

SEQ ID NO: 6620944 - DNA, 19 bp, Homo sapiens
acttcaaattttttaaaag

SEQ ID NO: 6620945 - DNA, 20 bp, Homo sapiens
acttcaagatgagcctgggc

SEQ ID NO: 6620946 - DNA, 21 bp, Homo sapiens
acttcaagatgagcctgggct

SEQ ID NO: 6620947 - DNA, 18 bp, Homo sapiens
acttcaagcaccagggaa

SEQ ID NO: 6620948 - DNA, 19 bp, Homo sapiens
acttcaaggaaaataagtg

SEQ ID NO: 6620949 - DNA, 18 bp, Homo sapiens
acttcaagggagaatata

SEQ ID NO: 6620950 - DNA, 23 bp, Homo sapiens
acttcaaggtgacagaaggacca

SEQ ID NO: 6620951 - DNA, 12 bp, Homo sapiens
acttcaatgaac

SEQ ID NO: 6620952 - DNA, 18 bp, Homo sapiens
acttcacacagacaagtg

SEQ ID NO: 6620953 - DNA, 15 bp, Homo sapiens
acttcacacagcacc

SEQ ID NO: 6620954 - DNA, 13 bp, Homo sapiens
acttcacactgaa

SEQ ID NO: 6620955 - DNA, 19 bp, Homo sapiens
acttcacactgcaagagcc

SEQ ID NO: 6620956 - DNA, 21 bp, Homo sapiens
acttcacagagactctgtcct

SEQ ID NO: 6620957 - DNA, 16 bp, Homo sapiens
acttcacagagtgtgc

SEQ ID NO: 6620958 - DNA, 19 bp, Homo sapiens
acttcacagagtgtgctgg

SEQ ID NO: 6620959 - DNA, 20 bp, Homo sapiens
acttcacagcgtctgctcat

SEQ ID NO: 6620960 - DNA, 13 bp, Homo sapiens
acttcacaggtga

SEQ ID NO: 6620961 - DNA, 17 bp, Homo sapiens
acttcacataggaaggg

SEQ ID NO: 6620962 - DNA, 17 bp, Homo sapiens
acttcaccaccccctgt

SEQ ID NO: 6620963 - DNA, 23 bp, Homo sapiens
acttcaccaccccctgtcccatt

SEQ ID NO: 6620964 - DNA, 15 bp, Homo sapiens
acttcacccccaact

SEQ ID NO: 6620965 - DNA, 21 bp, Homo sapiens
acttcacctttcctctccctc

SEQ ID NO: 6620966 - DNA, 19 bp, Homo sapiens
acttcacgctttcagcgaa

SEQ ID NO: 6620967 - DNA, 18 bp, Homo sapiens
acttcactaaagtgtcat

SEQ ID NO: 6620968 - DNA, 14 bp, Homo sapiens
acttcactaggcat

SEQ ID NO: 6620969 - DNA, 18 bp, Homo sapiens
acttcactccaaagagaa

SEQ ID NO: 6620970 - DNA, 16 bp, Homo sapiens
acttcactgcagcctt

SEQ ID NO: 6620971 - DNA, 17 bp, Homo sapiens
acttcactggtgtacat

SEQ ID NO: 6620972 - DNA, 15 bp, Homo sapiens
acttcactgtatata

SEQ ID NO: 6620973 - DNA, 16 bp, Homo sapiens
acttcactgtatataa

SEQ ID NO: 6620974 - DNA, 19 bp, Homo sapiens
acttcactgtcaggaagaa

SEQ ID NO: 6620975 - DNA, 12 bp, Homo sapiens
acttcactgtga

SEQ ID NO: 6620976 - DNA, 14 bp, Homo sapiens
acttcactgtgagg

SEQ ID NO: 6620977 - DNA, 21 bp, Homo sapiens
acttcactgtgaggggaaggc

SEQ ID NO: 6620978 - DNA, 14 bp, Homo sapiens
acttcactgtgctg

SEQ ID NO: 6620979 - DNA, 20 bp, Homo sapiens
acttcactgtgctgttgtta

SEQ ID NO: 6620980 - DNA, 22 bp, Homo sapiens
acttcactgtgctgttgttatg

SEQ ID NO: 6620981 - DNA, 24 bp, Homo sapiens
acttcactgtgctgttgttatgat

SEQ ID NO: 6620982 - DNA, 16 bp, Homo sapiens
acttcactttcttcaa

SEQ ID NO: 6620983 - DNA, 17 bp, Homo sapiens
acttcactttcttcaaa

SEQ ID NO: 6620984 - DNA, 22 bp, Homo sapiens
acttcagaaacccggcttcctg

SEQ ID NO: 6620985 - DNA, 18 bp, Homo sapiens
acttcagaaactttttct

SEQ ID NO: 6620986 - DNA, 19 bp, Homo sapiens
acttcagaaactttttcta

SEQ ID NO: 6620987 - DNA, 22 bp, Homo sapiens
acttcagaacagtgtttgattt

SEQ ID NO: 6620988 - DNA, 15 bp, Homo sapiens
acttcagaaggcctc

SEQ ID NO: 6620989 - DNA, 17 bp, Homo sapiens
acttcagaaggcctcac

SEQ ID NO: 6620990 - DNA, 18 bp, Homo sapiens
acttcagacacaggaaaa

SEQ ID NO: 6620991 - DNA, 13 bp, Homo sapiens
acttcagactctc

SEQ ID NO: 6620992 - DNA, 19 bp, Homo sapiens
acttcagactctctcctct

SEQ ID NO: 6620993 - DNA, 20 bp, Homo sapiens
acttcagactctctcctctc

SEQ ID NO: 6620994 - DNA, 13 bp, Homo sapiens
acttcagactgaa

SEQ ID NO: 6620995 - DNA, 18 bp, Homo sapiens
acttcagagagctggtag

SEQ ID NO: 6620996 - DNA, 20 bp, Homo sapiens
acttcagagtcctcattata

SEQ ID NO: 6620997 - DNA, 18 bp, Homo sapiens
acttcagatacttgtgaa

SEQ ID NO: 6620998 - DNA, 12 bp, Homo sapiens
acttcagatctc

SEQ ID NO: 6620999 - DNA, 18 bp, Homo sapiens
acttcagatgggaggaaa

SEQ ID NO: 6621000 - DNA, 23 bp, Homo sapiens
acttcagatgtttccaagatgtc

SEQ ID NO: 6621001 - DNA, 14 bp, Homo sapiens
acttcagattgaac

SEQ ID NO: 6621002 - DNA, 14 bp, Homo sapiens
acttcagatttcaa

SEQ ID NO: 6621003 - DNA, 16 bp, Homo sapiens
acttcagatttcaaat

SEQ ID NO: 6621004 - DNA, 21 bp, Homo sapiens
acttcagcaaccctacagtat

SEQ ID NO: 6621005 - DNA, 22 bp, Homo sapiens
acttcagcaaccctacagtata

SEQ ID NO: 6621006 - DNA, 21 bp, Homo sapiens
acttcagcaagagagaaccta

SEQ ID NO: 6621007 - DNA, 11 bp, Homo sapiens
acttcagcacc

SEQ ID NO: 6621008 - DNA, 11 bp, Homo sapiens
acttcagcagg

SEQ ID NO: 6621009 - DNA, 13 bp, Homo sapiens
acttcagcagggg

SEQ ID NO: 6621010 - DNA, 14 bp, Homo sapiens
acttcagcaggggt

SEQ ID NO: 6621011 - DNA, 22 bp, Homo sapiens
acttcagcaggggtgggaggct

SEQ ID NO: 6621012 - DNA, 18 bp, Homo sapiens
acttcagcattgtaatta

SEQ ID NO: 6621013 - DNA, 17 bp, Homo sapiens
acttcagccaccctttc

SEQ ID NO: 6621014 - DNA, 23 bp, Homo sapiens
acttcagccaccctttctggcac

SEQ ID NO: 6621015 - DNA, 16 bp, Homo sapiens
acttcagctagagctt

SEQ ID NO: 6621016 - DNA, 20 bp, Homo sapiens
acttcagcttaataagtatt

SEQ ID NO: 6621017 - DNA, 15 bp, Homo sapiens
acttcagctttgtgt

SEQ ID NO: 6621018 - DNA, 12 bp, Homo sapiens
acttcaggagcc

SEQ ID NO: 6621019 - DNA, 15 bp, Homo sapiens
acttcaggagcccta

SEQ ID NO: 6621020 - DNA, 19 bp, Homo sapiens
acttcaggagctgacagag

SEQ ID NO: 6621021 - DNA, 16 bp, Homo sapiens
acttcaggctcttctc

SEQ ID NO: 6621022 - DNA, 17 bp, Homo sapiens
acttcaggctcttctcc

SEQ ID NO: 6621023 - DNA, 20 bp, Homo sapiens
acttcaggctcttctccttt

SEQ ID NO: 6621024 - DNA, 17 bp, Homo sapiens
acttcagggcagatttt

SEQ ID NO: 6621025 - DNA, 20 bp, Homo sapiens
acttcagggcagattttagt

SEQ ID NO: 6621026 - DNA, 23 bp, Homo sapiens
acttcagggcagggctctgatat

SEQ ID NO: 6621027 - DNA, 17 bp, Homo sapiens
acttcaggtaaaaactt

SEQ ID NO: 6621028 - DNA, 20 bp, Homo sapiens
acttcaggtatacctcactt

SEQ ID NO: 6621029 - DNA, 20 bp, Homo sapiens
acttcaggtcaggtggctgt

SEQ ID NO: 6621030 - DNA, 20 bp, Homo sapiens
acttcaggtgtgactctagc

SEQ ID NO: 6621031 - DNA, 20 bp, Homo sapiens
acttcaggttgttctgtata

SEQ ID NO: 6621032 - DNA, 21 bp, Homo sapiens
acttcagtaggatttatgtat

SEQ ID NO: 6621033 - DNA, 21 bp, Homo sapiens
acttcagtatgttgtcaaaga

SEQ ID NO: 6621034 - DNA, 16 bp, Homo sapiens
acttcagtcctgggag

SEQ ID NO: 6621035 - DNA, 17 bp, Homo sapiens
acttcagtgaaattttc

SEQ ID NO: 6621036 - DNA, 21 bp, Homo sapiens
acttcagtgcacctgtggcct

SEQ ID NO: 6621037 - DNA, 14 bp, Homo sapiens
acttcagttctcat

SEQ ID NO: 6621038 - DNA, 16 bp, Homo sapiens
acttcagttgtggcct

SEQ ID NO: 6621039 - DNA, 21 bp, Homo sapiens
acttcagtttcacagaaaata

SEQ ID NO: 6621040 - DNA, 14 bp, Homo sapiens
acttcagttttact

SEQ ID NO: 6621041 - DNA, 19 bp, Homo sapiens
acttcataaatgttcagct

SEQ ID NO: 6621042 - DNA, 20 bp, Homo sapiens
acttcataagatattcttta

SEQ ID NO: 6621043 - DNA, 24 bp, Homo sapiens
acttcataagatattctttacaaa

SEQ ID NO: 6621044 - DNA, 15 bp, Homo sapiens
acttcataataaact

SEQ ID NO: 6621045 - DNA, 22 bp, Homo sapiens
acttcatagaaacctctctatt

SEQ ID NO: 6621046 - DNA, 19 bp, Homo sapiens
acttcatagatgcaggagg

SEQ ID NO: 6621047 - DNA, 15 bp, Homo sapiens
acttcatataactga

SEQ ID NO: 6621048 - DNA, 14 bp, Homo sapiens
acttcatattgctg

SEQ ID NO: 6621049 - DNA, 13 bp, Homo sapiens
acttcatcaatca

SEQ ID NO: 6621050 - DNA, 19 bp, Homo sapiens
acttcatcaatcaaatatt

SEQ ID NO: 6621051 - DNA, 14 bp, Homo sapiens
acttcatcccagct

SEQ ID NO: 6621052 - DNA, 16 bp, Homo sapiens
acttcatccctctggg

SEQ ID NO: 6621053 - DNA, 20 bp, Homo sapiens
acttcatcgacttagcctga

SEQ ID NO: 6621054 - DNA, 12 bp, Homo sapiens
acttcatctgcc

SEQ ID NO: 6621055 - DNA, 16 bp, Homo sapiens
acttcatctgccactg

SEQ ID NO: 6621056 - DNA, 14 bp, Homo sapiens
acttcatgcccact

SEQ ID NO: 6621057 - DNA, 16 bp, Homo sapiens
acttcatgcccactgc

SEQ ID NO: 6621058 - DNA, 15 bp, Homo sapiens
acttcatggaatgga

SEQ ID NO: 6621059 - DNA, 23 bp, Homo sapiens
acttcatggcctttgataaatgt

SEQ ID NO: 6621060 - DNA, 21 bp, Homo sapiens
acttcattattttaaaaatat

SEQ ID NO: 6621061 - DNA, 15 bp, Homo sapiens
acttcattccagcag

SEQ ID NO: 6621062 - DNA, 21 bp, Homo sapiens
acttcattccagcagctgcac

SEQ ID NO: 6621063 - DNA, 23 bp, Homo sapiens
acttcattctaaaccaaaacaga

SEQ ID NO: 6621064 - DNA, 14 bp, Homo sapiens
acttcattgaaaat

SEQ ID NO: 6621065 - DNA, 18 bp, Homo sapiens
acttcattgtaaatcact

SEQ ID NO: 6621066 - DNA, 17 bp, Homo sapiens
acttcatttaacactga

SEQ ID NO: 6621067 - DNA, 20 bp, Homo sapiens
acttcatttgacacaaagct

SEQ ID NO: 6621068 - DNA, 19 bp, Homo sapiens
acttcattttatatttaaa

SEQ ID NO: 6621069 - DNA, 18 bp, Homo sapiens
acttcattttcagagtga

SEQ ID NO: 6621070 - DNA, 19 bp, Homo sapiens
acttcattttcagagtgac

SEQ ID NO: 6621071 - DNA, 20 bp, Homo sapiens
acttcatttttaagaaagga

SEQ ID NO: 6621072 - DNA, 17 bp, Homo sapiens
acttccaaacagtgtgt

SEQ ID NO: 6621073 - DNA, 17 bp, Homo sapiens
acttccaaagaaagttc

SEQ ID NO: 6621074 - DNA, 19 bp, Homo sapiens
acttccaaatcccctaagc

SEQ ID NO: 6621075 - DNA, 11 bp, Homo sapiens
acttccaacaa

SEQ ID NO: 6621076 - DNA, 17 bp, Homo sapiens
acttccaacaagcctca

SEQ ID NO: 6621077 - DNA, 21 bp, Homo sapiens
acttccaagctccaaatccaa

SEQ ID NO: 6621078 - DNA, 16 bp, Homo sapiens
acttccaagtcattct

SEQ ID NO: 6621079 - DNA, 19 bp, Homo sapiens
acttccaagtgataatttt

SEQ ID NO: 6621080 - DNA, 18 bp, Homo sapiens
acttccaatttacatact

SEQ ID NO: 6621081 - DNA, 18 bp, Homo sapiens
acttccacatttttgcac

SEQ ID NO: 6621082 - DNA, 20 bp, Homo sapiens
acttccacatttttgcacag

SEQ ID NO: 6621083 - DNA, 14 bp, Homo sapiens
acttccaccagcct

SEQ ID NO: 6621084 - DNA, 15 bp, Homo sapiens
acttccacctccagc

SEQ ID NO: 6621085 - DNA, 21 bp, Homo sapiens
acttccacctcgggcacattt

SEQ ID NO: 6621086 - DNA, 15 bp, Homo sapiens
acttccactgatgga

SEQ ID NO: 6621087 - DNA, 19 bp, Homo sapiens
acttccactttgtataaat

SEQ ID NO: 6621088 - DNA, 16 bp, Homo sapiens
acttccagagccagaa

SEQ ID NO: 6621089 - DNA, 22 bp, Homo sapiens
acttccagaggacagctctggg

SEQ ID NO: 6621090 - DNA, 15 bp, Homo sapiens
acttccagagggggc

SEQ ID NO: 6621091 - DNA, 22 bp, Homo sapiens
acttccagatttgagctgcctg

SEQ ID NO: 6621092 - DNA, 14 bp, Homo sapiens
acttccagcaaaat

SEQ ID NO: 6621093 - DNA, 17 bp, Homo sapiens
acttccagcaaaatcca

SEQ ID NO: 6621094 - DNA, 15 bp, Homo sapiens
acttccaggatggat

SEQ ID NO: 6621095 - DNA, 16 bp, Homo sapiens
acttccaggtctgcct

SEQ ID NO: 6621096 - DNA, 22 bp, Homo sapiens
acttccaggtctgcctggttcc

SEQ ID NO: 6621097 - DNA, 21 bp, Homo sapiens
acttccaggttccatccacca

SEQ ID NO: 6621098 - DNA, 21 bp, Homo sapiens
acttccagtgttggctgtgtg

SEQ ID NO: 6621099 - DNA, 22 bp, Homo sapiens
acttccagtgttggctgtgtga

SEQ ID NO: 6621100 - DNA, 12 bp, Homo sapiens
acttccatagtg

SEQ ID NO: 6621101 - DNA, 20 bp, Homo sapiens
acttccatccctgcttattt

SEQ ID NO: 6621102 - DNA, 18 bp, Homo sapiens
acttccatgatactttaa

SEQ ID NO: 6621103 - DNA, 12 bp, Homo sapiens
acttccatgcct

SEQ ID NO: 6621104 - DNA, 22 bp, Homo sapiens
acttccatgtgagggttttcag

SEQ ID NO: 6621105 - DNA, 15 bp, Homo sapiens
acttccatgttctgg

SEQ ID NO: 6621106 - DNA, 13 bp, Homo sapiens
acttccatgttgt

SEQ ID NO: 6621107 - DNA, 16 bp, Homo sapiens
acttccattctttctt

SEQ ID NO: 6621108 - DNA, 20 bp, Homo sapiens
acttccattctttcttcctc

SEQ ID NO: 6621109 - DNA, 19 bp, Homo sapiens
acttccattgcaaaataga

SEQ ID NO: 6621110 - DNA, 19 bp, Homo sapiens
acttccattggttcttcct

SEQ ID NO: 6621111 - DNA, 13 bp, Homo sapiens
acttccattgttt

SEQ ID NO: 6621112 - DNA, 12 bp, Homo sapiens
acttccatttgg

SEQ ID NO: 6621113 - DNA, 14 bp, Homo sapiens
acttccatttgtat

SEQ ID NO: 6621114 - DNA, 20 bp, Homo sapiens
acttccatttgtattcaaat

SEQ ID NO: 6621115 - DNA, 16 bp, Homo sapiens
acttcccaaagcacaa

SEQ ID NO: 6621116 - DNA, 19 bp, Homo sapiens
acttcccaattgccacatt

SEQ ID NO: 6621117 - DNA, 14 bp, Homo sapiens
acttcccacacgat

SEQ ID NO: 6621118 - DNA, 22 bp, Homo sapiens
acttcccacacgattagcttta

SEQ ID NO: 6621119 - DNA, 12 bp, Homo sapiens
acttcccacccc

SEQ ID NO: 6621120 - DNA, 13 bp, Homo sapiens
acttcccaccctg

SEQ ID NO: 6621121 - DNA, 14 bp, Homo sapiens
acttcccaccctgc

SEQ ID NO: 6621122 - DNA, 14 bp, Homo sapiens
acttcccactgttc

SEQ ID NO: 6621123 - DNA, 23 bp, Homo sapiens
acttcccaggatctgctccaaca

SEQ ID NO: 6621124 - DNA, 12 bp, Homo sapiens
acttcccaggcc

SEQ ID NO: 6621125 - DNA, 22 bp, Homo sapiens
acttcccatctccagggaagcg

SEQ ID NO: 6621126 - DNA, 15 bp, Homo sapiens
acttcccatctggct

SEQ ID NO: 6621127 - DNA, 16 bp, Homo sapiens
acttcccatctggctc

SEQ ID NO: 6621128 - DNA, 17 bp, Homo sapiens
acttcccatctggctca

SEQ ID NO: 6621129 - DNA, 13 bp, Homo sapiens
acttccccacagg

SEQ ID NO: 6621130 - DNA, 20 bp, Homo sapiens
acttccccacggatggcggt

SEQ ID NO: 6621131 - DNA, 14 bp, Homo sapiens
acttccccagctct

SEQ ID NO: 6621132 - DNA, 13 bp, Homo sapiens
acttccccatccc

SEQ ID NO: 6621133 - DNA, 11 bp, Homo sapiens
acttcccccaa

SEQ ID NO: 6621134 - DNA, 21 bp, Homo sapiens
acttcccctcctacccctccc

SEQ ID NO: 6621135 - DNA, 14 bp, Homo sapiens
acttcccctgggat

SEQ ID NO: 6621136 - DNA, 19 bp, Homo sapiens
acttccccttcctaattcc

SEQ ID NO: 6621137 - DNA, 18 bp, Homo sapiens
acttcccgggccagggct

SEQ ID NO: 6621138 - DNA, 17 bp, Homo sapiens
acttccctaacacttac

SEQ ID NO: 6621139 - DNA, 18 bp, Homo sapiens
acttccctagaagtcttc

SEQ ID NO: 6621140 - DNA, 13 bp, Homo sapiens
acttccctcaggc

SEQ ID NO: 6621141 - DNA, 14 bp, Homo sapiens
acttccctctgttt

SEQ ID NO: 6621142 - DNA, 16 bp, Homo sapiens
acttccctgctgcctg

SEQ ID NO: 6621143 - DNA, 14 bp, Homo sapiens
acttccctgggcaa

SEQ ID NO: 6621144 - DNA, 21 bp, Homo sapiens
acttccctgggttagactgcc

SEQ ID NO: 6621145 - DNA, 23 bp, Homo sapiens
acttccctggtcaccaaggcagt

SEQ ID NO: 6621146 - DNA, 15 bp, Homo sapiens
acttccctgttcttt

SEQ ID NO: 6621147 - DNA, 13 bp, Homo sapiens
acttcccttcctc

SEQ ID NO: 6621148 - DNA, 13 bp, Homo sapiens
acttccgcctcct

SEQ ID NO: 6621149 - DNA, 16 bp, Homo sapiens
acttccgcctcctgtg

SEQ ID NO: 6621150 - DNA, 18 bp, Homo sapiens
acttccgctccctggata

SEQ ID NO: 6621151 - DNA, 16 bp, Homo sapiens
acttccgtcacccttg

SEQ ID NO: 6621152 - DNA, 20 bp, Homo sapiens
acttcctagagcatctgtcc

SEQ ID NO: 6621153 - DNA, 15 bp, Homo sapiens
acttcctagggatct

SEQ ID NO: 6621154 - DNA, 18 bp, Homo sapiens
acttcctagggatctgaa

SEQ ID NO: 6621155 - DNA, 21 bp, Homo sapiens
acttcctagggatctgaaatc

SEQ ID NO: 6621156 - DNA, 17 bp, Homo sapiens
acttcctattaatttat

SEQ ID NO: 6621157 - DNA, 21 bp, Homo sapiens
acttcctattaatttattaaa

SEQ ID NO: 6621158 - DNA, 17 bp, Homo sapiens
acttcctattttcttga

SEQ ID NO: 6621159 - DNA, 20 bp, Homo sapiens
acttcctcaatgcattgact

SEQ ID NO: 6621160 - DNA, 18 bp, Homo sapiens
acttcctccaatccccac

SEQ ID NO: 6621161 - DNA, 21 bp, Homo sapiens
acttcctccaatccccactcc

SEQ ID NO: 6621162 - DNA, 12 bp, Homo sapiens
acttcctccaca

SEQ ID NO: 6621163 - DNA, 13 bp, Homo sapiens
acttcctccacag

SEQ ID NO: 6621164 - DNA, 12 bp, Homo sapiens
acttcctcccct

SEQ ID NO: 6621165 - DNA, 15 bp, Homo sapiens
acttcctcctacctg

SEQ ID NO: 6621166 - DNA, 16 bp, Homo sapiens
acttcctcctacctgg

SEQ ID NO: 6621167 - DNA, 19 bp, Homo sapiens
acttcctcctacctgggga

SEQ ID NO: 6621168 - DNA, 18 bp, Homo sapiens
acttcctcctccccactt

SEQ ID NO: 6621169 - DNA, 18 bp, Homo sapiens
acttcctcgcctctccca

SEQ ID NO: 6621170 - DNA, 15 bp, Homo sapiens
acttcctctccacag

SEQ ID NO: 6621171 - DNA, 19 bp, Homo sapiens
acttcctctccacaggagc

SEQ ID NO: 6621172 - DNA, 20 bp, Homo sapiens
acttcctctccacaggagcc

SEQ ID NO: 6621173 - DNA, 19 bp, Homo sapiens
acttcctctggctccccaa

SEQ ID NO: 6621174 - DNA, 20 bp, Homo sapiens
acttcctctggctccccaag

SEQ ID NO: 6621175 - DNA, 18 bp, Homo sapiens
acttcctctgtgaactgt

SEQ ID NO: 6621176 - DNA, 19 bp, Homo sapiens
acttcctgactctcacctg

SEQ ID NO: 6621177 - DNA, 21 bp, Homo sapiens
acttcctgattggtttctctt

SEQ ID NO: 6621178 - DNA, 22 bp, Homo sapiens
acttcctgattggtttctcttc

SEQ ID NO: 6621179 - DNA, 17 bp, Homo sapiens
acttcctgcctggtctc

SEQ ID NO: 6621180 - DNA, 15 bp, Homo sapiens
acttcctgctgcacc

SEQ ID NO: 6621181 - DNA, 17 bp, Homo sapiens
acttcctgctgcaccct

SEQ ID NO: 6621182 - DNA, 23 bp, Homo sapiens
acttcctggctccttcactgaac

SEQ ID NO: 6621183 - DNA, 23 bp, Homo sapiens
acttcctggttttctcttactgc

SEQ ID NO: 6621184 - DNA, 12 bp, Homo sapiens
acttcctgtact

SEQ ID NO: 6621185 - DNA, 13 bp, Homo sapiens
acttcctgtccag

SEQ ID NO: 6621186 - DNA, 17 bp, Homo sapiens
acttcctgtccagagag

SEQ ID NO: 6621187 - DNA, 13 bp, Homo sapiens
acttcctgtccgg

SEQ ID NO: 6621188 - DNA, 20 bp, Homo sapiens
acttcctgtgcctttcctat

SEQ ID NO: 6621189 - DNA, 15 bp, Homo sapiens
acttcctgtggcctg

SEQ ID NO: 6621190 - DNA, 11 bp, Homo sapiens
acttcctgtgt

SEQ ID NO: 6621191 - DNA, 12 bp, Homo sapiens
acttcctgtgta

SEQ ID NO: 6621192 - DNA, 16 bp, Homo sapiens
acttcctgtgtactct

SEQ ID NO: 6621193 - DNA, 22 bp, Homo sapiens
acttccttactaagcatagcaa

SEQ ID NO: 6621194 - DNA, 22 bp, Homo sapiens
acttccttattgggacttttct

SEQ ID NO: 6621195 - DNA, 19 bp, Homo sapiens
acttccttcacatctccca

SEQ ID NO: 6621196 - DNA, 22 bp, Homo sapiens
acttccttgcccctgctctgta

SEQ ID NO: 6621197 - DNA, 19 bp, Homo sapiens
acttccttgctctccctct

SEQ ID NO: 6621198 - DNA, 12 bp, Homo sapiens
acttcctttaca

SEQ ID NO: 6621199 - DNA, 18 bp, Homo sapiens
acttcctttataatattt

SEQ ID NO: 6621200 - DNA, 14 bp, Homo sapiens
acttcctttcctac

SEQ ID NO: 6621201 - DNA, 18 bp, Homo sapiens
acttcctttgcccttcct

SEQ ID NO: 6621202 - DNA, 21 bp, Homo sapiens
acttcctttgcccttcctcct

SEQ ID NO: 6621203 - DNA, 20 bp, Homo sapiens
acttcgaatatatctgtaaa

SEQ ID NO: 6621204 - DNA, 14 bp, Homo sapiens
acttcgacactgtt

SEQ ID NO: 6621205 - DNA, 20 bp, Homo sapiens
acttcgaccctttctctgag

SEQ ID NO: 6621206 - DNA, 16 bp, Homo sapiens
acttcgcacacaccca

SEQ ID NO: 6621207 - DNA, 22 bp, Homo sapiens
acttcgcaccggagtgtctgga

SEQ ID NO: 6621208 - DNA, 22 bp, Homo sapiens
acttcgcgcaccttctcacctt

SEQ ID NO: 6621209 - DNA, 17 bp, Homo sapiens
acttcgctattcccagg

SEQ ID NO: 6621210 - DNA, 19 bp, Homo sapiens
acttcgctattcccaggca

SEQ ID NO: 6621211 - DNA, 14 bp, Homo sapiens
acttcgggctggcc

SEQ ID NO: 6621212 - DNA, 17 bp, Homo sapiens
acttcggggctgggaag

SEQ ID NO: 6621213 - DNA, 20 bp, Homo sapiens
acttcggggtagaggctggg

SEQ ID NO: 6621214 - DNA, 19 bp, Homo sapiens
acttcgtcttctaatttca

SEQ ID NO: 6621215 - DNA, 17 bp, Homo sapiens
acttcgtggatgacctc

SEQ ID NO: 6621216 - DNA, 23 bp, Homo sapiens
acttcgttttggttaagttggct

SEQ ID NO: 6621217 - DNA, 15 bp, Homo sapiens
acttctaaaactgta

SEQ ID NO: 6621218 - DNA, 22 bp, Homo sapiens
acttctaaaactgtactttgat

SEQ ID NO: 6621219 - DNA, 20 bp, Homo sapiens
acttctaaaataaatgtttt

SEQ ID NO: 6621220 - DNA, 13 bp, Homo sapiens
acttctaaatcag

SEQ ID NO: 6621221 - DNA, 15 bp, Homo sapiens
acttctaaatgaagt

SEQ ID NO: 6621222 - DNA, 17 bp, Homo sapiens
acttctaaatgcatatc

SEQ ID NO: 6621223 - DNA, 13 bp, Homo sapiens
acttctaaatgtt

SEQ ID NO: 6621224 - DNA, 14 bp, Homo sapiens
acttctaaatgttg

SEQ ID NO: 6621225 - DNA, 16 bp, Homo sapiens
acttctaactccactg

SEQ ID NO: 6621226 - DNA, 19 bp, Homo sapiens
acttctaagtaaaaccaca

SEQ ID NO: 6621227 - DNA, 11 bp, Homo sapiens
acttctaatat

SEQ ID NO: 6621228 - DNA, 18 bp, Homo sapiens
acttctactgttcaattt

SEQ ID NO: 6621229 - DNA, 15 bp, Homo sapiens
acttctagagggaga

SEQ ID NO: 6621230 - DNA, 22 bp, Homo sapiens
acttctagagggagaagactgt

SEQ ID NO: 6621231 - DNA, 16 bp, Homo sapiens
acttctagcagagacc

SEQ ID NO: 6621232 - DNA, 22 bp, Homo sapiens
acttctagcatatagactatat

SEQ ID NO: 6621233 - DNA, 13 bp, Homo sapiens
acttctagctcat

SEQ ID NO: 6621234 - DNA, 19 bp, Homo sapiens
acttctagctcatttaaca

SEQ ID NO: 6621235 - DNA, 13 bp, Homo sapiens
acttctagctgtc

SEQ ID NO: 6621236 - DNA, 18 bp, Homo sapiens
acttctaggaggatgctg

SEQ ID NO: 6621237 - DNA, 20 bp, Homo sapiens
acttctaggatttattgtta

SEQ ID NO: 6621238 - DNA, 16 bp, Homo sapiens
acttctagtcagtcat

SEQ ID NO: 6621239 - DNA, 13 bp, Homo sapiens
acttctagttgct

SEQ ID NO: 6621240 - DNA, 14 bp, Homo sapiens
acttctagttgctc

SEQ ID NO: 6621241 - DNA, 16 bp, Homo sapiens
acttctagtttcacgt

SEQ ID NO: 6621242 - DNA, 13 bp, Homo sapiens
acttctatatttt

SEQ ID NO: 6621243 - DNA, 20 bp, Homo sapiens
acttctatttatttattatt

SEQ ID NO: 6621244 - DNA, 21 bp, Homo sapiens
acttctattttaaagacaatg

SEQ ID NO: 6621245 - DNA, 20 bp, Homo sapiens
acttctattttttaaagact

SEQ ID NO: 6621246 - DNA, 15 bp, Homo sapiens
acttctcaaatgcta

SEQ ID NO: 6621247 - DNA, 12 bp, Homo sapiens
acttctcaagta

SEQ ID NO: 6621248 - DNA, 13 bp, Homo sapiens
acttctcaagtaa

SEQ ID NO: 6621249 - DNA, 21 bp, Homo sapiens
acttctcaagtaacatgactt

SEQ ID NO: 6621250 - DNA, 17 bp, Homo sapiens
acttctcactaatttgt

SEQ ID NO: 6621251 - DNA, 20 bp, Homo sapiens
acttctcaggaaatggcttt

SEQ ID NO: 6621252 - DNA, 18 bp, Homo sapiens
acttctcaggacacaggc

SEQ ID NO: 6621253 - DNA, 20 bp, Homo sapiens
acttctcaggacacaggcct

SEQ ID NO: 6621254 - DNA, 22 bp, Homo sapiens
acttctcaggacacaggcctgt

SEQ ID NO: 6621255 - DNA, 15 bp, Homo sapiens
acttctcatcacaca

SEQ ID NO: 6621256 - DNA, 16 bp, Homo sapiens
acttctcatcacacac

SEQ ID NO: 6621257 - DNA, 14 bp, Homo sapiens
acttctcatcttaa

SEQ ID NO: 6621258 - DNA, 18 bp, Homo sapiens
acttctcatttatgttat

SEQ ID NO: 6621259 - DNA, 23 bp, Homo sapiens
acttctcatttatgttatttatg

SEQ ID NO: 6621260 - DNA, 15 bp, Homo sapiens
acttctccaccctgc

SEQ ID NO: 6621261 - DNA, 22 bp, Homo sapiens
acttctccatcctttctgcctc

SEQ ID NO: 6621262 - DNA, 10 bp, Homo sapiens
acttctccca

SEQ ID NO: 6621263 - DNA, 13 bp, Homo sapiens
acttctcccaccc

SEQ ID NO: 6621264 - DNA, 14 bp, Homo sapiens
acttctcccacccc

SEQ ID NO: 6621265 - DNA, 15 bp, Homo sapiens
acttctcccacccct

SEQ ID NO: 6621266 - DNA, 20 bp, Homo sapiens
acttctcccaccccttggcc

SEQ ID NO: 6621267 - DNA, 21 bp, Homo sapiens
acttctcctgctgctcctgtt

SEQ ID NO: 6621268 - DNA, 14 bp, Homo sapiens
acttctcctttaaa

SEQ ID NO: 6621269 - DNA, 20 bp, Homo sapiens
acttctcctttaaattcttt

SEQ ID NO: 6621270 - DNA, 19 bp, Homo sapiens
acttctcgaattgaagcaa

SEQ ID NO: 6621271 - DNA, 20 bp, Homo sapiens
acttctcggaattcataata

SEQ ID NO: 6621272 - DNA, 20 bp, Homo sapiens
acttctctaatagaaaagtc

SEQ ID NO: 6621273 - DNA, 21 bp, Homo sapiens
acttctctacccatcttaaaa

SEQ ID NO: 6621274 - DNA, 11 bp, Homo sapiens
acttctctaga

SEQ ID NO: 6621275 - DNA, 19 bp, Homo sapiens
acttctctataaaaaatat

SEQ ID NO: 6621276 - DNA, 21 bp, Homo sapiens
acttctctataaaaaatatgt

SEQ ID NO: 6621277 - DNA, 16 bp, Homo sapiens
acttctctctaaggag

SEQ ID NO: 6621278 - DNA, 17 bp, Homo sapiens
acttctctgaagggagg

SEQ ID NO: 6621279 - DNA, 23 bp, Homo sapiens
acttctctgatcaaaattacttt

SEQ ID NO: 6621280 - DNA, 23 bp, Homo sapiens
acttctctgcctttgacatttaa

SEQ ID NO: 6621281 - DNA, 12 bp, Homo sapiens
acttctctgctg

SEQ ID NO: 6621282 - DNA, 20 bp, Homo sapiens
acttctctgtcctctgcttt

SEQ ID NO: 6621283 - DNA, 21 bp, Homo sapiens
acttctctgttaacctacaaa

SEQ ID NO: 6621284 - DNA, 19 bp, Homo sapiens
acttctcttaaacttgtga

SEQ ID NO: 6621285 - DNA, 20 bp, Homo sapiens
acttctcttaaacttgtgaa

SEQ ID NO: 6621286 - DNA, 21 bp, Homo sapiens
acttctcttaaacttgtgaat

SEQ ID NO: 6621287 - DNA, 15 bp, Homo sapiens
acttctcttacattt

SEQ ID NO: 6621288 - DNA, 17 bp, Homo sapiens
acttctcttacattttc

SEQ ID NO: 6621289 - DNA, 22 bp, Homo sapiens
acttctcttattctttacaaaa

SEQ ID NO: 6621290 - DNA, 17 bp, Homo sapiens
acttctcttgaaaagtt

SEQ ID NO: 6621291 - DNA, 15 bp, Homo sapiens
acttctcttgaatta

SEQ ID NO: 6621292 - DNA, 17 bp, Homo sapiens
acttctcttgctttcta

SEQ ID NO: 6621293 - DNA, 22 bp, Homo sapiens
acttctctttcttattttgtaa

SEQ ID NO: 6621294 - DNA, 15 bp, Homo sapiens
acttctctttgcctc

SEQ ID NO: 6621295 - DNA, 13 bp, Homo sapiens
acttctgaaactt

SEQ ID NO: 6621296 - DNA, 14 bp, Homo sapiens
acttctgaaagagc

SEQ ID NO: 6621297 - DNA, 16 bp, Homo sapiens
acttctgaagagacca

SEQ ID NO: 6621298 - DNA, 20 bp, Homo sapiens
acttctgaagagaccactca

SEQ ID NO: 6621299 - DNA, 23 bp, Homo sapiens
acttctgacaaaggtggtaaatt

SEQ ID NO: 6621300 - DNA, 15 bp, Homo sapiens
acttctgacagcctc

SEQ ID NO: 6621301 - DNA, 16 bp, Homo sapiens
acttctgactcttccc

SEQ ID NO: 6621302 - DNA, 14 bp, Homo sapiens
acttctgagcccca

SEQ ID NO: 6621303 - DNA, 20 bp, Homo sapiens
acttctgagccccagcccca

SEQ ID NO: 6621304 - DNA, 24 bp, Homo sapiens
acttctgataatttattgtcttta

SEQ ID NO: 6621305 - DNA, 22 bp, Homo sapiens
acttctgatactttagtacaat

SEQ ID NO: 6621306 - DNA, 18 bp, Homo sapiens
acttctgcattcctgtaa

SEQ ID NO: 6621307 - DNA, 13 bp, Homo sapiens
acttctgcctctt

SEQ ID NO: 6621308 - DNA, 12 bp, Homo sapiens
acttctgcctga

SEQ ID NO: 6621309 - DNA, 16 bp, Homo sapiens
acttctgcctggagac

SEQ ID NO: 6621310 - DNA, 10 bp, Homo sapiens
acttctgctc

SEQ ID NO: 6621311 - DNA, 11 bp, Homo sapiens
acttctgctga

SEQ ID NO: 6621312 - DNA, 22 bp, Homo sapiens
acttctgctgaaggacagaaca

SEQ ID NO: 6621313 - DNA, 15 bp, Homo sapiens
acttctgctgctggc

SEQ ID NO: 6621314 - DNA, 16 bp, Homo sapiens
acttctgctgctggcc

SEQ ID NO: 6621315 - DNA, 14 bp, Homo sapiens
acttctgctggcat

SEQ ID NO: 6621316 - DNA, 13 bp, Homo sapiens
acttctgctttca

SEQ ID NO: 6621317 - DNA, 22 bp, Homo sapiens
acttctgctttccacacctggc

SEQ ID NO: 6621318 - DNA, 16 bp, Homo sapiens
acttctggaaggctgg

SEQ ID NO: 6621319 - DNA, 21 bp, Homo sapiens
acttctggaaggctggctgag

SEQ ID NO: 6621320 - DNA, 19 bp, Homo sapiens
acttctggcataactaaaa

SEQ ID NO: 6621321 - DNA, 12 bp, Homo sapiens
acttctggcatg

SEQ ID NO: 6621322 - DNA, 17 bp, Homo sapiens
acttctggcctccagcc

SEQ ID NO: 6621323 - DNA, 18 bp, Homo sapiens
acttctggcctccagcct

SEQ ID NO: 6621324 - DNA, 13 bp, Homo sapiens
acttctggctcct

SEQ ID NO: 6621325 - DNA, 16 bp, Homo sapiens
acttctggctcctcaa

SEQ ID NO: 6621326 - DNA, 16 bp, Homo sapiens
acttctggcttatgct

SEQ ID NO: 6621327 - DNA, 14 bp, Homo sapiens
acttctgggaaaaa

SEQ ID NO: 6621328 - DNA, 17 bp, Homo sapiens
acttctgggcttcatct

SEQ ID NO: 6621329 - DNA, 22 bp, Homo sapiens
acttctgggcttcatctggcaa

SEQ ID NO: 6621330 - DNA, 21 bp, Homo sapiens
acttctggggccacctctgga

SEQ ID NO: 6621331 - DNA, 15 bp, Homo sapiens
acttctggggccagc

SEQ ID NO: 6621332 - DNA, 21 bp, Homo sapiens
acttctgggtcaatggaataa

SEQ ID NO: 6621333 - DNA, 18 bp, Homo sapiens
acttctggtataattgtg

SEQ ID NO: 6621334 - DNA, 19 bp, Homo sapiens
acttctggtataattgtgt

SEQ ID NO: 6621335 - DNA, 15 bp, Homo sapiens
acttctggtcaatca

SEQ ID NO: 6621336 - DNA, 14 bp, Homo sapiens
acttctggtcccct

SEQ ID NO: 6621337 - DNA, 21 bp, Homo sapiens
acttctggttgtatttctata

SEQ ID NO: 6621338 - DNA, 22 bp, Homo sapiens
acttctggttgtatttctatat

SEQ ID NO: 6621339 - DNA, 23 bp, Homo sapiens
acttctgtaacgggtcgtgctca

SEQ ID NO: 6621340 - DNA, 14 bp, Homo sapiens
acttctgtacagta

SEQ ID NO: 6621341 - DNA, 19 bp, Homo sapiens
acttctgtgagacccccac

SEQ ID NO: 6621342 - DNA, 16 bp, Homo sapiens
acttctgtgggcatgg

SEQ ID NO: 6621343 - DNA, 13 bp, Homo sapiens
acttctgtgggcc

SEQ ID NO: 6621344 - DNA, 22 bp, Homo sapiens
acttctgtgggcccctcaacag

SEQ ID NO: 6621345 - DNA, 23 bp, Homo sapiens
acttctgtgggcccctcaacagc

SEQ ID NO: 6621346 - DNA, 13 bp, Homo sapiens
acttctgtgttca

SEQ ID NO: 6621347 - DNA, 15 bp, Homo sapiens
acttctgttatcagg

SEQ ID NO: 6621348 - DNA, 12 bp, Homo sapiens
acttctgtttca

SEQ ID NO: 6621349 - DNA, 23 bp, Homo sapiens
acttctgtttgatcactgtgaac

SEQ ID NO: 6621350 - DNA, 14 bp, Homo sapiens
acttctgttttcaa

SEQ ID NO: 6621351 - DNA, 15 bp, Homo sapiens
acttctgttttcaat

SEQ ID NO: 6621352 - DNA, 18 bp, Homo sapiens
acttcttaaaaggagctc

SEQ ID NO: 6621353 - DNA, 21 bp, Homo sapiens
acttcttaaaggcctggaacc

SEQ ID NO: 6621354 - DNA, 14 bp, Homo sapiens
acttcttaaatatc

SEQ ID NO: 6621355 - DNA, 22 bp, Homo sapiens
acttcttaaatatcttttatgt

SEQ ID NO: 6621356 - DNA, 23 bp, Homo sapiens
acttcttaaggacagtgttcaaa

SEQ ID NO: 6621357 - DNA, 24 bp, Homo sapiens
acttcttaaggacagtgttcaaat

SEQ ID NO: 6621358 - DNA, 22 bp, Homo sapiens
acttcttaatgctttcctccct

SEQ ID NO: 6621359 - DNA, 14 bp, Homo sapiens
acttcttacccaaa

SEQ ID NO: 6621360 - DNA, 16 bp, Homo sapiens
acttcttacgactttt

SEQ ID NO: 6621361 - DNA, 17 bp, Homo sapiens
acttcttacgacttttt

SEQ ID NO: 6621362 - DNA, 17 bp, Homo sapiens
acttcttacttgtctgt

SEQ ID NO: 6621363 - DNA, 23 bp, Homo sapiens
acttcttagggattaaatataga

SEQ ID NO: 6621364 - DNA, 17 bp, Homo sapiens
acttcttatggaattga

SEQ ID NO: 6621365 - DNA, 20 bp, Homo sapiens
acttcttatggaattgattt

SEQ ID NO: 6621366 - DNA, 23 bp, Homo sapiens
acttcttattgcaaggcagtctc

SEQ ID NO: 6621367 - DNA, 13 bp, Homo sapiens
acttcttcacctc

SEQ ID NO: 6621368 - DNA, 15 bp, Homo sapiens
acttcttcacctctt

SEQ ID NO: 6621369 - DNA, 18 bp, Homo sapiens
acttcttcatccatagac

SEQ ID NO: 6621370 - DNA, 14 bp, Homo sapiens
acttcttccactgt

SEQ ID NO: 6621371 - DNA, 15 bp, Homo sapiens
acttcttccactgtg

SEQ ID NO: 6621372 - DNA, 23 bp, Homo sapiens
acttcttccactttttccagaat

SEQ ID NO: 6621373 - DNA, 18 bp, Homo sapiens
acttcttccctaaaatgt

SEQ ID NO: 6621374 - DNA, 19 bp, Homo sapiens
acttcttccctaaaatgta

SEQ ID NO: 6621375 - DNA, 14 bp, Homo sapiens
acttcttcctgctg

SEQ ID NO: 6621376 - DNA, 16 bp, Homo sapiens
acttcttcctgctgga

SEQ ID NO: 6621377 - DNA, 18 bp, Homo sapiens
acttcttcggaggtggca

SEQ ID NO: 6621378 - DNA, 17 bp, Homo sapiens
acttcttctagagtaat

SEQ ID NO: 6621379 - DNA, 22 bp, Homo sapiens
acttcttctagagtaattatct

SEQ ID NO: 6621380 - DNA, 13 bp, Homo sapiens
acttcttctctta

SEQ ID NO: 6621381 - DNA, 16 bp, Homo sapiens
acttcttctcttagat

SEQ ID NO: 6621382 - DNA, 18 bp, Homo sapiens
acttcttctcttagattc

SEQ ID NO: 6621383 - DNA, 11 bp, Homo sapiens
acttcttctgt

SEQ ID NO: 6621384 - DNA, 14 bp, Homo sapiens
acttcttctgtaat

SEQ ID NO: 6621385 - DNA, 16 bp, Homo sapiens
acttcttctgtaatat

SEQ ID NO: 6621386 - DNA, 18 bp, Homo sapiens
acttcttcttctttgttt

SEQ ID NO: 6621387 - DNA, 19 bp, Homo sapiens
acttcttgaaaaagatggc

SEQ ID NO: 6621388 - DNA, 17 bp, Homo sapiens
acttcttgaaacagcct

SEQ ID NO: 6621389 - DNA, 18 bp, Homo sapiens
acttcttgaaacagcctg

SEQ ID NO: 6621390 - DNA, 14 bp, Homo sapiens
acttcttggaaaaa

SEQ ID NO: 6621391 - DNA, 19 bp, Homo sapiens
acttcttggttcctgggat

SEQ ID NO: 6621392 - DNA, 19 bp, Homo sapiens
acttcttggtttggggaga

SEQ ID NO: 6621393 - DNA, 21 bp, Homo sapiens
acttcttggtttggggagaaa

SEQ ID NO: 6621394 - DNA, 22 bp, Homo sapiens
acttcttggtttggggagaaat

SEQ ID NO: 6621395 - DNA, 18 bp, Homo sapiens
acttcttggttttctctc

SEQ ID NO: 6621396 - DNA, 20 bp, Homo sapiens
acttcttggttttctctctg

SEQ ID NO: 6621397 - DNA, 22 bp, Homo sapiens
acttcttggttttctctctgga

SEQ ID NO: 6621398 - DNA, 23 bp, Homo sapiens
acttcttggttttctctctggat

SEQ ID NO: 6621399 - DNA, 17 bp, Homo sapiens
acttcttgtcagacata

SEQ ID NO: 6621400 - DNA, 20 bp, Homo sapiens
acttcttgtcagacataaag

SEQ ID NO: 6621401 - DNA, 15 bp, Homo sapiens
acttcttgtgtgtat

SEQ ID NO: 6621402 - DNA, 19 bp, Homo sapiens
acttctttaattttggaat

SEQ ID NO: 6621403 - DNA, 18 bp, Homo sapiens
acttctttatactctctt

SEQ ID NO: 6621404 - DNA, 18 bp, Homo sapiens
acttctttcccttcctcc

SEQ ID NO: 6621405 - DNA, 14 bp, Homo sapiens
acttctttgaagtt

SEQ ID NO: 6621406 - DNA, 14 bp, Homo sapiens
acttctttgcagtt

SEQ ID NO: 6621407 - DNA, 21 bp, Homo sapiens
acttctttgcagttcccatct

SEQ ID NO: 6621408 - DNA, 18 bp, Homo sapiens
acttctttgctttgccca

SEQ ID NO: 6621409 - DNA, 21 bp, Homo sapiens
acttctttgctttgcccagca

SEQ ID NO: 6621410 - DNA, 15 bp, Homo sapiens
acttcttttataact

SEQ ID NO: 6621411 - DNA, 11 bp, Homo sapiens
acttcttttca

SEQ ID NO: 6621412 - DNA, 20 bp, Homo sapiens
acttcttttccaaaaatact

SEQ ID NO: 6621413 - DNA, 21 bp, Homo sapiens
acttcttttccaaaaatactt

SEQ ID NO: 6621414 - DNA, 11 bp, Homo sapiens
acttgaaaaga

SEQ ID NO: 6621415 - DNA, 18 bp, Homo sapiens
acttgaaaagaaagtgtt

SEQ ID NO: 6621416 - DNA, 15 bp, Homo sapiens
acttgaaaagagaca

SEQ ID NO: 6621417 - DNA, 20 bp, Homo sapiens
acttgaaaagagacaggcag

SEQ ID NO: 6621418 - DNA, 22 bp, Homo sapiens
acttgaaaagagacaggcaggt

SEQ ID NO: 6621419 - DNA, 12 bp, Homo sapiens
acttgaaaagat

SEQ ID NO: 6621420 - DNA, 16 bp, Homo sapiens
acttgaaaagattgca

SEQ ID NO: 6621421 - DNA, 12 bp, Homo sapiens
acttgaaaatta

SEQ ID NO: 6621422 - DNA, 14 bp, Homo sapiens
acttgaaaattaac

SEQ ID NO: 6621423 - DNA, 15 bp, Homo sapiens
acttgaaacccacag

SEQ ID NO: 6621424 - DNA, 14 bp, Homo sapiens
acttgaaagatttt

SEQ ID NO: 6621425 - DNA, 18 bp, Homo sapiens
acttgaaagcatccatgt

SEQ ID NO: 6621426 - DNA, 16 bp, Homo sapiens
acttgaaataagttgt

SEQ ID NO: 6621427 - DNA, 18 bp, Homo sapiens
acttgaaataccagtgaa

SEQ ID NO: 6621428 - DNA, 20 bp, Homo sapiens
acttgaaatatcctgcttga

SEQ ID NO: 6621429 - DNA, 21 bp, Homo sapiens
acttgaaatctaatatttcta

SEQ ID NO: 6621430 - DNA, 16 bp, Homo sapiens
acttgaaattatatct

SEQ ID NO: 6621431 - DNA, 17 bp, Homo sapiens
acttgaaattatatctg

SEQ ID NO: 6621432 - DNA, 19 bp, Homo sapiens
acttgaaatttgaattttg

SEQ ID NO: 6621433 - DNA, 20 bp, Homo sapiens
acttgaaatttgaattttgt

SEQ ID NO: 6621434 - DNA, 13 bp, Homo sapiens
acttgaacaaaag

SEQ ID NO: 6621435 - DNA, 15 bp, Homo sapiens
acttgaacaaaaggg

SEQ ID NO: 6621436 - DNA, 16 bp, Homo sapiens
acttgaacaaaagggt

SEQ ID NO: 6621437 - DNA, 18 bp, Homo sapiens
acttgaacaaaagggtca

SEQ ID NO: 6621438 - DNA, 21 bp, Homo sapiens
acttgaacaaaagggtcagag

SEQ ID NO: 6621439 - DNA, 15 bp, Homo sapiens
acttgaacaaagaca

SEQ ID NO: 6621440 - DNA, 15 bp, Homo sapiens
acttgaacaaagtct

SEQ ID NO: 6621441 - DNA, 22 bp, Homo sapiens
acttgaacaaagtctctgggtc

SEQ ID NO: 6621442 - DNA, 22 bp, Homo sapiens
acttgaaccacaagtgaatctt

SEQ ID NO: 6621443 - DNA, 19 bp, Homo sapiens
acttgaaccataaaatgtc

SEQ ID NO: 6621444 - DNA, 17 bp, Homo sapiens
acttgaacccgggaggc

SEQ ID NO: 6621445 - DNA, 20 bp, Homo sapiens
acttgaacccgggaggcaga

SEQ ID NO: 6621446 - DNA, 23 bp, Homo sapiens
acttgaacccgggggacagaggt

SEQ ID NO: 6621447 - DNA, 15 bp, Homo sapiens
acttgaacctgaaga

SEQ ID NO: 6621448 - DNA, 17 bp, Homo sapiens
acttgaacgttttctaa

SEQ ID NO: 6621449 - DNA, 22 bp, Homo sapiens
acttgaacgttttctaattgct

SEQ ID NO: 6621450 - DNA, 21 bp, Homo sapiens
acttgaactgattcacatctc

SEQ ID NO: 6621451 - DNA, 19 bp, Homo sapiens
acttgaactgttgcccttc

SEQ ID NO: 6621452 - DNA, 22 bp, Homo sapiens
acttgaactgttgcccttctgt

SEQ ID NO: 6621453 - DNA, 20 bp, Homo sapiens
acttgaacttgcaggcaagc

SEQ ID NO: 6621454 - DNA, 15 bp, Homo sapiens
acttgaactttccaa

SEQ ID NO: 6621455 - DNA, 10 bp, Homo sapiens
acttgaagaa

SEQ ID NO: 6621456 - DNA, 14 bp, Homo sapiens
acttgaagattaat

SEQ ID NO: 6621457 - DNA, 20 bp, Homo sapiens
acttgaagattgtagcaata

SEQ ID NO: 6621458 - DNA, 17 bp, Homo sapiens
acttgaagcacttaagt

SEQ ID NO: 6621459 - DNA, 14 bp, Homo sapiens
acttgaagccaaac

SEQ ID NO: 6621460 - DNA, 21 bp, Homo sapiens
acttgaagcctaaatttgtgc

SEQ ID NO: 6621461 - DNA, 11 bp, Homo sapiens
acttgaaggat

SEQ ID NO: 6621462 - DNA, 23 bp, Homo sapiens
acttgaaggcccaggtcaacatc

SEQ ID NO: 6621463 - DNA, 15 bp, Homo sapiens
acttgaagggccaga

SEQ ID NO: 6621464 - DNA, 19 bp, Homo sapiens
acttgaagggccagagcca

SEQ ID NO: 6621465 - DNA, 20 bp, Homo sapiens
acttgaaggtttgatgccaa

SEQ ID NO: 6621466 - DNA, 22 bp, Homo sapiens
acttgaagtgaacaaatttcaa

SEQ ID NO: 6621467 - DNA, 18 bp, Homo sapiens
acttgaagtggtttctaa

SEQ ID NO: 6621468 - DNA, 22 bp, Homo sapiens
acttgaagttgttactaactaa

SEQ ID NO: 6621469 - DNA, 19 bp, Homo sapiens
acttgaataaaaaaaatat

SEQ ID NO: 6621470 - DNA, 19 bp, Homo sapiens
acttgaataaagtactaca

SEQ ID NO: 6621471 - DNA, 20 bp, Homo sapiens
acttgaataaccatctgaaa

SEQ ID NO: 6621472 - DNA, 12 bp, Homo sapiens
acttgaatcaga

SEQ ID NO: 6621473 - DNA, 21 bp, Homo sapiens
acttgaatcagatggtgtcat

SEQ ID NO: 6621474 - DNA, 23 bp, Homo sapiens
acttgaatcagatggtgtcattt

SEQ ID NO: 6621475 - DNA, 19 bp, Homo sapiens
acttgaatcctagggcctg

SEQ ID NO: 6621476 - DNA, 13 bp, Homo sapiens
acttgaatctgtt

SEQ ID NO: 6621477 - DNA, 14 bp, Homo sapiens
acttgaatctgtta

SEQ ID NO: 6621478 - DNA, 20 bp, Homo sapiens
acttgaatctgttactgaaa

SEQ ID NO: 6621479 - DNA, 22 bp, Homo sapiens
acttgaatctgttactgaaatg

SEQ ID NO: 6621480 - DNA, 11 bp, Homo sapiens
acttgaatgta

SEQ ID NO: 6621481 - DNA, 14 bp, Homo sapiens
acttgaatttcaaa

SEQ ID NO: 6621482 - DNA, 22 bp, Homo sapiens
acttgaatttggtctgtatagt

SEQ ID NO: 6621483 - DNA, 19 bp, Homo sapiens
acttgacaacatcccacag

SEQ ID NO: 6621484 - DNA, 12 bp, Homo sapiens
acttgacagtgg

SEQ ID NO: 6621485 - DNA, 14 bp, Homo sapiens
acttgacattcctt

SEQ ID NO: 6621486 - DNA, 15 bp, Homo sapiens
acttgaccctttcct

SEQ ID NO: 6621487 - DNA, 23 bp, Homo sapiens
acttgaccttctgtcgtccccag

SEQ ID NO: 6621488 - DNA, 16 bp, Homo sapiens
acttgacgcagccccc

SEQ ID NO: 6621489 - DNA, 14 bp, Homo sapiens
acttgactctaata

SEQ ID NO: 6621490 - DNA, 19 bp, Homo sapiens
acttgagaaaatgcaggag

SEQ ID NO: 6621491 - DNA, 20 bp, Homo sapiens
acttgagaaaatgcaggaga

SEQ ID NO: 6621492 - DNA, 20 bp, Homo sapiens
acttgagaaccagtctcctc

SEQ ID NO: 6621493 - DNA, 22 bp, Homo sapiens
acttgagaagtctaattcacag

SEQ ID NO: 6621494 - DNA, 19 bp, Homo sapiens
acttgagaattaccctttt

SEQ ID NO: 6621495 - DNA, 21 bp, Homo sapiens
acttgagacaatgttttcttc

SEQ ID NO: 6621496 - DNA, 20 bp, Homo sapiens
acttgagataatctaaatat

SEQ ID NO: 6621497 - DNA, 15 bp, Homo sapiens
acttgagatgaaaaa

SEQ ID NO: 6621498 - DNA, 21 bp, Homo sapiens
acttgagatgtatgaaggctt

SEQ ID NO: 6621499 - DNA, 23 bp, Homo sapiens
acttgagccagttacctttgctg

SEQ ID NO: 6621500 - DNA, 11 bp, Homo sapiens
acttgagccta

SEQ ID NO: 6621501 - DNA, 19 bp, Homo sapiens
acttgagcctccatttctg

SEQ ID NO: 6621502 - DNA, 22 bp, Homo sapiens
acttgagcctccatttctggct

SEQ ID NO: 6621503 - DNA, 23 bp, Homo sapiens
acttgagctgtatatatatatgt

SEQ ID NO: 6621504 - DNA, 14 bp, Homo sapiens
acttgaggacacat

SEQ ID NO: 6621505 - DNA, 18 bp, Homo sapiens
acttgaggacacatgtcc

SEQ ID NO: 6621506 - DNA, 19 bp, Homo sapiens
acttgaggacacatgtcca

SEQ ID NO: 6621507 - DNA, 21 bp, Homo sapiens
acttgaggaggagctggcctg

SEQ ID NO: 6621508 - DNA, 13 bp, Homo sapiens
acttgaggcctga

SEQ ID NO: 6621509 - DNA, 17 bp, Homo sapiens
acttgaggctttcagtg

SEQ ID NO: 6621510 - DNA, 16 bp, Homo sapiens
acttgagggaccaata

SEQ ID NO: 6621511 - DNA, 20 bp, Homo sapiens
acttgagggacgactttctt

SEQ ID NO: 6621512 - DNA, 23 bp, Homo sapiens
acttgagggacgactttctttaa

SEQ ID NO: 6621513 - DNA, 15 bp, Homo sapiens
acttgagggcccaga

SEQ ID NO: 6621514 - DNA, 18 bp, Homo sapiens
acttgagggcccagagca

SEQ ID NO: 6621515 - DNA, 16 bp, Homo sapiens
acttgagggcctgagc

SEQ ID NO: 6621516 - DNA, 13 bp, Homo sapiens
acttgaggtcagg

SEQ ID NO: 6621517 - DNA, 19 bp, Homo sapiens
acttgagtaaatctaaaga

SEQ ID NO: 6621518 - DNA, 16 bp, Homo sapiens
acttgagtatcataat

SEQ ID NO: 6621519 - DNA, 18 bp, Homo sapiens
acttgagtatcataatat

SEQ ID NO: 6621520 - DNA, 22 bp, Homo sapiens
acttgagtggaggtttatagtt

SEQ ID NO: 6621521 - DNA, 15 bp, Homo sapiens
acttgagtgttcctt

SEQ ID NO: 6621522 - DNA, 18 bp, Homo sapiens
acttgagttacaccagac

SEQ ID NO: 6621523 - DNA, 21 bp, Homo sapiens
acttgagttttatttatttta

SEQ ID NO: 6621524 - DNA, 23 bp, Homo sapiens
acttgataagggactgatgtttg

SEQ ID NO: 6621525 - DNA, 18 bp, Homo sapiens
acttgataatattagtga

SEQ ID NO: 6621526 - DNA, 23 bp, Homo sapiens
acttgataatattagtgattctg

SEQ ID NO: 6621527 - DNA, 14 bp, Homo sapiens
acttgatactgaat

SEQ ID NO: 6621528 - DNA, 19 bp, Homo sapiens
acttgatactgaatgcata

SEQ ID NO: 6621529 - DNA, 22 bp, Homo sapiens
acttgatataattacttaatgt

SEQ ID NO: 6621530 - DNA, 21 bp, Homo sapiens
acttgatatgactaattcagg

SEQ ID NO: 6621531 - DNA, 12 bp, Homo sapiens
acttgatattta

SEQ ID NO: 6621532 - DNA, 22 bp, Homo sapiens
acttgatatttaagcagcttga

SEQ ID NO: 6621533 - DNA, 15 bp, Homo sapiens
acttgatatttcctt

SEQ ID NO: 6621534 - DNA, 20 bp, Homo sapiens
acttgatcacatgcttgaat

SEQ ID NO: 6621535 - DNA, 20 bp, Homo sapiens
acttgatcatttttaccatt

SEQ ID NO: 6621536 - DNA, 17 bp, Homo sapiens
acttgatccatttctaa

SEQ ID NO: 6621537 - DNA, 19 bp, Homo sapiens
acttgatgaataaacactt

SEQ ID NO: 6621538 - DNA, 22 bp, Homo sapiens
acttgatgagtgtaacaagaaa

SEQ ID NO: 6621539 - DNA, 14 bp, Homo sapiens
acttgatgcactta

SEQ ID NO: 6621540 - DNA, 14 bp, Homo sapiens
acttgatgcatgtg

SEQ ID NO: 6621541 - DNA, 16 bp, Homo sapiens
acttgatggctgcgaa

SEQ ID NO: 6621542 - DNA, 13 bp, Homo sapiens
acttgatgtaact

SEQ ID NO: 6621543 - DNA, 13 bp, Homo sapiens
acttgatgtgaaa

SEQ ID NO: 6621544 - DNA, 23 bp, Homo sapiens
acttgatgtgatgtggcaggagg

SEQ ID NO: 6621545 - DNA, 19 bp, Homo sapiens
acttgatgtgccattttaa

SEQ ID NO: 6621546 - DNA, 22 bp, Homo sapiens
acttgatgttccacctgccaca

SEQ ID NO: 6621547 - DNA, 16 bp, Homo sapiens
acttgatgttcctggg

SEQ ID NO: 6621548 - DNA, 19 bp, Homo sapiens
acttgatgttcctgggatg

SEQ ID NO: 6621549 - DNA, 14 bp, Homo sapiens
acttgatgttcctt

SEQ ID NO: 6621550 - DNA, 17 bp, Homo sapiens
acttgatgtttcctgga

SEQ ID NO: 6621551 - DNA, 19 bp, Homo sapiens
acttgatgtttcctggaag

SEQ ID NO: 6621552 - DNA, 14 bp, Homo sapiens
acttgatgtttgtt

SEQ ID NO: 6621553 - DNA, 21 bp, Homo sapiens
acttgattaagattttacaaa

SEQ ID NO: 6621554 - DNA, 23 bp, Homo sapiens
acttgattaagattttacaaaag

SEQ ID NO: 6621555 - DNA, 16 bp, Homo sapiens
acttgattaaggacta

SEQ ID NO: 6621556 - DNA, 22 bp, Homo sapiens
acttgattaaggactacagaat

SEQ ID NO: 6621557 - DNA, 16 bp, Homo sapiens
acttgattcatctctg

SEQ ID NO: 6621558 - DNA, 19 bp, Homo sapiens
acttgattggtttaaaagt

SEQ ID NO: 6621559 - DNA, 13 bp, Homo sapiens
acttgatttcttc

SEQ ID NO: 6621560 - DNA, 16 bp, Homo sapiens
acttgatttgatgtga

SEQ ID NO: 6621561 - DNA, 21 bp, Homo sapiens
acttgatttgatgtgactttt

SEQ ID NO: 6621562 - DNA, 14 bp, Homo sapiens
acttgatttgcatg

SEQ ID NO: 6621563 - DNA, 19 bp, Homo sapiens
acttgatttttcaaagact

SEQ ID NO: 6621564 - DNA, 17 bp, Homo sapiens
acttgcaaaaagggtca

SEQ ID NO: 6621565 - DNA, 17 bp, Homo sapiens
acttgcaaaatcagttt

SEQ ID NO: 6621566 - DNA, 18 bp, Homo sapiens
acttgcaaaatcagtttt

SEQ ID NO: 6621567 - DNA, 17 bp, Homo sapiens
acttgcaaaatggagac

SEQ ID NO: 6621568 - DNA, 19 bp, Homo sapiens
acttgcaaagacctacctc

SEQ ID NO: 6621569 - DNA, 22 bp, Homo sapiens
acttgcaaagacctacctccag

SEQ ID NO: 6621570 - DNA, 13 bp, Homo sapiens
acttgcaaatgaa

SEQ ID NO: 6621571 - DNA, 21 bp, Homo sapiens
acttgcaaccgtctgttatgc

SEQ ID NO: 6621572 - DNA, 23 bp, Homo sapiens
acttgcaactaaggacaaattag

SEQ ID NO: 6621573 - DNA, 23 bp, Homo sapiens
acttgcaatccaggctgttctca

SEQ ID NO: 6621574 - DNA, 20 bp, Homo sapiens
acttgcacaagcttgtatat

SEQ ID NO: 6621575 - DNA, 19 bp, Homo sapiens
acttgcacatctctgcagt

SEQ ID NO: 6621576 - DNA, 15 bp, Homo sapiens
acttgcacatttgaa

SEQ ID NO: 6621577 - DNA, 14 bp, Homo sapiens
acttgcactcttta

SEQ ID NO: 6621578 - DNA, 20 bp, Homo sapiens
acttgcactctttaacacat

SEQ ID NO: 6621579 - DNA, 13 bp, Homo sapiens
acttgcactgtgc

SEQ ID NO: 6621580 - DNA, 18 bp, Homo sapiens
acttgcagaggagcccag

SEQ ID NO: 6621581 - DNA, 20 bp, Homo sapiens
acttgcagaggagcccagtg

SEQ ID NO: 6621582 - DNA, 14 bp, Homo sapiens
acttgcagagttca

SEQ ID NO: 6621583 - DNA, 16 bp, Homo sapiens
acttgcagatgaaaaa

SEQ ID NO: 6621584 - DNA, 18 bp, Homo sapiens
acttgcaggggtccctgc

SEQ ID NO: 6621585 - DNA, 19 bp, Homo sapiens
acttgcaggggtccctgct

SEQ ID NO: 6621586 - DNA, 15 bp, Homo sapiens
acttgcagtgtcttt

SEQ ID NO: 6621587 - DNA, 19 bp, Homo sapiens
acttgcatacaccactgca

SEQ ID NO: 6621588 - DNA, 19 bp, Homo sapiens
acttgcatccaactccagg

SEQ ID NO: 6621589 - DNA, 12 bp, Homo sapiens
acttgcatgaag

SEQ ID NO: 6621590 - DNA, 21 bp, Homo sapiens
acttgcatgaagagaagcaat

SEQ ID NO: 6621591 - DNA, 17 bp, Homo sapiens
acttgcatgaatgattt

SEQ ID NO: 6621592 - DNA, 20 bp, Homo sapiens
acttgcatgaattactgtat

SEQ ID NO: 6621593 - DNA, 21 bp, Homo sapiens
acttgcatgaattactgtata

SEQ ID NO: 6621594 - DNA, 14 bp, Homo sapiens
acttgcatttgatt

SEQ ID NO: 6621595 - DNA, 19 bp, Homo sapiens
acttgcatttttgcaggag

SEQ ID NO: 6621596 - DNA, 14 bp, Homo sapiens
acttgccaaattta

SEQ ID NO: 6621597 - DNA, 15 bp, Homo sapiens
acttgccacatccca

SEQ ID NO: 6621598 - DNA, 23 bp, Homo sapiens
acttgccacatggtgtctcccaa

SEQ ID NO: 6621599 - DNA, 18 bp, Homo sapiens
acttgccactgccataac

SEQ ID NO: 6621600 - DNA, 14 bp, Homo sapiens
acttgccagggctc

SEQ ID NO: 6621601 - DNA, 17 bp, Homo sapiens
acttgccagtcactccg

SEQ ID NO: 6621602 - DNA, 16 bp, Homo sapiens
acttgccatgcaggaa

SEQ ID NO: 6621603 - DNA, 23 bp, Homo sapiens
acttgccatgcaggaagaggccc

SEQ ID NO: 6621604 - DNA, 14 bp, Homo sapiens
acttgccattaaaa

SEQ ID NO: 6621605 - DNA, 18 bp, Homo sapiens
acttgccattgccaggag

SEQ ID NO: 6621606 - DNA, 21 bp, Homo sapiens
acttgccatttctttatatgg

SEQ ID NO: 6621607 - DNA, 15 bp, Homo sapiens
acttgcccaggtcac

SEQ ID NO: 6621608 - DNA, 15 bp, Homo sapiens
acttgccctgctccc

SEQ ID NO: 6621609 - DNA, 21 bp, Homo sapiens
acttgccctgtgttctttccc

SEQ ID NO: 6621610 - DNA, 17 bp, Homo sapiens
acttgccctgttctctt

SEQ ID NO: 6621611 - DNA, 18 bp, Homo sapiens
acttgccctgttctcttc

SEQ ID NO: 6621612 - DNA, 22 bp, Homo sapiens
acttgcctaactaactggcagg

SEQ ID NO: 6621613 - DNA, 13 bp, Homo sapiens
acttgcctctgca

SEQ ID NO: 6621614 - DNA, 12 bp, Homo sapiens
acttgcctcttc

SEQ ID NO: 6621615 - DNA, 18 bp, Homo sapiens
acttgcctgcctttccat

SEQ ID NO: 6621616 - DNA, 14 bp, Homo sapiens
acttgcctgctgct

SEQ ID NO: 6621617 - DNA, 19 bp, Homo sapiens
acttgcctgttggctgctg

SEQ ID NO: 6621618 - DNA, 24 bp, Homo sapiens
acttgccttcctaagcctgtggct

SEQ ID NO: 6621619 - DNA, 15 bp, Homo sapiens
acttgcctttgaaga

SEQ ID NO: 6621620 - DNA, 20 bp, Homo sapiens
acttgcggccacagcactag

SEQ ID NO: 6621621 - DNA, 15 bp, Homo sapiens
acttgcgtcctgcag

SEQ ID NO: 6621622 - DNA, 18 bp, Homo sapiens
acttgcgtcctgcagagg

SEQ ID NO: 6621623 - DNA, 20 bp, Homo sapiens
acttgcgtcctgcagaggac

SEQ ID NO: 6621624 - DNA, 13 bp, Homo sapiens
acttgctaaagca

SEQ ID NO: 6621625 - DNA, 17 bp, Homo sapiens
acttgctaaagcacttt

SEQ ID NO: 6621626 - DNA, 19 bp, Homo sapiens
acttgctataaatagattt

SEQ ID NO: 6621627 - DNA, 14 bp, Homo sapiens
acttgctcaataaa

SEQ ID NO: 6621628 - DNA, 22 bp, Homo sapiens
acttgctccattcatacacaac

SEQ ID NO: 6621629 - DNA, 13 bp, Homo sapiens
acttgctcccaac

SEQ ID NO: 6621630 - DNA, 13 bp, Homo sapiens
acttgctccctct

SEQ ID NO: 6621631 - DNA, 14 bp, Homo sapiens
acttgctcctttcc

SEQ ID NO: 6621632 - DNA, 20 bp, Homo sapiens
acttgctccttttgctcttt

SEQ ID NO: 6621633 - DNA, 18 bp, Homo sapiens
acttgctcttgatgcctg

SEQ ID NO: 6621634 - DNA, 13 bp, Homo sapiens
acttgctgaagga

SEQ ID NO: 6621635 - DNA, 22 bp, Homo sapiens
acttgctgcagtatgaaaataa

SEQ ID NO: 6621636 - DNA, 11 bp, Homo sapiens
acttgctgcct

SEQ ID NO: 6621637 - DNA, 23 bp, Homo sapiens
acttgctgcctgaagaacagtaa

SEQ ID NO: 6621638 - DNA, 15 bp, Homo sapiens
acttgctggctgtga

SEQ ID NO: 6621639 - DNA, 15 bp, Homo sapiens
acttgctggggctca

SEQ ID NO: 6621640 - DNA, 22 bp, Homo sapiens
acttgctgggtggttctctggg

SEQ ID NO: 6621641 - DNA, 17 bp, Homo sapiens
acttgctggtcctggct

SEQ ID NO: 6621642 - DNA, 14 bp, Homo sapiens
acttgctgtccagg

SEQ ID NO: 6621643 - DNA, 19 bp, Homo sapiens
acttgctgtcccttggaac

SEQ ID NO: 6621644 - DNA, 18 bp, Homo sapiens
acttgctgtgaaatgact

SEQ ID NO: 6621645 - DNA, 13 bp, Homo sapiens
acttgctgtgtga

SEQ ID NO: 6621646 - DNA, 20 bp, Homo sapiens
acttgctgtgtgaccctggg

SEQ ID NO: 6621647 - DNA, 15 bp, Homo sapiens
acttgcttaaatgtg

SEQ ID NO: 6621648 - DNA, 13 bp, Homo sapiens
acttgcttcagtg

SEQ ID NO: 6621649 - DNA, 23 bp, Homo sapiens
acttgcttctaaatgcccagttc

SEQ ID NO: 6621650 - DNA, 22 bp, Homo sapiens
acttgctttatgccttcttatt

SEQ ID NO: 6621651 - DNA, 17 bp, Homo sapiens
acttgctttatttttca

SEQ ID NO: 6621652 - DNA, 20 bp, Homo sapiens
acttgctttcaattgacaaa

SEQ ID NO: 6621653 - DNA, 19 bp, Homo sapiens
acttgctttggtcactttt

SEQ ID NO: 6621654 - DNA, 22 bp, Homo sapiens
acttggaaaaatccagaaagaa

SEQ ID NO: 6621655 - DNA, 16 bp, Homo sapiens
acttggaaataaacca

SEQ ID NO: 6621656 - DNA, 14 bp, Homo sapiens
acttggaaataata

SEQ ID NO: 6621657 - DNA, 16 bp, Homo sapiens
acttggaaataataaa

SEQ ID NO: 6621658 - DNA, 19 bp, Homo sapiens
acttggaaatattaaaaga

SEQ ID NO: 6621659 - DNA, 22 bp, Homo sapiens
acttggaaatcagtagaaagct

SEQ ID NO: 6621660 - DNA, 14 bp, Homo sapiens
acttggaaatgaca

SEQ ID NO: 6621661 - DNA, 19 bp, Homo sapiens
acttggaaattgttaacat

SEQ ID NO: 6621662 - DNA, 15 bp, Homo sapiens
acttggaacagtgtt

SEQ ID NO: 6621663 - DNA, 22 bp, Homo sapiens
acttggaacctcattgctacca

SEQ ID NO: 6621664 - DNA, 17 bp, Homo sapiens
acttggaagaggaggag

SEQ ID NO: 6621665 - DNA, 14 bp, Homo sapiens
acttggacatctct

SEQ ID NO: 6621666 - DNA, 21 bp, Homo sapiens
acttggacatctctctggctt

SEQ ID NO: 6621667 - DNA, 21 bp, Homo sapiens
acttggacatgggccccagat

SEQ ID NO: 6621668 - DNA, 16 bp, Homo sapiens
acttggactcttgctc

SEQ ID NO: 6621669 - DNA, 20 bp, Homo sapiens
acttggagaatactgccaaa

SEQ ID NO: 6621670 - DNA, 16 bp, Homo sapiens
acttggagactcctgg

SEQ ID NO: 6621671 - DNA, 19 bp, Homo sapiens
acttggagactcctggtct

SEQ ID NO: 6621672 - DNA, 21 bp, Homo sapiens
acttggagagcaaaggcccat

SEQ ID NO: 6621673 - DNA, 17 bp, Homo sapiens
acttggagataataaaa

SEQ ID NO: 6621674 - DNA, 19 bp, Homo sapiens
acttggagccaagggttca

SEQ ID NO: 6621675 - DNA, 14 bp, Homo sapiens
acttggagccccag

SEQ ID NO: 6621676 - DNA, 16 bp, Homo sapiens
acttggagcccgtgca

SEQ ID NO: 6621677 - DNA, 11 bp, Homo sapiens
acttggagccg

SEQ ID NO: 6621678 - DNA, 16 bp, Homo sapiens
acttggaggacctggc

SEQ ID NO: 6621679 - DNA, 13 bp, Homo sapiens
acttggagtaatt

SEQ ID NO: 6621680 - DNA, 21 bp, Homo sapiens
acttggatgagttttgggaag

SEQ ID NO: 6621681 - DNA, 18 bp, Homo sapiens
acttggattcaattttaa

SEQ ID NO: 6621682 - DNA, 16 bp, Homo sapiens
acttggattctttcca

SEQ ID NO: 6621683 - DNA, 15 bp, Homo sapiens
acttggatttcattt

SEQ ID NO: 6621684 - DNA, 17 bp, Homo sapiens
acttggcaaattctgag

SEQ ID NO: 6621685 - DNA, 10 bp, Homo sapiens
acttggcacc

SEQ ID NO: 6621686 - DNA, 17 bp, Homo sapiens
acttggcaccaataaag

SEQ ID NO: 6621687 - DNA, 20 bp, Homo sapiens
acttggcaccaataaaggag

SEQ ID NO: 6621688 - DNA, 17 bp, Homo sapiens
acttggcagccttgtga

SEQ ID NO: 6621689 - DNA, 11 bp, Homo sapiens
acttggcagct

SEQ ID NO: 6621690 - DNA, 22 bp, Homo sapiens
acttggcagctttttctgtgga

SEQ ID NO: 6621691 - DNA, 14 bp, Homo sapiens
acttggcatacaaa

SEQ ID NO: 6621692 - DNA, 15 bp, Homo sapiens
acttggcatacaaaa

SEQ ID NO: 6621693 - DNA, 15 bp, Homo sapiens
acttggccaccagga

SEQ ID NO: 6621694 - DNA, 18 bp, Homo sapiens
acttggcccagaaagctg

SEQ ID NO: 6621695 - DNA, 15 bp, Homo sapiens
acttggcccaggaaa

SEQ ID NO: 6621696 - DNA, 17 bp, Homo sapiens
acttggcccaggaaaaa

SEQ ID NO: 6621697 - DNA, 22 bp, Homo sapiens
acttggcccccttcaggagcct

SEQ ID NO: 6621698 - DNA, 21 bp, Homo sapiens
acttggccctcttgcgggcct

SEQ ID NO: 6621699 - DNA, 23 bp, Homo sapiens
acttggccctcttgcgggcctgg

SEQ ID NO: 6621700 - DNA, 22 bp, Homo sapiens
acttggcctcagctggctgtat

SEQ ID NO: 6621701 - DNA, 16 bp, Homo sapiens
acttggcctcatgctg

SEQ ID NO: 6621702 - DNA, 18 bp, Homo sapiens
acttggctaacatagcac

SEQ ID NO: 6621703 - DNA, 21 bp, Homo sapiens
acttggctcgaatctctgtgc

SEQ ID NO: 6621704 - DNA, 23 bp, Homo sapiens
acttggctcgaatctctgtgcct

SEQ ID NO: 6621705 - DNA, 16 bp, Homo sapiens
acttggctgcaggaat

SEQ ID NO: 6621706 - DNA, 13 bp, Homo sapiens
acttggctgctca

SEQ ID NO: 6621707 - DNA, 14 bp, Homo sapiens
acttggctggtgtg

SEQ ID NO: 6621708 - DNA, 14 bp, Homo sapiens
acttggctgtatgt

SEQ ID NO: 6621709 - DNA, 11 bp, Homo sapiens
acttggctgtc

SEQ ID NO: 6621710 - DNA, 13 bp, Homo sapiens
acttggctgtcct

SEQ ID NO: 6621711 - DNA, 14 bp, Homo sapiens
acttggctgtcctt

SEQ ID NO: 6621712 - DNA, 17 bp, Homo sapiens
acttggctgtccttccc

SEQ ID NO: 6621713 - DNA, 14 bp, Homo sapiens
acttggctgtctga

SEQ ID NO: 6621714 - DNA, 22 bp, Homo sapiens
acttggctgtctgaccagagaa

SEQ ID NO: 6621715 - DNA, 23 bp, Homo sapiens
acttggctttttccaaatgcttc

SEQ ID NO: 6621716 - DNA, 13 bp, Homo sapiens
acttgggaatata

SEQ ID NO: 6621717 - DNA, 22 bp, Homo sapiens
acttgggaatcattctggctta

SEQ ID NO: 6621718 - DNA, 19 bp, Homo sapiens
acttgggagctgctgggct

SEQ ID NO: 6621719 - DNA, 22 bp, Homo sapiens
acttgggagcttgtatatactt

SEQ ID NO: 6621720 - DNA, 21 bp, Homo sapiens
acttgggcaccagcttctttc

SEQ ID NO: 6621721 - DNA, 23 bp, Homo sapiens
acttgggcacccccagcctgggc

SEQ ID NO: 6621722 - DNA, 14 bp, Homo sapiens
acttgggccactgt

SEQ ID NO: 6621723 - DNA, 18 bp, Homo sapiens
acttgggccatagctcct

SEQ ID NO: 6621724 - DNA, 17 bp, Homo sapiens
acttgggcccaggaggt

SEQ ID NO: 6621725 - DNA, 16 bp, Homo sapiens
acttgggcgctctgcc

SEQ ID NO: 6621726 - DNA, 16 bp, Homo sapiens
acttgggctactgaac

SEQ ID NO: 6621727 - DNA, 22 bp, Homo sapiens
acttgggcttcaacagccaagc

SEQ ID NO: 6621728 - DNA, 12 bp, Homo sapiens
acttggggaagg

SEQ ID NO: 6621729 - DNA, 14 bp, Homo sapiens
acttggggaggcaa

SEQ ID NO: 6621730 - DNA, 21 bp, Homo sapiens
acttggggagttaagacctgg

SEQ ID NO: 6621731 - DNA, 20 bp, Homo sapiens
acttggggatttctggtcaa

SEQ ID NO: 6621732 - DNA, 17 bp, Homo sapiens
acttggggcacagggag

SEQ ID NO: 6621733 - DNA, 17 bp, Homo sapiens
acttgggggctcagcaa

SEQ ID NO: 6621734 - DNA, 20 bp, Homo sapiens
acttgggggctcagcaaggc

SEQ ID NO: 6621735 - DNA, 23 bp, Homo sapiens
acttggggggctgaggtgggagg

SEQ ID NO: 6621736 - DNA, 16 bp, Homo sapiens
acttgggtacatcttg

SEQ ID NO: 6621737 - DNA, 20 bp, Homo sapiens
acttgggtcacatgactctc

SEQ ID NO: 6621738 - DNA, 14 bp, Homo sapiens
acttgggtctctgg

SEQ ID NO: 6621739 - DNA, 16 bp, Homo sapiens
acttgggtgacggcag

SEQ ID NO: 6621740 - DNA, 15 bp, Homo sapiens
acttgggttgatctc

SEQ ID NO: 6621741 - DNA, 20 bp, Homo sapiens
acttgggttgatctcttaga

SEQ ID NO: 6621742 - DNA, 20 bp, Homo sapiens
acttggtaagatgactctga

SEQ ID NO: 6621743 - DNA, 22 bp, Homo sapiens
acttggtaagatgactctgaga

SEQ ID NO: 6621744 - DNA, 16 bp, Homo sapiens
acttggtaattgtact

SEQ ID NO: 6621745 - DNA, 20 bp, Homo sapiens
acttggtagttcataaaggt

SEQ ID NO: 6621746 - DNA, 14 bp, Homo sapiens
acttggtcaccagc

SEQ ID NO: 6621747 - DNA, 15 bp, Homo sapiens
acttggtcagagcca

SEQ ID NO: 6621748 - DNA, 14 bp, Homo sapiens
acttggtctgtgag

SEQ ID NO: 6621749 - DNA, 21 bp, Homo sapiens
acttggtctgtgagatgctag

SEQ ID NO: 6621750 - DNA, 15 bp, Homo sapiens
acttggtgaggagga

SEQ ID NO: 6621751 - DNA, 21 bp, Homo sapiens
acttggtgcggggttaacacc

SEQ ID NO: 6621752 - DNA, 16 bp, Homo sapiens
acttggtgtactgggt

SEQ ID NO: 6621753 - DNA, 23 bp, Homo sapiens
acttggttagacgccttccaggt

SEQ ID NO: 6621754 - DNA, 20 bp, Homo sapiens
acttggttatacatgacact

SEQ ID NO: 6621755 - DNA, 23 bp, Homo sapiens
acttggttccattgttatattgt

SEQ ID NO: 6621756 - DNA, 15 bp, Homo sapiens
acttggttcccagaa

SEQ ID NO: 6621757 - DNA, 17 bp, Homo sapiens
acttggttctgcttcaa

SEQ ID NO: 6621758 - DNA, 15 bp, Homo sapiens
acttggttcttgtac

SEQ ID NO: 6621759 - DNA, 17 bp, Homo sapiens
acttggttgatgtttaa

SEQ ID NO: 6621760 - DNA, 18 bp, Homo sapiens
acttggttgggtcagatt

SEQ ID NO: 6621761 - DNA, 12 bp, Homo sapiens
acttggtttgtg

SEQ ID NO: 6621762 - DNA, 19 bp, Homo sapiens
acttggtttttggctcttt

SEQ ID NO: 6621763 - DNA, 14 bp, Homo sapiens
acttgtaaaaccac

SEQ ID NO: 6621764 - DNA, 19 bp, Homo sapiens
acttgtaaaatgcttttca

SEQ ID NO: 6621765 - DNA, 19 bp, Homo sapiens
acttgtaaaggaatttaaa

SEQ ID NO: 6621766 - DNA, 15 bp, Homo sapiens
acttgtaaataaata

SEQ ID NO: 6621767 - DNA, 19 bp, Homo sapiens
acttgtaaataaatagatt

SEQ ID NO: 6621768 - DNA, 15 bp, Homo sapiens
acttgtaaatacacc

SEQ ID NO: 6621769 - DNA, 14 bp, Homo sapiens
acttgtaaatataa

SEQ ID NO: 6621770 - DNA, 17 bp, Homo sapiens
acttgtaaatataaaga

SEQ ID NO: 6621771 - DNA, 19 bp, Homo sapiens
acttgtaaatataaagacg

SEQ ID NO: 6621772 - DNA, 18 bp, Homo sapiens
acttgtaaatgtggtaaa

SEQ ID NO: 6621773 - DNA, 16 bp, Homo sapiens
acttgtaatatgtata

SEQ ID NO: 6621774 - DNA, 22 bp, Homo sapiens
acttgtaatatttttatataca

SEQ ID NO: 6621775 - DNA, 23 bp, Homo sapiens
acttgtaattcccctaaccataa

SEQ ID NO: 6621776 - DNA, 14 bp, Homo sapiens
acttgtacaaaata

SEQ ID NO: 6621777 - DNA, 23 bp, Homo sapiens
acttgtacatggaattttttgaa

SEQ ID NO: 6621778 - DNA, 23 bp, Homo sapiens
acttgtacccacaggtgaggggc

SEQ ID NO: 6621779 - DNA, 22 bp, Homo sapiens
acttgtactatgttaataactt

SEQ ID NO: 6621780 - DNA, 14 bp, Homo sapiens
acttgtacttgttt

SEQ ID NO: 6621781 - DNA, 15 bp, Homo sapiens
acttgtagaaatctg

SEQ ID NO: 6621782 - DNA, 23 bp, Homo sapiens
acttgtagaaatctgtaattcta

SEQ ID NO: 6621783 - DNA, 21 bp, Homo sapiens
acttgtagctgtaaaacgctg

SEQ ID NO: 6621784 - DNA, 18 bp, Homo sapiens
acttgtaggaatctgcct

SEQ ID NO: 6621785 - DNA, 22 bp, Homo sapiens
acttgtaggaatctgccttcca

SEQ ID NO: 6621786 - DNA, 20 bp, Homo sapiens
acttgtaggacttttaaaca

SEQ ID NO: 6621787 - DNA, 19 bp, Homo sapiens
acttgtaggtttctctgcc

SEQ ID NO: 6621788 - DNA, 16 bp, Homo sapiens
acttgtagtttagtgt

SEQ ID NO: 6621789 - DNA, 17 bp, Homo sapiens
acttgtataagtagaat

SEQ ID NO: 6621790 - DNA, 21 bp, Homo sapiens
acttgtataagtagaattctt

SEQ ID NO: 6621791 - DNA, 15 bp, Homo sapiens
acttgtatacttatt

SEQ ID NO: 6621792 - DNA, 15 bp, Homo sapiens
acttgtatatttgta

SEQ ID NO: 6621793 - DNA, 14 bp, Homo sapiens
acttgtatatttta

SEQ ID NO: 6621794 - DNA, 11 bp, Homo sapiens
acttgtatctg

SEQ ID NO: 6621795 - DNA, 15 bp, Homo sapiens
acttgtatctgaaga

SEQ ID NO: 6621796 - DNA, 14 bp, Homo sapiens
acttgtattccctt

SEQ ID NO: 6621797 - DNA, 15 bp, Homo sapiens
acttgtattccctta

SEQ ID NO: 6621798 - DNA, 18 bp, Homo sapiens
acttgtattcctaactgt

SEQ ID NO: 6621799 - DNA, 14 bp, Homo sapiens
acttgtattgactt

SEQ ID NO: 6621800 - DNA, 17 bp, Homo sapiens
acttgtattgactttat

SEQ ID NO: 6621801 - DNA, 14 bp, Homo sapiens
acttgtattggaag

SEQ ID NO: 6621802 - DNA, 20 bp, Homo sapiens
acttgtattttcttaatata

SEQ ID NO: 6621803 - DNA, 18 bp, Homo sapiens
acttgtattttgtcactt

SEQ ID NO: 6621804 - DNA, 18 bp, Homo sapiens
acttgtcaaagaaggttt

SEQ ID NO: 6621805 - DNA, 20 bp, Homo sapiens
acttgtcaagcctgtgcaaa

SEQ ID NO: 6621806 - DNA, 15 bp, Homo sapiens
acttgtcaataaaat

SEQ ID NO: 6621807 - DNA, 16 bp, Homo sapiens
acttgtcacctgagtg

SEQ ID NO: 6621808 - DNA, 14 bp, Homo sapiens
acttgtcacgaatt

SEQ ID NO: 6621809 - DNA, 21 bp, Homo sapiens
acttgtcactgacacaaagga

SEQ ID NO: 6621810 - DNA, 17 bp, Homo sapiens
acttgtcacttgcatgt

SEQ ID NO: 6621811 - DNA, 13 bp, Homo sapiens
acttgtcatgtga

SEQ ID NO: 6621812 - DNA, 13 bp, Homo sapiens
acttgtcccaagt

SEQ ID NO: 6621813 - DNA, 17 bp, Homo sapiens
acttgtcccaagtctga

SEQ ID NO: 6621814 - DNA, 22 bp, Homo sapiens
acttgtccccaaatccgaacct

SEQ ID NO: 6621815 - DNA, 23 bp, Homo sapiens
acttgtcccgggacacctaggct

SEQ ID NO: 6621816 - DNA, 17 bp, Homo sapiens
acttgtcctagcacaga

SEQ ID NO: 6621817 - DNA, 20 bp, Homo sapiens
acttgtccttagcctggacc

SEQ ID NO: 6621818 - DNA, 15 bp, Homo sapiens
acttgtcggctccag

SEQ ID NO: 6621819 - DNA, 16 bp, Homo sapiens
acttgtcgggggccca

SEQ ID NO: 6621820 - DNA, 15 bp, Homo sapiens
acttgtctaaataag

SEQ ID NO: 6621821 - DNA, 19 bp, Homo sapiens
acttgtctaaataagtttg

SEQ ID NO: 6621822 - DNA, 20 bp, Homo sapiens
acttgtctaaataagtttgc

SEQ ID NO: 6621823 - DNA, 19 bp, Homo sapiens
acttgtctcaggactctga

SEQ ID NO: 6621824 - DNA, 16 bp, Homo sapiens
acttgtctcattttaa

SEQ ID NO: 6621825 - DNA, 19 bp, Homo sapiens
acttgtctcattttaatgt

SEQ ID NO: 6621826 - DNA, 23 bp, Homo sapiens
acttgtctcccagtcgaggctgg

SEQ ID NO: 6621827 - DNA, 20 bp, Homo sapiens
acttgtctcctttctgactg

SEQ ID NO: 6621828 - DNA, 20 bp, Homo sapiens
acttgtctcttcatctaata

SEQ ID NO: 6621829 - DNA, 17 bp, Homo sapiens
acttgtctgaggcctca

SEQ ID NO: 6621830 - DNA, 16 bp, Homo sapiens
acttgtctgcctcctg

SEQ ID NO: 6621831 - DNA, 14 bp, Homo sapiens
acttgtctggcttt

SEQ ID NO: 6621832 - DNA, 17 bp, Homo sapiens
acttgtctggctttggc

SEQ ID NO: 6621833 - DNA, 22 bp, Homo sapiens
acttgtctgtcaaatgtttcct

SEQ ID NO: 6621834 - DNA, 19 bp, Homo sapiens
acttgtcttctagtttaga

SEQ ID NO: 6621835 - DNA, 16 bp, Homo sapiens
acttgtctttctgggg

SEQ ID NO: 6621836 - DNA, 21 bp, Homo sapiens
acttgtctttgattatgacag

SEQ ID NO: 6621837 - DNA, 21 bp, Homo sapiens
acttgtctttggaccctgagg

SEQ ID NO: 6621838 - DNA, 16 bp, Homo sapiens
acttgtctttttctgg

SEQ ID NO: 6621839 - DNA, 19 bp, Homo sapiens
acttgtgaaacacagctgt

SEQ ID NO: 6621840 - DNA, 18 bp, Homo sapiens
acttgtgaactccatcat

SEQ ID NO: 6621841 - DNA, 10 bp, Homo sapiens
acttgtgaat

SEQ ID NO: 6621842 - DNA, 15 bp, Homo sapiens
acttgtgaataaaga

SEQ ID NO: 6621843 - DNA, 11 bp, Homo sapiens
acttgtgaatg

SEQ ID NO: 6621844 - DNA, 17 bp, Homo sapiens
acttgtgaatgcttctc

SEQ ID NO: 6621845 - DNA, 16 bp, Homo sapiens
acttgtgactgaaggg

SEQ ID NO: 6621846 - DNA, 17 bp, Homo sapiens
acttgtgacttttgctt

SEQ ID NO: 6621847 - DNA, 16 bp, Homo sapiens
acttgtgatgagagat

SEQ ID NO: 6621848 - DNA, 17 bp, Homo sapiens
acttgtgattatttatt

SEQ ID NO: 6621849 - DNA, 12 bp, Homo sapiens
acttgtgccagc

SEQ ID NO: 6621850 - DNA, 16 bp, Homo sapiens
acttgtgccagcccgg

SEQ ID NO: 6621851 - DNA, 15 bp, Homo sapiens
acttgtgctatagtg

SEQ ID NO: 6621852 - DNA, 14 bp, Homo sapiens
acttgtgcttttgc

SEQ ID NO: 6621853 - DNA, 15 bp, Homo sapiens
acttgtggactaaaa

SEQ ID NO: 6621854 - DNA, 13 bp, Homo sapiens
acttgtggcctca

SEQ ID NO: 6621855 - DNA, 15 bp, Homo sapiens
acttgtgggatggtg

SEQ ID NO: 6621856 - DNA, 23 bp, Homo sapiens
acttgtgtatattttaatgaata

SEQ ID NO: 6621857 - DNA, 17 bp, Homo sapiens
acttgtgtattagatat

SEQ ID NO: 6621858 - DNA, 14 bp, Homo sapiens
acttgtgtctctgt

SEQ ID NO: 6621859 - DNA, 16 bp, Homo sapiens
acttgtgttcaatctg

SEQ ID NO: 6621860 - DNA, 21 bp, Homo sapiens
acttgtgttcaatctgtgaag

SEQ ID NO: 6621861 - DNA, 15 bp, Homo sapiens
acttgtgtttgctta

SEQ ID NO: 6621862 - DNA, 19 bp, Homo sapiens
acttgtgtttgcttaaaca

SEQ ID NO: 6621863 - DNA, 21 bp, Homo sapiens
acttgtgtttgcttaaacaaa

SEQ ID NO: 6621864 - DNA, 18 bp, Homo sapiens
acttgtgtttgtatataa

SEQ ID NO: 6621865 - DNA, 16 bp, Homo sapiens
acttgttagaaatgca

SEQ ID NO: 6621866 - DNA, 15 bp, Homo sapiens
acttgttatattata

SEQ ID NO: 6621867 - DNA, 16 bp, Homo sapiens
acttgttatgttgtaa

SEQ ID NO: 6621868 - DNA, 16 bp, Homo sapiens
acttgttattgtgaat

SEQ ID NO: 6621869 - DNA, 17 bp, Homo sapiens
acttgttattgtgaatg

SEQ ID NO: 6621870 - DNA, 20 bp, Homo sapiens
acttgttattgtgaatgatt

SEQ ID NO: 6621871 - DNA, 21 bp, Homo sapiens
acttgttcaaaatatgttctt

SEQ ID NO: 6621872 - DNA, 18 bp, Homo sapiens
acttgttcattctgtgac

SEQ ID NO: 6621873 - DNA, 19 bp, Homo sapiens
acttgttcattctgtgacc

SEQ ID NO: 6621874 - DNA, 13 bp, Homo sapiens
acttgttcattta

SEQ ID NO: 6621875 - DNA, 15 bp, Homo sapiens
acttgttccttctgc

SEQ ID NO: 6621876 - DNA, 18 bp, Homo sapiens
acttgttccttctgcttc

SEQ ID NO: 6621877 - DNA, 20 bp, Homo sapiens
acttgttccttctgcttctc

SEQ ID NO: 6621878 - DNA, 12 bp, Homo sapiens
acttgttcttcc

SEQ ID NO: 6621879 - DNA, 17 bp, Homo sapiens
acttgttcttttctggt

SEQ ID NO: 6621880 - DNA, 21 bp, Homo sapiens
acttgttgttttactaaagaa

SEQ ID NO: 6621881 - DNA, 21 bp, Homo sapiens
acttgtttaattctaaaagag

SEQ ID NO: 6621882 - DNA, 22 bp, Homo sapiens
acttgtttactcattgaagcag

SEQ ID NO: 6621883 - DNA, 11 bp, Homo sapiens
acttgtttcct

SEQ ID NO: 6621884 - DNA, 19 bp, Homo sapiens
acttgtttctctgttgtaa

SEQ ID NO: 6621885 - DNA, 14 bp, Homo sapiens
acttgtttctttct

SEQ ID NO: 6621886 - DNA, 14 bp, Homo sapiens
acttgtttgcactg

SEQ ID NO: 6621887 - DNA, 15 bp, Homo sapiens
acttgtttgcactgt

SEQ ID NO: 6621888 - DNA, 16 bp, Homo sapiens
acttgtttgcactgtg

SEQ ID NO: 6621889 - DNA, 13 bp, Homo sapiens
acttgtttgtaaa

SEQ ID NO: 6621890 - DNA, 15 bp, Homo sapiens
acttgttttaaaatg

SEQ ID NO: 6621891 - DNA, 18 bp, Homo sapiens
acttgttttcaaaccagt

SEQ ID NO: 6621892 - DNA, 15 bp, Homo sapiens
acttgttttcaatgt

SEQ ID NO: 6621893 - DNA, 16 bp, Homo sapiens
acttgttttctttgtt

SEQ ID NO: 6621894 - DNA, 13 bp, Homo sapiens
acttgttttggat

SEQ ID NO: 6621895 - DNA, 20 bp, Homo sapiens
acttgttttggatggcttgt

SEQ ID NO: 6621896 - DNA, 21 bp, Homo sapiens
acttgtttttgtaaagaaaaa

SEQ ID NO: 6621897 - DNA, 23 bp, Homo sapiens
acttgtttttgtttttgttttgt

SEQ ID NO: 6621898 - DNA, 21 bp, Homo sapiens
acttgttttttatcctgcctc

SEQ ID NO: 6621899 - DNA, 22 bp, Homo sapiens
actttaaaaaattttttgatta

SEQ ID NO: 6621900 - DNA, 15 bp, Homo sapiens
actttaaaaaggaaa

SEQ ID NO: 6621901 - DNA, 16 bp, Homo sapiens
actttaaaaaggaaat

SEQ ID NO: 6621902 - DNA, 15 bp, Homo sapiens
actttaaaaatcagt

SEQ ID NO: 6621903 - DNA, 16 bp, Homo sapiens
actttaaaactgtatt

SEQ ID NO: 6621904 - DNA, 18 bp, Homo sapiens
actttaaaaggcaactca

SEQ ID NO: 6621905 - DNA, 12 bp, Homo sapiens
actttaaaagtg

SEQ ID NO: 6621906 - DNA, 16 bp, Homo sapiens
actttaaaataaaaaa

SEQ ID NO: 6621907 - DNA, 23 bp, Homo sapiens
actttaaaatgcgaaattattgg

SEQ ID NO: 6621908 - DNA, 15 bp, Homo sapiens
actttaaagaggctg

SEQ ID NO: 6621909 - DNA, 23 bp, Homo sapiens
actttaaagaggctgtgtggcca

SEQ ID NO: 6621910 - DNA, 18 bp, Homo sapiens
actttaaagcaattgcat

SEQ ID NO: 6621911 - DNA, 20 bp, Homo sapiens
actttaaaggaaaaaatgtt

SEQ ID NO: 6621912 - DNA, 21 bp, Homo sapiens
actttaaaggaaaaaatgttg

SEQ ID NO: 6621913 - DNA, 12 bp, Homo sapiens
actttaaagtat

SEQ ID NO: 6621914 - DNA, 21 bp, Homo sapiens
actttaaagtctttccgtctc

SEQ ID NO: 6621915 - DNA, 12 bp, Homo sapiens
actttaaatctt

SEQ ID NO: 6621916 - DNA, 19 bp, Homo sapiens
actttaaatggaataatta

SEQ ID NO: 6621917 - DNA, 13 bp, Homo sapiens
actttaaattata

SEQ ID NO: 6621918 - DNA, 13 bp, Homo sapiens
actttaaattgtg

SEQ ID NO: 6621919 - DNA, 18 bp, Homo sapiens
actttaaattgtggatga

SEQ ID NO: 6621920 - DNA, 14 bp, Homo sapiens
actttaacataagc

SEQ ID NO: 6621921 - DNA, 18 bp, Homo sapiens
actttaacataagctatt

SEQ ID NO: 6621922 - DNA, 14 bp, Homo sapiens
actttaacattttg

SEQ ID NO: 6621923 - DNA, 15 bp, Homo sapiens
actttaaccctctct

SEQ ID NO: 6621924 - DNA, 21 bp, Homo sapiens
actttaacttagttttgcata

SEQ ID NO: 6621925 - DNA, 20 bp, Homo sapiens
actttaacttccactttgta

SEQ ID NO: 6621926 - DNA, 17 bp, Homo sapiens
actttaacttttgaaaa

SEQ ID NO: 6621927 - DNA, 14 bp, Homo sapiens
actttaagaggaca

SEQ ID NO: 6621928 - DNA, 15 bp, Homo sapiens
actttaagcactaca

SEQ ID NO: 6621929 - DNA, 19 bp, Homo sapiens
actttaagcagctcttgct

SEQ ID NO: 6621930 - DNA, 23 bp, Homo sapiens
actttaagcagctcttgctaatc

SEQ ID NO: 6621931 - DNA, 22 bp, Homo sapiens
actttaagctccttgagtaaaa

SEQ ID NO: 6621932 - DNA, 17 bp, Homo sapiens
actttaaggatttgaac

SEQ ID NO: 6621933 - DNA, 18 bp, Homo sapiens
actttaaggggaagataa

SEQ ID NO: 6621934 - DNA, 11 bp, Homo sapiens
actttaataat

SEQ ID NO: 6621935 - DNA, 15 bp, Homo sapiens
actttaataataaaa

SEQ ID NO: 6621936 - DNA, 13 bp, Homo sapiens
actttaatacagc

SEQ ID NO: 6621937 - DNA, 19 bp, Homo sapiens
actttaatactcacctcct

SEQ ID NO: 6621938 - DNA, 13 bp, Homo sapiens
actttaatatgta

SEQ ID NO: 6621939 - DNA, 14 bp, Homo sapiens
actttaatgataaa

SEQ ID NO: 6621940 - DNA, 19 bp, Homo sapiens
actttaatggtagcatgtt

SEQ ID NO: 6621941 - DNA, 13 bp, Homo sapiens
actttaattatat

SEQ ID NO: 6621942 - DNA, 21 bp, Homo sapiens
actttaattatatattttcat

SEQ ID NO: 6621943 - DNA, 23 bp, Homo sapiens
actttaattatatattttcatcc

SEQ ID NO: 6621944 - DNA, 14 bp, Homo sapiens
actttaatttatgt

SEQ ID NO: 6621945 - DNA, 13 bp, Homo sapiens
actttaattttta

SEQ ID NO: 6621946 - DNA, 21 bp, Homo sapiens
actttaatttttataaatatg

SEQ ID NO: 6621947 - DNA, 22 bp, Homo sapiens
actttacaaaccattacctgta

SEQ ID NO: 6621948 - DNA, 21 bp, Homo sapiens
actttacaaacctttgtttca

SEQ ID NO: 6621949 - DNA, 22 bp, Homo sapiens
actttacaaacctttgtttcaa

SEQ ID NO: 6621950 - DNA, 23 bp, Homo sapiens
actttacaaacctttgtttcaac

SEQ ID NO: 6621951 - DNA, 20 bp, Homo sapiens
actttacacaatagaattat

SEQ ID NO: 6621952 - DNA, 18 bp, Homo sapiens
actttacagaaatggact

SEQ ID NO: 6621953 - DNA, 13 bp, Homo sapiens
actttacaggaaa

SEQ ID NO: 6621954 - DNA, 19 bp, Homo sapiens
actttacagttctggagga

SEQ ID NO: 6621955 - DNA, 12 bp, Homo sapiens
actttacatatt

SEQ ID NO: 6621956 - DNA, 17 bp, Homo sapiens
actttacattcttgctc

SEQ ID NO: 6621957 - DNA, 13 bp, Homo sapiens
actttacccacct

SEQ ID NO: 6621958 - DNA, 17 bp, Homo sapiens
actttacccacctagaa

SEQ ID NO: 6621959 - DNA, 22 bp, Homo sapiens
actttacctctctgtcatgtgc

SEQ ID NO: 6621960 - DNA, 19 bp, Homo sapiens
actttacctgcaggctcca

SEQ ID NO: 6621961 - DNA, 12 bp, Homo sapiens
actttacctttt

SEQ ID NO: 6621962 - DNA, 15 bp, Homo sapiens
actttacgcccatct

SEQ ID NO: 6621963 - DNA, 15 bp, Homo sapiens
actttacgctgtctg

SEQ ID NO: 6621964 - DNA, 16 bp, Homo sapiens
actttactaagtaatc

SEQ ID NO: 6621965 - DNA, 22 bp, Homo sapiens
actttactaggtacataagctt

SEQ ID NO: 6621966 - DNA, 19 bp, Homo sapiens
actttactctgtgtttaaa

SEQ ID NO: 6621967 - DNA, 11 bp, Homo sapiens
actttactgta

SEQ ID NO: 6621968 - DNA, 21 bp, Homo sapiens
actttacttgtggtgtgacca

SEQ ID NO: 6621969 - DNA, 14 bp, Homo sapiens
actttactttcaag

SEQ ID NO: 6621970 - DNA, 16 bp, Homo sapiens
actttactttcaagta

SEQ ID NO: 6621971 - DNA, 14 bp, Homo sapiens
actttacttttgct

SEQ ID NO: 6621972 - DNA, 16 bp, Homo sapiens
actttactttttccat

SEQ ID NO: 6621973 - DNA, 17 bp, Homo sapiens
actttactttttccatt

SEQ ID NO: 6621974 - DNA, 22 bp, Homo sapiens
actttactttttccatttggca

SEQ ID NO: 6621975 - DNA, 14 bp, Homo sapiens
actttagaaataaa

SEQ ID NO: 6621976 - DNA, 20 bp, Homo sapiens
actttagaagtgcatttctg

SEQ ID NO: 6621977 - DNA, 21 bp, Homo sapiens
actttagaagtgcatttctga

SEQ ID NO: 6621978 - DNA, 12 bp, Homo sapiens
actttagaattc

SEQ ID NO: 6621979 - DNA, 17 bp, Homo sapiens
actttagactaattgtg

SEQ ID NO: 6621980 - DNA, 18 bp, Homo sapiens
actttagactaattgtgt

SEQ ID NO: 6621981 - DNA, 19 bp, Homo sapiens
actttagactaattgtgtt

SEQ ID NO: 6621982 - DNA, 19 bp, Homo sapiens
actttagacttcccactgt

SEQ ID NO: 6621983 - DNA, 14 bp, Homo sapiens
actttagatgctga

SEQ ID NO: 6621984 - DNA, 22 bp, Homo sapiens
actttagccactggtttctcag

SEQ ID NO: 6621985 - DNA, 16 bp, Homo sapiens
actttagctagtatct

SEQ ID NO: 6621986 - DNA, 12 bp, Homo sapiens
actttagctatg

SEQ ID NO: 6621987 - DNA, 19 bp, Homo sapiens
actttaggctttcagctta

SEQ ID NO: 6621988 - DNA, 19 bp, Homo sapiens
actttagggggtgggaggg

SEQ ID NO: 6621989 - DNA, 19 bp, Homo sapiens
actttagggggtgggattc

SEQ ID NO: 6621990 - DNA, 22 bp, Homo sapiens
actttagggtaaaaattgccat

SEQ ID NO: 6621991 - DNA, 21 bp, Homo sapiens
actttaggtttgttcccttga

SEQ ID NO: 6621992 - DNA, 13 bp, Homo sapiens
actttagtatgac

SEQ ID NO: 6621993 - DNA, 15 bp, Homo sapiens
actttagtattaaat

SEQ ID NO: 6621994 - DNA, 17 bp, Homo sapiens
actttagtatttttact

SEQ ID NO: 6621995 - DNA, 15 bp, Homo sapiens
actttagtctgcaaa

SEQ ID NO: 6621996 - DNA, 18 bp, Homo sapiens
actttagtctgcaaaatg

SEQ ID NO: 6621997 - DNA, 13 bp, Homo sapiens
actttagtgaaag

SEQ ID NO: 6621998 - DNA, 16 bp, Homo sapiens
actttagtgattgctt

SEQ ID NO: 6621999 - DNA, 18 bp, Homo sapiens
actttagtgattgctttt

SEQ ID NO: 6622000 - DNA, 14 bp, Homo sapiens
actttagtgccctg

SEQ ID NO: 6622001 - DNA, 18 bp, Homo sapiens
actttagtgccctgcccc

SEQ ID NO: 6622002 - DNA, 17 bp, Homo sapiens
actttagtgctacagaa

SEQ ID NO: 6622003 - DNA, 14 bp, Homo sapiens
actttagtgtctct

SEQ ID NO: 6622004 - DNA, 21 bp, Homo sapiens
actttagtgtctctaagttat

SEQ ID NO: 6622005 - DNA, 14 bp, Homo sapiens
actttagttagcat

SEQ ID NO: 6622006 - DNA, 20 bp, Homo sapiens
actttagttagcatgcgcgc

SEQ ID NO: 6622007 - DNA, 14 bp, Homo sapiens
actttataaattca

SEQ ID NO: 6622008 - DNA, 15 bp, Homo sapiens
actttataagccaat

SEQ ID NO: 6622009 - DNA, 17 bp, Homo sapiens
actttataagccaatga

SEQ ID NO: 6622010 - DNA, 15 bp, Homo sapiens
actttatacagaact

SEQ ID NO: 6622011 - DNA, 16 bp, Homo sapiens
actttatacattagta

SEQ ID NO: 6622012 - DNA, 22 bp, Homo sapiens
actttatacccagaaagttatt

SEQ ID NO: 6622013 - DNA, 18 bp, Homo sapiens
actttatacttgcctccc

SEQ ID NO: 6622014 - DNA, 14 bp, Homo sapiens
actttatagacatt

SEQ ID NO: 6622015 - DNA, 15 bp, Homo sapiens
actttatagctgcaa

SEQ ID NO: 6622016 - DNA, 18 bp, Homo sapiens
actttatatatgtacata

SEQ ID NO: 6622017 - DNA, 12 bp, Homo sapiens
actttatatctg

SEQ ID NO: 6622018 - DNA, 17 bp, Homo sapiens
actttatatctgtaatg

SEQ ID NO: 6622019 - DNA, 14 bp, Homo sapiens
actttatcaattaa

SEQ ID NO: 6622020 - DNA, 17 bp, Homo sapiens
actttatcactttttga

SEQ ID NO: 6622021 - DNA, 18 bp, Homo sapiens
actttatcatgaatgctt

SEQ ID NO: 6622022 - DNA, 17 bp, Homo sapiens
actttatccaatcctca

SEQ ID NO: 6622023 - DNA, 19 bp, Homo sapiens
actttatccaatcctcagg

SEQ ID NO: 6622024 - DNA, 17 bp, Homo sapiens
actttatctcctgctct

SEQ ID NO: 6622025 - DNA, 15 bp, Homo sapiens
actttatctgaaaat

SEQ ID NO: 6622026 - DNA, 21 bp, Homo sapiens
actttatgccggatgtgcttt

SEQ ID NO: 6622027 - DNA, 12 bp, Homo sapiens
actttatgctaa

SEQ ID NO: 6622028 - DNA, 14 bp, Homo sapiens
actttatgtactgc

SEQ ID NO: 6622029 - DNA, 14 bp, Homo sapiens
actttatgttctaa

SEQ ID NO: 6622030 - DNA, 20 bp, Homo sapiens
actttattaaatacaaaact

SEQ ID NO: 6622031 - DNA, 14 bp, Homo sapiens
actttattaatatg

SEQ ID NO: 6622032 - DNA, 19 bp, Homo sapiens
actttattacaatttgtat

SEQ ID NO: 6622033 - DNA, 23 bp, Homo sapiens
actttattaccttctttctaata

SEQ ID NO: 6622034 - DNA, 21 bp, Homo sapiens
actttattcttgaaagaagaa

SEQ ID NO: 6622035 - DNA, 14 bp, Homo sapiens
actttattcttgct

SEQ ID NO: 6622036 - DNA, 16 bp, Homo sapiens
actttattcttgctgg

SEQ ID NO: 6622037 - DNA, 15 bp, Homo sapiens
actttattctttgtt

SEQ ID NO: 6622038 - DNA, 19 bp, Homo sapiens
actttattgattttctttc

SEQ ID NO: 6622039 - DNA, 13 bp, Homo sapiens
actttattgcaat

SEQ ID NO: 6622040 - DNA, 17 bp, Homo sapiens
actttattgcaatgcag

SEQ ID NO: 6622041 - DNA, 18 bp, Homo sapiens
actttattgcaatgcaga

SEQ ID NO: 6622042 - DNA, 12 bp, Homo sapiens
actttattgcat

SEQ ID NO: 6622043 - DNA, 20 bp, Homo sapiens
actttattgccctaacaatt

SEQ ID NO: 6622044 - DNA, 21 bp, Homo sapiens
actttattgccttttaatttt

SEQ ID NO: 6622045 - DNA, 21 bp, Homo sapiens
actttattggagcattgatct

SEQ ID NO: 6622046 - DNA, 13 bp, Homo sapiens
actttattgtaca

SEQ ID NO: 6622047 - DNA, 14 bp, Homo sapiens
actttattgtagaa

SEQ ID NO: 6622048 - DNA, 13 bp, Homo sapiens
actttatttaaat

SEQ ID NO: 6622049 - DNA, 17 bp, Homo sapiens
actttatttaaatgcat

SEQ ID NO: 6622050 - DNA, 20 bp, Homo sapiens
actttatttaaatgcatgtc

SEQ ID NO: 6622051 - DNA, 17 bp, Homo sapiens
actttatttaatttcat

SEQ ID NO: 6622052 - DNA, 20 bp, Homo sapiens
actttatttatacactgtct

SEQ ID NO: 6622053 - DNA, 18 bp, Homo sapiens
actttatttgaataacaa

SEQ ID NO: 6622054 - DNA, 24 bp, Homo sapiens
actttattttctggtagatagaaa

SEQ ID NO: 6622055 - DNA, 17 bp, Homo sapiens
actttatttttctgata

SEQ ID NO: 6622056 - DNA, 15 bp, Homo sapiens
actttattttttaaa

SEQ ID NO: 6622057 - DNA, 10 bp, Homo sapiens
actttcaaaa

SEQ ID NO: 6622058 - DNA, 20 bp, Homo sapiens
actttcaaaatatattttgt

SEQ ID NO: 6622059 - DNA, 16 bp, Homo sapiens
actttcaaaatgaatt

SEQ ID NO: 6622060 - DNA, 18 bp, Homo sapiens
actttcaaaattaaatct

SEQ ID NO: 6622061 - DNA, 20 bp, Homo sapiens
actttcaaaattaaatctgt

SEQ ID NO: 6622062 - DNA, 17 bp, Homo sapiens
actttcaaagacaatca

SEQ ID NO: 6622063 - DNA, 21 bp, Homo sapiens
actttcaaagtggatgcaatt

SEQ ID NO: 6622064 - DNA, 21 bp, Homo sapiens
actttcaaatcggtcccctgt

SEQ ID NO: 6622065 - DNA, 20 bp, Homo sapiens
actttcaagtattatatttt

SEQ ID NO: 6622066 - DNA, 20 bp, Homo sapiens
actttcaatattttaacttt

SEQ ID NO: 6622067 - DNA, 23 bp, Homo sapiens
actttcaatattttaactttttg

SEQ ID NO: 6622068 - DNA, 20 bp, Homo sapiens
actttcaatcttcaatcctt

SEQ ID NO: 6622069 - DNA, 17 bp, Homo sapiens
actttcacatagatgtc

SEQ ID NO: 6622070 - DNA, 16 bp, Homo sapiens
actttcactataatgt

SEQ ID NO: 6622071 - DNA, 20 bp, Homo sapiens
actttcactataatgtgaaa

SEQ ID NO: 6622072 - DNA, 21 bp, Homo sapiens
actttcactataatgtgaaat

SEQ ID NO: 6622073 - DNA, 13 bp, Homo sapiens
actttcactttga

SEQ ID NO: 6622074 - DNA, 16 bp, Homo sapiens
actttcactttgaaaa

SEQ ID NO: 6622075 - DNA, 17 bp, Homo sapiens
actttcagcagtctaaa

SEQ ID NO: 6622076 - DNA, 11 bp, Homo sapiens
actttcagctg

SEQ ID NO: 6622077 - DNA, 13 bp, Homo sapiens
actttcagctgtc

SEQ ID NO: 6622078 - DNA, 18 bp, Homo sapiens
actttcagtgaaagcatc

SEQ ID NO: 6622079 - DNA, 17 bp, Homo sapiens
actttcagtttcaggag

SEQ ID NO: 6622080 - DNA, 19 bp, Homo sapiens
actttcatcctgactctgc

SEQ ID NO: 6622081 - DNA, 20 bp, Homo sapiens
actttcatctaaattactga

SEQ ID NO: 6622082 - DNA, 20 bp, Homo sapiens
actttcatctaccttttctg

SEQ ID NO: 6622083 - DNA, 19 bp, Homo sapiens
actttcatctggggtgggg

SEQ ID NO: 6622084 - DNA, 16 bp, Homo sapiens
actttcatcttaaact

SEQ ID NO: 6622085 - DNA, 19 bp, Homo sapiens
actttcattaaagcattta

SEQ ID NO: 6622086 - DNA, 15 bp, Homo sapiens
actttcattccttca

SEQ ID NO: 6622087 - DNA, 18 bp, Homo sapiens
actttcattccttcagat

SEQ ID NO: 6622088 - DNA, 20 bp, Homo sapiens
actttcattccttcagattt

SEQ ID NO: 6622089 - DNA, 21 bp, Homo sapiens
actttcattgccagtgtcttt

SEQ ID NO: 6622090 - DNA, 14 bp, Homo sapiens
actttcattggaaa

SEQ ID NO: 6622091 - DNA, 22 bp, Homo sapiens
actttcattggatttttgttaa

SEQ ID NO: 6622092 - DNA, 12 bp, Homo sapiens
actttcattttt

SEQ ID NO: 6622093 - DNA, 14 bp, Homo sapiens
actttccaaaacct

SEQ ID NO: 6622094 - DNA, 12 bp, Homo sapiens
actttccaaata

SEQ ID NO: 6622095 - DNA, 19 bp, Homo sapiens
actttccaatgccacagac

SEQ ID NO: 6622096 - DNA, 17 bp, Homo sapiens
actttccaattctcctt

SEQ ID NO: 6622097 - DNA, 23 bp, Homo sapiens
actttccaccaactttttccaag

SEQ ID NO: 6622098 - DNA, 16 bp, Homo sapiens
actttccaccccctcc

SEQ ID NO: 6622099 - DNA, 19 bp, Homo sapiens
actttccaccccctccctg

SEQ ID NO: 6622100 - DNA, 20 bp, Homo sapiens
actttccactgacaacgaaa

SEQ ID NO: 6622101 - DNA, 18 bp, Homo sapiens
actttccagaatgacctt

SEQ ID NO: 6622102 - DNA, 20 bp, Homo sapiens
actttccagaatgaccttga

SEQ ID NO: 6622103 - DNA, 17 bp, Homo sapiens
actttccagcagtcagt

SEQ ID NO: 6622104 - DNA, 15 bp, Homo sapiens
actttccagggatcc

SEQ ID NO: 6622105 - DNA, 18 bp, Homo sapiens
actttccatatcaagaga

SEQ ID NO: 6622106 - DNA, 17 bp, Homo sapiens
actttccatctgcttgt

SEQ ID NO: 6622107 - DNA, 19 bp, Homo sapiens
actttccatgacagtagca

SEQ ID NO: 6622108 - DNA, 15 bp, Homo sapiens
actttcccaaatgta

SEQ ID NO: 6622109 - DNA, 18 bp, Homo sapiens
actttcccaaatgtattg

SEQ ID NO: 6622110 - DNA, 23 bp, Homo sapiens
actttccccagatcaaattctat

SEQ ID NO: 6622111 - DNA, 19 bp, Homo sapiens
actttccccatactctgtc

SEQ ID NO: 6622112 - DNA, 21 bp, Homo sapiens
actttccccatactctgtctc

SEQ ID NO: 6622113 - DNA, 22 bp, Homo sapiens
actttccccgtgggccatggca

SEQ ID NO: 6622114 - DNA, 15 bp, Homo sapiens
actttcccctctcgc

SEQ ID NO: 6622115 - DNA, 13 bp, Homo sapiens
actttccctctct

SEQ ID NO: 6622116 - DNA, 19 bp, Homo sapiens
actttccctctctggacct

SEQ ID NO: 6622117 - DNA, 22 bp, Homo sapiens
actttccctgtgtaccctccat

SEQ ID NO: 6622118 - DNA, 17 bp, Homo sapiens
actttcccttgccctgg

SEQ ID NO: 6622119 - DNA, 23 bp, Homo sapiens
actttcccttgccctgggctgcc

SEQ ID NO: 6622120 - DNA, 13 bp, Homo sapiens
actttcccttgct

SEQ ID NO: 6622121 - DNA, 14 bp, Homo sapiens
actttcccttgctt

SEQ ID NO: 6622122 - DNA, 20 bp, Homo sapiens
actttcccttttgtaagttg

SEQ ID NO: 6622123 - DNA, 13 bp, Homo sapiens
actttcctacaaa

SEQ ID NO: 6622124 - DNA, 18 bp, Homo sapiens
actttcctacaaaatgga

SEQ ID NO: 6622125 - DNA, 14 bp, Homo sapiens
actttcctatgaca

SEQ ID NO: 6622126 - DNA, 21 bp, Homo sapiens
actttcctattttcttttcca

SEQ ID NO: 6622127 - DNA, 12 bp, Homo sapiens
actttcctcagt

SEQ ID NO: 6622128 - DNA, 18 bp, Homo sapiens
actttcctccacctccca

SEQ ID NO: 6622129 - DNA, 19 bp, Homo sapiens
actttcctcctgaggcttt

SEQ ID NO: 6622130 - DNA, 17 bp, Homo sapiens
actttcctcctggcaga

SEQ ID NO: 6622131 - DNA, 21 bp, Homo sapiens
actttcctctttggtctacac

SEQ ID NO: 6622132 - DNA, 19 bp, Homo sapiens
actttcctgagctgtcgct

SEQ ID NO: 6622133 - DNA, 14 bp, Homo sapiens
actttcctgtactc

SEQ ID NO: 6622134 - DNA, 21 bp, Homo sapiens
actttccttagacccgccagg

SEQ ID NO: 6622135 - DNA, 18 bp, Homo sapiens
actttccttccctctcct

SEQ ID NO: 6622136 - DNA, 20 bp, Homo sapiens
actttccttccctctcctgc

SEQ ID NO: 6622137 - DNA, 15 bp, Homo sapiens
actttccttctctgt

SEQ ID NO: 6622138 - DNA, 17 bp, Homo sapiens
actttccttctctgtaa

SEQ ID NO: 6622139 - DNA, 20 bp, Homo sapiens
actttcctttcaataaagtt

SEQ ID NO: 6622140 - DNA, 21 bp, Homo sapiens
actttcctttcaataaagttg

SEQ ID NO: 6622141 - DNA, 19 bp, Homo sapiens
actttcctttccccagccc

SEQ ID NO: 6622142 - DNA, 22 bp, Homo sapiens
actttcctttgcaccatgtgaa

SEQ ID NO: 6622143 - DNA, 21 bp, Homo sapiens
actttccttttctattccttc

SEQ ID NO: 6622144 - DNA, 20 bp, Homo sapiens
actttccttttcttgtctct

SEQ ID NO: 6622145 - DNA, 14 bp, Homo sapiens
actttcgcctcctc

SEQ ID NO: 6622146 - DNA, 16 bp, Homo sapiens
actttcgcctcctcca

SEQ ID NO: 6622147 - DNA, 18 bp, Homo sapiens
actttcgcctcctccagc

SEQ ID NO: 6622148 - DNA, 23 bp, Homo sapiens
actttcgcctcctccagctcctg

SEQ ID NO: 6622149 - DNA, 24 bp, Homo sapiens
actttcgcctcctccagctcctgc

SEQ ID NO: 6622150 - DNA, 17 bp, Homo sapiens
actttcggagcctgcct

SEQ ID NO: 6622151 - DNA, 15 bp, Homo sapiens
actttcgtacattgg

SEQ ID NO: 6622152 - DNA, 23 bp, Homo sapiens
actttcgttaatcttgctgctta

SEQ ID NO: 6622153 - DNA, 19 bp, Homo sapiens
actttctacaatgtgaact

SEQ ID NO: 6622154 - DNA, 21 bp, Homo sapiens
actttctacaatgtgaacttt

SEQ ID NO: 6622155 - DNA, 17 bp, Homo sapiens
actttctacacctgttg

SEQ ID NO: 6622156 - DNA, 17 bp, Homo sapiens
actttctactcatttta

SEQ ID NO: 6622157 - DNA, 15 bp, Homo sapiens
actttctatgtgaca

SEQ ID NO: 6622158 - DNA, 16 bp, Homo sapiens
actttctatgtgacat

SEQ ID NO: 6622159 - DNA, 18 bp, Homo sapiens
actttctatttttatgat

SEQ ID NO: 6622160 - DNA, 22 bp, Homo sapiens
actttctatttttatgatgaca

SEQ ID NO: 6622161 - DNA, 16 bp, Homo sapiens
actttctcactgctgt

SEQ ID NO: 6622162 - DNA, 17 bp, Homo sapiens
actttctcactgctgtc

SEQ ID NO: 6622163 - DNA, 13 bp, Homo sapiens
actttctcagttt

SEQ ID NO: 6622164 - DNA, 14 bp, Homo sapiens
actttctcagtttt

SEQ ID NO: 6622165 - DNA, 17 bp, Homo sapiens
actttctcagttttcat

SEQ ID NO: 6622166 - DNA, 21 bp, Homo sapiens
actttctccatttaagacaca

SEQ ID NO: 6622167 - DNA, 22 bp, Homo sapiens
actttctccccatccccttcct

SEQ ID NO: 6622168 - DNA, 12 bp, Homo sapiens
actttctcctgg

SEQ ID NO: 6622169 - DNA, 12 bp, Homo sapiens
actttctctaat

SEQ ID NO: 6622170 - DNA, 23 bp, Homo sapiens
actttctctaataataaatagtt

SEQ ID NO: 6622171 - DNA, 15 bp, Homo sapiens
actttctctctttgt

SEQ ID NO: 6622172 - DNA, 18 bp, Homo sapiens
actttctctgtgaaagct

SEQ ID NO: 6622173 - DNA, 20 bp, Homo sapiens
actttctcttaacttaattt

SEQ ID NO: 6622174 - DNA, 14 bp, Homo sapiens
actttctcttgttt

SEQ ID NO: 6622175 - DNA, 17 bp, Homo sapiens
actttctctttgccatt

SEQ ID NO: 6622176 - DNA, 23 bp, Homo sapiens
actttctctttgccatttcttct

SEQ ID NO: 6622177 - DNA, 13 bp, Homo sapiens
actttctgaaaat

SEQ ID NO: 6622178 - DNA, 19 bp, Homo sapiens
actttctgaaaatttatat

SEQ ID NO: 6622179 - DNA, 20 bp, Homo sapiens
actttctgaaactcccttgt

SEQ ID NO: 6622180 - DNA, 13 bp, Homo sapiens
actttctgatgca

SEQ ID NO: 6622181 - DNA, 12 bp, Homo sapiens
actttctgattg

SEQ ID NO: 6622182 - DNA, 12 bp, Homo sapiens
actttctgcctt

SEQ ID NO: 6622183 - DNA, 13 bp, Homo sapiens
actttctggaaaa

SEQ ID NO: 6622184 - DNA, 23 bp, Homo sapiens
actttctggggcctaataaaact

SEQ ID NO: 6622185 - DNA, 14 bp, Homo sapiens
actttctgtaaact

SEQ ID NO: 6622186 - DNA, 13 bp, Homo sapiens
actttctgtacta

SEQ ID NO: 6622187 - DNA, 19 bp, Homo sapiens
actttctgtactaaacatt

SEQ ID NO: 6622188 - DNA, 22 bp, Homo sapiens
actttctgtactaaacatttcc

SEQ ID NO: 6622189 - DNA, 23 bp, Homo sapiens
actttctgtgacgcagacagagg

SEQ ID NO: 6622190 - DNA, 20 bp, Homo sapiens
actttctgtgtaccactggg

SEQ ID NO: 6622191 - DNA, 22 bp, Homo sapiens
actttctgtgtaccactgggat

SEQ ID NO: 6622192 - DNA, 18 bp, Homo sapiens
actttctgttatgggctt

SEQ ID NO: 6622193 - DNA, 18 bp, Homo sapiens
actttctgttccctatgg

SEQ ID NO: 6622194 - DNA, 20 bp, Homo sapiens
actttcttatccaacttttt

SEQ ID NO: 6622195 - DNA, 11 bp, Homo sapiens
actttcttcaa

SEQ ID NO: 6622196 - DNA, 19 bp, Homo sapiens
actttcttcaaaaagcatt

SEQ ID NO: 6622197 - DNA, 16 bp, Homo sapiens
actttcttctaccaga

SEQ ID NO: 6622198 - DNA, 21 bp, Homo sapiens
actttcttctagctgagcttt

SEQ ID NO: 6622199 - DNA, 14 bp, Homo sapiens
actttcttctgaat

SEQ ID NO: 6622200 - DNA, 20 bp, Homo sapiens
actttcttgagcaccaggtg

SEQ ID NO: 6622201 - DNA, 15 bp, Homo sapiens
actttcttgcatgaa

SEQ ID NO: 6622202 - DNA, 17 bp, Homo sapiens
actttctttctgtaggt

SEQ ID NO: 6622203 - DNA, 21 bp, Homo sapiens
actttcttttcgccgtggctg

SEQ ID NO: 6622204 - DNA, 15 bp, Homo sapiens
actttgaaaaagata

SEQ ID NO: 6622205 - DNA, 17 bp, Homo sapiens
actttgaaaacaattca

SEQ ID NO: 6622206 - DNA, 16 bp, Homo sapiens
actttgaaaagttgga

SEQ ID NO: 6622207 - DNA, 10 bp, Homo sapiens
actttgaaat

SEQ ID NO: 6622208 - DNA, 22 bp, Homo sapiens
actttgaaatacctcatgttta

SEQ ID NO: 6622209 - DNA, 17 bp, Homo sapiens
actttgaaatgtgtttc

SEQ ID NO: 6622210 - DNA, 20 bp, Homo sapiens
actttgaacattaatgttga

SEQ ID NO: 6622211 - DNA, 23 bp, Homo sapiens
actttgaactactagaaaattgt

SEQ ID NO: 6622212 - DNA, 21 bp, Homo sapiens
actttgaactgaaacttttct

SEQ ID NO: 6622213 - DNA, 21 bp, Homo sapiens
actttgaagacccgctacaaa

SEQ ID NO: 6622214 - DNA, 14 bp, Homo sapiens
actttgaagggcaa

SEQ ID NO: 6622215 - DNA, 21 bp, Homo sapiens
actttgaagggcaagaaatgg

SEQ ID NO: 6622216 - DNA, 23 bp, Homo sapiens
actttgaagggcaagaaatggcg

SEQ ID NO: 6622217 - DNA, 19 bp, Homo sapiens
actttgaagtaaaaccttt

SEQ ID NO: 6622218 - DNA, 20 bp, Homo sapiens
actttgaagtgcagctcatg

SEQ ID NO: 6622219 - DNA, 22 bp, Homo sapiens
actttgaagtgcagctcatgtt

SEQ ID NO: 6622220 - DNA, 14 bp, Homo sapiens
actttgaagttagc

SEQ ID NO: 6622221 - DNA, 16 bp, Homo sapiens
actttgaataaaataa

SEQ ID NO: 6622222 - DNA, 18 bp, Homo sapiens
actttgaataaagaatac

SEQ ID NO: 6622223 - DNA, 22 bp, Homo sapiens
actttgaataaagaatacttga

SEQ ID NO: 6622224 - DNA, 20 bp, Homo sapiens
actttgaatagtcctaaaaa

SEQ ID NO: 6622225 - DNA, 13 bp, Homo sapiens
actttgaattatt

SEQ ID NO: 6622226 - DNA, 19 bp, Homo sapiens
actttgaatttatataaag

SEQ ID NO: 6622227 - DNA, 20 bp, Homo sapiens
actttgaatttatataaagt

SEQ ID NO: 6622228 - DNA, 23 bp, Homo sapiens
actttgaatttatataaagtatt

SEQ ID NO: 6622229 - DNA, 16 bp, Homo sapiens
actttgacaattactc

SEQ ID NO: 6622230 - DNA, 19 bp, Homo sapiens
actttgacagcgcacagct

SEQ ID NO: 6622231 - DNA, 16 bp, Homo sapiens
actttgacctctgcag

SEQ ID NO: 6622232 - DNA, 18 bp, Homo sapiens
actttgacctctgcagca

SEQ ID NO: 6622233 - DNA, 15 bp, Homo sapiens
actttgactcagagg

SEQ ID NO: 6622234 - DNA, 17 bp, Homo sapiens
actttgagaggctgagg

SEQ ID NO: 6622235 - DNA, 17 bp, Homo sapiens
actttgagatctaaaaa

SEQ ID NO: 6622236 - DNA, 19 bp, Homo sapiens
actttgagatctaaaaata

SEQ ID NO: 6622237 - DNA, 20 bp, Homo sapiens
actttgagcctgcatcttct

SEQ ID NO: 6622238 - DNA, 18 bp, Homo sapiens
actttgaggataactttt

SEQ ID NO: 6622239 - DNA, 17 bp, Homo sapiens
actttgagtacagatac

SEQ ID NO: 6622240 - DNA, 17 bp, Homo sapiens
actttgagttaagtcta

SEQ ID NO: 6622241 - DNA, 15 bp, Homo sapiens
actttgataattaag

SEQ ID NO: 6622242 - DNA, 14 bp, Homo sapiens
actttgatccttgg

SEQ ID NO: 6622243 - DNA, 16 bp, Homo sapiens
actttgatccttggaa

SEQ ID NO: 6622244 - DNA, 18 bp, Homo sapiens
actttgatccttggaaac

SEQ ID NO: 6622245 - DNA, 15 bp, Homo sapiens
actttgatctctgct

SEQ ID NO: 6622246 - DNA, 10 bp, Homo sapiens
actttgatgt

SEQ ID NO: 6622247 - DNA, 17 bp, Homo sapiens
actttgatgtcagcagt

SEQ ID NO: 6622248 - DNA, 22 bp, Homo sapiens
actttgatgtcagcagttgctg

SEQ ID NO: 6622249 - DNA, 19 bp, Homo sapiens
actttgatgtcatgtgttc

SEQ ID NO: 6622250 - DNA, 22 bp, Homo sapiens
actttgatgtcatgtgttccct

SEQ ID NO: 6622251 - DNA, 17 bp, Homo sapiens
actttgattcacatgtt

SEQ ID NO: 6622252 - DNA, 21 bp, Homo sapiens
actttgatttacagtgcctgt

SEQ ID NO: 6622253 - DNA, 21 bp, Homo sapiens
actttgcaaattatttattac

SEQ ID NO: 6622254 - DNA, 21 bp, Homo sapiens
actttgcacactttggcccag

SEQ ID NO: 6622255 - DNA, 13 bp, Homo sapiens
actttgcacttaa

SEQ ID NO: 6622256 - DNA, 17 bp, Homo sapiens
actttgcagcataccaa

SEQ ID NO: 6622257 - DNA, 23 bp, Homo sapiens
actttgcagccggcacagggtct

SEQ ID NO: 6622258 - DNA, 12 bp, Homo sapiens
actttgcaggag

SEQ ID NO: 6622259 - DNA, 13 bp, Homo sapiens
actttgcaggagt

SEQ ID NO: 6622260 - DNA, 17 bp, Homo sapiens
actttgcaggagttcct

SEQ ID NO: 6622261 - DNA, 18 bp, Homo sapiens
actttgcaggagttcctt

SEQ ID NO: 6622262 - DNA, 19 bp, Homo sapiens
actttgcaggcggccctca

SEQ ID NO: 6622263 - DNA, 16 bp, Homo sapiens
actttgcataaattaa

SEQ ID NO: 6622264 - DNA, 17 bp, Homo sapiens
actttgcatagcagctg

SEQ ID NO: 6622265 - DNA, 16 bp, Homo sapiens
actttgcattgtctgt

SEQ ID NO: 6622266 - DNA, 18 bp, Homo sapiens
actttgcattttgtttca

SEQ ID NO: 6622267 - DNA, 14 bp, Homo sapiens
actttgccaaggct

SEQ ID NO: 6622268 - DNA, 22 bp, Homo sapiens
actttgccaaggctctcccctc

SEQ ID NO: 6622269 - DNA, 19 bp, Homo sapiens
actttgccactgctgtatt

SEQ ID NO: 6622270 - DNA, 20 bp, Homo sapiens
actttgccactgctgtattt

SEQ ID NO: 6622271 - DNA, 23 bp, Homo sapiens
actttgccagcttttcctccctt

SEQ ID NO: 6622272 - DNA, 14 bp, Homo sapiens
actttgccatcctt

SEQ ID NO: 6622273 - DNA, 15 bp, Homo sapiens
actttgccatttttc

SEQ ID NO: 6622274 - DNA, 16 bp, Homo sapiens
actttgccatttttct

SEQ ID NO: 6622275 - DNA, 19 bp, Homo sapiens
actttgccatttttctata

SEQ ID NO: 6622276 - DNA, 18 bp, Homo sapiens
actttgcccctttcagta

SEQ ID NO: 6622277 - DNA, 23 bp, Homo sapiens
actttgcctcctgtgtactgtgt

SEQ ID NO: 6622278 - DNA, 12 bp, Homo sapiens
actttgcctgcc

SEQ ID NO: 6622279 - DNA, 14 bp, Homo sapiens
actttgccttccag

SEQ ID NO: 6622280 - DNA, 12 bp, Homo sapiens
actttgcctttt

SEQ ID NO: 6622281 - DNA, 21 bp, Homo sapiens
actttgctaaagacatgaagc

SEQ ID NO: 6622282 - DNA, 14 bp, Homo sapiens
actttgctccaggc

SEQ ID NO: 6622283 - DNA, 16 bp, Homo sapiens
actttgctccgtggag

SEQ ID NO: 6622284 - DNA, 15 bp, Homo sapiens
actttgctcctcaca

SEQ ID NO: 6622285 - DNA, 14 bp, Homo sapiens
actttgctctcttc

SEQ ID NO: 6622286 - DNA, 20 bp, Homo sapiens
actttgctctcttcttcttt

SEQ ID NO: 6622287 - DNA, 14 bp, Homo sapiens
actttgctctgggt

SEQ ID NO: 6622288 - DNA, 15 bp, Homo sapiens
actttgctctttctt

SEQ ID NO: 6622289 - DNA, 15 bp, Homo sapiens
actttgctgcatttt

SEQ ID NO: 6622290 - DNA, 19 bp, Homo sapiens
actttgctggtgtagtctt

SEQ ID NO: 6622291 - DNA, 20 bp, Homo sapiens
actttgctgttactgcttct

SEQ ID NO: 6622292 - DNA, 19 bp, Homo sapiens
actttgctgttccttactt

SEQ ID NO: 6622293 - DNA, 22 bp, Homo sapiens
actttgcttagtattgacaact

SEQ ID NO: 6622294 - DNA, 19 bp, Homo sapiens
actttgcttcccctccagg

SEQ ID NO: 6622295 - DNA, 14 bp, Homo sapiens
actttgcttctctc

SEQ ID NO: 6622296 - DNA, 12 bp, Homo sapiens
actttgcttgag

SEQ ID NO: 6622297 - DNA, 11 bp, Homo sapiens
actttgcttgc

SEQ ID NO: 6622298 - DNA, 14 bp, Homo sapiens
actttgcttgcttt

SEQ ID NO: 6622299 - DNA, 15 bp, Homo sapiens
actttgctttaatat

SEQ ID NO: 6622300 - DNA, 17 bp, Homo sapiens
actttgctttaatataa

SEQ ID NO: 6622301 - DNA, 22 bp, Homo sapiens
actttgctttctgaattggaag

SEQ ID NO: 6622302 - DNA, 17 bp, Homo sapiens
actttggaaagactttt

SEQ ID NO: 6622303 - DNA, 23 bp, Homo sapiens
actttggaaagacttttccaacc

SEQ ID NO: 6622304 - DNA, 15 bp, Homo sapiens
actttggaaccagac

SEQ ID NO: 6622305 - DNA, 22 bp, Homo sapiens
actttggaaccagactcttgcc

SEQ ID NO: 6622306 - DNA, 13 bp, Homo sapiens
actttggaagcac

SEQ ID NO: 6622307 - DNA, 18 bp, Homo sapiens
actttggaagtttgtgtt

SEQ ID NO: 6622308 - DNA, 18 bp, Homo sapiens
actttggaattctgcttc

SEQ ID NO: 6622309 - DNA, 15 bp, Homo sapiens
actttggaatttgaa

SEQ ID NO: 6622310 - DNA, 17 bp, Homo sapiens
actttggacagtggcct

SEQ ID NO: 6622311 - DNA, 19 bp, Homo sapiens
actttggacagtggcctct

SEQ ID NO: 6622312 - DNA, 21 bp, Homo sapiens
actttggagactggggtggcc

SEQ ID NO: 6622313 - DNA, 22 bp, Homo sapiens
actttggagtcccctcacctcc

SEQ ID NO: 6622314 - DNA, 21 bp, Homo sapiens
actttggcatcttttggagga

SEQ ID NO: 6622315 - DNA, 17 bp, Homo sapiens
actttggctgaactaca

SEQ ID NO: 6622316 - DNA, 14 bp, Homo sapiens
actttggctgcatg

SEQ ID NO: 6622317 - DNA, 17 bp, Homo sapiens
actttggctgcatgcga

SEQ ID NO: 6622318 - DNA, 22 bp, Homo sapiens
actttggcttataattctttca

SEQ ID NO: 6622319 - DNA, 12 bp, Homo sapiens
actttgggaggc

SEQ ID NO: 6622320 - DNA, 16 bp, Homo sapiens
actttgggaggcaggg

SEQ ID NO: 6622321 - DNA, 15 bp, Homo sapiens
actttgggaggccaa

SEQ ID NO: 6622322 - DNA, 21 bp, Homo sapiens
actttgggaggccgaggcagg

SEQ ID NO: 6622323 - DNA, 21 bp, Homo sapiens
actttgggaggccgaggcggg

SEQ ID NO: 6622324 - DNA, 19 bp, Homo sapiens
actttgggaggctgaggtg

SEQ ID NO: 6622325 - DNA, 20 bp, Homo sapiens
actttgggataggaaaaatg

SEQ ID NO: 6622326 - DNA, 18 bp, Homo sapiens
actttgggatatggtctt

SEQ ID NO: 6622327 - DNA, 12 bp, Homo sapiens
actttggggaca

SEQ ID NO: 6622328 - DNA, 20 bp, Homo sapiens
actttggggacaccctcctg

SEQ ID NO: 6622329 - DNA, 21 bp, Homo sapiens
actttggggttcggcctgtgt

SEQ ID NO: 6622330 - DNA, 16 bp, Homo sapiens
actttgggtttttaac

SEQ ID NO: 6622331 - DNA, 19 bp, Homo sapiens
actttgggtttttaactca

SEQ ID NO: 6622332 - DNA, 17 bp, Homo sapiens
actttggtaatgtgtca

SEQ ID NO: 6622333 - DNA, 19 bp, Homo sapiens
actttggtaccagataact

SEQ ID NO: 6622334 - DNA, 15 bp, Homo sapiens
actttggtaggcaaa

SEQ ID NO: 6622335 - DNA, 20 bp, Homo sapiens
actttggtctcagcgggagc

SEQ ID NO: 6622336 - DNA, 22 bp, Homo sapiens
actttggttattttactttttg

SEQ ID NO: 6622337 - DNA, 23 bp, Homo sapiens
actttggttattttactttttgg

SEQ ID NO: 6622338 - DNA, 18 bp, Homo sapiens
actttggtttctgtctgt

SEQ ID NO: 6622339 - DNA, 15 bp, Homo sapiens
actttggtttttcca

SEQ ID NO: 6622340 - DNA, 17 bp, Homo sapiens
actttgtaaaaatcttt

SEQ ID NO: 6622341 - DNA, 21 bp, Homo sapiens
actttgtaaaaatcttttgaa

SEQ ID NO: 6622342 - DNA, 13 bp, Homo sapiens
actttgtaaatag

SEQ ID NO: 6622343 - DNA, 12 bp, Homo sapiens
actttgtaaatt

SEQ ID NO: 6622344 - DNA, 21 bp, Homo sapiens
actttgtaaattctgatttct

SEQ ID NO: 6622345 - DNA, 12 bp, Homo sapiens
actttgtaattt

SEQ ID NO: 6622346 - DNA, 19 bp, Homo sapiens
actttgtaatttttgggga

SEQ ID NO: 6622347 - DNA, 18 bp, Homo sapiens
actttgtaccccccaacc

SEQ ID NO: 6622348 - DNA, 22 bp, Homo sapiens
actttgtaccccccaacccctg

SEQ ID NO: 6622349 - DNA, 14 bp, Homo sapiens
actttgtacttgtg

SEQ ID NO: 6622350 - DNA, 19 bp, Homo sapiens
actttgtagacattttgaa

SEQ ID NO: 6622351 - DNA, 12 bp, Homo sapiens
actttgtagtgt

SEQ ID NO: 6622352 - DNA, 15 bp, Homo sapiens
actttgtagtgtttg

SEQ ID NO: 6622353 - DNA, 20 bp, Homo sapiens
actttgtagtgtttggtgct

SEQ ID NO: 6622354 - DNA, 17 bp, Homo sapiens
actttgtataaattttt

SEQ ID NO: 6622355 - DNA, 22 bp, Homo sapiens
actttgtatgatattccatagt

SEQ ID NO: 6622356 - DNA, 19 bp, Homo sapiens
actttgtatgtcatttcct

SEQ ID NO: 6622357 - DNA, 15 bp, Homo sapiens
actttgtattactta

SEQ ID NO: 6622358 - DNA, 17 bp, Homo sapiens
actttgtattctctgtc

SEQ ID NO: 6622359 - DNA, 15 bp, Homo sapiens
actttgtattgtcct

SEQ ID NO: 6622360 - DNA, 22 bp, Homo sapiens
actttgtcacttatttccttat

SEQ ID NO: 6622361 - DNA, 20 bp, Homo sapiens
actttgtcacttctgctgta

SEQ ID NO: 6622362 - DNA, 15 bp, Homo sapiens
actttgtcattatga

SEQ ID NO: 6622363 - DNA, 21 bp, Homo sapiens
actttgtcattatgatttcat

SEQ ID NO: 6622364 - DNA, 20 bp, Homo sapiens
actttgtcctaagagattta

SEQ ID NO: 6622365 - DNA, 17 bp, Homo sapiens
actttgtcgtggttctt

SEQ ID NO: 6622366 - DNA, 16 bp, Homo sapiens
actttgtctaagaaac

SEQ ID NO: 6622367 - DNA, 16 bp, Homo sapiens
actttgtctctcctgg

SEQ ID NO: 6622368 - DNA, 12 bp, Homo sapiens
actttgtctgta

SEQ ID NO: 6622369 - DNA, 17 bp, Homo sapiens
actttgtctgtacatac

SEQ ID NO: 6622370 - DNA, 13 bp, Homo sapiens
actttgtgactgt

SEQ ID NO: 6622371 - DNA, 18 bp, Homo sapiens
actttgtgagtattctat

SEQ ID NO: 6622372 - DNA, 12 bp, Homo sapiens
actttgtgcaaa

SEQ ID NO: 6622373 - DNA, 17 bp, Homo sapiens
actttgtgcaatatgag

SEQ ID NO: 6622374 - DNA, 17 bp, Homo sapiens
actttgtgccagcgctg

SEQ ID NO: 6622375 - DNA, 14 bp, Homo sapiens
actttgtgcctttg

SEQ ID NO: 6622376 - DNA, 14 bp, Homo sapiens
actttgtgctacat

SEQ ID NO: 6622377 - DNA, 14 bp, Homo sapiens
actttgtgctcata

SEQ ID NO: 6622378 - DNA, 17 bp, Homo sapiens
actttgtggaccaatta

SEQ ID NO: 6622379 - DNA, 18 bp, Homo sapiens
actttgtggaccaattat

SEQ ID NO: 6622380 - DNA, 20 bp, Homo sapiens
actttgtggaccaattattg

SEQ ID NO: 6622381 - DNA, 21 bp, Homo sapiens
actttgtggaccaattattga

SEQ ID NO: 6622382 - DNA, 22 bp, Homo sapiens
actttgtggaccaattattgat

SEQ ID NO: 6622383 - DNA, 19 bp, Homo sapiens
actttgtggatgtcttcct

SEQ ID NO: 6622384 - DNA, 21 bp, Homo sapiens
actttgtggatgtcttccttg

SEQ ID NO: 6622385 - DNA, 13 bp, Homo sapiens
actttgtgtatta

SEQ ID NO: 6622386 - DNA, 21 bp, Homo sapiens
actttgtgtctctgttgtcta

SEQ ID NO: 6622387 - DNA, 20 bp, Homo sapiens
actttgtgtcttttgttctc

SEQ ID NO: 6622388 - DNA, 18 bp, Homo sapiens
actttgtgttcaccttgt

SEQ ID NO: 6622389 - DNA, 15 bp, Homo sapiens
actttgtgttcattt

SEQ ID NO: 6622390 - DNA, 15 bp, Homo sapiens
actttgttaacttca

SEQ ID NO: 6622391 - DNA, 22 bp, Homo sapiens
actttgttaatttatctgttgt

SEQ ID NO: 6622392 - DNA, 20 bp, Homo sapiens
actttgttaggattttcaca

SEQ ID NO: 6622393 - DNA, 22 bp, Homo sapiens
actttgttaggccaaagacaaa

SEQ ID NO: 6622394 - DNA, 11 bp, Homo sapiens
actttgttcac

SEQ ID NO: 6622395 - DNA, 14 bp, Homo sapiens
actttgttctgttg

SEQ ID NO: 6622396 - DNA, 17 bp, Homo sapiens
actttgttctgttgtct

SEQ ID NO: 6622397 - DNA, 19 bp, Homo sapiens
actttgttctgttgtctgc

SEQ ID NO: 6622398 - DNA, 20 bp, Homo sapiens
actttgttgcaagatgtgaa

SEQ ID NO: 6622399 - DNA, 21 bp, Homo sapiens
actttgttgcaagatgtgaat

SEQ ID NO: 6622400 - DNA, 18 bp, Homo sapiens
actttgttgccttatctt

SEQ ID NO: 6622401 - DNA, 21 bp, Homo sapiens
actttgttgccttatcttgaa

SEQ ID NO: 6622402 - DNA, 24 bp, Homo sapiens
actttgttggtagccatttggtag

SEQ ID NO: 6622403 - DNA, 23 bp, Homo sapiens
actttgtttagaaaaaaaactga

SEQ ID NO: 6622404 - DNA, 15 bp, Homo sapiens
actttgtttatgcat

SEQ ID NO: 6622405 - DNA, 20 bp, Homo sapiens
actttgtttcgtggggaggt

SEQ ID NO: 6622406 - DNA, 18 bp, Homo sapiens
actttgtttttattctgt

SEQ ID NO: 6622407 - DNA, 23 bp, Homo sapiens
acttttaaaaaaatttttataaa

SEQ ID NO: 6622408 - DNA, 19 bp, Homo sapiens
acttttaaaaaacaaaaaa

SEQ ID NO: 6622409 - DNA, 15 bp, Homo sapiens
acttttaaaaatgta

SEQ ID NO: 6622410 - DNA, 13 bp, Homo sapiens
acttttaaactgt

SEQ ID NO: 6622411 - DNA, 14 bp, Homo sapiens
acttttaaactgtg

SEQ ID NO: 6622412 - DNA, 20 bp, Homo sapiens
acttttaaactgtgtacata

SEQ ID NO: 6622413 - DNA, 22 bp, Homo sapiens
acttttaaagaaaaatatgata

SEQ ID NO: 6622414 - DNA, 13 bp, Homo sapiens
acttttaaagctc

SEQ ID NO: 6622415 - DNA, 13 bp, Homo sapiens
acttttaaatgtt

SEQ ID NO: 6622416 - DNA, 20 bp, Homo sapiens
acttttaaccaaacaattat

SEQ ID NO: 6622417 - DNA, 13 bp, Homo sapiens
acttttaagactt

SEQ ID NO: 6622418 - DNA, 19 bp, Homo sapiens
acttttaagatttctctaa

SEQ ID NO: 6622419 - DNA, 19 bp, Homo sapiens
acttttaaggataaatcat

SEQ ID NO: 6622420 - DNA, 17 bp, Homo sapiens
acttttaataaactttt

SEQ ID NO: 6622421 - DNA, 22 bp, Homo sapiens
acttttaatatcactaatttct

SEQ ID NO: 6622422 - DNA, 15 bp, Homo sapiens
acttttaatggtgat

SEQ ID NO: 6622423 - DNA, 13 bp, Homo sapiens
acttttaattcat

SEQ ID NO: 6622424 - DNA, 17 bp, Homo sapiens
acttttacagcttttct

SEQ ID NO: 6622425 - DNA, 21 bp, Homo sapiens
acttttacagcttttctcttt

SEQ ID NO: 6622426 - DNA, 19 bp, Homo sapiens
acttttacatttttctgat

SEQ ID NO: 6622427 - DNA, 21 bp, Homo sapiens
acttttacatttttctgatgg

SEQ ID NO: 6622428 - DNA, 13 bp, Homo sapiens
acttttagacttt

SEQ ID NO: 6622429 - DNA, 12 bp, Homo sapiens
acttttagatgt

SEQ ID NO: 6622430 - DNA, 16 bp, Homo sapiens
acttttagattaaaaa

SEQ ID NO: 6622431 - DNA, 17 bp, Homo sapiens
acttttagtagagacag

SEQ ID NO: 6622432 - DNA, 20 bp, Homo sapiens
acttttagtagagacagtgt

SEQ ID NO: 6622433 - DNA, 18 bp, Homo sapiens
acttttagtggttctgtg

SEQ ID NO: 6622434 - DNA, 19 bp, Homo sapiens
acttttagttggcatttgt

SEQ ID NO: 6622435 - DNA, 13 bp, Homo sapiens
acttttataaact

SEQ ID NO: 6622436 - DNA, 14 bp, Homo sapiens
acttttataaagca

SEQ ID NO: 6622437 - DNA, 17 bp, Homo sapiens
acttttataaagcatgt

SEQ ID NO: 6622438 - DNA, 23 bp, Homo sapiens
acttttataaatgttttaaagaa

SEQ ID NO: 6622439 - DNA, 16 bp, Homo sapiens
acttttataaattaaa

SEQ ID NO: 6622440 - DNA, 11 bp, Homo sapiens
acttttataat

SEQ ID NO: 6622441 - DNA, 17 bp, Homo sapiens
acttttatatttgaaaa

SEQ ID NO: 6622442 - DNA, 22 bp, Homo sapiens
acttttatatttgaaaaaatta

SEQ ID NO: 6622443 - DNA, 17 bp, Homo sapiens
acttttatcttaaaagg

SEQ ID NO: 6622444 - DNA, 15 bp, Homo sapiens
acttttatgaagttt

SEQ ID NO: 6622445 - DNA, 20 bp, Homo sapiens
acttttatgagcttccaagg

SEQ ID NO: 6622446 - DNA, 16 bp, Homo sapiens
acttttatgatacttg

SEQ ID NO: 6622447 - DNA, 21 bp, Homo sapiens
acttttatgcagcaaatatat

SEQ ID NO: 6622448 - DNA, 20 bp, Homo sapiens
acttttatggctctatcttt

SEQ ID NO: 6622449 - DNA, 11 bp, Homo sapiens
acttttattaa

SEQ ID NO: 6622450 - DNA, 15 bp, Homo sapiens
acttttattaataaa

SEQ ID NO: 6622451 - DNA, 14 bp, Homo sapiens
acttttattaatat

SEQ ID NO: 6622452 - DNA, 23 bp, Homo sapiens
acttttattatgggtatgtgttg

SEQ ID NO: 6622453 - DNA, 22 bp, Homo sapiens
acttttatttgcaacatttaca

SEQ ID NO: 6622454 - DNA, 16 bp, Homo sapiens
acttttattttcattg

SEQ ID NO: 6622455 - DNA, 22 bp, Homo sapiens
acttttcaagtctgatccatat

SEQ ID NO: 6622456 - DNA, 14 bp, Homo sapiens
acttttcacactgt

SEQ ID NO: 6622457 - DNA, 16 bp, Homo sapiens
acttttcacactgtct

SEQ ID NO: 6622458 - DNA, 22 bp, Homo sapiens
acttttcacctccttcaattcc

SEQ ID NO: 6622459 - DNA, 20 bp, Homo sapiens
acttttcagaagatggtgaa

SEQ ID NO: 6622460 - DNA, 12 bp, Homo sapiens
acttttcagtga

SEQ ID NO: 6622461 - DNA, 19 bp, Homo sapiens
acttttcatatttgcacta

SEQ ID NO: 6622462 - DNA, 10 bp, Homo sapiens
acttttcatt

SEQ ID NO: 6622463 - DNA, 15 bp, Homo sapiens
acttttcattccctg

SEQ ID NO: 6622464 - DNA, 20 bp, Homo sapiens
acttttcattctcttttaat

SEQ ID NO: 6622465 - DNA, 17 bp, Homo sapiens
acttttcattgcaaagt

SEQ ID NO: 6622466 - DNA, 17 bp, Homo sapiens
acttttcatttcagatt

SEQ ID NO: 6622467 - DNA, 20 bp, Homo sapiens
acttttcatttcagatttta

SEQ ID NO: 6622468 - DNA, 21 bp, Homo sapiens
acttttcatttcagattttaa

SEQ ID NO: 6622469 - DNA, 19 bp, Homo sapiens
acttttccaagcaaaatct

SEQ ID NO: 6622470 - DNA, 17 bp, Homo sapiens
acttttccaatatgtga

SEQ ID NO: 6622471 - DNA, 20 bp, Homo sapiens
acttttccaatatgtgattt

SEQ ID NO: 6622472 - DNA, 17 bp, Homo sapiens
acttttccatgtatcta

SEQ ID NO: 6622473 - DNA, 17 bp, Homo sapiens
acttttccattcccaat

SEQ ID NO: 6622474 - DNA, 18 bp, Homo sapiens
acttttcccctgttaaac

SEQ ID NO: 6622475 - DNA, 20 bp, Homo sapiens
acttttcccctgttaaacag

SEQ ID NO: 6622476 - DNA, 21 bp, Homo sapiens
acttttcccctgttaaacagt

SEQ ID NO: 6622477 - DNA, 13 bp, Homo sapiens
acttttcctctta

SEQ ID NO: 6622478 - DNA, 21 bp, Homo sapiens
acttttcctggacttaaagaa

SEQ ID NO: 6622479 - DNA, 21 bp, Homo sapiens
acttttcctgggtttcctgca

SEQ ID NO: 6622480 - DNA, 12 bp, Homo sapiens
acttttccttcc

SEQ ID NO: 6622481 - DNA, 13 bp, Homo sapiens
acttttccttccc

SEQ ID NO: 6622482 - DNA, 23 bp, Homo sapiens
acttttccttccctcaaagcttc

SEQ ID NO: 6622483 - DNA, 12 bp, Homo sapiens
acttttcctttg

SEQ ID NO: 6622484 - DNA, 18 bp, Homo sapiens
acttttcctttgaatcct

SEQ ID NO: 6622485 - DNA, 14 bp, Homo sapiens
acttttccttttct

SEQ ID NO: 6622486 - DNA, 15 bp, Homo sapiens
acttttccttttctt

SEQ ID NO: 6622487 - DNA, 12 bp, Homo sapiens
acttttcgttaa

SEQ ID NO: 6622488 - DNA, 16 bp, Homo sapiens
acttttcgttaacatt

SEQ ID NO: 6622489 - DNA, 18 bp, Homo sapiens
acttttctaaaatctaaa

SEQ ID NO: 6622490 - DNA, 23 bp, Homo sapiens
acttttctaaactaggctccttc

SEQ ID NO: 6622491 - DNA, 22 bp, Homo sapiens
acttttctaaagctctgaacaa

SEQ ID NO: 6622492 - DNA, 18 bp, Homo sapiens
acttttctaagaaaagca

SEQ ID NO: 6622493 - DNA, 22 bp, Homo sapiens
acttttctaagaaaagcatttt

SEQ ID NO: 6622494 - DNA, 17 bp, Homo sapiens
acttttctagttaactt

SEQ ID NO: 6622495 - DNA, 18 bp, Homo sapiens
acttttctctttaatttt

SEQ ID NO: 6622496 - DNA, 22 bp, Homo sapiens
acttttctgattaatatattta

SEQ ID NO: 6622497 - DNA, 15 bp, Homo sapiens
acttttctgccaaaa

SEQ ID NO: 6622498 - DNA, 14 bp, Homo sapiens
acttttctgtttag

SEQ ID NO: 6622499 - DNA, 17 bp, Homo sapiens
acttttcttaaaaagtt

SEQ ID NO: 6622500 - DNA, 12 bp, Homo sapiens
acttttcttcta

SEQ ID NO: 6622501 - DNA, 20 bp, Homo sapiens
acttttcttctattgcctct

SEQ ID NO: 6622502 - DNA, 15 bp, Homo sapiens
acttttcttcttcct

SEQ ID NO: 6622503 - DNA, 16 bp, Homo sapiens
acttttctttcttttc

SEQ ID NO: 6622504 - DNA, 14 bp, Homo sapiens
acttttctttgaag

SEQ ID NO: 6622505 - DNA, 18 bp, Homo sapiens
acttttctttttaaatgt

SEQ ID NO: 6622506 - DNA, 20 bp, Homo sapiens
acttttctttttaaatgtgc

SEQ ID NO: 6622507 - DNA, 12 bp, Homo sapiens
acttttgaaaga

SEQ ID NO: 6622508 - DNA, 17 bp, Homo sapiens
acttttgaaagatgtat

SEQ ID NO: 6622509 - DNA, 23 bp, Homo sapiens
acttttgaactcacgagccttgc

SEQ ID NO: 6622510 - DNA, 22 bp, Homo sapiens
acttttgaagtcttccctcaga

SEQ ID NO: 6622511 - DNA, 19 bp, Homo sapiens
acttttgaatctataaaag

SEQ ID NO: 6622512 - DNA, 13 bp, Homo sapiens
acttttgaatgtc

SEQ ID NO: 6622513 - DNA, 22 bp, Homo sapiens
acttttgacaatcaaagaaaag

SEQ ID NO: 6622514 - DNA, 19 bp, Homo sapiens
acttttgactaagaatttt

SEQ ID NO: 6622515 - DNA, 16 bp, Homo sapiens
acttttgagacttttt

SEQ ID NO: 6622516 - DNA, 11 bp, Homo sapiens
acttttgagga

SEQ ID NO: 6622517 - DNA, 12 bp, Homo sapiens
acttttgagtgt

SEQ ID NO: 6622518 - DNA, 13 bp, Homo sapiens
acttttgatgact

SEQ ID NO: 6622519 - DNA, 21 bp, Homo sapiens
acttttgcaaaataagtaaat

SEQ ID NO: 6622520 - DNA, 18 bp, Homo sapiens
acttttgcaagagtgatg

SEQ ID NO: 6622521 - DNA, 13 bp, Homo sapiens
acttttgcacata

SEQ ID NO: 6622522 - DNA, 13 bp, Homo sapiens
acttttgctgttt

SEQ ID NO: 6622523 - DNA, 20 bp, Homo sapiens
acttttgcttaccttttcct

SEQ ID NO: 6622524 - DNA, 12 bp, Homo sapiens
acttttgcttta

SEQ ID NO: 6622525 - DNA, 21 bp, Homo sapiens
acttttggaaccatgccttcc

SEQ ID NO: 6622526 - DNA, 16 bp, Homo sapiens
acttttggattttatg

SEQ ID NO: 6622527 - DNA, 18 bp, Homo sapiens
acttttggcatgaaagtg

SEQ ID NO: 6622528 - DNA, 13 bp, Homo sapiens
acttttggcctca

SEQ ID NO: 6622529 - DNA, 22 bp, Homo sapiens
acttttggcctcatctctgcct

SEQ ID NO: 6622530 - DNA, 23 bp, Homo sapiens
acttttgggaggtccaggcagga

SEQ ID NO: 6622531 - DNA, 16 bp, Homo sapiens
acttttggttaagtct

SEQ ID NO: 6622532 - DNA, 12 bp, Homo sapiens
acttttggtttt

SEQ ID NO: 6622533 - DNA, 12 bp, Homo sapiens
acttttgtaaat

SEQ ID NO: 6622534 - DNA, 15 bp, Homo sapiens
acttttgtaaatatt

SEQ ID NO: 6622535 - DNA, 19 bp, Homo sapiens
acttttgtaaatattcttg

SEQ ID NO: 6622536 - DNA, 23 bp, Homo sapiens
acttttgtagtcttatgaataga

SEQ ID NO: 6622537 - DNA, 13 bp, Homo sapiens
acttttgtgaaag

SEQ ID NO: 6622538 - DNA, 19 bp, Homo sapiens
acttttgtggagtttgaca

SEQ ID NO: 6622539 - DNA, 18 bp, Homo sapiens
acttttgtgtattctgtg

SEQ ID NO: 6622540 - DNA, 20 bp, Homo sapiens
acttttgtgtattctgtgga

SEQ ID NO: 6622541 - DNA, 22 bp, Homo sapiens
acttttgttaggaaaaaattga

SEQ ID NO: 6622542 - DNA, 15 bp, Homo sapiens
acttttgttattcca

SEQ ID NO: 6622543 - DNA, 16 bp, Homo sapiens
acttttgttattccat

SEQ ID NO: 6622544 - DNA, 18 bp, Homo sapiens
acttttgttattccatca

SEQ ID NO: 6622545 - DNA, 20 bp, Homo sapiens
acttttgttattccatcaat

SEQ ID NO: 6622546 - DNA, 20 bp, Homo sapiens
acttttgttccagtgtttaa

SEQ ID NO: 6622547 - DNA, 21 bp, Homo sapiens
acttttgttccagtgtttaaa

SEQ ID NO: 6622548 - DNA, 20 bp, Homo sapiens
acttttgttctactccttcc

SEQ ID NO: 6622549 - DNA, 13 bp, Homo sapiens
acttttgttctct

SEQ ID NO: 6622550 - DNA, 18 bp, Homo sapiens
acttttgttctcttctgc

SEQ ID NO: 6622551 - DNA, 16 bp, Homo sapiens
acttttgttgaaatag

SEQ ID NO: 6622552 - DNA, 19 bp, Homo sapiens
acttttgttgcccaggctg

SEQ ID NO: 6622553 - DNA, 18 bp, Homo sapiens
acttttgttgtatgggat

SEQ ID NO: 6622554 - DNA, 18 bp, Homo sapiens
actttttaaaaaactttc

SEQ ID NO: 6622555 - DNA, 18 bp, Homo sapiens
actttttaaaaaatgctg

SEQ ID NO: 6622556 - DNA, 21 bp, Homo sapiens
actttttaaaaaatgctgggt

SEQ ID NO: 6622557 - DNA, 22 bp, Homo sapiens
actttttaaacagtgtttatga

SEQ ID NO: 6622558 - DNA, 22 bp, Homo sapiens
actttttaaagaagtgcatgaa

SEQ ID NO: 6622559 - DNA, 19 bp, Homo sapiens
actttttaacattctcaat

SEQ ID NO: 6622560 - DNA, 23 bp, Homo sapiens
actttttaataaagtatattgaa

SEQ ID NO: 6622561 - DNA, 12 bp, Homo sapiens
actttttacatt

SEQ ID NO: 6622562 - DNA, 18 bp, Homo sapiens
actttttagtcttttact

SEQ ID NO: 6622563 - DNA, 14 bp, Homo sapiens
actttttatactcc

SEQ ID NO: 6622564 - DNA, 13 bp, Homo sapiens
actttttatatat

SEQ ID NO: 6622565 - DNA, 14 bp, Homo sapiens
actttttatatata

SEQ ID NO: 6622566 - DNA, 15 bp, Homo sapiens
actttttatatatat

SEQ ID NO: 6622567 - DNA, 22 bp, Homo sapiens
actttttatattctcagcagag

SEQ ID NO: 6622568 - DNA, 21 bp, Homo sapiens
actttttattcaattctgtat

SEQ ID NO: 6622569 - DNA, 15 bp, Homo sapiens
actttttattgcatg

SEQ ID NO: 6622570 - DNA, 13 bp, Homo sapiens
actttttattgcc

SEQ ID NO: 6622571 - DNA, 18 bp, Homo sapiens
actttttattgccttctc

SEQ ID NO: 6622572 - DNA, 12 bp, Homo sapiens
actttttcaaga

SEQ ID NO: 6622573 - DNA, 21 bp, Homo sapiens
actttttcagaggtgaattaa

SEQ ID NO: 6622574 - DNA, 12 bp, Homo sapiens
actttttcagtg

SEQ ID NO: 6622575 - DNA, 13 bp, Homo sapiens
actttttcatgaa

SEQ ID NO: 6622576 - DNA, 18 bp, Homo sapiens
actttttcatttgcctat

SEQ ID NO: 6622577 - DNA, 13 bp, Homo sapiens
actttttccaagt

SEQ ID NO: 6622578 - DNA, 15 bp, Homo sapiens
actttttccaagtcc

SEQ ID NO: 6622579 - DNA, 13 bp, Homo sapiens
actttttccagca

SEQ ID NO: 6622580 - DNA, 21 bp, Homo sapiens
actttttccatttcttcagag

SEQ ID NO: 6622581 - DNA, 12 bp, Homo sapiens
actttttccccc

SEQ ID NO: 6622582 - DNA, 14 bp, Homo sapiens
actttttcccctgc

SEQ ID NO: 6622583 - DNA, 16 bp, Homo sapiens
actttttcctctcgag

SEQ ID NO: 6622584 - DNA, 14 bp, Homo sapiens
actttttccttcct

SEQ ID NO: 6622585 - DNA, 14 bp, Homo sapiens
actttttccttctg

SEQ ID NO: 6622586 - DNA, 22 bp, Homo sapiens
actttttctaaattataaagac

SEQ ID NO: 6622587 - DNA, 19 bp, Homo sapiens
actttttcttaatcatttt

SEQ ID NO: 6622588 - DNA, 14 bp, Homo sapiens
actttttcttgtat

SEQ ID NO: 6622589 - DNA, 14 bp, Homo sapiens
actttttcttttgt

SEQ ID NO: 6622590 - DNA, 21 bp, Homo sapiens
actttttgaactaagaaactt

SEQ ID NO: 6622591 - DNA, 14 bp, Homo sapiens
actttttgaatgtc

SEQ ID NO: 6622592 - DNA, 22 bp, Homo sapiens
actttttgaatgtcataaagaa

SEQ ID NO: 6622593 - DNA, 16 bp, Homo sapiens
actttttgaggcaaaa

SEQ ID NO: 6622594 - DNA, 15 bp, Homo sapiens
actttttgcagcttt

SEQ ID NO: 6622595 - DNA, 13 bp, Homo sapiens
actttttgcattt

SEQ ID NO: 6622596 - DNA, 20 bp, Homo sapiens
actttttggaattcagcagt

SEQ ID NO: 6622597 - DNA, 22 bp, Homo sapiens
actttttggaattcagcagttt

SEQ ID NO: 6622598 - DNA, 14 bp, Homo sapiens
actttttggctgga

SEQ ID NO: 6622599 - DNA, 17 bp, Homo sapiens
actttttggtaatatat

SEQ ID NO: 6622600 - DNA, 12 bp, Homo sapiens
actttttgtaaa

SEQ ID NO: 6622601 - DNA, 14 bp, Homo sapiens
actttttgtaaatg

SEQ ID NO: 6622602 - DNA, 18 bp, Homo sapiens
actttttgtatttagtag

SEQ ID NO: 6622603 - DNA, 19 bp, Homo sapiens
actttttgtattttttcct

SEQ ID NO: 6622604 - DNA, 20 bp, Homo sapiens
actttttgtattttttcctt

SEQ ID NO: 6622605 - DNA, 15 bp, Homo sapiens
actttttgtgaagac

SEQ ID NO: 6622606 - DNA, 18 bp, Homo sapiens
actttttgtgaagacggc

SEQ ID NO: 6622607 - DNA, 13 bp, Homo sapiens
actttttgtgaat

SEQ ID NO: 6622608 - DNA, 16 bp, Homo sapiens
actttttgttcatgtg

SEQ ID NO: 6622609 - DNA, 16 bp, Homo sapiens
actttttgttccagag

SEQ ID NO: 6622610 - DNA, 23 bp, Homo sapiens
actttttgttctggtcctttttg

SEQ ID NO: 6622611 - DNA, 14 bp, Homo sapiens
actttttgtttctt

SEQ ID NO: 6622612 - DNA, 17 bp, Homo sapiens
actttttgttttgttct

SEQ ID NO: 6622613 - DNA, 18 bp, Homo sapiens
actttttgtttttatttc

SEQ ID NO: 6622614 - DNA, 21 bp, Homo sapiens
actttttgtttttatttcttt

SEQ ID NO: 6622615 - DNA, 14 bp, Homo sapiens
acttttttaaacta

SEQ ID NO: 6622616 - DNA, 22 bp, Homo sapiens
acttttttaaactaagatctgt

SEQ ID NO: 6622617 - DNA, 14 bp, Homo sapiens
acttttttaaataa

SEQ ID NO: 6622618 - DNA, 18 bp, Homo sapiens
acttttttaaataaactt

SEQ ID NO: 6622619 - DNA, 20 bp, Homo sapiens
acttttttaaataaactttt

SEQ ID NO: 6622620 - DNA, 19 bp, Homo sapiens
acttttttaaatattttct

SEQ ID NO: 6622621 - DNA, 20 bp, Homo sapiens
acttttttacaacctggcca

SEQ ID NO: 6622622 - DNA, 18 bp, Homo sapiens
acttttttacactgataa

SEQ ID NO: 6622623 - DNA, 19 bp, Homo sapiens
acttttttagaaatgcaaa

SEQ ID NO: 6622624 - DNA, 20 bp, Homo sapiens
acttttttatgaagaaaaag

SEQ ID NO: 6622625 - DNA, 18 bp, Homo sapiens
acttttttcaaatattga

SEQ ID NO: 6622626 - DNA, 13 bp, Homo sapiens
acttttttccaaa

SEQ ID NO: 6622627 - DNA, 18 bp, Homo sapiens
acttttttcctgtcaata

SEQ ID NO: 6622628 - DNA, 18 bp, Homo sapiens
acttttttgagtcattga

SEQ ID NO: 6622629 - DNA, 23 bp, Homo sapiens
acttttttggggatatgcttagt

SEQ ID NO: 6622630 - DNA, 20 bp, Homo sapiens
acttttttgtggcaattagt

SEQ ID NO: 6622631 - DNA, 12 bp, Homo sapiens
acttttttgtgt

SEQ ID NO: 6622632 - DNA, 13 bp, Homo sapiens
acttttttgtgta

SEQ ID NO: 6622633 - DNA, 18 bp, Homo sapiens
acttttttgtttgaatgt

SEQ ID NO: 6622634 - DNA, 16 bp, Homo sapiens
actttttttaaccatt

SEQ ID NO: 6622635 - DNA, 21 bp, Homo sapiens
actttttttaaccattattat

SEQ ID NO: 6622636 - DNA, 19 bp, Homo sapiens
actttttttataagcaaaa

SEQ ID NO: 6622637 - DNA, 14 bp, Homo sapiens
actttttttcaatg

SEQ ID NO: 6622638 - DNA, 16 bp, Homo sapiens
actttttttcaatgtg

SEQ ID NO: 6622639 - DNA, 14 bp, Homo sapiens
actttttttctgat

SEQ ID NO: 6622640 - DNA, 23 bp, Homo sapiens
actttttttctgtaccagttaat

SEQ ID NO: 6622641 - DNA, 14 bp, Homo sapiens
actttttttctgtg

SEQ ID NO: 6622642 - DNA, 15 bp, Homo sapiens
actttttttctgtga

SEQ ID NO: 6622643 - DNA, 17 bp, Homo sapiens
actttttttctttttct

SEQ ID NO: 6622644 - DNA, 14 bp, Homo sapiens
actttttttgtaga

SEQ ID NO: 6622645 - DNA, 21 bp, Homo sapiens
actttttttgtagatgaactt

SEQ ID NO: 6622646 - DNA, 16 bp, Homo sapiens
actttttttgtatgtg

SEQ ID NO: 6622647 - DNA, 17 bp, Homo sapiens
acttttttttgtatgtt

SEQ ID NO: 6622648 - DNA, 20 bp, Homo sapiens
actttttttttttctgcctg

SEQ ID NO: 6622649 - DNA, 21 bp, Homo sapiens
actttttttttttctgcctga

SEQ ID NO: 6622650 - DNA, 18 bp, Homo sapiens
actttttttttttttccc

SEQ ID NO: 6622651 - DNA, 15 bp, Homo sapiens
agaaaaaaaaaaaga

SEQ ID NO: 6622652 - DNA, 14 bp, Homo sapiens
agaaaaaaaaaaga

SEQ ID NO: 6622653 - DNA, 18 bp, Homo sapiens
agaaaaaaaaaagaagaa

SEQ ID NO: 6622654 - DNA, 19 bp, Homo sapiens
agaaaaaaaaaagaagaag

SEQ ID NO: 6622655 - DNA, 15 bp, Homo sapiens
agaaaaaaaaaagat

SEQ ID NO: 6622656 - DNA, 16 bp, Homo sapiens
agaaaaaaaaactggg

SEQ ID NO: 6622657 - DNA, 17 bp, Homo sapiens
agaaaaaaaaagaaaaa

SEQ ID NO: 6622658 - DNA, 18 bp, Homo sapiens
agaaaaaaaaagaaaaaa

SEQ ID NO: 6622659 - DNA, 19 bp, Homo sapiens
agaaaaaaaaagaaaaaaa

SEQ ID NO: 6622660 - DNA, 22 bp, Homo sapiens
agaaaaaaaaagcaaatcagaa

SEQ ID NO: 6622661 - DNA, 14 bp, Homo sapiens
agaaaaaaaaataa

SEQ ID NO: 6622662 - DNA, 19 bp, Homo sapiens
agaaaaaaaaattcacatg

SEQ ID NO: 6622663 - DNA, 17 bp, Homo sapiens
agaaaaaaaaccttgta

SEQ ID NO: 6622664 - DNA, 18 bp, Homo sapiens
agaaaaaaaactgaagat

SEQ ID NO: 6622665 - DNA, 17 bp, Homo sapiens
agaaaaaaaataacaca

SEQ ID NO: 6622666 - DNA, 18 bp, Homo sapiens
agaaaaaaacattctatc

SEQ ID NO: 6622667 - DNA, 12 bp, Homo sapiens
agaaaaaaacca

SEQ ID NO: 6622668 - DNA, 15 bp, Homo sapiens
agaaaaaaaccaaag

SEQ ID NO: 6622669 - DNA, 17 bp, Homo sapiens
agaaaaaaaccaaagta

SEQ ID NO: 6622670 - DNA, 12 bp, Homo sapiens
agaaaaaaacga

SEQ ID NO: 6622671 - DNA, 16 bp, Homo sapiens
agaaaaaaacttactg

SEQ ID NO: 6622672 - DNA, 12 bp, Homo sapiens
agaaaaaaagaa

SEQ ID NO: 6622673 - DNA, 14 bp, Homo sapiens
agaaaaaaagaaaa

SEQ ID NO: 6622674 - DNA, 20 bp, Homo sapiens
agaaaaaaagaaaaaaaaag

SEQ ID NO: 6622675 - DNA, 17 bp, Homo sapiens
agaaaaaaagggagaat

SEQ ID NO: 6622676 - DNA, 23 bp, Homo sapiens
agaaaaaaagtatttaatttgga

SEQ ID NO: 6622677 - DNA, 20 bp, Homo sapiens
agaaaaaaatataaaatttc

SEQ ID NO: 6622678 - DNA, 15 bp, Homo sapiens
agaaaaaaatatatt

SEQ ID NO: 6622679 - DNA, 17 bp, Homo sapiens
agaaaaaaatcttctcc

SEQ ID NO: 6622680 - DNA, 13 bp, Homo sapiens
agaaaaaaatgtc

SEQ ID NO: 6622681 - DNA, 19 bp, Homo sapiens
agaaaaaaatgtcaaaagt

SEQ ID NO: 6622682 - DNA, 19 bp, Homo sapiens
agaaaaaaattactaattt

SEQ ID NO: 6622683 - DNA, 20 bp, Homo sapiens
agaaaaaaattgctctgtgt

SEQ ID NO: 6622684 - DNA, 12 bp, Homo sapiens
agaaaaaagaag

SEQ ID NO: 6622685 - DNA, 14 bp, Homo sapiens
agaaaaaagaatgt

SEQ ID NO: 6622686 - DNA, 22 bp, Homo sapiens
agaaaaaagaatgtcagaaaaa

SEQ ID NO: 6622687 - DNA, 17 bp, Homo sapiens
agaaaaaagagaaaaga

SEQ ID NO: 6622688 - DNA, 13 bp, Homo sapiens
agaaaaaagcaat

SEQ ID NO: 6622689 - DNA, 12 bp, Homo sapiens
agaaaaaaggac

SEQ ID NO: 6622690 - DNA, 10 bp, Homo sapiens
agaaaaaagt

SEQ ID NO: 6622691 - DNA, 17 bp, Homo sapiens
agaaaaaagtagcaaat

SEQ ID NO: 6622692 - DNA, 17 bp, Homo sapiens
agaaaaaagtccttcag

SEQ ID NO: 6622693 - DNA, 20 bp, Homo sapiens
agaaaaaagtgcaacttgag

SEQ ID NO: 6622694 - DNA, 22 bp, Homo sapiens
agaaaaaagtgtttataatgca

SEQ ID NO: 6622695 - DNA, 14 bp, Homo sapiens
agaaaaaataaatg

SEQ ID NO: 6622696 - DNA, 15 bp, Homo sapiens
agaaaaaataaatgg

SEQ ID NO: 6622697 - DNA, 16 bp, Homo sapiens
agaaaaaataaatgga

SEQ ID NO: 6622698 - DNA, 14 bp, Homo sapiens
agaaaaaatacatt

SEQ ID NO: 6622699 - DNA, 15 bp, Homo sapiens
agaaaaaatattgta

SEQ ID NO: 6622700 - DNA, 18 bp, Homo sapiens
agaaaaaatggcaagaga

SEQ ID NO: 6622701 - DNA, 21 bp, Homo sapiens
agaaaaaatgtagaatgattt

SEQ ID NO: 6622702 - DNA, 22 bp, Homo sapiens
agaaaaaattccctcatttaaa

SEQ ID NO: 6622703 - DNA, 13 bp, Homo sapiens
agaaaaaatttta

SEQ ID NO: 6622704 - DNA, 22 bp, Homo sapiens
agaaaaacactgagaaaaagca

SEQ ID NO: 6622705 - DNA, 16 bp, Homo sapiens
agaaaaacagacaaaa

SEQ ID NO: 6622706 - DNA, 13 bp, Homo sapiens
agaaaaacaggca

SEQ ID NO: 6622707 - DNA, 15 bp, Homo sapiens
agaaaaacatgtcat

SEQ ID NO: 6622708 - DNA, 17 bp, Homo sapiens
agaaaaacatttaaact

SEQ ID NO: 6622709 - DNA, 20 bp, Homo sapiens
agaaaaaccaatgattcata

SEQ ID NO: 6622710 - DNA, 19 bp, Homo sapiens
agaaaaacctgctcccttc

SEQ ID NO: 6622711 - DNA, 14 bp, Homo sapiens
agaaaaagaaatgc

SEQ ID NO: 6622712 - DNA, 15 bp, Homo sapiens
agaaaaagaaatgca

SEQ ID NO: 6622713 - DNA, 11 bp, Homo sapiens
agaaaaagaag

SEQ ID NO: 6622714 - DNA, 13 bp, Homo sapiens
agaaaaagaagaa

SEQ ID NO: 6622715 - DNA, 14 bp, Homo sapiens
agaaaaagaagaaa

SEQ ID NO: 6622716 - DNA, 17 bp, Homo sapiens
agaaaaagaagaaaaga

SEQ ID NO: 6622717 - DNA, 19 bp, Homo sapiens
agaaaaagacctgcatttg

SEQ ID NO: 6622718 - DNA, 17 bp, Homo sapiens
agaaaaagataagaaat

SEQ ID NO: 6622719 - DNA, 12 bp, Homo sapiens
agaaaaagatat

SEQ ID NO: 6622720 - DNA, 12 bp, Homo sapiens
agaaaaagcaaa

SEQ ID NO: 6622721 - DNA, 16 bp, Homo sapiens
agaaaaagcaaaaggc

SEQ ID NO: 6622722 - DNA, 18 bp, Homo sapiens
agaaaaagcaagtgttca

SEQ ID NO: 6622723 - DNA, 15 bp, Homo sapiens
agaaaaagccctctt

SEQ ID NO: 6622724 - DNA, 21 bp, Homo sapiens
agaaaaaggatggaagaaaga

SEQ ID NO: 6622725 - DNA, 22 bp, Homo sapiens
agaaaaaggatggaagaaagaa

SEQ ID NO: 6622726 - DNA, 19 bp, Homo sapiens
agaaaaaggctgaaaagaa

SEQ ID NO: 6622727 - DNA, 14 bp, Homo sapiens
agaaaaagggtcaa

SEQ ID NO: 6622728 - DNA, 19 bp, Homo sapiens
agaaaaataaaaatctctt

SEQ ID NO: 6622729 - DNA, 16 bp, Homo sapiens
agaaaaataaatggaa

SEQ ID NO: 6622730 - DNA, 15 bp, Homo sapiens
agaaaaataaccctt

SEQ ID NO: 6622731 - DNA, 17 bp, Homo sapiens
agaaaaatagagcaaaa

SEQ ID NO: 6622732 - DNA, 17 bp, Homo sapiens
agaaaaatatgagagaa

SEQ ID NO: 6622733 - DNA, 18 bp, Homo sapiens
agaaaaatattcaagtaa

SEQ ID NO: 6622734 - DNA, 17 bp, Homo sapiens
agaaaaatcaatcattt

SEQ ID NO: 6622735 - DNA, 14 bp, Homo sapiens
agaaaaatcagttt

SEQ ID NO: 6622736 - DNA, 15 bp, Homo sapiens
agaaaaatcccagcc

SEQ ID NO: 6622737 - DNA, 14 bp, Homo sapiens
agaaaaatctcatt

SEQ ID NO: 6622738 - DNA, 23 bp, Homo sapiens
agaaaaatcttgtgctagaatac

SEQ ID NO: 6622739 - DNA, 21 bp, Homo sapiens
agaaaaatgagcatacatctt

SEQ ID NO: 6622740 - DNA, 18 bp, Homo sapiens
agaaaaatgagcctggca

SEQ ID NO: 6622741 - DNA, 13 bp, Homo sapiens
agaaaaatgatgt

SEQ ID NO: 6622742 - DNA, 13 bp, Homo sapiens
agaaaaatgcttt

SEQ ID NO: 6622743 - DNA, 19 bp, Homo sapiens
agaaaaatgtgtattttaa

SEQ ID NO: 6622744 - DNA, 13 bp, Homo sapiens
agaaaaatgttct

SEQ ID NO: 6622745 - DNA, 15 bp, Homo sapiens
agaaaaattattgta

SEQ ID NO: 6622746 - DNA, 15 bp, Homo sapiens
agaaaaattgtttcc

SEQ ID NO: 6622747 - DNA, 24 bp, Homo sapiens
agaaaaattgtttccaaagtgcat

SEQ ID NO: 6622748 - DNA, 19 bp, Homo sapiens
agaaaaatttacatggcaa

SEQ ID NO: 6622749 - DNA, 13 bp, Homo sapiens
agaaaacaaaact

SEQ ID NO: 6622750 - DNA, 21 bp, Homo sapiens
agaaaacaaactcttttttaa

SEQ ID NO: 6622751 - DNA, 22 bp, Homo sapiens
agaaaacaacttggcatttcta

SEQ ID NO: 6622752 - DNA, 23 bp, Homo sapiens
agaaaacaacttggcatttctat

SEQ ID NO: 6622753 - DNA, 13 bp, Homo sapiens
agaaaacaagaga

SEQ ID NO: 6622754 - DNA, 22 bp, Homo sapiens
agaaaacaagcaagttctgaga

SEQ ID NO: 6622755 - DNA, 15 bp, Homo sapiens
agaaaacaatggggc

SEQ ID NO: 6622756 - DNA, 23 bp, Homo sapiens
agaaaacaattgttctgggtgat

SEQ ID NO: 6622757 - DNA, 20 bp, Homo sapiens
agaaaacaccatggagatga

SEQ ID NO: 6622758 - DNA, 23 bp, Homo sapiens
agaaaacacttaaaatgatcatt

SEQ ID NO: 6622759 - DNA, 12 bp, Homo sapiens
agaaaacagaaa

SEQ ID NO: 6622760 - DNA, 12 bp, Homo sapiens
agaaaacagaga

SEQ ID NO: 6622761 - DNA, 12 bp, Homo sapiens
agaaaacagcaa

SEQ ID NO: 6622762 - DNA, 15 bp, Homo sapiens
agaaaacatgcctct

SEQ ID NO: 6622763 - DNA, 22 bp, Homo sapiens
agaaaacattcatccagttgca

SEQ ID NO: 6622764 - DNA, 11 bp, Homo sapiens
agaaaacattg

SEQ ID NO: 6622765 - DNA, 15 bp, Homo sapiens
agaaaacattgttcc

SEQ ID NO: 6622766 - DNA, 17 bp, Homo sapiens
agaaaacatttaacata

SEQ ID NO: 6622767 - DNA, 19 bp, Homo sapiens
agaaaacatttaacataat

SEQ ID NO: 6622768 - DNA, 16 bp, Homo sapiens
agaaaaccaaaataaa

SEQ ID NO: 6622769 - DNA, 16 bp, Homo sapiens
agaaaaccagctcagc

SEQ ID NO: 6622770 - DNA, 20 bp, Homo sapiens
agaaaaccagctcagcactg

SEQ ID NO: 6622771 - DNA, 22 bp, Homo sapiens
agaaaaccagtctgtgtttaca

SEQ ID NO: 6622772 - DNA, 16 bp, Homo sapiens
agaaaaccattttagt

SEQ ID NO: 6622773 - DNA, 17 bp, Homo sapiens
agaaaacccaagttttt

SEQ ID NO: 6622774 - DNA, 22 bp, Homo sapiens
agaaaacccacggtttttcttt

SEQ ID NO: 6622775 - DNA, 23 bp, Homo sapiens
agaaaacccacggtttttctttt

SEQ ID NO: 6622776 - DNA, 13 bp, Homo sapiens
agaaaacccctcc

SEQ ID NO: 6622777 - DNA, 16 bp, Homo sapiens
agaaaacccctcccac

SEQ ID NO: 6622778 - DNA, 22 bp, Homo sapiens
agaaaacccttgggccagaagt

SEQ ID NO: 6622779 - DNA, 14 bp, Homo sapiens
agaaaaccgagaat

SEQ ID NO: 6622780 - DNA, 21 bp, Homo sapiens
agaaaacctaattaaggaagt

SEQ ID NO: 6622781 - DNA, 14 bp, Homo sapiens
agaaaacctccagt

SEQ ID NO: 6622782 - DNA, 15 bp, Homo sapiens
agaaaacctgtattt

SEQ ID NO: 6622783 - DNA, 22 bp, Homo sapiens
agaaaacgaagtctttttcatt

SEQ ID NO: 6622784 - DNA, 16 bp, Homo sapiens
agaaaacgcacctcca

SEQ ID NO: 6622785 - DNA, 19 bp, Homo sapiens
agaaaacgcacctccatcc

SEQ ID NO: 6622786 - DNA, 20 bp, Homo sapiens
agaaaactaggcaatgtact

SEQ ID NO: 6622787 - DNA, 22 bp, Homo sapiens
agaaaactccagggtcccctgc

SEQ ID NO: 6622788 - DNA, 15 bp, Homo sapiens
agaaaactgaaaatc

SEQ ID NO: 6622789 - DNA, 22 bp, Homo sapiens
agaaaactggaaatctggattt

SEQ ID NO: 6622790 - DNA, 16 bp, Homo sapiens
agaaaactgtgatttc

SEQ ID NO: 6622791 - DNA, 22 bp, Homo sapiens
agaaaactgtggttaaagattt

SEQ ID NO: 6622792 - DNA, 21 bp, Homo sapiens
agaaaacttcgtaagaacatg

SEQ ID NO: 6622793 - DNA, 14 bp, Homo sapiens
agaaaacttctttt

SEQ ID NO: 6622794 - DNA, 14 bp, Homo sapiens
agaaaacttgcctt

SEQ ID NO: 6622795 - DNA, 19 bp, Homo sapiens
agaaaacttgtattatgtg

SEQ ID NO: 6622796 - DNA, 16 bp, Homo sapiens
agaaaacttttgttta

SEQ ID NO: 6622797 - DNA, 15 bp, Homo sapiens
agaaaagaaaaatat

SEQ ID NO: 6622798 - DNA, 15 bp, Homo sapiens
agaaaagaaaacatt

SEQ ID NO: 6622799 - DNA, 16 bp, Homo sapiens
agaaaagaaaaccatt

SEQ ID NO: 6622800 - DNA, 18 bp, Homo sapiens
agaaaagaaagctgcttt

SEQ ID NO: 6622801 - DNA, 18 bp, Homo sapiens
agaaaagaaatggtatgt

SEQ ID NO: 6622802 - DNA, 20 bp, Homo sapiens
agaaaagaacgtattttaaa

SEQ ID NO: 6622803 - DNA, 15 bp, Homo sapiens
agaaaagaactgctt

SEQ ID NO: 6622804 - DNA, 17 bp, Homo sapiens
agaaaagaactggaaac

SEQ ID NO: 6622805 - DNA, 16 bp, Homo sapiens
agaaaagaagtgaagt

SEQ ID NO: 6622806 - DNA, 23 bp, Homo sapiens
agaaaagacagggtgggagggag

SEQ ID NO: 6622807 - DNA, 14 bp, Homo sapiens
agaaaagacatttt

SEQ ID NO: 6622808 - DNA, 13 bp, Homo sapiens
agaaaagaccctg

SEQ ID NO: 6622809 - DNA, 19 bp, Homo sapiens
agaaaagacggatggcagg

SEQ ID NO: 6622810 - DNA, 15 bp, Homo sapiens
agaaaagactgacct

SEQ ID NO: 6622811 - DNA, 14 bp, Homo sapiens
agaaaagacttttg

SEQ ID NO: 6622812 - DNA, 9 bp, Homo sapiens
agaaaagag

SEQ ID NO: 6622813 - DNA, 14 bp, Homo sapiens
agaaaagagaagaa

SEQ ID NO: 6622814 - DNA, 17 bp, Homo sapiens
agaaaagagaagaaaga

SEQ ID NO: 6622815 - DNA, 15 bp, Homo sapiens
agaaaagagaagaag

SEQ ID NO: 6622816 - DNA, 20 bp, Homo sapiens
agaaaagagaagaagaaaaa

SEQ ID NO: 6622817 - DNA, 18 bp, Homo sapiens
agaaaagaggagaccctg

SEQ ID NO: 6622818 - DNA, 17 bp, Homo sapiens
agaaaagataaagatga

SEQ ID NO: 6622819 - DNA, 20 bp, Homo sapiens
agaaaagatacgactttatt

SEQ ID NO: 6622820 - DNA, 13 bp, Homo sapiens
agaaaagatatgt

SEQ ID NO: 6622821 - DNA, 19 bp, Homo sapiens
agaaaagatgagaggcaga

SEQ ID NO: 6622822 - DNA, 21 bp, Homo sapiens
agaaaagattaaaattagtga

SEQ ID NO: 6622823 - DNA, 16 bp, Homo sapiens
agaaaagattcttctt

SEQ ID NO: 6622824 - DNA, 12 bp, Homo sapiens
agaaaagatttt

SEQ ID NO: 6622825 - DNA, 17 bp, Homo sapiens
agaaaagcaatactgtt

SEQ ID NO: 6622826 - DNA, 16 bp, Homo sapiens
agaaaagcacaatcaa

SEQ ID NO: 6622827 - DNA, 12 bp, Homo sapiens
agaaaagcacac

SEQ ID NO: 6622828 - DNA, 13 bp, Homo sapiens
agaaaagcacctc

SEQ ID NO: 6622829 - DNA, 15 bp, Homo sapiens
agaaaagcacttaaa

SEQ ID NO: 6622830 - DNA, 16 bp, Homo sapiens
agaaaagcacttttgt

SEQ ID NO: 6622831 - DNA, 17 bp, Homo sapiens
agaaaagcacttttgtt

SEQ ID NO: 6622832 - DNA, 20 bp, Homo sapiens
agaaaagcacttttgttatt

SEQ ID NO: 6622833 - DNA, 20 bp, Homo sapiens
agaaaagcagtcccattcat

SEQ ID NO: 6622834 - DNA, 13 bp, Homo sapiens
agaaaagccaagc

SEQ ID NO: 6622835 - DNA, 13 bp, Homo sapiens
agaaaagccgaaa

SEQ ID NO: 6622836 - DNA, 19 bp, Homo sapiens
agaaaagcctaatcacagt

SEQ ID NO: 6622837 - DNA, 15 bp, Homo sapiens
agaaaagcctcagct

SEQ ID NO: 6622838 - DNA, 23 bp, Homo sapiens
agaaaagcgcgttgtgtatatta

SEQ ID NO: 6622839 - DNA, 13 bp, Homo sapiens
agaaaagcttgga

SEQ ID NO: 6622840 - DNA, 14 bp, Homo sapiens
agaaaagctttgaa

SEQ ID NO: 6622841 - DNA, 13 bp, Homo sapiens
agaaaaggaaaag

SEQ ID NO: 6622842 - DNA, 15 bp, Homo sapiens
agaaaaggaaaagaa

SEQ ID NO: 6622843 - DNA, 17 bp, Homo sapiens
agaaaaggaaaagaaaa

SEQ ID NO: 6622844 - DNA, 17 bp, Homo sapiens
agaaaaggaatgcaaga

SEQ ID NO: 6622845 - DNA, 19 bp, Homo sapiens
agaaaaggaatgcaagaga

SEQ ID NO: 6622846 - DNA, 13 bp, Homo sapiens
agaaaaggagggg

SEQ ID NO: 6622847 - DNA, 21 bp, Homo sapiens
agaaaaggagtcaagaacaat

SEQ ID NO: 6622848 - DNA, 16 bp, Homo sapiens
agaaaaggattttgga

SEQ ID NO: 6622849 - DNA, 22 bp, Homo sapiens
agaaaaggattttggaaactca

SEQ ID NO: 6622850 - DNA, 13 bp, Homo sapiens
agaaaaggcaaaa

SEQ ID NO: 6622851 - DNA, 12 bp, Homo sapiens
agaaaaggcagc

SEQ ID NO: 6622852 - DNA, 16 bp, Homo sapiens
agaaaaggcagccaga

SEQ ID NO: 6622853 - DNA, 21 bp, Homo sapiens
agaaaaggctggagagagatt

SEQ ID NO: 6622854 - DNA, 13 bp, Homo sapiens
agaaaaggtcttg

SEQ ID NO: 6622855 - DNA, 16 bp, Homo sapiens
agaaaaggtgataaaa

SEQ ID NO: 6622856 - DNA, 21 bp, Homo sapiens
agaaaaggtgataaaatcata

SEQ ID NO: 6622857 - DNA, 20 bp, Homo sapiens
agaaaaggttatcttaaata

SEQ ID NO: 6622858 - DNA, 15 bp, Homo sapiens
agaaaagtaagccct

SEQ ID NO: 6622859 - DNA, 13 bp, Homo sapiens
agaaaagtaatga

SEQ ID NO: 6622860 - DNA, 20 bp, Homo sapiens
agaaaagtaatgaagaatca

SEQ ID NO: 6622861 - DNA, 15 bp, Homo sapiens
agaaaagtaattttg

SEQ ID NO: 6622862 - DNA, 19 bp, Homo sapiens
agaaaagtagacaatcatt

SEQ ID NO: 6622863 - DNA, 15 bp, Homo sapiens
agaaaagtatgttct

SEQ ID NO: 6622864 - DNA, 21 bp, Homo sapiens
agaaaagtatgttctaacctt

SEQ ID NO: 6622865 - DNA, 17 bp, Homo sapiens
agaaaagtattttgaag

SEQ ID NO: 6622866 - DNA, 12 bp, Homo sapiens
agaaaagtgaat

SEQ ID NO: 6622867 - DNA, 14 bp, Homo sapiens
agaaaagtgaattg

SEQ ID NO: 6622868 - DNA, 21 bp, Homo sapiens
agaaaagtgcttagaaagtta

SEQ ID NO: 6622869 - DNA, 14 bp, Homo sapiens
agaaaagtgggctg

SEQ ID NO: 6622870 - DNA, 15 bp, Homo sapiens
agaaaagtgggctgc

SEQ ID NO: 6622871 - DNA, 21 bp, Homo sapiens
agaaaagtgtaatgcaagaat

SEQ ID NO: 6622872 - DNA, 20 bp, Homo sapiens
agaaaagttcttaaaacact

SEQ ID NO: 6622873 - DNA, 18 bp, Homo sapiens
agaaaagttgaattttac

SEQ ID NO: 6622874 - DNA, 15 bp, Homo sapiens
agaaaagttgcagat

SEQ ID NO: 6622875 - DNA, 15 bp, Homo sapiens
agaaaagtttgtttt

SEQ ID NO: 6622876 - DNA, 12 bp, Homo sapiens
agaaaataaaaa

SEQ ID NO: 6622877 - DNA, 16 bp, Homo sapiens
agaaaataaaaaaaag

SEQ ID NO: 6622878 - DNA, 17 bp, Homo sapiens
agaaaataaaaaaaaga

SEQ ID NO: 6622879 - DNA, 19 bp, Homo sapiens
agaaaataaaaaaaagaaa

SEQ ID NO: 6622880 - DNA, 20 bp, Homo sapiens
agaaaataaaaaaaagaaaa

SEQ ID NO: 6622881 - DNA, 21 bp, Homo sapiens
agaaaataaaaaaaagaaaaa

SEQ ID NO: 6622882 - DNA, 22 bp, Homo sapiens
agaaaataaaaaaaagaaaaaa

SEQ ID NO: 6622883 - DNA, 15 bp, Homo sapiens
agaaaataaaaagtt

SEQ ID NO: 6622884 - DNA, 21 bp, Homo sapiens
agaaaataaaggaaaatgact

SEQ ID NO: 6622885 - DNA, 14 bp, Homo sapiens
agaaaataacaata

SEQ ID NO: 6622886 - DNA, 19 bp, Homo sapiens
agaaaataatggagaatca

SEQ ID NO: 6622887 - DNA, 22 bp, Homo sapiens
agaaaataatggagaatcactt

SEQ ID NO: 6622888 - DNA, 18 bp, Homo sapiens
agaaaataattctctatt

SEQ ID NO: 6622889 - DNA, 15 bp, Homo sapiens
agaaaatacaataaa

SEQ ID NO: 6622890 - DNA, 13 bp, Homo sapiens
agaaaatacatta

SEQ ID NO: 6622891 - DNA, 15 bp, Homo sapiens
agaaaataccaagga

SEQ ID NO: 6622892 - DNA, 18 bp, Homo sapiens
agaaaatacttaaatgtt

SEQ ID NO: 6622893 - DNA, 19 bp, Homo sapiens
agaaaatagagatgagctt

SEQ ID NO: 6622894 - DNA, 14 bp, Homo sapiens
agaaaatagctttt

SEQ ID NO: 6622895 - DNA, 17 bp, Homo sapiens
agaaaatagcttttatt

SEQ ID NO: 6622896 - DNA, 18 bp, Homo sapiens
agaaaatagggtggacag

SEQ ID NO: 6622897 - DNA, 17 bp, Homo sapiens
agaaaatataaatgcat

SEQ ID NO: 6622898 - DNA, 16 bp, Homo sapiens
agaaaatataaatggt

SEQ ID NO: 6622899 - DNA, 12 bp, Homo sapiens
agaaaatataag

SEQ ID NO: 6622900 - DNA, 16 bp, Homo sapiens
agaaaatataataaaa

SEQ ID NO: 6622901 - DNA, 12 bp, Homo sapiens
agaaaatatact

SEQ ID NO: 6622902 - DNA, 13 bp, Homo sapiens
agaaaatatactg

SEQ ID NO: 6622903 - DNA, 14 bp, Homo sapiens
agaaaatatactgt

SEQ ID NO: 6622904 - DNA, 20 bp, Homo sapiens
agaaaatatcactgtaatga

SEQ ID NO: 6622905 - DNA, 14 bp, Homo sapiens
agaaaatatgtatt

SEQ ID NO: 6622906 - DNA, 23 bp, Homo sapiens
agaaaatattatgtgtttccata

SEQ ID NO: 6622907 - DNA, 14 bp, Homo sapiens
agaaaatattctaa

SEQ ID NO: 6622908 - DNA, 14 bp, Homo sapiens
agaaaatattctct

SEQ ID NO: 6622909 - DNA, 18 bp, Homo sapiens
agaaaatattttgtctaa

SEQ ID NO: 6622910 - DNA, 22 bp, Homo sapiens
agaaaatattttgtctaaaatg

SEQ ID NO: 6622911 - DNA, 23 bp, Homo sapiens
agaaaatcaagcaggttagagaa

SEQ ID NO: 6622912 - DNA, 16 bp, Homo sapiens
agaaaatcaggctggc

SEQ ID NO: 6622913 - DNA, 22 bp, Homo sapiens
agaaaatcagttgattaagtta

SEQ ID NO: 6622914 - DNA, 18 bp, Homo sapiens
agaaaatcctaactttca

SEQ ID NO: 6622915 - DNA, 16 bp, Homo sapiens
agaaaatctgcatgtt

SEQ ID NO: 6622916 - DNA, 23 bp, Homo sapiens
agaaaatcttcatggaattcaca

SEQ ID NO: 6622917 - DNA, 11 bp, Homo sapiens
agaaaatcttt

SEQ ID NO: 6622918 - DNA, 13 bp, Homo sapiens
agaaaatgaaaag

SEQ ID NO: 6622919 - DNA, 14 bp, Homo sapiens
agaaaatgaaagaa

SEQ ID NO: 6622920 - DNA, 17 bp, Homo sapiens
agaaaatgaaaggtagt

SEQ ID NO: 6622921 - DNA, 16 bp, Homo sapiens
agaaaatgaactgccc

SEQ ID NO: 6622922 - DNA, 14 bp, Homo sapiens
agaaaatgaagaaa

SEQ ID NO: 6622923 - DNA, 21 bp, Homo sapiens
agaaaatgaatttgactggtt

SEQ ID NO: 6622924 - DNA, 19 bp, Homo sapiens
agaaaatgaattttttcca

SEQ ID NO: 6622925 - DNA, 20 bp, Homo sapiens
agaaaatgacttatttctgc

SEQ ID NO: 6622926 - DNA, 15 bp, Homo sapiens
agaaaatgactttat

SEQ ID NO: 6622927 - DNA, 19 bp, Homo sapiens
agaaaatgagccatttttt

SEQ ID NO: 6622928 - DNA, 20 bp, Homo sapiens
agaaaatgatgagtttttat

SEQ ID NO: 6622929 - DNA, 13 bp, Homo sapiens
agaaaatgcaatt

SEQ ID NO: 6622930 - DNA, 17 bp, Homo sapiens
agaaaatgcacctcatt

SEQ ID NO: 6622931 - DNA, 14 bp, Homo sapiens
agaaaatgcaggag

SEQ ID NO: 6622932 - DNA, 15 bp, Homo sapiens
agaaaatgcaggaga

SEQ ID NO: 6622933 - DNA, 18 bp, Homo sapiens
agaaaatgcattatttag

SEQ ID NO: 6622934 - DNA, 16 bp, Homo sapiens
agaaaatgctagaaga

SEQ ID NO: 6622935 - DNA, 22 bp, Homo sapiens
agaaaatgctttctcatgcata

SEQ ID NO: 6622936 - DNA, 15 bp, Homo sapiens
agaaaatggaaagaa

SEQ ID NO: 6622937 - DNA, 17 bp, Homo sapiens
agaaaatggaaagaagg

SEQ ID NO: 6622938 - DNA, 18 bp, Homo sapiens
agaaaatggaaagaagga

SEQ ID NO: 6622939 - DNA, 19 bp, Homo sapiens
agaaaatggaaccaggctt

SEQ ID NO: 6622940 - DNA, 23 bp, Homo sapiens
agaaaatggaagacagctcttat

SEQ ID NO: 6622941 - DNA, 19 bp, Homo sapiens
agaaaatggaattactcca

SEQ ID NO: 6622942 - DNA, 15 bp, Homo sapiens
agaaaatggacactg

SEQ ID NO: 6622943 - DNA, 23 bp, Homo sapiens
agaaaatggacgtgttatgactc

SEQ ID NO: 6622944 - DNA, 23 bp, Homo sapiens
agaaaatggatgacaaagaaaat

SEQ ID NO: 6622945 - DNA, 22 bp, Homo sapiens
agaaaatggctaataaactgta

SEQ ID NO: 6622946 - DNA, 22 bp, Homo sapiens
agaaaatggctttaatcaattc

SEQ ID NO: 6622947 - DNA, 23 bp, Homo sapiens
agaaaatggggcttgccctgggt

SEQ ID NO: 6622948 - DNA, 18 bp, Homo sapiens
agaaaatgtaaaggaggg

SEQ ID NO: 6622949 - DNA, 19 bp, Homo sapiens
agaaaatgtaaaggaggga

SEQ ID NO: 6622950 - DNA, 19 bp, Homo sapiens
agaaaatgtaaataaagga

SEQ ID NO: 6622951 - DNA, 22 bp, Homo sapiens
agaaaatgtcagtagtgctaat

SEQ ID NO: 6622952 - DNA, 16 bp, Homo sapiens
agaaaatgttatttaa

SEQ ID NO: 6622953 - DNA, 18 bp, Homo sapiens
agaaaatgttatttaaca

SEQ ID NO: 6622954 - DNA, 16 bp, Homo sapiens
agaaaatgttcttcca

SEQ ID NO: 6622955 - DNA, 17 bp, Homo sapiens
agaaaatgttgagaatc

SEQ ID NO: 6622956 - DNA, 22 bp, Homo sapiens
agaaaattaagggccgatttaa

SEQ ID NO: 6622957 - DNA, 12 bp, Homo sapiens
agaaaattaatt

SEQ ID NO: 6622958 - DNA, 14 bp, Homo sapiens
agaaaattagtaat

SEQ ID NO: 6622959 - DNA, 17 bp, Homo sapiens
agaaaattatattctgt

SEQ ID NO: 6622960 - DNA, 20 bp, Homo sapiens
agaaaattatattctgttta

SEQ ID NO: 6622961 - DNA, 16 bp, Homo sapiens
agaaaattatgcagct

SEQ ID NO: 6622962 - DNA, 12 bp, Homo sapiens
agaaaattcaat

SEQ ID NO: 6622963 - DNA, 15 bp, Homo sapiens
agaaaattcaattgt

SEQ ID NO: 6622964 - DNA, 18 bp, Homo sapiens
agaaaattcaattgtaaa

SEQ ID NO: 6622965 - DNA, 14 bp, Homo sapiens
agaaaattcaggtc

SEQ ID NO: 6622966 - DNA, 15 bp, Homo sapiens
agaaaattcaggtct

SEQ ID NO: 6622967 - DNA, 20 bp, Homo sapiens
agaaaattctaatgattggc

SEQ ID NO: 6622968 - DNA, 14 bp, Homo sapiens
agaaaattctcaag

SEQ ID NO: 6622969 - DNA, 20 bp, Homo sapiens
agaaaattgaatttaacaat

SEQ ID NO: 6622970 - DNA, 22 bp, Homo sapiens
agaaaattgaatttaacaatgc

SEQ ID NO: 6622971 - DNA, 15 bp, Homo sapiens
agaaaattgatattt

SEQ ID NO: 6622972 - DNA, 15 bp, Homo sapiens
agaaaattgccaaaa

SEQ ID NO: 6622973 - DNA, 21 bp, Homo sapiens
agaaaattggaactctactca

SEQ ID NO: 6622974 - DNA, 23 bp, Homo sapiens
agaaaattgtctgggttccaaaa

SEQ ID NO: 6622975 - DNA, 12 bp, Homo sapiens
agaaaattgttt

SEQ ID NO: 6622976 - DNA, 12 bp, Homo sapiens
agaaaatttaat

SEQ ID NO: 6622977 - DNA, 21 bp, Homo sapiens
agaaaatttaataacttttta

SEQ ID NO: 6622978 - DNA, 15 bp, Homo sapiens
agaaaatttaattat

SEQ ID NO: 6622979 - DNA, 12 bp, Homo sapiens
agaaaatttaca

SEQ ID NO: 6622980 - DNA, 15 bp, Homo sapiens
agaaaatttagccct

SEQ ID NO: 6622981 - DNA, 20 bp, Homo sapiens
agaaaatttagccctttaaa

SEQ ID NO: 6622982 - DNA, 21 bp, Homo sapiens
agaaaatttgaagtaaaggat

SEQ ID NO: 6622983 - DNA, 22 bp, Homo sapiens
agaaaatttgcaacatataaag

SEQ ID NO: 6622984 - DNA, 18 bp, Homo sapiens
agaaaatttgctttaatt

SEQ ID NO: 6622985 - DNA, 14 bp, Homo sapiens
agaaaattttgcag

SEQ ID NO: 6622986 - DNA, 15 bp, Homo sapiens
agaaaattttgcaga

SEQ ID NO: 6622987 - DNA, 13 bp, Homo sapiens
agaaaattttgta

SEQ ID NO: 6622988 - DNA, 18 bp, Homo sapiens
agaaaattttgtaaaaca

SEQ ID NO: 6622989 - DNA, 21 bp, Homo sapiens
agaaaattttgtattaatttc

SEQ ID NO: 6622990 - DNA, 23 bp, Homo sapiens
agaaaatttttgtctttcatgga

SEQ ID NO: 6622991 - DNA, 16 bp, Homo sapiens
agaaacaaacaaaact

SEQ ID NO: 6622992 - DNA, 13 bp, Homo sapiens
agaaacaaagatg

SEQ ID NO: 6622993 - DNA, 13 bp, Homo sapiens
agaaacaaagcaa

SEQ ID NO: 6622994 - DNA, 18 bp, Homo sapiens
agaaacaacaatttctac

SEQ ID NO: 6622995 - DNA, 14 bp, Homo sapiens
agaaacaacactgt

SEQ ID NO: 6622996 - DNA, 17 bp, Homo sapiens
agaaacaagctgtgcag

SEQ ID NO: 6622997 - DNA, 22 bp, Homo sapiens
agaaacaagtattttgctatat

SEQ ID NO: 6622998 - DNA, 22 bp, Homo sapiens
agaaacaagtggacctcgtccc

SEQ ID NO: 6622999 - DNA, 14 bp, Homo sapiens
agaaacaataaaga

SEQ ID NO: 6623000 - DNA, 15 bp, Homo sapiens
agaaacaataaagag

SEQ ID NO: 6623001 - DNA, 17 bp, Homo sapiens
agaaacaataaagagat

SEQ ID NO: 6623002 - DNA, 15 bp, Homo sapiens
agaaacaatactgtt

SEQ ID NO: 6623003 - DNA, 16 bp, Homo sapiens
agaaacaatactgttc

SEQ ID NO: 6623004 - DNA, 21 bp, Homo sapiens
agaaacaatatttaaccaaag

SEQ ID NO: 6623005 - DNA, 12 bp, Homo sapiens
agaaacaatcta

SEQ ID NO: 6623006 - DNA, 13 bp, Homo sapiens
agaaacaatttct

SEQ ID NO: 6623007 - DNA, 10 bp, Homo sapiens
agaaacacaa

SEQ ID NO: 6623008 - DNA, 19 bp, Homo sapiens
agaaacacacttttgcaca

SEQ ID NO: 6623009 - DNA, 13 bp, Homo sapiens
agaaacacagcat

SEQ ID NO: 6623010 - DNA, 22 bp, Homo sapiens
agaaacacagggttttgtattc

SEQ ID NO: 6623011 - DNA, 15 bp, Homo sapiens
agaaacacagttttg

SEQ ID NO: 6623012 - DNA, 13 bp, Homo sapiens
agaaacacataac

SEQ ID NO: 6623013 - DNA, 16 bp, Homo sapiens
agaaacacattcttat

SEQ ID NO: 6623014 - DNA, 18 bp, Homo sapiens
agaaacaccacttaatct

SEQ ID NO: 6623015 - DNA, 20 bp, Homo sapiens
agaaacaccacttaatcttc

SEQ ID NO: 6623016 - DNA, 15 bp, Homo sapiens
agaaacaccagtgtt

SEQ ID NO: 6623017 - DNA, 15 bp, Homo sapiens
agaaacaccattcat

SEQ ID NO: 6623018 - DNA, 18 bp, Homo sapiens
agaaacacccctctgtct

SEQ ID NO: 6623019 - DNA, 20 bp, Homo sapiens
agaaacacccctctgtctag

SEQ ID NO: 6623020 - DNA, 21 bp, Homo sapiens
agaaacacccctctgtctagg

SEQ ID NO: 6623021 - DNA, 17 bp, Homo sapiens
agaaacaccctcacact

SEQ ID NO: 6623022 - DNA, 23 bp, Homo sapiens
agaaacacgtatcccacctgaca

SEQ ID NO: 6623023 - DNA, 13 bp, Homo sapiens
agaaacactaaat

SEQ ID NO: 6623024 - DNA, 20 bp, Homo sapiens
agaaacactaagctctctgg

SEQ ID NO: 6623025 - DNA, 19 bp, Homo sapiens
agaaacactgaaaagaagg

SEQ ID NO: 6623026 - DNA, 16 bp, Homo sapiens
agaaacactgcctgcc

SEQ ID NO: 6623027 - DNA, 13 bp, Homo sapiens
agaaacactttct

SEQ ID NO: 6623028 - DNA, 21 bp, Homo sapiens
agaaacagacagaaagagaca

SEQ ID NO: 6623029 - DNA, 19 bp, Homo sapiens
agaaacagagacaggccca

SEQ ID NO: 6623030 - DNA, 17 bp, Homo sapiens
agaaacagagagagaca

SEQ ID NO: 6623031 - DNA, 20 bp, Homo sapiens
agaaacagagtggcctccct

SEQ ID NO: 6623032 - DNA, 13 bp, Homo sapiens
agaaacagccatt

SEQ ID NO: 6623033 - DNA, 16 bp, Homo sapiens
agaaacagctatgaga

SEQ ID NO: 6623034 - DNA, 18 bp, Homo sapiens
agaaacagctcagccagt

SEQ ID NO: 6623035 - DNA, 16 bp, Homo sapiens
agaaacagctgcttct

SEQ ID NO: 6623036 - DNA, 22 bp, Homo sapiens
agaaacagctgcttctcccccc

SEQ ID NO: 6623037 - DNA, 11 bp, Homo sapiens
agaaacagctt

SEQ ID NO: 6623038 - DNA, 16 bp, Homo sapiens
agaaacaggcccagag

SEQ ID NO: 6623039 - DNA, 15 bp, Homo sapiens
agaaacaggctctga

SEQ ID NO: 6623040 - DNA, 14 bp, Homo sapiens
agaaacagggcagc

SEQ ID NO: 6623041 - DNA, 15 bp, Homo sapiens
agaaacagggcagca

SEQ ID NO: 6623042 - DNA, 20 bp, Homo sapiens
agaaacaggggatcaaagtt

SEQ ID NO: 6623043 - DNA, 22 bp, Homo sapiens
agaaacaggggatcaaagttcc

SEQ ID NO: 6623044 - DNA, 17 bp, Homo sapiens
agaaacagggtgttgtc

SEQ ID NO: 6623045 - DNA, 18 bp, Homo sapiens
agaaacagtattttcttc

SEQ ID NO: 6623046 - DNA, 21 bp, Homo sapiens
agaaacagtattttcttccca

SEQ ID NO: 6623047 - DNA, 13 bp, Homo sapiens
agaaacagtgagt

SEQ ID NO: 6623048 - DNA, 18 bp, Homo sapiens
agaaacagtgggagccct

SEQ ID NO: 6623049 - DNA, 19 bp, Homo sapiens
agaaacagtgggagccctg

SEQ ID NO: 6623050 - DNA, 21 bp, Homo sapiens
agaaacagtgtttgccctttg

SEQ ID NO: 6623051 - DNA, 17 bp, Homo sapiens
agaaacagttggtaact

SEQ ID NO: 6623052 - DNA, 18 bp, Homo sapiens
agaaacagttggtaactt

SEQ ID NO: 6623053 - DNA, 21 bp, Homo sapiens
agaaacagttggtaacttttg

SEQ ID NO: 6623054 - DNA, 22 bp, Homo sapiens
agaaacagttggtaacttttgt

SEQ ID NO: 6623055 - DNA, 16 bp, Homo sapiens
agaaacataatttttt

SEQ ID NO: 6623056 - DNA, 16 bp, Homo sapiens
agaaacatacacaagg

SEQ ID NO: 6623057 - DNA, 21 bp, Homo sapiens
agaaacatcagttactctgaa

SEQ ID NO: 6623058 - DNA, 15 bp, Homo sapiens
agaaacatctctggc

SEQ ID NO: 6623059 - DNA, 15 bp, Homo sapiens
agaaacatgacactg

SEQ ID NO: 6623060 - DNA, 18 bp, Homo sapiens
agaaacattctttcctaa

SEQ ID NO: 6623061 - DNA, 19 bp, Homo sapiens
agaaacattctttcctaaa

SEQ ID NO: 6623062 - DNA, 14 bp, Homo sapiens
agaaacattgaaga

SEQ ID NO: 6623063 - DNA, 15 bp, Homo sapiens
agaaacattgaagat

SEQ ID NO: 6623064 - DNA, 12 bp, Homo sapiens
agaaacatttag

SEQ ID NO: 6623065 - DNA, 17 bp, Homo sapiens
agaaacatttttgttct

SEQ ID NO: 6623066 - DNA, 13 bp, Homo sapiens
agaaaccaaagtc

SEQ ID NO: 6623067 - DNA, 12 bp, Homo sapiens
agaaaccaaatt

SEQ ID NO: 6623068 - DNA, 23 bp, Homo sapiens
agaaaccaacaagaaccactcct

SEQ ID NO: 6623069 - DNA, 18 bp, Homo sapiens
agaaaccaagtgggctgg

SEQ ID NO: 6623070 - DNA, 16 bp, Homo sapiens
agaaaccacagtcttc

SEQ ID NO: 6623071 - DNA, 19 bp, Homo sapiens
agaaaccaggagtaaaaga

SEQ ID NO: 6623072 - DNA, 23 bp, Homo sapiens
agaaaccagtatggaagggaggg

SEQ ID NO: 6623073 - DNA, 20 bp, Homo sapiens
agaaaccatcctctcccttc

SEQ ID NO: 6623074 - DNA, 13 bp, Homo sapiens
agaaaccatgaca

SEQ ID NO: 6623075 - DNA, 16 bp, Homo sapiens
agaaaccatgacaaac

SEQ ID NO: 6623076 - DNA, 15 bp, Homo sapiens
agaaacccaagctcc

SEQ ID NO: 6623077 - DNA, 15 bp, Homo sapiens
agaaacccacagaag

SEQ ID NO: 6623078 - DNA, 17 bp, Homo sapiens
agaaacccacagaaggg

SEQ ID NO: 6623079 - DNA, 18 bp, Homo sapiens
agaaacccaccagcctaa

SEQ ID NO: 6623080 - DNA, 15 bp, Homo sapiens
agaaacccagactga

SEQ ID NO: 6623081 - DNA, 19 bp, Homo sapiens
agaaacccagagatgcctg

SEQ ID NO: 6623082 - DNA, 21 bp, Homo sapiens
agaaacccagagatgcctgat

SEQ ID NO: 6623083 - DNA, 14 bp, Homo sapiens
agaaacccagggag

SEQ ID NO: 6623084 - DNA, 21 bp, Homo sapiens
agaaacccgacagagggaaga

SEQ ID NO: 6623085 - DNA, 21 bp, Homo sapiens
agaaacccggcttcctgtgct

SEQ ID NO: 6623086 - DNA, 17 bp, Homo sapiens
agaaaccctggtctccg

SEQ ID NO: 6623087 - DNA, 13 bp, Homo sapiens
agaaaccctgtct

SEQ ID NO: 6623088 - DNA, 21 bp, Homo sapiens
agaaacccttcagtgctacat

SEQ ID NO: 6623089 - DNA, 16 bp, Homo sapiens
agaaaccgacgacaaa

SEQ ID NO: 6623090 - DNA, 16 bp, Homo sapiens
agaaacctatctcagg

SEQ ID NO: 6623091 - DNA, 12 bp, Homo sapiens
agaaacctcatt

SEQ ID NO: 6623092 - DNA, 19 bp, Homo sapiens
agaaacctgcatgaaagca

SEQ ID NO: 6623093 - DNA, 18 bp, Homo sapiens
agaaacctgccaaggagc

SEQ ID NO: 6623094 - DNA, 12 bp, Homo sapiens
agaaacctgtat

SEQ ID NO: 6623095 - DNA, 17 bp, Homo sapiens
agaaacctgtatctttc

SEQ ID NO: 6623096 - DNA, 17 bp, Homo sapiens
agaaaccttaatatgtg

SEQ ID NO: 6623097 - DNA, 14 bp, Homo sapiens
agaaaccttcactc

SEQ ID NO: 6623098 - DNA, 15 bp, Homo sapiens
agaaaccttcactcc

SEQ ID NO: 6623099 - DNA, 22 bp, Homo sapiens
agaaaccttcactccagacaga

SEQ ID NO: 6623100 - DNA, 18 bp, Homo sapiens
agaaaccttccagagaac

SEQ ID NO: 6623101 - DNA, 13 bp, Homo sapiens
agaaaccttgttt

SEQ ID NO: 6623102 - DNA, 15 bp, Homo sapiens
agaaaccttgtttgt

SEQ ID NO: 6623103 - DNA, 15 bp, Homo sapiens
agaaaccttttattt

SEQ ID NO: 6623104 - DNA, 16 bp, Homo sapiens
agaaaccttttatttt

SEQ ID NO: 6623105 - DNA, 18 bp, Homo sapiens
agaaacctttttaaaaat

SEQ ID NO: 6623106 - DNA, 14 bp, Homo sapiens
agaaacgaaaagga

SEQ ID NO: 6623107 - DNA, 16 bp, Homo sapiens
agaaacgagatttgcc

SEQ ID NO: 6623108 - DNA, 22 bp, Homo sapiens
agaaacgcgctccttggcggac

SEQ ID NO: 6623109 - DNA, 16 bp, Homo sapiens
agaaacgtccatctct

SEQ ID NO: 6623110 - DNA, 20 bp, Homo sapiens
agaaacgtctacgtatgcat

SEQ ID NO: 6623111 - DNA, 22 bp, Homo sapiens
agaaacgtggatctccccctca

SEQ ID NO: 6623112 - DNA, 18 bp, Homo sapiens
agaaacgtgttaaaggtt

SEQ ID NO: 6623113 - DNA, 15 bp, Homo sapiens
agaaactaaaaatat

SEQ ID NO: 6623114 - DNA, 17 bp, Homo sapiens
agaaactaaaacaaata

SEQ ID NO: 6623115 - DNA, 18 bp, Homo sapiens
agaaactaacttggtggc

SEQ ID NO: 6623116 - DNA, 22 bp, Homo sapiens
agaaactagtatctctggcctc

SEQ ID NO: 6623117 - DNA, 18 bp, Homo sapiens
agaaactataaagtttta

SEQ ID NO: 6623118 - DNA, 12 bp, Homo sapiens
agaaactattgg

SEQ ID NO: 6623119 - DNA, 14 bp, Homo sapiens
agaaactatttctg

SEQ ID NO: 6623120 - DNA, 19 bp, Homo sapiens
agaaactattttttaaaaa

SEQ ID NO: 6623121 - DNA, 22 bp, Homo sapiens
agaaactcacccccaaggggca

SEQ ID NO: 6623122 - DNA, 16 bp, Homo sapiens
agaaactcagaagagt

SEQ ID NO: 6623123 - DNA, 13 bp, Homo sapiens
agaaactccaaag

SEQ ID NO: 6623124 - DNA, 15 bp, Homo sapiens
agaaactccatgatg

SEQ ID NO: 6623125 - DNA, 18 bp, Homo sapiens
agaaactcccctgggggt

SEQ ID NO: 6623126 - DNA, 20 bp, Homo sapiens
agaaactccgaagaaaagaa

SEQ ID NO: 6623127 - DNA, 19 bp, Homo sapiens
agaaactcctggatccctt

SEQ ID NO: 6623128 - DNA, 16 bp, Homo sapiens
agaaactcctgtttct

SEQ ID NO: 6623129 - DNA, 21 bp, Homo sapiens
agaaactctagactgcaagaa

SEQ ID NO: 6623130 - DNA, 14 bp, Homo sapiens
agaaactgaaagtg

SEQ ID NO: 6623131 - DNA, 20 bp, Homo sapiens
agaaactgaaccaacagaag

SEQ ID NO: 6623132 - DNA, 22 bp, Homo sapiens
agaaactgacatgccctccctt

SEQ ID NO: 6623133 - DNA, 16 bp, Homo sapiens
agaaactgaggaattt

SEQ ID NO: 6623134 - DNA, 13 bp, Homo sapiens
agaaactgaggag

SEQ ID NO: 6623135 - DNA, 18 bp, Homo sapiens
agaaactgaggagtagct

SEQ ID NO: 6623136 - DNA, 12 bp, Homo sapiens
agaaactgaggc

SEQ ID NO: 6623137 - DNA, 13 bp, Homo sapiens
agaaactgaggcc

SEQ ID NO: 6623138 - DNA, 19 bp, Homo sapiens
agaaactgaggcccacggt

SEQ ID NO: 6623139 - DNA, 21 bp, Homo sapiens
agaaactgaggcccagagagg

SEQ ID NO: 6623140 - DNA, 20 bp, Homo sapiens
agaaactgagtcctgttctt

SEQ ID NO: 6623141 - DNA, 14 bp, Homo sapiens
agaaactgatttct

SEQ ID NO: 6623142 - DNA, 18 bp, Homo sapiens
agaaactgcttacagttt

SEQ ID NO: 6623143 - DNA, 13 bp, Homo sapiens
agaaactggaact

SEQ ID NO: 6623144 - DNA, 15 bp, Homo sapiens
agaaactggaactct

SEQ ID NO: 6623145 - DNA, 13 bp, Homo sapiens
agaaactgtccaa

SEQ ID NO: 6623146 - DNA, 21 bp, Homo sapiens
agaaactgtccaaatgctttg

SEQ ID NO: 6623147 - DNA, 18 bp, Homo sapiens
agaaacttaaatgttatt

SEQ ID NO: 6623148 - DNA, 16 bp, Homo sapiens
agaaacttatcttaca

SEQ ID NO: 6623149 - DNA, 18 bp, Homo sapiens
agaaacttatcttacaaa

SEQ ID NO: 6623150 - DNA, 19 bp, Homo sapiens
agaaacttccaaatcccct

SEQ ID NO: 6623151 - DNA, 13 bp, Homo sapiens
agaaacttcgcct

SEQ ID NO: 6623152 - DNA, 15 bp, Homo sapiens
agaaacttgaactcc

SEQ ID NO: 6623153 - DNA, 12 bp, Homo sapiens
agaaacttgaag

SEQ ID NO: 6623154 - DNA, 14 bp, Homo sapiens
agaaacttgatatt

SEQ ID NO: 6623155 - DNA, 12 bp, Homo sapiens
agaaacttgcag

SEQ ID NO: 6623156 - DNA, 16 bp, Homo sapiens
agaaacttggctggaa

SEQ ID NO: 6623157 - DNA, 17 bp, Homo sapiens
agaaacttggctggaat

SEQ ID NO: 6623158 - DNA, 23 bp, Homo sapiens
agaaacttgtgaagtggaaatgt

SEQ ID NO: 6623159 - DNA, 15 bp, Homo sapiens
agaaactttatacat

SEQ ID NO: 6623160 - DNA, 18 bp, Homo sapiens
agaaactttatacattag

SEQ ID NO: 6623161 - DNA, 13 bp, Homo sapiens
agaaactttggaa

SEQ ID NO: 6623162 - DNA, 19 bp, Homo sapiens
agaaactttggaagcactt

SEQ ID NO: 6623163 - DNA, 23 bp, Homo sapiens
agaaacttttatctattctgaga

SEQ ID NO: 6623164 - DNA, 16 bp, Homo sapiens
agaaacttttgaaaaa

SEQ ID NO: 6623165 - DNA, 16 bp, Homo sapiens
agaaacttttgtaaag

SEQ ID NO: 6623166 - DNA, 17 bp, Homo sapiens
agaaacttttgtaaaga

SEQ ID NO: 6623167 - DNA, 23 bp, Homo sapiens
agaaacttttgtaaagaaattta

SEQ ID NO: 6623168 - DNA, 20 bp, Homo sapiens
agaaactttttaataaagta

SEQ ID NO: 6623169 - DNA, 17 bp, Homo sapiens
agaaacttttttatttt

SEQ ID NO: 6623170 - DNA, 11 bp, Homo sapiens
agaaagaaaaa

SEQ ID NO: 6623171 - DNA, 23 bp, Homo sapiens
agaaagaaaaatgcattattgac

SEQ ID NO: 6623172 - DNA, 19 bp, Homo sapiens
agaaagaaaagaccctgag

SEQ ID NO: 6623173 - DNA, 14 bp, Homo sapiens
agaaagaaaaggca

SEQ ID NO: 6623174 - DNA, 14 bp, Homo sapiens
agaaagaaaatcag

SEQ ID NO: 6623175 - DNA, 20 bp, Homo sapiens
agaaagaaaatggaaagaag

SEQ ID NO: 6623176 - DNA, 13 bp, Homo sapiens
agaaagaaaatta

SEQ ID NO: 6623177 - DNA, 22 bp, Homo sapiens
agaaagaaaattagtaattgta

SEQ ID NO: 6623178 - DNA, 16 bp, Homo sapiens
agaaagaaaattatat

SEQ ID NO: 6623179 - DNA, 17 bp, Homo sapiens
agaaagaaaattatatt

SEQ ID NO: 6623180 - DNA, 19 bp, Homo sapiens
agaaagaaaattatattct

SEQ ID NO: 6623181 - DNA, 23 bp, Homo sapiens
agaaagaaaccaagtgcgctttg

SEQ ID NO: 6623182 - DNA, 22 bp, Homo sapiens
agaaagaaacttcattcagagg

SEQ ID NO: 6623183 - DNA, 14 bp, Homo sapiens
agaaagaaaggaaa

SEQ ID NO: 6623184 - DNA, 17 bp, Homo sapiens
agaaagaaagtacccag

SEQ ID NO: 6623185 - DNA, 22 bp, Homo sapiens
agaaagaaagtacccagcaaat

SEQ ID NO: 6623186 - DNA, 11 bp, Homo sapiens
agaaagaaata

SEQ ID NO: 6623187 - DNA, 16 bp, Homo sapiens
agaaagaaatattaac

SEQ ID NO: 6623188 - DNA, 21 bp, Homo sapiens
agaaagaaattgtttttctga

SEQ ID NO: 6623189 - DNA, 12 bp, Homo sapiens
agaaagaagaga

SEQ ID NO: 6623190 - DNA, 20 bp, Homo sapiens
agaaagaagcagttctcaca

SEQ ID NO: 6623191 - DNA, 12 bp, Homo sapiens
agaaagaagcat

SEQ ID NO: 6623192 - DNA, 13 bp, Homo sapiens
agaaagaaggaag

SEQ ID NO: 6623193 - DNA, 14 bp, Homo sapiens
agaaagaaggaagt

SEQ ID NO: 6623194 - DNA, 14 bp, Homo sapiens
agaaagaaggcaaa

SEQ ID NO: 6623195 - DNA, 13 bp, Homo sapiens
agaaagaatgaga

SEQ ID NO: 6623196 - DNA, 17 bp, Homo sapiens
agaaagaatgagaaaga

SEQ ID NO: 6623197 - DNA, 22 bp, Homo sapiens
agaaagaatgagaaagaaaagg

SEQ ID NO: 6623198 - DNA, 14 bp, Homo sapiens
agaaagaatgtgtt

SEQ ID NO: 6623199 - DNA, 22 bp, Homo sapiens
agaaagaattcctgcagcagtt

SEQ ID NO: 6623200 - DNA, 15 bp, Homo sapiens
agaaagacagagctg

SEQ ID NO: 6623201 - DNA, 21 bp, Homo sapiens
agaaagacatcacatccctct

SEQ ID NO: 6623202 - DNA, 17 bp, Homo sapiens
agaaagacatctgagga

SEQ ID NO: 6623203 - DNA, 18 bp, Homo sapiens
agaaagacatctttctct

SEQ ID NO: 6623204 - DNA, 15 bp, Homo sapiens
agaaagacattctta

SEQ ID NO: 6623205 - DNA, 23 bp, Homo sapiens
agaaagaccatgcatttaaagta

SEQ ID NO: 6623206 - DNA, 18 bp, Homo sapiens
agaaagactattcaaaca

SEQ ID NO: 6623207 - DNA, 23 bp, Homo sapiens
agaaagactctgagatgtggaga

SEQ ID NO: 6623208 - DNA, 12 bp, Homo sapiens
agaaagactgag

SEQ ID NO: 6623209 - DNA, 16 bp, Homo sapiens
agaaagagaaagtact

SEQ ID NO: 6623210 - DNA, 16 bp, Homo sapiens
agaaagagaaatcaga

SEQ ID NO: 6623211 - DNA, 16 bp, Homo sapiens
agaaagagaagtcaca

SEQ ID NO: 6623212 - DNA, 16 bp, Homo sapiens
agaaagagaatgaact

SEQ ID NO: 6623213 - DNA, 17 bp, Homo sapiens
agaaagagaatgaactg

SEQ ID NO: 6623214 - DNA, 18 bp, Homo sapiens
agaaagagaatgaactgt

SEQ ID NO: 6623215 - DNA, 22 bp, Homo sapiens
agaaagagaatgaactgtggaa

SEQ ID NO: 6623216 - DNA, 24 bp, Homo sapiens
agaaagagactgtggggagggtca

SEQ ID NO: 6623217 - DNA, 17 bp, Homo sapiens
agaaagagagaaaataa

SEQ ID NO: 6623218 - DNA, 18 bp, Homo sapiens
agaaagagagaagccagc

SEQ ID NO: 6623219 - DNA, 19 bp, Homo sapiens
agaaagagagaagccagcc

SEQ ID NO: 6623220 - DNA, 22 bp, Homo sapiens
agaaagagagaagccagccaca

SEQ ID NO: 6623221 - DNA, 15 bp, Homo sapiens
agaaagagctacctg

SEQ ID NO: 6623222 - DNA, 18 bp, Homo sapiens
agaaagagctcaaaataa

SEQ ID NO: 6623223 - DNA, 14 bp, Homo sapiens
agaaagagctgcct

SEQ ID NO: 6623224 - DNA, 18 bp, Homo sapiens
agaaagagctgcctggat

SEQ ID NO: 6623225 - DNA, 19 bp, Homo sapiens
agaaagagctgcctggatg

SEQ ID NO: 6623226 - DNA, 13 bp, Homo sapiens
agaaagaggccct

SEQ ID NO: 6623227 - DNA, 20 bp, Homo sapiens
agaaagagggtcccagggct

SEQ ID NO: 6623228 - DNA, 22 bp, Homo sapiens
agaaagaggtgaccccagggca

SEQ ID NO: 6623229 - DNA, 23 bp, Homo sapiens
agaaagagtttgagacctgaata

SEQ ID NO: 6623230 - DNA, 18 bp, Homo sapiens
agaaagatacagacattc

SEQ ID NO: 6623231 - DNA, 21 bp, Homo sapiens
agaaagatacagacattcaat

SEQ ID NO: 6623232 - DNA, 14 bp, Homo sapiens
agaaagatgacaaa

SEQ ID NO: 6623233 - DNA, 14 bp, Homo sapiens
agaaagatggaaat

SEQ ID NO: 6623234 - DNA, 12 bp, Homo sapiens
agaaagatgtat

SEQ ID NO: 6623235 - DNA, 20 bp, Homo sapiens
agaaagatgtatataggtgt

SEQ ID NO: 6623236 - DNA, 18 bp, Homo sapiens
agaaagattaaatatatc

SEQ ID NO: 6623237 - DNA, 20 bp, Homo sapiens
agaaagattacttagaggaa

SEQ ID NO: 6623238 - DNA, 14 bp, Homo sapiens
agaaagattgtaaa

SEQ ID NO: 6623239 - DNA, 17 bp, Homo sapiens
agaaagatttggaaaat

SEQ ID NO: 6623240 - DNA, 19 bp, Homo sapiens
agaaagatttggaaaattc

SEQ ID NO: 6623241 - DNA, 20 bp, Homo sapiens
agaaagatttggaaaattca

SEQ ID NO: 6623242 - DNA, 13 bp, Homo sapiens
agaaagattttat

SEQ ID NO: 6623243 - DNA, 17 bp, Homo sapiens
agaaagcaaaaaataaa

SEQ ID NO: 6623244 - DNA, 16 bp, Homo sapiens
agaaagcaaaacattt

SEQ ID NO: 6623245 - DNA, 14 bp, Homo sapiens
agaaagcaaaatac

SEQ ID NO: 6623246 - DNA, 15 bp, Homo sapiens
agaaagcaaaattat

SEQ ID NO: 6623247 - DNA, 19 bp, Homo sapiens
agaaagcaaatcagacaca

SEQ ID NO: 6623248 - DNA, 14 bp, Homo sapiens
agaaagcaacttat

SEQ ID NO: 6623249 - DNA, 21 bp, Homo sapiens
agaaagcaagccaatttggaa

SEQ ID NO: 6623250 - DNA, 12 bp, Homo sapiens
agaaagcaagga

SEQ ID NO: 6623251 - DNA, 13 bp, Homo sapiens
agaaagcaaggac

SEQ ID NO: 6623252 - DNA, 11 bp, Homo sapiens
agaaagcaata

SEQ ID NO: 6623253 - DNA, 12 bp, Homo sapiens
agaaagcaataa

SEQ ID NO: 6623254 - DNA, 22 bp, Homo sapiens
agaaagcacaatttaaaacaat

SEQ ID NO: 6623255 - DNA, 18 bp, Homo sapiens
agaaagcacctgttttta

SEQ ID NO: 6623256 - DNA, 11 bp, Homo sapiens
agaaagcactt

SEQ ID NO: 6623257 - DNA, 20 bp, Homo sapiens
agaaagcagaacagtgatta

SEQ ID NO: 6623258 - DNA, 14 bp, Homo sapiens
agaaagcagagatt

SEQ ID NO: 6623259 - DNA, 14 bp, Homo sapiens
agaaagcagaggct

SEQ ID NO: 6623260 - DNA, 15 bp, Homo sapiens
agaaagcagccaaac

SEQ ID NO: 6623261 - DNA, 18 bp, Homo sapiens
agaaagcaggagcagctg

SEQ ID NO: 6623262 - DNA, 14 bp, Homo sapiens
agaaagcaggggct

SEQ ID NO: 6623263 - DNA, 20 bp, Homo sapiens
agaaagcaggggctacaaga

SEQ ID NO: 6623264 - DNA, 14 bp, Homo sapiens
agaaagcataaaat

SEQ ID NO: 6623265 - DNA, 19 bp, Homo sapiens
agaaagcatccctcaccca

SEQ ID NO: 6623266 - DNA, 16 bp, Homo sapiens
agaaagcattacattt

SEQ ID NO: 6623267 - DNA, 13 bp, Homo sapiens
agaaagcatttga

SEQ ID NO: 6623268 - DNA, 18 bp, Homo sapiens
agaaagcatttgaatgca

SEQ ID NO: 6623269 - DNA, 16 bp, Homo sapiens
agaaagccaccttgtt

SEQ ID NO: 6623270 - DNA, 17 bp, Homo sapiens
agaaagccacgccctcc

SEQ ID NO: 6623271 - DNA, 13 bp, Homo sapiens
agaaagccagaca

SEQ ID NO: 6623272 - DNA, 15 bp, Homo sapiens
agaaagccaggcagg

SEQ ID NO: 6623273 - DNA, 24 bp, Homo sapiens
agaaagccatattccagcagtgaa

SEQ ID NO: 6623274 - DNA, 17 bp, Homo sapiens
agaaagcccacctgggc

SEQ ID NO: 6623275 - DNA, 21 bp, Homo sapiens
agaaagcccacctgggctggg

SEQ ID NO: 6623276 - DNA, 18 bp, Homo sapiens
agaaagccccacccaggc

SEQ ID NO: 6623277 - DNA, 20 bp, Homo sapiens
agaaagcccctcacctcagg

SEQ ID NO: 6623278 - DNA, 21 bp, Homo sapiens
agaaagcccctcacctcagga

SEQ ID NO: 6623279 - DNA, 18 bp, Homo sapiens
agaaagccctaaaatact

SEQ ID NO: 6623280 - DNA, 14 bp, Homo sapiens
agaaagccctgtgc

SEQ ID NO: 6623281 - DNA, 22 bp, Homo sapiens
agaaagcccttaggaagaattt

SEQ ID NO: 6623282 - DNA, 16 bp, Homo sapiens
agaaagccgggggagg

SEQ ID NO: 6623283 - DNA, 17 bp, Homo sapiens
agaaagccgggggaggg

SEQ ID NO: 6623284 - DNA, 19 bp, Homo sapiens
agaaagccgggggaggggc

SEQ ID NO: 6623285 - DNA, 15 bp, Homo sapiens
agaaagcctcagaga

SEQ ID NO: 6623286 - DNA, 21 bp, Homo sapiens
agaaagcctccgctgggcttc

SEQ ID NO: 6623287 - DNA, 12 bp, Homo sapiens
agaaagcctcct

SEQ ID NO: 6623288 - DNA, 16 bp, Homo sapiens
agaaagcctcctctgg

SEQ ID NO: 6623289 - DNA, 14 bp, Homo sapiens
agaaagcctctctc

SEQ ID NO: 6623290 - DNA, 15 bp, Homo sapiens
agaaagcctctctct

SEQ ID NO: 6623291 - DNA, 18 bp, Homo sapiens
agaaagcctctctctccc

SEQ ID NO: 6623292 - DNA, 15 bp, Homo sapiens
agaaagctaaaatgg

SEQ ID NO: 6623293 - DNA, 17 bp, Homo sapiens
agaaagctaaagtgatc

SEQ ID NO: 6623294 - DNA, 16 bp, Homo sapiens
agaaagctaaatgaat

SEQ ID NO: 6623295 - DNA, 15 bp, Homo sapiens
agaaagctagatatg

SEQ ID NO: 6623296 - DNA, 11 bp, Homo sapiens
agaaagctcaa

SEQ ID NO: 6623297 - DNA, 18 bp, Homo sapiens
agaaagctccttccagac

SEQ ID NO: 6623298 - DNA, 19 bp, Homo sapiens
agaaagctctacatttgca

SEQ ID NO: 6623299 - DNA, 22 bp, Homo sapiens
agaaagctctacatttgcagat

SEQ ID NO: 6623300 - DNA, 16 bp, Homo sapiens
agaaagctctgcatgt

SEQ ID NO: 6623301 - DNA, 19 bp, Homo sapiens
agaaagctctgcatgtgtg

SEQ ID NO: 6623302 - DNA, 17 bp, Homo sapiens
agaaagctgacttggct

SEQ ID NO: 6623303 - DNA, 21 bp, Homo sapiens
agaaagctgacttggctggtg

SEQ ID NO: 6623304 - DNA, 13 bp, Homo sapiens
agaaagctggact

SEQ ID NO: 6623305 - DNA, 15 bp, Homo sapiens
agaaagctggactga

SEQ ID NO: 6623306 - DNA, 19 bp, Homo sapiens
agaaagctggactgaccaa

SEQ ID NO: 6623307 - DNA, 20 bp, Homo sapiens
agaaagctggactgaccaaa

SEQ ID NO: 6623308 - DNA, 19 bp, Homo sapiens
agaaagctggcaacatgaa

SEQ ID NO: 6623309 - DNA, 19 bp, Homo sapiens
agaaagctggtaaactatt

SEQ ID NO: 6623310 - DNA, 14 bp, Homo sapiens
agaaagctgtggct

SEQ ID NO: 6623311 - DNA, 16 bp, Homo sapiens
agaaagcttaatatat

SEQ ID NO: 6623312 - DNA, 14 bp, Homo sapiens
agaaagcttccttc

SEQ ID NO: 6623313 - DNA, 17 bp, Homo sapiens
agaaagcttctgagttt

SEQ ID NO: 6623314 - DNA, 23 bp, Homo sapiens
agaaagcttcttcagagtgaaga

SEQ ID NO: 6623315 - DNA, 14 bp, Homo sapiens
agaaagcttttatt

SEQ ID NO: 6623316 - DNA, 12 bp, Homo sapiens
agaaaggaaaaa

SEQ ID NO: 6623317 - DNA, 16 bp, Homo sapiens
agaaaggaaaacctga

SEQ ID NO: 6623318 - DNA, 14 bp, Homo sapiens
agaaaggaaacctt

SEQ ID NO: 6623319 - DNA, 15 bp, Homo sapiens
agaaaggaaagaagg

SEQ ID NO: 6623320 - DNA, 14 bp, Homo sapiens
agaaaggaaataga

SEQ ID NO: 6623321 - DNA, 15 bp, Homo sapiens
agaaaggaacatccg

SEQ ID NO: 6623322 - DNA, 16 bp, Homo sapiens
agaaaggaacctggga

SEQ ID NO: 6623323 - DNA, 17 bp, Homo sapiens
agaaaggaagcattgta

SEQ ID NO: 6623324 - DNA, 18 bp, Homo sapiens
agaaaggaagcattgtaa

SEQ ID NO: 6623325 - DNA, 22 bp, Homo sapiens
agaaaggaagcattgtaaaata

SEQ ID NO: 6623326 - DNA, 19 bp, Homo sapiens
agaaaggactcctgaaaaa

SEQ ID NO: 6623327 - DNA, 12 bp, Homo sapiens
agaaaggagagt

SEQ ID NO: 6623328 - DNA, 18 bp, Homo sapiens
agaaaggaggagacagag

SEQ ID NO: 6623329 - DNA, 13 bp, Homo sapiens
agaaaggagggca

SEQ ID NO: 6623330 - DNA, 17 bp, Homo sapiens
agaaaggatataaaagg

SEQ ID NO: 6623331 - DNA, 18 bp, Homo sapiens
agaaaggatatttaagaa

SEQ ID NO: 6623332 - DNA, 19 bp, Homo sapiens
agaaaggatatttaagaaa

SEQ ID NO: 6623333 - DNA, 21 bp, Homo sapiens
agaaaggatatttaagaaaat

SEQ ID NO: 6623334 - DNA, 18 bp, Homo sapiens
agaaaggcacatattgga

SEQ ID NO: 6623335 - DNA, 15 bp, Homo sapiens
agaaaggcctctgtg

SEQ ID NO: 6623336 - DNA, 14 bp, Homo sapiens
agaaaggctgcaac

SEQ ID NO: 6623337 - DNA, 21 bp, Homo sapiens
agaaaggctgttaaatacagg

SEQ ID NO: 6623338 - DNA, 16 bp, Homo sapiens
agaaagggacccacct

SEQ ID NO: 6623339 - DNA, 15 bp, Homo sapiens
agaaagggaggccca

SEQ ID NO: 6623340 - DNA, 23 bp, Homo sapiens
agaaagggaggcccagccgcagg

SEQ ID NO: 6623341 - DNA, 13 bp, Homo sapiens
agaaagggagggc

SEQ ID NO: 6623342 - DNA, 21 bp, Homo sapiens
agaaagggagggctctgaggc

SEQ ID NO: 6623343 - DNA, 17 bp, Homo sapiens
agaaagggcaaattatt

SEQ ID NO: 6623344 - DNA, 20 bp, Homo sapiens
agaaagggcaacaataaaat

SEQ ID NO: 6623345 - DNA, 14 bp, Homo sapiens
agaaagggcaagaa

SEQ ID NO: 6623346 - DNA, 15 bp, Homo sapiens
agaaagggcagagga

SEQ ID NO: 6623347 - DNA, 20 bp, Homo sapiens
agaaagggcagaggaagaga

SEQ ID NO: 6623348 - DNA, 20 bp, Homo sapiens
agaaagggcagcccctcccc

SEQ ID NO: 6623349 - DNA, 23 bp, Homo sapiens
agaaagggcagcttcagtctctg

SEQ ID NO: 6623350 - DNA, 16 bp, Homo sapiens
agaaagggccaggaga

SEQ ID NO: 6623351 - DNA, 20 bp, Homo sapiens
agaaagggccaggagatgga

SEQ ID NO: 6623352 - DNA, 23 bp, Homo sapiens
agaaagggccctgggcctgcctc

SEQ ID NO: 6623353 - DNA, 16 bp, Homo sapiens
agaaaggggacccaag

SEQ ID NO: 6623354 - DNA, 16 bp, Homo sapiens
agaaaggggagaatgt

SEQ ID NO: 6623355 - DNA, 20 bp, Homo sapiens
agaaaggggcaagaaattca

SEQ ID NO: 6623356 - DNA, 18 bp, Homo sapiens
agaaaggggctagcactg

SEQ ID NO: 6623357 - DNA, 17 bp, Homo sapiens
agaaaggggctcttctg

SEQ ID NO: 6623358 - DNA, 15 bp, Homo sapiens
agaaagggtctgata

SEQ ID NO: 6623359 - DNA, 23 bp, Homo sapiens
agaaagggtctgataaacacaga

SEQ ID NO: 6623360 - DNA, 17 bp, Homo sapiens
agaaagggtgtttttct

SEQ ID NO: 6623361 - DNA, 16 bp, Homo sapiens
agaaaggtcatccaaa

SEQ ID NO: 6623362 - DNA, 23 bp, Homo sapiens
agaaaggtctgaaatccagcatc

SEQ ID NO: 6623363 - DNA, 22 bp, Homo sapiens
agaaaggtgtgaggagagagga

SEQ ID NO: 6623364 - DNA, 17 bp, Homo sapiens
agaaaggttgattctca

SEQ ID NO: 6623365 - DNA, 19 bp, Homo sapiens
agaaaggttttgagcatgg

SEQ ID NO: 6623366 - DNA, 17 bp, Homo sapiens
agaaagtaaatctgaga

SEQ ID NO: 6623367 - DNA, 14 bp, Homo sapiens
agaaagtaatttaa

SEQ ID NO: 6623368 - DNA, 17 bp, Homo sapiens
agaaagtaatttaattt

SEQ ID NO: 6623369 - DNA, 18 bp, Homo sapiens
agaaagtaatttaatttg

SEQ ID NO: 6623370 - DNA, 14 bp, Homo sapiens
agaaagtataattt

SEQ ID NO: 6623371 - DNA, 19 bp, Homo sapiens
agaaagtataatttcagtg

SEQ ID NO: 6623372 - DNA, 19 bp, Homo sapiens
agaaagtcaaaaaattatt

SEQ ID NO: 6623373 - DNA, 13 bp, Homo sapiens
agaaagtcacaga

SEQ ID NO: 6623374 - DNA, 13 bp, Homo sapiens
agaaagtcatagt

SEQ ID NO: 6623375 - DNA, 15 bp, Homo sapiens
agaaagtcatccttt

SEQ ID NO: 6623376 - DNA, 15 bp, Homo sapiens
agaaagtcatctttg

SEQ ID NO: 6623377 - DNA, 21 bp, Homo sapiens
agaaagtcattcgcgtggctc

SEQ ID NO: 6623378 - DNA, 13 bp, Homo sapiens
agaaagtctatgc

SEQ ID NO: 6623379 - DNA, 21 bp, Homo sapiens
agaaagtgaataaaaattaag

SEQ ID NO: 6623380 - DNA, 14 bp, Homo sapiens
agaaagtgaccatg

SEQ ID NO: 6623381 - DNA, 21 bp, Homo sapiens
agaaagtgacctattttttaa

SEQ ID NO: 6623382 - DNA, 16 bp, Homo sapiens
agaaagtgagcagtgt

SEQ ID NO: 6623383 - DNA, 19 bp, Homo sapiens
agaaagtgagtctgaattg

SEQ ID NO: 6623384 - DNA, 15 bp, Homo sapiens
agaaagtgatttcta

SEQ ID NO: 6623385 - DNA, 17 bp, Homo sapiens
agaaagtgcagaatcaa

SEQ ID NO: 6623386 - DNA, 15 bp, Homo sapiens
agaaagtgcctgaca

SEQ ID NO: 6623387 - DNA, 16 bp, Homo sapiens
agaaagtgcctttcag

SEQ ID NO: 6623388 - DNA, 21 bp, Homo sapiens
agaaagtgcctttcaggatct

SEQ ID NO: 6623389 - DNA, 22 bp, Homo sapiens
agaaagtgcctttcaggatcta

SEQ ID NO: 6623390 - DNA, 21 bp, Homo sapiens
agaaagtggccatgccaccct

SEQ ID NO: 6623391 - DNA, 18 bp, Homo sapiens
agaaagtgggaggtcagg

SEQ ID NO: 6623392 - DNA, 17 bp, Homo sapiens
agaaagtgggggtggag

SEQ ID NO: 6623393 - DNA, 21 bp, Homo sapiens
agaaagtgggtgagatgctgg

SEQ ID NO: 6623394 - DNA, 20 bp, Homo sapiens
agaaagtggtcttaagaaat

SEQ ID NO: 6623395 - DNA, 17 bp, Homo sapiens
agaaagtggtgctcagt

SEQ ID NO: 6623396 - DNA, 13 bp, Homo sapiens
agaaagtgtattt

SEQ ID NO: 6623397 - DNA, 17 bp, Homo sapiens
agaaagtgtatttggaa

SEQ ID NO: 6623398 - DNA, 21 bp, Homo sapiens
agaaagtgtgggtttggttag

SEQ ID NO: 6623399 - DNA, 22 bp, Homo sapiens
agaaagtgtgtgtgttctgtag

SEQ ID NO: 6623400 - DNA, 12 bp, Homo sapiens
agaaagtgttca

SEQ ID NO: 6623401 - DNA, 14 bp, Homo sapiens
agaaagtgttctgt

SEQ ID NO: 6623402 - DNA, 19 bp, Homo sapiens
agaaagtgttctgttacaa

SEQ ID NO: 6623403 - DNA, 22 bp, Homo sapiens
agaaagtgttttattttcaaat

SEQ ID NO: 6623404 - DNA, 11 bp, Homo sapiens
agaaagttatt

SEQ ID NO: 6623405 - DNA, 20 bp, Homo sapiens
agaaagttattcttggtact

SEQ ID NO: 6623406 - DNA, 22 bp, Homo sapiens
agaaagttgcaaggcaaatgtt

SEQ ID NO: 6623407 - DNA, 20 bp, Homo sapiens
agaaagttgcacggctgctg

SEQ ID NO: 6623408 - DNA, 21 bp, Homo sapiens
agaaagttgctaactgggaag

SEQ ID NO: 6623409 - DNA, 23 bp, Homo sapiens
agaaagttgctaactgggaagaa

SEQ ID NO: 6623410 - DNA, 16 bp, Homo sapiens
agaaagttggaaagga

SEQ ID NO: 6623411 - DNA, 21 bp, Homo sapiens
agaaagttggccaatttcacc

SEQ ID NO: 6623412 - DNA, 15 bp, Homo sapiens
agaaagtttagatct

SEQ ID NO: 6623413 - DNA, 20 bp, Homo sapiens
agaaataaaacaactctgat

SEQ ID NO: 6623414 - DNA, 15 bp, Homo sapiens
agaaataaaactgtt

SEQ ID NO: 6623415 - DNA, 15 bp, Homo sapiens
agaaataaaagtatg

SEQ ID NO: 6623416 - DNA, 13 bp, Homo sapiens
agaaataaaagtg

SEQ ID NO: 6623417 - DNA, 13 bp, Homo sapiens
agaaataaaccaa

SEQ ID NO: 6623418 - DNA, 14 bp, Homo sapiens
agaaataaaccaaa

SEQ ID NO: 6623419 - DNA, 16 bp, Homo sapiens
agaaataaagggacca

SEQ ID NO: 6623420 - DNA, 19 bp, Homo sapiens
agaaataaagttggtgaca

SEQ ID NO: 6623421 - DNA, 18 bp, Homo sapiens
agaaataaagtttgctta

SEQ ID NO: 6623422 - DNA, 21 bp, Homo sapiens
agaaataaagtttgcttagaa

SEQ ID NO: 6623423 - DNA, 18 bp, Homo sapiens
agaaataaatagctatat

SEQ ID NO: 6623424 - DNA, 14 bp, Homo sapiens
agaaataaatcaca

SEQ ID NO: 6623425 - DNA, 15 bp, Homo sapiens
agaaataaatcacag

SEQ ID NO: 6623426 - DNA, 22 bp, Homo sapiens
agaaataaatcagagagcaagg

SEQ ID NO: 6623427 - DNA, 21 bp, Homo sapiens
agaaataaatccacccatgtt

SEQ ID NO: 6623428 - DNA, 13 bp, Homo sapiens
agaaataaatcta

SEQ ID NO: 6623429 - DNA, 22 bp, Homo sapiens
agaaataaattcacatcctcag

SEQ ID NO: 6623430 - DNA, 22 bp, Homo sapiens
agaaataaattttgtttcagaa

SEQ ID NO: 6623431 - DNA, 22 bp, Homo sapiens
agaaataacagaagaaaataga

SEQ ID NO: 6623432 - DNA, 16 bp, Homo sapiens
agaaataagaaaatgg

SEQ ID NO: 6623433 - DNA, 22 bp, Homo sapiens
agaaataagtagtgtcattcat

SEQ ID NO: 6623434 - DNA, 17 bp, Homo sapiens
agaaataagtggttatt

SEQ ID NO: 6623435 - DNA, 22 bp, Homo sapiens
agaaataagtggttatttctca

SEQ ID NO: 6623436 - DNA, 14 bp, Homo sapiens
agaaataagttttt

SEQ ID NO: 6623437 - DNA, 23 bp, Homo sapiens
agaaataagtttttgtttcacag

SEQ ID NO: 6623438 - DNA, 17 bp, Homo sapiens
agaaataatgctacaat

SEQ ID NO: 6623439 - DNA, 19 bp, Homo sapiens
agaaataatgctacaattt

SEQ ID NO: 6623440 - DNA, 15 bp, Homo sapiens
agaaataatggtctt

SEQ ID NO: 6623441 - DNA, 23 bp, Homo sapiens
agaaatacaaaaatactcagata

SEQ ID NO: 6623442 - DNA, 16 bp, Homo sapiens
agaaatacaaaataaa

SEQ ID NO: 6623443 - DNA, 18 bp, Homo sapiens
agaaatacagataaatga

SEQ ID NO: 6623444 - DNA, 20 bp, Homo sapiens
agaaatacagataaatgatt

SEQ ID NO: 6623445 - DNA, 12 bp, Homo sapiens
agaaatacagtc

SEQ ID NO: 6623446 - DNA, 15 bp, Homo sapiens
agaaatacagtgctt

SEQ ID NO: 6623447 - DNA, 19 bp, Homo sapiens
agaaatactgctctgaata

SEQ ID NO: 6623448 - DNA, 13 bp, Homo sapiens
agaaatactgtac

SEQ ID NO: 6623449 - DNA, 15 bp, Homo sapiens
agaaatactttcgaa

SEQ ID NO: 6623450 - DNA, 19 bp, Homo sapiens
agaaatagaataggcaaac

SEQ ID NO: 6623451 - DNA, 16 bp, Homo sapiens
agaaatagaattataa

SEQ ID NO: 6623452 - DNA, 18 bp, Homo sapiens
agaaatagacaaaaagta

SEQ ID NO: 6623453 - DNA, 15 bp, Homo sapiens
agaaatagcaagaga

SEQ ID NO: 6623454 - DNA, 19 bp, Homo sapiens
agaaatagctccgtggagc

SEQ ID NO: 6623455 - DNA, 23 bp, Homo sapiens
agaaatagctgaaaagggcactc

SEQ ID NO: 6623456 - DNA, 16 bp, Homo sapiens
agaaataggaagatta

SEQ ID NO: 6623457 - DNA, 19 bp, Homo sapiens
agaaatagttgtctgtgct

SEQ ID NO: 6623458 - DNA, 20 bp, Homo sapiens
agaaatagttgtctgtgctt

SEQ ID NO: 6623459 - DNA, 23 bp, Homo sapiens
agaaatagtttgagaaatgcata

SEQ ID NO: 6623460 - DNA, 17 bp, Homo sapiens
agaaatataaaaataat

SEQ ID NO: 6623461 - DNA, 14 bp, Homo sapiens
agaaatataattga

SEQ ID NO: 6623462 - DNA, 14 bp, Homo sapiens
agaaatatacagtt

SEQ ID NO: 6623463 - DNA, 15 bp, Homo sapiens
agaaatatacagttt

SEQ ID NO: 6623464 - DNA, 22 bp, Homo sapiens
agaaatataggatagacactgg

SEQ ID NO: 6623465 - DNA, 17 bp, Homo sapiens
agaaatatatatacata

SEQ ID NO: 6623466 - DNA, 18 bp, Homo sapiens
agaaatatatatacatat

SEQ ID NO: 6623467 - DNA, 16 bp, Homo sapiens
agaaatatatcctgtg

SEQ ID NO: 6623468 - DNA, 20 bp, Homo sapiens
agaaatatattatgaaaatt

SEQ ID NO: 6623469 - DNA, 18 bp, Homo sapiens
agaaatatatttgtcact

SEQ ID NO: 6623470 - DNA, 19 bp, Homo sapiens
agaaatatatttgtcactt

SEQ ID NO: 6623471 - DNA, 20 bp, Homo sapiens
agaaatatcgctgatgcaga

SEQ ID NO: 6623472 - DNA, 15 bp, Homo sapiens
agaaatatctgtgaa

SEQ ID NO: 6623473 - DNA, 13 bp, Homo sapiens
agaaatatcttca

SEQ ID NO: 6623474 - DNA, 20 bp, Homo sapiens
agaaatatcttcacttgtca

SEQ ID NO: 6623475 - DNA, 16 bp, Homo sapiens
agaaatatgattttat

SEQ ID NO: 6623476 - DNA, 16 bp, Homo sapiens
agaaatatggaactta

SEQ ID NO: 6623477 - DNA, 20 bp, Homo sapiens
agaaatatggaacttacatt

SEQ ID NO: 6623478 - DNA, 22 bp, Homo sapiens
agaaatatggaacttacattgt

SEQ ID NO: 6623479 - DNA, 17 bp, Homo sapiens
agaaatatggacactta

SEQ ID NO: 6623480 - DNA, 13 bp, Homo sapiens
agaaatatgtgag

SEQ ID NO: 6623481 - DNA, 14 bp, Homo sapiens
agaaatatgtgaga

SEQ ID NO: 6623482 - DNA, 15 bp, Homo sapiens
agaaatatgtgagat

SEQ ID NO: 6623483 - DNA, 16 bp, Homo sapiens
agaaatatgtgagatt

SEQ ID NO: 6623484 - DNA, 14 bp, Homo sapiens
agaaatatgtggtt

SEQ ID NO: 6623485 - DNA, 20 bp, Homo sapiens
agaaatattggttgaaagtt

SEQ ID NO: 6623486 - DNA, 15 bp, Homo sapiens
agaaatatttaccta

SEQ ID NO: 6623487 - DNA, 15 bp, Homo sapiens
agaaatattttaaaa

SEQ ID NO: 6623488 - DNA, 17 bp, Homo sapiens
agaaatattttaaaatc

SEQ ID NO: 6623489 - DNA, 21 bp, Homo sapiens
agaaatattttaaaatcagct

SEQ ID NO: 6623490 - DNA, 14 bp, Homo sapiens
agaaatattttaat

SEQ ID NO: 6623491 - DNA, 22 bp, Homo sapiens
agaaatcaatagtgcaactgtt

SEQ ID NO: 6623492 - DNA, 15 bp, Homo sapiens
agaaatcaatagttg

SEQ ID NO: 6623493 - DNA, 13 bp, Homo sapiens
agaaatcaatttt

SEQ ID NO: 6623494 - DNA, 20 bp, Homo sapiens
agaaatcacgttgctggtgg

SEQ ID NO: 6623495 - DNA, 14 bp, Homo sapiens
agaaatcactgtga

SEQ ID NO: 6623496 - DNA, 22 bp, Homo sapiens
agaaatcactgtgaaatttcat

SEQ ID NO: 6623497 - DNA, 23 bp, Homo sapiens
agaaatcactgtgaaatttcatg

SEQ ID NO: 6623498 - DNA, 15 bp, Homo sapiens
agaaatcagaaaaat

SEQ ID NO: 6623499 - DNA, 16 bp, Homo sapiens
agaaatcagaaaaatt

SEQ ID NO: 6623500 - DNA, 13 bp, Homo sapiens
agaaatcagaatt

SEQ ID NO: 6623501 - DNA, 14 bp, Homo sapiens
agaaatcagaggag

SEQ ID NO: 6623502 - DNA, 15 bp, Homo sapiens
agaaatcaggtgttt

SEQ ID NO: 6623503 - DNA, 18 bp, Homo sapiens
agaaatcagtaatattta

SEQ ID NO: 6623504 - DNA, 11 bp, Homo sapiens
agaaatcatgt

SEQ ID NO: 6623505 - DNA, 16 bp, Homo sapiens
agaaatcatgtccata

SEQ ID NO: 6623506 - DNA, 14 bp, Homo sapiens
agaaatcatgttat

SEQ ID NO: 6623507 - DNA, 17 bp, Homo sapiens
agaaatcatgttatgat

SEQ ID NO: 6623508 - DNA, 17 bp, Homo sapiens
agaaatcattgtagaaa

SEQ ID NO: 6623509 - DNA, 16 bp, Homo sapiens
agaaatccaaatttct

SEQ ID NO: 6623510 - DNA, 13 bp, Homo sapiens
agaaatccagatc

SEQ ID NO: 6623511 - DNA, 23 bp, Homo sapiens
agaaatccagtttgtgtttttct

SEQ ID NO: 6623512 - DNA, 21 bp, Homo sapiens
agaaatccatatcttaaagaa

SEQ ID NO: 6623513 - DNA, 21 bp, Homo sapiens
agaaatccccctttctctaat

SEQ ID NO: 6623514 - DNA, 16 bp, Homo sapiens
agaaatcccctaactg

SEQ ID NO: 6623515 - DNA, 18 bp, Homo sapiens
agaaatcctgcaatgaaa

SEQ ID NO: 6623516 - DNA, 19 bp, Homo sapiens
agaaatcctttcataaagc

SEQ ID NO: 6623517 - DNA, 15 bp, Homo sapiens
agaaatcgagagtgt

SEQ ID NO: 6623518 - DNA, 18 bp, Homo sapiens
agaaatcgccttatgaga

SEQ ID NO: 6623519 - DNA, 19 bp, Homo sapiens
agaaatctagaatttttac

SEQ ID NO: 6623520 - DNA, 23 bp, Homo sapiens
agaaatctagtatttcatgctgg

SEQ ID NO: 6623521 - DNA, 18 bp, Homo sapiens
agaaatctcacttttctc

SEQ ID NO: 6623522 - DNA, 18 bp, Homo sapiens
agaaatctcctaacaaaa

SEQ ID NO: 6623523 - DNA, 20 bp, Homo sapiens
agaaatctgggatgtactgt

SEQ ID NO: 6623524 - DNA, 19 bp, Homo sapiens
agaaatctgtaattctatt

SEQ ID NO: 6623525 - DNA, 14 bp, Homo sapiens
agaaatctgtttca

SEQ ID NO: 6623526 - DNA, 13 bp, Homo sapiens
agaaatctgtttt

SEQ ID NO: 6623527 - DNA, 16 bp, Homo sapiens
agaaatcttgaatagc

SEQ ID NO: 6623528 - DNA, 14 bp, Homo sapiens
agaaatctttccag

SEQ ID NO: 6623529 - DNA, 12 bp, Homo sapiens
agaaatctttct

SEQ ID NO: 6623530 - DNA, 16 bp, Homo sapiens
agaaatctttctccct

SEQ ID NO: 6623531 - DNA, 15 bp, Homo sapiens
agaaatctttctgga

SEQ ID NO: 6623532 - DNA, 12 bp, Homo sapiens
agaaatgaaaaa

SEQ ID NO: 6623533 - DNA, 23 bp, Homo sapiens
agaaatgaaaaaatatatatcaa

SEQ ID NO: 6623534 - DNA, 11 bp, Homo sapiens
agaaatgaaat

SEQ ID NO: 6623535 - DNA, 18 bp, Homo sapiens
agaaatgaaataaaatgg

SEQ ID NO: 6623536 - DNA, 15 bp, Homo sapiens
agaaatgaaattgac

SEQ ID NO: 6623537 - DNA, 19 bp, Homo sapiens
agaaatgaaattttaccaa

SEQ ID NO: 6623538 - DNA, 20 bp, Homo sapiens
agaaatgaagcagaggaagg

SEQ ID NO: 6623539 - DNA, 22 bp, Homo sapiens
agaaatgaagcagaggaaggaa

SEQ ID NO: 6623540 - DNA, 16 bp, Homo sapiens
agaaatgaataagctt

SEQ ID NO: 6623541 - DNA, 17 bp, Homo sapiens
agaaatgacaatagagg

SEQ ID NO: 6623542 - DNA, 23 bp, Homo sapiens
agaaatgaccaatattatactaa

SEQ ID NO: 6623543 - DNA, 14 bp, Homo sapiens
agaaatgactaatt

SEQ ID NO: 6623544 - DNA, 19 bp, Homo sapiens
agaaatgagatcaggctct

SEQ ID NO: 6623545 - DNA, 22 bp, Homo sapiens
agaaatgattcaaattgctgct

SEQ ID NO: 6623546 - DNA, 15 bp, Homo sapiens
agaaatgattcaggg

SEQ ID NO: 6623547 - DNA, 21 bp, Homo sapiens
agaaatgatttcaaaatgata

SEQ ID NO: 6623548 - DNA, 19 bp, Homo sapiens
agaaatgcaataactctgg

SEQ ID NO: 6623549 - DNA, 21 bp, Homo sapiens
agaaatgcaataactctggga

SEQ ID NO: 6623550 - DNA, 21 bp, Homo sapiens
agaaatgcagagaagaataag

SEQ ID NO: 6623551 - DNA, 16 bp, Homo sapiens
agaaatgccagaaaca

SEQ ID NO: 6623552 - DNA, 22 bp, Homo sapiens
agaaatgcccccattctcccag

SEQ ID NO: 6623553 - DNA, 15 bp, Homo sapiens
agaaatgccttaccc

SEQ ID NO: 6623554 - DNA, 22 bp, Homo sapiens
agaaatgctaatgtaatcattt

SEQ ID NO: 6623555 - DNA, 15 bp, Homo sapiens
agaaatgctgcccat

SEQ ID NO: 6623556 - DNA, 15 bp, Homo sapiens
agaaatgctgcctgc

SEQ ID NO: 6623557 - DNA, 14 bp, Homo sapiens
agaaatgctgctgg

SEQ ID NO: 6623558 - DNA, 15 bp, Homo sapiens
agaaatgctgctggc

SEQ ID NO: 6623559 - DNA, 21 bp, Homo sapiens
agaaatgctggtttttcagtt

SEQ ID NO: 6623560 - DNA, 13 bp, Homo sapiens
agaaatgctgttc

SEQ ID NO: 6623561 - DNA, 15 bp, Homo sapiens
agaaatgcttagaaa

SEQ ID NO: 6623562 - DNA, 20 bp, Homo sapiens
agaaatggacaaagaaaacg

SEQ ID NO: 6623563 - DNA, 23 bp, Homo sapiens
agaaatggcgtctgctctggtgg

SEQ ID NO: 6623564 - DNA, 15 bp, Homo sapiens
agaaatggctttcca

SEQ ID NO: 6623565 - DNA, 23 bp, Homo sapiens
agaaatgggaaatgcctaagaag

SEQ ID NO: 6623566 - DNA, 17 bp, Homo sapiens
agaaatgggaatcatgg

SEQ ID NO: 6623567 - DNA, 13 bp, Homo sapiens
agaaatgggcagt

SEQ ID NO: 6623568 - DNA, 13 bp, Homo sapiens
agaaatgggcctg

SEQ ID NO: 6623569 - DNA, 21 bp, Homo sapiens
agaaatggtccgctttcctgg

SEQ ID NO: 6623570 - DNA, 18 bp, Homo sapiens
agaaatggttgtattaga

SEQ ID NO: 6623571 - DNA, 22 bp, Homo sapiens
agaaatggttgtattagatgtt

SEQ ID NO: 6623572 - DNA, 17 bp, Homo sapiens
agaaatggtttcctctg

SEQ ID NO: 6623573 - DNA, 15 bp, Homo sapiens
agaaatgtaaactgc

SEQ ID NO: 6623574 - DNA, 15 bp, Homo sapiens
agaaatgtaaatgtt

SEQ ID NO: 6623575 - DNA, 14 bp, Homo sapiens
agaaatgtacagca

SEQ ID NO: 6623576 - DNA, 17 bp, Homo sapiens
agaaatgtacagcaagg

SEQ ID NO: 6623577 - DNA, 14 bp, Homo sapiens
agaaatgtactact

SEQ ID NO: 6623578 - DNA, 23 bp, Homo sapiens
agaaatgtagcagcagcctactg

SEQ ID NO: 6623579 - DNA, 19 bp, Homo sapiens
agaaatgtagctgaagtag

SEQ ID NO: 6623580 - DNA, 14 bp, Homo sapiens
agaaatgtattcct

SEQ ID NO: 6623581 - DNA, 12 bp, Homo sapiens
agaaatgtattt

SEQ ID NO: 6623582 - DNA, 21 bp, Homo sapiens
agaaatgtattttgaaaacac

SEQ ID NO: 6623583 - DNA, 15 bp, Homo sapiens
agaaatgtcataaat

SEQ ID NO: 6623584 - DNA, 19 bp, Homo sapiens
agaaatgtcatgattgccg

SEQ ID NO: 6623585 - DNA, 19 bp, Homo sapiens
agaaatgtccctttcttct

SEQ ID NO: 6623586 - DNA, 15 bp, Homo sapiens
agaaatgtctggaga

SEQ ID NO: 6623587 - DNA, 19 bp, Homo sapiens
agaaatgtctggagaataa

SEQ ID NO: 6623588 - DNA, 16 bp, Homo sapiens
agaaatgtcttaattt

SEQ ID NO: 6623589 - DNA, 22 bp, Homo sapiens
agaaatgtgaagttttctttta

SEQ ID NO: 6623590 - DNA, 14 bp, Homo sapiens
agaaatgtgctgca

SEQ ID NO: 6623591 - DNA, 19 bp, Homo sapiens
agaaatgtggatgctcttt

SEQ ID NO: 6623592 - DNA, 11 bp, Homo sapiens
agaaatgtgtt

SEQ ID NO: 6623593 - DNA, 18 bp, Homo sapiens
agaaatgtttaagccaaa

SEQ ID NO: 6623594 - DNA, 21 bp, Homo sapiens
agaaatgtttatacaataatt

SEQ ID NO: 6623595 - DNA, 13 bp, Homo sapiens
agaaattaaaata

SEQ ID NO: 6623596 - DNA, 21 bp, Homo sapiens
agaaattaaaatattatttga

SEQ ID NO: 6623597 - DNA, 19 bp, Homo sapiens
agaaattaacaataaagaa

SEQ ID NO: 6623598 - DNA, 21 bp, Homo sapiens
agaaattaatatattagtgaa

SEQ ID NO: 6623599 - DNA, 14 bp, Homo sapiens
agaaattacaagtt

SEQ ID NO: 6623600 - DNA, 18 bp, Homo sapiens
agaaattacaggttcctt

SEQ ID NO: 6623601 - DNA, 13 bp, Homo sapiens
agaaattagattt

SEQ ID NO: 6623602 - DNA, 16 bp, Homo sapiens
agaaattagatttgtg

SEQ ID NO: 6623603 - DNA, 14 bp, Homo sapiens
agaaattagccggg

SEQ ID NO: 6623604 - DNA, 20 bp, Homo sapiens
agaaattagggctctaattt

SEQ ID NO: 6623605 - DNA, 23 bp, Homo sapiens
agaaattagggctctaatttcct

SEQ ID NO: 6623606 - DNA, 19 bp, Homo sapiens
agaaattagtcacttaaaa

SEQ ID NO: 6623607 - DNA, 17 bp, Homo sapiens
agaaattatctttagtt

SEQ ID NO: 6623608 - DNA, 19 bp, Homo sapiens
agaaattatctttagttga

SEQ ID NO: 6623609 - DNA, 23 bp, Homo sapiens
agaaattatctttagttgaattc

SEQ ID NO: 6623610 - DNA, 13 bp, Homo sapiens
agaaattatgtgc

SEQ ID NO: 6623611 - DNA, 21 bp, Homo sapiens
agaaattatgtgccagattta

SEQ ID NO: 6623612 - DNA, 14 bp, Homo sapiens
agaaattattagat

SEQ ID NO: 6623613 - DNA, 15 bp, Homo sapiens
agaaattatttaata

SEQ ID NO: 6623614 - DNA, 20 bp, Homo sapiens
agaaattatttaatatgcat

SEQ ID NO: 6623615 - DNA, 13 bp, Homo sapiens
agaaattcaagaa

SEQ ID NO: 6623616 - DNA, 19 bp, Homo sapiens
agaaattcaatttggattt

SEQ ID NO: 6623617 - DNA, 20 bp, Homo sapiens
agaaattcaggtacagaaaa

SEQ ID NO: 6623618 - DNA, 16 bp, Homo sapiens
agaaattcattaaaga

SEQ ID NO: 6623619 - DNA, 18 bp, Homo sapiens
agaaattcattaaagaaa

SEQ ID NO: 6623620 - DNA, 20 bp, Homo sapiens
agaaattcattaaagaaaaa

SEQ ID NO: 6623621 - DNA, 19 bp, Homo sapiens
agaaattccaactcctgat

SEQ ID NO: 6623622 - DNA, 21 bp, Homo sapiens
agaaattccatacttctctca

SEQ ID NO: 6623623 - DNA, 24 bp, Homo sapiens
agaaattccctggaccagatgctg

SEQ ID NO: 6623624 - DNA, 21 bp, Homo sapiens
agaaattcgcatgtttaatgt

SEQ ID NO: 6623625 - DNA, 19 bp, Homo sapiens
agaaattcgccccattttc

SEQ ID NO: 6623626 - DNA, 11 bp, Homo sapiens
agaaattctat

SEQ ID NO: 6623627 - DNA, 20 bp, Homo sapiens
agaaattctataagagacaa

SEQ ID NO: 6623628 - DNA, 17 bp, Homo sapiens
agaaattctcaaaatac

SEQ ID NO: 6623629 - DNA, 14 bp, Homo sapiens
agaaattctcttta

SEQ ID NO: 6623630 - DNA, 16 bp, Homo sapiens
agaaattctggcccag

SEQ ID NO: 6623631 - DNA, 13 bp, Homo sapiens
agaaattctgtgg

SEQ ID NO: 6623632 - DNA, 13 bp, Homo sapiens
agaaattctgtta

SEQ ID NO: 6623633 - DNA, 16 bp, Homo sapiens
agaaattctgttttta

SEQ ID NO: 6623634 - DNA, 19 bp, Homo sapiens
agaaattctgtttttaaaa

SEQ ID NO: 6623635 - DNA, 20 bp, Homo sapiens
agaaattcttcaatttgaaa

SEQ ID NO: 6623636 - DNA, 22 bp, Homo sapiens
agaaattcttttcaaaagctga

SEQ ID NO: 6623637 - DNA, 15 bp, Homo sapiens
agaaattgaatactt

SEQ ID NO: 6623638 - DNA, 17 bp, Homo sapiens
agaaattgaatgtacct

SEQ ID NO: 6623639 - DNA, 23 bp, Homo sapiens
agaaattgacctgatttccattt

SEQ ID NO: 6623640 - DNA, 23 bp, Homo sapiens
agaaattgaggttgttcaaagtt

SEQ ID NO: 6623641 - DNA, 20 bp, Homo sapiens
agaaattgcatttcctgaca

SEQ ID NO: 6623642 - DNA, 14 bp, Homo sapiens
agaaattgcctatc

SEQ ID NO: 6623643 - DNA, 19 bp, Homo sapiens
agaaattggaacagaatgt

SEQ ID NO: 6623644 - DNA, 14 bp, Homo sapiens
agaaattggctgga

SEQ ID NO: 6623645 - DNA, 19 bp, Homo sapiens
agaaattgggctggattgt

SEQ ID NO: 6623646 - DNA, 18 bp, Homo sapiens
agaaattggtaccttgca

SEQ ID NO: 6623647 - DNA, 22 bp, Homo sapiens
agaaattggtattatcaaagca

SEQ ID NO: 6623648 - DNA, 17 bp, Homo sapiens
agaaattgtatattgta

SEQ ID NO: 6623649 - DNA, 21 bp, Homo sapiens
agaaattgtccttgaagcttg

SEQ ID NO: 6623650 - DNA, 18 bp, Homo sapiens
agaaattgtgaaaaatga

SEQ ID NO: 6623651 - DNA, 18 bp, Homo sapiens
agaaattgtgccaaagat

SEQ ID NO: 6623652 - DNA, 19 bp, Homo sapiens
agaaattgtgccaaagata

SEQ ID NO: 6623653 - DNA, 18 bp, Homo sapiens
agaaatttaaaagacact

SEQ ID NO: 6623654 - DNA, 16 bp, Homo sapiens
agaaatttaaactata

SEQ ID NO: 6623655 - DNA, 20 bp, Homo sapiens
agaaatttaaactataagca

SEQ ID NO: 6623656 - DNA, 21 bp, Homo sapiens
agaaatttaattcatgtttct

SEQ ID NO: 6623657 - DNA, 21 bp, Homo sapiens
agaaatttaccacaaaagcaa

SEQ ID NO: 6623658 - DNA, 16 bp, Homo sapiens
agaaatttactatata

SEQ ID NO: 6623659 - DNA, 17 bp, Homo sapiens
agaaatttactatatat

SEQ ID NO: 6623660 - DNA, 19 bp, Homo sapiens
agaaatttactatatatat

SEQ ID NO: 6623661 - DNA, 18 bp, Homo sapiens
agaaatttagagtcaatt

SEQ ID NO: 6623662 - DNA, 16 bp, Homo sapiens
agaaatttataaactt

SEQ ID NO: 6623663 - DNA, 23 bp, Homo sapiens
agaaatttattcttatcttagga

SEQ ID NO: 6623664 - DNA, 22 bp, Homo sapiens
agaaatttccactcaggtctgt

SEQ ID NO: 6623665 - DNA, 14 bp, Homo sapiens
agaaatttccagag

SEQ ID NO: 6623666 - DNA, 17 bp, Homo sapiens
agaaatttctgtgaaac

SEQ ID NO: 6623667 - DNA, 14 bp, Homo sapiens
agaaatttgaaaaa

SEQ ID NO: 6623668 - DNA, 13 bp, Homo sapiens
agaaatttgcaac

SEQ ID NO: 6623669 - DNA, 16 bp, Homo sapiens
agaaatttgcaactca

SEQ ID NO: 6623670 - DNA, 20 bp, Homo sapiens
agaaatttgcaactcactga

SEQ ID NO: 6623671 - DNA, 14 bp, Homo sapiens
agaaatttggcatt

SEQ ID NO: 6623672 - DNA, 19 bp, Homo sapiens
agaaatttgtctttttgta

SEQ ID NO: 6623673 - DNA, 22 bp, Homo sapiens
agaaattttactgacagaaatg

SEQ ID NO: 6623674 - DNA, 23 bp, Homo sapiens
agaaattttactgacagaaatgc

SEQ ID NO: 6623675 - DNA, 13 bp, Homo sapiens
agaaattttagta

SEQ ID NO: 6623676 - DNA, 23 bp, Homo sapiens
agaaattttattagacattctct

SEQ ID NO: 6623677 - DNA, 12 bp, Homo sapiens
agaaattttcaa

SEQ ID NO: 6623678 - DNA, 16 bp, Homo sapiens
agaaattttgtaagaa

SEQ ID NO: 6623679 - DNA, 17 bp, Homo sapiens
agaaattttgtaagaag

SEQ ID NO: 6623680 - DNA, 20 bp, Homo sapiens
agaaatttttaccaactcta

SEQ ID NO: 6623681 - DNA, 16 bp, Homo sapiens
agaaatttttatcagt

SEQ ID NO: 6623682 - DNA, 17 bp, Homo sapiens
agaaatttttatcagtt

SEQ ID NO: 6623683 - DNA, 22 bp, Homo sapiens
agaaatttttatttttctaagg

SEQ ID NO: 6623684 - DNA, 19 bp, Homo sapiens
agaaatttttatttttgaa

SEQ ID NO: 6623685 - DNA, 21 bp, Homo sapiens
agaaatttttcagatgcttct

SEQ ID NO: 6623686 - DNA, 14 bp, Homo sapiens
agaaattttttcat

SEQ ID NO: 6623687 - DNA, 18 bp, Homo sapiens
agaaatttttttccagaa

SEQ ID NO: 6623688 - DNA, 10 bp, Homo sapiens
agaacaaaaa

SEQ ID NO: 6623689 - DNA, 19 bp, Homo sapiens
agaacaaaaaaatctgcag

SEQ ID NO: 6623690 - DNA, 17 bp, Homo sapiens
agaacaaaaccccagaa

SEQ ID NO: 6623691 - DNA, 15 bp, Homo sapiens
agaacaaactcagat

SEQ ID NO: 6623692 - DNA, 19 bp, Homo sapiens
agaacaaactcagatctca

SEQ ID NO: 6623693 - DNA, 16 bp, Homo sapiens
agaacaaagagtgaaa

SEQ ID NO: 6623694 - DNA, 14 bp, Homo sapiens
agaacaaagctgtt

SEQ ID NO: 6623695 - DNA, 16 bp, Homo sapiens
agaacaaagctgttaa

SEQ ID NO: 6623696 - DNA, 22 bp, Homo sapiens
agaacaaagctgttaaactgtt

SEQ ID NO: 6623697 - DNA, 18 bp, Homo sapiens
agaacaaatattcagaat

SEQ ID NO: 6623698 - DNA, 12 bp, Homo sapiens
agaacaaatgaa

SEQ ID NO: 6623699 - DNA, 15 bp, Homo sapiens
agaacaaatgtgttt

SEQ ID NO: 6623700 - DNA, 18 bp, Homo sapiens
agaacaaatgtgtttttc

SEQ ID NO: 6623701 - DNA, 21 bp, Homo sapiens
agaacaaatgtgtttttctat

SEQ ID NO: 6623702 - DNA, 22 bp, Homo sapiens
agaacaacaaatatgttctctg

SEQ ID NO: 6623703 - DNA, 14 bp, Homo sapiens
agaacaacaacaaa

SEQ ID NO: 6623704 - DNA, 18 bp, Homo sapiens
agaacaacaacaacaata

SEQ ID NO: 6623705 - DNA, 22 bp, Homo sapiens
agaacaacaacaacaataacaa

SEQ ID NO: 6623706 - DNA, 17 bp, Homo sapiens
agaacaaccaaaatctt

SEQ ID NO: 6623707 - DNA, 11 bp, Homo sapiens
agaacaacttg

SEQ ID NO: 6623708 - DNA, 16 bp, Homo sapiens
agaacaacttgctact

SEQ ID NO: 6623709 - DNA, 22 bp, Homo sapiens
agaacaagaaagggccaggaga

SEQ ID NO: 6623710 - DNA, 18 bp, Homo sapiens
agaacaagaaatctttct

SEQ ID NO: 6623711 - DNA, 20 bp, Homo sapiens
agaacaagaaatctttctgg

SEQ ID NO: 6623712 - DNA, 20 bp, Homo sapiens
agaacaagagtttgttctgt

SEQ ID NO: 6623713 - DNA, 17 bp, Homo sapiens
agaacaagccagagccg

SEQ ID NO: 6623714 - DNA, 17 bp, Homo sapiens
agaacaaggaattgctt

SEQ ID NO: 6623715 - DNA, 18 bp, Homo sapiens
agaacaagtcacagctgc

SEQ ID NO: 6623716 - DNA, 19 bp, Homo sapiens
agaacaagtcacagctgca

SEQ ID NO: 6623717 - DNA, 18 bp, Homo sapiens
agaacaagtgcctcctgg

SEQ ID NO: 6623718 - DNA, 19 bp, Homo sapiens
agaacaagttttggcagcc

SEQ ID NO: 6623719 - DNA, 17 bp, Homo sapiens
agaacaataatgagagc

SEQ ID NO: 6623720 - DNA, 16 bp, Homo sapiens
agaacaatagctattg

SEQ ID NO: 6623721 - DNA, 19 bp, Homo sapiens
agaacaatagctattgcat

SEQ ID NO: 6623722 - DNA, 13 bp, Homo sapiens
agaacaatcacta

SEQ ID NO: 6623723 - DNA, 17 bp, Homo sapiens
agaacaatcactattct

SEQ ID NO: 6623724 - DNA, 19 bp, Homo sapiens
agaacaatcactattctta

SEQ ID NO: 6623725 - DNA, 16 bp, Homo sapiens
agaacaattacatgta

SEQ ID NO: 6623726 - DNA, 17 bp, Homo sapiens
agaacaattatgtttct

SEQ ID NO: 6623727 - DNA, 17 bp, Homo sapiens
agaacacaaaacttgaa

SEQ ID NO: 6623728 - DNA, 15 bp, Homo sapiens
agaacacaaagcggg

SEQ ID NO: 6623729 - DNA, 21 bp, Homo sapiens
agaacacaagccacgcctgcg

SEQ ID NO: 6623730 - DNA, 12 bp, Homo sapiens
agaacacacaga

SEQ ID NO: 6623731 - DNA, 19 bp, Homo sapiens
agaacacacagactttctg

SEQ ID NO: 6623732 - DNA, 19 bp, Homo sapiens
agaacacagaaagcctatc

SEQ ID NO: 6623733 - DNA, 21 bp, Homo sapiens
agaacacagaaagcctatcaa

SEQ ID NO: 6623734 - DNA, 11 bp, Homo sapiens
agaacacagtt

SEQ ID NO: 6623735 - DNA, 17 bp, Homo sapiens
agaacacatttctaatt

SEQ ID NO: 6623736 - DNA, 17 bp, Homo sapiens
agaacaccaagacttga

SEQ ID NO: 6623737 - DNA, 17 bp, Homo sapiens
agaacaccaagtaaatc

SEQ ID NO: 6623738 - DNA, 20 bp, Homo sapiens
agaacaccaagtaaatctat

SEQ ID NO: 6623739 - DNA, 15 bp, Homo sapiens
agaacacccactggc

SEQ ID NO: 6623740 - DNA, 16 bp, Homo sapiens
agaacacccactggcc

SEQ ID NO: 6623741 - DNA, 21 bp, Homo sapiens
agaacaccccgctctggcagt

SEQ ID NO: 6623742 - DNA, 21 bp, Homo sapiens
agaacacctgacaacttctga

SEQ ID NO: 6623743 - DNA, 11 bp, Homo sapiens
agaacacctgg

SEQ ID NO: 6623744 - DNA, 11 bp, Homo sapiens
agaacactaat

SEQ ID NO: 6623745 - DNA, 16 bp, Homo sapiens
agaacactattttcag

SEQ ID NO: 6623746 - DNA, 18 bp, Homo sapiens
agaacactattttcagaa

SEQ ID NO: 6623747 - DNA, 21 bp, Homo sapiens
agaacactattttcagaatct

SEQ ID NO: 6623748 - DNA, 23 bp, Homo sapiens
agaacactattttcagaatctga

SEQ ID NO: 6623749 - DNA, 20 bp, Homo sapiens
agaacactcgaaaagagcac

SEQ ID NO: 6623750 - DNA, 22 bp, Homo sapiens
agaacactcgaaaagagcactt

SEQ ID NO: 6623751 - DNA, 14 bp, Homo sapiens
agaacactgcctct

SEQ ID NO: 6623752 - DNA, 16 bp, Homo sapiens
agaacactgcctctga

SEQ ID NO: 6623753 - DNA, 23 bp, Homo sapiens
agaacactgcctctgagttttga

SEQ ID NO: 6623754 - DNA, 11 bp, Homo sapiens
agaacactggt

SEQ ID NO: 6623755 - DNA, 12 bp, Homo sapiens
agaacacttatg

SEQ ID NO: 6623756 - DNA, 13 bp, Homo sapiens
agaacacttcaga

SEQ ID NO: 6623757 - DNA, 20 bp, Homo sapiens
agaacacttcagcctgtgca

SEQ ID NO: 6623758 - DNA, 10 bp, Homo sapiens
agaacagaaa

SEQ ID NO: 6623759 - DNA, 13 bp, Homo sapiens
agaacagaaaaca

SEQ ID NO: 6623760 - DNA, 22 bp, Homo sapiens
agaacagaaaacaacaaaaaat

SEQ ID NO: 6623761 - DNA, 14 bp, Homo sapiens
agaacagaggcatt

SEQ ID NO: 6623762 - DNA, 16 bp, Homo sapiens
agaacagagggccaga

SEQ ID NO: 6623763 - DNA, 18 bp, Homo sapiens
agaacagagggccagagc

SEQ ID NO: 6623764 - DNA, 19 bp, Homo sapiens
agaacagataatcagtgtg

SEQ ID NO: 6623765 - DNA, 18 bp, Homo sapiens
agaacagatctccaaagc

SEQ ID NO: 6623766 - DNA, 15 bp, Homo sapiens
agaacagatggggtc

SEQ ID NO: 6623767 - DNA, 18 bp, Homo sapiens
agaacagcagaggttctt

SEQ ID NO: 6623768 - DNA, 19 bp, Homo sapiens
agaacagcaggcccaccta

SEQ ID NO: 6623769 - DNA, 23 bp, Homo sapiens
agaacagcagggtagtctggttt

SEQ ID NO: 6623770 - DNA, 18 bp, Homo sapiens
agaacagctgttcctgtg

SEQ ID NO: 6623771 - DNA, 12 bp, Homo sapiens
agaacagcttca

SEQ ID NO: 6623772 - DNA, 14 bp, Homo sapiens
agaacagcttcagg

SEQ ID NO: 6623773 - DNA, 18 bp, Homo sapiens
agaacagcttcaggttat

SEQ ID NO: 6623774 - DNA, 18 bp, Homo sapiens
agaacaggacctctgctt

SEQ ID NO: 6623775 - DNA, 11 bp, Homo sapiens
agaacaggact

SEQ ID NO: 6623776 - DNA, 14 bp, Homo sapiens
agaacaggctggtt

SEQ ID NO: 6623777 - DNA, 20 bp, Homo sapiens
agaacaggcttggcaaagaa

SEQ ID NO: 6623778 - DNA, 20 bp, Homo sapiens
agaacagggaaaataggcag

SEQ ID NO: 6623779 - DNA, 22 bp, Homo sapiens
agaacagggaaaataggcagga

SEQ ID NO: 6623780 - DNA, 22 bp, Homo sapiens
agaacagggcgggggggggggc

SEQ ID NO: 6623781 - DNA, 11 bp, Homo sapiens
agaacagggtc

SEQ ID NO: 6623782 - DNA, 19 bp, Homo sapiens
agaacaggtgttcctcctc

SEQ ID NO: 6623783 - DNA, 23 bp, Homo sapiens
agaacaggtgttggtgacaattg

SEQ ID NO: 6623784 - DNA, 23 bp, Homo sapiens
agaacaggttcttaaaaaggaac

SEQ ID NO: 6623785 - DNA, 17 bp, Homo sapiens
agaacaggtttttttgt

SEQ ID NO: 6623786 - DNA, 17 bp, Homo sapiens
agaacagtatctttgca

SEQ ID NO: 6623787 - DNA, 14 bp, Homo sapiens
agaacagtatgaat

SEQ ID NO: 6623788 - DNA, 20 bp, Homo sapiens
agaacagtatgaatttgagc

SEQ ID NO: 6623789 - DNA, 20 bp, Homo sapiens
agaacagtattgggcaggag

SEQ ID NO: 6623790 - DNA, 18 bp, Homo sapiens
agaacagtctctggaaga

SEQ ID NO: 6623791 - DNA, 22 bp, Homo sapiens
agaacagtgattaccagggact

SEQ ID NO: 6623792 - DNA, 18 bp, Homo sapiens
agaacagtggaaactatg

SEQ ID NO: 6623793 - DNA, 22 bp, Homo sapiens
agaacagtggaaactatgtgtt

SEQ ID NO: 6623794 - DNA, 22 bp, Homo sapiens
agaacagtggttgcctgggggc

SEQ ID NO: 6623795 - DNA, 21 bp, Homo sapiens
agaacagtgtttgatttttat

SEQ ID NO: 6623796 - DNA, 20 bp, Homo sapiens
agaacagttaagcagccgcc

SEQ ID NO: 6623797 - DNA, 14 bp, Homo sapiens
agaacataaagcaa

SEQ ID NO: 6623798 - DNA, 21 bp, Homo sapiens
agaacatagacagaagaaaca

SEQ ID NO: 6623799 - DNA, 18 bp, Homo sapiens
agaacatcattagaacaa

SEQ ID NO: 6623800 - DNA, 18 bp, Homo sapiens
agaacatcccgcttctga

SEQ ID NO: 6623801 - DNA, 17 bp, Homo sapiens
agaacatccctcctggg

SEQ ID NO: 6623802 - DNA, 16 bp, Homo sapiens
agaacatccctgccag

SEQ ID NO: 6623803 - DNA, 18 bp, Homo sapiens
agaacatccctgccagct

SEQ ID NO: 6623804 - DNA, 19 bp, Homo sapiens
agaacatccctgccagctc

SEQ ID NO: 6623805 - DNA, 18 bp, Homo sapiens
agaacatccctgggcaag

SEQ ID NO: 6623806 - DNA, 17 bp, Homo sapiens
agaacatctgccttgct

SEQ ID NO: 6623807 - DNA, 18 bp, Homo sapiens
agaacatgaatctctaac

SEQ ID NO: 6623808 - DNA, 15 bp, Homo sapiens
agaacatgatgggcc

SEQ ID NO: 6623809 - DNA, 18 bp, Homo sapiens
agaacatgatgggcctga

SEQ ID NO: 6623810 - DNA, 17 bp, Homo sapiens
agaacatgcaagaattt

SEQ ID NO: 6623811 - DNA, 17 bp, Homo sapiens
agaacatgcagtttgaa

SEQ ID NO: 6623812 - DNA, 23 bp, Homo sapiens
agaacatgcagtttgaaattctg

SEQ ID NO: 6623813 - DNA, 19 bp, Homo sapiens
agaacatgtagaaaacaaa

SEQ ID NO: 6623814 - DNA, 13 bp, Homo sapiens
agaacatgtgaga

SEQ ID NO: 6623815 - DNA, 18 bp, Homo sapiens
agaacattcacttttgtt

SEQ ID NO: 6623816 - DNA, 19 bp, Homo sapiens
agaacattcacttttgtta

SEQ ID NO: 6623817 - DNA, 15 bp, Homo sapiens
agaacattcagctct

SEQ ID NO: 6623818 - DNA, 16 bp, Homo sapiens
agaacattcagctctg

SEQ ID NO: 6623819 - DNA, 21 bp, Homo sapiens
agaacattcgaatctctgccc

SEQ ID NO: 6623820 - DNA, 13 bp, Homo sapiens
agaacattcttat

SEQ ID NO: 6623821 - DNA, 22 bp, Homo sapiens
agaacattcttatattttatca

SEQ ID NO: 6623822 - DNA, 16 bp, Homo sapiens
agaacattgatctgtt

SEQ ID NO: 6623823 - DNA, 18 bp, Homo sapiens
agaacattgattgctgtg

SEQ ID NO: 6623824 - DNA, 19 bp, Homo sapiens
agaacattggtattcgctt

SEQ ID NO: 6623825 - DNA, 22 bp, Homo sapiens
agaacatttaaaattaaataaa

SEQ ID NO: 6623826 - DNA, 23 bp, Homo sapiens
agaacatttaaaattaaataaat

SEQ ID NO: 6623827 - DNA, 11 bp, Homo sapiens
agaacatttac

SEQ ID NO: 6623828 - DNA, 17 bp, Homo sapiens
agaacatttacacattc

SEQ ID NO: 6623829 - DNA, 12 bp, Homo sapiens
agaacatttctc

SEQ ID NO: 6623830 - DNA, 16 bp, Homo sapiens
agaacatttctcatgt

SEQ ID NO: 6623831 - DNA, 13 bp, Homo sapiens
agaacattttaat

SEQ ID NO: 6623832 - DNA, 12 bp, Homo sapiens
agaacattttac

SEQ ID NO: 6623833 - DNA, 13 bp, Homo sapiens
agaacattttact

SEQ ID NO: 6623834 - DNA, 15 bp, Homo sapiens
agaacattttactgt

SEQ ID NO: 6623835 - DNA, 16 bp, Homo sapiens
agaacattttactgtt

SEQ ID NO: 6623836 - DNA, 19 bp, Homo sapiens
agaaccaaaagatgccttg

SEQ ID NO: 6623837 - DNA, 22 bp, Homo sapiens
agaaccaaaccgcaaacgtgaa

SEQ ID NO: 6623838 - DNA, 23 bp, Homo sapiens
agaaccaaactcctatttcaatg

SEQ ID NO: 6623839 - DNA, 11 bp, Homo sapiens
agaaccaaaga

SEQ ID NO: 6623840 - DNA, 19 bp, Homo sapiens
agaaccaaagaagaaagtc

SEQ ID NO: 6623841 - DNA, 17 bp, Homo sapiens
agaaccaaatacctcaa

SEQ ID NO: 6623842 - DNA, 13 bp, Homo sapiens
agaaccaaatctt

SEQ ID NO: 6623843 - DNA, 14 bp, Homo sapiens
agaaccaacaaaac

SEQ ID NO: 6623844 - DNA, 16 bp, Homo sapiens
agaaccaacgggtctg

SEQ ID NO: 6623845 - DNA, 17 bp, Homo sapiens
agaaccaacgggtctgt

SEQ ID NO: 6623846 - DNA, 18 bp, Homo sapiens
agaaccaactgcattggt

SEQ ID NO: 6623847 - DNA, 19 bp, Homo sapiens
agaaccaagcttcagagcc

SEQ ID NO: 6623848 - DNA, 23 bp, Homo sapiens
agaaccaagcttcagagcctagc

SEQ ID NO: 6623849 - DNA, 14 bp, Homo sapiens
agaaccacagcaga

SEQ ID NO: 6623850 - DNA, 19 bp, Homo sapiens
agaaccacagcagacacca

SEQ ID NO: 6623851 - DNA, 22 bp, Homo sapiens
agaaccacagggctattttgtt

SEQ ID NO: 6623852 - DNA, 13 bp, Homo sapiens
agaaccacttcct

SEQ ID NO: 6623853 - DNA, 20 bp, Homo sapiens
agaaccacttcctgctacag

SEQ ID NO: 6623854 - DNA, 19 bp, Homo sapiens
agaaccacttggctgctca

SEQ ID NO: 6623855 - DNA, 23 bp, Homo sapiens
agaaccagagggcatgctgaatg

SEQ ID NO: 6623856 - DNA, 12 bp, Homo sapiens
agaaccagcaga

SEQ ID NO: 6623857 - DNA, 16 bp, Homo sapiens
agaaccagcagaacag

SEQ ID NO: 6623858 - DNA, 20 bp, Homo sapiens
agaaccagccatatacactt

SEQ ID NO: 6623859 - DNA, 18 bp, Homo sapiens
agaaccagccgtatttta

SEQ ID NO: 6623860 - DNA, 12 bp, Homo sapiens
agaaccagcctc

SEQ ID NO: 6623861 - DNA, 13 bp, Homo sapiens
agaaccagcctca

SEQ ID NO: 6623862 - DNA, 16 bp, Homo sapiens
agaaccaggcatggaa

SEQ ID NO: 6623863 - DNA, 17 bp, Homo sapiens
agaaccaggctgctgca

SEQ ID NO: 6623864 - DNA, 19 bp, Homo sapiens
agaaccagtccccccaccc

SEQ ID NO: 6623865 - DNA, 20 bp, Homo sapiens
agaaccagtcttttgaaaga

SEQ ID NO: 6623866 - DNA, 13 bp, Homo sapiens
agaaccatctttg

SEQ ID NO: 6623867 - DNA, 16 bp, Homo sapiens
agaaccatcttttgtt

SEQ ID NO: 6623868 - DNA, 15 bp, Homo sapiens
agaaccatgcaggaa

SEQ ID NO: 6623869 - DNA, 20 bp, Homo sapiens
agaaccatttaagagactct

SEQ ID NO: 6623870 - DNA, 13 bp, Homo sapiens
agaacccaagtgc

SEQ ID NO: 6623871 - DNA, 14 bp, Homo sapiens
agaacccaagtgcc

SEQ ID NO: 6623872 - DNA, 19 bp, Homo sapiens
agaacccaattttgtttca

SEQ ID NO: 6623873 - DNA, 22 bp, Homo sapiens
agaacccacataaaagccccag

SEQ ID NO: 6623874 - DNA, 14 bp, Homo sapiens
agaacccagggctc

SEQ ID NO: 6623875 - DNA, 22 bp, Homo sapiens
agaacccaggtctgatgccaaa

SEQ ID NO: 6623876 - DNA, 22 bp, Homo sapiens
agaacccagtgtttccacactt

SEQ ID NO: 6623877 - DNA, 15 bp, Homo sapiens
agaaccccaactccc

SEQ ID NO: 6623878 - DNA, 16 bp, Homo sapiens
agaaccccaactccca

SEQ ID NO: 6623879 - DNA, 14 bp, Homo sapiens
agaacccccaggtg

SEQ ID NO: 6623880 - DNA, 13 bp, Homo sapiens
agaacccccctcc

SEQ ID NO: 6623881 - DNA, 23 bp, Homo sapiens
agaaccctagcacaaatttgctt

SEQ ID NO: 6623882 - DNA, 18 bp, Homo sapiens
agaaccctatttaaaact

SEQ ID NO: 6623883 - DNA, 20 bp, Homo sapiens
agaaccctctgtcccacccc

SEQ ID NO: 6623884 - DNA, 20 bp, Homo sapiens
agaaccctgcgtggggacag

SEQ ID NO: 6623885 - DNA, 22 bp, Homo sapiens
agaaccctggtgaggaagctcc

SEQ ID NO: 6623886 - DNA, 17 bp, Homo sapiens
agaacccttctgctttc

SEQ ID NO: 6623887 - DNA, 19 bp, Homo sapiens
agaacccttctgctttcta

SEQ ID NO: 6623888 - DNA, 20 bp, Homo sapiens
agaacccttggcttgcccac

SEQ ID NO: 6623889 - DNA, 15 bp, Homo sapiens
agaaccctttgggag

SEQ ID NO: 6623890 - DNA, 14 bp, Homo sapiens
agaaccgagaaggg

SEQ ID NO: 6623891 - DNA, 20 bp, Homo sapiens
agaaccggtcccagcctggg

SEQ ID NO: 6623892 - DNA, 19 bp, Homo sapiens
agaacctaactgtatcttg

SEQ ID NO: 6623893 - DNA, 15 bp, Homo sapiens
agaacctaattcaat

SEQ ID NO: 6623894 - DNA, 23 bp, Homo sapiens
agaacctacaaaagcttgtgtat

SEQ ID NO: 6623895 - DNA, 17 bp, Homo sapiens
agaacctactgttcctt

SEQ ID NO: 6623896 - DNA, 16 bp, Homo sapiens
agaacctaggaggatg

SEQ ID NO: 6623897 - DNA, 21 bp, Homo sapiens
agaacctcagattcttcattg

SEQ ID NO: 6623898 - DNA, 21 bp, Homo sapiens
agaacctcaggcttccttggc

SEQ ID NO: 6623899 - DNA, 22 bp, Homo sapiens
agaacctcaggtacggagaaga

SEQ ID NO: 6623900 - DNA, 20 bp, Homo sapiens
agaacctcgttgacatgcac

SEQ ID NO: 6623901 - DNA, 17 bp, Homo sapiens
agaacctctaagtgctg

SEQ ID NO: 6623902 - DNA, 13 bp, Homo sapiens
agaacctcttccc

SEQ ID NO: 6623903 - DNA, 19 bp, Homo sapiens
agaacctgagttcccggga

SEQ ID NO: 6623904 - DNA, 20 bp, Homo sapiens
agaacctgagttcccgggag

SEQ ID NO: 6623905 - DNA, 21 bp, Homo sapiens
agaacctgagttcccgggagc

SEQ ID NO: 6623906 - DNA, 20 bp, Homo sapiens
agaacctgcacacaggacag

SEQ ID NO: 6623907 - DNA, 13 bp, Homo sapiens
agaacctggaact

SEQ ID NO: 6623908 - DNA, 15 bp, Homo sapiens
agaacctggaagggc

SEQ ID NO: 6623909 - DNA, 16 bp, Homo sapiens
agaacctggaagggct

SEQ ID NO: 6623910 - DNA, 17 bp, Homo sapiens
agaacctggagagctag

SEQ ID NO: 6623911 - DNA, 12 bp, Homo sapiens
agaacctggagg

SEQ ID NO: 6623912 - DNA, 22 bp, Homo sapiens
agaacctggccttcagtgtacc

SEQ ID NO: 6623913 - DNA, 21 bp, Homo sapiens
agaacctgggttgcagacagg

SEQ ID NO: 6623914 - DNA, 14 bp, Homo sapiens
agaacctggtggct

SEQ ID NO: 6623915 - DNA, 19 bp, Homo sapiens
agaacctgtagaagatgac

SEQ ID NO: 6623916 - DNA, 12 bp, Homo sapiens
agaacctgtcct

SEQ ID NO: 6623917 - DNA, 21 bp, Homo sapiens
agaacctgtccttgcacactc

SEQ ID NO: 6623918 - DNA, 23 bp, Homo sapiens
agaacctgtcttattaagactgg

SEQ ID NO: 6623919 - DNA, 21 bp, Homo sapiens
agaacctgtgctctaagtgaa

SEQ ID NO: 6623920 - DNA, 21 bp, Homo sapiens
agaaccttctagaacctgggc

SEQ ID NO: 6623921 - DNA, 22 bp, Homo sapiens
agaaccttgtcccagccagtga

SEQ ID NO: 6623922 - DNA, 13 bp, Homo sapiens
agaacctttggac

SEQ ID NO: 6623923 - DNA, 19 bp, Homo sapiens
agaaccttttgagtgcctt

SEQ ID NO: 6623924 - DNA, 20 bp, Homo sapiens
agaacgaacacaagaaaaag

SEQ ID NO: 6623925 - DNA, 16 bp, Homo sapiens
agaacgagcctggaag

SEQ ID NO: 6623926 - DNA, 18 bp, Homo sapiens
agaacgagcctggaagca

SEQ ID NO: 6623927 - DNA, 19 bp, Homo sapiens
agaacgagcctggaagcac

SEQ ID NO: 6623928 - DNA, 20 bp, Homo sapiens
agaacgagcctggaagcact

SEQ ID NO: 6623929 - DNA, 23 bp, Homo sapiens
agaacgatgcctgcaggcatgga

SEQ ID NO: 6623930 - DNA, 24 bp, Homo sapiens
agaacgcaacttaggatggctagg

SEQ ID NO: 6623931 - DNA, 13 bp, Homo sapiens
agaacgcacccca

SEQ ID NO: 6623932 - DNA, 22 bp, Homo sapiens
agaacgcagccctagagcctgc

SEQ ID NO: 6623933 - DNA, 15 bp, Homo sapiens
agaacgccagtctcc

SEQ ID NO: 6623934 - DNA, 18 bp, Homo sapiens
agaacgccagtctcccag

SEQ ID NO: 6623935 - DNA, 20 bp, Homo sapiens
agaacgcggtgtgtaacact

SEQ ID NO: 6623936 - DNA, 16 bp, Homo sapiens
agaacgctgatttaaa

SEQ ID NO: 6623937 - DNA, 21 bp, Homo sapiens
agaacgcttcgggaaaatatt

SEQ ID NO: 6623938 - DNA, 13 bp, Homo sapiens
agaacgggcctcc

SEQ ID NO: 6623939 - DNA, 17 bp, Homo sapiens
agaacggggctcttctc

SEQ ID NO: 6623940 - DNA, 20 bp, Homo sapiens
agaacggggctcttctcatt

SEQ ID NO: 6623941 - DNA, 21 bp, Homo sapiens
agaacggggctcttctcattt

SEQ ID NO: 6623942 - DNA, 16 bp, Homo sapiens
agaacggttgccccag

SEQ ID NO: 6623943 - DNA, 16 bp, Homo sapiens
agaacgtatttagcca

SEQ ID NO: 6623944 - DNA, 23 bp, Homo sapiens
agaacgtattttaaaagccacat

SEQ ID NO: 6623945 - DNA, 17 bp, Homo sapiens
agaacgtggctctgctg

SEQ ID NO: 6623946 - DNA, 18 bp, Homo sapiens
agaacgtggctctgctgg

SEQ ID NO: 6623947 - DNA, 13 bp, Homo sapiens
agaacgtggtcag

SEQ ID NO: 6623948 - DNA, 14 bp, Homo sapiens
agaacgttcccttt

SEQ ID NO: 6623949 - DNA, 18 bp, Homo sapiens
agaactaaaggtggccac

SEQ ID NO: 6623950 - DNA, 11 bp, Homo sapiens
agaactaaatg

SEQ ID NO: 6623951 - DNA, 12 bp, Homo sapiens
agaactaaatgt

SEQ ID NO: 6623952 - DNA, 15 bp, Homo sapiens
agaactaactttggt

SEQ ID NO: 6623953 - DNA, 23 bp, Homo sapiens
agaactaagccaacttgatgtga

SEQ ID NO: 6623954 - DNA, 21 bp, Homo sapiens
agaactaaggatttttccatg

SEQ ID NO: 6623955 - DNA, 21 bp, Homo sapiens
agaactaagtaagaaacacaa

SEQ ID NO: 6623956 - DNA, 21 bp, Homo sapiens
agaactaatgataatcccacc

SEQ ID NO: 6623957 - DNA, 18 bp, Homo sapiens
agaactacaaacaaaatt

SEQ ID NO: 6623958 - DNA, 23 bp, Homo sapiens
agaactacaaacaaaatttctat

SEQ ID NO: 6623959 - DNA, 16 bp, Homo sapiens
agaactaccaaaatga

SEQ ID NO: 6623960 - DNA, 20 bp, Homo sapiens
agaactacctggatttgtat

SEQ ID NO: 6623961 - DNA, 19 bp, Homo sapiens
agaactactcagggaatga

SEQ ID NO: 6623962 - DNA, 11 bp, Homo sapiens
agaactacttg

SEQ ID NO: 6623963 - DNA, 20 bp, Homo sapiens
agaactagaggttttatgat

SEQ ID NO: 6623964 - DNA, 23 bp, Homo sapiens
agaactagaggttttatgatatt

SEQ ID NO: 6623965 - DNA, 21 bp, Homo sapiens
agaactagccaaaccaggacc

SEQ ID NO: 6623966 - DNA, 22 bp, Homo sapiens
agaactaggtgtgcaagaacca

SEQ ID NO: 6623967 - DNA, 19 bp, Homo sapiens
agaactaggtttaaaacag

SEQ ID NO: 6623968 - DNA, 14 bp, Homo sapiens
agaactagtttcta

SEQ ID NO: 6623969 - DNA, 17 bp, Homo sapiens
agaactataacattcaa

SEQ ID NO: 6623970 - DNA, 19 bp, Homo sapiens
agaactatatataaatgac

SEQ ID NO: 6623971 - DNA, 22 bp, Homo sapiens
agaactatcatttttacactat

SEQ ID NO: 6623972 - DNA, 19 bp, Homo sapiens
agaactatctgcattatct

SEQ ID NO: 6623973 - DNA, 18 bp, Homo sapiens
agaactatcttcatctga

SEQ ID NO: 6623974 - DNA, 19 bp, Homo sapiens
agaactatcttcatctgag

SEQ ID NO: 6623975 - DNA, 15 bp, Homo sapiens
agaactatgctaatt

SEQ ID NO: 6623976 - DNA, 15 bp, Homo sapiens
agaactatttaaaat

SEQ ID NO: 6623977 - DNA, 19 bp, Homo sapiens
agaactcactggggcctac

SEQ ID NO: 6623978 - DNA, 15 bp, Homo sapiens
agaactcagaagaga

SEQ ID NO: 6623979 - DNA, 19 bp, Homo sapiens
agaactcagccttaagaaa

SEQ ID NO: 6623980 - DNA, 23 bp, Homo sapiens
agaactcagccttaagaaagcta

SEQ ID NO: 6623981 - DNA, 14 bp, Homo sapiens
agaactcagtgcca

SEQ ID NO: 6623982 - DNA, 17 bp, Homo sapiens
agaactccaggccctcc

SEQ ID NO: 6623983 - DNA, 21 bp, Homo sapiens
agaactccatcagaaaaccaa

SEQ ID NO: 6623984 - DNA, 15 bp, Homo sapiens
agaactcccttctcc

SEQ ID NO: 6623985 - DNA, 15 bp, Homo sapiens
agaactccctttcaa

SEQ ID NO: 6623986 - DNA, 19 bp, Homo sapiens
agaactcctacctgaaggc

SEQ ID NO: 6623987 - DNA, 22 bp, Homo sapiens
agaactcctacctgaaggcagg

SEQ ID NO: 6623988 - DNA, 11 bp, Homo sapiens
agaactcctag

SEQ ID NO: 6623989 - DNA, 15 bp, Homo sapiens
agaactcctgactgt

SEQ ID NO: 6623990 - DNA, 17 bp, Homo sapiens
agaactcctgtcttctt

SEQ ID NO: 6623991 - DNA, 18 bp, Homo sapiens
agaactcctgtcttcttt

SEQ ID NO: 6623992 - DNA, 19 bp, Homo sapiens
agaactcctgtcttctttc

SEQ ID NO: 6623993 - DNA, 19 bp, Homo sapiens
agaactccttattttgtat

SEQ ID NO: 6623994 - DNA, 15 bp, Homo sapiens
agaactcctttctaa

SEQ ID NO: 6623995 - DNA, 17 bp, Homo sapiens
agaactcctttctaagg

SEQ ID NO: 6623996 - DNA, 18 bp, Homo sapiens
agaactcgaagcccttcc

SEQ ID NO: 6623997 - DNA, 22 bp, Homo sapiens
agaactcgaagcccttccagtg

SEQ ID NO: 6623998 - DNA, 18 bp, Homo sapiens
agaactcggtgtccccac

SEQ ID NO: 6623999 - DNA, 19 bp, Homo sapiens
agaactcggtgtccccacc

SEQ ID NO: 6624000 - DNA, 18 bp, Homo sapiens
agaactcgttaaagcaaa

SEQ ID NO: 6624001 - DNA, 16 bp, Homo sapiens
agaactctaaccagtg

SEQ ID NO: 6624002 - DNA, 20 bp, Homo sapiens
agaactctaaccagtgtaca

SEQ ID NO: 6624003 - DNA, 19 bp, Homo sapiens
agaactctagagagcctta

SEQ ID NO: 6624004 - DNA, 23 bp, Homo sapiens
agaactctccatcttattttcat

SEQ ID NO: 6624005 - DNA, 15 bp, Homo sapiens
agaactctcctcttt

SEQ ID NO: 6624006 - DNA, 14 bp, Homo sapiens
agaactctctgtct

SEQ ID NO: 6624007 - DNA, 21 bp, Homo sapiens
agaactctctgtcttctctcc

SEQ ID NO: 6624008 - DNA, 23 bp, Homo sapiens
agaactctctgtcttctctccac

SEQ ID NO: 6624009 - DNA, 14 bp, Homo sapiens
agaactctgcaggc

SEQ ID NO: 6624010 - DNA, 14 bp, Homo sapiens
agaactctgcctgc

SEQ ID NO: 6624011 - DNA, 13 bp, Homo sapiens
agaactctgggca

SEQ ID NO: 6624012 - DNA, 20 bp, Homo sapiens
agaactcttaaatacttttt

SEQ ID NO: 6624013 - DNA, 20 bp, Homo sapiens
agaactcttcctcctcccaa

SEQ ID NO: 6624014 - DNA, 21 bp, Homo sapiens
agaactcttcctcctcccaag

SEQ ID NO: 6624015 - DNA, 19 bp, Homo sapiens
agaactgaaaacataaaaa

SEQ ID NO: 6624016 - DNA, 21 bp, Homo sapiens
agaactgaaaacataaaaagt

SEQ ID NO: 6624017 - DNA, 13 bp, Homo sapiens
agaactgaaaaga

SEQ ID NO: 6624018 - DNA, 14 bp, Homo sapiens
agaactgaaaagag

SEQ ID NO: 6624019 - DNA, 15 bp, Homo sapiens
agaactgaaaagaga

SEQ ID NO: 6624020 - DNA, 14 bp, Homo sapiens
agaactgaaataaa

SEQ ID NO: 6624021 - DNA, 21 bp, Homo sapiens
agaactgaaccggctttacca

SEQ ID NO: 6624022 - DNA, 18 bp, Homo sapiens
agaactgaagccacttgg

SEQ ID NO: 6624023 - DNA, 22 bp, Homo sapiens
agaactgaaggggagttttcac

SEQ ID NO: 6624024 - DNA, 16 bp, Homo sapiens
agaactgaagtgtgct

SEQ ID NO: 6624025 - DNA, 19 bp, Homo sapiens
agaactgaattaagttatt

SEQ ID NO: 6624026 - DNA, 17 bp, Homo sapiens
agaactgaattttggga

SEQ ID NO: 6624027 - DNA, 18 bp, Homo sapiens
agaactgacaaaggagcc

SEQ ID NO: 6624028 - DNA, 21 bp, Homo sapiens
agaactgacaaaggagccttg

SEQ ID NO: 6624029 - DNA, 23 bp, Homo sapiens
agaactgacaaaggagccttgat

SEQ ID NO: 6624030 - DNA, 15 bp, Homo sapiens
agaactgagcatctc

SEQ ID NO: 6624031 - DNA, 12 bp, Homo sapiens
agaactgagctc

SEQ ID NO: 6624032 - DNA, 19 bp, Homo sapiens
agaactgaggtcactgggt

SEQ ID NO: 6624033 - DNA, 20 bp, Homo sapiens
agaactgaggtcactgggtt

SEQ ID NO: 6624034 - DNA, 22 bp, Homo sapiens
agaactgatgcgacttgttttg

SEQ ID NO: 6624035 - DNA, 15 bp, Homo sapiens
agaactgcaactgaa

SEQ ID NO: 6624036 - DNA, 15 bp, Homo sapiens
agaactgcacaatga

SEQ ID NO: 6624037 - DNA, 22 bp, Homo sapiens
agaactgcacaatgaccagcag

SEQ ID NO: 6624038 - DNA, 21 bp, Homo sapiens
agaactgcacatgaagaaata

SEQ ID NO: 6624039 - DNA, 20 bp, Homo sapiens
agaactgcactttttttact

SEQ ID NO: 6624040 - DNA, 14 bp, Homo sapiens
agaactgcagacct

SEQ ID NO: 6624041 - DNA, 15 bp, Homo sapiens
agaactgcagacctc

SEQ ID NO: 6624042 - DNA, 18 bp, Homo sapiens
agaactgcagacctcact

SEQ ID NO: 6624043 - DNA, 22 bp, Homo sapiens
agaactgcagatagcccaggag

SEQ ID NO: 6624044 - DNA, 23 bp, Homo sapiens
agaactgcatggacctaacattc

SEQ ID NO: 6624045 - DNA, 22 bp, Homo sapiens
agaactgccataaaatctcacg

SEQ ID NO: 6624046 - DNA, 14 bp, Homo sapiens
agaactgccattat

SEQ ID NO: 6624047 - DNA, 20 bp, Homo sapiens
agaactgccattattttctg

SEQ ID NO: 6624048 - DNA, 19 bp, Homo sapiens
agaactgccccatctcctc

SEQ ID NO: 6624049 - DNA, 16 bp, Homo sapiens
agaactgcccccactg

SEQ ID NO: 6624050 - DNA, 20 bp, Homo sapiens
agaactgcccttgctgcccg

SEQ ID NO: 6624051 - DNA, 21 bp, Homo sapiens
agaactgcccttgctgcccgc

SEQ ID NO: 6624052 - DNA, 21 bp, Homo sapiens
agaactgctaaatactgtaca

SEQ ID NO: 6624053 - DNA, 22 bp, Homo sapiens
agaactgctaaatactgtacat

SEQ ID NO: 6624054 - DNA, 18 bp, Homo sapiens
agaactgctaccatgaag

SEQ ID NO: 6624055 - DNA, 19 bp, Homo sapiens
agaactgctaccatgaagt

SEQ ID NO: 6624056 - DNA, 22 bp, Homo sapiens
agaactgctaccatgaagtgaa

SEQ ID NO: 6624057 - DNA, 15 bp, Homo sapiens
agaactgctaccttc

SEQ ID NO: 6624058 - DNA, 12 bp, Homo sapiens
agaactgctggg

SEQ ID NO: 6624059 - DNA, 13 bp, Homo sapiens
agaactgctgggg

SEQ ID NO: 6624060 - DNA, 21 bp, Homo sapiens
agaactggattttcagacctg

SEQ ID NO: 6624061 - DNA, 18 bp, Homo sapiens
agaactggctgggcccct

SEQ ID NO: 6624062 - DNA, 19 bp, Homo sapiens
agaactggctgggcccctg

SEQ ID NO: 6624063 - DNA, 17 bp, Homo sapiens
agaactgggaaaacagt

SEQ ID NO: 6624064 - DNA, 15 bp, Homo sapiens
agaactgggtaaatg

SEQ ID NO: 6624065 - DNA, 18 bp, Homo sapiens
agaactgggtaaatgcaa

SEQ ID NO: 6624066 - DNA, 20 bp, Homo sapiens
agaactgggtaaatgcaaag

SEQ ID NO: 6624067 - DNA, 22 bp, Homo sapiens
agaactggtcttccattttgcc

SEQ ID NO: 6624068 - DNA, 19 bp, Homo sapiens
agaactggtgatataaaga

SEQ ID NO: 6624069 - DNA, 12 bp, Homo sapiens
agaactgtacat

SEQ ID NO: 6624070 - DNA, 14 bp, Homo sapiens
agaactgtactgtt

SEQ ID NO: 6624071 - DNA, 18 bp, Homo sapiens
agaactgtactgttttct

SEQ ID NO: 6624072 - DNA, 17 bp, Homo sapiens
agaactgtcccacaaaa

SEQ ID NO: 6624073 - DNA, 13 bp, Homo sapiens
agaactgtcccat

SEQ ID NO: 6624074 - DNA, 16 bp, Homo sapiens
agaactgtcggaggaa

SEQ ID NO: 6624075 - DNA, 21 bp, Homo sapiens
agaactgtcggaggaaagaca

SEQ ID NO: 6624076 - DNA, 13 bp, Homo sapiens
agaactgtctttc

SEQ ID NO: 6624077 - DNA, 21 bp, Homo sapiens
agaactgtgaaatttacaaat

SEQ ID NO: 6624078 - DNA, 20 bp, Homo sapiens
agaactgtgaatatgtgtaa

SEQ ID NO: 6624079 - DNA, 22 bp, Homo sapiens
agaactgtgaatatgtgtaact

SEQ ID NO: 6624080 - DNA, 14 bp, Homo sapiens
agaactgtgataaa

SEQ ID NO: 6624081 - DNA, 19 bp, Homo sapiens
agaactgtgataaaaagag

SEQ ID NO: 6624082 - DNA, 22 bp, Homo sapiens
agaactgtggcacttaggggag

SEQ ID NO: 6624083 - DNA, 18 bp, Homo sapiens
agaactgttcatttccac

SEQ ID NO: 6624084 - DNA, 23 bp, Homo sapiens
agaactgttgcctaattggaaag

SEQ ID NO: 6624085 - DNA, 14 bp, Homo sapiens
agaacttagttttg

SEQ ID NO: 6624086 - DNA, 16 bp, Homo sapiens
agaacttagttttgtt

SEQ ID NO: 6624087 - DNA, 13 bp, Homo sapiens
agaacttcaatca

SEQ ID NO: 6624088 - DNA, 15 bp, Homo sapiens
agaacttcagaaaga

SEQ ID NO: 6624089 - DNA, 16 bp, Homo sapiens
agaacttcagcattgt

SEQ ID NO: 6624090 - DNA, 24 bp, Homo sapiens
agaacttccccatacaaataagca

SEQ ID NO: 6624091 - DNA, 13 bp, Homo sapiens
agaacttccctga

SEQ ID NO: 6624092 - DNA, 21 bp, Homo sapiens
agaacttccctgattgacctg

SEQ ID NO: 6624093 - DNA, 21 bp, Homo sapiens
agaacttcgaccctttctctg

SEQ ID NO: 6624094 - DNA, 23 bp, Homo sapiens
agaacttctcgtagatgctgcct

SEQ ID NO: 6624095 - DNA, 15 bp, Homo sapiens
agaacttctgcctct

SEQ ID NO: 6624096 - DNA, 16 bp, Homo sapiens
agaacttgaacaaagt

SEQ ID NO: 6624097 - DNA, 17 bp, Homo sapiens
agaacttgaagcctgct

SEQ ID NO: 6624098 - DNA, 18 bp, Homo sapiens
agaacttgaatgtgtcag

SEQ ID NO: 6624099 - DNA, 15 bp, Homo sapiens
agaacttgaccctga

SEQ ID NO: 6624100 - DNA, 16 bp, Homo sapiens
agaacttgatttgcat

SEQ ID NO: 6624101 - DNA, 17 bp, Homo sapiens
agaacttgatttgcatg

SEQ ID NO: 6624102 - DNA, 14 bp, Homo sapiens
agaacttgctgcct

SEQ ID NO: 6624103 - DNA, 16 bp, Homo sapiens
agaacttgctgctgcc

SEQ ID NO: 6624104 - DNA, 22 bp, Homo sapiens
agaacttgctgctgccttcaca

SEQ ID NO: 6624105 - DNA, 18 bp, Homo sapiens
agaacttggatgtacctg

SEQ ID NO: 6624106 - DNA, 23 bp, Homo sapiens
agaacttggatgtacctgccccc

SEQ ID NO: 6624107 - DNA, 17 bp, Homo sapiens
agaacttgtttaataaa

SEQ ID NO: 6624108 - DNA, 15 bp, Homo sapiens
agaactttaaagctc

SEQ ID NO: 6624109 - DNA, 14 bp, Homo sapiens
agaactttcatttt

SEQ ID NO: 6624110 - DNA, 22 bp, Homo sapiens
agaactttccagggatccaggg

SEQ ID NO: 6624111 - DNA, 20 bp, Homo sapiens
agaactttcggagcctgcct

SEQ ID NO: 6624112 - DNA, 13 bp, Homo sapiens
agaactttctctt

SEQ ID NO: 6624113 - DNA, 15 bp, Homo sapiens
agaactttgagctac

SEQ ID NO: 6624114 - DNA, 20 bp, Homo sapiens
agaactttgcacacttcaaa

SEQ ID NO: 6624115 - DNA, 21 bp, Homo sapiens
agaactttgcacacttcaaat

SEQ ID NO: 6624116 - DNA, 18 bp, Homo sapiens
agaactttgccttaagtt

SEQ ID NO: 6624117 - DNA, 23 bp, Homo sapiens
agaactttgtacagtggagaaat

SEQ ID NO: 6624118 - DNA, 12 bp, Homo sapiens
agaactttgtat

SEQ ID NO: 6624119 - DNA, 22 bp, Homo sapiens
agaacttttcatagatgaactt

SEQ ID NO: 6624120 - DNA, 23 bp, Homo sapiens
agaacttttcatagatgaacttt

SEQ ID NO: 6624121 - DNA, 21 bp, Homo sapiens
agaacttttggtaagggaaaa

SEQ ID NO: 6624122 - DNA, 13 bp, Homo sapiens
agaactttttcct

SEQ ID NO: 6624123 - DNA, 20 bp, Homo sapiens
agaactttttcttttccctc

SEQ ID NO: 6624124 - DNA, 14 bp, Homo sapiens
agaacttttttaaa

SEQ ID NO: 6624125 - DNA, 17 bp, Homo sapiens
agaagaaaaaagaatgt

SEQ ID NO: 6624126 - DNA, 17 bp, Homo sapiens
agaagaaaaaattaaga

SEQ ID NO: 6624127 - DNA, 15 bp, Homo sapiens
agaagaaaaagaagc

SEQ ID NO: 6624128 - DNA, 19 bp, Homo sapiens
agaagaaaaagaagctgag

SEQ ID NO: 6624129 - DNA, 12 bp, Homo sapiens
agaagaaaacaa

SEQ ID NO: 6624130 - DNA, 14 bp, Homo sapiens
agaagaaaactttt

SEQ ID NO: 6624131 - DNA, 14 bp, Homo sapiens
agaagaaaagactt

SEQ ID NO: 6624132 - DNA, 17 bp, Homo sapiens
agaagaaaagagaagaa

SEQ ID NO: 6624133 - DNA, 18 bp, Homo sapiens
agaagaaaagagaagaag

SEQ ID NO: 6624134 - DNA, 19 bp, Homo sapiens
agaagaaaaggttcttact

SEQ ID NO: 6624135 - DNA, 14 bp, Homo sapiens
agaagaaaataacc

SEQ ID NO: 6624136 - DNA, 19 bp, Homo sapiens
agaagaaaatagaattgac

SEQ ID NO: 6624137 - DNA, 20 bp, Homo sapiens
agaagaaaatggaaccaggc

SEQ ID NO: 6624138 - DNA, 23 bp, Homo sapiens
agaagaaaatggaaccaggcttg

SEQ ID NO: 6624139 - DNA, 17 bp, Homo sapiens
agaagaaaattctcctg

SEQ ID NO: 6624140 - DNA, 13 bp, Homo sapiens
agaagaaaatttg

SEQ ID NO: 6624141 - DNA, 12 bp, Homo sapiens
agaagaaactgc

SEQ ID NO: 6624142 - DNA, 16 bp, Homo sapiens
agaagaaacttgtaaa

SEQ ID NO: 6624143 - DNA, 18 bp, Homo sapiens
agaagaaagaaaatggaa

SEQ ID NO: 6624144 - DNA, 18 bp, Homo sapiens
agaagaaagaacggaaga

SEQ ID NO: 6624145 - DNA, 13 bp, Homo sapiens
agaagaaagaact

SEQ ID NO: 6624146 - DNA, 15 bp, Homo sapiens
agaagaaagactcta

SEQ ID NO: 6624147 - DNA, 16 bp, Homo sapiens
agaagaaagaggtgac

SEQ ID NO: 6624148 - DNA, 13 bp, Homo sapiens
agaagaaagatgt

SEQ ID NO: 6624149 - DNA, 22 bp, Homo sapiens
agaagaaagcaaaagcaaggga

SEQ ID NO: 6624150 - DNA, 14 bp, Homo sapiens
agaagaaagtgaaa

SEQ ID NO: 6624151 - DNA, 14 bp, Homo sapiens
agaagaaataaata

SEQ ID NO: 6624152 - DNA, 15 bp, Homo sapiens
agaagaaatagcaga

SEQ ID NO: 6624153 - DNA, 13 bp, Homo sapiens
agaagaaatatga

SEQ ID NO: 6624154 - DNA, 18 bp, Homo sapiens
agaagaaatgaaatttta

SEQ ID NO: 6624155 - DNA, 19 bp, Homo sapiens
agaagaaatgaaattttac

SEQ ID NO: 6624156 - DNA, 16 bp, Homo sapiens
agaagaaattatttaa

SEQ ID NO: 6624157 - DNA, 19 bp, Homo sapiens
agaagaaccaaatacctca

SEQ ID NO: 6624158 - DNA, 20 bp, Homo sapiens
agaagaaccaaatacctcaa

SEQ ID NO: 6624159 - DNA, 16 bp, Homo sapiens
agaagaaccagcccag

SEQ ID NO: 6624160 - DNA, 21 bp, Homo sapiens
agaagaaccagcccagcctgc

SEQ ID NO: 6624161 - DNA, 22 bp, Homo sapiens
agaagaaccagcccagcctgcc

SEQ ID NO: 6624162 - DNA, 23 bp, Homo sapiens
agaagaaccagcccagcctgccc

SEQ ID NO: 6624163 - DNA, 23 bp, Homo sapiens
agaagaactagaggttttatgat

SEQ ID NO: 6624164 - DNA, 20 bp, Homo sapiens
agaagaactgtgtttcaagt

SEQ ID NO: 6624165 - DNA, 21 bp, Homo sapiens
agaagaactgtgtttcaagtt

SEQ ID NO: 6624166 - DNA, 21 bp, Homo sapiens
agaagaacttgcatggagcag

SEQ ID NO: 6624167 - DNA, 16 bp, Homo sapiens
agaagaactttgcctt

SEQ ID NO: 6624168 - DNA, 11 bp, Homo sapiens
agaagaagaaa

SEQ ID NO: 6624169 - DNA, 12 bp, Homo sapiens
agaagaagaaat

SEQ ID NO: 6624170 - DNA, 14 bp, Homo sapiens
agaagaagaagaaa

SEQ ID NO: 6624171 - DNA, 18 bp, Homo sapiens
agaagaagaaggagagca

SEQ ID NO: 6624172 - DNA, 12 bp, Homo sapiens
agaagaagaatt

SEQ ID NO: 6624173 - DNA, 16 bp, Homo sapiens
agaagaagagaagctg

SEQ ID NO: 6624174 - DNA, 14 bp, Homo sapiens
agaagaagagaggc

SEQ ID NO: 6624175 - DNA, 13 bp, Homo sapiens
agaagaagctggg

SEQ ID NO: 6624176 - DNA, 17 bp, Homo sapiens
agaagaagctgggaggg

SEQ ID NO: 6624177 - DNA, 13 bp, Homo sapiens
agaagaaggaaat

SEQ ID NO: 6624178 - DNA, 14 bp, Homo sapiens
agaagaaggaaatg

SEQ ID NO: 6624179 - DNA, 18 bp, Homo sapiens
agaagaaggaaatgaatt

SEQ ID NO: 6624180 - DNA, 19 bp, Homo sapiens
agaagaaggactgaagaaa

SEQ ID NO: 6624181 - DNA, 11 bp, Homo sapiens
agaagaaggag

SEQ ID NO: 6624182 - DNA, 13 bp, Homo sapiens
agaagaaggcagc

SEQ ID NO: 6624183 - DNA, 21 bp, Homo sapiens
agaagaaggcagcaggtggca

SEQ ID NO: 6624184 - DNA, 17 bp, Homo sapiens
agaagaagtcagagagg

SEQ ID NO: 6624185 - DNA, 16 bp, Homo sapiens
agaagaagtgaacact

SEQ ID NO: 6624186 - DNA, 16 bp, Homo sapiens
agaagaagtgggagca

SEQ ID NO: 6624187 - DNA, 19 bp, Homo sapiens
agaagaagtgggagcagct

SEQ ID NO: 6624188 - DNA, 22 bp, Homo sapiens
agaagaagtgggagcagcttct

SEQ ID NO: 6624189 - DNA, 16 bp, Homo sapiens
agaagaagtgtgagaa

SEQ ID NO: 6624190 - DNA, 19 bp, Homo sapiens
agaagaatatcaaataata

SEQ ID NO: 6624191 - DNA, 22 bp, Homo sapiens
agaagaatatcgatataaattg

SEQ ID NO: 6624192 - DNA, 15 bp, Homo sapiens
agaagaatattcagg

SEQ ID NO: 6624193 - DNA, 16 bp, Homo sapiens
agaagaatattcagga

SEQ ID NO: 6624194 - DNA, 16 bp, Homo sapiens
agaagaatattgtatt

SEQ ID NO: 6624195 - DNA, 20 bp, Homo sapiens
agaagaatattgttcctaag

SEQ ID NO: 6624196 - DNA, 19 bp, Homo sapiens
agaagaatccgagtgtttg

SEQ ID NO: 6624197 - DNA, 20 bp, Homo sapiens
agaagaatcttcctggcaca

SEQ ID NO: 6624198 - DNA, 19 bp, Homo sapiens
agaagaattaagctgtgca

SEQ ID NO: 6624199 - DNA, 23 bp, Homo sapiens
agaagaatttgagaagaaatact

SEQ ID NO: 6624200 - DNA, 15 bp, Homo sapiens
agaagacaaaaagac

SEQ ID NO: 6624201 - DNA, 23 bp, Homo sapiens
agaagacaaaattgtaagccaga

SEQ ID NO: 6624202 - DNA, 16 bp, Homo sapiens
agaagacaaactttgc

SEQ ID NO: 6624203 - DNA, 14 bp, Homo sapiens
agaagacaaaggcc

SEQ ID NO: 6624204 - DNA, 16 bp, Homo sapiens
agaagacaaaggccca

SEQ ID NO: 6624205 - DNA, 15 bp, Homo sapiens
agaagacaaggcatg

SEQ ID NO: 6624206 - DNA, 22 bp, Homo sapiens
agaagacacaaggtgatttcag

SEQ ID NO: 6624207 - DNA, 12 bp, Homo sapiens
agaagacacaga

SEQ ID NO: 6624208 - DNA, 18 bp, Homo sapiens
agaagacacaggaaacaa

SEQ ID NO: 6624209 - DNA, 17 bp, Homo sapiens
agaagacaccagagcag

SEQ ID NO: 6624210 - DNA, 22 bp, Homo sapiens
agaagacaccagagcagatgca

SEQ ID NO: 6624211 - DNA, 16 bp, Homo sapiens
agaagacacgtgtttt

SEQ ID NO: 6624212 - DNA, 17 bp, Homo sapiens
agaagacacgtgttttt

SEQ ID NO: 6624213 - DNA, 21 bp, Homo sapiens
agaagacacgtgtttttgtat

SEQ ID NO: 6624214 - DNA, 18 bp, Homo sapiens
agaagacactaattcctt

SEQ ID NO: 6624215 - DNA, 13 bp, Homo sapiens
agaagacactgat

SEQ ID NO: 6624216 - DNA, 13 bp, Homo sapiens
agaagacactgca

SEQ ID NO: 6624217 - DNA, 14 bp, Homo sapiens
agaagacagcaaaa

SEQ ID NO: 6624218 - DNA, 14 bp, Homo sapiens
agaagacagcttaa

SEQ ID NO: 6624219 - DNA, 19 bp, Homo sapiens
agaagacatactgcttgat

SEQ ID NO: 6624220 - DNA, 12 bp, Homo sapiens
agaagacatgaa

SEQ ID NO: 6624221 - DNA, 15 bp, Homo sapiens
agaagacatgaacca

SEQ ID NO: 6624222 - DNA, 16 bp, Homo sapiens
agaagacatggagact

SEQ ID NO: 6624223 - DNA, 15 bp, Homo sapiens
agaagacatgtttta

SEQ ID NO: 6624224 - DNA, 12 bp, Homo sapiens
agaagacatttt

SEQ ID NO: 6624225 - DNA, 16 bp, Homo sapiens
agaagacattttctct

SEQ ID NO: 6624226 - DNA, 22 bp, Homo sapiens
agaagaccaaagcattgcctgc

SEQ ID NO: 6624227 - DNA, 21 bp, Homo sapiens
agaagaccacaaaaattgact

SEQ ID NO: 6624228 - DNA, 17 bp, Homo sapiens
agaagaccagtcacagc

SEQ ID NO: 6624229 - DNA, 19 bp, Homo sapiens
agaagaccagtcacagcca

SEQ ID NO: 6624230 - DNA, 14 bp, Homo sapiens
agaagacccctgcc

SEQ ID NO: 6624231 - DNA, 19 bp, Homo sapiens
agaagaccctttgttgaaa

SEQ ID NO: 6624232 - DNA, 17 bp, Homo sapiens
agaagacgggaggggag

SEQ ID NO: 6624233 - DNA, 23 bp, Homo sapiens
agaagacgggaggggaggcattg

SEQ ID NO: 6624234 - DNA, 16 bp, Homo sapiens
agaagactagcagcta

SEQ ID NO: 6624235 - DNA, 22 bp, Homo sapiens
agaagactagcagctagcaagg

SEQ ID NO: 6624236 - DNA, 15 bp, Homo sapiens
agaagactcctaggc

SEQ ID NO: 6624237 - DNA, 18 bp, Homo sapiens
agaagactcctaggccct

SEQ ID NO: 6624238 - DNA, 14 bp, Homo sapiens
agaagactctccac

SEQ ID NO: 6624239 - DNA, 22 bp, Homo sapiens
agaagactggctagtgtggaag

SEQ ID NO: 6624240 - DNA, 12 bp, Homo sapiens
agaagagaaaat

SEQ ID NO: 6624241 - DNA, 13 bp, Homo sapiens
agaagagaaagac

SEQ ID NO: 6624242 - DNA, 18 bp, Homo sapiens
agaagagaaagatgtgtt

SEQ ID NO: 6624243 - DNA, 15 bp, Homo sapiens
agaagagaaagtaca

SEQ ID NO: 6624244 - DNA, 21 bp, Homo sapiens
agaagagaaatacagctggct

SEQ ID NO: 6624245 - DNA, 16 bp, Homo sapiens
agaagagaagctgctg

SEQ ID NO: 6624246 - DNA, 13 bp, Homo sapiens
agaagagaagtga

SEQ ID NO: 6624247 - DNA, 22 bp, Homo sapiens
agaagagaatattagctttact

SEQ ID NO: 6624248 - DNA, 15 bp, Homo sapiens
agaagagagatcaaa

SEQ ID NO: 6624249 - DNA, 19 bp, Homo sapiens
agaagagagccagtaactt

SEQ ID NO: 6624250 - DNA, 19 bp, Homo sapiens
agaagagaggaaataacag

SEQ ID NO: 6624251 - DNA, 20 bp, Homo sapiens
agaagagaggagaggagaga

SEQ ID NO: 6624252 - DNA, 22 bp, Homo sapiens
agaagagaggagaggagagagg

SEQ ID NO: 6624253 - DNA, 13 bp, Homo sapiens
agaagagaggcat

SEQ ID NO: 6624254 - DNA, 20 bp, Homo sapiens
agaagagaggggaagaattt

SEQ ID NO: 6624255 - DNA, 22 bp, Homo sapiens
agaagagagtccatatttcaat

SEQ ID NO: 6624256 - DNA, 23 bp, Homo sapiens
agaagagagtggggcctgccctc

SEQ ID NO: 6624257 - DNA, 15 bp, Homo sapiens
agaagagatgtggca

SEQ ID NO: 6624258 - DNA, 21 bp, Homo sapiens
agaagagattgtggtttcatt

SEQ ID NO: 6624259 - DNA, 21 bp, Homo sapiens
agaagagccaagagtccagga

SEQ ID NO: 6624260 - DNA, 13 bp, Homo sapiens
agaagagccacag

SEQ ID NO: 6624261 - DNA, 14 bp, Homo sapiens
agaagagccatctt

SEQ ID NO: 6624262 - DNA, 17 bp, Homo sapiens
agaagagccccactctc

SEQ ID NO: 6624263 - DNA, 22 bp, Homo sapiens
agaagagccccactctcagagg

SEQ ID NO: 6624264 - DNA, 12 bp, Homo sapiens
agaagagcctga

SEQ ID NO: 6624265 - DNA, 17 bp, Homo sapiens
agaagagccttcacatg

SEQ ID NO: 6624266 - DNA, 20 bp, Homo sapiens
agaagagctgttcacagcca

SEQ ID NO: 6624267 - DNA, 22 bp, Homo sapiens
agaagagctgttcacagccaga

SEQ ID NO: 6624268 - DNA, 20 bp, Homo sapiens
agaagaggaaattaaagtct

SEQ ID NO: 6624269 - DNA, 13 bp, Homo sapiens
agaagaggaacat

SEQ ID NO: 6624270 - DNA, 11 bp, Homo sapiens
agaagaggaag

SEQ ID NO: 6624271 - DNA, 22 bp, Homo sapiens
agaagaggaagaaattcaggta

SEQ ID NO: 6624272 - DNA, 20 bp, Homo sapiens
agaagaggaagttagagata

SEQ ID NO: 6624273 - DNA, 19 bp, Homo sapiens
agaagaggagaaaaagaag

SEQ ID NO: 6624274 - DNA, 13 bp, Homo sapiens
agaagaggaggaa

SEQ ID NO: 6624275 - DNA, 15 bp, Homo sapiens
agaagaggaggaaga

SEQ ID NO: 6624276 - DNA, 20 bp, Homo sapiens
agaagaggaggaagactctg

SEQ ID NO: 6624277 - DNA, 13 bp, Homo sapiens
agaagaggaggga

SEQ ID NO: 6624278 - DNA, 14 bp, Homo sapiens
agaagaggagggac

SEQ ID NO: 6624279 - DNA, 15 bp, Homo sapiens
agaagaggcaagtgg

SEQ ID NO: 6624280 - DNA, 19 bp, Homo sapiens
agaagaggcatcctgcctg

SEQ ID NO: 6624281 - DNA, 17 bp, Homo sapiens
agaagaggctggtgctg

SEQ ID NO: 6624282 - DNA, 22 bp, Homo sapiens
agaagaggctggtgctgtggcc

SEQ ID NO: 6624283 - DNA, 18 bp, Homo sapiens
agaagagggagaaggaga

SEQ ID NO: 6624284 - DNA, 19 bp, Homo sapiens
agaagagggcccagcccag

SEQ ID NO: 6624285 - DNA, 14 bp, Homo sapiens
agaagagggcctgt

SEQ ID NO: 6624286 - DNA, 19 bp, Homo sapiens
agaagaggggtataggaca

SEQ ID NO: 6624287 - DNA, 15 bp, Homo sapiens
agaagagggtgtgtt

SEQ ID NO: 6624288 - DNA, 21 bp, Homo sapiens
agaagaggttcatttttctgg

SEQ ID NO: 6624289 - DNA, 18 bp, Homo sapiens
agaagagtaacacttgaa

SEQ ID NO: 6624290 - DNA, 16 bp, Homo sapiens
agaagagtttaaaagc

SEQ ID NO: 6624291 - DNA, 19 bp, Homo sapiens
agaagagttttagagaaaa

SEQ ID NO: 6624292 - DNA, 23 bp, Homo sapiens
agaagagttttagagaaaataaa

SEQ ID NO: 6624293 - DNA, 16 bp, Homo sapiens
agaagataacattttc

SEQ ID NO: 6624294 - DNA, 17 bp, Homo sapiens
agaagataacattttca

SEQ ID NO: 6624295 - DNA, 15 bp, Homo sapiens
agaagatagggaaca

SEQ ID NO: 6624296 - DNA, 17 bp, Homo sapiens
agaagatagtcttggaa

SEQ ID NO: 6624297 - DNA, 20 bp, Homo sapiens
agaagatagttgtaaagata

SEQ ID NO: 6624298 - DNA, 20 bp, Homo sapiens
agaagatatattaaatgtag

SEQ ID NO: 6624299 - DNA, 19 bp, Homo sapiens
agaagatcacagcagggcc

SEQ ID NO: 6624300 - DNA, 13 bp, Homo sapiens
agaagatcccctc

SEQ ID NO: 6624301 - DNA, 18 bp, Homo sapiens
agaagatcctaaaacaaa

SEQ ID NO: 6624302 - DNA, 23 bp, Homo sapiens
agaagatctgcttccctggggcc

SEQ ID NO: 6624303 - DNA, 17 bp, Homo sapiens
agaagatctttcttaat

SEQ ID NO: 6624304 - DNA, 18 bp, Homo sapiens
agaagatctttcttaata

SEQ ID NO: 6624305 - DNA, 12 bp, Homo sapiens
agaagatgaaaa

SEQ ID NO: 6624306 - DNA, 22 bp, Homo sapiens
agaagatgaaaatggaagtggc

SEQ ID NO: 6624307 - DNA, 17 bp, Homo sapiens
agaagatgaaatttgat

SEQ ID NO: 6624308 - DNA, 19 bp, Homo sapiens
agaagatgaatacaaacaa

SEQ ID NO: 6624309 - DNA, 17 bp, Homo sapiens
agaagatgatcagacct

SEQ ID NO: 6624310 - DNA, 23 bp, Homo sapiens
agaagatgccagcttctctctcc

SEQ ID NO: 6624311 - DNA, 17 bp, Homo sapiens
agaagatgcctgttaat

SEQ ID NO: 6624312 - DNA, 23 bp, Homo sapiens
agaagatgctccagcaacacagc

SEQ ID NO: 6624313 - DNA, 14 bp, Homo sapiens
agaagatgctgtga

SEQ ID NO: 6624314 - DNA, 16 bp, Homo sapiens
agaagatggactctga

SEQ ID NO: 6624315 - DNA, 18 bp, Homo sapiens
agaagatggcactgtcca

SEQ ID NO: 6624316 - DNA, 17 bp, Homo sapiens
agaagatgggggctgga

SEQ ID NO: 6624317 - DNA, 18 bp, Homo sapiens
agaagatggtaccaccag

SEQ ID NO: 6624318 - DNA, 20 bp, Homo sapiens
agaagatgtattcagagcca

SEQ ID NO: 6624319 - DNA, 13 bp, Homo sapiens
agaagatgtgaaa

SEQ ID NO: 6624320 - DNA, 18 bp, Homo sapiens
agaagatgtgtaaacagg

SEQ ID NO: 6624321 - DNA, 22 bp, Homo sapiens
agaagatgtttaacttaatcaa

SEQ ID NO: 6624322 - DNA, 17 bp, Homo sapiens
agaagattcccacccct

SEQ ID NO: 6624323 - DNA, 15 bp, Homo sapiens
agaagattctaaaac

SEQ ID NO: 6624324 - DNA, 13 bp, Homo sapiens
agaagattctatg

SEQ ID NO: 6624325 - DNA, 15 bp, Homo sapiens
agaagattctatgtt

SEQ ID NO: 6624326 - DNA, 17 bp, Homo sapiens
agaagattctatgttaa

SEQ ID NO: 6624327 - DNA, 22 bp, Homo sapiens
agaagattcttcccattctcca

SEQ ID NO: 6624328 - DNA, 19 bp, Homo sapiens
agaagcaaagatttcagta

SEQ ID NO: 6624329 - DNA, 19 bp, Homo sapiens
agaagcaaaggcaggaggt

SEQ ID NO: 6624330 - DNA, 19 bp, Homo sapiens
agaagcaaagttcaactta

SEQ ID NO: 6624331 - DNA, 23 bp, Homo sapiens
agaagcaactaagttaataataa

SEQ ID NO: 6624332 - DNA, 13 bp, Homo sapiens
agaagcaagctgg

SEQ ID NO: 6624333 - DNA, 15 bp, Homo sapiens
agaagcaaggaagta

SEQ ID NO: 6624334 - DNA, 20 bp, Homo sapiens
agaagcaaggtctcagactt

SEQ ID NO: 6624335 - DNA, 13 bp, Homo sapiens
agaagcaagtaaa

SEQ ID NO: 6624336 - DNA, 21 bp, Homo sapiens
agaagcaataaagaagagtgc

SEQ ID NO: 6624337 - DNA, 21 bp, Homo sapiens
agaagcaataataaagtactt

SEQ ID NO: 6624338 - DNA, 17 bp, Homo sapiens
agaagcaatctttgaaa

SEQ ID NO: 6624339 - DNA, 22 bp, Homo sapiens
agaagcacaggaatagtgagtg

SEQ ID NO: 6624340 - DNA, 13 bp, Homo sapiens
agaagcacatgtg

SEQ ID NO: 6624341 - DNA, 14 bp, Homo sapiens
agaagcacatgtgt

SEQ ID NO: 6624342 - DNA, 13 bp, Homo sapiens
agaagcacttctg

SEQ ID NO: 6624343 - DNA, 16 bp, Homo sapiens
agaagcactttgattg

SEQ ID NO: 6624344 - DNA, 14 bp, Homo sapiens
agaagcagaaatac

SEQ ID NO: 6624345 - DNA, 12 bp, Homo sapiens
agaagcagaggg

SEQ ID NO: 6624346 - DNA, 13 bp, Homo sapiens
agaagcagaggga

SEQ ID NO: 6624347 - DNA, 13 bp, Homo sapiens
agaagcagatgag

SEQ ID NO: 6624348 - DNA, 17 bp, Homo sapiens
agaagcagccataaaac

SEQ ID NO: 6624349 - DNA, 18 bp, Homo sapiens
agaagcagcccctcgagg

SEQ ID NO: 6624350 - DNA, 14 bp, Homo sapiens
agaagcaggaaggg

SEQ ID NO: 6624351 - DNA, 13 bp, Homo sapiens
agaagcaggagta

SEQ ID NO: 6624352 - DNA, 23 bp, Homo sapiens
agaagcaggcagggcaaaggtca

SEQ ID NO: 6624353 - DNA, 15 bp, Homo sapiens
agaagcagtggcctt

SEQ ID NO: 6624354 - DNA, 23 bp, Homo sapiens
agaagcagttgtaccaagtgaaa

SEQ ID NO: 6624355 - DNA, 16 bp, Homo sapiens
agaagcatattttgct

SEQ ID NO: 6624356 - DNA, 17 bp, Homo sapiens
agaagcatcaccatgca

SEQ ID NO: 6624357 - DNA, 22 bp, Homo sapiens
agaagcatccaaggaacttcat

SEQ ID NO: 6624358 - DNA, 15 bp, Homo sapiens
agaagcatctctgac

SEQ ID NO: 6624359 - DNA, 16 bp, Homo sapiens
agaagcatgaaaaagc

SEQ ID NO: 6624360 - DNA, 17 bp, Homo sapiens
agaagcatgaagtctta

SEQ ID NO: 6624361 - DNA, 14 bp, Homo sapiens
agaagcattccttc

SEQ ID NO: 6624362 - DNA, 22 bp, Homo sapiens
agaagcattctcattggaaatt

SEQ ID NO: 6624363 - DNA, 17 bp, Homo sapiens
agaagcattgaaaacaa

SEQ ID NO: 6624364 - DNA, 20 bp, Homo sapiens
agaagcattgaaaacaaaga

SEQ ID NO: 6624365 - DNA, 15 bp, Homo sapiens
agaagcattgcctgg

SEQ ID NO: 6624366 - DNA, 21 bp, Homo sapiens
agaagcattgcctggactgac

SEQ ID NO: 6624367 - DNA, 10 bp, Homo sapiens
agaagcattt

SEQ ID NO: 6624368 - DNA, 16 bp, Homo sapiens
agaagcatttgtattt

SEQ ID NO: 6624369 - DNA, 13 bp, Homo sapiens
agaagccaagaca

SEQ ID NO: 6624370 - DNA, 15 bp, Homo sapiens
agaagccaagacagt

SEQ ID NO: 6624371 - DNA, 11 bp, Homo sapiens
agaagccaagc

SEQ ID NO: 6624372 - DNA, 22 bp, Homo sapiens
agaagccaagcgctcatgttga

SEQ ID NO: 6624373 - DNA, 22 bp, Homo sapiens
agaagccaagctccctggagcc

SEQ ID NO: 6624374 - DNA, 18 bp, Homo sapiens
agaagccaagggaaaggg

SEQ ID NO: 6624375 - DNA, 21 bp, Homo sapiens
agaagccaagggaaaggggtg

SEQ ID NO: 6624376 - DNA, 22 bp, Homo sapiens
agaagccaagggaaaggggtgc

SEQ ID NO: 6624377 - DNA, 16 bp, Homo sapiens
agaagccaagggaaga

SEQ ID NO: 6624378 - DNA, 22 bp, Homo sapiens
agaagccaagggacacaggaga

SEQ ID NO: 6624379 - DNA, 13 bp, Homo sapiens
agaagccaagggg

SEQ ID NO: 6624380 - DNA, 24 bp, Homo sapiens
agaagccaagggggacctcgggct

SEQ ID NO: 6624381 - DNA, 14 bp, Homo sapiens
agaagccacagaaa

SEQ ID NO: 6624382 - DNA, 19 bp, Homo sapiens
agaagccacaggcctgaga

SEQ ID NO: 6624383 - DNA, 16 bp, Homo sapiens
agaagccacccttccc

SEQ ID NO: 6624384 - DNA, 18 bp, Homo sapiens
agaagccacccttccctg

SEQ ID NO: 6624385 - DNA, 14 bp, Homo sapiens
agaagccaccttcc

SEQ ID NO: 6624386 - DNA, 18 bp, Homo sapiens
agaagccacgctgtcctc

SEQ ID NO: 6624387 - DNA, 20 bp, Homo sapiens
agaagccacgctgtcctctc

SEQ ID NO: 6624388 - DNA, 11 bp, Homo sapiens
agaagccagcc

SEQ ID NO: 6624389 - DNA, 12 bp, Homo sapiens
agaagccagcca

SEQ ID NO: 6624390 - DNA, 18 bp, Homo sapiens
agaagccagccacagacc

SEQ ID NO: 6624391 - DNA, 12 bp, Homo sapiens
agaagccaggaa

SEQ ID NO: 6624392 - DNA, 14 bp, Homo sapiens
agaagccagtgtct

SEQ ID NO: 6624393 - DNA, 15 bp, Homo sapiens
agaagccatcaattt

SEQ ID NO: 6624394 - DNA, 18 bp, Homo sapiens
agaagccatcacctcaga

SEQ ID NO: 6624395 - DNA, 23 bp, Homo sapiens
agaagccatctgacagcaggcca

SEQ ID NO: 6624396 - DNA, 21 bp, Homo sapiens
agaagcccaatattataattt

SEQ ID NO: 6624397 - DNA, 13 bp, Homo sapiens
agaagcccagaat

SEQ ID NO: 6624398 - DNA, 18 bp, Homo sapiens
agaagcccaggaaaggct

SEQ ID NO: 6624399 - DNA, 23 bp, Homo sapiens
agaagcccaggaaaggctccagg

SEQ ID NO: 6624400 - DNA, 18 bp, Homo sapiens
agaagcccagtggtgagg

SEQ ID NO: 6624401 - DNA, 18 bp, Homo sapiens
agaagcccatgtcttctg

SEQ ID NO: 6624402 - DNA, 24 bp, Homo sapiens
agaagcccatgtcttctgctgttc

SEQ ID NO: 6624403 - DNA, 17 bp, Homo sapiens
agaagcccattaaaata

SEQ ID NO: 6624404 - DNA, 12 bp, Homo sapiens
agaagcccccag

SEQ ID NO: 6624405 - DNA, 14 bp, Homo sapiens
agaagcccccagct

SEQ ID NO: 6624406 - DNA, 23 bp, Homo sapiens
agaagccccgacacacggggctc

SEQ ID NO: 6624407 - DNA, 18 bp, Homo sapiens
agaagccccgcacgggct

SEQ ID NO: 6624408 - DNA, 20 bp, Homo sapiens
agaagccccttccccatggg

SEQ ID NO: 6624409 - DNA, 21 bp, Homo sapiens
agaagccccttccccatggga

SEQ ID NO: 6624410 - DNA, 14 bp, Homo sapiens
agaagcccggctcc

SEQ ID NO: 6624411 - DNA, 15 bp, Homo sapiens
agaagcccggctcct

SEQ ID NO: 6624412 - DNA, 16 bp, Homo sapiens
agaagcccggctcctg

SEQ ID NO: 6624413 - DNA, 20 bp, Homo sapiens
agaagcccgtgtgagaagtg

SEQ ID NO: 6624414 - DNA, 21 bp, Homo sapiens
agaagccctccttgccacccc

SEQ ID NO: 6624415 - DNA, 13 bp, Homo sapiens
agaagccctgatg

SEQ ID NO: 6624416 - DNA, 15 bp, Homo sapiens
agaagccctgttctc

SEQ ID NO: 6624417 - DNA, 16 bp, Homo sapiens
agaagccctgttctcg

SEQ ID NO: 6624418 - DNA, 15 bp, Homo sapiens
agaagccgcagggac

SEQ ID NO: 6624419 - DNA, 21 bp, Homo sapiens
agaagccggcggagctctggc

SEQ ID NO: 6624420 - DNA, 14 bp, Homo sapiens
agaagccgggaaca

SEQ ID NO: 6624421 - DNA, 16 bp, Homo sapiens
agaagccgggaacaga

SEQ ID NO: 6624422 - DNA, 22 bp, Homo sapiens
agaagcctattgtaaatacaag

SEQ ID NO: 6624423 - DNA, 23 bp, Homo sapiens
agaagcctattgtaaatacaagt

SEQ ID NO: 6624424 - DNA, 21 bp, Homo sapiens
agaagcctccaagcctgcctc

SEQ ID NO: 6624425 - DNA, 22 bp, Homo sapiens
agaagcctccttacattaaaaa

SEQ ID NO: 6624426 - DNA, 20 bp, Homo sapiens
agaagcctcgttttgatgcc

SEQ ID NO: 6624427 - DNA, 16 bp, Homo sapiens
agaagcctctgcctcc

SEQ ID NO: 6624428 - DNA, 13 bp, Homo sapiens
agaagcctctggc

SEQ ID NO: 6624429 - DNA, 16 bp, Homo sapiens
agaagcctctggctag

SEQ ID NO: 6624430 - DNA, 23 bp, Homo sapiens
agaagcctctggctagaggccag

SEQ ID NO: 6624431 - DNA, 19 bp, Homo sapiens
agaagcctgacaactcatt

SEQ ID NO: 6624432 - DNA, 10 bp, Homo sapiens
agaagcctgc

SEQ ID NO: 6624433 - DNA, 17 bp, Homo sapiens
agaagcctgcaggagaa

SEQ ID NO: 6624434 - DNA, 21 bp, Homo sapiens
agaagcctgcataatgtttct

SEQ ID NO: 6624435 - DNA, 12 bp, Homo sapiens
agaagcctgggg

SEQ ID NO: 6624436 - DNA, 14 bp, Homo sapiens
agaagcctgggggc

SEQ ID NO: 6624437 - DNA, 18 bp, Homo sapiens
agaagcctgggggcctgg

SEQ ID NO: 6624438 - DNA, 21 bp, Homo sapiens
agaagcctgggggcctggctg

SEQ ID NO: 6624439 - DNA, 16 bp, Homo sapiens
agaagcctgttttgtt

SEQ ID NO: 6624440 - DNA, 23 bp, Homo sapiens
agaagccttcaagctctgaggga

SEQ ID NO: 6624441 - DNA, 12 bp, Homo sapiens
agaagccttcag

SEQ ID NO: 6624442 - DNA, 13 bp, Homo sapiens
agaagccttcagc

SEQ ID NO: 6624443 - DNA, 23 bp, Homo sapiens
agaagccttggaaccagccccat

SEQ ID NO: 6624444 - DNA, 19 bp, Homo sapiens
agaagcctttgggaagggg

SEQ ID NO: 6624445 - DNA, 22 bp, Homo sapiens
agaagccttttccataaagtgt

SEQ ID NO: 6624446 - DNA, 18 bp, Homo sapiens
agaagcgcggctaactta

SEQ ID NO: 6624447 - DNA, 16 bp, Homo sapiens
agaagcgctcatctgg

SEQ ID NO: 6624448 - DNA, 18 bp, Homo sapiens
agaagcgctcatctggct

SEQ ID NO: 6624449 - DNA, 14 bp, Homo sapiens
agaagcgctgccct

SEQ ID NO: 6624450 - DNA, 19 bp, Homo sapiens
agaagcgctgttgcccgcc

SEQ ID NO: 6624451 - DNA, 16 bp, Homo sapiens
agaagcggatttccag

SEQ ID NO: 6624452 - DNA, 15 bp, Homo sapiens
agaagcgtctccctt

SEQ ID NO: 6624453 - DNA, 19 bp, Homo sapiens
agaagcgtgagacgccacc

SEQ ID NO: 6624454 - DNA, 20 bp, Homo sapiens
agaagcgtttttaacctgtt

SEQ ID NO: 6624455 - DNA, 13 bp, Homo sapiens
agaagctaagctg

SEQ ID NO: 6624456 - DNA, 20 bp, Homo sapiens
agaagctaatgtaggactgt

SEQ ID NO: 6624457 - DNA, 22 bp, Homo sapiens
agaagctacccctcaaactgca

SEQ ID NO: 6624458 - DNA, 15 bp, Homo sapiens
agaagctagatgccc

SEQ ID NO: 6624459 - DNA, 21 bp, Homo sapiens
agaagctataaattcctcttt

SEQ ID NO: 6624460 - DNA, 21 bp, Homo sapiens
agaagctatgtcaagaggctg

SEQ ID NO: 6624461 - DNA, 11 bp, Homo sapiens
agaagctattt

SEQ ID NO: 6624462 - DNA, 15 bp, Homo sapiens
agaagctcagctgcc

SEQ ID NO: 6624463 - DNA, 21 bp, Homo sapiens
agaagctcatttagttagaaa

SEQ ID NO: 6624464 - DNA, 13 bp, Homo sapiens
agaagctcccaga

SEQ ID NO: 6624465 - DNA, 15 bp, Homo sapiens
agaagctcccagatg

SEQ ID NO: 6624466 - DNA, 23 bp, Homo sapiens
agaagctccctgaagtaagcaaa

SEQ ID NO: 6624467 - DNA, 14 bp, Homo sapiens
agaagctcctctcc

SEQ ID NO: 6624468 - DNA, 18 bp, Homo sapiens
agaagctcctctccccag

SEQ ID NO: 6624469 - DNA, 19 bp, Homo sapiens
agaagctctcgggctagga

SEQ ID NO: 6624470 - DNA, 19 bp, Homo sapiens
agaagctctgaagaactct

SEQ ID NO: 6624471 - DNA, 23 bp, Homo sapiens
agaagctctggccccaggcttgt

SEQ ID NO: 6624472 - DNA, 20 bp, Homo sapiens
agaagctcttactctttcct

SEQ ID NO: 6624473 - DNA, 15 bp, Homo sapiens
agaagctgagaagaa

SEQ ID NO: 6624474 - DNA, 16 bp, Homo sapiens
agaagctgagaagaag

SEQ ID NO: 6624475 - DNA, 15 bp, Homo sapiens
agaagctgagcacca

SEQ ID NO: 6624476 - DNA, 12 bp, Homo sapiens
agaagctgagga

SEQ ID NO: 6624477 - DNA, 15 bp, Homo sapiens
agaagctgaggatcc

SEQ ID NO: 6624478 - DNA, 16 bp, Homo sapiens
agaagctgaggatcct

SEQ ID NO: 6624479 - DNA, 15 bp, Homo sapiens
agaagctgatccagt

SEQ ID NO: 6624480 - DNA, 17 bp, Homo sapiens
agaagctgatctgattg

SEQ ID NO: 6624481 - DNA, 17 bp, Homo sapiens
agaagctgatgaggaat

SEQ ID NO: 6624482 - DNA, 14 bp, Homo sapiens
agaagctgcaataa

SEQ ID NO: 6624483 - DNA, 13 bp, Homo sapiens
agaagctgcagct

SEQ ID NO: 6624484 - DNA, 19 bp, Homo sapiens
agaagctgcatccagaggc

SEQ ID NO: 6624485 - DNA, 13 bp, Homo sapiens
agaagctgcatgt

SEQ ID NO: 6624486 - DNA, 22 bp, Homo sapiens
agaagctgccaggtgagaaact

SEQ ID NO: 6624487 - DNA, 19 bp, Homo sapiens
agaagctgctccaggcctg

SEQ ID NO: 6624488 - DNA, 11 bp, Homo sapiens
agaagctgctg

SEQ ID NO: 6624489 - DNA, 13 bp, Homo sapiens
agaagctgctgac

SEQ ID NO: 6624490 - DNA, 14 bp, Homo sapiens
agaagctgcttctg

SEQ ID NO: 6624491 - DNA, 13 bp, Homo sapiens
agaagctggactt

SEQ ID NO: 6624492 - DNA, 13 bp, Homo sapiens
agaagctggagga

SEQ ID NO: 6624493 - DNA, 16 bp, Homo sapiens
agaagctggaggacta

SEQ ID NO: 6624494 - DNA, 22 bp, Homo sapiens
agaagctgggactcattcacat

SEQ ID NO: 6624495 - DNA, 13 bp, Homo sapiens
agaagctgggagg

SEQ ID NO: 6624496 - DNA, 16 bp, Homo sapiens
agaagctgggagggag

SEQ ID NO: 6624497 - DNA, 18 bp, Homo sapiens
agaagctgtcagaagttt

SEQ ID NO: 6624498 - DNA, 20 bp, Homo sapiens
agaagctgttgtacatttat

SEQ ID NO: 6624499 - DNA, 21 bp, Homo sapiens
agaagctgttgtacatttatg

SEQ ID NO: 6624500 - DNA, 16 bp, Homo sapiens
agaagcttaaaataaa

SEQ ID NO: 6624501 - DNA, 21 bp, Homo sapiens
agaagcttaaaataaagttaa

SEQ ID NO: 6624502 - DNA, 16 bp, Homo sapiens
agaagcttcagaagtt

SEQ ID NO: 6624503 - DNA, 17 bp, Homo sapiens
agaagcttcagaagttt

SEQ ID NO: 6624504 - DNA, 19 bp, Homo sapiens
agaagcttcatgccaggtt

SEQ ID NO: 6624505 - DNA, 22 bp, Homo sapiens
agaagcttccacaaaattagaa

SEQ ID NO: 6624506 - DNA, 16 bp, Homo sapiens
agaagcttctaataaa

SEQ ID NO: 6624507 - DNA, 18 bp, Homo sapiens
agaagcttctaataaatt

SEQ ID NO: 6624508 - DNA, 18 bp, Homo sapiens
agaagcttggaggagggt

SEQ ID NO: 6624509 - DNA, 20 bp, Homo sapiens
agaagctttttgtttgcatc

SEQ ID NO: 6624510 - DNA, 20 bp, Homo sapiens
agaagctttttttcttgcta

SEQ ID NO: 6624511 - DNA, 10 bp, Homo sapiens
agaaggaaaa

SEQ ID NO: 6624512 - DNA, 16 bp, Homo sapiens
agaaggaaaaaaggag

SEQ ID NO: 6624513 - DNA, 17 bp, Homo sapiens
agaaggaaaaaaggagg

SEQ ID NO: 6624514 - DNA, 22 bp, Homo sapiens
agaaggaaaaaaggaggataga

SEQ ID NO: 6624515 - DNA, 17 bp, Homo sapiens
agaaggaaaaagaaagt

SEQ ID NO: 6624516 - DNA, 17 bp, Homo sapiens
agaaggaaaaatgtgta

SEQ ID NO: 6624517 - DNA, 19 bp, Homo sapiens
agaaggaaaatgatctgag

SEQ ID NO: 6624518 - DNA, 23 bp, Homo sapiens
agaaggaaagctttggcagtgtt

SEQ ID NO: 6624519 - DNA, 15 bp, Homo sapiens
agaaggaaataaaat

SEQ ID NO: 6624520 - DNA, 15 bp, Homo sapiens
agaaggaaatgatgg

SEQ ID NO: 6624521 - DNA, 21 bp, Homo sapiens
agaaggaactgatacatctga

SEQ ID NO: 6624522 - DNA, 14 bp, Homo sapiens
agaaggaagacttt

SEQ ID NO: 6624523 - DNA, 19 bp, Homo sapiens
agaaggaaggatgccactt

SEQ ID NO: 6624524 - DNA, 11 bp, Homo sapiens
agaaggaaggc

SEQ ID NO: 6624525 - DNA, 19 bp, Homo sapiens
agaaggaaggcagggagga

SEQ ID NO: 6624526 - DNA, 20 bp, Homo sapiens
agaaggaaggcagggaggag

SEQ ID NO: 6624527 - DNA, 21 bp, Homo sapiens
agaaggaaggcagggaggagg

SEQ ID NO: 6624528 - DNA, 13 bp, Homo sapiens
agaaggaagggca

SEQ ID NO: 6624529 - DNA, 15 bp, Homo sapiens
agaaggaagggcaga

SEQ ID NO: 6624530 - DNA, 21 bp, Homo sapiens
agaaggaatggtgcgtggctt

SEQ ID NO: 6624531 - DNA, 18 bp, Homo sapiens
agaaggacaggtctctga

SEQ ID NO: 6624532 - DNA, 21 bp, Homo sapiens
agaaggacattttctctttaa

SEQ ID NO: 6624533 - DNA, 21 bp, Homo sapiens
agaaggacggtgccaagggcc

SEQ ID NO: 6624534 - DNA, 14 bp, Homo sapiens
agaaggactgaaga

SEQ ID NO: 6624535 - DNA, 17 bp, Homo sapiens
agaaggacttcctgcta

SEQ ID NO: 6624536 - DNA, 20 bp, Homo sapiens
agaaggacttcctgctacag

SEQ ID NO: 6624537 - DNA, 14 bp, Homo sapiens
agaaggacttgttt

SEQ ID NO: 6624538 - DNA, 15 bp, Homo sapiens
agaaggagaaggaag

SEQ ID NO: 6624539 - DNA, 16 bp, Homo sapiens
agaaggagacaggcag

SEQ ID NO: 6624540 - DNA, 13 bp, Homo sapiens
agaaggagagaaa

SEQ ID NO: 6624541 - DNA, 18 bp, Homo sapiens
agaaggagagaaagtggg

SEQ ID NO: 6624542 - DNA, 13 bp, Homo sapiens
agaaggagagccc

SEQ ID NO: 6624543 - DNA, 16 bp, Homo sapiens
agaaggagagcccagg

SEQ ID NO: 6624544 - DNA, 21 bp, Homo sapiens
agaaggagagggagtacaaag

SEQ ID NO: 6624545 - DNA, 14 bp, Homo sapiens
agaaggagatcagg

SEQ ID NO: 6624546 - DNA, 14 bp, Homo sapiens
agaaggagatgaat

SEQ ID NO: 6624547 - DNA, 16 bp, Homo sapiens
agaaggagcaggccct

SEQ ID NO: 6624548 - DNA, 13 bp, Homo sapiens
agaaggaggaatt

SEQ ID NO: 6624549 - DNA, 19 bp, Homo sapiens
agaaggaggaattttagaa

SEQ ID NO: 6624550 - DNA, 19 bp, Homo sapiens
agaaggaggagagggaaaa

SEQ ID NO: 6624551 - DNA, 21 bp, Homo sapiens
agaaggagggcagagccatgg

SEQ ID NO: 6624552 - DNA, 20 bp, Homo sapiens
agaaggagtcagaaactgtt

SEQ ID NO: 6624553 - DNA, 20 bp, Homo sapiens
agaaggagttctgacattca

SEQ ID NO: 6624554 - DNA, 13 bp, Homo sapiens
agaaggatgatgt

SEQ ID NO: 6624555 - DNA, 15 bp, Homo sapiens
agaaggatggcatct

SEQ ID NO: 6624556 - DNA, 17 bp, Homo sapiens
agaaggatgtacatttc

SEQ ID NO: 6624557 - DNA, 22 bp, Homo sapiens
agaaggatgtccgttccaggag

SEQ ID NO: 6624558 - DNA, 19 bp, Homo sapiens
agaaggattcttttttcaa

SEQ ID NO: 6624559 - DNA, 22 bp, Homo sapiens
agaaggattcttttttcaatgt

SEQ ID NO: 6624560 - DNA, 17 bp, Homo sapiens
agaaggcaaactgaggc

SEQ ID NO: 6624561 - DNA, 23 bp, Homo sapiens
agaaggcaaactgaggcagcatg

SEQ ID NO: 6624562 - DNA, 15 bp, Homo sapiens
agaaggcaaatgact

SEQ ID NO: 6624563 - DNA, 18 bp, Homo sapiens
agaaggcaacttgaagaa

SEQ ID NO: 6624564 - DNA, 23 bp, Homo sapiens
agaaggcaacttgaagaaacgct

SEQ ID NO: 6624565 - DNA, 20 bp, Homo sapiens
agaaggcaagccaaccttag

SEQ ID NO: 6624566 - DNA, 17 bp, Homo sapiens
agaaggcaagctggcag

SEQ ID NO: 6624567 - DNA, 22 bp, Homo sapiens
agaaggcaagtttctagctaga

SEQ ID NO: 6624568 - DNA, 23 bp, Homo sapiens
agaaggcaatcaagagcttccag

SEQ ID NO: 6624569 - DNA, 12 bp, Homo sapiens
agaaggcactgg

SEQ ID NO: 6624570 - DNA, 20 bp, Homo sapiens
agaaggcagagaaaacacac

SEQ ID NO: 6624571 - DNA, 13 bp, Homo sapiens
agaaggcagccac

SEQ ID NO: 6624572 - DNA, 12 bp, Homo sapiens
agaaggcaggga

SEQ ID NO: 6624573 - DNA, 22 bp, Homo sapiens
agaaggcagggaatgcctggag

SEQ ID NO: 6624574 - DNA, 11 bp, Homo sapiens
agaaggccaga

SEQ ID NO: 6624575 - DNA, 16 bp, Homo sapiens
agaaggccagagaggg

SEQ ID NO: 6624576 - DNA, 14 bp, Homo sapiens
agaaggccagccca

SEQ ID NO: 6624577 - DNA, 18 bp, Homo sapiens
agaaggccagcccactgg

SEQ ID NO: 6624578 - DNA, 23 bp, Homo sapiens
agaaggccagcccactgggccct

SEQ ID NO: 6624579 - DNA, 14 bp, Homo sapiens
agaaggccaggcct

SEQ ID NO: 6624580 - DNA, 13 bp, Homo sapiens
agaaggccccagg

SEQ ID NO: 6624581 - DNA, 15 bp, Homo sapiens
agaaggcccgggagg

SEQ ID NO: 6624582 - DNA, 17 bp, Homo sapiens
agaaggccctgtgccct

SEQ ID NO: 6624583 - DNA, 16 bp, Homo sapiens
agaaggccgctgcccc

SEQ ID NO: 6624584 - DNA, 21 bp, Homo sapiens
agaaggcctcactcaagcctg

SEQ ID NO: 6624585 - DNA, 13 bp, Homo sapiens
agaaggcctcccc

SEQ ID NO: 6624586 - DNA, 22 bp, Homo sapiens
agaaggcctcttgtgctcacgc

SEQ ID NO: 6624587 - DNA, 19 bp, Homo sapiens
agaaggcctgccccccttc

SEQ ID NO: 6624588 - DNA, 22 bp, Homo sapiens
agaaggcctgccccccttccca

SEQ ID NO: 6624589 - DNA, 19 bp, Homo sapiens
agaaggccttacagaaaat

SEQ ID NO: 6624590 - DNA, 13 bp, Homo sapiens
agaaggcgaggag

SEQ ID NO: 6624591 - DNA, 23 bp, Homo sapiens
agaaggctaaagaagacacacag

SEQ ID NO: 6624592 - DNA, 19 bp, Homo sapiens
agaaggctagaaaaaaaga

SEQ ID NO: 6624593 - DNA, 19 bp, Homo sapiens
agaaggctaggagttcata

SEQ ID NO: 6624594 - DNA, 11 bp, Homo sapiens
agaaggctctt

SEQ ID NO: 6624595 - DNA, 16 bp, Homo sapiens
agaaggctggggccag

SEQ ID NO: 6624596 - DNA, 21 bp, Homo sapiens
agaaggcttcctccagcggct

SEQ ID NO: 6624597 - DNA, 18 bp, Homo sapiens
agaagggaaggggagagg

SEQ ID NO: 6624598 - DNA, 18 bp, Homo sapiens
agaagggaatcctcctcc

SEQ ID NO: 6624599 - DNA, 14 bp, Homo sapiens
agaagggaatttgg

SEQ ID NO: 6624600 - DNA, 20 bp, Homo sapiens
agaagggagacattgtttgg

SEQ ID NO: 6624601 - DNA, 19 bp, Homo sapiens
agaagggagctagccagag

SEQ ID NO: 6624602 - DNA, 18 bp, Homo sapiens
agaagggagctggctcca

SEQ ID NO: 6624603 - DNA, 13 bp, Homo sapiens
agaagggagggtg

SEQ ID NO: 6624604 - DNA, 21 bp, Homo sapiens
agaagggagttgctcactcag

SEQ ID NO: 6624605 - DNA, 23 bp, Homo sapiens
agaagggagttgctcactcagga

SEQ ID NO: 6624606 - DNA, 21 bp, Homo sapiens
agaagggatatctactgtggt

SEQ ID NO: 6624607 - DNA, 11 bp, Homo sapiens
agaagggcagg

SEQ ID NO: 6624608 - DNA, 15 bp, Homo sapiens
agaagggccaccctg

SEQ ID NO: 6624609 - DNA, 12 bp, Homo sapiens
agaagggccagc

SEQ ID NO: 6624610 - DNA, 13 bp, Homo sapiens
agaagggcctgct

SEQ ID NO: 6624611 - DNA, 18 bp, Homo sapiens
agaagggcctgctctgct

SEQ ID NO: 6624612 - DNA, 21 bp, Homo sapiens
agaagggctagaacctggaga

SEQ ID NO: 6624613 - DNA, 15 bp, Homo sapiens
agaagggctcagaga

SEQ ID NO: 6624614 - DNA, 17 bp, Homo sapiens
agaagggctcctgcagg

SEQ ID NO: 6624615 - DNA, 18 bp, Homo sapiens
agaaggggaagatactga

SEQ ID NO: 6624616 - DNA, 23 bp, Homo sapiens
agaaggggaatgtgtcctcctgc

SEQ ID NO: 6624617 - DNA, 19 bp, Homo sapiens
agaaggggacagcgccacc

SEQ ID NO: 6624618 - DNA, 20 bp, Homo sapiens
agaaggggacagcgccacct

SEQ ID NO: 6624619 - DNA, 16 bp, Homo sapiens
agaaggggactgccac

SEQ ID NO: 6624620 - DNA, 19 bp, Homo sapiens
agaaggggactgccacctc

SEQ ID NO: 6624621 - DNA, 19 bp, Homo sapiens
agaaggggacttctcttcc

SEQ ID NO: 6624622 - DNA, 15 bp, Homo sapiens
agaaggggagatgga

SEQ ID NO: 6624623 - DNA, 14 bp, Homo sapiens
agaaggggagcttt

SEQ ID NO: 6624624 - DNA, 23 bp, Homo sapiens
agaaggggatgggaaataaagaa

SEQ ID NO: 6624625 - DNA, 18 bp, Homo sapiens
agaaggggatggtgttgt

SEQ ID NO: 6624626 - DNA, 20 bp, Homo sapiens
agaaggggcccaagagagac

SEQ ID NO: 6624627 - DNA, 21 bp, Homo sapiens
agaaggggcgggaatattgtt

SEQ ID NO: 6624628 - DNA, 19 bp, Homo sapiens
agaagggggacgtttctgg

SEQ ID NO: 6624629 - DNA, 20 bp, Homo sapiens
agaagggggagtgaaacaga

SEQ ID NO: 6624630 - DNA, 17 bp, Homo sapiens
agaagggggccatgagg

SEQ ID NO: 6624631 - DNA, 21 bp, Homo sapiens
agaagggggccctgctacctg

SEQ ID NO: 6624632 - DNA, 16 bp, Homo sapiens
agaagggggctctgcc

SEQ ID NO: 6624633 - DNA, 18 bp, Homo sapiens
agaagggggtctctgtta

SEQ ID NO: 6624634 - DNA, 13 bp, Homo sapiens
agaagggggtggg

SEQ ID NO: 6624635 - DNA, 15 bp, Homo sapiens
agaagggtccttccc

SEQ ID NO: 6624636 - DNA, 23 bp, Homo sapiens
agaagggtgggagtggggccttt

SEQ ID NO: 6624637 - DNA, 19 bp, Homo sapiens
agaagggtgtggcatttgg

SEQ ID NO: 6624638 - DNA, 21 bp, Homo sapiens
agaagggttagacaagcctgg

SEQ ID NO: 6624639 - DNA, 23 bp, Homo sapiens
agaagggttagacaagcctggag

SEQ ID NO: 6624640 - DNA, 19 bp, Homo sapiens
agaagggttatattttact

SEQ ID NO: 6624641 - DNA, 20 bp, Homo sapiens
agaagggttatcctttcatt

SEQ ID NO: 6624642 - DNA, 18 bp, Homo sapiens
agaagggttctgccctgc

SEQ ID NO: 6624643 - DNA, 15 bp, Homo sapiens
agaaggtaataggaa

SEQ ID NO: 6624644 - DNA, 20 bp, Homo sapiens
agaaggtatcagttatatga

SEQ ID NO: 6624645 - DNA, 21 bp, Homo sapiens
agaaggtatcagttatatgat

SEQ ID NO: 6624646 - DNA, 23 bp, Homo sapiens
agaaggtatcagttatatgatat

SEQ ID NO: 6624647 - DNA, 21 bp, Homo sapiens
agaaggtattagcaaagcaaa

SEQ ID NO: 6624648 - DNA, 23 bp, Homo sapiens
agaaggtattctgaccttgtgaa

SEQ ID NO: 6624649 - DNA, 20 bp, Homo sapiens
agaaggtatttttgaagtct

SEQ ID NO: 6624650 - DNA, 14 bp, Homo sapiens
agaaggtccttaat

SEQ ID NO: 6624651 - DNA, 20 bp, Homo sapiens
agaaggtccttaatgatccg

SEQ ID NO: 6624652 - DNA, 14 bp, Homo sapiens
agaaggtgaacttt

SEQ ID NO: 6624653 - DNA, 22 bp, Homo sapiens
agaaggtgcaggggccaggggt

SEQ ID NO: 6624654 - DNA, 15 bp, Homo sapiens
agaaggtgccacttt

SEQ ID NO: 6624655 - DNA, 22 bp, Homo sapiens
agaaggtgccgtgagcaggctt

SEQ ID NO: 6624656 - DNA, 15 bp, Homo sapiens
agaaggtgcttgggc

SEQ ID NO: 6624657 - DNA, 16 bp, Homo sapiens
agaaggtgcttgggct

SEQ ID NO: 6624658 - DNA, 20 bp, Homo sapiens
agaaggtggacctggcagtg

SEQ ID NO: 6624659 - DNA, 18 bp, Homo sapiens
agaaggtggaccttttaa

SEQ ID NO: 6624660 - DNA, 22 bp, Homo sapiens
agaaggtgggaggatgtgaatt

SEQ ID NO: 6624661 - DNA, 16 bp, Homo sapiens
agaaggtggtctgcac

SEQ ID NO: 6624662 - DNA, 17 bp, Homo sapiens
agaaggtggtctgcacc

SEQ ID NO: 6624663 - DNA, 13 bp, Homo sapiens
agaaggtggtttg

SEQ ID NO: 6624664 - DNA, 18 bp, Homo sapiens
agaaggttaccaagaagc

SEQ ID NO: 6624665 - DNA, 17 bp, Homo sapiens
agaaggttgacacagtt

SEQ ID NO: 6624666 - DNA, 16 bp, Homo sapiens
agaaggttggtggggg

SEQ ID NO: 6624667 - DNA, 14 bp, Homo sapiens
agaaggtttattgt

SEQ ID NO: 6624668 - DNA, 17 bp, Homo sapiens
agaaggtttattgttaa

SEQ ID NO: 6624669 - DNA, 22 bp, Homo sapiens
agaaggtttggtccagcctggt

SEQ ID NO: 6624670 - DNA, 17 bp, Homo sapiens
agaaggtttgtgttttt

SEQ ID NO: 6624671 - DNA, 19 bp, Homo sapiens
agaagtaaagtttatttca

SEQ ID NO: 6624672 - DNA, 13 bp, Homo sapiens
agaagtaaattat

SEQ ID NO: 6624673 - DNA, 16 bp, Homo sapiens
agaagtaactcccact

SEQ ID NO: 6624674 - DNA, 14 bp, Homo sapiens
agaagtaacttact

SEQ ID NO: 6624675 - DNA, 14 bp, Homo sapiens
agaagtaacttatt

SEQ ID NO: 6624676 - DNA, 21 bp, Homo sapiens
agaagtaacttattttgtact

SEQ ID NO: 6624677 - DNA, 20 bp, Homo sapiens
agaagtaagaggctacctct

SEQ ID NO: 6624678 - DNA, 21 bp, Homo sapiens
agaagtaagaggctacctctt

SEQ ID NO: 6624679 - DNA, 14 bp, Homo sapiens
agaagtacagggca

SEQ ID NO: 6624680 - DNA, 14 bp, Homo sapiens
agaagtaccagact

SEQ ID NO: 6624681 - DNA, 16 bp, Homo sapiens
agaagtaccagactag

SEQ ID NO: 6624682 - DNA, 17 bp, Homo sapiens
agaagtacgtttttgca

SEQ ID NO: 6624683 - DNA, 22 bp, Homo sapiens
agaagtacgtttttgcattatt

SEQ ID NO: 6624684 - DNA, 13 bp, Homo sapiens
agaagtactggca

SEQ ID NO: 6624685 - DNA, 13 bp, Homo sapiens
agaagtagattaa

SEQ ID NO: 6624686 - DNA, 20 bp, Homo sapiens
agaagtagattaagagccat

SEQ ID NO: 6624687 - DNA, 16 bp, Homo sapiens
agaagtagccacagta

SEQ ID NO: 6624688 - DNA, 21 bp, Homo sapiens
agaagtagctagtagcaatgt

SEQ ID NO: 6624689 - DNA, 23 bp, Homo sapiens
agaagtaggaaggaaaaaataag

SEQ ID NO: 6624690 - DNA, 14 bp, Homo sapiens
agaagtaggaggaa

SEQ ID NO: 6624691 - DNA, 15 bp, Homo sapiens
agaagtaggaggaaa

SEQ ID NO: 6624692 - DNA, 21 bp, Homo sapiens
agaagtaggttctgttttgtt

SEQ ID NO: 6624693 - DNA, 16 bp, Homo sapiens
agaagtataaagaatt

SEQ ID NO: 6624694 - DNA, 16 bp, Homo sapiens
agaagtatatttttgc

SEQ ID NO: 6624695 - DNA, 23 bp, Homo sapiens
agaagtatccctgatttattctg

SEQ ID NO: 6624696 - DNA, 16 bp, Homo sapiens
agaagtatgtcagtta

SEQ ID NO: 6624697 - DNA, 16 bp, Homo sapiens
agaagtattataaatt

SEQ ID NO: 6624698 - DNA, 14 bp, Homo sapiens
agaagtattcctgt

SEQ ID NO: 6624699 - DNA, 16 bp, Homo sapiens
agaagtattcctgttg

SEQ ID NO: 6624700 - DNA, 23 bp, Homo sapiens
agaagtattcctgttgctgtctt

SEQ ID NO: 6624701 - DNA, 24 bp, Homo sapiens
agaagtattcctgttgctgtcttc

SEQ ID NO: 6624702 - DNA, 14 bp, Homo sapiens
agaagtatttttag

SEQ ID NO: 6624703 - DNA, 15 bp, Homo sapiens
agaagtatttttaga

SEQ ID NO: 6624704 - DNA, 18 bp, Homo sapiens
agaagtcaaatgaatgag

SEQ ID NO: 6624705 - DNA, 17 bp, Homo sapiens
agaagtcaacagtgaaa

SEQ ID NO: 6624706 - DNA, 15 bp, Homo sapiens
agaagtcaacatcct

SEQ ID NO: 6624707 - DNA, 17 bp, Homo sapiens
agaagtcaaggcttaga

SEQ ID NO: 6624708 - DNA, 18 bp, Homo sapiens
agaagtcaaggcttagac

SEQ ID NO: 6624709 - DNA, 19 bp, Homo sapiens
agaagtcaaggcttagacc

SEQ ID NO: 6624710 - DNA, 17 bp, Homo sapiens
agaagtcacaacaaaag

SEQ ID NO: 6624711 - DNA, 18 bp, Homo sapiens
agaagtcacaacaaaagg

SEQ ID NO: 6624712 - DNA, 20 bp, Homo sapiens
agaagtcacaacaaaaggaa

SEQ ID NO: 6624713 - DNA, 15 bp, Homo sapiens
agaagtcacagggca

SEQ ID NO: 6624714 - DNA, 18 bp, Homo sapiens
agaagtcactcaattgtt

SEQ ID NO: 6624715 - DNA, 22 bp, Homo sapiens
agaagtcagagagggtgacaag

SEQ ID NO: 6624716 - DNA, 20 bp, Homo sapiens
agaagtcagctactctagtt

SEQ ID NO: 6624717 - DNA, 20 bp, Homo sapiens
agaagtcatacctttttctt

SEQ ID NO: 6624718 - DNA, 16 bp, Homo sapiens
agaagtcatcttgcta

SEQ ID NO: 6624719 - DNA, 17 bp, Homo sapiens
agaagtcatgaagccca

SEQ ID NO: 6624720 - DNA, 22 bp, Homo sapiens
agaagtccaagcaacagccttt

SEQ ID NO: 6624721 - DNA, 15 bp, Homo sapiens
agaagtccacaggac

SEQ ID NO: 6624722 - DNA, 16 bp, Homo sapiens
agaagtccatgtgata

SEQ ID NO: 6624723 - DNA, 19 bp, Homo sapiens
agaagtccctaggagggaa

SEQ ID NO: 6624724 - DNA, 21 bp, Homo sapiens
agaagtccctaggagggaagg

SEQ ID NO: 6624725 - DNA, 24 bp, Homo sapiens
agaagtcctccctcctgcaggctg

SEQ ID NO: 6624726 - DNA, 21 bp, Homo sapiens
agaagtccttaagcagaggaa

SEQ ID NO: 6624727 - DNA, 15 bp, Homo sapiens
agaagtccttatgtt

SEQ ID NO: 6624728 - DNA, 15 bp, Homo sapiens
agaagtcggccaggt

SEQ ID NO: 6624729 - DNA, 16 bp, Homo sapiens
agaagtcggccaggta

SEQ ID NO: 6624730 - DNA, 14 bp, Homo sapiens
agaagtctcagcta

SEQ ID NO: 6624731 - DNA, 23 bp, Homo sapiens
agaagtctccctgcacagcctct

SEQ ID NO: 6624732 - DNA, 20 bp, Homo sapiens
agaagtctcttaattctgat

SEQ ID NO: 6624733 - DNA, 15 bp, Homo sapiens
agaagtctggaaaaa

SEQ ID NO: 6624734 - DNA, 14 bp, Homo sapiens
agaagtctggtcag

SEQ ID NO: 6624735 - DNA, 23 bp, Homo sapiens
agaagtctggtcagagccacagg

SEQ ID NO: 6624736 - DNA, 23 bp, Homo sapiens
agaagtctgtccaaatttaaaat

SEQ ID NO: 6624737 - DNA, 18 bp, Homo sapiens
agaagtctgtctttctat

SEQ ID NO: 6624738 - DNA, 17 bp, Homo sapiens
agaagtcttctatttat

SEQ ID NO: 6624739 - DNA, 18 bp, Homo sapiens
agaagtcttctatttatt

SEQ ID NO: 6624740 - DNA, 16 bp, Homo sapiens
agaagtctttcaagaa

SEQ ID NO: 6624741 - DNA, 17 bp, Homo sapiens
agaagtctttcagatga

SEQ ID NO: 6624742 - DNA, 16 bp, Homo sapiens
agaagtgaaaaagact

SEQ ID NO: 6624743 - DNA, 21 bp, Homo sapiens
agaagtgaaaaagacttcaaa

SEQ ID NO: 6624744 - DNA, 21 bp, Homo sapiens
agaagtgaaaatctacactcc

SEQ ID NO: 6624745 - DNA, 16 bp, Homo sapiens
agaagtgacagggaag

SEQ ID NO: 6624746 - DNA, 18 bp, Homo sapiens
agaagtgacagggaagct

SEQ ID NO: 6624747 - DNA, 14 bp, Homo sapiens
agaagtgagcaaaa

SEQ ID NO: 6624748 - DNA, 14 bp, Homo sapiens
agaagtgagccccc

SEQ ID NO: 6624749 - DNA, 19 bp, Homo sapiens
agaagtgagctttgctgct

SEQ ID NO: 6624750 - DNA, 23 bp, Homo sapiens
agaagtgagctttgctgctacag

SEQ ID NO: 6624751 - DNA, 17 bp, Homo sapiens
agaagtgagtgtttcta

SEQ ID NO: 6624752 - DNA, 19 bp, Homo sapiens
agaagtgagtttgtaaata

SEQ ID NO: 6624753 - DNA, 14 bp, Homo sapiens
agaagtgatttagt

SEQ ID NO: 6624754 - DNA, 19 bp, Homo sapiens
agaagtgcaaaggtgtgca

SEQ ID NO: 6624755 - DNA, 13 bp, Homo sapiens
agaagtgcagccc

SEQ ID NO: 6624756 - DNA, 15 bp, Homo sapiens
agaagtgcatcctga

SEQ ID NO: 6624757 - DNA, 16 bp, Homo sapiens
agaagtgcatttctga

SEQ ID NO: 6624758 - DNA, 15 bp, Homo sapiens
agaagtgccaataat

SEQ ID NO: 6624759 - DNA, 16 bp, Homo sapiens
agaagtgccatctcaa

SEQ ID NO: 6624760 - DNA, 19 bp, Homo sapiens
agaagtgcccctgctgcct

SEQ ID NO: 6624761 - DNA, 22 bp, Homo sapiens
agaagtgcccctgctgcctccc

SEQ ID NO: 6624762 - DNA, 18 bp, Homo sapiens
agaagtgctccctggagg

SEQ ID NO: 6624763 - DNA, 16 bp, Homo sapiens
agaagtggaaatttat

SEQ ID NO: 6624764 - DNA, 22 bp, Homo sapiens
agaagtggaaggataatgagat

SEQ ID NO: 6624765 - DNA, 22 bp, Homo sapiens
agaagtggaagtgcttgatatg

SEQ ID NO: 6624766 - DNA, 22 bp, Homo sapiens
agaagtggagatttcagttcag

SEQ ID NO: 6624767 - DNA, 15 bp, Homo sapiens
agaagtggagtgact

SEQ ID NO: 6624768 - DNA, 17 bp, Homo sapiens
agaagtgggagcagctt

SEQ ID NO: 6624769 - DNA, 22 bp, Homo sapiens
agaagtgggattcaggaatggg

SEQ ID NO: 6624770 - DNA, 18 bp, Homo sapiens
agaagtggggaccccacc

SEQ ID NO: 6624771 - DNA, 18 bp, Homo sapiens
agaagtgggggcagccca

SEQ ID NO: 6624772 - DNA, 20 bp, Homo sapiens
agaagtgggggcagcccagg

SEQ ID NO: 6624773 - DNA, 15 bp, Homo sapiens
agaagtgggtgggga

SEQ ID NO: 6624774 - DNA, 12 bp, Homo sapiens
agaagtggtact

SEQ ID NO: 6624775 - DNA, 15 bp, Homo sapiens
agaagtggtgttcca

SEQ ID NO: 6624776 - DNA, 24 bp, Homo sapiens
agaagtggtgttccatgacttcag

SEQ ID NO: 6624777 - DNA, 13 bp, Homo sapiens
agaagtgtatata

SEQ ID NO: 6624778 - DNA, 21 bp, Homo sapiens
agaagtgtcaccctgtgggtg

SEQ ID NO: 6624779 - DNA, 19 bp, Homo sapiens
agaagtgtccgagaactaa

SEQ ID NO: 6624780 - DNA, 14 bp, Homo sapiens
agaagtgtgattgg

SEQ ID NO: 6624781 - DNA, 21 bp, Homo sapiens
agaagtgtgccttctctctcc

SEQ ID NO: 6624782 - DNA, 13 bp, Homo sapiens
agaagtgtgttct

SEQ ID NO: 6624783 - DNA, 20 bp, Homo sapiens
agaagttaaaaaacagctgc

SEQ ID NO: 6624784 - DNA, 21 bp, Homo sapiens
agaagttaaaggttactgttt

SEQ ID NO: 6624785 - DNA, 19 bp, Homo sapiens
agaagttaagcaacatcta

SEQ ID NO: 6624786 - DNA, 14 bp, Homo sapiens
agaagttaagcagc

SEQ ID NO: 6624787 - DNA, 13 bp, Homo sapiens
agaagttaccaaa

SEQ ID NO: 6624788 - DNA, 14 bp, Homo sapiens
agaagttactgaat

SEQ ID NO: 6624789 - DNA, 11 bp, Homo sapiens
agaagttactt

SEQ ID NO: 6624790 - DNA, 15 bp, Homo sapiens
agaagttactttgta

SEQ ID NO: 6624791 - DNA, 15 bp, Homo sapiens
agaagttagtttgta

SEQ ID NO: 6624792 - DNA, 18 bp, Homo sapiens
agaagttagtttgtatat

SEQ ID NO: 6624793 - DNA, 19 bp, Homo sapiens
agaagttagtttgtatata

SEQ ID NO: 6624794 - DNA, 19 bp, Homo sapiens
agaagttcaatataagctt

SEQ ID NO: 6624795 - DNA, 15 bp, Homo sapiens
agaagttcaccagcc

SEQ ID NO: 6624796 - DNA, 17 bp, Homo sapiens
agaagttcaccagccct

SEQ ID NO: 6624797 - DNA, 18 bp, Homo sapiens
agaagttcaccagccctg

SEQ ID NO: 6624798 - DNA, 16 bp, Homo sapiens
agaagttcagttttta

SEQ ID NO: 6624799 - DNA, 15 bp, Homo sapiens
agaagttcattcctg

SEQ ID NO: 6624800 - DNA, 17 bp, Homo sapiens
agaagttcattcctgtc

SEQ ID NO: 6624801 - DNA, 15 bp, Homo sapiens
agaagttctagtgtt

SEQ ID NO: 6624802 - DNA, 16 bp, Homo sapiens
agaagttctagtgttt

SEQ ID NO: 6624803 - DNA, 18 bp, Homo sapiens
agaagttctcaaagttaa

SEQ ID NO: 6624804 - DNA, 13 bp, Homo sapiens
agaagttctcaga

SEQ ID NO: 6624805 - DNA, 15 bp, Homo sapiens
agaagttcttaaata

SEQ ID NO: 6624806 - DNA, 21 bp, Homo sapiens
agaagttctttgattctgtaa

SEQ ID NO: 6624807 - DNA, 19 bp, Homo sapiens
agaagttgatatagaacag

SEQ ID NO: 6624808 - DNA, 15 bp, Homo sapiens
agaagttgatggata

SEQ ID NO: 6624809 - DNA, 16 bp, Homo sapiens
agaagttgccaagagt

SEQ ID NO: 6624810 - DNA, 21 bp, Homo sapiens
agaagttgtaaagtatgtatt

SEQ ID NO: 6624811 - DNA, 20 bp, Homo sapiens
agaagttgttagtgatttgc

SEQ ID NO: 6624812 - DNA, 22 bp, Homo sapiens
agaagttgttagtgatttgcta

SEQ ID NO: 6624813 - DNA, 20 bp, Homo sapiens
agaagttgtttgaggcaaat

SEQ ID NO: 6624814 - DNA, 13 bp, Homo sapiens
agaagtttaaata

SEQ ID NO: 6624815 - DNA, 15 bp, Homo sapiens
agaagtttaaggaat

SEQ ID NO: 6624816 - DNA, 17 bp, Homo sapiens
agaagtttaaggaatat

SEQ ID NO: 6624817 - DNA, 17 bp, Homo sapiens
agaagtttaagtaagta

SEQ ID NO: 6624818 - DNA, 21 bp, Homo sapiens
agaagtttcagttgtccttaa

SEQ ID NO: 6624819 - DNA, 23 bp, Homo sapiens
agaagtttcatcattttttactt

SEQ ID NO: 6624820 - DNA, 18 bp, Homo sapiens
agaagtttcccttcctcc

SEQ ID NO: 6624821 - DNA, 22 bp, Homo sapiens
agaagtttctgccgcagccctg

SEQ ID NO: 6624822 - DNA, 22 bp, Homo sapiens
agaagtttctggagcaagagag

SEQ ID NO: 6624823 - DNA, 23 bp, Homo sapiens
agaagtttgcactatctttcagc

SEQ ID NO: 6624824 - DNA, 12 bp, Homo sapiens
agaagtttgcat

SEQ ID NO: 6624825 - DNA, 21 bp, Homo sapiens
agaagtttggctgctgtcata

SEQ ID NO: 6624826 - DNA, 20 bp, Homo sapiens
agaagtttgggctaacattt

SEQ ID NO: 6624827 - DNA, 19 bp, Homo sapiens
agaagtttgtccatttgta

SEQ ID NO: 6624828 - DNA, 22 bp, Homo sapiens
agaagtttgtccatttgtaaaa

SEQ ID NO: 6624829 - DNA, 20 bp, Homo sapiens
agaagtttgtggtataaaaa

SEQ ID NO: 6624830 - DNA, 22 bp, Homo sapiens
agaagtttgtgtctttgtctgg

SEQ ID NO: 6624831 - DNA, 17 bp, Homo sapiens
agaagttttaaattttg

SEQ ID NO: 6624832 - DNA, 13 bp, Homo sapiens
agaagttttaact

SEQ ID NO: 6624833 - DNA, 12 bp, Homo sapiens
agaagtttttct

SEQ ID NO: 6624834 - DNA, 16 bp, Homo sapiens
agaagtttttctttgt

SEQ ID NO: 6624835 - DNA, 14 bp, Homo sapiens
agaagtttttgtac

SEQ ID NO: 6624836 - DNA, 15 bp, Homo sapiens
agaagtttttgtact

SEQ ID NO: 6624837 - DNA, 17 bp, Homo sapiens
agaagtttttgtactgt

SEQ ID NO: 6624838 - DNA, 20 bp, Homo sapiens
agaagtttttgtactgtaaa

SEQ ID NO: 6624839 - DNA, 15 bp, Homo sapiens
agaataaaaactttt

SEQ ID NO: 6624840 - DNA, 15 bp, Homo sapiens
agaataaaagaaatt

SEQ ID NO: 6624841 - DNA, 14 bp, Homo sapiens
agaataaaagctat

SEQ ID NO: 6624842 - DNA, 19 bp, Homo sapiens
agaataaaagctataaagt

SEQ ID NO: 6624843 - DNA, 20 bp, Homo sapiens
agaataaaagctataaagta

SEQ ID NO: 6624844 - DNA, 22 bp, Homo sapiens
agaataaaagctataaagtata

SEQ ID NO: 6624845 - DNA, 13 bp, Homo sapiens
agaataaaatgtt

SEQ ID NO: 6624846 - DNA, 14 bp, Homo sapiens
agaataaaatgttg

SEQ ID NO: 6624847 - DNA, 17 bp, Homo sapiens
agaataaaatgtttctc

SEQ ID NO: 6624848 - DNA, 15 bp, Homo sapiens
agaataaaattccta

SEQ ID NO: 6624849 - DNA, 18 bp, Homo sapiens
agaataaaattcctatct

SEQ ID NO: 6624850 - DNA, 12 bp, Homo sapiens
agaataaaattt

SEQ ID NO: 6624851 - DNA, 14 bp, Homo sapiens
agaataaaattttt

SEQ ID NO: 6624852 - DNA, 17 bp, Homo sapiens
agaataaaatttttaat

SEQ ID NO: 6624853 - DNA, 14 bp, Homo sapiens
agaataaacatttg

SEQ ID NO: 6624854 - DNA, 17 bp, Homo sapiens
agaataaacatttgtta

SEQ ID NO: 6624855 - DNA, 22 bp, Homo sapiens
agaataaaccggatcctgttgc

SEQ ID NO: 6624856 - DNA, 14 bp, Homo sapiens
agaataaagaacat

SEQ ID NO: 6624857 - DNA, 12 bp, Homo sapiens
agaataaagcaa

SEQ ID NO: 6624858 - DNA, 13 bp, Homo sapiens
agaataaagcaat

SEQ ID NO: 6624859 - DNA, 19 bp, Homo sapiens
agaataaagcaattttcct

SEQ ID NO: 6624860 - DNA, 20 bp, Homo sapiens
agaataaagcaattttcctt

SEQ ID NO: 6624861 - DNA, 22 bp, Homo sapiens
agaataaagcaattttccttga

SEQ ID NO: 6624862 - DNA, 13 bp, Homo sapiens
agaataaagcagc

SEQ ID NO: 6624863 - DNA, 17 bp, Homo sapiens
agaataaagcagcctga

SEQ ID NO: 6624864 - DNA, 14 bp, Homo sapiens
agaataaaggcagt

SEQ ID NO: 6624865 - DNA, 18 bp, Homo sapiens
agaataaaggcagttttc

SEQ ID NO: 6624866 - DNA, 15 bp, Homo sapiens
agaataaaggcctgc

SEQ ID NO: 6624867 - DNA, 20 bp, Homo sapiens
agaataaaggtatgaaaggg

SEQ ID NO: 6624868 - DNA, 18 bp, Homo sapiens
agaataaagttcctgtca

SEQ ID NO: 6624869 - DNA, 12 bp, Homo sapiens
agaataaataaa

SEQ ID NO: 6624870 - DNA, 14 bp, Homo sapiens
agaataaataaaga

SEQ ID NO: 6624871 - DNA, 14 bp, Homo sapiens
agaataaatccttg

SEQ ID NO: 6624872 - DNA, 23 bp, Homo sapiens
agaataaatccttgggagtcatt

SEQ ID NO: 6624873 - DNA, 15 bp, Homo sapiens
agaataactacctcc

SEQ ID NO: 6624874 - DNA, 16 bp, Homo sapiens
agaataagaatttgca

SEQ ID NO: 6624875 - DNA, 22 bp, Homo sapiens
agaataagagagtcataaacct

SEQ ID NO: 6624876 - DNA, 13 bp, Homo sapiens
agaataaggagga

SEQ ID NO: 6624877 - DNA, 21 bp, Homo sapiens
agaataaggaggaggagggag

SEQ ID NO: 6624878 - DNA, 18 bp, Homo sapiens
agaataagtcatgttcct

SEQ ID NO: 6624879 - DNA, 13 bp, Homo sapiens
agaataagttatt

SEQ ID NO: 6624880 - DNA, 17 bp, Homo sapiens
agaataagttattgcag

SEQ ID NO: 6624881 - DNA, 22 bp, Homo sapiens
agaataagttggagaaatgttt

SEQ ID NO: 6624882 - DNA, 12 bp, Homo sapiens
agaataataaat

SEQ ID NO: 6624883 - DNA, 14 bp, Homo sapiens
agaataatctatta

SEQ ID NO: 6624884 - DNA, 16 bp, Homo sapiens
agaataatctttgggt

SEQ ID NO: 6624885 - DNA, 13 bp, Homo sapiens
agaataatgaaga

SEQ ID NO: 6624886 - DNA, 20 bp, Homo sapiens
agaataatgacgtattgtga

SEQ ID NO: 6624887 - DNA, 16 bp, Homo sapiens
agaataatggaaacat

SEQ ID NO: 6624888 - DNA, 14 bp, Homo sapiens
agaataatgttcta

SEQ ID NO: 6624889 - DNA, 13 bp, Homo sapiens
agaataattattt

SEQ ID NO: 6624890 - DNA, 15 bp, Homo sapiens
agaataattatttca

SEQ ID NO: 6624891 - DNA, 17 bp, Homo sapiens
agaataattatttcaga

SEQ ID NO: 6624892 - DNA, 21 bp, Homo sapiens
agaataattcaattttaaaga

SEQ ID NO: 6624893 - DNA, 19 bp, Homo sapiens
agaataattcttttctgag

SEQ ID NO: 6624894 - DNA, 16 bp, Homo sapiens
agaataatttatagta

SEQ ID NO: 6624895 - DNA, 18 bp, Homo sapiens
agaatacagaaagatgga

SEQ ID NO: 6624896 - DNA, 15 bp, Homo sapiens
agaatacagctttct

SEQ ID NO: 6624897 - DNA, 16 bp, Homo sapiens
agaatacagctttctg

SEQ ID NO: 6624898 - DNA, 17 bp, Homo sapiens
agaatacagctttctga

SEQ ID NO: 6624899 - DNA, 13 bp, Homo sapiens
agaatacatcttg

SEQ ID NO: 6624900 - DNA, 15 bp, Homo sapiens
agaatacattgtact

SEQ ID NO: 6624901 - DNA, 15 bp, Homo sapiens
agaatacccaggaag

SEQ ID NO: 6624902 - DNA, 19 bp, Homo sapiens
agaataccccaccagcaga

SEQ ID NO: 6624903 - DNA, 11 bp, Homo sapiens
agaatacctcc

SEQ ID NO: 6624904 - DNA, 17 bp, Homo sapiens
agaatacgcagaactac

SEQ ID NO: 6624905 - DNA, 15 bp, Homo sapiens
agaatactacagcat

SEQ ID NO: 6624906 - DNA, 11 bp, Homo sapiens
agaatactgat

SEQ ID NO: 6624907 - DNA, 15 bp, Homo sapiens
agaatactgatggaa

SEQ ID NO: 6624908 - DNA, 17 bp, Homo sapiens
agaatactgatggaatt

SEQ ID NO: 6624909 - DNA, 17 bp, Homo sapiens
agaatactgccaaaaca

SEQ ID NO: 6624910 - DNA, 16 bp, Homo sapiens
agaatactggtctcag

SEQ ID NO: 6624911 - DNA, 14 bp, Homo sapiens
agaatactgtattg

SEQ ID NO: 6624912 - DNA, 15 bp, Homo sapiens
agaatacttctcatt

SEQ ID NO: 6624913 - DNA, 16 bp, Homo sapiens
agaatactttgcttca

SEQ ID NO: 6624914 - DNA, 14 bp, Homo sapiens
agaatacttttctc

SEQ ID NO: 6624915 - DNA, 16 bp, Homo sapiens
agaatacttttctctt

SEQ ID NO: 6624916 - DNA, 14 bp, Homo sapiens
agaatactttttaa

SEQ ID NO: 6624917 - DNA, 19 bp, Homo sapiens
agaatacttttttctagtt

SEQ ID NO: 6624918 - DNA, 13 bp, Homo sapiens
agaatagaaacaa

SEQ ID NO: 6624919 - DNA, 21 bp, Homo sapiens
agaatagaacaacatatacaa

SEQ ID NO: 6624920 - DNA, 17 bp, Homo sapiens
agaatagaacacagttt

SEQ ID NO: 6624921 - DNA, 16 bp, Homo sapiens
agaatagaaggaaact

SEQ ID NO: 6624922 - DNA, 17 bp, Homo sapiens
agaatagaaggaaacta

SEQ ID NO: 6624923 - DNA, 15 bp, Homo sapiens
agaatagagctgcca

SEQ ID NO: 6624924 - DNA, 16 bp, Homo sapiens
agaatagagctgccac

SEQ ID NO: 6624925 - DNA, 20 bp, Homo sapiens
agaatagagctgccactggg

SEQ ID NO: 6624926 - DNA, 12 bp, Homo sapiens
agaatagcacag

SEQ ID NO: 6624927 - DNA, 14 bp, Homo sapiens
agaatagcacagcc

SEQ ID NO: 6624928 - DNA, 17 bp, Homo sapiens
agaatagcagagagcca

SEQ ID NO: 6624929 - DNA, 18 bp, Homo sapiens
agaatagcatctgtacaa

SEQ ID NO: 6624930 - DNA, 22 bp, Homo sapiens
agaatagcatctgtacaaaggg

SEQ ID NO: 6624931 - DNA, 15 bp, Homo sapiens
agaatagcatgttgt

SEQ ID NO: 6624932 - DNA, 20 bp, Homo sapiens
agaatagctgttttgtgtat

SEQ ID NO: 6624933 - DNA, 20 bp, Homo sapiens
agaatagcttccaataaagc

SEQ ID NO: 6624934 - DNA, 17 bp, Homo sapiens
agaataggacttgtttt

SEQ ID NO: 6624935 - DNA, 23 bp, Homo sapiens
agaataggcaaacttttatgcag

SEQ ID NO: 6624936 - DNA, 20 bp, Homo sapiens
agaataggcagggggccctg

SEQ ID NO: 6624937 - DNA, 18 bp, Homo sapiens
agaatagggtatgatcct

SEQ ID NO: 6624938 - DNA, 21 bp, Homo sapiens
agaataggtgcaaacaaacaa

SEQ ID NO: 6624939 - DNA, 12 bp, Homo sapiens
agaatagtctct

SEQ ID NO: 6624940 - DNA, 14 bp, Homo sapiens
agaatagtctctgg

SEQ ID NO: 6624941 - DNA, 15 bp, Homo sapiens
agaatagtgcctcag

SEQ ID NO: 6624942 - DNA, 20 bp, Homo sapiens
agaatagtgcctcagcgctg

SEQ ID NO: 6624943 - DNA, 23 bp, Homo sapiens
agaatagtgcctcagcgctgccc

SEQ ID NO: 6624944 - DNA, 20 bp, Homo sapiens
agaatagttaaattggcttg

SEQ ID NO: 6624945 - DNA, 20 bp, Homo sapiens
agaatagttgaacctatttc

SEQ ID NO: 6624946 - DNA, 13 bp, Homo sapiens
agaatagttgtca

SEQ ID NO: 6624947 - DNA, 13 bp, Homo sapiens
agaatagtttaca

SEQ ID NO: 6624948 - DNA, 18 bp, Homo sapiens
agaatagtttgaaataga

SEQ ID NO: 6624949 - DNA, 22 bp, Homo sapiens
agaatagtttggttcttcaaat

SEQ ID NO: 6624950 - DNA, 19 bp, Homo sapiens
agaatataaaaaatgttat

SEQ ID NO: 6624951 - DNA, 17 bp, Homo sapiens
agaatataaacacataa

SEQ ID NO: 6624952 - DNA, 14 bp, Homo sapiens
agaatataaataaa

SEQ ID NO: 6624953 - DNA, 14 bp, Homo sapiens
agaatataacatga

SEQ ID NO: 6624954 - DNA, 15 bp, Homo sapiens
agaatataacatgaa

SEQ ID NO: 6624955 - DNA, 15 bp, Homo sapiens
agaatataattatcg

SEQ ID NO: 6624956 - DNA, 20 bp, Homo sapiens
agaatatacacattttgtaa

SEQ ID NO: 6624957 - DNA, 23 bp, Homo sapiens
agaatatacacattttgtaaatc

SEQ ID NO: 6624958 - DNA, 12 bp, Homo sapiens
agaatatacctt

SEQ ID NO: 6624959 - DNA, 15 bp, Homo sapiens
agaatatactgtctt

SEQ ID NO: 6624960 - DNA, 18 bp, Homo sapiens
agaatatagcatctttca

SEQ ID NO: 6624961 - DNA, 19 bp, Homo sapiens
agaatataggtctcttctc

SEQ ID NO: 6624962 - DNA, 12 bp, Homo sapiens
agaatatataaa

SEQ ID NO: 6624963 - DNA, 11 bp, Homo sapiens
agaatatatat

SEQ ID NO: 6624964 - DNA, 12 bp, Homo sapiens
agaatatattta

SEQ ID NO: 6624965 - DNA, 18 bp, Homo sapiens
agaatatatttatttaaa

SEQ ID NO: 6624966 - DNA, 20 bp, Homo sapiens
agaatatcaagatgattctg

SEQ ID NO: 6624967 - DNA, 14 bp, Homo sapiens
agaatatcatcttt

SEQ ID NO: 6624968 - DNA, 22 bp, Homo sapiens
agaatatcctttaaaatttaaa

SEQ ID NO: 6624969 - DNA, 16 bp, Homo sapiens
agaatatgacaatcta

SEQ ID NO: 6624970 - DNA, 12 bp, Homo sapiens
agaatatgcctt

SEQ ID NO: 6624971 - DNA, 14 bp, Homo sapiens
agaatatggacaaa

SEQ ID NO: 6624972 - DNA, 13 bp, Homo sapiens
agaatatgtctgc

SEQ ID NO: 6624973 - DNA, 20 bp, Homo sapiens
agaatatgttaatgcaaagc

SEQ ID NO: 6624974 - DNA, 15 bp, Homo sapiens
agaatatgttcacat

SEQ ID NO: 6624975 - DNA, 18 bp, Homo sapiens
agaatatgttgctttgaa

SEQ ID NO: 6624976 - DNA, 17 bp, Homo sapiens
agaatatgtttcaaact

SEQ ID NO: 6624977 - DNA, 14 bp, Homo sapiens
agaatattaaaaat

SEQ ID NO: 6624978 - DNA, 24 bp, Homo sapiens
agaatattaagcacattattgtag

SEQ ID NO: 6624979 - DNA, 20 bp, Homo sapiens
agaatattagctttactgtt

SEQ ID NO: 6624980 - DNA, 18 bp, Homo sapiens
agaatattataaaaatat

SEQ ID NO: 6624981 - DNA, 18 bp, Homo sapiens
agaatattcaaaattcca

SEQ ID NO: 6624982 - DNA, 15 bp, Homo sapiens
agaatattcaaatgt

SEQ ID NO: 6624983 - DNA, 12 bp, Homo sapiens
agaatattcagg

SEQ ID NO: 6624984 - DNA, 15 bp, Homo sapiens
agaatattcaggact

SEQ ID NO: 6624985 - DNA, 21 bp, Homo sapiens
agaatattgaagtacttgcca

SEQ ID NO: 6624986 - DNA, 21 bp, Homo sapiens
agaatattgcaaaatacatga

SEQ ID NO: 6624987 - DNA, 20 bp, Homo sapiens
agaatattgcccaaataata

SEQ ID NO: 6624988 - DNA, 18 bp, Homo sapiens
agaatattgtattgttag

SEQ ID NO: 6624989 - DNA, 14 bp, Homo sapiens
agaatattgttcct

SEQ ID NO: 6624990 - DNA, 20 bp, Homo sapiens
agaatatttaaccccacaca

SEQ ID NO: 6624991 - DNA, 23 bp, Homo sapiens
agaatatttaagaaaagcacttt

SEQ ID NO: 6624992 - DNA, 14 bp, Homo sapiens
agaatatttagaaa

SEQ ID NO: 6624993 - DNA, 11 bp, Homo sapiens
agaatatttat

SEQ ID NO: 6624994 - DNA, 22 bp, Homo sapiens
agaatatttattacctctgata

SEQ ID NO: 6624995 - DNA, 16 bp, Homo sapiens
agaatatttcaaatga

SEQ ID NO: 6624996 - DNA, 13 bp, Homo sapiens
agaatatttctat

SEQ ID NO: 6624997 - DNA, 16 bp, Homo sapiens
agaatatttctattga

SEQ ID NO: 6624998 - DNA, 14 bp, Homo sapiens
agaatattttaagt

SEQ ID NO: 6624999 - DNA, 23 bp, Homo sapiens
agaatatttttatatttccttta

SEQ ID NO: 6625000 - DNA, 21 bp, Homo sapiens
agaatatttttggcattcctc

SEQ ID NO: 6625001 - DNA, 16 bp, Homo sapiens
agaatcacacaagttt

SEQ ID NO: 6625002 - DNA, 22 bp, Homo sapiens
agaatcacttctgagaactcat

SEQ ID NO: 6625003 - DNA, 16 bp, Homo sapiens
agaatcagaagatagt

SEQ ID NO: 6625004 - DNA, 23 bp, Homo sapiens
agaatcagagaaggaacataccc

SEQ ID NO: 6625005 - DNA, 16 bp, Homo sapiens
agaatcagagtagaaa

SEQ ID NO: 6625006 - DNA, 13 bp, Homo sapiens
agaatcagcctag

SEQ ID NO: 6625007 - DNA, 18 bp, Homo sapiens
agaatcagtagctggaga

SEQ ID NO: 6625008 - DNA, 17 bp, Homo sapiens
agaatcagtaggaccag

SEQ ID NO: 6625009 - DNA, 20 bp, Homo sapiens
agaatcagtaggaccaggcc

SEQ ID NO: 6625010 - DNA, 14 bp, Homo sapiens
agaatcagtgttaa

SEQ ID NO: 6625011 - DNA, 16 bp, Homo sapiens
agaatcataattttca

SEQ ID NO: 6625012 - DNA, 19 bp, Homo sapiens
agaatcatacttaacattt

SEQ ID NO: 6625013 - DNA, 20 bp, Homo sapiens
agaatcatcctcatgccttt

SEQ ID NO: 6625014 - DNA, 13 bp, Homo sapiens
agaatcatgctgt

SEQ ID NO: 6625015 - DNA, 16 bp, Homo sapiens
agaatcatgctgttct

SEQ ID NO: 6625016 - DNA, 16 bp, Homo sapiens
agaatcatgtttcttt

SEQ ID NO: 6625017 - DNA, 21 bp, Homo sapiens
agaatcatgtttctttgatca

SEQ ID NO: 6625018 - DNA, 14 bp, Homo sapiens
agaatcattattta

SEQ ID NO: 6625019 - DNA, 21 bp, Homo sapiens
agaatcattatttattaaatt

SEQ ID NO: 6625020 - DNA, 21 bp, Homo sapiens
agaatcattgtgcttaataat

SEQ ID NO: 6625021 - DNA, 12 bp, Homo sapiens
agaatccaaaga

SEQ ID NO: 6625022 - DNA, 17 bp, Homo sapiens
agaatccaaagatcaca

SEQ ID NO: 6625023 - DNA, 23 bp, Homo sapiens
agaatccaagacaaactaaactt

SEQ ID NO: 6625024 - DNA, 21 bp, Homo sapiens
agaatccacataaaagaagaa

SEQ ID NO: 6625025 - DNA, 17 bp, Homo sapiens
agaatccagtttctttc

SEQ ID NO: 6625026 - DNA, 17 bp, Homo sapiens
agaatccataaatgtgt

SEQ ID NO: 6625027 - DNA, 13 bp, Homo sapiens
agaatcccaaaga

SEQ ID NO: 6625028 - DNA, 15 bp, Homo sapiens
agaatcccaaatttg

SEQ ID NO: 6625029 - DNA, 17 bp, Homo sapiens
agaatcccaaatttgat

SEQ ID NO: 6625030 - DNA, 18 bp, Homo sapiens
agaatcccactttctata

SEQ ID NO: 6625031 - DNA, 12 bp, Homo sapiens
agaatcccagcc

SEQ ID NO: 6625032 - DNA, 18 bp, Homo sapiens
agaatccccaagtgcctg

SEQ ID NO: 6625033 - DNA, 22 bp, Homo sapiens
agaatccccgtgctcacagtag

SEQ ID NO: 6625034 - DNA, 19 bp, Homo sapiens
agaatccctagactttagg

SEQ ID NO: 6625035 - DNA, 18 bp, Homo sapiens
agaatccctggcaaaggg

SEQ ID NO: 6625036 - DNA, 15 bp, Homo sapiens
agaatccctgttcat

SEQ ID NO: 6625037 - DNA, 16 bp, Homo sapiens
agaatccctgttcatt

SEQ ID NO: 6625038 - DNA, 15 bp, Homo sapiens
agaatcccttaaaat

SEQ ID NO: 6625039 - DNA, 19 bp, Homo sapiens
agaatcccttaaaattacc

SEQ ID NO: 6625040 - DNA, 17 bp, Homo sapiens
agaatccgtattgaatt

SEQ ID NO: 6625041 - DNA, 20 bp, Homo sapiens
agaatcctcagttggaatca

SEQ ID NO: 6625042 - DNA, 15 bp, Homo sapiens
agaatcctcccttcc

SEQ ID NO: 6625043 - DNA, 17 bp, Homo sapiens
agaatcctcccttccca

SEQ ID NO: 6625044 - DNA, 21 bp, Homo sapiens
agaatcctctcctttcttatt

SEQ ID NO: 6625045 - DNA, 17 bp, Homo sapiens
agaatcctgcctctccc

SEQ ID NO: 6625046 - DNA, 22 bp, Homo sapiens
agaatcctggccctctgtgttg

SEQ ID NO: 6625047 - DNA, 14 bp, Homo sapiens
agaatcctgggccc

SEQ ID NO: 6625048 - DNA, 15 bp, Homo sapiens
agaatcctgggcccc

SEQ ID NO: 6625049 - DNA, 19 bp, Homo sapiens
agaatcctgggcccccaga

SEQ ID NO: 6625050 - DNA, 20 bp, Homo sapiens
agaatccttatctataaaag

SEQ ID NO: 6625051 - DNA, 21 bp, Homo sapiens
agaatccttatctataaaagg

SEQ ID NO: 6625052 - DNA, 21 bp, Homo sapiens
agaatccttggctgaattaaa

SEQ ID NO: 6625053 - DNA, 14 bp, Homo sapiens
agaatcctttacat

SEQ ID NO: 6625054 - DNA, 19 bp, Homo sapiens
agaatcggcagtattttct

SEQ ID NO: 6625055 - DNA, 18 bp, Homo sapiens
agaatcggctttgcagtg

SEQ ID NO: 6625056 - DNA, 10 bp, Homo sapiens
agaatctaaa

SEQ ID NO: 6625057 - DNA, 16 bp, Homo sapiens
agaatctaaagccagt

SEQ ID NO: 6625058 - DNA, 15 bp, Homo sapiens
agaatctactttaat

SEQ ID NO: 6625059 - DNA, 13 bp, Homo sapiens
agaatctagaaat

SEQ ID NO: 6625060 - DNA, 12 bp, Homo sapiens
agaatctatttt

SEQ ID NO: 6625061 - DNA, 16 bp, Homo sapiens
agaatctattttctat

SEQ ID NO: 6625062 - DNA, 22 bp, Homo sapiens
agaatctattttctatgtacta

SEQ ID NO: 6625063 - DNA, 13 bp, Homo sapiens
agaatctcagcac

SEQ ID NO: 6625064 - DNA, 20 bp, Homo sapiens
agaatctctatgtatattct

SEQ ID NO: 6625065 - DNA, 21 bp, Homo sapiens
agaatctctatgtatattcta

SEQ ID NO: 6625066 - DNA, 15 bp, Homo sapiens
agaatctctcctctc

SEQ ID NO: 6625067 - DNA, 17 bp, Homo sapiens
agaatctctcctctctc

SEQ ID NO: 6625068 - DNA, 22 bp, Homo sapiens
agaatctcttcatgcttgacat

SEQ ID NO: 6625069 - DNA, 13 bp, Homo sapiens
agaatctctttcg

SEQ ID NO: 6625070 - DNA, 15 bp, Homo sapiens
agaatctcttttctg

SEQ ID NO: 6625071 - DNA, 18 bp, Homo sapiens
agaatctgaagctattga

SEQ ID NO: 6625072 - DNA, 20 bp, Homo sapiens
agaatctgaagctattgatg

SEQ ID NO: 6625073 - DNA, 17 bp, Homo sapiens
agaatctgcaattcaaa

SEQ ID NO: 6625074 - DNA, 17 bp, Homo sapiens
agaatctgctgcatagc

SEQ ID NO: 6625075 - DNA, 17 bp, Homo sapiens
agaatctgctgttgcca

SEQ ID NO: 6625076 - DNA, 19 bp, Homo sapiens
agaatctggctcctgtttc

SEQ ID NO: 6625077 - DNA, 19 bp, Homo sapiens
agaatctgtagaggagcct

SEQ ID NO: 6625078 - DNA, 14 bp, Homo sapiens
agaatctgtgcagt

SEQ ID NO: 6625079 - DNA, 12 bp, Homo sapiens
agaatcttaagg

SEQ ID NO: 6625080 - DNA, 16 bp, Homo sapiens
agaatcttaaggtcta

SEQ ID NO: 6625081 - DNA, 12 bp, Homo sapiens
agaatcttcctg

SEQ ID NO: 6625082 - DNA, 13 bp, Homo sapiens
agaatcttctggg

SEQ ID NO: 6625083 - DNA, 16 bp, Homo sapiens
agaatcttgactttct

SEQ ID NO: 6625084 - DNA, 19 bp, Homo sapiens
agaatcttggtttgccttc

SEQ ID NO: 6625085 - DNA, 14 bp, Homo sapiens
agaatcttgtattt

SEQ ID NO: 6625086 - DNA, 23 bp, Homo sapiens
agaatctttagagaagtatacat

SEQ ID NO: 6625087 - DNA, 19 bp, Homo sapiens
agaatctttattcaaactt

SEQ ID NO: 6625088 - DNA, 21 bp, Homo sapiens
agaatctttattgagaaagag

SEQ ID NO: 6625089 - DNA, 19 bp, Homo sapiens
agaatctttccttcctctc

SEQ ID NO: 6625090 - DNA, 16 bp, Homo sapiens
agaatctttgcaagaa

SEQ ID NO: 6625091 - DNA, 22 bp, Homo sapiens
agaatctttgcatgcagaggag

SEQ ID NO: 6625092 - DNA, 12 bp, Homo sapiens
agaatcttttaa

SEQ ID NO: 6625093 - DNA, 20 bp, Homo sapiens
agaatcttttcaatgggttt

SEQ ID NO: 6625094 - DNA, 22 bp, Homo sapiens
agaatgaaaaatgaaagatgat

SEQ ID NO: 6625095 - DNA, 14 bp, Homo sapiens
agaatgaaaacaat

SEQ ID NO: 6625096 - DNA, 16 bp, Homo sapiens
agaatgaaaactcatt

SEQ ID NO: 6625097 - DNA, 16 bp, Homo sapiens
agaatgaaaagtttag

SEQ ID NO: 6625098 - DNA, 17 bp, Homo sapiens
agaatgaaaattgtatg

SEQ ID NO: 6625099 - DNA, 15 bp, Homo sapiens
agaatgaaagctcct

SEQ ID NO: 6625100 - DNA, 16 bp, Homo sapiens
agaatgaaagggccca

SEQ ID NO: 6625101 - DNA, 16 bp, Homo sapiens
agaatgaaatactgtt

SEQ ID NO: 6625102 - DNA, 15 bp, Homo sapiens
agaatgaaatgaatg

SEQ ID NO: 6625103 - DNA, 17 bp, Homo sapiens
agaatgaaatgaatgat

SEQ ID NO: 6625104 - DNA, 12 bp, Homo sapiens
agaatgaacaca

SEQ ID NO: 6625105 - DNA, 14 bp, Homo sapiens
agaatgaactgtgg

SEQ ID NO: 6625106 - DNA, 21 bp, Homo sapiens
agaatgaactgtggaatttat

SEQ ID NO: 6625107 - DNA, 19 bp, Homo sapiens
agaatgaagaactgcatgt

SEQ ID NO: 6625108 - DNA, 16 bp, Homo sapiens
agaatgaagccattta

SEQ ID NO: 6625109 - DNA, 19 bp, Homo sapiens
agaatgaaggtttttgtaa

SEQ ID NO: 6625110 - DNA, 18 bp, Homo sapiens
agaatgaattcgatgcgt

SEQ ID NO: 6625111 - DNA, 22 bp, Homo sapiens
agaatgaatttatctttaccaa

SEQ ID NO: 6625112 - DNA, 17 bp, Homo sapiens
agaatgaccctgtcaag

SEQ ID NO: 6625113 - DNA, 15 bp, Homo sapiens
agaatgaccttgtaa

SEQ ID NO: 6625114 - DNA, 16 bp, Homo sapiens
agaatgaccttgtaat

SEQ ID NO: 6625115 - DNA, 20 bp, Homo sapiens
agaatgaccttgtaatgtaa

SEQ ID NO: 6625116 - DNA, 15 bp, Homo sapiens
agaatgactctggaa

SEQ ID NO: 6625117 - DNA, 14 bp, Homo sapiens
agaatgagagtgtg

SEQ ID NO: 6625118 - DNA, 21 bp, Homo sapiens
agaatgagatgatttaattct

SEQ ID NO: 6625119 - DNA, 17 bp, Homo sapiens
agaatgagcagtcccta

SEQ ID NO: 6625120 - DNA, 12 bp, Homo sapiens
agaatgagcctg

SEQ ID NO: 6625121 - DNA, 13 bp, Homo sapiens
agaatgaggctgc

SEQ ID NO: 6625122 - DNA, 14 bp, Homo sapiens
agaatgagtgaatc

SEQ ID NO: 6625123 - DNA, 16 bp, Homo sapiens
agaatgagtgggaatc

SEQ ID NO: 6625124 - DNA, 20 bp, Homo sapiens
agaatgagtgggaatccggg

SEQ ID NO: 6625125 - DNA, 15 bp, Homo sapiens
agaatgagtttctta

SEQ ID NO: 6625126 - DNA, 17 bp, Homo sapiens
agaatgatagaactttg

SEQ ID NO: 6625127 - DNA, 19 bp, Homo sapiens
agaatgatagaactttgcc

SEQ ID NO: 6625128 - DNA, 23 bp, Homo sapiens
agaatgatatccagtaagcacat

SEQ ID NO: 6625129 - DNA, 16 bp, Homo sapiens
agaatgatcaccctga

SEQ ID NO: 6625130 - DNA, 15 bp, Homo sapiens
agaatgatcatctgt

SEQ ID NO: 6625131 - DNA, 20 bp, Homo sapiens
agaatgatccctcagtctga

SEQ ID NO: 6625132 - DNA, 14 bp, Homo sapiens
agaatgatgcacat

SEQ ID NO: 6625133 - DNA, 19 bp, Homo sapiens
agaatgatgcacatttcat

SEQ ID NO: 6625134 - DNA, 12 bp, Homo sapiens
agaatgatgcta

SEQ ID NO: 6625135 - DNA, 13 bp, Homo sapiens
agaatgatgctca

SEQ ID NO: 6625136 - DNA, 20 bp, Homo sapiens
agaatgatttgtaaatagct

SEQ ID NO: 6625137 - DNA, 16 bp, Homo sapiens
agaatgattttgacat

SEQ ID NO: 6625138 - DNA, 14 bp, Homo sapiens
agaatgattttgct

SEQ ID NO: 6625139 - DNA, 22 bp, Homo sapiens
agaatgatttttgctatttcta

SEQ ID NO: 6625140 - DNA, 15 bp, Homo sapiens
agaatgcaaaagtct

SEQ ID NO: 6625141 - DNA, 19 bp, Homo sapiens
agaatgcacaaacagaggc

SEQ ID NO: 6625142 - DNA, 19 bp, Homo sapiens
agaatgcacaagaatggat

SEQ ID NO: 6625143 - DNA, 20 bp, Homo sapiens
agaatgcacaagaatggatc

SEQ ID NO: 6625144 - DNA, 11 bp, Homo sapiens
agaatgcacac

SEQ ID NO: 6625145 - DNA, 22 bp, Homo sapiens
agaatgcacagatatactttgt

SEQ ID NO: 6625146 - DNA, 18 bp, Homo sapiens
agaatgcaccatactcat

SEQ ID NO: 6625147 - DNA, 21 bp, Homo sapiens
agaatgcacctcttgttactc

SEQ ID NO: 6625148 - DNA, 20 bp, Homo sapiens
agaatgcagattcctgggcc

SEQ ID NO: 6625149 - DNA, 22 bp, Homo sapiens
agaatgcagattcctgggcctg

SEQ ID NO: 6625150 - DNA, 17 bp, Homo sapiens
agaatgcagtacagaat

SEQ ID NO: 6625151 - DNA, 23 bp, Homo sapiens
agaatgcagtactaacatttatt

SEQ ID NO: 6625152 - DNA, 15 bp, Homo sapiens
agaatgcagttgttg

SEQ ID NO: 6625153 - DNA, 17 bp, Homo sapiens
agaatgcatctcatcaa

SEQ ID NO: 6625154 - DNA, 16 bp, Homo sapiens
agaatgcatgctttcc

SEQ ID NO: 6625155 - DNA, 18 bp, Homo sapiens
agaatgcatgctttccat

SEQ ID NO: 6625156 - DNA, 15 bp, Homo sapiens
agaatgcattaaaaa

SEQ ID NO: 6625157 - DNA, 21 bp, Homo sapiens
agaatgcattccctgaatctg

SEQ ID NO: 6625158 - DNA, 12 bp, Homo sapiens
agaatgccagcc

SEQ ID NO: 6625159 - DNA, 23 bp, Homo sapiens
agaatgctctacttctttttctt

SEQ ID NO: 6625160 - DNA, 12 bp, Homo sapiens
agaatgctgaaa

SEQ ID NO: 6625161 - DNA, 20 bp, Homo sapiens
agaatgctgaactccttgtt

SEQ ID NO: 6625162 - DNA, 17 bp, Homo sapiens
agaatgctgcaactttt

SEQ ID NO: 6625163 - DNA, 18 bp, Homo sapiens
agaatgctgcaacttttt

SEQ ID NO: 6625164 - DNA, 13 bp, Homo sapiens
agaatgctggttt

SEQ ID NO: 6625165 - DNA, 13 bp, Homo sapiens
agaatgctgtaca

SEQ ID NO: 6625166 - DNA, 14 bp, Homo sapiens
agaatgctgtacat

SEQ ID NO: 6625167 - DNA, 20 bp, Homo sapiens
agaatgctgtacatctattt

SEQ ID NO: 6625168 - DNA, 21 bp, Homo sapiens
agaatggaaatttataatata

SEQ ID NO: 6625169 - DNA, 14 bp, Homo sapiens
agaatggaagcctg

SEQ ID NO: 6625170 - DNA, 15 bp, Homo sapiens
agaatggaagcctga

SEQ ID NO: 6625171 - DNA, 14 bp, Homo sapiens
agaatggaatagaa

SEQ ID NO: 6625172 - DNA, 18 bp, Homo sapiens
agaatggaatccatctgt

SEQ ID NO: 6625173 - DNA, 13 bp, Homo sapiens
agaatggagacag

SEQ ID NO: 6625174 - DNA, 15 bp, Homo sapiens
agaatggagaggaac

SEQ ID NO: 6625175 - DNA, 14 bp, Homo sapiens
agaatggaggaaga

SEQ ID NO: 6625176 - DNA, 16 bp, Homo sapiens
agaatggaggaagaac

SEQ ID NO: 6625177 - DNA, 14 bp, Homo sapiens
agaatggaggcagg

SEQ ID NO: 6625178 - DNA, 20 bp, Homo sapiens
agaatggatcacaagatgga

SEQ ID NO: 6625179 - DNA, 13 bp, Homo sapiens
agaatggcagctg

SEQ ID NO: 6625180 - DNA, 14 bp, Homo sapiens
agaatggcatggca

SEQ ID NO: 6625181 - DNA, 22 bp, Homo sapiens
agaatggcccagtcctctccca

SEQ ID NO: 6625182 - DNA, 19 bp, Homo sapiens
agaatggcctctttgtaga

SEQ ID NO: 6625183 - DNA, 13 bp, Homo sapiens
agaatggcctgga

SEQ ID NO: 6625184 - DNA, 14 bp, Homo sapiens
agaatggcctggag

SEQ ID NO: 6625185 - DNA, 17 bp, Homo sapiens
agaatggcctggagcag

SEQ ID NO: 6625186 - DNA, 22 bp, Homo sapiens
agaatggcctggagcaggccca

SEQ ID NO: 6625187 - DNA, 15 bp, Homo sapiens
agaatggctgggtca

SEQ ID NO: 6625188 - DNA, 23 bp, Homo sapiens
agaatggctttcaataccctttt

SEQ ID NO: 6625189 - DNA, 23 bp, Homo sapiens
agaatgggaaagagaaagagaca

SEQ ID NO: 6625190 - DNA, 14 bp, Homo sapiens
agaatgggatgtgt

SEQ ID NO: 6625191 - DNA, 16 bp, Homo sapiens
agaatggggttcctgc

SEQ ID NO: 6625192 - DNA, 18 bp, Homo sapiens
agaatgggtttactctca

SEQ ID NO: 6625193 - DNA, 15 bp, Homo sapiens
agaatggtctcagtg

SEQ ID NO: 6625194 - DNA, 14 bp, Homo sapiens
agaatggtgatttt

SEQ ID NO: 6625195 - DNA, 18 bp, Homo sapiens
agaatggtgattttaaat

SEQ ID NO: 6625196 - DNA, 19 bp, Homo sapiens
agaatggtgattttaaatg

SEQ ID NO: 6625197 - DNA, 21 bp, Homo sapiens
agaatggtgattttaaatgtg

SEQ ID NO: 6625198 - DNA, 23 bp, Homo sapiens
agaatggtgattttaaatgtgtg

SEQ ID NO: 6625199 - DNA, 16 bp, Homo sapiens
agaatggtgctgttta

SEQ ID NO: 6625200 - DNA, 20 bp, Homo sapiens
agaatggtgtgaacccggga

SEQ ID NO: 6625201 - DNA, 17 bp, Homo sapiens
agaatggtgttccattg

SEQ ID NO: 6625202 - DNA, 22 bp, Homo sapiens
agaatggttgagtgcaaatcca

SEQ ID NO: 6625203 - DNA, 23 bp, Homo sapiens
agaatggtttttgttgagtctct

SEQ ID NO: 6625204 - DNA, 17 bp, Homo sapiens
agaatgtaaaagaactt

SEQ ID NO: 6625205 - DNA, 21 bp, Homo sapiens
agaatgtaaagttatgtattt

SEQ ID NO: 6625206 - DNA, 17 bp, Homo sapiens
agaatgtaaatgtctca

SEQ ID NO: 6625207 - DNA, 22 bp, Homo sapiens
agaatgtaaatgtctcactgag

SEQ ID NO: 6625208 - DNA, 14 bp, Homo sapiens
agaatgtaagaaaa

SEQ ID NO: 6625209 - DNA, 19 bp, Homo sapiens
agaatgtaaggtatatcat

SEQ ID NO: 6625210 - DNA, 21 bp, Homo sapiens
agaatgtaaggtatatcattc

SEQ ID NO: 6625211 - DNA, 16 bp, Homo sapiens
agaatgtacacagttt

SEQ ID NO: 6625212 - DNA, 16 bp, Homo sapiens
agaatgtacagaaaat

SEQ ID NO: 6625213 - DNA, 19 bp, Homo sapiens
agaatgtacagaaaatagc

SEQ ID NO: 6625214 - DNA, 13 bp, Homo sapiens
agaatgtacatta

SEQ ID NO: 6625215 - DNA, 21 bp, Homo sapiens
agaatgtacgtccagcctgcc

SEQ ID NO: 6625216 - DNA, 16 bp, Homo sapiens
agaatgtagtcagact

SEQ ID NO: 6625217 - DNA, 23 bp, Homo sapiens
agaatgtagtcagactgacacta

SEQ ID NO: 6625218 - DNA, 14 bp, Homo sapiens
agaatgtagtttga

SEQ ID NO: 6625219 - DNA, 23 bp, Homo sapiens
agaatgtatattaaggtgtggct

SEQ ID NO: 6625220 - DNA, 14 bp, Homo sapiens
agaatgtatcccca

SEQ ID NO: 6625221 - DNA, 15 bp, Homo sapiens
agaatgtatctgtga

SEQ ID NO: 6625222 - DNA, 19 bp, Homo sapiens
agaatgtatggagagttac

SEQ ID NO: 6625223 - DNA, 17 bp, Homo sapiens
agaatgtattgtacctt

SEQ ID NO: 6625224 - DNA, 21 bp, Homo sapiens
agaatgtattgtaccttttaa

SEQ ID NO: 6625225 - DNA, 21 bp, Homo sapiens
agaatgtcaataaatttgctt

SEQ ID NO: 6625226 - DNA, 14 bp, Homo sapiens
agaatgtcagaaaa

SEQ ID NO: 6625227 - DNA, 16 bp, Homo sapiens
agaatgtcatttgcta

SEQ ID NO: 6625228 - DNA, 17 bp, Homo sapiens
agaatgtcatttgctaa

SEQ ID NO: 6625229 - DNA, 18 bp, Homo sapiens
agaatgtcatttgctaat

SEQ ID NO: 6625230 - DNA, 20 bp, Homo sapiens
agaatgtcattttggtactt

SEQ ID NO: 6625231 - DNA, 23 bp, Homo sapiens
agaatgtccaatggtaggaattt

SEQ ID NO: 6625232 - DNA, 12 bp, Homo sapiens
agaatgtctcca

SEQ ID NO: 6625233 - DNA, 22 bp, Homo sapiens
agaatgtctccatacgcgttct

SEQ ID NO: 6625234 - DNA, 16 bp, Homo sapiens
agaatgtctgaagtac

SEQ ID NO: 6625235 - DNA, 19 bp, Homo sapiens
agaatgtctgaagtacaaa

SEQ ID NO: 6625236 - DNA, 16 bp, Homo sapiens
agaatgtctgtacctt

SEQ ID NO: 6625237 - DNA, 11 bp, Homo sapiens
agaatgtgaaa

SEQ ID NO: 6625238 - DNA, 17 bp, Homo sapiens
agaatgtgaaaaaggaa

SEQ ID NO: 6625239 - DNA, 16 bp, Homo sapiens
agaatgtgattccttt

SEQ ID NO: 6625240 - DNA, 14 bp, Homo sapiens
agaatgtgattttt

SEQ ID NO: 6625241 - DNA, 22 bp, Homo sapiens
agaatgtgcagtgtcttgtaac

SEQ ID NO: 6625242 - DNA, 19 bp, Homo sapiens
agaatgtgctagagttaaa

SEQ ID NO: 6625243 - DNA, 21 bp, Homo sapiens
agaatgtgtgtcaatttataa

SEQ ID NO: 6625244 - DNA, 17 bp, Homo sapiens
agaatgtgtgtgtgtgg

SEQ ID NO: 6625245 - DNA, 19 bp, Homo sapiens
agaatgtgtttcaaaacca

SEQ ID NO: 6625246 - DNA, 22 bp, Homo sapiens
agaatgtgtttcaaactgtaaa

SEQ ID NO: 6625247 - DNA, 20 bp, Homo sapiens
agaatgttaatttattttgc

SEQ ID NO: 6625248 - DNA, 18 bp, Homo sapiens
agaatgttaccagacttc

SEQ ID NO: 6625249 - DNA, 21 bp, Homo sapiens
agaatgttaccagacttcaag

SEQ ID NO: 6625250 - DNA, 17 bp, Homo sapiens
agaatgttactgcctta

SEQ ID NO: 6625251 - DNA, 15 bp, Homo sapiens
agaatgttagagtaa

SEQ ID NO: 6625252 - DNA, 22 bp, Homo sapiens
agaatgttatagtgaattatcc

SEQ ID NO: 6625253 - DNA, 14 bp, Homo sapiens
agaatgttctcaat

SEQ ID NO: 6625254 - DNA, 23 bp, Homo sapiens
agaatgttgaaactgacttgctg

SEQ ID NO: 6625255 - DNA, 17 bp, Homo sapiens
agaatgttggtttactt

SEQ ID NO: 6625256 - DNA, 21 bp, Homo sapiens
agaatgttggtttactttcaa

SEQ ID NO: 6625257 - DNA, 17 bp, Homo sapiens
agaatgttgtacttgaa

SEQ ID NO: 6625258 - DNA, 18 bp, Homo sapiens
agaatgttgtacttgaaa

SEQ ID NO: 6625259 - DNA, 19 bp, Homo sapiens
agaatgttgtattcagtga

SEQ ID NO: 6625260 - DNA, 23 bp, Homo sapiens
agaatgttgttgtctatttgtct

SEQ ID NO: 6625261 - DNA, 17 bp, Homo sapiens
agaatgtttaatagaaa

SEQ ID NO: 6625262 - DNA, 16 bp, Homo sapiens
agaatgtttcctgtgg

SEQ ID NO: 6625263 - DNA, 21 bp, Homo sapiens
agaatgtttcctgtggaaata

SEQ ID NO: 6625264 - DNA, 18 bp, Homo sapiens
agaatgttttactgtgaa

SEQ ID NO: 6625265 - DNA, 14 bp, Homo sapiens
agaatgttttcctt

SEQ ID NO: 6625266 - DNA, 21 bp, Homo sapiens
agaattaaaactcaacattac

SEQ ID NO: 6625267 - DNA, 14 bp, Homo sapiens
agaattaaaactga

SEQ ID NO: 6625268 - DNA, 15 bp, Homo sapiens
agaattaaaactgag

SEQ ID NO: 6625269 - DNA, 12 bp, Homo sapiens
agaattaaaata

SEQ ID NO: 6625270 - DNA, 15 bp, Homo sapiens
agaattaaaatttat

SEQ ID NO: 6625271 - DNA, 16 bp, Homo sapiens
agaattaaaatttatt

SEQ ID NO: 6625272 - DNA, 22 bp, Homo sapiens
agaattaaacttttaattcatt

SEQ ID NO: 6625273 - DNA, 17 bp, Homo sapiens
agaattaacagagattg

SEQ ID NO: 6625274 - DNA, 22 bp, Homo sapiens
agaattaagcagaacactgcag

SEQ ID NO: 6625275 - DNA, 17 bp, Homo sapiens
agaattaatgacaacaa

SEQ ID NO: 6625276 - DNA, 18 bp, Homo sapiens
agaattaatgcattcaaa

SEQ ID NO: 6625277 - DNA, 15 bp, Homo sapiens
agaattaccattaat

SEQ ID NO: 6625278 - DNA, 20 bp, Homo sapiens
agaattactatttactttat

SEQ ID NO: 6625279 - DNA, 13 bp, Homo sapiens
agaattactgtaa

SEQ ID NO: 6625280 - DNA, 20 bp, Homo sapiens
agaattactgtaactgatta

SEQ ID NO: 6625281 - DNA, 23 bp, Homo sapiens
agaattacttgtgttacttgcca

SEQ ID NO: 6625282 - DNA, 13 bp, Homo sapiens
agaattactttgt

SEQ ID NO: 6625283 - DNA, 14 bp, Homo sapiens
agaattagctgctt

SEQ ID NO: 6625284 - DNA, 16 bp, Homo sapiens
agaattagctttttca

SEQ ID NO: 6625285 - DNA, 22 bp, Homo sapiens
agaattaggtaatggatatgaa

SEQ ID NO: 6625286 - DNA, 13 bp, Homo sapiens
agaattagtcctc

SEQ ID NO: 6625287 - DNA, 22 bp, Homo sapiens
agaattagtgccagaattttag

SEQ ID NO: 6625288 - DNA, 14 bp, Homo sapiens
agaattatatctaa

SEQ ID NO: 6625289 - DNA, 24 bp, Homo sapiens
agaattatatctaatttatacaaa

SEQ ID NO: 6625290 - DNA, 17 bp, Homo sapiens
agaattatccattacgt

SEQ ID NO: 6625291 - DNA, 23 bp, Homo sapiens
agaattatccattacgtgcattt

SEQ ID NO: 6625292 - DNA, 14 bp, Homo sapiens
agaattatctaatt

SEQ ID NO: 6625293 - DNA, 21 bp, Homo sapiens
agaattatctaatttataaaa

SEQ ID NO: 6625294 - DNA, 12 bp, Homo sapiens
agaattatctca

SEQ ID NO: 6625295 - DNA, 13 bp, Homo sapiens
agaattatctcaa

SEQ ID NO: 6625296 - DNA, 18 bp, Homo sapiens
agaattatctcaagtaaa

SEQ ID NO: 6625297 - DNA, 21 bp, Homo sapiens
agaattatctcaagtaaaaca

SEQ ID NO: 6625298 - DNA, 23 bp, Homo sapiens
agaattatgtaatatattgtaca

SEQ ID NO: 6625299 - DNA, 18 bp, Homo sapiens
agaattatttgccttctg

SEQ ID NO: 6625300 - DNA, 21 bp, Homo sapiens
agaattatttgccttctgaaa

SEQ ID NO: 6625301 - DNA, 18 bp, Homo sapiens
agaattatttttaaaaag

SEQ ID NO: 6625302 - DNA, 14 bp, Homo sapiens
agaattcaaaagtg

SEQ ID NO: 6625303 - DNA, 22 bp, Homo sapiens
agaattcaaatttgtaataaaa

SEQ ID NO: 6625304 - DNA, 15 bp, Homo sapiens
agaattcaacagtta

SEQ ID NO: 6625305 - DNA, 15 bp, Homo sapiens
agaattcacacctta

SEQ ID NO: 6625306 - DNA, 14 bp, Homo sapiens
agaattcactgtct

SEQ ID NO: 6625307 - DNA, 14 bp, Homo sapiens
agaattcatgatgc

SEQ ID NO: 6625308 - DNA, 17 bp, Homo sapiens
agaattcatgatgctag

SEQ ID NO: 6625309 - DNA, 21 bp, Homo sapiens
agaattcattccccagctcca

SEQ ID NO: 6625310 - DNA, 16 bp, Homo sapiens
agaattccaaagcaaa

SEQ ID NO: 6625311 - DNA, 20 bp, Homo sapiens
agaattccaaggagttccat

SEQ ID NO: 6625312 - DNA, 18 bp, Homo sapiens
agaattccagttgtattt

SEQ ID NO: 6625313 - DNA, 15 bp, Homo sapiens
agaattcccagctgt

SEQ ID NO: 6625314 - DNA, 19 bp, Homo sapiens
agaattcccctctggaggg

SEQ ID NO: 6625315 - DNA, 13 bp, Homo sapiens
agaattccctgtg

SEQ ID NO: 6625316 - DNA, 20 bp, Homo sapiens
agaattcccttgaattgtgt

SEQ ID NO: 6625317 - DNA, 19 bp, Homo sapiens
agaattcctacaatatata

SEQ ID NO: 6625318 - DNA, 21 bp, Homo sapiens
agaattcctgcagcagttatt

SEQ ID NO: 6625319 - DNA, 20 bp, Homo sapiens
agaattccttcagggtgatg

SEQ ID NO: 6625320 - DNA, 16 bp, Homo sapiens
agaattcggtgtgctg

SEQ ID NO: 6625321 - DNA, 18 bp, Homo sapiens
agaattcggtgtgctgcc

SEQ ID NO: 6625322 - DNA, 16 bp, Homo sapiens
agaattctaagattgt

SEQ ID NO: 6625323 - DNA, 17 bp, Homo sapiens
agaattctagaaataaa

SEQ ID NO: 6625324 - DNA, 15 bp, Homo sapiens
agaattctagctttt

SEQ ID NO: 6625325 - DNA, 13 bp, Homo sapiens
agaattctatttt

SEQ ID NO: 6625326 - DNA, 17 bp, Homo sapiens
agaattctattttgctg

SEQ ID NO: 6625327 - DNA, 20 bp, Homo sapiens
agaattctattttgctggag

SEQ ID NO: 6625328 - DNA, 19 bp, Homo sapiens
agaattctctagtttgatt

SEQ ID NO: 6625329 - DNA, 23 bp, Homo sapiens
agaattctgattgatttgattgg

SEQ ID NO: 6625330 - DNA, 18 bp, Homo sapiens
agaattctggtgtttaca

SEQ ID NO: 6625331 - DNA, 23 bp, Homo sapiens
agaattcttagcatacattcaga

SEQ ID NO: 6625332 - DNA, 17 bp, Homo sapiens
agaattcttcaggtgga

SEQ ID NO: 6625333 - DNA, 13 bp, Homo sapiens
agaattctttcaa

SEQ ID NO: 6625334 - DNA, 16 bp, Homo sapiens
agaattgaaaagtttt

SEQ ID NO: 6625335 - DNA, 13 bp, Homo sapiens
agaattgaaaatg

SEQ ID NO: 6625336 - DNA, 22 bp, Homo sapiens
agaattgaacccaggaggtgga

SEQ ID NO: 6625337 - DNA, 19 bp, Homo sapiens
agaattgaaccgtcaatgt

SEQ ID NO: 6625338 - DNA, 20 bp, Homo sapiens
agaattgaaccgtcaatgtg

SEQ ID NO: 6625339 - DNA, 22 bp, Homo sapiens
agaattgaaccgtcaatgtgaa

SEQ ID NO: 6625340 - DNA, 16 bp, Homo sapiens
agaattgaagaaaatc

SEQ ID NO: 6625341 - DNA, 13 bp, Homo sapiens
agaattgaagata

SEQ ID NO: 6625342 - DNA, 15 bp, Homo sapiens
agaattgaaggtttt

SEQ ID NO: 6625343 - DNA, 20 bp, Homo sapiens
agaattgacagttgaacaga

SEQ ID NO: 6625344 - DNA, 17 bp, Homo sapiens
agaattgacattgaaat

SEQ ID NO: 6625345 - DNA, 19 bp, Homo sapiens
agaattgacattgaaatct

SEQ ID NO: 6625346 - DNA, 18 bp, Homo sapiens
agaattgactgaagcaca

SEQ ID NO: 6625347 - DNA, 21 bp, Homo sapiens
agaattgactgaagcacagca

SEQ ID NO: 6625348 - DNA, 16 bp, Homo sapiens
agaattgaggggaggt

SEQ ID NO: 6625349 - DNA, 21 bp, Homo sapiens
agaattgatttcccttcttct

SEQ ID NO: 6625350 - DNA, 17 bp, Homo sapiens
agaattgcaatctataa

SEQ ID NO: 6625351 - DNA, 20 bp, Homo sapiens
agaattgcaatctataatat

SEQ ID NO: 6625352 - DNA, 16 bp, Homo sapiens
agaattgcagtaaagt

SEQ ID NO: 6625353 - DNA, 17 bp, Homo sapiens
agaattgcagtaaagtc

SEQ ID NO: 6625354 - DNA, 15 bp, Homo sapiens
agaattgccaatctt

SEQ ID NO: 6625355 - DNA, 23 bp, Homo sapiens
agaattgctgaagggcattcttt

SEQ ID NO: 6625356 - DNA, 20 bp, Homo sapiens
agaattgctggatgcatttt

SEQ ID NO: 6625357 - DNA, 12 bp, Homo sapiens
agaattgcttga

SEQ ID NO: 6625358 - DNA, 23 bp, Homo sapiens
agaattgcttgaacccaggaggt

SEQ ID NO: 6625359 - DNA, 21 bp, Homo sapiens
agaattgcttgaaccggggag

SEQ ID NO: 6625360 - DNA, 23 bp, Homo sapiens
agaattgcttgaacctgtgagga

SEQ ID NO: 6625361 - DNA, 19 bp, Homo sapiens
agaattgcttgagcttggg

SEQ ID NO: 6625362 - DNA, 12 bp, Homo sapiens
agaattggaaaa

SEQ ID NO: 6625363 - DNA, 18 bp, Homo sapiens
agaattggaaaagactaa

SEQ ID NO: 6625364 - DNA, 21 bp, Homo sapiens
agaattggagagtaaaaactg

SEQ ID NO: 6625365 - DNA, 16 bp, Homo sapiens
agaattggccagagcc

SEQ ID NO: 6625366 - DNA, 24 bp, Homo sapiens
agaattgggactctgttgctggtc

SEQ ID NO: 6625367 - DNA, 22 bp, Homo sapiens
agaattgggcccttagaatgtg

SEQ ID NO: 6625368 - DNA, 21 bp, Homo sapiens
agaattgtatatcattttgcc

SEQ ID NO: 6625369 - DNA, 15 bp, Homo sapiens
agaattgtatcattt

SEQ ID NO: 6625370 - DNA, 19 bp, Homo sapiens
agaattgtccatgtgcttc

SEQ ID NO: 6625371 - DNA, 15 bp, Homo sapiens
agaattgtctctggg

SEQ ID NO: 6625372 - DNA, 19 bp, Homo sapiens
agaattgtctctgggctga

SEQ ID NO: 6625373 - DNA, 15 bp, Homo sapiens
agaattgtcttgcaa

SEQ ID NO: 6625374 - DNA, 23 bp, Homo sapiens
agaattgtgcaaatggaagacaa

SEQ ID NO: 6625375 - DNA, 19 bp, Homo sapiens
agaattgtgctttttctcc

SEQ ID NO: 6625376 - DNA, 12 bp, Homo sapiens
agaattgtggtt

SEQ ID NO: 6625377 - DNA, 19 bp, Homo sapiens
agaattgtgtcagactgtt

SEQ ID NO: 6625378 - DNA, 18 bp, Homo sapiens
agaattgtgtctgcagga

SEQ ID NO: 6625379 - DNA, 19 bp, Homo sapiens
agaattgtgtgttaatgtc

SEQ ID NO: 6625380 - DNA, 19 bp, Homo sapiens
agaattgttgcatccctca

SEQ ID NO: 6625381 - DNA, 15 bp, Homo sapiens
agaattgtttagatt

SEQ ID NO: 6625382 - DNA, 21 bp, Homo sapiens
agaattgtttttagaaattta

SEQ ID NO: 6625383 - DNA, 12 bp, Homo sapiens
agaatttaaaga

SEQ ID NO: 6625384 - DNA, 13 bp, Homo sapiens
agaatttaatata

SEQ ID NO: 6625385 - DNA, 21 bp, Homo sapiens
agaatttaatggactgtgaat

SEQ ID NO: 6625386 - DNA, 23 bp, Homo sapiens
agaatttaatggactgtgaattt

SEQ ID NO: 6625387 - DNA, 20 bp, Homo sapiens
agaatttaatttttaaaaga

SEQ ID NO: 6625388 - DNA, 14 bp, Homo sapiens
agaatttagactga

SEQ ID NO: 6625389 - DNA, 20 bp, Homo sapiens
agaatttagatcttatattg

SEQ ID NO: 6625390 - DNA, 14 bp, Homo sapiens
agaatttagggaga

SEQ ID NO: 6625391 - DNA, 14 bp, Homo sapiens
agaatttagtgtat

SEQ ID NO: 6625392 - DNA, 15 bp, Homo sapiens
agaatttattacaaa

SEQ ID NO: 6625393 - DNA, 21 bp, Homo sapiens
agaatttattagtttaaaatg

SEQ ID NO: 6625394 - DNA, 14 bp, Homo sapiens
agaatttcaatttg

SEQ ID NO: 6625395 - DNA, 13 bp, Homo sapiens
agaatttcactgt

SEQ ID NO: 6625396 - DNA, 15 bp, Homo sapiens
agaatttccactgta

SEQ ID NO: 6625397 - DNA, 17 bp, Homo sapiens
agaatttccactgtaat

SEQ ID NO: 6625398 - DNA, 23 bp, Homo sapiens
agaatttctaaaaagattagcaa

SEQ ID NO: 6625399 - DNA, 13 bp, Homo sapiens
agaatttctaaag

SEQ ID NO: 6625400 - DNA, 16 bp, Homo sapiens
agaatttctaaagtaa

SEQ ID NO: 6625401 - DNA, 21 bp, Homo sapiens
agaatttctaggactgaatta

SEQ ID NO: 6625402 - DNA, 18 bp, Homo sapiens
agaatttctgctaaatat

SEQ ID NO: 6625403 - DNA, 18 bp, Homo sapiens
agaatttctggaagaaag

SEQ ID NO: 6625404 - DNA, 22 bp, Homo sapiens
agaatttctggaagaaaggctg

SEQ ID NO: 6625405 - DNA, 22 bp, Homo sapiens
agaatttcttggtaagaagccg

SEQ ID NO: 6625406 - DNA, 18 bp, Homo sapiens
agaatttgaaaggaaaaa

SEQ ID NO: 6625407 - DNA, 13 bp, Homo sapiens
agaatttgaaagt

SEQ ID NO: 6625408 - DNA, 22 bp, Homo sapiens
agaatttgaagacttcaaaata

SEQ ID NO: 6625409 - DNA, 12 bp, Homo sapiens
agaatttgagaa

SEQ ID NO: 6625410 - DNA, 18 bp, Homo sapiens
agaatttgagtgctctga

SEQ ID NO: 6625411 - DNA, 17 bp, Homo sapiens
agaatttgatatgtgaa

SEQ ID NO: 6625412 - DNA, 21 bp, Homo sapiens
agaatttgatatgtgaacagt

SEQ ID NO: 6625413 - DNA, 15 bp, Homo sapiens
agaatttggcccaga

SEQ ID NO: 6625414 - DNA, 16 bp, Homo sapiens
agaatttgtattttgc

SEQ ID NO: 6625415 - DNA, 20 bp, Homo sapiens
agaatttgtgaatatatttt

SEQ ID NO: 6625416 - DNA, 20 bp, Homo sapiens
agaatttgtgtggatattta

SEQ ID NO: 6625417 - DNA, 13 bp, Homo sapiens
agaatttgtttca

SEQ ID NO: 6625418 - DNA, 19 bp, Homo sapiens
agaatttgtttcatctatt

SEQ ID NO: 6625419 - DNA, 17 bp, Homo sapiens
agaattttaaaaaagat

SEQ ID NO: 6625420 - DNA, 16 bp, Homo sapiens
agaattttaaaaatga

SEQ ID NO: 6625421 - DNA, 19 bp, Homo sapiens
agaattttaaaaatgaatc

SEQ ID NO: 6625422 - DNA, 20 bp, Homo sapiens
agaattttaaaaatgaatcc

SEQ ID NO: 6625423 - DNA, 21 bp, Homo sapiens
agaattttaagtgctttgtaa

SEQ ID NO: 6625424 - DNA, 22 bp, Homo sapiens
agaattttaagtgctttgtaat

SEQ ID NO: 6625425 - DNA, 20 bp, Homo sapiens
agaattttaggaacttcaga

SEQ ID NO: 6625426 - DNA, 21 bp, Homo sapiens
agaattttatactttccctac

SEQ ID NO: 6625427 - DNA, 14 bp, Homo sapiens
agaattttatttat

SEQ ID NO: 6625428 - DNA, 19 bp, Homo sapiens
agaattttcaaataaggaa

SEQ ID NO: 6625429 - DNA, 20 bp, Homo sapiens
agaattttcagaccccagcg

SEQ ID NO: 6625430 - DNA, 22 bp, Homo sapiens
agaattttcatcccgtatcaca

SEQ ID NO: 6625431 - DNA, 17 bp, Homo sapiens
agaattttccatttatt

SEQ ID NO: 6625432 - DNA, 22 bp, Homo sapiens
agaattttcctaaaaataagct

SEQ ID NO: 6625433 - DNA, 23 bp, Homo sapiens
agaattttcctgagacaaatttt

SEQ ID NO: 6625434 - DNA, 21 bp, Homo sapiens
agaattttctggcctttcatg

SEQ ID NO: 6625435 - DNA, 22 bp, Homo sapiens
agaattttgagtattccatgag

SEQ ID NO: 6625436 - DNA, 21 bp, Homo sapiens
agaattttggaaaaatgtcac

SEQ ID NO: 6625437 - DNA, 13 bp, Homo sapiens
agaattttgtata

SEQ ID NO: 6625438 - DNA, 22 bp, Homo sapiens
agaattttgtatattgtaggaa

SEQ ID NO: 6625439 - DNA, 22 bp, Homo sapiens
agaattttgtgaaacagacttg

SEQ ID NO: 6625440 - DNA, 16 bp, Homo sapiens
agaattttgtttcaaa

SEQ ID NO: 6625441 - DNA, 20 bp, Homo sapiens
agaatttttaaaaaagtgat

SEQ ID NO: 6625442 - DNA, 18 bp, Homo sapiens
agaatttttgtttggact

SEQ ID NO: 6625443 - DNA, 21 bp, Homo sapiens
agaattttttgagtaattcta

SEQ ID NO: 6625444 - DNA, 14 bp, Homo sapiens
agaattttttttgt

SEQ ID NO: 6625445 - DNA, 20 bp, Homo sapiens
agaattttttttgttgtttc

SEQ ID NO: 6625446 - DNA, 18 bp, Homo sapiens
agacaaaaaaatttaaaa

SEQ ID NO: 6625447 - DNA, 12 bp, Homo sapiens
agacaaaaacaa

SEQ ID NO: 6625448 - DNA, 21 bp, Homo sapiens
agacaaaaacaagtaaatata

SEQ ID NO: 6625449 - DNA, 23 bp, Homo sapiens
agacaaaaacaagtaaatatata

SEQ ID NO: 6625450 - DNA, 16 bp, Homo sapiens
agacaaaaacagcctc

SEQ ID NO: 6625451 - DNA, 18 bp, Homo sapiens
agacaaaaagaacaaaaa

SEQ ID NO: 6625452 - DNA, 19 bp, Homo sapiens
agacaaaaagaacaaaaaa

SEQ ID NO: 6625453 - DNA, 14 bp, Homo sapiens
agacaaaaagacaa

SEQ ID NO: 6625454 - DNA, 23 bp, Homo sapiens
agacaaaaatcaaagaacagatg

SEQ ID NO: 6625455 - DNA, 21 bp, Homo sapiens
agacaaaaattatctatttgt

SEQ ID NO: 6625456 - DNA, 19 bp, Homo sapiens
agacaaaacttataatttc

SEQ ID NO: 6625457 - DNA, 14 bp, Homo sapiens
agacaaaagaaact

SEQ ID NO: 6625458 - DNA, 16 bp, Homo sapiens
agacaaaagaaactta

SEQ ID NO: 6625459 - DNA, 18 bp, Homo sapiens
agacaaaagaaacttacc

SEQ ID NO: 6625460 - DNA, 24 bp, Homo sapiens
agacaaaatctctatactgccctg

SEQ ID NO: 6625461 - DNA, 22 bp, Homo sapiens
agacaaaatggatacataaaga

SEQ ID NO: 6625462 - DNA, 13 bp, Homo sapiens
agacaaaatgtga

SEQ ID NO: 6625463 - DNA, 17 bp, Homo sapiens
agacaaaattgctgagg

SEQ ID NO: 6625464 - DNA, 18 bp, Homo sapiens
agacaaaatttaattgtg

SEQ ID NO: 6625465 - DNA, 13 bp, Homo sapiens
agacaaaatttag

SEQ ID NO: 6625466 - DNA, 19 bp, Homo sapiens
agacaaaatttagatttaa

SEQ ID NO: 6625467 - DNA, 17 bp, Homo sapiens
agacaaaatttgagaat

SEQ ID NO: 6625468 - DNA, 23 bp, Homo sapiens
agacaaaatttgagaatacataa

SEQ ID NO: 6625469 - DNA, 20 bp, Homo sapiens
agacaaaattttagtccaaa

SEQ ID NO: 6625470 - DNA, 10 bp, Homo sapiens
agacaaacac

SEQ ID NO: 6625471 - DNA, 13 bp, Homo sapiens
agacaaacactgc

SEQ ID NO: 6625472 - DNA, 17 bp, Homo sapiens
agacaaacagcccttcc

SEQ ID NO: 6625473 - DNA, 14 bp, Homo sapiens
agacaaaccactgt

SEQ ID NO: 6625474 - DNA, 18 bp, Homo sapiens
agacaaaccactgtacat

SEQ ID NO: 6625475 - DNA, 21 bp, Homo sapiens
agacaaaccactgtacatata

SEQ ID NO: 6625476 - DNA, 19 bp, Homo sapiens
agacaaactccggcactgg

SEQ ID NO: 6625477 - DNA, 18 bp, Homo sapiens
agacaaactgtaaaaaat

SEQ ID NO: 6625478 - DNA, 13 bp, Homo sapiens
agacaaagaagga

SEQ ID NO: 6625479 - DNA, 14 bp, Homo sapiens
agacaaagacattt

SEQ ID NO: 6625480 - DNA, 22 bp, Homo sapiens
agacaaagacatttcaaataac

SEQ ID NO: 6625481 - DNA, 15 bp, Homo sapiens
agacaaagatttctt

SEQ ID NO: 6625482 - DNA, 12 bp, Homo sapiens
agacaaagcaaa

SEQ ID NO: 6625483 - DNA, 18 bp, Homo sapiens
agacaaagcaggagtgga

SEQ ID NO: 6625484 - DNA, 15 bp, Homo sapiens
agacaaagccctgtc

SEQ ID NO: 6625485 - DNA, 14 bp, Homo sapiens
agacaaaggaggaa

SEQ ID NO: 6625486 - DNA, 16 bp, Homo sapiens
agacaaaggaggaatt

SEQ ID NO: 6625487 - DNA, 17 bp, Homo sapiens
agacaaaggaggaattt

SEQ ID NO: 6625488 - DNA, 16 bp, Homo sapiens
agacaaaggcccagaa

SEQ ID NO: 6625489 - DNA, 13 bp, Homo sapiens
agacaaaggcctt

SEQ ID NO: 6625490 - DNA, 23 bp, Homo sapiens
agacaaagtcaataaaagagctg

SEQ ID NO: 6625491 - DNA, 24 bp, Homo sapiens
agacaaagtcaataaaagagctgt

SEQ ID NO: 6625492 - DNA, 23 bp, Homo sapiens
agacaaagtgggtgtgtggcctc

SEQ ID NO: 6625493 - DNA, 12 bp, Homo sapiens
agacaaatacac

SEQ ID NO: 6625494 - DNA, 14 bp, Homo sapiens
agacaaatacacat

SEQ ID NO: 6625495 - DNA, 14 bp, Homo sapiens
agacaaatactcat

SEQ ID NO: 6625496 - DNA, 17 bp, Homo sapiens
agacaaatactcatgtg

SEQ ID NO: 6625497 - DNA, 20 bp, Homo sapiens
agacaaatactcatgtgtat

SEQ ID NO: 6625498 - DNA, 19 bp, Homo sapiens
agacaaatagaaaatggtc

SEQ ID NO: 6625499 - DNA, 17 bp, Homo sapiens
agacaaatagtaggcaa

SEQ ID NO: 6625500 - DNA, 22 bp, Homo sapiens
agacaaatattcctttgcatat

SEQ ID NO: 6625501 - DNA, 16 bp, Homo sapiens
agacaaatcaaagcag

SEQ ID NO: 6625502 - DNA, 21 bp, Homo sapiens
agacaaatcaacagaagcatt

SEQ ID NO: 6625503 - DNA, 23 bp, Homo sapiens
agacaaatctatgccactcagaa

SEQ ID NO: 6625504 - DNA, 14 bp, Homo sapiens
agacaaatgaaata

SEQ ID NO: 6625505 - DNA, 13 bp, Homo sapiens
agacaaatgcagt

SEQ ID NO: 6625506 - DNA, 14 bp, Homo sapiens
agacaaatggagga

SEQ ID NO: 6625507 - DNA, 18 bp, Homo sapiens
agacaaatggaggaatat

SEQ ID NO: 6625508 - DNA, 12 bp, Homo sapiens
agacaaatgtgc

SEQ ID NO: 6625509 - DNA, 19 bp, Homo sapiens
agacaaattctgtttcttg

SEQ ID NO: 6625510 - DNA, 21 bp, Homo sapiens
agacaaattctgtttcttgag

SEQ ID NO: 6625511 - DNA, 14 bp, Homo sapiens
agacaaatttaaag

SEQ ID NO: 6625512 - DNA, 13 bp, Homo sapiens
agacaacacacac

SEQ ID NO: 6625513 - DNA, 14 bp, Homo sapiens
agacaacacacaca

SEQ ID NO: 6625514 - DNA, 13 bp, Homo sapiens
agacaacagaagt

SEQ ID NO: 6625515 - DNA, 15 bp, Homo sapiens
agacaacagaagtca

SEQ ID NO: 6625516 - DNA, 17 bp, Homo sapiens
agacaacagcacacagg

SEQ ID NO: 6625517 - DNA, 13 bp, Homo sapiens
agacaacagccca

SEQ ID NO: 6625518 - DNA, 16 bp, Homo sapiens
agacaacagcccaggc

SEQ ID NO: 6625519 - DNA, 18 bp, Homo sapiens
agacaacattatgatcta

SEQ ID NO: 6625520 - DNA, 20 bp, Homo sapiens
agacaacattatgatctaat

SEQ ID NO: 6625521 - DNA, 22 bp, Homo sapiens
agacaacattatgatctaataa

SEQ ID NO: 6625522 - DNA, 19 bp, Homo sapiens
agacaaccagatcaggaga

SEQ ID NO: 6625523 - DNA, 23 bp, Homo sapiens
agacaaccctgaggtatctgtgt

SEQ ID NO: 6625524 - DNA, 14 bp, Homo sapiens
agacaaccctgcaa

SEQ ID NO: 6625525 - DNA, 21 bp, Homo sapiens
agacaaccctgcaaaggactg

SEQ ID NO: 6625526 - DNA, 17 bp, Homo sapiens
agacaacctgaaattta

SEQ ID NO: 6625527 - DNA, 20 bp, Homo sapiens
agacaaccttgtcccaagga

SEQ ID NO: 6625528 - DNA, 16 bp, Homo sapiens
agacaacctttctgta

SEQ ID NO: 6625529 - DNA, 16 bp, Homo sapiens
agacaacgtgctcttt

SEQ ID NO: 6625530 - DNA, 14 bp, Homo sapiens
agacaactagattt

SEQ ID NO: 6625531 - DNA, 17 bp, Homo sapiens
agacaactcttccattt

SEQ ID NO: 6625532 - DNA, 14 bp, Homo sapiens
agacaacttctgtt

SEQ ID NO: 6625533 - DNA, 13 bp, Homo sapiens
agacaagaaatcc

SEQ ID NO: 6625534 - DNA, 14 bp, Homo sapiens
agacaagaatatgt

SEQ ID NO: 6625535 - DNA, 16 bp, Homo sapiens
agacaagaatatgttc

SEQ ID NO: 6625536 - DNA, 18 bp, Homo sapiens
agacaagacagaggggag

SEQ ID NO: 6625537 - DNA, 19 bp, Homo sapiens
agacaagacagaggggagc

SEQ ID NO: 6625538 - DNA, 15 bp, Homo sapiens
agacaagacttcagt

SEQ ID NO: 6625539 - DNA, 16 bp, Homo sapiens
agacaagagctgctgt

SEQ ID NO: 6625540 - DNA, 16 bp, Homo sapiens
agacaagagctgttat

SEQ ID NO: 6625541 - DNA, 14 bp, Homo sapiens
agacaagagggcaa

SEQ ID NO: 6625542 - DNA, 18 bp, Homo sapiens
agacaagatattgtacat

SEQ ID NO: 6625543 - DNA, 20 bp, Homo sapiens
agacaagatattgtacataa

SEQ ID NO: 6625544 - DNA, 20 bp, Homo sapiens
agacaagattttttaattgt

SEQ ID NO: 6625545 - DNA, 21 bp, Homo sapiens
agacaagattttttaattgtt

SEQ ID NO: 6625546 - DNA, 22 bp, Homo sapiens
agacaagattttttaattgttt

SEQ ID NO: 6625547 - DNA, 13 bp, Homo sapiens
agacaagcagccc

SEQ ID NO: 6625548 - DNA, 18 bp, Homo sapiens
agacaagcattgggtcag

SEQ ID NO: 6625549 - DNA, 12 bp, Homo sapiens
agacaagccctg

SEQ ID NO: 6625550 - DNA, 13 bp, Homo sapiens
agacaagcctgga

SEQ ID NO: 6625551 - DNA, 14 bp, Homo sapiens
agacaagcctggag

SEQ ID NO: 6625552 - DNA, 13 bp, Homo sapiens
agacaagctgcaa

SEQ ID NO: 6625553 - DNA, 13 bp, Homo sapiens
agacaaggaacca

SEQ ID NO: 6625554 - DNA, 23 bp, Homo sapiens
agacaaggctggcaaaccctccc

SEQ ID NO: 6625555 - DNA, 15 bp, Homo sapiens
agacaaggtgctaac

SEQ ID NO: 6625556 - DNA, 17 bp, Homo sapiens
agacaaggttgctgttg

SEQ ID NO: 6625557 - DNA, 17 bp, Homo sapiens
agacaagtatgaatatt

SEQ ID NO: 6625558 - DNA, 14 bp, Homo sapiens
agacaagtctgagt

SEQ ID NO: 6625559 - DNA, 21 bp, Homo sapiens
agacaagtctgagtagttatg

SEQ ID NO: 6625560 - DNA, 16 bp, Homo sapiens
agacaagtcttgctgt

SEQ ID NO: 6625561 - DNA, 23 bp, Homo sapiens
agacaagtgctcaagcagcaaaa

SEQ ID NO: 6625562 - DNA, 14 bp, Homo sapiens
agacaagttttgtt

SEQ ID NO: 6625563 - DNA, 15 bp, Homo sapiens
agacaataaaacatt

SEQ ID NO: 6625564 - DNA, 15 bp, Homo sapiens
agacaataaacagct

SEQ ID NO: 6625565 - DNA, 21 bp, Homo sapiens
agacaataaacagctgaacca

SEQ ID NO: 6625566 - DNA, 22 bp, Homo sapiens
agacaataaaccctcagagcct

SEQ ID NO: 6625567 - DNA, 14 bp, Homo sapiens
agacaataattcta

SEQ ID NO: 6625568 - DNA, 18 bp, Homo sapiens
agacaatatgtgagtgcc

SEQ ID NO: 6625569 - DNA, 14 bp, Homo sapiens
agacaatcattgtt

SEQ ID NO: 6625570 - DNA, 23 bp, Homo sapiens
agacaatcattgttttgaatatt

SEQ ID NO: 6625571 - DNA, 18 bp, Homo sapiens
agacaatccactctcagg

SEQ ID NO: 6625572 - DNA, 19 bp, Homo sapiens
agacaatccactctcagga

SEQ ID NO: 6625573 - DNA, 20 bp, Homo sapiens
agacaatctaaaaaatatct

SEQ ID NO: 6625574 - DNA, 14 bp, Homo sapiens
agacaatcttctgt

SEQ ID NO: 6625575 - DNA, 23 bp, Homo sapiens
agacaatgacttactgtacatga

SEQ ID NO: 6625576 - DNA, 14 bp, Homo sapiens
agacaatgtggaat

SEQ ID NO: 6625577 - DNA, 22 bp, Homo sapiens
agacaatgtggaattacataac

SEQ ID NO: 6625578 - DNA, 14 bp, Homo sapiens
agacaatgttttct

SEQ ID NO: 6625579 - DNA, 15 bp, Homo sapiens
agacaattagcagaa

SEQ ID NO: 6625580 - DNA, 19 bp, Homo sapiens
agacaattagcagaatgga

SEQ ID NO: 6625581 - DNA, 22 bp, Homo sapiens
agacaattctaatggtaacttt

SEQ ID NO: 6625582 - DNA, 13 bp, Homo sapiens
agacaattcttta

SEQ ID NO: 6625583 - DNA, 14 bp, Homo sapiens
agacaatttattat

SEQ ID NO: 6625584 - DNA, 15 bp, Homo sapiens
agacaatttattatg

SEQ ID NO: 6625585 - DNA, 18 bp, Homo sapiens
agacaatttgatacataa

SEQ ID NO: 6625586 - DNA, 13 bp, Homo sapiens
agacaatttgcac

SEQ ID NO: 6625587 - DNA, 18 bp, Homo sapiens
agacaatttgcacatctt

SEQ ID NO: 6625588 - DNA, 24 bp, Homo sapiens
agacaattttcataacttgataaa

SEQ ID NO: 6625589 - DNA, 19 bp, Homo sapiens
agacaattttttttcaaat

SEQ ID NO: 6625590 - DNA, 20 bp, Homo sapiens
agacaattttttttcaaatg

SEQ ID NO: 6625591 - DNA, 14 bp, Homo sapiens
agacacaactattt

SEQ ID NO: 6625592 - DNA, 14 bp, Homo sapiens
agacacaatttcat

SEQ ID NO: 6625593 - DNA, 16 bp, Homo sapiens
agacacaatttcattt

SEQ ID NO: 6625594 - DNA, 15 bp, Homo sapiens
agacacacaaagcag

SEQ ID NO: 6625595 - DNA, 13 bp, Homo sapiens
agacacacaacat

SEQ ID NO: 6625596 - DNA, 10 bp, Homo sapiens
agacacacac

SEQ ID NO: 6625597 - DNA, 13 bp, Homo sapiens
agacacacacaca

SEQ ID NO: 6625598 - DNA, 23 bp, Homo sapiens
agacacacacacacacacacata

SEQ ID NO: 6625599 - DNA, 20 bp, Homo sapiens
agacacacacacaccttgca

SEQ ID NO: 6625600 - DNA, 14 bp, Homo sapiens
agacacacacacgc

SEQ ID NO: 6625601 - DNA, 15 bp, Homo sapiens
agacacacacacgca

SEQ ID NO: 6625602 - DNA, 16 bp, Homo sapiens
agacacacacacgcac

SEQ ID NO: 6625603 - DNA, 18 bp, Homo sapiens
agacacacacacgcacgc

SEQ ID NO: 6625604 - DNA, 21 bp, Homo sapiens
agacacacacacgcacgcaca

SEQ ID NO: 6625605 - DNA, 13 bp, Homo sapiens
agacacacacata

SEQ ID NO: 6625606 - DNA, 19 bp, Homo sapiens
agacacacacatatataca

SEQ ID NO: 6625607 - DNA, 21 bp, Homo sapiens
agacacacacatatatacata

SEQ ID NO: 6625608 - DNA, 17 bp, Homo sapiens
agacacacactggctcc

SEQ ID NO: 6625609 - DNA, 20 bp, Homo sapiens
agacacacactggctcctgg

SEQ ID NO: 6625610 - DNA, 13 bp, Homo sapiens
agacacacagcct

SEQ ID NO: 6625611 - DNA, 16 bp, Homo sapiens
agacacacagcctttc

SEQ ID NO: 6625612 - DNA, 20 bp, Homo sapiens
agacacacagcctttctgta

SEQ ID NO: 6625613 - DNA, 21 bp, Homo sapiens
agacacacagcctttctgtat

SEQ ID NO: 6625614 - DNA, 22 bp, Homo sapiens
agacacacaggagtcctttctt

SEQ ID NO: 6625615 - DNA, 14 bp, Homo sapiens
agacacacatacat

SEQ ID NO: 6625616 - DNA, 16 bp, Homo sapiens
agacacacatacataa

SEQ ID NO: 6625617 - DNA, 12 bp, Homo sapiens
agacacacatga

SEQ ID NO: 6625618 - DNA, 17 bp, Homo sapiens
agacacacatgggcagc

SEQ ID NO: 6625619 - DNA, 23 bp, Homo sapiens
agacacaccgcggccaggcaccc

SEQ ID NO: 6625620 - DNA, 14 bp, Homo sapiens
agacacacctgagg

SEQ ID NO: 6625621 - DNA, 17 bp, Homo sapiens
agacacagaagaggctg

SEQ ID NO: 6625622 - DNA, 16 bp, Homo sapiens
agacacagactggcaa

SEQ ID NO: 6625623 - DNA, 23 bp, Homo sapiens
agacacagagtggagccctcagt

SEQ ID NO: 6625624 - DNA, 22 bp, Homo sapiens
agacacagatggcacctgtggc

SEQ ID NO: 6625625 - DNA, 14 bp, Homo sapiens
agacacagatgttc

SEQ ID NO: 6625626 - DNA, 16 bp, Homo sapiens
agacacagcccagaca

SEQ ID NO: 6625627 - DNA, 16 bp, Homo sapiens
agacacagcccagaga

SEQ ID NO: 6625628 - DNA, 18 bp, Homo sapiens
agacacagcccagagact

SEQ ID NO: 6625629 - DNA, 12 bp, Homo sapiens
agacacagctct

SEQ ID NO: 6625630 - DNA, 14 bp, Homo sapiens
agacacagctcttc

SEQ ID NO: 6625631 - DNA, 22 bp, Homo sapiens
agacacagctcttccagggcag

SEQ ID NO: 6625632 - DNA, 17 bp, Homo sapiens
agacacaggaaaaataa

SEQ ID NO: 6625633 - DNA, 19 bp, Homo sapiens
agacacaggaaaaataaac

SEQ ID NO: 6625634 - DNA, 22 bp, Homo sapiens
agacacaggcccggctccaggc

SEQ ID NO: 6625635 - DNA, 17 bp, Homo sapiens
agacacaggccgtggga

SEQ ID NO: 6625636 - DNA, 19 bp, Homo sapiens
agacacagggacttgaagt

SEQ ID NO: 6625637 - DNA, 13 bp, Homo sapiens
agacacaggggac

SEQ ID NO: 6625638 - DNA, 17 bp, Homo sapiens
agacacatacaaaaaaa

SEQ ID NO: 6625639 - DNA, 14 bp, Homo sapiens
agacacatatgagg

SEQ ID NO: 6625640 - DNA, 16 bp, Homo sapiens
agacacatatgagggg

SEQ ID NO: 6625641 - DNA, 17 bp, Homo sapiens
agacacatccagcaatt

SEQ ID NO: 6625642 - DNA, 12 bp, Homo sapiens
agacacatgaag

SEQ ID NO: 6625643 - DNA, 21 bp, Homo sapiens
agacacatgaaggtaaataaa

SEQ ID NO: 6625644 - DNA, 23 bp, Homo sapiens
agacacatgaaggtaaataaaaa

SEQ ID NO: 6625645 - DNA, 21 bp, Homo sapiens
agacacatgctatgttctgtc

SEQ ID NO: 6625646 - DNA, 22 bp, Homo sapiens
agacacatggctatcctagaga

SEQ ID NO: 6625647 - DNA, 16 bp, Homo sapiens
agacacatgggtgcta

SEQ ID NO: 6625648 - DNA, 21 bp, Homo sapiens
agacacatgtccaagaagccc

SEQ ID NO: 6625649 - DNA, 22 bp, Homo sapiens
agacacatttttggatttctgt

SEQ ID NO: 6625650 - DNA, 18 bp, Homo sapiens
agacaccaaagttctaat

SEQ ID NO: 6625651 - DNA, 21 bp, Homo sapiens
agacaccaaattccaaacttc

SEQ ID NO: 6625652 - DNA, 16 bp, Homo sapiens
agacaccacagcctcc

SEQ ID NO: 6625653 - DNA, 19 bp, Homo sapiens
agacaccacagcctcccct

SEQ ID NO: 6625654 - DNA, 23 bp, Homo sapiens
agacaccagactgaagtaaacag

SEQ ID NO: 6625655 - DNA, 16 bp, Homo sapiens
agacaccagagtgtat

SEQ ID NO: 6625656 - DNA, 19 bp, Homo sapiens
agacaccatcctgagccag

SEQ ID NO: 6625657 - DNA, 18 bp, Homo sapiens
agacaccatgtgcaataa

SEQ ID NO: 6625658 - DNA, 17 bp, Homo sapiens
agacaccattcattcca

SEQ ID NO: 6625659 - DNA, 11 bp, Homo sapiens
agacacccagt

SEQ ID NO: 6625660 - DNA, 19 bp, Homo sapiens
agacaccctcaacctcttc

SEQ ID NO: 6625661 - DNA, 20 bp, Homo sapiens
agacaccctccactctgagg

SEQ ID NO: 6625662 - DNA, 14 bp, Homo sapiens
agacaccctctggg

SEQ ID NO: 6625663 - DNA, 22 bp, Homo sapiens
agacaccctctgggggtcctct

SEQ ID NO: 6625664 - DNA, 15 bp, Homo sapiens
agacaccctggcagc

SEQ ID NO: 6625665 - DNA, 17 bp, Homo sapiens
agacacccttggagctc

SEQ ID NO: 6625666 - DNA, 18 bp, Homo sapiens
agacaccggagtatgtgc

SEQ ID NO: 6625667 - DNA, 21 bp, Homo sapiens
agacaccggagtatgtgcagt

SEQ ID NO: 6625668 - DNA, 17 bp, Homo sapiens
agacacctaaccccagg

SEQ ID NO: 6625669 - DNA, 23 bp, Homo sapiens
agacacctaaccccagggcactg

SEQ ID NO: 6625670 - DNA, 12 bp, Homo sapiens
agacacctcaga

SEQ ID NO: 6625671 - DNA, 15 bp, Homo sapiens
agacacctcagagcc

SEQ ID NO: 6625672 - DNA, 16 bp, Homo sapiens
agacacctcagagccc

SEQ ID NO: 6625673 - DNA, 14 bp, Homo sapiens
agacacctccccct

SEQ ID NO: 6625674 - DNA, 13 bp, Homo sapiens
agacacctggact

SEQ ID NO: 6625675 - DNA, 14 bp, Homo sapiens
agacacctggttgc

SEQ ID NO: 6625676 - DNA, 19 bp, Homo sapiens
agacaccttcccagctgct

SEQ ID NO: 6625677 - DNA, 20 bp, Homo sapiens
agacaccttctgtgctcatg

SEQ ID NO: 6625678 - DNA, 19 bp, Homo sapiens
agacaccttgacagggcac

SEQ ID NO: 6625679 - DNA, 14 bp, Homo sapiens
agacaccttttgta

SEQ ID NO: 6625680 - DNA, 21 bp, Homo sapiens
agacacgcccgactctctcca

SEQ ID NO: 6625681 - DNA, 22 bp, Homo sapiens
agacacgccttcccctcagcca

SEQ ID NO: 6625682 - DNA, 16 bp, Homo sapiens
agacacgctcttctat

SEQ ID NO: 6625683 - DNA, 15 bp, Homo sapiens
agacactaagttata

SEQ ID NO: 6625684 - DNA, 16 bp, Homo sapiens
agacactaattcctta

SEQ ID NO: 6625685 - DNA, 18 bp, Homo sapiens
agacactaattccttaaa

SEQ ID NO: 6625686 - DNA, 22 bp, Homo sapiens
agacactaattccttaaatgaa

SEQ ID NO: 6625687 - DNA, 23 bp, Homo sapiens
agacactaattccttaaatgaac

SEQ ID NO: 6625688 - DNA, 16 bp, Homo sapiens
agacactacaacatat

SEQ ID NO: 6625689 - DNA, 16 bp, Homo sapiens
agacactacatatcta

SEQ ID NO: 6625690 - DNA, 18 bp, Homo sapiens
agacactagttcagagga

SEQ ID NO: 6625691 - DNA, 18 bp, Homo sapiens
agacactcaagagccctt

SEQ ID NO: 6625692 - DNA, 15 bp, Homo sapiens
agacactcccaggga

SEQ ID NO: 6625693 - DNA, 16 bp, Homo sapiens
agacactcccagggac

SEQ ID NO: 6625694 - DNA, 20 bp, Homo sapiens
agacactcctataaggagag

SEQ ID NO: 6625695 - DNA, 14 bp, Homo sapiens
agacactctgacaa

SEQ ID NO: 6625696 - DNA, 18 bp, Homo sapiens
agacactgaaaaatctaa

SEQ ID NO: 6625697 - DNA, 19 bp, Homo sapiens
agacactgaccatccactc

SEQ ID NO: 6625698 - DNA, 17 bp, Homo sapiens
agacactgagcttctga

SEQ ID NO: 6625699 - DNA, 19 bp, Homo sapiens
agacactgagcttctgaga

SEQ ID NO: 6625700 - DNA, 13 bp, Homo sapiens
agacactgagtca

SEQ ID NO: 6625701 - DNA, 15 bp, Homo sapiens
agacactgagtcaga

SEQ ID NO: 6625702 - DNA, 15 bp, Homo sapiens
agacactgcacagaa

SEQ ID NO: 6625703 - DNA, 22 bp, Homo sapiens
agacactgcacagaagacagca

SEQ ID NO: 6625704 - DNA, 20 bp, Homo sapiens
agacactgccgacatcagca

SEQ ID NO: 6625705 - DNA, 21 bp, Homo sapiens
agacactgccgacatcagcat

SEQ ID NO: 6625706 - DNA, 14 bp, Homo sapiens
agacactgcctggg

SEQ ID NO: 6625707 - DNA, 16 bp, Homo sapiens
agacactgcctgggct

SEQ ID NO: 6625708 - DNA, 13 bp, Homo sapiens
agacactgcttgg

SEQ ID NO: 6625709 - DNA, 18 bp, Homo sapiens
agacactggcagagagat

SEQ ID NO: 6625710 - DNA, 18 bp, Homo sapiens
agacactggctgccagct

SEQ ID NO: 6625711 - DNA, 13 bp, Homo sapiens
agacactgggaga

SEQ ID NO: 6625712 - DNA, 20 bp, Homo sapiens
agacactgggagaagagaac

SEQ ID NO: 6625713 - DNA, 21 bp, Homo sapiens
agacactgggagaagagaacc

SEQ ID NO: 6625714 - DNA, 13 bp, Homo sapiens
agacactggtctc

SEQ ID NO: 6625715 - DNA, 18 bp, Homo sapiens
agacactggtctcagagg

SEQ ID NO: 6625716 - DNA, 17 bp, Homo sapiens
agacactgtcaatgagg

SEQ ID NO: 6625717 - DNA, 17 bp, Homo sapiens
agacactgtgcaggccc

SEQ ID NO: 6625718 - DNA, 19 bp, Homo sapiens
agacactgtgcaggcccag

SEQ ID NO: 6625719 - DNA, 18 bp, Homo sapiens
agacactgttgataaaaa

SEQ ID NO: 6625720 - DNA, 17 bp, Homo sapiens
agacactgttgcaaagg

SEQ ID NO: 6625721 - DNA, 20 bp, Homo sapiens
agacactgtttacaagaaaa

SEQ ID NO: 6625722 - DNA, 11 bp, Homo sapiens
agacacttact

SEQ ID NO: 6625723 - DNA, 21 bp, Homo sapiens
agacacttatattttgatttt

SEQ ID NO: 6625724 - DNA, 13 bp, Homo sapiens
agacacttcagat

SEQ ID NO: 6625725 - DNA, 13 bp, Homo sapiens
agacacttcatgg

SEQ ID NO: 6625726 - DNA, 22 bp, Homo sapiens
agacacttcatggaccaagaat

SEQ ID NO: 6625727 - DNA, 13 bp, Homo sapiens
agacacttccgtc

SEQ ID NO: 6625728 - DNA, 15 bp, Homo sapiens
agacacttgccttct

SEQ ID NO: 6625729 - DNA, 17 bp, Homo sapiens
agacacttgctcccaac

SEQ ID NO: 6625730 - DNA, 23 bp, Homo sapiens
agacacttgctgagtgaaggaaa

SEQ ID NO: 6625731 - DNA, 22 bp, Homo sapiens
agacactttggaatctaaccac

SEQ ID NO: 6625732 - DNA, 20 bp, Homo sapiens
agacactttgtctagtgtat

SEQ ID NO: 6625733 - DNA, 15 bp, Homo sapiens
agacacttttaccga

SEQ ID NO: 6625734 - DNA, 17 bp, Homo sapiens
agacagaaaaaaataaa

SEQ ID NO: 6625735 - DNA, 21 bp, Homo sapiens
agacagaaaaaaataaaaaca

SEQ ID NO: 6625736 - DNA, 22 bp, Homo sapiens
agacagaaaactaaaaaggaag

SEQ ID NO: 6625737 - DNA, 20 bp, Homo sapiens
agacagaaaagtgcctgagc

SEQ ID NO: 6625738 - DNA, 22 bp, Homo sapiens
agacagaaaagtgcctgagctg

SEQ ID NO: 6625739 - DNA, 14 bp, Homo sapiens
agacagaaacagag

SEQ ID NO: 6625740 - DNA, 16 bp, Homo sapiens
agacagaaacagagag

SEQ ID NO: 6625741 - DNA, 14 bp, Homo sapiens
agacagaaagcctc

SEQ ID NO: 6625742 - DNA, 12 bp, Homo sapiens
agacagaacacc

SEQ ID NO: 6625743 - DNA, 15 bp, Homo sapiens
agacagaagcaggct

SEQ ID NO: 6625744 - DNA, 17 bp, Homo sapiens
agacagaagcaggctgg

SEQ ID NO: 6625745 - DNA, 19 bp, Homo sapiens
agacagaagcaggctggag

SEQ ID NO: 6625746 - DNA, 18 bp, Homo sapiens
agacagaagctgaagtgc

SEQ ID NO: 6625747 - DNA, 18 bp, Homo sapiens
agacagaaggcaaagttt

SEQ ID NO: 6625748 - DNA, 21 bp, Homo sapiens
agacagaatgagagagaaaag

SEQ ID NO: 6625749 - DNA, 15 bp, Homo sapiens
agacagaatggtgga

SEQ ID NO: 6625750 - DNA, 14 bp, Homo sapiens
agacagaatgtatc

SEQ ID NO: 6625751 - DNA, 20 bp, Homo sapiens
agacagaatgtatctgtgaa

SEQ ID NO: 6625752 - DNA, 14 bp, Homo sapiens
agacagaatgtcac

SEQ ID NO: 6625753 - DNA, 15 bp, Homo sapiens
agacagaatgtcacc

SEQ ID NO: 6625754 - DNA, 16 bp, Homo sapiens
agacagacacacacac

SEQ ID NO: 6625755 - DNA, 19 bp, Homo sapiens
agacagacacacagcctca

SEQ ID NO: 6625756 - DNA, 16 bp, Homo sapiens
agacagaccacttgcc

SEQ ID NO: 6625757 - DNA, 18 bp, Homo sapiens
agacagacccagtgagtg

SEQ ID NO: 6625758 - DNA, 24 bp, Homo sapiens
agacagacggacgggacagcggcc

SEQ ID NO: 6625759 - DNA, 14 bp, Homo sapiens
agacagactagaag

SEQ ID NO: 6625760 - DNA, 17 bp, Homo sapiens
agacagagaaaacttgc

SEQ ID NO: 6625761 - DNA, 15 bp, Homo sapiens
agacagagaaacaga

SEQ ID NO: 6625762 - DNA, 14 bp, Homo sapiens
agacagagaaatgt

SEQ ID NO: 6625763 - DNA, 16 bp, Homo sapiens
agacagagaaatgtga

SEQ ID NO: 6625764 - DNA, 22 bp, Homo sapiens
agacagagaccctctgccacca

SEQ ID NO: 6625765 - DNA, 21 bp, Homo sapiens
agacagagacctcctgcctcc

SEQ ID NO: 6625766 - DNA, 16 bp, Homo sapiens
agacagagacgcagga

SEQ ID NO: 6625767 - DNA, 17 bp, Homo sapiens
agacagagagagactga

SEQ ID NO: 6625768 - DNA, 11 bp, Homo sapiens
agacagagatc

SEQ ID NO: 6625769 - DNA, 18 bp, Homo sapiens
agacagagatggcagagc

SEQ ID NO: 6625770 - DNA, 20 bp, Homo sapiens
agacagagcaacccctggac

SEQ ID NO: 6625771 - DNA, 13 bp, Homo sapiens
agacagagcaggc

SEQ ID NO: 6625772 - DNA, 22 bp, Homo sapiens
agacagagcaggctttgtgaga

SEQ ID NO: 6625773 - DNA, 17 bp, Homo sapiens
agacagagcccccaagc

SEQ ID NO: 6625774 - DNA, 13 bp, Homo sapiens
agacagagcctcc

SEQ ID NO: 6625775 - DNA, 13 bp, Homo sapiens
agacagagctaca

SEQ ID NO: 6625776 - DNA, 15 bp, Homo sapiens
agacagagctcacaa

SEQ ID NO: 6625777 - DNA, 18 bp, Homo sapiens
agacagaggaaagggctg

SEQ ID NO: 6625778 - DNA, 20 bp, Homo sapiens
agacagaggaaagggctggc

SEQ ID NO: 6625779 - DNA, 15 bp, Homo sapiens
agacagaggcagaga

SEQ ID NO: 6625780 - DNA, 16 bp, Homo sapiens
agacagaggcagggca

SEQ ID NO: 6625781 - DNA, 15 bp, Homo sapiens
agacagaggccctca

SEQ ID NO: 6625782 - DNA, 16 bp, Homo sapiens
agacagaggccctcaa

SEQ ID NO: 6625783 - DNA, 19 bp, Homo sapiens
agacagagggtcacagtgt

SEQ ID NO: 6625784 - DNA, 23 bp, Homo sapiens
agacagagtccctggctcctcta

SEQ ID NO: 6625785 - DNA, 11 bp, Homo sapiens
agacagagtct

SEQ ID NO: 6625786 - DNA, 21 bp, Homo sapiens
agacagagtctcactgttgcc

SEQ ID NO: 6625787 - DNA, 23 bp, Homo sapiens
agacagagtctcactgttgccca

SEQ ID NO: 6625788 - DNA, 20 bp, Homo sapiens
agacagagtcttactctgtt

SEQ ID NO: 6625789 - DNA, 18 bp, Homo sapiens
agacagagtgaatttcag

SEQ ID NO: 6625790 - DNA, 18 bp, Homo sapiens
agacagagtggatctgga

SEQ ID NO: 6625791 - DNA, 19 bp, Homo sapiens
agacagagtttcaccatgt

SEQ ID NO: 6625792 - DNA, 17 bp, Homo sapiens
agacagatacagcccca

SEQ ID NO: 6625793 - DNA, 21 bp, Homo sapiens
agacagatactcctccaaggt

SEQ ID NO: 6625794 - DNA, 22 bp, Homo sapiens
agacagatactcctccaaggtt

SEQ ID NO: 6625795 - DNA, 17 bp, Homo sapiens
agacagatagtgaaaca

SEQ ID NO: 6625796 - DNA, 17 bp, Homo sapiens
agacagatcactcctgg

SEQ ID NO: 6625797 - DNA, 20 bp, Homo sapiens
agacagatctggaatgtgaa

SEQ ID NO: 6625798 - DNA, 16 bp, Homo sapiens
agacagatgagcagga

SEQ ID NO: 6625799 - DNA, 19 bp, Homo sapiens
agacagatgagcaggagct

SEQ ID NO: 6625800 - DNA, 24 bp, Homo sapiens
agacagatgagcaggagcttgggt

SEQ ID NO: 6625801 - DNA, 15 bp, Homo sapiens
agacagatgccccag

SEQ ID NO: 6625802 - DNA, 17 bp, Homo sapiens
agacagatgctggtgga

SEQ ID NO: 6625803 - DNA, 20 bp, Homo sapiens
agacagatgctggtggagga

SEQ ID NO: 6625804 - DNA, 22 bp, Homo sapiens
agacagatgctggtggaggaag

SEQ ID NO: 6625805 - DNA, 18 bp, Homo sapiens
agacagatgtggacatgc

SEQ ID NO: 6625806 - DNA, 19 bp, Homo sapiens
agacagatgtggacatgca

SEQ ID NO: 6625807 - DNA, 21 bp, Homo sapiens
agacagatgtggacatgcacc

SEQ ID NO: 6625808 - DNA, 16 bp, Homo sapiens
agacagatgttgggag

SEQ ID NO: 6625809 - DNA, 21 bp, Homo sapiens
agacagattttcggaacacat

SEQ ID NO: 6625810 - DNA, 13 bp, Homo sapiens
agacagcaaaaaa

SEQ ID NO: 6625811 - DNA, 18 bp, Homo sapiens
agacagcaaaaaaagcaa

SEQ ID NO: 6625812 - DNA, 20 bp, Homo sapiens
agacagcaaggtgtggaggc

SEQ ID NO: 6625813 - DNA, 21 bp, Homo sapiens
agacagcacaggcagccccac

SEQ ID NO: 6625814 - DNA, 13 bp, Homo sapiens
agacagcagcagc

SEQ ID NO: 6625815 - DNA, 17 bp, Homo sapiens
agacagcagcagcctgc

SEQ ID NO: 6625816 - DNA, 14 bp, Homo sapiens
agacagcagctcag

SEQ ID NO: 6625817 - DNA, 19 bp, Homo sapiens
agacagccaaaggctggcg

SEQ ID NO: 6625818 - DNA, 22 bp, Homo sapiens
agacagccaactatggcctgtg

SEQ ID NO: 6625819 - DNA, 24 bp, Homo sapiens
agacagccacttttagctactgct

SEQ ID NO: 6625820 - DNA, 17 bp, Homo sapiens
agacagccaggtggcac

SEQ ID NO: 6625821 - DNA, 22 bp, Homo sapiens
agacagccaggtggcacctgca

SEQ ID NO: 6625822 - DNA, 16 bp, Homo sapiens
agacagccatacttcc

SEQ ID NO: 6625823 - DNA, 22 bp, Homo sapiens
agacagcccaggatactggcac

SEQ ID NO: 6625824 - DNA, 12 bp, Homo sapiens
agacagccccag

SEQ ID NO: 6625825 - DNA, 13 bp, Homo sapiens
agacagccccaga

SEQ ID NO: 6625826 - DNA, 15 bp, Homo sapiens
agacagccccagagc

SEQ ID NO: 6625827 - DNA, 17 bp, Homo sapiens
agacagccccagagcag

SEQ ID NO: 6625828 - DNA, 20 bp, Homo sapiens
agacagccccagagcagggt

SEQ ID NO: 6625829 - DNA, 15 bp, Homo sapiens
agacagccccctgcc

SEQ ID NO: 6625830 - DNA, 14 bp, Homo sapiens
agacagcccgggct

SEQ ID NO: 6625831 - DNA, 16 bp, Homo sapiens
agacagcccgggctct

SEQ ID NO: 6625832 - DNA, 18 bp, Homo sapiens
agacagcccgggctctgc

SEQ ID NO: 6625833 - DNA, 23 bp, Homo sapiens
agacagcccgggctctgcctccc

SEQ ID NO: 6625834 - DNA, 22 bp, Homo sapiens
agacagccctgcctatcctctg

SEQ ID NO: 6625835 - DNA, 16 bp, Homo sapiens
agacagccctggggga

SEQ ID NO: 6625836 - DNA, 17 bp, Homo sapiens
agacagcctaatgaagg

SEQ ID NO: 6625837 - DNA, 20 bp, Homo sapiens
agacagcctgtatcttgggg

SEQ ID NO: 6625838 - DNA, 13 bp, Homo sapiens
agacagcctgtct

SEQ ID NO: 6625839 - DNA, 22 bp, Homo sapiens
agacagccttcacttttctgag

SEQ ID NO: 6625840 - DNA, 20 bp, Homo sapiens
agacagcgaactagaagaaa

SEQ ID NO: 6625841 - DNA, 21 bp, Homo sapiens
agacagcgaactagaagaaag

SEQ ID NO: 6625842 - DNA, 19 bp, Homo sapiens
agacagctccctctgcctg

SEQ ID NO: 6625843 - DNA, 11 bp, Homo sapiens
agacagctctt

SEQ ID NO: 6625844 - DNA, 19 bp, Homo sapiens
agacagctgacagatacat

SEQ ID NO: 6625845 - DNA, 20 bp, Homo sapiens
agacagctgatacttcattt

SEQ ID NO: 6625846 - DNA, 12 bp, Homo sapiens
agacagctgcct

SEQ ID NO: 6625847 - DNA, 14 bp, Homo sapiens
agacagctggcgga

SEQ ID NO: 6625848 - DNA, 16 bp, Homo sapiens
agacagctggcggagg

SEQ ID NO: 6625849 - DNA, 22 bp, Homo sapiens
agacagctggcggaggctgctc

SEQ ID NO: 6625850 - DNA, 19 bp, Homo sapiens
agacagcttacaggagcca

SEQ ID NO: 6625851 - DNA, 20 bp, Homo sapiens
agacagcttacaggagccag

SEQ ID NO: 6625852 - DNA, 17 bp, Homo sapiens
agacagcttactgcagc

SEQ ID NO: 6625853 - DNA, 11 bp, Homo sapiens
agacagcttct

SEQ ID NO: 6625854 - DNA, 23 bp, Homo sapiens
agacagcttctcatcctgcaggc

SEQ ID NO: 6625855 - DNA, 14 bp, Homo sapiens
agacagcttttctc

SEQ ID NO: 6625856 - DNA, 13 bp, Homo sapiens
agacagcttttta

SEQ ID NO: 6625857 - DNA, 21 bp, Homo sapiens
agacaggaaaatcctctggct

SEQ ID NO: 6625858 - DNA, 14 bp, Homo sapiens
agacaggaaaggga

SEQ ID NO: 6625859 - DNA, 18 bp, Homo sapiens
agacaggaaagggaaggc

SEQ ID NO: 6625860 - DNA, 17 bp, Homo sapiens
agacaggaagaccaagg

SEQ ID NO: 6625861 - DNA, 13 bp, Homo sapiens
agacaggaaggaa

SEQ ID NO: 6625862 - DNA, 15 bp, Homo sapiens
agacaggaaggaagc

SEQ ID NO: 6625863 - DNA, 22 bp, Homo sapiens
agacaggaaggaagcacaaaag

SEQ ID NO: 6625864 - DNA, 14 bp, Homo sapiens
agacaggacagaat

SEQ ID NO: 6625865 - DNA, 22 bp, Homo sapiens
agacaggacagaatgtgttctt

SEQ ID NO: 6625866 - DNA, 15 bp, Homo sapiens
agacaggaccaggga

SEQ ID NO: 6625867 - DNA, 16 bp, Homo sapiens
agacaggacctaggat

SEQ ID NO: 6625868 - DNA, 14 bp, Homo sapiens
agacaggagaaatg

SEQ ID NO: 6625869 - DNA, 14 bp, Homo sapiens
agacaggagaatca

SEQ ID NO: 6625870 - DNA, 14 bp, Homo sapiens
agacaggagcctag

SEQ ID NO: 6625871 - DNA, 15 bp, Homo sapiens
agacaggagcctagc

SEQ ID NO: 6625872 - DNA, 15 bp, Homo sapiens
agacaggatgttcaa

SEQ ID NO: 6625873 - DNA, 20 bp, Homo sapiens
agacaggcaagcacctcctg

SEQ ID NO: 6625874 - DNA, 23 bp, Homo sapiens
agacaggcaagcacctcctgcct

SEQ ID NO: 6625875 - DNA, 20 bp, Homo sapiens
agacaggcacaaaatgtgac

SEQ ID NO: 6625876 - DNA, 21 bp, Homo sapiens
agacaggcagaatcagtagct

SEQ ID NO: 6625877 - DNA, 20 bp, Homo sapiens
agacaggcaggtgatctgct

SEQ ID NO: 6625878 - DNA, 22 bp, Homo sapiens
agacaggcccaagagatgaaga

SEQ ID NO: 6625879 - DNA, 23 bp, Homo sapiens
agacaggcccaagagatgaagag

SEQ ID NO: 6625880 - DNA, 13 bp, Homo sapiens
agacaggccctcc

SEQ ID NO: 6625881 - DNA, 18 bp, Homo sapiens
agacaggccctccctgtc

SEQ ID NO: 6625882 - DNA, 19 bp, Homo sapiens
agacaggccctccctgtct

SEQ ID NO: 6625883 - DNA, 17 bp, Homo sapiens
agacaggcctttccctg

SEQ ID NO: 6625884 - DNA, 20 bp, Homo sapiens
agacaggcctttccctgccg

SEQ ID NO: 6625885 - DNA, 17 bp, Homo sapiens
agacaggcggggcccag

SEQ ID NO: 6625886 - DNA, 21 bp, Homo sapiens
agacaggcggggcccagcgct

SEQ ID NO: 6625887 - DNA, 23 bp, Homo sapiens
agacaggctacaaagcagagatc

SEQ ID NO: 6625888 - DNA, 21 bp, Homo sapiens
agacaggctctgaggggcacg

SEQ ID NO: 6625889 - DNA, 15 bp, Homo sapiens
agacaggctcttagc

SEQ ID NO: 6625890 - DNA, 20 bp, Homo sapiens
agacaggctcttagcagctt

SEQ ID NO: 6625891 - DNA, 14 bp, Homo sapiens
agacaggctgggtc

SEQ ID NO: 6625892 - DNA, 16 bp, Homo sapiens
agacaggctgggtcct

SEQ ID NO: 6625893 - DNA, 19 bp, Homo sapiens
agacaggctgggtcctgcc

SEQ ID NO: 6625894 - DNA, 21 bp, Homo sapiens
agacaggctgggtcctgccag

SEQ ID NO: 6625895 - DNA, 22 bp, Homo sapiens
agacagggaaaggtcagcccgt

SEQ ID NO: 6625896 - DNA, 13 bp, Homo sapiens
agacagggctcca

SEQ ID NO: 6625897 - DNA, 16 bp, Homo sapiens
agacagggctgctccc

SEQ ID NO: 6625898 - DNA, 22 bp, Homo sapiens
agacaggggagttgtcaacttg

SEQ ID NO: 6625899 - DNA, 22 bp, Homo sapiens
agacaggggtctcgggggtggg

SEQ ID NO: 6625900 - DNA, 17 bp, Homo sapiens
agacagggtcctgctat

SEQ ID NO: 6625901 - DNA, 15 bp, Homo sapiens
agacagggtctcact

SEQ ID NO: 6625902 - DNA, 16 bp, Homo sapiens
agacagggtctcactc

SEQ ID NO: 6625903 - DNA, 18 bp, Homo sapiens
agacagggtctcactgtg

SEQ ID NO: 6625904 - DNA, 23 bp, Homo sapiens
agacagggtgctgatgggaagga

SEQ ID NO: 6625905 - DNA, 16 bp, Homo sapiens
agacagggtgggaggg

SEQ ID NO: 6625906 - DNA, 22 bp, Homo sapiens
agacagggtgggcttcctgccc

SEQ ID NO: 6625907 - DNA, 17 bp, Homo sapiens
agacagggtggggctta

SEQ ID NO: 6625908 - DNA, 19 bp, Homo sapiens
agacagggtttcaccatgt

SEQ ID NO: 6625909 - DNA, 23 bp, Homo sapiens
agacagggtttggctgtgtctaa

SEQ ID NO: 6625910 - DNA, 17 bp, Homo sapiens
agacaggtcaaatgctg

SEQ ID NO: 6625911 - DNA, 14 bp, Homo sapiens
agacaggtgaggcg

SEQ ID NO: 6625912 - DNA, 21 bp, Homo sapiens
agacaggtgcctaacctggga

SEQ ID NO: 6625913 - DNA, 22 bp, Homo sapiens
agacaggtgcctaacctgggac

SEQ ID NO: 6625914 - DNA, 15 bp, Homo sapiens
agacaggtgcctggg

SEQ ID NO: 6625915 - DNA, 16 bp, Homo sapiens
agacaggtgcctgggg

SEQ ID NO: 6625916 - DNA, 22 bp, Homo sapiens
agacaggtgcctggggctggct

SEQ ID NO: 6625917 - DNA, 14 bp, Homo sapiens
agacaggtggaaaa

SEQ ID NO: 6625918 - DNA, 15 bp, Homo sapiens
agacaggtggcctag

SEQ ID NO: 6625919 - DNA, 16 bp, Homo sapiens
agacaggtggcctagc

SEQ ID NO: 6625920 - DNA, 16 bp, Homo sapiens
agacaggtgggagatg

SEQ ID NO: 6625921 - DNA, 17 bp, Homo sapiens
agacaggtgggagatgg

SEQ ID NO: 6625922 - DNA, 18 bp, Homo sapiens
agacaggtttaaaagttg

SEQ ID NO: 6625923 - DNA, 13 bp, Homo sapiens
agacagtaagtat

SEQ ID NO: 6625924 - DNA, 21 bp, Homo sapiens
agacagtatacagtcctgtgg

SEQ ID NO: 6625925 - DNA, 15 bp, Homo sapiens
agacagtatatttat

SEQ ID NO: 6625926 - DNA, 18 bp, Homo sapiens
agacagtatatttatagt

SEQ ID NO: 6625927 - DNA, 21 bp, Homo sapiens
agacagtatttattggtgggt

SEQ ID NO: 6625928 - DNA, 14 bp, Homo sapiens
agacagtcaaggag

SEQ ID NO: 6625929 - DNA, 18 bp, Homo sapiens
agacagtcaaggagatga

SEQ ID NO: 6625930 - DNA, 15 bp, Homo sapiens
agacagtcacaaatt

SEQ ID NO: 6625931 - DNA, 15 bp, Homo sapiens
agacagtccagcctg

SEQ ID NO: 6625932 - DNA, 13 bp, Homo sapiens
agacagtccagtg

SEQ ID NO: 6625933 - DNA, 16 bp, Homo sapiens
agacagtccctgccaa

SEQ ID NO: 6625934 - DNA, 18 bp, Homo sapiens
agacagtcgctcagtctg

SEQ ID NO: 6625935 - DNA, 15 bp, Homo sapiens
agacagtctggaaag

SEQ ID NO: 6625936 - DNA, 17 bp, Homo sapiens
agacagtctggaaagtg

SEQ ID NO: 6625937 - DNA, 19 bp, Homo sapiens
agacagtgaagtaaaattg

SEQ ID NO: 6625938 - DNA, 19 bp, Homo sapiens
agacagtgagacagtctgg

SEQ ID NO: 6625939 - DNA, 21 bp, Homo sapiens
agacagtgatctccatatgtt

SEQ ID NO: 6625940 - DNA, 16 bp, Homo sapiens
agacagtgatgcctgc

SEQ ID NO: 6625941 - DNA, 17 bp, Homo sapiens
agacagtgcccttggtg

SEQ ID NO: 6625942 - DNA, 19 bp, Homo sapiens
agacagtgctgccctgcga

SEQ ID NO: 6625943 - DNA, 20 bp, Homo sapiens
agacagtggcactaaaatgt

SEQ ID NO: 6625944 - DNA, 13 bp, Homo sapiens
agacagtgggaaa

SEQ ID NO: 6625945 - DNA, 24 bp, Homo sapiens
agacagtgggcactaagggtggag

SEQ ID NO: 6625946 - DNA, 12 bp, Homo sapiens
agacagtggggg

SEQ ID NO: 6625947 - DNA, 19 bp, Homo sapiens
agacagtgggggtgcctgg

SEQ ID NO: 6625948 - DNA, 13 bp, Homo sapiens
agacagtggttct

SEQ ID NO: 6625949 - DNA, 11 bp, Homo sapiens
agacagtgtac

SEQ ID NO: 6625950 - DNA, 13 bp, Homo sapiens
agacagtgtacaa

SEQ ID NO: 6625951 - DNA, 21 bp, Homo sapiens
agacagtgtatgtagaagcat

SEQ ID NO: 6625952 - DNA, 17 bp, Homo sapiens
agacagttaatatcaaa

SEQ ID NO: 6625953 - DNA, 20 bp, Homo sapiens
agacagtttactttgccaac

SEQ ID NO: 6625954 - DNA, 13 bp, Homo sapiens
agacagtttctta

SEQ ID NO: 6625955 - DNA, 20 bp, Homo sapiens
agacagtttcttagcttttt

SEQ ID NO: 6625956 - DNA, 22 bp, Homo sapiens
agacagtttcttagctttttaa

SEQ ID NO: 6625957 - DNA, 16 bp, Homo sapiens
agacagtttcttgcaa

SEQ ID NO: 6625958 - DNA, 15 bp, Homo sapiens
agacagtttgtaaat

SEQ ID NO: 6625959 - DNA, 16 bp, Homo sapiens
agacagtttgtaaatg

SEQ ID NO: 6625960 - DNA, 17 bp, Homo sapiens
agacagtttgtaaatgt

SEQ ID NO: 6625961 - DNA, 23 bp, Homo sapiens
agacagttttccaaactgtgtca

SEQ ID NO: 6625962 - DNA, 16 bp, Homo sapiens
agacagttttgagaac

SEQ ID NO: 6625963 - DNA, 21 bp, Homo sapiens
agacagttttgagaacgtaaa

SEQ ID NO: 6625964 - DNA, 16 bp, Homo sapiens
agacagttttgcttta

SEQ ID NO: 6625965 - DNA, 12 bp, Homo sapiens
agacataaaaca

SEQ ID NO: 6625966 - DNA, 13 bp, Homo sapiens
agacataaaacag

SEQ ID NO: 6625967 - DNA, 14 bp, Homo sapiens
agacataaaacaga

SEQ ID NO: 6625968 - DNA, 15 bp, Homo sapiens
agacataaaacagaa

SEQ ID NO: 6625969 - DNA, 16 bp, Homo sapiens
agacataaaacagaat

SEQ ID NO: 6625970 - DNA, 14 bp, Homo sapiens
agacataaaacttt

SEQ ID NO: 6625971 - DNA, 17 bp, Homo sapiens
agacataaaactttaaa

SEQ ID NO: 6625972 - DNA, 18 bp, Homo sapiens
agacataaacaaagacat

SEQ ID NO: 6625973 - DNA, 22 bp, Homo sapiens
agacataaagaagaaacttgta

SEQ ID NO: 6625974 - DNA, 12 bp, Homo sapiens
agacataaagcc

SEQ ID NO: 6625975 - DNA, 21 bp, Homo sapiens
agacataaaggaaaagacaca

SEQ ID NO: 6625976 - DNA, 15 bp, Homo sapiens
agacataaattgtaa

SEQ ID NO: 6625977 - DNA, 12 bp, Homo sapiens
agacataattta

SEQ ID NO: 6625978 - DNA, 13 bp, Homo sapiens
agacataatttaa

SEQ ID NO: 6625979 - DNA, 18 bp, Homo sapiens
agacataatttaaaataa

SEQ ID NO: 6625980 - DNA, 16 bp, Homo sapiens
agacatacagctgcct

SEQ ID NO: 6625981 - DNA, 20 bp, Homo sapiens
agacatacatagacatttca

SEQ ID NO: 6625982 - DNA, 16 bp, Homo sapiens
agacatacgaaacaca

SEQ ID NO: 6625983 - DNA, 22 bp, Homo sapiens
agacatactgcttgattttaat

SEQ ID NO: 6625984 - DNA, 14 bp, Homo sapiens
agacatacttgaag

SEQ ID NO: 6625985 - DNA, 17 bp, Homo sapiens
agacatacttgaagggc

SEQ ID NO: 6625986 - DNA, 23 bp, Homo sapiens
agacatacttgaagggccagagc

SEQ ID NO: 6625987 - DNA, 18 bp, Homo sapiens
agacataggccatgaaaa

SEQ ID NO: 6625988 - DNA, 19 bp, Homo sapiens
agacataggccatgaaaaa

SEQ ID NO: 6625989 - DNA, 14 bp, Homo sapiens
agacatataccaaa

SEQ ID NO: 6625990 - DNA, 14 bp, Homo sapiens
agacatatattata

SEQ ID NO: 6625991 - DNA, 15 bp, Homo sapiens
agacatatatttatg

SEQ ID NO: 6625992 - DNA, 21 bp, Homo sapiens
agacatatcactgctgctggg

SEQ ID NO: 6625993 - DNA, 13 bp, Homo sapiens
agacatatctcta

SEQ ID NO: 6625994 - DNA, 21 bp, Homo sapiens
agacatattcttggagaactt

SEQ ID NO: 6625995 - DNA, 14 bp, Homo sapiens
agacatatttaact

SEQ ID NO: 6625996 - DNA, 14 bp, Homo sapiens
agacatatttcagt

SEQ ID NO: 6625997 - DNA, 18 bp, Homo sapiens
agacatcaacagataaat

SEQ ID NO: 6625998 - DNA, 21 bp, Homo sapiens
agacatcattgtcagccttgc

SEQ ID NO: 6625999 - DNA, 15 bp, Homo sapiens
agacatccataaaga

SEQ ID NO: 6626000 - DNA, 16 bp, Homo sapiens
agacatccttgcagtt

SEQ ID NO: 6626001 - DNA, 17 bp, Homo sapiens
agacatctcaaatacag

SEQ ID NO: 6626002 - DNA, 16 bp, Homo sapiens
agacatctctgcaccc

SEQ ID NO: 6626003 - DNA, 16 bp, Homo sapiens
agacatctctggagcc

SEQ ID NO: 6626004 - DNA, 19 bp, Homo sapiens
agacatctgaggttttatt

SEQ ID NO: 6626005 - DNA, 12 bp, Homo sapiens
agacatcttcag

SEQ ID NO: 6626006 - DNA, 13 bp, Homo sapiens
agacatcttcaga

SEQ ID NO: 6626007 - DNA, 14 bp, Homo sapiens
agacatcttcagat

SEQ ID NO: 6626008 - DNA, 22 bp, Homo sapiens
agacatcttgcctacttttctt

SEQ ID NO: 6626009 - DNA, 18 bp, Homo sapiens
agacatctttaacatagt

SEQ ID NO: 6626010 - DNA, 15 bp, Homo sapiens
agacatgaaaactat

SEQ ID NO: 6626011 - DNA, 16 bp, Homo sapiens
agacatgaaataaaag

SEQ ID NO: 6626012 - DNA, 14 bp, Homo sapiens
agacatgaatatga

SEQ ID NO: 6626013 - DNA, 19 bp, Homo sapiens
agacatgaattttaaataa

SEQ ID NO: 6626014 - DNA, 16 bp, Homo sapiens
agacatgagccactgc

SEQ ID NO: 6626015 - DNA, 22 bp, Homo sapiens
agacatgatttccttgaatgtg

SEQ ID NO: 6626016 - DNA, 17 bp, Homo sapiens
agacatgcccaaaactt

SEQ ID NO: 6626017 - DNA, 16 bp, Homo sapiens
agacatgctgcccacc

SEQ ID NO: 6626018 - DNA, 23 bp, Homo sapiens
agacatgctgcccaccccctgct

SEQ ID NO: 6626019 - DNA, 13 bp, Homo sapiens
agacatgcttggg

SEQ ID NO: 6626020 - DNA, 15 bp, Homo sapiens
agacatggaaaagga

SEQ ID NO: 6626021 - DNA, 18 bp, Homo sapiens
agacatggaacagtgtaa

SEQ ID NO: 6626022 - DNA, 16 bp, Homo sapiens
agacatggaagagaga

SEQ ID NO: 6626023 - DNA, 21 bp, Homo sapiens
agacatggaagagagagccat

SEQ ID NO: 6626024 - DNA, 13 bp, Homo sapiens
agacatggaaggt

SEQ ID NO: 6626025 - DNA, 17 bp, Homo sapiens
agacatggaccagcatc

SEQ ID NO: 6626026 - DNA, 20 bp, Homo sapiens
agacatggaccttctctcca

SEQ ID NO: 6626027 - DNA, 24 bp, Homo sapiens
agacatggaccttctctccagagc

SEQ ID NO: 6626028 - DNA, 19 bp, Homo sapiens
agacatggagatgtaaaat

SEQ ID NO: 6626029 - DNA, 21 bp, Homo sapiens
agacatggaggggatgataaa

SEQ ID NO: 6626030 - DNA, 15 bp, Homo sapiens
agacatggaggttct

SEQ ID NO: 6626031 - DNA, 19 bp, Homo sapiens
agacatggaggttctaagg

SEQ ID NO: 6626032 - DNA, 21 bp, Homo sapiens
agacatggaggttctaaggcc

SEQ ID NO: 6626033 - DNA, 18 bp, Homo sapiens
agacatggcctctggaaa

SEQ ID NO: 6626034 - DNA, 22 bp, Homo sapiens
agacatggcttgccacagctct

SEQ ID NO: 6626035 - DNA, 23 bp, Homo sapiens
agacatgggctatcagggaggaa

SEQ ID NO: 6626036 - DNA, 12 bp, Homo sapiens
agacatggtggc

SEQ ID NO: 6626037 - DNA, 18 bp, Homo sapiens
agacatggtgtctcacac

SEQ ID NO: 6626038 - DNA, 20 bp, Homo sapiens
agacatgtatactccataga

SEQ ID NO: 6626039 - DNA, 13 bp, Homo sapiens
agacatgtgacat

SEQ ID NO: 6626040 - DNA, 20 bp, Homo sapiens
agacatgtggaggggcagcc

SEQ ID NO: 6626041 - DNA, 17 bp, Homo sapiens
agacatgtggtgggaca

SEQ ID NO: 6626042 - DNA, 15 bp, Homo sapiens
agacatgttttagac

SEQ ID NO: 6626043 - DNA, 23 bp, Homo sapiens
agacatgttttagacaaatactc

SEQ ID NO: 6626044 - DNA, 14 bp, Homo sapiens
agacattaaatcta

SEQ ID NO: 6626045 - DNA, 22 bp, Homo sapiens
agacattaactcattagactgg

SEQ ID NO: 6626046 - DNA, 19 bp, Homo sapiens
agacattagagaaaacctt

SEQ ID NO: 6626047 - DNA, 18 bp, Homo sapiens
agacattcaccaacaaca

SEQ ID NO: 6626048 - DNA, 12 bp, Homo sapiens
agacattcagag

SEQ ID NO: 6626049 - DNA, 18 bp, Homo sapiens
agacattccaaaacgaag

SEQ ID NO: 6626050 - DNA, 23 bp, Homo sapiens
agacattccttctacatgtaatg

SEQ ID NO: 6626051 - DNA, 14 bp, Homo sapiens
agacattctcacat

SEQ ID NO: 6626052 - DNA, 14 bp, Homo sapiens
agacattctgccag

SEQ ID NO: 6626053 - DNA, 17 bp, Homo sapiens
agacattctgttggagt

SEQ ID NO: 6626054 - DNA, 15 bp, Homo sapiens
agacattcttagtta

SEQ ID NO: 6626055 - DNA, 19 bp, Homo sapiens
agacattcttccaaaaaga

SEQ ID NO: 6626056 - DNA, 17 bp, Homo sapiens
agacattgaaagctcta

SEQ ID NO: 6626057 - DNA, 14 bp, Homo sapiens
agacattgacagca

SEQ ID NO: 6626058 - DNA, 22 bp, Homo sapiens
agacattgagtttacttataaa

SEQ ID NO: 6626059 - DNA, 21 bp, Homo sapiens
agacattgctctatgtctgcc

SEQ ID NO: 6626060 - DNA, 15 bp, Homo sapiens
agacattggcaccta

SEQ ID NO: 6626061 - DNA, 11 bp, Homo sapiens
agacattgtaa

SEQ ID NO: 6626062 - DNA, 13 bp, Homo sapiens
agacattgtaaat

SEQ ID NO: 6626063 - DNA, 17 bp, Homo sapiens
agacattgtaaataaat

SEQ ID NO: 6626064 - DNA, 21 bp, Homo sapiens
agacattgtaaataaattttg

SEQ ID NO: 6626065 - DNA, 15 bp, Homo sapiens
agacatttaaaatag

SEQ ID NO: 6626066 - DNA, 21 bp, Homo sapiens
agacatttatactcttttttc

SEQ ID NO: 6626067 - DNA, 13 bp, Homo sapiens
agacatttatata

SEQ ID NO: 6626068 - DNA, 18 bp, Homo sapiens
agacatttattaaccaaa

SEQ ID NO: 6626069 - DNA, 18 bp, Homo sapiens
agacatttcaaaattaat

SEQ ID NO: 6626070 - DNA, 16 bp, Homo sapiens
agacatttcaaataac

SEQ ID NO: 6626071 - DNA, 20 bp, Homo sapiens
agacatttcaaataactgca

SEQ ID NO: 6626072 - DNA, 21 bp, Homo sapiens
agacatttcatccaccaatat

SEQ ID NO: 6626073 - DNA, 14 bp, Homo sapiens
agacatttcttttc

SEQ ID NO: 6626074 - DNA, 19 bp, Homo sapiens
agacatttcttttcttttt

SEQ ID NO: 6626075 - DNA, 22 bp, Homo sapiens
agacatttgatagaaaggaaca

SEQ ID NO: 6626076 - DNA, 22 bp, Homo sapiens
agacatttgctgaactcagcac

SEQ ID NO: 6626077 - DNA, 15 bp, Homo sapiens
agacatttgtatatt

SEQ ID NO: 6626078 - DNA, 18 bp, Homo sapiens
agacatttgtttgctgta

SEQ ID NO: 6626079 - DNA, 21 bp, Homo sapiens
agacatttgtttgctgtacag

SEQ ID NO: 6626080 - DNA, 22 bp, Homo sapiens
agacattttaaaaaatggtcac

SEQ ID NO: 6626081 - DNA, 23 bp, Homo sapiens
agacattttaacaagaagatgaa

SEQ ID NO: 6626082 - DNA, 12 bp, Homo sapiens
agacattttaag

SEQ ID NO: 6626083 - DNA, 14 bp, Homo sapiens
agacattttaagtt

SEQ ID NO: 6626084 - DNA, 21 bp, Homo sapiens
agacattttaagtttgtagta

SEQ ID NO: 6626085 - DNA, 20 bp, Homo sapiens
agacattttcagacattttt

SEQ ID NO: 6626086 - DNA, 24 bp, Homo sapiens
agacattttgaaataaaaatggat

SEQ ID NO: 6626087 - DNA, 15 bp, Homo sapiens
agacattttgtgtga

SEQ ID NO: 6626088 - DNA, 17 bp, Homo sapiens
agacattttgtgtgaga

SEQ ID NO: 6626089 - DNA, 19 bp, Homo sapiens
agacattttgtgtgagact

SEQ ID NO: 6626090 - DNA, 18 bp, Homo sapiens
agacattttgttacataa

SEQ ID NO: 6626091 - DNA, 20 bp, Homo sapiens
agacattttgtttttactgt

SEQ ID NO: 6626092 - DNA, 22 bp, Homo sapiens
agacattttgtttttactgtat

SEQ ID NO: 6626093 - DNA, 17 bp, Homo sapiens
agacatttttatttagt

SEQ ID NO: 6626094 - DNA, 22 bp, Homo sapiens
agacatttttccgtttgctttt

SEQ ID NO: 6626095 - DNA, 18 bp, Homo sapiens
agacatttttggaaattt

SEQ ID NO: 6626096 - DNA, 15 bp, Homo sapiens
agacatttttgtgcc

SEQ ID NO: 6626097 - DNA, 19 bp, Homo sapiens
agacattttttaaaagcct

SEQ ID NO: 6626098 - DNA, 20 bp, Homo sapiens
agacatttttttgttccaaa

SEQ ID NO: 6626099 - DNA, 13 bp, Homo sapiens
agaccaaaatgaa

SEQ ID NO: 6626100 - DNA, 17 bp, Homo sapiens
agaccaaaatgacaatg

SEQ ID NO: 6626101 - DNA, 13 bp, Homo sapiens
agaccaaacttca

SEQ ID NO: 6626102 - DNA, 24 bp, Homo sapiens
agaccaaacttcactctgggcaca

SEQ ID NO: 6626103 - DNA, 23 bp, Homo sapiens
agaccaaagacttgttaaatgta

SEQ ID NO: 6626104 - DNA, 19 bp, Homo sapiens
agaccaaagcaaagaaaat

SEQ ID NO: 6626105 - DNA, 17 bp, Homo sapiens
agaccaaaggaaggaac

SEQ ID NO: 6626106 - DNA, 22 bp, Homo sapiens
agaccaaatctcagttgtttgc

SEQ ID NO: 6626107 - DNA, 17 bp, Homo sapiens
agaccaaatggaaacag

SEQ ID NO: 6626108 - DNA, 22 bp, Homo sapiens
agaccaaattgagctagggggg

SEQ ID NO: 6626109 - DNA, 14 bp, Homo sapiens
agaccaaattttga

SEQ ID NO: 6626110 - DNA, 16 bp, Homo sapiens
agaccaaccctgggac

SEQ ID NO: 6626111 - DNA, 14 bp, Homo sapiens
agaccaacttttca

SEQ ID NO: 6626112 - DNA, 22 bp, Homo sapiens
agaccaactttttcattccctg

SEQ ID NO: 6626113 - DNA, 15 bp, Homo sapiens
agaccaagccggtgc

SEQ ID NO: 6626114 - DNA, 20 bp, Homo sapiens
agaccaagccggtgcccacc

SEQ ID NO: 6626115 - DNA, 19 bp, Homo sapiens
agaccaagcttagtcctgg

SEQ ID NO: 6626116 - DNA, 23 bp, Homo sapiens
agaccaagcttagtcctgggaga

SEQ ID NO: 6626117 - DNA, 22 bp, Homo sapiens
agaccaagggatgggacctgat

SEQ ID NO: 6626118 - DNA, 13 bp, Homo sapiens
agaccaaggtcag

SEQ ID NO: 6626119 - DNA, 16 bp, Homo sapiens
agaccaagtcctggct

SEQ ID NO: 6626120 - DNA, 23 bp, Homo sapiens
agaccaagtctctctaagacaaa

SEQ ID NO: 6626121 - DNA, 11 bp, Homo sapiens
agaccaataaa

SEQ ID NO: 6626122 - DNA, 17 bp, Homo sapiens
agaccaataaacttcct

SEQ ID NO: 6626123 - DNA, 16 bp, Homo sapiens
agaccaataaatttgt

SEQ ID NO: 6626124 - DNA, 17 bp, Homo sapiens
agaccaatcaaatatat

SEQ ID NO: 6626125 - DNA, 16 bp, Homo sapiens
agaccaattgaagcat

SEQ ID NO: 6626126 - DNA, 18 bp, Homo sapiens
agaccaattgaagcatga

SEQ ID NO: 6626127 - DNA, 22 bp, Homo sapiens
agaccaattttttgtgtgtgaa

SEQ ID NO: 6626128 - DNA, 13 bp, Homo sapiens
agaccacagacgg

SEQ ID NO: 6626129 - DNA, 13 bp, Homo sapiens
agaccacaggaag

SEQ ID NO: 6626130 - DNA, 21 bp, Homo sapiens
agaccacagggttcaaaatgt

SEQ ID NO: 6626131 - DNA, 22 bp, Homo sapiens
agaccacatgcgctcctggctt

SEQ ID NO: 6626132 - DNA, 13 bp, Homo sapiens
agaccaccaagcc

SEQ ID NO: 6626133 - DNA, 16 bp, Homo sapiens
agaccaccacctcaga

SEQ ID NO: 6626134 - DNA, 19 bp, Homo sapiens
agaccacccaacctcaccc

SEQ ID NO: 6626135 - DNA, 16 bp, Homo sapiens
agaccaccgcgcccct

SEQ ID NO: 6626136 - DNA, 18 bp, Homo sapiens
agaccacctccctgccct

SEQ ID NO: 6626137 - DNA, 11 bp, Homo sapiens
agaccacctgc

SEQ ID NO: 6626138 - DNA, 14 bp, Homo sapiens
agaccacctgccag

SEQ ID NO: 6626139 - DNA, 17 bp, Homo sapiens
agaccacctgccagcca

SEQ ID NO: 6626140 - DNA, 22 bp, Homo sapiens
agaccacctgccagccatcaca

SEQ ID NO: 6626141 - DNA, 15 bp, Homo sapiens
agaccacctgcttct

SEQ ID NO: 6626142 - DNA, 16 bp, Homo sapiens
agaccacctgcttctg

SEQ ID NO: 6626143 - DNA, 21 bp, Homo sapiens
agaccacctgcttctgaactc

SEQ ID NO: 6626144 - DNA, 13 bp, Homo sapiens
agaccaccttccc

SEQ ID NO: 6626145 - DNA, 16 bp, Homo sapiens
agaccacgcccctgcc

SEQ ID NO: 6626146 - DNA, 18 bp, Homo sapiens
agaccacgcccctgcctg

SEQ ID NO: 6626147 - DNA, 23 bp, Homo sapiens
agaccacgcccgtcctgcctgtg

SEQ ID NO: 6626148 - DNA, 24 bp, Homo sapiens
agaccacgcccgtcctgcctgtgg

SEQ ID NO: 6626149 - DNA, 22 bp, Homo sapiens
agaccacggtccaatccagcct

SEQ ID NO: 6626150 - DNA, 14 bp, Homo sapiens
agaccactgccata

SEQ ID NO: 6626151 - DNA, 23 bp, Homo sapiens
agaccactgtctccacccacctt

SEQ ID NO: 6626152 - DNA, 15 bp, Homo sapiens
agaccacttccttaa

SEQ ID NO: 6626153 - DNA, 17 bp, Homo sapiens
agaccacttccttaaca

SEQ ID NO: 6626154 - DNA, 20 bp, Homo sapiens
agaccacttccttaacagct

SEQ ID NO: 6626155 - DNA, 16 bp, Homo sapiens
agaccacttgccacgc

SEQ ID NO: 6626156 - DNA, 19 bp, Homo sapiens
agaccagaaaccttccaga

SEQ ID NO: 6626157 - DNA, 15 bp, Homo sapiens
agaccagaaagtgtg

SEQ ID NO: 6626158 - DNA, 16 bp, Homo sapiens
agaccagactgtggag

SEQ ID NO: 6626159 - DNA, 17 bp, Homo sapiens
agaccagactgtggaga

SEQ ID NO: 6626160 - DNA, 18 bp, Homo sapiens
agaccagactgtggagaa

SEQ ID NO: 6626161 - DNA, 15 bp, Homo sapiens
agaccagagcagttt

SEQ ID NO: 6626162 - DNA, 18 bp, Homo sapiens
agaccagagcagtttcat

SEQ ID NO: 6626163 - DNA, 16 bp, Homo sapiens
agaccagagctctgga

SEQ ID NO: 6626164 - DNA, 18 bp, Homo sapiens
agaccagagctctggagc

SEQ ID NO: 6626165 - DNA, 15 bp, Homo sapiens
agaccagagctgtct

SEQ ID NO: 6626166 - DNA, 18 bp, Homo sapiens
agaccagagctgtctgaa

SEQ ID NO: 6626167 - DNA, 12 bp, Homo sapiens
agaccagcagca

SEQ ID NO: 6626168 - DNA, 23 bp, Homo sapiens
agaccagcatagttctgcaataa

SEQ ID NO: 6626169 - DNA, 18 bp, Homo sapiens
agaccagcccagccaaca

SEQ ID NO: 6626170 - DNA, 20 bp, Homo sapiens
agaccagcccagccaacatg

SEQ ID NO: 6626171 - DNA, 22 bp, Homo sapiens
agaccagccccaccatgcaact

SEQ ID NO: 6626172 - DNA, 12 bp, Homo sapiens
agaccagcctcg

SEQ ID NO: 6626173 - DNA, 16 bp, Homo sapiens
agaccagcctgccagg

SEQ ID NO: 6626174 - DNA, 12 bp, Homo sapiens
agaccagcctgg

SEQ ID NO: 6626175 - DNA, 13 bp, Homo sapiens
agaccagcctggc

SEQ ID NO: 6626176 - DNA, 15 bp, Homo sapiens
agaccagcctggcca

SEQ ID NO: 6626177 - DNA, 22 bp, Homo sapiens
agaccagcctggccagtatggt

SEQ ID NO: 6626178 - DNA, 22 bp, Homo sapiens
agaccagcctgggcaacaaagt

SEQ ID NO: 6626179 - DNA, 16 bp, Homo sapiens
agaccagcctttcttc

SEQ ID NO: 6626180 - DNA, 12 bp, Homo sapiens
agaccagctcag

SEQ ID NO: 6626181 - DNA, 20 bp, Homo sapiens
agaccagctcagaggcccag

SEQ ID NO: 6626182 - DNA, 19 bp, Homo sapiens
agaccagctcccagatggc

SEQ ID NO: 6626183 - DNA, 12 bp, Homo sapiens
agaccagctctt

SEQ ID NO: 6626184 - DNA, 13 bp, Homo sapiens
agaccagctcttc

SEQ ID NO: 6626185 - DNA, 22 bp, Homo sapiens
agaccagctgtgtttcttaact

SEQ ID NO: 6626186 - DNA, 14 bp, Homo sapiens
agaccaggactctg

SEQ ID NO: 6626187 - DNA, 16 bp, Homo sapiens
agaccaggactctgcc

SEQ ID NO: 6626188 - DNA, 17 bp, Homo sapiens
agaccaggactctgcct

SEQ ID NO: 6626189 - DNA, 18 bp, Homo sapiens
agaccaggactctgcctt

SEQ ID NO: 6626190 - DNA, 16 bp, Homo sapiens
agaccaggatttctaa

SEQ ID NO: 6626191 - DNA, 14 bp, Homo sapiens
agaccagggatgct

SEQ ID NO: 6626192 - DNA, 14 bp, Homo sapiens
agaccagggctgct

SEQ ID NO: 6626193 - DNA, 16 bp, Homo sapiens
agaccagggctgctct

SEQ ID NO: 6626194 - DNA, 18 bp, Homo sapiens
agaccagggtcttacctc

SEQ ID NO: 6626195 - DNA, 13 bp, Homo sapiens
agaccagggtggc

SEQ ID NO: 6626196 - DNA, 15 bp, Homo sapiens
agaccagggtggcca

SEQ ID NO: 6626197 - DNA, 17 bp, Homo sapiens
agaccagggtggccaca

SEQ ID NO: 6626198 - DNA, 17 bp, Homo sapiens
agaccagtactgggaag

SEQ ID NO: 6626199 - DNA, 15 bp, Homo sapiens
agaccagtagtgacc

SEQ ID NO: 6626200 - DNA, 15 bp, Homo sapiens
agaccagtctggcca

SEQ ID NO: 6626201 - DNA, 18 bp, Homo sapiens
agaccagtgaccccagaa

SEQ ID NO: 6626202 - DNA, 23 bp, Homo sapiens
agaccagtggtctggaaacagct

SEQ ID NO: 6626203 - DNA, 21 bp, Homo sapiens
agaccagtgtatcaggtcagg

SEQ ID NO: 6626204 - DNA, 23 bp, Homo sapiens
agaccagtgtatcaggtcaggga

SEQ ID NO: 6626205 - DNA, 13 bp, Homo sapiens
agaccagttggga

SEQ ID NO: 6626206 - DNA, 20 bp, Homo sapiens
agaccagttgggagcactgg

SEQ ID NO: 6626207 - DNA, 14 bp, Homo sapiens
agaccagtttgcat

SEQ ID NO: 6626208 - DNA, 15 bp, Homo sapiens
agaccagtttgcatg

SEQ ID NO: 6626209 - DNA, 17 bp, Homo sapiens
agaccagtttgcatgat

SEQ ID NO: 6626210 - DNA, 15 bp, Homo sapiens
agaccataagagaaa

SEQ ID NO: 6626211 - DNA, 17 bp, Homo sapiens
agaccataagagaaacc

SEQ ID NO: 6626212 - DNA, 18 bp, Homo sapiens
agaccataagagaaacct

SEQ ID NO: 6626213 - DNA, 23 bp, Homo sapiens
agaccataagagaaacctgccaa

SEQ ID NO: 6626214 - DNA, 16 bp, Homo sapiens
agaccatattacctgg

SEQ ID NO: 6626215 - DNA, 14 bp, Homo sapiens
agaccatcctggcc

SEQ ID NO: 6626216 - DNA, 19 bp, Homo sapiens
agaccatcctggcccctcc

SEQ ID NO: 6626217 - DNA, 14 bp, Homo sapiens
agaccatcctggct

SEQ ID NO: 6626218 - DNA, 12 bp, Homo sapiens
agaccatctcct

SEQ ID NO: 6626219 - DNA, 20 bp, Homo sapiens
agaccatctctccctcctgg

SEQ ID NO: 6626220 - DNA, 19 bp, Homo sapiens
agaccatctgtatgttagg

SEQ ID NO: 6626221 - DNA, 21 bp, Homo sapiens
agaccatgaagtaaattatgt

SEQ ID NO: 6626222 - DNA, 17 bp, Homo sapiens
agaccatgcattcagat

SEQ ID NO: 6626223 - DNA, 14 bp, Homo sapiens
agaccatgcattta

SEQ ID NO: 6626224 - DNA, 22 bp, Homo sapiens
agaccatggggtggaaggagaa

SEQ ID NO: 6626225 - DNA, 13 bp, Homo sapiens
agaccattctgtg

SEQ ID NO: 6626226 - DNA, 19 bp, Homo sapiens
agaccattggggctcccag

SEQ ID NO: 6626227 - DNA, 22 bp, Homo sapiens
agaccattggggctcccagcca

SEQ ID NO: 6626228 - DNA, 21 bp, Homo sapiens
agaccattgtcttccaacccc

SEQ ID NO: 6626229 - DNA, 15 bp, Homo sapiens
agaccatttaacatg

SEQ ID NO: 6626230 - DNA, 16 bp, Homo sapiens
agaccatttaacatgc

SEQ ID NO: 6626231 - DNA, 15 bp, Homo sapiens
agaccatttcacaga

SEQ ID NO: 6626232 - DNA, 23 bp, Homo sapiens
agaccatttcacagaaaacattg

SEQ ID NO: 6626233 - DNA, 13 bp, Homo sapiens
agacccaaaacag

SEQ ID NO: 6626234 - DNA, 14 bp, Homo sapiens
agacccaaaacagc

SEQ ID NO: 6626235 - DNA, 21 bp, Homo sapiens
agacccaaaacagctttgtct

SEQ ID NO: 6626236 - DNA, 19 bp, Homo sapiens
agacccaaaaggcagaagc

SEQ ID NO: 6626237 - DNA, 23 bp, Homo sapiens
agacccaaattataagggccctg

SEQ ID NO: 6626238 - DNA, 22 bp, Homo sapiens
agacccaacacatgggacctat

SEQ ID NO: 6626239 - DNA, 21 bp, Homo sapiens
agacccaacccatgcccctga

SEQ ID NO: 6626240 - DNA, 16 bp, Homo sapiens
agacccaaggaggaaa

SEQ ID NO: 6626241 - DNA, 15 bp, Homo sapiens
agacccaataaagaa

SEQ ID NO: 6626242 - DNA, 16 bp, Homo sapiens
agacccaccccacctg

SEQ ID NO: 6626243 - DNA, 18 bp, Homo sapiens
agacccaccccacctgca

SEQ ID NO: 6626244 - DNA, 13 bp, Homo sapiens
agacccacctgga

SEQ ID NO: 6626245 - DNA, 21 bp, Homo sapiens
agacccactgaaatgaccaag

SEQ ID NO: 6626246 - DNA, 18 bp, Homo sapiens
agacccagacaggactgc

SEQ ID NO: 6626247 - DNA, 23 bp, Homo sapiens
agacccagagaaggacggtgcca

SEQ ID NO: 6626248 - DNA, 15 bp, Homo sapiens
agacccagaggtcca

SEQ ID NO: 6626249 - DNA, 17 bp, Homo sapiens
agacccagatctcatgg

SEQ ID NO: 6626250 - DNA, 13 bp, Homo sapiens
agacccagcagga

SEQ ID NO: 6626251 - DNA, 15 bp, Homo sapiens
agacccagcggtcca

SEQ ID NO: 6626252 - DNA, 17 bp, Homo sapiens
agacccagctgcagacc

SEQ ID NO: 6626253 - DNA, 11 bp, Homo sapiens
agacccaggag

SEQ ID NO: 6626254 - DNA, 18 bp, Homo sapiens
agacccaggagagacaga

SEQ ID NO: 6626255 - DNA, 18 bp, Homo sapiens
agacccaggagtccagac

SEQ ID NO: 6626256 - DNA, 12 bp, Homo sapiens
agacccaggtct

SEQ ID NO: 6626257 - DNA, 16 bp, Homo sapiens
agacccaggtcttcca

SEQ ID NO: 6626258 - DNA, 17 bp, Homo sapiens
agacccaggtcttccag

SEQ ID NO: 6626259 - DNA, 20 bp, Homo sapiens
agacccaggtcttccagacc

SEQ ID NO: 6626260 - DNA, 13 bp, Homo sapiens
agacccaggtgga

SEQ ID NO: 6626261 - DNA, 22 bp, Homo sapiens
agacccagtagctgcccttcct

SEQ ID NO: 6626262 - DNA, 13 bp, Homo sapiens
agacccagtgagc

SEQ ID NO: 6626263 - DNA, 21 bp, Homo sapiens
agacccagtgagtgaatcagg

SEQ ID NO: 6626264 - DNA, 16 bp, Homo sapiens
agacccagtgtaaaga

SEQ ID NO: 6626265 - DNA, 22 bp, Homo sapiens
agacccagtgtaaagaataaat

SEQ ID NO: 6626266 - DNA, 15 bp, Homo sapiens
agacccatagcagct

SEQ ID NO: 6626267 - DNA, 16 bp, Homo sapiens
agacccatctggaggc

SEQ ID NO: 6626268 - DNA, 13 bp, Homo sapiens
agacccatgctgg

SEQ ID NO: 6626269 - DNA, 15 bp, Homo sapiens
agacccatgtgctgg

SEQ ID NO: 6626270 - DNA, 16 bp, Homo sapiens
agacccatgtgctggg

SEQ ID NO: 6626271 - DNA, 15 bp, Homo sapiens
agacccattccttcc

SEQ ID NO: 6626272 - DNA, 17 bp, Homo sapiens
agacccattccttccca

SEQ ID NO: 6626273 - DNA, 23 bp, Homo sapiens
agacccattgcgatggccgctcc

SEQ ID NO: 6626274 - DNA, 23 bp, Homo sapiens
agacccatttccttgtgctcctg

SEQ ID NO: 6626275 - DNA, 12 bp, Homo sapiens
agaccccaccca

SEQ ID NO: 6626276 - DNA, 18 bp, Homo sapiens
agaccccaccctacgctc

SEQ ID NO: 6626277 - DNA, 16 bp, Homo sapiens
agaccccagagtaggg

SEQ ID NO: 6626278 - DNA, 13 bp, Homo sapiens
agaccccagctgg

SEQ ID NO: 6626279 - DNA, 19 bp, Homo sapiens
agaccccagtcaagctcct

SEQ ID NO: 6626280 - DNA, 19 bp, Homo sapiens
agaccccatccagccaggg

SEQ ID NO: 6626281 - DNA, 13 bp, Homo sapiens
agacccccacccc

SEQ ID NO: 6626282 - DNA, 16 bp, Homo sapiens
agacccccaccccttc

SEQ ID NO: 6626283 - DNA, 17 bp, Homo sapiens
agacccccaccccttcc

SEQ ID NO: 6626284 - DNA, 21 bp, Homo sapiens
agacccccaccccttccccac

SEQ ID NO: 6626285 - DNA, 12 bp, Homo sapiens
agacccccagga

SEQ ID NO: 6626286 - DNA, 16 bp, Homo sapiens
agacccccatccagcc

SEQ ID NO: 6626287 - DNA, 21 bp, Homo sapiens
agacccccatttgtcccagac

SEQ ID NO: 6626288 - DNA, 14 bp, Homo sapiens
agaccccccagccc

SEQ ID NO: 6626289 - DNA, 18 bp, Homo sapiens
agaccccccagcccctcc

SEQ ID NO: 6626290 - DNA, 23 bp, Homo sapiens
agacccccccatttcccgcacat

SEQ ID NO: 6626291 - DNA, 15 bp, Homo sapiens
agaccccctcagcct

SEQ ID NO: 6626292 - DNA, 17 bp, Homo sapiens
agaccccgtggctctgg

SEQ ID NO: 6626293 - DNA, 16 bp, Homo sapiens
agacccctcagcccca

SEQ ID NO: 6626294 - DNA, 19 bp, Homo sapiens
agacccctctggccaggat

SEQ ID NO: 6626295 - DNA, 21 bp, Homo sapiens
agacccctctggccaggatgg

SEQ ID NO: 6626296 - DNA, 11 bp, Homo sapiens
agacccctgcc

SEQ ID NO: 6626297 - DNA, 13 bp, Homo sapiens
agacccctgccca

SEQ ID NO: 6626298 - DNA, 13 bp, Homo sapiens
agacccctgcctg

SEQ ID NO: 6626299 - DNA, 12 bp, Homo sapiens
agacccctggcc

SEQ ID NO: 6626300 - DNA, 14 bp, Homo sapiens
agacccctggcctc

SEQ ID NO: 6626301 - DNA, 12 bp, Homo sapiens
agacccctggct

SEQ ID NO: 6626302 - DNA, 21 bp, Homo sapiens
agacccctggcttttcactgc

SEQ ID NO: 6626303 - DNA, 14 bp, Homo sapiens
agacccctgggtgg

SEQ ID NO: 6626304 - DNA, 13 bp, Homo sapiens
agacccctgtctt

SEQ ID NO: 6626305 - DNA, 16 bp, Homo sapiens
agacccctgtggcaga

SEQ ID NO: 6626306 - DNA, 13 bp, Homo sapiens
agaccccttcctt

SEQ ID NO: 6626307 - DNA, 19 bp, Homo sapiens
agacccctttgccttcccc

SEQ ID NO: 6626308 - DNA, 14 bp, Homo sapiens
agacccggctgcgt

SEQ ID NO: 6626309 - DNA, 17 bp, Homo sapiens
agacccgggaaggaagg

SEQ ID NO: 6626310 - DNA, 19 bp, Homo sapiens
agaccctactgaagtggct

SEQ ID NO: 6626311 - DNA, 15 bp, Homo sapiens
agaccctaggaagct

SEQ ID NO: 6626312 - DNA, 18 bp, Homo sapiens
agaccctatctcccacaa

SEQ ID NO: 6626313 - DNA, 20 bp, Homo sapiens
agaccctatttgtttcatta

SEQ ID NO: 6626314 - DNA, 11 bp, Homo sapiens
agaccctcact

SEQ ID NO: 6626315 - DNA, 17 bp, Homo sapiens
agaccctcatgctgcca

SEQ ID NO: 6626316 - DNA, 24 bp, Homo sapiens
agaccctcatgctgccaatatcct

SEQ ID NO: 6626317 - DNA, 15 bp, Homo sapiens
agaccctcccctgcc

SEQ ID NO: 6626318 - DNA, 18 bp, Homo sapiens
agaccctcccctgcctcc

SEQ ID NO: 6626319 - DNA, 13 bp, Homo sapiens
agaccctccttcc

SEQ ID NO: 6626320 - DNA, 16 bp, Homo sapiens
agaccctccttcccca

SEQ ID NO: 6626321 - DNA, 18 bp, Homo sapiens
agaccctccttccccacc

SEQ ID NO: 6626322 - DNA, 21 bp, Homo sapiens
agaccctccttccccacccca

SEQ ID NO: 6626323 - DNA, 17 bp, Homo sapiens
agaccctcgcaaaatga

SEQ ID NO: 6626324 - DNA, 21 bp, Homo sapiens
agaccctctatttacctgcga

SEQ ID NO: 6626325 - DNA, 13 bp, Homo sapiens
agaccctctcagg

SEQ ID NO: 6626326 - DNA, 14 bp, Homo sapiens
agaccctctcaggc

SEQ ID NO: 6626327 - DNA, 20 bp, Homo sapiens
agaccctctcaggctgtccc

SEQ ID NO: 6626328 - DNA, 21 bp, Homo sapiens
agaccctctcaggctgtccca

SEQ ID NO: 6626329 - DNA, 15 bp, Homo sapiens
agaccctctgccacc

SEQ ID NO: 6626330 - DNA, 12 bp, Homo sapiens
agaccctcttct

SEQ ID NO: 6626331 - DNA, 15 bp, Homo sapiens
agaccctcttctctg

SEQ ID NO: 6626332 - DNA, 18 bp, Homo sapiens
agaccctcttctctgggc

SEQ ID NO: 6626333 - DNA, 19 bp, Homo sapiens
agaccctcttgcccatcct

SEQ ID NO: 6626334 - DNA, 18 bp, Homo sapiens
agaccctctttcttgttt

SEQ ID NO: 6626335 - DNA, 14 bp, Homo sapiens
agaccctgaaccca

SEQ ID NO: 6626336 - DNA, 11 bp, Homo sapiens
agaccctgaga

SEQ ID NO: 6626337 - DNA, 13 bp, Homo sapiens
agaccctgagact

SEQ ID NO: 6626338 - DNA, 18 bp, Homo sapiens
agaccctgagactccaga

SEQ ID NO: 6626339 - DNA, 12 bp, Homo sapiens
agaccctgaggc

SEQ ID NO: 6626340 - DNA, 20 bp, Homo sapiens
agaccctgaggccctgggct

SEQ ID NO: 6626341 - DNA, 18 bp, Homo sapiens
agaccctgatgcaggtca

SEQ ID NO: 6626342 - DNA, 21 bp, Homo sapiens
agaccctgcaaacagaacagg

SEQ ID NO: 6626343 - DNA, 15 bp, Homo sapiens
agaccctgccacagc

SEQ ID NO: 6626344 - DNA, 16 bp, Homo sapiens
agaccctgccacagcc

SEQ ID NO: 6626345 - DNA, 24 bp, Homo sapiens
agaccctgccacagccagaggagg

SEQ ID NO: 6626346 - DNA, 13 bp, Homo sapiens
agaccctgccagg

SEQ ID NO: 6626347 - DNA, 14 bp, Homo sapiens
agaccctgccaggg

SEQ ID NO: 6626348 - DNA, 16 bp, Homo sapiens
agaccctgcccacccc

SEQ ID NO: 6626349 - DNA, 18 bp, Homo sapiens
agaccctgcccaccccat

SEQ ID NO: 6626350 - DNA, 20 bp, Homo sapiens
agaccctgccccctgccagc

SEQ ID NO: 6626351 - DNA, 11 bp, Homo sapiens
agaccctgcct

SEQ ID NO: 6626352 - DNA, 14 bp, Homo sapiens
agaccctgcctgag

SEQ ID NO: 6626353 - DNA, 18 bp, Homo sapiens
agaccctgcctgagccca

SEQ ID NO: 6626354 - DNA, 22 bp, Homo sapiens
agaccctgcctgagcccaggag

SEQ ID NO: 6626355 - DNA, 17 bp, Homo sapiens
agaccctgcgcccctgc

SEQ ID NO: 6626356 - DNA, 18 bp, Homo sapiens
agaccctgcgcccctgcc

SEQ ID NO: 6626357 - DNA, 21 bp, Homo sapiens
agaccctgcgcccctgcccag

SEQ ID NO: 6626358 - DNA, 14 bp, Homo sapiens
agaccctggaggcc

SEQ ID NO: 6626359 - DNA, 17 bp, Homo sapiens
agaccctgggtgggctc

SEQ ID NO: 6626360 - DNA, 22 bp, Homo sapiens
agaccctgggtgggctctgtgc

SEQ ID NO: 6626361 - DNA, 18 bp, Homo sapiens
agaccctggtgcctggct

SEQ ID NO: 6626362 - DNA, 21 bp, Homo sapiens
agaccctgtctttgctgttta

SEQ ID NO: 6626363 - DNA, 12 bp, Homo sapiens
agaccctgtgtc

SEQ ID NO: 6626364 - DNA, 16 bp, Homo sapiens
agacccttcttgcctg

SEQ ID NO: 6626365 - DNA, 16 bp, Homo sapiens
agacccttgaagatgt

SEQ ID NO: 6626366 - DNA, 13 bp, Homo sapiens
agacccttgtggt

SEQ ID NO: 6626367 - DNA, 19 bp, Homo sapiens
agacccttgtggtcccacc

SEQ ID NO: 6626368 - DNA, 22 bp, Homo sapiens
agaccctttcttcagctctgaa

SEQ ID NO: 6626369 - DNA, 15 bp, Homo sapiens
agacccttttctcag

SEQ ID NO: 6626370 - DNA, 21 bp, Homo sapiens
agaccgagcgctttctggaaa

SEQ ID NO: 6626371 - DNA, 16 bp, Homo sapiens
agaccgagtgaaccta

SEQ ID NO: 6626372 - DNA, 13 bp, Homo sapiens
agaccgcgcccct

SEQ ID NO: 6626373 - DNA, 18 bp, Homo sapiens
agaccgcgcccctgggac

SEQ ID NO: 6626374 - DNA, 19 bp, Homo sapiens
agaccgcttcacccctgca

SEQ ID NO: 6626375 - DNA, 21 bp, Homo sapiens
agaccgcttcacccctgcact

SEQ ID NO: 6626376 - DNA, 12 bp, Homo sapiens
agaccggaagct

SEQ ID NO: 6626377 - DNA, 19 bp, Homo sapiens
agaccggacaagagcctgc

SEQ ID NO: 6626378 - DNA, 22 bp, Homo sapiens
agaccggccgcatgtctgcatg

SEQ ID NO: 6626379 - DNA, 24 bp, Homo sapiens
agaccggccgcatgtctgcatggc

SEQ ID NO: 6626380 - DNA, 19 bp, Homo sapiens
agaccggcctgccaggagg

SEQ ID NO: 6626381 - DNA, 17 bp, Homo sapiens
agaccgggggccagaca

SEQ ID NO: 6626382 - DNA, 19 bp, Homo sapiens
agaccgtacaaactcagat

SEQ ID NO: 6626383 - DNA, 15 bp, Homo sapiens
agaccgtcctcaccc

SEQ ID NO: 6626384 - DNA, 16 bp, Homo sapiens
agaccgtcctcacccc

SEQ ID NO: 6626385 - DNA, 19 bp, Homo sapiens
agaccgtcctcacccctgt

SEQ ID NO: 6626386 - DNA, 21 bp, Homo sapiens
agaccgtgaagatactttgta

SEQ ID NO: 6626387 - DNA, 14 bp, Homo sapiens
agaccgtgagcgcc

SEQ ID NO: 6626388 - DNA, 20 bp, Homo sapiens
agaccgttataaagtgtgcc

SEQ ID NO: 6626389 - DNA, 18 bp, Homo sapiens
agacctaaagcaagcctg

SEQ ID NO: 6626390 - DNA, 18 bp, Homo sapiens
agacctaaatgacctcag

SEQ ID NO: 6626391 - DNA, 23 bp, Homo sapiens
agacctaaatgacctcagcaaat

SEQ ID NO: 6626392 - DNA, 17 bp, Homo sapiens
agacctaaccagggcca

SEQ ID NO: 6626393 - DNA, 14 bp, Homo sapiens
agacctaagccctg

SEQ ID NO: 6626394 - DNA, 20 bp, Homo sapiens
agacctaaggcagacaggaa

SEQ ID NO: 6626395 - DNA, 22 bp, Homo sapiens
agacctaaggcagacaggaagg

SEQ ID NO: 6626396 - DNA, 18 bp, Homo sapiens
agacctaatatcatttta

SEQ ID NO: 6626397 - DNA, 19 bp, Homo sapiens
agacctaatatcattttat

SEQ ID NO: 6626398 - DNA, 21 bp, Homo sapiens
agacctaatctctgtaaagct

SEQ ID NO: 6626399 - DNA, 11 bp, Homo sapiens
agacctacagg

SEQ ID NO: 6626400 - DNA, 14 bp, Homo sapiens
agacctacaggctg

SEQ ID NO: 6626401 - DNA, 22 bp, Homo sapiens
agacctacagggggtctggctg

SEQ ID NO: 6626402 - DNA, 21 bp, Homo sapiens
agacctacattccctctcctg

SEQ ID NO: 6626403 - DNA, 16 bp, Homo sapiens
agacctacctcaggtt

SEQ ID NO: 6626404 - DNA, 23 bp, Homo sapiens
agacctacctcaggttgctggtt

SEQ ID NO: 6626405 - DNA, 16 bp, Homo sapiens
agacctactgttctaa

SEQ ID NO: 6626406 - DNA, 16 bp, Homo sapiens
agacctagacctgggc

SEQ ID NO: 6626407 - DNA, 15 bp, Homo sapiens
agacctagcaggctg

SEQ ID NO: 6626408 - DNA, 16 bp, Homo sapiens
agacctagcaggctgt

SEQ ID NO: 6626409 - DNA, 19 bp, Homo sapiens
agacctagggaggacctta

SEQ ID NO: 6626410 - DNA, 21 bp, Homo sapiens
agacctagtcccctttcctct

SEQ ID NO: 6626411 - DNA, 22 bp, Homo sapiens
agacctagtcccctttcctcta

SEQ ID NO: 6626412 - DNA, 22 bp, Homo sapiens
agacctatactgaaagatctct

SEQ ID NO: 6626413 - DNA, 16 bp, Homo sapiens
agacctatgataaata

SEQ ID NO: 6626414 - DNA, 14 bp, Homo sapiens
agacctcagccatg

SEQ ID NO: 6626415 - DNA, 19 bp, Homo sapiens
agacctcagcctgtgctgc

SEQ ID NO: 6626416 - DNA, 20 bp, Homo sapiens
agacctcagcctgtgctgcc

SEQ ID NO: 6626417 - DNA, 15 bp, Homo sapiens
agacctcatcagcct

SEQ ID NO: 6626418 - DNA, 19 bp, Homo sapiens
agacctcatcaggatgaac

SEQ ID NO: 6626419 - DNA, 16 bp, Homo sapiens
agacctcatctccaag

SEQ ID NO: 6626420 - DNA, 21 bp, Homo sapiens
agacctcatctgtggagctgc

SEQ ID NO: 6626421 - DNA, 13 bp, Homo sapiens
agacctcatgccc

SEQ ID NO: 6626422 - DNA, 15 bp, Homo sapiens
agacctcatgcccag

SEQ ID NO: 6626423 - DNA, 23 bp, Homo sapiens
agacctcatgcccagctctctga

SEQ ID NO: 6626424 - DNA, 17 bp, Homo sapiens
agacctccacttgctta

SEQ ID NO: 6626425 - DNA, 22 bp, Homo sapiens
agacctccacttgcttaagtat

SEQ ID NO: 6626426 - DNA, 23 bp, Homo sapiens
agacctccagattattttctata

SEQ ID NO: 6626427 - DNA, 15 bp, Homo sapiens
agacctccccagccc

SEQ ID NO: 6626428 - DNA, 17 bp, Homo sapiens
agacctccccagcccct

SEQ ID NO: 6626429 - DNA, 15 bp, Homo sapiens
agacctcccccaggg

SEQ ID NO: 6626430 - DNA, 20 bp, Homo sapiens
agacctcccccagggagggg

SEQ ID NO: 6626431 - DNA, 16 bp, Homo sapiens
agacctcccctcttcc

SEQ ID NO: 6626432 - DNA, 18 bp, Homo sapiens
agacctcctgatgtcttg

SEQ ID NO: 6626433 - DNA, 19 bp, Homo sapiens
agacctctactgccttgga

SEQ ID NO: 6626434 - DNA, 15 bp, Homo sapiens
agacctctcccaccc

SEQ ID NO: 6626435 - DNA, 15 bp, Homo sapiens
agacctctccttcct

SEQ ID NO: 6626436 - DNA, 11 bp, Homo sapiens
agacctctgag

SEQ ID NO: 6626437 - DNA, 14 bp, Homo sapiens
agacctctgatccc

SEQ ID NO: 6626438 - DNA, 20 bp, Homo sapiens
agacctctggttaatttata

SEQ ID NO: 6626439 - DNA, 17 bp, Homo sapiens
agacctcttccctctgg

SEQ ID NO: 6626440 - DNA, 19 bp, Homo sapiens
agacctcttccctctgggc

SEQ ID NO: 6626441 - DNA, 22 bp, Homo sapiens
agacctcttcctggaataaaca

SEQ ID NO: 6626442 - DNA, 19 bp, Homo sapiens
agacctcttctaagaggat

SEQ ID NO: 6626443 - DNA, 20 bp, Homo sapiens
agacctgaaagagaggactg

SEQ ID NO: 6626444 - DNA, 13 bp, Homo sapiens
agacctgaagaat

SEQ ID NO: 6626445 - DNA, 18 bp, Homo sapiens
agacctgaaggacctccc

SEQ ID NO: 6626446 - DNA, 20 bp, Homo sapiens
agacctgaaggacctccccc

SEQ ID NO: 6626447 - DNA, 13 bp, Homo sapiens
agacctgacaatt

SEQ ID NO: 6626448 - DNA, 20 bp, Homo sapiens
agacctgacccaacaccccc

SEQ ID NO: 6626449 - DNA, 16 bp, Homo sapiens
agacctgagctcccca

SEQ ID NO: 6626450 - DNA, 22 bp, Homo sapiens
agacctgcagtgaggggccctc

SEQ ID NO: 6626451 - DNA, 11 bp, Homo sapiens
agacctgcatg

SEQ ID NO: 6626452 - DNA, 16 bp, Homo sapiens
agacctgcatttggca

SEQ ID NO: 6626453 - DNA, 17 bp, Homo sapiens
agacctgccagccactg

SEQ ID NO: 6626454 - DNA, 22 bp, Homo sapiens
agacctgccagccactgtcacc

SEQ ID NO: 6626455 - DNA, 12 bp, Homo sapiens
agacctgcccct

SEQ ID NO: 6626456 - DNA, 15 bp, Homo sapiens
agacctgcccctccc

SEQ ID NO: 6626457 - DNA, 10 bp, Homo sapiens
agacctgcct

SEQ ID NO: 6626458 - DNA, 13 bp, Homo sapiens
agacctgcctgtg

SEQ ID NO: 6626459 - DNA, 12 bp, Homo sapiens
agacctgctcag

SEQ ID NO: 6626460 - DNA, 12 bp, Homo sapiens
agacctgctctg

SEQ ID NO: 6626461 - DNA, 21 bp, Homo sapiens
agacctgcttcctgaaataaa

SEQ ID NO: 6626462 - DNA, 22 bp, Homo sapiens
agacctgcttcctgaaataaac

SEQ ID NO: 6626463 - DNA, 23 bp, Homo sapiens
agacctgcttcctgaaataaaca

SEQ ID NO: 6626464 - DNA, 16 bp, Homo sapiens
agacctggaaccagag

SEQ ID NO: 6626465 - DNA, 19 bp, Homo sapiens
agacctggacacaggcctg

SEQ ID NO: 6626466 - DNA, 19 bp, Homo sapiens
agacctggagcccctgggt

SEQ ID NO: 6626467 - DNA, 15 bp, Homo sapiens
agacctggagcttca

SEQ ID NO: 6626468 - DNA, 21 bp, Homo sapiens
agacctggagcttcagccagg

SEQ ID NO: 6626469 - DNA, 14 bp, Homo sapiens
agacctggcagctc

SEQ ID NO: 6626470 - DNA, 15 bp, Homo sapiens
agacctggcagctct

SEQ ID NO: 6626471 - DNA, 16 bp, Homo sapiens
agacctggcagctctg

SEQ ID NO: 6626472 - DNA, 15 bp, Homo sapiens
agacctggcctctgc

SEQ ID NO: 6626473 - DNA, 23 bp, Homo sapiens
agacctggcctctgccatcctcc

SEQ ID NO: 6626474 - DNA, 18 bp, Homo sapiens
agacctggcctttcactt

SEQ ID NO: 6626475 - DNA, 17 bp, Homo sapiens
agacctggctccactct

SEQ ID NO: 6626476 - DNA, 18 bp, Homo sapiens
agacctggctctcagagg

SEQ ID NO: 6626477 - DNA, 16 bp, Homo sapiens
agacctggctgggcct

SEQ ID NO: 6626478 - DNA, 17 bp, Homo sapiens
agacctgggatttgaga

SEQ ID NO: 6626479 - DNA, 12 bp, Homo sapiens
agacctgggcca

SEQ ID NO: 6626480 - DNA, 15 bp, Homo sapiens
agacctgtcctcctg

SEQ ID NO: 6626481 - DNA, 21 bp, Homo sapiens
agacctgtcgtctctcccacc

SEQ ID NO: 6626482 - DNA, 14 bp, Homo sapiens
agacctgtctcctg

SEQ ID NO: 6626483 - DNA, 16 bp, Homo sapiens
agacctgtctcctggc

SEQ ID NO: 6626484 - DNA, 14 bp, Homo sapiens
agacctgtcttcca

SEQ ID NO: 6626485 - DNA, 20 bp, Homo sapiens
agacctgtgacctggtctgg

SEQ ID NO: 6626486 - DNA, 19 bp, Homo sapiens
agacctgtgctagttttac

SEQ ID NO: 6626487 - DNA, 23 bp, Homo sapiens
agacctgtgctagttttacagat

SEQ ID NO: 6626488 - DNA, 12 bp, Homo sapiens
agacctgtgtga

SEQ ID NO: 6626489 - DNA, 17 bp, Homo sapiens
agacctgtgtgaactat

SEQ ID NO: 6626490 - DNA, 18 bp, Homo sapiens
agacctgttagcagacag

SEQ ID NO: 6626491 - DNA, 23 bp, Homo sapiens
agacctgttttgcttttgtaact

SEQ ID NO: 6626492 - DNA, 15 bp, Homo sapiens
agaccttaatttata

SEQ ID NO: 6626493 - DNA, 22 bp, Homo sapiens
agaccttcacagatgcctactt

SEQ ID NO: 6626494 - DNA, 22 bp, Homo sapiens
agaccttcggggcctgtctgaa

SEQ ID NO: 6626495 - DNA, 21 bp, Homo sapiens
agaccttctagtgagcctggg

SEQ ID NO: 6626496 - DNA, 14 bp, Homo sapiens
agaccttctcccta

SEQ ID NO: 6626497 - DNA, 21 bp, Homo sapiens
agaccttctccttcacctttg

SEQ ID NO: 6626498 - DNA, 12 bp, Homo sapiens
agaccttctctt

SEQ ID NO: 6626499 - DNA, 17 bp, Homo sapiens
agaccttgagggtgggc

SEQ ID NO: 6626500 - DNA, 19 bp, Homo sapiens
agaccttgagggtgggcca

SEQ ID NO: 6626501 - DNA, 20 bp, Homo sapiens
agaccttgcctcccctcctc

SEQ ID NO: 6626502 - DNA, 17 bp, Homo sapiens
agaccttgcgaccatgt

SEQ ID NO: 6626503 - DNA, 23 bp, Homo sapiens
agaccttggatcagatgaactct

SEQ ID NO: 6626504 - DNA, 18 bp, Homo sapiens
agaccttggctgctcact

SEQ ID NO: 6626505 - DNA, 14 bp, Homo sapiens
agaccttgtggtct

SEQ ID NO: 6626506 - DNA, 18 bp, Homo sapiens
agaccttgttacttctga

SEQ ID NO: 6626507 - DNA, 19 bp, Homo sapiens
agaccttgttacttctgag

SEQ ID NO: 6626508 - DNA, 22 bp, Homo sapiens
agaccttgttacttctgaggta

SEQ ID NO: 6626509 - DNA, 21 bp, Homo sapiens
agaccttgttcacactctcac

SEQ ID NO: 6626510 - DNA, 22 bp, Homo sapiens
agaccttgttcacactctcaca

SEQ ID NO: 6626511 - DNA, 12 bp, Homo sapiens
agacctttactg

SEQ ID NO: 6626512 - DNA, 13 bp, Homo sapiens
agacctttatcca

SEQ ID NO: 6626513 - DNA, 19 bp, Homo sapiens
agacctttattcacccctg

SEQ ID NO: 6626514 - DNA, 16 bp, Homo sapiens
agacctttcaaagcca

SEQ ID NO: 6626515 - DNA, 19 bp, Homo sapiens
agacctttcaaagccattt

SEQ ID NO: 6626516 - DNA, 23 bp, Homo sapiens
agacctttgatgaattcttcctc

SEQ ID NO: 6626517 - DNA, 16 bp, Homo sapiens
agacctttgcccacac

SEQ ID NO: 6626518 - DNA, 17 bp, Homo sapiens
agacctttgcccacaca

SEQ ID NO: 6626519 - DNA, 22 bp, Homo sapiens
agaccttttctctcccatacca

SEQ ID NO: 6626520 - DNA, 23 bp, Homo sapiens
agaccttttctctcccataccat

SEQ ID NO: 6626521 - DNA, 14 bp, Homo sapiens
agaccttttttagg

SEQ ID NO: 6626522 - DNA, 18 bp, Homo sapiens
agacgaaacatttgttct

SEQ ID NO: 6626523 - DNA, 22 bp, Homo sapiens
agacgaagagtttaaagagaaa

SEQ ID NO: 6626524 - DNA, 21 bp, Homo sapiens
agacgaatgccattggaacct

SEQ ID NO: 6626525 - DNA, 13 bp, Homo sapiens
agacgacaggcga

SEQ ID NO: 6626526 - DNA, 15 bp, Homo sapiens
agacgactagcccag

SEQ ID NO: 6626527 - DNA, 16 bp, Homo sapiens
agacgagacaacagca

SEQ ID NO: 6626528 - DNA, 21 bp, Homo sapiens
agacgagacaacagcacacag

SEQ ID NO: 6626529 - DNA, 12 bp, Homo sapiens
agacgagacagg

SEQ ID NO: 6626530 - DNA, 15 bp, Homo sapiens
agacgagaggacgag

SEQ ID NO: 6626531 - DNA, 13 bp, Homo sapiens
agacgaggcaggg

SEQ ID NO: 6626532 - DNA, 17 bp, Homo sapiens
agacgaggccctcgggc

SEQ ID NO: 6626533 - DNA, 12 bp, Homo sapiens
agacgaggggca

SEQ ID NO: 6626534 - DNA, 21 bp, Homo sapiens
agacgaggggcagggaaggac

SEQ ID NO: 6626535 - DNA, 20 bp, Homo sapiens
agacgatagttatctgttct

SEQ ID NO: 6626536 - DNA, 13 bp, Homo sapiens
agacgatgtttat

SEQ ID NO: 6626537 - DNA, 16 bp, Homo sapiens
agacgatttggggggg

SEQ ID NO: 6626538 - DNA, 15 bp, Homo sapiens
agacgcaccatgtgg

SEQ ID NO: 6626539 - DNA, 16 bp, Homo sapiens
agacgcaccttgctgc

SEQ ID NO: 6626540 - DNA, 17 bp, Homo sapiens
agacgcaccttgctgca

SEQ ID NO: 6626541 - DNA, 23 bp, Homo sapiens
agacgcactttggcttataattc

SEQ ID NO: 6626542 - DNA, 13 bp, Homo sapiens
agacgcagagcaa

SEQ ID NO: 6626543 - DNA, 22 bp, Homo sapiens
agacgcatagactgaggtataa

SEQ ID NO: 6626544 - DNA, 20 bp, Homo sapiens
agacgccaccattcctggaa

SEQ ID NO: 6626545 - DNA, 19 bp, Homo sapiens
agacgcccagccccatccc

SEQ ID NO: 6626546 - DNA, 14 bp, Homo sapiens
agacgcccctccca

SEQ ID NO: 6626547 - DNA, 13 bp, Homo sapiens
agacgcctgagga

SEQ ID NO: 6626548 - DNA, 14 bp, Homo sapiens
agacgccttactgg

SEQ ID NO: 6626549 - DNA, 19 bp, Homo sapiens
agacgccttcctctctgga

SEQ ID NO: 6626550 - DNA, 21 bp, Homo sapiens
agacgctaataaaaatttatt

SEQ ID NO: 6626551 - DNA, 20 bp, Homo sapiens
agacgctcaagaatcctctg

SEQ ID NO: 6626552 - DNA, 13 bp, Homo sapiens
agacgctcttttc

SEQ ID NO: 6626553 - DNA, 22 bp, Homo sapiens
agacgctgtgctgccctgccca

SEQ ID NO: 6626554 - DNA, 14 bp, Homo sapiens
agacggaacagtgt

SEQ ID NO: 6626555 - DNA, 18 bp, Homo sapiens
agacggaagggtaaacaa

SEQ ID NO: 6626556 - DNA, 23 bp, Homo sapiens
agacggaagtaaattatgatgtc

SEQ ID NO: 6626557 - DNA, 22 bp, Homo sapiens
agacggagccctggcatgtcaa

SEQ ID NO: 6626558 - DNA, 14 bp, Homo sapiens
agacggaggaagcc

SEQ ID NO: 6626559 - DNA, 17 bp, Homo sapiens
agacggaggaggggaag

SEQ ID NO: 6626560 - DNA, 21 bp, Homo sapiens
agacggaggaggggaaggggc

SEQ ID NO: 6626561 - DNA, 18 bp, Homo sapiens
agacggagtctcagtctg

SEQ ID NO: 6626562 - DNA, 20 bp, Homo sapiens
agacggagtctcgctctgtc

SEQ ID NO: 6626563 - DNA, 17 bp, Homo sapiens
agacggatactggggag

SEQ ID NO: 6626564 - DNA, 22 bp, Homo sapiens
agacggatgcccattcctgcct

SEQ ID NO: 6626565 - DNA, 20 bp, Homo sapiens
agacggatggaaggagagag

SEQ ID NO: 6626566 - DNA, 13 bp, Homo sapiens
agacggatggcag

SEQ ID NO: 6626567 - DNA, 19 bp, Homo sapiens
agacggatggcaggatcca

SEQ ID NO: 6626568 - DNA, 22 bp, Homo sapiens
agacggcagagaccccaggatc

SEQ ID NO: 6626569 - DNA, 13 bp, Homo sapiens
agacggcagcccc

SEQ ID NO: 6626570 - DNA, 14 bp, Homo sapiens
agacggcagcccca

SEQ ID NO: 6626571 - DNA, 13 bp, Homo sapiens
agacggccctgct

SEQ ID NO: 6626572 - DNA, 22 bp, Homo sapiens
agacggccggccggacctctga

SEQ ID NO: 6626573 - DNA, 12 bp, Homo sapiens
agacggcctagg

SEQ ID NO: 6626574 - DNA, 14 bp, Homo sapiens
agacggcggccagg

SEQ ID NO: 6626575 - DNA, 21 bp, Homo sapiens
agacggcggccaggcacaggg

SEQ ID NO: 6626576 - DNA, 13 bp, Homo sapiens
agacgggaatgcc

SEQ ID NO: 6626577 - DNA, 23 bp, Homo sapiens
agacgggatttgaagctgtaccc

SEQ ID NO: 6626578 - DNA, 11 bp, Homo sapiens
agacgggcaca

SEQ ID NO: 6626579 - DNA, 16 bp, Homo sapiens
agacgggctgagagga

SEQ ID NO: 6626580 - DNA, 13 bp, Homo sapiens
agacggggctgga

SEQ ID NO: 6626581 - DNA, 18 bp, Homo sapiens
agacgggggcagagaggg

SEQ ID NO: 6626582 - DNA, 21 bp, Homo sapiens
agacgggtattgttgggaaag

SEQ ID NO: 6626583 - DNA, 15 bp, Homo sapiens
agacggtgttgcaga

SEQ ID NO: 6626584 - DNA, 16 bp, Homo sapiens
agacggtgttttgcca

SEQ ID NO: 6626585 - DNA, 21 bp, Homo sapiens
agacggtgttttgccatgttg

SEQ ID NO: 6626586 - DNA, 16 bp, Homo sapiens
agacggtttccaggga

SEQ ID NO: 6626587 - DNA, 16 bp, Homo sapiens
agacgtatgcttattt

SEQ ID NO: 6626588 - DNA, 20 bp, Homo sapiens
agacgtctggccctggcggg

SEQ ID NO: 6626589 - DNA, 12 bp, Homo sapiens
agacgtgaatgt

SEQ ID NO: 6626590 - DNA, 21 bp, Homo sapiens
agacgtgatgggctaggcctc

SEQ ID NO: 6626591 - DNA, 17 bp, Homo sapiens
agacgtggactcctctt

SEQ ID NO: 6626592 - DNA, 16 bp, Homo sapiens
agacgtggtctagacc

SEQ ID NO: 6626593 - DNA, 19 bp, Homo sapiens
agacgtggtctagaccagg

SEQ ID NO: 6626594 - DNA, 16 bp, Homo sapiens
agacgtttaactgcag

SEQ ID NO: 6626595 - DNA, 13 bp, Homo sapiens
agacgtttataaa

SEQ ID NO: 6626596 - DNA, 16 bp, Homo sapiens
agacgtttataaacag

SEQ ID NO: 6626597 - DNA, 18 bp, Homo sapiens
agacgtttggactgattt

SEQ ID NO: 6626598 - DNA, 13 bp, Homo sapiens
agactaaatgaaa

SEQ ID NO: 6626599 - DNA, 22 bp, Homo sapiens
agactaaatgagaggaaaagaa

SEQ ID NO: 6626600 - DNA, 18 bp, Homo sapiens
agactaacaaaggcagct

SEQ ID NO: 6626601 - DNA, 15 bp, Homo sapiens
agactaacctgccca

SEQ ID NO: 6626602 - DNA, 17 bp, Homo sapiens
agactaagagaaacctt

SEQ ID NO: 6626603 - DNA, 21 bp, Homo sapiens
agactaagatcggttaacaaa

SEQ ID NO: 6626604 - DNA, 20 bp, Homo sapiens
agactaaggggcagctcctg

SEQ ID NO: 6626605 - DNA, 19 bp, Homo sapiens
agactaatagagacacaga

SEQ ID NO: 6626606 - DNA, 20 bp, Homo sapiens
agactaatagagacacagag

SEQ ID NO: 6626607 - DNA, 22 bp, Homo sapiens
agactaattaaaatctggaaat

SEQ ID NO: 6626608 - DNA, 19 bp, Homo sapiens
agactaattcctgccctgc

SEQ ID NO: 6626609 - DNA, 14 bp, Homo sapiens
agactaatttaaaa

SEQ ID NO: 6626610 - DNA, 15 bp, Homo sapiens
agactaatttaaaaa

SEQ ID NO: 6626611 - DNA, 15 bp, Homo sapiens
agactacagccagaa

SEQ ID NO: 6626612 - DNA, 19 bp, Homo sapiens
agactacagccagaagccc

SEQ ID NO: 6626613 - DNA, 16 bp, Homo sapiens
agactactaaggcctt

SEQ ID NO: 6626614 - DNA, 18 bp, Homo sapiens
agactactattttctttt

SEQ ID NO: 6626615 - DNA, 13 bp, Homo sapiens
agactactcaata

SEQ ID NO: 6626616 - DNA, 14 bp, Homo sapiens
agactactctgcct

SEQ ID NO: 6626617 - DNA, 15 bp, Homo sapiens
agactactgttcagc

SEQ ID NO: 6626618 - DNA, 17 bp, Homo sapiens
agactagacaaataact

SEQ ID NO: 6626619 - DNA, 19 bp, Homo sapiens
agactagacaccttctgtg

SEQ ID NO: 6626620 - DNA, 15 bp, Homo sapiens
agactagagcaaaat

SEQ ID NO: 6626621 - DNA, 20 bp, Homo sapiens
agactagagcaaaataatgc

SEQ ID NO: 6626622 - DNA, 16 bp, Homo sapiens
agactagatggacctg

SEQ ID NO: 6626623 - DNA, 14 bp, Homo sapiens
agactagatgtagt

SEQ ID NO: 6626624 - DNA, 18 bp, Homo sapiens
agactagattctcacctg

SEQ ID NO: 6626625 - DNA, 15 bp, Homo sapiens
agactagcctggcca

SEQ ID NO: 6626626 - DNA, 21 bp, Homo sapiens
agactaggagaccagaagtga

SEQ ID NO: 6626627 - DNA, 22 bp, Homo sapiens
agactaggataatgtccaacta

SEQ ID NO: 6626628 - DNA, 18 bp, Homo sapiens
agactaggatagcttcat

SEQ ID NO: 6626629 - DNA, 12 bp, Homo sapiens
agactaggttta

SEQ ID NO: 6626630 - DNA, 15 bp, Homo sapiens
agactagtgctttac

SEQ ID NO: 6626631 - DNA, 21 bp, Homo sapiens
agactagttatatattcctta

SEQ ID NO: 6626632 - DNA, 22 bp, Homo sapiens
agactagtttgttattaatcca

SEQ ID NO: 6626633 - DNA, 13 bp, Homo sapiens
agactataaataa

SEQ ID NO: 6626634 - DNA, 18 bp, Homo sapiens
agactatatacatgtgtg

SEQ ID NO: 6626635 - DNA, 19 bp, Homo sapiens
agactatatatataaatgt

SEQ ID NO: 6626636 - DNA, 15 bp, Homo sapiens
agactatcagcccaa

SEQ ID NO: 6626637 - DNA, 17 bp, Homo sapiens
agactatccattttaca

SEQ ID NO: 6626638 - DNA, 15 bp, Homo sapiens
agactatctaaatgt

SEQ ID NO: 6626639 - DNA, 14 bp, Homo sapiens
agactatctacaaa

SEQ ID NO: 6626640 - DNA, 17 bp, Homo sapiens
agactatcttactattt

SEQ ID NO: 6626641 - DNA, 21 bp, Homo sapiens
agactatggagcctggcacag

SEQ ID NO: 6626642 - DNA, 17 bp, Homo sapiens
agactatggcctcgcct

SEQ ID NO: 6626643 - DNA, 18 bp, Homo sapiens
agactatggcctcgcctc

SEQ ID NO: 6626644 - DNA, 20 bp, Homo sapiens
agactatgtgtcatgatttc

SEQ ID NO: 6626645 - DNA, 18 bp, Homo sapiens
agactattcaaacagtct

SEQ ID NO: 6626646 - DNA, 20 bp, Homo sapiens
agactattcaaacagtctca

SEQ ID NO: 6626647 - DNA, 19 bp, Homo sapiens
agactatttaaacttataa

SEQ ID NO: 6626648 - DNA, 17 bp, Homo sapiens
agactatttaacttgag

SEQ ID NO: 6626649 - DNA, 18 bp, Homo sapiens
agactatttaacttgagg

SEQ ID NO: 6626650 - DNA, 13 bp, Homo sapiens
agactatttaagt

SEQ ID NO: 6626651 - DNA, 14 bp, Homo sapiens
agactatttaagta

SEQ ID NO: 6626652 - DNA, 12 bp, Homo sapiens
agactatttctt

SEQ ID NO: 6626653 - DNA, 13 bp, Homo sapiens
agactatttcttt

SEQ ID NO: 6626654 - DNA, 16 bp, Homo sapiens
agactatttcttttta

SEQ ID NO: 6626655 - DNA, 18 bp, Homo sapiens
agactatttgctaatgta

SEQ ID NO: 6626656 - DNA, 13 bp, Homo sapiens
agactattttcta

SEQ ID NO: 6626657 - DNA, 20 bp, Homo sapiens
agactattttctattttccc

SEQ ID NO: 6626658 - DNA, 21 bp, Homo sapiens
agactatttttagattttctt

SEQ ID NO: 6626659 - DNA, 15 bp, Homo sapiens
agactcaaaacctgg

SEQ ID NO: 6626660 - DNA, 22 bp, Homo sapiens
agactcaaaacctggagatgca

SEQ ID NO: 6626661 - DNA, 16 bp, Homo sapiens
agactcaaaccacatg

SEQ ID NO: 6626662 - DNA, 13 bp, Homo sapiens
agactcaaatgct

SEQ ID NO: 6626663 - DNA, 16 bp, Homo sapiens
agactcaaatgttcta

SEQ ID NO: 6626664 - DNA, 17 bp, Homo sapiens
agactcaaatgttctaa

SEQ ID NO: 6626665 - DNA, 20 bp, Homo sapiens
agactcaaatgttctaagtt

SEQ ID NO: 6626666 - DNA, 17 bp, Homo sapiens
agactcaagcctcccca

SEQ ID NO: 6626667 - DNA, 15 bp, Homo sapiens
agactcaaggggctg

SEQ ID NO: 6626668 - DNA, 22 bp, Homo sapiens
agactcaaggtggtcagtaaat

SEQ ID NO: 6626669 - DNA, 12 bp, Homo sapiens
agactcaatcat

SEQ ID NO: 6626670 - DNA, 18 bp, Homo sapiens
agactcaatgtccccctc

SEQ ID NO: 6626671 - DNA, 14 bp, Homo sapiens
agactcaatgtgct

SEQ ID NO: 6626672 - DNA, 18 bp, Homo sapiens
agactcacactctctgca

SEQ ID NO: 6626673 - DNA, 19 bp, Homo sapiens
agactcacactctctgcag

SEQ ID NO: 6626674 - DNA, 21 bp, Homo sapiens
agactcacactctctgcagcc

SEQ ID NO: 6626675 - DNA, 14 bp, Homo sapiens
agactcacctctgc

SEQ ID NO: 6626676 - DNA, 15 bp, Homo sapiens
agactcacctctgcc

SEQ ID NO: 6626677 - DNA, 16 bp, Homo sapiens
agactcacctctgcct

SEQ ID NO: 6626678 - DNA, 18 bp, Homo sapiens
agactcacctctgcctca

SEQ ID NO: 6626679 - DNA, 14 bp, Homo sapiens
agactcacttacat

SEQ ID NO: 6626680 - DNA, 18 bp, Homo sapiens
agactcacttacatcttc

SEQ ID NO: 6626681 - DNA, 21 bp, Homo sapiens
agactcacttctcagctgaaa

SEQ ID NO: 6626682 - DNA, 17 bp, Homo sapiens
agactcagagctctctc

SEQ ID NO: 6626683 - DNA, 21 bp, Homo sapiens
agactcagaggacccacctgg

SEQ ID NO: 6626684 - DNA, 16 bp, Homo sapiens
agactcagaggtccag

SEQ ID NO: 6626685 - DNA, 12 bp, Homo sapiens
agactcagcaga

SEQ ID NO: 6626686 - DNA, 17 bp, Homo sapiens
agactcagcagagtgag

SEQ ID NO: 6626687 - DNA, 11 bp, Homo sapiens
agactcagcca

SEQ ID NO: 6626688 - DNA, 13 bp, Homo sapiens
agactcagcctct

SEQ ID NO: 6626689 - DNA, 14 bp, Homo sapiens
agactcagcctctg

SEQ ID NO: 6626690 - DNA, 16 bp, Homo sapiens
agactcagcctctgct

SEQ ID NO: 6626691 - DNA, 19 bp, Homo sapiens
agactcagcctctgctgga

SEQ ID NO: 6626692 - DNA, 14 bp, Homo sapiens
agactcagcctgca

SEQ ID NO: 6626693 - DNA, 19 bp, Homo sapiens
agactcagcgctcctcctg

SEQ ID NO: 6626694 - DNA, 20 bp, Homo sapiens
agactcagcgctcctcctgt

SEQ ID NO: 6626695 - DNA, 13 bp, Homo sapiens
agactcagctctg

SEQ ID NO: 6626696 - DNA, 20 bp, Homo sapiens
agactcagctctgacattct

SEQ ID NO: 6626697 - DNA, 15 bp, Homo sapiens
agactcagctgctat

SEQ ID NO: 6626698 - DNA, 20 bp, Homo sapiens
agactcagctgctatactta

SEQ ID NO: 6626699 - DNA, 22 bp, Homo sapiens
agactcagctgctatacttatc

SEQ ID NO: 6626700 - DNA, 23 bp, Homo sapiens
agactcagctggaagtctacctg

SEQ ID NO: 6626701 - DNA, 20 bp, Homo sapiens
agactcaggcccacattgcc

SEQ ID NO: 6626702 - DNA, 13 bp, Homo sapiens
agactcaggttcc

SEQ ID NO: 6626703 - DNA, 20 bp, Homo sapiens
agactcaggttccagaacag

SEQ ID NO: 6626704 - DNA, 22 bp, Homo sapiens
agactcaggttgtagtaaagaa

SEQ ID NO: 6626705 - DNA, 23 bp, Homo sapiens
agactcagtatgctttccctgag

SEQ ID NO: 6626706 - DNA, 13 bp, Homo sapiens
agactcagtgttc

SEQ ID NO: 6626707 - DNA, 16 bp, Homo sapiens
agactcagtttgtcag

SEQ ID NO: 6626708 - DNA, 17 bp, Homo sapiens
agactcagtttgtcaga

SEQ ID NO: 6626709 - DNA, 21 bp, Homo sapiens
agactcagtttgtcagacttt

SEQ ID NO: 6626710 - DNA, 22 bp, Homo sapiens
agactcatattactggtaggaa

SEQ ID NO: 6626711 - DNA, 21 bp, Homo sapiens
agactcatcctgaacagcatg

SEQ ID NO: 6626712 - DNA, 22 bp, Homo sapiens
agactcatcctgaacagcatgg

SEQ ID NO: 6626713 - DNA, 16 bp, Homo sapiens
agactcatcttactgt

SEQ ID NO: 6626714 - DNA, 17 bp, Homo sapiens
agactcatcttactgta

SEQ ID NO: 6626715 - DNA, 13 bp, Homo sapiens
agactcatctttt

SEQ ID NO: 6626716 - DNA, 17 bp, Homo sapiens
agactcattgctggagg

SEQ ID NO: 6626717 - DNA, 13 bp, Homo sapiens
agactccaaagaa

SEQ ID NO: 6626718 - DNA, 20 bp, Homo sapiens
agactccaatggggccagca

SEQ ID NO: 6626719 - DNA, 22 bp, Homo sapiens
agactccaatggggccagcact

SEQ ID NO: 6626720 - DNA, 18 bp, Homo sapiens
agactccagacctgaggc

SEQ ID NO: 6626721 - DNA, 13 bp, Homo sapiens
agactccaggccc

SEQ ID NO: 6626722 - DNA, 14 bp, Homo sapiens
agactccaggcccc

SEQ ID NO: 6626723 - DNA, 18 bp, Homo sapiens
agactccatctcttctgc

SEQ ID NO: 6626724 - DNA, 16 bp, Homo sapiens
agactcccaagctgga

SEQ ID NO: 6626725 - DNA, 16 bp, Homo sapiens
agactcccatgaagcc

SEQ ID NO: 6626726 - DNA, 21 bp, Homo sapiens
agactcccatgaagccttttg

SEQ ID NO: 6626727 - DNA, 16 bp, Homo sapiens
agactcccatgaggga

SEQ ID NO: 6626728 - DNA, 17 bp, Homo sapiens
agactcccattcctgaa

SEQ ID NO: 6626729 - DNA, 19 bp, Homo sapiens
agactcccattcctgaaga

SEQ ID NO: 6626730 - DNA, 22 bp, Homo sapiens
agactcccgccccgggctggcc

SEQ ID NO: 6626731 - DNA, 17 bp, Homo sapiens
agactccctgatcccag

SEQ ID NO: 6626732 - DNA, 19 bp, Homo sapiens
agactccggcctgtaatca

SEQ ID NO: 6626733 - DNA, 14 bp, Homo sapiens
agactcctaggcag

SEQ ID NO: 6626734 - DNA, 13 bp, Homo sapiens
agactcctcagca

SEQ ID NO: 6626735 - DNA, 15 bp, Homo sapiens
agactcctcagcacc

SEQ ID NO: 6626736 - DNA, 14 bp, Homo sapiens
agactcctcctggg

SEQ ID NO: 6626737 - DNA, 21 bp, Homo sapiens
agactcctcctgggggctggc

SEQ ID NO: 6626738 - DNA, 22 bp, Homo sapiens
agactcctcctgggggctggct

SEQ ID NO: 6626739 - DNA, 12 bp, Homo sapiens
agactcctctgg

SEQ ID NO: 6626740 - DNA, 15 bp, Homo sapiens
agactcctcttccca

SEQ ID NO: 6626741 - DNA, 20 bp, Homo sapiens
agactcctgaggacagctgt

SEQ ID NO: 6626742 - DNA, 14 bp, Homo sapiens
agactcctgcaggc

SEQ ID NO: 6626743 - DNA, 16 bp, Homo sapiens
agactcctgcaggcag

SEQ ID NO: 6626744 - DNA, 17 bp, Homo sapiens
agactcctgcaggcagc

SEQ ID NO: 6626745 - DNA, 14 bp, Homo sapiens
agactcctgccctg

SEQ ID NO: 6626746 - DNA, 15 bp, Homo sapiens
agactcctgccctgt

SEQ ID NO: 6626747 - DNA, 14 bp, Homo sapiens
agactcctgtccct

SEQ ID NO: 6626748 - DNA, 18 bp, Homo sapiens
agactccttcgtccccag

SEQ ID NO: 6626749 - DNA, 15 bp, Homo sapiens
agactcctttcctct

SEQ ID NO: 6626750 - DNA, 22 bp, Homo sapiens
agactcctttcctgcatctttc

SEQ ID NO: 6626751 - DNA, 23 bp, Homo sapiens
agactcctttcctgcatctttca

SEQ ID NO: 6626752 - DNA, 13 bp, Homo sapiens
agactcgagaacc

SEQ ID NO: 6626753 - DNA, 15 bp, Homo sapiens
agactcgagaacttt

SEQ ID NO: 6626754 - DNA, 19 bp, Homo sapiens
agactcgagagggctgagc

SEQ ID NO: 6626755 - DNA, 17 bp, Homo sapiens
agactcgagtccccatg

SEQ ID NO: 6626756 - DNA, 20 bp, Homo sapiens
agactcgattcatattgaat

SEQ ID NO: 6626757 - DNA, 23 bp, Homo sapiens
agactcgattcatattgaatata

SEQ ID NO: 6626758 - DNA, 19 bp, Homo sapiens
agactcgccaacatggtga

SEQ ID NO: 6626759 - DNA, 18 bp, Homo sapiens
agactcgcctatcttagg

SEQ ID NO: 6626760 - DNA, 18 bp, Homo sapiens
agactcgcgacaatgcaa

SEQ ID NO: 6626761 - DNA, 21 bp, Homo sapiens
agactcgcgacaatgcaaacc

SEQ ID NO: 6626762 - DNA, 18 bp, Homo sapiens
agactcggaatctatttt

SEQ ID NO: 6626763 - DNA, 15 bp, Homo sapiens
agactcggccgcagc

SEQ ID NO: 6626764 - DNA, 18 bp, Homo sapiens
agactcggccgcagcggc

SEQ ID NO: 6626765 - DNA, 22 bp, Homo sapiens
agactctaaaactatcagcagc

SEQ ID NO: 6626766 - DNA, 22 bp, Homo sapiens
agactctaaacacacaagtaga

SEQ ID NO: 6626767 - DNA, 18 bp, Homo sapiens
agactctaaatatttcat

SEQ ID NO: 6626768 - DNA, 20 bp, Homo sapiens
agactctaaatatttcatga

SEQ ID NO: 6626769 - DNA, 16 bp, Homo sapiens
agactctaagaaagaa

SEQ ID NO: 6626770 - DNA, 16 bp, Homo sapiens
agactctagagtccaa

SEQ ID NO: 6626771 - DNA, 14 bp, Homo sapiens
agactctagatgtt

SEQ ID NO: 6626772 - DNA, 19 bp, Homo sapiens
agactctagatgtttagat

SEQ ID NO: 6626773 - DNA, 15 bp, Homo sapiens
agactctagggtcca

SEQ ID NO: 6626774 - DNA, 11 bp, Homo sapiens
agactctcagc

SEQ ID NO: 6626775 - DNA, 16 bp, Homo sapiens
agactctcagcccaga

SEQ ID NO: 6626776 - DNA, 17 bp, Homo sapiens
agactctcagcccagaa

SEQ ID NO: 6626777 - DNA, 18 bp, Homo sapiens
agactctcagcccagaag

SEQ ID NO: 6626778 - DNA, 15 bp, Homo sapiens
agactctcaggtgga

SEQ ID NO: 6626779 - DNA, 17 bp, Homo sapiens
agactctccactgacct

SEQ ID NO: 6626780 - DNA, 16 bp, Homo sapiens
agactctctagtttta

SEQ ID NO: 6626781 - DNA, 14 bp, Homo sapiens
agactctctcctct

SEQ ID NO: 6626782 - DNA, 16 bp, Homo sapiens
agactctgaaatctca

SEQ ID NO: 6626783 - DNA, 12 bp, Homo sapiens
agactctgagcc

SEQ ID NO: 6626784 - DNA, 15 bp, Homo sapiens
agactctgagccaag

SEQ ID NO: 6626785 - DNA, 18 bp, Homo sapiens
agactctgagccaaggga

SEQ ID NO: 6626786 - DNA, 20 bp, Homo sapiens
agactctgagccaagggagg

SEQ ID NO: 6626787 - DNA, 23 bp, Homo sapiens
agactctgatggaatgtgccacc

SEQ ID NO: 6626788 - DNA, 12 bp, Homo sapiens
agactctggaag

SEQ ID NO: 6626789 - DNA, 13 bp, Homo sapiens
agactctggaagc

SEQ ID NO: 6626790 - DNA, 22 bp, Homo sapiens
agactctggagccaaggcagag

SEQ ID NO: 6626791 - DNA, 12 bp, Homo sapiens
agactctggagg

SEQ ID NO: 6626792 - DNA, 18 bp, Homo sapiens
agactctgtctcaaaaaa

SEQ ID NO: 6626793 - DNA, 18 bp, Homo sapiens
agactctgtgagattcta

SEQ ID NO: 6626794 - DNA, 13 bp, Homo sapiens
agactctgtgatc

SEQ ID NO: 6626795 - DNA, 15 bp, Homo sapiens
agactctgtgatcta

SEQ ID NO: 6626796 - DNA, 13 bp, Homo sapiens
agactctgtgtgg

SEQ ID NO: 6626797 - DNA, 22 bp, Homo sapiens
agactcttacgtggagagtgca

SEQ ID NO: 6626798 - DNA, 22 bp, Homo sapiens
agactcttgcctgtttcccagg

SEQ ID NO: 6626799 - DNA, 15 bp, Homo sapiens
agactcttgctcctg

SEQ ID NO: 6626800 - DNA, 22 bp, Homo sapiens
agactcttggggaagcgggtgg

SEQ ID NO: 6626801 - DNA, 20 bp, Homo sapiens
agactctttaataaattgct

SEQ ID NO: 6626802 - DNA, 20 bp, Homo sapiens
agactctttatttttctctt

SEQ ID NO: 6626803 - DNA, 15 bp, Homo sapiens
agactctttgcatat

SEQ ID NO: 6626804 - DNA, 21 bp, Homo sapiens
agactcttttccttccctttt

SEQ ID NO: 6626805 - DNA, 18 bp, Homo sapiens
agactctttttttgagtg

SEQ ID NO: 6626806 - DNA, 18 bp, Homo sapiens
agactgaaacgccttgca

SEQ ID NO: 6626807 - DNA, 16 bp, Homo sapiens
agactgaaagaaacta

SEQ ID NO: 6626808 - DNA, 23 bp, Homo sapiens
agactgaaagaaactaagattta

SEQ ID NO: 6626809 - DNA, 17 bp, Homo sapiens
agactgaactcgcaggg

SEQ ID NO: 6626810 - DNA, 15 bp, Homo sapiens
agactgaagatttat

SEQ ID NO: 6626811 - DNA, 22 bp, Homo sapiens
agactgaatagatatgaaagct

SEQ ID NO: 6626812 - DNA, 13 bp, Homo sapiens
agactgaatgttt

SEQ ID NO: 6626813 - DNA, 20 bp, Homo sapiens
agactgaatgttttatttat

SEQ ID NO: 6626814 - DNA, 12 bp, Homo sapiens
agactgaattta

SEQ ID NO: 6626815 - DNA, 12 bp, Homo sapiens
agactgaccaat

SEQ ID NO: 6626816 - DNA, 21 bp, Homo sapiens
agactgaccaatattgtacag

SEQ ID NO: 6626817 - DNA, 20 bp, Homo sapiens
agactgactcacattgcctt

SEQ ID NO: 6626818 - DNA, 19 bp, Homo sapiens
agactgactggcaccaaca

SEQ ID NO: 6626819 - DNA, 19 bp, Homo sapiens
agactgagaggcagaagtc

SEQ ID NO: 6626820 - DNA, 16 bp, Homo sapiens
agactgagcacctgct

SEQ ID NO: 6626821 - DNA, 17 bp, Homo sapiens
agactgagcacctgctt

SEQ ID NO: 6626822 - DNA, 17 bp, Homo sapiens
agactgagccagattgg

SEQ ID NO: 6626823 - DNA, 13 bp, Homo sapiens
agactgagctcaa

SEQ ID NO: 6626824 - DNA, 15 bp, Homo sapiens
agactgagctctcca

SEQ ID NO: 6626825 - DNA, 17 bp, Homo sapiens
agactgagctctccagg

SEQ ID NO: 6626826 - DNA, 16 bp, Homo sapiens
agactgaggacaaagt

SEQ ID NO: 6626827 - DNA, 13 bp, Homo sapiens
agactgagggaga

SEQ ID NO: 6626828 - DNA, 19 bp, Homo sapiens
agactgaggtataaagaca

SEQ ID NO: 6626829 - DNA, 20 bp, Homo sapiens
agactgagtacgttgtgcat

SEQ ID NO: 6626830 - DNA, 23 bp, Homo sapiens
agactgagtacgttgtgcatttg

SEQ ID NO: 6626831 - DNA, 17 bp, Homo sapiens
agactgagtcagatggg

SEQ ID NO: 6626832 - DNA, 23 bp, Homo sapiens
agactgataacaaccttttacat

SEQ ID NO: 6626833 - DNA, 15 bp, Homo sapiens
agactgataatttta

SEQ ID NO: 6626834 - DNA, 18 bp, Homo sapiens
agactgataattttacaa

SEQ ID NO: 6626835 - DNA, 14 bp, Homo sapiens
agactgatcaggac

SEQ ID NO: 6626836 - DNA, 16 bp, Homo sapiens
agactgatcaggacct

SEQ ID NO: 6626837 - DNA, 21 bp, Homo sapiens
agactgatcatccaggcctca

SEQ ID NO: 6626838 - DNA, 19 bp, Homo sapiens
agactgatccaaaaattat

SEQ ID NO: 6626839 - DNA, 20 bp, Homo sapiens
agactgatctcgatgcaggt

SEQ ID NO: 6626840 - DNA, 19 bp, Homo sapiens
agactgatggaacagaata

SEQ ID NO: 6626841 - DNA, 15 bp, Homo sapiens
agactgatggccagg

SEQ ID NO: 6626842 - DNA, 12 bp, Homo sapiens
agactgattacc

SEQ ID NO: 6626843 - DNA, 21 bp, Homo sapiens
agactgattgattattcaaca

SEQ ID NO: 6626844 - DNA, 15 bp, Homo sapiens
agactgcaaactttt

SEQ ID NO: 6626845 - DNA, 16 bp, Homo sapiens
agactgcaaacttttt

SEQ ID NO: 6626846 - DNA, 14 bp, Homo sapiens
agactgcaagaact

SEQ ID NO: 6626847 - DNA, 23 bp, Homo sapiens
agactgcaagagatggaaaaaaa

SEQ ID NO: 6626848 - DNA, 15 bp, Homo sapiens
agactgcaagctgct

SEQ ID NO: 6626849 - DNA, 16 bp, Homo sapiens
agactgcaagctgctt

SEQ ID NO: 6626850 - DNA, 13 bp, Homo sapiens
agactgcagagga

SEQ ID NO: 6626851 - DNA, 14 bp, Homo sapiens
agactgcagaggag

SEQ ID NO: 6626852 - DNA, 21 bp, Homo sapiens
agactgcagaggggaaagact

SEQ ID NO: 6626853 - DNA, 15 bp, Homo sapiens
agactgcagctgctg

SEQ ID NO: 6626854 - DNA, 16 bp, Homo sapiens
agactgcagctgctga

SEQ ID NO: 6626855 - DNA, 18 bp, Homo sapiens
agactgcaggttggaccc

SEQ ID NO: 6626856 - DNA, 21 bp, Homo sapiens
agactgcaggttggaccccag

SEQ ID NO: 6626857 - DNA, 23 bp, Homo sapiens
agactgcatcccgtacctcttcc

SEQ ID NO: 6626858 - DNA, 17 bp, Homo sapiens
agactgcattatattta

SEQ ID NO: 6626859 - DNA, 21 bp, Homo sapiens
agactgcattatatttattac

SEQ ID NO: 6626860 - DNA, 22 bp, Homo sapiens
agactgccacaaggaagaaatt

SEQ ID NO: 6626861 - DNA, 14 bp, Homo sapiens
agactgccaggtgg

SEQ ID NO: 6626862 - DNA, 14 bp, Homo sapiens
agactgccatacat

SEQ ID NO: 6626863 - DNA, 11 bp, Homo sapiens
agactgcccac

SEQ ID NO: 6626864 - DNA, 16 bp, Homo sapiens
agactgcccaccctgg

SEQ ID NO: 6626865 - DNA, 23 bp, Homo sapiens
agactgccccacggagacagagg

SEQ ID NO: 6626866 - DNA, 14 bp, Homo sapiens
agactgccctgccc

SEQ ID NO: 6626867 - DNA, 15 bp, Homo sapiens
agactgcctccctct

SEQ ID NO: 6626868 - DNA, 23 bp, Homo sapiens
agactgccttatattattttctg

SEQ ID NO: 6626869 - DNA, 15 bp, Homo sapiens
agactgccttctcca

SEQ ID NO: 6626870 - DNA, 13 bp, Homo sapiens
agactgcggagca

SEQ ID NO: 6626871 - DNA, 23 bp, Homo sapiens
agactgcgggatggtcctggggc

SEQ ID NO: 6626872 - DNA, 20 bp, Homo sapiens
agactgcgtgttgtttttcc

SEQ ID NO: 6626873 - DNA, 14 bp, Homo sapiens
agactgctcagatt

SEQ ID NO: 6626874 - DNA, 21 bp, Homo sapiens
agactgctcccggcccgcctg

SEQ ID NO: 6626875 - DNA, 17 bp, Homo sapiens
agactgctcctgagccc

SEQ ID NO: 6626876 - DNA, 20 bp, Homo sapiens
agactgctcctgagccccca

SEQ ID NO: 6626877 - DNA, 20 bp, Homo sapiens
agactgctgctgaatttata

SEQ ID NO: 6626878 - DNA, 19 bp, Homo sapiens
agactgctgggactggcca

SEQ ID NO: 6626879 - DNA, 17 bp, Homo sapiens
agactgctgtggccagg

SEQ ID NO: 6626880 - DNA, 20 bp, Homo sapiens
agactgctgtggccaggagg

SEQ ID NO: 6626881 - DNA, 20 bp, Homo sapiens
agactgctgtgtttgagctc

SEQ ID NO: 6626882 - DNA, 23 bp, Homo sapiens
agactgcttcccatcctaccctc

SEQ ID NO: 6626883 - DNA, 15 bp, Homo sapiens
agactgcttgacaaa

SEQ ID NO: 6626884 - DNA, 20 bp, Homo sapiens
agactgcttggccagatgcg

SEQ ID NO: 6626885 - DNA, 16 bp, Homo sapiens
agactgctttgagaaa

SEQ ID NO: 6626886 - DNA, 16 bp, Homo sapiens
agactggaaaatagtc

SEQ ID NO: 6626887 - DNA, 18 bp, Homo sapiens
agactggaagacacttca

SEQ ID NO: 6626888 - DNA, 16 bp, Homo sapiens
agactggaagcacagc

SEQ ID NO: 6626889 - DNA, 21 bp, Homo sapiens
agactggaagctaatttgcat

SEQ ID NO: 6626890 - DNA, 14 bp, Homo sapiens
agactggaagttca

SEQ ID NO: 6626891 - DNA, 21 bp, Homo sapiens
agactggaagttcatacctaa

SEQ ID NO: 6626892 - DNA, 16 bp, Homo sapiens
agactggacagcttgt

SEQ ID NO: 6626893 - DNA, 17 bp, Homo sapiens
agactggacagcttgtg

SEQ ID NO: 6626894 - DNA, 23 bp, Homo sapiens
agactggagaaaacccctcccac

SEQ ID NO: 6626895 - DNA, 11 bp, Homo sapiens
agactggaggg

SEQ ID NO: 6626896 - DNA, 13 bp, Homo sapiens
agactggagggga

SEQ ID NO: 6626897 - DNA, 22 bp, Homo sapiens
agactggagggttgagacccag

SEQ ID NO: 6626898 - DNA, 22 bp, Homo sapiens
agactggaggtcgaagcaatca

SEQ ID NO: 6626899 - DNA, 14 bp, Homo sapiens
agactggagtgagg

SEQ ID NO: 6626900 - DNA, 21 bp, Homo sapiens
agactggagtgaggcttccag

SEQ ID NO: 6626901 - DNA, 16 bp, Homo sapiens
agactggatactgccc

SEQ ID NO: 6626902 - DNA, 16 bp, Homo sapiens
agactggatggaaact

SEQ ID NO: 6626903 - DNA, 15 bp, Homo sapiens
agactggcacagttt

SEQ ID NO: 6626904 - DNA, 14 bp, Homo sapiens
agactggcagccag

SEQ ID NO: 6626905 - DNA, 17 bp, Homo sapiens
agactggcagccaggga

SEQ ID NO: 6626906 - DNA, 22 bp, Homo sapiens
agactggcagccagggagcccg

SEQ ID NO: 6626907 - DNA, 11 bp, Homo sapiens
agactggcagg

SEQ ID NO: 6626908 - DNA, 19 bp, Homo sapiens
agactggccgggcaggcgt

SEQ ID NO: 6626909 - DNA, 11 bp, Homo sapiens
agactggcctg

SEQ ID NO: 6626910 - DNA, 22 bp, Homo sapiens
agactggcgtgaacccaggagg

SEQ ID NO: 6626911 - DNA, 17 bp, Homo sapiens
agactggctgcacagcc

SEQ ID NO: 6626912 - DNA, 19 bp, Homo sapiens
agactggctgcacagccca

SEQ ID NO: 6626913 - DNA, 20 bp, Homo sapiens
agactggctgcacagcccaa

SEQ ID NO: 6626914 - DNA, 11 bp, Homo sapiens
agactggcttt

SEQ ID NO: 6626915 - DNA, 23 bp, Homo sapiens
agactggcttttattaatgcact

SEQ ID NO: 6626916 - DNA, 23 bp, Homo sapiens
agactgggaagataggctctgca

SEQ ID NO: 6626917 - DNA, 19 bp, Homo sapiens
agactgggaaggcttggga

SEQ ID NO: 6626918 - DNA, 20 bp, Homo sapiens
agactgggaccttagaaatc

SEQ ID NO: 6626919 - DNA, 18 bp, Homo sapiens
agactgggcacccctgcc

SEQ ID NO: 6626920 - DNA, 23 bp, Homo sapiens
agactgggcacccctgcctcctg

SEQ ID NO: 6626921 - DNA, 17 bp, Homo sapiens
agactgggcccaggcag

SEQ ID NO: 6626922 - DNA, 19 bp, Homo sapiens
agactgggcccaggcaggt

SEQ ID NO: 6626923 - DNA, 17 bp, Homo sapiens
agactgggcctaggcca

SEQ ID NO: 6626924 - DNA, 18 bp, Homo sapiens
agactgggctctggctct

SEQ ID NO: 6626925 - DNA, 22 bp, Homo sapiens
agactgggctggctgccttctg

SEQ ID NO: 6626926 - DNA, 14 bp, Homo sapiens
agactggggccact

SEQ ID NO: 6626927 - DNA, 18 bp, Homo sapiens
agactggggtggcctcaa

SEQ ID NO: 6626928 - DNA, 19 bp, Homo sapiens
agactggggtggcctcaag

SEQ ID NO: 6626929 - DNA, 17 bp, Homo sapiens
agactgggtgaaagtga

SEQ ID NO: 6626930 - DNA, 21 bp, Homo sapiens
agactgggtgaggataacaca

SEQ ID NO: 6626931 - DNA, 23 bp, Homo sapiens
agactggtaggaggaggcatgga

SEQ ID NO: 6626932 - DNA, 18 bp, Homo sapiens
agactggtccacagggct

SEQ ID NO: 6626933 - DNA, 17 bp, Homo sapiens
agactggtcctgtgtgc

SEQ ID NO: 6626934 - DNA, 20 bp, Homo sapiens
agactggtctcgaactcctg

SEQ ID NO: 6626935 - DNA, 13 bp, Homo sapiens
agactggtgactg

SEQ ID NO: 6626936 - DNA, 15 bp, Homo sapiens
agactggtgttaatg

SEQ ID NO: 6626937 - DNA, 16 bp, Homo sapiens
agactggtgttaatga

SEQ ID NO: 6626938 - DNA, 16 bp, Homo sapiens
agactggttcggctct

SEQ ID NO: 6626939 - DNA, 13 bp, Homo sapiens
agactggtttgtt

SEQ ID NO: 6626940 - DNA, 15 bp, Homo sapiens
agactggtttgtttg

SEQ ID NO: 6626941 - DNA, 16 bp, Homo sapiens
agactggtttgtttgc

SEQ ID NO: 6626942 - DNA, 19 bp, Homo sapiens
agactggtttgtttgctta

SEQ ID NO: 6626943 - DNA, 14 bp, Homo sapiens
agactggttttctg

SEQ ID NO: 6626944 - DNA, 20 bp, Homo sapiens
agactgtaaattccaaagat

SEQ ID NO: 6626945 - DNA, 17 bp, Homo sapiens
agactgtaagatgttgt

SEQ ID NO: 6626946 - DNA, 14 bp, Homo sapiens
agactgtaatgaat

SEQ ID NO: 6626947 - DNA, 16 bp, Homo sapiens
agactgtaatgaatct

SEQ ID NO: 6626948 - DNA, 15 bp, Homo sapiens
agactgtacaaagta

SEQ ID NO: 6626949 - DNA, 14 bp, Homo sapiens
agactgtacataat

SEQ ID NO: 6626950 - DNA, 14 bp, Homo sapiens
agactgtacattat

SEQ ID NO: 6626951 - DNA, 12 bp, Homo sapiens
agactgtactgg

SEQ ID NO: 6626952 - DNA, 17 bp, Homo sapiens
agactgtacttattttc

SEQ ID NO: 6626953 - DNA, 22 bp, Homo sapiens
agactgtagattgcttctgtag

SEQ ID NO: 6626954 - DNA, 18 bp, Homo sapiens
agactgtagcttctcttg

SEQ ID NO: 6626955 - DNA, 19 bp, Homo sapiens
agactgtagcttctcttgc

SEQ ID NO: 6626956 - DNA, 15 bp, Homo sapiens
agactgtcaaatgaa

SEQ ID NO: 6626957 - DNA, 18 bp, Homo sapiens
agactgtcaaatgaactt

SEQ ID NO: 6626958 - DNA, 14 bp, Homo sapiens
agactgtcaggaag

SEQ ID NO: 6626959 - DNA, 20 bp, Homo sapiens
agactgtcaggcaagcccgg

SEQ ID NO: 6626960 - DNA, 15 bp, Homo sapiens
agactgtccacttct

SEQ ID NO: 6626961 - DNA, 20 bp, Homo sapiens
agactgtcggagaggctgtc

SEQ ID NO: 6626962 - DNA, 21 bp, Homo sapiens
agactgtcggagaggctgtct

SEQ ID NO: 6626963 - DNA, 19 bp, Homo sapiens
agactgtcttacctggcag

SEQ ID NO: 6626964 - DNA, 15 bp, Homo sapiens
agactgtgaacttga

SEQ ID NO: 6626965 - DNA, 21 bp, Homo sapiens
agactgtgaacttgactgggt

SEQ ID NO: 6626966 - DNA, 18 bp, Homo sapiens
agactgtgacaactgtct

SEQ ID NO: 6626967 - DNA, 16 bp, Homo sapiens
agactgtgattcagaa

SEQ ID NO: 6626968 - DNA, 17 bp, Homo sapiens
agactgtgattcagaaa

SEQ ID NO: 6626969 - DNA, 18 bp, Homo sapiens
agactgtgattcttagca

SEQ ID NO: 6626970 - DNA, 14 bp, Homo sapiens
agactgtgcaatac

SEQ ID NO: 6626971 - DNA, 13 bp, Homo sapiens
agactgtgcagaa

SEQ ID NO: 6626972 - DNA, 16 bp, Homo sapiens
agactgtgctctctgt

SEQ ID NO: 6626973 - DNA, 23 bp, Homo sapiens
agactgtgctctctgtggtgcct

SEQ ID NO: 6626974 - DNA, 16 bp, Homo sapiens
agactgtgctgagaag

SEQ ID NO: 6626975 - DNA, 22 bp, Homo sapiens
agactgtgctgtcctttaacat

SEQ ID NO: 6626976 - DNA, 19 bp, Homo sapiens
agactgtgctgttgttctc

SEQ ID NO: 6626977 - DNA, 20 bp, Homo sapiens
agactgtggagactgctcct

SEQ ID NO: 6626978 - DNA, 19 bp, Homo sapiens
agactgtggctagtgacaa

SEQ ID NO: 6626979 - DNA, 21 bp, Homo sapiens
agactgtgggtccctgcgtct

SEQ ID NO: 6626980 - DNA, 13 bp, Homo sapiens
agactgtgggtgg

SEQ ID NO: 6626981 - DNA, 16 bp, Homo sapiens
agactgtgggtgggga

SEQ ID NO: 6626982 - DNA, 17 bp, Homo sapiens
agactgtgggtggggag

SEQ ID NO: 6626983 - DNA, 21 bp, Homo sapiens
agactgtggtattggggtctt

SEQ ID NO: 6626984 - DNA, 11 bp, Homo sapiens
agactgtgtat

SEQ ID NO: 6626985 - DNA, 23 bp, Homo sapiens
agactgtgtctgaatcatgtctg

SEQ ID NO: 6626986 - DNA, 18 bp, Homo sapiens
agactgtgtgtgccctct

SEQ ID NO: 6626987 - DNA, 20 bp, Homo sapiens
agactgtgtgtgccctctgg

SEQ ID NO: 6626988 - DNA, 17 bp, Homo sapiens
agactgtgtttggtcct

SEQ ID NO: 6626989 - DNA, 23 bp, Homo sapiens
agactgtgtttggtcctgtagga

SEQ ID NO: 6626990 - DNA, 17 bp, Homo sapiens
agactgttaaatgaaac

SEQ ID NO: 6626991 - DNA, 16 bp, Homo sapiens
agactgttctgttcct

SEQ ID NO: 6626992 - DNA, 23 bp, Homo sapiens
agactgttggggtgggtataaaa

SEQ ID NO: 6626993 - DNA, 14 bp, Homo sapiens
agactgttgtgctc

SEQ ID NO: 6626994 - DNA, 14 bp, Homo sapiens
agactgtttcacat

SEQ ID NO: 6626995 - DNA, 18 bp, Homo sapiens
agactgtttgaatgtttt

SEQ ID NO: 6626996 - DNA, 21 bp, Homo sapiens
agactgtttgctgatccccaa

SEQ ID NO: 6626997 - DNA, 22 bp, Homo sapiens
agactgtttgctgatccccaac

SEQ ID NO: 6626998 - DNA, 23 bp, Homo sapiens
agactgtttttcagggaggtggc

SEQ ID NO: 6626999 - DNA, 17 bp, Homo sapiens
agacttaaaacatggtg

SEQ ID NO: 6627000 - DNA, 22 bp, Homo sapiens
agacttaaaacatggtgcctat

SEQ ID NO: 6627001 - DNA, 21 bp, Homo sapiens
agacttaaaagagctcagaca

SEQ ID NO: 6627002 - DNA, 17 bp, Homo sapiens
agacttaaacttcctta

SEQ ID NO: 6627003 - DNA, 22 bp, Homo sapiens
agacttaaatagttcagtataa

SEQ ID NO: 6627004 - DNA, 22 bp, Homo sapiens
agacttaactggcccagaagct

SEQ ID NO: 6627005 - DNA, 15 bp, Homo sapiens
agacttaagaaagct

SEQ ID NO: 6627006 - DNA, 21 bp, Homo sapiens
agacttaagaaagcttaaggt

SEQ ID NO: 6627007 - DNA, 19 bp, Homo sapiens
agacttaagattaaattat

SEQ ID NO: 6627008 - DNA, 17 bp, Homo sapiens
agacttaatcatatcaa

SEQ ID NO: 6627009 - DNA, 17 bp, Homo sapiens
agacttaatctttgctg

SEQ ID NO: 6627010 - DNA, 16 bp, Homo sapiens
agacttaattctgatt

SEQ ID NO: 6627011 - DNA, 16 bp, Homo sapiens
agacttactaataaaa

SEQ ID NO: 6627012 - DNA, 18 bp, Homo sapiens
agacttactaataaaatg

SEQ ID NO: 6627013 - DNA, 22 bp, Homo sapiens
agacttactaataaaatgtgaa

SEQ ID NO: 6627014 - DNA, 15 bp, Homo sapiens
agacttactgcattg

SEQ ID NO: 6627015 - DNA, 22 bp, Homo sapiens
agacttactgggtgaggaaatc

SEQ ID NO: 6627016 - DNA, 21 bp, Homo sapiens
agacttacttgcattgctgga

SEQ ID NO: 6627017 - DNA, 20 bp, Homo sapiens
agacttactttactcatttt

SEQ ID NO: 6627018 - DNA, 12 bp, Homo sapiens
agacttactttc

SEQ ID NO: 6627019 - DNA, 14 bp, Homo sapiens
agacttagaataga

SEQ ID NO: 6627020 - DNA, 13 bp, Homo sapiens
agacttagatctg

SEQ ID NO: 6627021 - DNA, 22 bp, Homo sapiens
agacttaggcattaacatgttt

SEQ ID NO: 6627022 - DNA, 19 bp, Homo sapiens
agacttagtatattttctt

SEQ ID NO: 6627023 - DNA, 22 bp, Homo sapiens
agacttagtatattttcttttc

SEQ ID NO: 6627024 - DNA, 18 bp, Homo sapiens
agacttagtttttataaa

SEQ ID NO: 6627025 - DNA, 20 bp, Homo sapiens
agacttatagtcctcctgga

SEQ ID NO: 6627026 - DNA, 13 bp, Homo sapiens
agacttatgccat

SEQ ID NO: 6627027 - DNA, 14 bp, Homo sapiens
agacttattctttt

SEQ ID NO: 6627028 - DNA, 17 bp, Homo sapiens
agacttcaaaaataaaa

SEQ ID NO: 6627029 - DNA, 18 bp, Homo sapiens
agacttcaaaaataaaaa

SEQ ID NO: 6627030 - DNA, 18 bp, Homo sapiens
agacttcaatattaaatg

SEQ ID NO: 6627031 - DNA, 15 bp, Homo sapiens
agacttcacactgca

SEQ ID NO: 6627032 - DNA, 21 bp, Homo sapiens
agacttcacactgcaagagcc

SEQ ID NO: 6627033 - DNA, 21 bp, Homo sapiens
agacttcacagcgtctgctca

SEQ ID NO: 6627034 - DNA, 19 bp, Homo sapiens
agacttcaccaaatatatg

SEQ ID NO: 6627035 - DNA, 17 bp, Homo sapiens
agacttcactgcagcct

SEQ ID NO: 6627036 - DNA, 20 bp, Homo sapiens
agacttcagaacatgctgga

SEQ ID NO: 6627037 - DNA, 15 bp, Homo sapiens
agacttcagatttca

SEQ ID NO: 6627038 - DNA, 18 bp, Homo sapiens
agacttcagatttcaaat

SEQ ID NO: 6627039 - DNA, 19 bp, Homo sapiens
agacttcagatttcaaatt

SEQ ID NO: 6627040 - DNA, 22 bp, Homo sapiens
agacttcagggagtcagctgtt

SEQ ID NO: 6627041 - DNA, 22 bp, Homo sapiens
agacttcagtatgttgtcaaag

SEQ ID NO: 6627042 - DNA, 18 bp, Homo sapiens
agacttcagtcctggtct

SEQ ID NO: 6627043 - DNA, 14 bp, Homo sapiens
agacttcatttaac

SEQ ID NO: 6627044 - DNA, 20 bp, Homo sapiens
agacttccaaacctgacaga

SEQ ID NO: 6627045 - DNA, 13 bp, Homo sapiens
agacttccaaaga

SEQ ID NO: 6627046 - DNA, 15 bp, Homo sapiens
agacttccaaagaat

SEQ ID NO: 6627047 - DNA, 20 bp, Homo sapiens
agacttccaaatcctggaag

SEQ ID NO: 6627048 - DNA, 16 bp, Homo sapiens
agacttccagctttct

SEQ ID NO: 6627049 - DNA, 17 bp, Homo sapiens
agacttccagctttctc

SEQ ID NO: 6627050 - DNA, 22 bp, Homo sapiens
agacttcccactgttctgaaag

SEQ ID NO: 6627051 - DNA, 14 bp, Homo sapiens
agacttcccagctt

SEQ ID NO: 6627052 - DNA, 15 bp, Homo sapiens
agacttcccagcttc

SEQ ID NO: 6627053 - DNA, 21 bp, Homo sapiens
agacttccccaagcctggcag

SEQ ID NO: 6627054 - DNA, 14 bp, Homo sapiens
agacttccccatcc

SEQ ID NO: 6627055 - DNA, 19 bp, Homo sapiens
agacttccctgaatgtatt

SEQ ID NO: 6627056 - DNA, 22 bp, Homo sapiens
agacttcctattaatttattaa

SEQ ID NO: 6627057 - DNA, 23 bp, Homo sapiens
agacttcctattaatttattaaa

SEQ ID NO: 6627058 - DNA, 12 bp, Homo sapiens
agacttcctctc

SEQ ID NO: 6627059 - DNA, 21 bp, Homo sapiens
agacttcctctctacccccca

SEQ ID NO: 6627060 - DNA, 20 bp, Homo sapiens
agacttcctctggctcccca

SEQ ID NO: 6627061 - DNA, 22 bp, Homo sapiens
agacttcctgtaagattgcttt

SEQ ID NO: 6627062 - DNA, 16 bp, Homo sapiens
agacttccttgagaca

SEQ ID NO: 6627063 - DNA, 16 bp, Homo sapiens
agacttcctttataat

SEQ ID NO: 6627064 - DNA, 22 bp, Homo sapiens
agacttcctttataatatttca

SEQ ID NO: 6627065 - DNA, 16 bp, Homo sapiens
agacttcgaaaacaga

SEQ ID NO: 6627066 - DNA, 18 bp, Homo sapiens
agacttcgctattcccag

SEQ ID NO: 6627067 - DNA, 15 bp, Homo sapiens
agacttctaaaataa

SEQ ID NO: 6627068 - DNA, 16 bp, Homo sapiens
agacttctaaaataaa

SEQ ID NO: 6627069 - DNA, 19 bp, Homo sapiens
agacttctaaaataaatgt

SEQ ID NO: 6627070 - DNA, 21 bp, Homo sapiens
agacttctaaaataaatgttt

SEQ ID NO: 6627071 - DNA, 14 bp, Homo sapiens
agacttctaaatca

SEQ ID NO: 6627072 - DNA, 20 bp, Homo sapiens
agacttctaggaggatgctg

SEQ ID NO: 6627073 - DNA, 23 bp, Homo sapiens
agacttctctgtcctctgctttg

SEQ ID NO: 6627074 - DNA, 17 bp, Homo sapiens
agacttctcttacattt

SEQ ID NO: 6627075 - DNA, 17 bp, Homo sapiens
agacttctctttgcctc

SEQ ID NO: 6627076 - DNA, 18 bp, Homo sapiens
agacttctctttgcctca

SEQ ID NO: 6627077 - DNA, 14 bp, Homo sapiens
agacttctgagtaa

SEQ ID NO: 6627078 - DNA, 18 bp, Homo sapiens
agacttctgctttccaca

SEQ ID NO: 6627079 - DNA, 16 bp, Homo sapiens
agacttctggaaggct

SEQ ID NO: 6627080 - DNA, 19 bp, Homo sapiens
agacttctggaaggctggc

SEQ ID NO: 6627081 - DNA, 20 bp, Homo sapiens
agacttctggaaggctggct

SEQ ID NO: 6627082 - DNA, 21 bp, Homo sapiens
agacttctggaaggctggctg

SEQ ID NO: 6627083 - DNA, 23 bp, Homo sapiens
agacttctggaaggctggctgag

SEQ ID NO: 6627084 - DNA, 22 bp, Homo sapiens
agacttctggttgtatttctat

SEQ ID NO: 6627085 - DNA, 12 bp, Homo sapiens
agacttgaaaag

SEQ ID NO: 6627086 - DNA, 19 bp, Homo sapiens
agacttgaaagttttccag

SEQ ID NO: 6627087 - DNA, 20 bp, Homo sapiens
agacttgaaagttttccagt

SEQ ID NO: 6627088 - DNA, 23 bp, Homo sapiens
agacttgacaacatcccacagtg

SEQ ID NO: 6627089 - DNA, 14 bp, Homo sapiens
agacttgacagtgg

SEQ ID NO: 6627090 - DNA, 15 bp, Homo sapiens
agacttgagccatcc

SEQ ID NO: 6627091 - DNA, 16 bp, Homo sapiens
agacttgagccatcca

SEQ ID NO: 6627092 - DNA, 17 bp, Homo sapiens
agacttgattggtttaa

SEQ ID NO: 6627093 - DNA, 16 bp, Homo sapiens
agacttgatttacaag

SEQ ID NO: 6627094 - DNA, 16 bp, Homo sapiens
agacttgcagttagac

SEQ ID NO: 6627095 - DNA, 12 bp, Homo sapiens
agacttgccaac

SEQ ID NO: 6627096 - DNA, 17 bp, Homo sapiens
agacttgccatgtgact

SEQ ID NO: 6627097 - DNA, 13 bp, Homo sapiens
agacttgccttcc

SEQ ID NO: 6627098 - DNA, 14 bp, Homo sapiens
agacttgcggccac

SEQ ID NO: 6627099 - DNA, 16 bp, Homo sapiens
agacttgctccctctc

SEQ ID NO: 6627100 - DNA, 20 bp, Homo sapiens
agacttgctccctctccaag

SEQ ID NO: 6627101 - DNA, 12 bp, Homo sapiens
agacttgctgaa

SEQ ID NO: 6627102 - DNA, 16 bp, Homo sapiens
agacttggacatctct

SEQ ID NO: 6627103 - DNA, 18 bp, Homo sapiens
agacttggacatctctct

SEQ ID NO: 6627104 - DNA, 23 bp, Homo sapiens
agacttggacatctctctggctt

SEQ ID NO: 6627105 - DNA, 20 bp, Homo sapiens
agacttggagaatactgcca

SEQ ID NO: 6627106 - DNA, 15 bp, Homo sapiens
agacttggattcttt

SEQ ID NO: 6627107 - DNA, 17 bp, Homo sapiens
agacttggcaacagaag

SEQ ID NO: 6627108 - DNA, 21 bp, Homo sapiens
agacttggccataaagataat

SEQ ID NO: 6627109 - DNA, 18 bp, Homo sapiens
agacttggcccaggaaaa

SEQ ID NO: 6627110 - DNA, 17 bp, Homo sapiens
agacttggcctccagct

SEQ ID NO: 6627111 - DNA, 15 bp, Homo sapiens
agacttgggacattg

SEQ ID NO: 6627112 - DNA, 15 bp, Homo sapiens
agacttgggagcttt

SEQ ID NO: 6627113 - DNA, 22 bp, Homo sapiens
agacttggggccagcgcttctg

SEQ ID NO: 6627114 - DNA, 20 bp, Homo sapiens
agacttggtggtctgagctg

SEQ ID NO: 6627115 - DNA, 16 bp, Homo sapiens
agacttggtgtgaaga

SEQ ID NO: 6627116 - DNA, 19 bp, Homo sapiens
agacttgtacagttgactg

SEQ ID NO: 6627117 - DNA, 18 bp, Homo sapiens
agacttgtatgaaagatg

SEQ ID NO: 6627118 - DNA, 14 bp, Homo sapiens
agacttgtgcatcc

SEQ ID NO: 6627119 - DNA, 14 bp, Homo sapiens
agacttgtgtgcat

SEQ ID NO: 6627120 - DNA, 20 bp, Homo sapiens
agacttgtgtgcatggaagt

SEQ ID NO: 6627121 - DNA, 16 bp, Homo sapiens
agacttgttaaatgta

SEQ ID NO: 6627122 - DNA, 15 bp, Homo sapiens
agacttgttctagag

SEQ ID NO: 6627123 - DNA, 21 bp, Homo sapiens
agacttgttggcgtaggctac

SEQ ID NO: 6627124 - DNA, 14 bp, Homo sapiens
agacttgtttcttt

SEQ ID NO: 6627125 - DNA, 15 bp, Homo sapiens
agacttgtttctttc

SEQ ID NO: 6627126 - DNA, 22 bp, Homo sapiens
agacttgtttctttctgtctct

SEQ ID NO: 6627127 - DNA, 14 bp, Homo sapiens
agactttaaagaat

SEQ ID NO: 6627128 - DNA, 22 bp, Homo sapiens
agactttaagaagcgaacaaaa

SEQ ID NO: 6627129 - DNA, 14 bp, Homo sapiens
agactttaattata

SEQ ID NO: 6627130 - DNA, 17 bp, Homo sapiens
agactttacaaaccttt

SEQ ID NO: 6627131 - DNA, 19 bp, Homo sapiens
agactttacaaacctttgt

SEQ ID NO: 6627132 - DNA, 12 bp, Homo sapiens
agactttagaaa

SEQ ID NO: 6627133 - DNA, 16 bp, Homo sapiens
agactttaggctttca

SEQ ID NO: 6627134 - DNA, 22 bp, Homo sapiens
agactttaggctttcagcttac

SEQ ID NO: 6627135 - DNA, 16 bp, Homo sapiens
agactttatgcaataa

SEQ ID NO: 6627136 - DNA, 18 bp, Homo sapiens
agactttatgcaataaat

SEQ ID NO: 6627137 - DNA, 23 bp, Homo sapiens
agactttatgcaataaataacag

SEQ ID NO: 6627138 - DNA, 15 bp, Homo sapiens
agactttattgccta

SEQ ID NO: 6627139 - DNA, 16 bp, Homo sapiens
agactttattgcctat

SEQ ID NO: 6627140 - DNA, 20 bp, Homo sapiens
agactttcaagggaattaaa

SEQ ID NO: 6627141 - DNA, 19 bp, Homo sapiens
agactttccattaaatcaa

SEQ ID NO: 6627142 - DNA, 20 bp, Homo sapiens
agactttccattaaatcaat

SEQ ID NO: 6627143 - DNA, 15 bp, Homo sapiens
agactttccattaca

SEQ ID NO: 6627144 - DNA, 17 bp, Homo sapiens
agactttcccctctcgc

SEQ ID NO: 6627145 - DNA, 18 bp, Homo sapiens
agactttcctttgcacca

SEQ ID NO: 6627146 - DNA, 17 bp, Homo sapiens
agactttctacacctgt

SEQ ID NO: 6627147 - DNA, 20 bp, Homo sapiens
agactttctattaatattta

SEQ ID NO: 6627148 - DNA, 18 bp, Homo sapiens
agactttctctgtgtatg

SEQ ID NO: 6627149 - DNA, 16 bp, Homo sapiens
agactttctgttacta

SEQ ID NO: 6627150 - DNA, 12 bp, Homo sapiens
agactttcttct

SEQ ID NO: 6627151 - DNA, 21 bp, Homo sapiens
agactttctttctgtaggtgg

SEQ ID NO: 6627152 - DNA, 17 bp, Homo sapiens
agactttctttttctac

SEQ ID NO: 6627153 - DNA, 21 bp, Homo sapiens
agactttctttttctacatgt

SEQ ID NO: 6627154 - DNA, 23 bp, Homo sapiens
agactttctttttctacatgtga

SEQ ID NO: 6627155 - DNA, 19 bp, Homo sapiens
agactttgatccatgtatg

SEQ ID NO: 6627156 - DNA, 14 bp, Homo sapiens
agactttgatcctt

SEQ ID NO: 6627157 - DNA, 17 bp, Homo sapiens
agactttgctgcatttt

SEQ ID NO: 6627158 - DNA, 16 bp, Homo sapiens
agactttgctgttact

SEQ ID NO: 6627159 - DNA, 17 bp, Homo sapiens
agactttgctgttactg

SEQ ID NO: 6627160 - DNA, 22 bp, Homo sapiens
agactttgctgttactgcttct

SEQ ID NO: 6627161 - DNA, 12 bp, Homo sapiens
agactttggaaa

SEQ ID NO: 6627162 - DNA, 22 bp, Homo sapiens
agactttggaaaatgcattgta

SEQ ID NO: 6627163 - DNA, 23 bp, Homo sapiens
agactttggaaaatgcattgtat

SEQ ID NO: 6627164 - DNA, 15 bp, Homo sapiens
agactttggaaagac

SEQ ID NO: 6627165 - DNA, 19 bp, Homo sapiens
agactttggaaagagtagg

SEQ ID NO: 6627166 - DNA, 18 bp, Homo sapiens
agactttggacagtggcc

SEQ ID NO: 6627167 - DNA, 19 bp, Homo sapiens
agactttggacagtggcct

SEQ ID NO: 6627168 - DNA, 17 bp, Homo sapiens
agactttgtcacttatt

SEQ ID NO: 6627169 - DNA, 18 bp, Homo sapiens
agactttgtttttaaaat

SEQ ID NO: 6627170 - DNA, 16 bp, Homo sapiens
agacttttaatatcac

SEQ ID NO: 6627171 - DNA, 18 bp, Homo sapiens
agacttttatcaaaatcc

SEQ ID NO: 6627172 - DNA, 12 bp, Homo sapiens
agacttttatga

SEQ ID NO: 6627173 - DNA, 15 bp, Homo sapiens
agacttttatgatac

SEQ ID NO: 6627174 - DNA, 18 bp, Homo sapiens
agacttttattaataaaa

SEQ ID NO: 6627175 - DNA, 21 bp, Homo sapiens
agacttttcagaagatggtga

SEQ ID NO: 6627176 - DNA, 13 bp, Homo sapiens
agacttttcagac

SEQ ID NO: 6627177 - DNA, 15 bp, Homo sapiens
agacttttccaaccc

SEQ ID NO: 6627178 - DNA, 21 bp, Homo sapiens
agacttttccaatatgtgatt

SEQ ID NO: 6627179 - DNA, 13 bp, Homo sapiens
agacttttctttg

SEQ ID NO: 6627180 - DNA, 13 bp, Homo sapiens
agacttttgaaaa

SEQ ID NO: 6627181 - DNA, 23 bp, Homo sapiens
agactttttggtggatgtaaata

SEQ ID NO: 6627182 - DNA, 22 bp, Homo sapiens
agagaaaaaaaaacacacaaaa

SEQ ID NO: 6627183 - DNA, 23 bp, Homo sapiens
agagaaaaaaaaacacacaaaaa

SEQ ID NO: 6627184 - DNA, 17 bp, Homo sapiens
agagaaaaaaaaatatg

SEQ ID NO: 6627185 - DNA, 22 bp, Homo sapiens
agagaaaaaaaaatatgtgtac

SEQ ID NO: 6627186 - DNA, 21 bp, Homo sapiens
agagaaaaaaaggaaaagaag

SEQ ID NO: 6627187 - DNA, 22 bp, Homo sapiens
agagaaaaaaatataaaatttc

SEQ ID NO: 6627188 - DNA, 13 bp, Homo sapiens
agagaaaaaagaa

SEQ ID NO: 6627189 - DNA, 13 bp, Homo sapiens
agagaaaaacaaa

SEQ ID NO: 6627190 - DNA, 15 bp, Homo sapiens
agagaaaaacaaatt

SEQ ID NO: 6627191 - DNA, 18 bp, Homo sapiens
agagaaaaaccaatgatt

SEQ ID NO: 6627192 - DNA, 14 bp, Homo sapiens
agagaaaaagaaag

SEQ ID NO: 6627193 - DNA, 12 bp, Homo sapiens
agagaaaaagag

SEQ ID NO: 6627194 - DNA, 17 bp, Homo sapiens
agagaaaaaggctgaaa

SEQ ID NO: 6627195 - DNA, 18 bp, Homo sapiens
agagaaaaatggcctgca

SEQ ID NO: 6627196 - DNA, 17 bp, Homo sapiens
agagaaaacatgcagaa

SEQ ID NO: 6627197 - DNA, 23 bp, Homo sapiens
agagaaaacatgcagaacaaatg

SEQ ID NO: 6627198 - DNA, 17 bp, Homo sapiens
agagaaaacccggagca

SEQ ID NO: 6627199 - DNA, 17 bp, Homo sapiens
agagaaaaccttaaaag

SEQ ID NO: 6627200 - DNA, 13 bp, Homo sapiens
agagaaaactctt

SEQ ID NO: 6627201 - DNA, 18 bp, Homo sapiens
agagaaaacttatttgag

SEQ ID NO: 6627202 - DNA, 19 bp, Homo sapiens
agagaaaacttatttgagt

SEQ ID NO: 6627203 - DNA, 16 bp, Homo sapiens
agagaaaacttgcctt

SEQ ID NO: 6627204 - DNA, 10 bp, Homo sapiens
agagaaaaga

SEQ ID NO: 6627205 - DNA, 11 bp, Homo sapiens
agagaaaagaa

SEQ ID NO: 6627206 - DNA, 12 bp, Homo sapiens
agagaaaagaaa

SEQ ID NO: 6627207 - DNA, 14 bp, Homo sapiens
agagaaaagaaaaa

SEQ ID NO: 6627208 - DNA, 15 bp, Homo sapiens
agagaaaagaaaaaa

SEQ ID NO: 6627209 - DNA, 15 bp, Homo sapiens
agagaaaagaaaaat

SEQ ID NO: 6627210 - DNA, 14 bp, Homo sapiens
agagaaaagcaggc

SEQ ID NO: 6627211 - DNA, 17 bp, Homo sapiens
agagaaaagggaaaaaa

SEQ ID NO: 6627212 - DNA, 20 bp, Homo sapiens
agagaaaagggaaaaaagaa

SEQ ID NO: 6627213 - DNA, 19 bp, Homo sapiens
agagaaaataaaaagttaa

SEQ ID NO: 6627214 - DNA, 20 bp, Homo sapiens
agagaaaataaaaagttaaa

SEQ ID NO: 6627215 - DNA, 19 bp, Homo sapiens
agagaaaatactatttcaa

SEQ ID NO: 6627216 - DNA, 12 bp, Homo sapiens
agagaaaatata

SEQ ID NO: 6627217 - DNA, 13 bp, Homo sapiens
agagaaaatgaat

SEQ ID NO: 6627218 - DNA, 16 bp, Homo sapiens
agagaaaatgaatttg

SEQ ID NO: 6627219 - DNA, 17 bp, Homo sapiens
agagaaaatgctttctc

SEQ ID NO: 6627220 - DNA, 13 bp, Homo sapiens
agagaaacaaact

SEQ ID NO: 6627221 - DNA, 14 bp, Homo sapiens
agagaaacaaactt

SEQ ID NO: 6627222 - DNA, 20 bp, Homo sapiens
agagaaacactaatggccaa

SEQ ID NO: 6627223 - DNA, 20 bp, Homo sapiens
agagaaaccagcttccttca

SEQ ID NO: 6627224 - DNA, 18 bp, Homo sapiens
agagaaacccctggggac

SEQ ID NO: 6627225 - DNA, 23 bp, Homo sapiens
agagaaacctattaagtcatcat

SEQ ID NO: 6627226 - DNA, 18 bp, Homo sapiens
agagaaactaacttggtg

SEQ ID NO: 6627227 - DNA, 21 bp, Homo sapiens
agagaaactttatacattagt

SEQ ID NO: 6627228 - DNA, 10 bp, Homo sapiens
agagaaagaa

SEQ ID NO: 6627229 - DNA, 12 bp, Homo sapiens
agagaaagaaaa

SEQ ID NO: 6627230 - DNA, 23 bp, Homo sapiens
agagaaagaaagggaaactggct

SEQ ID NO: 6627231 - DNA, 14 bp, Homo sapiens
agagaaagaatgag

SEQ ID NO: 6627232 - DNA, 15 bp, Homo sapiens
agagaaagacaaaat

SEQ ID NO: 6627233 - DNA, 14 bp, Homo sapiens
agagaaagagagaa

SEQ ID NO: 6627234 - DNA, 15 bp, Homo sapiens
agagaaagagagaag

SEQ ID NO: 6627235 - DNA, 14 bp, Homo sapiens
agagaaagaggcca

SEQ ID NO: 6627236 - DNA, 20 bp, Homo sapiens
agagaaagcaaaggtgcact

SEQ ID NO: 6627237 - DNA, 18 bp, Homo sapiens
agagaaagcacgtgtctc

SEQ ID NO: 6627238 - DNA, 13 bp, Homo sapiens
agagaaagccagg

SEQ ID NO: 6627239 - DNA, 14 bp, Homo sapiens
agagaaagcgcaga

SEQ ID NO: 6627240 - DNA, 18 bp, Homo sapiens
agagaaaggcctgcacac

SEQ ID NO: 6627241 - DNA, 19 bp, Homo sapiens
agagaaaggcctgcacaca

SEQ ID NO: 6627242 - DNA, 20 bp, Homo sapiens
agagaaaggcctgcacacaa

SEQ ID NO: 6627243 - DNA, 12 bp, Homo sapiens
agagaaagggga

SEQ ID NO: 6627244 - DNA, 18 bp, Homo sapiens
agagaaaggggagcccac

SEQ ID NO: 6627245 - DNA, 21 bp, Homo sapiens
agagaaaggggagcccactgt

SEQ ID NO: 6627246 - DNA, 13 bp, Homo sapiens
agagaaagtactc

SEQ ID NO: 6627247 - DNA, 19 bp, Homo sapiens
agagaaagtccattgatgt

SEQ ID NO: 6627248 - DNA, 21 bp, Homo sapiens
agagaaagttggtgctgctca

SEQ ID NO: 6627249 - DNA, 12 bp, Homo sapiens
agagaaatacag

SEQ ID NO: 6627250 - DNA, 17 bp, Homo sapiens
agagaaatacagctggc

SEQ ID NO: 6627251 - DNA, 19 bp, Homo sapiens
agagaaatacagctggcta

SEQ ID NO: 6627252 - DNA, 15 bp, Homo sapiens
agagaaatattttaa

SEQ ID NO: 6627253 - DNA, 23 bp, Homo sapiens
agagaaatattttaatttttaaa

SEQ ID NO: 6627254 - DNA, 20 bp, Homo sapiens
agagaaatcaatagtgcaac

SEQ ID NO: 6627255 - DNA, 12 bp, Homo sapiens
agagaaatgaaa

SEQ ID NO: 6627256 - DNA, 14 bp, Homo sapiens
agagaaatgaggaa

SEQ ID NO: 6627257 - DNA, 16 bp, Homo sapiens
agagaaatgaggaaga

SEQ ID NO: 6627258 - DNA, 18 bp, Homo sapiens
agagaaatgtgaagggtg

SEQ ID NO: 6627259 - DNA, 20 bp, Homo sapiens
agagaaatgtgaagggtggg

SEQ ID NO: 6627260 - DNA, 13 bp, Homo sapiens
agagaaattagaa

SEQ ID NO: 6627261 - DNA, 12 bp, Homo sapiens
agagaaattctg

SEQ ID NO: 6627262 - DNA, 17 bp, Homo sapiens
agagaaattctgttaaa

SEQ ID NO: 6627263 - DNA, 23 bp, Homo sapiens
agagaacaaagggccaaatagag

SEQ ID NO: 6627264 - DNA, 16 bp, Homo sapiens
agagaacaagaggtgc

SEQ ID NO: 6627265 - DNA, 21 bp, Homo sapiens
agagaacagtattgggcagga

SEQ ID NO: 6627266 - DNA, 16 bp, Homo sapiens
agagaacatttctaga

SEQ ID NO: 6627267 - DNA, 20 bp, Homo sapiens
agagaaccaccactgcctga

SEQ ID NO: 6627268 - DNA, 23 bp, Homo sapiens
agagaaccaggagggtaacagaa

SEQ ID NO: 6627269 - DNA, 20 bp, Homo sapiens
agagaaccattcccaagcca

SEQ ID NO: 6627270 - DNA, 24 bp, Homo sapiens
agagaaccattcccaagccatggc

SEQ ID NO: 6627271 - DNA, 21 bp, Homo sapiens
agagaaccgagcaaagatcaa

SEQ ID NO: 6627272 - DNA, 23 bp, Homo sapiens
agagaacctaactgtatcttgag

SEQ ID NO: 6627273 - DNA, 22 bp, Homo sapiens
agagaacctcacgcacctccca

SEQ ID NO: 6627274 - DNA, 13 bp, Homo sapiens
agagaacctgtgg

SEQ ID NO: 6627275 - DNA, 17 bp, Homo sapiens
agagaacctttccactc

SEQ ID NO: 6627276 - DNA, 14 bp, Homo sapiens
agagaacgcagccc

SEQ ID NO: 6627277 - DNA, 16 bp, Homo sapiens
agagaacgggcgtcag

SEQ ID NO: 6627278 - DNA, 12 bp, Homo sapiens
agagaactaaag

SEQ ID NO: 6627279 - DNA, 16 bp, Homo sapiens
agagaactaacactat

SEQ ID NO: 6627280 - DNA, 22 bp, Homo sapiens
agagaactaacactattttatg

SEQ ID NO: 6627281 - DNA, 14 bp, Homo sapiens
agagaactgcagac

SEQ ID NO: 6627282 - DNA, 23 bp, Homo sapiens
agagaactgcagacctcactgtc

SEQ ID NO: 6627283 - DNA, 20 bp, Homo sapiens
agagaactgtcaccctgagg

SEQ ID NO: 6627284 - DNA, 17 bp, Homo sapiens
agagaacttccagatcc

SEQ ID NO: 6627285 - DNA, 16 bp, Homo sapiens
agagaactttattttg

SEQ ID NO: 6627286 - DNA, 23 bp, Homo sapiens
agagaactttcggagcctgcctc

SEQ ID NO: 6627287 - DNA, 16 bp, Homo sapiens
agagaacttttttcaa

SEQ ID NO: 6627288 - DNA, 14 bp, Homo sapiens
agagaagaaagaag

SEQ ID NO: 6627289 - DNA, 13 bp, Homo sapiens
agagaagaaagtg

SEQ ID NO: 6627290 - DNA, 14 bp, Homo sapiens
agagaagaaagtga

SEQ ID NO: 6627291 - DNA, 13 bp, Homo sapiens
agagaagaaatgt

SEQ ID NO: 6627292 - DNA, 15 bp, Homo sapiens
agagaagaagaaaaa

SEQ ID NO: 6627293 - DNA, 15 bp, Homo sapiens
agagaagaatgagcc

SEQ ID NO: 6627294 - DNA, 14 bp, Homo sapiens
agagaagacaggct

SEQ ID NO: 6627295 - DNA, 16 bp, Homo sapiens
agagaagacaggctgg

SEQ ID NO: 6627296 - DNA, 16 bp, Homo sapiens
agagaagacccttctc

SEQ ID NO: 6627297 - DNA, 13 bp, Homo sapiens
agagaagagaaag

SEQ ID NO: 6627298 - DNA, 21 bp, Homo sapiens
agagaagagccccactctcag

SEQ ID NO: 6627299 - DNA, 15 bp, Homo sapiens
agagaagagtccagg

SEQ ID NO: 6627300 - DNA, 19 bp, Homo sapiens
agagaagagtccaggaagg

SEQ ID NO: 6627301 - DNA, 21 bp, Homo sapiens
agagaagatggatatgaccag

SEQ ID NO: 6627302 - DNA, 20 bp, Homo sapiens
agagaagatggccatgccct

SEQ ID NO: 6627303 - DNA, 19 bp, Homo sapiens
agagaagatgtgatttatt

SEQ ID NO: 6627304 - DNA, 13 bp, Homo sapiens
agagaagcaattt

SEQ ID NO: 6627305 - DNA, 12 bp, Homo sapiens
agagaagcaggc

SEQ ID NO: 6627306 - DNA, 15 bp, Homo sapiens
agagaagcaggcaga

SEQ ID NO: 6627307 - DNA, 17 bp, Homo sapiens
agagaagcatcctccac

SEQ ID NO: 6627308 - DNA, 17 bp, Homo sapiens
agagaagccacgctgtc

SEQ ID NO: 6627309 - DNA, 14 bp, Homo sapiens
agagaagccagcca

SEQ ID NO: 6627310 - DNA, 15 bp, Homo sapiens
agagaagccagccac

SEQ ID NO: 6627311 - DNA, 12 bp, Homo sapiens
agagaagccata

SEQ ID NO: 6627312 - DNA, 16 bp, Homo sapiens
agagaagccatcacct

SEQ ID NO: 6627313 - DNA, 21 bp, Homo sapiens
agagaagccccgcacgggctg

SEQ ID NO: 6627314 - DNA, 21 bp, Homo sapiens
agagaagcctatttttatatt

SEQ ID NO: 6627315 - DNA, 13 bp, Homo sapiens
agagaagccttca

SEQ ID NO: 6627316 - DNA, 14 bp, Homo sapiens
agagaagccttcaa

SEQ ID NO: 6627317 - DNA, 21 bp, Homo sapiens
agagaagccttcaagctctga

SEQ ID NO: 6627318 - DNA, 23 bp, Homo sapiens
agagaagccttcaagctctgagg

SEQ ID NO: 6627319 - DNA, 17 bp, Homo sapiens
agagaagcggatttcca

SEQ ID NO: 6627320 - DNA, 12 bp, Homo sapiens
agagaagctacc

SEQ ID NO: 6627321 - DNA, 16 bp, Homo sapiens
agagaagctcctgcta

SEQ ID NO: 6627322 - DNA, 12 bp, Homo sapiens
agagaagctgct

SEQ ID NO: 6627323 - DNA, 15 bp, Homo sapiens
agagaagctggactt

SEQ ID NO: 6627324 - DNA, 21 bp, Homo sapiens
agagaagctggacttctgtgg

SEQ ID NO: 6627325 - DNA, 13 bp, Homo sapiens
agagaaggaaaag

SEQ ID NO: 6627326 - DNA, 18 bp, Homo sapiens
agagaaggagcagaaaga

SEQ ID NO: 6627327 - DNA, 20 bp, Homo sapiens
agagaaggcctcttgtgctc

SEQ ID NO: 6627328 - DNA, 18 bp, Homo sapiens
agagaaggcctggtcagc

SEQ ID NO: 6627329 - DNA, 21 bp, Homo sapiens
agagaaggccttacagaaaat

SEQ ID NO: 6627330 - DNA, 19 bp, Homo sapiens
agagaaggcctttaataaa

SEQ ID NO: 6627331 - DNA, 15 bp, Homo sapiens
agagaagggagctga

SEQ ID NO: 6627332 - DNA, 22 bp, Homo sapiens
agagaagggcaggagaggaaga

SEQ ID NO: 6627333 - DNA, 21 bp, Homo sapiens
agagaagggcataaaacagct

SEQ ID NO: 6627334 - DNA, 18 bp, Homo sapiens
agagaaggggtgtgcatg

SEQ ID NO: 6627335 - DNA, 21 bp, Homo sapiens
agagaaggtagattttaagaa

SEQ ID NO: 6627336 - DNA, 17 bp, Homo sapiens
agagaaggtggtctgca

SEQ ID NO: 6627337 - DNA, 21 bp, Homo sapiens
agagaagtatccaattatgtg

SEQ ID NO: 6627338 - DNA, 15 bp, Homo sapiens
agagaagtcacaggg

SEQ ID NO: 6627339 - DNA, 19 bp, Homo sapiens
agagaagtcagttggagaa

SEQ ID NO: 6627340 - DNA, 15 bp, Homo sapiens
agagaagtctcattc

SEQ ID NO: 6627341 - DNA, 20 bp, Homo sapiens
agagaagtctggtcagagcc

SEQ ID NO: 6627342 - DNA, 14 bp, Homo sapiens
agagaagtgacagg

SEQ ID NO: 6627343 - DNA, 15 bp, Homo sapiens
agagaagtgacaggg

SEQ ID NO: 6627344 - DNA, 15 bp, Homo sapiens
agagaagtgcccctg

SEQ ID NO: 6627345 - DNA, 23 bp, Homo sapiens
agagaagtttgtagccaggtact

SEQ ID NO: 6627346 - DNA, 15 bp, Homo sapiens
agagaagtttgtggt

SEQ ID NO: 6627347 - DNA, 17 bp, Homo sapiens
agagaataaactagatc

SEQ ID NO: 6627348 - DNA, 16 bp, Homo sapiens
agagaataaattggat

SEQ ID NO: 6627349 - DNA, 21 bp, Homo sapiens
agagaataaattggattattt

SEQ ID NO: 6627350 - DNA, 16 bp, Homo sapiens
agagaataatttttgt

SEQ ID NO: 6627351 - DNA, 20 bp, Homo sapiens
agagaatacacatataaaaa

SEQ ID NO: 6627352 - DNA, 23 bp, Homo sapiens
agagaatacacatataaaaacaa

SEQ ID NO: 6627353 - DNA, 19 bp, Homo sapiens
agagaatagagctgccact

SEQ ID NO: 6627354 - DNA, 22 bp, Homo sapiens
agagaatataacatgaaatgat

SEQ ID NO: 6627355 - DNA, 23 bp, Homo sapiens
agagaatataacatgaaatgata

SEQ ID NO: 6627356 - DNA, 18 bp, Homo sapiens
agagaatatatttttgat

SEQ ID NO: 6627357 - DNA, 21 bp, Homo sapiens
agagaatatgtatgcctgcaa

SEQ ID NO: 6627358 - DNA, 22 bp, Homo sapiens
agagaatatgtctgctcctttc

SEQ ID NO: 6627359 - DNA, 22 bp, Homo sapiens
agagaatattagctttactgtt

SEQ ID NO: 6627360 - DNA, 17 bp, Homo sapiens
agagaatatttcaaatg

SEQ ID NO: 6627361 - DNA, 19 bp, Homo sapiens
agagaatcaacagatgata

SEQ ID NO: 6627362 - DNA, 15 bp, Homo sapiens
agagaatcaacattt

SEQ ID NO: 6627363 - DNA, 20 bp, Homo sapiens
agagaatcaacatttctcaa

SEQ ID NO: 6627364 - DNA, 18 bp, Homo sapiens
agagaatccacataaaag

SEQ ID NO: 6627365 - DNA, 19 bp, Homo sapiens
agagaatccacataaaaga

SEQ ID NO: 6627366 - DNA, 22 bp, Homo sapiens
agagaatcccacattagcttgt

SEQ ID NO: 6627367 - DNA, 16 bp, Homo sapiens
agagaatctcttggga

SEQ ID NO: 6627368 - DNA, 16 bp, Homo sapiens
agagaatctgatcaat

SEQ ID NO: 6627369 - DNA, 13 bp, Homo sapiens
agagaatctgcct

SEQ ID NO: 6627370 - DNA, 18 bp, Homo sapiens
agagaatgaaagggccca

SEQ ID NO: 6627371 - DNA, 22 bp, Homo sapiens
agagaatgaaattgctgaaaga

SEQ ID NO: 6627372 - DNA, 12 bp, Homo sapiens
agagaatgaact

SEQ ID NO: 6627373 - DNA, 14 bp, Homo sapiens
agagaatgaactgt

SEQ ID NO: 6627374 - DNA, 15 bp, Homo sapiens
agagaatgagagaca

SEQ ID NO: 6627375 - DNA, 14 bp, Homo sapiens
agagaatgagagcg

SEQ ID NO: 6627376 - DNA, 20 bp, Homo sapiens
agagaatgagagcgacacag

SEQ ID NO: 6627377 - DNA, 18 bp, Homo sapiens
agagaatgagtccttgat

SEQ ID NO: 6627378 - DNA, 23 bp, Homo sapiens
agagaatgataggcttttgttct

SEQ ID NO: 6627379 - DNA, 16 bp, Homo sapiens
agagaatgatgctcaa

SEQ ID NO: 6627380 - DNA, 15 bp, Homo sapiens
agagaatgcacctct

SEQ ID NO: 6627381 - DNA, 15 bp, Homo sapiens
agagaatgctttgaa

SEQ ID NO: 6627382 - DNA, 16 bp, Homo sapiens
agagaatgctttgaaa

SEQ ID NO: 6627383 - DNA, 17 bp, Homo sapiens
agagaatggagacagag

SEQ ID NO: 6627384 - DNA, 20 bp, Homo sapiens
agagaatgtcactgtagttt

SEQ ID NO: 6627385 - DNA, 14 bp, Homo sapiens
agagaatgtggaaa

SEQ ID NO: 6627386 - DNA, 18 bp, Homo sapiens
agagaatgttatagtgaa

SEQ ID NO: 6627387 - DNA, 21 bp, Homo sapiens
agagaatgttatagtgaatta

SEQ ID NO: 6627388 - DNA, 12 bp, Homo sapiens
agagaattaaaa

SEQ ID NO: 6627389 - DNA, 15 bp, Homo sapiens
agagaattaaacgaa

SEQ ID NO: 6627390 - DNA, 14 bp, Homo sapiens
agagaattatctca

SEQ ID NO: 6627391 - DNA, 15 bp, Homo sapiens
agagaattatctcaa

SEQ ID NO: 6627392 - DNA, 18 bp, Homo sapiens
agagaattatctcaagta

SEQ ID NO: 6627393 - DNA, 14 bp, Homo sapiens
agagaattcatgtg

SEQ ID NO: 6627394 - DNA, 14 bp, Homo sapiens
agagaattctaaga

SEQ ID NO: 6627395 - DNA, 21 bp, Homo sapiens
agagaattctaagattgtaca

SEQ ID NO: 6627396 - DNA, 22 bp, Homo sapiens
agagaattctaagattgtacat

SEQ ID NO: 6627397 - DNA, 16 bp, Homo sapiens
agagaattgaaatgag

SEQ ID NO: 6627398 - DNA, 20 bp, Homo sapiens
agagacaaacacctcccagg

SEQ ID NO: 6627399 - DNA, 19 bp, Homo sapiens
agagacaaaccttaaaaca

SEQ ID NO: 6627400 - DNA, 22 bp, Homo sapiens
agagacaaactgtaaaaaatgt

SEQ ID NO: 6627401 - DNA, 14 bp, Homo sapiens
agagacaaatcttt

SEQ ID NO: 6627402 - DNA, 18 bp, Homo sapiens
agagacaaatctttaaga

SEQ ID NO: 6627403 - DNA, 15 bp, Homo sapiens
agagacaagacttcg

SEQ ID NO: 6627404 - DNA, 19 bp, Homo sapiens
agagacaagtaatttcagt

SEQ ID NO: 6627405 - DNA, 23 bp, Homo sapiens
agagacaatttaaggcctgcact

SEQ ID NO: 6627406 - DNA, 15 bp, Homo sapiens
agagacacaaaagat

SEQ ID NO: 6627407 - DNA, 18 bp, Homo sapiens
agagacacaagtggcctt

SEQ ID NO: 6627408 - DNA, 17 bp, Homo sapiens
agagacacatacagagt

SEQ ID NO: 6627409 - DNA, 19 bp, Homo sapiens
agagacacatacagagtgg

SEQ ID NO: 6627410 - DNA, 15 bp, Homo sapiens
agagacaccaaactg

SEQ ID NO: 6627411 - DNA, 18 bp, Homo sapiens
agagacaccaaactgcca

SEQ ID NO: 6627412 - DNA, 23 bp, Homo sapiens
agagacaccccttcctgctgaca

SEQ ID NO: 6627413 - DNA, 16 bp, Homo sapiens
agagacacctgcacct

SEQ ID NO: 6627414 - DNA, 19 bp, Homo sapiens
agagacacctgcacctccc

SEQ ID NO: 6627415 - DNA, 20 bp, Homo sapiens
agagacactcccagggacaa

SEQ ID NO: 6627416 - DNA, 16 bp, Homo sapiens
agagacactggtgggg

SEQ ID NO: 6627417 - DNA, 15 bp, Homo sapiens
agagacagaaagcag

SEQ ID NO: 6627418 - DNA, 23 bp, Homo sapiens
agagacagaactgtccacatctg

SEQ ID NO: 6627419 - DNA, 17 bp, Homo sapiens
agagacagaagcaggct

SEQ ID NO: 6627420 - DNA, 20 bp, Homo sapiens
agagacagaagcaggctgga

SEQ ID NO: 6627421 - DNA, 13 bp, Homo sapiens
agagacagaatga

SEQ ID NO: 6627422 - DNA, 12 bp, Homo sapiens
agagacagagtt

SEQ ID NO: 6627423 - DNA, 23 bp, Homo sapiens
agagacagatacctccaaccctg

SEQ ID NO: 6627424 - DNA, 12 bp, Homo sapiens
agagacagatgc

SEQ ID NO: 6627425 - DNA, 17 bp, Homo sapiens
agagacagcacaggcag

SEQ ID NO: 6627426 - DNA, 16 bp, Homo sapiens
agagacagcccaggat

SEQ ID NO: 6627427 - DNA, 21 bp, Homo sapiens
agagacagctacacagagctt

SEQ ID NO: 6627428 - DNA, 21 bp, Homo sapiens
agagacaggaaaatcctctgg

SEQ ID NO: 6627429 - DNA, 23 bp, Homo sapiens
agagacaggattgggccaacaag

SEQ ID NO: 6627430 - DNA, 14 bp, Homo sapiens
agagacaggcagcc

SEQ ID NO: 6627431 - DNA, 15 bp, Homo sapiens
agagacaggcagccc

SEQ ID NO: 6627432 - DNA, 17 bp, Homo sapiens
agagacaggcagcccag

SEQ ID NO: 6627433 - DNA, 15 bp, Homo sapiens
agagacaggcccaag

SEQ ID NO: 6627434 - DNA, 22 bp, Homo sapiens
agagacagggtctcactgtgtt

SEQ ID NO: 6627435 - DNA, 18 bp, Homo sapiens
agagacagtaacacaatt

SEQ ID NO: 6627436 - DNA, 13 bp, Homo sapiens
agagacagtatgt

SEQ ID NO: 6627437 - DNA, 21 bp, Homo sapiens
agagacagtgtttcgtcatgt

SEQ ID NO: 6627438 - DNA, 16 bp, Homo sapiens
agagacagttctctgt

SEQ ID NO: 6627439 - DNA, 20 bp, Homo sapiens
agagacagttgggtgagaac

SEQ ID NO: 6627440 - DNA, 22 bp, Homo sapiens
agagacatacttgaagggccag

SEQ ID NO: 6627441 - DNA, 24 bp, Homo sapiens
agagacatctttgggcctgtccct

SEQ ID NO: 6627442 - DNA, 17 bp, Homo sapiens
agagacatgagaaaggg

SEQ ID NO: 6627443 - DNA, 17 bp, Homo sapiens
agagacatggaagagag

SEQ ID NO: 6627444 - DNA, 17 bp, Homo sapiens
agagacatgtggcagca

SEQ ID NO: 6627445 - DNA, 18 bp, Homo sapiens
agagacattaactcatta

SEQ ID NO: 6627446 - DNA, 14 bp, Homo sapiens
agagacattcctcc

SEQ ID NO: 6627447 - DNA, 21 bp, Homo sapiens
agagacattgcctccacctct

SEQ ID NO: 6627448 - DNA, 12 bp, Homo sapiens
agagacatttca

SEQ ID NO: 6627449 - DNA, 22 bp, Homo sapiens
agagaccaagcttgtttccctg

SEQ ID NO: 6627450 - DNA, 13 bp, Homo sapiens
agagaccacacca

SEQ ID NO: 6627451 - DNA, 23 bp, Homo sapiens
agagaccacagcaattggctcct

SEQ ID NO: 6627452 - DNA, 19 bp, Homo sapiens
agagaccacccatatcatg

SEQ ID NO: 6627453 - DNA, 13 bp, Homo sapiens
agagaccacttcc

SEQ ID NO: 6627454 - DNA, 19 bp, Homo sapiens
agagaccagcctttcttcc

SEQ ID NO: 6627455 - DNA, 15 bp, Homo sapiens
agagaccaggaggga

SEQ ID NO: 6627456 - DNA, 14 bp, Homo sapiens
agagaccagggctc

SEQ ID NO: 6627457 - DNA, 19 bp, Homo sapiens
agagaccagggctccagcc

SEQ ID NO: 6627458 - DNA, 20 bp, Homo sapiens
agagaccagggctccagccc

SEQ ID NO: 6627459 - DNA, 17 bp, Homo sapiens
agagaccataagagaaa

SEQ ID NO: 6627460 - DNA, 14 bp, Homo sapiens
agagaccatccctg

SEQ ID NO: 6627461 - DNA, 19 bp, Homo sapiens
agagaccatccctgaaggc

SEQ ID NO: 6627462 - DNA, 23 bp, Homo sapiens
agagaccatccctgaaggccccg

SEQ ID NO: 6627463 - DNA, 16 bp, Homo sapiens
agagacccaacagcag

SEQ ID NO: 6627464 - DNA, 16 bp, Homo sapiens
agagacccaaggagga

SEQ ID NO: 6627465 - DNA, 15 bp, Homo sapiens
agagaccccaccgcc

SEQ ID NO: 6627466 - DNA, 21 bp, Homo sapiens
agagaccccagtcaagctcct

SEQ ID NO: 6627467 - DNA, 14 bp, Homo sapiens
agagacccccaggc

SEQ ID NO: 6627468 - DNA, 15 bp, Homo sapiens
agagacccccaggcc

SEQ ID NO: 6627469 - DNA, 19 bp, Homo sapiens
agagaccccgcacccggct

SEQ ID NO: 6627470 - DNA, 15 bp, Homo sapiens
agagaccccggtaat

SEQ ID NO: 6627471 - DNA, 23 bp, Homo sapiens
agagacccctcccctcccaccca

SEQ ID NO: 6627472 - DNA, 19 bp, Homo sapiens
agagaccccttcctttcct

SEQ ID NO: 6627473 - DNA, 21 bp, Homo sapiens
agagaccccttcctttcctct

SEQ ID NO: 6627474 - DNA, 17 bp, Homo sapiens
agagacccgggaaggaa

SEQ ID NO: 6627475 - DNA, 19 bp, Homo sapiens
agagaccctctgccaccag

SEQ ID NO: 6627476 - DNA, 22 bp, Homo sapiens
agagaccggacaagagcctgca

SEQ ID NO: 6627477 - DNA, 22 bp, Homo sapiens
agagaccgtcctcacccctgtc

SEQ ID NO: 6627478 - DNA, 22 bp, Homo sapiens
agagacctagataggtcatgca

SEQ ID NO: 6627479 - DNA, 11 bp, Homo sapiens
agagacctgaa

SEQ ID NO: 6627480 - DNA, 14 bp, Homo sapiens
agagacctgaccca

SEQ ID NO: 6627481 - DNA, 22 bp, Homo sapiens
agagacctgacccaacaccccc

SEQ ID NO: 6627482 - DNA, 14 bp, Homo sapiens
agagacctgaccct

SEQ ID NO: 6627483 - DNA, 14 bp, Homo sapiens
agagacctgccctc

SEQ ID NO: 6627484 - DNA, 16 bp, Homo sapiens
agagacctgctcaggc

SEQ ID NO: 6627485 - DNA, 17 bp, Homo sapiens
agagacctgctccagat

SEQ ID NO: 6627486 - DNA, 16 bp, Homo sapiens
agagacctttgcccac

SEQ ID NO: 6627487 - DNA, 19 bp, Homo sapiens
agagaccttttctctccca

SEQ ID NO: 6627488 - DNA, 23 bp, Homo sapiens
agagaccttttctctcccatacc

SEQ ID NO: 6627489 - DNA, 12 bp, Homo sapiens
agagacgaggtc

SEQ ID NO: 6627490 - DNA, 14 bp, Homo sapiens
agagacgccactcc

SEQ ID NO: 6627491 - DNA, 15 bp, Homo sapiens
agagacgccactccc

SEQ ID NO: 6627492 - DNA, 14 bp, Homo sapiens
agagacgcccagcc

SEQ ID NO: 6627493 - DNA, 22 bp, Homo sapiens
agagacgccctatttctatgtc

SEQ ID NO: 6627494 - DNA, 16 bp, Homo sapiens
agagacggcagcccca

SEQ ID NO: 6627495 - DNA, 17 bp, Homo sapiens
agagacgggccctggtg

SEQ ID NO: 6627496 - DNA, 19 bp, Homo sapiens
agagacggggtttcaccct

SEQ ID NO: 6627497 - DNA, 12 bp, Homo sapiens
agagacggtctg

SEQ ID NO: 6627498 - DNA, 16 bp, Homo sapiens
agagactactctgcct

SEQ ID NO: 6627499 - DNA, 18 bp, Homo sapiens
agagactagacaaataac

SEQ ID NO: 6627500 - DNA, 18 bp, Homo sapiens
agagactatggagcctgg

SEQ ID NO: 6627501 - DNA, 22 bp, Homo sapiens
agagactatggagcctggcaca

SEQ ID NO: 6627502 - DNA, 18 bp, Homo sapiens
agagactcagaggaccca

SEQ ID NO: 6627503 - DNA, 18 bp, Homo sapiens
agagactcagcctgcagt

SEQ ID NO: 6627504 - DNA, 19 bp, Homo sapiens
agagactcagcgctcctcc

SEQ ID NO: 6627505 - DNA, 22 bp, Homo sapiens
agagactcagcgctcctcctgt

SEQ ID NO: 6627506 - DNA, 22 bp, Homo sapiens
agagactcatttcacagccttt

SEQ ID NO: 6627507 - DNA, 14 bp, Homo sapiens
agagactcccagga

SEQ ID NO: 6627508 - DNA, 11 bp, Homo sapiens
agagactcctg

SEQ ID NO: 6627509 - DNA, 13 bp, Homo sapiens
agagactcctgca

SEQ ID NO: 6627510 - DNA, 19 bp, Homo sapiens
agagactcctgcaggcagc

SEQ ID NO: 6627511 - DNA, 21 bp, Homo sapiens
agagactcctgcaggcagcca

SEQ ID NO: 6627512 - DNA, 21 bp, Homo sapiens
agagactccttgagagaccag

SEQ ID NO: 6627513 - DNA, 15 bp, Homo sapiens
agagactcgcctggg

SEQ ID NO: 6627514 - DNA, 14 bp, Homo sapiens
agagactctatttt

SEQ ID NO: 6627515 - DNA, 14 bp, Homo sapiens
agagactctccctg

SEQ ID NO: 6627516 - DNA, 14 bp, Homo sapiens
agagactctggaag

SEQ ID NO: 6627517 - DNA, 23 bp, Homo sapiens
agagactctggaagccccccacc

SEQ ID NO: 6627518 - DNA, 12 bp, Homo sapiens
agagactctgtg

SEQ ID NO: 6627519 - DNA, 13 bp, Homo sapiens
agagactctttat

SEQ ID NO: 6627520 - DNA, 18 bp, Homo sapiens
agagactgaaagcagcag

SEQ ID NO: 6627521 - DNA, 20 bp, Homo sapiens
agagactgaaagcagcagct

SEQ ID NO: 6627522 - DNA, 16 bp, Homo sapiens
agagactgagcagccg

SEQ ID NO: 6627523 - DNA, 21 bp, Homo sapiens
agagactgatccaaaaattat

SEQ ID NO: 6627524 - DNA, 15 bp, Homo sapiens
agagactgcccaccc

SEQ ID NO: 6627525 - DNA, 16 bp, Homo sapiens
agagactgcccaccct

SEQ ID NO: 6627526 - DNA, 18 bp, Homo sapiens
agagactgcgttctgcaa

SEQ ID NO: 6627527 - DNA, 16 bp, Homo sapiens
agagactgcttgacaa

SEQ ID NO: 6627528 - DNA, 14 bp, Homo sapiens
agagactggagcat

SEQ ID NO: 6627529 - DNA, 21 bp, Homo sapiens
agagactggagcatctgactc

SEQ ID NO: 6627530 - DNA, 22 bp, Homo sapiens
agagactggaggcatttctttt

SEQ ID NO: 6627531 - DNA, 23 bp, Homo sapiens
agagactgggaagataggctctg

SEQ ID NO: 6627532 - DNA, 19 bp, Homo sapiens
agagactgttctgttcctt

SEQ ID NO: 6627533 - DNA, 16 bp, Homo sapiens
agagactgtttgaatg

SEQ ID NO: 6627534 - DNA, 18 bp, Homo sapiens
agagacttaaaggacagg

SEQ ID NO: 6627535 - DNA, 23 bp, Homo sapiens
agagacttgcagttagactcaaa

SEQ ID NO: 6627536 - DNA, 15 bp, Homo sapiens
agagacttggatgag

SEQ ID NO: 6627537 - DNA, 16 bp, Homo sapiens
agagacttggggacca

SEQ ID NO: 6627538 - DNA, 19 bp, Homo sapiens
agagacttgtgctcaagga

SEQ ID NO: 6627539 - DNA, 12 bp, Homo sapiens
agagacttgttt

SEQ ID NO: 6627540 - DNA, 21 bp, Homo sapiens
agagactttgatactaccagg

SEQ ID NO: 6627541 - DNA, 16 bp, Homo sapiens
agagactttgtcactt

SEQ ID NO: 6627542 - DNA, 14 bp, Homo sapiens
agagagaaaaacaa

SEQ ID NO: 6627543 - DNA, 14 bp, Homo sapiens
agagagaaaaagag

SEQ ID NO: 6627544 - DNA, 15 bp, Homo sapiens
agagagaaaaagaga

SEQ ID NO: 6627545 - DNA, 16 bp, Homo sapiens
agagagaaaaagagag

SEQ ID NO: 6627546 - DNA, 18 bp, Homo sapiens
agagagaaaaagagagag

SEQ ID NO: 6627547 - DNA, 16 bp, Homo sapiens
agagagaaaataaaaa

SEQ ID NO: 6627548 - DNA, 20 bp, Homo sapiens
agagagaaaataaaaagtta

SEQ ID NO: 6627549 - DNA, 22 bp, Homo sapiens
agagagaaaataaaaagttaaa

SEQ ID NO: 6627550 - DNA, 21 bp, Homo sapiens
agagagaaacggtcctttgtt

SEQ ID NO: 6627551 - DNA, 12 bp, Homo sapiens
agagagaaagaa

SEQ ID NO: 6627552 - DNA, 14 bp, Homo sapiens
agagagaaagaatg

SEQ ID NO: 6627553 - DNA, 15 bp, Homo sapiens
agagagaaagaatga

SEQ ID NO: 6627554 - DNA, 14 bp, Homo sapiens
agagagaaagagag

SEQ ID NO: 6627555 - DNA, 15 bp, Homo sapiens
agagagaaagcatat

SEQ ID NO: 6627556 - DNA, 14 bp, Homo sapiens
agagagaaagccag

SEQ ID NO: 6627557 - DNA, 22 bp, Homo sapiens
agagagaaagccaggcaggtag

SEQ ID NO: 6627558 - DNA, 19 bp, Homo sapiens
agagagaacctaactgtat

SEQ ID NO: 6627559 - DNA, 11 bp, Homo sapiens
agagagaagcc

SEQ ID NO: 6627560 - DNA, 18 bp, Homo sapiens
agagagaagtcggccagg

SEQ ID NO: 6627561 - DNA, 19 bp, Homo sapiens
agagagaagtgcccctgct

SEQ ID NO: 6627562 - DNA, 11 bp, Homo sapiens
agagagaataa

SEQ ID NO: 6627563 - DNA, 19 bp, Homo sapiens
agagagaatagagctgcca

SEQ ID NO: 6627564 - DNA, 15 bp, Homo sapiens
agagagaatgagagc

SEQ ID NO: 6627565 - DNA, 21 bp, Homo sapiens
agagagaatttgctttatctg

SEQ ID NO: 6627566 - DNA, 13 bp, Homo sapiens
agagagacagcac

SEQ ID NO: 6627567 - DNA, 16 bp, Homo sapiens
agagagacagcacagg

SEQ ID NO: 6627568 - DNA, 16 bp, Homo sapiens
agagagaccacttttc

SEQ ID NO: 6627569 - DNA, 19 bp, Homo sapiens
agagagaccccgcacccgg

SEQ ID NO: 6627570 - DNA, 14 bp, Homo sapiens
agagagaccctcac

SEQ ID NO: 6627571 - DNA, 20 bp, Homo sapiens
agagagacctcatcctgctc

SEQ ID NO: 6627572 - DNA, 17 bp, Homo sapiens
agagagactcaaagaga

SEQ ID NO: 6627573 - DNA, 17 bp, Homo sapiens
agagagactgagggaga

SEQ ID NO: 6627574 - DNA, 22 bp, Homo sapiens
agagagacttggaagaggagga

SEQ ID NO: 6627575 - DNA, 15 bp, Homo sapiens
agagagagaaagaat

SEQ ID NO: 6627576 - DNA, 15 bp, Homo sapiens
agagagagaaagaga

SEQ ID NO: 6627577 - DNA, 11 bp, Homo sapiens
agagagagaag

SEQ ID NO: 6627578 - DNA, 12 bp, Homo sapiens
agagagagaagg

SEQ ID NO: 6627579 - DNA, 14 bp, Homo sapiens
agagagagaagggg

SEQ ID NO: 6627580 - DNA, 13 bp, Homo sapiens
agagagagaagtg

SEQ ID NO: 6627581 - DNA, 12 bp, Homo sapiens
agagagagactg

SEQ ID NO: 6627582 - DNA, 13 bp, Homo sapiens
agagagagagaag

SEQ ID NO: 6627583 - DNA, 14 bp, Homo sapiens
agagagagagagag

SEQ ID NO: 6627584 - DNA, 15 bp, Homo sapiens
agagagagagagagg

SEQ ID NO: 6627585 - DNA, 13 bp, Homo sapiens
agagagagagagg

SEQ ID NO: 6627586 - DNA, 14 bp, Homo sapiens
agagagagagaggt

SEQ ID NO: 6627587 - DNA, 12 bp, Homo sapiens
agagagagaggt

SEQ ID NO: 6627588 - DNA, 12 bp, Homo sapiens
agagagagcctt

SEQ ID NO: 6627589 - DNA, 23 bp, Homo sapiens
agagagagcgcgggagagagtga

SEQ ID NO: 6627590 - DNA, 15 bp, Homo sapiens
agagagagctgtatt

SEQ ID NO: 6627591 - DNA, 16 bp, Homo sapiens
agagagagctgtatta

SEQ ID NO: 6627592 - DNA, 15 bp, Homo sapiens
agagagaggcctggg

SEQ ID NO: 6627593 - DNA, 22 bp, Homo sapiens
agagagagggagaaacaagtgg

SEQ ID NO: 6627594 - DNA, 23 bp, Homo sapiens
agagagagggcctgctggagagc

SEQ ID NO: 6627595 - DNA, 16 bp, Homo sapiens
agagagagggcgccca

SEQ ID NO: 6627596 - DNA, 17 bp, Homo sapiens
agagagagggcgcccag

SEQ ID NO: 6627597 - DNA, 23 bp, Homo sapiens
agagagagggcgcccagcccagg

SEQ ID NO: 6627598 - DNA, 19 bp, Homo sapiens
agagagaggtatttaactg

SEQ ID NO: 6627599 - DNA, 14 bp, Homo sapiens
agagagagtgtttg

SEQ ID NO: 6627600 - DNA, 21 bp, Homo sapiens
agagagatcaaatggaaagga

SEQ ID NO: 6627601 - DNA, 19 bp, Homo sapiens
agagagatgagaagccagg

SEQ ID NO: 6627602 - DNA, 19 bp, Homo sapiens
agagagatgggagctcctc

SEQ ID NO: 6627603 - DNA, 14 bp, Homo sapiens
agagagatgtgtaa

SEQ ID NO: 6627604 - DNA, 14 bp, Homo sapiens
agagagatgttttg

SEQ ID NO: 6627605 - DNA, 19 bp, Homo sapiens
agagagattgaactttgag

SEQ ID NO: 6627606 - DNA, 22 bp, Homo sapiens
agagagcaaacataggaatatg

SEQ ID NO: 6627607 - DNA, 20 bp, Homo sapiens
agagagcaaagatggcttcc

SEQ ID NO: 6627608 - DNA, 11 bp, Homo sapiens
agagagcaaga

SEQ ID NO: 6627609 - DNA, 13 bp, Homo sapiens
agagagcaaggca

SEQ ID NO: 6627610 - DNA, 16 bp, Homo sapiens
agagagcaatcttgct

SEQ ID NO: 6627611 - DNA, 12 bp, Homo sapiens
agagagcacctg

SEQ ID NO: 6627612 - DNA, 15 bp, Homo sapiens
agagagcagagaagt

SEQ ID NO: 6627613 - DNA, 14 bp, Homo sapiens
agagagcagcattc

SEQ ID NO: 6627614 - DNA, 17 bp, Homo sapiens
agagagcagcttctgcc

SEQ ID NO: 6627615 - DNA, 15 bp, Homo sapiens
agagagcaggggagc

SEQ ID NO: 6627616 - DNA, 16 bp, Homo sapiens
agagagcaggggagct

SEQ ID NO: 6627617 - DNA, 16 bp, Homo sapiens
agagagccaggatgcc

SEQ ID NO: 6627618 - DNA, 15 bp, Homo sapiens
agagagccctggtcc

SEQ ID NO: 6627619 - DNA, 11 bp, Homo sapiens
agagagccctt

SEQ ID NO: 6627620 - DNA, 22 bp, Homo sapiens
agagagcctagaacatccctgg

SEQ ID NO: 6627621 - DNA, 12 bp, Homo sapiens
agagagcctgcc

SEQ ID NO: 6627622 - DNA, 13 bp, Homo sapiens
agagagcctgtca

SEQ ID NO: 6627623 - DNA, 20 bp, Homo sapiens
agagagcctgtcaccagagc

SEQ ID NO: 6627624 - DNA, 19 bp, Homo sapiens
agagagccttaatggatgc

SEQ ID NO: 6627625 - DNA, 18 bp, Homo sapiens
agagagcgcgggagagag

SEQ ID NO: 6627626 - DNA, 20 bp, Homo sapiens
agagagcgcgggagagagtg

SEQ ID NO: 6627627 - DNA, 17 bp, Homo sapiens
agagagcggcttcccca

SEQ ID NO: 6627628 - DNA, 20 bp, Homo sapiens
agagagctcgttcctacctg

SEQ ID NO: 6627629 - DNA, 15 bp, Homo sapiens
agagagctgtattaa

SEQ ID NO: 6627630 - DNA, 19 bp, Homo sapiens
agagagctgtattaagtga

SEQ ID NO: 6627631 - DNA, 21 bp, Homo sapiens
agagagctgtattaagtgact

SEQ ID NO: 6627632 - DNA, 17 bp, Homo sapiens
agagagcttagcctgga

SEQ ID NO: 6627633 - DNA, 20 bp, Homo sapiens
agagagcttctgttgctgcc

SEQ ID NO: 6627634 - DNA, 12 bp, Homo sapiens
agagaggaaaag

SEQ ID NO: 6627635 - DNA, 19 bp, Homo sapiens
agagaggaaggagattcca

SEQ ID NO: 6627636 - DNA, 19 bp, Homo sapiens
agagaggacaaaataaagt

SEQ ID NO: 6627637 - DNA, 18 bp, Homo sapiens
agagaggacagtttagga

SEQ ID NO: 6627638 - DNA, 16 bp, Homo sapiens
agagaggagaaacaca

SEQ ID NO: 6627639 - DNA, 18 bp, Homo sapiens
agagaggagaaacacatc

SEQ ID NO: 6627640 - DNA, 15 bp, Homo sapiens
agagaggagcacctg

SEQ ID NO: 6627641 - DNA, 18 bp, Homo sapiens
agagaggaggcagccccc

SEQ ID NO: 6627642 - DNA, 20 bp, Homo sapiens
agagaggaggcagccccctc

SEQ ID NO: 6627643 - DNA, 13 bp, Homo sapiens
agagaggagtcag

SEQ ID NO: 6627644 - DNA, 13 bp, Homo sapiens
agagaggagttca

SEQ ID NO: 6627645 - DNA, 15 bp, Homo sapiens
agagaggagttcaat

SEQ ID NO: 6627646 - DNA, 17 bp, Homo sapiens
agagaggagttcaatga

SEQ ID NO: 6627647 - DNA, 20 bp, Homo sapiens
agagaggatacatttaataa

SEQ ID NO: 6627648 - DNA, 22 bp, Homo sapiens
agagaggatacatttaataaaa

SEQ ID NO: 6627649 - DNA, 23 bp, Homo sapiens
agagaggatgtggaaagcacttt

SEQ ID NO: 6627650 - DNA, 18 bp, Homo sapiens
agagaggcacctgctgga

SEQ ID NO: 6627651 - DNA, 15 bp, Homo sapiens
agagaggcagcaagt

SEQ ID NO: 6627652 - DNA, 11 bp, Homo sapiens
agagaggcatg

SEQ ID NO: 6627653 - DNA, 19 bp, Homo sapiens
agagaggcccgcccgccca

SEQ ID NO: 6627654 - DNA, 16 bp, Homo sapiens
agagaggcctgctttg

SEQ ID NO: 6627655 - DNA, 14 bp, Homo sapiens
agagaggccttttg

SEQ ID NO: 6627656 - DNA, 23 bp, Homo sapiens
agagaggcgcgtctgccccaccc

SEQ ID NO: 6627657 - DNA, 15 bp, Homo sapiens
agagaggcgtcctgg

SEQ ID NO: 6627658 - DNA, 16 bp, Homo sapiens
agagaggctctggggc

SEQ ID NO: 6627659 - DNA, 16 bp, Homo sapiens
agagaggctgcctcag

SEQ ID NO: 6627660 - DNA, 17 bp, Homo sapiens
agagagggaaaaggcag

SEQ ID NO: 6627661 - DNA, 23 bp, Homo sapiens
agagagggaaaaggcaggtgctt

SEQ ID NO: 6627662 - DNA, 14 bp, Homo sapiens
agagagggaagatg

SEQ ID NO: 6627663 - DNA, 19 bp, Homo sapiens
agagagggaagctgaggcc

SEQ ID NO: 6627664 - DNA, 22 bp, Homo sapiens
agagagggaagctgaggcccat

SEQ ID NO: 6627665 - DNA, 18 bp, Homo sapiens
agagagggaattctcttg

SEQ ID NO: 6627666 - DNA, 23 bp, Homo sapiens
agagagggacacatgcccctccc

SEQ ID NO: 6627667 - DNA, 13 bp, Homo sapiens
agagagggactca

SEQ ID NO: 6627668 - DNA, 22 bp, Homo sapiens
agagagggactcaagggaaagg

SEQ ID NO: 6627669 - DNA, 16 bp, Homo sapiens
agagagggagaagaag

SEQ ID NO: 6627670 - DNA, 19 bp, Homo sapiens
agagagggagaagaagtca

SEQ ID NO: 6627671 - DNA, 17 bp, Homo sapiens
agagagggaggtatgga

SEQ ID NO: 6627672 - DNA, 15 bp, Homo sapiens
agagagggcaagtgt

SEQ ID NO: 6627673 - DNA, 15 bp, Homo sapiens
agagagggcatagga

SEQ ID NO: 6627674 - DNA, 13 bp, Homo sapiens
agagagggcccag

SEQ ID NO: 6627675 - DNA, 21 bp, Homo sapiens
agagagggcgcccagcccagg

SEQ ID NO: 6627676 - DNA, 19 bp, Homo sapiens
agagaggggaaagtgtgag

SEQ ID NO: 6627677 - DNA, 17 bp, Homo sapiens
agagaggggacatttcc

SEQ ID NO: 6627678 - DNA, 23 bp, Homo sapiens
agagaggggcaaatagagagtct

SEQ ID NO: 6627679 - DNA, 20 bp, Homo sapiens
agagaggggcctctggctgc

SEQ ID NO: 6627680 - DNA, 21 bp, Homo sapiens
agagaggggcctctggctgcc

SEQ ID NO: 6627681 - DNA, 17 bp, Homo sapiens
agagaggggcctgcagg

SEQ ID NO: 6627682 - DNA, 16 bp, Homo sapiens
agagagggggcactgt

SEQ ID NO: 6627683 - DNA, 18 bp, Homo sapiens
agagagggggcactgtgg

SEQ ID NO: 6627684 - DNA, 22 bp, Homo sapiens
agagagggtggtgacctctgcc

SEQ ID NO: 6627685 - DNA, 23 bp, Homo sapiens
agagagggtggtgacctctgcct

SEQ ID NO: 6627686 - DNA, 17 bp, Homo sapiens
agagaggtatttaactg

SEQ ID NO: 6627687 - DNA, 22 bp, Homo sapiens
agagaggtcaagcccaggagga

SEQ ID NO: 6627688 - DNA, 12 bp, Homo sapiens
agagaggtccag

SEQ ID NO: 6627689 - DNA, 16 bp, Homo sapiens
agagaggtggatcctg

SEQ ID NO: 6627690 - DNA, 13 bp, Homo sapiens
agagaggtggcca

SEQ ID NO: 6627691 - DNA, 21 bp, Homo sapiens
agagaggtgggcagcagctca

SEQ ID NO: 6627692 - DNA, 15 bp, Homo sapiens
agagaggttaacaga

SEQ ID NO: 6627693 - DNA, 20 bp, Homo sapiens
agagaggttaacagatttat

SEQ ID NO: 6627694 - DNA, 17 bp, Homo sapiens
agagaggttctggggag

SEQ ID NO: 6627695 - DNA, 21 bp, Homo sapiens
agagaggttctggggaggaag

SEQ ID NO: 6627696 - DNA, 18 bp, Homo sapiens
agagagtacactgtgtct

SEQ ID NO: 6627697 - DNA, 21 bp, Homo sapiens
agagagtagctgcagccttca

SEQ ID NO: 6627698 - DNA, 20 bp, Homo sapiens
agagagtcccactgcctcag

SEQ ID NO: 6627699 - DNA, 13 bp, Homo sapiens
agagagtgaaatt

SEQ ID NO: 6627700 - DNA, 18 bp, Homo sapiens
agagagtgaatacactgg

SEQ ID NO: 6627701 - DNA, 15 bp, Homo sapiens
agagagtgagagaga

SEQ ID NO: 6627702 - DNA, 19 bp, Homo sapiens
agagagtgagcatgagctc

SEQ ID NO: 6627703 - DNA, 14 bp, Homo sapiens
agagagtggctggg

SEQ ID NO: 6627704 - DNA, 16 bp, Homo sapiens
agagagtggtaaaaaa

SEQ ID NO: 6627705 - DNA, 18 bp, Homo sapiens
agagagtggtaaaaaaga

SEQ ID NO: 6627706 - DNA, 19 bp, Homo sapiens
agagagtggtaaaaaagaa

SEQ ID NO: 6627707 - DNA, 20 bp, Homo sapiens
agagagtggtaaaaaagaaa

SEQ ID NO: 6627708 - DNA, 14 bp, Homo sapiens
agagagtgtgtgtt

SEQ ID NO: 6627709 - DNA, 15 bp, Homo sapiens
agagagtgttgaaac

SEQ ID NO: 6627710 - DNA, 22 bp, Homo sapiens
agagagttaatcaactgaaagt

SEQ ID NO: 6627711 - DNA, 15 bp, Homo sapiens
agagagttgaaccta

SEQ ID NO: 6627712 - DNA, 13 bp, Homo sapiens
agagagtttcaaa

SEQ ID NO: 6627713 - DNA, 13 bp, Homo sapiens
agagagtttgtaa

SEQ ID NO: 6627714 - DNA, 14 bp, Homo sapiens
agagataaaaatca

SEQ ID NO: 6627715 - DNA, 21 bp, Homo sapiens
agagataaaccaataaatcca

SEQ ID NO: 6627716 - DNA, 17 bp, Homo sapiens
agagataaatatttatg

SEQ ID NO: 6627717 - DNA, 18 bp, Homo sapiens
agagataaatatttatgc

SEQ ID NO: 6627718 - DNA, 13 bp, Homo sapiens
agagataatgagg

SEQ ID NO: 6627719 - DNA, 15 bp, Homo sapiens
agagataatgaggca

SEQ ID NO: 6627720 - DNA, 15 bp, Homo sapiens
agagataattcttaa

SEQ ID NO: 6627721 - DNA, 14 bp, Homo sapiens
agagataattgctt

SEQ ID NO: 6627722 - DNA, 19 bp, Homo sapiens
agagataccaagatgccat

SEQ ID NO: 6627723 - DNA, 15 bp, Homo sapiens
agagataccctctga

SEQ ID NO: 6627724 - DNA, 16 bp, Homo sapiens
agagataccttgaaaa

SEQ ID NO: 6627725 - DNA, 16 bp, Homo sapiens
agagatataaatgaag

SEQ ID NO: 6627726 - DNA, 17 bp, Homo sapiens
agagatatacaaatata

SEQ ID NO: 6627727 - DNA, 16 bp, Homo sapiens
agagatatagatatta

SEQ ID NO: 6627728 - DNA, 13 bp, Homo sapiens
agagatatatata

SEQ ID NO: 6627729 - DNA, 16 bp, Homo sapiens
agagatatatctgaaa

SEQ ID NO: 6627730 - DNA, 18 bp, Homo sapiens
agagatatctatgaaaac

SEQ ID NO: 6627731 - DNA, 20 bp, Homo sapiens
agagatatgcagaaggaagg

SEQ ID NO: 6627732 - DNA, 20 bp, Homo sapiens
agagatatgtagaaggcaca

SEQ ID NO: 6627733 - DNA, 21 bp, Homo sapiens
agagatattgatattgaagga

SEQ ID NO: 6627734 - DNA, 13 bp, Homo sapiens
agagatattggaa

SEQ ID NO: 6627735 - DNA, 13 bp, Homo sapiens
agagatatttaaa

SEQ ID NO: 6627736 - DNA, 17 bp, Homo sapiens
agagatattttaaaatg

SEQ ID NO: 6627737 - DNA, 20 bp, Homo sapiens
agagatattttaaaatgaga

SEQ ID NO: 6627738 - DNA, 18 bp, Homo sapiens
agagatattttgggcatg

SEQ ID NO: 6627739 - DNA, 23 bp, Homo sapiens
agagatattttgggcatgtgggc

SEQ ID NO: 6627740 - DNA, 14 bp, Homo sapiens
agagatattttgta

SEQ ID NO: 6627741 - DNA, 17 bp, Homo sapiens
agagatcacccactcct

SEQ ID NO: 6627742 - DNA, 18 bp, Homo sapiens
agagatcagcagtggcag

SEQ ID NO: 6627743 - DNA, 15 bp, Homo sapiens
agagatcatgagaaa

SEQ ID NO: 6627744 - DNA, 16 bp, Homo sapiens
agagatccaggaagca

SEQ ID NO: 6627745 - DNA, 21 bp, Homo sapiens
agagatcccaagtagaatctc

SEQ ID NO: 6627746 - DNA, 19 bp, Homo sapiens
agagatccctgcagaaccc

SEQ ID NO: 6627747 - DNA, 22 bp, Homo sapiens
agagatcccttaagaagttaga

SEQ ID NO: 6627748 - DNA, 22 bp, Homo sapiens
agagatcctacttctctgagtc

SEQ ID NO: 6627749 - DNA, 20 bp, Homo sapiens
agagatcgacagacagccag

SEQ ID NO: 6627750 - DNA, 15 bp, Homo sapiens
agagatcgagaccat

SEQ ID NO: 6627751 - DNA, 13 bp, Homo sapiens
agagatctacaca

SEQ ID NO: 6627752 - DNA, 18 bp, Homo sapiens
agagatctacacatgttg

SEQ ID NO: 6627753 - DNA, 16 bp, Homo sapiens
agagatctagaaagtg

SEQ ID NO: 6627754 - DNA, 12 bp, Homo sapiens
agagatctgtgt

SEQ ID NO: 6627755 - DNA, 16 bp, Homo sapiens
agagatcttgagagag

SEQ ID NO: 6627756 - DNA, 19 bp, Homo sapiens
agagatctttctttccaaa

SEQ ID NO: 6627757 - DNA, 15 bp, Homo sapiens
agagatgaaataatt

SEQ ID NO: 6627758 - DNA, 15 bp, Homo sapiens
agagatgacaaacca

SEQ ID NO: 6627759 - DNA, 18 bp, Homo sapiens
agagatgacaacaaattt

SEQ ID NO: 6627760 - DNA, 17 bp, Homo sapiens
agagatgagaagccagg

SEQ ID NO: 6627761 - DNA, 13 bp, Homo sapiens
agagatgagccca

SEQ ID NO: 6627762 - DNA, 14 bp, Homo sapiens
agagatgagcccac

SEQ ID NO: 6627763 - DNA, 14 bp, Homo sapiens
agagatgaggaaat

SEQ ID NO: 6627764 - DNA, 17 bp, Homo sapiens
agagatgagtgtctgga

SEQ ID NO: 6627765 - DNA, 22 bp, Homo sapiens
agagatgattcggatttgacaa

SEQ ID NO: 6627766 - DNA, 14 bp, Homo sapiens
agagatgcaatgat

SEQ ID NO: 6627767 - DNA, 17 bp, Homo sapiens
agagatgcagaaatatt

SEQ ID NO: 6627768 - DNA, 14 bp, Homo sapiens
agagatgccagccc

SEQ ID NO: 6627769 - DNA, 18 bp, Homo sapiens
agagatgccagcccttca

SEQ ID NO: 6627770 - DNA, 12 bp, Homo sapiens
agagatgcctcc

SEQ ID NO: 6627771 - DNA, 23 bp, Homo sapiens
agagatgctactgtcagtgtcct

SEQ ID NO: 6627772 - DNA, 23 bp, Homo sapiens
agagatgctgtaacttaaaatag

SEQ ID NO: 6627773 - DNA, 22 bp, Homo sapiens
agagatgcttggagcaatcaga

SEQ ID NO: 6627774 - DNA, 22 bp, Homo sapiens
agagatggacagttcacaccct

SEQ ID NO: 6627775 - DNA, 14 bp, Homo sapiens
agagatggagaaat

SEQ ID NO: 6627776 - DNA, 18 bp, Homo sapiens
agagatggagaaatagac

SEQ ID NO: 6627777 - DNA, 19 bp, Homo sapiens
agagatggagaaatagact

SEQ ID NO: 6627778 - DNA, 15 bp, Homo sapiens
agagatggaggagga

SEQ ID NO: 6627779 - DNA, 24 bp, Homo sapiens
agagatggctccttgggatgaaga

SEQ ID NO: 6627780 - DNA, 16 bp, Homo sapiens
agagatgggacaagca

SEQ ID NO: 6627781 - DNA, 16 bp, Homo sapiens
agagatgggactggga

SEQ ID NO: 6627782 - DNA, 22 bp, Homo sapiens
agagatgggccaggcagagaac

SEQ ID NO: 6627783 - DNA, 21 bp, Homo sapiens
agagatgtgcaattgatttct

SEQ ID NO: 6627784 - DNA, 13 bp, Homo sapiens
agagatgtgcaga

SEQ ID NO: 6627785 - DNA, 18 bp, Homo sapiens
agagatgtgcccccaccc

SEQ ID NO: 6627786 - DNA, 19 bp, Homo sapiens
agagatgtgcccccacccc

SEQ ID NO: 6627787 - DNA, 13 bp, Homo sapiens
agagatgtgtcca

SEQ ID NO: 6627788 - DNA, 20 bp, Homo sapiens
agagatgtgtgttgatactg

SEQ ID NO: 6627789 - DNA, 14 bp, Homo sapiens
agagatgttttcaa

SEQ ID NO: 6627790 - DNA, 12 bp, Homo sapiens
agagatgttttt

SEQ ID NO: 6627791 - DNA, 20 bp, Homo sapiens
agagatgtttttaaaagttt

SEQ ID NO: 6627792 - DNA, 22 bp, Homo sapiens
agagattaaaaaaggtagtttt

SEQ ID NO: 6627793 - DNA, 15 bp, Homo sapiens
agagattaattttaa

SEQ ID NO: 6627794 - DNA, 20 bp, Homo sapiens
agagattacctcctgagaaa

SEQ ID NO: 6627795 - DNA, 12 bp, Homo sapiens
agagattagaac

SEQ ID NO: 6627796 - DNA, 18 bp, Homo sapiens
agagattagcatgaaagg

SEQ ID NO: 6627797 - DNA, 12 bp, Homo sapiens
agagattataac

SEQ ID NO: 6627798 - DNA, 18 bp, Homo sapiens
agagattattcaacagag

SEQ ID NO: 6627799 - DNA, 15 bp, Homo sapiens
agagattcattttct

SEQ ID NO: 6627800 - DNA, 12 bp, Homo sapiens
agagattctgat

SEQ ID NO: 6627801 - DNA, 19 bp, Homo sapiens
agagattctgatttgccac

SEQ ID NO: 6627802 - DNA, 20 bp, Homo sapiens
agagattctgtgatctttta

SEQ ID NO: 6627803 - DNA, 20 bp, Homo sapiens
agagattgacttcagaaact

SEQ ID NO: 6627804 - DNA, 23 bp, Homo sapiens
agagattgacttcagaaactttt

SEQ ID NO: 6627805 - DNA, 18 bp, Homo sapiens
agagattgccccagagcc

SEQ ID NO: 6627806 - DNA, 14 bp, Homo sapiens
agagattgctaatt

SEQ ID NO: 6627807 - DNA, 21 bp, Homo sapiens
agagattggaatgggcagctc

SEQ ID NO: 6627808 - DNA, 22 bp, Homo sapiens
agagattggaatgggcagctca

SEQ ID NO: 6627809 - DNA, 20 bp, Homo sapiens
agagattggatcaagtatta

SEQ ID NO: 6627810 - DNA, 20 bp, Homo sapiens
agagattgggagaaatcatc

SEQ ID NO: 6627811 - DNA, 19 bp, Homo sapiens
agagattgggggggcttgg

SEQ ID NO: 6627812 - DNA, 14 bp, Homo sapiens
agagattgtagtat

SEQ ID NO: 6627813 - DNA, 17 bp, Homo sapiens
agagattgtagtattta

SEQ ID NO: 6627814 - DNA, 22 bp, Homo sapiens
agagattgtgcgttcaaaccta

SEQ ID NO: 6627815 - DNA, 21 bp, Homo sapiens
agagattgtggtggtgctaaa

SEQ ID NO: 6627816 - DNA, 22 bp, Homo sapiens
agagattgtggtggtgctaaag

SEQ ID NO: 6627817 - DNA, 13 bp, Homo sapiens
agagatttaatta

SEQ ID NO: 6627818 - DNA, 21 bp, Homo sapiens
agagatttatataaatgtaaa

SEQ ID NO: 6627819 - DNA, 14 bp, Homo sapiens
agagatttatcttt

SEQ ID NO: 6627820 - DNA, 13 bp, Homo sapiens
agagatttcatag

SEQ ID NO: 6627821 - DNA, 16 bp, Homo sapiens
agagatttcatagcta

SEQ ID NO: 6627822 - DNA, 21 bp, Homo sapiens
agagatttcctccatggtgga

SEQ ID NO: 6627823 - DNA, 17 bp, Homo sapiens
agagatttgctttttct

SEQ ID NO: 6627824 - DNA, 17 bp, Homo sapiens
agagatttgtctaattg

SEQ ID NO: 6627825 - DNA, 16 bp, Homo sapiens
agagattttatgttta

SEQ ID NO: 6627826 - DNA, 18 bp, Homo sapiens
agagattttatgtttaaa

SEQ ID NO: 6627827 - DNA, 16 bp, Homo sapiens
agagattttcatttta

SEQ ID NO: 6627828 - DNA, 14 bp, Homo sapiens
agagattttctctt

SEQ ID NO: 6627829 - DNA, 18 bp, Homo sapiens
agagattttgtcgggaca

SEQ ID NO: 6627830 - DNA, 13 bp, Homo sapiens
agagatttttgtt

SEQ ID NO: 6627831 - DNA, 22 bp, Homo sapiens
agagatttttttgttgtttgtt

SEQ ID NO: 6627832 - DNA, 23 bp, Homo sapiens
agagcaaaaatgtaaaaaacaaa

SEQ ID NO: 6627833 - DNA, 19 bp, Homo sapiens
agagcaaaactcagtctca

SEQ ID NO: 6627834 - DNA, 19 bp, Homo sapiens
agagcaaaactccgtctca

SEQ ID NO: 6627835 - DNA, 21 bp, Homo sapiens
agagcaaaagcctcagaaagg

SEQ ID NO: 6627836 - DNA, 16 bp, Homo sapiens
agagcaaaagggagga

SEQ ID NO: 6627837 - DNA, 23 bp, Homo sapiens
agagcaaaatgctcttgtccctg

SEQ ID NO: 6627838 - DNA, 16 bp, Homo sapiens
agagcaaacagaaaaa

SEQ ID NO: 6627839 - DNA, 13 bp, Homo sapiens
agagcaaacttta

SEQ ID NO: 6627840 - DNA, 17 bp, Homo sapiens
agagcaaagatggcttc

SEQ ID NO: 6627841 - DNA, 19 bp, Homo sapiens
agagcaaagcatcaaagaa

SEQ ID NO: 6627842 - DNA, 16 bp, Homo sapiens
agagcaaaggagaaat

SEQ ID NO: 6627843 - DNA, 19 bp, Homo sapiens
agagcaaaggcccatgccc

SEQ ID NO: 6627844 - DNA, 15 bp, Homo sapiens
agagcaaagggccag

SEQ ID NO: 6627845 - DNA, 19 bp, Homo sapiens
agagcaaatgcaaaaataa

SEQ ID NO: 6627846 - DNA, 20 bp, Homo sapiens
agagcaaatgcaaaaataac

SEQ ID NO: 6627847 - DNA, 13 bp, Homo sapiens
agagcaacaagta

SEQ ID NO: 6627848 - DNA, 13 bp, Homo sapiens
agagcaacccctg

SEQ ID NO: 6627849 - DNA, 21 bp, Homo sapiens
agagcaacccctggaccccag

SEQ ID NO: 6627850 - DNA, 22 bp, Homo sapiens
agagcaacccctggaccccagc

SEQ ID NO: 6627851 - DNA, 24 bp, Homo sapiens
agagcaacccctggaccccagcct

SEQ ID NO: 6627852 - DNA, 17 bp, Homo sapiens
agagcaacctctcactc

SEQ ID NO: 6627853 - DNA, 18 bp, Homo sapiens
agagcaacctctgtatta

SEQ ID NO: 6627854 - DNA, 12 bp, Homo sapiens
agagcaagaagg

SEQ ID NO: 6627855 - DNA, 13 bp, Homo sapiens
agagcaagaagga

SEQ ID NO: 6627856 - DNA, 14 bp, Homo sapiens
agagcaagaccctg

SEQ ID NO: 6627857 - DNA, 19 bp, Homo sapiens
agagcaagactccatttca

SEQ ID NO: 6627858 - DNA, 20 bp, Homo sapiens
agagcaagactccatttcaa

SEQ ID NO: 6627859 - DNA, 15 bp, Homo sapiens
agagcaagactctgt

SEQ ID NO: 6627860 - DNA, 12 bp, Homo sapiens
agagcaagcctt

SEQ ID NO: 6627861 - DNA, 18 bp, Homo sapiens
agagcaagcctttgacct

SEQ ID NO: 6627862 - DNA, 17 bp, Homo sapiens
agagcaagcttttttat

SEQ ID NO: 6627863 - DNA, 18 bp, Homo sapiens
agagcaagcttttttatt

SEQ ID NO: 6627864 - DNA, 22 bp, Homo sapiens
agagcaaggtcatgaaggaggg

SEQ ID NO: 6627865 - DNA, 14 bp, Homo sapiens
agagcaagtctgga

SEQ ID NO: 6627866 - DNA, 12 bp, Homo sapiens
agagcaataaca

SEQ ID NO: 6627867 - DNA, 17 bp, Homo sapiens
agagcaataacactata

SEQ ID NO: 6627868 - DNA, 19 bp, Homo sapiens
agagcaatcttgctgtgaa

SEQ ID NO: 6627869 - DNA, 17 bp, Homo sapiens
agagcaattccaggctg

SEQ ID NO: 6627870 - DNA, 13 bp, Homo sapiens
agagcaattgcag

SEQ ID NO: 6627871 - DNA, 16 bp, Homo sapiens
agagcaattgcagcag

SEQ ID NO: 6627872 - DNA, 22 bp, Homo sapiens
agagcaatttacctggtactaa

SEQ ID NO: 6627873 - DNA, 17 bp, Homo sapiens
agagcacaaacattttt

SEQ ID NO: 6627874 - DNA, 14 bp, Homo sapiens
agagcacaaacttc

SEQ ID NO: 6627875 - DNA, 15 bp, Homo sapiens
agagcacaaacttca

SEQ ID NO: 6627876 - DNA, 17 bp, Homo sapiens
agagcacaagaaggcca

SEQ ID NO: 6627877 - DNA, 18 bp, Homo sapiens
agagcacaagaaggccag

SEQ ID NO: 6627878 - DNA, 16 bp, Homo sapiens
agagcacacagagaag

SEQ ID NO: 6627879 - DNA, 18 bp, Homo sapiens
agagcacacagagaaggg

SEQ ID NO: 6627880 - DNA, 19 bp, Homo sapiens
agagcacacttatttatga

SEQ ID NO: 6627881 - DNA, 21 bp, Homo sapiens
agagcacacttatttatgaat

SEQ ID NO: 6627882 - DNA, 22 bp, Homo sapiens
agagcacacttatttatgaatt

SEQ ID NO: 6627883 - DNA, 15 bp, Homo sapiens
agagcacagagccct

SEQ ID NO: 6627884 - DNA, 12 bp, Homo sapiens
agagcacagcca

SEQ ID NO: 6627885 - DNA, 16 bp, Homo sapiens
agagcacagccctccc

SEQ ID NO: 6627886 - DNA, 16 bp, Homo sapiens
agagcacagcttcttc

SEQ ID NO: 6627887 - DNA, 17 bp, Homo sapiens
agagcaccctcgagaag

SEQ ID NO: 6627888 - DNA, 23 bp, Homo sapiens
agagcaccctcgagaagggtgga

SEQ ID NO: 6627889 - DNA, 17 bp, Homo sapiens
agagcaccctctggttg

SEQ ID NO: 6627890 - DNA, 21 bp, Homo sapiens
agagcaccttcctcacttcca

SEQ ID NO: 6627891 - DNA, 16 bp, Homo sapiens
agagcaccttgcagtt

SEQ ID NO: 6627892 - DNA, 19 bp, Homo sapiens
agagcacgggcgttatgta

SEQ ID NO: 6627893 - DNA, 15 bp, Homo sapiens
agagcactctcaccc

SEQ ID NO: 6627894 - DNA, 15 bp, Homo sapiens
agagcactgccacca

SEQ ID NO: 6627895 - DNA, 14 bp, Homo sapiens
agagcactgcctct

SEQ ID NO: 6627896 - DNA, 18 bp, Homo sapiens
agagcactgcctctatgc

SEQ ID NO: 6627897 - DNA, 20 bp, Homo sapiens
agagcactgcctctatgccc

SEQ ID NO: 6627898 - DNA, 22 bp, Homo sapiens
agagcactgcctctatgccctg

SEQ ID NO: 6627899 - DNA, 16 bp, Homo sapiens
agagcactgctccagt

SEQ ID NO: 6627900 - DNA, 22 bp, Homo sapiens
agagcactgggtcatatggaaa

SEQ ID NO: 6627901 - DNA, 20 bp, Homo sapiens
agagcactgggttgcagggg

SEQ ID NO: 6627902 - DNA, 22 bp, Homo sapiens
agagcactgtgtaaccagcagt

SEQ ID NO: 6627903 - DNA, 20 bp, Homo sapiens
agagcacttaagagaatatt

SEQ ID NO: 6627904 - DNA, 14 bp, Homo sapiens
agagcacttgagct

SEQ ID NO: 6627905 - DNA, 15 bp, Homo sapiens
agagcagaaataaaa

SEQ ID NO: 6627906 - DNA, 17 bp, Homo sapiens
agagcagactacagctg

SEQ ID NO: 6627907 - DNA, 16 bp, Homo sapiens
agagcagagcccccat

SEQ ID NO: 6627908 - DNA, 15 bp, Homo sapiens
agagcagagtctggg

SEQ ID NO: 6627909 - DNA, 13 bp, Homo sapiens
agagcagagttta

SEQ ID NO: 6627910 - DNA, 19 bp, Homo sapiens
agagcagatgcagagagcc

SEQ ID NO: 6627911 - DNA, 13 bp, Homo sapiens
agagcagatgcca

SEQ ID NO: 6627912 - DNA, 20 bp, Homo sapiens
agagcagatttctatggtac

SEQ ID NO: 6627913 - DNA, 16 bp, Homo sapiens
agagcagcacctcctc

SEQ ID NO: 6627914 - DNA, 16 bp, Homo sapiens
agagcagcactggggt

SEQ ID NO: 6627915 - DNA, 12 bp, Homo sapiens
agagcagcagaa

SEQ ID NO: 6627916 - DNA, 15 bp, Homo sapiens
agagcagcagcacct

SEQ ID NO: 6627917 - DNA, 14 bp, Homo sapiens
agagcagcaggtgc

SEQ ID NO: 6627918 - DNA, 19 bp, Homo sapiens
agagcagcagtgaaaacaa

SEQ ID NO: 6627919 - DNA, 22 bp, Homo sapiens
agagcagcattcccagggacct

SEQ ID NO: 6627920 - DNA, 18 bp, Homo sapiens
agagcagcatttttaatt

SEQ ID NO: 6627921 - DNA, 22 bp, Homo sapiens
agagcagcatttttaattttca

SEQ ID NO: 6627922 - DNA, 14 bp, Homo sapiens
agagcagccagcac

SEQ ID NO: 6627923 - DNA, 14 bp, Homo sapiens
agagcagcctcgtg

SEQ ID NO: 6627924 - DNA, 17 bp, Homo sapiens
agagcagcctcgtggag

SEQ ID NO: 6627925 - DNA, 13 bp, Homo sapiens
agagcagcctctt

SEQ ID NO: 6627926 - DNA, 12 bp, Homo sapiens
agagcagcctgc

SEQ ID NO: 6627927 - DNA, 13 bp, Homo sapiens
agagcagcctgct

SEQ ID NO: 6627928 - DNA, 14 bp, Homo sapiens
agagcagcctggcc

SEQ ID NO: 6627929 - DNA, 12 bp, Homo sapiens
agagcagcctgt

SEQ ID NO: 6627930 - DNA, 17 bp, Homo sapiens
agagcagcctgtggcat

SEQ ID NO: 6627931 - DNA, 14 bp, Homo sapiens
agagcagcgcccag

SEQ ID NO: 6627932 - DNA, 21 bp, Homo sapiens
agagcagcgcccaggcctgct

SEQ ID NO: 6627933 - DNA, 23 bp, Homo sapiens
agagcagcggggcgaagcccagg

SEQ ID NO: 6627934 - DNA, 20 bp, Homo sapiens
agagcagctccaccactgtg

SEQ ID NO: 6627935 - DNA, 16 bp, Homo sapiens
agagcagctccccagg

SEQ ID NO: 6627936 - DNA, 19 bp, Homo sapiens
agagcagctccctttctca

SEQ ID NO: 6627937 - DNA, 20 bp, Homo sapiens
agagcagctccctttctcag

SEQ ID NO: 6627938 - DNA, 19 bp, Homo sapiens
agagcagctccttcctagc

SEQ ID NO: 6627939 - DNA, 16 bp, Homo sapiens
agagcagctggctctc

SEQ ID NO: 6627940 - DNA, 20 bp, Homo sapiens
agagcagcttcggtgtgcag

SEQ ID NO: 6627941 - DNA, 13 bp, Homo sapiens
agagcagcttctg

SEQ ID NO: 6627942 - DNA, 21 bp, Homo sapiens
agagcagctttaaactcaggg

SEQ ID NO: 6627943 - DNA, 17 bp, Homo sapiens
agagcaggactccaggc

SEQ ID NO: 6627944 - DNA, 20 bp, Homo sapiens
agagcaggactccaggccca

SEQ ID NO: 6627945 - DNA, 12 bp, Homo sapiens
agagcaggagcc

SEQ ID NO: 6627946 - DNA, 18 bp, Homo sapiens
agagcaggatagctcttc

SEQ ID NO: 6627947 - DNA, 17 bp, Homo sapiens
agagcaggccagcccgg

SEQ ID NO: 6627948 - DNA, 15 bp, Homo sapiens
agagcaggccaggcg

SEQ ID NO: 6627949 - DNA, 20 bp, Homo sapiens
agagcaggctcagactctgg

SEQ ID NO: 6627950 - DNA, 17 bp, Homo sapiens
agagcaggctggcagct

SEQ ID NO: 6627951 - DNA, 23 bp, Homo sapiens
agagcaggctggcagctctccag

SEQ ID NO: 6627952 - DNA, 17 bp, Homo sapiens
agagcaggctttgtgag

SEQ ID NO: 6627953 - DNA, 19 bp, Homo sapiens
agagcaggctttgtgagag

SEQ ID NO: 6627954 - DNA, 20 bp, Homo sapiens
agagcagggctaaataaaga

SEQ ID NO: 6627955 - DNA, 21 bp, Homo sapiens
agagcagggctaaataaagag

SEQ ID NO: 6627956 - DNA, 19 bp, Homo sapiens
agagcaggggagcttggga

SEQ ID NO: 6627957 - DNA, 15 bp, Homo sapiens
agagcaggggctcca

SEQ ID NO: 6627958 - DNA, 15 bp, Homo sapiens
agagcaggggctgct

SEQ ID NO: 6627959 - DNA, 16 bp, Homo sapiens
agagcaggggctgctg

SEQ ID NO: 6627960 - DNA, 16 bp, Homo sapiens
agagcagggggaccta

SEQ ID NO: 6627961 - DNA, 15 bp, Homo sapiens
agagcaggtctgcag

SEQ ID NO: 6627962 - DNA, 19 bp, Homo sapiens
agagcaggtctgcaggcca

SEQ ID NO: 6627963 - DNA, 21 bp, Homo sapiens
agagcaggtctgcaggccacc

SEQ ID NO: 6627964 - DNA, 20 bp, Homo sapiens
agagcaggtgactgtgctgt

SEQ ID NO: 6627965 - DNA, 18 bp, Homo sapiens
agagcaggtgctggctct

SEQ ID NO: 6627966 - DNA, 19 bp, Homo sapiens
agagcagtaccagcgctct

SEQ ID NO: 6627967 - DNA, 18 bp, Homo sapiens
agagcagtccatttctac

SEQ ID NO: 6627968 - DNA, 17 bp, Homo sapiens
agagcagtctaaacaga

SEQ ID NO: 6627969 - DNA, 22 bp, Homo sapiens
agagcagtgattctctcttctc

SEQ ID NO: 6627970 - DNA, 12 bp, Homo sapiens
agagcagtgctt

SEQ ID NO: 6627971 - DNA, 15 bp, Homo sapiens
agagcagtgggcagg

SEQ ID NO: 6627972 - DNA, 16 bp, Homo sapiens
agagcagtgggcctgg

SEQ ID NO: 6627973 - DNA, 23 bp, Homo sapiens
agagcagttaacatctgaagtgt

SEQ ID NO: 6627974 - DNA, 21 bp, Homo sapiens
agagcagttggccaagcagaa

SEQ ID NO: 6627975 - DNA, 23 bp, Homo sapiens
agagcagtttctgtcctgctggt

SEQ ID NO: 6627976 - DNA, 21 bp, Homo sapiens
agagcagtttggtttctagca

SEQ ID NO: 6627977 - DNA, 14 bp, Homo sapiens
agagcataaacaat

SEQ ID NO: 6627978 - DNA, 18 bp, Homo sapiens
agagcataatttaaaaat

SEQ ID NO: 6627979 - DNA, 23 bp, Homo sapiens
agagcataatttaaaaatatatt

SEQ ID NO: 6627980 - DNA, 18 bp, Homo sapiens
agagcatacaacagaggg

SEQ ID NO: 6627981 - DNA, 15 bp, Homo sapiens
agagcatcatgcctc

SEQ ID NO: 6627982 - DNA, 17 bp, Homo sapiens
agagcatcatgcctctg

SEQ ID NO: 6627983 - DNA, 19 bp, Homo sapiens
agagcatcatgcctctgag

SEQ ID NO: 6627984 - DNA, 21 bp, Homo sapiens
agagcatcatgcctctgaggc

SEQ ID NO: 6627985 - DNA, 20 bp, Homo sapiens
agagcatccggccaaatgca

SEQ ID NO: 6627986 - DNA, 19 bp, Homo sapiens
agagcatccgtctcccctc

SEQ ID NO: 6627987 - DNA, 19 bp, Homo sapiens
agagcatctgcaacaaaaa

SEQ ID NO: 6627988 - DNA, 13 bp, Homo sapiens
agagcatctgccc

SEQ ID NO: 6627989 - DNA, 16 bp, Homo sapiens
agagcatctgccccag

SEQ ID NO: 6627990 - DNA, 14 bp, Homo sapiens
agagcatctgctct

SEQ ID NO: 6627991 - DNA, 18 bp, Homo sapiens
agagcatctgctctgaga

SEQ ID NO: 6627992 - DNA, 22 bp, Homo sapiens
agagcatctgtcccactgggac

SEQ ID NO: 6627993 - DNA, 15 bp, Homo sapiens
agagcatgatgggag

SEQ ID NO: 6627994 - DNA, 14 bp, Homo sapiens
agagcatgcacatg

SEQ ID NO: 6627995 - DNA, 13 bp, Homo sapiens
agagcatggatgc

SEQ ID NO: 6627996 - DNA, 19 bp, Homo sapiens
agagcatggatgcatttca

SEQ ID NO: 6627997 - DNA, 23 bp, Homo sapiens
agagcatggatgcatttcaaatg

SEQ ID NO: 6627998 - DNA, 19 bp, Homo sapiens
agagcatggttccagtgag

SEQ ID NO: 6627999 - DNA, 18 bp, Homo sapiens
agagcatgtgaggggtag

SEQ ID NO: 6628000 - DNA, 23 bp, Homo sapiens
agagcatgtgaggggtagtggga

SEQ ID NO: 6628001 - DNA, 16 bp, Homo sapiens
agagcatgttggacac

SEQ ID NO: 6628002 - DNA, 13 bp, Homo sapiens
agagcattaaaat

SEQ ID NO: 6628003 - DNA, 17 bp, Homo sapiens
agagcattaaaataact

SEQ ID NO: 6628004 - DNA, 19 bp, Homo sapiens
agagcattaaaataactat

SEQ ID NO: 6628005 - DNA, 19 bp, Homo sapiens
agagcattccagtcaggct

SEQ ID NO: 6628006 - DNA, 19 bp, Homo sapiens
agagcattgaattggagag

SEQ ID NO: 6628007 - DNA, 15 bp, Homo sapiens
agagcattgccattc

SEQ ID NO: 6628008 - DNA, 23 bp, Homo sapiens
agagcattgtcaccgcaggtgct

SEQ ID NO: 6628009 - DNA, 17 bp, Homo sapiens
agagcatttaaggaaac

SEQ ID NO: 6628010 - DNA, 20 bp, Homo sapiens
agagcatttccaacaccaca

SEQ ID NO: 6628011 - DNA, 20 bp, Homo sapiens
agagcattttttatgatatc

SEQ ID NO: 6628012 - DNA, 19 bp, Homo sapiens
agagccaagacggaggagg

SEQ ID NO: 6628013 - DNA, 20 bp, Homo sapiens
agagccaagacggaggaggg

SEQ ID NO: 6628014 - DNA, 21 bp, Homo sapiens
agagccaagacggaggagggg

SEQ ID NO: 6628015 - DNA, 19 bp, Homo sapiens
agagccaagcactgctcac

SEQ ID NO: 6628016 - DNA, 11 bp, Homo sapiens
agagccaaggc

SEQ ID NO: 6628017 - DNA, 19 bp, Homo sapiens
agagccaaggcctatgcca

SEQ ID NO: 6628018 - DNA, 12 bp, Homo sapiens
agagccaagttc

SEQ ID NO: 6628019 - DNA, 21 bp, Homo sapiens
agagccacaaaagaaaagact

SEQ ID NO: 6628020 - DNA, 11 bp, Homo sapiens
agagccacaca

SEQ ID NO: 6628021 - DNA, 12 bp, Homo sapiens
agagccacacat

SEQ ID NO: 6628022 - DNA, 13 bp, Homo sapiens
agagccacacatg

SEQ ID NO: 6628023 - DNA, 19 bp, Homo sapiens
agagccaccaagagggacg

SEQ ID NO: 6628024 - DNA, 23 bp, Homo sapiens
agagccaccagggcactgtctgc

SEQ ID NO: 6628025 - DNA, 23 bp, Homo sapiens
agagccacccaggccactgacct

SEQ ID NO: 6628026 - DNA, 13 bp, Homo sapiens
agagccacctgca

SEQ ID NO: 6628027 - DNA, 14 bp, Homo sapiens
agagccacctgcaa

SEQ ID NO: 6628028 - DNA, 16 bp, Homo sapiens
agagccacctgcaaga

SEQ ID NO: 6628029 - DNA, 19 bp, Homo sapiens
agagccacctgcaagatgg

SEQ ID NO: 6628030 - DNA, 18 bp, Homo sapiens
agagccacgctggccttc

SEQ ID NO: 6628031 - DNA, 15 bp, Homo sapiens
agagccactcttcaa

SEQ ID NO: 6628032 - DNA, 15 bp, Homo sapiens
agagccactgccatt

SEQ ID NO: 6628033 - DNA, 13 bp, Homo sapiens
agagccactgggc

SEQ ID NO: 6628034 - DNA, 15 bp, Homo sapiens
agagccactgggccc

SEQ ID NO: 6628035 - DNA, 19 bp, Homo sapiens
agagccactgggcccctgt

SEQ ID NO: 6628036 - DNA, 21 bp, Homo sapiens
agagccactgggcccctgtcc

SEQ ID NO: 6628037 - DNA, 18 bp, Homo sapiens
agagccagaaagggtgcc

SEQ ID NO: 6628038 - DNA, 22 bp, Homo sapiens
agagccagaacctggagggcta

SEQ ID NO: 6628039 - DNA, 14 bp, Homo sapiens
agagccagaggcac

SEQ ID NO: 6628040 - DNA, 14 bp, Homo sapiens
agagccagatgcag

SEQ ID NO: 6628041 - DNA, 18 bp, Homo sapiens
agagccagatgcaggaca

SEQ ID NO: 6628042 - DNA, 16 bp, Homo sapiens
agagccagatgcctcc

SEQ ID NO: 6628043 - DNA, 23 bp, Homo sapiens
agagccagatgcctccccaagac

SEQ ID NO: 6628044 - DNA, 13 bp, Homo sapiens
agagccagcagca

SEQ ID NO: 6628045 - DNA, 22 bp, Homo sapiens
agagccagcccacagatgatga

SEQ ID NO: 6628046 - DNA, 12 bp, Homo sapiens
agagccagccct

SEQ ID NO: 6628047 - DNA, 13 bp, Homo sapiens
agagccagccctc

SEQ ID NO: 6628048 - DNA, 16 bp, Homo sapiens
agagccagccctccct

SEQ ID NO: 6628049 - DNA, 20 bp, Homo sapiens
agagccagccctccctgtcc

SEQ ID NO: 6628050 - DNA, 21 bp, Homo sapiens
agagccagccctccctgtcct

SEQ ID NO: 6628051 - DNA, 19 bp, Homo sapiens
agagccagccgtaatgggg

SEQ ID NO: 6628052 - DNA, 15 bp, Homo sapiens
agagccagcctggct

SEQ ID NO: 6628053 - DNA, 20 bp, Homo sapiens
agagccagcctggctctgcc

SEQ ID NO: 6628054 - DNA, 21 bp, Homo sapiens
agagccagcctggctctgccc

SEQ ID NO: 6628055 - DNA, 22 bp, Homo sapiens
agagccagcctggctctgcccc

SEQ ID NO: 6628056 - DNA, 15 bp, Homo sapiens
agagccagcctggga

SEQ ID NO: 6628057 - DNA, 17 bp, Homo sapiens
agagccagcctgggact

SEQ ID NO: 6628058 - DNA, 13 bp, Homo sapiens
agagccagccttg

SEQ ID NO: 6628059 - DNA, 15 bp, Homo sapiens
agagccagcggctcc

SEQ ID NO: 6628060 - DNA, 13 bp, Homo sapiens
agagccagctccc

SEQ ID NO: 6628061 - DNA, 16 bp, Homo sapiens
agagccagctctctct

SEQ ID NO: 6628062 - DNA, 13 bp, Homo sapiens
agagccagcttgg

SEQ ID NO: 6628063 - DNA, 16 bp, Homo sapiens
agagccaggagaagct

SEQ ID NO: 6628064 - DNA, 18 bp, Homo sapiens
agagccaggagaagctca

SEQ ID NO: 6628065 - DNA, 20 bp, Homo sapiens
agagccaggattcaaccctg

SEQ ID NO: 6628066 - DNA, 16 bp, Homo sapiens
agagccagggctgtcc

SEQ ID NO: 6628067 - DNA, 23 bp, Homo sapiens
agagccaggggggtgaggagctg

SEQ ID NO: 6628068 - DNA, 22 bp, Homo sapiens
agagccaggggtgtcccagtcc

SEQ ID NO: 6628069 - DNA, 13 bp, Homo sapiens
agagccaggtgct

SEQ ID NO: 6628070 - DNA, 13 bp, Homo sapiens
agagccatacata

SEQ ID NO: 6628071 - DNA, 18 bp, Homo sapiens
agagccatacataaaaga

SEQ ID NO: 6628072 - DNA, 19 bp, Homo sapiens
agagccatacataaaagaa

SEQ ID NO: 6628073 - DNA, 15 bp, Homo sapiens
agagccatccaccct

SEQ ID NO: 6628074 - DNA, 16 bp, Homo sapiens
agagccatccaccctg

SEQ ID NO: 6628075 - DNA, 16 bp, Homo sapiens
agagccatgctgggaa

SEQ ID NO: 6628076 - DNA, 15 bp, Homo sapiens
agagccatgggcctg

SEQ ID NO: 6628077 - DNA, 16 bp, Homo sapiens
agagccatgggcctgg

SEQ ID NO: 6628078 - DNA, 18 bp, Homo sapiens
agagccatgggcctgggc

SEQ ID NO: 6628079 - DNA, 22 bp, Homo sapiens
agagccatgggcctgggcctgc

SEQ ID NO: 6628080 - DNA, 21 bp, Homo sapiens
agagccatggtgtgtttgtaa

SEQ ID NO: 6628081 - DNA, 15 bp, Homo sapiens
agagccatgtaccag

SEQ ID NO: 6628082 - DNA, 15 bp, Homo sapiens
agagccatgtgtcat

SEQ ID NO: 6628083 - DNA, 17 bp, Homo sapiens
agagccattttgtgaat

SEQ ID NO: 6628084 - DNA, 22 bp, Homo sapiens
agagcccacatggccgggccct

SEQ ID NO: 6628085 - DNA, 18 bp, Homo sapiens
agagcccaccagccagcc

SEQ ID NO: 6628086 - DNA, 21 bp, Homo sapiens
agagcccaccagccagccctg

SEQ ID NO: 6628087 - DNA, 13 bp, Homo sapiens
agagcccactgct

SEQ ID NO: 6628088 - DNA, 22 bp, Homo sapiens
agagcccagaggtaacagaaca

SEQ ID NO: 6628089 - DNA, 24 bp, Homo sapiens
agagcccagaggtaacagaacagc

SEQ ID NO: 6628090 - DNA, 21 bp, Homo sapiens
agagcccagcagggcctcaaa

SEQ ID NO: 6628091 - DNA, 17 bp, Homo sapiens
agagcccagcccaggag

SEQ ID NO: 6628092 - DNA, 15 bp, Homo sapiens
agagcccagctcttg

SEQ ID NO: 6628093 - DNA, 15 bp, Homo sapiens
agagcccaggagctc

SEQ ID NO: 6628094 - DNA, 16 bp, Homo sapiens
agagcccaggagctcc

SEQ ID NO: 6628095 - DNA, 13 bp, Homo sapiens
agagcccaggcct

SEQ ID NO: 6628096 - DNA, 20 bp, Homo sapiens
agagcccaggctcggcctgc

SEQ ID NO: 6628097 - DNA, 16 bp, Homo sapiens
agagcccaggggagaa

SEQ ID NO: 6628098 - DNA, 21 bp, Homo sapiens
agagcccatgctcaaccactg

SEQ ID NO: 6628099 - DNA, 17 bp, Homo sapiens
agagcccattaatcttg

SEQ ID NO: 6628100 - DNA, 19 bp, Homo sapiens
agagcccattaatcttgat

SEQ ID NO: 6628101 - DNA, 18 bp, Homo sapiens
agagccccaaagatccca

SEQ ID NO: 6628102 - DNA, 15 bp, Homo sapiens
agagccccacacgga

SEQ ID NO: 6628103 - DNA, 13 bp, Homo sapiens
agagccccactct

SEQ ID NO: 6628104 - DNA, 21 bp, Homo sapiens
agagccccactctcagaggcc

SEQ ID NO: 6628105 - DNA, 22 bp, Homo sapiens
agagccccactctcagaggccc

SEQ ID NO: 6628106 - DNA, 23 bp, Homo sapiens
agagccccactctcagaggcccc

SEQ ID NO: 6628107 - DNA, 14 bp, Homo sapiens
agagccccagctga

SEQ ID NO: 6628108 - DNA, 16 bp, Homo sapiens
agagccccaggactgg

SEQ ID NO: 6628109 - DNA, 18 bp, Homo sapiens
agagcccccaagcctctg

SEQ ID NO: 6628110 - DNA, 23 bp, Homo sapiens
agagcccccaagcctctgcccca

SEQ ID NO: 6628111 - DNA, 13 bp, Homo sapiens
agagcccccaagg

SEQ ID NO: 6628112 - DNA, 13 bp, Homo sapiens
agagcccccagcc

SEQ ID NO: 6628113 - DNA, 15 bp, Homo sapiens
agagcccccagccct

SEQ ID NO: 6628114 - DNA, 16 bp, Homo sapiens
agagcccccagccctg

SEQ ID NO: 6628115 - DNA, 12 bp, Homo sapiens
agagcccccagg

SEQ ID NO: 6628116 - DNA, 13 bp, Homo sapiens
agagcccccagga

SEQ ID NO: 6628117 - DNA, 14 bp, Homo sapiens
agagccccccacaa

SEQ ID NO: 6628118 - DNA, 18 bp, Homo sapiens
agagccccccgtgtggct

SEQ ID NO: 6628119 - DNA, 21 bp, Homo sapiens
agagccccgcaaaacccactg

SEQ ID NO: 6628120 - DNA, 17 bp, Homo sapiens
agagccccggagcacca

SEQ ID NO: 6628121 - DNA, 22 bp, Homo sapiens
agagccccggagcaccacgggg

SEQ ID NO: 6628122 - DNA, 16 bp, Homo sapiens
agagcccctactgtgg

SEQ ID NO: 6628123 - DNA, 23 bp, Homo sapiens
agagcccctactgtgggcaaagt

SEQ ID NO: 6628124 - DNA, 14 bp, Homo sapiens
agagcccctgcccc

SEQ ID NO: 6628125 - DNA, 14 bp, Homo sapiens
agagcccgcagggc

SEQ ID NO: 6628126 - DNA, 24 bp, Homo sapiens
agagcccgcccacctgggccctag

SEQ ID NO: 6628127 - DNA, 15 bp, Homo sapiens
agagcccgccgtctg

SEQ ID NO: 6628128 - DNA, 20 bp, Homo sapiens
agagcccgccgtctgcaggg

SEQ ID NO: 6628129 - DNA, 21 bp, Homo sapiens
agagcccgccgtctgcagggg

SEQ ID NO: 6628130 - DNA, 16 bp, Homo sapiens
agagcccgcgtgctgg

SEQ ID NO: 6628131 - DNA, 20 bp, Homo sapiens
agagcccgcgtgctggagaa

SEQ ID NO: 6628132 - DNA, 16 bp, Homo sapiens
agagcccggagctccg

SEQ ID NO: 6628133 - DNA, 17 bp, Homo sapiens
agagcccgggagagact

SEQ ID NO: 6628134 - DNA, 23 bp, Homo sapiens
agagccctattggcttactgaaa

SEQ ID NO: 6628135 - DNA, 23 bp, Homo sapiens
agagccctcagtcggggcaggcc

SEQ ID NO: 6628136 - DNA, 13 bp, Homo sapiens
agagccctcccta

SEQ ID NO: 6628137 - DNA, 20 bp, Homo sapiens
agagccctccctaaatatac

SEQ ID NO: 6628138 - DNA, 13 bp, Homo sapiens
agagccctctgag

SEQ ID NO: 6628139 - DNA, 11 bp, Homo sapiens
agagccctgag

SEQ ID NO: 6628140 - DNA, 17 bp, Homo sapiens
agagccctgagcccaga

SEQ ID NO: 6628141 - DNA, 14 bp, Homo sapiens
agagccctgagctc

SEQ ID NO: 6628142 - DNA, 16 bp, Homo sapiens
agagccctgagctcag

SEQ ID NO: 6628143 - DNA, 18 bp, Homo sapiens
agagccctgagctcaggc

SEQ ID NO: 6628144 - DNA, 22 bp, Homo sapiens
agagccctgaggcctagactct

SEQ ID NO: 6628145 - DNA, 13 bp, Homo sapiens
agagccctgaggg

SEQ ID NO: 6628146 - DNA, 21 bp, Homo sapiens
agagccctgaggggctgggct

SEQ ID NO: 6628147 - DNA, 10 bp, Homo sapiens
agagccctgc

SEQ ID NO: 6628148 - DNA, 14 bp, Homo sapiens
agagccctgcagtc

SEQ ID NO: 6628149 - DNA, 15 bp, Homo sapiens
agagccctgcagtca

SEQ ID NO: 6628150 - DNA, 16 bp, Homo sapiens
agagccctgccctgca

SEQ ID NO: 6628151 - DNA, 16 bp, Homo sapiens
agagccctgctccctc

SEQ ID NO: 6628152 - DNA, 18 bp, Homo sapiens
agagccctgctccctccg

SEQ ID NO: 6628153 - DNA, 16 bp, Homo sapiens
agagccctgctgtggg

SEQ ID NO: 6628154 - DNA, 20 bp, Homo sapiens
agagccctggacacccctgc

SEQ ID NO: 6628155 - DNA, 18 bp, Homo sapiens
agagccctggccagccct

SEQ ID NO: 6628156 - DNA, 21 bp, Homo sapiens
agagccctggccagcccttcc

SEQ ID NO: 6628157 - DNA, 22 bp, Homo sapiens
agagccctggccagcccttcct

SEQ ID NO: 6628158 - DNA, 23 bp, Homo sapiens
agagccctggctctgcccctcag

SEQ ID NO: 6628159 - DNA, 11 bp, Homo sapiens
agagccctgtc

SEQ ID NO: 6628160 - DNA, 12 bp, Homo sapiens
agagccctgtgg

SEQ ID NO: 6628161 - DNA, 17 bp, Homo sapiens
agagcccttcactgcca

SEQ ID NO: 6628162 - DNA, 18 bp, Homo sapiens
agagcccttcactgccat

SEQ ID NO: 6628163 - DNA, 20 bp, Homo sapiens
agagcccttcactgccatga

SEQ ID NO: 6628164 - DNA, 21 bp, Homo sapiens
agagcccttgactgtacagag

SEQ ID NO: 6628165 - DNA, 14 bp, Homo sapiens
agagcccttgcctc

SEQ ID NO: 6628166 - DNA, 17 bp, Homo sapiens
agagcccttttgctata

SEQ ID NO: 6628167 - DNA, 23 bp, Homo sapiens
agagccgacaatgccctgctggc

SEQ ID NO: 6628168 - DNA, 21 bp, Homo sapiens
agagccggcccgcctctcctc

SEQ ID NO: 6628169 - DNA, 19 bp, Homo sapiens
agagccggccgtggaagga

SEQ ID NO: 6628170 - DNA, 13 bp, Homo sapiens
agagccgggaagc

SEQ ID NO: 6628171 - DNA, 23 bp, Homo sapiens
agagccgggaggaaaaggcccct

SEQ ID NO: 6628172 - DNA, 24 bp, Homo sapiens
agagccgggaggaaaaggcccctg

SEQ ID NO: 6628173 - DNA, 23 bp, Homo sapiens
agagccggggtggggtggctgca

SEQ ID NO: 6628174 - DNA, 15 bp, Homo sapiens
agagccggtggtgcc

SEQ ID NO: 6628175 - DNA, 18 bp, Homo sapiens
agagccggtggtgcccgt

SEQ ID NO: 6628176 - DNA, 17 bp, Homo sapiens
agagccgtgatgcctcc

SEQ ID NO: 6628177 - DNA, 14 bp, Homo sapiens
agagccgttcctgg

SEQ ID NO: 6628178 - DNA, 21 bp, Homo sapiens
agagcctaccttcaccaccta

SEQ ID NO: 6628179 - DNA, 16 bp, Homo sapiens
agagcctagaacatcc

SEQ ID NO: 6628180 - DNA, 21 bp, Homo sapiens
agagcctagaacatccctggg

SEQ ID NO: 6628181 - DNA, 16 bp, Homo sapiens
agagcctagccacctc

SEQ ID NO: 6628182 - DNA, 22 bp, Homo sapiens
agagcctagccacctcccaccc

SEQ ID NO: 6628183 - DNA, 17 bp, Homo sapiens
agagcctatggaaaggg

SEQ ID NO: 6628184 - DNA, 21 bp, Homo sapiens
agagcctcccaaggagaacaa

SEQ ID NO: 6628185 - DNA, 21 bp, Homo sapiens
agagcctcccaccagagccgg

SEQ ID NO: 6628186 - DNA, 13 bp, Homo sapiens
agagcctccctca

SEQ ID NO: 6628187 - DNA, 16 bp, Homo sapiens
agagcctccctcagcc

SEQ ID NO: 6628188 - DNA, 21 bp, Homo sapiens
agagcctcggccctagcattg

SEQ ID NO: 6628189 - DNA, 18 bp, Homo sapiens
agagcctcgtccctccct

SEQ ID NO: 6628190 - DNA, 12 bp, Homo sapiens
agagcctctgga

SEQ ID NO: 6628191 - DNA, 22 bp, Homo sapiens
agagcctcttgtggaccccgcc

SEQ ID NO: 6628192 - DNA, 15 bp, Homo sapiens
agagcctgaagctgg

SEQ ID NO: 6628193 - DNA, 15 bp, Homo sapiens
agagcctgaatttgt

SEQ ID NO: 6628194 - DNA, 16 bp, Homo sapiens
agagcctgacctgaga

SEQ ID NO: 6628195 - DNA, 16 bp, Homo sapiens
agagcctgagactgga

SEQ ID NO: 6628196 - DNA, 22 bp, Homo sapiens
agagcctgagactggaaaaggt

SEQ ID NO: 6628197 - DNA, 20 bp, Homo sapiens
agagcctgatctcttcctgt

SEQ ID NO: 6628198 - DNA, 17 bp, Homo sapiens
agagcctgattttttga

SEQ ID NO: 6628199 - DNA, 14 bp, Homo sapiens
agagcctgcctcag

SEQ ID NO: 6628200 - DNA, 19 bp, Homo sapiens
agagcctgctcccccaccc

SEQ ID NO: 6628201 - DNA, 15 bp, Homo sapiens
agagcctgctgcatg

SEQ ID NO: 6628202 - DNA, 16 bp, Homo sapiens
agagcctgctggatct

SEQ ID NO: 6628203 - DNA, 14 bp, Homo sapiens
agagcctggagaag

SEQ ID NO: 6628204 - DNA, 16 bp, Homo sapiens
agagcctggagaagct

SEQ ID NO: 6628205 - DNA, 21 bp, Homo sapiens
agagcctgggaaggaggccgc

SEQ ID NO: 6628206 - DNA, 13 bp, Homo sapiens
agagcctggggct

SEQ ID NO: 6628207 - DNA, 19 bp, Homo sapiens
agagcctggggtgggtgtg

SEQ ID NO: 6628208 - DNA, 10 bp, Homo sapiens
agagcctggt

SEQ ID NO: 6628209 - DNA, 18 bp, Homo sapiens
agagcctggtagagacta

SEQ ID NO: 6628210 - DNA, 18 bp, Homo sapiens
agagcctggtgctgctgc

SEQ ID NO: 6628211 - DNA, 22 bp, Homo sapiens
agagcctgtctttcagcattca

SEQ ID NO: 6628212 - DNA, 18 bp, Homo sapiens
agagcctgtgctaaagaa

SEQ ID NO: 6628213 - DNA, 14 bp, Homo sapiens
agagcctgttttaa

SEQ ID NO: 6628214 - DNA, 17 bp, Homo sapiens
agagccttaacttctta

SEQ ID NO: 6628215 - DNA, 21 bp, Homo sapiens
agagccttaatggatgctcat

SEQ ID NO: 6628216 - DNA, 20 bp, Homo sapiens
agagccttacttcaaagtgc

SEQ ID NO: 6628217 - DNA, 18 bp, Homo sapiens
agagccttagcagccctg

SEQ ID NO: 6628218 - DNA, 22 bp, Homo sapiens
agagccttagcagccctggatg

SEQ ID NO: 6628219 - DNA, 19 bp, Homo sapiens
agagccttcaagtgccaaa

SEQ ID NO: 6628220 - DNA, 22 bp, Homo sapiens
agagccttcacaaccagccaca

SEQ ID NO: 6628221 - DNA, 13 bp, Homo sapiens
agagccttccacc

SEQ ID NO: 6628222 - DNA, 16 bp, Homo sapiens
agagccttccacccag

SEQ ID NO: 6628223 - DNA, 22 bp, Homo sapiens
agagccttccacccaggggcag

SEQ ID NO: 6628224 - DNA, 15 bp, Homo sapiens
agagccttctcagaa

SEQ ID NO: 6628225 - DNA, 19 bp, Homo sapiens
agagccttctcagaagcac

SEQ ID NO: 6628226 - DNA, 19 bp, Homo sapiens
agagccttctcctgcctac

SEQ ID NO: 6628227 - DNA, 14 bp, Homo sapiens
agagccttgacaat

SEQ ID NO: 6628228 - DNA, 21 bp, Homo sapiens
agagccttgcggaaggttcta

SEQ ID NO: 6628229 - DNA, 20 bp, Homo sapiens
agagccttgggagccactgc

SEQ ID NO: 6628230 - DNA, 17 bp, Homo sapiens
agagccttggtgtccac

SEQ ID NO: 6628231 - DNA, 19 bp, Homo sapiens
agagccttggtgtccacct

SEQ ID NO: 6628232 - DNA, 15 bp, Homo sapiens
agagcctttccaaag

SEQ ID NO: 6628233 - DNA, 11 bp, Homo sapiens
agagcctttga

SEQ ID NO: 6628234 - DNA, 18 bp, Homo sapiens
agagcctttgatcttcag

SEQ ID NO: 6628235 - DNA, 23 bp, Homo sapiens
agagcctttggatgaccagaaca

SEQ ID NO: 6628236 - DNA, 19 bp, Homo sapiens
agagccttttatctgcaga

SEQ ID NO: 6628237 - DNA, 21 bp, Homo sapiens
agagcctttttacctggccta

SEQ ID NO: 6628238 - DNA, 22 bp, Homo sapiens
agagcctttttacctggcctag

SEQ ID NO: 6628239 - DNA, 13 bp, Homo sapiens
agagcgacacaga

SEQ ID NO: 6628240 - DNA, 16 bp, Homo sapiens
agagcgacagagcagt

SEQ ID NO: 6628241 - DNA, 12 bp, Homo sapiens
agagcgaggctg

SEQ ID NO: 6628242 - DNA, 14 bp, Homo sapiens
agagcgaggctgag

SEQ ID NO: 6628243 - DNA, 17 bp, Homo sapiens
agagcgatgtgttcttt

SEQ ID NO: 6628244 - DNA, 14 bp, Homo sapiens
agagcgcagcatcc

SEQ ID NO: 6628245 - DNA, 14 bp, Homo sapiens
agagcgcagccccc

SEQ ID NO: 6628246 - DNA, 17 bp, Homo sapiens
agagcgccacccgcccg

SEQ ID NO: 6628247 - DNA, 20 bp, Homo sapiens
agagcgccaggaagccagag

SEQ ID NO: 6628248 - DNA, 23 bp, Homo sapiens
agagcgccaggaagccagagccc

SEQ ID NO: 6628249 - DNA, 17 bp, Homo sapiens
agagcgcctcacctgca

SEQ ID NO: 6628250 - DNA, 22 bp, Homo sapiens
agagcgcctcacctgcatcctc

SEQ ID NO: 6628251 - DNA, 19 bp, Homo sapiens
agagcgcctcttcctctgg

SEQ ID NO: 6628252 - DNA, 20 bp, Homo sapiens
agagcgcctcttcctctggg

SEQ ID NO: 6628253 - DNA, 22 bp, Homo sapiens
agagcgcctcttcctctgggca

SEQ ID NO: 6628254 - DNA, 20 bp, Homo sapiens
agagcgcctgcccctcccag

SEQ ID NO: 6628255 - DNA, 14 bp, Homo sapiens
agagcgcggctggc

SEQ ID NO: 6628256 - DNA, 23 bp, Homo sapiens
agagcgcggctggctctgtggag

SEQ ID NO: 6628257 - DNA, 16 bp, Homo sapiens
agagcgcgggagagag

SEQ ID NO: 6628258 - DNA, 16 bp, Homo sapiens
agagcgctggcctctt

SEQ ID NO: 6628259 - DNA, 14 bp, Homo sapiens
agagcggaggagga

SEQ ID NO: 6628260 - DNA, 15 bp, Homo sapiens
agagcgggagggagt

SEQ ID NO: 6628261 - DNA, 22 bp, Homo sapiens
agagcgggagggagtctcagga

SEQ ID NO: 6628262 - DNA, 20 bp, Homo sapiens
agagcgggcctcttccctca

SEQ ID NO: 6628263 - DNA, 19 bp, Homo sapiens
agagcggggaggtgcctga

SEQ ID NO: 6628264 - DNA, 16 bp, Homo sapiens
agagcggtatctctgg

SEQ ID NO: 6628265 - DNA, 22 bp, Homo sapiens
agagcggtatctctggcaccac

SEQ ID NO: 6628266 - DNA, 23 bp, Homo sapiens
agagcggtatctctggcaccaca

SEQ ID NO: 6628267 - DNA, 14 bp, Homo sapiens
agagcggtctcagg

SEQ ID NO: 6628268 - DNA, 10 bp, Homo sapiens
agagcgtcct

SEQ ID NO: 6628269 - DNA, 18 bp, Homo sapiens
agagcgtccttccccctg

SEQ ID NO: 6628270 - DNA, 16 bp, Homo sapiens
agagcgtgagctgagc

SEQ ID NO: 6628271 - DNA, 18 bp, Homo sapiens
agagcgtgagctgagcag

SEQ ID NO: 6628272 - DNA, 18 bp, Homo sapiens
agagcgtgcacttgtgat

SEQ ID NO: 6628273 - DNA, 23 bp, Homo sapiens
agagcgtgtgcggctccagccca

SEQ ID NO: 6628274 - DNA, 17 bp, Homo sapiens
agagcgttactgtagac

SEQ ID NO: 6628275 - DNA, 15 bp, Homo sapiens
agagcgttgaagttg

SEQ ID NO: 6628276 - DNA, 17 bp, Homo sapiens
agagctaaaaaggccct

SEQ ID NO: 6628277 - DNA, 21 bp, Homo sapiens
agagctaaaaaggcccttaga

SEQ ID NO: 6628278 - DNA, 22 bp, Homo sapiens
agagctaaaaaggcccttagag

SEQ ID NO: 6628279 - DNA, 16 bp, Homo sapiens
agagctaaggccaatg

SEQ ID NO: 6628280 - DNA, 23 bp, Homo sapiens
agagctaaggccaatgggctaga

SEQ ID NO: 6628281 - DNA, 17 bp, Homo sapiens
agagctaagggtgggtg

SEQ ID NO: 6628282 - DNA, 14 bp, Homo sapiens
agagctacataatt

SEQ ID NO: 6628283 - DNA, 16 bp, Homo sapiens
agagctacataattta

SEQ ID NO: 6628284 - DNA, 16 bp, Homo sapiens
agagctacgtatttaa

SEQ ID NO: 6628285 - DNA, 17 bp, Homo sapiens
agagctactcagaaatg

SEQ ID NO: 6628286 - DNA, 17 bp, Homo sapiens
agagctagaaaaataaa

SEQ ID NO: 6628287 - DNA, 17 bp, Homo sapiens
agagctagaacatggag

SEQ ID NO: 6628288 - DNA, 22 bp, Homo sapiens
agagctagaacatggagagcta

SEQ ID NO: 6628289 - DNA, 23 bp, Homo sapiens
agagctagaacccggcaggctag

SEQ ID NO: 6628290 - DNA, 16 bp, Homo sapiens
agagctagaacctgga

SEQ ID NO: 6628291 - DNA, 19 bp, Homo sapiens
agagctagaacctggagag

SEQ ID NO: 6628292 - DNA, 18 bp, Homo sapiens
agagctagaacctggagg

SEQ ID NO: 6628293 - DNA, 14 bp, Homo sapiens
agagctagcgctgc

SEQ ID NO: 6628294 - DNA, 16 bp, Homo sapiens
agagctagcgctgccg

SEQ ID NO: 6628295 - DNA, 21 bp, Homo sapiens
agagctagcgctgccgcaccc

SEQ ID NO: 6628296 - DNA, 13 bp, Homo sapiens
agagctaggagca

SEQ ID NO: 6628297 - DNA, 23 bp, Homo sapiens
agagctaggcccccaaattgcct

SEQ ID NO: 6628298 - DNA, 24 bp, Homo sapiens
agagctaggctgtggagtagagtt

SEQ ID NO: 6628299 - DNA, 17 bp, Homo sapiens
agagctagggctgctgc

SEQ ID NO: 6628300 - DNA, 19 bp, Homo sapiens
agagctagggctgctgctt

SEQ ID NO: 6628301 - DNA, 13 bp, Homo sapiens
agagctatacagt

SEQ ID NO: 6628302 - DNA, 19 bp, Homo sapiens
agagctatggtgcttgctg

SEQ ID NO: 6628303 - DNA, 14 bp, Homo sapiens
agagctattgccaa

SEQ ID NO: 6628304 - DNA, 16 bp, Homo sapiens
agagctattttagaaa

SEQ ID NO: 6628305 - DNA, 20 bp, Homo sapiens
agagctattttagaaagcta

SEQ ID NO: 6628306 - DNA, 22 bp, Homo sapiens
agagctattttagaaagctaaa

SEQ ID NO: 6628307 - DNA, 19 bp, Homo sapiens
agagctcaccatggaatga

SEQ ID NO: 6628308 - DNA, 13 bp, Homo sapiens
agagctcagagga

SEQ ID NO: 6628309 - DNA, 18 bp, Homo sapiens
agagctcagcctgcctgg

SEQ ID NO: 6628310 - DNA, 17 bp, Homo sapiens
agagctcagctttctga

SEQ ID NO: 6628311 - DNA, 10 bp, Homo sapiens
agagctcagg

SEQ ID NO: 6628312 - DNA, 14 bp, Homo sapiens
agagctcaggagaa

SEQ ID NO: 6628313 - DNA, 13 bp, Homo sapiens
agagctcaggatg

SEQ ID NO: 6628314 - DNA, 14 bp, Homo sapiens
agagctcaggcagc

SEQ ID NO: 6628315 - DNA, 15 bp, Homo sapiens
agagctcagtacagg

SEQ ID NO: 6628316 - DNA, 18 bp, Homo sapiens
agagctccatgctgttct

SEQ ID NO: 6628317 - DNA, 18 bp, Homo sapiens
agagctcccaggacgcag

SEQ ID NO: 6628318 - DNA, 14 bp, Homo sapiens
agagctccccatgg

SEQ ID NO: 6628319 - DNA, 20 bp, Homo sapiens
agagctcccctacggaccag

SEQ ID NO: 6628320 - DNA, 15 bp, Homo sapiens
agagctcccctccac

SEQ ID NO: 6628321 - DNA, 18 bp, Homo sapiens
agagctcccctccacagc

SEQ ID NO: 6628322 - DNA, 20 bp, Homo sapiens
agagctcccctccacagctg

SEQ ID NO: 6628323 - DNA, 21 bp, Homo sapiens
agagctcccctccacagctgc

SEQ ID NO: 6628324 - DNA, 17 bp, Homo sapiens
agagctcccgaggaagc

SEQ ID NO: 6628325 - DNA, 12 bp, Homo sapiens
agagctcctccc

SEQ ID NO: 6628326 - DNA, 13 bp, Homo sapiens
agagctcctccct

SEQ ID NO: 6628327 - DNA, 23 bp, Homo sapiens
agagctcctctgtcctgcttctg

SEQ ID NO: 6628328 - DNA, 22 bp, Homo sapiens
agagctctacaggcctgcagcc

SEQ ID NO: 6628329 - DNA, 15 bp, Homo sapiens
agagctctccagctc

SEQ ID NO: 6628330 - DNA, 20 bp, Homo sapiens
agagctctctattctggaag

SEQ ID NO: 6628331 - DNA, 18 bp, Homo sapiens
agagctctggagccacct

SEQ ID NO: 6628332 - DNA, 22 bp, Homo sapiens
agagctctggagccacctgtcc

SEQ ID NO: 6628333 - DNA, 17 bp, Homo sapiens
agagctctggccccgct

SEQ ID NO: 6628334 - DNA, 21 bp, Homo sapiens
agagctctggtgataaggaca

SEQ ID NO: 6628335 - DNA, 15 bp, Homo sapiens
agagctcttaatgtt

SEQ ID NO: 6628336 - DNA, 18 bp, Homo sapiens
agagctcttagtttttaa

SEQ ID NO: 6628337 - DNA, 20 bp, Homo sapiens
agagctcttagtttttaaaa

SEQ ID NO: 6628338 - DNA, 22 bp, Homo sapiens
agagctcttagtttttaaaaag

SEQ ID NO: 6628339 - DNA, 21 bp, Homo sapiens
agagctcttcggtttctgagc

SEQ ID NO: 6628340 - DNA, 13 bp, Homo sapiens
agagctcttggcc

SEQ ID NO: 6628341 - DNA, 23 bp, Homo sapiens
agagctcttgtgttcagaagaat

SEQ ID NO: 6628342 - DNA, 12 bp, Homo sapiens
agagctgaacag

SEQ ID NO: 6628343 - DNA, 19 bp, Homo sapiens
agagctgaaggttgtggcc

SEQ ID NO: 6628344 - DNA, 18 bp, Homo sapiens
agagctgacacaaacctg

SEQ ID NO: 6628345 - DNA, 20 bp, Homo sapiens
agagctgacgggaggcccca

SEQ ID NO: 6628346 - DNA, 23 bp, Homo sapiens
agagctgagagtctgaaagacag

SEQ ID NO: 6628347 - DNA, 14 bp, Homo sapiens
agagctgagccagt

SEQ ID NO: 6628348 - DNA, 16 bp, Homo sapiens
agagctgagccagttg

SEQ ID NO: 6628349 - DNA, 20 bp, Homo sapiens
agagctgagtcggctgggca

SEQ ID NO: 6628350 - DNA, 21 bp, Homo sapiens
agagctgatgtgagtgtgtgt

SEQ ID NO: 6628351 - DNA, 13 bp, Homo sapiens
agagctgcacagg

SEQ ID NO: 6628352 - DNA, 19 bp, Homo sapiens
agagctgcacttggcctca

SEQ ID NO: 6628353 - DNA, 21 bp, Homo sapiens
agagctgcacttggcctcagc

SEQ ID NO: 6628354 - DNA, 12 bp, Homo sapiens
agagctgcagaa

SEQ ID NO: 6628355 - DNA, 23 bp, Homo sapiens
agagctgcagagagcacctggtg

SEQ ID NO: 6628356 - DNA, 21 bp, Homo sapiens
agagctgcagttgtgaaagca

SEQ ID NO: 6628357 - DNA, 16 bp, Homo sapiens
agagctgccactgggc

SEQ ID NO: 6628358 - DNA, 16 bp, Homo sapiens
agagctgccatcgctg

SEQ ID NO: 6628359 - DNA, 13 bp, Homo sapiens
agagctgccctct

SEQ ID NO: 6628360 - DNA, 20 bp, Homo sapiens
agagctgccctctcctgggc

SEQ ID NO: 6628361 - DNA, 21 bp, Homo sapiens
agagctgcctaagaggcaatg

SEQ ID NO: 6628362 - DNA, 14 bp, Homo sapiens
agagctgcctctcg

SEQ ID NO: 6628363 - DNA, 16 bp, Homo sapiens
agagctgcctggatga

SEQ ID NO: 6628364 - DNA, 17 bp, Homo sapiens
agagctgcctggatgag

SEQ ID NO: 6628365 - DNA, 19 bp, Homo sapiens
agagctgcctggatgagaa

SEQ ID NO: 6628366 - DNA, 17 bp, Homo sapiens
agagctgcgggctgagg

SEQ ID NO: 6628367 - DNA, 14 bp, Homo sapiens
agagctgctgagca

SEQ ID NO: 6628368 - DNA, 15 bp, Homo sapiens
agagctgctgtattt

SEQ ID NO: 6628369 - DNA, 15 bp, Homo sapiens
agagctggaaggcag

SEQ ID NO: 6628370 - DNA, 16 bp, Homo sapiens
agagctggaaggcagg

SEQ ID NO: 6628371 - DNA, 19 bp, Homo sapiens
agagctggaaggcagggca

SEQ ID NO: 6628372 - DNA, 21 bp, Homo sapiens
agagctggaaggcagggcaga

SEQ ID NO: 6628373 - DNA, 23 bp, Homo sapiens
agagctggagatgaggccagacc

SEQ ID NO: 6628374 - DNA, 12 bp, Homo sapiens
agagctggagcc

SEQ ID NO: 6628375 - DNA, 15 bp, Homo sapiens
agagctggagcctgg

SEQ ID NO: 6628376 - DNA, 12 bp, Homo sapiens
agagctggaggc

SEQ ID NO: 6628377 - DNA, 19 bp, Homo sapiens
agagctggagtctgggctc

SEQ ID NO: 6628378 - DNA, 12 bp, Homo sapiens
agagctggcctc

SEQ ID NO: 6628379 - DNA, 16 bp, Homo sapiens
agagctggcctccccc

SEQ ID NO: 6628380 - DNA, 16 bp, Homo sapiens
agagctggcgctcagc

SEQ ID NO: 6628381 - DNA, 22 bp, Homo sapiens
agagctggcgctcagcagccct

SEQ ID NO: 6628382 - DNA, 23 bp, Homo sapiens
agagctggcgctcagcagcccta

SEQ ID NO: 6628383 - DNA, 18 bp, Homo sapiens
agagctgggaaacaggga

SEQ ID NO: 6628384 - DNA, 19 bp, Homo sapiens
agagctgggaaacagggag

SEQ ID NO: 6628385 - DNA, 20 bp, Homo sapiens
agagctgggatcccacagcc

SEQ ID NO: 6628386 - DNA, 21 bp, Homo sapiens
agagctgggatcccacagccc

SEQ ID NO: 6628387 - DNA, 16 bp, Homo sapiens
agagctgggcagacag

SEQ ID NO: 6628388 - DNA, 20 bp, Homo sapiens
agagctggggctgccagcct

SEQ ID NO: 6628389 - DNA, 21 bp, Homo sapiens
agagctggtagttagtagcat

SEQ ID NO: 6628390 - DNA, 17 bp, Homo sapiens
agagctggtgactttgg

SEQ ID NO: 6628391 - DNA, 15 bp, Homo sapiens
agagctggtgccaga

SEQ ID NO: 6628392 - DNA, 15 bp, Homo sapiens
agagctggtgcccgg

SEQ ID NO: 6628393 - DNA, 19 bp, Homo sapiens
agagctggtgcggctggcc

SEQ ID NO: 6628394 - DNA, 20 bp, Homo sapiens
agagctggtggtgcagcctt

SEQ ID NO: 6628395 - DNA, 16 bp, Homo sapiens
agagctggtggtttga

SEQ ID NO: 6628396 - DNA, 17 bp, Homo sapiens
agagctggtgtctgatt

SEQ ID NO: 6628397 - DNA, 13 bp, Homo sapiens
agagctgtacatt

SEQ ID NO: 6628398 - DNA, 17 bp, Homo sapiens
agagctgtattaagcca

SEQ ID NO: 6628399 - DNA, 19 bp, Homo sapiens
agagctgtattaagccact

SEQ ID NO: 6628400 - DNA, 22 bp, Homo sapiens
agagctgtctatgcagcctgct

SEQ ID NO: 6628401 - DNA, 12 bp, Homo sapiens
agagctgtctga

SEQ ID NO: 6628402 - DNA, 17 bp, Homo sapiens
agagctgtcttcccctg

SEQ ID NO: 6628403 - DNA, 18 bp, Homo sapiens
agagctgtcttcccctga

SEQ ID NO: 6628404 - DNA, 22 bp, Homo sapiens
agagctgtcttcccctgagagt

SEQ ID NO: 6628405 - DNA, 10 bp, Homo sapiens
agagctgtgc

SEQ ID NO: 6628406 - DNA, 11 bp, Homo sapiens
agagctgtgcc

SEQ ID NO: 6628407 - DNA, 12 bp, Homo sapiens
agagctgtgcca

SEQ ID NO: 6628408 - DNA, 17 bp, Homo sapiens
agagctgtgcctgctca

SEQ ID NO: 6628409 - DNA, 24 bp, Homo sapiens
agagctgtgcctgctcagcagcca

SEQ ID NO: 6628410 - DNA, 20 bp, Homo sapiens
agagctgtggaggattgcta

SEQ ID NO: 6628411 - DNA, 16 bp, Homo sapiens
agagctgtggctgggg

SEQ ID NO: 6628412 - DNA, 17 bp, Homo sapiens
agagctgttatgctgtt

SEQ ID NO: 6628413 - DNA, 22 bp, Homo sapiens
agagctgttatgctgtttccta

SEQ ID NO: 6628414 - DNA, 19 bp, Homo sapiens
agagctgttcacagccaga

SEQ ID NO: 6628415 - DNA, 20 bp, Homo sapiens
agagctgttcgctcctccca

SEQ ID NO: 6628416 - DNA, 16 bp, Homo sapiens
agagctgttggcctcg

SEQ ID NO: 6628417 - DNA, 20 bp, Homo sapiens
agagctgttggcctcgcctg

SEQ ID NO: 6628418 - DNA, 21 bp, Homo sapiens
agagctgtttatggcctcagc

SEQ ID NO: 6628419 - DNA, 22 bp, Homo sapiens
agagctgtttggatacagctgc

SEQ ID NO: 6628420 - DNA, 17 bp, Homo sapiens
agagcttaaattgtcat

SEQ ID NO: 6628421 - DNA, 15 bp, Homo sapiens
agagcttagcctgga

SEQ ID NO: 6628422 - DNA, 14 bp, Homo sapiens
agagcttagggtct

SEQ ID NO: 6628423 - DNA, 18 bp, Homo sapiens
agagcttagggtctcagg

SEQ ID NO: 6628424 - DNA, 15 bp, Homo sapiens
agagcttataaaatt

SEQ ID NO: 6628425 - DNA, 18 bp, Homo sapiens
agagcttattggccactg

SEQ ID NO: 6628426 - DNA, 16 bp, Homo sapiens
agagcttcagaggtgg

SEQ ID NO: 6628427 - DNA, 18 bp, Homo sapiens
agagcttcaggccccagg

SEQ ID NO: 6628428 - DNA, 12 bp, Homo sapiens
agagcttccaaa

SEQ ID NO: 6628429 - DNA, 21 bp, Homo sapiens
agagcttccaaatgtgtcaga

SEQ ID NO: 6628430 - DNA, 14 bp, Homo sapiens
agagcttcccagga

SEQ ID NO: 6628431 - DNA, 15 bp, Homo sapiens
agagcttcccaggat

SEQ ID NO: 6628432 - DNA, 21 bp, Homo sapiens
agagcttcctggggaccaaga

SEQ ID NO: 6628433 - DNA, 13 bp, Homo sapiens
agagcttctcctg

SEQ ID NO: 6628434 - DNA, 19 bp, Homo sapiens
agagcttctcctgaccagg

SEQ ID NO: 6628435 - DNA, 12 bp, Homo sapiens
agagcttctctg

SEQ ID NO: 6628436 - DNA, 17 bp, Homo sapiens
agagcttctctgggctg

SEQ ID NO: 6628437 - DNA, 21 bp, Homo sapiens
agagcttctctgggctgaatg

SEQ ID NO: 6628438 - DNA, 22 bp, Homo sapiens
agagcttcttccaggtgcccag

SEQ ID NO: 6628439 - DNA, 14 bp, Homo sapiens
agagcttgaagatt

SEQ ID NO: 6628440 - DNA, 21 bp, Homo sapiens
agagcttgattagaagccaag

SEQ ID NO: 6628441 - DNA, 22 bp, Homo sapiens
agagcttgattagaagccaaga

SEQ ID NO: 6628442 - DNA, 15 bp, Homo sapiens
agagcttgcacagcc

SEQ ID NO: 6628443 - DNA, 14 bp, Homo sapiens
agagcttgctccag

SEQ ID NO: 6628444 - DNA, 15 bp, Homo sapiens
agagcttgctccaga

SEQ ID NO: 6628445 - DNA, 23 bp, Homo sapiens
agagcttgctccagattctgatg

SEQ ID NO: 6628446 - DNA, 23 bp, Homo sapiens
agagcttggactggatgcatgtt

SEQ ID NO: 6628447 - DNA, 19 bp, Homo sapiens
agagcttggtggctgagct

SEQ ID NO: 6628448 - DNA, 17 bp, Homo sapiens
agagcttgtaataaata

SEQ ID NO: 6628449 - DNA, 18 bp, Homo sapiens
agagcttgtaataaatac

SEQ ID NO: 6628450 - DNA, 20 bp, Homo sapiens
agagcttgtaataaatactg

SEQ ID NO: 6628451 - DNA, 17 bp, Homo sapiens
agagcttgtcagcaaga

SEQ ID NO: 6628452 - DNA, 18 bp, Homo sapiens
agagcttgtgctcctctt

SEQ ID NO: 6628453 - DNA, 21 bp, Homo sapiens
agagcttgtggtggggcagga

SEQ ID NO: 6628454 - DNA, 15 bp, Homo sapiens
agagcttgtgtcctg

SEQ ID NO: 6628455 - DNA, 23 bp, Homo sapiens
agagcttgttgtctccacttgta

SEQ ID NO: 6628456 - DNA, 19 bp, Homo sapiens
agagctttaaaagtatctt

SEQ ID NO: 6628457 - DNA, 21 bp, Homo sapiens
agagctttaaaagtatcttta

SEQ ID NO: 6628458 - DNA, 15 bp, Homo sapiens
agagctttacaaaaa

SEQ ID NO: 6628459 - DNA, 15 bp, Homo sapiens
agagctttctgcctt

SEQ ID NO: 6628460 - DNA, 20 bp, Homo sapiens
agagctttctgccttagcct

SEQ ID NO: 6628461 - DNA, 12 bp, Homo sapiens
agagctttcttt

SEQ ID NO: 6628462 - DNA, 17 bp, Homo sapiens
agagctttcttttgtat

SEQ ID NO: 6628463 - DNA, 11 bp, Homo sapiens
agagctttgtc

SEQ ID NO: 6628464 - DNA, 12 bp, Homo sapiens
agagctttgtca

SEQ ID NO: 6628465 - DNA, 15 bp, Homo sapiens
agagctttgtcactt

SEQ ID NO: 6628466 - DNA, 20 bp, Homo sapiens
agagctttgtcacttgccac

SEQ ID NO: 6628467 - DNA, 17 bp, Homo sapiens
agagctttgtcgtattt

SEQ ID NO: 6628468 - DNA, 23 bp, Homo sapiens
agagcttttatttggtgtgttcg

SEQ ID NO: 6628469 - DNA, 14 bp, Homo sapiens
agagcttttcagaa

SEQ ID NO: 6628470 - DNA, 20 bp, Homo sapiens
agagcttttcagattgtgga

SEQ ID NO: 6628471 - DNA, 23 bp, Homo sapiens
agagcttttcgaactgtgctccc

SEQ ID NO: 6628472 - DNA, 22 bp, Homo sapiens
agagcttttgcatttcctgtgt

SEQ ID NO: 6628473 - DNA, 17 bp, Homo sapiens
agagctttttaatagca

SEQ ID NO: 6628474 - DNA, 22 bp, Homo sapiens
agaggaaaaacagaggatgctg

SEQ ID NO: 6628475 - DNA, 22 bp, Homo sapiens
agaggaaaaacgatcgctgtga

SEQ ID NO: 6628476 - DNA, 22 bp, Homo sapiens
agaggaaaaatgggagccagga

SEQ ID NO: 6628477 - DNA, 12 bp, Homo sapiens
agaggaaaaccc

SEQ ID NO: 6628478 - DNA, 14 bp, Homo sapiens
agaggaaaagctgc

SEQ ID NO: 6628479 - DNA, 23 bp, Homo sapiens
agaggaaaaggcttgagtctgga

SEQ ID NO: 6628480 - DNA, 18 bp, Homo sapiens
agaggaaaagtaaggtgc

SEQ ID NO: 6628481 - DNA, 12 bp, Homo sapiens
agaggaaagcaa

SEQ ID NO: 6628482 - DNA, 17 bp, Homo sapiens
agaggaaaggcgccccc

SEQ ID NO: 6628483 - DNA, 15 bp, Homo sapiens
agaggaaagggctgg

SEQ ID NO: 6628484 - DNA, 18 bp, Homo sapiens
agaggaaagggctggctc

SEQ ID NO: 6628485 - DNA, 17 bp, Homo sapiens
agaggaaagtacatttt

SEQ ID NO: 6628486 - DNA, 11 bp, Homo sapiens
agaggaaatca

SEQ ID NO: 6628487 - DNA, 14 bp, Homo sapiens
agaggaaatctgta

SEQ ID NO: 6628488 - DNA, 21 bp, Homo sapiens
agaggaaatctgtaacaggta

SEQ ID NO: 6628489 - DNA, 13 bp, Homo sapiens
agaggaaattaaa

SEQ ID NO: 6628490 - DNA, 18 bp, Homo sapiens
agaggaaattaaataatt

SEQ ID NO: 6628491 - DNA, 21 bp, Homo sapiens
agaggaaattaaataatttta

SEQ ID NO: 6628492 - DNA, 15 bp, Homo sapiens
agaggaacaggtgga

SEQ ID NO: 6628493 - DNA, 15 bp, Homo sapiens
agaggaacagtgtgg

SEQ ID NO: 6628494 - DNA, 14 bp, Homo sapiens
agaggaaccaaccc

SEQ ID NO: 6628495 - DNA, 21 bp, Homo sapiens
agaggaaccgttttacactgg

SEQ ID NO: 6628496 - DNA, 20 bp, Homo sapiens
agaggaacctctgatttatt

SEQ ID NO: 6628497 - DNA, 21 bp, Homo sapiens
agaggaactccttggcctagc

SEQ ID NO: 6628498 - DNA, 10 bp, Homo sapiens
agaggaagaa

SEQ ID NO: 6628499 - DNA, 11 bp, Homo sapiens
agaggaagaaa

SEQ ID NO: 6628500 - DNA, 20 bp, Homo sapiens
agaggaagaaattcaggtac

SEQ ID NO: 6628501 - DNA, 16 bp, Homo sapiens
agaggaagagaagccc

SEQ ID NO: 6628502 - DNA, 13 bp, Homo sapiens
agaggaagagaca

SEQ ID NO: 6628503 - DNA, 16 bp, Homo sapiens
agaggaagagacactc

SEQ ID NO: 6628504 - DNA, 19 bp, Homo sapiens
agaggaagagagggaggag

SEQ ID NO: 6628505 - DNA, 13 bp, Homo sapiens
agaggaagagcag

SEQ ID NO: 6628506 - DNA, 18 bp, Homo sapiens
agaggaagatgaagagaa

SEQ ID NO: 6628507 - DNA, 14 bp, Homo sapiens
agaggaagcaagaa

SEQ ID NO: 6628508 - DNA, 21 bp, Homo sapiens
agaggaagcacactgcagggc

SEQ ID NO: 6628509 - DNA, 21 bp, Homo sapiens
agaggaagccttgcccagcaa

SEQ ID NO: 6628510 - DNA, 15 bp, Homo sapiens
agaggaagctgttgg

SEQ ID NO: 6628511 - DNA, 15 bp, Homo sapiens
agaggaaggaaaagg

SEQ ID NO: 6628512 - DNA, 22 bp, Homo sapiens
agaggaaggaaacatagaaaga

SEQ ID NO: 6628513 - DNA, 23 bp, Homo sapiens
agaggaaggaaacatagaaagac

SEQ ID NO: 6628514 - DNA, 19 bp, Homo sapiens
agaggaagggaggcctgag

SEQ ID NO: 6628515 - DNA, 22 bp, Homo sapiens
agaggaaggggtgctgtgaggc

SEQ ID NO: 6628516 - DNA, 21 bp, Homo sapiens
agaggaataaaatgattaagt

SEQ ID NO: 6628517 - DNA, 14 bp, Homo sapiens
agaggaataagaat

SEQ ID NO: 6628518 - DNA, 21 bp, Homo sapiens
agaggaataaggcccagagcg

SEQ ID NO: 6628519 - DNA, 22 bp, Homo sapiens
agaggaatcactcttgtggatg

SEQ ID NO: 6628520 - DNA, 24 bp, Homo sapiens
agaggaatcagacttcacactgca

SEQ ID NO: 6628521 - DNA, 20 bp, Homo sapiens
agaggaatctgtttctctgc

SEQ ID NO: 6628522 - DNA, 22 bp, Homo sapiens
agaggaatctgtttctctgctg

SEQ ID NO: 6628523 - DNA, 23 bp, Homo sapiens
agaggaatctgtttctctgctgt

SEQ ID NO: 6628524 - DNA, 16 bp, Homo sapiens
agaggaatgatgggct

SEQ ID NO: 6628525 - DNA, 21 bp, Homo sapiens
agaggaatgatgggcttttgt

SEQ ID NO: 6628526 - DNA, 13 bp, Homo sapiens
agaggaatttata

SEQ ID NO: 6628527 - DNA, 14 bp, Homo sapiens
agaggaatttggct

SEQ ID NO: 6628528 - DNA, 19 bp, Homo sapiens
agaggacaatctagctctc

SEQ ID NO: 6628529 - DNA, 23 bp, Homo sapiens
agaggacacctgtactggagagc

SEQ ID NO: 6628530 - DNA, 19 bp, Homo sapiens
agaggacacggaccctgtg

SEQ ID NO: 6628531 - DNA, 20 bp, Homo sapiens
agaggacacggaccctgtgt

SEQ ID NO: 6628532 - DNA, 22 bp, Homo sapiens
agaggacacggaccctgtgtgg

SEQ ID NO: 6628533 - DNA, 14 bp, Homo sapiens
agaggacagaatgg

SEQ ID NO: 6628534 - DNA, 19 bp, Homo sapiens
agaggacagaatggatata

SEQ ID NO: 6628535 - DNA, 12 bp, Homo sapiens
agaggacaggga

SEQ ID NO: 6628536 - DNA, 18 bp, Homo sapiens
agaggacagtctggagaa

SEQ ID NO: 6628537 - DNA, 22 bp, Homo sapiens
agaggacagtgctgaccccagg

SEQ ID NO: 6628538 - DNA, 13 bp, Homo sapiens
agaggacatacca

SEQ ID NO: 6628539 - DNA, 20 bp, Homo sapiens
agaggaccacagtgggtggc

SEQ ID NO: 6628540 - DNA, 15 bp, Homo sapiens
agaggaccagggcct

SEQ ID NO: 6628541 - DNA, 14 bp, Homo sapiens
agaggacccacctg

SEQ ID NO: 6628542 - DNA, 19 bp, Homo sapiens
agaggacctctttggggca

SEQ ID NO: 6628543 - DNA, 16 bp, Homo sapiens
agaggacctgagactc

SEQ ID NO: 6628544 - DNA, 22 bp, Homo sapiens
agaggacctgtatttaagcaaa

SEQ ID NO: 6628545 - DNA, 23 bp, Homo sapiens
agaggacctgtatttaagcaaat

SEQ ID NO: 6628546 - DNA, 23 bp, Homo sapiens
agaggacgcacgctcgctgccat

SEQ ID NO: 6628547 - DNA, 14 bp, Homo sapiens
agaggacgggaggc

SEQ ID NO: 6628548 - DNA, 14 bp, Homo sapiens
agaggacgtgggcg

SEQ ID NO: 6628549 - DNA, 16 bp, Homo sapiens
agaggacgtgggcggc

SEQ ID NO: 6628550 - DNA, 22 bp, Homo sapiens
agaggacgtgttacccactgcc

SEQ ID NO: 6628551 - DNA, 18 bp, Homo sapiens
agaggactcccaaccctg

SEQ ID NO: 6628552 - DNA, 23 bp, Homo sapiens
agaggactcgcttgtaaatacca

SEQ ID NO: 6628553 - DNA, 22 bp, Homo sapiens
agaggactctgcttaaacaaag

SEQ ID NO: 6628554 - DNA, 20 bp, Homo sapiens
agaggactggttctgaggcc

SEQ ID NO: 6628555 - DNA, 21 bp, Homo sapiens
agaggactggttctgaggcca

SEQ ID NO: 6628556 - DNA, 24 bp, Homo sapiens
agaggactggttctgaggccagaa

SEQ ID NO: 6628557 - DNA, 22 bp, Homo sapiens
agaggacttttctttgtggctt

SEQ ID NO: 6628558 - DNA, 13 bp, Homo sapiens
agaggagaaaaaa

SEQ ID NO: 6628559 - DNA, 14 bp, Homo sapiens
agaggagaaaaaaa

SEQ ID NO: 6628560 - DNA, 14 bp, Homo sapiens
agaggagaaactga

SEQ ID NO: 6628561 - DNA, 17 bp, Homo sapiens
agaggagaaaggtgaaa

SEQ ID NO: 6628562 - DNA, 16 bp, Homo sapiens
agaggagaaagtggaa

SEQ ID NO: 6628563 - DNA, 11 bp, Homo sapiens
agaggagaaga

SEQ ID NO: 6628564 - DNA, 16 bp, Homo sapiens
agaggagaaggagagg

SEQ ID NO: 6628565 - DNA, 12 bp, Homo sapiens
agaggagacagc

SEQ ID NO: 6628566 - DNA, 15 bp, Homo sapiens
agaggagaccctgga

SEQ ID NO: 6628567 - DNA, 10 bp, Homo sapiens
agaggagaga

SEQ ID NO: 6628568 - DNA, 11 bp, Homo sapiens
agaggagagaa

SEQ ID NO: 6628569 - DNA, 18 bp, Homo sapiens
agaggagagaatgagaga

SEQ ID NO: 6628570 - DNA, 20 bp, Homo sapiens
agaggagagaatgagagagt

SEQ ID NO: 6628571 - DNA, 15 bp, Homo sapiens
agaggagagaggacc

SEQ ID NO: 6628572 - DNA, 13 bp, Homo sapiens
agaggagagaggc

SEQ ID NO: 6628573 - DNA, 15 bp, Homo sapiens
agaggagagaggcag

SEQ ID NO: 6628574 - DNA, 22 bp, Homo sapiens
agaggagagcatctgctctgag

SEQ ID NO: 6628575 - DNA, 13 bp, Homo sapiens
agaggagagccag

SEQ ID NO: 6628576 - DNA, 14 bp, Homo sapiens
agaggagagccaga

SEQ ID NO: 6628577 - DNA, 19 bp, Homo sapiens
agaggagagtggcaggtgg

SEQ ID NO: 6628578 - DNA, 18 bp, Homo sapiens
agaggagagtggcctggg

SEQ ID NO: 6628579 - DNA, 21 bp, Homo sapiens
agaggagataaggtggcttct

SEQ ID NO: 6628580 - DNA, 22 bp, Homo sapiens
agaggagataaggtggcttctc

SEQ ID NO: 6628581 - DNA, 19 bp, Homo sapiens
agaggagataatgtggatt

SEQ ID NO: 6628582 - DNA, 13 bp, Homo sapiens
agaggagatcagg

SEQ ID NO: 6628583 - DNA, 20 bp, Homo sapiens
agaggagatgtgatcaggcc

SEQ ID NO: 6628584 - DNA, 22 bp, Homo sapiens
agaggagatgtgatcaggcccc

SEQ ID NO: 6628585 - DNA, 20 bp, Homo sapiens
agaggagattggccagtgag

SEQ ID NO: 6628586 - DNA, 13 bp, Homo sapiens
agaggagcacctg

SEQ ID NO: 6628587 - DNA, 18 bp, Homo sapiens
agaggagcagagggcagg

SEQ ID NO: 6628588 - DNA, 19 bp, Homo sapiens
agaggagccacctgggctg

SEQ ID NO: 6628589 - DNA, 12 bp, Homo sapiens
agaggagccaga

SEQ ID NO: 6628590 - DNA, 14 bp, Homo sapiens
agaggagccctgcc

SEQ ID NO: 6628591 - DNA, 15 bp, Homo sapiens
agaggagccctgcct

SEQ ID NO: 6628592 - DNA, 21 bp, Homo sapiens
agaggagcctcagaagaaaac

SEQ ID NO: 6628593 - DNA, 22 bp, Homo sapiens
agaggagcctttttaaaacaca

SEQ ID NO: 6628594 - DNA, 23 bp, Homo sapiens
agaggagcctttttaaaacacat

SEQ ID NO: 6628595 - DNA, 20 bp, Homo sapiens
agaggagctctaccctgctc

SEQ ID NO: 6628596 - DNA, 15 bp, Homo sapiens
agaggagctgcttgt

SEQ ID NO: 6628597 - DNA, 20 bp, Homo sapiens
agaggagctgggagccgggc

SEQ ID NO: 6628598 - DNA, 23 bp, Homo sapiens
agaggaggacccctgccttcctc

SEQ ID NO: 6628599 - DNA, 17 bp, Homo sapiens
agaggaggaggtggggg

SEQ ID NO: 6628600 - DNA, 16 bp, Homo sapiens
agaggaggcagcagga

SEQ ID NO: 6628601 - DNA, 12 bp, Homo sapiens
agaggaggcctg

SEQ ID NO: 6628602 - DNA, 13 bp, Homo sapiens
agaggaggcctgg

SEQ ID NO: 6628603 - DNA, 17 bp, Homo sapiens
agaggagggacctactg

SEQ ID NO: 6628604 - DNA, 13 bp, Homo sapiens
agaggagggcaga

SEQ ID NO: 6628605 - DNA, 21 bp, Homo sapiens
agaggagggcgtgactcaccc

SEQ ID NO: 6628606 - DNA, 18 bp, Homo sapiens
agaggaggggccgctgcc

SEQ ID NO: 6628607 - DNA, 20 bp, Homo sapiens
agaggaggggccgctgccac

SEQ ID NO: 6628608 - DNA, 19 bp, Homo sapiens
agaggagggggcaggctga

SEQ ID NO: 6628609 - DNA, 20 bp, Homo sapiens
agaggagggggcaggctgag

SEQ ID NO: 6628610 - DNA, 17 bp, Homo sapiens
agaggaggggtaaatat

SEQ ID NO: 6628611 - DNA, 18 bp, Homo sapiens
agaggaggggtaaatata

SEQ ID NO: 6628612 - DNA, 19 bp, Homo sapiens
agaggaggggtaaatatat

SEQ ID NO: 6628613 - DNA, 20 bp, Homo sapiens
agaggaggtgtggagtggag

SEQ ID NO: 6628614 - DNA, 16 bp, Homo sapiens
agaggaggtttgcctg

SEQ ID NO: 6628615 - DNA, 19 bp, Homo sapiens
agaggagtgcagccttctc

SEQ ID NO: 6628616 - DNA, 14 bp, Homo sapiens
agaggagtgttatt

SEQ ID NO: 6628617 - DNA, 15 bp, Homo sapiens
agaggagttcaatga

SEQ ID NO: 6628618 - DNA, 16 bp, Homo sapiens
agaggagttcaatgat

SEQ ID NO: 6628619 - DNA, 15 bp, Homo sapiens
agaggagttctttgg

SEQ ID NO: 6628620 - DNA, 21 bp, Homo sapiens
agaggataaataataaaggtt

SEQ ID NO: 6628621 - DNA, 19 bp, Homo sapiens
agaggatccgtgctgtctc

SEQ ID NO: 6628622 - DNA, 14 bp, Homo sapiens
agaggatgaaggaa

SEQ ID NO: 6628623 - DNA, 22 bp, Homo sapiens
agaggatgaaggctgtgaaaaa

SEQ ID NO: 6628624 - DNA, 16 bp, Homo sapiens
agaggatgatgtaatt

SEQ ID NO: 6628625 - DNA, 20 bp, Homo sapiens
agaggatgccttttctgtga

SEQ ID NO: 6628626 - DNA, 20 bp, Homo sapiens
agaggatgctctttcccagg

SEQ ID NO: 6628627 - DNA, 20 bp, Homo sapiens
agaggatgctgacatcattt

SEQ ID NO: 6628628 - DNA, 16 bp, Homo sapiens
agaggatggccagtgt

SEQ ID NO: 6628629 - DNA, 22 bp, Homo sapiens
agaggatgtggcaggggcagtg

SEQ ID NO: 6628630 - DNA, 23 bp, Homo sapiens
agaggatgtggcaggggcagtgg

SEQ ID NO: 6628631 - DNA, 19 bp, Homo sapiens
agaggattagtaagatctc

SEQ ID NO: 6628632 - DNA, 16 bp, Homo sapiens
agaggattagtagaaa

SEQ ID NO: 6628633 - DNA, 18 bp, Homo sapiens
agaggattagtagaaaat

SEQ ID NO: 6628634 - DNA, 20 bp, Homo sapiens
agaggattgtccaccttctg

SEQ ID NO: 6628635 - DNA, 15 bp, Homo sapiens
agaggatttctgctt

SEQ ID NO: 6628636 - DNA, 13 bp, Homo sapiens
agaggatttggct

SEQ ID NO: 6628637 - DNA, 23 bp, Homo sapiens
agaggatttggctcgctgtggtt

SEQ ID NO: 6628638 - DNA, 14 bp, Homo sapiens
agaggattttgcgt

SEQ ID NO: 6628639 - DNA, 19 bp, Homo sapiens
agaggcaagcgaccgaggc

SEQ ID NO: 6628640 - DNA, 16 bp, Homo sapiens
agaggcaagctgaaat

SEQ ID NO: 6628641 - DNA, 14 bp, Homo sapiens
agaggcaaggatgg

SEQ ID NO: 6628642 - DNA, 20 bp, Homo sapiens
agaggcaataaataaatgtt

SEQ ID NO: 6628643 - DNA, 14 bp, Homo sapiens
agaggcaccaggaa

SEQ ID NO: 6628644 - DNA, 12 bp, Homo sapiens
agaggcaccagt

SEQ ID NO: 6628645 - DNA, 15 bp, Homo sapiens
agaggcacctgctgg

SEQ ID NO: 6628646 - DNA, 18 bp, Homo sapiens
agaggcacctgtcccaga

SEQ ID NO: 6628647 - DNA, 21 bp, Homo sapiens
agaggcactcagtgagcctcc

SEQ ID NO: 6628648 - DNA, 18 bp, Homo sapiens
agaggcagaaaattgcac

SEQ ID NO: 6628649 - DNA, 17 bp, Homo sapiens
agaggcagaagaaccct

SEQ ID NO: 6628650 - DNA, 17 bp, Homo sapiens
agaggcagagaaagaag

SEQ ID NO: 6628651 - DNA, 18 bp, Homo sapiens
agaggcagagaaagaaga

SEQ ID NO: 6628652 - DNA, 20 bp, Homo sapiens
agaggcagagaaagaagaga

SEQ ID NO: 6628653 - DNA, 21 bp, Homo sapiens
agaggcagagaaagaagagac

SEQ ID NO: 6628654 - DNA, 21 bp, Homo sapiens
agaggcagagacctcctgatg

SEQ ID NO: 6628655 - DNA, 14 bp, Homo sapiens
agaggcagagagcg

SEQ ID NO: 6628656 - DNA, 15 bp, Homo sapiens
agaggcagagagcgg

SEQ ID NO: 6628657 - DNA, 23 bp, Homo sapiens
agaggcagagagcggtctcaggc

SEQ ID NO: 6628658 - DNA, 19 bp, Homo sapiens
agaggcagagtgccccacc

SEQ ID NO: 6628659 - DNA, 20 bp, Homo sapiens
agaggcagagttctgtgaag

SEQ ID NO: 6628660 - DNA, 13 bp, Homo sapiens
agaggcagcaagg

SEQ ID NO: 6628661 - DNA, 12 bp, Homo sapiens
agaggcagcatg

SEQ ID NO: 6628662 - DNA, 19 bp, Homo sapiens
agaggcagcatgcttgggc

SEQ ID NO: 6628663 - DNA, 20 bp, Homo sapiens
agaggcagcatgcttgggct

SEQ ID NO: 6628664 - DNA, 19 bp, Homo sapiens
agaggcagcccaggaagtc

SEQ ID NO: 6628665 - DNA, 13 bp, Homo sapiens
agaggcagcccca

SEQ ID NO: 6628666 - DNA, 20 bp, Homo sapiens
agaggcagctaaggggcagg

SEQ ID NO: 6628667 - DNA, 19 bp, Homo sapiens
agaggcagcttcaagtgcc

SEQ ID NO: 6628668 - DNA, 21 bp, Homo sapiens
agaggcagcttctagacagag

SEQ ID NO: 6628669 - DNA, 15 bp, Homo sapiens
agaggcaggaatggg

SEQ ID NO: 6628670 - DNA, 17 bp, Homo sapiens
agaggcagggaggggac

SEQ ID NO: 6628671 - DNA, 15 bp, Homo sapiens
agaggcagggccctg

SEQ ID NO: 6628672 - DNA, 13 bp, Homo sapiens
agaggcagggtct

SEQ ID NO: 6628673 - DNA, 15 bp, Homo sapiens
agaggcaggtagggg

SEQ ID NO: 6628674 - DNA, 21 bp, Homo sapiens
agaggcaggtagggggtccct

SEQ ID NO: 6628675 - DNA, 18 bp, Homo sapiens
agaggcagttgcccagcc

SEQ ID NO: 6628676 - DNA, 22 bp, Homo sapiens
agaggcagttgcccagcctctt

SEQ ID NO: 6628677 - DNA, 22 bp, Homo sapiens
agaggcataaacctgtgctgaa

SEQ ID NO: 6628678 - DNA, 18 bp, Homo sapiens
agaggcatcccaagacct

SEQ ID NO: 6628679 - DNA, 15 bp, Homo sapiens
agaggcatcctgcct

SEQ ID NO: 6628680 - DNA, 18 bp, Homo sapiens
agaggcatcctgcctggg

SEQ ID NO: 6628681 - DNA, 16 bp, Homo sapiens
agaggcatgacagctg

SEQ ID NO: 6628682 - DNA, 15 bp, Homo sapiens
agaggcattgttagt

SEQ ID NO: 6628683 - DNA, 19 bp, Homo sapiens
agaggcatttaaaatggaa

SEQ ID NO: 6628684 - DNA, 18 bp, Homo sapiens
agaggccaaaggctggtg

SEQ ID NO: 6628685 - DNA, 14 bp, Homo sapiens
agaggccaaggact

SEQ ID NO: 6628686 - DNA, 15 bp, Homo sapiens
agaggccaaggactg

SEQ ID NO: 6628687 - DNA, 16 bp, Homo sapiens
agaggccaaggactga

SEQ ID NO: 6628688 - DNA, 14 bp, Homo sapiens
agaggccacaggaa

SEQ ID NO: 6628689 - DNA, 17 bp, Homo sapiens
agaggccagacatggtg

SEQ ID NO: 6628690 - DNA, 23 bp, Homo sapiens
agaggccagccccacccaggagg

SEQ ID NO: 6628691 - DNA, 15 bp, Homo sapiens
agaggccagcctggc

SEQ ID NO: 6628692 - DNA, 23 bp, Homo sapiens
agaggccaggcaggagcccttct

SEQ ID NO: 6628693 - DNA, 14 bp, Homo sapiens
agaggccaggcatg

SEQ ID NO: 6628694 - DNA, 18 bp, Homo sapiens
agaggccagggtggccag

SEQ ID NO: 6628695 - DNA, 14 bp, Homo sapiens
agaggccagtagga

SEQ ID NO: 6628696 - DNA, 21 bp, Homo sapiens
agaggccagttgatctgctct

SEQ ID NO: 6628697 - DNA, 14 bp, Homo sapiens
agaggccatggagg

SEQ ID NO: 6628698 - DNA, 14 bp, Homo sapiens
agaggccatggcag

SEQ ID NO: 6628699 - DNA, 16 bp, Homo sapiens
agaggcccaaaacagt

SEQ ID NO: 6628700 - DNA, 19 bp, Homo sapiens
agaggcccactagagggcc

SEQ ID NO: 6628701 - DNA, 13 bp, Homo sapiens
agaggcccagcca

SEQ ID NO: 6628702 - DNA, 18 bp, Homo sapiens
agaggcccagccctcaga

SEQ ID NO: 6628703 - DNA, 16 bp, Homo sapiens
agaggcccaggcacca

SEQ ID NO: 6628704 - DNA, 17 bp, Homo sapiens
agaggcccaggcaccac

SEQ ID NO: 6628705 - DNA, 13 bp, Homo sapiens
agaggcccaggga

SEQ ID NO: 6628706 - DNA, 22 bp, Homo sapiens
agaggcccagggagcaatggga

SEQ ID NO: 6628707 - DNA, 23 bp, Homo sapiens
agaggccccagcctccctgaagc

SEQ ID NO: 6628708 - DNA, 14 bp, Homo sapiens
agaggcccccagcc

SEQ ID NO: 6628709 - DNA, 17 bp, Homo sapiens
agaggcccccagcccag

SEQ ID NO: 6628710 - DNA, 22 bp, Homo sapiens
agaggcccccagcccagggctc

SEQ ID NO: 6628711 - DNA, 16 bp, Homo sapiens
agaggcccccagtggg

SEQ ID NO: 6628712 - DNA, 17 bp, Homo sapiens
agaggccccttgctgct

SEQ ID NO: 6628713 - DNA, 19 bp, Homo sapiens
agaggccctcgctgccagc

SEQ ID NO: 6628714 - DNA, 18 bp, Homo sapiens
agaggccctctggagtgg

SEQ ID NO: 6628715 - DNA, 24 bp, Homo sapiens
agaggccctctggagtggccacta

SEQ ID NO: 6628716 - DNA, 18 bp, Homo sapiens
agaggccctgcccccacc

SEQ ID NO: 6628717 - DNA, 12 bp, Homo sapiens
agaggccctgga

SEQ ID NO: 6628718 - DNA, 16 bp, Homo sapiens
agaggccctggaggga

SEQ ID NO: 6628719 - DNA, 22 bp, Homo sapiens
agaggccctggaggtctccagg

SEQ ID NO: 6628720 - DNA, 23 bp, Homo sapiens
agaggccctggatcagcgtggcc

SEQ ID NO: 6628721 - DNA, 17 bp, Homo sapiens
agaggccctttgctgtc

SEQ ID NO: 6628722 - DNA, 13 bp, Homo sapiens
agaggccgctctg

SEQ ID NO: 6628723 - DNA, 20 bp, Homo sapiens
agaggccgctgcagggtggc

SEQ ID NO: 6628724 - DNA, 18 bp, Homo sapiens
agaggcctcccccagcca

SEQ ID NO: 6628725 - DNA, 21 bp, Homo sapiens
agaggcctcccccagccagga

SEQ ID NO: 6628726 - DNA, 22 bp, Homo sapiens
agaggcctcccccagccaggac

SEQ ID NO: 6628727 - DNA, 18 bp, Homo sapiens
agaggcctgaagctgagc

SEQ ID NO: 6628728 - DNA, 13 bp, Homo sapiens
agaggcctgcccg

SEQ ID NO: 6628729 - DNA, 20 bp, Homo sapiens
agaggcctgcctccagggct

SEQ ID NO: 6628730 - DNA, 16 bp, Homo sapiens
agaggcctgctgccag

SEQ ID NO: 6628731 - DNA, 19 bp, Homo sapiens
agaggcctggcatcttctg

SEQ ID NO: 6628732 - DNA, 14 bp, Homo sapiens
agaggcctgggctg

SEQ ID NO: 6628733 - DNA, 22 bp, Homo sapiens
agaggcctgggggacccctggc

SEQ ID NO: 6628734 - DNA, 21 bp, Homo sapiens
agaggcctggggtgggacagg

SEQ ID NO: 6628735 - DNA, 23 bp, Homo sapiens
agaggcctggtgccctggcccag

SEQ ID NO: 6628736 - DNA, 18 bp, Homo sapiens
agaggcctgtttggcctc

SEQ ID NO: 6628737 - DNA, 20 bp, Homo sapiens
agaggccttcccatggccat

SEQ ID NO: 6628738 - DNA, 14 bp, Homo sapiens
agaggccttgctgt

SEQ ID NO: 6628739 - DNA, 12 bp, Homo sapiens
agaggccttggg

SEQ ID NO: 6628740 - DNA, 22 bp, Homo sapiens
agaggccttgggggtctgctct

SEQ ID NO: 6628741 - DNA, 21 bp, Homo sapiens
agaggccttgtcatcctccct

SEQ ID NO: 6628742 - DNA, 21 bp, Homo sapiens
agaggcctttagttataaagg

SEQ ID NO: 6628743 - DNA, 19 bp, Homo sapiens
agaggccttttggaatgtg

SEQ ID NO: 6628744 - DNA, 14 bp, Homo sapiens
agaggcgacttcct

SEQ ID NO: 6628745 - DNA, 15 bp, Homo sapiens
agaggcgagaggtga

SEQ ID NO: 6628746 - DNA, 23 bp, Homo sapiens
agaggcgagaggtgagctacttt

SEQ ID NO: 6628747 - DNA, 17 bp, Homo sapiens
agaggcgcgtctgcccc

SEQ ID NO: 6628748 - DNA, 18 bp, Homo sapiens
agaggcgcgtctgcccca

SEQ ID NO: 6628749 - DNA, 16 bp, Homo sapiens
agaggcggaaaccttg

SEQ ID NO: 6628750 - DNA, 17 bp, Homo sapiens
agaggcgggccagccag

SEQ ID NO: 6628751 - DNA, 21 bp, Homo sapiens
agaggcgggtctataacaggc

SEQ ID NO: 6628752 - DNA, 22 bp, Homo sapiens
agaggcgtactacccagctctg

SEQ ID NO: 6628753 - DNA, 23 bp, Homo sapiens
agaggcgtactacccagctctgt

SEQ ID NO: 6628754 - DNA, 16 bp, Homo sapiens
agaggcgtcctggtga

SEQ ID NO: 6628755 - DNA, 17 bp, Homo sapiens
agaggcgtcctggtgag

SEQ ID NO: 6628756 - DNA, 21 bp, Homo sapiens
agaggcgtcctggtgaggaca

SEQ ID NO: 6628757 - DNA, 19 bp, Homo sapiens
agaggcgtcttgtattttc

SEQ ID NO: 6628758 - DNA, 19 bp, Homo sapiens
agaggcgtgtgcaggccga

SEQ ID NO: 6628759 - DNA, 22 bp, Homo sapiens
agaggcgttagtgggcaggtgg

SEQ ID NO: 6628760 - DNA, 19 bp, Homo sapiens
agaggctaaattactcagg

SEQ ID NO: 6628761 - DNA, 16 bp, Homo sapiens
agaggctaagatgaga

SEQ ID NO: 6628762 - DNA, 15 bp, Homo sapiens
agaggctacagggcc

SEQ ID NO: 6628763 - DNA, 16 bp, Homo sapiens
agaggctagcttctgc

SEQ ID NO: 6628764 - DNA, 20 bp, Homo sapiens
agaggctagtctcttctcag

SEQ ID NO: 6628765 - DNA, 15 bp, Homo sapiens
agaggctatcctgga

SEQ ID NO: 6628766 - DNA, 16 bp, Homo sapiens
agaggctatgaagaaa

SEQ ID NO: 6628767 - DNA, 17 bp, Homo sapiens
agaggctatgtgagcac

SEQ ID NO: 6628768 - DNA, 19 bp, Homo sapiens
agaggctattattttcact

SEQ ID NO: 6628769 - DNA, 10 bp, Homo sapiens
agaggctcag

SEQ ID NO: 6628770 - DNA, 18 bp, Homo sapiens
agaggctcagattgtaat

SEQ ID NO: 6628771 - DNA, 16 bp, Homo sapiens
agaggctcatggccct

SEQ ID NO: 6628772 - DNA, 20 bp, Homo sapiens
agaggctcatggccctgtag

SEQ ID NO: 6628773 - DNA, 12 bp, Homo sapiens
agaggctcctgg

SEQ ID NO: 6628774 - DNA, 16 bp, Homo sapiens
agaggctcctggagcc

SEQ ID NO: 6628775 - DNA, 20 bp, Homo sapiens
agaggctcctggagccagcc

SEQ ID NO: 6628776 - DNA, 22 bp, Homo sapiens
agaggctcctggagccagccac

SEQ ID NO: 6628777 - DNA, 19 bp, Homo sapiens
agaggctctggacagcaga

SEQ ID NO: 6628778 - DNA, 15 bp, Homo sapiens
agaggctctggggca

SEQ ID NO: 6628779 - DNA, 16 bp, Homo sapiens
agaggctcttgatggt

SEQ ID NO: 6628780 - DNA, 13 bp, Homo sapiens
agaggctgaaaga

SEQ ID NO: 6628781 - DNA, 17 bp, Homo sapiens
agaggctgacttttcca

SEQ ID NO: 6628782 - DNA, 19 bp, Homo sapiens
agaggctgacttttccaaa

SEQ ID NO: 6628783 - DNA, 16 bp, Homo sapiens
agaggctgagacagga

SEQ ID NO: 6628784 - DNA, 14 bp, Homo sapiens
agaggctgaggcct

SEQ ID NO: 6628785 - DNA, 17 bp, Homo sapiens
agaggctgaggcctgga

SEQ ID NO: 6628786 - DNA, 13 bp, Homo sapiens
agaggctgaggga

SEQ ID NO: 6628787 - DNA, 20 bp, Homo sapiens
agaggctgcacccctgggcc

SEQ ID NO: 6628788 - DNA, 21 bp, Homo sapiens
agaggctgcagaaggccaaga

SEQ ID NO: 6628789 - DNA, 12 bp, Homo sapiens
agaggctgcagg

SEQ ID NO: 6628790 - DNA, 12 bp, Homo sapiens
agaggctgcccc

SEQ ID NO: 6628791 - DNA, 19 bp, Homo sapiens
agaggctgcccctctcacc

SEQ ID NO: 6628792 - DNA, 14 bp, Homo sapiens
agaggctgcctcag

SEQ ID NO: 6628793 - DNA, 16 bp, Homo sapiens
agaggctgcctcagcc

SEQ ID NO: 6628794 - DNA, 14 bp, Homo sapiens
agaggctgcctccg

SEQ ID NO: 6628795 - DNA, 17 bp, Homo sapiens
agaggctgcctgggcct

SEQ ID NO: 6628796 - DNA, 19 bp, Homo sapiens
agaggctggaggcagggcc

SEQ ID NO: 6628797 - DNA, 22 bp, Homo sapiens
agaggctggaggcagggccttg

SEQ ID NO: 6628798 - DNA, 20 bp, Homo sapiens
agaggctggatgacttgctc

SEQ ID NO: 6628799 - DNA, 21 bp, Homo sapiens
agaggctggatgacttgctca

SEQ ID NO: 6628800 - DNA, 19 bp, Homo sapiens
agaggctggcattgaggct

SEQ ID NO: 6628801 - DNA, 14 bp, Homo sapiens
agaggctgggagca

SEQ ID NO: 6628802 - DNA, 13 bp, Homo sapiens
agaggctgggagg

SEQ ID NO: 6628803 - DNA, 18 bp, Homo sapiens
agaggctgggaggagccc

SEQ ID NO: 6628804 - DNA, 14 bp, Homo sapiens
agaggctgggggag

SEQ ID NO: 6628805 - DNA, 14 bp, Homo sapiens
agaggctggtgctg

SEQ ID NO: 6628806 - DNA, 16 bp, Homo sapiens
agaggctggtgctgtg

SEQ ID NO: 6628807 - DNA, 22 bp, Homo sapiens
agaggctggtgtatgcactgct

SEQ ID NO: 6628808 - DNA, 14 bp, Homo sapiens
agaggctggttttg

SEQ ID NO: 6628809 - DNA, 15 bp, Homo sapiens
agaggctgtctgggg

SEQ ID NO: 6628810 - DNA, 14 bp, Homo sapiens
agaggctgtctgtt

SEQ ID NO: 6628811 - DNA, 16 bp, Homo sapiens
agaggctgtggtcaga

SEQ ID NO: 6628812 - DNA, 15 bp, Homo sapiens
agaggctgtgtccct

SEQ ID NO: 6628813 - DNA, 17 bp, Homo sapiens
agaggctgtgtggccaa

SEQ ID NO: 6628814 - DNA, 14 bp, Homo sapiens
agaggcttccctac

SEQ ID NO: 6628815 - DNA, 23 bp, Homo sapiens
agaggcttccctacacagggcct

SEQ ID NO: 6628816 - DNA, 24 bp, Homo sapiens
agaggcttccctacacagggcctg

SEQ ID NO: 6628817 - DNA, 17 bp, Homo sapiens
agaggcttctccgccag

SEQ ID NO: 6628818 - DNA, 20 bp, Homo sapiens
agaggcttctccgccagcct

SEQ ID NO: 6628819 - DNA, 22 bp, Homo sapiens
agaggcttctccgccagcctcc

SEQ ID NO: 6628820 - DNA, 21 bp, Homo sapiens
agaggcttgaaggccagcagc

SEQ ID NO: 6628821 - DNA, 14 bp, Homo sapiens
agaggctttatgtt

SEQ ID NO: 6628822 - DNA, 16 bp, Homo sapiens
agaggctttggcccaa

SEQ ID NO: 6628823 - DNA, 20 bp, Homo sapiens
agaggcttttattagaaagc

SEQ ID NO: 6628824 - DNA, 17 bp, Homo sapiens
agaggcttttccagtgt

SEQ ID NO: 6628825 - DNA, 14 bp, Homo sapiens
agagggaaaaagag

SEQ ID NO: 6628826 - DNA, 21 bp, Homo sapiens
agagggaaaatgtgaaatctc

SEQ ID NO: 6628827 - DNA, 17 bp, Homo sapiens
agagggaaactctggag

SEQ ID NO: 6628828 - DNA, 19 bp, Homo sapiens
agagggaaactctggagag

SEQ ID NO: 6628829 - DNA, 19 bp, Homo sapiens
agagggaaatacaaggagg

SEQ ID NO: 6628830 - DNA, 14 bp, Homo sapiens
agagggaagaaaag

SEQ ID NO: 6628831 - DNA, 12 bp, Homo sapiens
agagggaagctg

SEQ ID NO: 6628832 - DNA, 20 bp, Homo sapiens
agagggaagctgaggcccat

SEQ ID NO: 6628833 - DNA, 16 bp, Homo sapiens
agagggaatctagccc

SEQ ID NO: 6628834 - DNA, 12 bp, Homo sapiens
agagggaatgtg

SEQ ID NO: 6628835 - DNA, 22 bp, Homo sapiens
agagggacaaccagaaggccct

SEQ ID NO: 6628836 - DNA, 17 bp, Homo sapiens
agagggacacatgcccc

SEQ ID NO: 6628837 - DNA, 22 bp, Homo sapiens
agagggacacatgcccctcccc

SEQ ID NO: 6628838 - DNA, 13 bp, Homo sapiens
agagggacagagc

SEQ ID NO: 6628839 - DNA, 15 bp, Homo sapiens
agagggacagagccc

SEQ ID NO: 6628840 - DNA, 21 bp, Homo sapiens
agagggacagagcccgggaga

SEQ ID NO: 6628841 - DNA, 17 bp, Homo sapiens
agagggacaggcactcc

SEQ ID NO: 6628842 - DNA, 18 bp, Homo sapiens
agagggacaggctgaaga

SEQ ID NO: 6628843 - DNA, 15 bp, Homo sapiens
agagggacagtgggc

SEQ ID NO: 6628844 - DNA, 19 bp, Homo sapiens
agagggacagtgggctatg

SEQ ID NO: 6628845 - DNA, 23 bp, Homo sapiens
agagggacataagataaaatgat

SEQ ID NO: 6628846 - DNA, 19 bp, Homo sapiens
agagggacctctcccaggg

SEQ ID NO: 6628847 - DNA, 21 bp, Homo sapiens
agagggacgcacagcactgcc

SEQ ID NO: 6628848 - DNA, 22 bp, Homo sapiens
agagggacggccaagaatgtac

SEQ ID NO: 6628849 - DNA, 13 bp, Homo sapiens
agagggactgaat

SEQ ID NO: 6628850 - DNA, 18 bp, Homo sapiens
agagggactgtatttctg

SEQ ID NO: 6628851 - DNA, 16 bp, Homo sapiens
agagggagaagaaaga

SEQ ID NO: 6628852 - DNA, 15 bp, Homo sapiens
agagggagaagactg

SEQ ID NO: 6628853 - DNA, 19 bp, Homo sapiens
agagggagaagggatggag

SEQ ID NO: 6628854 - DNA, 14 bp, Homo sapiens
agagggagaatcca

SEQ ID NO: 6628855 - DNA, 22 bp, Homo sapiens
agagggagacagggctgctccc

SEQ ID NO: 6628856 - DNA, 13 bp, Homo sapiens
agagggagagaga

SEQ ID NO: 6628857 - DNA, 16 bp, Homo sapiens
agagggagatgtgtga

SEQ ID NO: 6628858 - DNA, 13 bp, Homo sapiens
agagggagcaacg

SEQ ID NO: 6628859 - DNA, 15 bp, Homo sapiens
agagggagcaagcct

SEQ ID NO: 6628860 - DNA, 18 bp, Homo sapiens
agagggagcaagccttcc

SEQ ID NO: 6628861 - DNA, 24 bp, Homo sapiens
agagggaggagaatgagcctcggc

SEQ ID NO: 6628862 - DNA, 16 bp, Homo sapiens
agagggaggcaagccc

SEQ ID NO: 6628863 - DNA, 20 bp, Homo sapiens
agagggaggcttcctgactg

SEQ ID NO: 6628864 - DNA, 16 bp, Homo sapiens
agagggaggggcctag

SEQ ID NO: 6628865 - DNA, 18 bp, Homo sapiens
agagggaggggcctaggc

SEQ ID NO: 6628866 - DNA, 18 bp, Homo sapiens
agagggagtacaaagaca

SEQ ID NO: 6628867 - DNA, 17 bp, Homo sapiens
agagggagtagaaagct

SEQ ID NO: 6628868 - DNA, 12 bp, Homo sapiens
agagggagtcag

SEQ ID NO: 6628869 - DNA, 15 bp, Homo sapiens
agagggagtgacaga

SEQ ID NO: 6628870 - DNA, 23 bp, Homo sapiens
agagggataaggtacctttcaca

SEQ ID NO: 6628871 - DNA, 20 bp, Homo sapiens
agagggatgaaatgccaaga

SEQ ID NO: 6628872 - DNA, 22 bp, Homo sapiens
agagggatgaggtgctgggagg

SEQ ID NO: 6628873 - DNA, 23 bp, Homo sapiens
agagggatgaggtgctgggaggg

SEQ ID NO: 6628874 - DNA, 17 bp, Homo sapiens
agagggatgcatggaga

SEQ ID NO: 6628875 - DNA, 15 bp, Homo sapiens
agagggatttccctg

SEQ ID NO: 6628876 - DNA, 19 bp, Homo sapiens
agagggatttccctgcaga

SEQ ID NO: 6628877 - DNA, 18 bp, Homo sapiens
agagggcaaacccaaaac

SEQ ID NO: 6628878 - DNA, 14 bp, Homo sapiens
agagggcaaagctg

SEQ ID NO: 6628879 - DNA, 15 bp, Homo sapiens
agagggcaaagctga

SEQ ID NO: 6628880 - DNA, 20 bp, Homo sapiens
agagggcaatctttgccttt

SEQ ID NO: 6628881 - DNA, 21 bp, Homo sapiens
agagggcactcccaggcccct

SEQ ID NO: 6628882 - DNA, 16 bp, Homo sapiens
agagggcactctgctt

SEQ ID NO: 6628883 - DNA, 21 bp, Homo sapiens
agagggcagcccccactttcc

SEQ ID NO: 6628884 - DNA, 12 bp, Homo sapiens
agagggcagggg

SEQ ID NO: 6628885 - DNA, 20 bp, Homo sapiens
agagggcaggggctgcatcc

SEQ ID NO: 6628886 - DNA, 17 bp, Homo sapiens
agagggcaggggtgctg

SEQ ID NO: 6628887 - DNA, 15 bp, Homo sapiens
agagggcagtacctg

SEQ ID NO: 6628888 - DNA, 20 bp, Homo sapiens
agagggcagtacctgggaaa

SEQ ID NO: 6628889 - DNA, 18 bp, Homo sapiens
agagggccaagacttggc

SEQ ID NO: 6628890 - DNA, 16 bp, Homo sapiens
agagggccaagagaga

SEQ ID NO: 6628891 - DNA, 18 bp, Homo sapiens
agagggccaagagagaca

SEQ ID NO: 6628892 - DNA, 15 bp, Homo sapiens
agagggccagagcta

SEQ ID NO: 6628893 - DNA, 24 bp, Homo sapiens
agagggccagagctagggctgctg

SEQ ID NO: 6628894 - DNA, 12 bp, Homo sapiens
agagggccagca

SEQ ID NO: 6628895 - DNA, 15 bp, Homo sapiens
agagggccagcaggc

SEQ ID NO: 6628896 - DNA, 22 bp, Homo sapiens
agagggcccaaagaattggaat

SEQ ID NO: 6628897 - DNA, 17 bp, Homo sapiens
agagggcccagcccaga

SEQ ID NO: 6628898 - DNA, 19 bp, Homo sapiens
agagggcccagcccagagc

SEQ ID NO: 6628899 - DNA, 14 bp, Homo sapiens
agagggcccagctg

SEQ ID NO: 6628900 - DNA, 15 bp, Homo sapiens
agagggcccagctgt

SEQ ID NO: 6628901 - DNA, 20 bp, Homo sapiens
agagggcccagctgtagcca

SEQ ID NO: 6628902 - DNA, 23 bp, Homo sapiens
agagggcccagctgtagccatgg

SEQ ID NO: 6628903 - DNA, 16 bp, Homo sapiens
agagggcccaggcagg

SEQ ID NO: 6628904 - DNA, 18 bp, Homo sapiens
agagggcccatcaggcag

SEQ ID NO: 6628905 - DNA, 19 bp, Homo sapiens
agagggcccatcaggcagt

SEQ ID NO: 6628906 - DNA, 13 bp, Homo sapiens
agagggccctggt

SEQ ID NO: 6628907 - DNA, 18 bp, Homo sapiens
agagggccgggcagaggg

SEQ ID NO: 6628908 - DNA, 21 bp, Homo sapiens
agagggccttgcttctcttct

SEQ ID NO: 6628909 - DNA, 18 bp, Homo sapiens
agagggcgcccagcccag

SEQ ID NO: 6628910 - DNA, 22 bp, Homo sapiens
agagggcgcccagcccaggcct

SEQ ID NO: 6628911 - DNA, 15 bp, Homo sapiens
agagggcgctcctgt

SEQ ID NO: 6628912 - DNA, 20 bp, Homo sapiens
agagggctcgaggggtgggc

SEQ ID NO: 6628913 - DNA, 21 bp, Homo sapiens
agagggctctgatctaacaaa

SEQ ID NO: 6628914 - DNA, 12 bp, Homo sapiens
agagggctgagc

SEQ ID NO: 6628915 - DNA, 13 bp, Homo sapiens
agagggctgagcc

SEQ ID NO: 6628916 - DNA, 22 bp, Homo sapiens
agagggctgagccatgggggtt

SEQ ID NO: 6628917 - DNA, 18 bp, Homo sapiens
agagggctgagcccctcc

SEQ ID NO: 6628918 - DNA, 10 bp, Homo sapiens
agagggctgc

SEQ ID NO: 6628919 - DNA, 20 bp, Homo sapiens
agagggctgcgagcatttcc

SEQ ID NO: 6628920 - DNA, 20 bp, Homo sapiens
agagggctgtggctgggtgg

SEQ ID NO: 6628921 - DNA, 22 bp, Homo sapiens
agagggctttttaaatttggtg

SEQ ID NO: 6628922 - DNA, 18 bp, Homo sapiens
agaggggaaaagagatga

SEQ ID NO: 6628923 - DNA, 22 bp, Homo sapiens
agaggggaacagactggaagca

SEQ ID NO: 6628924 - DNA, 12 bp, Homo sapiens
agaggggaagaa

SEQ ID NO: 6628925 - DNA, 12 bp, Homo sapiens
agaggggaagga

SEQ ID NO: 6628926 - DNA, 15 bp, Homo sapiens
agaggggaaggaaat

SEQ ID NO: 6628927 - DNA, 19 bp, Homo sapiens
agaggggaataatagaaga

SEQ ID NO: 6628928 - DNA, 20 bp, Homo sapiens
agaggggacaaaacccacct

SEQ ID NO: 6628929 - DNA, 17 bp, Homo sapiens
agaggggacatttccct

SEQ ID NO: 6628930 - DNA, 20 bp, Homo sapiens
agaggggacgcaggcccctc

SEQ ID NO: 6628931 - DNA, 15 bp, Homo sapiens
agaggggactctggg

SEQ ID NO: 6628932 - DNA, 22 bp, Homo sapiens
agaggggacttggataggagct

SEQ ID NO: 6628933 - DNA, 12 bp, Homo sapiens
agaggggagagg

SEQ ID NO: 6628934 - DNA, 15 bp, Homo sapiens
agaggggagaggaag

SEQ ID NO: 6628935 - DNA, 13 bp, Homo sapiens
agaggggaggcca

SEQ ID NO: 6628936 - DNA, 15 bp, Homo sapiens
agaggggaggccaag

SEQ ID NO: 6628937 - DNA, 14 bp, Homo sapiens
agaggggaggggcc

SEQ ID NO: 6628938 - DNA, 23 bp, Homo sapiens
agaggggatggggatagaggaaa

SEQ ID NO: 6628939 - DNA, 14 bp, Homo sapiens
agaggggcaaaaat

SEQ ID NO: 6628940 - DNA, 22 bp, Homo sapiens
agaggggcaaatagagagtctc

SEQ ID NO: 6628941 - DNA, 13 bp, Homo sapiens
agaggggcagccc

SEQ ID NO: 6628942 - DNA, 16 bp, Homo sapiens
agaggggcagcccttg

SEQ ID NO: 6628943 - DNA, 15 bp, Homo sapiens
agaggggcagccgct

SEQ ID NO: 6628944 - DNA, 13 bp, Homo sapiens
agaggggccgctg

SEQ ID NO: 6628945 - DNA, 15 bp, Homo sapiens
agaggggcctgcagg

SEQ ID NO: 6628946 - DNA, 20 bp, Homo sapiens
agaggggcctgccacctgga

SEQ ID NO: 6628947 - DNA, 13 bp, Homo sapiens
agaggggcctggg

SEQ ID NO: 6628948 - DNA, 17 bp, Homo sapiens
agaggggcctgggaaag

SEQ ID NO: 6628949 - DNA, 14 bp, Homo sapiens
agaggggcgctgcc

SEQ ID NO: 6628950 - DNA, 18 bp, Homo sapiens
agaggggcgggctcagag

SEQ ID NO: 6628951 - DNA, 17 bp, Homo sapiens
agaggggcggggccagg

SEQ ID NO: 6628952 - DNA, 21 bp, Homo sapiens
agaggggcgttctcccaaaga

SEQ ID NO: 6628953 - DNA, 17 bp, Homo sapiens
agaggggctggacctgg

SEQ ID NO: 6628954 - DNA, 16 bp, Homo sapiens
agagggggactgctgc

SEQ ID NO: 6628955 - DNA, 12 bp, Homo sapiens
agagggggaggt

SEQ ID NO: 6628956 - DNA, 23 bp, Homo sapiens
agagggggatgcccctggccctg

SEQ ID NO: 6628957 - DNA, 12 bp, Homo sapiens
agagggggccac

SEQ ID NO: 6628958 - DNA, 22 bp, Homo sapiens
agagggggcctgggacttccat

SEQ ID NO: 6628959 - DNA, 14 bp, Homo sapiens
agagggggctggtg

SEQ ID NO: 6628960 - DNA, 19 bp, Homo sapiens
agaggggtcacacccaccc

SEQ ID NO: 6628961 - DNA, 16 bp, Homo sapiens
agaggggtgcacccac

SEQ ID NO: 6628962 - DNA, 16 bp, Homo sapiens
agaggggtggagactg

SEQ ID NO: 6628963 - DNA, 21 bp, Homo sapiens
agagggtaataaccagacaca

SEQ ID NO: 6628964 - DNA, 17 bp, Homo sapiens
agagggtcccagggctg

SEQ ID NO: 6628965 - DNA, 18 bp, Homo sapiens
agagggtcccagggctgc

SEQ ID NO: 6628966 - DNA, 19 bp, Homo sapiens
agagggtcccagggctgca

SEQ ID NO: 6628967 - DNA, 14 bp, Homo sapiens
agagggtctccagt

SEQ ID NO: 6628968 - DNA, 23 bp, Homo sapiens
agagggtctcgctgtcactggct

SEQ ID NO: 6628969 - DNA, 18 bp, Homo sapiens
agagggtctgggggcaca

SEQ ID NO: 6628970 - DNA, 14 bp, Homo sapiens
agagggtgaaaggc

SEQ ID NO: 6628971 - DNA, 14 bp, Homo sapiens
agagggtgaaggag

SEQ ID NO: 6628972 - DNA, 14 bp, Homo sapiens
agagggtgagggcc

SEQ ID NO: 6628973 - DNA, 19 bp, Homo sapiens
agagggtgagggccttctt

SEQ ID NO: 6628974 - DNA, 19 bp, Homo sapiens
agagggtgagtcctccaga

SEQ ID NO: 6628975 - DNA, 20 bp, Homo sapiens
agagggtgagtcctccagaa

SEQ ID NO: 6628976 - DNA, 15 bp, Homo sapiens
agagggtgcagtcca

SEQ ID NO: 6628977 - DNA, 14 bp, Homo sapiens
agagggtggcatca

SEQ ID NO: 6628978 - DNA, 22 bp, Homo sapiens
agagggtgggagcctaaggaag

SEQ ID NO: 6628979 - DNA, 21 bp, Homo sapiens
agagggttcacacagcccagt

SEQ ID NO: 6628980 - DNA, 17 bp, Homo sapiens
agagggttgctgccttt

SEQ ID NO: 6628981 - DNA, 12 bp, Homo sapiens
agaggtaaaaaa

SEQ ID NO: 6628982 - DNA, 15 bp, Homo sapiens
agaggtaaaaaaaag

SEQ ID NO: 6628983 - DNA, 17 bp, Homo sapiens
agaggtaacagaacagc

SEQ ID NO: 6628984 - DNA, 20 bp, Homo sapiens
agaggtaacagaacagcttc

SEQ ID NO: 6628985 - DNA, 18 bp, Homo sapiens
agaggtaatttttcacct

SEQ ID NO: 6628986 - DNA, 17 bp, Homo sapiens
agaggtacacttgtgaa

SEQ ID NO: 6628987 - DNA, 13 bp, Homo sapiens
agaggtagcactc

SEQ ID NO: 6628988 - DNA, 17 bp, Homo sapiens
agaggtagcactctcag

SEQ ID NO: 6628989 - DNA, 18 bp, Homo sapiens
agaggtagccgggctctg

SEQ ID NO: 6628990 - DNA, 20 bp, Homo sapiens
agaggtagcgagctgctctg

SEQ ID NO: 6628991 - DNA, 16 bp, Homo sapiens
agaggtagggctgcca

SEQ ID NO: 6628992 - DNA, 19 bp, Homo sapiens
agaggtatcctctttttgc

SEQ ID NO: 6628993 - DNA, 14 bp, Homo sapiens
agaggtatgtgccc

SEQ ID NO: 6628994 - DNA, 19 bp, Homo sapiens
agaggtatgtgcccctcct

SEQ ID NO: 6628995 - DNA, 16 bp, Homo sapiens
agaggtattaaaacta

SEQ ID NO: 6628996 - DNA, 17 bp, Homo sapiens
agaggtattaaaactaa

SEQ ID NO: 6628997 - DNA, 19 bp, Homo sapiens
agaggtattggattttcac

SEQ ID NO: 6628998 - DNA, 16 bp, Homo sapiens
agaggtcaccagctgc

SEQ ID NO: 6628999 - DNA, 23 bp, Homo sapiens
agaggtcagaggggactctgacc

SEQ ID NO: 6629000 - DNA, 22 bp, Homo sapiens
agaggtcaggacggctcctcag

SEQ ID NO: 6629001 - DNA, 12 bp, Homo sapiens
agaggtccagcc

SEQ ID NO: 6629002 - DNA, 13 bp, Homo sapiens
agaggtccagccc

SEQ ID NO: 6629003 - DNA, 22 bp, Homo sapiens
agaggtccagccccccaggctg

SEQ ID NO: 6629004 - DNA, 23 bp, Homo sapiens
agaggtccaggtcccagcccctc

SEQ ID NO: 6629005 - DNA, 13 bp, Homo sapiens
agaggtccctgct

SEQ ID NO: 6629006 - DNA, 22 bp, Homo sapiens
agaggtccctgcttacctgacg

SEQ ID NO: 6629007 - DNA, 18 bp, Homo sapiens
agaggtctcatctcccag

SEQ ID NO: 6629008 - DNA, 19 bp, Homo sapiens
agaggtctcatctcccagg

SEQ ID NO: 6629009 - DNA, 22 bp, Homo sapiens
agaggtctccatcatggcagtg

SEQ ID NO: 6629010 - DNA, 13 bp, Homo sapiens
agaggtctcccca

SEQ ID NO: 6629011 - DNA, 16 bp, Homo sapiens
agaggtctccccatcc

SEQ ID NO: 6629012 - DNA, 14 bp, Homo sapiens
agaggtctccctat

SEQ ID NO: 6629013 - DNA, 13 bp, Homo sapiens
agaggtctgagcc

SEQ ID NO: 6629014 - DNA, 16 bp, Homo sapiens
agaggtctgagccctg

SEQ ID NO: 6629015 - DNA, 14 bp, Homo sapiens
agaggtctgtgctg

SEQ ID NO: 6629016 - DNA, 19 bp, Homo sapiens
agaggtctgtgctgaggcc

SEQ ID NO: 6629017 - DNA, 19 bp, Homo sapiens
agaggtcttttttaaaagg

SEQ ID NO: 6629018 - DNA, 21 bp, Homo sapiens
agaggtgaaaatgaagaagga

SEQ ID NO: 6629019 - DNA, 24 bp, Homo sapiens
agaggtgaccccagggcacaggag

SEQ ID NO: 6629020 - DNA, 18 bp, Homo sapiens
agaggtgagaaaactcaa

SEQ ID NO: 6629021 - DNA, 22 bp, Homo sapiens
agaggtgagaccaaaggatcca

SEQ ID NO: 6629022 - DNA, 13 bp, Homo sapiens
agaggtgagcaga

SEQ ID NO: 6629023 - DNA, 18 bp, Homo sapiens
agaggtgagggaggcctg

SEQ ID NO: 6629024 - DNA, 19 bp, Homo sapiens
agaggtgagggaggcctga

SEQ ID NO: 6629025 - DNA, 20 bp, Homo sapiens
agaggtgccagcaactgaat

SEQ ID NO: 6629026 - DNA, 12 bp, Homo sapiens
agaggtgcctgg

SEQ ID NO: 6629027 - DNA, 20 bp, Homo sapiens
agaggtgcctgggaggagtg

SEQ ID NO: 6629028 - DNA, 23 bp, Homo sapiens
agaggtgctgctttgcttcttca

SEQ ID NO: 6629029 - DNA, 15 bp, Homo sapiens
agaggtggaaaaaca

SEQ ID NO: 6629030 - DNA, 19 bp, Homo sapiens
agaggtggaggttgcagtg

SEQ ID NO: 6629031 - DNA, 14 bp, Homo sapiens
agaggtggatgtta

SEQ ID NO: 6629032 - DNA, 10 bp, Homo sapiens
agaggtggcc

SEQ ID NO: 6629033 - DNA, 14 bp, Homo sapiens
agaggtggcccttg

SEQ ID NO: 6629034 - DNA, 20 bp, Homo sapiens
agaggtgggaggcccctggt

SEQ ID NO: 6629035 - DNA, 15 bp, Homo sapiens
agaggtgggcagctg

SEQ ID NO: 6629036 - DNA, 14 bp, Homo sapiens
agaggtgggcaggt

SEQ ID NO: 6629037 - DNA, 17 bp, Homo sapiens
agaggtgggcaggtggt

SEQ ID NO: 6629038 - DNA, 19 bp, Homo sapiens
agaggtgggcaggtggtgg

SEQ ID NO: 6629039 - DNA, 18 bp, Homo sapiens
agaggtggggaagagagc

SEQ ID NO: 6629040 - DNA, 13 bp, Homo sapiens
agaggtggggacc

SEQ ID NO: 6629041 - DNA, 13 bp, Homo sapiens
agaggtggggagg

SEQ ID NO: 6629042 - DNA, 19 bp, Homo sapiens
agaggtggggtgaagctgg

SEQ ID NO: 6629043 - DNA, 22 bp, Homo sapiens
agaggtggggtgaagctgggga

SEQ ID NO: 6629044 - DNA, 23 bp, Homo sapiens
agaggtggggtgaagctggggac

SEQ ID NO: 6629045 - DNA, 20 bp, Homo sapiens
agaggtggggtgctggggct

SEQ ID NO: 6629046 - DNA, 21 bp, Homo sapiens
agaggtggggtgctggggctg

SEQ ID NO: 6629047 - DNA, 20 bp, Homo sapiens
agaggtgggtggtgggcttc

SEQ ID NO: 6629048 - DNA, 21 bp, Homo sapiens
agaggtgggtggtgggcttct

SEQ ID NO: 6629049 - DNA, 21 bp, Homo sapiens
agaggtgtacactaacatttc

SEQ ID NO: 6629050 - DNA, 23 bp, Homo sapiens
agaggtgtgcaagagagggatgc

SEQ ID NO: 6629051 - DNA, 16 bp, Homo sapiens
agaggtgttatttgga

SEQ ID NO: 6629052 - DNA, 16 bp, Homo sapiens
agaggttagaaatact

SEQ ID NO: 6629053 - DNA, 19 bp, Homo sapiens
agaggttagaaatactttt

SEQ ID NO: 6629054 - DNA, 16 bp, Homo sapiens
agaggttatctgcctg

SEQ ID NO: 6629055 - DNA, 13 bp, Homo sapiens
agaggttcaaaga

SEQ ID NO: 6629056 - DNA, 19 bp, Homo sapiens
agaggttctaaaatcatga

SEQ ID NO: 6629057 - DNA, 14 bp, Homo sapiens
agaggttctaactt

SEQ ID NO: 6629058 - DNA, 16 bp, Homo sapiens
agaggttctaacttct

SEQ ID NO: 6629059 - DNA, 13 bp, Homo sapiens
agaggttctcagc

SEQ ID NO: 6629060 - DNA, 15 bp, Homo sapiens
agaggttctcagcaa

SEQ ID NO: 6629061 - DNA, 19 bp, Homo sapiens
agaggttctgattttcttg

SEQ ID NO: 6629062 - DNA, 13 bp, Homo sapiens
agaggttctgcac

SEQ ID NO: 6629063 - DNA, 18 bp, Homo sapiens
agaggttctgcactcctg

SEQ ID NO: 6629064 - DNA, 13 bp, Homo sapiens
agaggttctgcct

SEQ ID NO: 6629065 - DNA, 14 bp, Homo sapiens
agaggttctgcctc

SEQ ID NO: 6629066 - DNA, 21 bp, Homo sapiens
agaggttgcagtgagccgaga

SEQ ID NO: 6629067 - DNA, 21 bp, Homo sapiens
agaggttgtagtgagccaaga

SEQ ID NO: 6629068 - DNA, 19 bp, Homo sapiens
agaggttgtggtgagccga

SEQ ID NO: 6629069 - DNA, 14 bp, Homo sapiens
agaggtttaaagaa

SEQ ID NO: 6629070 - DNA, 14 bp, Homo sapiens
agaggtttaaatgt

SEQ ID NO: 6629071 - DNA, 15 bp, Homo sapiens
agaggtttaaatgta

SEQ ID NO: 6629072 - DNA, 18 bp, Homo sapiens
agaggtttcagcattccc

SEQ ID NO: 6629073 - DNA, 15 bp, Homo sapiens
agaggtttcttgaat

SEQ ID NO: 6629074 - DNA, 18 bp, Homo sapiens
agaggtttgaaggagaat

SEQ ID NO: 6629075 - DNA, 15 bp, Homo sapiens
agaggtttgcagtcc

SEQ ID NO: 6629076 - DNA, 20 bp, Homo sapiens
agaggtttgcagtcccaagc

SEQ ID NO: 6629077 - DNA, 22 bp, Homo sapiens
agaggtttggagccgggaaagc

SEQ ID NO: 6629078 - DNA, 17 bp, Homo sapiens
agaggtttgtcaacaaa

SEQ ID NO: 6629079 - DNA, 23 bp, Homo sapiens
agaggtttgtcaacaaaaagaca

SEQ ID NO: 6629080 - DNA, 17 bp, Homo sapiens
agaggttttaatgtctg

SEQ ID NO: 6629081 - DNA, 18 bp, Homo sapiens
agaggttttaatgtctgt

SEQ ID NO: 6629082 - DNA, 17 bp, Homo sapiens
agaggttttatgatatt

SEQ ID NO: 6629083 - DNA, 13 bp, Homo sapiens
agaggttttgtat

SEQ ID NO: 6629084 - DNA, 12 bp, Homo sapiens
agaggttttgtt

SEQ ID NO: 6629085 - DNA, 16 bp, Homo sapiens
agaggttttgttgttt

SEQ ID NO: 6629086 - DNA, 19 bp, Homo sapiens
agaggtttttctccccgct

SEQ ID NO: 6629087 - DNA, 20 bp, Homo sapiens
agaggtttttcttgggaaag

SEQ ID NO: 6629088 - DNA, 16 bp, Homo sapiens
agagtaaaaccaaagg

SEQ ID NO: 6629089 - DNA, 13 bp, Homo sapiens
agagtaaagcaac

SEQ ID NO: 6629090 - DNA, 22 bp, Homo sapiens
agagtaaataaactgtttatat

SEQ ID NO: 6629091 - DNA, 16 bp, Homo sapiens
agagtaaatatacttg

SEQ ID NO: 6629092 - DNA, 17 bp, Homo sapiens
agagtaaattgctctgt

SEQ ID NO: 6629093 - DNA, 19 bp, Homo sapiens
agagtaacatgccagcttc

SEQ ID NO: 6629094 - DNA, 19 bp, Homo sapiens
agagtaacgagaagtgctt

SEQ ID NO: 6629095 - DNA, 16 bp, Homo sapiens
agagtaactttactct

SEQ ID NO: 6629096 - DNA, 23 bp, Homo sapiens
agagtaactttactctgtgttta

SEQ ID NO: 6629097 - DNA, 20 bp, Homo sapiens
agagtaagaaatttcaggtt

SEQ ID NO: 6629098 - DNA, 21 bp, Homo sapiens
agagtaagcacctttagaata

SEQ ID NO: 6629099 - DNA, 14 bp, Homo sapiens
agagtaagcagtgt

SEQ ID NO: 6629100 - DNA, 19 bp, Homo sapiens
agagtaagcagtgttactt

SEQ ID NO: 6629101 - DNA, 18 bp, Homo sapiens
agagtaatccaagcaaat

SEQ ID NO: 6629102 - DNA, 20 bp, Homo sapiens
agagtaatccaagcaaatgt

SEQ ID NO: 6629103 - DNA, 17 bp, Homo sapiens
agagtaatgggtttcat

SEQ ID NO: 6629104 - DNA, 18 bp, Homo sapiens
agagtaatgggtttcata

SEQ ID NO: 6629105 - DNA, 15 bp, Homo sapiens
agagtaattatagga

SEQ ID NO: 6629106 - DNA, 22 bp, Homo sapiens
agagtaattataggaagttctt

SEQ ID NO: 6629107 - DNA, 20 bp, Homo sapiens
agagtaattcatctgtgaat

SEQ ID NO: 6629108 - DNA, 14 bp, Homo sapiens
agagtaatttggga

SEQ ID NO: 6629109 - DNA, 20 bp, Homo sapiens
agagtacaagctcttgtttc

SEQ ID NO: 6629110 - DNA, 19 bp, Homo sapiens
agagtacactcagccactg

SEQ ID NO: 6629111 - DNA, 19 bp, Homo sapiens
agagtacactgcctgcctt

SEQ ID NO: 6629112 - DNA, 15 bp, Homo sapiens
agagtacactgtgtc

SEQ ID NO: 6629113 - DNA, 16 bp, Homo sapiens
agagtacactgtgtct

SEQ ID NO: 6629114 - DNA, 19 bp, Homo sapiens
agagtacactgtgtctcta

SEQ ID NO: 6629115 - DNA, 17 bp, Homo sapiens
agagtacagactgcaga

SEQ ID NO: 6629116 - DNA, 16 bp, Homo sapiens
agagtacagtgagcca

SEQ ID NO: 6629117 - DNA, 14 bp, Homo sapiens
agagtaccatgctg

SEQ ID NO: 6629118 - DNA, 16 bp, Homo sapiens
agagtacccccctgag

SEQ ID NO: 6629119 - DNA, 22 bp, Homo sapiens
agagtacccccctgagagcatg

SEQ ID NO: 6629120 - DNA, 17 bp, Homo sapiens
agagtacctgtgtgttt

SEQ ID NO: 6629121 - DNA, 19 bp, Homo sapiens
agagtacgtcctgcctggc

SEQ ID NO: 6629122 - DNA, 21 bp, Homo sapiens
agagtacgtcctgcctggcac

SEQ ID NO: 6629123 - DNA, 23 bp, Homo sapiens
agagtacgtcctgcctggcactt

SEQ ID NO: 6629124 - DNA, 17 bp, Homo sapiens
agagtacgtgaaatgct

SEQ ID NO: 6629125 - DNA, 17 bp, Homo sapiens
agagtactattaataga

SEQ ID NO: 6629126 - DNA, 16 bp, Homo sapiens
agagtacttaatatac

SEQ ID NO: 6629127 - DNA, 12 bp, Homo sapiens
agagtactttgg

SEQ ID NO: 6629128 - DNA, 16 bp, Homo sapiens
agagtagaattgcatt

SEQ ID NO: 6629129 - DNA, 20 bp, Homo sapiens
agagtagacctgagatgctg

SEQ ID NO: 6629130 - DNA, 21 bp, Homo sapiens
agagtagatggtgaaatttat

SEQ ID NO: 6629131 - DNA, 22 bp, Homo sapiens
agagtagcaagttctagagaag

SEQ ID NO: 6629132 - DNA, 13 bp, Homo sapiens
agagtagccgaga

SEQ ID NO: 6629133 - DNA, 18 bp, Homo sapiens
agagtagccgagagcctg

SEQ ID NO: 6629134 - DNA, 23 bp, Homo sapiens
agagtagccgagagcctgctccc

SEQ ID NO: 6629135 - DNA, 22 bp, Homo sapiens
agagtagctgcagccttcatca

SEQ ID NO: 6629136 - DNA, 16 bp, Homo sapiens
agagtagggccctgac

SEQ ID NO: 6629137 - DNA, 22 bp, Homo sapiens
agagtagggccctgacaggcct

SEQ ID NO: 6629138 - DNA, 21 bp, Homo sapiens
agagtagggttgccagtcctg

SEQ ID NO: 6629139 - DNA, 13 bp, Homo sapiens
agagtatatgcac

SEQ ID NO: 6629140 - DNA, 18 bp, Homo sapiens
agagtatattatgtattt

SEQ ID NO: 6629141 - DNA, 24 bp, Homo sapiens
agagtatatttttgtctgcagctg

SEQ ID NO: 6629142 - DNA, 17 bp, Homo sapiens
agagtatccttccttca

SEQ ID NO: 6629143 - DNA, 21 bp, Homo sapiens
agagtatccttccttcagggt

SEQ ID NO: 6629144 - DNA, 14 bp, Homo sapiens
agagtatgaacacc

SEQ ID NO: 6629145 - DNA, 17 bp, Homo sapiens
agagtatgcaagaagaa

SEQ ID NO: 6629146 - DNA, 18 bp, Homo sapiens
agagtatgcaagaagaat

SEQ ID NO: 6629147 - DNA, 20 bp, Homo sapiens
agagtatgcaagaagaatat

SEQ ID NO: 6629148 - DNA, 21 bp, Homo sapiens
agagtatgcaagaagaatata

SEQ ID NO: 6629149 - DNA, 15 bp, Homo sapiens
agagtatggattgaa

SEQ ID NO: 6629150 - DNA, 20 bp, Homo sapiens
agagtatgtggcaaaacata

SEQ ID NO: 6629151 - DNA, 14 bp, Homo sapiens
agagtatgtgtatg

SEQ ID NO: 6629152 - DNA, 22 bp, Homo sapiens
agagtattcagtgatatgtaaa

SEQ ID NO: 6629153 - DNA, 20 bp, Homo sapiens
agagtattctaaaaaaataa

SEQ ID NO: 6629154 - DNA, 16 bp, Homo sapiens
agagtattgagatact

SEQ ID NO: 6629155 - DNA, 23 bp, Homo sapiens
agagtattggtctcctctcagcc

SEQ ID NO: 6629156 - DNA, 14 bp, Homo sapiens
agagtatttccctt

SEQ ID NO: 6629157 - DNA, 19 bp, Homo sapiens
agagtatttggaaaaagaa

SEQ ID NO: 6629158 - DNA, 21 bp, Homo sapiens
agagtatttggaaaaagaaaa

SEQ ID NO: 6629159 - DNA, 15 bp, Homo sapiens
agagtatttttaaca

SEQ ID NO: 6629160 - DNA, 16 bp, Homo sapiens
agagtatttttaacac

SEQ ID NO: 6629161 - DNA, 17 bp, Homo sapiens
agagtatttttgtattc

SEQ ID NO: 6629162 - DNA, 23 bp, Homo sapiens
agagtcaacaaattaaataaatt

SEQ ID NO: 6629163 - DNA, 22 bp, Homo sapiens
agagtcaactacacaaagcagg

SEQ ID NO: 6629164 - DNA, 14 bp, Homo sapiens
agagtcacaagcct

SEQ ID NO: 6629165 - DNA, 20 bp, Homo sapiens
agagtcacacgggggcagct

SEQ ID NO: 6629166 - DNA, 18 bp, Homo sapiens
agagtcacccccccaggc

SEQ ID NO: 6629167 - DNA, 22 bp, Homo sapiens
agagtcacccccccaggcctcc

SEQ ID NO: 6629168 - DNA, 16 bp, Homo sapiens
agagtcaccttttctg

SEQ ID NO: 6629169 - DNA, 15 bp, Homo sapiens
agagtcactggaaca

SEQ ID NO: 6629170 - DNA, 22 bp, Homo sapiens
agagtcagaagtttctgccgca

SEQ ID NO: 6629171 - DNA, 12 bp, Homo sapiens
agagtcagacat

SEQ ID NO: 6629172 - DNA, 18 bp, Homo sapiens
agagtcagagatcttggt

SEQ ID NO: 6629173 - DNA, 16 bp, Homo sapiens
agagtcagcagaactg

SEQ ID NO: 6629174 - DNA, 18 bp, Homo sapiens
agagtcagccaggaccat

SEQ ID NO: 6629175 - DNA, 13 bp, Homo sapiens
agagtcagccctt

SEQ ID NO: 6629176 - DNA, 20 bp, Homo sapiens
agagtcagctctctgccctg

SEQ ID NO: 6629177 - DNA, 12 bp, Homo sapiens
agagtcaggaag

SEQ ID NO: 6629178 - DNA, 19 bp, Homo sapiens
agagtcaggagaaacccct

SEQ ID NO: 6629179 - DNA, 13 bp, Homo sapiens
agagtcatctcca

SEQ ID NO: 6629180 - DNA, 12 bp, Homo sapiens
agagtcatgagt

SEQ ID NO: 6629181 - DNA, 17 bp, Homo sapiens
agagtcatgtgagcctc

SEQ ID NO: 6629182 - DNA, 22 bp, Homo sapiens
agagtcatgtgagcctcgtgtc

SEQ ID NO: 6629183 - DNA, 23 bp, Homo sapiens
agagtcatgtgagcctcgtgtca

SEQ ID NO: 6629184 - DNA, 14 bp, Homo sapiens
agagtcattcatat

SEQ ID NO: 6629185 - DNA, 16 bp, Homo sapiens
agagtcattgtaatgt

SEQ ID NO: 6629186 - DNA, 20 bp, Homo sapiens
agagtcatttatgagcagaa

SEQ ID NO: 6629187 - DNA, 21 bp, Homo sapiens
agagtccaaggtttaaagagt

SEQ ID NO: 6629188 - DNA, 13 bp, Homo sapiens
agagtccaggcct

SEQ ID NO: 6629189 - DNA, 15 bp, Homo sapiens
agagtccaggcctgg

SEQ ID NO: 6629190 - DNA, 13 bp, Homo sapiens
agagtccagtcaa

SEQ ID NO: 6629191 - DNA, 17 bp, Homo sapiens
agagtccagtgctctgc

SEQ ID NO: 6629192 - DNA, 20 bp, Homo sapiens
agagtccagtgctctgcctc

SEQ ID NO: 6629193 - DNA, 14 bp, Homo sapiens
agagtccatgtgga

SEQ ID NO: 6629194 - DNA, 17 bp, Homo sapiens
agagtccatttcccaca

SEQ ID NO: 6629195 - DNA, 21 bp, Homo sapiens
agagtccatttcccacatctt

SEQ ID NO: 6629196 - DNA, 23 bp, Homo sapiens
agagtccatttcccacatctttc

SEQ ID NO: 6629197 - DNA, 21 bp, Homo sapiens
agagtcccactgcctcaggtt

SEQ ID NO: 6629198 - DNA, 22 bp, Homo sapiens
agagtcccaggaccttgagtgt

SEQ ID NO: 6629199 - DNA, 22 bp, Homo sapiens
agagtccccagactctgcctag

SEQ ID NO: 6629200 - DNA, 15 bp, Homo sapiens
agagtccccccactc

SEQ ID NO: 6629201 - DNA, 18 bp, Homo sapiens
agagtccccccactccca

SEQ ID NO: 6629202 - DNA, 16 bp, Homo sapiens
agagtccggatttcta

SEQ ID NO: 6629203 - DNA, 22 bp, Homo sapiens
agagtccgtactcggcttcctg

SEQ ID NO: 6629204 - DNA, 12 bp, Homo sapiens
agagtcctctga

SEQ ID NO: 6629205 - DNA, 12 bp, Homo sapiens
agagtcctgcct

SEQ ID NO: 6629206 - DNA, 17 bp, Homo sapiens
agagtcctgtgctgaat

SEQ ID NO: 6629207 - DNA, 22 bp, Homo sapiens
agagtccttaagacggaagtaa

SEQ ID NO: 6629208 - DNA, 18 bp, Homo sapiens
agagtccttagcctgggc

SEQ ID NO: 6629209 - DNA, 21 bp, Homo sapiens
agagtccttattcttctcata

SEQ ID NO: 6629210 - DNA, 21 bp, Homo sapiens
agagtccttgcaaaattgtct

SEQ ID NO: 6629211 - DNA, 21 bp, Homo sapiens
agagtccttttagcacatcac

SEQ ID NO: 6629212 - DNA, 22 bp, Homo sapiens
agagtcgagtgatatggcttgt

SEQ ID NO: 6629213 - DNA, 22 bp, Homo sapiens
agagtcggaacggagaaaggtg

SEQ ID NO: 6629214 - DNA, 15 bp, Homo sapiens
agagtcggtctgctt

SEQ ID NO: 6629215 - DNA, 22 bp, Homo sapiens
agagtctaaagatggagtttct

SEQ ID NO: 6629216 - DNA, 11 bp, Homo sapiens
agagtctagat

SEQ ID NO: 6629217 - DNA, 12 bp, Homo sapiens
agagtctagatt

SEQ ID NO: 6629218 - DNA, 15 bp, Homo sapiens
agagtctagattcaa

SEQ ID NO: 6629219 - DNA, 19 bp, Homo sapiens
agagtctagattcaaaggt

SEQ ID NO: 6629220 - DNA, 20 bp, Homo sapiens
agagtctcactgttgcccag

SEQ ID NO: 6629221 - DNA, 21 bp, Homo sapiens
agagtctcccagtgggtgatg

SEQ ID NO: 6629222 - DNA, 15 bp, Homo sapiens
agagtctccttctct

SEQ ID NO: 6629223 - DNA, 18 bp, Homo sapiens
agagtctccttctcttct

SEQ ID NO: 6629224 - DNA, 15 bp, Homo sapiens
agagtctctccagcc

SEQ ID NO: 6629225 - DNA, 17 bp, Homo sapiens
agagtctctcttcactt

SEQ ID NO: 6629226 - DNA, 13 bp, Homo sapiens
agagtctctgata

SEQ ID NO: 6629227 - DNA, 12 bp, Homo sapiens
agagtctctggc

SEQ ID NO: 6629228 - DNA, 18 bp, Homo sapiens
agagtctgaaagacagaa

SEQ ID NO: 6629229 - DNA, 13 bp, Homo sapiens
agagtctgaacag

SEQ ID NO: 6629230 - DNA, 16 bp, Homo sapiens
agagtctgaacctatt

SEQ ID NO: 6629231 - DNA, 17 bp, Homo sapiens
agagtctgacaggaaga

SEQ ID NO: 6629232 - DNA, 14 bp, Homo sapiens
agagtctgagggct

SEQ ID NO: 6629233 - DNA, 21 bp, Homo sapiens
agagtctgagggcttgtagtt

SEQ ID NO: 6629234 - DNA, 12 bp, Homo sapiens
agagtctggagc

SEQ ID NO: 6629235 - DNA, 23 bp, Homo sapiens
agagtctggagctgagctacctg

SEQ ID NO: 6629236 - DNA, 18 bp, Homo sapiens
agagtctggcctgccagg

SEQ ID NO: 6629237 - DNA, 22 bp, Homo sapiens
agagtctggcctgccaggctcc

SEQ ID NO: 6629238 - DNA, 17 bp, Homo sapiens
agagtctgggcctctga

SEQ ID NO: 6629239 - DNA, 22 bp, Homo sapiens
agagtctgtgtgtagccaggaa

SEQ ID NO: 6629240 - DNA, 24 bp, Homo sapiens
agagtctgtgtgtagccaggaagc

SEQ ID NO: 6629241 - DNA, 20 bp, Homo sapiens
agagtcttaattttctaaaa

SEQ ID NO: 6629242 - DNA, 21 bp, Homo sapiens
agagtcttacaatcaaatctc

SEQ ID NO: 6629243 - DNA, 15 bp, Homo sapiens
agagtcttgctctgt

SEQ ID NO: 6629244 - DNA, 17 bp, Homo sapiens
agagtcttgctctgtct

SEQ ID NO: 6629245 - DNA, 16 bp, Homo sapiens
agagtgaaaattgtct

SEQ ID NO: 6629246 - DNA, 23 bp, Homo sapiens
agagtgaaaccatgactgtgacc

SEQ ID NO: 6629247 - DNA, 16 bp, Homo sapiens
agagtgaaagggctat

SEQ ID NO: 6629248 - DNA, 13 bp, Homo sapiens
agagtgaaataaa

SEQ ID NO: 6629249 - DNA, 19 bp, Homo sapiens
agagtgaaatattgtaaat

SEQ ID NO: 6629250 - DNA, 21 bp, Homo sapiens
agagtgaaatattgtaaatgc

SEQ ID NO: 6629251 - DNA, 20 bp, Homo sapiens
agagtgaagagtagaaccca

SEQ ID NO: 6629252 - DNA, 23 bp, Homo sapiens
agagtgaagcgtttttctttttc

SEQ ID NO: 6629253 - DNA, 14 bp, Homo sapiens
agagtgaagggaag

SEQ ID NO: 6629254 - DNA, 22 bp, Homo sapiens
agagtgaagggaagagacagcc

SEQ ID NO: 6629255 - DNA, 15 bp, Homo sapiens
agagtgaatacactg

SEQ ID NO: 6629256 - DNA, 19 bp, Homo sapiens
agagtgaatacactggaat

SEQ ID NO: 6629257 - DNA, 16 bp, Homo sapiens
agagtgaattccctca

SEQ ID NO: 6629258 - DNA, 23 bp, Homo sapiens
agagtgaattgaatattgtaagt

SEQ ID NO: 6629259 - DNA, 21 bp, Homo sapiens
agagtgacaggcaccagatgg

SEQ ID NO: 6629260 - DNA, 23 bp, Homo sapiens
agagtgacagtcataaatactgt

SEQ ID NO: 6629261 - DNA, 15 bp, Homo sapiens
agagtgaccctcagc

SEQ ID NO: 6629262 - DNA, 17 bp, Homo sapiens
agagtgaccctcagctg

SEQ ID NO: 6629263 - DNA, 17 bp, Homo sapiens
agagtgacctcggacag

SEQ ID NO: 6629264 - DNA, 17 bp, Homo sapiens
agagtgaccttttaatc

SEQ ID NO: 6629265 - DNA, 17 bp, Homo sapiens
agagtgacttattttgt

SEQ ID NO: 6629266 - DNA, 22 bp, Homo sapiens
agagtgacttattttgtcttat

SEQ ID NO: 6629267 - DNA, 20 bp, Homo sapiens
agagtgacttggagagagat

SEQ ID NO: 6629268 - DNA, 20 bp, Homo sapiens
agagtgagaataattgtgta

SEQ ID NO: 6629269 - DNA, 22 bp, Homo sapiens
agagtgagaataattgtgtaca

SEQ ID NO: 6629270 - DNA, 22 bp, Homo sapiens
agagtgagaatctggctcctgt

SEQ ID NO: 6629271 - DNA, 18 bp, Homo sapiens
agagtgagaccatgtttc

SEQ ID NO: 6629272 - DNA, 18 bp, Homo sapiens
agagtgagactcagtctt

SEQ ID NO: 6629273 - DNA, 20 bp, Homo sapiens
agagtgagactcgtctcaaa

SEQ ID NO: 6629274 - DNA, 15 bp, Homo sapiens
agagtgagactctgt

SEQ ID NO: 6629275 - DNA, 19 bp, Homo sapiens
agagtgagactctgtctca

SEQ ID NO: 6629276 - DNA, 13 bp, Homo sapiens
agagtgagagaca

SEQ ID NO: 6629277 - DNA, 14 bp, Homo sapiens
agagtgagagagag

SEQ ID NO: 6629278 - DNA, 17 bp, Homo sapiens
agagtgagcatgagctc

SEQ ID NO: 6629279 - DNA, 21 bp, Homo sapiens
agagtgattcaggggctcccc

SEQ ID NO: 6629280 - DNA, 23 bp, Homo sapiens
agagtgattcgggggctgaccta

SEQ ID NO: 6629281 - DNA, 20 bp, Homo sapiens
agagtgcaagaagtctggcc

SEQ ID NO: 6629282 - DNA, 13 bp, Homo sapiens
agagtgcacatgc

SEQ ID NO: 6629283 - DNA, 15 bp, Homo sapiens
agagtgcactactgt

SEQ ID NO: 6629284 - DNA, 16 bp, Homo sapiens
agagtgcactactgta

SEQ ID NO: 6629285 - DNA, 17 bp, Homo sapiens
agagtgcactgacctgt

SEQ ID NO: 6629286 - DNA, 18 bp, Homo sapiens
agagtgcattgtgagggt

SEQ ID NO: 6629287 - DNA, 17 bp, Homo sapiens
agagtgccatccctgag

SEQ ID NO: 6629288 - DNA, 12 bp, Homo sapiens
agagtgcccaga

SEQ ID NO: 6629289 - DNA, 13 bp, Homo sapiens
agagtgcccagaa

SEQ ID NO: 6629290 - DNA, 16 bp, Homo sapiens
agagtgcccagcagag

SEQ ID NO: 6629291 - DNA, 13 bp, Homo sapiens
agagtgccctggg

SEQ ID NO: 6629292 - DNA, 15 bp, Homo sapiens
agagtgccctggggc

SEQ ID NO: 6629293 - DNA, 12 bp, Homo sapiens
agagtgcctccc

SEQ ID NO: 6629294 - DNA, 17 bp, Homo sapiens
agagtgcgccgagtctg

SEQ ID NO: 6629295 - DNA, 22 bp, Homo sapiens
agagtgctcaacctacagtgga

SEQ ID NO: 6629296 - DNA, 19 bp, Homo sapiens
agagtgctctgaccctggg

SEQ ID NO: 6629297 - DNA, 14 bp, Homo sapiens
agagtgctgagaac

SEQ ID NO: 6629298 - DNA, 22 bp, Homo sapiens
agagtgctgagaaggacacctc

SEQ ID NO: 6629299 - DNA, 12 bp, Homo sapiens
agagtgctggga

SEQ ID NO: 6629300 - DNA, 17 bp, Homo sapiens
agagtggaaactcagcc

SEQ ID NO: 6629301 - DNA, 15 bp, Homo sapiens
agagtggacctgtgc

SEQ ID NO: 6629302 - DNA, 18 bp, Homo sapiens
agagtggactcttccctc

SEQ ID NO: 6629303 - DNA, 17 bp, Homo sapiens
agagtggactgcattta

SEQ ID NO: 6629304 - DNA, 15 bp, Homo sapiens
agagtggagagagca

SEQ ID NO: 6629305 - DNA, 16 bp, Homo sapiens
agagtggagagagcag

SEQ ID NO: 6629306 - DNA, 21 bp, Homo sapiens
agagtggagagagcagggcta

SEQ ID NO: 6629307 - DNA, 20 bp, Homo sapiens
agagtggagcaaatgcttaa

SEQ ID NO: 6629308 - DNA, 14 bp, Homo sapiens
agagtggagcccag

SEQ ID NO: 6629309 - DNA, 18 bp, Homo sapiens
agagtggagcccagggtg

SEQ ID NO: 6629310 - DNA, 17 bp, Homo sapiens
agagtggagccctcagt

SEQ ID NO: 6629311 - DNA, 13 bp, Homo sapiens
agagtggaggtgg

SEQ ID NO: 6629312 - DNA, 16 bp, Homo sapiens
agagtggatctggagt

SEQ ID NO: 6629313 - DNA, 22 bp, Homo sapiens
agagtggatctggagtctgaag

SEQ ID NO: 6629314 - DNA, 22 bp, Homo sapiens
agagtggccacggcccagggag

SEQ ID NO: 6629315 - DNA, 23 bp, Homo sapiens
agagtggcccagaattgcattct

SEQ ID NO: 6629316 - DNA, 14 bp, Homo sapiens
agagtggccccacc

SEQ ID NO: 6629317 - DNA, 22 bp, Homo sapiens
agagtggcctccctgctgtgcc

SEQ ID NO: 6629318 - DNA, 13 bp, Homo sapiens
agagtggcctggc

SEQ ID NO: 6629319 - DNA, 19 bp, Homo sapiens
agagtggcctggccaggag

SEQ ID NO: 6629320 - DNA, 14 bp, Homo sapiens
agagtggcctgggt

SEQ ID NO: 6629321 - DNA, 19 bp, Homo sapiens
agagtggcctgggtcccag

SEQ ID NO: 6629322 - DNA, 20 bp, Homo sapiens
agagtggcctgggtcccagg

SEQ ID NO: 6629323 - DNA, 21 bp, Homo sapiens
agagtggcctgggtcccaggg

SEQ ID NO: 6629324 - DNA, 18 bp, Homo sapiens
agagtggcgtgagctgcc

SEQ ID NO: 6629325 - DNA, 12 bp, Homo sapiens
agagtggctcac

SEQ ID NO: 6629326 - DNA, 18 bp, Homo sapiens
agagtggctcactggctg

SEQ ID NO: 6629327 - DNA, 17 bp, Homo sapiens
agagtgggccccgggct

SEQ ID NO: 6629328 - DNA, 20 bp, Homo sapiens
agagtgggccccgggctgga

SEQ ID NO: 6629329 - DNA, 20 bp, Homo sapiens
agagtgggctgcctggggat

SEQ ID NO: 6629330 - DNA, 16 bp, Homo sapiens
agagtggggcctgccc

SEQ ID NO: 6629331 - DNA, 19 bp, Homo sapiens
agagtggggtaggttggga

SEQ ID NO: 6629332 - DNA, 20 bp, Homo sapiens
agagtgggtcttggaccagg

SEQ ID NO: 6629333 - DNA, 18 bp, Homo sapiens
agagtggtaaaaaagaaa

SEQ ID NO: 6629334 - DNA, 16 bp, Homo sapiens
agagtggtcagttgaa

SEQ ID NO: 6629335 - DNA, 18 bp, Homo sapiens
agagtggtctatttctcc

SEQ ID NO: 6629336 - DNA, 18 bp, Homo sapiens
agagtggtctttctggag

SEQ ID NO: 6629337 - DNA, 16 bp, Homo sapiens
agagtggtggcagctc

SEQ ID NO: 6629338 - DNA, 23 bp, Homo sapiens
agagtggtggcctatttcagctg

SEQ ID NO: 6629339 - DNA, 13 bp, Homo sapiens
agagtggtggggg

SEQ ID NO: 6629340 - DNA, 21 bp, Homo sapiens
agagtggtgggggaaggctgt

SEQ ID NO: 6629341 - DNA, 15 bp, Homo sapiens
agagtggttattcat

SEQ ID NO: 6629342 - DNA, 22 bp, Homo sapiens
agagtggtttcattgccttcct

SEQ ID NO: 6629343 - DNA, 12 bp, Homo sapiens
agagtgtaacat

SEQ ID NO: 6629344 - DNA, 16 bp, Homo sapiens
agagtgtacatcatgt

SEQ ID NO: 6629345 - DNA, 12 bp, Homo sapiens
agagtgtagaag

SEQ ID NO: 6629346 - DNA, 13 bp, Homo sapiens
agagtgtagaagc

SEQ ID NO: 6629347 - DNA, 17 bp, Homo sapiens
agagtgtagaagcattc

SEQ ID NO: 6629348 - DNA, 13 bp, Homo sapiens
agagtgtagccta

SEQ ID NO: 6629349 - DNA, 21 bp, Homo sapiens
agagtgtagcctaaagggcag

SEQ ID NO: 6629350 - DNA, 12 bp, Homo sapiens
agagtgtagctg

SEQ ID NO: 6629351 - DNA, 20 bp, Homo sapiens
agagtgtagggggccttgcg

SEQ ID NO: 6629352 - DNA, 19 bp, Homo sapiens
agagtgtaggtgaaatgaa

SEQ ID NO: 6629353 - DNA, 12 bp, Homo sapiens
agagtgtatgca

SEQ ID NO: 6629354 - DNA, 13 bp, Homo sapiens
agagtgtatgcat

SEQ ID NO: 6629355 - DNA, 15 bp, Homo sapiens
agagtgtatgcatac

SEQ ID NO: 6629356 - DNA, 19 bp, Homo sapiens
agagtgtatgcatacaaat

SEQ ID NO: 6629357 - DNA, 18 bp, Homo sapiens
agagtgtcaaccagacag

SEQ ID NO: 6629358 - DNA, 20 bp, Homo sapiens
agagtgtcaaccagacagag

SEQ ID NO: 6629359 - DNA, 22 bp, Homo sapiens
agagtgtcaaccagacagaggg

SEQ ID NO: 6629360 - DNA, 19 bp, Homo sapiens
agagtgtcactgagctgtg

SEQ ID NO: 6629361 - DNA, 21 bp, Homo sapiens
agagtgtccctttttgcaggg

SEQ ID NO: 6629362 - DNA, 23 bp, Homo sapiens
agagtgtccctttttgcagggga

SEQ ID NO: 6629363 - DNA, 18 bp, Homo sapiens
agagtgtcctgctacctt

SEQ ID NO: 6629364 - DNA, 20 bp, Homo sapiens
agagtgtcttcacggcagga

SEQ ID NO: 6629365 - DNA, 18 bp, Homo sapiens
agagtgtgactcatcagg

SEQ ID NO: 6629366 - DNA, 23 bp, Homo sapiens
agagtgtgagagagactgatggg

SEQ ID NO: 6629367 - DNA, 17 bp, Homo sapiens
agagtgtggcaaaataa

SEQ ID NO: 6629368 - DNA, 15 bp, Homo sapiens
agagtgtgttataaa

SEQ ID NO: 6629369 - DNA, 14 bp, Homo sapiens
agagtgttataaca

SEQ ID NO: 6629370 - DNA, 15 bp, Homo sapiens
agagtgttatcatat

SEQ ID NO: 6629371 - DNA, 19 bp, Homo sapiens
agagtgttatcatattggt

SEQ ID NO: 6629372 - DNA, 18 bp, Homo sapiens
agagtgtttgtgagcttt

SEQ ID NO: 6629373 - DNA, 20 bp, Homo sapiens
agagtgtttgtgagcttttt

SEQ ID NO: 6629374 - DNA, 15 bp, Homo sapiens
agagttaaaagcagc

SEQ ID NO: 6629375 - DNA, 22 bp, Homo sapiens
agagttaaaagttagcattgtt

SEQ ID NO: 6629376 - DNA, 16 bp, Homo sapiens
agagttaaaatgttta

SEQ ID NO: 6629377 - DNA, 21 bp, Homo sapiens
agagttaaaatgtttactgta

SEQ ID NO: 6629378 - DNA, 17 bp, Homo sapiens
agagttaaacttagaga

SEQ ID NO: 6629379 - DNA, 15 bp, Homo sapiens
agagttaagaagctg

SEQ ID NO: 6629380 - DNA, 14 bp, Homo sapiens
agagttaatcaact

SEQ ID NO: 6629381 - DNA, 19 bp, Homo sapiens
agagttaatcaactgaaag

SEQ ID NO: 6629382 - DNA, 14 bp, Homo sapiens
agagttacaataaa

SEQ ID NO: 6629383 - DNA, 17 bp, Homo sapiens
agagttacagttctgtg

SEQ ID NO: 6629384 - DNA, 22 bp, Homo sapiens
agagttacagttctgtggtttc

SEQ ID NO: 6629385 - DNA, 22 bp, Homo sapiens
agagttaccattatttaatttg

SEQ ID NO: 6629386 - DNA, 17 bp, Homo sapiens
agagttagactgttggg

SEQ ID NO: 6629387 - DNA, 16 bp, Homo sapiens
agagttaggtttaaca

SEQ ID NO: 6629388 - DNA, 14 bp, Homo sapiens
agagttatatgtgt

SEQ ID NO: 6629389 - DNA, 23 bp, Homo sapiens
agagttatcttctttattattcc

SEQ ID NO: 6629390 - DNA, 15 bp, Homo sapiens
agagttattcaaatg

SEQ ID NO: 6629391 - DNA, 16 bp, Homo sapiens
agagttattcaaatga

SEQ ID NO: 6629392 - DNA, 15 bp, Homo sapiens
agagttattgaatct

SEQ ID NO: 6629393 - DNA, 15 bp, Homo sapiens
agagttcaagaaata

SEQ ID NO: 6629394 - DNA, 18 bp, Homo sapiens
agagttcaagaaataagt

SEQ ID NO: 6629395 - DNA, 15 bp, Homo sapiens
agagttcacaggagg

SEQ ID NO: 6629396 - DNA, 19 bp, Homo sapiens
agagttcagggaggggctg

SEQ ID NO: 6629397 - DNA, 14 bp, Homo sapiens
agagttcatcccag

SEQ ID NO: 6629398 - DNA, 20 bp, Homo sapiens
agagttccagattcccagct

SEQ ID NO: 6629399 - DNA, 20 bp, Homo sapiens
agagttccggggagaaaccc

SEQ ID NO: 6629400 - DNA, 12 bp, Homo sapiens
agagttcctcct

SEQ ID NO: 6629401 - DNA, 22 bp, Homo sapiens
agagttcctctttgccctgagg

SEQ ID NO: 6629402 - DNA, 14 bp, Homo sapiens
agagttccttctca

SEQ ID NO: 6629403 - DNA, 18 bp, Homo sapiens
agagttcctttctgggaa

SEQ ID NO: 6629404 - DNA, 22 bp, Homo sapiens
agagttcggtctgacagtcctt

SEQ ID NO: 6629405 - DNA, 15 bp, Homo sapiens
agagttctagacctc

SEQ ID NO: 6629406 - DNA, 19 bp, Homo sapiens
agagttctatactgtaaag

SEQ ID NO: 6629407 - DNA, 15 bp, Homo sapiens
agagttctggatgta

SEQ ID NO: 6629408 - DNA, 18 bp, Homo sapiens
agagttctggatgtctgg

SEQ ID NO: 6629409 - DNA, 15 bp, Homo sapiens
agagttcttaaagtt

SEQ ID NO: 6629410 - DNA, 13 bp, Homo sapiens
agagttcttcttt

SEQ ID NO: 6629411 - DNA, 16 bp, Homo sapiens
agagttcttctttctt

SEQ ID NO: 6629412 - DNA, 13 bp, Homo sapiens
agagttcttgccc

SEQ ID NO: 6629413 - DNA, 20 bp, Homo sapiens
agagttctttaggtgcctcc

SEQ ID NO: 6629414 - DNA, 22 bp, Homo sapiens
agagttctttttgaagtattta

SEQ ID NO: 6629415 - DNA, 15 bp, Homo sapiens
agagttgaagacaga

SEQ ID NO: 6629416 - DNA, 18 bp, Homo sapiens
agagttgacccctcctga

SEQ ID NO: 6629417 - DNA, 13 bp, Homo sapiens
agagttgagcaca

SEQ ID NO: 6629418 - DNA, 19 bp, Homo sapiens
agagttgaggaactgtaca

SEQ ID NO: 6629419 - DNA, 20 bp, Homo sapiens
agagttgatactacagtttg

SEQ ID NO: 6629420 - DNA, 16 bp, Homo sapiens
agagttgcaacttaag

SEQ ID NO: 6629421 - DNA, 15 bp, Homo sapiens
agagttgcagtaaag

SEQ ID NO: 6629422 - DNA, 14 bp, Homo sapiens
agagttggagtttt

SEQ ID NO: 6629423 - DNA, 16 bp, Homo sapiens
agagttggagttttat

SEQ ID NO: 6629424 - DNA, 15 bp, Homo sapiens
agagttggctcaggc

SEQ ID NO: 6629425 - DNA, 17 bp, Homo sapiens
agagttggctgtattta

SEQ ID NO: 6629426 - DNA, 23 bp, Homo sapiens
agagttggggagaaactgaagcc

SEQ ID NO: 6629427 - DNA, 20 bp, Homo sapiens
agagttgggggctaggggag

SEQ ID NO: 6629428 - DNA, 19 bp, Homo sapiens
agagttgggtgtctcctta

SEQ ID NO: 6629429 - DNA, 17 bp, Homo sapiens
agagttgtaaatatata

SEQ ID NO: 6629430 - DNA, 18 bp, Homo sapiens
agagttgtaaatatataa

SEQ ID NO: 6629431 - DNA, 21 bp, Homo sapiens
agagttgtaaatatataaata

SEQ ID NO: 6629432 - DNA, 20 bp, Homo sapiens
agagttgtctgtccaggccc

SEQ ID NO: 6629433 - DNA, 15 bp, Homo sapiens
agagttgtcttaaat

SEQ ID NO: 6629434 - DNA, 17 bp, Homo sapiens
agagttgtcttaaatta

SEQ ID NO: 6629435 - DNA, 18 bp, Homo sapiens
agagttgtgatggagggg

SEQ ID NO: 6629436 - DNA, 20 bp, Homo sapiens
agagttgtgatggaggggag

SEQ ID NO: 6629437 - DNA, 17 bp, Homo sapiens
agagttgtgttgttctt

SEQ ID NO: 6629438 - DNA, 21 bp, Homo sapiens
agagttgtgttgttcttttcc

SEQ ID NO: 6629439 - DNA, 12 bp, Homo sapiens
agagttgttaca

SEQ ID NO: 6629440 - DNA, 16 bp, Homo sapiens
agagttgttacatttt

SEQ ID NO: 6629441 - DNA, 21 bp, Homo sapiens
agagttgttacatttttaagt

SEQ ID NO: 6629442 - DNA, 19 bp, Homo sapiens
agagttgttgtttgccaag

SEQ ID NO: 6629443 - DNA, 14 bp, Homo sapiens
agagtttaaacaaa

SEQ ID NO: 6629444 - DNA, 17 bp, Homo sapiens
agagtttaaagagaaaa

SEQ ID NO: 6629445 - DNA, 21 bp, Homo sapiens
agagtttaacagatatttaaa

SEQ ID NO: 6629446 - DNA, 13 bp, Homo sapiens
agagtttacaaga

SEQ ID NO: 6629447 - DNA, 17 bp, Homo sapiens
agagtttacaagaaata

SEQ ID NO: 6629448 - DNA, 18 bp, Homo sapiens
agagtttacaagaaataa

SEQ ID NO: 6629449 - DNA, 12 bp, Homo sapiens
agagtttacagt

SEQ ID NO: 6629450 - DNA, 15 bp, Homo sapiens
agagtttagccctga

SEQ ID NO: 6629451 - DNA, 22 bp, Homo sapiens
agagtttagctgtaacagttct

SEQ ID NO: 6629452 - DNA, 21 bp, Homo sapiens
agagtttatacagtgtacatg

SEQ ID NO: 6629453 - DNA, 23 bp, Homo sapiens
agagtttatttttttgatggcta

SEQ ID NO: 6629454 - DNA, 16 bp, Homo sapiens
agagtttcaaccatga

SEQ ID NO: 6629455 - DNA, 19 bp, Homo sapiens
agagtttcgtggcttcagg

SEQ ID NO: 6629456 - DNA, 19 bp, Homo sapiens
agagtttctgcagttccat

SEQ ID NO: 6629457 - DNA, 14 bp, Homo sapiens
agagtttctgtttg

SEQ ID NO: 6629458 - DNA, 15 bp, Homo sapiens
agagtttctgtttga

SEQ ID NO: 6629459 - DNA, 22 bp, Homo sapiens
agagtttctgtttgattctttt

SEQ ID NO: 6629460 - DNA, 21 bp, Homo sapiens
agagtttcttctcatatccat

SEQ ID NO: 6629461 - DNA, 14 bp, Homo sapiens
agagtttgaaactc

SEQ ID NO: 6629462 - DNA, 22 bp, Homo sapiens
agagtttgaaactcgagaccat

SEQ ID NO: 6629463 - DNA, 13 bp, Homo sapiens
agagtttgaagga

SEQ ID NO: 6629464 - DNA, 19 bp, Homo sapiens
agagtttgatcatagaatt

SEQ ID NO: 6629465 - DNA, 20 bp, Homo sapiens
agagtttgatcatagaattg

SEQ ID NO: 6629466 - DNA, 22 bp, Homo sapiens
agagtttgatgaggccctccac

SEQ ID NO: 6629467 - DNA, 23 bp, Homo sapiens
agagtttgatgaggccctccaca

SEQ ID NO: 6629468 - DNA, 14 bp, Homo sapiens
agagtttgcctccc

SEQ ID NO: 6629469 - DNA, 19 bp, Homo sapiens
agagtttggaattattgta

SEQ ID NO: 6629470 - DNA, 13 bp, Homo sapiens
agagtttgtcatt

SEQ ID NO: 6629471 - DNA, 13 bp, Homo sapiens
agagtttgtgtgt

SEQ ID NO: 6629472 - DNA, 17 bp, Homo sapiens
agagtttgtgtgtattt

SEQ ID NO: 6629473 - DNA, 18 bp, Homo sapiens
agagtttgtgtgtatttg

SEQ ID NO: 6629474 - DNA, 22 bp, Homo sapiens
agagttttaacacttctagatc

SEQ ID NO: 6629475 - DNA, 16 bp, Homo sapiens
agagttttagagaaaa

SEQ ID NO: 6629476 - DNA, 15 bp, Homo sapiens
agagttttctatgaa

SEQ ID NO: 6629477 - DNA, 13 bp, Homo sapiens
agagttttcttta

SEQ ID NO: 6629478 - DNA, 16 bp, Homo sapiens
agagttttctttagta

SEQ ID NO: 6629479 - DNA, 13 bp, Homo sapiens
agagttttggatg

SEQ ID NO: 6629480 - DNA, 12 bp, Homo sapiens
agagttttggga

SEQ ID NO: 6629481 - DNA, 13 bp, Homo sapiens
agagttttgtctt

SEQ ID NO: 6629482 - DNA, 21 bp, Homo sapiens
agagtttttatgcctttctct

SEQ ID NO: 6629483 - DNA, 17 bp, Homo sapiens
agagttttttaaacaaa

SEQ ID NO: 6629484 - DNA, 12 bp, Homo sapiens
agataaaaagat

SEQ ID NO: 6629485 - DNA, 21 bp, Homo sapiens
agataaaaagtggaatttctt

SEQ ID NO: 6629486 - DNA, 18 bp, Homo sapiens
agataaaaataaaatgta

SEQ ID NO: 6629487 - DNA, 13 bp, Homo sapiens
agataaaaatcag

SEQ ID NO: 6629488 - DNA, 17 bp, Homo sapiens
agataaaactctagcag

SEQ ID NO: 6629489 - DNA, 13 bp, Homo sapiens
agataaaagcaat

SEQ ID NO: 6629490 - DNA, 14 bp, Homo sapiens
agataaaagcaatt

SEQ ID NO: 6629491 - DNA, 15 bp, Homo sapiens
agataaaagcaattc

SEQ ID NO: 6629492 - DNA, 18 bp, Homo sapiens
agataaaaggagagaaag

SEQ ID NO: 6629493 - DNA, 15 bp, Homo sapiens
agataaaaggtggag

SEQ ID NO: 6629494 - DNA, 22 bp, Homo sapiens
agataaaattatagatgggaat

SEQ ID NO: 6629495 - DNA, 18 bp, Homo sapiens
agataaacacaggcaggt

SEQ ID NO: 6629496 - DNA, 17 bp, Homo sapiens
agataaacaccaaccca

SEQ ID NO: 6629497 - DNA, 23 bp, Homo sapiens
agataaacagaaatgctctgatt

SEQ ID NO: 6629498 - DNA, 23 bp, Homo sapiens
agataaaccgtttttaacacata

SEQ ID NO: 6629499 - DNA, 19 bp, Homo sapiens
agataaacctagataaaga

SEQ ID NO: 6629500 - DNA, 16 bp, Homo sapiens
agataaacgaccaaac

SEQ ID NO: 6629501 - DNA, 13 bp, Homo sapiens
agataaactcaga

SEQ ID NO: 6629502 - DNA, 19 bp, Homo sapiens
agataaactcagaaattta

SEQ ID NO: 6629503 - DNA, 13 bp, Homo sapiens
agataaactgaaa

SEQ ID NO: 6629504 - DNA, 16 bp, Homo sapiens
agataaagaataataa

SEQ ID NO: 6629505 - DNA, 13 bp, Homo sapiens
agataaagatgat

SEQ ID NO: 6629506 - DNA, 14 bp, Homo sapiens
agataaagatttct

SEQ ID NO: 6629507 - DNA, 15 bp, Homo sapiens
agataaaggaaacat

SEQ ID NO: 6629508 - DNA, 22 bp, Homo sapiens
agataaaggaaacatataacta

SEQ ID NO: 6629509 - DNA, 17 bp, Homo sapiens
agataaaggttcatgca

SEQ ID NO: 6629510 - DNA, 13 bp, Homo sapiens
agataaagtcaaa

SEQ ID NO: 6629511 - DNA, 23 bp, Homo sapiens
agataaagtcctgaacctttcaa

SEQ ID NO: 6629512 - DNA, 16 bp, Homo sapiens
agataaataaaagata

SEQ ID NO: 6629513 - DNA, 16 bp, Homo sapiens
agataaatagaactat

SEQ ID NO: 6629514 - DNA, 14 bp, Homo sapiens
agataaatatcatt

SEQ ID NO: 6629515 - DNA, 12 bp, Homo sapiens
agataaatcatg

SEQ ID NO: 6629516 - DNA, 14 bp, Homo sapiens
agataaatctagta

SEQ ID NO: 6629517 - DNA, 16 bp, Homo sapiens
agataaatgagctttc

SEQ ID NO: 6629518 - DNA, 18 bp, Homo sapiens
agataaatgcacatttca

SEQ ID NO: 6629519 - DNA, 13 bp, Homo sapiens
agataaatgcttt

SEQ ID NO: 6629520 - DNA, 17 bp, Homo sapiens
agataaatgctttaaat

SEQ ID NO: 6629521 - DNA, 22 bp, Homo sapiens
agataaatgctttaaatagttt

SEQ ID NO: 6629522 - DNA, 12 bp, Homo sapiens
agataaatgtgc

SEQ ID NO: 6629523 - DNA, 13 bp, Homo sapiens
agataaattataa

SEQ ID NO: 6629524 - DNA, 22 bp, Homo sapiens
agataaattttataggactgtt

SEQ ID NO: 6629525 - DNA, 20 bp, Homo sapiens
agataaattttgacttgaaa

SEQ ID NO: 6629526 - DNA, 22 bp, Homo sapiens
agataaattttgacttgaaaaa

SEQ ID NO: 6629527 - DNA, 18 bp, Homo sapiens
agataacaagatctttca

SEQ ID NO: 6629528 - DNA, 21 bp, Homo sapiens
agataacaatgcagcaaggcc

SEQ ID NO: 6629529 - DNA, 14 bp, Homo sapiens
agataacactgact

SEQ ID NO: 6629530 - DNA, 13 bp, Homo sapiens
agataacagcaag

SEQ ID NO: 6629531 - DNA, 12 bp, Homo sapiens
agataacataaa

SEQ ID NO: 6629532 - DNA, 17 bp, Homo sapiens
agataacccttattcca

SEQ ID NO: 6629533 - DNA, 22 bp, Homo sapiens
agataacctaataattgtatct

SEQ ID NO: 6629534 - DNA, 14 bp, Homo sapiens
agataaccttgttt

SEQ ID NO: 6629535 - DNA, 22 bp, Homo sapiens
agataacgcttaaaggaagtca

SEQ ID NO: 6629536 - DNA, 22 bp, Homo sapiens
agataacttccttcacatctcc

SEQ ID NO: 6629537 - DNA, 13 bp, Homo sapiens
agataacttcttt

SEQ ID NO: 6629538 - DNA, 21 bp, Homo sapiens
agataacttttttgagtcatt

SEQ ID NO: 6629539 - DNA, 15 bp, Homo sapiens
agataagaaaagcct

SEQ ID NO: 6629540 - DNA, 16 bp, Homo sapiens
agataagcaagagaga

SEQ ID NO: 6629541 - DNA, 18 bp, Homo sapiens
agataaggaaactgaggc

SEQ ID NO: 6629542 - DNA, 22 bp, Homo sapiens
agataaggaaactgaggcccag

SEQ ID NO: 6629543 - DNA, 22 bp, Homo sapiens
agataaggactagatactactt

SEQ ID NO: 6629544 - DNA, 15 bp, Homo sapiens
agataaggagaaaga

SEQ ID NO: 6629545 - DNA, 16 bp, Homo sapiens
agataaggcaacaaaa

SEQ ID NO: 6629546 - DNA, 17 bp, Homo sapiens
agataaggcaacaaaat

SEQ ID NO: 6629547 - DNA, 19 bp, Homo sapiens
agataagggtatctggtga

SEQ ID NO: 6629548 - DNA, 13 bp, Homo sapiens
agataaggtggct

SEQ ID NO: 6629549 - DNA, 15 bp, Homo sapiens
agataaggtggcttc

SEQ ID NO: 6629550 - DNA, 18 bp, Homo sapiens
agataaggtggcttctca

SEQ ID NO: 6629551 - DNA, 17 bp, Homo sapiens
agataaggtttcctgct

SEQ ID NO: 6629552 - DNA, 23 bp, Homo sapiens
agataaggtttcctgctccagtg

SEQ ID NO: 6629553 - DNA, 20 bp, Homo sapiens
agataagtgctcagtattga

SEQ ID NO: 6629554 - DNA, 15 bp, Homo sapiens
agataagtggccttg

SEQ ID NO: 6629555 - DNA, 17 bp, Homo sapiens
agataagtgtaaataga

SEQ ID NO: 6629556 - DNA, 18 bp, Homo sapiens
agataagttggaaacact

SEQ ID NO: 6629557 - DNA, 14 bp, Homo sapiens
agataataaattga

SEQ ID NO: 6629558 - DNA, 16 bp, Homo sapiens
agataataaattgatt

SEQ ID NO: 6629559 - DNA, 19 bp, Homo sapiens
agataataaattgatttgt

SEQ ID NO: 6629560 - DNA, 21 bp, Homo sapiens
agataataaattgatttgtta

SEQ ID NO: 6629561 - DNA, 20 bp, Homo sapiens
agataataactgtcttctgg

SEQ ID NO: 6629562 - DNA, 16 bp, Homo sapiens
agataataatatatgt

SEQ ID NO: 6629563 - DNA, 22 bp, Homo sapiens
agataataatgggtttctttca

SEQ ID NO: 6629564 - DNA, 18 bp, Homo sapiens
agataatagggttttcag

SEQ ID NO: 6629565 - DNA, 24 bp, Homo sapiens
agataatagggttttcagatgaaa

SEQ ID NO: 6629566 - DNA, 13 bp, Homo sapiens
agataatagttta

SEQ ID NO: 6629567 - DNA, 22 bp, Homo sapiens
agataatattaaggaagacaat

SEQ ID NO: 6629568 - DNA, 14 bp, Homo sapiens
agataatattgttt

SEQ ID NO: 6629569 - DNA, 17 bp, Homo sapiens
agataatattgtttggt

SEQ ID NO: 6629570 - DNA, 19 bp, Homo sapiens
agataatatttaaaatagt

SEQ ID NO: 6629571 - DNA, 14 bp, Homo sapiens
agataatcagcctc

SEQ ID NO: 6629572 - DNA, 18 bp, Homo sapiens
agataatcattgcttatg

SEQ ID NO: 6629573 - DNA, 19 bp, Homo sapiens
agataatcgaagcaaaagt

SEQ ID NO: 6629574 - DNA, 17 bp, Homo sapiens
agataatctaaatataa

SEQ ID NO: 6629575 - DNA, 16 bp, Homo sapiens
agataatctcagtgct

SEQ ID NO: 6629576 - DNA, 19 bp, Homo sapiens
agataatcttagctgccaa

SEQ ID NO: 6629577 - DNA, 16 bp, Homo sapiens
agataatcttttacat

SEQ ID NO: 6629578 - DNA, 19 bp, Homo sapiens
agataatcttttacattga

SEQ ID NO: 6629579 - DNA, 14 bp, Homo sapiens
agataatgcccaga

SEQ ID NO: 6629580 - DNA, 21 bp, Homo sapiens
agataatgcccagacattttt

SEQ ID NO: 6629581 - DNA, 14 bp, Homo sapiens
agataatggagaat

SEQ ID NO: 6629582 - DNA, 15 bp, Homo sapiens
agataatggtaattt

SEQ ID NO: 6629583 - DNA, 16 bp, Homo sapiens
agataatggtaattta

SEQ ID NO: 6629584 - DNA, 23 bp, Homo sapiens
agataatgttatacatcctattt

SEQ ID NO: 6629585 - DNA, 22 bp, Homo sapiens
agataattaaatgaaatacttg

SEQ ID NO: 6629586 - DNA, 19 bp, Homo sapiens
agataattactgccttgaa

SEQ ID NO: 6629587 - DNA, 14 bp, Homo sapiens
agataattcatttg

SEQ ID NO: 6629588 - DNA, 16 bp, Homo sapiens
agataattcatttgta

SEQ ID NO: 6629589 - DNA, 21 bp, Homo sapiens
agataattctgatcaatcatt

SEQ ID NO: 6629590 - DNA, 20 bp, Homo sapiens
agataattctggaccagaga

SEQ ID NO: 6629591 - DNA, 16 bp, Homo sapiens
agataattcttaaaag

SEQ ID NO: 6629592 - DNA, 17 bp, Homo sapiens
agataattgcttgccag

SEQ ID NO: 6629593 - DNA, 17 bp, Homo sapiens
agataattgtactttga

SEQ ID NO: 6629594 - DNA, 22 bp, Homo sapiens
agataattgttgaaattttgca

SEQ ID NO: 6629595 - DNA, 22 bp, Homo sapiens
agataatttaaccctgcctctc

SEQ ID NO: 6629596 - DNA, 16 bp, Homo sapiens
agataatttattttgt

SEQ ID NO: 6629597 - DNA, 17 bp, Homo sapiens
agataatttattttgta

SEQ ID NO: 6629598 - DNA, 20 bp, Homo sapiens
agataatttattttgtattt

SEQ ID NO: 6629599 - DNA, 12 bp, Homo sapiens
agataatttgaa

SEQ ID NO: 6629600 - DNA, 13 bp, Homo sapiens
agataatttgcat

SEQ ID NO: 6629601 - DNA, 14 bp, Homo sapiens
agataatttgcata

SEQ ID NO: 6629602 - DNA, 21 bp, Homo sapiens
agataatttgcatattctatt

SEQ ID NO: 6629603 - DNA, 17 bp, Homo sapiens
agataattttatgtgtt

SEQ ID NO: 6629604 - DNA, 14 bp, Homo sapiens
agatacaaaacctt

SEQ ID NO: 6629605 - DNA, 14 bp, Homo sapiens
agatacaaattaat

SEQ ID NO: 6629606 - DNA, 18 bp, Homo sapiens
agatacaaattaatttta

SEQ ID NO: 6629607 - DNA, 20 bp, Homo sapiens
agatacaagtttcagacagg

SEQ ID NO: 6629608 - DNA, 15 bp, Homo sapiens
agatacaatcagctg

SEQ ID NO: 6629609 - DNA, 16 bp, Homo sapiens
agatacaatcagctgc

SEQ ID NO: 6629610 - DNA, 18 bp, Homo sapiens
agatacaatcagctgctt

SEQ ID NO: 6629611 - DNA, 23 bp, Homo sapiens
agatacaatgtatttatttaaaa

SEQ ID NO: 6629612 - DNA, 13 bp, Homo sapiens
agatacacagctc

SEQ ID NO: 6629613 - DNA, 21 bp, Homo sapiens
agatacacattacagccaggt

SEQ ID NO: 6629614 - DNA, 15 bp, Homo sapiens
agatacactgcactt

SEQ ID NO: 6629615 - DNA, 17 bp, Homo sapiens
agatacacttgtaaata

SEQ ID NO: 6629616 - DNA, 17 bp, Homo sapiens
agatacagaataatgga

SEQ ID NO: 6629617 - DNA, 19 bp, Homo sapiens
agatacagatccgcatgtg

SEQ ID NO: 6629618 - DNA, 23 bp, Homo sapiens
agatacagccccaaaccagggtg

SEQ ID NO: 6629619 - DNA, 24 bp, Homo sapiens
agatacagggtgctccttgtcaat

SEQ ID NO: 6629620 - DNA, 15 bp, Homo sapiens
agatacatagatgga

SEQ ID NO: 6629621 - DNA, 16 bp, Homo sapiens
agatacatagatggac

SEQ ID NO: 6629622 - DNA, 14 bp, Homo sapiens
agatacatagtaaa

SEQ ID NO: 6629623 - DNA, 21 bp, Homo sapiens
agatacatcttataaactgac

SEQ ID NO: 6629624 - DNA, 21 bp, Homo sapiens
agatacatggttgtgacctga

SEQ ID NO: 6629625 - DNA, 17 bp, Homo sapiens
agatacatgttgtattt

SEQ ID NO: 6629626 - DNA, 22 bp, Homo sapiens
agatacattccctatcaaaaca

SEQ ID NO: 6629627 - DNA, 15 bp, Homo sapiens
agatacatttcatct

SEQ ID NO: 6629628 - DNA, 19 bp, Homo sapiens
agatacatttgatcttgta

SEQ ID NO: 6629629 - DNA, 20 bp, Homo sapiens
agataccatgatgctgagcc

SEQ ID NO: 6629630 - DNA, 17 bp, Homo sapiens
agatacccagagagaaa

SEQ ID NO: 6629631 - DNA, 20 bp, Homo sapiens
agatacccagagagaaaaag

SEQ ID NO: 6629632 - DNA, 17 bp, Homo sapiens
agataccgagaatgatc

SEQ ID NO: 6629633 - DNA, 22 bp, Homo sapiens
agataccggtgcttctggaaac

SEQ ID NO: 6629634 - DNA, 22 bp, Homo sapiens
agatacctaaaagagatttcaa

SEQ ID NO: 6629635 - DNA, 13 bp, Homo sapiens
agatacctcaccc

SEQ ID NO: 6629636 - DNA, 14 bp, Homo sapiens
agatacctcaccct

SEQ ID NO: 6629637 - DNA, 17 bp, Homo sapiens
agatacctcaccctgct

SEQ ID NO: 6629638 - DNA, 14 bp, Homo sapiens
agatacctgtgagg

SEQ ID NO: 6629639 - DNA, 14 bp, Homo sapiens
agatacgactttat

SEQ ID NO: 6629640 - DNA, 17 bp, Homo sapiens
agatacggttgcttcac

SEQ ID NO: 6629641 - DNA, 22 bp, Homo sapiens
agatacggttgcttcaccttgg

SEQ ID NO: 6629642 - DNA, 16 bp, Homo sapiens
agatactactttctct

SEQ ID NO: 6629643 - DNA, 14 bp, Homo sapiens
agatactattttca

SEQ ID NO: 6629644 - DNA, 22 bp, Homo sapiens
agatactcatcatatacaaatg

SEQ ID NO: 6629645 - DNA, 17 bp, Homo sapiens
agatactctcagcacca

SEQ ID NO: 6629646 - DNA, 15 bp, Homo sapiens
agatactctcttctt

SEQ ID NO: 6629647 - DNA, 18 bp, Homo sapiens
agatactcttattttact

SEQ ID NO: 6629648 - DNA, 16 bp, Homo sapiens
agatactgaaacattt

SEQ ID NO: 6629649 - DNA, 18 bp, Homo sapiens
agatactgaaacatttga

SEQ ID NO: 6629650 - DNA, 17 bp, Homo sapiens
agatactgaagtgcagc

SEQ ID NO: 6629651 - DNA, 20 bp, Homo sapiens
agatactgattattgagttc

SEQ ID NO: 6629652 - DNA, 19 bp, Homo sapiens
agatactgctactgtaatt

SEQ ID NO: 6629653 - DNA, 16 bp, Homo sapiens
agatactgctgatgct

SEQ ID NO: 6629654 - DNA, 14 bp, Homo sapiens
agatactggattgt

SEQ ID NO: 6629655 - DNA, 17 bp, Homo sapiens
agatactggattgtact

SEQ ID NO: 6629656 - DNA, 14 bp, Homo sapiens
agatactggtggaa

SEQ ID NO: 6629657 - DNA, 15 bp, Homo sapiens
agatactgtatatgt

SEQ ID NO: 6629658 - DNA, 16 bp, Homo sapiens
agatactgtatatgtc

SEQ ID NO: 6629659 - DNA, 15 bp, Homo sapiens
agatactgtatcatg

SEQ ID NO: 6629660 - DNA, 17 bp, Homo sapiens
agatactgttgatcttt

SEQ ID NO: 6629661 - DNA, 15 bp, Homo sapiens
agatacttaaaggaa

SEQ ID NO: 6629662 - DNA, 17 bp, Homo sapiens
agatacttacatttcca

SEQ ID NO: 6629663 - DNA, 17 bp, Homo sapiens
agatacttatttttctg

SEQ ID NO: 6629664 - DNA, 16 bp, Homo sapiens
agatacttcctgccct

SEQ ID NO: 6629665 - DNA, 14 bp, Homo sapiens
agatacttgatgca

SEQ ID NO: 6629666 - DNA, 15 bp, Homo sapiens
agatacttgatgcac

SEQ ID NO: 6629667 - DNA, 21 bp, Homo sapiens
agatacttgatgcacttattt

SEQ ID NO: 6629668 - DNA, 21 bp, Homo sapiens
agatacttggtcacagccagg

SEQ ID NO: 6629669 - DNA, 17 bp, Homo sapiens
agatactttgctagccg

SEQ ID NO: 6629670 - DNA, 22 bp, Homo sapiens
agatactttgtattgtcctatt

SEQ ID NO: 6629671 - DNA, 17 bp, Homo sapiens
agatactttttcttttg

SEQ ID NO: 6629672 - DNA, 23 bp, Homo sapiens
agatagaaaaggtccaaaactgt

SEQ ID NO: 6629673 - DNA, 15 bp, Homo sapiens
agatagaaagctgga

SEQ ID NO: 6629674 - DNA, 20 bp, Homo sapiens
agatagaaagggtgctgcca

SEQ ID NO: 6629675 - DNA, 18 bp, Homo sapiens
agatagaaataaatagct

SEQ ID NO: 6629676 - DNA, 22 bp, Homo sapiens
agatagaaatagttggttccta

SEQ ID NO: 6629677 - DNA, 21 bp, Homo sapiens
agatagaacacaaaacttgaa

SEQ ID NO: 6629678 - DNA, 13 bp, Homo sapiens
agatagaacaggc

SEQ ID NO: 6629679 - DNA, 17 bp, Homo sapiens
agatagaagaaaaaaga

SEQ ID NO: 6629680 - DNA, 16 bp, Homo sapiens
agatagaagaactgca

SEQ ID NO: 6629681 - DNA, 17 bp, Homo sapiens
agatagaagaattttat

SEQ ID NO: 6629682 - DNA, 12 bp, Homo sapiens
agatagaatgac

SEQ ID NO: 6629683 - DNA, 18 bp, Homo sapiens
agatagaatttggcccag

SEQ ID NO: 6629684 - DNA, 23 bp, Homo sapiens
agatagaatttggcccagagagg

SEQ ID NO: 6629685 - DNA, 14 bp, Homo sapiens
agatagacaggtcc

SEQ ID NO: 6629686 - DNA, 16 bp, Homo sapiens
agatagacctgacaat

SEQ ID NO: 6629687 - DNA, 16 bp, Homo sapiens
agatagacctgtgacc

SEQ ID NO: 6629688 - DNA, 23 bp, Homo sapiens
agatagacgggttgaaagacatc

SEQ ID NO: 6629689 - DNA, 12 bp, Homo sapiens
agatagagaaat

SEQ ID NO: 6629690 - DNA, 17 bp, Homo sapiens
agatagaggggttttag

SEQ ID NO: 6629691 - DNA, 13 bp, Homo sapiens
agatagagtaaaa

SEQ ID NO: 6629692 - DNA, 12 bp, Homo sapiens
agatagcacatg

SEQ ID NO: 6629693 - DNA, 16 bp, Homo sapiens
agatagcagaggaaaa

SEQ ID NO: 6629694 - DNA, 16 bp, Homo sapiens
agatagcagcctggct

SEQ ID NO: 6629695 - DNA, 23 bp, Homo sapiens
agatagcagcctggctcccctgg

SEQ ID NO: 6629696 - DNA, 15 bp, Homo sapiens
agatagccaaggcca

SEQ ID NO: 6629697 - DNA, 15 bp, Homo sapiens
agatagccagacaca

SEQ ID NO: 6629698 - DNA, 12 bp, Homo sapiens
agatagcccagg

SEQ ID NO: 6629699 - DNA, 15 bp, Homo sapiens
agatagcccaggagc

SEQ ID NO: 6629700 - DNA, 16 bp, Homo sapiens
agatagcccaggagca

SEQ ID NO: 6629701 - DNA, 14 bp, Homo sapiens
agatagcctgtggc

SEQ ID NO: 6629702 - DNA, 17 bp, Homo sapiens
agatagcctgtggccct

SEQ ID NO: 6629703 - DNA, 18 bp, Homo sapiens
agatagcctgtggccctg

SEQ ID NO: 6629704 - DNA, 20 bp, Homo sapiens
agatagctattaagatactt

SEQ ID NO: 6629705 - DNA, 14 bp, Homo sapiens
agatagctccttca

SEQ ID NO: 6629706 - DNA, 12 bp, Homo sapiens
agatagctgggg

SEQ ID NO: 6629707 - DNA, 13 bp, Homo sapiens
agatagctggggc

SEQ ID NO: 6629708 - DNA, 15 bp, Homo sapiens
agatagctggggctt

SEQ ID NO: 6629709 - DNA, 14 bp, Homo sapiens
agataggaaactga

SEQ ID NO: 6629710 - DNA, 22 bp, Homo sapiens
agataggcccctggggctcccg

SEQ ID NO: 6629711 - DNA, 14 bp, Homo sapiens
agataggctctgca

SEQ ID NO: 6629712 - DNA, 19 bp, Homo sapiens
agataggcttaacaaatgg

SEQ ID NO: 6629713 - DNA, 12 bp, Homo sapiens
agatagggaaaa

SEQ ID NO: 6629714 - DNA, 22 bp, Homo sapiens
agatagggaaaaggggctcctt

SEQ ID NO: 6629715 - DNA, 12 bp, Homo sapiens
agatagggaaca

SEQ ID NO: 6629716 - DNA, 15 bp, Homo sapiens
agatagggctgggca

SEQ ID NO: 6629717 - DNA, 18 bp, Homo sapiens
agatagggctgggcaagg

SEQ ID NO: 6629718 - DNA, 15 bp, Homo sapiens
agataggggaggggg

SEQ ID NO: 6629719 - DNA, 20 bp, Homo sapiens
agataggtcatgcaagtgag

SEQ ID NO: 6629720 - DNA, 16 bp, Homo sapiens
agataggtgcttttaa

SEQ ID NO: 6629721 - DNA, 17 bp, Homo sapiens
agataggttctgctttc

SEQ ID NO: 6629722 - DNA, 19 bp, Homo sapiens
agataggtttgagttcaaa

SEQ ID NO: 6629723 - DNA, 14 bp, Homo sapiens
agatagtaactgta

SEQ ID NO: 6629724 - DNA, 17 bp, Homo sapiens
agatagtagcatacatt

SEQ ID NO: 6629725 - DNA, 19 bp, Homo sapiens
agatagtatctagcaatca

SEQ ID NO: 6629726 - DNA, 22 bp, Homo sapiens
agatagtatctagcaatcacaa

SEQ ID NO: 6629727 - DNA, 16 bp, Homo sapiens
agatagtcatgctgct

SEQ ID NO: 6629728 - DNA, 17 bp, Homo sapiens
agatagtcatgctgcta

SEQ ID NO: 6629729 - DNA, 16 bp, Homo sapiens
agatagtcttcagttt

SEQ ID NO: 6629730 - DNA, 21 bp, Homo sapiens
agatagtcttggaagctgttt

SEQ ID NO: 6629731 - DNA, 15 bp, Homo sapiens
agatagttacattta

SEQ ID NO: 6629732 - DNA, 15 bp, Homo sapiens
agatagttactatat

SEQ ID NO: 6629733 - DNA, 16 bp, Homo sapiens
agatagttttaattct

SEQ ID NO: 6629734 - DNA, 13 bp, Homo sapiens
agatagttttcat

SEQ ID NO: 6629735 - DNA, 14 bp, Homo sapiens
agatagttttcatc

SEQ ID NO: 6629736 - DNA, 17 bp, Homo sapiens
agatagttttcatccat

SEQ ID NO: 6629737 - DNA, 14 bp, Homo sapiens
agatagttttcatt

SEQ ID NO: 6629738 - DNA, 15 bp, Homo sapiens
agatagttttcattt

SEQ ID NO: 6629739 - DNA, 12 bp, Homo sapiens
agatataaagcc

SEQ ID NO: 6629740 - DNA, 14 bp, Homo sapiens
agatataaagccat

SEQ ID NO: 6629741 - DNA, 12 bp, Homo sapiens
agatataaatac

SEQ ID NO: 6629742 - DNA, 23 bp, Homo sapiens
agatataaatactgacaatgtat

SEQ ID NO: 6629743 - DNA, 16 bp, Homo sapiens
agatataactgtcttg

SEQ ID NO: 6629744 - DNA, 22 bp, Homo sapiens
agatataagagaagtctcattc

SEQ ID NO: 6629745 - DNA, 17 bp, Homo sapiens
agatataagatttgtac

SEQ ID NO: 6629746 - DNA, 17 bp, Homo sapiens
agatataagtgctgtat

SEQ ID NO: 6629747 - DNA, 21 bp, Homo sapiens
agatataatgaacaaaattat

SEQ ID NO: 6629748 - DNA, 15 bp, Homo sapiens
agatatacaaaaaca

SEQ ID NO: 6629749 - DNA, 23 bp, Homo sapiens
agatatacaaatatatttaattg

SEQ ID NO: 6629750 - DNA, 12 bp, Homo sapiens
agatataccaag

SEQ ID NO: 6629751 - DNA, 11 bp, Homo sapiens
agatatactgg

SEQ ID NO: 6629752 - DNA, 19 bp, Homo sapiens
agatatactggaacccttt

SEQ ID NO: 6629753 - DNA, 23 bp, Homo sapiens
agatatacttgtttttgtaaaga

SEQ ID NO: 6629754 - DNA, 21 bp, Homo sapiens
agatatagggtgtggctccta

SEQ ID NO: 6629755 - DNA, 17 bp, Homo sapiens
agatatataactttaga

SEQ ID NO: 6629756 - DNA, 22 bp, Homo sapiens
agatatataagaaaaaattctt

SEQ ID NO: 6629757 - DNA, 15 bp, Homo sapiens
agatatatagatata

SEQ ID NO: 6629758 - DNA, 14 bp, Homo sapiens
agatatatattcat

SEQ ID NO: 6629759 - DNA, 23 bp, Homo sapiens
agatatatatttactaaaagaat

SEQ ID NO: 6629760 - DNA, 17 bp, Homo sapiens
agatatatatttccaaa

SEQ ID NO: 6629761 - DNA, 15 bp, Homo sapiens
agatatatctgaaaa

SEQ ID NO: 6629762 - DNA, 18 bp, Homo sapiens
agatatatctttatactt

SEQ ID NO: 6629763 - DNA, 14 bp, Homo sapiens
agatatatgccttc

SEQ ID NO: 6629764 - DNA, 14 bp, Homo sapiens
agatatatgtgtat

SEQ ID NO: 6629765 - DNA, 17 bp, Homo sapiens
agatatattaaaaatat

SEQ ID NO: 6629766 - DNA, 19 bp, Homo sapiens
agatatattaaaaatataa

SEQ ID NO: 6629767 - DNA, 20 bp, Homo sapiens
agatatattaaaaatataaa

SEQ ID NO: 6629768 - DNA, 14 bp, Homo sapiens
agatatattctcta

SEQ ID NO: 6629769 - DNA, 19 bp, Homo sapiens
agatatattctctaataaa

SEQ ID NO: 6629770 - DNA, 21 bp, Homo sapiens
agatatattctctaataaaat

SEQ ID NO: 6629771 - DNA, 18 bp, Homo sapiens
agatatatttaagcctta

SEQ ID NO: 6629772 - DNA, 22 bp, Homo sapiens
agatatatttcacttttgttct

SEQ ID NO: 6629773 - DNA, 14 bp, Homo sapiens
agatatatttgtca

SEQ ID NO: 6629774 - DNA, 21 bp, Homo sapiens
agatatatttttaagataata

SEQ ID NO: 6629775 - DNA, 15 bp, Homo sapiens
agatatatttttcac

SEQ ID NO: 6629776 - DNA, 15 bp, Homo sapiens
agatatcaaaattct

SEQ ID NO: 6629777 - DNA, 16 bp, Homo sapiens
agatatcaatcagtaa

SEQ ID NO: 6629778 - DNA, 18 bp, Homo sapiens
agatatcagagctcttaa

SEQ ID NO: 6629779 - DNA, 17 bp, Homo sapiens
agatatcagtgtctccc

SEQ ID NO: 6629780 - DNA, 16 bp, Homo sapiens
agatatccacataaat

SEQ ID NO: 6629781 - DNA, 18 bp, Homo sapiens
agatatcctctccccctc

SEQ ID NO: 6629782 - DNA, 21 bp, Homo sapiens
agatatcctctccccctcctc

SEQ ID NO: 6629783 - DNA, 17 bp, Homo sapiens
agatatcctctgcttaa

SEQ ID NO: 6629784 - DNA, 18 bp, Homo sapiens
agatatcctctgcttaaa

SEQ ID NO: 6629785 - DNA, 16 bp, Homo sapiens
agatatcgacttgttt

SEQ ID NO: 6629786 - DNA, 14 bp, Homo sapiens
agatatctatgact

SEQ ID NO: 6629787 - DNA, 17 bp, Homo sapiens
agatatctgagggagga

SEQ ID NO: 6629788 - DNA, 14 bp, Homo sapiens
agatatctgcatgt

SEQ ID NO: 6629789 - DNA, 16 bp, Homo sapiens
agatatctgcatgtgt

SEQ ID NO: 6629790 - DNA, 18 bp, Homo sapiens
agatatcttcagtttaat

SEQ ID NO: 6629791 - DNA, 19 bp, Homo sapiens
agatatcttcagtttaatg

SEQ ID NO: 6629792 - DNA, 17 bp, Homo sapiens
agatatctttttattga

SEQ ID NO: 6629793 - DNA, 22 bp, Homo sapiens
agatatctttttattgatgtgc

SEQ ID NO: 6629794 - DNA, 18 bp, Homo sapiens
agatatgaacatattgtt

SEQ ID NO: 6629795 - DNA, 15 bp, Homo sapiens
agatatgagttgttt

SEQ ID NO: 6629796 - DNA, 16 bp, Homo sapiens
agatatgcaataaata

SEQ ID NO: 6629797 - DNA, 19 bp, Homo sapiens
agatatgcaataaatatta

SEQ ID NO: 6629798 - DNA, 13 bp, Homo sapiens
agatatgcattca

SEQ ID NO: 6629799 - DNA, 19 bp, Homo sapiens
agatatgccactaacttct

SEQ ID NO: 6629800 - DNA, 20 bp, Homo sapiens
agatatgccactaacttcta

SEQ ID NO: 6629801 - DNA, 22 bp, Homo sapiens
agatatgccactaacttctaaa

SEQ ID NO: 6629802 - DNA, 20 bp, Homo sapiens
agatatgcttactaaatctt

SEQ ID NO: 6629803 - DNA, 16 bp, Homo sapiens
agatatgggaacactg

SEQ ID NO: 6629804 - DNA, 22 bp, Homo sapiens
agatatgggtgtttttaataaa

SEQ ID NO: 6629805 - DNA, 12 bp, Homo sapiens
agatatggtgga

SEQ ID NO: 6629806 - DNA, 22 bp, Homo sapiens
agatatgtatatttttgatctt

SEQ ID NO: 6629807 - DNA, 12 bp, Homo sapiens
agatatgtatta

SEQ ID NO: 6629808 - DNA, 22 bp, Homo sapiens
agatatgtattacttttctgca

SEQ ID NO: 6629809 - DNA, 14 bp, Homo sapiens
agatatgtattcta

SEQ ID NO: 6629810 - DNA, 14 bp, Homo sapiens
agatatgtattctt

SEQ ID NO: 6629811 - DNA, 15 bp, Homo sapiens
agatattaagtctca

SEQ ID NO: 6629812 - DNA, 11 bp, Homo sapiens
agatattaatg

SEQ ID NO: 6629813 - DNA, 17 bp, Homo sapiens
agatattaatgcccaga

SEQ ID NO: 6629814 - DNA, 22 bp, Homo sapiens
agatattactttatcacttttt

SEQ ID NO: 6629815 - DNA, 19 bp, Homo sapiens
agatattaggggggaaagt

SEQ ID NO: 6629816 - DNA, 19 bp, Homo sapiens
agatattatatacaacaca

SEQ ID NO: 6629817 - DNA, 18 bp, Homo sapiens
agatattatcataacatc

SEQ ID NO: 6629818 - DNA, 15 bp, Homo sapiens
agatattatgtataa

SEQ ID NO: 6629819 - DNA, 19 bp, Homo sapiens
agatattatgtataaaatg

SEQ ID NO: 6629820 - DNA, 21 bp, Homo sapiens
agatattatgtataaaatgta

SEQ ID NO: 6629821 - DNA, 16 bp, Homo sapiens
agatattatgtataga

SEQ ID NO: 6629822 - DNA, 18 bp, Homo sapiens
agatattattaattttta

SEQ ID NO: 6629823 - DNA, 13 bp, Homo sapiens
agatattatttat

SEQ ID NO: 6629824 - DNA, 20 bp, Homo sapiens
agatattattttaaatttct

SEQ ID NO: 6629825 - DNA, 12 bp, Homo sapiens
agatattcaagt

SEQ ID NO: 6629826 - DNA, 19 bp, Homo sapiens
agatattcaggtggccaga

SEQ ID NO: 6629827 - DNA, 15 bp, Homo sapiens
agatattcatacttt

SEQ ID NO: 6629828 - DNA, 18 bp, Homo sapiens
agatattcatactttcca

SEQ ID NO: 6629829 - DNA, 16 bp, Homo sapiens
agatattcattaatag

SEQ ID NO: 6629830 - DNA, 23 bp, Homo sapiens
agatattctctagtcatttgtta

SEQ ID NO: 6629831 - DNA, 21 bp, Homo sapiens
agatattgaaggagaaaatag

SEQ ID NO: 6629832 - DNA, 19 bp, Homo sapiens
agatattgggaaggaaata

SEQ ID NO: 6629833 - DNA, 23 bp, Homo sapiens
agatattgggaaggaaatatatt

SEQ ID NO: 6629834 - DNA, 14 bp, Homo sapiens
agatattgtacata

SEQ ID NO: 6629835 - DNA, 16 bp, Homo sapiens
agatattgtacataaa

SEQ ID NO: 6629836 - DNA, 13 bp, Homo sapiens
agatattgtatta

SEQ ID NO: 6629837 - DNA, 18 bp, Homo sapiens
agatattgtgaagtacat

SEQ ID NO: 6629838 - DNA, 21 bp, Homo sapiens
agatattgtgaagtacatatt

SEQ ID NO: 6629839 - DNA, 18 bp, Homo sapiens
agatattgttataaataa

SEQ ID NO: 6629840 - DNA, 19 bp, Homo sapiens
agatattgttcaaacaata

SEQ ID NO: 6629841 - DNA, 19 bp, Homo sapiens
agatattgttgttttccat

SEQ ID NO: 6629842 - DNA, 20 bp, Homo sapiens
agatattgttttctgtaaat

SEQ ID NO: 6629843 - DNA, 20 bp, Homo sapiens
agatatttaaaagacaaaca

SEQ ID NO: 6629844 - DNA, 17 bp, Homo sapiens
agatatttaaatttagt

SEQ ID NO: 6629845 - DNA, 20 bp, Homo sapiens
agatatttaggaaaatgctt

SEQ ID NO: 6629846 - DNA, 13 bp, Homo sapiens
agatatttatata

SEQ ID NO: 6629847 - DNA, 17 bp, Homo sapiens
agatatttatattttta

SEQ ID NO: 6629848 - DNA, 23 bp, Homo sapiens
agatatttatatttttattttat

SEQ ID NO: 6629849 - DNA, 13 bp, Homo sapiens
agatatttatgta

SEQ ID NO: 6629850 - DNA, 16 bp, Homo sapiens
agatatttccatttct

SEQ ID NO: 6629851 - DNA, 21 bp, Homo sapiens
agatatttccatttcttcctc

SEQ ID NO: 6629852 - DNA, 23 bp, Homo sapiens
agatatttccatttcttcctcac

SEQ ID NO: 6629853 - DNA, 21 bp, Homo sapiens
agatatttcgaccctggggcg

SEQ ID NO: 6629854 - DNA, 12 bp, Homo sapiens
agatatttctta

SEQ ID NO: 6629855 - DNA, 16 bp, Homo sapiens
agatatttcttcagga

SEQ ID NO: 6629856 - DNA, 17 bp, Homo sapiens
agatatttcttcaggag

SEQ ID NO: 6629857 - DNA, 13 bp, Homo sapiens
agatatttgcacc

SEQ ID NO: 6629858 - DNA, 18 bp, Homo sapiens
agatatttgcagtttttc

SEQ ID NO: 6629859 - DNA, 19 bp, Homo sapiens
agatatttggcttaaatat

SEQ ID NO: 6629860 - DNA, 18 bp, Homo sapiens
agatattttaaaatgaga

SEQ ID NO: 6629861 - DNA, 21 bp, Homo sapiens
agatattttatttctgatgtt

SEQ ID NO: 6629862 - DNA, 21 bp, Homo sapiens
agatattttcacaatgtcagt

SEQ ID NO: 6629863 - DNA, 12 bp, Homo sapiens
agatattttcat

SEQ ID NO: 6629864 - DNA, 16 bp, Homo sapiens
agatattttcatattt

SEQ ID NO: 6629865 - DNA, 19 bp, Homo sapiens
agatattttcatatttaaa

SEQ ID NO: 6629866 - DNA, 22 bp, Homo sapiens
agatattttgtaaaatgtatta

SEQ ID NO: 6629867 - DNA, 20 bp, Homo sapiens
agatatttttatctttatat

SEQ ID NO: 6629868 - DNA, 23 bp, Homo sapiens
agatatttttattcaaactacct

SEQ ID NO: 6629869 - DNA, 12 bp, Homo sapiens
agatatttttca

SEQ ID NO: 6629870 - DNA, 14 bp, Homo sapiens
agatatttttgtac

SEQ ID NO: 6629871 - DNA, 15 bp, Homo sapiens
agatcaaaaaggctt

SEQ ID NO: 6629872 - DNA, 19 bp, Homo sapiens
agatcaaaaaggcttataa

SEQ ID NO: 6629873 - DNA, 20 bp, Homo sapiens
agatcaaaaaggcttataaa

SEQ ID NO: 6629874 - DNA, 16 bp, Homo sapiens
agatcaaaataaaaag

SEQ ID NO: 6629875 - DNA, 17 bp, Homo sapiens
agatcaaaataaaaagt

SEQ ID NO: 6629876 - DNA, 12 bp, Homo sapiens
agatcaaagatg

SEQ ID NO: 6629877 - DNA, 13 bp, Homo sapiens
agatcaaatactt

SEQ ID NO: 6629878 - DNA, 13 bp, Homo sapiens
agatcaaatgaaa

SEQ ID NO: 6629879 - DNA, 16 bp, Homo sapiens
agatcaaatggaaagg

SEQ ID NO: 6629880 - DNA, 22 bp, Homo sapiens
agatcaacaacactacttccct

SEQ ID NO: 6629881 - DNA, 14 bp, Homo sapiens
agatcaaccccttc

SEQ ID NO: 6629882 - DNA, 15 bp, Homo sapiens
agatcaactcatgtt

SEQ ID NO: 6629883 - DNA, 19 bp, Homo sapiens
agatcaagaaatgtctctg

SEQ ID NO: 6629884 - DNA, 21 bp, Homo sapiens
agatcaagaaatgtctctgct

SEQ ID NO: 6629885 - DNA, 24 bp, Homo sapiens
agatcaagaatcttttgtgaaatt

SEQ ID NO: 6629886 - DNA, 16 bp, Homo sapiens
agatcaaggagcccag

SEQ ID NO: 6629887 - DNA, 16 bp, Homo sapiens
agatcaagtgggcctt

SEQ ID NO: 6629888 - DNA, 14 bp, Homo sapiens
agatcaattaattc

SEQ ID NO: 6629889 - DNA, 18 bp, Homo sapiens
agatcaattccctctctc

SEQ ID NO: 6629890 - DNA, 20 bp, Homo sapiens
agatcaattccctctctcag

SEQ ID NO: 6629891 - DNA, 14 bp, Homo sapiens
agatcaatttgtaa

SEQ ID NO: 6629892 - DNA, 17 bp, Homo sapiens
agatcacagcagggcct

SEQ ID NO: 6629893 - DNA, 13 bp, Homo sapiens
agatcacagcctc

SEQ ID NO: 6629894 - DNA, 16 bp, Homo sapiens
agatcacagcctccag

SEQ ID NO: 6629895 - DNA, 17 bp, Homo sapiens
agatcacagcctccagg

SEQ ID NO: 6629896 - DNA, 20 bp, Homo sapiens
agatcacataacagaatgca

SEQ ID NO: 6629897 - DNA, 17 bp, Homo sapiens
agatcacatattctagt

SEQ ID NO: 6629898 - DNA, 20 bp, Homo sapiens
agatcacatcttaaattcat

SEQ ID NO: 6629899 - DNA, 14 bp, Homo sapiens
agatcacccactcc

SEQ ID NO: 6629900 - DNA, 15 bp, Homo sapiens
agatcacccactcct

SEQ ID NO: 6629901 - DNA, 16 bp, Homo sapiens
agatcacccactccta

SEQ ID NO: 6629902 - DNA, 14 bp, Homo sapiens
agatcacgccactg

SEQ ID NO: 6629903 - DNA, 16 bp, Homo sapiens
agatcacgccactgca

SEQ ID NO: 6629904 - DNA, 17 bp, Homo sapiens
agatcacgccactgcac

SEQ ID NO: 6629905 - DNA, 21 bp, Homo sapiens
agatcacgccattgcactcca

SEQ ID NO: 6629906 - DNA, 16 bp, Homo sapiens
agatcacgctccccgc

SEQ ID NO: 6629907 - DNA, 21 bp, Homo sapiens
agatcacgctccccgcctgtt

SEQ ID NO: 6629908 - DNA, 22 bp, Homo sapiens
agatcacgctccccgcctgttc

SEQ ID NO: 6629909 - DNA, 14 bp, Homo sapiens
agatcactcctgga

SEQ ID NO: 6629910 - DNA, 21 bp, Homo sapiens
agatcactgaacttttcaaaa

SEQ ID NO: 6629911 - DNA, 18 bp, Homo sapiens
agatcactgaatttataa

SEQ ID NO: 6629912 - DNA, 22 bp, Homo sapiens
agatcactgcaacctctgcctc

SEQ ID NO: 6629913 - DNA, 23 bp, Homo sapiens
agatcactgccctttttgaaatc

SEQ ID NO: 6629914 - DNA, 23 bp, Homo sapiens
agatcactgtagtttagttctgt

SEQ ID NO: 6629915 - DNA, 14 bp, Homo sapiens
agatcactgtgctt

SEQ ID NO: 6629916 - DNA, 19 bp, Homo sapiens
agatcactgtgcttatttt

SEQ ID NO: 6629917 - DNA, 17 bp, Homo sapiens
agatcactgtttagatt

SEQ ID NO: 6629918 - DNA, 20 bp, Homo sapiens
agatcactgtttagatttgc

SEQ ID NO: 6629919 - DNA, 15 bp, Homo sapiens
agatcacttgtcctc

SEQ ID NO: 6629920 - DNA, 15 bp, Homo sapiens
agatcactttgctct

SEQ ID NO: 6629921 - DNA, 13 bp, Homo sapiens
agatcacttttta

SEQ ID NO: 6629922 - DNA, 16 bp, Homo sapiens
agatcactttttaaac

SEQ ID NO: 6629923 - DNA, 22 bp, Homo sapiens
agatcagaaagtgacatttgct

SEQ ID NO: 6629924 - DNA, 17 bp, Homo sapiens
agatcagaacattcagc

SEQ ID NO: 6629925 - DNA, 18 bp, Homo sapiens
agatcagaacattcagct

SEQ ID NO: 6629926 - DNA, 15 bp, Homo sapiens
agatcagactctcct

SEQ ID NO: 6629927 - DNA, 18 bp, Homo sapiens
agatcagagctgcagcca

SEQ ID NO: 6629928 - DNA, 23 bp, Homo sapiens
agatcagatgctccaagattcta

SEQ ID NO: 6629929 - DNA, 20 bp, Homo sapiens
agatcagcaaaccggggcct

SEQ ID NO: 6629930 - DNA, 16 bp, Homo sapiens
agatcagcagtggcag

SEQ ID NO: 6629931 - DNA, 22 bp, Homo sapiens
agatcagcatccaaaagcagga

SEQ ID NO: 6629932 - DNA, 18 bp, Homo sapiens
agatcagcattcaaaata

SEQ ID NO: 6629933 - DNA, 20 bp, Homo sapiens
agatcagcattcaaaatagt

SEQ ID NO: 6629934 - DNA, 12 bp, Homo sapiens
agatcagccatt

SEQ ID NO: 6629935 - DNA, 18 bp, Homo sapiens
agatcagccattaaaata

SEQ ID NO: 6629936 - DNA, 20 bp, Homo sapiens
agatcagccattaaaataaa

SEQ ID NO: 6629937 - DNA, 13 bp, Homo sapiens
agatcagcctggg

SEQ ID NO: 6629938 - DNA, 15 bp, Homo sapiens
agatcagcctgggca

SEQ ID NO: 6629939 - DNA, 16 bp, Homo sapiens
agatcagcctgggcaa

SEQ ID NO: 6629940 - DNA, 12 bp, Homo sapiens
agatcaggaacc

SEQ ID NO: 6629941 - DNA, 18 bp, Homo sapiens
agatcaggaagagaagga

SEQ ID NO: 6629942 - DNA, 19 bp, Homo sapiens
agatcaggaagagaaggag

SEQ ID NO: 6629943 - DNA, 20 bp, Homo sapiens
agatcaggaattctaaataa

SEQ ID NO: 6629944 - DNA, 17 bp, Homo sapiens
agatcaggagtgacaga

SEQ ID NO: 6629945 - DNA, 17 bp, Homo sapiens
agatcaggatcagcttt

SEQ ID NO: 6629946 - DNA, 16 bp, Homo sapiens
agatcagggcctgccc

SEQ ID NO: 6629947 - DNA, 19 bp, Homo sapiens
agatcagggcctgccccct

SEQ ID NO: 6629948 - DNA, 20 bp, Homo sapiens
agatcagggcctgccccctg

SEQ ID NO: 6629949 - DNA, 23 bp, Homo sapiens
agatcagggcctgccccctgggg

SEQ ID NO: 6629950 - DNA, 21 bp, Homo sapiens
agatcaggtcagagcccagga

SEQ ID NO: 6629951 - DNA, 13 bp, Homo sapiens
agatcagtaaaga

SEQ ID NO: 6629952 - DNA, 15 bp, Homo sapiens
agatcagtaaagaac

SEQ ID NO: 6629953 - DNA, 15 bp, Homo sapiens
agatcagtgtaccat

SEQ ID NO: 6629954 - DNA, 21 bp, Homo sapiens
agatcagtgtaccatttgcct

SEQ ID NO: 6629955 - DNA, 21 bp, Homo sapiens
agatcagttttcctagtcttt

SEQ ID NO: 6629956 - DNA, 13 bp, Homo sapiens
agatcataaggct

SEQ ID NO: 6629957 - DNA, 16 bp, Homo sapiens
agatcataaggcttca

SEQ ID NO: 6629958 - DNA, 13 bp, Homo sapiens
agatcatagtttt

SEQ ID NO: 6629959 - DNA, 14 bp, Homo sapiens
agatcatagtttta

SEQ ID NO: 6629960 - DNA, 16 bp, Homo sapiens
agatcatagttttatt

SEQ ID NO: 6629961 - DNA, 22 bp, Homo sapiens
agatcatagttttatttatatt

SEQ ID NO: 6629962 - DNA, 23 bp, Homo sapiens
agatcatagttttatttatattt

SEQ ID NO: 6629963 - DNA, 21 bp, Homo sapiens
agatcatataagcaagacagt

SEQ ID NO: 6629964 - DNA, 17 bp, Homo sapiens
agatcatattaatgaca

SEQ ID NO: 6629965 - DNA, 21 bp, Homo sapiens
agatcatccagaagttcctca

SEQ ID NO: 6629966 - DNA, 22 bp, Homo sapiens
agatcatcctaacaatgtgggg

SEQ ID NO: 6629967 - DNA, 17 bp, Homo sapiens
agatcatctccaaatct

SEQ ID NO: 6629968 - DNA, 22 bp, Homo sapiens
agatcatctggggacctggttt

SEQ ID NO: 6629969 - DNA, 14 bp, Homo sapiens
agatcatgcataga

SEQ ID NO: 6629970 - DNA, 13 bp, Homo sapiens
agatcatgccgcc

SEQ ID NO: 6629971 - DNA, 17 bp, Homo sapiens
agatcatggaacacaaa

SEQ ID NO: 6629972 - DNA, 19 bp, Homo sapiens
agatcatggaacacaaaca

SEQ ID NO: 6629973 - DNA, 14 bp, Homo sapiens
agatcatggcagca

SEQ ID NO: 6629974 - DNA, 20 bp, Homo sapiens
agatcattgaagaccagctt

SEQ ID NO: 6629975 - DNA, 21 bp, Homo sapiens
agatcattgaagaccagcttt

SEQ ID NO: 6629976 - DNA, 22 bp, Homo sapiens
agatcattgaagaccagctttc

SEQ ID NO: 6629977 - DNA, 12 bp, Homo sapiens
agatcatttcta

SEQ ID NO: 6629978 - DNA, 13 bp, Homo sapiens
agatcatttctag

SEQ ID NO: 6629979 - DNA, 23 bp, Homo sapiens
agatcatttctaggcaaaattgt

SEQ ID NO: 6629980 - DNA, 17 bp, Homo sapiens
agatcatttgagttcag

SEQ ID NO: 6629981 - DNA, 20 bp, Homo sapiens
agatcatttttatcccgcca

SEQ ID NO: 6629982 - DNA, 12 bp, Homo sapiens
agatcatttttt

SEQ ID NO: 6629983 - DNA, 18 bp, Homo sapiens
agatccaaaagaagcccc

SEQ ID NO: 6629984 - DNA, 14 bp, Homo sapiens
agatccaaagactc

SEQ ID NO: 6629985 - DNA, 20 bp, Homo sapiens
agatccaaatgctgtgcaaa

SEQ ID NO: 6629986 - DNA, 23 bp, Homo sapiens
agatccaagccaagttttctcaa

SEQ ID NO: 6629987 - DNA, 20 bp, Homo sapiens
agatccaaggccgcggccca

SEQ ID NO: 6629988 - DNA, 14 bp, Homo sapiens
agatccacacacag

SEQ ID NO: 6629989 - DNA, 16 bp, Homo sapiens
agatccacacacagag

SEQ ID NO: 6629990 - DNA, 17 bp, Homo sapiens
agatccacacacagagg

SEQ ID NO: 6629991 - DNA, 11 bp, Homo sapiens
agatccacccc

SEQ ID NO: 6629992 - DNA, 19 bp, Homo sapiens
agatccacctgcacaaaca

SEQ ID NO: 6629993 - DNA, 23 bp, Homo sapiens
agatccacctgcacaaacataga

SEQ ID NO: 6629994 - DNA, 18 bp, Homo sapiens
agatccacgtgtggcctc

SEQ ID NO: 6629995 - DNA, 20 bp, Homo sapiens
agatccacgtgtggcctccg

SEQ ID NO: 6629996 - DNA, 14 bp, Homo sapiens
agatccagactgta

SEQ ID NO: 6629997 - DNA, 17 bp, Homo sapiens
agatccagcccaaacct

SEQ ID NO: 6629998 - DNA, 13 bp, Homo sapiens
agatccagcctgg

SEQ ID NO: 6629999 - DNA, 22 bp, Homo sapiens
agatccaggaacacatgcacac

SEQ ID NO: 6630000 - DNA, 10 bp, Homo sapiens
agatccaggc

SEQ ID NO: 6630001 - DNA, 20 bp, Homo sapiens
agatccaggcttctcccgga

SEQ ID NO: 6630002 - DNA, 19 bp, Homo sapiens
agatccagggacagaggcc

SEQ ID NO: 6630003 - DNA, 9 bp, Homo sapiens
agatccagt

SEQ ID NO: 6630004 - DNA, 10 bp, Homo sapiens
agatccagtg

SEQ ID NO: 6630005 - DNA, 15 bp, Homo sapiens
agatccattaattta

SEQ ID NO: 6630006 - DNA, 13 bp, Homo sapiens
agatccatttgcc

SEQ ID NO: 6630007 - DNA, 18 bp, Homo sapiens
agatcccaacactgccag

SEQ ID NO: 6630008 - DNA, 19 bp, Homo sapiens
agatcccaacactgccagc

SEQ ID NO: 6630009 - DNA, 18 bp, Homo sapiens
agatcccaacatggtcct

SEQ ID NO: 6630010 - DNA, 19 bp, Homo sapiens
agatcccaacatggtccta

SEQ ID NO: 6630011 - DNA, 20 bp, Homo sapiens
agatcccaagtcaaacagtg

SEQ ID NO: 6630012 - DNA, 19 bp, Homo sapiens
agatcccacatatttcaaa

SEQ ID NO: 6630013 - DNA, 22 bp, Homo sapiens
agatcccaccgacccttcctgg

SEQ ID NO: 6630014 - DNA, 22 bp, Homo sapiens
agatcccagaaggacctcctga

SEQ ID NO: 6630015 - DNA, 16 bp, Homo sapiens
agatcccagcccaccc

SEQ ID NO: 6630016 - DNA, 13 bp, Homo sapiens
agatcccagctca

SEQ ID NO: 6630017 - DNA, 14 bp, Homo sapiens
agatcccaggaggt

SEQ ID NO: 6630018 - DNA, 20 bp, Homo sapiens
agatcccaggaggtgcagtg

SEQ ID NO: 6630019 - DNA, 20 bp, Homo sapiens
agatcccaggcccctggagg

SEQ ID NO: 6630020 - DNA, 18 bp, Homo sapiens
agatcccatgtcacctca

SEQ ID NO: 6630021 - DNA, 23 bp, Homo sapiens
agatcccatgtcacctcagctga

SEQ ID NO: 6630022 - DNA, 21 bp, Homo sapiens
agatccccaaaacaggccagg

SEQ ID NO: 6630023 - DNA, 21 bp, Homo sapiens
agatccccaactgctccagcc

SEQ ID NO: 6630024 - DNA, 16 bp, Homo sapiens
agatccccagcccctc

SEQ ID NO: 6630025 - DNA, 23 bp, Homo sapiens
agatccccagcccctcctccctc

SEQ ID NO: 6630026 - DNA, 14 bp, Homo sapiens
agatccccagggca

SEQ ID NO: 6630027 - DNA, 17 bp, Homo sapiens
agatccccgttcctgac

SEQ ID NO: 6630028 - DNA, 17 bp, Homo sapiens
agatcccctctcctgcc

SEQ ID NO: 6630029 - DNA, 14 bp, Homo sapiens
agatcccctgagcc

SEQ ID NO: 6630030 - DNA, 22 bp, Homo sapiens
agatcccgcctcttcttcttca

SEQ ID NO: 6630031 - DNA, 22 bp, Homo sapiens
agatccctcggtcagcaccgtg

SEQ ID NO: 6630032 - DNA, 22 bp, Homo sapiens
agatccgagcgacggctcctcc

SEQ ID NO: 6630033 - DNA, 23 bp, Homo sapiens
agatccgcaatgtggagcagcag

SEQ ID NO: 6630034 - DNA, 14 bp, Homo sapiens
agatccgcatgtgt

SEQ ID NO: 6630035 - DNA, 15 bp, Homo sapiens
agatccgcatgtgtc

SEQ ID NO: 6630036 - DNA, 17 bp, Homo sapiens
agatccgcatgtgtctg

SEQ ID NO: 6630037 - DNA, 19 bp, Homo sapiens
agatccgcatgtgtctgta

SEQ ID NO: 6630038 - DNA, 23 bp, Homo sapiens
agatccgcatgtgtctgtattca

SEQ ID NO: 6630039 - DNA, 21 bp, Homo sapiens
agatccgccctgggctctggg

SEQ ID NO: 6630040 - DNA, 19 bp, Homo sapiens
agatccgggagactgacac

SEQ ID NO: 6630041 - DNA, 13 bp, Homo sapiens
agatcctaaaaca

SEQ ID NO: 6630042 - DNA, 12 bp, Homo sapiens
agatcctaaact

SEQ ID NO: 6630043 - DNA, 14 bp, Homo sapiens
agatcctaaactct

SEQ ID NO: 6630044 - DNA, 19 bp, Homo sapiens
agatcctaaactctctagc

SEQ ID NO: 6630045 - DNA, 17 bp, Homo sapiens
agatcctaactgagaat

SEQ ID NO: 6630046 - DNA, 23 bp, Homo sapiens
agatcctaagggtcgaaagctct

SEQ ID NO: 6630047 - DNA, 22 bp, Homo sapiens
agatcctaccccaattccttgt

SEQ ID NO: 6630048 - DNA, 19 bp, Homo sapiens
agatcctaggtgctggatg

SEQ ID NO: 6630049 - DNA, 20 bp, Homo sapiens
agatcctccgcggaggcccc

SEQ ID NO: 6630050 - DNA, 23 bp, Homo sapiens
agatcctccgcggaggcccctga

SEQ ID NO: 6630051 - DNA, 18 bp, Homo sapiens
agatcctccttccaggcc

SEQ ID NO: 6630052 - DNA, 19 bp, Homo sapiens
agatcctccttccaggccc

SEQ ID NO: 6630053 - DNA, 13 bp, Homo sapiens
agatcctctctgg

SEQ ID NO: 6630054 - DNA, 17 bp, Homo sapiens
agatcctctctggggct

SEQ ID NO: 6630055 - DNA, 12 bp, Homo sapiens
agatcctcttct

SEQ ID NO: 6630056 - DNA, 22 bp, Homo sapiens
agatcctcttgccacatcttga

SEQ ID NO: 6630057 - DNA, 20 bp, Homo sapiens
agatcctctttactctgggc

SEQ ID NO: 6630058 - DNA, 21 bp, Homo sapiens
agatcctctttactctgggca

SEQ ID NO: 6630059 - DNA, 19 bp, Homo sapiens
agatcctctttccccactg

SEQ ID NO: 6630060 - DNA, 22 bp, Homo sapiens
agatcctctttccccactgaag

SEQ ID NO: 6630061 - DNA, 23 bp, Homo sapiens
agatcctgaagcagttcagaagg

SEQ ID NO: 6630062 - DNA, 13 bp, Homo sapiens
agatcctgcaccc

SEQ ID NO: 6630063 - DNA, 15 bp, Homo sapiens
agatcctgcacccca

SEQ ID NO: 6630064 - DNA, 17 bp, Homo sapiens
agatcctgcaccccagc

SEQ ID NO: 6630065 - DNA, 12 bp, Homo sapiens
agatcctgggca

SEQ ID NO: 6630066 - DNA, 21 bp, Homo sapiens
agatcctgtctttaaggaaaa

SEQ ID NO: 6630067 - DNA, 23 bp, Homo sapiens
agatcctgtgaggagccccatct

SEQ ID NO: 6630068 - DNA, 12 bp, Homo sapiens
agatcctgtgat

SEQ ID NO: 6630069 - DNA, 13 bp, Homo sapiens
agatcctgtgatt

SEQ ID NO: 6630070 - DNA, 12 bp, Homo sapiens
agatccttcaca

SEQ ID NO: 6630071 - DNA, 21 bp, Homo sapiens
agatccttcgggtgctggaag

SEQ ID NO: 6630072 - DNA, 22 bp, Homo sapiens
agatccttttccatcccactcc

SEQ ID NO: 6630073 - DNA, 20 bp, Homo sapiens
agatcgacaccatcctggct

SEQ ID NO: 6630074 - DNA, 21 bp, Homo sapiens
agatcgacaccatcctggcta

SEQ ID NO: 6630075 - DNA, 13 bp, Homo sapiens
agatcgagaccat

SEQ ID NO: 6630076 - DNA, 16 bp, Homo sapiens
agatcgagaccatcct

SEQ ID NO: 6630077 - DNA, 18 bp, Homo sapiens
agatcgaggctacagtga

SEQ ID NO: 6630078 - DNA, 14 bp, Homo sapiens
agatcgcatttcct

SEQ ID NO: 6630079 - DNA, 19 bp, Homo sapiens
agatcgcgccactgcactc

SEQ ID NO: 6630080 - DNA, 16 bp, Homo sapiens
agatcgcttgagccca

SEQ ID NO: 6630081 - DNA, 15 bp, Homo sapiens
agatcggggccagag

SEQ ID NO: 6630082 - DNA, 16 bp, Homo sapiens
agatcggggtggcaga

SEQ ID NO: 6630083 - DNA, 15 bp, Homo sapiens
agatcggttaacaaa

SEQ ID NO: 6630084 - DNA, 17 bp, Homo sapiens
agatcggttaacaaata

SEQ ID NO: 6630085 - DNA, 17 bp, Homo sapiens
agatcgtattaattatc

SEQ ID NO: 6630086 - DNA, 20 bp, Homo sapiens
agatcgtattaattatctga

SEQ ID NO: 6630087 - DNA, 15 bp, Homo sapiens
agatcgtgccgtgga

SEQ ID NO: 6630088 - DNA, 23 bp, Homo sapiens
agatcgtgccgtggagcttggag

SEQ ID NO: 6630089 - DNA, 19 bp, Homo sapiens
agatcgtgctactgcactc

SEQ ID NO: 6630090 - DNA, 14 bp, Homo sapiens
agatcgtgtattga

SEQ ID NO: 6630091 - DNA, 13 bp, Homo sapiens
agatctaaaaata

SEQ ID NO: 6630092 - DNA, 19 bp, Homo sapiens
agatctaaataaaatgcta

SEQ ID NO: 6630093 - DNA, 23 bp, Homo sapiens
agatctaacgtgttccagtgtct

SEQ ID NO: 6630094 - DNA, 20 bp, Homo sapiens
agatctaagcctttccataa

SEQ ID NO: 6630095 - DNA, 22 bp, Homo sapiens
agatctaaggatgtcacagggc

SEQ ID NO: 6630096 - DNA, 13 bp, Homo sapiens
agatctacacatg

SEQ ID NO: 6630097 - DNA, 14 bp, Homo sapiens
agatctacacatgt

SEQ ID NO: 6630098 - DNA, 22 bp, Homo sapiens
agatctacaggacaaagggagg

SEQ ID NO: 6630099 - DNA, 13 bp, Homo sapiens
agatctagaaagt

SEQ ID NO: 6630100 - DNA, 13 bp, Homo sapiens
agatctagccagg

SEQ ID NO: 6630101 - DNA, 19 bp, Homo sapiens
agatctaggtgaggattga

SEQ ID NO: 6630102 - DNA, 21 bp, Homo sapiens
agatctcaacatggaaaaatc

SEQ ID NO: 6630103 - DNA, 23 bp, Homo sapiens
agatctcaacatggaaaaatcct

SEQ ID NO: 6630104 - DNA, 16 bp, Homo sapiens
agatctcactctgccc

SEQ ID NO: 6630105 - DNA, 21 bp, Homo sapiens
agatctcagcagccagctcct

SEQ ID NO: 6630106 - DNA, 13 bp, Homo sapiens
agatctcaggtcc

SEQ ID NO: 6630107 - DNA, 17 bp, Homo sapiens
agatctcatagatgacc

SEQ ID NO: 6630108 - DNA, 23 bp, Homo sapiens
agatctcatcagggtagcagcag

SEQ ID NO: 6630109 - DNA, 16 bp, Homo sapiens
agatctcatgtcctct

SEQ ID NO: 6630110 - DNA, 18 bp, Homo sapiens
agatctccacggtcagat

SEQ ID NO: 6630111 - DNA, 22 bp, Homo sapiens
agatctccatgctttgctctca

SEQ ID NO: 6630112 - DNA, 16 bp, Homo sapiens
agatctccctccaggg

SEQ ID NO: 6630113 - DNA, 17 bp, Homo sapiens
agatctccctccaggga

SEQ ID NO: 6630114 - DNA, 15 bp, Homo sapiens
agatctcctgtaatt

SEQ ID NO: 6630115 - DNA, 15 bp, Homo sapiens
agatctcctgtattc

SEQ ID NO: 6630116 - DNA, 18 bp, Homo sapiens
agatctcctgtattcttg

SEQ ID NO: 6630117 - DNA, 17 bp, Homo sapiens
agatctcctgtgcacct

SEQ ID NO: 6630118 - DNA, 15 bp, Homo sapiens
agatctctagagttt

SEQ ID NO: 6630119 - DNA, 15 bp, Homo sapiens
agatctctcctgcaa

SEQ ID NO: 6630120 - DNA, 17 bp, Homo sapiens
agatctctgcagggccg

SEQ ID NO: 6630121 - DNA, 18 bp, Homo sapiens
agatctctgctttggaaa

SEQ ID NO: 6630122 - DNA, 23 bp, Homo sapiens
agatctctggattctaattttgg

SEQ ID NO: 6630123 - DNA, 13 bp, Homo sapiens
agatctgaagtag

SEQ ID NO: 6630124 - DNA, 12 bp, Homo sapiens
agatctgactgc

SEQ ID NO: 6630125 - DNA, 19 bp, Homo sapiens
agatctgagccctccctct

SEQ ID NO: 6630126 - DNA, 19 bp, Homo sapiens
agatctgatggtgagctgg

SEQ ID NO: 6630127 - DNA, 23 bp, Homo sapiens
agatctgatggtgagctgggaag

SEQ ID NO: 6630128 - DNA, 14 bp, Homo sapiens
agatctgcacagtc

SEQ ID NO: 6630129 - DNA, 20 bp, Homo sapiens
agatctgcaccaccatgccc

SEQ ID NO: 6630130 - DNA, 14 bp, Homo sapiens
agatctgcaccgcc

SEQ ID NO: 6630131 - DNA, 19 bp, Homo sapiens
agatctgcaggctgcacct

SEQ ID NO: 6630132 - DNA, 20 bp, Homo sapiens
agatctgccagacctgcatg

SEQ ID NO: 6630133 - DNA, 12 bp, Homo sapiens
agatctgcctgg

SEQ ID NO: 6630134 - DNA, 16 bp, Homo sapiens
agatctgcctgggcct

SEQ ID NO: 6630135 - DNA, 23 bp, Homo sapiens
agatctgcctgggcctgtgcagc

SEQ ID NO: 6630136 - DNA, 13 bp, Homo sapiens
agatctgcttctt

SEQ ID NO: 6630137 - DNA, 20 bp, Homo sapiens
agatctgctttctgttcatc

SEQ ID NO: 6630138 - DNA, 22 bp, Homo sapiens
agatctgctttctgttcatctc

SEQ ID NO: 6630139 - DNA, 23 bp, Homo sapiens
agatctggaaccttaccacgtta

SEQ ID NO: 6630140 - DNA, 13 bp, Homo sapiens
agatctggggagg

SEQ ID NO: 6630141 - DNA, 14 bp, Homo sapiens
agatctggtttcta

SEQ ID NO: 6630142 - DNA, 18 bp, Homo sapiens
agatctgtaatttttatt

SEQ ID NO: 6630143 - DNA, 14 bp, Homo sapiens
agatctgtataaat

SEQ ID NO: 6630144 - DNA, 19 bp, Homo sapiens
agatctgtcccttaataaa

SEQ ID NO: 6630145 - DNA, 15 bp, Homo sapiens
agatctgtcctcagc

SEQ ID NO: 6630146 - DNA, 17 bp, Homo sapiens
agatctgtcctcagcct

SEQ ID NO: 6630147 - DNA, 18 bp, Homo sapiens
agatctgtcctcagcctt

SEQ ID NO: 6630148 - DNA, 20 bp, Homo sapiens
agatctgtgccatagaacaa

SEQ ID NO: 6630149 - DNA, 16 bp, Homo sapiens
agatctgtgcctggga

SEQ ID NO: 6630150 - DNA, 16 bp, Homo sapiens
agatctgtgtggctcc

SEQ ID NO: 6630151 - DNA, 18 bp, Homo sapiens
agatctgtgtggctcctg

SEQ ID NO: 6630152 - DNA, 23 bp, Homo sapiens
agatctgtgtggctcctgggccg

SEQ ID NO: 6630153 - DNA, 18 bp, Homo sapiens
agatctgttttgaaggca

SEQ ID NO: 6630154 - DNA, 14 bp, Homo sapiens
agatcttaaatttt

SEQ ID NO: 6630155 - DNA, 12 bp, Homo sapiens
agatcttaatat

SEQ ID NO: 6630156 - DNA, 13 bp, Homo sapiens
agatcttaatata

SEQ ID NO: 6630157 - DNA, 19 bp, Homo sapiens
agatcttaatataaattca

SEQ ID NO: 6630158 - DNA, 22 bp, Homo sapiens
agatcttatattggtttgcaca

SEQ ID NO: 6630159 - DNA, 19 bp, Homo sapiens
agatcttcaaacagaataa

SEQ ID NO: 6630160 - DNA, 18 bp, Homo sapiens
agatcttcccataataaa

SEQ ID NO: 6630161 - DNA, 21 bp, Homo sapiens
agatcttcccataataaagca

SEQ ID NO: 6630162 - DNA, 18 bp, Homo sapiens
agatcttccgtggtcaga

SEQ ID NO: 6630163 - DNA, 20 bp, Homo sapiens
agatcttccgtggtcagagt

SEQ ID NO: 6630164 - DNA, 12 bp, Homo sapiens
agatcttcctgc

SEQ ID NO: 6630165 - DNA, 14 bp, Homo sapiens
agatcttcctgctg

SEQ ID NO: 6630166 - DNA, 22 bp, Homo sapiens
agatcttcctgctgagtccttt

SEQ ID NO: 6630167 - DNA, 13 bp, Homo sapiens
agatcttccttcc

SEQ ID NO: 6630168 - DNA, 17 bp, Homo sapiens
agatcttctgaaatgaa

SEQ ID NO: 6630169 - DNA, 14 bp, Homo sapiens
agatcttcttttgg

SEQ ID NO: 6630170 - DNA, 16 bp, Homo sapiens
agatcttgagagagaa

SEQ ID NO: 6630171 - DNA, 16 bp, Homo sapiens
agatcttgagagctgc

SEQ ID NO: 6630172 - DNA, 19 bp, Homo sapiens
agatcttgagagctgctga

SEQ ID NO: 6630173 - DNA, 16 bp, Homo sapiens
agatcttgagcaaggc

SEQ ID NO: 6630174 - DNA, 17 bp, Homo sapiens
agatcttgcctctttcc

SEQ ID NO: 6630175 - DNA, 18 bp, Homo sapiens
agatcttgcctctttcct

SEQ ID NO: 6630176 - DNA, 22 bp, Homo sapiens
agatcttgtctccactaaatga

SEQ ID NO: 6630177 - DNA, 13 bp, Homo sapiens
agatctttatatt

SEQ ID NO: 6630178 - DNA, 16 bp, Homo sapiens
agatctttcagaaata

SEQ ID NO: 6630179 - DNA, 17 bp, Homo sapiens
agatctttcagaaatat

SEQ ID NO: 6630180 - DNA, 21 bp, Homo sapiens
agatctttcgttggttgtttc

SEQ ID NO: 6630181 - DNA, 22 bp, Homo sapiens
agatctttcgttggttgtttct

SEQ ID NO: 6630182 - DNA, 23 bp, Homo sapiens
agatctttcgttggttgtttctc

SEQ ID NO: 6630183 - DNA, 13 bp, Homo sapiens
agatctttctctt

SEQ ID NO: 6630184 - DNA, 15 bp, Homo sapiens
agatctttctcttcc

SEQ ID NO: 6630185 - DNA, 18 bp, Homo sapiens
agatctttctcttccctg

SEQ ID NO: 6630186 - DNA, 12 bp, Homo sapiens
agatctttgcta

SEQ ID NO: 6630187 - DNA, 18 bp, Homo sapiens
agatctttgcttccttgc

SEQ ID NO: 6630188 - DNA, 19 bp, Homo sapiens
agatctttggaacactgtt

SEQ ID NO: 6630189 - DNA, 14 bp, Homo sapiens
agatctttttgtct

SEQ ID NO: 6630190 - DNA, 20 bp, Homo sapiens
agatctttttgtgaaattca

SEQ ID NO: 6630191 - DNA, 17 bp, Homo sapiens
agatctttttttaagtg

SEQ ID NO: 6630192 - DNA, 19 bp, Homo sapiens
agatgaaaaagcatgtaca

SEQ ID NO: 6630193 - DNA, 11 bp, Homo sapiens
agatgaaaacc

SEQ ID NO: 6630194 - DNA, 13 bp, Homo sapiens
agatgaaaataaa

SEQ ID NO: 6630195 - DNA, 15 bp, Homo sapiens
agatgaaaataaaat

SEQ ID NO: 6630196 - DNA, 18 bp, Homo sapiens
agatgaaaataaaataaa

SEQ ID NO: 6630197 - DNA, 23 bp, Homo sapiens
agatgaaaataaaataaacgaaa

SEQ ID NO: 6630198 - DNA, 17 bp, Homo sapiens
agatgaaacacaaacaa

SEQ ID NO: 6630199 - DNA, 22 bp, Homo sapiens
agatgaaacattaactctaact

SEQ ID NO: 6630200 - DNA, 18 bp, Homo sapiens
agatgaaaccgtccctga

SEQ ID NO: 6630201 - DNA, 11 bp, Homo sapiens
agatgaaactg

SEQ ID NO: 6630202 - DNA, 12 bp, Homo sapiens
agatgaaactga

SEQ ID NO: 6630203 - DNA, 20 bp, Homo sapiens
agatgaaaggagtaagaaat

SEQ ID NO: 6630204 - DNA, 21 bp, Homo sapiens
agatgaaataaagacccaggg

SEQ ID NO: 6630205 - DNA, 14 bp, Homo sapiens
agatgaaataattt

SEQ ID NO: 6630206 - DNA, 22 bp, Homo sapiens
agatgaaatatatattgtaaag

SEQ ID NO: 6630207 - DNA, 17 bp, Homo sapiens
agatgaaatgcactgta

SEQ ID NO: 6630208 - DNA, 15 bp, Homo sapiens
agatgaaatgccttt

SEQ ID NO: 6630209 - DNA, 17 bp, Homo sapiens
agatgaacatctctgtt

SEQ ID NO: 6630210 - DNA, 11 bp, Homo sapiens
agatgaacatt

SEQ ID NO: 6630211 - DNA, 14 bp, Homo sapiens
agatgaacatttca

SEQ ID NO: 6630212 - DNA, 19 bp, Homo sapiens
agatgaactctgaactttg

SEQ ID NO: 6630213 - DNA, 22 bp, Homo sapiens
agatgaactctgaactttggag

SEQ ID NO: 6630214 - DNA, 21 bp, Homo sapiens
agatgaactctttctggcctg

SEQ ID NO: 6630215 - DNA, 11 bp, Homo sapiens
agatgaacttg

SEQ ID NO: 6630216 - DNA, 15 bp, Homo sapiens
agatgaacttgagct

SEQ ID NO: 6630217 - DNA, 17 bp, Homo sapiens
agatgaacttgagctct

SEQ ID NO: 6630218 - DNA, 22 bp, Homo sapiens
agatgaactttgtcattatgat

SEQ ID NO: 6630219 - DNA, 23 bp, Homo sapiens
agatgaactttgtcattatgatt

SEQ ID NO: 6630220 - DNA, 23 bp, Homo sapiens
agatgaactttttaacaaatgtt

SEQ ID NO: 6630221 - DNA, 14 bp, Homo sapiens
agatgaagaagcct

SEQ ID NO: 6630222 - DNA, 15 bp, Homo sapiens
agatgaagagaagct

SEQ ID NO: 6630223 - DNA, 16 bp, Homo sapiens
agatgaagagaagctg

SEQ ID NO: 6630224 - DNA, 16 bp, Homo sapiens
agatgaagattcatgt

SEQ ID NO: 6630225 - DNA, 23 bp, Homo sapiens
agatgaagctttggccctcagtg

SEQ ID NO: 6630226 - DNA, 14 bp, Homo sapiens
agatgaaggtctgt

SEQ ID NO: 6630227 - DNA, 21 bp, Homo sapiens
agatgaagtgagatacaaagc

SEQ ID NO: 6630228 - DNA, 14 bp, Homo sapiens
agatgaagttttat

SEQ ID NO: 6630229 - DNA, 15 bp, Homo sapiens
agatgaatagaagaa

SEQ ID NO: 6630230 - DNA, 17 bp, Homo sapiens
agatgaatagaagaaag

SEQ ID NO: 6630231 - DNA, 18 bp, Homo sapiens
agatgaatagaagaaaga

SEQ ID NO: 6630232 - DNA, 22 bp, Homo sapiens
agatgaatccaaatgtgaaaga

SEQ ID NO: 6630233 - DNA, 18 bp, Homo sapiens
agatgaatggtctggcaa

SEQ ID NO: 6630234 - DNA, 11 bp, Homo sapiens
agatgaatgtc

SEQ ID NO: 6630235 - DNA, 22 bp, Homo sapiens
agatgaatgtcagttgttattt

SEQ ID NO: 6630236 - DNA, 13 bp, Homo sapiens
agatgaatttgtc

SEQ ID NO: 6630237 - DNA, 14 bp, Homo sapiens
agatgaatttgtcc

SEQ ID NO: 6630238 - DNA, 15 bp, Homo sapiens
agatgacaacaaatt

SEQ ID NO: 6630239 - DNA, 21 bp, Homo sapiens
agatgacacataaatctgtct

SEQ ID NO: 6630240 - DNA, 22 bp, Homo sapiens
agatgacaccctaaagcaggct

SEQ ID NO: 6630241 - DNA, 22 bp, Homo sapiens
agatgacacgcgctctccacca

SEQ ID NO: 6630242 - DNA, 11 bp, Homo sapiens
agatgacactt

SEQ ID NO: 6630243 - DNA, 15 bp, Homo sapiens
agatgacagaaatat

SEQ ID NO: 6630244 - DNA, 22 bp, Homo sapiens
agatgacagaggtttgaaggag

SEQ ID NO: 6630245 - DNA, 23 bp, Homo sapiens
agatgacagaggtttgaaggaga

SEQ ID NO: 6630246 - DNA, 14 bp, Homo sapiens
agatgacagctctt

SEQ ID NO: 6630247 - DNA, 21 bp, Homo sapiens
agatgacagctcttctaagga

SEQ ID NO: 6630248 - DNA, 18 bp, Homo sapiens
agatgacattgactattt

SEQ ID NO: 6630249 - DNA, 15 bp, Homo sapiens
agatgacattgctaa

SEQ ID NO: 6630250 - DNA, 16 bp, Homo sapiens
agatgacatttgcttt

SEQ ID NO: 6630251 - DNA, 20 bp, Homo sapiens
agatgaccactttttagaaa

SEQ ID NO: 6630252 - DNA, 17 bp, Homo sapiens
agatgaccataattttt

SEQ ID NO: 6630253 - DNA, 17 bp, Homo sapiens
agatgaccccagaaact

SEQ ID NO: 6630254 - DNA, 18 bp, Homo sapiens
agatgacccccaggtatt

SEQ ID NO: 6630255 - DNA, 21 bp, Homo sapiens
agatgacccctaccccctcat

SEQ ID NO: 6630256 - DNA, 23 bp, Homo sapiens
agatgacccctaccccctcatcc

SEQ ID NO: 6630257 - DNA, 14 bp, Homo sapiens
agatgacccctccc

SEQ ID NO: 6630258 - DNA, 21 bp, Homo sapiens
agatgacctacagtgctgtgt

SEQ ID NO: 6630259 - DNA, 19 bp, Homo sapiens
agatgacctcgtactcagg

SEQ ID NO: 6630260 - DNA, 20 bp, Homo sapiens
agatgacctgaggaaaggag

SEQ ID NO: 6630261 - DNA, 13 bp, Homo sapiens
agatgactctgag

SEQ ID NO: 6630262 - DNA, 14 bp, Homo sapiens
agatgactctgaga

SEQ ID NO: 6630263 - DNA, 23 bp, Homo sapiens
agatgactctgtctcattgacct

SEQ ID NO: 6630264 - DNA, 17 bp, Homo sapiens
agatgactgaatttcta

SEQ ID NO: 6630265 - DNA, 14 bp, Homo sapiens
agatgactgagggt

SEQ ID NO: 6630266 - DNA, 15 bp, Homo sapiens
agatgactgagtcct

SEQ ID NO: 6630267 - DNA, 15 bp, Homo sapiens
agatgactttgcaga

SEQ ID NO: 6630268 - DNA, 20 bp, Homo sapiens
agatgagaaagcttttattc

SEQ ID NO: 6630269 - DNA, 15 bp, Homo sapiens
agatgagaacaaagc

SEQ ID NO: 6630270 - DNA, 18 bp, Homo sapiens
agatgagaacaaagctgt

SEQ ID NO: 6630271 - DNA, 16 bp, Homo sapiens
agatgagaagccaaag

SEQ ID NO: 6630272 - DNA, 16 bp, Homo sapiens
agatgagaagccagga

SEQ ID NO: 6630273 - DNA, 17 bp, Homo sapiens
agatgagaattcagctg

SEQ ID NO: 6630274 - DNA, 20 bp, Homo sapiens
agatgagaattcagctgccc

SEQ ID NO: 6630275 - DNA, 15 bp, Homo sapiens
agatgagaggcagag

SEQ ID NO: 6630276 - DNA, 16 bp, Homo sapiens
agatgagaggcagagg

SEQ ID NO: 6630277 - DNA, 19 bp, Homo sapiens
agatgagattggcatggct

SEQ ID NO: 6630278 - DNA, 17 bp, Homo sapiens
agatgagatttgccagc

SEQ ID NO: 6630279 - DNA, 20 bp, Homo sapiens
agatgagatttgccagcaca

SEQ ID NO: 6630280 - DNA, 16 bp, Homo sapiens
agatgagcaaggacat

SEQ ID NO: 6630281 - DNA, 19 bp, Homo sapiens
agatgagcacttctaagtt

SEQ ID NO: 6630282 - DNA, 23 bp, Homo sapiens
agatgagcttcattgggagttcc

SEQ ID NO: 6630283 - DNA, 16 bp, Homo sapiens
agatgagctttctttt

SEQ ID NO: 6630284 - DNA, 13 bp, Homo sapiens
agatgagcttttc

SEQ ID NO: 6630285 - DNA, 17 bp, Homo sapiens
agatgaggaaacaggcc

SEQ ID NO: 6630286 - DNA, 19 bp, Homo sapiens
agatgaggaaacaggcctc

SEQ ID NO: 6630287 - DNA, 20 bp, Homo sapiens
agatgaggagtaaaattcag

SEQ ID NO: 6630288 - DNA, 14 bp, Homo sapiens
agatgaggccctgc

SEQ ID NO: 6630289 - DNA, 22 bp, Homo sapiens
agatgaggccctgcaccttccc

SEQ ID NO: 6630290 - DNA, 23 bp, Homo sapiens
agatgaggctcagagaggtagca

SEQ ID NO: 6630291 - DNA, 13 bp, Homo sapiens
agatgaggctgga

SEQ ID NO: 6630292 - DNA, 15 bp, Homo sapiens
agatgaggctggata

SEQ ID NO: 6630293 - DNA, 22 bp, Homo sapiens
agatgaggctggataggagagg

SEQ ID NO: 6630294 - DNA, 17 bp, Homo sapiens
agatgagggctggctgc

SEQ ID NO: 6630295 - DNA, 13 bp, Homo sapiens
agatgaggggcca

SEQ ID NO: 6630296 - DNA, 20 bp, Homo sapiens
agatgaggggccactgaccc

SEQ ID NO: 6630297 - DNA, 17 bp, Homo sapiens
agatgagggtgactgtc

SEQ ID NO: 6630298 - DNA, 21 bp, Homo sapiens
agatgagtaaaggagtaagaa

SEQ ID NO: 6630299 - DNA, 14 bp, Homo sapiens
agatgagtcctgtt

SEQ ID NO: 6630300 - DNA, 14 bp, Homo sapiens
agatgagtgggctt

SEQ ID NO: 6630301 - DNA, 17 bp, Homo sapiens
agatgagttatctaaga

SEQ ID NO: 6630302 - DNA, 20 bp, Homo sapiens
agatgagttatctaagaata

SEQ ID NO: 6630303 - DNA, 17 bp, Homo sapiens
agatgagttgcagtttt

SEQ ID NO: 6630304 - DNA, 20 bp, Homo sapiens
agatgagttgcagtttttat

SEQ ID NO: 6630305 - DNA, 22 bp, Homo sapiens
agatgataatcccatactctca

SEQ ID NO: 6630306 - DNA, 24 bp, Homo sapiens
agatgatacttccaagtgataatt

SEQ ID NO: 6630307 - DNA, 18 bp, Homo sapiens
agatgatattacaggact

SEQ ID NO: 6630308 - DNA, 13 bp, Homo sapiens
agatgatcaggga

SEQ ID NO: 6630309 - DNA, 23 bp, Homo sapiens
agatgatcccagtcactcctctc

SEQ ID NO: 6630310 - DNA, 17 bp, Homo sapiens
agatgatcgctgtattt

SEQ ID NO: 6630311 - DNA, 21 bp, Homo sapiens
agatgatcgtgcctataaata

SEQ ID NO: 6630312 - DNA, 16 bp, Homo sapiens
agatgatctactcaga

SEQ ID NO: 6630313 - DNA, 15 bp, Homo sapiens
agatgatctctccac

SEQ ID NO: 6630314 - DNA, 14 bp, Homo sapiens
agatgatgaagaaa

SEQ ID NO: 6630315 - DNA, 16 bp, Homo sapiens
agatgatgaagaaatg

SEQ ID NO: 6630316 - DNA, 17 bp, Homo sapiens
agatgatgatgatgatg

SEQ ID NO: 6630317 - DNA, 16 bp, Homo sapiens
agatgatgctttggaa

SEQ ID NO: 6630318 - DNA, 22 bp, Homo sapiens
agatgatggaaacgcacttaca

SEQ ID NO: 6630319 - DNA, 23 bp, Homo sapiens
agatgatggaaacgcacttacaa

SEQ ID NO: 6630320 - DNA, 17 bp, Homo sapiens
agatgatggccatttct

SEQ ID NO: 6630321 - DNA, 20 bp, Homo sapiens
agatgatggggtcagcaggc

SEQ ID NO: 6630322 - DNA, 22 bp, Homo sapiens
agatgatggggtcagcaggccc

SEQ ID NO: 6630323 - DNA, 24 bp, Homo sapiens
agatgatggggtcagcaggcccag

SEQ ID NO: 6630324 - DNA, 21 bp, Homo sapiens
agatgatgtgatggaacacac

SEQ ID NO: 6630325 - DNA, 18 bp, Homo sapiens
agatgattaaataagatt

SEQ ID NO: 6630326 - DNA, 19 bp, Homo sapiens
agatgattaaataagattc

SEQ ID NO: 6630327 - DNA, 21 bp, Homo sapiens
agatgattaaataagattcta

SEQ ID NO: 6630328 - DNA, 21 bp, Homo sapiens
agatgattcggatttgacaaa

SEQ ID NO: 6630329 - DNA, 13 bp, Homo sapiens
agatgattgaatc

SEQ ID NO: 6630330 - DNA, 20 bp, Homo sapiens
agatgattgttcttttgttt

SEQ ID NO: 6630331 - DNA, 16 bp, Homo sapiens
agatgatttcccccct

SEQ ID NO: 6630332 - DNA, 14 bp, Homo sapiens
agatgatttggtca

SEQ ID NO: 6630333 - DNA, 18 bp, Homo sapiens
agatgattttcctccctg

SEQ ID NO: 6630334 - DNA, 13 bp, Homo sapiens
agatgattttgct

SEQ ID NO: 6630335 - DNA, 15 bp, Homo sapiens
agatgattttgcttt

SEQ ID NO: 6630336 - DNA, 16 bp, Homo sapiens
agatgattttgctttt

SEQ ID NO: 6630337 - DNA, 17 bp, Homo sapiens
agatgattttgcttttc

SEQ ID NO: 6630338 - DNA, 21 bp, Homo sapiens
agatgattttttaaggagctg

SEQ ID NO: 6630339 - DNA, 14 bp, Homo sapiens
agatgcaaagaggc

SEQ ID NO: 6630340 - DNA, 16 bp, Homo sapiens
agatgcaaagaggcaa

SEQ ID NO: 6630341 - DNA, 17 bp, Homo sapiens
agatgcaaagaggcaag

SEQ ID NO: 6630342 - DNA, 17 bp, Homo sapiens
agatgcaaatgttttga

SEQ ID NO: 6630343 - DNA, 15 bp, Homo sapiens
agatgcaaggaccag

SEQ ID NO: 6630344 - DNA, 18 bp, Homo sapiens
agatgcaattgctcccat

SEQ ID NO: 6630345 - DNA, 13 bp, Homo sapiens
agatgcacatgag

SEQ ID NO: 6630346 - DNA, 22 bp, Homo sapiens
agatgcaccaagtacagccttc

SEQ ID NO: 6630347 - DNA, 20 bp, Homo sapiens
agatgcaccaccaagccaag

SEQ ID NO: 6630348 - DNA, 21 bp, Homo sapiens
agatgcaccaccaagccaagg

SEQ ID NO: 6630349 - DNA, 23 bp, Homo sapiens
agatgcaccaccaagccaaggga

SEQ ID NO: 6630350 - DNA, 19 bp, Homo sapiens
agatgcacgtggggcccac

SEQ ID NO: 6630351 - DNA, 13 bp, Homo sapiens
agatgcactcgct

SEQ ID NO: 6630352 - DNA, 23 bp, Homo sapiens
agatgcacttaagttagcctcca

SEQ ID NO: 6630353 - DNA, 22 bp, Homo sapiens
agatgcactttgctttaatata

SEQ ID NO: 6630354 - DNA, 15 bp, Homo sapiens
agatgcagaaaaaga

SEQ ID NO: 6630355 - DNA, 20 bp, Homo sapiens
agatgcagagagccattttg

SEQ ID NO: 6630356 - DNA, 14 bp, Homo sapiens
agatgcagagtaag

SEQ ID NO: 6630357 - DNA, 18 bp, Homo sapiens
agatgcagctcttcctgg

SEQ ID NO: 6630358 - DNA, 12 bp, Homo sapiens
agatgcagctgg

SEQ ID NO: 6630359 - DNA, 13 bp, Homo sapiens
agatgcagctgga

SEQ ID NO: 6630360 - DNA, 17 bp, Homo sapiens
agatgcaggacaggagg

SEQ ID NO: 6630361 - DNA, 20 bp, Homo sapiens
agatgcagtcctcaggaagg

SEQ ID NO: 6630362 - DNA, 22 bp, Homo sapiens
agatgcagttcaaaaacaagac

SEQ ID NO: 6630363 - DNA, 16 bp, Homo sapiens
agatgcagttctgaag

SEQ ID NO: 6630364 - DNA, 20 bp, Homo sapiens
agatgcagttctgaagaaga

SEQ ID NO: 6630365 - DNA, 15 bp, Homo sapiens
agatgcagtttggag

SEQ ID NO: 6630366 - DNA, 20 bp, Homo sapiens
agatgcatatagacacacat

SEQ ID NO: 6630367 - DNA, 19 bp, Homo sapiens
agatgcatcatctcttcct

SEQ ID NO: 6630368 - DNA, 15 bp, Homo sapiens
agatgcatctgtggc

SEQ ID NO: 6630369 - DNA, 20 bp, Homo sapiens
agatgcatctgtggcctggg

SEQ ID NO: 6630370 - DNA, 20 bp, Homo sapiens
agatgcatgttactgccaaa

SEQ ID NO: 6630371 - DNA, 22 bp, Homo sapiens
agatgcattcttggttggctgg

SEQ ID NO: 6630372 - DNA, 14 bp, Homo sapiens
agatgcatttggaa

SEQ ID NO: 6630373 - DNA, 18 bp, Homo sapiens
agatgcatttgggtccag

SEQ ID NO: 6630374 - DNA, 21 bp, Homo sapiens
agatgcatttgggtccaggag

SEQ ID NO: 6630375 - DNA, 22 bp, Homo sapiens
agatgcatttgggtccaggagg

SEQ ID NO: 6630376 - DNA, 19 bp, Homo sapiens
agatgcattttaaatgtct

SEQ ID NO: 6630377 - DNA, 20 bp, Homo sapiens
agatgcattttaaatgtcta

SEQ ID NO: 6630378 - DNA, 19 bp, Homo sapiens
agatgcattttgagtgttt

SEQ ID NO: 6630379 - DNA, 11 bp, Homo sapiens
agatgccaaaa

SEQ ID NO: 6630380 - DNA, 22 bp, Homo sapiens
agatgccaaaccacaagactct

SEQ ID NO: 6630381 - DNA, 12 bp, Homo sapiens
agatgccaactt

SEQ ID NO: 6630382 - DNA, 17 bp, Homo sapiens
agatgccaacttcccac

SEQ ID NO: 6630383 - DNA, 20 bp, Homo sapiens
agatgccaaggaggtcccag

SEQ ID NO: 6630384 - DNA, 16 bp, Homo sapiens
agatgccacacctgct

SEQ ID NO: 6630385 - DNA, 22 bp, Homo sapiens
agatgccagcttctctctccag

SEQ ID NO: 6630386 - DNA, 23 bp, Homo sapiens
agatgccagcttctctctccagg

SEQ ID NO: 6630387 - DNA, 15 bp, Homo sapiens
agatgccatgatatc

SEQ ID NO: 6630388 - DNA, 16 bp, Homo sapiens
agatgccatggcctgt

SEQ ID NO: 6630389 - DNA, 17 bp, Homo sapiens
agatgccatgtgcaggt

SEQ ID NO: 6630390 - DNA, 16 bp, Homo sapiens
agatgccattctccag

SEQ ID NO: 6630391 - DNA, 15 bp, Homo sapiens
agatgcccaaatcct

SEQ ID NO: 6630392 - DNA, 21 bp, Homo sapiens
agatgcccagagggcccaggc

SEQ ID NO: 6630393 - DNA, 14 bp, Homo sapiens
agatgccccattcc

SEQ ID NO: 6630394 - DNA, 14 bp, Homo sapiens
agatgccccctcca

SEQ ID NO: 6630395 - DNA, 17 bp, Homo sapiens
agatgcccctgctccct

SEQ ID NO: 6630396 - DNA, 21 bp, Homo sapiens
agatgcccttgctgggcctgg

SEQ ID NO: 6630397 - DNA, 22 bp, Homo sapiens
agatgcccttgctgggcctggg

SEQ ID NO: 6630398 - DNA, 23 bp, Homo sapiens
agatgcccttgctgggcctgggg

SEQ ID NO: 6630399 - DNA, 18 bp, Homo sapiens
agatgccggagccccaag

SEQ ID NO: 6630400 - DNA, 20 bp, Homo sapiens
agatgcctaaaaattccctt

SEQ ID NO: 6630401 - DNA, 12 bp, Homo sapiens
agatgcctccac

SEQ ID NO: 6630402 - DNA, 22 bp, Homo sapiens
agatgcctccaccccccagaac

SEQ ID NO: 6630403 - DNA, 17 bp, Homo sapiens
agatgcctccaccgctg

SEQ ID NO: 6630404 - DNA, 18 bp, Homo sapiens
agatgcctcctgtcagat

SEQ ID NO: 6630405 - DNA, 16 bp, Homo sapiens
agatgcctccttcctc

SEQ ID NO: 6630406 - DNA, 15 bp, Homo sapiens
agatgcctgatcaga

SEQ ID NO: 6630407 - DNA, 15 bp, Homo sapiens
agatgcctgttaatt

SEQ ID NO: 6630408 - DNA, 18 bp, Homo sapiens
agatgcctgttttgagac

SEQ ID NO: 6630409 - DNA, 19 bp, Homo sapiens
agatgcctgttttgagacc

SEQ ID NO: 6630410 - DNA, 20 bp, Homo sapiens
agatgcgcagccccatctgt

SEQ ID NO: 6630411 - DNA, 23 bp, Homo sapiens
agatgcgcagccccatctgtgca

SEQ ID NO: 6630412 - DNA, 23 bp, Homo sapiens
agatgcgcattctaacctggagg

SEQ ID NO: 6630413 - DNA, 18 bp, Homo sapiens
agatgcggggacaggctg

SEQ ID NO: 6630414 - DNA, 20 bp, Homo sapiens
agatgcggggacaggctgga

SEQ ID NO: 6630415 - DNA, 17 bp, Homo sapiens
agatgcgtttgcctcct

SEQ ID NO: 6630416 - DNA, 15 bp, Homo sapiens
agatgctaataaact

SEQ ID NO: 6630417 - DNA, 17 bp, Homo sapiens
agatgctaatagaaaac

SEQ ID NO: 6630418 - DNA, 14 bp, Homo sapiens
agatgctaatttat

SEQ ID NO: 6630419 - DNA, 11 bp, Homo sapiens
agatgctactg

SEQ ID NO: 6630420 - DNA, 21 bp, Homo sapiens
agatgctactgtcagtgtcct

SEQ ID NO: 6630421 - DNA, 16 bp, Homo sapiens
agatgctagaaaaatg

SEQ ID NO: 6630422 - DNA, 14 bp, Homo sapiens
agatgctagaactc

SEQ ID NO: 6630423 - DNA, 13 bp, Homo sapiens
agatgctatggaa

SEQ ID NO: 6630424 - DNA, 14 bp, Homo sapiens
agatgctattaaag

SEQ ID NO: 6630425 - DNA, 20 bp, Homo sapiens
agatgctcaggtacagagaa

SEQ ID NO: 6630426 - DNA, 20 bp, Homo sapiens
agatgctccaagattctaga

SEQ ID NO: 6630427 - DNA, 13 bp, Homo sapiens
agatgctccaggg

SEQ ID NO: 6630428 - DNA, 23 bp, Homo sapiens
agatgctctatcttgctctgtaa

SEQ ID NO: 6630429 - DNA, 16 bp, Homo sapiens
agatgctctgagaaat

SEQ ID NO: 6630430 - DNA, 20 bp, Homo sapiens
agatgctctgagaaattgaa

SEQ ID NO: 6630431 - DNA, 13 bp, Homo sapiens
agatgctgaatat

SEQ ID NO: 6630432 - DNA, 17 bp, Homo sapiens
agatgctgaatatctgt

SEQ ID NO: 6630433 - DNA, 15 bp, Homo sapiens
agatgctgactggca

SEQ ID NO: 6630434 - DNA, 23 bp, Homo sapiens
agatgctgactgtactcctccca

SEQ ID NO: 6630435 - DNA, 13 bp, Homo sapiens
agatgctgagcca

SEQ ID NO: 6630436 - DNA, 14 bp, Homo sapiens
agatgctgaggccc

SEQ ID NO: 6630437 - DNA, 16 bp, Homo sapiens
agatgctgaggcccct

SEQ ID NO: 6630438 - DNA, 21 bp, Homo sapiens
agatgctgaggcccctaggtg

SEQ ID NO: 6630439 - DNA, 20 bp, Homo sapiens
agatgctgatggagccttcc

SEQ ID NO: 6630440 - DNA, 18 bp, Homo sapiens
agatgctgatgttcagtg

SEQ ID NO: 6630441 - DNA, 20 bp, Homo sapiens
agatgctgatgttcagtgta

SEQ ID NO: 6630442 - DNA, 22 bp, Homo sapiens
agatgctgatgttcagtgtaat

SEQ ID NO: 6630443 - DNA, 19 bp, Homo sapiens
agatgctgcagagtcacaa

SEQ ID NO: 6630444 - DNA, 12 bp, Homo sapiens
agatgctgccta

SEQ ID NO: 6630445 - DNA, 13 bp, Homo sapiens
agatgctggagaa

SEQ ID NO: 6630446 - DNA, 21 bp, Homo sapiens
agatgctggagaagagaggag

SEQ ID NO: 6630447 - DNA, 21 bp, Homo sapiens
agatgctggatgtctgccaat

SEQ ID NO: 6630448 - DNA, 15 bp, Homo sapiens
agatgctggcccagg

SEQ ID NO: 6630449 - DNA, 22 bp, Homo sapiens
agatgctggcccagggcccaga

SEQ ID NO: 6630450 - DNA, 23 bp, Homo sapiens
agatgctggcccagggcccagag

SEQ ID NO: 6630451 - DNA, 23 bp, Homo sapiens
agatgctggcctgcgcctgcacc

SEQ ID NO: 6630452 - DNA, 18 bp, Homo sapiens
agatgctgggagggctga

SEQ ID NO: 6630453 - DNA, 13 bp, Homo sapiens
agatgctgggttg

SEQ ID NO: 6630454 - DNA, 17 bp, Homo sapiens
agatgctggtggaggaa

SEQ ID NO: 6630455 - DNA, 13 bp, Homo sapiens
agatgctgtaaat

SEQ ID NO: 6630456 - DNA, 19 bp, Homo sapiens
agatgctgtagtaactgcc

SEQ ID NO: 6630457 - DNA, 16 bp, Homo sapiens
agatgctgtgagtctt

SEQ ID NO: 6630458 - DNA, 15 bp, Homo sapiens
agatgctgtgcccct

SEQ ID NO: 6630459 - DNA, 15 bp, Homo sapiens
agatgcttctcactg

SEQ ID NO: 6630460 - DNA, 22 bp, Homo sapiens
agatgcttgcggcaaaaggaaa

SEQ ID NO: 6630461 - DNA, 19 bp, Homo sapiens
agatgcttggagcaatcag

SEQ ID NO: 6630462 - DNA, 19 bp, Homo sapiens
agatgctttcctaaatcag

SEQ ID NO: 6630463 - DNA, 13 bp, Homo sapiens
agatgctttgccc

SEQ ID NO: 6630464 - DNA, 21 bp, Homo sapiens
agatgctttgcccaggcttct

SEQ ID NO: 6630465 - DNA, 11 bp, Homo sapiens
agatgctttta

SEQ ID NO: 6630466 - DNA, 17 bp, Homo sapiens
agatgcttttcaaactg

SEQ ID NO: 6630467 - DNA, 17 bp, Homo sapiens
agatgcttttctgtctc

SEQ ID NO: 6630468 - DNA, 22 bp, Homo sapiens
agatgcttttctgtctctgcct

SEQ ID NO: 6630469 - DNA, 17 bp, Homo sapiens
agatgctttttgatcta

SEQ ID NO: 6630470 - DNA, 23 bp, Homo sapiens
agatggaaaaaaaaaacaaaaaa

SEQ ID NO: 6630471 - DNA, 17 bp, Homo sapiens
agatggaaaaacttgtg

SEQ ID NO: 6630472 - DNA, 17 bp, Homo sapiens
agatggaaaaataacaa

SEQ ID NO: 6630473 - DNA, 15 bp, Homo sapiens
agatggaaatacagt

SEQ ID NO: 6630474 - DNA, 22 bp, Homo sapiens
agatggaaattctgaaaactga

SEQ ID NO: 6630475 - DNA, 22 bp, Homo sapiens
agatggaaatttttacctttat

SEQ ID NO: 6630476 - DNA, 22 bp, Homo sapiens
agatggaacccttttggccccc

SEQ ID NO: 6630477 - DNA, 17 bp, Homo sapiens
agatggaaccgcaggaa

SEQ ID NO: 6630478 - DNA, 18 bp, Homo sapiens
agatggaaccgcaggaag

SEQ ID NO: 6630479 - DNA, 20 bp, Homo sapiens
agatggaaccgcaggaagct

SEQ ID NO: 6630480 - DNA, 15 bp, Homo sapiens
agatggaagagtcat

SEQ ID NO: 6630481 - DNA, 12 bp, Homo sapiens
agatggaagctt

SEQ ID NO: 6630482 - DNA, 22 bp, Homo sapiens
agatggaagcttactctctgct

SEQ ID NO: 6630483 - DNA, 19 bp, Homo sapiens
agatggaagcttgttgaaa

SEQ ID NO: 6630484 - DNA, 17 bp, Homo sapiens
agatggaaggaatcaaa

SEQ ID NO: 6630485 - DNA, 15 bp, Homo sapiens
agatggaaggccttt

SEQ ID NO: 6630486 - DNA, 20 bp, Homo sapiens
agatggaagtcacctttctg

SEQ ID NO: 6630487 - DNA, 22 bp, Homo sapiens
agatggaagttgcagtgagctg

SEQ ID NO: 6630488 - DNA, 15 bp, Homo sapiens
agatggaatgctgtg

SEQ ID NO: 6630489 - DNA, 17 bp, Homo sapiens
agatggacacgagccac

SEQ ID NO: 6630490 - DNA, 18 bp, Homo sapiens
agatggacactgccaaga

SEQ ID NO: 6630491 - DNA, 14 bp, Homo sapiens
agatggacatggct

SEQ ID NO: 6630492 - DNA, 15 bp, Homo sapiens
agatggaccaaaaga

SEQ ID NO: 6630493 - DNA, 12 bp, Homo sapiens
agatggaccagt

SEQ ID NO: 6630494 - DNA, 17 bp, Homo sapiens
agatggaccagtagaca

SEQ ID NO: 6630495 - DNA, 14 bp, Homo sapiens
agatggaccccagc

SEQ ID NO: 6630496 - DNA, 21 bp, Homo sapiens
agatggacccctcccttgctc

SEQ ID NO: 6630497 - DNA, 19 bp, Homo sapiens
agatggacgcaggccctgt

SEQ ID NO: 6630498 - DNA, 21 bp, Homo sapiens
agatggactcaggatccagtg

SEQ ID NO: 6630499 - DNA, 22 bp, Homo sapiens
agatggactcaggatccagtga

SEQ ID NO: 6630500 - DNA, 17 bp, Homo sapiens
agatggagaaacaggct

SEQ ID NO: 6630501 - DNA, 15 bp, Homo sapiens
agatggagaataaat

SEQ ID NO: 6630502 - DNA, 19 bp, Homo sapiens
agatggagacaccctctgg

SEQ ID NO: 6630503 - DNA, 13 bp, Homo sapiens
agatggagaggaa

SEQ ID NO: 6630504 - DNA, 14 bp, Homo sapiens
agatggagaggaag

SEQ ID NO: 6630505 - DNA, 15 bp, Homo sapiens
agatggagaggaaga

SEQ ID NO: 6630506 - DNA, 18 bp, Homo sapiens
agatggagaggaagaaac

SEQ ID NO: 6630507 - DNA, 19 bp, Homo sapiens
agatggagaggaagaaacg

SEQ ID NO: 6630508 - DNA, 14 bp, Homo sapiens
agatggagaggcat

SEQ ID NO: 6630509 - DNA, 19 bp, Homo sapiens
agatggagggcttggccca

SEQ ID NO: 6630510 - DNA, 22 bp, Homo sapiens
agatggagggcttggcccagcg

SEQ ID NO: 6630511 - DNA, 19 bp, Homo sapiens
agatggagggggctggggt

SEQ ID NO: 6630512 - DNA, 18 bp, Homo sapiens
agatggaggtagggctgg

SEQ ID NO: 6630513 - DNA, 13 bp, Homo sapiens
agatggagtccct

SEQ ID NO: 6630514 - DNA, 23 bp, Homo sapiens
agatggagtcccttttcattctc

SEQ ID NO: 6630515 - DNA, 20 bp, Homo sapiens
agatggagtctcactcttgt

SEQ ID NO: 6630516 - DNA, 20 bp, Homo sapiens
agatggagtctcgctctgct

SEQ ID NO: 6630517 - DNA, 20 bp, Homo sapiens
agatggagttgtattttgac

SEQ ID NO: 6630518 - DNA, 14 bp, Homo sapiens
agatggagtttcta

SEQ ID NO: 6630519 - DNA, 18 bp, Homo sapiens
agatggagtttctaaggt

SEQ ID NO: 6630520 - DNA, 18 bp, Homo sapiens
agatggagtttctctctt

SEQ ID NO: 6630521 - DNA, 20 bp, Homo sapiens
agatggataaactgagcctc

SEQ ID NO: 6630522 - DNA, 15 bp, Homo sapiens
agatggatattagat

SEQ ID NO: 6630523 - DNA, 14 bp, Homo sapiens
agatggatgtagat

SEQ ID NO: 6630524 - DNA, 18 bp, Homo sapiens
agatggatgtatttgtag

SEQ ID NO: 6630525 - DNA, 16 bp, Homo sapiens
agatggattctcagat

SEQ ID NO: 6630526 - DNA, 23 bp, Homo sapiens
agatggattctccactcagttgc

SEQ ID NO: 6630527 - DNA, 14 bp, Homo sapiens
agatggcaacattg

SEQ ID NO: 6630528 - DNA, 15 bp, Homo sapiens
agatggcaacattgg

SEQ ID NO: 6630529 - DNA, 22 bp, Homo sapiens
agatggcaagagggtgacagct

SEQ ID NO: 6630530 - DNA, 24 bp, Homo sapiens
agatggcaatgggtactccagcag

SEQ ID NO: 6630531 - DNA, 16 bp, Homo sapiens
agatggcacagggcat

SEQ ID NO: 6630532 - DNA, 22 bp, Homo sapiens
agatggcacagggcatgaaatg

SEQ ID NO: 6630533 - DNA, 23 bp, Homo sapiens
agatggcacagggcatgaaatga

SEQ ID NO: 6630534 - DNA, 20 bp, Homo sapiens
agatggcacctgtggccaga

SEQ ID NO: 6630535 - DNA, 17 bp, Homo sapiens
agatggcactgtccagg

SEQ ID NO: 6630536 - DNA, 18 bp, Homo sapiens
agatggcactgtccaggg

SEQ ID NO: 6630537 - DNA, 20 bp, Homo sapiens
agatggcactgtccagggcc

SEQ ID NO: 6630538 - DNA, 21 bp, Homo sapiens
agatggcactgtccagggccc

SEQ ID NO: 6630539 - DNA, 22 bp, Homo sapiens
agatggcactgtccagggccca

SEQ ID NO: 6630540 - DNA, 14 bp, Homo sapiens
agatggcagctttt

SEQ ID NO: 6630541 - DNA, 21 bp, Homo sapiens
agatggcagcttttaaaagat

SEQ ID NO: 6630542 - DNA, 20 bp, Homo sapiens
agatggccagccccttagac

SEQ ID NO: 6630543 - DNA, 19 bp, Homo sapiens
agatggcccaagggatggc

SEQ ID NO: 6630544 - DNA, 19 bp, Homo sapiens
agatggcccagctccccaa

SEQ ID NO: 6630545 - DNA, 15 bp, Homo sapiens
agatggcccctccac

SEQ ID NO: 6630546 - DNA, 17 bp, Homo sapiens
agatggcccctccactg

SEQ ID NO: 6630547 - DNA, 21 bp, Homo sapiens
agatggcccggatgctgcttc

SEQ ID NO: 6630548 - DNA, 19 bp, Homo sapiens
agatggcctgagaagagag

SEQ ID NO: 6630549 - DNA, 19 bp, Homo sapiens
agatggcgaccaccaaagt

SEQ ID NO: 6630550 - DNA, 20 bp, Homo sapiens
agatggcgaccaccaaagtc

SEQ ID NO: 6630551 - DNA, 11 bp, Homo sapiens
agatggctccc

SEQ ID NO: 6630552 - DNA, 16 bp, Homo sapiens
agatggctccctgggc

SEQ ID NO: 6630553 - DNA, 15 bp, Homo sapiens
agatggctcctctca

SEQ ID NO: 6630554 - DNA, 16 bp, Homo sapiens
agatggctgctgctca

SEQ ID NO: 6630555 - DNA, 13 bp, Homo sapiens
agatggctgtgaa

SEQ ID NO: 6630556 - DNA, 14 bp, Homo sapiens
agatggctgtgcct

SEQ ID NO: 6630557 - DNA, 20 bp, Homo sapiens
agatggctgtgcctctgcct

SEQ ID NO: 6630558 - DNA, 21 bp, Homo sapiens
agatggctgtggcatttccaa

SEQ ID NO: 6630559 - DNA, 18 bp, Homo sapiens
agatggcttattttttaa

SEQ ID NO: 6630560 - DNA, 21 bp, Homo sapiens
agatggcttccgtgagacaca

SEQ ID NO: 6630561 - DNA, 19 bp, Homo sapiens
agatggcttcggagggccg

SEQ ID NO: 6630562 - DNA, 21 bp, Homo sapiens
agatggcttcggagggccgca

SEQ ID NO: 6630563 - DNA, 14 bp, Homo sapiens
agatggctttcagg

SEQ ID NO: 6630564 - DNA, 14 bp, Homo sapiens
agatgggaaaacca

SEQ ID NO: 6630565 - DNA, 19 bp, Homo sapiens
agatgggaagggcttatct

SEQ ID NO: 6630566 - DNA, 23 bp, Homo sapiens
agatgggaaggttagaaaggcag

SEQ ID NO: 6630567 - DNA, 17 bp, Homo sapiens
agatgggaatgaagctt

SEQ ID NO: 6630568 - DNA, 13 bp, Homo sapiens
agatgggacaagc

SEQ ID NO: 6630569 - DNA, 20 bp, Homo sapiens
agatgggacaagcagtccct

SEQ ID NO: 6630570 - DNA, 15 bp, Homo sapiens
agatgggacagcaac

SEQ ID NO: 6630571 - DNA, 19 bp, Homo sapiens
agatgggactgggagggcc

SEQ ID NO: 6630572 - DNA, 20 bp, Homo sapiens
agatgggagagcaacaagta

SEQ ID NO: 6630573 - DNA, 23 bp, Homo sapiens
agatgggagctcctctcctggag

SEQ ID NO: 6630574 - DNA, 19 bp, Homo sapiens
agatgggaggaaagagagc

SEQ ID NO: 6630575 - DNA, 14 bp, Homo sapiens
agatgggaggagac

SEQ ID NO: 6630576 - DNA, 17 bp, Homo sapiens
agatgggaggagaccag

SEQ ID NO: 6630577 - DNA, 22 bp, Homo sapiens
agatgggaggggaaaggggaga

SEQ ID NO: 6630578 - DNA, 16 bp, Homo sapiens
agatgggatgcttgcc

SEQ ID NO: 6630579 - DNA, 18 bp, Homo sapiens
agatgggcagtaaacagg

SEQ ID NO: 6630580 - DNA, 22 bp, Homo sapiens
agatgggcatatgtgtcagtgg

SEQ ID NO: 6630581 - DNA, 18 bp, Homo sapiens
agatgggcatcttttgta

SEQ ID NO: 6630582 - DNA, 20 bp, Homo sapiens
agatgggcatcttttgtatt

SEQ ID NO: 6630583 - DNA, 21 bp, Homo sapiens
agatgggccggcccccttcct

SEQ ID NO: 6630584 - DNA, 17 bp, Homo sapiens
agatgggcttgttttct

SEQ ID NO: 6630585 - DNA, 19 bp, Homo sapiens
agatggggaccagcagccc

SEQ ID NO: 6630586 - DNA, 19 bp, Homo sapiens
agatggggcatataataaa

SEQ ID NO: 6630587 - DNA, 17 bp, Homo sapiens
agatggggcctgggctg

SEQ ID NO: 6630588 - DNA, 18 bp, Homo sapiens
agatgggggaaagcacag

SEQ ID NO: 6630589 - DNA, 16 bp, Homo sapiens
agatgggggcaagaag

SEQ ID NO: 6630590 - DNA, 17 bp, Homo sapiens
agatgggggcaagaaga

SEQ ID NO: 6630591 - DNA, 16 bp, Homo sapiens
agatgggggcagggct

SEQ ID NO: 6630592 - DNA, 17 bp, Homo sapiens
agatgggggcagggctg

SEQ ID NO: 6630593 - DNA, 19 bp, Homo sapiens
agatgggggcctctctgga

SEQ ID NO: 6630594 - DNA, 15 bp, Homo sapiens
agatgggggctggag

SEQ ID NO: 6630595 - DNA, 18 bp, Homo sapiens
agatgggggctggagggg

SEQ ID NO: 6630596 - DNA, 14 bp, Homo sapiens
agatgggggcttct

SEQ ID NO: 6630597 - DNA, 19 bp, Homo sapiens
agatggggtctgtaaaatc

SEQ ID NO: 6630598 - DNA, 21 bp, Homo sapiens
agatggggtctgtgactggat

SEQ ID NO: 6630599 - DNA, 23 bp, Homo sapiens
agatgggtccaggggtctgtctg

SEQ ID NO: 6630600 - DNA, 16 bp, Homo sapiens
agatgggtccctggcc

SEQ ID NO: 6630601 - DNA, 20 bp, Homo sapiens
agatgggtccctggccacca

SEQ ID NO: 6630602 - DNA, 21 bp, Homo sapiens
agatgggtctggctgagctga

SEQ ID NO: 6630603 - DNA, 17 bp, Homo sapiens
agatgggtgaaggctgg

SEQ ID NO: 6630604 - DNA, 16 bp, Homo sapiens
agatgggtgatatata

SEQ ID NO: 6630605 - DNA, 23 bp, Homo sapiens
agatgggtgattatgaaatgcca

SEQ ID NO: 6630606 - DNA, 22 bp, Homo sapiens
agatgggtggatcacttgaggt

SEQ ID NO: 6630607 - DNA, 15 bp, Homo sapiens
agatgggtgggagga

SEQ ID NO: 6630608 - DNA, 13 bp, Homo sapiens
agatgggtgggga

SEQ ID NO: 6630609 - DNA, 19 bp, Homo sapiens
agatgggtgggggctcctg

SEQ ID NO: 6630610 - DNA, 21 bp, Homo sapiens
agatgggtgggggctcctggt

SEQ ID NO: 6630611 - DNA, 19 bp, Homo sapiens
agatggtaagacctctgag

SEQ ID NO: 6630612 - DNA, 23 bp, Homo sapiens
agatggtaagacctctgagacca

SEQ ID NO: 6630613 - DNA, 15 bp, Homo sapiens
agatggtaatctttt

SEQ ID NO: 6630614 - DNA, 18 bp, Homo sapiens
agatggtactgctgaggt

SEQ ID NO: 6630615 - DNA, 22 bp, Homo sapiens
agatggtagcagataaagacag

SEQ ID NO: 6630616 - DNA, 22 bp, Homo sapiens
agatggtatgcagcatacaaaa

SEQ ID NO: 6630617 - DNA, 14 bp, Homo sapiens
agatggtcagtgtg

SEQ ID NO: 6630618 - DNA, 16 bp, Homo sapiens
agatggtcatattatt

SEQ ID NO: 6630619 - DNA, 22 bp, Homo sapiens
agatggtcatatttaaacagaa

SEQ ID NO: 6630620 - DNA, 19 bp, Homo sapiens
agatggtccatttgttcct

SEQ ID NO: 6630621 - DNA, 21 bp, Homo sapiens
agatggtctgcatcagctttt

SEQ ID NO: 6630622 - DNA, 20 bp, Homo sapiens
agatggtgaagcattctccc

SEQ ID NO: 6630623 - DNA, 15 bp, Homo sapiens
agatggtgctgctaa

SEQ ID NO: 6630624 - DNA, 17 bp, Homo sapiens
agatggtgctgctaatt

SEQ ID NO: 6630625 - DNA, 14 bp, Homo sapiens
agatggtgtcattt

SEQ ID NO: 6630626 - DNA, 17 bp, Homo sapiens
agatggttaaaaaggcc

SEQ ID NO: 6630627 - DNA, 18 bp, Homo sapiens
agatggttaaaaaggcca

SEQ ID NO: 6630628 - DNA, 17 bp, Homo sapiens
agatggttaaacatttt

SEQ ID NO: 6630629 - DNA, 19 bp, Homo sapiens
agatggttacactgttaga

SEQ ID NO: 6630630 - DNA, 18 bp, Homo sapiens
agatggttcaaagataca

SEQ ID NO: 6630631 - DNA, 19 bp, Homo sapiens
agatggttcaaagatacaa

SEQ ID NO: 6630632 - DNA, 14 bp, Homo sapiens
agatggttgtgtat

SEQ ID NO: 6630633 - DNA, 18 bp, Homo sapiens
agatggtttcaattcaga

SEQ ID NO: 6630634 - DNA, 22 bp, Homo sapiens
agatggttttataatctgattt

SEQ ID NO: 6630635 - DNA, 18 bp, Homo sapiens
agatgtaaatcgggaagg

SEQ ID NO: 6630636 - DNA, 16 bp, Homo sapiens
agatgtaaattgaaga

SEQ ID NO: 6630637 - DNA, 21 bp, Homo sapiens
agatgtaactaggccatttgt

SEQ ID NO: 6630638 - DNA, 20 bp, Homo sapiens
agatgtaagagctttacaaa

SEQ ID NO: 6630639 - DNA, 15 bp, Homo sapiens
agatgtaatgacaga

SEQ ID NO: 6630640 - DNA, 22 bp, Homo sapiens
agatgtaatgtagttctttgtt

SEQ ID NO: 6630641 - DNA, 13 bp, Homo sapiens
agatgtaattttg

SEQ ID NO: 6630642 - DNA, 19 bp, Homo sapiens
agatgtaattttgtgtaag

SEQ ID NO: 6630643 - DNA, 14 bp, Homo sapiens
agatgtacatttaa

SEQ ID NO: 6630644 - DNA, 17 bp, Homo sapiens
agatgtacatttaataa

SEQ ID NO: 6630645 - DNA, 23 bp, Homo sapiens
agatgtaccaattgtcaaattac

SEQ ID NO: 6630646 - DNA, 14 bp, Homo sapiens
agatgtaccatgtt

SEQ ID NO: 6630647 - DNA, 20 bp, Homo sapiens
agatgtaccatgttaaagag

SEQ ID NO: 6630648 - DNA, 16 bp, Homo sapiens
agatgtacctggtgga

SEQ ID NO: 6630649 - DNA, 14 bp, Homo sapiens
agatgtactgagag

SEQ ID NO: 6630650 - DNA, 20 bp, Homo sapiens
agatgtagatataaatataa

SEQ ID NO: 6630651 - DNA, 15 bp, Homo sapiens
agatgtagatttatt

SEQ ID NO: 6630652 - DNA, 18 bp, Homo sapiens
agatgtagatttatttca

SEQ ID NO: 6630653 - DNA, 21 bp, Homo sapiens
agatgtagcaaaacgcatgga

SEQ ID NO: 6630654 - DNA, 23 bp, Homo sapiens
agatgtagcaaaccctgtcaaac

SEQ ID NO: 6630655 - DNA, 22 bp, Homo sapiens
agatgtagcccctctcctggaa

SEQ ID NO: 6630656 - DNA, 13 bp, Homo sapiens
agatgtaggaggg

SEQ ID NO: 6630657 - DNA, 22 bp, Homo sapiens
agatgtaggggaagagatgttt

SEQ ID NO: 6630658 - DNA, 23 bp, Homo sapiens
agatgtaggggaagagatgttta

SEQ ID NO: 6630659 - DNA, 21 bp, Homo sapiens
agatgtagtcttgacgaatat

SEQ ID NO: 6630660 - DNA, 19 bp, Homo sapiens
agatgtatcatgattgatt

SEQ ID NO: 6630661 - DNA, 17 bp, Homo sapiens
agatgtatcattaatgt

SEQ ID NO: 6630662 - DNA, 12 bp, Homo sapiens
agatgtatcctt

SEQ ID NO: 6630663 - DNA, 17 bp, Homo sapiens
agatgtatccttccaat

SEQ ID NO: 6630664 - DNA, 15 bp, Homo sapiens
agatgtatgaaggct

SEQ ID NO: 6630665 - DNA, 20 bp, Homo sapiens
agatgtatgctttgaatgca

SEQ ID NO: 6630666 - DNA, 20 bp, Homo sapiens
agatgtatggatttccagtt

SEQ ID NO: 6630667 - DNA, 22 bp, Homo sapiens
agatgtatgtacttcatgctgt

SEQ ID NO: 6630668 - DNA, 16 bp, Homo sapiens
agatgtatgttgctat

SEQ ID NO: 6630669 - DNA, 17 bp, Homo sapiens
agatgtattttcaataa

SEQ ID NO: 6630670 - DNA, 13 bp, Homo sapiens
agatgtatttttg

SEQ ID NO: 6630671 - DNA, 13 bp, Homo sapiens
agatgtcaaatat

SEQ ID NO: 6630672 - DNA, 22 bp, Homo sapiens
agatgtcaagctggccgtggag

SEQ ID NO: 6630673 - DNA, 22 bp, Homo sapiens
agatgtcaataggaattgcatt

SEQ ID NO: 6630674 - DNA, 15 bp, Homo sapiens
agatgtcagactggc

SEQ ID NO: 6630675 - DNA, 19 bp, Homo sapiens
agatgtcagcttcccagcc

SEQ ID NO: 6630676 - DNA, 19 bp, Homo sapiens
agatgtcagtctgtccacg

SEQ ID NO: 6630677 - DNA, 13 bp, Homo sapiens
agatgtcatcaga

SEQ ID NO: 6630678 - DNA, 15 bp, Homo sapiens
agatgtcatcagagc

SEQ ID NO: 6630679 - DNA, 22 bp, Homo sapiens
agatgtcatcagagctcctctg

SEQ ID NO: 6630680 - DNA, 14 bp, Homo sapiens
agatgtcatgagga

SEQ ID NO: 6630681 - DNA, 21 bp, Homo sapiens
agatgtccatcagatgacaag

SEQ ID NO: 6630682 - DNA, 21 bp, Homo sapiens
agatgtccatttttacaagtt

SEQ ID NO: 6630683 - DNA, 15 bp, Homo sapiens
agatgtcccacaggg

SEQ ID NO: 6630684 - DNA, 16 bp, Homo sapiens
agatgtcccttgatgc

SEQ ID NO: 6630685 - DNA, 22 bp, Homo sapiens
agatgtcccttgatgcacagag

SEQ ID NO: 6630686 - DNA, 23 bp, Homo sapiens
agatgtcccttgatgcacagaga

SEQ ID NO: 6630687 - DNA, 24 bp, Homo sapiens
agatgtcccttgatgcacagagaa

SEQ ID NO: 6630688 - DNA, 22 bp, Homo sapiens
agatgtccctttcttggccagt

SEQ ID NO: 6630689 - DNA, 20 bp, Homo sapiens
agatgtccgtctctcttgct

SEQ ID NO: 6630690 - DNA, 17 bp, Homo sapiens
agatgtcctaatggtga

SEQ ID NO: 6630691 - DNA, 16 bp, Homo sapiens
agatgtctcccctgcc

SEQ ID NO: 6630692 - DNA, 22 bp, Homo sapiens
agatgtctcctcaagcctgtgg

SEQ ID NO: 6630693 - DNA, 14 bp, Homo sapiens
agatgtctctaaaa

SEQ ID NO: 6630694 - DNA, 14 bp, Homo sapiens
agatgtctctgggg

SEQ ID NO: 6630695 - DNA, 17 bp, Homo sapiens
agatgtctgtgtataca

SEQ ID NO: 6630696 - DNA, 19 bp, Homo sapiens
agatgtctgtgtatacata

SEQ ID NO: 6630697 - DNA, 11 bp, Homo sapiens
agatgtctgtt

SEQ ID NO: 6630698 - DNA, 17 bp, Homo sapiens
agatgtctgttctaagt

SEQ ID NO: 6630699 - DNA, 18 bp, Homo sapiens
agatgtcttaacctcagg

SEQ ID NO: 6630700 - DNA, 15 bp, Homo sapiens
agatgtcttccctgg

SEQ ID NO: 6630701 - DNA, 16 bp, Homo sapiens
agatgtcttccctggg

SEQ ID NO: 6630702 - DNA, 18 bp, Homo sapiens
agatgtcttctgcctgtt

SEQ ID NO: 6630703 - DNA, 15 bp, Homo sapiens
agatgtctttaggca

SEQ ID NO: 6630704 - DNA, 17 bp, Homo sapiens
agatgtcttttatagtg

SEQ ID NO: 6630705 - DNA, 17 bp, Homo sapiens
agatgtgaaaatatact

SEQ ID NO: 6630706 - DNA, 15 bp, Homo sapiens
agatgtgaaaattac

SEQ ID NO: 6630707 - DNA, 11 bp, Homo sapiens
agatgtgaatt

SEQ ID NO: 6630708 - DNA, 16 bp, Homo sapiens
agatgtgaattattga

SEQ ID NO: 6630709 - DNA, 20 bp, Homo sapiens
agatgtgacccaccagtgcc

SEQ ID NO: 6630710 - DNA, 17 bp, Homo sapiens
agatgtgataaggatca

SEQ ID NO: 6630711 - DNA, 17 bp, Homo sapiens
agatgtgatcaggcccc

SEQ ID NO: 6630712 - DNA, 12 bp, Homo sapiens
agatgtgatgct

SEQ ID NO: 6630713 - DNA, 20 bp, Homo sapiens
agatgtgatttaatagtgtt

SEQ ID NO: 6630714 - DNA, 16 bp, Homo sapiens
agatgtgcaaatgcaa

SEQ ID NO: 6630715 - DNA, 19 bp, Homo sapiens
agatgtgcaataatttgta

SEQ ID NO: 6630716 - DNA, 15 bp, Homo sapiens
agatgtgcacccatg

SEQ ID NO: 6630717 - DNA, 22 bp, Homo sapiens
agatgtgcagcagattggaagg

SEQ ID NO: 6630718 - DNA, 15 bp, Homo sapiens
agatgtgcaggctcc

SEQ ID NO: 6630719 - DNA, 19 bp, Homo sapiens
agatgtgcatttcacctgt

SEQ ID NO: 6630720 - DNA, 18 bp, Homo sapiens
agatgtgccaataaccaa

SEQ ID NO: 6630721 - DNA, 15 bp, Homo sapiens
agatgtgcccagagt

SEQ ID NO: 6630722 - DNA, 23 bp, Homo sapiens
agatgtgcccagagtagcccagg

SEQ ID NO: 6630723 - DNA, 18 bp, Homo sapiens
agatgtgcctgtgggagg

SEQ ID NO: 6630724 - DNA, 20 bp, Homo sapiens
agatgtgctcccaccaggca

SEQ ID NO: 6630725 - DNA, 22 bp, Homo sapiens
agatgtgctcccaccaggcagc

SEQ ID NO: 6630726 - DNA, 17 bp, Homo sapiens
agatgtggaaaagccaa

SEQ ID NO: 6630727 - DNA, 22 bp, Homo sapiens
agatgtggaaaagccaagaggc

SEQ ID NO: 6630728 - DNA, 16 bp, Homo sapiens
agatgtggacatgcac

SEQ ID NO: 6630729 - DNA, 14 bp, Homo sapiens
agatgtggagccag

SEQ ID NO: 6630730 - DNA, 20 bp, Homo sapiens
agatgtggatccctttagaa

SEQ ID NO: 6630731 - DNA, 22 bp, Homo sapiens
agatgtgggctcagatcctggg

SEQ ID NO: 6630732 - DNA, 21 bp, Homo sapiens
agatgtggttgcataaggttt

SEQ ID NO: 6630733 - DNA, 17 bp, Homo sapiens
agatgtggtttttaatt

SEQ ID NO: 6630734 - DNA, 22 bp, Homo sapiens
agatgtgtccatgtgaaattta

SEQ ID NO: 6630735 - DNA, 20 bp, Homo sapiens
agatgtgtctgggagagcct

SEQ ID NO: 6630736 - DNA, 21 bp, Homo sapiens
agatgtgtctgggagagcctg

SEQ ID NO: 6630737 - DNA, 19 bp, Homo sapiens
agatgtgtggactgtggca

SEQ ID NO: 6630738 - DNA, 13 bp, Homo sapiens
agatgtgtgttga

SEQ ID NO: 6630739 - DNA, 19 bp, Homo sapiens
agatgtgtgttgatactgt

SEQ ID NO: 6630740 - DNA, 20 bp, Homo sapiens
agatgtgtgttgatactgtt

SEQ ID NO: 6630741 - DNA, 23 bp, Homo sapiens
agatgtgttcctccattttctta

SEQ ID NO: 6630742 - DNA, 17 bp, Homo sapiens
agatgtgttcctcctgc

SEQ ID NO: 6630743 - DNA, 15 bp, Homo sapiens
agatgttaaaataaa

SEQ ID NO: 6630744 - DNA, 17 bp, Homo sapiens
agatgttaaaataaatg

SEQ ID NO: 6630745 - DNA, 14 bp, Homo sapiens
agatgttaaatgga

SEQ ID NO: 6630746 - DNA, 13 bp, Homo sapiens
agatgttaacagt

SEQ ID NO: 6630747 - DNA, 17 bp, Homo sapiens
agatgttaacagtattt

SEQ ID NO: 6630748 - DNA, 14 bp, Homo sapiens
agatgttaatttac

SEQ ID NO: 6630749 - DNA, 23 bp, Homo sapiens
agatgttacaagtttatatatat

SEQ ID NO: 6630750 - DNA, 15 bp, Homo sapiens
agatgttagatattt

SEQ ID NO: 6630751 - DNA, 22 bp, Homo sapiens
agatgttagtgtttagataata

SEQ ID NO: 6630752 - DNA, 19 bp, Homo sapiens
agatgttatattaaagaaa

SEQ ID NO: 6630753 - DNA, 19 bp, Homo sapiens
agatgttatatttttctta

SEQ ID NO: 6630754 - DNA, 21 bp, Homo sapiens
agatgttatatttttcttaaa

SEQ ID NO: 6630755 - DNA, 18 bp, Homo sapiens
agatgttcaatagaacat

SEQ ID NO: 6630756 - DNA, 21 bp, Homo sapiens
agatgttcaatagaacatgca

SEQ ID NO: 6630757 - DNA, 18 bp, Homo sapiens
agatgttcagtcattttt

SEQ ID NO: 6630758 - DNA, 19 bp, Homo sapiens
agatgttccagtgaggaac

SEQ ID NO: 6630759 - DNA, 20 bp, Homo sapiens
agatgttcgctcgtgcagta

SEQ ID NO: 6630760 - DNA, 20 bp, Homo sapiens
agatgttctaagtctttcca

SEQ ID NO: 6630761 - DNA, 21 bp, Homo sapiens
agatgttctaagtctttccat

SEQ ID NO: 6630762 - DNA, 11 bp, Homo sapiens
agatgttctag

SEQ ID NO: 6630763 - DNA, 12 bp, Homo sapiens
agatgttctcta

SEQ ID NO: 6630764 - DNA, 21 bp, Homo sapiens
agatgttgaagaatacagtta

SEQ ID NO: 6630765 - DNA, 16 bp, Homo sapiens
agatgttgaggggagg

SEQ ID NO: 6630766 - DNA, 16 bp, Homo sapiens
agatgttgatttttac

SEQ ID NO: 6630767 - DNA, 23 bp, Homo sapiens
agatgttgatttttactgtgttt

SEQ ID NO: 6630768 - DNA, 15 bp, Homo sapiens
agatgttggtcttgg

SEQ ID NO: 6630769 - DNA, 21 bp, Homo sapiens
agatgttggtcttggtcattt

SEQ ID NO: 6630770 - DNA, 17 bp, Homo sapiens
agatgttggtggtgcag

SEQ ID NO: 6630771 - DNA, 14 bp, Homo sapiens
agatgttgtcttgc

SEQ ID NO: 6630772 - DNA, 16 bp, Homo sapiens
agatgttgtcttggct

SEQ ID NO: 6630773 - DNA, 18 bp, Homo sapiens
agatgtttaacaaatcta

SEQ ID NO: 6630774 - DNA, 13 bp, Homo sapiens
agatgtttacatt

SEQ ID NO: 6630775 - DNA, 18 bp, Homo sapiens
agatgtttatctgacaca

SEQ ID NO: 6630776 - DNA, 22 bp, Homo sapiens
agatgtttattcttctagagtt

SEQ ID NO: 6630777 - DNA, 15 bp, Homo sapiens
agatgtttatttaga

SEQ ID NO: 6630778 - DNA, 20 bp, Homo sapiens
agatgtttatttagaaactg

SEQ ID NO: 6630779 - DNA, 14 bp, Homo sapiens
agatgtttcacacc

SEQ ID NO: 6630780 - DNA, 23 bp, Homo sapiens
agatgtttcacaccggaaggttt

SEQ ID NO: 6630781 - DNA, 14 bp, Homo sapiens
agatgtttcacgaa

SEQ ID NO: 6630782 - DNA, 19 bp, Homo sapiens
agatgtttctcattttaaa

SEQ ID NO: 6630783 - DNA, 14 bp, Homo sapiens
agatgtttcttata

SEQ ID NO: 6630784 - DNA, 19 bp, Homo sapiens
agatgtttgatagattttc

SEQ ID NO: 6630785 - DNA, 14 bp, Homo sapiens
agatgtttgcctca

SEQ ID NO: 6630786 - DNA, 17 bp, Homo sapiens
agatgtttggaaaccac

SEQ ID NO: 6630787 - DNA, 21 bp, Homo sapiens
agatgtttggcaagaaatccc

SEQ ID NO: 6630788 - DNA, 14 bp, Homo sapiens
agatgtttgttttc

SEQ ID NO: 6630789 - DNA, 11 bp, Homo sapiens
agatgttttaa

SEQ ID NO: 6630790 - DNA, 23 bp, Homo sapiens
agatgttttaacttatttatatg

SEQ ID NO: 6630791 - DNA, 14 bp, Homo sapiens
agatgttttacaaa

SEQ ID NO: 6630792 - DNA, 19 bp, Homo sapiens
agatgttttagagataaat

SEQ ID NO: 6630793 - DNA, 20 bp, Homo sapiens
agatgttttccatttgggca

SEQ ID NO: 6630794 - DNA, 21 bp, Homo sapiens
agatgttttgggatcaggagc

SEQ ID NO: 6630795 - DNA, 21 bp, Homo sapiens
agatgttttgtataaaatctg

SEQ ID NO: 6630796 - DNA, 18 bp, Homo sapiens
agatgtttttaaaagttt

SEQ ID NO: 6630797 - DNA, 13 bp, Homo sapiens
agatgtttttaga

SEQ ID NO: 6630798 - DNA, 14 bp, Homo sapiens
agatgtttttagag

SEQ ID NO: 6630799 - DNA, 18 bp, Homo sapiens
agattaaaaagtaaaaga

SEQ ID NO: 6630800 - DNA, 17 bp, Homo sapiens
agattaaaaccacagaa

SEQ ID NO: 6630801 - DNA, 20 bp, Homo sapiens
agattaaaaccacagaacag

SEQ ID NO: 6630802 - DNA, 17 bp, Homo sapiens
agattaaaatatttgcc

SEQ ID NO: 6630803 - DNA, 20 bp, Homo sapiens
agattaaaattagtgagatt

SEQ ID NO: 6630804 - DNA, 17 bp, Homo sapiens
agattaaagattgcttt

SEQ ID NO: 6630805 - DNA, 16 bp, Homo sapiens
agattaaaggaaggaa

SEQ ID NO: 6630806 - DNA, 16 bp, Homo sapiens
agattaaatatagatt

SEQ ID NO: 6630807 - DNA, 13 bp, Homo sapiens
agattaaatatat

SEQ ID NO: 6630808 - DNA, 20 bp, Homo sapiens
agattaaatatatctttgta

SEQ ID NO: 6630809 - DNA, 20 bp, Homo sapiens
agattaaattacagctttta

SEQ ID NO: 6630810 - DNA, 16 bp, Homo sapiens
agattaacactcattt

SEQ ID NO: 6630811 - DNA, 18 bp, Homo sapiens
agattaacctaatgcaga

SEQ ID NO: 6630812 - DNA, 22 bp, Homo sapiens
agattaacctaatgcagaattg

SEQ ID NO: 6630813 - DNA, 20 bp, Homo sapiens
agattaaccttctctgtccg

SEQ ID NO: 6630814 - DNA, 22 bp, Homo sapiens
agattaactttcaaaagcaaac

SEQ ID NO: 6630815 - DNA, 16 bp, Homo sapiens
agattaagagccatat

SEQ ID NO: 6630816 - DNA, 13 bp, Homo sapiens
agattaagatgcc

SEQ ID NO: 6630817 - DNA, 13 bp, Homo sapiens
agattaagctttt

SEQ ID NO: 6630818 - DNA, 23 bp, Homo sapiens
agattaagttataccagcaaaag

SEQ ID NO: 6630819 - DNA, 15 bp, Homo sapiens
agattaataagattt

SEQ ID NO: 6630820 - DNA, 20 bp, Homo sapiens
agattaatactctattttta

SEQ ID NO: 6630821 - DNA, 20 bp, Homo sapiens
agattaatgacctgaattga

SEQ ID NO: 6630822 - DNA, 18 bp, Homo sapiens
agattaatgtgtattaaa

SEQ ID NO: 6630823 - DNA, 15 bp, Homo sapiens
agattaattcctttc

SEQ ID NO: 6630824 - DNA, 16 bp, Homo sapiens
agattacaaaagcaat

SEQ ID NO: 6630825 - DNA, 15 bp, Homo sapiens
agattacaagataaa

SEQ ID NO: 6630826 - DNA, 20 bp, Homo sapiens
agattacagagggctcattt

SEQ ID NO: 6630827 - DNA, 19 bp, Homo sapiens
agattacaggaatgaagaa

SEQ ID NO: 6630828 - DNA, 20 bp, Homo sapiens
agattacaggaatgaagaac

SEQ ID NO: 6630829 - DNA, 21 bp, Homo sapiens
agattacaggaatgaagaact

SEQ ID NO: 6630830 - DNA, 22 bp, Homo sapiens
agattacaggaatgaagaactg

SEQ ID NO: 6630831 - DNA, 21 bp, Homo sapiens
agattacaggattaatatatt

SEQ ID NO: 6630832 - DNA, 18 bp, Homo sapiens
agattacatctgccttaa

SEQ ID NO: 6630833 - DNA, 22 bp, Homo sapiens
agattacccaaaaactgtcttt

SEQ ID NO: 6630834 - DNA, 20 bp, Homo sapiens
agattaccctcaaatgctag

SEQ ID NO: 6630835 - DNA, 14 bp, Homo sapiens
agattactgatgtg

SEQ ID NO: 6630836 - DNA, 23 bp, Homo sapiens
agattactgatgtgatattctgt

SEQ ID NO: 6630837 - DNA, 16 bp, Homo sapiens
agattacttagaggaa

SEQ ID NO: 6630838 - DNA, 16 bp, Homo sapiens
agattagaacatttaa

SEQ ID NO: 6630839 - DNA, 22 bp, Homo sapiens
agattagaacatttaataatgt

SEQ ID NO: 6630840 - DNA, 15 bp, Homo sapiens
agattagaagtgttt

SEQ ID NO: 6630841 - DNA, 17 bp, Homo sapiens
agattagaagtgtttta

SEQ ID NO: 6630842 - DNA, 15 bp, Homo sapiens
agattagaattctgt

SEQ ID NO: 6630843 - DNA, 16 bp, Homo sapiens
agattagaattctgta

SEQ ID NO: 6630844 - DNA, 21 bp, Homo sapiens
agattagagcctgtaaacttt

SEQ ID NO: 6630845 - DNA, 14 bp, Homo sapiens
agattagagggagg

SEQ ID NO: 6630846 - DNA, 17 bp, Homo sapiens
agattagaggtttgtca

SEQ ID NO: 6630847 - DNA, 15 bp, Homo sapiens
agattagctctggac

SEQ ID NO: 6630848 - DNA, 16 bp, Homo sapiens
agattaggcacacaga

SEQ ID NO: 6630849 - DNA, 13 bp, Homo sapiens
agattaggcctgg

SEQ ID NO: 6630850 - DNA, 14 bp, Homo sapiens
agattaggcctgga

SEQ ID NO: 6630851 - DNA, 15 bp, Homo sapiens
agattaggcctggag

SEQ ID NO: 6630852 - DNA, 13 bp, Homo sapiens
agattaggctgag

SEQ ID NO: 6630853 - DNA, 20 bp, Homo sapiens
agattaggtagactttgctt

SEQ ID NO: 6630854 - DNA, 16 bp, Homo sapiens
agattagtaactgttc

SEQ ID NO: 6630855 - DNA, 18 bp, Homo sapiens
agattataattgttgcat

SEQ ID NO: 6630856 - DNA, 17 bp, Homo sapiens
agattatacagaattgt

SEQ ID NO: 6630857 - DNA, 16 bp, Homo sapiens
agattatagattctaa

SEQ ID NO: 6630858 - DNA, 17 bp, Homo sapiens
agattatagattctaaa

SEQ ID NO: 6630859 - DNA, 19 bp, Homo sapiens
agattatagattctaaaga

SEQ ID NO: 6630860 - DNA, 21 bp, Homo sapiens
agattatagattctaaagatt

SEQ ID NO: 6630861 - DNA, 23 bp, Homo sapiens
agattatagattctaaagattct

SEQ ID NO: 6630862 - DNA, 21 bp, Homo sapiens
agattatatacaaagctgtca

SEQ ID NO: 6630863 - DNA, 21 bp, Homo sapiens
agattatattgagacaaaaat

SEQ ID NO: 6630864 - DNA, 19 bp, Homo sapiens
agattatcagtagaaagag

SEQ ID NO: 6630865 - DNA, 19 bp, Homo sapiens
agattatcctgttactgaa

SEQ ID NO: 6630866 - DNA, 19 bp, Homo sapiens
agattatctgattccttta

SEQ ID NO: 6630867 - DNA, 17 bp, Homo sapiens
agattatgatgcataca

SEQ ID NO: 6630868 - DNA, 18 bp, Homo sapiens
agattatggcctttttaa

SEQ ID NO: 6630869 - DNA, 16 bp, Homo sapiens
agattatgttcctgct

SEQ ID NO: 6630870 - DNA, 16 bp, Homo sapiens
agattattaaaactga

SEQ ID NO: 6630871 - DNA, 13 bp, Homo sapiens
agattattaaatc

SEQ ID NO: 6630872 - DNA, 14 bp, Homo sapiens
agattattcaacag

SEQ ID NO: 6630873 - DNA, 19 bp, Homo sapiens
agattattcataatgtgag

SEQ ID NO: 6630874 - DNA, 17 bp, Homo sapiens
agattattggctgcttt

SEQ ID NO: 6630875 - DNA, 22 bp, Homo sapiens
agattattgtgacttcactgta

SEQ ID NO: 6630876 - DNA, 14 bp, Homo sapiens
agattatttaaatg

SEQ ID NO: 6630877 - DNA, 14 bp, Homo sapiens
agattatttacaag

SEQ ID NO: 6630878 - DNA, 13 bp, Homo sapiens
agattatttcata

SEQ ID NO: 6630879 - DNA, 21 bp, Homo sapiens
agattatttcatatactataa

SEQ ID NO: 6630880 - DNA, 16 bp, Homo sapiens
agattatttcattcgt

SEQ ID NO: 6630881 - DNA, 13 bp, Homo sapiens
agattatttctgt

SEQ ID NO: 6630882 - DNA, 18 bp, Homo sapiens
agattatttctgtatttg

SEQ ID NO: 6630883 - DNA, 12 bp, Homo sapiens
agattattttat

SEQ ID NO: 6630884 - DNA, 16 bp, Homo sapiens
agattattttattatg

SEQ ID NO: 6630885 - DNA, 16 bp, Homo sapiens
agattattttctatat

SEQ ID NO: 6630886 - DNA, 21 bp, Homo sapiens
agattattttctatatttgga

SEQ ID NO: 6630887 - DNA, 17 bp, Homo sapiens
agattattttttaaaaa

SEQ ID NO: 6630888 - DNA, 23 bp, Homo sapiens
agattcaaaatggcttgtctttg

SEQ ID NO: 6630889 - DNA, 15 bp, Homo sapiens
agattcaaaggttct

SEQ ID NO: 6630890 - DNA, 14 bp, Homo sapiens
agattcaagacaag

SEQ ID NO: 6630891 - DNA, 18 bp, Homo sapiens
agattcaagacaagagct

SEQ ID NO: 6630892 - DNA, 14 bp, Homo sapiens
agattcaaggcccc

SEQ ID NO: 6630893 - DNA, 22 bp, Homo sapiens
agattcaataatgagagctcag

SEQ ID NO: 6630894 - DNA, 11 bp, Homo sapiens
agattcaattt

SEQ ID NO: 6630895 - DNA, 13 bp, Homo sapiens
agattcacacatg

SEQ ID NO: 6630896 - DNA, 16 bp, Homo sapiens
agattcacctaagaga

SEQ ID NO: 6630897 - DNA, 20 bp, Homo sapiens
agattcacctaagagattct

SEQ ID NO: 6630898 - DNA, 16 bp, Homo sapiens
agattcacctgtaaaa

SEQ ID NO: 6630899 - DNA, 20 bp, Homo sapiens
agattcacctgtaaaacttt

SEQ ID NO: 6630900 - DNA, 22 bp, Homo sapiens
agattcacttaacaaacaaatt

SEQ ID NO: 6630901 - DNA, 17 bp, Homo sapiens
agattcactttgacact

SEQ ID NO: 6630902 - DNA, 23 bp, Homo sapiens
agattcactttgacacttttcat

SEQ ID NO: 6630903 - DNA, 17 bp, Homo sapiens
agattcactttgtttat

SEQ ID NO: 6630904 - DNA, 22 bp, Homo sapiens
agattcactttgtttatgcata

SEQ ID NO: 6630905 - DNA, 17 bp, Homo sapiens
agattcagaatgagaat

SEQ ID NO: 6630906 - DNA, 14 bp, Homo sapiens
agattcagactgct

SEQ ID NO: 6630907 - DNA, 17 bp, Homo sapiens
agattcagactgcttca

SEQ ID NO: 6630908 - DNA, 13 bp, Homo sapiens
agattcagagaaa

SEQ ID NO: 6630909 - DNA, 14 bp, Homo sapiens
agattcaggcattt

SEQ ID NO: 6630910 - DNA, 15 bp, Homo sapiens
agattcaggccagcc

SEQ ID NO: 6630911 - DNA, 16 bp, Homo sapiens
agattcaggccagccc

SEQ ID NO: 6630912 - DNA, 17 bp, Homo sapiens
agattcaggccagccca

SEQ ID NO: 6630913 - DNA, 20 bp, Homo sapiens
agattcaggccagcccagcc

SEQ ID NO: 6630914 - DNA, 23 bp, Homo sapiens
agattcaggccagcccagccagg

SEQ ID NO: 6630915 - DNA, 12 bp, Homo sapiens
agattcaggctt

SEQ ID NO: 6630916 - DNA, 20 bp, Homo sapiens
agattcaggcttgcattaaa

SEQ ID NO: 6630917 - DNA, 21 bp, Homo sapiens
agattcaggcttgcattaaaa

SEQ ID NO: 6630918 - DNA, 17 bp, Homo sapiens
agattcagggagaatgt

SEQ ID NO: 6630919 - DNA, 13 bp, Homo sapiens
agattcaggggaa

SEQ ID NO: 6630920 - DNA, 18 bp, Homo sapiens
agattcaggtaatacaaa

SEQ ID NO: 6630921 - DNA, 19 bp, Homo sapiens
agattcaggtatgttgcct

SEQ ID NO: 6630922 - DNA, 20 bp, Homo sapiens
agattcaggtatgttgcctt

SEQ ID NO: 6630923 - DNA, 18 bp, Homo sapiens
agattcagtcttgcctta

SEQ ID NO: 6630924 - DNA, 23 bp, Homo sapiens
agattcagtttaagagttttcct

SEQ ID NO: 6630925 - DNA, 15 bp, Homo sapiens
agattcataaagtaa

SEQ ID NO: 6630926 - DNA, 22 bp, Homo sapiens
agattcatatttacttcttata

SEQ ID NO: 6630927 - DNA, 15 bp, Homo sapiens
agattcatccattta

SEQ ID NO: 6630928 - DNA, 14 bp, Homo sapiens
agattcatctatgg

SEQ ID NO: 6630929 - DNA, 19 bp, Homo sapiens
agattcatggctttaacag

SEQ ID NO: 6630930 - DNA, 21 bp, Homo sapiens
agattcattatttttccactt

SEQ ID NO: 6630931 - DNA, 15 bp, Homo sapiens
agattcattttctag

SEQ ID NO: 6630932 - DNA, 18 bp, Homo sapiens
agattccaagtgtattta

SEQ ID NO: 6630933 - DNA, 11 bp, Homo sapiens
agattccacac

SEQ ID NO: 6630934 - DNA, 22 bp, Homo sapiens
agattccacacaaaatgtcaca

SEQ ID NO: 6630935 - DNA, 20 bp, Homo sapiens
agattccagaacgccctgtg

SEQ ID NO: 6630936 - DNA, 22 bp, Homo sapiens
agattccagaacgccctgtgtc

SEQ ID NO: 6630937 - DNA, 19 bp, Homo sapiens
agattccagagagtggctc

SEQ ID NO: 6630938 - DNA, 22 bp, Homo sapiens
agattccagagagtggctcctc

SEQ ID NO: 6630939 - DNA, 12 bp, Homo sapiens
agattccaggat

SEQ ID NO: 6630940 - DNA, 19 bp, Homo sapiens
agattccattggtccaaga

SEQ ID NO: 6630941 - DNA, 14 bp, Homo sapiens
agattccattttat

SEQ ID NO: 6630942 - DNA, 13 bp, Homo sapiens
agattcccacctt

SEQ ID NO: 6630943 - DNA, 17 bp, Homo sapiens
agattcccagcttccag

SEQ ID NO: 6630944 - DNA, 20 bp, Homo sapiens
agattcccagcttccagatg

SEQ ID NO: 6630945 - DNA, 14 bp, Homo sapiens
agattcccaggagt

SEQ ID NO: 6630946 - DNA, 17 bp, Homo sapiens
agattcccaggagttct

SEQ ID NO: 6630947 - DNA, 19 bp, Homo sapiens
agattcccaggagttctgc

SEQ ID NO: 6630948 - DNA, 14 bp, Homo sapiens
agattcccaggcca

SEQ ID NO: 6630949 - DNA, 19 bp, Homo sapiens
agattcccaggccagggct

SEQ ID NO: 6630950 - DNA, 15 bp, Homo sapiens
agattccccaggaat

SEQ ID NO: 6630951 - DNA, 19 bp, Homo sapiens
agattccccattgcctcct

SEQ ID NO: 6630952 - DNA, 17 bp, Homo sapiens
agattcccggctggact

SEQ ID NO: 6630953 - DNA, 19 bp, Homo sapiens
agattccctctcctccccc

SEQ ID NO: 6630954 - DNA, 14 bp, Homo sapiens
agattcctacttaa

SEQ ID NO: 6630955 - DNA, 22 bp, Homo sapiens
agattcctcgaagttctaggaa

SEQ ID NO: 6630956 - DNA, 13 bp, Homo sapiens
agattcctgggcc

SEQ ID NO: 6630957 - DNA, 15 bp, Homo sapiens
agattccttcccatg

SEQ ID NO: 6630958 - DNA, 14 bp, Homo sapiens
agattcctttccct

SEQ ID NO: 6630959 - DNA, 16 bp, Homo sapiens
agattcctttcccttt

SEQ ID NO: 6630960 - DNA, 20 bp, Homo sapiens
agattcctttccctttagca

SEQ ID NO: 6630961 - DNA, 20 bp, Homo sapiens
agattcctttggccactgta

SEQ ID NO: 6630962 - DNA, 17 bp, Homo sapiens
agattccttttcttgtt

SEQ ID NO: 6630963 - DNA, 15 bp, Homo sapiens
agattcgctgtcccc

SEQ ID NO: 6630964 - DNA, 16 bp, Homo sapiens
agattcgctttccatg

SEQ ID NO: 6630965 - DNA, 13 bp, Homo sapiens
agattctaaagat

SEQ ID NO: 6630966 - DNA, 21 bp, Homo sapiens
agattctaaagattctatagt

SEQ ID NO: 6630967 - DNA, 13 bp, Homo sapiens
agattctaaagct

SEQ ID NO: 6630968 - DNA, 10 bp, Homo sapiens
agattctaac

SEQ ID NO: 6630969 - DNA, 12 bp, Homo sapiens
agattctactaa

SEQ ID NO: 6630970 - DNA, 20 bp, Homo sapiens
agattctaggacctgtgtcc

SEQ ID NO: 6630971 - DNA, 16 bp, Homo sapiens
agattctatgttaata

SEQ ID NO: 6630972 - DNA, 18 bp, Homo sapiens
agattctatgttaatatt

SEQ ID NO: 6630973 - DNA, 21 bp, Homo sapiens
agattctatgttaatatttta

SEQ ID NO: 6630974 - DNA, 17 bp, Homo sapiens
agattctatttaattga

SEQ ID NO: 6630975 - DNA, 12 bp, Homo sapiens
agattctcacat

SEQ ID NO: 6630976 - DNA, 16 bp, Homo sapiens
agattctccaaatgat

SEQ ID NO: 6630977 - DNA, 17 bp, Homo sapiens
agattctccaaatgatt

SEQ ID NO: 6630978 - DNA, 15 bp, Homo sapiens
agattctcctgtgct

SEQ ID NO: 6630979 - DNA, 22 bp, Homo sapiens
agattctctgtgtctaagattc

SEQ ID NO: 6630980 - DNA, 14 bp, Homo sapiens
agattctgatgcat

SEQ ID NO: 6630981 - DNA, 17 bp, Homo sapiens
agattctgattcccttc

SEQ ID NO: 6630982 - DNA, 21 bp, Homo sapiens
agattctgatttgccactgat

SEQ ID NO: 6630983 - DNA, 15 bp, Homo sapiens
agattctgcctctct

SEQ ID NO: 6630984 - DNA, 13 bp, Homo sapiens
agattctgccttt

SEQ ID NO: 6630985 - DNA, 14 bp, Homo sapiens
agattctggatctc

SEQ ID NO: 6630986 - DNA, 20 bp, Homo sapiens
agattctggatctcctgctg

SEQ ID NO: 6630987 - DNA, 13 bp, Homo sapiens
agattctgggaaa

SEQ ID NO: 6630988 - DNA, 19 bp, Homo sapiens
agattctgggaaaggtgct

SEQ ID NO: 6630989 - DNA, 11 bp, Homo sapiens
agattctgggt

SEQ ID NO: 6630990 - DNA, 21 bp, Homo sapiens
agattctgtgatcttttaaag

SEQ ID NO: 6630991 - DNA, 23 bp, Homo sapiens
agattctgtgggcagctggctct

SEQ ID NO: 6630992 - DNA, 18 bp, Homo sapiens
agattctgtgtattaaca

SEQ ID NO: 6630993 - DNA, 19 bp, Homo sapiens
agattctgtgtattaacat

SEQ ID NO: 6630994 - DNA, 20 bp, Homo sapiens
agattctgttaaaaaaataa

SEQ ID NO: 6630995 - DNA, 17 bp, Homo sapiens
agattcttacaaggccc

SEQ ID NO: 6630996 - DNA, 18 bp, Homo sapiens
agattcttaccaagagtg

SEQ ID NO: 6630997 - DNA, 22 bp, Homo sapiens
agattcttctaggggtagctgg

SEQ ID NO: 6630998 - DNA, 13 bp, Homo sapiens
agattcttctgtg

SEQ ID NO: 6630999 - DNA, 19 bp, Homo sapiens
agattcttgagctgttgtg

SEQ ID NO: 6631000 - DNA, 21 bp, Homo sapiens
agattcttgctgtgacccaag

SEQ ID NO: 6631001 - DNA, 19 bp, Homo sapiens
agattctttaaactactga

SEQ ID NO: 6631002 - DNA, 13 bp, Homo sapiens
agattctttaagg

SEQ ID NO: 6631003 - DNA, 15 bp, Homo sapiens
agattctttaaggag

SEQ ID NO: 6631004 - DNA, 20 bp, Homo sapiens
agattctttaaggagataga

SEQ ID NO: 6631005 - DNA, 21 bp, Homo sapiens
agattctttcagttctttgga

SEQ ID NO: 6631006 - DNA, 16 bp, Homo sapiens
agattctttcctgagg

SEQ ID NO: 6631007 - DNA, 13 bp, Homo sapiens
agattctttgaga

SEQ ID NO: 6631008 - DNA, 11 bp, Homo sapiens
agattctttta

SEQ ID NO: 6631009 - DNA, 22 bp, Homo sapiens
agattcttttaaattagaaaat

SEQ ID NO: 6631010 - DNA, 19 bp, Homo sapiens
agattgaaaacttttctca

SEQ ID NO: 6631011 - DNA, 16 bp, Homo sapiens
agattgaaaaggaaga

SEQ ID NO: 6631012 - DNA, 13 bp, Homo sapiens
agattgaaaagtg

SEQ ID NO: 6631013 - DNA, 17 bp, Homo sapiens
agattgaaaagtgtcct

SEQ ID NO: 6631014 - DNA, 18 bp, Homo sapiens
agattgaaaatcttgtgt

SEQ ID NO: 6631015 - DNA, 16 bp, Homo sapiens
agattgaaatttatga

SEQ ID NO: 6631016 - DNA, 17 bp, Homo sapiens
agattgaaatttatgac

SEQ ID NO: 6631017 - DNA, 20 bp, Homo sapiens
agattgaagaatctgcccct

SEQ ID NO: 6631018 - DNA, 19 bp, Homo sapiens
agattgaagctaaaacact

SEQ ID NO: 6631019 - DNA, 14 bp, Homo sapiens
agattgacaaggta

SEQ ID NO: 6631020 - DNA, 19 bp, Homo sapiens
agattgacctataaaacaa

SEQ ID NO: 6631021 - DNA, 15 bp, Homo sapiens
agattgacgacaagt

SEQ ID NO: 6631022 - DNA, 21 bp, Homo sapiens
agattgactatttatacaaat

SEQ ID NO: 6631023 - DNA, 16 bp, Homo sapiens
agattgacttcagaaa

SEQ ID NO: 6631024 - DNA, 12 bp, Homo sapiens
agattgagaaat

SEQ ID NO: 6631025 - DNA, 17 bp, Homo sapiens
agattgagaaatgtgta

SEQ ID NO: 6631026 - DNA, 15 bp, Homo sapiens
agattgagaaggaga

SEQ ID NO: 6631027 - DNA, 16 bp, Homo sapiens
agattgagaaggagag

SEQ ID NO: 6631028 - DNA, 18 bp, Homo sapiens
agattgagagaagagaca

SEQ ID NO: 6631029 - DNA, 15 bp, Homo sapiens
agattgagagaattt

SEQ ID NO: 6631030 - DNA, 17 bp, Homo sapiens
agattgagctctctgcc

SEQ ID NO: 6631031 - DNA, 19 bp, Homo sapiens
agattgaggcctgccctca

SEQ ID NO: 6631032 - DNA, 21 bp, Homo sapiens
agattgagtaggtaccttgta

SEQ ID NO: 6631033 - DNA, 22 bp, Homo sapiens
agattgagtataaaaacttgaa

SEQ ID NO: 6631034 - DNA, 23 bp, Homo sapiens
agattgagtataaaaacttgaaa

SEQ ID NO: 6631035 - DNA, 17 bp, Homo sapiens
agattgataagtaatga

SEQ ID NO: 6631036 - DNA, 22 bp, Homo sapiens
agattgatatctataaaataga

SEQ ID NO: 6631037 - DNA, 15 bp, Homo sapiens
agattgatcattttt

SEQ ID NO: 6631038 - DNA, 22 bp, Homo sapiens
agattgatcatttttataacca

SEQ ID NO: 6631039 - DNA, 16 bp, Homo sapiens
agattgattgtattgt

SEQ ID NO: 6631040 - DNA, 21 bp, Homo sapiens
agattgatttacctttggaat

SEQ ID NO: 6631041 - DNA, 13 bp, Homo sapiens
agattgcaaaggg

SEQ ID NO: 6631042 - DNA, 19 bp, Homo sapiens
agattgcaacaggctgggc

SEQ ID NO: 6631043 - DNA, 20 bp, Homo sapiens
agattgcaacaggctgggct

SEQ ID NO: 6631044 - DNA, 21 bp, Homo sapiens
agattgcaacaggctgggctt

SEQ ID NO: 6631045 - DNA, 23 bp, Homo sapiens
agattgcaacaggctgggcttca

SEQ ID NO: 6631046 - DNA, 23 bp, Homo sapiens
agattgcagaaaattctgtgcct

SEQ ID NO: 6631047 - DNA, 13 bp, Homo sapiens
agattgcatgtga

SEQ ID NO: 6631048 - DNA, 18 bp, Homo sapiens
agattgcatgtgactctg

SEQ ID NO: 6631049 - DNA, 19 bp, Homo sapiens
agattgcatgtgactctga

SEQ ID NO: 6631050 - DNA, 22 bp, Homo sapiens
agattgcatgtgactctgaagc

SEQ ID NO: 6631051 - DNA, 17 bp, Homo sapiens
agattgccccagagccc

SEQ ID NO: 6631052 - DNA, 15 bp, Homo sapiens
agattgcgcctgaga

SEQ ID NO: 6631053 - DNA, 16 bp, Homo sapiens
agattgctaattgctg

SEQ ID NO: 6631054 - DNA, 18 bp, Homo sapiens
agattgctaattgctgtt

SEQ ID NO: 6631055 - DNA, 17 bp, Homo sapiens
agattgctacacacaca

SEQ ID NO: 6631056 - DNA, 16 bp, Homo sapiens
agattgctcaaatcag

SEQ ID NO: 6631057 - DNA, 22 bp, Homo sapiens
agattgctgaaattttatatgc

SEQ ID NO: 6631058 - DNA, 15 bp, Homo sapiens
agattgctgcaaaga

SEQ ID NO: 6631059 - DNA, 23 bp, Homo sapiens
agattgctggaaaccaagtcagg

SEQ ID NO: 6631060 - DNA, 17 bp, Homo sapiens
agattgcttctgtagta

SEQ ID NO: 6631061 - DNA, 18 bp, Homo sapiens
agattgctttaagaaact

SEQ ID NO: 6631062 - DNA, 18 bp, Homo sapiens
agattggaaaaaattaga

SEQ ID NO: 6631063 - DNA, 12 bp, Homo sapiens
agattggaaatg

SEQ ID NO: 6631064 - DNA, 13 bp, Homo sapiens
agattggaaggaa

SEQ ID NO: 6631065 - DNA, 16 bp, Homo sapiens
agattggaaggagaca

SEQ ID NO: 6631066 - DNA, 21 bp, Homo sapiens
agattggaaggagacacagat

SEQ ID NO: 6631067 - DNA, 20 bp, Homo sapiens
agattggagtggggaagtgt

SEQ ID NO: 6631068 - DNA, 15 bp, Homo sapiens
agattggatcaagta

SEQ ID NO: 6631069 - DNA, 22 bp, Homo sapiens
agattggatcaagtattactaa

SEQ ID NO: 6631070 - DNA, 22 bp, Homo sapiens
agattggattttatgttgacat

SEQ ID NO: 6631071 - DNA, 23 bp, Homo sapiens
agattggattttatgttgacatt

SEQ ID NO: 6631072 - DNA, 18 bp, Homo sapiens
agattggccaattaaaaa

SEQ ID NO: 6631073 - DNA, 14 bp, Homo sapiens
agattggccagcaa

SEQ ID NO: 6631074 - DNA, 15 bp, Homo sapiens
agattggccagtgag

SEQ ID NO: 6631075 - DNA, 23 bp, Homo sapiens
agattggctcacactgagaatgt

SEQ ID NO: 6631076 - DNA, 17 bp, Homo sapiens
agattgggatactgtaa

SEQ ID NO: 6631077 - DNA, 18 bp, Homo sapiens
agattgggctggctctga

SEQ ID NO: 6631078 - DNA, 18 bp, Homo sapiens
agattggggacactcata

SEQ ID NO: 6631079 - DNA, 13 bp, Homo sapiens
agattgggggccc

SEQ ID NO: 6631080 - DNA, 23 bp, Homo sapiens
agattgggggccctggggtcccc

SEQ ID NO: 6631081 - DNA, 23 bp, Homo sapiens
agattggggtaacgtgcactgta

SEQ ID NO: 6631082 - DNA, 12 bp, Homo sapiens
agattgggtcta

SEQ ID NO: 6631083 - DNA, 17 bp, Homo sapiens
agattggtcattaaata

SEQ ID NO: 6631084 - DNA, 19 bp, Homo sapiens
agattggtcattaaatact

SEQ ID NO: 6631085 - DNA, 20 bp, Homo sapiens
agattggtgtttttttctat

SEQ ID NO: 6631086 - DNA, 19 bp, Homo sapiens
agattggttcatgcctggg

SEQ ID NO: 6631087 - DNA, 21 bp, Homo sapiens
agattggttcatgcctggggt

SEQ ID NO: 6631088 - DNA, 16 bp, Homo sapiens
agattggttctgtttt

SEQ ID NO: 6631089 - DNA, 19 bp, Homo sapiens
agattggttgcctctgcct

SEQ ID NO: 6631090 - DNA, 20 bp, Homo sapiens
agattgtaaaggtaggtgca

SEQ ID NO: 6631091 - DNA, 15 bp, Homo sapiens
agattgtactgttca

SEQ ID NO: 6631092 - DNA, 17 bp, Homo sapiens
agattgtattaactatc

SEQ ID NO: 6631093 - DNA, 17 bp, Homo sapiens
agattgtattactttaa

SEQ ID NO: 6631094 - DNA, 14 bp, Homo sapiens
agattgtcatagtt

SEQ ID NO: 6631095 - DNA, 23 bp, Homo sapiens
agattgtccggccgctttgtgat

SEQ ID NO: 6631096 - DNA, 23 bp, Homo sapiens
agattgtcttgcaacttcagttt

SEQ ID NO: 6631097 - DNA, 14 bp, Homo sapiens
agattgtgaataat

SEQ ID NO: 6631098 - DNA, 18 bp, Homo sapiens
agattgtgaatatttcca

SEQ ID NO: 6631099 - DNA, 17 bp, Homo sapiens
agattgtgcgttcaaac

SEQ ID NO: 6631100 - DNA, 20 bp, Homo sapiens
agattgtgggggaaaaataa

SEQ ID NO: 6631101 - DNA, 17 bp, Homo sapiens
agattgtggtggtgcta

SEQ ID NO: 6631102 - DNA, 19 bp, Homo sapiens
agattgtggtggtgctaaa

SEQ ID NO: 6631103 - DNA, 15 bp, Homo sapiens
agattgtgtaacaat

SEQ ID NO: 6631104 - DNA, 20 bp, Homo sapiens
agattgtgtacatagagcaa

SEQ ID NO: 6631105 - DNA, 17 bp, Homo sapiens
agattgttaaattcaat

SEQ ID NO: 6631106 - DNA, 16 bp, Homo sapiens
agattgttaagggcat

SEQ ID NO: 6631107 - DNA, 15 bp, Homo sapiens
agattgttattaaat

SEQ ID NO: 6631108 - DNA, 22 bp, Homo sapiens
agattgttgtttgccatacttt

SEQ ID NO: 6631109 - DNA, 21 bp, Homo sapiens
agattgtttatctagatgtaa

SEQ ID NO: 6631110 - DNA, 18 bp, Homo sapiens
agattgtttctatacaaa

SEQ ID NO: 6631111 - DNA, 22 bp, Homo sapiens
agattgttttatcatgacatgt

SEQ ID NO: 6631112 - DNA, 14 bp, Homo sapiens
agatttaaaataaa

SEQ ID NO: 6631113 - DNA, 17 bp, Homo sapiens
agatttaaaataaacat

SEQ ID NO: 6631114 - DNA, 20 bp, Homo sapiens
agatttaaactctgaattta

SEQ ID NO: 6631115 - DNA, 21 bp, Homo sapiens
agatttaaactctgaatttat

SEQ ID NO: 6631116 - DNA, 18 bp, Homo sapiens
agatttaaagtattttaa

SEQ ID NO: 6631117 - DNA, 14 bp, Homo sapiens
agatttaacactaa

SEQ ID NO: 6631118 - DNA, 21 bp, Homo sapiens
agatttaacactaaaattcca

SEQ ID NO: 6631119 - DNA, 15 bp, Homo sapiens
agatttaagcaagac

SEQ ID NO: 6631120 - DNA, 17 bp, Homo sapiens
agatttaagccttacaa

SEQ ID NO: 6631121 - DNA, 15 bp, Homo sapiens
agatttaagccttga

SEQ ID NO: 6631122 - DNA, 23 bp, Homo sapiens
agatttaagtgaatacattaacg

SEQ ID NO: 6631123 - DNA, 18 bp, Homo sapiens
agatttaagttcctgctg

SEQ ID NO: 6631124 - DNA, 21 bp, Homo sapiens
agatttaagttcctgctgcct

SEQ ID NO: 6631125 - DNA, 16 bp, Homo sapiens
agatttaatattacag

SEQ ID NO: 6631126 - DNA, 13 bp, Homo sapiens
agatttaattaat

SEQ ID NO: 6631127 - DNA, 16 bp, Homo sapiens
agatttaatttgccaa

SEQ ID NO: 6631128 - DNA, 22 bp, Homo sapiens
agatttaccaattcacccactc

SEQ ID NO: 6631129 - DNA, 16 bp, Homo sapiens
agatttaccacttgtg

SEQ ID NO: 6631130 - DNA, 21 bp, Homo sapiens
agatttacccagaatgtcaga

SEQ ID NO: 6631131 - DNA, 16 bp, Homo sapiens
agatttactaaatcaa

SEQ ID NO: 6631132 - DNA, 21 bp, Homo sapiens
agatttactgctctagaaagt

SEQ ID NO: 6631133 - DNA, 17 bp, Homo sapiens
agatttacttaattgct

SEQ ID NO: 6631134 - DNA, 23 bp, Homo sapiens
agatttacttcagtataaattat

SEQ ID NO: 6631135 - DNA, 14 bp, Homo sapiens
agatttagctattt

SEQ ID NO: 6631136 - DNA, 17 bp, Homo sapiens
agatttaggagcagaaa

SEQ ID NO: 6631137 - DNA, 12 bp, Homo sapiens
agatttagtgta

SEQ ID NO: 6631138 - DNA, 18 bp, Homo sapiens
agatttagttgagttatt

SEQ ID NO: 6631139 - DNA, 15 bp, Homo sapiens
agatttataaatgca

SEQ ID NO: 6631140 - DNA, 14 bp, Homo sapiens
agatttatacagtt

SEQ ID NO: 6631141 - DNA, 18 bp, Homo sapiens
agatttatctttatacag

SEQ ID NO: 6631142 - DNA, 20 bp, Homo sapiens
agatttatgtaatgctttat

SEQ ID NO: 6631143 - DNA, 16 bp, Homo sapiens
agatttattcctttgt

SEQ ID NO: 6631144 - DNA, 12 bp, Homo sapiens
agatttattgtc

SEQ ID NO: 6631145 - DNA, 14 bp, Homo sapiens
agatttatttttaa

SEQ ID NO: 6631146 - DNA, 18 bp, Homo sapiens
agatttatttttcagttc

SEQ ID NO: 6631147 - DNA, 20 bp, Homo sapiens
agatttatttttcagttcca

SEQ ID NO: 6631148 - DNA, 13 bp, Homo sapiens
agatttcaacata

SEQ ID NO: 6631149 - DNA, 12 bp, Homo sapiens
agatttcaagat

SEQ ID NO: 6631150 - DNA, 19 bp, Homo sapiens
agatttcagctatgcagaa

SEQ ID NO: 6631151 - DNA, 14 bp, Homo sapiens
agatttcagtagaa

SEQ ID NO: 6631152 - DNA, 16 bp, Homo sapiens
agatttcagtagaatt

SEQ ID NO: 6631153 - DNA, 23 bp, Homo sapiens
agatttcagtagaattttagtcc

SEQ ID NO: 6631154 - DNA, 18 bp, Homo sapiens
agatttcagtagtttcta

SEQ ID NO: 6631155 - DNA, 15 bp, Homo sapiens
agatttcatccagaa

SEQ ID NO: 6631156 - DNA, 22 bp, Homo sapiens
agatttcatccagaagtcaaca

SEQ ID NO: 6631157 - DNA, 19 bp, Homo sapiens
agatttcatctgctctcct

SEQ ID NO: 6631158 - DNA, 14 bp, Homo sapiens
agatttccacagag

SEQ ID NO: 6631159 - DNA, 15 bp, Homo sapiens
agatttccagtctcc

SEQ ID NO: 6631160 - DNA, 23 bp, Homo sapiens
agatttccagtctccaccaggaa

SEQ ID NO: 6631161 - DNA, 21 bp, Homo sapiens
agatttccattgtgtggcctg

SEQ ID NO: 6631162 - DNA, 22 bp, Homo sapiens
agatttccattgtgtggcctgg

SEQ ID NO: 6631163 - DNA, 21 bp, Homo sapiens
agatttcccttcatttaaact

SEQ ID NO: 6631164 - DNA, 13 bp, Homo sapiens
agatttcctccat

SEQ ID NO: 6631165 - DNA, 19 bp, Homo sapiens
agatttcctcctcccagtg

SEQ ID NO: 6631166 - DNA, 22 bp, Homo sapiens
agatttcctttggcaatatcat

SEQ ID NO: 6631167 - DNA, 15 bp, Homo sapiens
agatttccttttttc

SEQ ID NO: 6631168 - DNA, 20 bp, Homo sapiens
agatttcggtcataaagaat

SEQ ID NO: 6631169 - DNA, 15 bp, Homo sapiens
agatttctaaataaa

SEQ ID NO: 6631170 - DNA, 21 bp, Homo sapiens
agatttctaagttaaatcatt

SEQ ID NO: 6631171 - DNA, 12 bp, Homo sapiens
agatttctatga

SEQ ID NO: 6631172 - DNA, 22 bp, Homo sapiens
agatttctcagaagtctttcag

SEQ ID NO: 6631173 - DNA, 18 bp, Homo sapiens
agatttctcattgacttt

SEQ ID NO: 6631174 - DNA, 22 bp, Homo sapiens
agatttctcattgatcacagat

SEQ ID NO: 6631175 - DNA, 22 bp, Homo sapiens
agatttctcttgggcaggcaga

SEQ ID NO: 6631176 - DNA, 11 bp, Homo sapiens
agatttctgac

SEQ ID NO: 6631177 - DNA, 17 bp, Homo sapiens
agatttctgctccaaat

SEQ ID NO: 6631178 - DNA, 14 bp, Homo sapiens
agatttctggttga

SEQ ID NO: 6631179 - DNA, 16 bp, Homo sapiens
agatttctggttgatt

SEQ ID NO: 6631180 - DNA, 22 bp, Homo sapiens
agatttcttaaataatgcttca

SEQ ID NO: 6631181 - DNA, 18 bp, Homo sapiens
agatttcttaaatctttc

SEQ ID NO: 6631182 - DNA, 19 bp, Homo sapiens
agatttcttaaatctttct

SEQ ID NO: 6631183 - DNA, 22 bp, Homo sapiens
agatttcttaaatctttcttca

SEQ ID NO: 6631184 - DNA, 22 bp, Homo sapiens
agatttcttaatgtctgtcaga

SEQ ID NO: 6631185 - DNA, 20 bp, Homo sapiens
agatttcttctctttagtat

SEQ ID NO: 6631186 - DNA, 19 bp, Homo sapiens
agatttgaaaagaacagaa

SEQ ID NO: 6631187 - DNA, 14 bp, Homo sapiens
agatttgaaaattg

SEQ ID NO: 6631188 - DNA, 17 bp, Homo sapiens
agatttgaactcttcaa

SEQ ID NO: 6631189 - DNA, 20 bp, Homo sapiens
agatttgaagacaaaaatac

SEQ ID NO: 6631190 - DNA, 13 bp, Homo sapiens
agatttgacctcc

SEQ ID NO: 6631191 - DNA, 19 bp, Homo sapiens
agatttgacctcctccctg

SEQ ID NO: 6631192 - DNA, 22 bp, Homo sapiens
agatttgacctcctccctgtta

SEQ ID NO: 6631193 - DNA, 14 bp, Homo sapiens
agatttgacgttgt

SEQ ID NO: 6631194 - DNA, 19 bp, Homo sapiens
agatttgacgttgttgtca

SEQ ID NO: 6631195 - DNA, 15 bp, Homo sapiens
agatttgagctgcct

SEQ ID NO: 6631196 - DNA, 16 bp, Homo sapiens
agatttgatatatgta

SEQ ID NO: 6631197 - DNA, 13 bp, Homo sapiens
agatttgattatt

SEQ ID NO: 6631198 - DNA, 19 bp, Homo sapiens
agatttgcaacagcaaatt

SEQ ID NO: 6631199 - DNA, 17 bp, Homo sapiens
agatttgcacaaaaaga

SEQ ID NO: 6631200 - DNA, 19 bp, Homo sapiens
agatttgccatagagtaca

SEQ ID NO: 6631201 - DNA, 21 bp, Homo sapiens
agatttgccatagagtacact

SEQ ID NO: 6631202 - DNA, 16 bp, Homo sapiens
agatttgcccatttac

SEQ ID NO: 6631203 - DNA, 22 bp, Homo sapiens
agatttgcccatttacactttt

SEQ ID NO: 6631204 - DNA, 22 bp, Homo sapiens
agatttggaataggaataagct

SEQ ID NO: 6631205 - DNA, 17 bp, Homo sapiens
agatttggcttgacaaa

SEQ ID NO: 6631206 - DNA, 12 bp, Homo sapiens
agatttgggaga

SEQ ID NO: 6631207 - DNA, 15 bp, Homo sapiens
agatttgggagctga

SEQ ID NO: 6631208 - DNA, 16 bp, Homo sapiens
agatttggtgaacaac

SEQ ID NO: 6631209 - DNA, 13 bp, Homo sapiens
agatttgtaaatc

SEQ ID NO: 6631210 - DNA, 22 bp, Homo sapiens
agatttgtaacattagttttaa

SEQ ID NO: 6631211 - DNA, 17 bp, Homo sapiens
agatttgtaattacagg

SEQ ID NO: 6631212 - DNA, 13 bp, Homo sapiens
agatttgtacata

SEQ ID NO: 6631213 - DNA, 22 bp, Homo sapiens
agatttgtaggaaggtctcatt

SEQ ID NO: 6631214 - DNA, 15 bp, Homo sapiens
agatttgtatttata

SEQ ID NO: 6631215 - DNA, 12 bp, Homo sapiens
agatttgtcctt

SEQ ID NO: 6631216 - DNA, 15 bp, Homo sapiens
agatttgtctaattg

SEQ ID NO: 6631217 - DNA, 11 bp, Homo sapiens
agatttgtgaa

SEQ ID NO: 6631218 - DNA, 21 bp, Homo sapiens
agatttgtgaactcagccaag

SEQ ID NO: 6631219 - DNA, 18 bp, Homo sapiens
agatttgtgaactggaag

SEQ ID NO: 6631220 - DNA, 16 bp, Homo sapiens
agatttgtggaaaaat

SEQ ID NO: 6631221 - DNA, 12 bp, Homo sapiens
agatttgttcat

SEQ ID NO: 6631222 - DNA, 15 bp, Homo sapiens
agatttgttttgcat

SEQ ID NO: 6631223 - DNA, 13 bp, Homo sapiens
agatttgttttgt

SEQ ID NO: 6631224 - DNA, 15 bp, Homo sapiens
agatttgtttttaaa

SEQ ID NO: 6631225 - DNA, 19 bp, Homo sapiens
agatttgtttttaaactgt

SEQ ID NO: 6631226 - DNA, 23 bp, Homo sapiens
agatttgtttttaaactgtacag

SEQ ID NO: 6631227 - DNA, 20 bp, Homo sapiens
agattttaaaacttcatctg

SEQ ID NO: 6631228 - DNA, 12 bp, Homo sapiens
agattttaaaga

SEQ ID NO: 6631229 - DNA, 14 bp, Homo sapiens
agattttaaagaca

SEQ ID NO: 6631230 - DNA, 15 bp, Homo sapiens
agattttaatcaaat

SEQ ID NO: 6631231 - DNA, 18 bp, Homo sapiens
agattttaatcaaatttg

SEQ ID NO: 6631232 - DNA, 17 bp, Homo sapiens
agattttaattttgaat

SEQ ID NO: 6631233 - DNA, 19 bp, Homo sapiens
agattttacaaaagatgta

SEQ ID NO: 6631234 - DNA, 13 bp, Homo sapiens
agattttagaatt

SEQ ID NO: 6631235 - DNA, 12 bp, Homo sapiens
agattttagaca

SEQ ID NO: 6631236 - DNA, 19 bp, Homo sapiens
agattttaggaaatgaatg

SEQ ID NO: 6631237 - DNA, 12 bp, Homo sapiens
agattttagttc

SEQ ID NO: 6631238 - DNA, 22 bp, Homo sapiens
agattttatccctttctcttct

SEQ ID NO: 6631239 - DNA, 12 bp, Homo sapiens
agattttatgca

SEQ ID NO: 6631240 - DNA, 22 bp, Homo sapiens
agattttatggtactaatgaaa

SEQ ID NO: 6631241 - DNA, 20 bp, Homo sapiens
agattttatggttttataac

SEQ ID NO: 6631242 - DNA, 22 bp, Homo sapiens
agattttatgtgcttgaagatt

SEQ ID NO: 6631243 - DNA, 16 bp, Homo sapiens
agattttatgtttaaa

SEQ ID NO: 6631244 - DNA, 21 bp, Homo sapiens
agattttattatgtaaatccc

SEQ ID NO: 6631245 - DNA, 14 bp, Homo sapiens
agattttattttac

SEQ ID NO: 6631246 - DNA, 15 bp, Homo sapiens
agattttattttact

SEQ ID NO: 6631247 - DNA, 12 bp, Homo sapiens
agattttcagaa

SEQ ID NO: 6631248 - DNA, 13 bp, Homo sapiens
agattttcatttt

SEQ ID NO: 6631249 - DNA, 16 bp, Homo sapiens
agattttcattttagt

SEQ ID NO: 6631250 - DNA, 21 bp, Homo sapiens
agattttccattaactatttt

SEQ ID NO: 6631251 - DNA, 19 bp, Homo sapiens
agattttcctccattttta

SEQ ID NO: 6631252 - DNA, 20 bp, Homo sapiens
agattttcctcttgtgattt

SEQ ID NO: 6631253 - DNA, 15 bp, Homo sapiens
agattttcctgaaaa

SEQ ID NO: 6631254 - DNA, 16 bp, Homo sapiens
agattttcctgaaaac

SEQ ID NO: 6631255 - DNA, 13 bp, Homo sapiens
agattttccttcc

SEQ ID NO: 6631256 - DNA, 14 bp, Homo sapiens
agattttctctgga

SEQ ID NO: 6631257 - DNA, 16 bp, Homo sapiens
agattttctgctactt

SEQ ID NO: 6631258 - DNA, 22 bp, Homo sapiens
agattttcttaaggaattttgt

SEQ ID NO: 6631259 - DNA, 13 bp, Homo sapiens
agattttcttgca

SEQ ID NO: 6631260 - DNA, 14 bp, Homo sapiens
agattttctttaaa

SEQ ID NO: 6631261 - DNA, 13 bp, Homo sapiens
agattttgaaaaa

SEQ ID NO: 6631262 - DNA, 17 bp, Homo sapiens
agattttgaaaaattac

SEQ ID NO: 6631263 - DNA, 21 bp, Homo sapiens
agattttgaaaactacatttt

SEQ ID NO: 6631264 - DNA, 14 bp, Homo sapiens
agattttgaatgct

SEQ ID NO: 6631265 - DNA, 14 bp, Homo sapiens
agattttgataact

SEQ ID NO: 6631266 - DNA, 17 bp, Homo sapiens
agattttgataactgtt

SEQ ID NO: 6631267 - DNA, 18 bp, Homo sapiens
agattttgatagcaaagc

SEQ ID NO: 6631268 - DNA, 15 bp, Homo sapiens
agattttggtaatga

SEQ ID NO: 6631269 - DNA, 18 bp, Homo sapiens
agattttgtcgggacaga

SEQ ID NO: 6631270 - DNA, 15 bp, Homo sapiens
agattttgtgaaatt

SEQ ID NO: 6631271 - DNA, 19 bp, Homo sapiens
agattttgtgaaatttcat

SEQ ID NO: 6631272 - DNA, 19 bp, Homo sapiens
agattttgttatgttcaat

SEQ ID NO: 6631273 - DNA, 12 bp, Homo sapiens
agattttgttgg

SEQ ID NO: 6631274 - DNA, 23 bp, Homo sapiens
agattttgttttgctttttctga

SEQ ID NO: 6631275 - DNA, 22 bp, Homo sapiens
agatttttaaaaggtaggtttt

SEQ ID NO: 6631276 - DNA, 19 bp, Homo sapiens
agatttttaaattggagaa

SEQ ID NO: 6631277 - DNA, 23 bp, Homo sapiens
agatttttaaattggagaaaagc

SEQ ID NO: 6631278 - DNA, 15 bp, Homo sapiens
agatttttaacaaaa

SEQ ID NO: 6631279 - DNA, 14 bp, Homo sapiens
agatttttaagaac

SEQ ID NO: 6631280 - DNA, 17 bp, Homo sapiens
agatttttaagaacttc

SEQ ID NO: 6631281 - DNA, 20 bp, Homo sapiens
agatttttaagaacttcatt

SEQ ID NO: 6631282 - DNA, 21 bp, Homo sapiens
agatttttaagaacttcattt

SEQ ID NO: 6631283 - DNA, 18 bp, Homo sapiens
agatttttactaatatat

SEQ ID NO: 6631284 - DNA, 19 bp, Homo sapiens
agatttttactaatatata

SEQ ID NO: 6631285 - DNA, 23 bp, Homo sapiens
agatttttactaatatatatttt

SEQ ID NO: 6631286 - DNA, 21 bp, Homo sapiens
agatttttatattagttgctt

SEQ ID NO: 6631287 - DNA, 22 bp, Homo sapiens
agatttttatattagttgcttt

SEQ ID NO: 6631288 - DNA, 16 bp, Homo sapiens
agatttttatcttaat

SEQ ID NO: 6631289 - DNA, 12 bp, Homo sapiens
agatttttcaaa

SEQ ID NO: 6631290 - DNA, 23 bp, Homo sapiens
agatttttcttttaagccctgct

SEQ ID NO: 6631291 - DNA, 12 bp, Homo sapiens
agatttttgaat

SEQ ID NO: 6631292 - DNA, 14 bp, Homo sapiens
agatttttgaatca

SEQ ID NO: 6631293 - DNA, 18 bp, Homo sapiens
agatttttgatatctcaa

SEQ ID NO: 6631294 - DNA, 16 bp, Homo sapiens
agatttttgattcagc

SEQ ID NO: 6631295 - DNA, 14 bp, Homo sapiens
agatttttgttaag

SEQ ID NO: 6631296 - DNA, 14 bp, Homo sapiens
agatttttgtttgt

SEQ ID NO: 6631297 - DNA, 16 bp, Homo sapiens
agattttttattgcta

SEQ ID NO: 6631298 - DNA, 23 bp, Homo sapiens
agattttttattgctagtatttg

SEQ ID NO: 6631299 - DNA, 21 bp, Homo sapiens
agattttttcagacttgtcaa

SEQ ID NO: 6631300 - DNA, 12 bp, Homo sapiens
agatttttttgt

SEQ ID NO: 6631301 - DNA, 18 bp, Homo sapiens
agatttttttgtgtatgt

SEQ ID NO: 6631302 - DNA, 16 bp, Homo sapiens
agattttttttaaagt

SEQ ID NO: 6631303 - DNA, 18 bp, Homo sapiens
agattttttttgtaactt

SEQ ID NO: 6631304 - DNA, 22 bp, Homo sapiens
agatttttttttccacttttgt

SEQ ID NO: 6631305 - DNA, 18 bp, Homo sapiens
agattttttttttaagtg

SEQ ID NO: 6631306 - DNA, 18 bp, Homo sapiens
agattttttttttttctc

SEQ ID NO: 6631307 - DNA, 23 bp, Homo sapiens
agcaaaaaaaacccatgtggtga

SEQ ID NO: 6631308 - DNA, 20 bp, Homo sapiens
agcaaaaaaagcaacttttc

SEQ ID NO: 6631309 - DNA, 19 bp, Homo sapiens
agcaaaaaataaaataagt

SEQ ID NO: 6631310 - DNA, 14 bp, Homo sapiens
agcaaaaacatgta

SEQ ID NO: 6631311 - DNA, 22 bp, Homo sapiens
agcaaaaactacattttgcaac

SEQ ID NO: 6631312 - DNA, 21 bp, Homo sapiens
agcaaaaactagtaaagacat

SEQ ID NO: 6631313 - DNA, 20 bp, Homo sapiens
agcaaaaactgtgggaagat

SEQ ID NO: 6631314 - DNA, 19 bp, Homo sapiens
agcaaaaagactggatttg

SEQ ID NO: 6631315 - DNA, 15 bp, Homo sapiens
agcaaaaagcaaaat

SEQ ID NO: 6631316 - DNA, 12 bp, Homo sapiens
agcaaaaagtgg

SEQ ID NO: 6631317 - DNA, 13 bp, Homo sapiens
agcaaaaagtgta

SEQ ID NO: 6631318 - DNA, 15 bp, Homo sapiens
agcaaaaagtgtaat

SEQ ID NO: 6631319 - DNA, 15 bp, Homo sapiens
agcaaaaatatttta

SEQ ID NO: 6631320 - DNA, 17 bp, Homo sapiens
agcaaaaatattttatg

SEQ ID NO: 6631321 - DNA, 13 bp, Homo sapiens
agcaaaaatctcc

SEQ ID NO: 6631322 - DNA, 21 bp, Homo sapiens
agcaaaaatctcccagtgaca

SEQ ID NO: 6631323 - DNA, 16 bp, Homo sapiens
agcaaaaatgccaggc

SEQ ID NO: 6631324 - DNA, 15 bp, Homo sapiens
agcaaaaatgctaat

SEQ ID NO: 6631325 - DNA, 21 bp, Homo sapiens
agcaaaaatgctaatattaaa

SEQ ID NO: 6631326 - DNA, 14 bp, Homo sapiens
agcaaaaatgtaaa

SEQ ID NO: 6631327 - DNA, 17 bp, Homo sapiens
agcaaaaatgtaaaaaa

SEQ ID NO: 6631328 - DNA, 21 bp, Homo sapiens
agcaaaaatgtaaaaaacaaa

SEQ ID NO: 6631329 - DNA, 16 bp, Homo sapiens
agcaaaacaagtgaca

SEQ ID NO: 6631330 - DNA, 17 bp, Homo sapiens
agcaaaacatcacattc

SEQ ID NO: 6631331 - DNA, 20 bp, Homo sapiens
agcaaaacatcttttcctga

SEQ ID NO: 6631332 - DNA, 17 bp, Homo sapiens
agcaaaaccaaactggg

SEQ ID NO: 6631333 - DNA, 19 bp, Homo sapiens
agcaaaaccaaactgggtc

SEQ ID NO: 6631334 - DNA, 21 bp, Homo sapiens
agcaaaaccaaatattccaga

SEQ ID NO: 6631335 - DNA, 19 bp, Homo sapiens
agcaaaaccattgcttcac

SEQ ID NO: 6631336 - DNA, 17 bp, Homo sapiens
agcaaaactccatctca

SEQ ID NO: 6631337 - DNA, 19 bp, Homo sapiens
agcaaaactcccaatggat

SEQ ID NO: 6631338 - DNA, 19 bp, Homo sapiens
agcaaaactttactttcag

SEQ ID NO: 6631339 - DNA, 14 bp, Homo sapiens
agcaaaagaaaaag

SEQ ID NO: 6631340 - DNA, 13 bp, Homo sapiens
agcaaaagaaact

SEQ ID NO: 6631341 - DNA, 16 bp, Homo sapiens
agcaaaagaccaaatc

SEQ ID NO: 6631342 - DNA, 20 bp, Homo sapiens
agcaaaagactctgtaccta

SEQ ID NO: 6631343 - DNA, 12 bp, Homo sapiens
agcaaaagagaa

SEQ ID NO: 6631344 - DNA, 16 bp, Homo sapiens
agcaaaaggcagctca

SEQ ID NO: 6631345 - DNA, 15 bp, Homo sapiens
agcaaaaggctgaga

SEQ ID NO: 6631346 - DNA, 18 bp, Homo sapiens
agcaaaagtaatcactta

SEQ ID NO: 6631347 - DNA, 13 bp, Homo sapiens
agcaaaagttctt

SEQ ID NO: 6631348 - DNA, 16 bp, Homo sapiens
agcaaaataaaaacta

SEQ ID NO: 6631349 - DNA, 17 bp, Homo sapiens
agcaaaataaaaactat

SEQ ID NO: 6631350 - DNA, 23 bp, Homo sapiens
agcaaaataacaaaaaagagaaa

SEQ ID NO: 6631351 - DNA, 20 bp, Homo sapiens
agcaaaataaggaagagggc

SEQ ID NO: 6631352 - DNA, 20 bp, Homo sapiens
agcaaaatatggcctttctt

SEQ ID NO: 6631353 - DNA, 18 bp, Homo sapiens
agcaaaatatttgtgaaa

SEQ ID NO: 6631354 - DNA, 13 bp, Homo sapiens
agcaaaatcaaca

SEQ ID NO: 6631355 - DNA, 23 bp, Homo sapiens
agcaaaatcatggaatggttata

SEQ ID NO: 6631356 - DNA, 15 bp, Homo sapiens
agcaaaatccaaact

SEQ ID NO: 6631357 - DNA, 21 bp, Homo sapiens
agcaaaatccaaactgctgtc

SEQ ID NO: 6631358 - DNA, 21 bp, Homo sapiens
agcaaaatccttacttccagc

SEQ ID NO: 6631359 - DNA, 14 bp, Homo sapiens
agcaaaatctaaaa

SEQ ID NO: 6631360 - DNA, 17 bp, Homo sapiens
agcaaaatctaaaatgt

SEQ ID NO: 6631361 - DNA, 18 bp, Homo sapiens
agcaaaatctaaaatgtt

SEQ ID NO: 6631362 - DNA, 16 bp, Homo sapiens
agcaaaatgaaaagag

SEQ ID NO: 6631363 - DNA, 22 bp, Homo sapiens
agcaaaatggaagcaaagacaa

SEQ ID NO: 6631364 - DNA, 23 bp, Homo sapiens
agcaaaatgtgaatgggaaaaga

SEQ ID NO: 6631365 - DNA, 22 bp, Homo sapiens
agcaaaattataagaagaggaa

SEQ ID NO: 6631366 - DNA, 13 bp, Homo sapiens
agcaaaattttta

SEQ ID NO: 6631367 - DNA, 20 bp, Homo sapiens
agcaaacaaaaatagaatat

SEQ ID NO: 6631368 - DNA, 18 bp, Homo sapiens
agcaaacaactttctgga

SEQ ID NO: 6631369 - DNA, 17 bp, Homo sapiens
agcaaacaagcttgatt

SEQ ID NO: 6631370 - DNA, 21 bp, Homo sapiens
agcaaacaatggtgtctcttt

SEQ ID NO: 6631371 - DNA, 13 bp, Homo sapiens
agcaaacacaata

SEQ ID NO: 6631372 - DNA, 13 bp, Homo sapiens
agcaaacacatta

SEQ ID NO: 6631373 - DNA, 14 bp, Homo sapiens
agcaaacagaaaaa

SEQ ID NO: 6631374 - DNA, 22 bp, Homo sapiens
agcaaacagctgaaagaggagg

SEQ ID NO: 6631375 - DNA, 19 bp, Homo sapiens
agcaaacatttctaactct

SEQ ID NO: 6631376 - DNA, 16 bp, Homo sapiens
agcaaaccagcctcag

SEQ ID NO: 6631377 - DNA, 23 bp, Homo sapiens
agcaaaccagcttgttctgggct

SEQ ID NO: 6631378 - DNA, 11 bp, Homo sapiens
agcaaaccatt

SEQ ID NO: 6631379 - DNA, 14 bp, Homo sapiens
agcaaacccaaaga

SEQ ID NO: 6631380 - DNA, 20 bp, Homo sapiens
agcaaacccaaagatgttaa

SEQ ID NO: 6631381 - DNA, 15 bp, Homo sapiens
agcaaacccagacgg

SEQ ID NO: 6631382 - DNA, 13 bp, Homo sapiens
agcaaacccagag

SEQ ID NO: 6631383 - DNA, 19 bp, Homo sapiens
agcaaacccagaggtggat

SEQ ID NO: 6631384 - DNA, 19 bp, Homo sapiens
agcaaacctaacaggagaa

SEQ ID NO: 6631385 - DNA, 20 bp, Homo sapiens
agcaaacctaacaggagaaa

SEQ ID NO: 6631386 - DNA, 19 bp, Homo sapiens
agcaaacctaattgcacaa

SEQ ID NO: 6631387 - DNA, 22 bp, Homo sapiens
agcaaacctcagtcatattctt

SEQ ID NO: 6631388 - DNA, 15 bp, Homo sapiens
agcaaacctgcccca

SEQ ID NO: 6631389 - DNA, 13 bp, Homo sapiens
agcaaacctgtaa

SEQ ID NO: 6631390 - DNA, 19 bp, Homo sapiens
agcaaactaacttgacttt

SEQ ID NO: 6631391 - DNA, 13 bp, Homo sapiens
agcaaactaagcc

SEQ ID NO: 6631392 - DNA, 17 bp, Homo sapiens
agcaaactatttcagtg

SEQ ID NO: 6631393 - DNA, 13 bp, Homo sapiens
agcaaactctgct

SEQ ID NO: 6631394 - DNA, 15 bp, Homo sapiens
agcaaactctgctgt

SEQ ID NO: 6631395 - DNA, 15 bp, Homo sapiens
agcaaagacaaaaga

SEQ ID NO: 6631396 - DNA, 16 bp, Homo sapiens
agcaaagacaaaagaa

SEQ ID NO: 6631397 - DNA, 16 bp, Homo sapiens
agcaaagacagtttct

SEQ ID NO: 6631398 - DNA, 14 bp, Homo sapiens
agcaaagagaatgt

SEQ ID NO: 6631399 - DNA, 23 bp, Homo sapiens
agcaaagaggactcgcttgtaaa

SEQ ID NO: 6631400 - DNA, 22 bp, Homo sapiens
agcaaagaggggcgctgtcctg

SEQ ID NO: 6631401 - DNA, 16 bp, Homo sapiens
agcaaagatatatatt

SEQ ID NO: 6631402 - DNA, 20 bp, Homo sapiens
agcaaagatatctcatctct

SEQ ID NO: 6631403 - DNA, 10 bp, Homo sapiens
agcaaagatg

SEQ ID NO: 6631404 - DNA, 22 bp, Homo sapiens
agcaaagatttcagtagaattt

SEQ ID NO: 6631405 - DNA, 15 bp, Homo sapiens
agcaaagcacagaga

SEQ ID NO: 6631406 - DNA, 15 bp, Homo sapiens
agcaaagcaccagct

SEQ ID NO: 6631407 - DNA, 20 bp, Homo sapiens
agcaaagccatattctaaat

SEQ ID NO: 6631408 - DNA, 18 bp, Homo sapiens
agcaaagccatccccgct

SEQ ID NO: 6631409 - DNA, 22 bp, Homo sapiens
agcaaagccccatgctggagcc

SEQ ID NO: 6631410 - DNA, 16 bp, Homo sapiens
agcaaagcccccagag

SEQ ID NO: 6631411 - DNA, 17 bp, Homo sapiens
agcaaagcccccagagc

SEQ ID NO: 6631412 - DNA, 21 bp, Homo sapiens
agcaaagcctgttcatggcag

SEQ ID NO: 6631413 - DNA, 22 bp, Homo sapiens
agcaaagcctgttcatggcaga

SEQ ID NO: 6631414 - DNA, 20 bp, Homo sapiens
agcaaagcgcccacccaggt

SEQ ID NO: 6631415 - DNA, 22 bp, Homo sapiens
agcaaagcgggttataatgaat

SEQ ID NO: 6631416 - DNA, 15 bp, Homo sapiens
agcaaaggagaaatc

SEQ ID NO: 6631417 - DNA, 16 bp, Homo sapiens
agcaaaggagaaatct

SEQ ID NO: 6631418 - DNA, 12 bp, Homo sapiens
agcaaaggcagt

SEQ ID NO: 6631419 - DNA, 20 bp, Homo sapiens
agcaaaggcagtcccgggag

SEQ ID NO: 6631420 - DNA, 17 bp, Homo sapiens
agcaaaggcccatgccc

SEQ ID NO: 6631421 - DNA, 19 bp, Homo sapiens
agcaaaggcccatgccccc

SEQ ID NO: 6631422 - DNA, 15 bp, Homo sapiens
agcaaaggccctggg

SEQ ID NO: 6631423 - DNA, 16 bp, Homo sapiens
agcaaaggccctgggt

SEQ ID NO: 6631424 - DNA, 17 bp, Homo sapiens
agcaaagggaaggactg

SEQ ID NO: 6631425 - DNA, 12 bp, Homo sapiens
agcaaagggggg

SEQ ID NO: 6631426 - DNA, 16 bp, Homo sapiens
agcaaaggtgcactcc

SEQ ID NO: 6631427 - DNA, 18 bp, Homo sapiens
agcaaaggtgcactccag

SEQ ID NO: 6631428 - DNA, 20 bp, Homo sapiens
agcaaaggtgcactccagac

SEQ ID NO: 6631429 - DNA, 22 bp, Homo sapiens
agcaaagtagtacttcttctgt

SEQ ID NO: 6631430 - DNA, 17 bp, Homo sapiens
agcaaagtcacttctcc

SEQ ID NO: 6631431 - DNA, 20 bp, Homo sapiens
agcaaagtctaaagtttaca

SEQ ID NO: 6631432 - DNA, 22 bp, Homo sapiens
agcaaagtggtaggtacttttt

SEQ ID NO: 6631433 - DNA, 20 bp, Homo sapiens
agcaaagttcaacttatttc

SEQ ID NO: 6631434 - DNA, 22 bp, Homo sapiens
agcaaagttcaacttatttcat

SEQ ID NO: 6631435 - DNA, 12 bp, Homo sapiens
agcaaataaaca

SEQ ID NO: 6631436 - DNA, 16 bp, Homo sapiens
agcaaataaacaacta

SEQ ID NO: 6631437 - DNA, 20 bp, Homo sapiens
agcaaataaacttacagatc

SEQ ID NO: 6631438 - DNA, 19 bp, Homo sapiens
agcaaataaagcagtcatg

SEQ ID NO: 6631439 - DNA, 15 bp, Homo sapiens
agcaaataaccattg

SEQ ID NO: 6631440 - DNA, 18 bp, Homo sapiens
agcaaatactgattttca

SEQ ID NO: 6631441 - DNA, 21 bp, Homo sapiens
agcaaatactgattttcaaaa

SEQ ID NO: 6631442 - DNA, 21 bp, Homo sapiens
agcaaatacttagcaaaaagt

SEQ ID NO: 6631443 - DNA, 14 bp, Homo sapiens
agcaaatagcaaat

SEQ ID NO: 6631444 - DNA, 16 bp, Homo sapiens
agcaaatatctaaata

SEQ ID NO: 6631445 - DNA, 15 bp, Homo sapiens
agcaaatatgctgtt

SEQ ID NO: 6631446 - DNA, 21 bp, Homo sapiens
agcaaatattgttcttcccat

SEQ ID NO: 6631447 - DNA, 18 bp, Homo sapiens
agcaaatatttatgacct

SEQ ID NO: 6631448 - DNA, 18 bp, Homo sapiens
agcaaatcaccacaaact

SEQ ID NO: 6631449 - DNA, 22 bp, Homo sapiens
agcaaatcaccacaaactgtaa

SEQ ID NO: 6631450 - DNA, 20 bp, Homo sapiens
agcaaatcagaaacttgtga

SEQ ID NO: 6631451 - DNA, 13 bp, Homo sapiens
agcaaatcagaca

SEQ ID NO: 6631452 - DNA, 15 bp, Homo sapiens
agcaaatcagacaca

SEQ ID NO: 6631453 - DNA, 22 bp, Homo sapiens
agcaaatcatctgcattcctga

SEQ ID NO: 6631454 - DNA, 14 bp, Homo sapiens
agcaaatcctcttc

SEQ ID NO: 6631455 - DNA, 22 bp, Homo sapiens
agcaaatcgaatgaaattaact

SEQ ID NO: 6631456 - DNA, 11 bp, Homo sapiens
agcaaatcttt

SEQ ID NO: 6631457 - DNA, 22 bp, Homo sapiens
agcaaatgcaaaaactctttga

SEQ ID NO: 6631458 - DNA, 16 bp, Homo sapiens
agcaaatgcattctat

SEQ ID NO: 6631459 - DNA, 22 bp, Homo sapiens
agcaaatgcattctatcgttat

SEQ ID NO: 6631460 - DNA, 17 bp, Homo sapiens
agcaaatgcctgccaaa

SEQ ID NO: 6631461 - DNA, 11 bp, Homo sapiens
agcaaatgctg

SEQ ID NO: 6631462 - DNA, 19 bp, Homo sapiens
agcaaatgctttgtgacta

SEQ ID NO: 6631463 - DNA, 23 bp, Homo sapiens
agcaaatgctttgtgactattaa

SEQ ID NO: 6631464 - DNA, 18 bp, Homo sapiens
agcaaatggaaaatgtat

SEQ ID NO: 6631465 - DNA, 13 bp, Homo sapiens
agcaaatggcgtt

SEQ ID NO: 6631466 - DNA, 13 bp, Homo sapiens
agcaaatgggcat

SEQ ID NO: 6631467 - DNA, 21 bp, Homo sapiens
agcaaatgggcattttacaag

SEQ ID NO: 6631468 - DNA, 19 bp, Homo sapiens
agcaaatgtcatgctgcct

SEQ ID NO: 6631469 - DNA, 14 bp, Homo sapiens
agcaaatgttacat

SEQ ID NO: 6631470 - DNA, 15 bp, Homo sapiens
agcaaatgttacata

SEQ ID NO: 6631471 - DNA, 17 bp, Homo sapiens
agcaaatgttatgcata

SEQ ID NO: 6631472 - DNA, 17 bp, Homo sapiens
agcaaatgtttactgta

SEQ ID NO: 6631473 - DNA, 20 bp, Homo sapiens
agcaaatgtttactgtatca

SEQ ID NO: 6631474 - DNA, 13 bp, Homo sapiens
agcaaatgtttct

SEQ ID NO: 6631475 - DNA, 14 bp, Homo sapiens
agcaaatgtttctg

SEQ ID NO: 6631476 - DNA, 14 bp, Homo sapiens
agcaaattccagat

SEQ ID NO: 6631477 - DNA, 23 bp, Homo sapiens
agcaaattccagatttgtttcct

SEQ ID NO: 6631478 - DNA, 19 bp, Homo sapiens
agcaaattctgtttttcta

SEQ ID NO: 6631479 - DNA, 14 bp, Homo sapiens
agcaaatttataat

SEQ ID NO: 6631480 - DNA, 24 bp, Homo sapiens
agcaaatttcaaaagacatgttgt

SEQ ID NO: 6631481 - DNA, 19 bp, Homo sapiens
agcaaatttcatctttcca

SEQ ID NO: 6631482 - DNA, 20 bp, Homo sapiens
agcaaatttctctctttctt

SEQ ID NO: 6631483 - DNA, 14 bp, Homo sapiens
agcaacaaaatcat

SEQ ID NO: 6631484 - DNA, 13 bp, Homo sapiens
agcaacaaagaaa

SEQ ID NO: 6631485 - DNA, 19 bp, Homo sapiens
agcaacaaaggatttgaaa

SEQ ID NO: 6631486 - DNA, 19 bp, Homo sapiens
agcaacaaatccatggacc

SEQ ID NO: 6631487 - DNA, 13 bp, Homo sapiens
agcaacaagctat

SEQ ID NO: 6631488 - DNA, 16 bp, Homo sapiens
agcaacaagctatttt

SEQ ID NO: 6631489 - DNA, 23 bp, Homo sapiens
agcaacaagtagagatgaagtta

SEQ ID NO: 6631490 - DNA, 21 bp, Homo sapiens
agcaacaatttatgaattgaa

SEQ ID NO: 6631491 - DNA, 17 bp, Homo sapiens
agcaacaattttcagat

SEQ ID NO: 6631492 - DNA, 18 bp, Homo sapiens
agcaacacaaagcttttg

SEQ ID NO: 6631493 - DNA, 13 bp, Homo sapiens
agcaacacagagc

SEQ ID NO: 6631494 - DNA, 15 bp, Homo sapiens
agcaacacagaggaa

SEQ ID NO: 6631495 - DNA, 22 bp, Homo sapiens
agcaacacagaggaatttatac

SEQ ID NO: 6631496 - DNA, 15 bp, Homo sapiens
agcaacacccaagtc

SEQ ID NO: 6631497 - DNA, 21 bp, Homo sapiens
agcaacacccaagtccacccc

SEQ ID NO: 6631498 - DNA, 13 bp, Homo sapiens
agcaacagaaaaa

SEQ ID NO: 6631499 - DNA, 18 bp, Homo sapiens
agcaacagactctcacag

SEQ ID NO: 6631500 - DNA, 20 bp, Homo sapiens
agcaacagagtgagaccctg

SEQ ID NO: 6631501 - DNA, 16 bp, Homo sapiens
agcaacagataaagtt

SEQ ID NO: 6631502 - DNA, 13 bp, Homo sapiens
agcaacagataga

SEQ ID NO: 6631503 - DNA, 14 bp, Homo sapiens
agcaacagcaaaag

SEQ ID NO: 6631504 - DNA, 24 bp, Homo sapiens
agcaacagcctttgaatgtaacca

SEQ ID NO: 6631505 - DNA, 13 bp, Homo sapiens
agcaacagctgga

SEQ ID NO: 6631506 - DNA, 14 bp, Homo sapiens
agcaacagcttcag

SEQ ID NO: 6631507 - DNA, 14 bp, Homo sapiens
agcaacaggaaaaa

SEQ ID NO: 6631508 - DNA, 15 bp, Homo sapiens
agcaacaggaccagg

SEQ ID NO: 6631509 - DNA, 17 bp, Homo sapiens
agcaacatatctctgcc

SEQ ID NO: 6631510 - DNA, 21 bp, Homo sapiens
agcaacatctagcaaatgtta

SEQ ID NO: 6631511 - DNA, 13 bp, Homo sapiens
agcaacatgaatt

SEQ ID NO: 6631512 - DNA, 18 bp, Homo sapiens
agcaacatggaggatggt

SEQ ID NO: 6631513 - DNA, 22 bp, Homo sapiens
agcaacattataatggccctgt

SEQ ID NO: 6631514 - DNA, 14 bp, Homo sapiens
agcaacatttgtat

SEQ ID NO: 6631515 - DNA, 21 bp, Homo sapiens
agcaacattttcttgaatttt

SEQ ID NO: 6631516 - DNA, 23 bp, Homo sapiens
agcaacattttcttgaatttttt

SEQ ID NO: 6631517 - DNA, 14 bp, Homo sapiens
agcaaccaaaaaga

SEQ ID NO: 6631518 - DNA, 15 bp, Homo sapiens
agcaaccacactgct

SEQ ID NO: 6631519 - DNA, 16 bp, Homo sapiens
agcaaccagagcactg

SEQ ID NO: 6631520 - DNA, 17 bp, Homo sapiens
agcaaccagagcactgt

SEQ ID NO: 6631521 - DNA, 14 bp, Homo sapiens
agcaaccccaggct

SEQ ID NO: 6631522 - DNA, 15 bp, Homo sapiens
agcaaccccaggctg

SEQ ID NO: 6631523 - DNA, 20 bp, Homo sapiens
agcaacccctggaccccagc

SEQ ID NO: 6631524 - DNA, 23 bp, Homo sapiens
agcaacccctggaccccagcctc

SEQ ID NO: 6631525 - DNA, 24 bp, Homo sapiens
agcaacccctggaccccagcctca

SEQ ID NO: 6631526 - DNA, 21 bp, Homo sapiens
agcaacccctgtacccagctc

SEQ ID NO: 6631527 - DNA, 18 bp, Homo sapiens
agcaacccgctggagccc

SEQ ID NO: 6631528 - DNA, 19 bp, Homo sapiens
agcaacccgctggagccca

SEQ ID NO: 6631529 - DNA, 21 bp, Homo sapiens
agcaacccgctggagcccaca

SEQ ID NO: 6631530 - DNA, 22 bp, Homo sapiens
agcaacccgctggagcccacag

SEQ ID NO: 6631531 - DNA, 18 bp, Homo sapiens
agcaaccctacagtatat

SEQ ID NO: 6631532 - DNA, 19 bp, Homo sapiens
agcaaccctacagtatata

SEQ ID NO: 6631533 - DNA, 15 bp, Homo sapiens
agcaaccctctgaag

SEQ ID NO: 6631534 - DNA, 20 bp, Homo sapiens
agcaaccctctgaagaaggg

SEQ ID NO: 6631535 - DNA, 16 bp, Homo sapiens
agcaaccctgtgatac

SEQ ID NO: 6631536 - DNA, 19 bp, Homo sapiens
agcaacccttcctgctgct

SEQ ID NO: 6631537 - DNA, 20 bp, Homo sapiens
agcaaccgcctcaaaatgtg

SEQ ID NO: 6631538 - DNA, 15 bp, Homo sapiens
agcaaccgtggccct

SEQ ID NO: 6631539 - DNA, 19 bp, Homo sapiens
agcaaccgtggcccttcct

SEQ ID NO: 6631540 - DNA, 15 bp, Homo sapiens
agcaacctacccagc

SEQ ID NO: 6631541 - DNA, 13 bp, Homo sapiens
agcaacctcccaa

SEQ ID NO: 6631542 - DNA, 19 bp, Homo sapiens
agcaacctgtaactcacat

SEQ ID NO: 6631543 - DNA, 15 bp, Homo sapiens
agcaacctgtagagt

SEQ ID NO: 6631544 - DNA, 16 bp, Homo sapiens
agcaaccttaaagcaa

SEQ ID NO: 6631545 - DNA, 17 bp, Homo sapiens
agcaaccttaaagcaat

SEQ ID NO: 6631546 - DNA, 16 bp, Homo sapiens
agcaaccttcatttta

SEQ ID NO: 6631547 - DNA, 19 bp, Homo sapiens
agcaacctttcacctttgt

SEQ ID NO: 6631548 - DNA, 23 bp, Homo sapiens
agcaacctttcacctttgtgtat

SEQ ID NO: 6631549 - DNA, 14 bp, Homo sapiens
agcaacctttccct

SEQ ID NO: 6631550 - DNA, 13 bp, Homo sapiens
agcaacgccagtg

SEQ ID NO: 6631551 - DNA, 19 bp, Homo sapiens
agcaacgcctgccttctgg

SEQ ID NO: 6631552 - DNA, 19 bp, Homo sapiens
agcaacgctattccagctg

SEQ ID NO: 6631553 - DNA, 23 bp, Homo sapiens
agcaacgctattccagctgtccc

SEQ ID NO: 6631554 - DNA, 17 bp, Homo sapiens
agcaacgcttgtagaac

SEQ ID NO: 6631555 - DNA, 23 bp, Homo sapiens
agcaacggcccatagccttgggg

SEQ ID NO: 6631556 - DNA, 21 bp, Homo sapiens
agcaacgggaacacctgctga

SEQ ID NO: 6631557 - DNA, 21 bp, Homo sapiens
agcaactaaaatgtgtcttgc

SEQ ID NO: 6631558 - DNA, 15 bp, Homo sapiens
agcaactaattttct

SEQ ID NO: 6631559 - DNA, 16 bp, Homo sapiens
agcaactacaacttct

SEQ ID NO: 6631560 - DNA, 16 bp, Homo sapiens
agcaactaggccttca

SEQ ID NO: 6631561 - DNA, 19 bp, Homo sapiens
agcaactcattggtggtag

SEQ ID NO: 6631562 - DNA, 14 bp, Homo sapiens
agcaactcccacga

SEQ ID NO: 6631563 - DNA, 21 bp, Homo sapiens
agcaactcctgttctttgggc

SEQ ID NO: 6631564 - DNA, 22 bp, Homo sapiens
agcaactcttatttctttcctt

SEQ ID NO: 6631565 - DNA, 15 bp, Homo sapiens
agcaactgaaaatga

SEQ ID NO: 6631566 - DNA, 17 bp, Homo sapiens
agcaactgaagacaatt

SEQ ID NO: 6631567 - DNA, 14 bp, Homo sapiens
agcaactgaataaa

SEQ ID NO: 6631568 - DNA, 15 bp, Homo sapiens
agcaactgaataaat

SEQ ID NO: 6631569 - DNA, 19 bp, Homo sapiens
agcaactgaataaatacct

SEQ ID NO: 6631570 - DNA, 22 bp, Homo sapiens
agcaactgaataaatacctctt

SEQ ID NO: 6631571 - DNA, 23 bp, Homo sapiens
agcaactgaataaatacctctta

SEQ ID NO: 6631572 - DNA, 13 bp, Homo sapiens
agcaactggaaaa

SEQ ID NO: 6631573 - DNA, 19 bp, Homo sapiens
agcaactggttaggtagca

SEQ ID NO: 6631574 - DNA, 22 bp, Homo sapiens
agcaactggttaggtagcaaca

SEQ ID NO: 6631575 - DNA, 22 bp, Homo sapiens
agcaactgtctatttctgctga

SEQ ID NO: 6631576 - DNA, 15 bp, Homo sapiens
agcaactgttagctg

SEQ ID NO: 6631577 - DNA, 22 bp, Homo sapiens
agcaacttcatcccagctgctg

SEQ ID NO: 6631578 - DNA, 20 bp, Homo sapiens
agcaacttctagcatataga

SEQ ID NO: 6631579 - DNA, 12 bp, Homo sapiens
agcaacttgaac

SEQ ID NO: 6631580 - DNA, 13 bp, Homo sapiens
agcaacttgcttc

SEQ ID NO: 6631581 - DNA, 19 bp, Homo sapiens
agcaactttccaacttttc

SEQ ID NO: 6631582 - DNA, 15 bp, Homo sapiens
agcaacttttctcat

SEQ ID NO: 6631583 - DNA, 15 bp, Homo sapiens
agcaacttttgtgta

SEQ ID NO: 6631584 - DNA, 18 bp, Homo sapiens
agcaagaaaaaaaaatgc

SEQ ID NO: 6631585 - DNA, 22 bp, Homo sapiens
agcaagaaaaaagtacagaaca

SEQ ID NO: 6631586 - DNA, 12 bp, Homo sapiens
agcaagaaacag

SEQ ID NO: 6631587 - DNA, 11 bp, Homo sapiens
agcaagaaata

SEQ ID NO: 6631588 - DNA, 15 bp, Homo sapiens
agcaagaagattcta

SEQ ID NO: 6631589 - DNA, 19 bp, Homo sapiens
agcaagaagattctaaaac

SEQ ID NO: 6631590 - DNA, 22 bp, Homo sapiens
agcaagaaggaaagatttgtga

SEQ ID NO: 6631591 - DNA, 12 bp, Homo sapiens
agcaagaaggag

SEQ ID NO: 6631592 - DNA, 22 bp, Homo sapiens
agcaagaaggcaacttgaagaa

SEQ ID NO: 6631593 - DNA, 18 bp, Homo sapiens
agcaagaagggagttcca

SEQ ID NO: 6631594 - DNA, 21 bp, Homo sapiens
agcaagaataaaaaagaaatc

SEQ ID NO: 6631595 - DNA, 14 bp, Homo sapiens
agcaagacagctct

SEQ ID NO: 6631596 - DNA, 23 bp, Homo sapiens
agcaagaccaaatcattgtatca

SEQ ID NO: 6631597 - DNA, 19 bp, Homo sapiens
agcaagacctcatctgtgg

SEQ ID NO: 6631598 - DNA, 15 bp, Homo sapiens
agcaagacctcgtct

SEQ ID NO: 6631599 - DNA, 13 bp, Homo sapiens
agcaagacgctgt

SEQ ID NO: 6631600 - DNA, 23 bp, Homo sapiens
agcaagacgctgtgctgccctgc

SEQ ID NO: 6631601 - DNA, 16 bp, Homo sapiens
agcaagacgtcctgga

SEQ ID NO: 6631602 - DNA, 17 bp, Homo sapiens
agcaagacgtcctggaa

SEQ ID NO: 6631603 - DNA, 18 bp, Homo sapiens
agcaagactctttcaaaa

SEQ ID NO: 6631604 - DNA, 14 bp, Homo sapiens
agcaagactgggcc

SEQ ID NO: 6631605 - DNA, 17 bp, Homo sapiens
agcaagactgttagccc

SEQ ID NO: 6631606 - DNA, 23 bp, Homo sapiens
agcaagacttctctttgcctcaa

SEQ ID NO: 6631607 - DNA, 23 bp, Homo sapiens
agcaagagagcagcaaggtcttg

SEQ ID NO: 6631608 - DNA, 14 bp, Homo sapiens
agcaagagatgaga

SEQ ID NO: 6631609 - DNA, 12 bp, Homo sapiens
agcaagagccag

SEQ ID NO: 6631610 - DNA, 13 bp, Homo sapiens
agcaagagctggc

SEQ ID NO: 6631611 - DNA, 17 bp, Homo sapiens
agcaagagctggcaaag

SEQ ID NO: 6631612 - DNA, 23 bp, Homo sapiens
agcaagagctggcaaaggtggct

SEQ ID NO: 6631613 - DNA, 19 bp, Homo sapiens
agcaagaggccgtggctgc

SEQ ID NO: 6631614 - DNA, 17 bp, Homo sapiens
agcaagagtaagcagtg

SEQ ID NO: 6631615 - DNA, 18 bp, Homo sapiens
agcaagagtaagcagtgt

SEQ ID NO: 6631616 - DNA, 16 bp, Homo sapiens
agcaagataaacatta

SEQ ID NO: 6631617 - DNA, 18 bp, Homo sapiens
agcaagatattgatcaaa

SEQ ID NO: 6631618 - DNA, 21 bp, Homo sapiens
agcaagatcctgtctttaagg

SEQ ID NO: 6631619 - DNA, 17 bp, Homo sapiens
agcaagatcttgtctcc

SEQ ID NO: 6631620 - DNA, 23 bp, Homo sapiens
agcaagatgatttttaagtacaa

SEQ ID NO: 6631621 - DNA, 14 bp, Homo sapiens
agcaagatgcaaat

SEQ ID NO: 6631622 - DNA, 15 bp, Homo sapiens
agcaagatgtactat

SEQ ID NO: 6631623 - DNA, 22 bp, Homo sapiens
agcaagatgtttcttgcctttt

SEQ ID NO: 6631624 - DNA, 19 bp, Homo sapiens
agcaagatgttttgtataa

SEQ ID NO: 6631625 - DNA, 21 bp, Homo sapiens
agcaagattttgtcaaaaact

SEQ ID NO: 6631626 - DNA, 16 bp, Homo sapiens
agcaagcaacacagag

SEQ ID NO: 6631627 - DNA, 15 bp, Homo sapiens
agcaagcaagaggcc

SEQ ID NO: 6631628 - DNA, 23 bp, Homo sapiens
agcaagcacctgggtgtgctcca

SEQ ID NO: 6631629 - DNA, 14 bp, Homo sapiens
agcaagcaggagtg

SEQ ID NO: 6631630 - DNA, 13 bp, Homo sapiens
agcaagcaggggt

SEQ ID NO: 6631631 - DNA, 18 bp, Homo sapiens
agcaagcagtagcatttg

SEQ ID NO: 6631632 - DNA, 19 bp, Homo sapiens
agcaagcagtctaccctgt

SEQ ID NO: 6631633 - DNA, 22 bp, Homo sapiens
agcaagcagtctaccctgtcct

SEQ ID NO: 6631634 - DNA, 15 bp, Homo sapiens
agcaagcatctccgc

SEQ ID NO: 6631635 - DNA, 15 bp, Homo sapiens
agcaagcattcagaa

SEQ ID NO: 6631636 - DNA, 21 bp, Homo sapiens
agcaagcattcagaagaaaaa

SEQ ID NO: 6631637 - DNA, 23 bp, Homo sapiens
agcaagccagccaatagaatggg

SEQ ID NO: 6631638 - DNA, 13 bp, Homo sapiens
agcaagccaggag

SEQ ID NO: 6631639 - DNA, 17 bp, Homo sapiens
agcaagccaggagaaga

SEQ ID NO: 6631640 - DNA, 14 bp, Homo sapiens
agcaagccatcatc

SEQ ID NO: 6631641 - DNA, 22 bp, Homo sapiens
agcaagccggcagaaatagcta

SEQ ID NO: 6631642 - DNA, 13 bp, Homo sapiens
agcaagcgggagc

SEQ ID NO: 6631643 - DNA, 11 bp, Homo sapiens
agcaagctccc

SEQ ID NO: 6631644 - DNA, 20 bp, Homo sapiens
agcaagctctgccctggctg

SEQ ID NO: 6631645 - DNA, 21 bp, Homo sapiens
agcaagctctgccctggctgt

SEQ ID NO: 6631646 - DNA, 23 bp, Homo sapiens
agcaagctctgccctggctgtgg

SEQ ID NO: 6631647 - DNA, 16 bp, Homo sapiens
agcaagctcttccctt

SEQ ID NO: 6631648 - DNA, 16 bp, Homo sapiens
agcaagctcttctcct

SEQ ID NO: 6631649 - DNA, 22 bp, Homo sapiens
agcaagctgcccagccctggcc

SEQ ID NO: 6631650 - DNA, 13 bp, Homo sapiens
agcaagctggcct

SEQ ID NO: 6631651 - DNA, 14 bp, Homo sapiens
agcaagctggcctc

SEQ ID NO: 6631652 - DNA, 10 bp, Homo sapiens
agcaagctgt

SEQ ID NO: 6631653 - DNA, 14 bp, Homo sapiens
agcaagctgtgtta

SEQ ID NO: 6631654 - DNA, 19 bp, Homo sapiens
agcaagctgtgttacttga

SEQ ID NO: 6631655 - DNA, 17 bp, Homo sapiens
agcaagcttaatggctg

SEQ ID NO: 6631656 - DNA, 22 bp, Homo sapiens
agcaagcttttacaacagtgct

SEQ ID NO: 6631657 - DNA, 17 bp, Homo sapiens
agcaagcttttttattt

SEQ ID NO: 6631658 - DNA, 13 bp, Homo sapiens
agcaaggaaacat

SEQ ID NO: 6631659 - DNA, 21 bp, Homo sapiens
agcaaggaaatgtcctgcatg

SEQ ID NO: 6631660 - DNA, 16 bp, Homo sapiens
agcaaggaagcagagc

SEQ ID NO: 6631661 - DNA, 16 bp, Homo sapiens
agcaaggacattgccc

SEQ ID NO: 6631662 - DNA, 23 bp, Homo sapiens
agcaaggacattgccccaagata

SEQ ID NO: 6631663 - DNA, 20 bp, Homo sapiens
agcaaggaccagtgagacag

SEQ ID NO: 6631664 - DNA, 18 bp, Homo sapiens
agcaaggactgcccttca

SEQ ID NO: 6631665 - DNA, 17 bp, Homo sapiens
agcaaggagatttacaa

SEQ ID NO: 6631666 - DNA, 15 bp, Homo sapiens
agcaaggatatcaga

SEQ ID NO: 6631667 - DNA, 14 bp, Homo sapiens
agcaaggcacagcc

SEQ ID NO: 6631668 - DNA, 15 bp, Homo sapiens
agcaaggcacagcct

SEQ ID NO: 6631669 - DNA, 14 bp, Homo sapiens
agcaaggcacaggc

SEQ ID NO: 6631670 - DNA, 19 bp, Homo sapiens
agcaaggcagaaggccagg

SEQ ID NO: 6631671 - DNA, 15 bp, Homo sapiens
agcaaggccacctct

SEQ ID NO: 6631672 - DNA, 21 bp, Homo sapiens
agcaaggccacctcttcctgg

SEQ ID NO: 6631673 - DNA, 13 bp, Homo sapiens
agcaaggccaggg

SEQ ID NO: 6631674 - DNA, 17 bp, Homo sapiens
agcaaggcccgagcagc

SEQ ID NO: 6631675 - DNA, 21 bp, Homo sapiens
agcaaggcccgagcagctgag

SEQ ID NO: 6631676 - DNA, 22 bp, Homo sapiens
agcaaggcccgagcagctgagc

SEQ ID NO: 6631677 - DNA, 12 bp, Homo sapiens
agcaaggccctg

SEQ ID NO: 6631678 - DNA, 15 bp, Homo sapiens
agcaaggccctgctg

SEQ ID NO: 6631679 - DNA, 19 bp, Homo sapiens
agcaaggccctgctgccca

SEQ ID NO: 6631680 - DNA, 17 bp, Homo sapiens
agcaaggctgccctgtc

SEQ ID NO: 6631681 - DNA, 16 bp, Homo sapiens
agcaaggctgctaagt

SEQ ID NO: 6631682 - DNA, 21 bp, Homo sapiens
agcaaggctgctaagtggaag

SEQ ID NO: 6631683 - DNA, 14 bp, Homo sapiens
agcaaggctggggt

SEQ ID NO: 6631684 - DNA, 18 bp, Homo sapiens
agcaagggacagaaaaga

SEQ ID NO: 6631685 - DNA, 13 bp, Homo sapiens
agcaagggacctg

SEQ ID NO: 6631686 - DNA, 23 bp, Homo sapiens
agcaagggaccttcatgcccttc

SEQ ID NO: 6631687 - DNA, 14 bp, Homo sapiens
agcaagggagaaaa

SEQ ID NO: 6631688 - DNA, 20 bp, Homo sapiens
agcaagggagatttttgaat

SEQ ID NO: 6631689 - DNA, 17 bp, Homo sapiens
agcaaggggaccccgag

SEQ ID NO: 6631690 - DNA, 17 bp, Homo sapiens
agcaaggggaccttggc

SEQ ID NO: 6631691 - DNA, 13 bp, Homo sapiens
agcaaggggctgc

SEQ ID NO: 6631692 - DNA, 24 bp, Homo sapiens
agcaagggggaaggctgcaaagta

SEQ ID NO: 6631693 - DNA, 18 bp, Homo sapiens
agcaagggggtgatgtag

SEQ ID NO: 6631694 - DNA, 16 bp, Homo sapiens
agcaaggtcatttctt

SEQ ID NO: 6631695 - DNA, 19 bp, Homo sapiens
agcaaggtcttgctctcct

SEQ ID NO: 6631696 - DNA, 18 bp, Homo sapiens
agcaaggtggacatcttc

SEQ ID NO: 6631697 - DNA, 20 bp, Homo sapiens
agcaaggtgggtggaaacta

SEQ ID NO: 6631698 - DNA, 24 bp, Homo sapiens
agcaaggtgtggaggctcctgtgg

SEQ ID NO: 6631699 - DNA, 14 bp, Homo sapiens
agcaaggtttctgg

SEQ ID NO: 6631700 - DNA, 16 bp, Homo sapiens
agcaagtactttgtct

SEQ ID NO: 6631701 - DNA, 15 bp, Homo sapiens
agcaagtagataaat

SEQ ID NO: 6631702 - DNA, 19 bp, Homo sapiens
agcaagtatccttcattgt

SEQ ID NO: 6631703 - DNA, 15 bp, Homo sapiens
agcaagtcagaatag

SEQ ID NO: 6631704 - DNA, 13 bp, Homo sapiens
agcaagtcccaga

SEQ ID NO: 6631705 - DNA, 22 bp, Homo sapiens
agcaagtcccagacaaggagag

SEQ ID NO: 6631706 - DNA, 17 bp, Homo sapiens
agcaagtgagagagatg

SEQ ID NO: 6631707 - DNA, 18 bp, Homo sapiens
agcaagtgagagagatgg

SEQ ID NO: 6631708 - DNA, 16 bp, Homo sapiens
agcaagtgagagctgg

SEQ ID NO: 6631709 - DNA, 13 bp, Homo sapiens
agcaagtgaggcc

SEQ ID NO: 6631710 - DNA, 23 bp, Homo sapiens
agcaagtgagtctggtggaggag

SEQ ID NO: 6631711 - DNA, 14 bp, Homo sapiens
agcaagtgcccagt

SEQ ID NO: 6631712 - DNA, 13 bp, Homo sapiens
agcaagtggtcct

SEQ ID NO: 6631713 - DNA, 21 bp, Homo sapiens
agcaagtgtgaatactgcttg

SEQ ID NO: 6631714 - DNA, 17 bp, Homo sapiens
agcaagtgttcactgct

SEQ ID NO: 6631715 - DNA, 19 bp, Homo sapiens
agcaagttcactacagcat

SEQ ID NO: 6631716 - DNA, 20 bp, Homo sapiens
agcaagttcctgagtgcgtg

SEQ ID NO: 6631717 - DNA, 18 bp, Homo sapiens
agcaagttcgtctgttgt

SEQ ID NO: 6631718 - DNA, 21 bp, Homo sapiens
agcaagttctagagaagaggc

SEQ ID NO: 6631719 - DNA, 17 bp, Homo sapiens
agcaataaaaactgtct

SEQ ID NO: 6631720 - DNA, 23 bp, Homo sapiens
agcaataaaaactgtctgtctcc

SEQ ID NO: 6631721 - DNA, 13 bp, Homo sapiens
agcaataaaactg

SEQ ID NO: 6631722 - DNA, 18 bp, Homo sapiens
agcaataaaactgctagt

SEQ ID NO: 6631723 - DNA, 16 bp, Homo sapiens
agcaataaagaagagt

SEQ ID NO: 6631724 - DNA, 14 bp, Homo sapiens
agcaataaagctct

SEQ ID NO: 6631725 - DNA, 14 bp, Homo sapiens
agcaataaataaca

SEQ ID NO: 6631726 - DNA, 19 bp, Homo sapiens
agcaataaataacacttgt

SEQ ID NO: 6631727 - DNA, 13 bp, Homo sapiens
agcaataaatgaa

SEQ ID NO: 6631728 - DNA, 15 bp, Homo sapiens
agcaataaatgaatg

SEQ ID NO: 6631729 - DNA, 16 bp, Homo sapiens
agcaataaatgctttt

SEQ ID NO: 6631730 - DNA, 18 bp, Homo sapiens
agcaataaatgttttaat

SEQ ID NO: 6631731 - DNA, 15 bp, Homo sapiens
agcaataactccaag

SEQ ID NO: 6631732 - DNA, 16 bp, Homo sapiens
agcaataactccaagc

SEQ ID NO: 6631733 - DNA, 18 bp, Homo sapiens
agcaataactccaagcag

SEQ ID NO: 6631734 - DNA, 19 bp, Homo sapiens
agcaataactccaagcaga

SEQ ID NO: 6631735 - DNA, 20 bp, Homo sapiens
agcaataactccaagcagac

SEQ ID NO: 6631736 - DNA, 23 bp, Homo sapiens
agcaataacttctatgttggttt

SEQ ID NO: 6631737 - DNA, 15 bp, Homo sapiens
agcaataagaaatga

SEQ ID NO: 6631738 - DNA, 20 bp, Homo sapiens
agcaataagttcattaaaca

SEQ ID NO: 6631739 - DNA, 23 bp, Homo sapiens
agcaataagttcattaaacagaa

SEQ ID NO: 6631740 - DNA, 22 bp, Homo sapiens
agcaataagttgaatgataata

SEQ ID NO: 6631741 - DNA, 19 bp, Homo sapiens
agcaataatggtcccatcc

SEQ ID NO: 6631742 - DNA, 20 bp, Homo sapiens
agcaataatggtcccatcca

SEQ ID NO: 6631743 - DNA, 21 bp, Homo sapiens
agcaataatggtcccatccag

SEQ ID NO: 6631744 - DNA, 19 bp, Homo sapiens
agcaataattaggatctat

SEQ ID NO: 6631745 - DNA, 22 bp, Homo sapiens
agcaataattaggatctatgca

SEQ ID NO: 6631746 - DNA, 13 bp, Homo sapiens
agcaataattgtt

SEQ ID NO: 6631747 - DNA, 15 bp, Homo sapiens
agcaataattgtttc

SEQ ID NO: 6631748 - DNA, 11 bp, Homo sapiens
agcaatacaac

SEQ ID NO: 6631749 - DNA, 16 bp, Homo sapiens
agcaatacaactttac

SEQ ID NO: 6631750 - DNA, 20 bp, Homo sapiens
agcaatacaactttaccata

SEQ ID NO: 6631751 - DNA, 22 bp, Homo sapiens
agcaataccctgtctttaaaaa

SEQ ID NO: 6631752 - DNA, 20 bp, Homo sapiens
agcaatacgtttgtgcagaa

SEQ ID NO: 6631753 - DNA, 16 bp, Homo sapiens
agcaatactcatcaga

SEQ ID NO: 6631754 - DNA, 20 bp, Homo sapiens
agcaatactgtttccatttt

SEQ ID NO: 6631755 - DNA, 20 bp, Homo sapiens
agcaataggtagctggggag

SEQ ID NO: 6631756 - DNA, 16 bp, Homo sapiens
agcaatatattaccag

SEQ ID NO: 6631757 - DNA, 14 bp, Homo sapiens
agcaatatcaaaag

SEQ ID NO: 6631758 - DNA, 12 bp, Homo sapiens
agcaatatgtca

SEQ ID NO: 6631759 - DNA, 18 bp, Homo sapiens
agcaatatgttagcaaga

SEQ ID NO: 6631760 - DNA, 14 bp, Homo sapiens
agcaatattgcctg

SEQ ID NO: 6631761 - DNA, 21 bp, Homo sapiens
agcaatattgcctgtgcttct

SEQ ID NO: 6631762 - DNA, 13 bp, Homo sapiens
agcaatattgtat

SEQ ID NO: 6631763 - DNA, 21 bp, Homo sapiens
agcaatatttaacaatttatt

SEQ ID NO: 6631764 - DNA, 16 bp, Homo sapiens
agcaatatttatggat

SEQ ID NO: 6631765 - DNA, 22 bp, Homo sapiens
agcaatatttatggatgcaaca

SEQ ID NO: 6631766 - DNA, 18 bp, Homo sapiens
agcaatattttttattca

SEQ ID NO: 6631767 - DNA, 13 bp, Homo sapiens
agcaatcacagga

SEQ ID NO: 6631768 - DNA, 17 bp, Homo sapiens
agcaatcagaacttcag

SEQ ID NO: 6631769 - DNA, 13 bp, Homo sapiens
agcaatcagcaaa

SEQ ID NO: 6631770 - DNA, 23 bp, Homo sapiens
agcaatcagcaaacacaataaga

SEQ ID NO: 6631771 - DNA, 18 bp, Homo sapiens
agcaatcatttcccctcc

SEQ ID NO: 6631772 - DNA, 20 bp, Homo sapiens
agcaatccatgttagttttt

SEQ ID NO: 6631773 - DNA, 22 bp, Homo sapiens
agcaatccatgttagtttttac

SEQ ID NO: 6631774 - DNA, 19 bp, Homo sapiens
agcaatcctaggtagggtt

SEQ ID NO: 6631775 - DNA, 22 bp, Homo sapiens
agcaatcctcctacctcagcct

SEQ ID NO: 6631776 - DNA, 19 bp, Homo sapiens
agcaatcctcctgcctcag

SEQ ID NO: 6631777 - DNA, 23 bp, Homo sapiens
agcaatcctctcacctcagcctc

SEQ ID NO: 6631778 - DNA, 17 bp, Homo sapiens
agcaatccttaaaaaga

SEQ ID NO: 6631779 - DNA, 19 bp, Homo sapiens
agcaatcgggataaaacag

SEQ ID NO: 6631780 - DNA, 13 bp, Homo sapiens
agcaatcggttcc

SEQ ID NO: 6631781 - DNA, 17 bp, Homo sapiens
agcaatctccatgtgta

SEQ ID NO: 6631782 - DNA, 23 bp, Homo sapiens
agcaatctccttactgtgtttca

SEQ ID NO: 6631783 - DNA, 23 bp, Homo sapiens
agcaatctcttcattattctctg

SEQ ID NO: 6631784 - DNA, 13 bp, Homo sapiens
agcaatctgaccc

SEQ ID NO: 6631785 - DNA, 20 bp, Homo sapiens
agcaatctgattcagcatca

SEQ ID NO: 6631786 - DNA, 12 bp, Homo sapiens
agcaatctgcct

SEQ ID NO: 6631787 - DNA, 13 bp, Homo sapiens
agcaatctggaaa

SEQ ID NO: 6631788 - DNA, 14 bp, Homo sapiens
agcaatctggaaaa

SEQ ID NO: 6631789 - DNA, 14 bp, Homo sapiens
agcaatctgtcttt

SEQ ID NO: 6631790 - DNA, 20 bp, Homo sapiens
agcaatctgtgtactgaaca

SEQ ID NO: 6631791 - DNA, 23 bp, Homo sapiens
agcaatcttgctgtgaaacagtg

SEQ ID NO: 6631792 - DNA, 14 bp, Homo sapiens
agcaatcttggcag

SEQ ID NO: 6631793 - DNA, 16 bp, Homo sapiens
agcaatctttgaaata

SEQ ID NO: 6631794 - DNA, 20 bp, Homo sapiens
agcaatgaactcaagaagga

SEQ ID NO: 6631795 - DNA, 19 bp, Homo sapiens
agcaatgacatctcagggg

SEQ ID NO: 6631796 - DNA, 21 bp, Homo sapiens
agcaatgacatctcaggggcc

SEQ ID NO: 6631797 - DNA, 19 bp, Homo sapiens
agcaatgatgtccagaaga

SEQ ID NO: 6631798 - DNA, 15 bp, Homo sapiens
agcaatgcaagaaaa

SEQ ID NO: 6631799 - DNA, 22 bp, Homo sapiens
agcaatgcattctggagacaga

SEQ ID NO: 6631800 - DNA, 21 bp, Homo sapiens
agcaatgccccaaactttctc

SEQ ID NO: 6631801 - DNA, 21 bp, Homo sapiens
agcaatgcccgtaatgcttag

SEQ ID NO: 6631802 - DNA, 17 bp, Homo sapiens
agcaatgccctgccttg

SEQ ID NO: 6631803 - DNA, 22 bp, Homo sapiens
agcaatgccctgccttgctgcc

SEQ ID NO: 6631804 - DNA, 17 bp, Homo sapiens
agcaatgcctgtgaaaa

SEQ ID NO: 6631805 - DNA, 22 bp, Homo sapiens
agcaatgcttctgcctcagctt

SEQ ID NO: 6631806 - DNA, 20 bp, Homo sapiens
agcaatgcttttaatgaatt

SEQ ID NO: 6631807 - DNA, 21 bp, Homo sapiens
agcaatggacctttggggaag

SEQ ID NO: 6631808 - DNA, 18 bp, Homo sapiens
agcaatggccagagcctc

SEQ ID NO: 6631809 - DNA, 20 bp, Homo sapiens
agcaatgggactggagtcag

SEQ ID NO: 6631810 - DNA, 16 bp, Homo sapiens
agcaatgggagggggc

SEQ ID NO: 6631811 - DNA, 20 bp, Homo sapiens
agcaatgggagggggctcca

SEQ ID NO: 6631812 - DNA, 18 bp, Homo sapiens
agcaatggtaactgcacc

SEQ ID NO: 6631813 - DNA, 17 bp, Homo sapiens
agcaatgtaaaaatggt

SEQ ID NO: 6631814 - DNA, 13 bp, Homo sapiens
agcaatgtctgtg

SEQ ID NO: 6631815 - DNA, 21 bp, Homo sapiens
agcaatgtgagtcccagagcc

SEQ ID NO: 6631816 - DNA, 14 bp, Homo sapiens
agcaatgtgatttt

SEQ ID NO: 6631817 - DNA, 16 bp, Homo sapiens
agcaatgtgttttttc

SEQ ID NO: 6631818 - DNA, 13 bp, Homo sapiens
agcaattaaaaat

SEQ ID NO: 6631819 - DNA, 13 bp, Homo sapiens
agcaattaattag

SEQ ID NO: 6631820 - DNA, 19 bp, Homo sapiens
agcaattagcagaagtgac

SEQ ID NO: 6631821 - DNA, 23 bp, Homo sapiens
agcaattagtctgaaactggctt

SEQ ID NO: 6631822 - DNA, 16 bp, Homo sapiens
agcaattatttaaaga

SEQ ID NO: 6631823 - DNA, 18 bp, Homo sapiens
agcaattatttaaagaaa

SEQ ID NO: 6631824 - DNA, 15 bp, Homo sapiens
agcaattcatggttc

SEQ ID NO: 6631825 - DNA, 21 bp, Homo sapiens
agcaattcatttcactttaaa

SEQ ID NO: 6631826 - DNA, 17 bp, Homo sapiens
agcaattccaggctgag

SEQ ID NO: 6631827 - DNA, 19 bp, Homo sapiens
agcaattccaggctgagcc

SEQ ID NO: 6631828 - DNA, 22 bp, Homo sapiens
agcaattccaggctgagccatg

SEQ ID NO: 6631829 - DNA, 24 bp, Homo sapiens
agcaattccaggctgagccatgag

SEQ ID NO: 6631830 - DNA, 14 bp, Homo sapiens
agcaattctaccca

SEQ ID NO: 6631831 - DNA, 16 bp, Homo sapiens
agcaattctcctgcct

SEQ ID NO: 6631832 - DNA, 22 bp, Homo sapiens
agcaattctcctgcctcagcct

SEQ ID NO: 6631833 - DNA, 20 bp, Homo sapiens
agcaattctgggagaatgaa

SEQ ID NO: 6631834 - DNA, 18 bp, Homo sapiens
agcaattgctgcatctta

SEQ ID NO: 6631835 - DNA, 18 bp, Homo sapiens
agcaattggttgtttaac

SEQ ID NO: 6631836 - DNA, 16 bp, Homo sapiens
agcaattgtgtggtca

SEQ ID NO: 6631837 - DNA, 22 bp, Homo sapiens
agcaatttaactagacacagat

SEQ ID NO: 6631838 - DNA, 15 bp, Homo sapiens
agcaatttagacaaa

SEQ ID NO: 6631839 - DNA, 20 bp, Homo sapiens
agcaatttatacaatatcat

SEQ ID NO: 6631840 - DNA, 20 bp, Homo sapiens
agcaatttcagttttaaaaa

SEQ ID NO: 6631841 - DNA, 22 bp, Homo sapiens
agcaatttcgccgttgaagagg

SEQ ID NO: 6631842 - DNA, 14 bp, Homo sapiens
agcaatttgcacat

SEQ ID NO: 6631843 - DNA, 15 bp, Homo sapiens
agcaatttgcacatg

SEQ ID NO: 6631844 - DNA, 17 bp, Homo sapiens
agcaattttcataataa

SEQ ID NO: 6631845 - DNA, 17 bp, Homo sapiens
agcaattttccttgaag

SEQ ID NO: 6631846 - DNA, 18 bp, Homo sapiens
agcaattttccttgaagc

SEQ ID NO: 6631847 - DNA, 20 bp, Homo sapiens
agcaattttccttgaagccg

SEQ ID NO: 6631848 - DNA, 14 bp, Homo sapiens
agcaattttctttg

SEQ ID NO: 6631849 - DNA, 11 bp, Homo sapiens
agcaatttttg

SEQ ID NO: 6631850 - DNA, 15 bp, Homo sapiens
agcacaaaatggatt

SEQ ID NO: 6631851 - DNA, 14 bp, Homo sapiens
agcacaaaattcaa

SEQ ID NO: 6631852 - DNA, 20 bp, Homo sapiens
agcacaaaattcaaagcatg

SEQ ID NO: 6631853 - DNA, 15 bp, Homo sapiens
agcacaaacacaagg

SEQ ID NO: 6631854 - DNA, 17 bp, Homo sapiens
agcacaaacattgctgc

SEQ ID NO: 6631855 - DNA, 14 bp, Homo sapiens
agcacaaacatttt

SEQ ID NO: 6631856 - DNA, 16 bp, Homo sapiens
agcacaaactgtcgtc

SEQ ID NO: 6631857 - DNA, 15 bp, Homo sapiens
agcacaaactttagg

SEQ ID NO: 6631858 - DNA, 15 bp, Homo sapiens
agcacaaagaagaaa

SEQ ID NO: 6631859 - DNA, 19 bp, Homo sapiens
agcacaaagaagaaagctg

SEQ ID NO: 6631860 - DNA, 19 bp, Homo sapiens
agcacaaagaccctggctt

SEQ ID NO: 6631861 - DNA, 13 bp, Homo sapiens
agcacaaagataa

SEQ ID NO: 6631862 - DNA, 22 bp, Homo sapiens
agcacaaagcagtttttccccc

SEQ ID NO: 6631863 - DNA, 20 bp, Homo sapiens
agcacaaagttctcagagct

SEQ ID NO: 6631864 - DNA, 19 bp, Homo sapiens
agcacaaattagttatata

SEQ ID NO: 6631865 - DNA, 21 bp, Homo sapiens
agcacaaccggtcccttccat

SEQ ID NO: 6631866 - DNA, 20 bp, Homo sapiens
agcacaaccttcaagctgct

SEQ ID NO: 6631867 - DNA, 21 bp, Homo sapiens
agcacaactgctgtttagtga

SEQ ID NO: 6631868 - DNA, 11 bp, Homo sapiens
agcacaagaag

SEQ ID NO: 6631869 - DNA, 13 bp, Homo sapiens
agcacaagaagcg

SEQ ID NO: 6631870 - DNA, 21 bp, Homo sapiens
agcacaagaaggccagcccac

SEQ ID NO: 6631871 - DNA, 16 bp, Homo sapiens
agcacaagaagtggga

SEQ ID NO: 6631872 - DNA, 18 bp, Homo sapiens
agcacaagactggcccag

SEQ ID NO: 6631873 - DNA, 14 bp, Homo sapiens
agcacaagcgtgtt

SEQ ID NO: 6631874 - DNA, 12 bp, Homo sapiens
agcacaaggaat

SEQ ID NO: 6631875 - DNA, 16 bp, Homo sapiens
agcacaaggagtgccc

SEQ ID NO: 6631876 - DNA, 22 bp, Homo sapiens
agcacaaggccttgcctggcct

SEQ ID NO: 6631877 - DNA, 15 bp, Homo sapiens
agcacaagggcacat

SEQ ID NO: 6631878 - DNA, 17 bp, Homo sapiens
agcacaagggcacattg

SEQ ID NO: 6631879 - DNA, 20 bp, Homo sapiens
agcacaagggcacattgccc

SEQ ID NO: 6631880 - DNA, 17 bp, Homo sapiens
agcacaagttatttaaa

SEQ ID NO: 6631881 - DNA, 18 bp, Homo sapiens
agcacaagttatttaaat

SEQ ID NO: 6631882 - DNA, 14 bp, Homo sapiens
agcacaagttcctg

SEQ ID NO: 6631883 - DNA, 14 bp, Homo sapiens
agcacaataatttg

SEQ ID NO: 6631884 - DNA, 16 bp, Homo sapiens
agcacaataatttgtt

SEQ ID NO: 6631885 - DNA, 21 bp, Homo sapiens
agcacaataatttgttttcat

SEQ ID NO: 6631886 - DNA, 13 bp, Homo sapiens
agcacaatcaact

SEQ ID NO: 6631887 - DNA, 17 bp, Homo sapiens
agcacaatcactaaact

SEQ ID NO: 6631888 - DNA, 22 bp, Homo sapiens
agcacaatcactaaactttatt

SEQ ID NO: 6631889 - DNA, 22 bp, Homo sapiens
agcacaatctgtaaatttttaa

SEQ ID NO: 6631890 - DNA, 13 bp, Homo sapiens
agcacaatctgtt

SEQ ID NO: 6631891 - DNA, 16 bp, Homo sapiens
agcacaatctgttcta

SEQ ID NO: 6631892 - DNA, 18 bp, Homo sapiens
agcacaatctgttctact

SEQ ID NO: 6631893 - DNA, 13 bp, Homo sapiens
agcacaattcatt

SEQ ID NO: 6631894 - DNA, 15 bp, Homo sapiens
agcacaattctgtcc

SEQ ID NO: 6631895 - DNA, 18 bp, Homo sapiens
agcacaattctgtccctg

SEQ ID NO: 6631896 - DNA, 20 bp, Homo sapiens
agcacaatttgagactgaaa

SEQ ID NO: 6631897 - DNA, 19 bp, Homo sapiens
agcacacacaaacctactg

SEQ ID NO: 6631898 - DNA, 23 bp, Homo sapiens
agcacacacaaacctactgccca

SEQ ID NO: 6631899 - DNA, 21 bp, Homo sapiens
agcacacacacataagcactg

SEQ ID NO: 6631900 - DNA, 14 bp, Homo sapiens
agcacacacttttg

SEQ ID NO: 6631901 - DNA, 18 bp, Homo sapiens
agcacacaggcagccagc

SEQ ID NO: 6631902 - DNA, 20 bp, Homo sapiens
agcacacatccaagagggac

SEQ ID NO: 6631903 - DNA, 14 bp, Homo sapiens
agcacacattattt

SEQ ID NO: 6631904 - DNA, 21 bp, Homo sapiens
agcacaccaatcttactttgt

SEQ ID NO: 6631905 - DNA, 16 bp, Homo sapiens
agcacaccagccgctg

SEQ ID NO: 6631906 - DNA, 18 bp, Homo sapiens
agcacaccagccgctgca

SEQ ID NO: 6631907 - DNA, 18 bp, Homo sapiens
agcacaccccaagggaca

SEQ ID NO: 6631908 - DNA, 13 bp, Homo sapiens
agcacacgaaccc

SEQ ID NO: 6631909 - DNA, 18 bp, Homo sapiens
agcacacgagttccagac

SEQ ID NO: 6631910 - DNA, 17 bp, Homo sapiens
agcacacggccctgccc

SEQ ID NO: 6631911 - DNA, 23 bp, Homo sapiens
agcacacggccctgccccatcct

SEQ ID NO: 6631912 - DNA, 14 bp, Homo sapiens
agcacactcatccc

SEQ ID NO: 6631913 - DNA, 17 bp, Homo sapiens
agcacactctggtcttg

SEQ ID NO: 6631914 - DNA, 21 bp, Homo sapiens
agcacactgcagggctgctgt

SEQ ID NO: 6631915 - DNA, 22 bp, Homo sapiens
agcacactgcagggctgctgtg

SEQ ID NO: 6631916 - DNA, 22 bp, Homo sapiens
agcacactgcttctcggaggcc

SEQ ID NO: 6631917 - DNA, 14 bp, Homo sapiens
agcacactggaata

SEQ ID NO: 6631918 - DNA, 19 bp, Homo sapiens
agcacactggaatataaaa

SEQ ID NO: 6631919 - DNA, 16 bp, Homo sapiens
agcacacttatttatg

SEQ ID NO: 6631920 - DNA, 17 bp, Homo sapiens
agcacacttatttatga

SEQ ID NO: 6631921 - DNA, 18 bp, Homo sapiens
agcacacttatttatgaa

SEQ ID NO: 6631922 - DNA, 21 bp, Homo sapiens
agcacactttacacaagaatc

SEQ ID NO: 6631923 - DNA, 16 bp, Homo sapiens
agcacagaaaactaga

SEQ ID NO: 6631924 - DNA, 17 bp, Homo sapiens
agcacagaccctgccct

SEQ ID NO: 6631925 - DNA, 19 bp, Homo sapiens
agcacagaccctgccctgt

SEQ ID NO: 6631926 - DNA, 13 bp, Homo sapiens
agcacagagaggg

SEQ ID NO: 6631927 - DNA, 14 bp, Homo sapiens
agcacagagaggga

SEQ ID NO: 6631928 - DNA, 15 bp, Homo sapiens
agcacagagagggac

SEQ ID NO: 6631929 - DNA, 21 bp, Homo sapiens
agcacagagagggggccacct

SEQ ID NO: 6631930 - DNA, 17 bp, Homo sapiens
agcacagagagtctgga

SEQ ID NO: 6631931 - DNA, 19 bp, Homo sapiens
agcacagagagtctggata

SEQ ID NO: 6631932 - DNA, 14 bp, Homo sapiens
agcacagagccctg

SEQ ID NO: 6631933 - DNA, 12 bp, Homo sapiens
agcacagagcct

SEQ ID NO: 6631934 - DNA, 15 bp, Homo sapiens
agcacagagcctggc

SEQ ID NO: 6631935 - DNA, 21 bp, Homo sapiens
agcacagaggatggcttcccc

SEQ ID NO: 6631936 - DNA, 22 bp, Homo sapiens
agcacagaggatggcttcccca

SEQ ID NO: 6631937 - DNA, 13 bp, Homo sapiens
agcacagaggcct

SEQ ID NO: 6631938 - DNA, 15 bp, Homo sapiens
agcacagattttaat

SEQ ID NO: 6631939 - DNA, 23 bp, Homo sapiens
agcacagattttaattgtcatgg

SEQ ID NO: 6631940 - DNA, 22 bp, Homo sapiens
agcacagcactttggttttgct

SEQ ID NO: 6631941 - DNA, 12 bp, Homo sapiens
agcacagccaac

SEQ ID NO: 6631942 - DNA, 23 bp, Homo sapiens
agcacagccaatctccaggctcc

SEQ ID NO: 6631943 - DNA, 14 bp, Homo sapiens
agcacagccacctc

SEQ ID NO: 6631944 - DNA, 15 bp, Homo sapiens
agcacagccacctcc

SEQ ID NO: 6631945 - DNA, 12 bp, Homo sapiens
agcacagccata

SEQ ID NO: 6631946 - DNA, 13 bp, Homo sapiens
agcacagcccagg

SEQ ID NO: 6631947 - DNA, 15 bp, Homo sapiens
agcacagcccagggc

SEQ ID NO: 6631948 - DNA, 13 bp, Homo sapiens
agcacagccctcc

SEQ ID NO: 6631949 - DNA, 15 bp, Homo sapiens
agcacagccctcccg

SEQ ID NO: 6631950 - DNA, 12 bp, Homo sapiens
agcacagccctg

SEQ ID NO: 6631951 - DNA, 12 bp, Homo sapiens
agcacagccctt

SEQ ID NO: 6631952 - DNA, 22 bp, Homo sapiens
agcacagcctcacccctgcagg

SEQ ID NO: 6631953 - DNA, 16 bp, Homo sapiens
agcacagcctcgggga

SEQ ID NO: 6631954 - DNA, 12 bp, Homo sapiens
agcacagcctgg

SEQ ID NO: 6631955 - DNA, 16 bp, Homo sapiens
agcacagcgctgagca

SEQ ID NO: 6631956 - DNA, 16 bp, Homo sapiens
agcacagcgtttacat

SEQ ID NO: 6631957 - DNA, 18 bp, Homo sapiens
agcacagctactcagatc

SEQ ID NO: 6631958 - DNA, 18 bp, Homo sapiens
agcacagctccctgccaa

SEQ ID NO: 6631959 - DNA, 15 bp, Homo sapiens
agcacagctcccttc

SEQ ID NO: 6631960 - DNA, 13 bp, Homo sapiens
agcacagctcctc

SEQ ID NO: 6631961 - DNA, 17 bp, Homo sapiens
agcacagctcctcccct

SEQ ID NO: 6631962 - DNA, 19 bp, Homo sapiens
agcacagctcctgccaggg

SEQ ID NO: 6631963 - DNA, 14 bp, Homo sapiens
agcacagctgagga

SEQ ID NO: 6631964 - DNA, 12 bp, Homo sapiens
agcacagctggg

SEQ ID NO: 6631965 - DNA, 14 bp, Homo sapiens
agcacagctgggca

SEQ ID NO: 6631966 - DNA, 15 bp, Homo sapiens
agcacagctgtgagg

SEQ ID NO: 6631967 - DNA, 20 bp, Homo sapiens
agcacagcttagatttcata

SEQ ID NO: 6631968 - DNA, 21 bp, Homo sapiens
agcacagcttcatttcctgtg

SEQ ID NO: 6631969 - DNA, 14 bp, Homo sapiens
agcacagcttgacc

SEQ ID NO: 6631970 - DNA, 14 bp, Homo sapiens
agcacagcttgggt

SEQ ID NO: 6631971 - DNA, 19 bp, Homo sapiens
agcacaggaattctcaaga

SEQ ID NO: 6631972 - DNA, 23 bp, Homo sapiens
agcacaggaattctcaagacctg

SEQ ID NO: 6631973 - DNA, 13 bp, Homo sapiens
agcacaggcagct

SEQ ID NO: 6631974 - DNA, 12 bp, Homo sapiens
agcacaggctga

SEQ ID NO: 6631975 - DNA, 20 bp, Homo sapiens
agcacaggctgagtgcaggc

SEQ ID NO: 6631976 - DNA, 22 bp, Homo sapiens
agcacaggctgagtgcaggccc

SEQ ID NO: 6631977 - DNA, 12 bp, Homo sapiens
agcacagggcag

SEQ ID NO: 6631978 - DNA, 15 bp, Homo sapiens
agcacaggggcccca

SEQ ID NO: 6631979 - DNA, 19 bp, Homo sapiens
agcacaggggccccagatc

SEQ ID NO: 6631980 - DNA, 20 bp, Homo sapiens
agcacaggggccccagatct

SEQ ID NO: 6631981 - DNA, 20 bp, Homo sapiens
agcacaggtccaaggctggt

SEQ ID NO: 6631982 - DNA, 22 bp, Homo sapiens
agcacaggtccaaggctggtcc

SEQ ID NO: 6631983 - DNA, 15 bp, Homo sapiens
agcacaggtcccacc

SEQ ID NO: 6631984 - DNA, 20 bp, Homo sapiens
agcacaggtcccacctccag

SEQ ID NO: 6631985 - DNA, 21 bp, Homo sapiens
agcacaggtcccacctccagc

SEQ ID NO: 6631986 - DNA, 12 bp, Homo sapiens
agcacaggtgtc

SEQ ID NO: 6631987 - DNA, 18 bp, Homo sapiens
agcacaggtgtctgccta

SEQ ID NO: 6631988 - DNA, 12 bp, Homo sapiens
agcacagtattt

SEQ ID NO: 6631989 - DNA, 16 bp, Homo sapiens
agcacagtattttgat

SEQ ID NO: 6631990 - DNA, 17 bp, Homo sapiens
agcacagtcaggggctg

SEQ ID NO: 6631991 - DNA, 20 bp, Homo sapiens
agcacagtcaggggctgggc

SEQ ID NO: 6631992 - DNA, 18 bp, Homo sapiens
agcacagtcaggttgaag

SEQ ID NO: 6631993 - DNA, 19 bp, Homo sapiens
agcacagtctgatgacaca

SEQ ID NO: 6631994 - DNA, 14 bp, Homo sapiens
agcacagtgcctgc

SEQ ID NO: 6631995 - DNA, 18 bp, Homo sapiens
agcacagtgttaaatgaa

SEQ ID NO: 6631996 - DNA, 19 bp, Homo sapiens
agcacagtgttaaatgaaa

SEQ ID NO: 6631997 - DNA, 22 bp, Homo sapiens
agcacagtgttaaatgaaattg

SEQ ID NO: 6631998 - DNA, 12 bp, Homo sapiens
agcacagttcct

SEQ ID NO: 6631999 - DNA, 18 bp, Homo sapiens
agcacagttccttgcatg

SEQ ID NO: 6632000 - DNA, 12 bp, Homo sapiens
agcacagtttgt

SEQ ID NO: 6632001 - DNA, 19 bp, Homo sapiens
agcacatactacctagaag

SEQ ID NO: 6632002 - DNA, 18 bp, Homo sapiens
agcacatactgtgttcca

SEQ ID NO: 6632003 - DNA, 19 bp, Homo sapiens
agcacatagagctttttaa

SEQ ID NO: 6632004 - DNA, 20 bp, Homo sapiens
agcacatagagctttttaat

SEQ ID NO: 6632005 - DNA, 17 bp, Homo sapiens
agcacatagccctgttg

SEQ ID NO: 6632006 - DNA, 24 bp, Homo sapiens
agcacatagccctgttgacctgcc

SEQ ID NO: 6632007 - DNA, 16 bp, Homo sapiens
agcacatagtgtcctg

SEQ ID NO: 6632008 - DNA, 17 bp, Homo sapiens
agcacatagtgtcctgc

SEQ ID NO: 6632009 - DNA, 16 bp, Homo sapiens
agcacatatggaattt

SEQ ID NO: 6632010 - DNA, 17 bp, Homo sapiens
agcacatattttctgtt

SEQ ID NO: 6632011 - DNA, 13 bp, Homo sapiens
agcacatcacctc

SEQ ID NO: 6632012 - DNA, 21 bp, Homo sapiens
agcacatcactgagaagatgg

SEQ ID NO: 6632013 - DNA, 20 bp, Homo sapiens
agcacatcatggcagtggga

SEQ ID NO: 6632014 - DNA, 13 bp, Homo sapiens
agcacatccacca

SEQ ID NO: 6632015 - DNA, 21 bp, Homo sapiens
agcacatccaccaaactcctg

SEQ ID NO: 6632016 - DNA, 22 bp, Homo sapiens
agcacatcgccagccctgggcc

SEQ ID NO: 6632017 - DNA, 20 bp, Homo sapiens
agcacatctcaacaggcctc

SEQ ID NO: 6632018 - DNA, 15 bp, Homo sapiens
agcacatgatttggg

SEQ ID NO: 6632019 - DNA, 18 bp, Homo sapiens
agcacatgattttctttt

SEQ ID NO: 6632020 - DNA, 13 bp, Homo sapiens
agcacatgcctct

SEQ ID NO: 6632021 - DNA, 20 bp, Homo sapiens
agcacatgcctctctcaggc

SEQ ID NO: 6632022 - DNA, 21 bp, Homo sapiens
agcacatgcctctctcaggcc

SEQ ID NO: 6632023 - DNA, 23 bp, Homo sapiens
agcacatgcgtatatgtgcgtct

SEQ ID NO: 6632024 - DNA, 19 bp, Homo sapiens
agcacatgctggccagcct

SEQ ID NO: 6632025 - DNA, 16 bp, Homo sapiens
agcacatgcttagctt

SEQ ID NO: 6632026 - DNA, 22 bp, Homo sapiens
agcacatgcttagcttatcttt

SEQ ID NO: 6632027 - DNA, 19 bp, Homo sapiens
agcacatggaggccctttt

SEQ ID NO: 6632028 - DNA, 17 bp, Homo sapiens
agcacatggccatagag

SEQ ID NO: 6632029 - DNA, 20 bp, Homo sapiens
agcacatggccatagaggcc

SEQ ID NO: 6632030 - DNA, 21 bp, Homo sapiens
agcacatgtaataaattcaaa

SEQ ID NO: 6632031 - DNA, 20 bp, Homo sapiens
agcacatgttactgcttcat

SEQ ID NO: 6632032 - DNA, 14 bp, Homo sapiens
agcacatgttcata

SEQ ID NO: 6632033 - DNA, 13 bp, Homo sapiens
agcacatgtttta

SEQ ID NO: 6632034 - DNA, 13 bp, Homo sapiens
agcacattattgt

SEQ ID NO: 6632035 - DNA, 18 bp, Homo sapiens
agcacattattgtagaga

SEQ ID NO: 6632036 - DNA, 20 bp, Homo sapiens
agcacattattgtagagaaa

SEQ ID NO: 6632037 - DNA, 13 bp, Homo sapiens
agcacattcggga

SEQ ID NO: 6632038 - DNA, 19 bp, Homo sapiens
agcacattcgggaccaata

SEQ ID NO: 6632039 - DNA, 19 bp, Homo sapiens
agcacattgccctgagggg

SEQ ID NO: 6632040 - DNA, 23 bp, Homo sapiens
agcacattgccctgaggggcctg

SEQ ID NO: 6632041 - DNA, 13 bp, Homo sapiens
agcacatttcctc

SEQ ID NO: 6632042 - DNA, 15 bp, Homo sapiens
agcacatttcctctc

SEQ ID NO: 6632043 - DNA, 16 bp, Homo sapiens
agcacatttcctctct

SEQ ID NO: 6632044 - DNA, 18 bp, Homo sapiens
agcacatttctcctgttt

SEQ ID NO: 6632045 - DNA, 17 bp, Homo sapiens
agcacatttgtcagtat

SEQ ID NO: 6632046 - DNA, 22 bp, Homo sapiens
agcacattttgacacaatgttg

SEQ ID NO: 6632047 - DNA, 18 bp, Homo sapiens
agcaccaaaataagaaaa

SEQ ID NO: 6632048 - DNA, 14 bp, Homo sapiens
agcaccaaataaat

SEQ ID NO: 6632049 - DNA, 13 bp, Homo sapiens
agcaccacactgg

SEQ ID NO: 6632050 - DNA, 16 bp, Homo sapiens
agcaccaccaggtctc

SEQ ID NO: 6632051 - DNA, 17 bp, Homo sapiens
agcaccaccatttaatt

SEQ ID NO: 6632052 - DNA, 21 bp, Homo sapiens
agcaccaccatttaatttcat

SEQ ID NO: 6632053 - DNA, 23 bp, Homo sapiens
agcaccaccctagtcccttcccc

SEQ ID NO: 6632054 - DNA, 15 bp, Homo sapiens
agcaccaccctcctt

SEQ ID NO: 6632055 - DNA, 16 bp, Homo sapiens
agcaccaccctccttc

SEQ ID NO: 6632056 - DNA, 15 bp, Homo sapiens
agcaccacggccaga

SEQ ID NO: 6632057 - DNA, 21 bp, Homo sapiens
agcaccacggccagaagtaac

SEQ ID NO: 6632058 - DNA, 16 bp, Homo sapiens
agcaccacggggtcgg

SEQ ID NO: 6632059 - DNA, 18 bp, Homo sapiens
agcaccactcaagaccaa

SEQ ID NO: 6632060 - DNA, 13 bp, Homo sapiens
agcaccactctgg

SEQ ID NO: 6632061 - DNA, 17 bp, Homo sapiens
agcaccactctgggcac

SEQ ID NO: 6632062 - DNA, 15 bp, Homo sapiens
agcaccactgctgag

SEQ ID NO: 6632063 - DNA, 21 bp, Homo sapiens
agcaccagcctcagtgcagcc

SEQ ID NO: 6632064 - DNA, 17 bp, Homo sapiens
agcaccagcttctccag

SEQ ID NO: 6632065 - DNA, 18 bp, Homo sapiens
agcaccagcttctccagg

SEQ ID NO: 6632066 - DNA, 19 bp, Homo sapiens
agcaccagcttctccaggc

SEQ ID NO: 6632067 - DNA, 22 bp, Homo sapiens
agcaccagcttgcttctctgcc

SEQ ID NO: 6632068 - DNA, 12 bp, Homo sapiens
agcaccaggaag

SEQ ID NO: 6632069 - DNA, 14 bp, Homo sapiens
agcaccaggcacga

SEQ ID NO: 6632070 - DNA, 13 bp, Homo sapiens
agcaccagggaag

SEQ ID NO: 6632071 - DNA, 24 bp, Homo sapiens
agcaccagggagaggcctcggctg

SEQ ID NO: 6632072 - DNA, 21 bp, Homo sapiens
agcaccaggtgttaaaaacca

SEQ ID NO: 6632073 - DNA, 23 bp, Homo sapiens
agcaccaggtgttaaaaaccatt

SEQ ID NO: 6632074 - DNA, 14 bp, Homo sapiens
agcaccatcccctc

SEQ ID NO: 6632075 - DNA, 20 bp, Homo sapiens
agcaccatccgccagggccc

SEQ ID NO: 6632076 - DNA, 23 bp, Homo sapiens
agcaccattttaagtccctgtca

SEQ ID NO: 6632077 - DNA, 12 bp, Homo sapiens
agcacccacagc

SEQ ID NO: 6632078 - DNA, 16 bp, Homo sapiens
agcacccacagccgca

SEQ ID NO: 6632079 - DNA, 13 bp, Homo sapiens
agcacccacgtga

SEQ ID NO: 6632080 - DNA, 23 bp, Homo sapiens
agcacccacgtgagagaatctgc

SEQ ID NO: 6632081 - DNA, 15 bp, Homo sapiens
agcacccactcagcc

SEQ ID NO: 6632082 - DNA, 16 bp, Homo sapiens
agcacccactgtgcac

SEQ ID NO: 6632083 - DNA, 14 bp, Homo sapiens
agcacccagagcac

SEQ ID NO: 6632084 - DNA, 15 bp, Homo sapiens
agcacccaggctcca

SEQ ID NO: 6632085 - DNA, 20 bp, Homo sapiens
agcacccaggctccatgggg

SEQ ID NO: 6632086 - DNA, 21 bp, Homo sapiens
agcacccatatctgtgtgccc

SEQ ID NO: 6632087 - DNA, 18 bp, Homo sapiens
agcacccatcatgccaca

SEQ ID NO: 6632088 - DNA, 19 bp, Homo sapiens
agcacccatgccccactct

SEQ ID NO: 6632089 - DNA, 21 bp, Homo sapiens
agcacccatgccccactctgc

SEQ ID NO: 6632090 - DNA, 21 bp, Homo sapiens
agcaccccaccacacacaccc

SEQ ID NO: 6632091 - DNA, 23 bp, Homo sapiens
agcaccccagacctcacctccat

SEQ ID NO: 6632092 - DNA, 17 bp, Homo sapiens
agcacccccaagcctgg

SEQ ID NO: 6632093 - DNA, 12 bp, Homo sapiens
agcacccccacc

SEQ ID NO: 6632094 - DNA, 17 bp, Homo sapiens
agcacccccaccaaact

SEQ ID NO: 6632095 - DNA, 14 bp, Homo sapiens
agcacccccaccca

SEQ ID NO: 6632096 - DNA, 18 bp, Homo sapiens
agcacccccacccacctc

SEQ ID NO: 6632097 - DNA, 20 bp, Homo sapiens
agcacccccacccacctcca

SEQ ID NO: 6632098 - DNA, 15 bp, Homo sapiens
agcacccccagcctc

SEQ ID NO: 6632099 - DNA, 17 bp, Homo sapiens
agcacccccagcctccc

SEQ ID NO: 6632100 - DNA, 21 bp, Homo sapiens
agcaccccctcattcccctcg

SEQ ID NO: 6632101 - DNA, 19 bp, Homo sapiens
agcaccccctctcctggag

SEQ ID NO: 6632102 - DNA, 14 bp, Homo sapiens
agcaccccctgctc

SEQ ID NO: 6632103 - DNA, 22 bp, Homo sapiens
agcaccccgcttttgcagcaga

SEQ ID NO: 6632104 - DNA, 22 bp, Homo sapiens
agcacccctccagttttgcctg

SEQ ID NO: 6632105 - DNA, 14 bp, Homo sapiens
agcacccctctctg

SEQ ID NO: 6632106 - DNA, 15 bp, Homo sapiens
agcacccctgtctct

SEQ ID NO: 6632107 - DNA, 13 bp, Homo sapiens
agcaccccttcca

SEQ ID NO: 6632108 - DNA, 17 bp, Homo sapiens
agcaccctagaggacta

SEQ ID NO: 6632109 - DNA, 12 bp, Homo sapiens
agcaccctctcc

SEQ ID NO: 6632110 - DNA, 16 bp, Homo sapiens
agcaccctctcctggg

SEQ ID NO: 6632111 - DNA, 21 bp, Homo sapiens
agcaccctctgttagtgccgc

SEQ ID NO: 6632112 - DNA, 12 bp, Homo sapiens
agcaccctgagg

SEQ ID NO: 6632113 - DNA, 14 bp, Homo sapiens
agcaccctgagggc

SEQ ID NO: 6632114 - DNA, 14 bp, Homo sapiens
agcaccctgcagag

SEQ ID NO: 6632115 - DNA, 12 bp, Homo sapiens
agcaccctgggt

SEQ ID NO: 6632116 - DNA, 17 bp, Homo sapiens
agcaccctgtcttctta

SEQ ID NO: 6632117 - DNA, 22 bp, Homo sapiens
agcacccttctcggagacccat

SEQ ID NO: 6632118 - DNA, 16 bp, Homo sapiens
agcacccttctgctgt

SEQ ID NO: 6632119 - DNA, 18 bp, Homo sapiens
agcaccgaatattgagca

SEQ ID NO: 6632120 - DNA, 20 bp, Homo sapiens
agcaccgcagcctctgcccc

SEQ ID NO: 6632121 - DNA, 18 bp, Homo sapiens
agcaccggaccagcctgg

SEQ ID NO: 6632122 - DNA, 16 bp, Homo sapiens
agcaccgtgccaaccc

SEQ ID NO: 6632123 - DNA, 19 bp, Homo sapiens
agcaccgtgtcaagctgct

SEQ ID NO: 6632124 - DNA, 21 bp, Homo sapiens
agcaccgtgtcaagctgctct

SEQ ID NO: 6632125 - DNA, 16 bp, Homo sapiens
agcaccgttctgtgca

SEQ ID NO: 6632126 - DNA, 18 bp, Homo sapiens
agcaccgttctgtgcaca

SEQ ID NO: 6632127 - DNA, 14 bp, Homo sapiens
agcacctacagtgt

SEQ ID NO: 6632128 - DNA, 19 bp, Homo sapiens
agcacctacagtgtacagt

SEQ ID NO: 6632129 - DNA, 22 bp, Homo sapiens
agcacctacagtgtacagtctt

SEQ ID NO: 6632130 - DNA, 15 bp, Homo sapiens
agcacctacttacat

SEQ ID NO: 6632131 - DNA, 19 bp, Homo sapiens
agcacctcaagtgcaagga

SEQ ID NO: 6632132 - DNA, 22 bp, Homo sapiens
agcacctcaagtgcaaggacca

SEQ ID NO: 6632133 - DNA, 21 bp, Homo sapiens
agcacctcacctgagacctcc

SEQ ID NO: 6632134 - DNA, 19 bp, Homo sapiens
agcacctcactatctgaaa

SEQ ID NO: 6632135 - DNA, 14 bp, Homo sapiens
agcacctcagcctg

SEQ ID NO: 6632136 - DNA, 16 bp, Homo sapiens
agcacctcagcctgca

SEQ ID NO: 6632137 - DNA, 22 bp, Homo sapiens
agcacctccaaccaaataagac

SEQ ID NO: 6632138 - DNA, 18 bp, Homo sapiens
agcacctcccagcccctg

SEQ ID NO: 6632139 - DNA, 22 bp, Homo sapiens
agcacctcccagcccctgcccc

SEQ ID NO: 6632140 - DNA, 18 bp, Homo sapiens
agcacctccccagacagg

SEQ ID NO: 6632141 - DNA, 18 bp, Homo sapiens
agcacctcctcagcctga

SEQ ID NO: 6632142 - DNA, 13 bp, Homo sapiens
agcacctcctccg

SEQ ID NO: 6632143 - DNA, 14 bp, Homo sapiens
agcacctcctccgt

SEQ ID NO: 6632144 - DNA, 13 bp, Homo sapiens
agcacctcctgcc

SEQ ID NO: 6632145 - DNA, 22 bp, Homo sapiens
agcacctctcagagcaagcctt

SEQ ID NO: 6632146 - DNA, 16 bp, Homo sapiens
agcacctctcaggatt

SEQ ID NO: 6632147 - DNA, 13 bp, Homo sapiens
agcacctcttgaa

SEQ ID NO: 6632148 - DNA, 22 bp, Homo sapiens
agcacctcttgaagaactgact

SEQ ID NO: 6632149 - DNA, 13 bp, Homo sapiens
agcacctgaacca

SEQ ID NO: 6632150 - DNA, 14 bp, Homo sapiens
agcacctgaaccac

SEQ ID NO: 6632151 - DNA, 13 bp, Homo sapiens
agcacctgaaccc

SEQ ID NO: 6632152 - DNA, 13 bp, Homo sapiens
agcacctgcagat

SEQ ID NO: 6632153 - DNA, 16 bp, Homo sapiens
agcacctgccagggcc

SEQ ID NO: 6632154 - DNA, 18 bp, Homo sapiens
agcacctgccctacctgc

SEQ ID NO: 6632155 - DNA, 18 bp, Homo sapiens
agcacctgccctctgttt

SEQ ID NO: 6632156 - DNA, 14 bp, Homo sapiens
agcacctgctgtct

SEQ ID NO: 6632157 - DNA, 21 bp, Homo sapiens
agcacctgcttcatgctcagc

SEQ ID NO: 6632158 - DNA, 13 bp, Homo sapiens
agcacctggaccc

SEQ ID NO: 6632159 - DNA, 16 bp, Homo sapiens
agcacctggaccccct

SEQ ID NO: 6632160 - DNA, 19 bp, Homo sapiens
agcacctggaccccctgcc

SEQ ID NO: 6632161 - DNA, 12 bp, Homo sapiens
agcacctgggcc

SEQ ID NO: 6632162 - DNA, 20 bp, Homo sapiens
agcacctgggccccactgga

SEQ ID NO: 6632163 - DNA, 12 bp, Homo sapiens
agcacctgggct

SEQ ID NO: 6632164 - DNA, 14 bp, Homo sapiens
agcacctgggctga

SEQ ID NO: 6632165 - DNA, 13 bp, Homo sapiens
agcacctgggtgt

SEQ ID NO: 6632166 - DNA, 17 bp, Homo sapiens
agcacctgggtgtgctc

SEQ ID NO: 6632167 - DNA, 20 bp, Homo sapiens
agcacctgggtgtgctccag

SEQ ID NO: 6632168 - DNA, 15 bp, Homo sapiens
agcacctgtcacctt

SEQ ID NO: 6632169 - DNA, 12 bp, Homo sapiens
agcacctgtctg

SEQ ID NO: 6632170 - DNA, 13 bp, Homo sapiens
agcacctgttttt

SEQ ID NO: 6632171 - DNA, 20 bp, Homo sapiens
agcaccttaatattattggg

SEQ ID NO: 6632172 - DNA, 20 bp, Homo sapiens
agcaccttagacagtccctg

SEQ ID NO: 6632173 - DNA, 22 bp, Homo sapiens
agcaccttagacagtccctgcc

SEQ ID NO: 6632174 - DNA, 16 bp, Homo sapiens
agcaccttcctcactt

SEQ ID NO: 6632175 - DNA, 19 bp, Homo sapiens
agcaccttcctcacttcca

SEQ ID NO: 6632176 - DNA, 20 bp, Homo sapiens
agcaccttcctcacttccat

SEQ ID NO: 6632177 - DNA, 19 bp, Homo sapiens
agcaccttctttctggact

SEQ ID NO: 6632178 - DNA, 20 bp, Homo sapiens
agcaccttctttctggactg

SEQ ID NO: 6632179 - DNA, 15 bp, Homo sapiens
agcaccttggcccag

SEQ ID NO: 6632180 - DNA, 17 bp, Homo sapiens
agcaccttggcccagga

SEQ ID NO: 6632181 - DNA, 19 bp, Homo sapiens
agcaccttggcccaggagc

SEQ ID NO: 6632182 - DNA, 15 bp, Homo sapiens
agcaccttgtgcctg

SEQ ID NO: 6632183 - DNA, 15 bp, Homo sapiens
agcaccttgttctta

SEQ ID NO: 6632184 - DNA, 22 bp, Homo sapiens
agcaccttgttcttagagcaga

SEQ ID NO: 6632185 - DNA, 22 bp, Homo sapiens
agcacctttcaaccaggcacct

SEQ ID NO: 6632186 - DNA, 14 bp, Homo sapiens
agcacctttctctg

SEQ ID NO: 6632187 - DNA, 15 bp, Homo sapiens
agcacctttctctga

SEQ ID NO: 6632188 - DNA, 18 bp, Homo sapiens
agcacctttctctgagaa

SEQ ID NO: 6632189 - DNA, 20 bp, Homo sapiens
agcacctttggaaacaacat

SEQ ID NO: 6632190 - DNA, 13 bp, Homo sapiens
agcacctttgtaa

SEQ ID NO: 6632191 - DNA, 23 bp, Homo sapiens
agcacgaagctatgagaataact

SEQ ID NO: 6632192 - DNA, 16 bp, Homo sapiens
agcacgatttctgttt

SEQ ID NO: 6632193 - DNA, 17 bp, Homo sapiens
agcacgatttctgttta

SEQ ID NO: 6632194 - DNA, 17 bp, Homo sapiens
agcacgattttgcacaa

SEQ ID NO: 6632195 - DNA, 19 bp, Homo sapiens
agcacgcatgtccctccaa

SEQ ID NO: 6632196 - DNA, 16 bp, Homo sapiens
agcacgcctctcccca

SEQ ID NO: 6632197 - DNA, 20 bp, Homo sapiens
agcacgcctctccccacctt

SEQ ID NO: 6632198 - DNA, 17 bp, Homo sapiens
agcacgcctgccatctt

SEQ ID NO: 6632199 - DNA, 13 bp, Homo sapiens
agcacgctgcctg

SEQ ID NO: 6632200 - DNA, 18 bp, Homo sapiens
agcacgctgcctgccaaa

SEQ ID NO: 6632201 - DNA, 13 bp, Homo sapiens
agcacggacaata

SEQ ID NO: 6632202 - DNA, 14 bp, Homo sapiens
agcacggacaataa

SEQ ID NO: 6632203 - DNA, 15 bp, Homo sapiens
agcacggacaataaa

SEQ ID NO: 6632204 - DNA, 17 bp, Homo sapiens
agcacggactcttactg

SEQ ID NO: 6632205 - DNA, 17 bp, Homo sapiens
agcacggactgtcagtt

SEQ ID NO: 6632206 - DNA, 20 bp, Homo sapiens
agcacggccaacaaagctgt

SEQ ID NO: 6632207 - DNA, 18 bp, Homo sapiens
agcacggcccggcccctc

SEQ ID NO: 6632208 - DNA, 20 bp, Homo sapiens
agcacggctctgtccccagc

SEQ ID NO: 6632209 - DNA, 16 bp, Homo sapiens
agcacgggcaaagaaa

SEQ ID NO: 6632210 - DNA, 17 bp, Homo sapiens
agcacgggcaaagaaaa

SEQ ID NO: 6632211 - DNA, 20 bp, Homo sapiens
agcacgggcaaagaaaacac

SEQ ID NO: 6632212 - DNA, 22 bp, Homo sapiens
agcacgggcgttatgtaagttt

SEQ ID NO: 6632213 - DNA, 20 bp, Homo sapiens
agcacggggctggcagggcg

SEQ ID NO: 6632214 - DNA, 20 bp, Homo sapiens
agcacgggggagtgagacag

SEQ ID NO: 6632215 - DNA, 18 bp, Homo sapiens
agcacggttgcctgaggt

SEQ ID NO: 6632216 - DNA, 16 bp, Homo sapiens
agcacgtctcagagat

SEQ ID NO: 6632217 - DNA, 15 bp, Homo sapiens
agcacgtgcaaggac

SEQ ID NO: 6632218 - DNA, 20 bp, Homo sapiens
agcacgttggcgaggaaaaa

SEQ ID NO: 6632219 - DNA, 23 bp, Homo sapiens
agcacgttttccattatgaggaa

SEQ ID NO: 6632220 - DNA, 19 bp, Homo sapiens
agcactaaacttggtgctt

SEQ ID NO: 6632221 - DNA, 14 bp, Homo sapiens
agcactaaagcagt

SEQ ID NO: 6632222 - DNA, 19 bp, Homo sapiens
agcactaaggtgtgctctg

SEQ ID NO: 6632223 - DNA, 17 bp, Homo sapiens
agcactacaatcatggt

SEQ ID NO: 6632224 - DNA, 15 bp, Homo sapiens
agcactacctaagta

SEQ ID NO: 6632225 - DNA, 19 bp, Homo sapiens
agcactactaaaagtttag

SEQ ID NO: 6632226 - DNA, 14 bp, Homo sapiens
agcactactgggtg

SEQ ID NO: 6632227 - DNA, 15 bp, Homo sapiens
agcactactgggtgt

SEQ ID NO: 6632228 - DNA, 22 bp, Homo sapiens
agcactactgggtgtcatttca

SEQ ID NO: 6632229 - DNA, 17 bp, Homo sapiens
agcactagaatgagaaa

SEQ ID NO: 6632230 - DNA, 19 bp, Homo sapiens
agcactagaatgagaaatc

SEQ ID NO: 6632231 - DNA, 23 bp, Homo sapiens
agcactagacatgtcatggtcct

SEQ ID NO: 6632232 - DNA, 20 bp, Homo sapiens
agcactagagaatgcacaga

SEQ ID NO: 6632233 - DNA, 16 bp, Homo sapiens
agcactagagtcaccc

SEQ ID NO: 6632234 - DNA, 19 bp, Homo sapiens
agcactagccaaacctcac

SEQ ID NO: 6632235 - DNA, 22 bp, Homo sapiens
agcactagccttcccagcttcc

SEQ ID NO: 6632236 - DNA, 22 bp, Homo sapiens
agcactagtaaaggaggaatag

SEQ ID NO: 6632237 - DNA, 16 bp, Homo sapiens
agcactagtttgatta

SEQ ID NO: 6632238 - DNA, 20 bp, Homo sapiens
agcactatcgaggtatttgg

SEQ ID NO: 6632239 - DNA, 18 bp, Homo sapiens
agcactatgctttccttc

SEQ ID NO: 6632240 - DNA, 20 bp, Homo sapiens
agcactattttatatttaaa

SEQ ID NO: 6632241 - DNA, 17 bp, Homo sapiens
agcactcaataaagtgg

SEQ ID NO: 6632242 - DNA, 14 bp, Homo sapiens
agcactcacacagg

SEQ ID NO: 6632243 - DNA, 21 bp, Homo sapiens
agcactcacatgctggacagg

SEQ ID NO: 6632244 - DNA, 15 bp, Homo sapiens
agcactcaggctctc

SEQ ID NO: 6632245 - DNA, 14 bp, Homo sapiens
agcactcccaagtc

SEQ ID NO: 6632246 - DNA, 12 bp, Homo sapiens
agcactcccagg

SEQ ID NO: 6632247 - DNA, 14 bp, Homo sapiens
agcactcccagggc

SEQ ID NO: 6632248 - DNA, 16 bp, Homo sapiens
agcactcccagggccc

SEQ ID NO: 6632249 - DNA, 19 bp, Homo sapiens
agcactcccagggcccgag

SEQ ID NO: 6632250 - DNA, 18 bp, Homo sapiens
agcactccccagagctgt

SEQ ID NO: 6632251 - DNA, 20 bp, Homo sapiens
agcactccccagagctgtgc

SEQ ID NO: 6632252 - DNA, 22 bp, Homo sapiens
agcactccccagagctgtgcca

SEQ ID NO: 6632253 - DNA, 23 bp, Homo sapiens
agcactccccttgccttcccctg

SEQ ID NO: 6632254 - DNA, 16 bp, Homo sapiens
agcactcccgctgcac

SEQ ID NO: 6632255 - DNA, 19 bp, Homo sapiens
agcactcccgctgcacaca

SEQ ID NO: 6632256 - DNA, 23 bp, Homo sapiens
agcactcccgctgcacacagacg

SEQ ID NO: 6632257 - DNA, 23 bp, Homo sapiens
agcactccctaatttatgtgcta

SEQ ID NO: 6632258 - DNA, 20 bp, Homo sapiens
agcactcctcaagactttga

SEQ ID NO: 6632259 - DNA, 14 bp, Homo sapiens
agcactcctcggca

SEQ ID NO: 6632260 - DNA, 21 bp, Homo sapiens
agcactcctcggtactcccat

SEQ ID NO: 6632261 - DNA, 16 bp, Homo sapiens
agcactcctctgtctc

SEQ ID NO: 6632262 - DNA, 18 bp, Homo sapiens
agcactcctctgtctctg

SEQ ID NO: 6632263 - DNA, 15 bp, Homo sapiens
agcactcctggtgca

SEQ ID NO: 6632264 - DNA, 19 bp, Homo sapiens
agcactcgagaccatcctg

SEQ ID NO: 6632265 - DNA, 17 bp, Homo sapiens
agcactcggggtccctg

SEQ ID NO: 6632266 - DNA, 18 bp, Homo sapiens
agcactcggggtccctgg

SEQ ID NO: 6632267 - DNA, 19 bp, Homo sapiens
agcactcggggtccctgga

SEQ ID NO: 6632268 - DNA, 16 bp, Homo sapiens
agcactctaattagag

SEQ ID NO: 6632269 - DNA, 14 bp, Homo sapiens
agcactctgctggc

SEQ ID NO: 6632270 - DNA, 21 bp, Homo sapiens
agcactctggggtgggagggt

SEQ ID NO: 6632271 - DNA, 16 bp, Homo sapiens
agcactcttaaagcaa

SEQ ID NO: 6632272 - DNA, 22 bp, Homo sapiens
agcactgaaccacattcaggga

SEQ ID NO: 6632273 - DNA, 23 bp, Homo sapiens
agcactgaaccacattcagggaa

SEQ ID NO: 6632274 - DNA, 16 bp, Homo sapiens
agcactgaacctggga

SEQ ID NO: 6632275 - DNA, 18 bp, Homo sapiens
agcactgaactgctttta

SEQ ID NO: 6632276 - DNA, 12 bp, Homo sapiens
agcactgacctg

SEQ ID NO: 6632277 - DNA, 13 bp, Homo sapiens
agcactgacctgt

SEQ ID NO: 6632278 - DNA, 20 bp, Homo sapiens
agcactgacctgtcatgccc

SEQ ID NO: 6632279 - DNA, 23 bp, Homo sapiens
agcactgactagggaaatgatca

SEQ ID NO: 6632280 - DNA, 16 bp, Homo sapiens
agcactgagcaaagca

SEQ ID NO: 6632281 - DNA, 17 bp, Homo sapiens
agcactgagcaagttga

SEQ ID NO: 6632282 - DNA, 12 bp, Homo sapiens
agcactgagctc

SEQ ID NO: 6632283 - DNA, 13 bp, Homo sapiens
agcactgatttca

SEQ ID NO: 6632284 - DNA, 17 bp, Homo sapiens
agcactgatttcacaac

SEQ ID NO: 6632285 - DNA, 21 bp, Homo sapiens
agcactgcacctgcctccagc

SEQ ID NO: 6632286 - DNA, 22 bp, Homo sapiens
agcactgcacctgcctccagcc

SEQ ID NO: 6632287 - DNA, 22 bp, Homo sapiens
agcactgcagatagccagacac

SEQ ID NO: 6632288 - DNA, 23 bp, Homo sapiens
agcactgcagatagccagacaca

SEQ ID NO: 6632289 - DNA, 18 bp, Homo sapiens
agcactgcatgtcagagc

SEQ ID NO: 6632290 - DNA, 19 bp, Homo sapiens
agcactgccaactcggctg

SEQ ID NO: 6632291 - DNA, 13 bp, Homo sapiens
agcactgccagga

SEQ ID NO: 6632292 - DNA, 12 bp, Homo sapiens
agcactgcccaa

SEQ ID NO: 6632293 - DNA, 16 bp, Homo sapiens
agcactgcccatccca

SEQ ID NO: 6632294 - DNA, 14 bp, Homo sapiens
agcactgccccaca

SEQ ID NO: 6632295 - DNA, 16 bp, Homo sapiens
agcactgccccacatg

SEQ ID NO: 6632296 - DNA, 18 bp, Homo sapiens
agcactgccccacatgca

SEQ ID NO: 6632297 - DNA, 13 bp, Homo sapiens
agcactgcctcct

SEQ ID NO: 6632298 - DNA, 14 bp, Homo sapiens
agcactgcctcctg

SEQ ID NO: 6632299 - DNA, 16 bp, Homo sapiens
agcactgcctgccaag

SEQ ID NO: 6632300 - DNA, 21 bp, Homo sapiens
agcactgctaggcgagtgcca

SEQ ID NO: 6632301 - DNA, 20 bp, Homo sapiens
agcactgctcacgtctctgc

SEQ ID NO: 6632302 - DNA, 22 bp, Homo sapiens
agcactgctcacgtctctgccg

SEQ ID NO: 6632303 - DNA, 15 bp, Homo sapiens
agcactgctgcctca

SEQ ID NO: 6632304 - DNA, 17 bp, Homo sapiens
agcactgctgcctcagc

SEQ ID NO: 6632305 - DNA, 18 bp, Homo sapiens
agcactgctgcctcagct

SEQ ID NO: 6632306 - DNA, 19 bp, Homo sapiens
agcactgctgcctcagctc

SEQ ID NO: 6632307 - DNA, 12 bp, Homo sapiens
agcactggactc

SEQ ID NO: 6632308 - DNA, 17 bp, Homo sapiens
agcactggaggcctctg

SEQ ID NO: 6632309 - DNA, 19 bp, Homo sapiens
agcactggaggcctctgca

SEQ ID NO: 6632310 - DNA, 21 bp, Homo sapiens
agcactggaggcctctgcaag

SEQ ID NO: 6632311 - DNA, 17 bp, Homo sapiens
agcactggaggggccca

SEQ ID NO: 6632312 - DNA, 19 bp, Homo sapiens
agcactggagtgcagggag

SEQ ID NO: 6632313 - DNA, 22 bp, Homo sapiens
agcactggagtgcagggaggag

SEQ ID NO: 6632314 - DNA, 12 bp, Homo sapiens
agcactggccag

SEQ ID NO: 6632315 - DNA, 13 bp, Homo sapiens
agcactggccaga

SEQ ID NO: 6632316 - DNA, 19 bp, Homo sapiens
agcactggccagagagggc

SEQ ID NO: 6632317 - DNA, 20 bp, Homo sapiens
agcactggccagagagggcc

SEQ ID NO: 6632318 - DNA, 16 bp, Homo sapiens
agcactggccttgcct

SEQ ID NO: 6632319 - DNA, 20 bp, Homo sapiens
agcactggctctctccagga

SEQ ID NO: 6632320 - DNA, 23 bp, Homo sapiens
agcactgggctaatttgtatgtt

SEQ ID NO: 6632321 - DNA, 17 bp, Homo sapiens
agcactgggttgacttt

SEQ ID NO: 6632322 - DNA, 17 bp, Homo sapiens
agcactggtttcaagaa

SEQ ID NO: 6632323 - DNA, 14 bp, Homo sapiens
agcactgtctcagt

SEQ ID NO: 6632324 - DNA, 12 bp, Homo sapiens
agcactgtgcag

SEQ ID NO: 6632325 - DNA, 14 bp, Homo sapiens
agcactgtgcagcc

SEQ ID NO: 6632326 - DNA, 17 bp, Homo sapiens
agcactgtgcagccggg

SEQ ID NO: 6632327 - DNA, 17 bp, Homo sapiens
agcactgtgtaaccagc

SEQ ID NO: 6632328 - DNA, 14 bp, Homo sapiens
agcactgtgtttat

SEQ ID NO: 6632329 - DNA, 17 bp, Homo sapiens
agcactgttccagcctg

SEQ ID NO: 6632330 - DNA, 18 bp, Homo sapiens
agcactgttctgggactc

SEQ ID NO: 6632331 - DNA, 14 bp, Homo sapiens
agcactgtttttcc

SEQ ID NO: 6632332 - DNA, 14 bp, Homo sapiens
agcacttaaacaga

SEQ ID NO: 6632333 - DNA, 16 bp, Homo sapiens
agcacttaaacagaag

SEQ ID NO: 6632334 - DNA, 12 bp, Homo sapiens
agcacttaaagt

SEQ ID NO: 6632335 - DNA, 17 bp, Homo sapiens
agcacttaagagaatat

SEQ ID NO: 6632336 - DNA, 18 bp, Homo sapiens
agcacttaagagaatatt

SEQ ID NO: 6632337 - DNA, 20 bp, Homo sapiens
agcacttacagataggcctt

SEQ ID NO: 6632338 - DNA, 17 bp, Homo sapiens
agcacttagacctgcca

SEQ ID NO: 6632339 - DNA, 21 bp, Homo sapiens
agcacttcaaagaagctgtct

SEQ ID NO: 6632340 - DNA, 23 bp, Homo sapiens
agcacttcaaagaagctgtcttg

SEQ ID NO: 6632341 - DNA, 18 bp, Homo sapiens
agcacttcacagctggac

SEQ ID NO: 6632342 - DNA, 19 bp, Homo sapiens
agcacttcagggcagattt

SEQ ID NO: 6632343 - DNA, 19 bp, Homo sapiens
agcacttcatctggctgcc

SEQ ID NO: 6632344 - DNA, 23 bp, Homo sapiens
agcacttcatctggctgcctttg

SEQ ID NO: 6632345 - DNA, 18 bp, Homo sapiens
agcacttccaaaattctt

SEQ ID NO: 6632346 - DNA, 19 bp, Homo sapiens
agcacttccttgccagtct

SEQ ID NO: 6632347 - DNA, 14 bp, Homo sapiens
agcacttctagaat

SEQ ID NO: 6632348 - DNA, 14 bp, Homo sapiens
agcacttctgctgc

SEQ ID NO: 6632349 - DNA, 15 bp, Homo sapiens
agcacttctttttct

SEQ ID NO: 6632350 - DNA, 13 bp, Homo sapiens
agcacttgaagaa

SEQ ID NO: 6632351 - DNA, 22 bp, Homo sapiens
agcacttgagaaccagtctcct

SEQ ID NO: 6632352 - DNA, 13 bp, Homo sapiens
agcacttgcctgg

SEQ ID NO: 6632353 - DNA, 16 bp, Homo sapiens
agcacttgcctggaat

SEQ ID NO: 6632354 - DNA, 15 bp, Homo sapiens
agcacttgcgtcctg

SEQ ID NO: 6632355 - DNA, 16 bp, Homo sapiens
agcacttgcgtcctgc

SEQ ID NO: 6632356 - DNA, 20 bp, Homo sapiens
agcacttgcgtcctgcagag

SEQ ID NO: 6632357 - DNA, 19 bp, Homo sapiens
agcacttgcttacatcctc

SEQ ID NO: 6632358 - DNA, 20 bp, Homo sapiens
agcacttggactcttgctct

SEQ ID NO: 6632359 - DNA, 14 bp, Homo sapiens
agcacttggagcca

SEQ ID NO: 6632360 - DNA, 12 bp, Homo sapiens
agcacttgtata

SEQ ID NO: 6632361 - DNA, 19 bp, Homo sapiens
agcacttgtctcaggactc

SEQ ID NO: 6632362 - DNA, 17 bp, Homo sapiens
agcacttgttccttctg

SEQ ID NO: 6632363 - DNA, 14 bp, Homo sapiens
agcacttgttttca

SEQ ID NO: 6632364 - DNA, 22 bp, Homo sapiens
agcactttaaaaacaggccagc

SEQ ID NO: 6632365 - DNA, 14 bp, Homo sapiens
agcactttaaactt

SEQ ID NO: 6632366 - DNA, 16 bp, Homo sapiens
agcactttaaacttaa

SEQ ID NO: 6632367 - DNA, 18 bp, Homo sapiens
agcactttaaccctctct

SEQ ID NO: 6632368 - DNA, 22 bp, Homo sapiens
agcactttaaccctctcttccc

SEQ ID NO: 6632369 - DNA, 23 bp, Homo sapiens
agcactttaatggcctggaggga

SEQ ID NO: 6632370 - DNA, 21 bp, Homo sapiens
agcactttacgctgtctgtaa

SEQ ID NO: 6632371 - DNA, 22 bp, Homo sapiens
agcactttctacaatgtgaact

SEQ ID NO: 6632372 - DNA, 17 bp, Homo sapiens
agcactttgaaatacct

SEQ ID NO: 6632373 - DNA, 19 bp, Homo sapiens
agcactttgaaatacctca

SEQ ID NO: 6632374 - DNA, 21 bp, Homo sapiens
agcactttgattgaagtattc

SEQ ID NO: 6632375 - DNA, 15 bp, Homo sapiens
agcactttgcaagga

SEQ ID NO: 6632376 - DNA, 19 bp, Homo sapiens
agcactttgggaggcaggg

SEQ ID NO: 6632377 - DNA, 21 bp, Homo sapiens
agcactttgggaggccaaggc

SEQ ID NO: 6632378 - DNA, 21 bp, Homo sapiens
agcactttgggaggccaaggt

SEQ ID NO: 6632379 - DNA, 23 bp, Homo sapiens
agcactttgggaggccaaggtgg

SEQ ID NO: 6632380 - DNA, 17 bp, Homo sapiens
agcactttgggaggccg

SEQ ID NO: 6632381 - DNA, 21 bp, Homo sapiens
agcactttgggaggccgaggc

SEQ ID NO: 6632382 - DNA, 19 bp, Homo sapiens
agcactttgggaggctgaa

SEQ ID NO: 6632383 - DNA, 22 bp, Homo sapiens
agcactttgggaggctgaggtg

SEQ ID NO: 6632384 - DNA, 13 bp, Homo sapiens
agcacttttcaaa

SEQ ID NO: 6632385 - DNA, 19 bp, Homo sapiens
agcacttttgttattccat

SEQ ID NO: 6632386 - DNA, 22 bp, Homo sapiens
agcacttttgttattccatcaa

SEQ ID NO: 6632387 - DNA, 23 bp, Homo sapiens
agcacttttgttattccatcaat

SEQ ID NO: 6632388 - DNA, 19 bp, Homo sapiens
agcagaaaaaaaagtgtct

SEQ ID NO: 6632389 - DNA, 23 bp, Homo sapiens
agcagaaaaaaaagtgtctcaaa

SEQ ID NO: 6632390 - DNA, 22 bp, Homo sapiens
agcagaaaacctgttcaggcag

SEQ ID NO: 6632391 - DNA, 18 bp, Homo sapiens
agcagaaaagatgaattt

SEQ ID NO: 6632392 - DNA, 14 bp, Homo sapiens
agcagaaaagtgct

SEQ ID NO: 6632393 - DNA, 18 bp, Homo sapiens
agcagaaaataaaggaag

SEQ ID NO: 6632394 - DNA, 13 bp, Homo sapiens
agcagaaaataca

SEQ ID NO: 6632395 - DNA, 14 bp, Homo sapiens
agcagaaacaaaat

SEQ ID NO: 6632396 - DNA, 14 bp, Homo sapiens
agcagaaacagcca

SEQ ID NO: 6632397 - DNA, 16 bp, Homo sapiens
agcagaaacagccatt

SEQ ID NO: 6632398 - DNA, 16 bp, Homo sapiens
agcagaaacccatgtg

SEQ ID NO: 6632399 - DNA, 17 bp, Homo sapiens
agcagaaacccccagga

SEQ ID NO: 6632400 - DNA, 18 bp, Homo sapiens
agcagaaacccccaggag

SEQ ID NO: 6632401 - DNA, 20 bp, Homo sapiens
agcagaaacccccaggagga

SEQ ID NO: 6632402 - DNA, 13 bp, Homo sapiens
agcagaaagaaga

SEQ ID NO: 6632403 - DNA, 20 bp, Homo sapiens
agcagaaagaagagaagtga

SEQ ID NO: 6632404 - DNA, 11 bp, Homo sapiens
agcagaaagat

SEQ ID NO: 6632405 - DNA, 15 bp, Homo sapiens
agcagaaagccaggg

SEQ ID NO: 6632406 - DNA, 21 bp, Homo sapiens
agcagaaagccagggtcctga

SEQ ID NO: 6632407 - DNA, 17 bp, Homo sapiens
agcagaaaggctctgaa

SEQ ID NO: 6632408 - DNA, 15 bp, Homo sapiens
agcagaaagtgcctt

SEQ ID NO: 6632409 - DNA, 22 bp, Homo sapiens
agcagaaatgcccccattctcc

SEQ ID NO: 6632410 - DNA, 14 bp, Homo sapiens
agcagaaattctgt

SEQ ID NO: 6632411 - DNA, 20 bp, Homo sapiens
agcagaaattctgtttttaa

SEQ ID NO: 6632412 - DNA, 17 bp, Homo sapiens
agcagaacaaactcaga

SEQ ID NO: 6632413 - DNA, 21 bp, Homo sapiens
agcagaacaaatgtgtttttc

SEQ ID NO: 6632414 - DNA, 22 bp, Homo sapiens
agcagaacaagtgcctcctgga

SEQ ID NO: 6632415 - DNA, 16 bp, Homo sapiens
agcagaacagccattt

SEQ ID NO: 6632416 - DNA, 22 bp, Homo sapiens
agcagaacaggtagtattacac

SEQ ID NO: 6632417 - DNA, 14 bp, Homo sapiens
agcagaacagtgat

SEQ ID NO: 6632418 - DNA, 17 bp, Homo sapiens
agcagaacatactgttc

SEQ ID NO: 6632419 - DNA, 16 bp, Homo sapiens
agcagaaccagcctca

SEQ ID NO: 6632420 - DNA, 22 bp, Homo sapiens
agcagaacctgcacacaggaca

SEQ ID NO: 6632421 - DNA, 23 bp, Homo sapiens
agcagaacctgcacacaggacag

SEQ ID NO: 6632422 - DNA, 14 bp, Homo sapiens
agcagaacctgtag

SEQ ID NO: 6632423 - DNA, 22 bp, Homo sapiens
agcagaaccttctttggttcca

SEQ ID NO: 6632424 - DNA, 21 bp, Homo sapiens
agcagaacggagccccaggcc

SEQ ID NO: 6632425 - DNA, 23 bp, Homo sapiens
agcagaactcattctatccccaa

SEQ ID NO: 6632426 - DNA, 14 bp, Homo sapiens
agcagaactgaagt

SEQ ID NO: 6632427 - DNA, 21 bp, Homo sapiens
agcagaagaaaaagttgcagt

SEQ ID NO: 6632428 - DNA, 13 bp, Homo sapiens
agcagaagacaaa

SEQ ID NO: 6632429 - DNA, 18 bp, Homo sapiens
agcagaagaccagatcca

SEQ ID NO: 6632430 - DNA, 20 bp, Homo sapiens
agcagaagactatttaccag

SEQ ID NO: 6632431 - DNA, 15 bp, Homo sapiens
agcagaagactctcc

SEQ ID NO: 6632432 - DNA, 14 bp, Homo sapiens
agcagaagagggag

SEQ ID NO: 6632433 - DNA, 13 bp, Homo sapiens
agcagaagcagca

SEQ ID NO: 6632434 - DNA, 14 bp, Homo sapiens
agcagaagcagcaa

SEQ ID NO: 6632435 - DNA, 18 bp, Homo sapiens
agcagaagccccaaagtt

SEQ ID NO: 6632436 - DNA, 14 bp, Homo sapiens
agcagaaggaaaca

SEQ ID NO: 6632437 - DNA, 20 bp, Homo sapiens
agcagaaggacaggtctctg

SEQ ID NO: 6632438 - DNA, 14 bp, Homo sapiens
agcagaaggcagga

SEQ ID NO: 6632439 - DNA, 17 bp, Homo sapiens
agcagaaggccttgcct

SEQ ID NO: 6632440 - DNA, 22 bp, Homo sapiens
agcagaagggggtggtgtctcc

SEQ ID NO: 6632441 - DNA, 15 bp, Homo sapiens
agcagaagtctggct

SEQ ID NO: 6632442 - DNA, 13 bp, Homo sapiens
agcagaagtgacc

SEQ ID NO: 6632443 - DNA, 12 bp, Homo sapiens
agcagaataaag

SEQ ID NO: 6632444 - DNA, 16 bp, Homo sapiens
agcagaataaagcaat

SEQ ID NO: 6632445 - DNA, 22 bp, Homo sapiens
agcagaataaagcaattttcct

SEQ ID NO: 6632446 - DNA, 19 bp, Homo sapiens
agcagaatgagatgattta

SEQ ID NO: 6632447 - DNA, 15 bp, Homo sapiens
agcagaatggaaaaa

SEQ ID NO: 6632448 - DNA, 18 bp, Homo sapiens
agcagaattgaccgacag

SEQ ID NO: 6632449 - DNA, 15 bp, Homo sapiens
agcagaattttaatg

SEQ ID NO: 6632450 - DNA, 18 bp, Homo sapiens
agcagaattttaatgtga

SEQ ID NO: 6632451 - DNA, 20 bp, Homo sapiens
agcagaattttaatgtgaag

SEQ ID NO: 6632452 - DNA, 17 bp, Homo sapiens
agcagacaagagggcaa

SEQ ID NO: 6632453 - DNA, 13 bp, Homo sapiens
agcagacacacac

SEQ ID NO: 6632454 - DNA, 16 bp, Homo sapiens
agcagacacacacata

SEQ ID NO: 6632455 - DNA, 19 bp, Homo sapiens
agcagacacacacatatat

SEQ ID NO: 6632456 - DNA, 13 bp, Homo sapiens
agcagacacacat

SEQ ID NO: 6632457 - DNA, 11 bp, Homo sapiens
agcagacacat

SEQ ID NO: 6632458 - DNA, 17 bp, Homo sapiens
agcagacacccttggag

SEQ ID NO: 6632459 - DNA, 22 bp, Homo sapiens
agcagacactccagtttgccca

SEQ ID NO: 6632460 - DNA, 13 bp, Homo sapiens
agcagacactgcc

SEQ ID NO: 6632461 - DNA, 13 bp, Homo sapiens
agcagacagaaac

SEQ ID NO: 6632462 - DNA, 17 bp, Homo sapiens
agcagacagaaactgga

SEQ ID NO: 6632463 - DNA, 18 bp, Homo sapiens
agcagacagagccaggag

SEQ ID NO: 6632464 - DNA, 23 bp, Homo sapiens
agcagacagagccaggagaagct

SEQ ID NO: 6632465 - DNA, 17 bp, Homo sapiens
agcagacagcaagggct

SEQ ID NO: 6632466 - DNA, 13 bp, Homo sapiens
agcagacagggcg

SEQ ID NO: 6632467 - DNA, 21 bp, Homo sapiens
agcagacagtgttttctggga

SEQ ID NO: 6632468 - DNA, 23 bp, Homo sapiens
agcagacattgtcagcaaattaa

SEQ ID NO: 6632469 - DNA, 11 bp, Homo sapiens
agcagacattt

SEQ ID NO: 6632470 - DNA, 20 bp, Homo sapiens
agcagacgcagcagctggga

SEQ ID NO: 6632471 - DNA, 17 bp, Homo sapiens
agcagactacagctggg

SEQ ID NO: 6632472 - DNA, 18 bp, Homo sapiens
agcagactagaattctgg

SEQ ID NO: 6632473 - DNA, 16 bp, Homo sapiens
agcagactcagctctg

SEQ ID NO: 6632474 - DNA, 19 bp, Homo sapiens
agcagactcagctctgaca

SEQ ID NO: 6632475 - DNA, 15 bp, Homo sapiens
agcagactcagctgc

SEQ ID NO: 6632476 - DNA, 17 bp, Homo sapiens
agcagactcagctgcta

SEQ ID NO: 6632477 - DNA, 13 bp, Homo sapiens
agcagactccagc

SEQ ID NO: 6632478 - DNA, 17 bp, Homo sapiens
agcagactccagcccct

SEQ ID NO: 6632479 - DNA, 18 bp, Homo sapiens
agcagactccagcccctg

SEQ ID NO: 6632480 - DNA, 18 bp, Homo sapiens
agcagactggaaaagtga

SEQ ID NO: 6632481 - DNA, 20 bp, Homo sapiens
agcagactttcccaaatgta

SEQ ID NO: 6632482 - DNA, 21 bp, Homo sapiens
agcagactttcccaaatgtat

SEQ ID NO: 6632483 - DNA, 18 bp, Homo sapiens
agcagacttttaaagact

SEQ ID NO: 6632484 - DNA, 16 bp, Homo sapiens
agcagagaatataaca

SEQ ID NO: 6632485 - DNA, 20 bp, Homo sapiens
agcagagaatataacatgaa

SEQ ID NO: 6632486 - DNA, 24 bp, Homo sapiens
agcagagaatataacatgaaatga

SEQ ID NO: 6632487 - DNA, 15 bp, Homo sapiens
agcagagaccatccc

SEQ ID NO: 6632488 - DNA, 18 bp, Homo sapiens
agcagagaccatccctga

SEQ ID NO: 6632489 - DNA, 16 bp, Homo sapiens
agcagagacggcagcc

SEQ ID NO: 6632490 - DNA, 21 bp, Homo sapiens
agcagagacggcagccccatc

SEQ ID NO: 6632491 - DNA, 14 bp, Homo sapiens
agcagagagagaga

SEQ ID NO: 6632492 - DNA, 12 bp, Homo sapiens
agcagagagagc

SEQ ID NO: 6632493 - DNA, 17 bp, Homo sapiens
agcagagagagccagac

SEQ ID NO: 6632494 - DNA, 14 bp, Homo sapiens
agcagagagccaaa

SEQ ID NO: 6632495 - DNA, 15 bp, Homo sapiens
agcagagagccaaat

SEQ ID NO: 6632496 - DNA, 19 bp, Homo sapiens
agcagagagccaaatctga

SEQ ID NO: 6632497 - DNA, 22 bp, Homo sapiens
agcagagagccaaatctgacct

SEQ ID NO: 6632498 - DNA, 14 bp, Homo sapiens
agcagagagccctg

SEQ ID NO: 6632499 - DNA, 15 bp, Homo sapiens
agcagagagccctgg

SEQ ID NO: 6632500 - DNA, 22 bp, Homo sapiens
agcagagaggtggatcctgtag

SEQ ID NO: 6632501 - DNA, 18 bp, Homo sapiens
agcagagaggtggccacc

SEQ ID NO: 6632502 - DNA, 19 bp, Homo sapiens
agcagagaggtggccaccg

SEQ ID NO: 6632503 - DNA, 22 bp, Homo sapiens
agcagagatcgacagacagcca

SEQ ID NO: 6632504 - DNA, 17 bp, Homo sapiens
agcagagatgtactgca

SEQ ID NO: 6632505 - DNA, 20 bp, Homo sapiens
agcagagcaaaatgctcttg

SEQ ID NO: 6632506 - DNA, 22 bp, Homo sapiens
agcagagcaaaatgctcttgtc

SEQ ID NO: 6632507 - DNA, 17 bp, Homo sapiens
agcagagcaaatgaggg

SEQ ID NO: 6632508 - DNA, 19 bp, Homo sapiens
agcagagcaagtctgcagg

SEQ ID NO: 6632509 - DNA, 13 bp, Homo sapiens
agcagagcactgt

SEQ ID NO: 6632510 - DNA, 16 bp, Homo sapiens
agcagagcagaacttt

SEQ ID NO: 6632511 - DNA, 14 bp, Homo sapiens
agcagagcaggggc

SEQ ID NO: 6632512 - DNA, 16 bp, Homo sapiens
agcagagccaaggcca

SEQ ID NO: 6632513 - DNA, 12 bp, Homo sapiens
agcagagccagg

SEQ ID NO: 6632514 - DNA, 15 bp, Homo sapiens
agcagagccagggca

SEQ ID NO: 6632515 - DNA, 13 bp, Homo sapiens
agcagagccatct

SEQ ID NO: 6632516 - DNA, 16 bp, Homo sapiens
agcagagccatctgcg

SEQ ID NO: 6632517 - DNA, 10 bp, Homo sapiens
agcagagccg

SEQ ID NO: 6632518 - DNA, 13 bp, Homo sapiens
agcagagccgccc

SEQ ID NO: 6632519 - DNA, 22 bp, Homo sapiens
agcagagccgccccgtgtcccc

SEQ ID NO: 6632520 - DNA, 19 bp, Homo sapiens
agcagagccgttcctggga

SEQ ID NO: 6632521 - DNA, 15 bp, Homo sapiens
agcagagcctcctgg

SEQ ID NO: 6632522 - DNA, 18 bp, Homo sapiens
agcagagctaggtggaaa

SEQ ID NO: 6632523 - DNA, 15 bp, Homo sapiens
agcagagctctgccg

SEQ ID NO: 6632524 - DNA, 12 bp, Homo sapiens
agcagaggaagg

SEQ ID NO: 6632525 - DNA, 17 bp, Homo sapiens
agcagaggaaggagagg

SEQ ID NO: 6632526 - DNA, 15 bp, Homo sapiens
agcagaggaggggcc

SEQ ID NO: 6632527 - DNA, 19 bp, Homo sapiens
agcagaggaggggccgctg

SEQ ID NO: 6632528 - DNA, 13 bp, Homo sapiens
agcagaggcactg

SEQ ID NO: 6632529 - DNA, 15 bp, Homo sapiens
agcagaggcactggg

SEQ ID NO: 6632530 - DNA, 17 bp, Homo sapiens
agcagaggcactggggg

SEQ ID NO: 6632531 - DNA, 13 bp, Homo sapiens
agcagaggcagcg

SEQ ID NO: 6632532 - DNA, 20 bp, Homo sapiens
agcagaggcaggaccagaag

SEQ ID NO: 6632533 - DNA, 21 bp, Homo sapiens
agcagaggcaggaccagaagg

SEQ ID NO: 6632534 - DNA, 19 bp, Homo sapiens
agcagaggcaggctgggac

SEQ ID NO: 6632535 - DNA, 14 bp, Homo sapiens
agcagaggcagtgg

SEQ ID NO: 6632536 - DNA, 11 bp, Homo sapiens
agcagaggccc

SEQ ID NO: 6632537 - DNA, 13 bp, Homo sapiens
agcagaggccctg

SEQ ID NO: 6632538 - DNA, 15 bp, Homo sapiens
agcagaggccctgcc

SEQ ID NO: 6632539 - DNA, 19 bp, Homo sapiens
agcagaggccctgccccca

SEQ ID NO: 6632540 - DNA, 20 bp, Homo sapiens
agcagaggccctgcccccac

SEQ ID NO: 6632541 - DNA, 21 bp, Homo sapiens
agcagaggccctgtggtcccc

SEQ ID NO: 6632542 - DNA, 22 bp, Homo sapiens
agcagaggcctttattgtcttg

SEQ ID NO: 6632543 - DNA, 13 bp, Homo sapiens
agcagaggctcca

SEQ ID NO: 6632544 - DNA, 15 bp, Homo sapiens
agcagagggaggaag

SEQ ID NO: 6632545 - DNA, 13 bp, Homo sapiens
agcagagggcagg

SEQ ID NO: 6632546 - DNA, 19 bp, Homo sapiens
agcagagggcaggggtgct

SEQ ID NO: 6632547 - DNA, 15 bp, Homo sapiens
agcagaggggccagg

SEQ ID NO: 6632548 - DNA, 16 bp, Homo sapiens
agcagaggggccaggc

SEQ ID NO: 6632549 - DNA, 18 bp, Homo sapiens
agcagaggggccaggccc

SEQ ID NO: 6632550 - DNA, 21 bp, Homo sapiens
agcagaggggccaggcccagg

SEQ ID NO: 6632551 - DNA, 19 bp, Homo sapiens
agcagagggggagtagcca

SEQ ID NO: 6632552 - DNA, 23 bp, Homo sapiens
agcagaggtggccagagctggga

SEQ ID NO: 6632553 - DNA, 17 bp, Homo sapiens
agcagaggtttaaatgt

SEQ ID NO: 6632554 - DNA, 18 bp, Homo sapiens
agcagagtataggatgga

SEQ ID NO: 6632555 - DNA, 19 bp, Homo sapiens
agcagagtataggatggat

SEQ ID NO: 6632556 - DNA, 15 bp, Homo sapiens
agcagagtcattgtt

SEQ ID NO: 6632557 - DNA, 20 bp, Homo sapiens
agcagagtccttattcttct

SEQ ID NO: 6632558 - DNA, 14 bp, Homo sapiens
agcagagtctgtct

SEQ ID NO: 6632559 - DNA, 15 bp, Homo sapiens
agcagagtctgtctc

SEQ ID NO: 6632560 - DNA, 18 bp, Homo sapiens
agcagagtcttccaggtg

SEQ ID NO: 6632561 - DNA, 17 bp, Homo sapiens
agcagagtgaaattcaa

SEQ ID NO: 6632562 - DNA, 20 bp, Homo sapiens
agcagagtgaaattcaattc

SEQ ID NO: 6632563 - DNA, 10 bp, Homo sapiens
agcagagtgc

SEQ ID NO: 6632564 - DNA, 16 bp, Homo sapiens
agcagagtgcacagct

SEQ ID NO: 6632565 - DNA, 17 bp, Homo sapiens
agcagagtgcacagctg

SEQ ID NO: 6632566 - DNA, 23 bp, Homo sapiens
agcagagtgcacagctgtccact

SEQ ID NO: 6632567 - DNA, 13 bp, Homo sapiens
agcagagtgctgg

SEQ ID NO: 6632568 - DNA, 16 bp, Homo sapiens
agcagagtgctggcac

SEQ ID NO: 6632569 - DNA, 19 bp, Homo sapiens
agcagagtgctggcactta

SEQ ID NO: 6632570 - DNA, 13 bp, Homo sapiens
agcagagtgcttt

SEQ ID NO: 6632571 - DNA, 19 bp, Homo sapiens
agcagagtggactgcattt

SEQ ID NO: 6632572 - DNA, 20 bp, Homo sapiens
agcagagtgggacttggaga

SEQ ID NO: 6632573 - DNA, 22 bp, Homo sapiens
agcagagtgggacttggagagc

SEQ ID NO: 6632574 - DNA, 12 bp, Homo sapiens
agcagagttaaa

SEQ ID NO: 6632575 - DNA, 19 bp, Homo sapiens
agcagagttttcattaaat

SEQ ID NO: 6632576 - DNA, 15 bp, Homo sapiens
agcagataaagacag

SEQ ID NO: 6632577 - DNA, 16 bp, Homo sapiens
agcagataaagacagc

SEQ ID NO: 6632578 - DNA, 16 bp, Homo sapiens
agcagataactttttt

SEQ ID NO: 6632579 - DNA, 17 bp, Homo sapiens
agcagataaggccgagc

SEQ ID NO: 6632580 - DNA, 21 bp, Homo sapiens
agcagataaggccgagcccac

SEQ ID NO: 6632581 - DNA, 23 bp, Homo sapiens
agcagataaggccgagcccacac

SEQ ID NO: 6632582 - DNA, 22 bp, Homo sapiens
agcagatacatatgagtgtgga

SEQ ID NO: 6632583 - DNA, 20 bp, Homo sapiens
agcagatccacctgcacaaa

SEQ ID NO: 6632584 - DNA, 23 bp, Homo sapiens
agcagatccacctgcacaaacat

SEQ ID NO: 6632585 - DNA, 21 bp, Homo sapiens
agcagatcgtgccgtggagct

SEQ ID NO: 6632586 - DNA, 23 bp, Homo sapiens
agcagatcgtgccgtggagcttg

SEQ ID NO: 6632587 - DNA, 19 bp, Homo sapiens
agcagatctgaaaggcaca

SEQ ID NO: 6632588 - DNA, 15 bp, Homo sapiens
agcagatgacagagg

SEQ ID NO: 6632589 - DNA, 17 bp, Homo sapiens
agcagatgactgagaac

SEQ ID NO: 6632590 - DNA, 17 bp, Homo sapiens
agcagatgcaaagaggc

SEQ ID NO: 6632591 - DNA, 18 bp, Homo sapiens
agcagatgcaaagaggca

SEQ ID NO: 6632592 - DNA, 20 bp, Homo sapiens
agcagatgcaaagaggcaag

SEQ ID NO: 6632593 - DNA, 19 bp, Homo sapiens
agcagatgcaatgactcag

SEQ ID NO: 6632594 - DNA, 17 bp, Homo sapiens
agcagatgcagagagcc

SEQ ID NO: 6632595 - DNA, 21 bp, Homo sapiens
agcagatgcgtagcatttgct

SEQ ID NO: 6632596 - DNA, 17 bp, Homo sapiens
agcagatggaaagaaag

SEQ ID NO: 6632597 - DNA, 14 bp, Homo sapiens
agcagatggacagc

SEQ ID NO: 6632598 - DNA, 13 bp, Homo sapiens
agcagatgggaca

SEQ ID NO: 6632599 - DNA, 16 bp, Homo sapiens
agcagatggggagggt

SEQ ID NO: 6632600 - DNA, 15 bp, Homo sapiens
agcagatgtttaatg

SEQ ID NO: 6632601 - DNA, 14 bp, Homo sapiens
agcagattattcac

SEQ ID NO: 6632602 - DNA, 15 bp, Homo sapiens
agcagattattcact

SEQ ID NO: 6632603 - DNA, 19 bp, Homo sapiens
agcagattattcactgatt

SEQ ID NO: 6632604 - DNA, 20 bp, Homo sapiens
agcagattattcactgattt

SEQ ID NO: 6632605 - DNA, 24 bp, Homo sapiens
agcagattcagaaatgaggccatg

SEQ ID NO: 6632606 - DNA, 17 bp, Homo sapiens
agcagattccacaggac

SEQ ID NO: 6632607 - DNA, 15 bp, Homo sapiens
agcagattccctgtt

SEQ ID NO: 6632608 - DNA, 13 bp, Homo sapiens
agcagattggaag

SEQ ID NO: 6632609 - DNA, 22 bp, Homo sapiens
agcagattggaaggagacacag

SEQ ID NO: 6632610 - DNA, 20 bp, Homo sapiens
agcagattttcctaaggcca

SEQ ID NO: 6632611 - DNA, 21 bp, Homo sapiens
agcagattttcctaaggccac

SEQ ID NO: 6632612 - DNA, 23 bp, Homo sapiens
agcagattttcctaaggccactg

SEQ ID NO: 6632613 - DNA, 16 bp, Homo sapiens
agcagcaaaaatataa

SEQ ID NO: 6632614 - DNA, 17 bp, Homo sapiens
agcagcaaaaatataaa

SEQ ID NO: 6632615 - DNA, 14 bp, Homo sapiens
agcagcaaaatcct

SEQ ID NO: 6632616 - DNA, 20 bp, Homo sapiens
agcagcaaattttcagcatt

SEQ ID NO: 6632617 - DNA, 20 bp, Homo sapiens
agcagcaagaaaaaaaaatg

SEQ ID NO: 6632618 - DNA, 14 bp, Homo sapiens
agcagcaaggtctt

SEQ ID NO: 6632619 - DNA, 18 bp, Homo sapiens
agcagcaaggtcttgctc

SEQ ID NO: 6632620 - DNA, 16 bp, Homo sapiens
agcagcaaggtggggg

SEQ ID NO: 6632621 - DNA, 21 bp, Homo sapiens
agcagcaaggtgggggtcagg

SEQ ID NO: 6632622 - DNA, 15 bp, Homo sapiens
agcagcaagtgtgct

SEQ ID NO: 6632623 - DNA, 15 bp, Homo sapiens
agcagcaatattttg

SEQ ID NO: 6632624 - DNA, 17 bp, Homo sapiens
agcagcaatattttgta

SEQ ID NO: 6632625 - DNA, 18 bp, Homo sapiens
agcagcacaaagaaacag

SEQ ID NO: 6632626 - DNA, 14 bp, Homo sapiens
agcagcacaaggaa

SEQ ID NO: 6632627 - DNA, 14 bp, Homo sapiens
agcagcacaattct

SEQ ID NO: 6632628 - DNA, 15 bp, Homo sapiens
agcagcacaattctg

SEQ ID NO: 6632629 - DNA, 18 bp, Homo sapiens
agcagcacaattctgtcc

SEQ ID NO: 6632630 - DNA, 22 bp, Homo sapiens
agcagcacaattctgtccctgt

SEQ ID NO: 6632631 - DNA, 18 bp, Homo sapiens
agcagcaccaaccacagc

SEQ ID NO: 6632632 - DNA, 13 bp, Homo sapiens
agcagcacccatc

SEQ ID NO: 6632633 - DNA, 17 bp, Homo sapiens
agcagcacctcctcagc

SEQ ID NO: 6632634 - DNA, 19 bp, Homo sapiens
agcagcacctgccctacct

SEQ ID NO: 6632635 - DNA, 20 bp, Homo sapiens
agcagcacctgccctacctg

SEQ ID NO: 6632636 - DNA, 16 bp, Homo sapiens
agcagcacctttctct

SEQ ID NO: 6632637 - DNA, 18 bp, Homo sapiens
agcagcacctttctctga

SEQ ID NO: 6632638 - DNA, 20 bp, Homo sapiens
agcagcacgcatgtccctcc

SEQ ID NO: 6632639 - DNA, 24 bp, Homo sapiens
agcagcactcccgctgcacacaga

SEQ ID NO: 6632640 - DNA, 15 bp, Homo sapiens
agcagcactggaacc

SEQ ID NO: 6632641 - DNA, 14 bp, Homo sapiens
agcagcactgtgag

SEQ ID NO: 6632642 - DNA, 18 bp, Homo sapiens
agcagcagaatggaaaaa

SEQ ID NO: 6632643 - DNA, 13 bp, Homo sapiens
agcagcagagagc

SEQ ID NO: 6632644 - DNA, 14 bp, Homo sapiens
agcagcagaggcag

SEQ ID NO: 6632645 - DNA, 17 bp, Homo sapiens
agcagcagaggcaggac

SEQ ID NO: 6632646 - DNA, 13 bp, Homo sapiens
agcagcagcacct

SEQ ID NO: 6632647 - DNA, 23 bp, Homo sapiens
agcagcagcacctttctctgaga

SEQ ID NO: 6632648 - DNA, 21 bp, Homo sapiens
agcagcagcccaagcttccct

SEQ ID NO: 6632649 - DNA, 12 bp, Homo sapiens
agcagcagccct

SEQ ID NO: 6632650 - DNA, 13 bp, Homo sapiens
agcagcagccctg

SEQ ID NO: 6632651 - DNA, 15 bp, Homo sapiens
agcagcagcctgcac

SEQ ID NO: 6632652 - DNA, 18 bp, Homo sapiens
agcagcagcctgcacctg

SEQ ID NO: 6632653 - DNA, 15 bp, Homo sapiens
agcagcaggaggggg

SEQ ID NO: 6632654 - DNA, 17 bp, Homo sapiens
agcagcaggagggggga

SEQ ID NO: 6632655 - DNA, 13 bp, Homo sapiens
agcagcaggatgg

SEQ ID NO: 6632656 - DNA, 18 bp, Homo sapiens
agcagcaggatgggctga

SEQ ID NO: 6632657 - DNA, 20 bp, Homo sapiens
agcagcaggatgggctgagc

SEQ ID NO: 6632658 - DNA, 16 bp, Homo sapiens
agcagcaggcctctgg

SEQ ID NO: 6632659 - DNA, 17 bp, Homo sapiens
agcagcaggcctctggg

SEQ ID NO: 6632660 - DNA, 19 bp, Homo sapiens
agcagcaggcctctgggac

SEQ ID NO: 6632661 - DNA, 22 bp, Homo sapiens
agcagcaggcctctgggaccca

SEQ ID NO: 6632662 - DNA, 23 bp, Homo sapiens
agcagcaggcctctgggacccac

SEQ ID NO: 6632663 - DNA, 14 bp, Homo sapiens
agcagcaggctcag

SEQ ID NO: 6632664 - DNA, 15 bp, Homo sapiens
agcagcaggctcagg

SEQ ID NO: 6632665 - DNA, 12 bp, Homo sapiens
agcagcaggtga

SEQ ID NO: 6632666 - DNA, 14 bp, Homo sapiens
agcagcaggtgctg

SEQ ID NO: 6632667 - DNA, 13 bp, Homo sapiens
agcagcagtgagc

SEQ ID NO: 6632668 - DNA, 14 bp, Homo sapiens
agcagcagtgtcca

SEQ ID NO: 6632669 - DNA, 15 bp, Homo sapiens
agcagcatagaacag

SEQ ID NO: 6632670 - DNA, 22 bp, Homo sapiens
agcagcatcctcctctctggcc

SEQ ID NO: 6632671 - DNA, 15 bp, Homo sapiens
agcagcatcttctgg

SEQ ID NO: 6632672 - DNA, 14 bp, Homo sapiens
agcagcatggaaaa

SEQ ID NO: 6632673 - DNA, 19 bp, Homo sapiens
agcagcatggaaaaatggt

SEQ ID NO: 6632674 - DNA, 21 bp, Homo sapiens
agcagcatggaaaaatggttg

SEQ ID NO: 6632675 - DNA, 17 bp, Homo sapiens
agcagcatggcatagcc

SEQ ID NO: 6632676 - DNA, 14 bp, Homo sapiens
agcagcattacaga

SEQ ID NO: 6632677 - DNA, 15 bp, Homo sapiens
agcagcattcagcac

SEQ ID NO: 6632678 - DNA, 20 bp, Homo sapiens
agcagcatttttatttcaga

SEQ ID NO: 6632679 - DNA, 21 bp, Homo sapiens
agcagccaagctccttgggag

SEQ ID NO: 6632680 - DNA, 20 bp, Homo sapiens
agcagccacacttcctttag

SEQ ID NO: 6632681 - DNA, 12 bp, Homo sapiens
agcagccagagc

SEQ ID NO: 6632682 - DNA, 14 bp, Homo sapiens
agcagccagagctg

SEQ ID NO: 6632683 - DNA, 17 bp, Homo sapiens
agcagccagagctgtgc

SEQ ID NO: 6632684 - DNA, 18 bp, Homo sapiens
agcagccagagctgtgcc

SEQ ID NO: 6632685 - DNA, 22 bp, Homo sapiens
agcagccagcaccacctacaca

SEQ ID NO: 6632686 - DNA, 13 bp, Homo sapiens
agcagccagccag

SEQ ID NO: 6632687 - DNA, 16 bp, Homo sapiens
agcagccagccagtct

SEQ ID NO: 6632688 - DNA, 12 bp, Homo sapiens
agcagccagccc

SEQ ID NO: 6632689 - DNA, 13 bp, Homo sapiens
agcagccagccct

SEQ ID NO: 6632690 - DNA, 17 bp, Homo sapiens
agcagccagccctgcct

SEQ ID NO: 6632691 - DNA, 15 bp, Homo sapiens
agcagccagccgtga

SEQ ID NO: 6632692 - DNA, 12 bp, Homo sapiens
agcagccagctc

SEQ ID NO: 6632693 - DNA, 13 bp, Homo sapiens
agcagccagctcc

SEQ ID NO: 6632694 - DNA, 13 bp, Homo sapiens
agcagccagctct

SEQ ID NO: 6632695 - DNA, 14 bp, Homo sapiens
agcagccagctctc

SEQ ID NO: 6632696 - DNA, 19 bp, Homo sapiens
agcagccagggacccccag

SEQ ID NO: 6632697 - DNA, 13 bp, Homo sapiens
agcagccagtctc

SEQ ID NO: 6632698 - DNA, 19 bp, Homo sapiens
agcagccagtctcagagac

SEQ ID NO: 6632699 - DNA, 21 bp, Homo sapiens
agcagccagtctcagagacca

SEQ ID NO: 6632700 - DNA, 20 bp, Homo sapiens
agcagccatcataggaaggg

SEQ ID NO: 6632701 - DNA, 14 bp, Homo sapiens
agcagcccaccctg

SEQ ID NO: 6632702 - DNA, 20 bp, Homo sapiens
agcagcccaccctgctgctg

SEQ ID NO: 6632703 - DNA, 18 bp, Homo sapiens
agcagcccacctgctgcc

SEQ ID NO: 6632704 - DNA, 22 bp, Homo sapiens
agcagcccacctgctgcccgtg

SEQ ID NO: 6632705 - DNA, 13 bp, Homo sapiens
agcagcccagcat

SEQ ID NO: 6632706 - DNA, 12 bp, Homo sapiens
agcagcccccaa

SEQ ID NO: 6632707 - DNA, 20 bp, Homo sapiens
agcagcccccagctcccacc

SEQ ID NO: 6632708 - DNA, 13 bp, Homo sapiens
agcagccccccag

SEQ ID NO: 6632709 - DNA, 18 bp, Homo sapiens
agcagccccccagcacta

SEQ ID NO: 6632710 - DNA, 22 bp, Homo sapiens
agcagcccccgggccgctggct

SEQ ID NO: 6632711 - DNA, 16 bp, Homo sapiens
agcagccccctgtggc

SEQ ID NO: 6632712 - DNA, 21 bp, Homo sapiens
agcagcccctcagcgccccca

SEQ ID NO: 6632713 - DNA, 15 bp, Homo sapiens
agcagcccctgagag

SEQ ID NO: 6632714 - DNA, 21 bp, Homo sapiens
agcagcccctgagagcctgtg

SEQ ID NO: 6632715 - DNA, 15 bp, Homo sapiens
agcagcccggggagg

SEQ ID NO: 6632716 - DNA, 18 bp, Homo sapiens
agcagcccggggaggaac

SEQ ID NO: 6632717 - DNA, 20 bp, Homo sapiens
agcagccctcaacaggccca

SEQ ID NO: 6632718 - DNA, 23 bp, Homo sapiens
agcagccctcctcaccccgtctg

SEQ ID NO: 6632719 - DNA, 17 bp, Homo sapiens
agcagccctggagtcat

SEQ ID NO: 6632720 - DNA, 18 bp, Homo sapiens
agcagccctggatggtgg

SEQ ID NO: 6632721 - DNA, 19 bp, Homo sapiens
agcagccctggatggtggc

SEQ ID NO: 6632722 - DNA, 21 bp, Homo sapiens
agcagcccttgtgtgtgccct

SEQ ID NO: 6632723 - DNA, 23 bp, Homo sapiens
agcagcccttgtgtgtgccctgg

SEQ ID NO: 6632724 - DNA, 23 bp, Homo sapiens
agcagcccttgtttatatgccca

SEQ ID NO: 6632725 - DNA, 21 bp, Homo sapiens
agcagccgccttaagctgatc

SEQ ID NO: 6632726 - DNA, 22 bp, Homo sapiens
agcagcctcacactggcgtctg

SEQ ID NO: 6632727 - DNA, 12 bp, Homo sapiens
agcagcctcaga

SEQ ID NO: 6632728 - DNA, 16 bp, Homo sapiens
agcagcctcattctga

SEQ ID NO: 6632729 - DNA, 14 bp, Homo sapiens
agcagcctccaaga

SEQ ID NO: 6632730 - DNA, 21 bp, Homo sapiens
agcagcctccactgtgtccag

SEQ ID NO: 6632731 - DNA, 17 bp, Homo sapiens
agcagcctccagtgctg

SEQ ID NO: 6632732 - DNA, 18 bp, Homo sapiens
agcagcctccagtgctgg

SEQ ID NO: 6632733 - DNA, 19 bp, Homo sapiens
agcagcctccagtgctggc

SEQ ID NO: 6632734 - DNA, 20 bp, Homo sapiens
agcagcctccagtgctggct

SEQ ID NO: 6632735 - DNA, 23 bp, Homo sapiens
agcagcctccagtgctggctgct

SEQ ID NO: 6632736 - DNA, 15 bp, Homo sapiens
agcagcctcctgggc

SEQ ID NO: 6632737 - DNA, 17 bp, Homo sapiens
agcagcctcctgggcag

SEQ ID NO: 6632738 - DNA, 19 bp, Homo sapiens
agcagcctcctgggcagtc

SEQ ID NO: 6632739 - DNA, 14 bp, Homo sapiens
agcagcctccttat

SEQ ID NO: 6632740 - DNA, 18 bp, Homo sapiens
agcagcctcgaggctggt

SEQ ID NO: 6632741 - DNA, 20 bp, Homo sapiens
agcagcctcgcacaggccct

SEQ ID NO: 6632742 - DNA, 24 bp, Homo sapiens
agcagcctcgcacaggccctagct

SEQ ID NO: 6632743 - DNA, 22 bp, Homo sapiens
agcagcctcgcccctggcagag

SEQ ID NO: 6632744 - DNA, 11 bp, Homo sapiens
agcagcctcgt

SEQ ID NO: 6632745 - DNA, 18 bp, Homo sapiens
agcagcctctccccaggt

SEQ ID NO: 6632746 - DNA, 21 bp, Homo sapiens
agcagcctctgatctgtgcag

SEQ ID NO: 6632747 - DNA, 20 bp, Homo sapiens
agcagcctctgccaggcctg

SEQ ID NO: 6632748 - DNA, 21 bp, Homo sapiens
agcagcctctggacagccagt

SEQ ID NO: 6632749 - DNA, 14 bp, Homo sapiens
agcagcctctgtcc

SEQ ID NO: 6632750 - DNA, 19 bp, Homo sapiens
agcagcctctgtcctggct

SEQ ID NO: 6632751 - DNA, 13 bp, Homo sapiens
agcagcctgagca

SEQ ID NO: 6632752 - DNA, 19 bp, Homo sapiens
agcagcctgagcaactctt

SEQ ID NO: 6632753 - DNA, 13 bp, Homo sapiens
agcagcctgatgg

SEQ ID NO: 6632754 - DNA, 14 bp, Homo sapiens
agcagcctgcacct

SEQ ID NO: 6632755 - DNA, 14 bp, Homo sapiens
agcagcctgccagc

SEQ ID NO: 6632756 - DNA, 23 bp, Homo sapiens
agcagcctgcgctcggcaggaag

SEQ ID NO: 6632757 - DNA, 16 bp, Homo sapiens
agcagcctgcttccca

SEQ ID NO: 6632758 - DNA, 22 bp, Homo sapiens
agcagcctgcttcccacctccc

SEQ ID NO: 6632759 - DNA, 16 bp, Homo sapiens
agcagcctggaccctg

SEQ ID NO: 6632760 - DNA, 20 bp, Homo sapiens
agcagcctggagccctggag

SEQ ID NO: 6632761 - DNA, 17 bp, Homo sapiens
agcagcctggctcccct

SEQ ID NO: 6632762 - DNA, 12 bp, Homo sapiens
agcagcctgggg

SEQ ID NO: 6632763 - DNA, 12 bp, Homo sapiens
agcagcctgttt

SEQ ID NO: 6632764 - DNA, 21 bp, Homo sapiens
agcagccttccagtggcttct

SEQ ID NO: 6632765 - DNA, 16 bp, Homo sapiens
agcagcctttaatgca

SEQ ID NO: 6632766 - DNA, 22 bp, Homo sapiens
agcagcctttctctctttatac

SEQ ID NO: 6632767 - DNA, 23 bp, Homo sapiens
agcagcctttttcaccatggcaa

SEQ ID NO: 6632768 - DNA, 20 bp, Homo sapiens
agcagcgaccacccctgcct

SEQ ID NO: 6632769 - DNA, 16 bp, Homo sapiens
agcagcgcccaggcct

SEQ ID NO: 6632770 - DNA, 17 bp, Homo sapiens
agcagcgcccaggcctg

SEQ ID NO: 6632771 - DNA, 14 bp, Homo sapiens
agcagcgcccgagg

SEQ ID NO: 6632772 - DNA, 19 bp, Homo sapiens
agcagcgcccgaggccagg

SEQ ID NO: 6632773 - DNA, 22 bp, Homo sapiens
agcagcgcccgaggccagggcc

SEQ ID NO: 6632774 - DNA, 19 bp, Homo sapiens
agcagcgcggatttctctt

SEQ ID NO: 6632775 - DNA, 15 bp, Homo sapiens
agcagcgctcgctga

SEQ ID NO: 6632776 - DNA, 18 bp, Homo sapiens
agcagcgcttcctggctg

SEQ ID NO: 6632777 - DNA, 20 bp, Homo sapiens
agcagcggattgctctggag

SEQ ID NO: 6632778 - DNA, 14 bp, Homo sapiens
agcagcggctctgg

SEQ ID NO: 6632779 - DNA, 12 bp, Homo sapiens
agcagcgggcta

SEQ ID NO: 6632780 - DNA, 21 bp, Homo sapiens
agcagcggggcgaagcccagg

SEQ ID NO: 6632781 - DNA, 20 bp, Homo sapiens
agcagcgggggcggcccagc

SEQ ID NO: 6632782 - DNA, 15 bp, Homo sapiens
agcagcggtggcctc

SEQ ID NO: 6632783 - DNA, 17 bp, Homo sapiens
agcagcggtttggggag

SEQ ID NO: 6632784 - DNA, 17 bp, Homo sapiens
agcagcgtgcaggagca

SEQ ID NO: 6632785 - DNA, 18 bp, Homo sapiens
agcagcgtttctatgaca

SEQ ID NO: 6632786 - DNA, 19 bp, Homo sapiens
agcagcgtttctatgacac

SEQ ID NO: 6632787 - DNA, 17 bp, Homo sapiens
agcagctaaattttctg

SEQ ID NO: 6632788 - DNA, 11 bp, Homo sapiens
agcagctacca

SEQ ID NO: 6632789 - DNA, 18 bp, Homo sapiens
agcagctagaaagagaaa

SEQ ID NO: 6632790 - DNA, 14 bp, Homo sapiens
agcagctagctgct

SEQ ID NO: 6632791 - DNA, 15 bp, Homo sapiens
agcagctagctgctt

SEQ ID NO: 6632792 - DNA, 18 bp, Homo sapiens
agcagctaggactgagga

SEQ ID NO: 6632793 - DNA, 22 bp, Homo sapiens
agcagctaggactgaggagtgg

SEQ ID NO: 6632794 - DNA, 19 bp, Homo sapiens
agcagctatctctcagtga

SEQ ID NO: 6632795 - DNA, 20 bp, Homo sapiens
agcagctcaaaggcacagtg

SEQ ID NO: 6632796 - DNA, 18 bp, Homo sapiens
agcagctcaacctaccct

SEQ ID NO: 6632797 - DNA, 20 bp, Homo sapiens
agcagctcacaccctacctt

SEQ ID NO: 6632798 - DNA, 23 bp, Homo sapiens
agcagctcacaccctaccttccc

SEQ ID NO: 6632799 - DNA, 15 bp, Homo sapiens
agcagctcagcctcc

SEQ ID NO: 6632800 - DNA, 13 bp, Homo sapiens
agcagctcaggca

SEQ ID NO: 6632801 - DNA, 15 bp, Homo sapiens
agcagctcaggcgca

SEQ ID NO: 6632802 - DNA, 23 bp, Homo sapiens
agcagctcaggcgcagccctagt

SEQ ID NO: 6632803 - DNA, 21 bp, Homo sapiens
agcagctccaacctggaggct

SEQ ID NO: 6632804 - DNA, 17 bp, Homo sapiens
agcagctccaccactgt

SEQ ID NO: 6632805 - DNA, 19 bp, Homo sapiens
agcagctccccaggagctc

SEQ ID NO: 6632806 - DNA, 15 bp, Homo sapiens
agcagctccctttct

SEQ ID NO: 6632807 - DNA, 18 bp, Homo sapiens
agcagctccctttctcag

SEQ ID NO: 6632808 - DNA, 22 bp, Homo sapiens
agcagctccctttctcaggagc

SEQ ID NO: 6632809 - DNA, 22 bp, Homo sapiens
agcagctccttcctagccttgc

SEQ ID NO: 6632810 - DNA, 14 bp, Homo sapiens
agcagctctgagcc

SEQ ID NO: 6632811 - DNA, 22 bp, Homo sapiens
agcagctctgagccagattaca

SEQ ID NO: 6632812 - DNA, 16 bp, Homo sapiens
agcagctctgccttct

SEQ ID NO: 6632813 - DNA, 23 bp, Homo sapiens
agcagctctgctatgagtgtgtg

SEQ ID NO: 6632814 - DNA, 15 bp, Homo sapiens
agcagctctggctct

SEQ ID NO: 6632815 - DNA, 16 bp, Homo sapiens
agcagctctggctctg

SEQ ID NO: 6632816 - DNA, 15 bp, Homo sapiens
agcagctctgtcccc

SEQ ID NO: 6632817 - DNA, 13 bp, Homo sapiens
agcagctcttgct

SEQ ID NO: 6632818 - DNA, 22 bp, Homo sapiens
agcagctgaaatatgctggctg

SEQ ID NO: 6632819 - DNA, 21 bp, Homo sapiens
agcagctgaagccagctccct

SEQ ID NO: 6632820 - DNA, 12 bp, Homo sapiens
agcagctgaagg

SEQ ID NO: 6632821 - DNA, 12 bp, Homo sapiens
agcagctgaagt

SEQ ID NO: 6632822 - DNA, 13 bp, Homo sapiens
agcagctgagcag

SEQ ID NO: 6632823 - DNA, 14 bp, Homo sapiens
agcagctgagcagg

SEQ ID NO: 6632824 - DNA, 16 bp, Homo sapiens
agcagctgagcagggc

SEQ ID NO: 6632825 - DNA, 15 bp, Homo sapiens
agcagctgcattttt

SEQ ID NO: 6632826 - DNA, 17 bp, Homo sapiens
agcagctgcgggtctga

SEQ ID NO: 6632827 - DNA, 13 bp, Homo sapiens
agcagctggacta

SEQ ID NO: 6632828 - DNA, 14 bp, Homo sapiens
agcagctggcactg

SEQ ID NO: 6632829 - DNA, 15 bp, Homo sapiens
agcagctggcactga

SEQ ID NO: 6632830 - DNA, 19 bp, Homo sapiens
agcagctggcactgacagc

SEQ ID NO: 6632831 - DNA, 13 bp, Homo sapiens
agcagctggccta

SEQ ID NO: 6632832 - DNA, 20 bp, Homo sapiens
agcagctggctctccacctt

SEQ ID NO: 6632833 - DNA, 14 bp, Homo sapiens
agcagctgggaact

SEQ ID NO: 6632834 - DNA, 19 bp, Homo sapiens
agcagctgggccggccagc

SEQ ID NO: 6632835 - DNA, 21 bp, Homo sapiens
agcagctgggccggccagcct

SEQ ID NO: 6632836 - DNA, 22 bp, Homo sapiens
agcagctggtaatcttgctctg

SEQ ID NO: 6632837 - DNA, 20 bp, Homo sapiens
agcagctggtcagtctttgc

SEQ ID NO: 6632838 - DNA, 22 bp, Homo sapiens
agcagctgtctaaaatgcagtg

SEQ ID NO: 6632839 - DNA, 18 bp, Homo sapiens
agcagcttagactaaggc

SEQ ID NO: 6632840 - DNA, 12 bp, Homo sapiens
agcagcttccag

SEQ ID NO: 6632841 - DNA, 17 bp, Homo sapiens
agcagcttccttctggg

SEQ ID NO: 6632842 - DNA, 18 bp, Homo sapiens
agcagcttcggtgtgcag

SEQ ID NO: 6632843 - DNA, 15 bp, Homo sapiens
agcagcttctgccac

SEQ ID NO: 6632844 - DNA, 17 bp, Homo sapiens
agcagcttcttgggctg

SEQ ID NO: 6632845 - DNA, 14 bp, Homo sapiens
agcagcttggctga

SEQ ID NO: 6632846 - DNA, 17 bp, Homo sapiens
agcagcttggctgagcc

SEQ ID NO: 6632847 - DNA, 18 bp, Homo sapiens
agcagcttggctgagccc

SEQ ID NO: 6632848 - DNA, 22 bp, Homo sapiens
agcagcttggctgagccccctc

SEQ ID NO: 6632849 - DNA, 23 bp, Homo sapiens
agcagctttttattccctgccca

SEQ ID NO: 6632850 - DNA, 17 bp, Homo sapiens
agcaggaaagatcccaa

SEQ ID NO: 6632851 - DNA, 12 bp, Homo sapiens
agcaggaaatag

SEQ ID NO: 6632852 - DNA, 14 bp, Homo sapiens
agcaggaaatgtag

SEQ ID NO: 6632853 - DNA, 16 bp, Homo sapiens
agcaggaacagagact

SEQ ID NO: 6632854 - DNA, 18 bp, Homo sapiens
agcaggaacagagactct

SEQ ID NO: 6632855 - DNA, 20 bp, Homo sapiens
agcaggaacagagactctgg

SEQ ID NO: 6632856 - DNA, 16 bp, Homo sapiens
agcaggaacccatcta

SEQ ID NO: 6632857 - DNA, 17 bp, Homo sapiens
agcaggaacctgtactg

SEQ ID NO: 6632858 - DNA, 21 bp, Homo sapiens
agcaggaagcattcagagagc

SEQ ID NO: 6632859 - DNA, 22 bp, Homo sapiens
agcaggaagcattcagagagca

SEQ ID NO: 6632860 - DNA, 14 bp, Homo sapiens
agcaggaaggaccc

SEQ ID NO: 6632861 - DNA, 17 bp, Homo sapiens
agcaggaaggcctgggt

SEQ ID NO: 6632862 - DNA, 21 bp, Homo sapiens
agcaggaaggtctcatgcctg

SEQ ID NO: 6632863 - DNA, 23 bp, Homo sapiens
agcaggaaggtctcatgcctgag

SEQ ID NO: 6632864 - DNA, 13 bp, Homo sapiens
agcaggaataaag

SEQ ID NO: 6632865 - DNA, 18 bp, Homo sapiens
agcaggaataaagacttg

SEQ ID NO: 6632866 - DNA, 16 bp, Homo sapiens
agcaggaatttctttt

SEQ ID NO: 6632867 - DNA, 16 bp, Homo sapiens
agcaggacagccagca

SEQ ID NO: 6632868 - DNA, 12 bp, Homo sapiens
agcaggacctag

SEQ ID NO: 6632869 - DNA, 18 bp, Homo sapiens
agcaggacctcccttccg

SEQ ID NO: 6632870 - DNA, 20 bp, Homo sapiens
agcaggacctggcatcatgg

SEQ ID NO: 6632871 - DNA, 18 bp, Homo sapiens
agcaggactaacaactgg

SEQ ID NO: 6632872 - DNA, 16 bp, Homo sapiens
agcaggactaggcatg

SEQ ID NO: 6632873 - DNA, 14 bp, Homo sapiens
agcaggactccagg

SEQ ID NO: 6632874 - DNA, 18 bp, Homo sapiens
agcaggactccaggccca

SEQ ID NO: 6632875 - DNA, 19 bp, Homo sapiens
agcaggactccaggcccaa

SEQ ID NO: 6632876 - DNA, 22 bp, Homo sapiens
agcaggactccaggcccaaggc

SEQ ID NO: 6632877 - DNA, 23 bp, Homo sapiens
agcaggacttgctaaagcacttt

SEQ ID NO: 6632878 - DNA, 22 bp, Homo sapiens
agcaggagaggagagccagaga

SEQ ID NO: 6632879 - DNA, 23 bp, Homo sapiens
agcaggagaggagagccagagaa

SEQ ID NO: 6632880 - DNA, 18 bp, Homo sapiens
agcaggagattgagaagg

SEQ ID NO: 6632881 - DNA, 19 bp, Homo sapiens
agcaggagattgagaagga

SEQ ID NO: 6632882 - DNA, 20 bp, Homo sapiens
agcaggagattgagaaggag

SEQ ID NO: 6632883 - DNA, 17 bp, Homo sapiens
agcaggagccccgccac

SEQ ID NO: 6632884 - DNA, 21 bp, Homo sapiens
agcaggaggacagagtgccct

SEQ ID NO: 6632885 - DNA, 16 bp, Homo sapiens
agcaggaggaggtgcc

SEQ ID NO: 6632886 - DNA, 10 bp, Homo sapiens
agcaggaggc

SEQ ID NO: 6632887 - DNA, 15 bp, Homo sapiens
agcaggaggcacagc

SEQ ID NO: 6632888 - DNA, 18 bp, Homo sapiens
agcaggaggcacagcagt

SEQ ID NO: 6632889 - DNA, 23 bp, Homo sapiens
agcaggaggccaataaaaagttc

SEQ ID NO: 6632890 - DNA, 15 bp, Homo sapiens
agcaggaggcccctg

SEQ ID NO: 6632891 - DNA, 20 bp, Homo sapiens
agcaggaggcccctggccca

SEQ ID NO: 6632892 - DNA, 15 bp, Homo sapiens
agcaggaggctggga

SEQ ID NO: 6632893 - DNA, 23 bp, Homo sapiens
agcaggagggactctgtctggcc

SEQ ID NO: 6632894 - DNA, 21 bp, Homo sapiens
agcaggaggggggagggaagg

SEQ ID NO: 6632895 - DNA, 21 bp, Homo sapiens
agcaggagtggtgcagacaga

SEQ ID NO: 6632896 - DNA, 20 bp, Homo sapiens
agcaggatagctcttcctcc

SEQ ID NO: 6632897 - DNA, 20 bp, Homo sapiens
agcaggatcgaagggttttt

SEQ ID NO: 6632898 - DNA, 21 bp, Homo sapiens
agcaggatgaccacgcacctc

SEQ ID NO: 6632899 - DNA, 13 bp, Homo sapiens
agcaggatgccct

SEQ ID NO: 6632900 - DNA, 18 bp, Homo sapiens
agcaggatgctcagtgat

SEQ ID NO: 6632901 - DNA, 21 bp, Homo sapiens
agcaggatttttttgtagaga

SEQ ID NO: 6632902 - DNA, 17 bp, Homo sapiens
agcaggcaaaaaaggga

SEQ ID NO: 6632903 - DNA, 15 bp, Homo sapiens
agcaggcaagcatgt

SEQ ID NO: 6632904 - DNA, 19 bp, Homo sapiens
agcaggcacatggaggagc

SEQ ID NO: 6632905 - DNA, 15 bp, Homo sapiens
agcaggcaccgccac

SEQ ID NO: 6632906 - DNA, 13 bp, Homo sapiens
agcaggcagagga

SEQ ID NO: 6632907 - DNA, 21 bp, Homo sapiens
agcaggcagagtggcgtggcc

SEQ ID NO: 6632908 - DNA, 23 bp, Homo sapiens
agcaggcagataagttggagcag

SEQ ID NO: 6632909 - DNA, 15 bp, Homo sapiens
agcaggcagcgcctg

SEQ ID NO: 6632910 - DNA, 22 bp, Homo sapiens
agcaggcagcgcctgtcccctc

SEQ ID NO: 6632911 - DNA, 13 bp, Homo sapiens
agcaggcaggcag

SEQ ID NO: 6632912 - DNA, 13 bp, Homo sapiens
agcaggcaggctg

SEQ ID NO: 6632913 - DNA, 16 bp, Homo sapiens
agcaggcaggctgggg

SEQ ID NO: 6632914 - DNA, 23 bp, Homo sapiens
agcaggcaggggcatctgtctgt

SEQ ID NO: 6632915 - DNA, 17 bp, Homo sapiens
agcaggcaggtggactg

SEQ ID NO: 6632916 - DNA, 22 bp, Homo sapiens
agcaggcatttgctaaggcagc

SEQ ID NO: 6632917 - DNA, 13 bp, Homo sapiens
agcaggccacact

SEQ ID NO: 6632918 - DNA, 24 bp, Homo sapiens
agcaggccacacttcaaactactt

SEQ ID NO: 6632919 - DNA, 12 bp, Homo sapiens
agcaggccagag

SEQ ID NO: 6632920 - DNA, 15 bp, Homo sapiens
agcaggccagagaaa

SEQ ID NO: 6632921 - DNA, 16 bp, Homo sapiens
agcaggccagcccgga

SEQ ID NO: 6632922 - DNA, 19 bp, Homo sapiens
agcaggccagcccggacct

SEQ ID NO: 6632923 - DNA, 19 bp, Homo sapiens
agcaggccaggtccagaga

SEQ ID NO: 6632924 - DNA, 23 bp, Homo sapiens
agcaggccaggtccagagagacc

SEQ ID NO: 6632925 - DNA, 13 bp, Homo sapiens
agcaggcccacct

SEQ ID NO: 6632926 - DNA, 15 bp, Homo sapiens
agcaggcccagcatg

SEQ ID NO: 6632927 - DNA, 17 bp, Homo sapiens
agcaggcccagcatgca

SEQ ID NO: 6632928 - DNA, 18 bp, Homo sapiens
agcaggcccagcatgcag

SEQ ID NO: 6632929 - DNA, 12 bp, Homo sapiens
agcaggcccagg

SEQ ID NO: 6632930 - DNA, 16 bp, Homo sapiens
agcaggcccaggagaa

SEQ ID NO: 6632931 - DNA, 23 bp, Homo sapiens
agcaggcccatgggaggctggag

SEQ ID NO: 6632932 - DNA, 16 bp, Homo sapiens
agcaggcccgacagag

SEQ ID NO: 6632933 - DNA, 17 bp, Homo sapiens
agcaggcccgacagaga

SEQ ID NO: 6632934 - DNA, 21 bp, Homo sapiens
agcaggcccgacagagagatg

SEQ ID NO: 6632935 - DNA, 23 bp, Homo sapiens
agcaggcccgacagagagatgaa

SEQ ID NO: 6632936 - DNA, 12 bp, Homo sapiens
agcaggccgccc

SEQ ID NO: 6632937 - DNA, 18 bp, Homo sapiens
agcaggccggaaccacag

SEQ ID NO: 6632938 - DNA, 19 bp, Homo sapiens
agcaggccggaaccacagg

SEQ ID NO: 6632939 - DNA, 22 bp, Homo sapiens
agcaggccggaaccacagggcc

SEQ ID NO: 6632940 - DNA, 20 bp, Homo sapiens
agcaggcctaagacatgtga

SEQ ID NO: 6632941 - DNA, 14 bp, Homo sapiens
agcaggcctctggg

SEQ ID NO: 6632942 - DNA, 15 bp, Homo sapiens
agcaggcctctggga

SEQ ID NO: 6632943 - DNA, 22 bp, Homo sapiens
agcaggcctctgggacccacag

SEQ ID NO: 6632944 - DNA, 14 bp, Homo sapiens
agcaggcctctggt

SEQ ID NO: 6632945 - DNA, 17 bp, Homo sapiens
agcaggcctctggttgc

SEQ ID NO: 6632946 - DNA, 21 bp, Homo sapiens
agcaggcctctggttgcctcc

SEQ ID NO: 6632947 - DNA, 16 bp, Homo sapiens
agcaggcctgttgctt

SEQ ID NO: 6632948 - DNA, 22 bp, Homo sapiens
agcaggcgacaaaatctcctgg

SEQ ID NO: 6632949 - DNA, 21 bp, Homo sapiens
agcaggcgctgtgctatcatg

SEQ ID NO: 6632950 - DNA, 15 bp, Homo sapiens
agcaggcgggctcct

SEQ ID NO: 6632951 - DNA, 21 bp, Homo sapiens
agcaggcgttcagctcactgt

SEQ ID NO: 6632952 - DNA, 14 bp, Homo sapiens
agcaggctactgtc

SEQ ID NO: 6632953 - DNA, 16 bp, Homo sapiens
agcaggctactgtcag

SEQ ID NO: 6632954 - DNA, 15 bp, Homo sapiens
agcaggctagacaga

SEQ ID NO: 6632955 - DNA, 18 bp, Homo sapiens
agcaggctcagactctgg

SEQ ID NO: 6632956 - DNA, 15 bp, Homo sapiens
agcaggctcctcagc

SEQ ID NO: 6632957 - DNA, 20 bp, Homo sapiens
agcaggctcctcagccctct

SEQ ID NO: 6632958 - DNA, 16 bp, Homo sapiens
agcaggctcctggctg

SEQ ID NO: 6632959 - DNA, 19 bp, Homo sapiens
agcaggctcctggctgtgc

SEQ ID NO: 6632960 - DNA, 17 bp, Homo sapiens
agcaggctcgggctccc

SEQ ID NO: 6632961 - DNA, 13 bp, Homo sapiens
agcaggctctcag

SEQ ID NO: 6632962 - DNA, 14 bp, Homo sapiens
agcaggctctcagg

SEQ ID NO: 6632963 - DNA, 18 bp, Homo sapiens
agcaggctctcaggccag

SEQ ID NO: 6632964 - DNA, 21 bp, Homo sapiens
agcaggctgcagcaggcagag

SEQ ID NO: 6632965 - DNA, 15 bp, Homo sapiens
agcaggctgtgagtt

SEQ ID NO: 6632966 - DNA, 22 bp, Homo sapiens
agcaggcttctatgaaagactc

SEQ ID NO: 6632967 - DNA, 16 bp, Homo sapiens
agcaggctttgtgaga

SEQ ID NO: 6632968 - DNA, 17 bp, Homo sapiens
agcaggctttgtgagag

SEQ ID NO: 6632969 - DNA, 15 bp, Homo sapiens
agcagggaaacagct

SEQ ID NO: 6632970 - DNA, 16 bp, Homo sapiens
agcagggaaggcctga

SEQ ID NO: 6632971 - DNA, 16 bp, Homo sapiens
agcagggaagggatga

SEQ ID NO: 6632972 - DNA, 18 bp, Homo sapiens
agcagggaccgggcgcag

SEQ ID NO: 6632973 - DNA, 21 bp, Homo sapiens
agcagggaccgggcgcagccc

SEQ ID NO: 6632974 - DNA, 16 bp, Homo sapiens
agcagggccaaagcac

SEQ ID NO: 6632975 - DNA, 19 bp, Homo sapiens
agcagggccaaagcacagc

SEQ ID NO: 6632976 - DNA, 18 bp, Homo sapiens
agcagggccctcagagga

SEQ ID NO: 6632977 - DNA, 14 bp, Homo sapiens
agcagggccgggga

SEQ ID NO: 6632978 - DNA, 23 bp, Homo sapiens
agcagggccggggaactggccaa

SEQ ID NO: 6632979 - DNA, 18 bp, Homo sapiens
agcagggccttctgcctg

SEQ ID NO: 6632980 - DNA, 19 bp, Homo sapiens
agcagggccttctgcctgc

SEQ ID NO: 6632981 - DNA, 22 bp, Homo sapiens
agcagggccttctgcctgctga

SEQ ID NO: 6632982 - DNA, 15 bp, Homo sapiens
agcagggcggctgcc

SEQ ID NO: 6632983 - DNA, 16 bp, Homo sapiens
agcagggcggctgccg

SEQ ID NO: 6632984 - DNA, 19 bp, Homo sapiens
agcagggcgggccaggaga

SEQ ID NO: 6632985 - DNA, 23 bp, Homo sapiens
agcagggctaccctgagctgagg

SEQ ID NO: 6632986 - DNA, 16 bp, Homo sapiens
agcagggctctgcccc

SEQ ID NO: 6632987 - DNA, 14 bp, Homo sapiens
agcagggctgggcc

SEQ ID NO: 6632988 - DNA, 19 bp, Homo sapiens
agcagggctgggcgcctct

SEQ ID NO: 6632989 - DNA, 20 bp, Homo sapiens
agcagggctggtcacctccc

SEQ ID NO: 6632990 - DNA, 15 bp, Homo sapiens
agcaggggagccctg

SEQ ID NO: 6632991 - DNA, 16 bp, Homo sapiens
agcaggggagcttggg

SEQ ID NO: 6632992 - DNA, 21 bp, Homo sapiens
agcaggggatggcgctagggg

SEQ ID NO: 6632993 - DNA, 15 bp, Homo sapiens
agcaggggcagaagg

SEQ ID NO: 6632994 - DNA, 16 bp, Homo sapiens
agcaggggcagaagga

SEQ ID NO: 6632995 - DNA, 16 bp, Homo sapiens
agcaggggcaggcgca

SEQ ID NO: 6632996 - DNA, 15 bp, Homo sapiens
agcaggggcccctgg

SEQ ID NO: 6632997 - DNA, 20 bp, Homo sapiens
agcaggggctacaagaggga

SEQ ID NO: 6632998 - DNA, 13 bp, Homo sapiens
agcaggggctcca

SEQ ID NO: 6632999 - DNA, 17 bp, Homo sapiens
agcaggggctgctgggg

SEQ ID NO: 6633000 - DNA, 15 bp, Homo sapiens
agcaggggctggccc

SEQ ID NO: 6633001 - DNA, 22 bp, Homo sapiens
agcagggggagaaacccttcac

SEQ ID NO: 6633002 - DNA, 15 bp, Homo sapiens
agcaggggggctgtg

SEQ ID NO: 6633003 - DNA, 17 bp, Homo sapiens
agcaggggggctgtgcc

SEQ ID NO: 6633004 - DNA, 20 bp, Homo sapiens
agcaggggggctgtgccaac

SEQ ID NO: 6633005 - DNA, 12 bp, Homo sapiens
agcaggggtctc

SEQ ID NO: 6633006 - DNA, 23 bp, Homo sapiens
agcaggggtgactttgtctctcc

SEQ ID NO: 6633007 - DNA, 23 bp, Homo sapiens
agcaggggtgggaggctcccaga

SEQ ID NO: 6633008 - DNA, 19 bp, Homo sapiens
agcagggtacctgaaagag

SEQ ID NO: 6633009 - DNA, 18 bp, Homo sapiens
agcagggtagtctggttt

SEQ ID NO: 6633010 - DNA, 21 bp, Homo sapiens
agcagggtagtctggtttcta

SEQ ID NO: 6633011 - DNA, 16 bp, Homo sapiens
agcagggtccacagct

SEQ ID NO: 6633012 - DNA, 16 bp, Homo sapiens
agcagggtcttgctgt

SEQ ID NO: 6633013 - DNA, 19 bp, Homo sapiens
agcagggtcttttcatctg

SEQ ID NO: 6633014 - DNA, 19 bp, Homo sapiens
agcagggtgggcttgtggg

SEQ ID NO: 6633015 - DNA, 13 bp, Homo sapiens
agcagggtggggt

SEQ ID NO: 6633016 - DNA, 19 bp, Homo sapiens
agcagggtggggtctggga

SEQ ID NO: 6633017 - DNA, 17 bp, Homo sapiens
agcaggtacatttctga

SEQ ID NO: 6633018 - DNA, 18 bp, Homo sapiens
agcaggtacatttctgat

SEQ ID NO: 6633019 - DNA, 22 bp, Homo sapiens
agcaggtacatttctgattctg

SEQ ID NO: 6633020 - DNA, 14 bp, Homo sapiens
agcaggtaccactg

SEQ ID NO: 6633021 - DNA, 17 bp, Homo sapiens
agcaggtagcctgctgg

SEQ ID NO: 6633022 - DNA, 18 bp, Homo sapiens
agcaggtagcctgctggt

SEQ ID NO: 6633023 - DNA, 17 bp, Homo sapiens
agcaggtaggggcacag

SEQ ID NO: 6633024 - DNA, 20 bp, Homo sapiens
agcaggtccccagctttggc

SEQ ID NO: 6633025 - DNA, 21 bp, Homo sapiens
agcaggtccccagctttggct

SEQ ID NO: 6633026 - DNA, 13 bp, Homo sapiens
agcaggtctctgg

SEQ ID NO: 6633027 - DNA, 12 bp, Homo sapiens
agcaggtctgca

SEQ ID NO: 6633028 - DNA, 15 bp, Homo sapiens
agcaggtctgcaggc

SEQ ID NO: 6633029 - DNA, 22 bp, Homo sapiens
agcaggtgattggaccaggcca

SEQ ID NO: 6633030 - DNA, 19 bp, Homo sapiens
agcaggtgcccccaggtga

SEQ ID NO: 6633031 - DNA, 17 bp, Homo sapiens
agcaggtgctgctaccc

SEQ ID NO: 6633032 - DNA, 19 bp, Homo sapiens
agcaggtggcatctctaat

SEQ ID NO: 6633033 - DNA, 14 bp, Homo sapiens
agcaggtggggagg

SEQ ID NO: 6633034 - DNA, 20 bp, Homo sapiens
agcaggtggtcctgagacct

SEQ ID NO: 6633035 - DNA, 17 bp, Homo sapiens
agcaggtgtaataagac

SEQ ID NO: 6633036 - DNA, 19 bp, Homo sapiens
agcaggtgtcctttcccct

SEQ ID NO: 6633037 - DNA, 18 bp, Homo sapiens
agcaggtgtgaccctgag

SEQ ID NO: 6633038 - DNA, 21 bp, Homo sapiens
agcaggtgtgaccctgagggc

SEQ ID NO: 6633039 - DNA, 18 bp, Homo sapiens
agcaggtgtgagggcagt

SEQ ID NO: 6633040 - DNA, 16 bp, Homo sapiens
agcaggttaaatgttt

SEQ ID NO: 6633041 - DNA, 18 bp, Homo sapiens
agcaggttactaaggaag

SEQ ID NO: 6633042 - DNA, 23 bp, Homo sapiens
agcaggttcccaagctcagaggc

SEQ ID NO: 6633043 - DNA, 15 bp, Homo sapiens
agcaggttccccaag

SEQ ID NO: 6633044 - DNA, 20 bp, Homo sapiens
agcaggttccccaagggccc

SEQ ID NO: 6633045 - DNA, 14 bp, Homo sapiens
agcaggttctaggc

SEQ ID NO: 6633046 - DNA, 21 bp, Homo sapiens
agcaggttcttgatgtcatgt

SEQ ID NO: 6633047 - DNA, 14 bp, Homo sapiens
agcaggttcttgtt

SEQ ID NO: 6633048 - DNA, 22 bp, Homo sapiens
agcaggttggcttttttccctg

SEQ ID NO: 6633049 - DNA, 21 bp, Homo sapiens
agcaggtttgttttcagcact

SEQ ID NO: 6633050 - DNA, 13 bp, Homo sapiens
agcagtaaaagat

SEQ ID NO: 6633051 - DNA, 22 bp, Homo sapiens
agcagtaaaagataaatttgtt

SEQ ID NO: 6633052 - DNA, 13 bp, Homo sapiens
agcagtaaaataa

SEQ ID NO: 6633053 - DNA, 19 bp, Homo sapiens
agcagtaaatacttgcagt

SEQ ID NO: 6633054 - DNA, 21 bp, Homo sapiens
agcagtaaatacttgcagttg

SEQ ID NO: 6633055 - DNA, 23 bp, Homo sapiens
agcagtaaatacttgcagttgtg

SEQ ID NO: 6633056 - DNA, 19 bp, Homo sapiens
agcagtaaatttgctagca

SEQ ID NO: 6633057 - DNA, 17 bp, Homo sapiens
agcagtaagcaggcctt

SEQ ID NO: 6633058 - DNA, 22 bp, Homo sapiens
agcagtaattaatatctcctgg

SEQ ID NO: 6633059 - DNA, 23 bp, Homo sapiens
agcagtaattaatatctcctgga

SEQ ID NO: 6633060 - DNA, 14 bp, Homo sapiens
agcagtacatcttg

SEQ ID NO: 6633061 - DNA, 15 bp, Homo sapiens
agcagtacatcttgt

SEQ ID NO: 6633062 - DNA, 20 bp, Homo sapiens
agcagtacatcttgtgcatg

SEQ ID NO: 6633063 - DNA, 23 bp, Homo sapiens
agcagtacgtggcttcagaggcc

SEQ ID NO: 6633064 - DNA, 15 bp, Homo sapiens
agcagtacttgctca

SEQ ID NO: 6633065 - DNA, 16 bp, Homo sapiens
agcagtacttgctcaa

SEQ ID NO: 6633066 - DNA, 19 bp, Homo sapiens
agcagtacttgctcaataa

SEQ ID NO: 6633067 - DNA, 13 bp, Homo sapiens
agcagtagacatt

SEQ ID NO: 6633068 - DNA, 18 bp, Homo sapiens
agcagtagacattttaac

SEQ ID NO: 6633069 - DNA, 22 bp, Homo sapiens
agcagtagacattttaacaaga

SEQ ID NO: 6633070 - DNA, 17 bp, Homo sapiens
agcagtatataataact

SEQ ID NO: 6633071 - DNA, 14 bp, Homo sapiens
agcagtatatgtta

SEQ ID NO: 6633072 - DNA, 16 bp, Homo sapiens
agcagtatattagtat

SEQ ID NO: 6633073 - DNA, 14 bp, Homo sapiens
agcagtattctagt

SEQ ID NO: 6633074 - DNA, 15 bp, Homo sapiens
agcagtattctattt

SEQ ID NO: 6633075 - DNA, 14 bp, Homo sapiens
agcagtcacactgt

SEQ ID NO: 6633076 - DNA, 15 bp, Homo sapiens
agcagtcacaggccc

SEQ ID NO: 6633077 - DNA, 16 bp, Homo sapiens
agcagtcacaggccca

SEQ ID NO: 6633078 - DNA, 17 bp, Homo sapiens
agcagtcactgggagag

SEQ ID NO: 6633079 - DNA, 23 bp, Homo sapiens
agcagtcacttttcctgtgctgt

SEQ ID NO: 6633080 - DNA, 14 bp, Homo sapiens
agcagtcagccctt

SEQ ID NO: 6633081 - DNA, 18 bp, Homo sapiens
agcagtcagcggagagga

SEQ ID NO: 6633082 - DNA, 19 bp, Homo sapiens
agcagtcaggaaagagaac

SEQ ID NO: 6633083 - DNA, 16 bp, Homo sapiens
agcagtccaaggtatt

SEQ ID NO: 6633084 - DNA, 14 bp, Homo sapiens
agcagtccagagct

SEQ ID NO: 6633085 - DNA, 16 bp, Homo sapiens
agcagtccatttttga

SEQ ID NO: 6633086 - DNA, 23 bp, Homo sapiens
agcagtcccagtattctcagagc

SEQ ID NO: 6633087 - DNA, 20 bp, Homo sapiens
agcagtcccattcatattaa

SEQ ID NO: 6633088 - DNA, 15 bp, Homo sapiens
agcagtccccagctg

SEQ ID NO: 6633089 - DNA, 22 bp, Homo sapiens
agcagtccccttccctccaaga

SEQ ID NO: 6633090 - DNA, 15 bp, Homo sapiens
agcagtccctgagac

SEQ ID NO: 6633091 - DNA, 15 bp, Homo sapiens
agcagtccctgctta

SEQ ID NO: 6633092 - DNA, 22 bp, Homo sapiens
agcagtcctcccaccttggcct

SEQ ID NO: 6633093 - DNA, 23 bp, Homo sapiens
agcagtcctcccaccttggcctc

SEQ ID NO: 6633094 - DNA, 14 bp, Homo sapiens
agcagtcctcttat

SEQ ID NO: 6633095 - DNA, 19 bp, Homo sapiens
agcagtcctgcctcagcct

SEQ ID NO: 6633096 - DNA, 21 bp, Homo sapiens
agcagtcctgggccccctggg

SEQ ID NO: 6633097 - DNA, 17 bp, Homo sapiens
agcagtcctgttcaaat

SEQ ID NO: 6633098 - DNA, 13 bp, Homo sapiens
agcagtccttggc

SEQ ID NO: 6633099 - DNA, 15 bp, Homo sapiens
agcagtccttggcct

SEQ ID NO: 6633100 - DNA, 20 bp, Homo sapiens
agcagtcgcccaagcagaca

SEQ ID NO: 6633101 - DNA, 23 bp, Homo sapiens
agcagtcgcgagcacatgttcat

SEQ ID NO: 6633102 - DNA, 22 bp, Homo sapiens
agcagtcgtggctttggcagtg

SEQ ID NO: 6633103 - DNA, 15 bp, Homo sapiens
agcagtctaaatttt

SEQ ID NO: 6633104 - DNA, 17 bp, Homo sapiens
agcagtctaccctgtcc

SEQ ID NO: 6633105 - DNA, 18 bp, Homo sapiens
agcagtctaccctgtcct

SEQ ID NO: 6633106 - DNA, 15 bp, Homo sapiens
agcagtctacttctg

SEQ ID NO: 6633107 - DNA, 16 bp, Homo sapiens
agcagtctacttctgt

SEQ ID NO: 6633108 - DNA, 17 bp, Homo sapiens
agcagtctacttctgtg

SEQ ID NO: 6633109 - DNA, 19 bp, Homo sapiens
agcagtctccgctcccgca

SEQ ID NO: 6633110 - DNA, 16 bp, Homo sapiens
agcagtctctgccttg

SEQ ID NO: 6633111 - DNA, 15 bp, Homo sapiens
agcagtctgaaggat

SEQ ID NO: 6633112 - DNA, 22 bp, Homo sapiens
agcagtcttatgcttccagaaa

SEQ ID NO: 6633113 - DNA, 13 bp, Homo sapiens
agcagtcttgctc

SEQ ID NO: 6633114 - DNA, 17 bp, Homo sapiens
agcagtgaaaacaagtg

SEQ ID NO: 6633115 - DNA, 22 bp, Homo sapiens
agcagtgaatgattcagtgtta

SEQ ID NO: 6633116 - DNA, 22 bp, Homo sapiens
agcagtgagaaaaagctcctgt

SEQ ID NO: 6633117 - DNA, 14 bp, Homo sapiens
agcagtgagcactg

SEQ ID NO: 6633118 - DNA, 17 bp, Homo sapiens
agcagtgagccaaatgt

SEQ ID NO: 6633119 - DNA, 20 bp, Homo sapiens
agcagtgagccaaatgtaaa

SEQ ID NO: 6633120 - DNA, 14 bp, Homo sapiens
agcagtgagccgca

SEQ ID NO: 6633121 - DNA, 17 bp, Homo sapiens
agcagtgagcttctatt

SEQ ID NO: 6633122 - DNA, 23 bp, Homo sapiens
agcagtgagttacagcgagaggc

SEQ ID NO: 6633123 - DNA, 15 bp, Homo sapiens
agcagtgatattctt

SEQ ID NO: 6633124 - DNA, 13 bp, Homo sapiens
agcagtgatctca

SEQ ID NO: 6633125 - DNA, 19 bp, Homo sapiens
agcagtgatctcagggcag

SEQ ID NO: 6633126 - DNA, 20 bp, Homo sapiens
agcagtgatctcagggcaga

SEQ ID NO: 6633127 - DNA, 21 bp, Homo sapiens
agcagtgcacatttcatagtt

SEQ ID NO: 6633128 - DNA, 15 bp, Homo sapiens
agcagtgcaggcaca

SEQ ID NO: 6633129 - DNA, 19 bp, Homo sapiens
agcagtgcatgctgtccct

SEQ ID NO: 6633130 - DNA, 22 bp, Homo sapiens
agcagtgccctctggacagctt

SEQ ID NO: 6633131 - DNA, 20 bp, Homo sapiens
agcagtgcctcgaggcaccg

SEQ ID NO: 6633132 - DNA, 22 bp, Homo sapiens
agcagtgcctcgaggcaccggc

SEQ ID NO: 6633133 - DNA, 17 bp, Homo sapiens
agcagtgccttccataa

SEQ ID NO: 6633134 - DNA, 12 bp, Homo sapiens
agcagtgctggg

SEQ ID NO: 6633135 - DNA, 13 bp, Homo sapiens
agcagtgctgggc

SEQ ID NO: 6633136 - DNA, 18 bp, Homo sapiens
agcagtgctgggcccagc

SEQ ID NO: 6633137 - DNA, 12 bp, Homo sapiens
agcagtgctttt

SEQ ID NO: 6633138 - DNA, 12 bp, Homo sapiens
agcagtggacac

SEQ ID NO: 6633139 - DNA, 19 bp, Homo sapiens
agcagtggacaccaggagt

SEQ ID NO: 6633140 - DNA, 20 bp, Homo sapiens
agcagtggcaaaatattatg

SEQ ID NO: 6633141 - DNA, 16 bp, Homo sapiens
agcagtggctggtcca

SEQ ID NO: 6633142 - DNA, 20 bp, Homo sapiens
agcagtggctggtgcccatg

SEQ ID NO: 6633143 - DNA, 21 bp, Homo sapiens
agcagtggctggtgcccatga

SEQ ID NO: 6633144 - DNA, 22 bp, Homo sapiens
agcagtggctggtgcccatgaa

SEQ ID NO: 6633145 - DNA, 20 bp, Homo sapiens
agcagtggcttagctgccat

SEQ ID NO: 6633146 - DNA, 15 bp, Homo sapiens
agcagtgggccctgg

SEQ ID NO: 6633147 - DNA, 14 bp, Homo sapiens
agcagtgggcctgg

SEQ ID NO: 6633148 - DNA, 18 bp, Homo sapiens
agcagtgggcctggccag

SEQ ID NO: 6633149 - DNA, 17 bp, Homo sapiens
agcagtgggctcctggc

SEQ ID NO: 6633150 - DNA, 15 bp, Homo sapiens
agcagtggggagcgg

SEQ ID NO: 6633151 - DNA, 12 bp, Homo sapiens
agcagtggggtg

SEQ ID NO: 6633152 - DNA, 13 bp, Homo sapiens
agcagtgtcatca

SEQ ID NO: 6633153 - DNA, 19 bp, Homo sapiens
agcagtgtcatcagaagat

SEQ ID NO: 6633154 - DNA, 20 bp, Homo sapiens
agcagtgtcatcagaagata

SEQ ID NO: 6633155 - DNA, 14 bp, Homo sapiens
agcagtgtcccctg

SEQ ID NO: 6633156 - DNA, 16 bp, Homo sapiens
agcagtgtcccctgcc

SEQ ID NO: 6633157 - DNA, 20 bp, Homo sapiens
agcagtgtcccctgccccag

SEQ ID NO: 6633158 - DNA, 23 bp, Homo sapiens
agcagtgtcgccgtccctctgcc

SEQ ID NO: 6633159 - DNA, 16 bp, Homo sapiens
agcagtgtctgttctt

SEQ ID NO: 6633160 - DNA, 18 bp, Homo sapiens
agcagtgtctgttcttca

SEQ ID NO: 6633161 - DNA, 15 bp, Homo sapiens
agcagtgtcttccat

SEQ ID NO: 6633162 - DNA, 16 bp, Homo sapiens
agcagtgtcttccata

SEQ ID NO: 6633163 - DNA, 17 bp, Homo sapiens
agcagtgtcttccataa

SEQ ID NO: 6633164 - DNA, 20 bp, Homo sapiens
agcagtgtgaatagcctggc

SEQ ID NO: 6633165 - DNA, 23 bp, Homo sapiens
agcagtgtgaatagcctggccac

SEQ ID NO: 6633166 - DNA, 20 bp, Homo sapiens
agcagtgtgacctcctgtga

SEQ ID NO: 6633167 - DNA, 21 bp, Homo sapiens
agcagtgtgagggtgcaggga

SEQ ID NO: 6633168 - DNA, 22 bp, Homo sapiens
agcagtgtgctttgcattttct

SEQ ID NO: 6633169 - DNA, 16 bp, Homo sapiens
agcagtgtgtccttgg

SEQ ID NO: 6633170 - DNA, 17 bp, Homo sapiens
agcagtgtgtccttggg

SEQ ID NO: 6633171 - DNA, 23 bp, Homo sapiens
agcagtgtgtccttggggcacag

SEQ ID NO: 6633172 - DNA, 17 bp, Homo sapiens
agcagtgtgtctcctgc

SEQ ID NO: 6633173 - DNA, 17 bp, Homo sapiens
agcagtgttacttgcag

SEQ ID NO: 6633174 - DNA, 21 bp, Homo sapiens
agcagtgttccccatctgggt

SEQ ID NO: 6633175 - DNA, 17 bp, Homo sapiens
agcagtgttctcacagt

SEQ ID NO: 6633176 - DNA, 21 bp, Homo sapiens
agcagtgttctcacagtgtgg

SEQ ID NO: 6633177 - DNA, 15 bp, Homo sapiens
agcagtgttctgggt

SEQ ID NO: 6633178 - DNA, 22 bp, Homo sapiens
agcagtgttgcgtttttccttg

SEQ ID NO: 6633179 - DNA, 15 bp, Homo sapiens
agcagttaactttaa

SEQ ID NO: 6633180 - DNA, 17 bp, Homo sapiens
agcagttaatttatata

SEQ ID NO: 6633181 - DNA, 21 bp, Homo sapiens
agcagttacaaaaaccttccc

SEQ ID NO: 6633182 - DNA, 20 bp, Homo sapiens
agcagttacccaacagaaac

SEQ ID NO: 6633183 - DNA, 21 bp, Homo sapiens
agcagttactccctacactga

SEQ ID NO: 6633184 - DNA, 14 bp, Homo sapiens
agcagttaggcacc

SEQ ID NO: 6633185 - DNA, 17 bp, Homo sapiens
agcagttaggcacctta

SEQ ID NO: 6633186 - DNA, 23 bp, Homo sapiens
agcagttaggcaccttaactgga

SEQ ID NO: 6633187 - DNA, 17 bp, Homo sapiens
agcagttaggctgtaca

SEQ ID NO: 6633188 - DNA, 15 bp, Homo sapiens
agcagttataacaga

SEQ ID NO: 6633189 - DNA, 21 bp, Homo sapiens
agcagttataacagatgtgaa

SEQ ID NO: 6633190 - DNA, 20 bp, Homo sapiens
agcagttatggtgatgactt

SEQ ID NO: 6633191 - DNA, 22 bp, Homo sapiens
agcagttcacaaaaaaatgttc

SEQ ID NO: 6633192 - DNA, 16 bp, Homo sapiens
agcagttcagagctgc

SEQ ID NO: 6633193 - DNA, 18 bp, Homo sapiens
agcagttcattctaccaa

SEQ ID NO: 6633194 - DNA, 23 bp, Homo sapiens
agcagttcattctaccaagctgt

SEQ ID NO: 6633195 - DNA, 18 bp, Homo sapiens
agcagttccatgaagaca

SEQ ID NO: 6633196 - DNA, 19 bp, Homo sapiens
agcagttcccctggagccc

SEQ ID NO: 6633197 - DNA, 14 bp, Homo sapiens
agcagttccggatt

SEQ ID NO: 6633198 - DNA, 17 bp, Homo sapiens
agcagttcctgtcccac

SEQ ID NO: 6633199 - DNA, 15 bp, Homo sapiens
agcagttctctgcca

SEQ ID NO: 6633200 - DNA, 16 bp, Homo sapiens
agcagttctgcaaata

SEQ ID NO: 6633201 - DNA, 21 bp, Homo sapiens
agcagttctgttatatcccct

SEQ ID NO: 6633202 - DNA, 16 bp, Homo sapiens
agcagttgaaaagact

SEQ ID NO: 6633203 - DNA, 23 bp, Homo sapiens
agcagttgaaaagactccaaaga

SEQ ID NO: 6633204 - DNA, 15 bp, Homo sapiens
agcagttgacatcca

SEQ ID NO: 6633205 - DNA, 20 bp, Homo sapiens
agcagttgacatccaaatct

SEQ ID NO: 6633206 - DNA, 19 bp, Homo sapiens
agcagttgagacaagaaaa

SEQ ID NO: 6633207 - DNA, 20 bp, Homo sapiens
agcagttgagacaagaaaat

SEQ ID NO: 6633208 - DNA, 14 bp, Homo sapiens
agcagttgatatta

SEQ ID NO: 6633209 - DNA, 12 bp, Homo sapiens
agcagttgctag

SEQ ID NO: 6633210 - DNA, 23 bp, Homo sapiens
agcagttgctagcaacaacttac

SEQ ID NO: 6633211 - DNA, 15 bp, Homo sapiens
agcagttgctcacat

SEQ ID NO: 6633212 - DNA, 20 bp, Homo sapiens
agcagttgctcacatgtctt

SEQ ID NO: 6633213 - DNA, 21 bp, Homo sapiens
agcagttgctggtaaaatgaa

SEQ ID NO: 6633214 - DNA, 22 bp, Homo sapiens
agcagttgctggtaaaatgaag

SEQ ID NO: 6633215 - DNA, 14 bp, Homo sapiens
agcagttggcctgt

SEQ ID NO: 6633216 - DNA, 16 bp, Homo sapiens
agcagttggcctgtgc

SEQ ID NO: 6633217 - DNA, 18 bp, Homo sapiens
agcagttgggagtacata

SEQ ID NO: 6633218 - DNA, 16 bp, Homo sapiens
agcagttggggccctc

SEQ ID NO: 6633219 - DNA, 17 bp, Homo sapiens
agcagttggggccctct

SEQ ID NO: 6633220 - DNA, 18 bp, Homo sapiens
agcagttggggccctctt

SEQ ID NO: 6633221 - DNA, 13 bp, Homo sapiens
agcagttgtgtca

SEQ ID NO: 6633222 - DNA, 15 bp, Homo sapiens
agcagtttcaccatc

SEQ ID NO: 6633223 - DNA, 21 bp, Homo sapiens
agcagtttcagataaatcatg

SEQ ID NO: 6633224 - DNA, 18 bp, Homo sapiens
agcagtttcatctggttg

SEQ ID NO: 6633225 - DNA, 15 bp, Homo sapiens
agcagtttccagaga

SEQ ID NO: 6633226 - DNA, 19 bp, Homo sapiens
agcagtttcctcagtgatg

SEQ ID NO: 6633227 - DNA, 19 bp, Homo sapiens
agcagtttctgtcctgctg

SEQ ID NO: 6633228 - DNA, 15 bp, Homo sapiens
agcagtttgccaccc

SEQ ID NO: 6633229 - DNA, 16 bp, Homo sapiens
agcagtttgcctctgc

SEQ ID NO: 6633230 - DNA, 17 bp, Homo sapiens
agcagtttggggcaggg

SEQ ID NO: 6633231 - DNA, 22 bp, Homo sapiens
agcagtttggtttctagcatga

SEQ ID NO: 6633232 - DNA, 18 bp, Homo sapiens
agcagttttcaagtcaaa

SEQ ID NO: 6633233 - DNA, 22 bp, Homo sapiens
agcagttttcaagtcaaattaa

SEQ ID NO: 6633234 - DNA, 14 bp, Homo sapiens
agcagttttcccct

SEQ ID NO: 6633235 - DNA, 14 bp, Homo sapiens
agcagttttgtaaa

SEQ ID NO: 6633236 - DNA, 17 bp, Homo sapiens
agcagttttgtaaatgt

SEQ ID NO: 6633237 - DNA, 13 bp, Homo sapiens
agcataaaaacat

SEQ ID NO: 6633238 - DNA, 21 bp, Homo sapiens
agcataaaaacattttaaaaa

SEQ ID NO: 6633239 - DNA, 19 bp, Homo sapiens
agcataaaaattagccaag

SEQ ID NO: 6633240 - DNA, 18 bp, Homo sapiens
agcataaaactttggcaa

SEQ ID NO: 6633241 - DNA, 21 bp, Homo sapiens
agcataaaagaatatttagaa

SEQ ID NO: 6633242 - DNA, 20 bp, Homo sapiens
agcataaaagatcaccttgt

SEQ ID NO: 6633243 - DNA, 23 bp, Homo sapiens
agcataaaagatgaaagagcagt

SEQ ID NO: 6633244 - DNA, 16 bp, Homo sapiens
agcataaacaatattg

SEQ ID NO: 6633245 - DNA, 14 bp, Homo sapiens
agcataaacatcac

SEQ ID NO: 6633246 - DNA, 18 bp, Homo sapiens
agcataaagctcaaatga

SEQ ID NO: 6633247 - DNA, 23 bp, Homo sapiens
agcataaagctcaaatgaaatgt

SEQ ID NO: 6633248 - DNA, 19 bp, Homo sapiens
agcataaatctgttagcat

SEQ ID NO: 6633249 - DNA, 20 bp, Homo sapiens
agcataaatctgttagcatt

SEQ ID NO: 6633250 - DNA, 13 bp, Homo sapiens
agcataaatgcaa

SEQ ID NO: 6633251 - DNA, 16 bp, Homo sapiens
agcataaatttaatgt

SEQ ID NO: 6633252 - DNA, 19 bp, Homo sapiens
agcataacaccaatcccag

SEQ ID NO: 6633253 - DNA, 13 bp, Homo sapiens
agcataacatatg

SEQ ID NO: 6633254 - DNA, 16 bp, Homo sapiens
agcataactaggatta

SEQ ID NO: 6633255 - DNA, 18 bp, Homo sapiens
agcataagtatacagttc

SEQ ID NO: 6633256 - DNA, 21 bp, Homo sapiens
agcataatacttgctttggaa

SEQ ID NO: 6633257 - DNA, 13 bp, Homo sapiens
agcataatatgaa

SEQ ID NO: 6633258 - DNA, 14 bp, Homo sapiens
agcataatatgaag

SEQ ID NO: 6633259 - DNA, 15 bp, Homo sapiens
agcataatatgaagc

SEQ ID NO: 6633260 - DNA, 19 bp, Homo sapiens
agcataatctgaaaacatc

SEQ ID NO: 6633261 - DNA, 22 bp, Homo sapiens
agcataatgctcccatctcctg

SEQ ID NO: 6633262 - DNA, 20 bp, Homo sapiens
agcataatttaaaaatatat

SEQ ID NO: 6633263 - DNA, 21 bp, Homo sapiens
agcataatttaaaaatatatt

SEQ ID NO: 6633264 - DNA, 16 bp, Homo sapiens
agcataatttgtttaa

SEQ ID NO: 6633265 - DNA, 21 bp, Homo sapiens
agcatacaaaaatatattaaa

SEQ ID NO: 6633266 - DNA, 20 bp, Homo sapiens
agcatacaccaaacatttct

SEQ ID NO: 6633267 - DNA, 23 bp, Homo sapiens
agcatacaggttaacctgcagaa

SEQ ID NO: 6633268 - DNA, 20 bp, Homo sapiens
agcatacatttataatgttt

SEQ ID NO: 6633269 - DNA, 14 bp, Homo sapiens
agcatacattttct

SEQ ID NO: 6633270 - DNA, 16 bp, Homo sapiens
agcatacctttattgt

SEQ ID NO: 6633271 - DNA, 17 bp, Homo sapiens
agcatacctttattgtg

SEQ ID NO: 6633272 - DNA, 15 bp, Homo sapiens
agcatacgtacacat

SEQ ID NO: 6633273 - DNA, 19 bp, Homo sapiens
agcatacgtacacatttta

SEQ ID NO: 6633274 - DNA, 20 bp, Homo sapiens
agcatacgtacacattttat

SEQ ID NO: 6633275 - DNA, 14 bp, Homo sapiens
agcatactctatgt

SEQ ID NO: 6633276 - DNA, 16 bp, Homo sapiens
agcatactgtgtatgt

SEQ ID NO: 6633277 - DNA, 11 bp, Homo sapiens
agcatacttaa

SEQ ID NO: 6633278 - DNA, 22 bp, Homo sapiens
agcatactttgtaaataggatt

SEQ ID NO: 6633279 - DNA, 22 bp, Homo sapiens
agcatagaacaggacctctgct

SEQ ID NO: 6633280 - DNA, 16 bp, Homo sapiens
agcatagaagccacat

SEQ ID NO: 6633281 - DNA, 24 bp, Homo sapiens
agcatagagaacgggagtggccat

SEQ ID NO: 6633282 - DNA, 15 bp, Homo sapiens
agcatagataatatt

SEQ ID NO: 6633283 - DNA, 21 bp, Homo sapiens
agcatagatatctatattttt

SEQ ID NO: 6633284 - DNA, 15 bp, Homo sapiens
agcatagcctgcctg

SEQ ID NO: 6633285 - DNA, 17 bp, Homo sapiens
agcatagctacaatttg

SEQ ID NO: 6633286 - DNA, 19 bp, Homo sapiens
agcatagctacaatttgtt

SEQ ID NO: 6633287 - DNA, 16 bp, Homo sapiens
agcatagctctgtaca

SEQ ID NO: 6633288 - DNA, 20 bp, Homo sapiens
agcatagcttattattgaag

SEQ ID NO: 6633289 - DNA, 21 bp, Homo sapiens
agcataggaattggagattgg

SEQ ID NO: 6633290 - DNA, 15 bp, Homo sapiens
agcataggctgggga

SEQ ID NO: 6633291 - DNA, 18 bp, Homo sapiens
agcataggctggggacac

SEQ ID NO: 6633292 - DNA, 20 bp, Homo sapiens
agcataggtgatccatgtaa

SEQ ID NO: 6633293 - DNA, 15 bp, Homo sapiens
agcatagtgaacaca

SEQ ID NO: 6633294 - DNA, 14 bp, Homo sapiens
agcatataaaatgg

SEQ ID NO: 6633295 - DNA, 14 bp, Homo sapiens
agcatataaatgtt

SEQ ID NO: 6633296 - DNA, 18 bp, Homo sapiens
agcatataaatgtttata

SEQ ID NO: 6633297 - DNA, 13 bp, Homo sapiens
agcatatacaata

SEQ ID NO: 6633298 - DNA, 16 bp, Homo sapiens
agcatatagaatatat

SEQ ID NO: 6633299 - DNA, 14 bp, Homo sapiens
agcatatagagatg

SEQ ID NO: 6633300 - DNA, 11 bp, Homo sapiens
agcatatataa

SEQ ID NO: 6633301 - DNA, 13 bp, Homo sapiens
agcatatatactt

SEQ ID NO: 6633302 - DNA, 13 bp, Homo sapiens
agcatatatataa

SEQ ID NO: 6633303 - DNA, 20 bp, Homo sapiens
agcatatatttttatattta

SEQ ID NO: 6633304 - DNA, 22 bp, Homo sapiens
agcatatatttttatatttact

SEQ ID NO: 6633305 - DNA, 23 bp, Homo sapiens
agcatatcccaccaacctccagt

SEQ ID NO: 6633306 - DNA, 17 bp, Homo sapiens
agcatatctgcctttat

SEQ ID NO: 6633307 - DNA, 21 bp, Homo sapiens
agcatatctggtatatgtcat

SEQ ID NO: 6633308 - DNA, 22 bp, Homo sapiens
agcatatctggtatatgtcatt

SEQ ID NO: 6633309 - DNA, 23 bp, Homo sapiens
agcatatctggtatatgtcatta

SEQ ID NO: 6633310 - DNA, 16 bp, Homo sapiens
agcatatgacaaatgt

SEQ ID NO: 6633311 - DNA, 18 bp, Homo sapiens
agcatatgacaaatgttt

SEQ ID NO: 6633312 - DNA, 12 bp, Homo sapiens
agcatatgagga

SEQ ID NO: 6633313 - DNA, 21 bp, Homo sapiens
agcatatgagtttcatagcta

SEQ ID NO: 6633314 - DNA, 23 bp, Homo sapiens
agcatatgggtgggattttgcaa

SEQ ID NO: 6633315 - DNA, 20 bp, Homo sapiens
agcatatgtgtaaagattta

SEQ ID NO: 6633316 - DNA, 15 bp, Homo sapiens
agcatatgtgttact

SEQ ID NO: 6633317 - DNA, 16 bp, Homo sapiens
agcatatgtgttggct

SEQ ID NO: 6633318 - DNA, 18 bp, Homo sapiens
agcatatgtgttggcttg

SEQ ID NO: 6633319 - DNA, 21 bp, Homo sapiens
agcatatgttagcattaaagt

SEQ ID NO: 6633320 - DNA, 19 bp, Homo sapiens
agcatattcaggaagctca

SEQ ID NO: 6633321 - DNA, 14 bp, Homo sapiens
agcatattcttcac

SEQ ID NO: 6633322 - DNA, 20 bp, Homo sapiens
agcatatttgccaataaagc

SEQ ID NO: 6633323 - DNA, 20 bp, Homo sapiens
agcatatttgtatagttgct

SEQ ID NO: 6633324 - DNA, 22 bp, Homo sapiens
agcatatttgtatagttgcttg

SEQ ID NO: 6633325 - DNA, 21 bp, Homo sapiens
agcatattttctctaggcttt

SEQ ID NO: 6633326 - DNA, 15 bp, Homo sapiens
agcatattttcttac

SEQ ID NO: 6633327 - DNA, 16 bp, Homo sapiens
agcatcaaaaacatca

SEQ ID NO: 6633328 - DNA, 15 bp, Homo sapiens
agcatcaaaatacaa

SEQ ID NO: 6633329 - DNA, 19 bp, Homo sapiens
agcatcaaacatgaaaaca

SEQ ID NO: 6633330 - DNA, 14 bp, Homo sapiens
agcatcaaataata

SEQ ID NO: 6633331 - DNA, 13 bp, Homo sapiens
agcatcaatcttg

SEQ ID NO: 6633332 - DNA, 15 bp, Homo sapiens
agcatcaatcttgtt

SEQ ID NO: 6633333 - DNA, 13 bp, Homo sapiens
agcatcaccacca

SEQ ID NO: 6633334 - DNA, 15 bp, Homo sapiens
agcatcaccaccaca

SEQ ID NO: 6633335 - DNA, 18 bp, Homo sapiens
agcatcacctagaaactt

SEQ ID NO: 6633336 - DNA, 15 bp, Homo sapiens
agcatcacctcaggc

SEQ ID NO: 6633337 - DNA, 16 bp, Homo sapiens
agcatcacctcaggcc

SEQ ID NO: 6633338 - DNA, 15 bp, Homo sapiens
agcatcacctgcctg

SEQ ID NO: 6633339 - DNA, 23 bp, Homo sapiens
agcatcactaaaccgataatgca

SEQ ID NO: 6633340 - DNA, 12 bp, Homo sapiens
agcatcactccc

SEQ ID NO: 6633341 - DNA, 14 bp, Homo sapiens
agcatcactgcctt

SEQ ID NO: 6633342 - DNA, 12 bp, Homo sapiens
agcatcagagat

SEQ ID NO: 6633343 - DNA, 23 bp, Homo sapiens
agcatcagagcccttttgctata

SEQ ID NO: 6633344 - DNA, 21 bp, Homo sapiens
agcatcagccagtgaatctgt

SEQ ID NO: 6633345 - DNA, 22 bp, Homo sapiens
agcatcagccagtgaatctgtt

SEQ ID NO: 6633346 - DNA, 12 bp, Homo sapiens
agcatcaggcca

SEQ ID NO: 6633347 - DNA, 20 bp, Homo sapiens
agcatcagggggaagaagca

SEQ ID NO: 6633348 - DNA, 22 bp, Homo sapiens
agcatcagggttaagaagactt

SEQ ID NO: 6633349 - DNA, 19 bp, Homo sapiens
agcatcatccttagaaatc

SEQ ID NO: 6633350 - DNA, 20 bp, Homo sapiens
agcatcatctgggaacttgt

SEQ ID NO: 6633351 - DNA, 13 bp, Homo sapiens
agcatcatgcctc

SEQ ID NO: 6633352 - DNA, 16 bp, Homo sapiens
agcatcattacaatac

SEQ ID NO: 6633353 - DNA, 21 bp, Homo sapiens
agcatcattatttatgtattg

SEQ ID NO: 6633354 - DNA, 16 bp, Homo sapiens
agcatcattgtaaatt

SEQ ID NO: 6633355 - DNA, 20 bp, Homo sapiens
agcatcattgtccccatgca

SEQ ID NO: 6633356 - DNA, 21 bp, Homo sapiens
agcatcattgtccccatgcaa

SEQ ID NO: 6633357 - DNA, 18 bp, Homo sapiens
agcatcattttgcattca

SEQ ID NO: 6633358 - DNA, 20 bp, Homo sapiens
agcatcattttgcattcaaa

SEQ ID NO: 6633359 - DNA, 20 bp, Homo sapiens
agcatccaaaagcaggaacc

SEQ ID NO: 6633360 - DNA, 22 bp, Homo sapiens
agcatccaaaagcaggaaccca

SEQ ID NO: 6633361 - DNA, 14 bp, Homo sapiens
agcatccaaagatt

SEQ ID NO: 6633362 - DNA, 20 bp, Homo sapiens
agcatccaaggaacttcatg

SEQ ID NO: 6633363 - DNA, 16 bp, Homo sapiens
agcatccaagtggcat

SEQ ID NO: 6633364 - DNA, 15 bp, Homo sapiens
agcatccaccccacc

SEQ ID NO: 6633365 - DNA, 16 bp, Homo sapiens
agcatccaccccaccc

SEQ ID NO: 6633366 - DNA, 15 bp, Homo sapiens
agcatccacctcctt

SEQ ID NO: 6633367 - DNA, 20 bp, Homo sapiens
agcatccaccttggctctgc

SEQ ID NO: 6633368 - DNA, 23 bp, Homo sapiens
agcatccactggaaaaggtgaaa

SEQ ID NO: 6633369 - DNA, 12 bp, Homo sapiens
agcatccagcct

SEQ ID NO: 6633370 - DNA, 16 bp, Homo sapiens
agcatccagcctgtgt

SEQ ID NO: 6633371 - DNA, 13 bp, Homo sapiens
agcatccaggctg

SEQ ID NO: 6633372 - DNA, 18 bp, Homo sapiens
agcatccaggctggccag

SEQ ID NO: 6633373 - DNA, 23 bp, Homo sapiens
agcatccatgcggccggcctggg

SEQ ID NO: 6633374 - DNA, 14 bp, Homo sapiens
agcatcccacagga

SEQ ID NO: 6633375 - DNA, 16 bp, Homo sapiens
agcatcccagcctcag

SEQ ID NO: 6633376 - DNA, 22 bp, Homo sapiens
agcatcccaggatcgcaagagc

SEQ ID NO: 6633377 - DNA, 20 bp, Homo sapiens
agcatcccccaaagttcaca

SEQ ID NO: 6633378 - DNA, 15 bp, Homo sapiens
agcatccccctcctc

SEQ ID NO: 6633379 - DNA, 22 bp, Homo sapiens
agcatccccctcctctccctgt

SEQ ID NO: 6633380 - DNA, 15 bp, Homo sapiens
agcatccctcaccca

SEQ ID NO: 6633381 - DNA, 20 bp, Homo sapiens
agcatccctgaggagccagg

SEQ ID NO: 6633382 - DNA, 19 bp, Homo sapiens
agcatccctggagcaggag

SEQ ID NO: 6633383 - DNA, 20 bp, Homo sapiens
agcatccctggagcaggagc

SEQ ID NO: 6633384 - DNA, 13 bp, Homo sapiens
agcatcccttccc

SEQ ID NO: 6633385 - DNA, 15 bp, Homo sapiens
agcatcccttcccac

SEQ ID NO: 6633386 - DNA, 18 bp, Homo sapiens
agcatcccttctgccccc

SEQ ID NO: 6633387 - DNA, 22 bp, Homo sapiens
agcatcccttctgcccccgttc

SEQ ID NO: 6633388 - DNA, 14 bp, Homo sapiens
agcatccgtctccc

SEQ ID NO: 6633389 - DNA, 15 bp, Homo sapiens
agcatccgtgtattt

SEQ ID NO: 6633390 - DNA, 16 bp, Homo sapiens
agcatcctaagaaata

SEQ ID NO: 6633391 - DNA, 22 bp, Homo sapiens
agcatcctaagaaatatgtgag

SEQ ID NO: 6633392 - DNA, 20 bp, Homo sapiens
agcatcctccacatcctgtg

SEQ ID NO: 6633393 - DNA, 21 bp, Homo sapiens
agcatcctccacatcctgtgt

SEQ ID NO: 6633394 - DNA, 14 bp, Homo sapiens
agcatcctccccac

SEQ ID NO: 6633395 - DNA, 18 bp, Homo sapiens
agcatcctccccaccaga

SEQ ID NO: 6633396 - DNA, 20 bp, Homo sapiens
agcatcctccccaccagagc

SEQ ID NO: 6633397 - DNA, 14 bp, Homo sapiens
agcatcctctgctg

SEQ ID NO: 6633398 - DNA, 11 bp, Homo sapiens
agcatcctgat

SEQ ID NO: 6633399 - DNA, 18 bp, Homo sapiens
agcatcctgataccattc

SEQ ID NO: 6633400 - DNA, 13 bp, Homo sapiens
agcatcctgcaag

SEQ ID NO: 6633401 - DNA, 22 bp, Homo sapiens
agcatcctgccttagagccagg

SEQ ID NO: 6633402 - DNA, 17 bp, Homo sapiens
agcatcctgctgcttag

SEQ ID NO: 6633403 - DNA, 21 bp, Homo sapiens
agcatcctggaaatttgtgtg

SEQ ID NO: 6633404 - DNA, 14 bp, Homo sapiens
agcatcctggaata

SEQ ID NO: 6633405 - DNA, 13 bp, Homo sapiens
agcatcctggcac

SEQ ID NO: 6633406 - DNA, 22 bp, Homo sapiens
agcatcctggcacccggcccct

SEQ ID NO: 6633407 - DNA, 22 bp, Homo sapiens
agcatcctgtctggcattttgt

SEQ ID NO: 6633408 - DNA, 14 bp, Homo sapiens
agcatcgcactctg

SEQ ID NO: 6633409 - DNA, 13 bp, Homo sapiens
agcatcggaggga

SEQ ID NO: 6633410 - DNA, 18 bp, Homo sapiens
agcatcggtcatgtgtgt

SEQ ID NO: 6633411 - DNA, 19 bp, Homo sapiens
agcatcgtctcatgtaaaa

SEQ ID NO: 6633412 - DNA, 20 bp, Homo sapiens
agcatcgtgacccttcaggg

SEQ ID NO: 6633413 - DNA, 22 bp, Homo sapiens
agcatcgtgacccttcagggcc

SEQ ID NO: 6633414 - DNA, 16 bp, Homo sapiens
agcatcgtgtgggtcc

SEQ ID NO: 6633415 - DNA, 13 bp, Homo sapiens
agcatctaaactt

SEQ ID NO: 6633416 - DNA, 16 bp, Homo sapiens
agcatctaaactttaa

SEQ ID NO: 6633417 - DNA, 17 bp, Homo sapiens
agcatctaaactttaat

SEQ ID NO: 6633418 - DNA, 21 bp, Homo sapiens
agcatctactctaaagaaaaa

SEQ ID NO: 6633419 - DNA, 18 bp, Homo sapiens
agcatctagtataagtct

SEQ ID NO: 6633420 - DNA, 13 bp, Homo sapiens
agcatctatcaga

SEQ ID NO: 6633421 - DNA, 15 bp, Homo sapiens
agcatctatctcatc

SEQ ID NO: 6633422 - DNA, 16 bp, Homo sapiens
agcatctatgtgagac

SEQ ID NO: 6633423 - DNA, 17 bp, Homo sapiens
agcatctcagcgccagc

SEQ ID NO: 6633424 - DNA, 23 bp, Homo sapiens
agcatctcagtggtgtgtgaagt

SEQ ID NO: 6633425 - DNA, 14 bp, Homo sapiens
agcatctcatgagt

SEQ ID NO: 6633426 - DNA, 20 bp, Homo sapiens
agcatctccctcactgaaac

SEQ ID NO: 6633427 - DNA, 15 bp, Homo sapiens
agcatctctgaccag

SEQ ID NO: 6633428 - DNA, 14 bp, Homo sapiens
agcatctctgcctc

SEQ ID NO: 6633429 - DNA, 21 bp, Homo sapiens
agcatctctgtgtacccactc

SEQ ID NO: 6633430 - DNA, 19 bp, Homo sapiens
agcatctcttcttccctgt

SEQ ID NO: 6633431 - DNA, 19 bp, Homo sapiens
agcatctcttgaggccagg

SEQ ID NO: 6633432 - DNA, 22 bp, Homo sapiens
agcatctcttgaggccaggagt

SEQ ID NO: 6633433 - DNA, 17 bp, Homo sapiens
agcatctgacaggtgaa

SEQ ID NO: 6633434 - DNA, 15 bp, Homo sapiens
agcatctgaccatct

SEQ ID NO: 6633435 - DNA, 22 bp, Homo sapiens
agcatctgaccatctgtgacta

SEQ ID NO: 6633436 - DNA, 21 bp, Homo sapiens
agcatctgcagtacagtctta

SEQ ID NO: 6633437 - DNA, 19 bp, Homo sapiens
agcatctgcattgcccagt

SEQ ID NO: 6633438 - DNA, 24 bp, Homo sapiens
agcatctgccacaaaaatgttcac

SEQ ID NO: 6633439 - DNA, 15 bp, Homo sapiens
agcatctgccccagg

SEQ ID NO: 6633440 - DNA, 18 bp, Homo sapiens
agcatctgccccaggtac

SEQ ID NO: 6633441 - DNA, 18 bp, Homo sapiens
agcatctgcctctattca

SEQ ID NO: 6633442 - DNA, 19 bp, Homo sapiens
agcatctgcctctattcaa

SEQ ID NO: 6633443 - DNA, 13 bp, Homo sapiens
agcatctgctaat

SEQ ID NO: 6633444 - DNA, 13 bp, Homo sapiens
agcatctgctctg

SEQ ID NO: 6633445 - DNA, 13 bp, Homo sapiens
agcatctggctct

SEQ ID NO: 6633446 - DNA, 23 bp, Homo sapiens
agcatctggctgtttagcagaac

SEQ ID NO: 6633447 - DNA, 19 bp, Homo sapiens
agcatctgggccttggcct

SEQ ID NO: 6633448 - DNA, 22 bp, Homo sapiens
agcatctgggccttggcctgga

SEQ ID NO: 6633449 - DNA, 17 bp, Homo sapiens
agcatctgtaaatttgg

SEQ ID NO: 6633450 - DNA, 17 bp, Homo sapiens
agcatctgtacaaaggg

SEQ ID NO: 6633451 - DNA, 16 bp, Homo sapiens
agcatctgtcccactg

SEQ ID NO: 6633452 - DNA, 20 bp, Homo sapiens
agcatctgtcccactgggac

SEQ ID NO: 6633453 - DNA, 19 bp, Homo sapiens
agcatctgtttacctggca

SEQ ID NO: 6633454 - DNA, 12 bp, Homo sapiens
agcatcttctgg

SEQ ID NO: 6633455 - DNA, 15 bp, Homo sapiens
agcatcttctggagt

SEQ ID NO: 6633456 - DNA, 19 bp, Homo sapiens
agcatcttgggggggtggc

SEQ ID NO: 6633457 - DNA, 15 bp, Homo sapiens
agcatcttgtcaaga

SEQ ID NO: 6633458 - DNA, 20 bp, Homo sapiens
agcatcttttccatcctgag

SEQ ID NO: 6633459 - DNA, 22 bp, Homo sapiens
agcatgaaagataaatgggttt

SEQ ID NO: 6633460 - DNA, 15 bp, Homo sapiens
agcatgaaatgtgaa

SEQ ID NO: 6633461 - DNA, 17 bp, Homo sapiens
agcatgaaatgtgaatt

SEQ ID NO: 6633462 - DNA, 13 bp, Homo sapiens
agcatgaaccttt

SEQ ID NO: 6633463 - DNA, 12 bp, Homo sapiens
agcatgaagaca

SEQ ID NO: 6633464 - DNA, 20 bp, Homo sapiens
agcatgaagtcttaaggaca

SEQ ID NO: 6633465 - DNA, 19 bp, Homo sapiens
agcatgaataaaacactca

SEQ ID NO: 6633466 - DNA, 21 bp, Homo sapiens
agcatgaataacatttaaatt

SEQ ID NO: 6633467 - DNA, 22 bp, Homo sapiens
agcatgaatggtatggaactct

SEQ ID NO: 6633468 - DNA, 14 bp, Homo sapiens
agcatgaatgtttt

SEQ ID NO: 6633469 - DNA, 16 bp, Homo sapiens
agcatgacaaaaataa

SEQ ID NO: 6633470 - DNA, 17 bp, Homo sapiens
agcatgacaaaaataac

SEQ ID NO: 6633471 - DNA, 23 bp, Homo sapiens
agcatgacaaaaataacactgtt

SEQ ID NO: 6633472 - DNA, 17 bp, Homo sapiens
agcatgacaaaagtgac

SEQ ID NO: 6633473 - DNA, 21 bp, Homo sapiens
agcatgacaacttttaaagaa

SEQ ID NO: 6633474 - DNA, 22 bp, Homo sapiens
agcatgacaagccccaggcagg

SEQ ID NO: 6633475 - DNA, 14 bp, Homo sapiens
agcatgacagaaaa

SEQ ID NO: 6633476 - DNA, 18 bp, Homo sapiens
agcatgacagaaaatatg

SEQ ID NO: 6633477 - DNA, 21 bp, Homo sapiens
agcatgacagaaaatatgtat

SEQ ID NO: 6633478 - DNA, 23 bp, Homo sapiens
agcatgacagaaaatatgtatta

SEQ ID NO: 6633479 - DNA, 19 bp, Homo sapiens
agcatgaccttttggcctt

SEQ ID NO: 6633480 - DNA, 23 bp, Homo sapiens
agcatgaccttttggcctttgta

SEQ ID NO: 6633481 - DNA, 23 bp, Homo sapiens
agcatgactttccttaggaggcc

SEQ ID NO: 6633482 - DNA, 17 bp, Homo sapiens
agcatgagattgtacat

SEQ ID NO: 6633483 - DNA, 19 bp, Homo sapiens
agcatgagatttttctatc

SEQ ID NO: 6633484 - DNA, 16 bp, Homo sapiens
agcatgagccagctct

SEQ ID NO: 6633485 - DNA, 18 bp, Homo sapiens
agcatgagctttccagtt

SEQ ID NO: 6633486 - DNA, 13 bp, Homo sapiens
agcatgaggaact

SEQ ID NO: 6633487 - DNA, 23 bp, Homo sapiens
agcatgaggcagcacgtgcacaa

SEQ ID NO: 6633488 - DNA, 22 bp, Homo sapiens
agcatgaggtgttgtgcatttg

SEQ ID NO: 6633489 - DNA, 19 bp, Homo sapiens
agcatgatggctgtagctg

SEQ ID NO: 6633490 - DNA, 19 bp, Homo sapiens
agcatgatgggaaaatatt

SEQ ID NO: 6633491 - DNA, 21 bp, Homo sapiens
agcatgatgggaggtgtgcca

SEQ ID NO: 6633492 - DNA, 19 bp, Homo sapiens
agcatgattctttaataga

SEQ ID NO: 6633493 - DNA, 19 bp, Homo sapiens
agcatgattttaagaggct

SEQ ID NO: 6633494 - DNA, 23 bp, Homo sapiens
agcatgcaagcttggtcaaactt

SEQ ID NO: 6633495 - DNA, 18 bp, Homo sapiens
agcatgcaatacatacca

SEQ ID NO: 6633496 - DNA, 18 bp, Homo sapiens
agcatgcacaaagtgtat

SEQ ID NO: 6633497 - DNA, 20 bp, Homo sapiens
agcatgcagcgaattcagaa

SEQ ID NO: 6633498 - DNA, 17 bp, Homo sapiens
agcatgcagctttgcaa

SEQ ID NO: 6633499 - DNA, 17 bp, Homo sapiens
agcatgcataaatcaat

SEQ ID NO: 6633500 - DNA, 21 bp, Homo sapiens
agcatgcattttcttgtatga

SEQ ID NO: 6633501 - DNA, 16 bp, Homo sapiens
agcatgccaacaagaa

SEQ ID NO: 6633502 - DNA, 20 bp, Homo sapiens
agcatgccaacaagaatgca

SEQ ID NO: 6633503 - DNA, 20 bp, Homo sapiens
agcatgcccaaatataacat

SEQ ID NO: 6633504 - DNA, 16 bp, Homo sapiens
agcatgcccagattcc

SEQ ID NO: 6633505 - DNA, 21 bp, Homo sapiens
agcatgcccagattcccagac

SEQ ID NO: 6633506 - DNA, 14 bp, Homo sapiens
agcatgcccagtgc

SEQ ID NO: 6633507 - DNA, 21 bp, Homo sapiens
agcatgccccacccacccctc

SEQ ID NO: 6633508 - DNA, 23 bp, Homo sapiens
agcatgccccacccacccctcct

SEQ ID NO: 6633509 - DNA, 19 bp, Homo sapiens
agcatgccccttggctgga

SEQ ID NO: 6633510 - DNA, 19 bp, Homo sapiens
agcatgccgttctgcaccc

SEQ ID NO: 6633511 - DNA, 20 bp, Homo sapiens
agcatgcctggatggggctg

SEQ ID NO: 6633512 - DNA, 18 bp, Homo sapiens
agcatgcgcagaggccag

SEQ ID NO: 6633513 - DNA, 15 bp, Homo sapiens
agcatgcgcgctgtg

SEQ ID NO: 6633514 - DNA, 20 bp, Homo sapiens
agcatgcggagccagcaggc

SEQ ID NO: 6633515 - DNA, 11 bp, Homo sapiens
agcatgctcag

SEQ ID NO: 6633516 - DNA, 21 bp, Homo sapiens
agcatgctccctcatgcagat

SEQ ID NO: 6633517 - DNA, 21 bp, Homo sapiens
agcatgctgctttttgtactt

SEQ ID NO: 6633518 - DNA, 22 bp, Homo sapiens
agcatgcttaccttctgctgtt

SEQ ID NO: 6633519 - DNA, 14 bp, Homo sapiens
agcatgcttcccag

SEQ ID NO: 6633520 - DNA, 16 bp, Homo sapiens
agcatgcttcccagag

SEQ ID NO: 6633521 - DNA, 17 bp, Homo sapiens
agcatgcttcccagagg

SEQ ID NO: 6633522 - DNA, 20 bp, Homo sapiens
agcatgcttcccagagggag

SEQ ID NO: 6633523 - DNA, 22 bp, Homo sapiens
agcatgcttcccagagggagca

SEQ ID NO: 6633524 - DNA, 16 bp, Homo sapiens
agcatgcttccctgca

SEQ ID NO: 6633525 - DNA, 19 bp, Homo sapiens
agcatgcttccctgcagct

SEQ ID NO: 6633526 - DNA, 23 bp, Homo sapiens
agcatgcttccctgcagctgacc

SEQ ID NO: 6633527 - DNA, 16 bp, Homo sapiens
agcatgcttgggctga

SEQ ID NO: 6633528 - DNA, 18 bp, Homo sapiens
agcatgcttgggctgacc

SEQ ID NO: 6633529 - DNA, 21 bp, Homo sapiens
agcatgcttgggctgacccag

SEQ ID NO: 6633530 - DNA, 23 bp, Homo sapiens
agcatgcttgtgaaaatgtgttc

SEQ ID NO: 6633531 - DNA, 18 bp, Homo sapiens
agcatgctttctttgagt

SEQ ID NO: 6633532 - DNA, 19 bp, Homo sapiens
agcatgctttctttgagtt

SEQ ID NO: 6633533 - DNA, 16 bp, Homo sapiens
agcatgctttgctgct

SEQ ID NO: 6633534 - DNA, 18 bp, Homo sapiens
agcatgctttgctgctat

SEQ ID NO: 6633535 - DNA, 13 bp, Homo sapiens
agcatggaaaaat

SEQ ID NO: 6633536 - DNA, 17 bp, Homo sapiens
agcatggaacacttcga

SEQ ID NO: 6633537 - DNA, 19 bp, Homo sapiens
agcatggaacacttcgagt

SEQ ID NO: 6633538 - DNA, 12 bp, Homo sapiens
agcatggaatct

SEQ ID NO: 6633539 - DNA, 20 bp, Homo sapiens
agcatggacatttagaagaa

SEQ ID NO: 6633540 - DNA, 15 bp, Homo sapiens
agcatggactctggg

SEQ ID NO: 6633541 - DNA, 18 bp, Homo sapiens
agcatggactctgggttt

SEQ ID NO: 6633542 - DNA, 15 bp, Homo sapiens
agcatggagacagca

SEQ ID NO: 6633543 - DNA, 17 bp, Homo sapiens
agcatggagctgtcacc

SEQ ID NO: 6633544 - DNA, 23 bp, Homo sapiens
agcatggaggaaaatctgaactc

SEQ ID NO: 6633545 - DNA, 11 bp, Homo sapiens
agcatggatgc

SEQ ID NO: 6633546 - DNA, 21 bp, Homo sapiens
agcatggcactccctccagca

SEQ ID NO: 6633547 - DNA, 19 bp, Homo sapiens
agcatggcatagccccggc

SEQ ID NO: 6633548 - DNA, 20 bp, Homo sapiens
agcatggcatagccccggcc

SEQ ID NO: 6633549 - DNA, 20 bp, Homo sapiens
agcatggcatattttaatca

SEQ ID NO: 6633550 - DNA, 13 bp, Homo sapiens
agcatggccctgc

SEQ ID NO: 6633551 - DNA, 21 bp, Homo sapiens
agcatggccctgctgcccctc

SEQ ID NO: 6633552 - DNA, 23 bp, Homo sapiens
agcatggccctgctgcccctccc

SEQ ID NO: 6633553 - DNA, 13 bp, Homo sapiens
agcatggcctgga

SEQ ID NO: 6633554 - DNA, 16 bp, Homo sapiens
agcatggcctggactg

SEQ ID NO: 6633555 - DNA, 17 bp, Homo sapiens
agcatggcggcacacat

SEQ ID NO: 6633556 - DNA, 15 bp, Homo sapiens
agcatggctatttta

SEQ ID NO: 6633557 - DNA, 12 bp, Homo sapiens
agcatggctgcc

SEQ ID NO: 6633558 - DNA, 19 bp, Homo sapiens
agcatggctgccaatggga

SEQ ID NO: 6633559 - DNA, 12 bp, Homo sapiens
agcatggctgtc

SEQ ID NO: 6633560 - DNA, 14 bp, Homo sapiens
agcatggctgtctg

SEQ ID NO: 6633561 - DNA, 20 bp, Homo sapiens
agcatgggaaaaagagactc

SEQ ID NO: 6633562 - DNA, 16 bp, Homo sapiens
agcatggggccaggaa

SEQ ID NO: 6633563 - DNA, 23 bp, Homo sapiens
agcatggggcgctcccactcaga

SEQ ID NO: 6633564 - DNA, 19 bp, Homo sapiens
agcatgggggaccccttcc

SEQ ID NO: 6633565 - DNA, 21 bp, Homo sapiens
agcatgggggaccccttccca

SEQ ID NO: 6633566 - DNA, 13 bp, Homo sapiens
agcatggggtcag

SEQ ID NO: 6633567 - DNA, 21 bp, Homo sapiens
agcatggggtcagccccaagg

SEQ ID NO: 6633568 - DNA, 20 bp, Homo sapiens
agcatgggtgtgcccttggg

SEQ ID NO: 6633569 - DNA, 16 bp, Homo sapiens
agcatgggttcatcct

SEQ ID NO: 6633570 - DNA, 21 bp, Homo sapiens
agcatggtacttggcctttgg

SEQ ID NO: 6633571 - DNA, 16 bp, Homo sapiens
agcatggtataattga

SEQ ID NO: 6633572 - DNA, 21 bp, Homo sapiens
agcatggtcccacatccctgg

SEQ ID NO: 6633573 - DNA, 17 bp, Homo sapiens
agcatggtccctgcctt

SEQ ID NO: 6633574 - DNA, 16 bp, Homo sapiens
agcatggtgcatgccg

SEQ ID NO: 6633575 - DNA, 16 bp, Homo sapiens
agcatggtgttttcat

SEQ ID NO: 6633576 - DNA, 18 bp, Homo sapiens
agcatggtgttttcattc

SEQ ID NO: 6633577 - DNA, 19 bp, Homo sapiens
agcatggtgttttcattcc

SEQ ID NO: 6633578 - DNA, 20 bp, Homo sapiens
agcatggtgttttcattccc

SEQ ID NO: 6633579 - DNA, 23 bp, Homo sapiens
agcatggtgttttcattccccct

SEQ ID NO: 6633580 - DNA, 19 bp, Homo sapiens
agcatggttccaatttttt

SEQ ID NO: 6633581 - DNA, 17 bp, Homo sapiens
agcatggtttgcatgac

SEQ ID NO: 6633582 - DNA, 17 bp, Homo sapiens
agcatggttttagcaaa

SEQ ID NO: 6633583 - DNA, 19 bp, Homo sapiens
agcatgtaaagagctggga

SEQ ID NO: 6633584 - DNA, 17 bp, Homo sapiens
agcatgtaatattaaat

SEQ ID NO: 6633585 - DNA, 12 bp, Homo sapiens
agcatgtacaaa

SEQ ID NO: 6633586 - DNA, 21 bp, Homo sapiens
agcatgtacaaaagtaccata

SEQ ID NO: 6633587 - DNA, 15 bp, Homo sapiens
agcatgtacagtgtt

SEQ ID NO: 6633588 - DNA, 16 bp, Homo sapiens
agcatgtacagtgttc

SEQ ID NO: 6633589 - DNA, 19 bp, Homo sapiens
agcatgtacagtgttctgt

SEQ ID NO: 6633590 - DNA, 21 bp, Homo sapiens
agcatgtacggattttcagtt

SEQ ID NO: 6633591 - DNA, 22 bp, Homo sapiens
agcatgtactgtacttcccaat

SEQ ID NO: 6633592 - DNA, 18 bp, Homo sapiens
agcatgtatagttgcttt

SEQ ID NO: 6633593 - DNA, 14 bp, Homo sapiens
agcatgtattgtgt

SEQ ID NO: 6633594 - DNA, 22 bp, Homo sapiens
agcatgtattgtgtcttttgca

SEQ ID NO: 6633595 - DNA, 17 bp, Homo sapiens
agcatgtcactcccaga

SEQ ID NO: 6633596 - DNA, 15 bp, Homo sapiens
agcatgtcctatccc

SEQ ID NO: 6633597 - DNA, 14 bp, Homo sapiens
agcatgtctactgc

SEQ ID NO: 6633598 - DNA, 16 bp, Homo sapiens
agcatgtctctctgcc

SEQ ID NO: 6633599 - DNA, 14 bp, Homo sapiens
agcatgtctctgct

SEQ ID NO: 6633600 - DNA, 16 bp, Homo sapiens
agcatgtctctgcttc

SEQ ID NO: 6633601 - DNA, 20 bp, Homo sapiens
agcatgtctctgcttccatg

SEQ ID NO: 6633602 - DNA, 18 bp, Homo sapiens
agcatgtggagcgagagg

SEQ ID NO: 6633603 - DNA, 19 bp, Homo sapiens
agcatgtggatgacacaat

SEQ ID NO: 6633604 - DNA, 24 bp, Homo sapiens
agcatgtggcatcgcagtctctta

SEQ ID NO: 6633605 - DNA, 22 bp, Homo sapiens
agcatgtgggggaaggccttgc

SEQ ID NO: 6633606 - DNA, 19 bp, Homo sapiens
agcatgtgtatttccagtg

SEQ ID NO: 6633607 - DNA, 13 bp, Homo sapiens
agcatgtgtcaga

SEQ ID NO: 6633608 - DNA, 16 bp, Homo sapiens
agcatgtgtcccagga

SEQ ID NO: 6633609 - DNA, 12 bp, Homo sapiens
agcatgtgtgtg

SEQ ID NO: 6633610 - DNA, 14 bp, Homo sapiens
agcatgtgtgtgtc

SEQ ID NO: 6633611 - DNA, 16 bp, Homo sapiens
agcatgtgtgtgtctc

SEQ ID NO: 6633612 - DNA, 19 bp, Homo sapiens
agcatgtgtgtgtctctat

SEQ ID NO: 6633613 - DNA, 16 bp, Homo sapiens
agcatgtgttaatctt

SEQ ID NO: 6633614 - DNA, 20 bp, Homo sapiens
agcatgtgttgcagctgtca

SEQ ID NO: 6633615 - DNA, 21 bp, Homo sapiens
agcatgtgttgcagctgtcac

SEQ ID NO: 6633616 - DNA, 14 bp, Homo sapiens
agcatgttcctcct

SEQ ID NO: 6633617 - DNA, 15 bp, Homo sapiens
agcatgttgaatgta

SEQ ID NO: 6633618 - DNA, 16 bp, Homo sapiens
agcatgttgagccagg

SEQ ID NO: 6633619 - DNA, 20 bp, Homo sapiens
agcatgttggacacccccca

SEQ ID NO: 6633620 - DNA, 23 bp, Homo sapiens
agcatgttgtagatacaatcagc

SEQ ID NO: 6633621 - DNA, 17 bp, Homo sapiens
agcatgttgttttttca

SEQ ID NO: 6633622 - DNA, 18 bp, Homo sapiens
agcatgtttagactttaa

SEQ ID NO: 6633623 - DNA, 21 bp, Homo sapiens
agcatgtttagactttaacat

SEQ ID NO: 6633624 - DNA, 18 bp, Homo sapiens
agcatgtttcattctctg

SEQ ID NO: 6633625 - DNA, 16 bp, Homo sapiens
agcatgtttgctgaac

SEQ ID NO: 6633626 - DNA, 20 bp, Homo sapiens
agcatgtttggcctatttca

SEQ ID NO: 6633627 - DNA, 14 bp, Homo sapiens
agcatgttttgtat

SEQ ID NO: 6633628 - DNA, 17 bp, Homo sapiens
agcatgttttgtataca

SEQ ID NO: 6633629 - DNA, 14 bp, Homo sapiens
agcattaaaaataa

SEQ ID NO: 6633630 - DNA, 17 bp, Homo sapiens
agcattaaaaataaaag

SEQ ID NO: 6633631 - DNA, 15 bp, Homo sapiens
agcattaaaataact

SEQ ID NO: 6633632 - DNA, 15 bp, Homo sapiens
agcattaaatataaa

SEQ ID NO: 6633633 - DNA, 18 bp, Homo sapiens
agcattaaatataaaata

SEQ ID NO: 6633634 - DNA, 14 bp, Homo sapiens
agcattaactaatc

SEQ ID NO: 6633635 - DNA, 17 bp, Homo sapiens
agcattaagaacacttt

SEQ ID NO: 6633636 - DNA, 16 bp, Homo sapiens
agcattaagcccaatc

SEQ ID NO: 6633637 - DNA, 17 bp, Homo sapiens
agcattaataaaactgt

SEQ ID NO: 6633638 - DNA, 22 bp, Homo sapiens
agcattacctaatttttttcct

SEQ ID NO: 6633639 - DNA, 20 bp, Homo sapiens
agcattacgtgagccaggta

SEQ ID NO: 6633640 - DNA, 15 bp, Homo sapiens
agcattactcttgta

SEQ ID NO: 6633641 - DNA, 17 bp, Homo sapiens
agcattactttaacctc

SEQ ID NO: 6633642 - DNA, 23 bp, Homo sapiens
agcattagatagtcatgctgcta

SEQ ID NO: 6633643 - DNA, 18 bp, Homo sapiens
agcattataccaagagta

SEQ ID NO: 6633644 - DNA, 15 bp, Homo sapiens
agcattattcttcag

SEQ ID NO: 6633645 - DNA, 19 bp, Homo sapiens
agcattattgccaaataag

SEQ ID NO: 6633646 - DNA, 15 bp, Homo sapiens
agcattatttacaaa

SEQ ID NO: 6633647 - DNA, 17 bp, Homo sapiens
agcattatttgaaaaca

SEQ ID NO: 6633648 - DNA, 21 bp, Homo sapiens
agcattattttttgttgaata

SEQ ID NO: 6633649 - DNA, 22 bp, Homo sapiens
agcattcaaaatagttctattt

SEQ ID NO: 6633650 - DNA, 17 bp, Homo sapiens
agcattcaaatgaagat

SEQ ID NO: 6633651 - DNA, 20 bp, Homo sapiens
agcattcaaatgaagattca

SEQ ID NO: 6633652 - DNA, 22 bp, Homo sapiens
agcattcaaatgaagattcagc

SEQ ID NO: 6633653 - DNA, 18 bp, Homo sapiens
agcattcacaacttgttt

SEQ ID NO: 6633654 - DNA, 14 bp, Homo sapiens
agcattcagaagaa

SEQ ID NO: 6633655 - DNA, 14 bp, Homo sapiens
agcattcagcacac

SEQ ID NO: 6633656 - DNA, 15 bp, Homo sapiens
agcattcaggcagca

SEQ ID NO: 6633657 - DNA, 19 bp, Homo sapiens
agcattcaggcagcactga

SEQ ID NO: 6633658 - DNA, 20 bp, Homo sapiens
agcattcagggttatacaca

SEQ ID NO: 6633659 - DNA, 18 bp, Homo sapiens
agcattcataattaaaat

SEQ ID NO: 6633660 - DNA, 20 bp, Homo sapiens
agcattcattacctgtttat

SEQ ID NO: 6633661 - DNA, 22 bp, Homo sapiens
agcattcatttgttttttcaat

SEQ ID NO: 6633662 - DNA, 16 bp, Homo sapiens
agcattccagtaactt

SEQ ID NO: 6633663 - DNA, 14 bp, Homo sapiens
agcattccagtcag

SEQ ID NO: 6633664 - DNA, 16 bp, Homo sapiens
agcattcccaccaaca

SEQ ID NO: 6633665 - DNA, 19 bp, Homo sapiens
agcattccttagcagctca

SEQ ID NO: 6633666 - DNA, 21 bp, Homo sapiens
agcattccttctttgataatg

SEQ ID NO: 6633667 - DNA, 14 bp, Homo sapiens
agcattcggaggga

SEQ ID NO: 6633668 - DNA, 19 bp, Homo sapiens
agcattctaaatgaactca

SEQ ID NO: 6633669 - DNA, 16 bp, Homo sapiens
agcattctcagccaca

SEQ ID NO: 6633670 - DNA, 17 bp, Homo sapiens
agcattctccccagtgt

SEQ ID NO: 6633671 - DNA, 17 bp, Homo sapiens
agcattctgagctgggc

SEQ ID NO: 6633672 - DNA, 15 bp, Homo sapiens
agcattctgcaacat

SEQ ID NO: 6633673 - DNA, 14 bp, Homo sapiens
agcattctggaggg

SEQ ID NO: 6633674 - DNA, 16 bp, Homo sapiens
agcattctggggtggg

SEQ ID NO: 6633675 - DNA, 15 bp, Homo sapiens
agcattctttaacag

SEQ ID NO: 6633676 - DNA, 22 bp, Homo sapiens
agcattctttggagttaaaatg

SEQ ID NO: 6633677 - DNA, 13 bp, Homo sapiens
agcattgaaaaat

SEQ ID NO: 6633678 - DNA, 17 bp, Homo sapiens
agcattgaaataataat

SEQ ID NO: 6633679 - DNA, 18 bp, Homo sapiens
agcattgagacggtgctc

SEQ ID NO: 6633680 - DNA, 16 bp, Homo sapiens
agcattgataatcttc

SEQ ID NO: 6633681 - DNA, 19 bp, Homo sapiens
agcattgataatcttcagg

SEQ ID NO: 6633682 - DNA, 18 bp, Homo sapiens
agcattgatatttgtgca

SEQ ID NO: 6633683 - DNA, 12 bp, Homo sapiens
agcattgcactt

SEQ ID NO: 6633684 - DNA, 21 bp, Homo sapiens
agcattgcagcctaagaagaa

SEQ ID NO: 6633685 - DNA, 19 bp, Homo sapiens
agcattgcagtcactttga

SEQ ID NO: 6633686 - DNA, 13 bp, Homo sapiens
agcattgcatgga

SEQ ID NO: 6633687 - DNA, 22 bp, Homo sapiens
agcattgccattccctgcctgg

SEQ ID NO: 6633688 - DNA, 13 bp, Homo sapiens
agcattgccattg

SEQ ID NO: 6633689 - DNA, 14 bp, Homo sapiens
agcattgcctggac

SEQ ID NO: 6633690 - DNA, 15 bp, Homo sapiens
agcattgcctggact

SEQ ID NO: 6633691 - DNA, 16 bp, Homo sapiens
agcattgcctggactg

SEQ ID NO: 6633692 - DNA, 18 bp, Homo sapiens
agcattgcctggactgac

SEQ ID NO: 6633693 - DNA, 19 bp, Homo sapiens
agcattgcctggactgacc

SEQ ID NO: 6633694 - DNA, 20 bp, Homo sapiens
agcattgcctggactgacca

SEQ ID NO: 6633695 - DNA, 22 bp, Homo sapiens
agcattgcctggactgaccaca

SEQ ID NO: 6633696 - DNA, 15 bp, Homo sapiens
agcattgctggttct

SEQ ID NO: 6633697 - DNA, 17 bp, Homo sapiens
agcattgctgttatgtc

SEQ ID NO: 6633698 - DNA, 20 bp, Homo sapiens
agcattgctgttatgtctgt

SEQ ID NO: 6633699 - DNA, 23 bp, Homo sapiens
agcattgcttttattttgaaaag

SEQ ID NO: 6633700 - DNA, 21 bp, Homo sapiens
agcattgcttttgtttcttaa

SEQ ID NO: 6633701 - DNA, 17 bp, Homo sapiens
agcattggatacagcag

SEQ ID NO: 6633702 - DNA, 15 bp, Homo sapiens
agcattggcccctga

SEQ ID NO: 6633703 - DNA, 21 bp, Homo sapiens
agcattgggtgaggtaataaa

SEQ ID NO: 6633704 - DNA, 17 bp, Homo sapiens
agcattgtaaaagcatt

SEQ ID NO: 6633705 - DNA, 14 bp, Homo sapiens
agcattgtaaaata

SEQ ID NO: 6633706 - DNA, 16 bp, Homo sapiens
agcattgtaaaataat

SEQ ID NO: 6633707 - DNA, 22 bp, Homo sapiens
agcattgtaaaattatttcatg

SEQ ID NO: 6633708 - DNA, 17 bp, Homo sapiens
agcattgtaaatgtgct

SEQ ID NO: 6633709 - DNA, 16 bp, Homo sapiens
agcattgtctttgctg

SEQ ID NO: 6633710 - DNA, 21 bp, Homo sapiens
agcattgtgaactgacaggca

SEQ ID NO: 6633711 - DNA, 13 bp, Homo sapiens
agcattgtgagta

SEQ ID NO: 6633712 - DNA, 12 bp, Homo sapiens
agcattgttcca

SEQ ID NO: 6633713 - DNA, 18 bp, Homo sapiens
agcattgtttcaaaatag

SEQ ID NO: 6633714 - DNA, 19 bp, Homo sapiens
agcattgtttcaaaatagt

SEQ ID NO: 6633715 - DNA, 15 bp, Homo sapiens
agcattgtttttgtc

SEQ ID NO: 6633716 - DNA, 11 bp, Homo sapiens
agcatttaaag

SEQ ID NO: 6633717 - DNA, 21 bp, Homo sapiens
agcatttaacccccctgtaca

SEQ ID NO: 6633718 - DNA, 17 bp, Homo sapiens
agcatttaatgtagcca

SEQ ID NO: 6633719 - DNA, 20 bp, Homo sapiens
agcatttaatgtagccatgg

SEQ ID NO: 6633720 - DNA, 14 bp, Homo sapiens
agcatttacagaaa

SEQ ID NO: 6633721 - DNA, 20 bp, Homo sapiens
agcatttaccaacatgtatc

SEQ ID NO: 6633722 - DNA, 12 bp, Homo sapiens
agcatttactat

SEQ ID NO: 6633723 - DNA, 16 bp, Homo sapiens
agcatttactgtgtct

SEQ ID NO: 6633724 - DNA, 15 bp, Homo sapiens
agcatttagagcttt

SEQ ID NO: 6633725 - DNA, 15 bp, Homo sapiens
agcatttagatctac

SEQ ID NO: 6633726 - DNA, 21 bp, Homo sapiens
agcatttagcacaatttgaga

SEQ ID NO: 6633727 - DNA, 23 bp, Homo sapiens
agcatttagcttgttccactgca

SEQ ID NO: 6633728 - DNA, 14 bp, Homo sapiens
agcatttaggaatg

SEQ ID NO: 6633729 - DNA, 13 bp, Homo sapiens
agcatttaggaga

SEQ ID NO: 6633730 - DNA, 19 bp, Homo sapiens
agcatttatgtagacattg

SEQ ID NO: 6633731 - DNA, 13 bp, Homo sapiens
agcatttatttct

SEQ ID NO: 6633732 - DNA, 20 bp, Homo sapiens
agcatttcaaagccctgcct

SEQ ID NO: 6633733 - DNA, 14 bp, Homo sapiens
agcatttcatgaaa

SEQ ID NO: 6633734 - DNA, 14 bp, Homo sapiens
agcatttccaacac

SEQ ID NO: 6633735 - DNA, 17 bp, Homo sapiens
agcatttccaacaccac

SEQ ID NO: 6633736 - DNA, 19 bp, Homo sapiens
agcatttccaacaccacag

SEQ ID NO: 6633737 - DNA, 21 bp, Homo sapiens
agcatttccaacaccacagac

SEQ ID NO: 6633738 - DNA, 17 bp, Homo sapiens
agcatttcccttccttc

SEQ ID NO: 6633739 - DNA, 16 bp, Homo sapiens
agcatttcctcagtct

SEQ ID NO: 6633740 - DNA, 16 bp, Homo sapiens
agcatttcggtgcttc

SEQ ID NO: 6633741 - DNA, 22 bp, Homo sapiens
agcatttctgaagtggactctt

SEQ ID NO: 6633742 - DNA, 20 bp, Homo sapiens
agcatttcttccaattatta

SEQ ID NO: 6633743 - DNA, 18 bp, Homo sapiens
agcatttcttttctcttt

SEQ ID NO: 6633744 - DNA, 15 bp, Homo sapiens
agcatttgaatgcat

SEQ ID NO: 6633745 - DNA, 21 bp, Homo sapiens
agcatttgacccttgctgtga

SEQ ID NO: 6633746 - DNA, 15 bp, Homo sapiens
agcatttgataagca

SEQ ID NO: 6633747 - DNA, 13 bp, Homo sapiens
agcatttgccact

SEQ ID NO: 6633748 - DNA, 18 bp, Homo sapiens
agcatttgccattcctgg

SEQ ID NO: 6633749 - DNA, 18 bp, Homo sapiens
agcatttgctttcctctg

SEQ ID NO: 6633750 - DNA, 13 bp, Homo sapiens
agcatttggaagg

SEQ ID NO: 6633751 - DNA, 13 bp, Homo sapiens
agcatttggtgct

SEQ ID NO: 6633752 - DNA, 21 bp, Homo sapiens
agcatttggttttacacagga

SEQ ID NO: 6633753 - DNA, 11 bp, Homo sapiens
agcatttgtat

SEQ ID NO: 6633754 - DNA, 14 bp, Homo sapiens
agcatttgtatatt

SEQ ID NO: 6633755 - DNA, 14 bp, Homo sapiens
agcatttgtatttt

SEQ ID NO: 6633756 - DNA, 12 bp, Homo sapiens
agcatttgtcct

SEQ ID NO: 6633757 - DNA, 14 bp, Homo sapiens
agcatttgtccttt

SEQ ID NO: 6633758 - DNA, 17 bp, Homo sapiens
agcatttgtttctactt

SEQ ID NO: 6633759 - DNA, 17 bp, Homo sapiens
agcatttgttttagcat

SEQ ID NO: 6633760 - DNA, 15 bp, Homo sapiens
agcattttaaacaaa

SEQ ID NO: 6633761 - DNA, 19 bp, Homo sapiens
agcattttaaacaaaatag

SEQ ID NO: 6633762 - DNA, 20 bp, Homo sapiens
agcattttaaggttctcaga

SEQ ID NO: 6633763 - DNA, 22 bp, Homo sapiens
agcattttaatagtttctaaac

SEQ ID NO: 6633764 - DNA, 15 bp, Homo sapiens
agcattttaattctc

SEQ ID NO: 6633765 - DNA, 17 bp, Homo sapiens
agcattttaattctctc

SEQ ID NO: 6633766 - DNA, 20 bp, Homo sapiens
agcattttactacttgttac

SEQ ID NO: 6633767 - DNA, 23 bp, Homo sapiens
agcattttactgtctgtaagaga

SEQ ID NO: 6633768 - DNA, 21 bp, Homo sapiens
agcattttaggtcccagaatg

SEQ ID NO: 6633769 - DNA, 13 bp, Homo sapiens
agcattttataaa

SEQ ID NO: 6633770 - DNA, 20 bp, Homo sapiens
agcattttataaatcgcttt

SEQ ID NO: 6633771 - DNA, 19 bp, Homo sapiens
agcattttatatccacatc

SEQ ID NO: 6633772 - DNA, 17 bp, Homo sapiens
agcattttcaagaagac

SEQ ID NO: 6633773 - DNA, 14 bp, Homo sapiens
agcattttcacatt

SEQ ID NO: 6633774 - DNA, 21 bp, Homo sapiens
agcattttcagcatcaaacat

SEQ ID NO: 6633775 - DNA, 20 bp, Homo sapiens
agcattttccagcactttgc

SEQ ID NO: 6633776 - DNA, 12 bp, Homo sapiens
agcattttcctc

SEQ ID NO: 6633777 - DNA, 22 bp, Homo sapiens
agcattttcctctgctttgaaa

SEQ ID NO: 6633778 - DNA, 17 bp, Homo sapiens
agcattttctacacagc

SEQ ID NO: 6633779 - DNA, 18 bp, Homo sapiens
agcattttctacacagcg

SEQ ID NO: 6633780 - DNA, 18 bp, Homo sapiens
agcattttctttctgttt

SEQ ID NO: 6633781 - DNA, 19 bp, Homo sapiens
agcatttttataaactacc

SEQ ID NO: 6633782 - DNA, 19 bp, Homo sapiens
agcatttttatgcagacag

SEQ ID NO: 6633783 - DNA, 20 bp, Homo sapiens
agcatttttcaatatattga

SEQ ID NO: 6633784 - DNA, 23 bp, Homo sapiens
agcatttttcaatatattgaact

SEQ ID NO: 6633785 - DNA, 13 bp, Homo sapiens
agcatttttcaga

SEQ ID NO: 6633786 - DNA, 15 bp, Homo sapiens
agcatttttcagagt

SEQ ID NO: 6633787 - DNA, 13 bp, Homo sapiens
agcatttttctaa

SEQ ID NO: 6633788 - DNA, 15 bp, Homo sapiens
agcattttttaacct

SEQ ID NO: 6633789 - DNA, 21 bp, Homo sapiens
agcattttttatcaggcagga

SEQ ID NO: 6633790 - DNA, 20 bp, Homo sapiens
agcatttttttattcagcag

SEQ ID NO: 6633791 - DNA, 22 bp, Homo sapiens
agcatttttttattcagcagac

SEQ ID NO: 6633792 - DNA, 17 bp, Homo sapiens
agccaaaaaatgggaga

SEQ ID NO: 6633793 - DNA, 17 bp, Homo sapiens
agccaaaaaggcaaata

SEQ ID NO: 6633794 - DNA, 19 bp, Homo sapiens
agccaaaagtccctccctg

SEQ ID NO: 6633795 - DNA, 21 bp, Homo sapiens
agccaaaagtccctccctgcc

SEQ ID NO: 6633796 - DNA, 22 bp, Homo sapiens
agccaaaagtccctccctgcct

SEQ ID NO: 6633797 - DNA, 18 bp, Homo sapiens
agccaaaataagactatt

SEQ ID NO: 6633798 - DNA, 16 bp, Homo sapiens
agccaaaatagagagt

SEQ ID NO: 6633799 - DNA, 15 bp, Homo sapiens
agccaaaattaaggt

SEQ ID NO: 6633800 - DNA, 19 bp, Homo sapiens
agccaaacaagccttagct

SEQ ID NO: 6633801 - DNA, 22 bp, Homo sapiens
agccaaacacacagaaggggac

SEQ ID NO: 6633802 - DNA, 18 bp, Homo sapiens
agccaaacacactgtaaa

SEQ ID NO: 6633803 - DNA, 16 bp, Homo sapiens
agccaaacacagagcg

SEQ ID NO: 6633804 - DNA, 14 bp, Homo sapiens
agccaaacagagcc

SEQ ID NO: 6633805 - DNA, 20 bp, Homo sapiens
agccaaacagagccttcaca

SEQ ID NO: 6633806 - DNA, 17 bp, Homo sapiens
agccaaacattcttatt

SEQ ID NO: 6633807 - DNA, 18 bp, Homo sapiens
agccaaacccatgaggca

SEQ ID NO: 6633808 - DNA, 22 bp, Homo sapiens
agccaaacccctagagacagtg

SEQ ID NO: 6633809 - DNA, 14 bp, Homo sapiens
agccaaaccctgtc

SEQ ID NO: 6633810 - DNA, 16 bp, Homo sapiens
agccaaaccctgtctg

SEQ ID NO: 6633811 - DNA, 19 bp, Homo sapiens
agccaaacccttgtcagtg

SEQ ID NO: 6633812 - DNA, 17 bp, Homo sapiens
agccaaacctcaccaac

SEQ ID NO: 6633813 - DNA, 21 bp, Homo sapiens
agccaaacctcaccaactcct

SEQ ID NO: 6633814 - DNA, 14 bp, Homo sapiens
agccaaacgggagc

SEQ ID NO: 6633815 - DNA, 15 bp, Homo sapiens
agccaaacgggagct

SEQ ID NO: 6633816 - DNA, 19 bp, Homo sapiens
agccaaacgggagcttttg

SEQ ID NO: 6633817 - DNA, 14 bp, Homo sapiens
agccaaactctgcc

SEQ ID NO: 6633818 - DNA, 14 bp, Homo sapiens
agccaaactgtaga

SEQ ID NO: 6633819 - DNA, 15 bp, Homo sapiens
agccaaactgtagat

SEQ ID NO: 6633820 - DNA, 12 bp, Homo sapiens
agccaaagaaaa

SEQ ID NO: 6633821 - DNA, 13 bp, Homo sapiens
agccaaagaaaaa

SEQ ID NO: 6633822 - DNA, 18 bp, Homo sapiens
agccaaagaaacaagctg

SEQ ID NO: 6633823 - DNA, 14 bp, Homo sapiens
agccaaagaaatga

SEQ ID NO: 6633824 - DNA, 19 bp, Homo sapiens
agccaaagaaatgaacatt

SEQ ID NO: 6633825 - DNA, 15 bp, Homo sapiens
agccaaagaaatggg

SEQ ID NO: 6633826 - DNA, 20 bp, Homo sapiens
agccaaagaaatgggcctgc

SEQ ID NO: 6633827 - DNA, 21 bp, Homo sapiens
agccaaagaaatgggcctgcc

SEQ ID NO: 6633828 - DNA, 21 bp, Homo sapiens
agccaaagagaaaagattaaa

SEQ ID NO: 6633829 - DNA, 16 bp, Homo sapiens
agccaaagagctcttt

SEQ ID NO: 6633830 - DNA, 16 bp, Homo sapiens
agccaaagaggcattc

SEQ ID NO: 6633831 - DNA, 11 bp, Homo sapiens
agccaaagagt

SEQ ID NO: 6633832 - DNA, 12 bp, Homo sapiens
agccaaagccag

SEQ ID NO: 6633833 - DNA, 18 bp, Homo sapiens
agccaaagctaggcctgg

SEQ ID NO: 6633834 - DNA, 23 bp, Homo sapiens
agccaaagctaggcctggccaga

SEQ ID NO: 6633835 - DNA, 18 bp, Homo sapiens
agccaaagctatatgttg

SEQ ID NO: 6633836 - DNA, 13 bp, Homo sapiens
agccaaaggcagc

SEQ ID NO: 6633837 - DNA, 18 bp, Homo sapiens
agccaaaggcagctaaga

SEQ ID NO: 6633838 - DNA, 15 bp, Homo sapiens
agccaaaggggagcc

SEQ ID NO: 6633839 - DNA, 18 bp, Homo sapiens
agccaaaggggagccaga

SEQ ID NO: 6633840 - DNA, 21 bp, Homo sapiens
agccaaaggtcaaacaggctg

SEQ ID NO: 6633841 - DNA, 10 bp, Homo sapiens
agccaaagtt

SEQ ID NO: 6633842 - DNA, 15 bp, Homo sapiens
agccaaagtttctgt

SEQ ID NO: 6633843 - DNA, 21 bp, Homo sapiens
agccaaatccatcctgctctt

SEQ ID NO: 6633844 - DNA, 21 bp, Homo sapiens
agccaaatgaccgagccctgg

SEQ ID NO: 6633845 - DNA, 22 bp, Homo sapiens
agccaaatgaccgagccctgga

SEQ ID NO: 6633846 - DNA, 23 bp, Homo sapiens
agccaaatgaccgagccctggag

SEQ ID NO: 6633847 - DNA, 22 bp, Homo sapiens
agccaaatgacttcatttctga

SEQ ID NO: 6633848 - DNA, 23 bp, Homo sapiens
agccaaatgcagggaggggaggc

SEQ ID NO: 6633849 - DNA, 13 bp, Homo sapiens
agccaaatgtaaa

SEQ ID NO: 6633850 - DNA, 16 bp, Homo sapiens
agccaaattagaaaat

SEQ ID NO: 6633851 - DNA, 12 bp, Homo sapiens
agccaaatttaa

SEQ ID NO: 6633852 - DNA, 19 bp, Homo sapiens
agccaaatttaaaactgtt

SEQ ID NO: 6633853 - DNA, 20 bp, Homo sapiens
agccaaatttcctgtttgaa

SEQ ID NO: 6633854 - DNA, 13 bp, Homo sapiens
agccaaattttat

SEQ ID NO: 6633855 - DNA, 20 bp, Homo sapiens
agccaacaaccacagtgcca

SEQ ID NO: 6633856 - DNA, 22 bp, Homo sapiens
agccaacaaccacagtgccacc

SEQ ID NO: 6633857 - DNA, 22 bp, Homo sapiens
agccaacaaccaccaccacaat

SEQ ID NO: 6633858 - DNA, 18 bp, Homo sapiens
agccaacaactctgcctt

SEQ ID NO: 6633859 - DNA, 23 bp, Homo sapiens
agccaacaactctgcctttatga

SEQ ID NO: 6633860 - DNA, 20 bp, Homo sapiens
agccaacaagaccgccccag

SEQ ID NO: 6633861 - DNA, 19 bp, Homo sapiens
agccaacacgcacctgcct

SEQ ID NO: 6633862 - DNA, 12 bp, Homo sapiens
agccaacagcag

SEQ ID NO: 6633863 - DNA, 19 bp, Homo sapiens
agccaacagctacaacagc

SEQ ID NO: 6633864 - DNA, 16 bp, Homo sapiens
agccaacaggtaaaca

SEQ ID NO: 6633865 - DNA, 15 bp, Homo sapiens
agccaacaggtggca

SEQ ID NO: 6633866 - DNA, 17 bp, Homo sapiens
agccaacaggtggcagg

SEQ ID NO: 6633867 - DNA, 20 bp, Homo sapiens
agccaacatgtggctcctcc

SEQ ID NO: 6633868 - DNA, 15 bp, Homo sapiens
agccaacattgcctt

SEQ ID NO: 6633869 - DNA, 21 bp, Homo sapiens
agccaacattgccttgcattt

SEQ ID NO: 6633870 - DNA, 15 bp, Homo sapiens
agccaaccagccttt

SEQ ID NO: 6633871 - DNA, 20 bp, Homo sapiens
agccaaccctggaaaaggag

SEQ ID NO: 6633872 - DNA, 16 bp, Homo sapiens
agccaacctggacttc

SEQ ID NO: 6633873 - DNA, 23 bp, Homo sapiens
agccaaccttacttacagcataa

SEQ ID NO: 6633874 - DNA, 20 bp, Homo sapiens
agccaacgttcatgcatttt

SEQ ID NO: 6633875 - DNA, 17 bp, Homo sapiens
agccaactagcccctgg

SEQ ID NO: 6633876 - DNA, 20 bp, Homo sapiens
agccaactcactcttatgaa

SEQ ID NO: 6633877 - DNA, 19 bp, Homo sapiens
agccaactctaacaggcac

SEQ ID NO: 6633878 - DNA, 15 bp, Homo sapiens
agccaactctcccaa

SEQ ID NO: 6633879 - DNA, 13 bp, Homo sapiens
agccaactgctgc

SEQ ID NO: 6633880 - DNA, 23 bp, Homo sapiens
agccaacttaaacctgtgctttc

SEQ ID NO: 6633881 - DNA, 19 bp, Homo sapiens
agccaacttggctttcccg

SEQ ID NO: 6633882 - DNA, 20 bp, Homo sapiens
agccaacttggctttcccgg

SEQ ID NO: 6633883 - DNA, 18 bp, Homo sapiens
agccaacttgtaaataca

SEQ ID NO: 6633884 - DNA, 12 bp, Homo sapiens
agccaagaaagt

SEQ ID NO: 6633885 - DNA, 23 bp, Homo sapiens
agccaagaatttctctctatgtc

SEQ ID NO: 6633886 - DNA, 19 bp, Homo sapiens
agccaagacaaggaggtag

SEQ ID NO: 6633887 - DNA, 13 bp, Homo sapiens
agccaagaccaag

SEQ ID NO: 6633888 - DNA, 19 bp, Homo sapiens
agccaagatcgtgccattg

SEQ ID NO: 6633889 - DNA, 20 bp, Homo sapiens
agccaagattttcctcttgt

SEQ ID NO: 6633890 - DNA, 20 bp, Homo sapiens
agccaagcaaaccaatggtg

SEQ ID NO: 6633891 - DNA, 17 bp, Homo sapiens
agccaagccctccgcct

SEQ ID NO: 6633892 - DNA, 14 bp, Homo sapiens
agccaagcctgact

SEQ ID NO: 6633893 - DNA, 12 bp, Homo sapiens
agccaagcctgg

SEQ ID NO: 6633894 - DNA, 21 bp, Homo sapiens
agccaagctagaattccctct

SEQ ID NO: 6633895 - DNA, 17 bp, Homo sapiens
agccaagctccctggag

SEQ ID NO: 6633896 - DNA, 18 bp, Homo sapiens
agccaagctccctggagc

SEQ ID NO: 6633897 - DNA, 20 bp, Homo sapiens
agccaagctccctggagccc

SEQ ID NO: 6633898 - DNA, 22 bp, Homo sapiens
agccaagctccctggagccctg

SEQ ID NO: 6633899 - DNA, 23 bp, Homo sapiens
agccaagctccctggagccctgt

SEQ ID NO: 6633900 - DNA, 16 bp, Homo sapiens
agccaagctctgcagt

SEQ ID NO: 6633901 - DNA, 13 bp, Homo sapiens
agccaagctggca

SEQ ID NO: 6633902 - DNA, 15 bp, Homo sapiens
agccaagctggcaca

SEQ ID NO: 6633903 - DNA, 12 bp, Homo sapiens
agccaagctgtg

SEQ ID NO: 6633904 - DNA, 18 bp, Homo sapiens
agccaagctgtgttcatc

SEQ ID NO: 6633905 - DNA, 19 bp, Homo sapiens
agccaagcttcaaccctca

SEQ ID NO: 6633906 - DNA, 20 bp, Homo sapiens
agccaagcttcaaccctcag

SEQ ID NO: 6633907 - DNA, 20 bp, Homo sapiens
agccaagctttaaattatgt

SEQ ID NO: 6633908 - DNA, 19 bp, Homo sapiens
agccaaggagtcactgaga

SEQ ID NO: 6633909 - DNA, 17 bp, Homo sapiens
agccaaggatagaagct

SEQ ID NO: 6633910 - DNA, 17 bp, Homo sapiens
agccaaggcagagggga

SEQ ID NO: 6633911 - DNA, 15 bp, Homo sapiens
agccaaggcagcgac

SEQ ID NO: 6633912 - DNA, 22 bp, Homo sapiens
agccaaggccaaaggaagcaca

SEQ ID NO: 6633913 - DNA, 12 bp, Homo sapiens
agccaaggccac

SEQ ID NO: 6633914 - DNA, 22 bp, Homo sapiens
agccaaggccgaagctctggct

SEQ ID NO: 6633915 - DNA, 20 bp, Homo sapiens
agccaaggcctatgccacct

SEQ ID NO: 6633916 - DNA, 22 bp, Homo sapiens
agccaaggcctatgccacctgc

SEQ ID NO: 6633917 - DNA, 14 bp, Homo sapiens
agccaagggaaagg

SEQ ID NO: 6633918 - DNA, 16 bp, Homo sapiens
agccaagggaacctgt

SEQ ID NO: 6633919 - DNA, 17 bp, Homo sapiens
agccaagggaacctgtg

SEQ ID NO: 6633920 - DNA, 21 bp, Homo sapiens
agccaagggaacctgtgtccg

SEQ ID NO: 6633921 - DNA, 15 bp, Homo sapiens
agccaagggacacag

SEQ ID NO: 6633922 - DNA, 12 bp, Homo sapiens
agccaagggagg

SEQ ID NO: 6633923 - DNA, 13 bp, Homo sapiens
agccaagggaggg

SEQ ID NO: 6633924 - DNA, 14 bp, Homo sapiens
agccaagggaggga

SEQ ID NO: 6633925 - DNA, 23 bp, Homo sapiens
agccaagggcaacagatcagtaa

SEQ ID NO: 6633926 - DNA, 17 bp, Homo sapiens
agccaaggggatattta

SEQ ID NO: 6633927 - DNA, 17 bp, Homo sapiens
agccaaggggctgcgct

SEQ ID NO: 6633928 - DNA, 22 bp, Homo sapiens
agccaaggggctgcgctagcag

SEQ ID NO: 6633929 - DNA, 20 bp, Homo sapiens
agccaagggggacctcgggc

SEQ ID NO: 6633930 - DNA, 17 bp, Homo sapiens
agccaagggtatccaag

SEQ ID NO: 6633931 - DNA, 22 bp, Homo sapiens
agccaagggttcagagactcag

SEQ ID NO: 6633932 - DNA, 13 bp, Homo sapiens
agccaaggtgcta

SEQ ID NO: 6633933 - DNA, 21 bp, Homo sapiens
agccaaggtgctaaaaggaat

SEQ ID NO: 6633934 - DNA, 22 bp, Homo sapiens
agccaaggtgctaaaaggaata

SEQ ID NO: 6633935 - DNA, 20 bp, Homo sapiens
agccaaggtgggctgagccc

SEQ ID NO: 6633936 - DNA, 23 bp, Homo sapiens
agccaaggtgggctgagccctgg

SEQ ID NO: 6633937 - DNA, 22 bp, Homo sapiens
agccaaggttttataaggctga

SEQ ID NO: 6633938 - DNA, 17 bp, Homo sapiens
agccaagtagcctctcc

SEQ ID NO: 6633939 - DNA, 15 bp, Homo sapiens
agccaagtagctttg

SEQ ID NO: 6633940 - DNA, 23 bp, Homo sapiens
agccaagtcagctttgccttcca

SEQ ID NO: 6633941 - DNA, 13 bp, Homo sapiens
agccaagtccaga

SEQ ID NO: 6633942 - DNA, 18 bp, Homo sapiens
agccaagtccagatttac

SEQ ID NO: 6633943 - DNA, 17 bp, Homo sapiens
agccaagtcctccctct

SEQ ID NO: 6633944 - DNA, 13 bp, Homo sapiens
agccaagtgcagg

SEQ ID NO: 6633945 - DNA, 16 bp, Homo sapiens
agccaagtggtccagc

SEQ ID NO: 6633946 - DNA, 15 bp, Homo sapiens
agccaagtgtctttt

SEQ ID NO: 6633947 - DNA, 12 bp, Homo sapiens
agccaagtgtga

SEQ ID NO: 6633948 - DNA, 14 bp, Homo sapiens
agccaagtgtgacc

SEQ ID NO: 6633949 - DNA, 12 bp, Homo sapiens
agccaatataac

SEQ ID NO: 6633950 - DNA, 20 bp, Homo sapiens
agccaatattaaaagagacc

SEQ ID NO: 6633951 - DNA, 15 bp, Homo sapiens
agccaatcccctcct

SEQ ID NO: 6633952 - DNA, 16 bp, Homo sapiens
agccaatcccctcctt

SEQ ID NO: 6633953 - DNA, 21 bp, Homo sapiens
agccaatcccctccttgggca

SEQ ID NO: 6633954 - DNA, 19 bp, Homo sapiens
agccaatctacaatctctt

SEQ ID NO: 6633955 - DNA, 22 bp, Homo sapiens
agccaatctacaatctcttttt

SEQ ID NO: 6633956 - DNA, 18 bp, Homo sapiens
agccaatgaagcaaacac

SEQ ID NO: 6633957 - DNA, 13 bp, Homo sapiens
agccaatgctgtc

SEQ ID NO: 6633958 - DNA, 19 bp, Homo sapiens
agccaatggtgagggctga

SEQ ID NO: 6633959 - DNA, 23 bp, Homo sapiens
agccaatggtgagggctgagagg

SEQ ID NO: 6633960 - DNA, 20 bp, Homo sapiens
agccaatgtctcctcccctt

SEQ ID NO: 6633961 - DNA, 19 bp, Homo sapiens
agccaattaaaaacatgaa

SEQ ID NO: 6633962 - DNA, 15 bp, Homo sapiens
agccaattatgttaa

SEQ ID NO: 6633963 - DNA, 16 bp, Homo sapiens
agccaattatgttaaa

SEQ ID NO: 6633964 - DNA, 14 bp, Homo sapiens
agccaatttggaaa

SEQ ID NO: 6633965 - DNA, 17 bp, Homo sapiens
agccaatttgtctccta

SEQ ID NO: 6633966 - DNA, 20 bp, Homo sapiens
agccacaaagtagttgtccc

SEQ ID NO: 6633967 - DNA, 12 bp, Homo sapiens
agccacaaatgc

SEQ ID NO: 6633968 - DNA, 17 bp, Homo sapiens
agccacaaccacataca

SEQ ID NO: 6633969 - DNA, 12 bp, Homo sapiens
agccacaagctg

SEQ ID NO: 6633970 - DNA, 15 bp, Homo sapiens
agccacaagctgcac

SEQ ID NO: 6633971 - DNA, 21 bp, Homo sapiens
agccacaagctgcactgtgaa

SEQ ID NO: 6633972 - DNA, 15 bp, Homo sapiens
agccacaaggctggc

SEQ ID NO: 6633973 - DNA, 16 bp, Homo sapiens
agccacaagtcttcca

SEQ ID NO: 6633974 - DNA, 12 bp, Homo sapiens
agccacacacac

SEQ ID NO: 6633975 - DNA, 14 bp, Homo sapiens
agccacacacacag

SEQ ID NO: 6633976 - DNA, 15 bp, Homo sapiens
agccacacacacaga

SEQ ID NO: 6633977 - DNA, 17 bp, Homo sapiens
agccacacacacagaaa

SEQ ID NO: 6633978 - DNA, 12 bp, Homo sapiens
agccacacagag

SEQ ID NO: 6633979 - DNA, 15 bp, Homo sapiens
agccacacagcccag

SEQ ID NO: 6633980 - DNA, 14 bp, Homo sapiens
agccacacagtggc

SEQ ID NO: 6633981 - DNA, 22 bp, Homo sapiens
agccacacagtggccggggctg

SEQ ID NO: 6633982 - DNA, 17 bp, Homo sapiens
agccacaccaggataga

SEQ ID NO: 6633983 - DNA, 24 bp, Homo sapiens
agccacaccaggatagagactgga

SEQ ID NO: 6633984 - DNA, 16 bp, Homo sapiens
agccacaccgctggct

SEQ ID NO: 6633985 - DNA, 21 bp, Homo sapiens
agccacacctggactgaccct

SEQ ID NO: 6633986 - DNA, 22 bp, Homo sapiens
agccacacctggactgaccctg

SEQ ID NO: 6633987 - DNA, 18 bp, Homo sapiens
agccacacgcaggcggcc

SEQ ID NO: 6633988 - DNA, 20 bp, Homo sapiens
agccacacgcaggcggccag

SEQ ID NO: 6633989 - DNA, 22 bp, Homo sapiens
agccacacgcaggcggccaggg

SEQ ID NO: 6633990 - DNA, 18 bp, Homo sapiens
agccacacttctcaggac

SEQ ID NO: 6633991 - DNA, 19 bp, Homo sapiens
agccacacttctcaggaca

SEQ ID NO: 6633992 - DNA, 18 bp, Homo sapiens
agccacagaagccaggag

SEQ ID NO: 6633993 - DNA, 23 bp, Homo sapiens
agccacagaagccaggagcaaat

SEQ ID NO: 6633994 - DNA, 13 bp, Homo sapiens
agccacagaccac

SEQ ID NO: 6633995 - DNA, 16 bp, Homo sapiens
agccacagaccacctg

SEQ ID NO: 6633996 - DNA, 16 bp, Homo sapiens
agccacagacccctgg

SEQ ID NO: 6633997 - DNA, 14 bp, Homo sapiens
agccacagcagagc

SEQ ID NO: 6633998 - DNA, 16 bp, Homo sapiens
agccacagcagagcat

SEQ ID NO: 6633999 - DNA, 16 bp, Homo sapiens
agccacagcagcattt

SEQ ID NO: 6634000 - DNA, 16 bp, Homo sapiens
agccacagcccaggcc

SEQ ID NO: 6634001 - DNA, 21 bp, Homo sapiens
agccacagcccccgggacacc

SEQ ID NO: 6634002 - DNA, 18 bp, Homo sapiens
agccacagcccctgcctg

SEQ ID NO: 6634003 - DNA, 16 bp, Homo sapiens
agccacagcctgtctt

SEQ ID NO: 6634004 - DNA, 18 bp, Homo sapiens
agccacagctgctgttct

SEQ ID NO: 6634005 - DNA, 21 bp, Homo sapiens
agccacagctgctgttctcag

SEQ ID NO: 6634006 - DNA, 18 bp, Homo sapiens
agccacaggaacggccct

SEQ ID NO: 6634007 - DNA, 21 bp, Homo sapiens
agccacaggaacggccctgca

SEQ ID NO: 6634008 - DNA, 23 bp, Homo sapiens
agccacaggaaggaggggagaga

SEQ ID NO: 6634009 - DNA, 11 bp, Homo sapiens
agccacaggac

SEQ ID NO: 6634010 - DNA, 17 bp, Homo sapiens
agccacaggaccacctc

SEQ ID NO: 6634011 - DNA, 13 bp, Homo sapiens
agccacaggactg

SEQ ID NO: 6634012 - DNA, 12 bp, Homo sapiens
agccacaggagc

SEQ ID NO: 6634013 - DNA, 13 bp, Homo sapiens
agccacaggcaga

SEQ ID NO: 6634014 - DNA, 14 bp, Homo sapiens
agccacaggcagac

SEQ ID NO: 6634015 - DNA, 12 bp, Homo sapiens
agccacaggcca

SEQ ID NO: 6634016 - DNA, 12 bp, Homo sapiens
agccacaggcct

SEQ ID NO: 6634017 - DNA, 23 bp, Homo sapiens
agccacaggcctgagatttcatc

SEQ ID NO: 6634018 - DNA, 22 bp, Homo sapiens
agccacagggaagcatgtactg

SEQ ID NO: 6634019 - DNA, 16 bp, Homo sapiens
agccacagggaagctc

SEQ ID NO: 6634020 - DNA, 11 bp, Homo sapiens
agccacagggt

SEQ ID NO: 6634021 - DNA, 21 bp, Homo sapiens
agccacagggtctgcctccag

SEQ ID NO: 6634022 - DNA, 16 bp, Homo sapiens
agccacagtacatatg

SEQ ID NO: 6634023 - DNA, 13 bp, Homo sapiens
agccacagtgggg

SEQ ID NO: 6634024 - DNA, 16 bp, Homo sapiens
agccacagtggggccc

SEQ ID NO: 6634025 - DNA, 20 bp, Homo sapiens
agccacagttcccctatgtg

SEQ ID NO: 6634026 - DNA, 21 bp, Homo sapiens
agccacatagagtgactccaa

SEQ ID NO: 6634027 - DNA, 12 bp, Homo sapiens
agccacatcact

SEQ ID NO: 6634028 - DNA, 15 bp, Homo sapiens
agccacatccccaag

SEQ ID NO: 6634029 - DNA, 18 bp, Homo sapiens
agccacatccccaagccc

SEQ ID NO: 6634030 - DNA, 12 bp, Homo sapiens
agccacatcttg

SEQ ID NO: 6634031 - DNA, 18 bp, Homo sapiens
agccacatcttgctctgc

SEQ ID NO: 6634032 - DNA, 18 bp, Homo sapiens
agccacatgccccaggct

SEQ ID NO: 6634033 - DNA, 15 bp, Homo sapiens
agccacatttacata

SEQ ID NO: 6634034 - DNA, 20 bp, Homo sapiens
agccacatttggaatacttt

SEQ ID NO: 6634035 - DNA, 19 bp, Homo sapiens
agccaccaacatactccca

SEQ ID NO: 6634036 - DNA, 23 bp, Homo sapiens
agccaccaacatactcccatctg

SEQ ID NO: 6634037 - DNA, 16 bp, Homo sapiens
agccaccaagggcctc

SEQ ID NO: 6634038 - DNA, 18 bp, Homo sapiens
agccaccaagggcctcac

SEQ ID NO: 6634039 - DNA, 20 bp, Homo sapiens
agccaccaagggcctcacct

SEQ ID NO: 6634040 - DNA, 15 bp, Homo sapiens
agccaccacacactg

SEQ ID NO: 6634041 - DNA, 15 bp, Homo sapiens
agccaccacacctgg

SEQ ID NO: 6634042 - DNA, 23 bp, Homo sapiens
agccaccaccactgtccctacca

SEQ ID NO: 6634043 - DNA, 18 bp, Homo sapiens
agccaccaccctcaggtg

SEQ ID NO: 6634044 - DNA, 21 bp, Homo sapiens
agccaccaccctcaggtgcct

SEQ ID NO: 6634045 - DNA, 23 bp, Homo sapiens
agccaccacctggatggatctgc

SEQ ID NO: 6634046 - DNA, 13 bp, Homo sapiens
agccaccacgccc

SEQ ID NO: 6634047 - DNA, 14 bp, Homo sapiens
agccaccactcctg

SEQ ID NO: 6634048 - DNA, 13 bp, Homo sapiens
agccaccagcccc

SEQ ID NO: 6634049 - DNA, 13 bp, Homo sapiens
agccaccagtgtc

SEQ ID NO: 6634050 - DNA, 12 bp, Homo sapiens
agccaccagttc

SEQ ID NO: 6634051 - DNA, 23 bp, Homo sapiens
agccaccatgcccagctcagagg

SEQ ID NO: 6634052 - DNA, 23 bp, Homo sapiens
agccacccaagcctgctggctgc

SEQ ID NO: 6634053 - DNA, 13 bp, Homo sapiens
agccacccagcca

SEQ ID NO: 6634054 - DNA, 16 bp, Homo sapiens
agccaccccatgagct

SEQ ID NO: 6634055 - DNA, 16 bp, Homo sapiens
agccaccccatgctgg

SEQ ID NO: 6634056 - DNA, 19 bp, Homo sapiens
agccaccccatgctggcct

SEQ ID NO: 6634057 - DNA, 14 bp, Homo sapiens
agccacccccaggc

SEQ ID NO: 6634058 - DNA, 14 bp, Homo sapiens
agccaccccgggct

SEQ ID NO: 6634059 - DNA, 20 bp, Homo sapiens
agccaccccgggctctctgc

SEQ ID NO: 6634060 - DNA, 23 bp, Homo sapiens
agccaccccgggctctctgctgt

SEQ ID NO: 6634061 - DNA, 13 bp, Homo sapiens
agccacccctcag

SEQ ID NO: 6634062 - DNA, 17 bp, Homo sapiens
agccacccctcagatgc

SEQ ID NO: 6634063 - DNA, 16 bp, Homo sapiens
agccacccctgccact

SEQ ID NO: 6634064 - DNA, 23 bp, Homo sapiens
agccacccggatctccaggccca

SEQ ID NO: 6634065 - DNA, 22 bp, Homo sapiens
agccaccctaactgagctgcca

SEQ ID NO: 6634066 - DNA, 23 bp, Homo sapiens
agccaccctaactgagctgccag

SEQ ID NO: 6634067 - DNA, 22 bp, Homo sapiens
agccaccctcaccgcggctgga

SEQ ID NO: 6634068 - DNA, 13 bp, Homo sapiens
agccaccctgagg

SEQ ID NO: 6634069 - DNA, 14 bp, Homo sapiens
agccaccctgagtt

SEQ ID NO: 6634070 - DNA, 13 bp, Homo sapiens
agccaccctgcca

SEQ ID NO: 6634071 - DNA, 14 bp, Homo sapiens
agccaccctgccat

SEQ ID NO: 6634072 - DNA, 18 bp, Homo sapiens
agccacccttccctgcct

SEQ ID NO: 6634073 - DNA, 22 bp, Homo sapiens
agccacccttggtctcatgccc

SEQ ID NO: 6634074 - DNA, 20 bp, Homo sapiens
agccaccctttctggcacga

SEQ ID NO: 6634075 - DNA, 15 bp, Homo sapiens
agccaccgaagccgc

SEQ ID NO: 6634076 - DNA, 12 bp, Homo sapiens
agccaccgcagc

SEQ ID NO: 6634077 - DNA, 18 bp, Homo sapiens
agccaccgcagctgctgc

SEQ ID NO: 6634078 - DNA, 21 bp, Homo sapiens
agccaccgcagctgctgccac

SEQ ID NO: 6634079 - DNA, 22 bp, Homo sapiens
agccaccgcagctgctgccact

SEQ ID NO: 6634080 - DNA, 22 bp, Homo sapiens
agccaccgcgcccagccaagaa

SEQ ID NO: 6634081 - DNA, 21 bp, Homo sapiens
agccaccgtctacagatggct

SEQ ID NO: 6634082 - DNA, 16 bp, Homo sapiens
agccaccgtgcctggc

SEQ ID NO: 6634083 - DNA, 22 bp, Homo sapiens
agccaccgtgcctggccagatt

SEQ ID NO: 6634084 - DNA, 18 bp, Homo sapiens
agccacctcatccccaac

SEQ ID NO: 6634085 - DNA, 17 bp, Homo sapiens
agccacctccaccccca

SEQ ID NO: 6634086 - DNA, 11 bp, Homo sapiens
agccacctccc

SEQ ID NO: 6634087 - DNA, 17 bp, Homo sapiens
agccacctcccaaggac

SEQ ID NO: 6634088 - DNA, 14 bp, Homo sapiens
agccacctcccacc

SEQ ID NO: 6634089 - DNA, 16 bp, Homo sapiens
agccacctcccacccc

SEQ ID NO: 6634090 - DNA, 20 bp, Homo sapiens
agccacctcccaccccactc

SEQ ID NO: 6634091 - DNA, 15 bp, Homo sapiens
agccacctccgccag

SEQ ID NO: 6634092 - DNA, 16 bp, Homo sapiens
agccacctccttggca

SEQ ID NO: 6634093 - DNA, 15 bp, Homo sapiens
agccacctctccctc

SEQ ID NO: 6634094 - DNA, 16 bp, Homo sapiens
agccacctctccctca

SEQ ID NO: 6634095 - DNA, 16 bp, Homo sapiens
agccacctctgtcatt

SEQ ID NO: 6634096 - DNA, 12 bp, Homo sapiens
agccacctcttg

SEQ ID NO: 6634097 - DNA, 16 bp, Homo sapiens
agccacctgagttcct

SEQ ID NO: 6634098 - DNA, 19 bp, Homo sapiens
agccacctgagttcctgag

SEQ ID NO: 6634099 - DNA, 14 bp, Homo sapiens
agccacctgcaaga

SEQ ID NO: 6634100 - DNA, 23 bp, Homo sapiens
agccacctgctgcgggggagcca

SEQ ID NO: 6634101 - DNA, 22 bp, Homo sapiens
agccacctgggctgggagaagg

SEQ ID NO: 6634102 - DNA, 13 bp, Homo sapiens
agccacctgtccc

SEQ ID NO: 6634103 - DNA, 14 bp, Homo sapiens
agccacctgtccca

SEQ ID NO: 6634104 - DNA, 15 bp, Homo sapiens
agccacctgtcccac

SEQ ID NO: 6634105 - DNA, 20 bp, Homo sapiens
agccaccttcctgactggga

SEQ ID NO: 6634106 - DNA, 22 bp, Homo sapiens
agccaccttcctgactgggaag

SEQ ID NO: 6634107 - DNA, 15 bp, Homo sapiens
agccaccttgttaca

SEQ ID NO: 6634108 - DNA, 16 bp, Homo sapiens
agccacgaccagcccc

SEQ ID NO: 6634109 - DNA, 19 bp, Homo sapiens
agccacgaccagccccttc

SEQ ID NO: 6634110 - DNA, 20 bp, Homo sapiens
agccacgaccagccccttcc

SEQ ID NO: 6634111 - DNA, 14 bp, Homo sapiens
agccacgactgcca

SEQ ID NO: 6634112 - DNA, 14 bp, Homo sapiens
agccacgaggtggt

SEQ ID NO: 6634113 - DNA, 16 bp, Homo sapiens
agccacgattggagaa

SEQ ID NO: 6634114 - DNA, 23 bp, Homo sapiens
agccacgcagggccatccactgt

SEQ ID NO: 6634115 - DNA, 17 bp, Homo sapiens
agccacgcagtgcctgg

SEQ ID NO: 6634116 - DNA, 18 bp, Homo sapiens
agccacgcagtgcctgga

SEQ ID NO: 6634117 - DNA, 22 bp, Homo sapiens
agccacgccctccctgctagca

SEQ ID NO: 6634118 - DNA, 15 bp, Homo sapiens
agccacgcctctctc

SEQ ID NO: 6634119 - DNA, 16 bp, Homo sapiens
agccacgcctctctca

SEQ ID NO: 6634120 - DNA, 15 bp, Homo sapiens
agccacgctggcctt

SEQ ID NO: 6634121 - DNA, 17 bp, Homo sapiens
agccacgctggccttcg

SEQ ID NO: 6634122 - DNA, 18 bp, Homo sapiens
agccacgctgtcctctcg

SEQ ID NO: 6634123 - DNA, 14 bp, Homo sapiens
agccacggaaacat

SEQ ID NO: 6634124 - DNA, 13 bp, Homo sapiens
agccacggaggga

SEQ ID NO: 6634125 - DNA, 18 bp, Homo sapiens
agccacggagggaggcac

SEQ ID NO: 6634126 - DNA, 20 bp, Homo sapiens
agccacggagggaggcacca

SEQ ID NO: 6634127 - DNA, 21 bp, Homo sapiens
agccacggagggaggcaccat

SEQ ID NO: 6634128 - DNA, 14 bp, Homo sapiens
agccacgtgaatgg

SEQ ID NO: 6634129 - DNA, 16 bp, Homo sapiens
agccacgtgctggaga

SEQ ID NO: 6634130 - DNA, 20 bp, Homo sapiens
agccacgttccttactgcag

SEQ ID NO: 6634131 - DNA, 21 bp, Homo sapiens
agccacgttccttactgcaga

SEQ ID NO: 6634132 - DNA, 23 bp, Homo sapiens
agccacgttccttactgcagaat

SEQ ID NO: 6634133 - DNA, 18 bp, Homo sapiens
agccacgttgcagaaaaa

SEQ ID NO: 6634134 - DNA, 15 bp, Homo sapiens
agccacgttggtggt

SEQ ID NO: 6634135 - DNA, 20 bp, Homo sapiens
agccacgttggtggtattgg

SEQ ID NO: 6634136 - DNA, 17 bp, Homo sapiens
agccactaccttctgac

SEQ ID NO: 6634137 - DNA, 14 bp, Homo sapiens
agccactagactct

SEQ ID NO: 6634138 - DNA, 19 bp, Homo sapiens
agccactagcccactcccc

SEQ ID NO: 6634139 - DNA, 16 bp, Homo sapiens
agccactatgtccagc

SEQ ID NO: 6634140 - DNA, 15 bp, Homo sapiens
agccactccaagccc

SEQ ID NO: 6634141 - DNA, 21 bp, Homo sapiens
agccactccaagccccctggc

SEQ ID NO: 6634142 - DNA, 22 bp, Homo sapiens
agccactccaagccccctggca

SEQ ID NO: 6634143 - DNA, 14 bp, Homo sapiens
agccactccccagc

SEQ ID NO: 6634144 - DNA, 14 bp, Homo sapiens
agccactcccctcc

SEQ ID NO: 6634145 - DNA, 15 bp, Homo sapiens
agccactcccctcca

SEQ ID NO: 6634146 - DNA, 16 bp, Homo sapiens
agccactccctcccag

SEQ ID NO: 6634147 - DNA, 14 bp, Homo sapiens
agccactcctctga

SEQ ID NO: 6634148 - DNA, 16 bp, Homo sapiens
agccactcctgtcccg

SEQ ID NO: 6634149 - DNA, 17 bp, Homo sapiens
agccactcctgtcccgc

SEQ ID NO: 6634150 - DNA, 23 bp, Homo sapiens
agccactcgcagtcgcaggatcc

SEQ ID NO: 6634151 - DNA, 15 bp, Homo sapiens
agccactcgggaggc

SEQ ID NO: 6634152 - DNA, 22 bp, Homo sapiens
agccactctaccagtgcaggct

SEQ ID NO: 6634153 - DNA, 21 bp, Homo sapiens
agccactctatgagttggact

SEQ ID NO: 6634154 - DNA, 14 bp, Homo sapiens
agccactctctgcc

SEQ ID NO: 6634155 - DNA, 20 bp, Homo sapiens
agccactctcttccctttcc

SEQ ID NO: 6634156 - DNA, 15 bp, Homo sapiens
agccactctgttcct

SEQ ID NO: 6634157 - DNA, 16 bp, Homo sapiens
agccactgaagctggg

SEQ ID NO: 6634158 - DNA, 15 bp, Homo sapiens
agccactgagcaatg

SEQ ID NO: 6634159 - DNA, 16 bp, Homo sapiens
agccactgagcctggc

SEQ ID NO: 6634160 - DNA, 18 bp, Homo sapiens
agccactgatggtgacag

SEQ ID NO: 6634161 - DNA, 19 bp, Homo sapiens
agccactgcaccgggccac

SEQ ID NO: 6634162 - DNA, 22 bp, Homo sapiens
agccactgcaccgggccacaga

SEQ ID NO: 6634163 - DNA, 12 bp, Homo sapiens
agccactgcagc

SEQ ID NO: 6634164 - DNA, 17 bp, Homo sapiens
agccactgcagcacagg

SEQ ID NO: 6634165 - DNA, 16 bp, Homo sapiens
agccactgccactcca

SEQ ID NO: 6634166 - DNA, 12 bp, Homo sapiens
agccactgccat

SEQ ID NO: 6634167 - DNA, 14 bp, Homo sapiens
agccactgcctctc

SEQ ID NO: 6634168 - DNA, 20 bp, Homo sapiens
agccactgcctctccctctg

SEQ ID NO: 6634169 - DNA, 20 bp, Homo sapiens
agccactgcgcccggcccaa

SEQ ID NO: 6634170 - DNA, 15 bp, Homo sapiens
agccactggaaggag

SEQ ID NO: 6634171 - DNA, 17 bp, Homo sapiens
agccactggaaggagca

SEQ ID NO: 6634172 - DNA, 12 bp, Homo sapiens
agccactggagg

SEQ ID NO: 6634173 - DNA, 13 bp, Homo sapiens
agccactggaggg

SEQ ID NO: 6634174 - DNA, 20 bp, Homo sapiens
agccactggctgctaacaag

SEQ ID NO: 6634175 - DNA, 21 bp, Homo sapiens
agccactgggacccgaggatt

SEQ ID NO: 6634176 - DNA, 13 bp, Homo sapiens
agccactgggagg

SEQ ID NO: 6634177 - DNA, 13 bp, Homo sapiens
agccactgggccc

SEQ ID NO: 6634178 - DNA, 13 bp, Homo sapiens
agccactgtcaca

SEQ ID NO: 6634179 - DNA, 14 bp, Homo sapiens
agccactgtcacag

SEQ ID NO: 6634180 - DNA, 18 bp, Homo sapiens
agccactgtcacaggcat

SEQ ID NO: 6634181 - DNA, 22 bp, Homo sapiens
agccactgtgcccagcagtttc

SEQ ID NO: 6634182 - DNA, 14 bp, Homo sapiens
agccactgtgctga

SEQ ID NO: 6634183 - DNA, 18 bp, Homo sapiens
agccactgtgctgaattc

SEQ ID NO: 6634184 - DNA, 17 bp, Homo sapiens
agccacttaccttcaat

SEQ ID NO: 6634185 - DNA, 23 bp, Homo sapiens
agccacttaccttcaataaagta

SEQ ID NO: 6634186 - DNA, 17 bp, Homo sapiens
agccacttcggccaggt

SEQ ID NO: 6634187 - DNA, 22 bp, Homo sapiens
agccacttcggccaggtcacac

SEQ ID NO: 6634188 - DNA, 15 bp, Homo sapiens
agccacttctcccca

SEQ ID NO: 6634189 - DNA, 20 bp, Homo sapiens
agccacttctggcttcagcc

SEQ ID NO: 6634190 - DNA, 15 bp, Homo sapiens
agccacttgcctgtg

SEQ ID NO: 6634191 - DNA, 16 bp, Homo sapiens
agccacttggcccaga

SEQ ID NO: 6634192 - DNA, 23 bp, Homo sapiens
agccactttcaatcttcaatcct

SEQ ID NO: 6634193 - DNA, 11 bp, Homo sapiens
agccagaaagg

SEQ ID NO: 6634194 - DNA, 23 bp, Homo sapiens
agccagaaataaagttggtgaca

SEQ ID NO: 6634195 - DNA, 14 bp, Homo sapiens
agccagaacctgga

SEQ ID NO: 6634196 - DNA, 20 bp, Homo sapiens
agccagaacgtggctctgct

SEQ ID NO: 6634197 - DNA, 18 bp, Homo sapiens
agccagaactctgtgtcc

SEQ ID NO: 6634198 - DNA, 18 bp, Homo sapiens
agccagaatcagcacaga

SEQ ID NO: 6634199 - DNA, 13 bp, Homo sapiens
agccagacacatg

SEQ ID NO: 6634200 - DNA, 20 bp, Homo sapiens
agccagacactctgctctgc

SEQ ID NO: 6634201 - DNA, 22 bp, Homo sapiens
agccagacactctgctctgccc

SEQ ID NO: 6634202 - DNA, 12 bp, Homo sapiens
agccagacagac

SEQ ID NO: 6634203 - DNA, 14 bp, Homo sapiens
agccagacagttta

SEQ ID NO: 6634204 - DNA, 15 bp, Homo sapiens
agccagaccagcagg

SEQ ID NO: 6634205 - DNA, 21 bp, Homo sapiens
agccagaccccacgctgacca

SEQ ID NO: 6634206 - DNA, 19 bp, Homo sapiens
agccagacctagcaggctg

SEQ ID NO: 6634207 - DNA, 18 bp, Homo sapiens
agccagacctattcctcc

SEQ ID NO: 6634208 - DNA, 14 bp, Homo sapiens
agccagactggcac

SEQ ID NO: 6634209 - DNA, 14 bp, Homo sapiens
agccagactgtcca

SEQ ID NO: 6634210 - DNA, 22 bp, Homo sapiens
agccagactgtccagggaaaca

SEQ ID NO: 6634211 - DNA, 23 bp, Homo sapiens
agccagactgtccagggaaacag

SEQ ID NO: 6634212 - DNA, 11 bp, Homo sapiens
agccagacttg

SEQ ID NO: 6634213 - DNA, 21 bp, Homo sapiens
agccagagaagtgacagggaa

SEQ ID NO: 6634214 - DNA, 17 bp, Homo sapiens
agccagagacagaggat

SEQ ID NO: 6634215 - DNA, 15 bp, Homo sapiens
agccagagagaacaa

SEQ ID NO: 6634216 - DNA, 17 bp, Homo sapiens
agccagagaggagcacc

SEQ ID NO: 6634217 - DNA, 20 bp, Homo sapiens
agccagagccccaagcagga

SEQ ID NO: 6634218 - DNA, 15 bp, Homo sapiens
agccagagcccttca

SEQ ID NO: 6634219 - DNA, 19 bp, Homo sapiens
agccagagcccttcactgc

SEQ ID NO: 6634220 - DNA, 14 bp, Homo sapiens
agccagagcctctg

SEQ ID NO: 6634221 - DNA, 15 bp, Homo sapiens
agccagagcctgggg

SEQ ID NO: 6634222 - DNA, 12 bp, Homo sapiens
agccagagctgg

SEQ ID NO: 6634223 - DNA, 17 bp, Homo sapiens
agccagagctgtgcctg

SEQ ID NO: 6634224 - DNA, 20 bp, Homo sapiens
agccagagctgtgcctgctc

SEQ ID NO: 6634225 - DNA, 22 bp, Homo sapiens
agccagagctgtgcctgctcag

SEQ ID NO: 6634226 - DNA, 24 bp, Homo sapiens
agccagagctgtgcctgctcagca

SEQ ID NO: 6634227 - DNA, 12 bp, Homo sapiens
agccagaggaac

SEQ ID NO: 6634228 - DNA, 20 bp, Homo sapiens
agccagaggagagaggaccc

SEQ ID NO: 6634229 - DNA, 16 bp, Homo sapiens
agccagaggagggcag

SEQ ID NO: 6634230 - DNA, 21 bp, Homo sapiens
agccagaggagggcagaggga

SEQ ID NO: 6634231 - DNA, 13 bp, Homo sapiens
agccagaggccag

SEQ ID NO: 6634232 - DNA, 15 bp, Homo sapiens
agccagaggctgggt

SEQ ID NO: 6634233 - DNA, 16 bp, Homo sapiens
agccagagggagctgt

SEQ ID NO: 6634234 - DNA, 14 bp, Homo sapiens
agccagagggtggg

SEQ ID NO: 6634235 - DNA, 13 bp, Homo sapiens
agccagaggtctg

SEQ ID NO: 6634236 - DNA, 11 bp, Homo sapiens
agccagagtca

SEQ ID NO: 6634237 - DNA, 13 bp, Homo sapiens
agccagagtcaac

SEQ ID NO: 6634238 - DNA, 16 bp, Homo sapiens
agccagagtcaacaaa

SEQ ID NO: 6634239 - DNA, 22 bp, Homo sapiens
agccagagtcaacaaattaaat

SEQ ID NO: 6634240 - DNA, 23 bp, Homo sapiens
agccagagtggccacggcccagg

SEQ ID NO: 6634241 - DNA, 15 bp, Homo sapiens
agccagagttcctgc

SEQ ID NO: 6634242 - DNA, 21 bp, Homo sapiens
agccagagttgttctcagggg

SEQ ID NO: 6634243 - DNA, 22 bp, Homo sapiens
agccagagttgttctcaggggt

SEQ ID NO: 6634244 - DNA, 13 bp, Homo sapiens
agccagatccacc

SEQ ID NO: 6634245 - DNA, 17 bp, Homo sapiens
agccagatccccagggc

SEQ ID NO: 6634246 - DNA, 15 bp, Homo sapiens
agccagatcctcttg

SEQ ID NO: 6634247 - DNA, 16 bp, Homo sapiens
agccagatcctcttgg

SEQ ID NO: 6634248 - DNA, 17 bp, Homo sapiens
agccagatcctcttggt

SEQ ID NO: 6634249 - DNA, 17 bp, Homo sapiens
agccagatgacagggag

SEQ ID NO: 6634250 - DNA, 18 bp, Homo sapiens
agccagatgacagggagc

SEQ ID NO: 6634251 - DNA, 17 bp, Homo sapiens
agccagatgcaggacag

SEQ ID NO: 6634252 - DNA, 18 bp, Homo sapiens
agccagatgcaggacagg

SEQ ID NO: 6634253 - DNA, 22 bp, Homo sapiens
agccagatggactccagcctgc

SEQ ID NO: 6634254 - DNA, 21 bp, Homo sapiens
agccagattggccaattaaaa

SEQ ID NO: 6634255 - DNA, 17 bp, Homo sapiens
agccagatttcactctc

SEQ ID NO: 6634256 - DNA, 20 bp, Homo sapiens
agccagatttcactctcctt

SEQ ID NO: 6634257 - DNA, 15 bp, Homo sapiens
agccagattttcctg

SEQ ID NO: 6634258 - DNA, 22 bp, Homo sapiens
agccagattttttaaaatttat

SEQ ID NO: 6634259 - DNA, 23 bp, Homo sapiens
agccagattttttaaaatttata

SEQ ID NO: 6634260 - DNA, 14 bp, Homo sapiens
agccagcaaagcct

SEQ ID NO: 6634261 - DNA, 20 bp, Homo sapiens
agccagcaaagcctccagca

SEQ ID NO: 6634262 - DNA, 15 bp, Homo sapiens
agccagcaagtaagc

SEQ ID NO: 6634263 - DNA, 22 bp, Homo sapiens
agccagcaatgatgtccagaag

SEQ ID NO: 6634264 - DNA, 13 bp, Homo sapiens
agccagcacacag

SEQ ID NO: 6634265 - DNA, 15 bp, Homo sapiens
agccagcacacaggg

SEQ ID NO: 6634266 - DNA, 20 bp, Homo sapiens
agccagcaccggaccagcct

SEQ ID NO: 6634267 - DNA, 22 bp, Homo sapiens
agccagcaccggaccagcctgg

SEQ ID NO: 6634268 - DNA, 23 bp, Homo sapiens
agccagcaccggaccagcctggc

SEQ ID NO: 6634269 - DNA, 15 bp, Homo sapiens
agccagcacctggca

SEQ ID NO: 6634270 - DNA, 23 bp, Homo sapiens
agccagcacctggcatcgcacca

SEQ ID NO: 6634271 - DNA, 18 bp, Homo sapiens
agccagcacctgtaagaa

SEQ ID NO: 6634272 - DNA, 14 bp, Homo sapiens
agccagcagacatt

SEQ ID NO: 6634273 - DNA, 15 bp, Homo sapiens
agccagcagacattg

SEQ ID NO: 6634274 - DNA, 17 bp, Homo sapiens
agccagcagacattgtc

SEQ ID NO: 6634275 - DNA, 11 bp, Homo sapiens
agccagcagcc

SEQ ID NO: 6634276 - DNA, 20 bp, Homo sapiens
agccagcagccagctctcag

SEQ ID NO: 6634277 - DNA, 22 bp, Homo sapiens
agccagcaggctctcaggccag

SEQ ID NO: 6634278 - DNA, 21 bp, Homo sapiens
agccagcagggcgggccagga

SEQ ID NO: 6634279 - DNA, 22 bp, Homo sapiens
agccagcagggcgggccaggag

SEQ ID NO: 6634280 - DNA, 24 bp, Homo sapiens
agccagcagggcgggccaggagaa

SEQ ID NO: 6634281 - DNA, 13 bp, Homo sapiens
agccagcagggct

SEQ ID NO: 6634282 - DNA, 17 bp, Homo sapiens
agccagcagttcagagc

SEQ ID NO: 6634283 - DNA, 20 bp, Homo sapiens
agccagcagttcagagctgc

SEQ ID NO: 6634284 - DNA, 21 bp, Homo sapiens
agccagcagttcagagctgcc

SEQ ID NO: 6634285 - DNA, 14 bp, Homo sapiens
agccagcatcggaa

SEQ ID NO: 6634286 - DNA, 12 bp, Homo sapiens
agccagcatctg

SEQ ID NO: 6634287 - DNA, 17 bp, Homo sapiens
agccagcatctgggcct

SEQ ID NO: 6634288 - DNA, 17 bp, Homo sapiens
agccagcattcagcaca

SEQ ID NO: 6634289 - DNA, 21 bp, Homo sapiens
agccagcatttcctcagtctc

SEQ ID NO: 6634290 - DNA, 9 bp, Homo sapiens
agccagcca

SEQ ID NO: 6634291 - DNA, 20 bp, Homo sapiens
agccagccaagctttaaatt

SEQ ID NO: 6634292 - DNA, 22 bp, Homo sapiens
agccagccacagacccctggga

SEQ ID NO: 6634293 - DNA, 15 bp, Homo sapiens
agccagccacccctg

SEQ ID NO: 6634294 - DNA, 21 bp, Homo sapiens
agccagccacccctgccactc

SEQ ID NO: 6634295 - DNA, 12 bp, Homo sapiens
agccagccactc

SEQ ID NO: 6634296 - DNA, 13 bp, Homo sapiens
agccagccactct

SEQ ID NO: 6634297 - DNA, 16 bp, Homo sapiens
agccagccactctacc

SEQ ID NO: 6634298 - DNA, 21 bp, Homo sapiens
agccagccaggaactggctcc

SEQ ID NO: 6634299 - DNA, 13 bp, Homo sapiens
agccagccaggac

SEQ ID NO: 6634300 - DNA, 14 bp, Homo sapiens
agccagcccagccc

SEQ ID NO: 6634301 - DNA, 16 bp, Homo sapiens
agccagcccagcccag

SEQ ID NO: 6634302 - DNA, 13 bp, Homo sapiens
agccagcccagct

SEQ ID NO: 6634303 - DNA, 20 bp, Homo sapiens
agccagcccatggcccccaa

SEQ ID NO: 6634304 - DNA, 14 bp, Homo sapiens
agccagccccctcc

SEQ ID NO: 6634305 - DNA, 16 bp, Homo sapiens
agccagccccctccag

SEQ ID NO: 6634306 - DNA, 19 bp, Homo sapiens
agccagccccctccagctc

SEQ ID NO: 6634307 - DNA, 12 bp, Homo sapiens
agccagccctcc

SEQ ID NO: 6634308 - DNA, 23 bp, Homo sapiens
agccagccctccctgtcctcctc

SEQ ID NO: 6634309 - DNA, 13 bp, Homo sapiens
agccagccctgcc

SEQ ID NO: 6634310 - DNA, 18 bp, Homo sapiens
agccagccctgcctggag

SEQ ID NO: 6634311 - DNA, 20 bp, Homo sapiens
agccagccctgcctggagga

SEQ ID NO: 6634312 - DNA, 12 bp, Homo sapiens
agccagccctgg

SEQ ID NO: 6634313 - DNA, 14 bp, Homo sapiens
agccagccctggag

SEQ ID NO: 6634314 - DNA, 17 bp, Homo sapiens
agccagccctggaggct

SEQ ID NO: 6634315 - DNA, 23 bp, Homo sapiens
agccagccctggaggctggatgg

SEQ ID NO: 6634316 - DNA, 14 bp, Homo sapiens
agccagccctggcc

SEQ ID NO: 6634317 - DNA, 17 bp, Homo sapiens
agccagccctggcccac

SEQ ID NO: 6634318 - DNA, 18 bp, Homo sapiens
agccagccctggcccacc

SEQ ID NO: 6634319 - DNA, 14 bp, Homo sapiens
agccagccctggct

SEQ ID NO: 6634320 - DNA, 18 bp, Homo sapiens
agccagcccttcccaggc

SEQ ID NO: 6634321 - DNA, 21 bp, Homo sapiens
agccagcccttcccaggccag

SEQ ID NO: 6634322 - DNA, 22 bp, Homo sapiens
agccagcccttcccaggccagc

SEQ ID NO: 6634323 - DNA, 19 bp, Homo sapiens
agccagccgagcaggaggc

SEQ ID NO: 6634324 - DNA, 16 bp, Homo sapiens
agccagccgccctggg

SEQ ID NO: 6634325 - DNA, 16 bp, Homo sapiens
agccagcctcagaagg

SEQ ID NO: 6634326 - DNA, 13 bp, Homo sapiens
agccagcctgctt

SEQ ID NO: 6634327 - DNA, 19 bp, Homo sapiens
agccagcctgcttcccaca

SEQ ID NO: 6634328 - DNA, 15 bp, Homo sapiens
agccagcctggctgg

SEQ ID NO: 6634329 - DNA, 22 bp, Homo sapiens
agccagcctggctgggactggg

SEQ ID NO: 6634330 - DNA, 12 bp, Homo sapiens
agccagcctggg

SEQ ID NO: 6634331 - DNA, 14 bp, Homo sapiens
agccagcctgggac

SEQ ID NO: 6634332 - DNA, 16 bp, Homo sapiens
agccagcctgggactc

SEQ ID NO: 6634333 - DNA, 20 bp, Homo sapiens
agccagcctgggactcccag

SEQ ID NO: 6634334 - DNA, 11 bp, Homo sapiens
agccagccttg

SEQ ID NO: 6634335 - DNA, 15 bp, Homo sapiens
agccagcgcctccct

SEQ ID NO: 6634336 - DNA, 16 bp, Homo sapiens
agccagcgcctccctc

SEQ ID NO: 6634337 - DNA, 19 bp, Homo sapiens
agccagcgcctccctccac

SEQ ID NO: 6634338 - DNA, 16 bp, Homo sapiens
agccagcgtcctcctc

SEQ ID NO: 6634339 - DNA, 22 bp, Homo sapiens
agccagctacaggcttgagctt

SEQ ID NO: 6634340 - DNA, 17 bp, Homo sapiens
agccagctccctctatt

SEQ ID NO: 6634341 - DNA, 22 bp, Homo sapiens
agccagctccctctatttatgt

SEQ ID NO: 6634342 - DNA, 14 bp, Homo sapiens
agccagctccctga

SEQ ID NO: 6634343 - DNA, 17 bp, Homo sapiens
agccagctcctgggcag

SEQ ID NO: 6634344 - DNA, 15 bp, Homo sapiens
agccagctcctttcc

SEQ ID NO: 6634345 - DNA, 20 bp, Homo sapiens
agccagctcctttccctttt

SEQ ID NO: 6634346 - DNA, 14 bp, Homo sapiens
agccagctctgagc

SEQ ID NO: 6634347 - DNA, 16 bp, Homo sapiens
agccagctctgcatta

SEQ ID NO: 6634348 - DNA, 12 bp, Homo sapiens
agccagctgcag

SEQ ID NO: 6634349 - DNA, 13 bp, Homo sapiens
agccagctgcaga

SEQ ID NO: 6634350 - DNA, 15 bp, Homo sapiens
agccagctgcagggc

SEQ ID NO: 6634351 - DNA, 18 bp, Homo sapiens
agccagctgcagggcacg

SEQ ID NO: 6634352 - DNA, 14 bp, Homo sapiens
agccagctgccccc

SEQ ID NO: 6634353 - DNA, 19 bp, Homo sapiens
agccagctgcccccagagc

SEQ ID NO: 6634354 - DNA, 20 bp, Homo sapiens
agccagctgccgaccagagc

SEQ ID NO: 6634355 - DNA, 12 bp, Homo sapiens
agccagctgcct

SEQ ID NO: 6634356 - DNA, 12 bp, Homo sapiens
agccagctgctt

SEQ ID NO: 6634357 - DNA, 14 bp, Homo sapiens
agccagctgctttt

SEQ ID NO: 6634358 - DNA, 22 bp, Homo sapiens
agccagctgtgttcacactgta

SEQ ID NO: 6634359 - DNA, 14 bp, Homo sapiens
agccagcttaaacc

SEQ ID NO: 6634360 - DNA, 18 bp, Homo sapiens
agccagcttcctgtgcag

SEQ ID NO: 6634361 - DNA, 18 bp, Homo sapiens
agccaggaaaccctcttc

SEQ ID NO: 6634362 - DNA, 21 bp, Homo sapiens
agccaggaacagggaccagct

SEQ ID NO: 6634363 - DNA, 21 bp, Homo sapiens
agccaggaagatcccccagaa

SEQ ID NO: 6634364 - DNA, 20 bp, Homo sapiens
agccaggaagccccgctcag

SEQ ID NO: 6634365 - DNA, 17 bp, Homo sapiens
agccaggaatttcccag

SEQ ID NO: 6634366 - DNA, 23 bp, Homo sapiens
agccaggaatttcccaggaccct

SEQ ID NO: 6634367 - DNA, 15 bp, Homo sapiens
agccaggacagtcag

SEQ ID NO: 6634368 - DNA, 18 bp, Homo sapiens
agccaggacccgcctgct

SEQ ID NO: 6634369 - DNA, 15 bp, Homo sapiens
agccaggactcccag

SEQ ID NO: 6634370 - DNA, 20 bp, Homo sapiens
agccaggagaagacccctgc

SEQ ID NO: 6634371 - DNA, 22 bp, Homo sapiens
agccaggagaagacccctgccc

SEQ ID NO: 6634372 - DNA, 15 bp, Homo sapiens
agccaggagaagctc

SEQ ID NO: 6634373 - DNA, 17 bp, Homo sapiens
agccaggagaaggtcag

SEQ ID NO: 6634374 - DNA, 23 bp, Homo sapiens
agccaggagagcttagggtctca

SEQ ID NO: 6634375 - DNA, 23 bp, Homo sapiens
agccaggagcaaatgtttctgca

SEQ ID NO: 6634376 - DNA, 16 bp, Homo sapiens
agccaggagcagccct

SEQ ID NO: 6634377 - DNA, 22 bp, Homo sapiens
agccaggagcagccctggcccc

SEQ ID NO: 6634378 - DNA, 14 bp, Homo sapiens
agccaggagctgtc

SEQ ID NO: 6634379 - DNA, 24 bp, Homo sapiens
agccaggaggctttaagctccagc

SEQ ID NO: 6634380 - DNA, 13 bp, Homo sapiens
agccaggagggac

SEQ ID NO: 6634381 - DNA, 16 bp, Homo sapiens
agccaggagggacctg

SEQ ID NO: 6634382 - DNA, 17 bp, Homo sapiens
agccaggagggacctgc

SEQ ID NO: 6634383 - DNA, 16 bp, Homo sapiens
agccaggagtctgtgc

SEQ ID NO: 6634384 - DNA, 17 bp, Homo sapiens
agccaggagtctgtgct

SEQ ID NO: 6634385 - DNA, 18 bp, Homo sapiens
agccaggagtgcccccgg

SEQ ID NO: 6634386 - DNA, 14 bp, Homo sapiens
agccaggatcatgg

SEQ ID NO: 6634387 - DNA, 18 bp, Homo sapiens
agccaggatcatggtgta

SEQ ID NO: 6634388 - DNA, 20 bp, Homo sapiens
agccaggatcatggtgtaat

SEQ ID NO: 6634389 - DNA, 14 bp, Homo sapiens
agccaggcaagaaa

SEQ ID NO: 6634390 - DNA, 17 bp, Homo sapiens
agccaggcaagaaagct

SEQ ID NO: 6634391 - DNA, 18 bp, Homo sapiens
agccaggcacacactgtg

SEQ ID NO: 6634392 - DNA, 20 bp, Homo sapiens
agccaggcacacactgtgct

SEQ ID NO: 6634393 - DNA, 23 bp, Homo sapiens
agccaggcacacactgtgctttc

SEQ ID NO: 6634394 - DNA, 23 bp, Homo sapiens
agccaggcagaggttttaatgtc

SEQ ID NO: 6634395 - DNA, 21 bp, Homo sapiens
agccaggccacaagacccttg

SEQ ID NO: 6634396 - DNA, 22 bp, Homo sapiens
agccaggccacaagacccttgt

SEQ ID NO: 6634397 - DNA, 15 bp, Homo sapiens
agccaggcccaggcc

SEQ ID NO: 6634398 - DNA, 16 bp, Homo sapiens
agccaggcccaggcca

SEQ ID NO: 6634399 - DNA, 19 bp, Homo sapiens
agccaggcccaggccagcc

SEQ ID NO: 6634400 - DNA, 20 bp, Homo sapiens
agccaggcccaggccagccc

SEQ ID NO: 6634401 - DNA, 15 bp, Homo sapiens
agccaggccccaccc

SEQ ID NO: 6634402 - DNA, 19 bp, Homo sapiens
agccaggccccaccccttc

SEQ ID NO: 6634403 - DNA, 19 bp, Homo sapiens
agccaggccctctctgcag

SEQ ID NO: 6634404 - DNA, 20 bp, Homo sapiens
agccaggccctctctgcagt

SEQ ID NO: 6634405 - DNA, 21 bp, Homo sapiens
agccaggccctctctgcagtc

SEQ ID NO: 6634406 - DNA, 16 bp, Homo sapiens
agccaggcctcgcctg

SEQ ID NO: 6634407 - DNA, 23 bp, Homo sapiens
agccaggcctcgcctgccctcct

SEQ ID NO: 6634408 - DNA, 13 bp, Homo sapiens
agccaggcctggc

SEQ ID NO: 6634409 - DNA, 21 bp, Homo sapiens
agccaggcctggctggaggag

SEQ ID NO: 6634410 - DNA, 20 bp, Homo sapiens
agccaggctatggttgccac

SEQ ID NO: 6634411 - DNA, 22 bp, Homo sapiens
agccaggctcaggagaagccag

SEQ ID NO: 6634412 - DNA, 15 bp, Homo sapiens
agccaggctcaggcc

SEQ ID NO: 6634413 - DNA, 12 bp, Homo sapiens
agccaggctctg

SEQ ID NO: 6634414 - DNA, 13 bp, Homo sapiens
agccaggctctgc

SEQ ID NO: 6634415 - DNA, 21 bp, Homo sapiens
agccaggctctgtgctgaccc

SEQ ID NO: 6634416 - DNA, 21 bp, Homo sapiens
agccaggctgctaacctggaa

SEQ ID NO: 6634417 - DNA, 22 bp, Homo sapiens
agccaggctgggccgcaagggc

SEQ ID NO: 6634418 - DNA, 18 bp, Homo sapiens
agccaggcttggatggaa

SEQ ID NO: 6634419 - DNA, 14 bp, Homo sapiens
agccaggcttttct

SEQ ID NO: 6634420 - DNA, 17 bp, Homo sapiens
agccagggaacagcccc

SEQ ID NO: 6634421 - DNA, 15 bp, Homo sapiens
agccagggaaggctg

SEQ ID NO: 6634422 - DNA, 18 bp, Homo sapiens
agccagggagagcccagg

SEQ ID NO: 6634423 - DNA, 15 bp, Homo sapiens
agccagggagcccgg

SEQ ID NO: 6634424 - DNA, 15 bp, Homo sapiens
agccagggcagagga

SEQ ID NO: 6634425 - DNA, 12 bp, Homo sapiens
agccagggcagg

SEQ ID NO: 6634426 - DNA, 15 bp, Homo sapiens
agccagggcagggcg

SEQ ID NO: 6634427 - DNA, 23 bp, Homo sapiens
agccagggcagggcgagctgcag

SEQ ID NO: 6634428 - DNA, 15 bp, Homo sapiens
agccagggcagggct

SEQ ID NO: 6634429 - DNA, 11 bp, Homo sapiens
agccagggcca

SEQ ID NO: 6634430 - DNA, 18 bp, Homo sapiens
agccagggcccagagccc

SEQ ID NO: 6634431 - DNA, 19 bp, Homo sapiens
agccagggcccagagccct

SEQ ID NO: 6634432 - DNA, 21 bp, Homo sapiens
agccagggcccagagcccttg

SEQ ID NO: 6634433 - DNA, 17 bp, Homo sapiens
agccagggcccctggat

SEQ ID NO: 6634434 - DNA, 11 bp, Homo sapiens
agccagggcct

SEQ ID NO: 6634435 - DNA, 10 bp, Homo sapiens
agccagggct

SEQ ID NO: 6634436 - DNA, 11 bp, Homo sapiens
agccagggctg

SEQ ID NO: 6634437 - DNA, 12 bp, Homo sapiens
agccagggctgc

SEQ ID NO: 6634438 - DNA, 16 bp, Homo sapiens
agccagggctggagaa

SEQ ID NO: 6634439 - DNA, 15 bp, Homo sapiens
agccagggctggggt

SEQ ID NO: 6634440 - DNA, 16 bp, Homo sapiens
agccagggctgtcctt

SEQ ID NO: 6634441 - DNA, 16 bp, Homo sapiens
agccaggggctgctca

SEQ ID NO: 6634442 - DNA, 23 bp, Homo sapiens
agccaggggctgctcatcaccca

SEQ ID NO: 6634443 - DNA, 18 bp, Homo sapiens
agccagggggactagccc

SEQ ID NO: 6634444 - DNA, 22 bp, Homo sapiens
agccagggggactagcccctgt

SEQ ID NO: 6634445 - DNA, 20 bp, Homo sapiens
agccagggggatgccactcc

SEQ ID NO: 6634446 - DNA, 20 bp, Homo sapiens
agccagggtcctgagtggct

SEQ ID NO: 6634447 - DNA, 16 bp, Homo sapiens
agccagggtctccaga

SEQ ID NO: 6634448 - DNA, 18 bp, Homo sapiens
agccagggtctctccctc

SEQ ID NO: 6634449 - DNA, 14 bp, Homo sapiens
agccagggttccag

SEQ ID NO: 6634450 - DNA, 16 bp, Homo sapiens
agccagggttccagac

SEQ ID NO: 6634451 - DNA, 18 bp, Homo sapiens
agccagggttccagacag

SEQ ID NO: 6634452 - DNA, 20 bp, Homo sapiens
agccagggttccagacaggg

SEQ ID NO: 6634453 - DNA, 20 bp, Homo sapiens
agccaggtacaggagaggca

SEQ ID NO: 6634454 - DNA, 19 bp, Homo sapiens
agccaggtatggctctgca

SEQ ID NO: 6634455 - DNA, 15 bp, Homo sapiens
agccaggtccccctg

SEQ ID NO: 6634456 - DNA, 16 bp, Homo sapiens
agccaggtccccctgc

SEQ ID NO: 6634457 - DNA, 17 bp, Homo sapiens
agccaggtccccctgca

SEQ ID NO: 6634458 - DNA, 12 bp, Homo sapiens
agccaggtccct

SEQ ID NO: 6634459 - DNA, 19 bp, Homo sapiens
agccaggtctcctgggaaa

SEQ ID NO: 6634460 - DNA, 20 bp, Homo sapiens
agccaggtctgactccaaag

SEQ ID NO: 6634461 - DNA, 22 bp, Homo sapiens
agccaggtctgactccaaagct

SEQ ID NO: 6634462 - DNA, 17 bp, Homo sapiens
agccaggtgccttggag

SEQ ID NO: 6634463 - DNA, 17 bp, Homo sapiens
agccaggtgctgtgaca

SEQ ID NO: 6634464 - DNA, 17 bp, Homo sapiens
agccaggtggcacctgc

SEQ ID NO: 6634465 - DNA, 18 bp, Homo sapiens
agccaggtggcacctgca

SEQ ID NO: 6634466 - DNA, 23 bp, Homo sapiens
agccaggtgtggtagcaggcacc

SEQ ID NO: 6634467 - DNA, 19 bp, Homo sapiens
agccaggttcacactcaga

SEQ ID NO: 6634468 - DNA, 23 bp, Homo sapiens
agccaggttgttttatagaggtt

SEQ ID NO: 6634469 - DNA, 13 bp, Homo sapiens
agccagtaaatgg

SEQ ID NO: 6634470 - DNA, 14 bp, Homo sapiens
agccagtaacttat

SEQ ID NO: 6634471 - DNA, 14 bp, Homo sapiens
agccagtaatcctg

SEQ ID NO: 6634472 - DNA, 14 bp, Homo sapiens
agccagtaatcttt

SEQ ID NO: 6634473 - DNA, 21 bp, Homo sapiens
agccagtcatcatctcttgat

SEQ ID NO: 6634474 - DNA, 18 bp, Homo sapiens
agccagtctcagagacca

SEQ ID NO: 6634475 - DNA, 20 bp, Homo sapiens
agccagtctcagagaccagc

SEQ ID NO: 6634476 - DNA, 20 bp, Homo sapiens
agccagtctcctatacccag

SEQ ID NO: 6634477 - DNA, 20 bp, Homo sapiens
agccagtctgcgtcaggcac

SEQ ID NO: 6634478 - DNA, 18 bp, Homo sapiens
agccagtcttgcctaggc

SEQ ID NO: 6634479 - DNA, 14 bp, Homo sapiens
agccagtctttgaa

SEQ ID NO: 6634480 - DNA, 19 bp, Homo sapiens
agccagtgaaatgtgaagg

SEQ ID NO: 6634481 - DNA, 13 bp, Homo sapiens
agccagtgacact

SEQ ID NO: 6634482 - DNA, 19 bp, Homo sapiens
agccagtgacctgaggaag

SEQ ID NO: 6634483 - DNA, 21 bp, Homo sapiens
agccagtgacctgaggaagcg

SEQ ID NO: 6634484 - DNA, 13 bp, Homo sapiens
agccagtgactcc

SEQ ID NO: 6634485 - DNA, 15 bp, Homo sapiens
agccagtgacttttt

SEQ ID NO: 6634486 - DNA, 21 bp, Homo sapiens
agccagtgattattcttgttc

SEQ ID NO: 6634487 - DNA, 16 bp, Homo sapiens
agccagtggagctggt

SEQ ID NO: 6634488 - DNA, 18 bp, Homo sapiens
agccagtggagctggtct

SEQ ID NO: 6634489 - DNA, 22 bp, Homo sapiens
agccagtggagctggtctgcca

SEQ ID NO: 6634490 - DNA, 23 bp, Homo sapiens
agccagtggcgggtgatggccag

SEQ ID NO: 6634491 - DNA, 19 bp, Homo sapiens
agccagtggggaagtgcgt

SEQ ID NO: 6634492 - DNA, 16 bp, Homo sapiens
agccagtgttgcctaa

SEQ ID NO: 6634493 - DNA, 16 bp, Homo sapiens
agccagttaaggaaag

SEQ ID NO: 6634494 - DNA, 19 bp, Homo sapiens
agccagttacctttgctgt

SEQ ID NO: 6634495 - DNA, 18 bp, Homo sapiens
agccagttcaaagtgtat

SEQ ID NO: 6634496 - DNA, 17 bp, Homo sapiens
agccagttcagtacctg

SEQ ID NO: 6634497 - DNA, 20 bp, Homo sapiens
agccagttctccttccctgc

SEQ ID NO: 6634498 - DNA, 11 bp, Homo sapiens
agccagttctg

SEQ ID NO: 6634499 - DNA, 22 bp, Homo sapiens
agccagttgcttcttcagctga

SEQ ID NO: 6634500 - DNA, 16 bp, Homo sapiens
agccagttggtggggc

SEQ ID NO: 6634501 - DNA, 19 bp, Homo sapiens
agccagttggtggggccag

SEQ ID NO: 6634502 - DNA, 17 bp, Homo sapiens
agccagtttagagaaat

SEQ ID NO: 6634503 - DNA, 22 bp, Homo sapiens
agccagtttgggtaaaatactt

SEQ ID NO: 6634504 - DNA, 22 bp, Homo sapiens
agccataaaagcattgtctctc

SEQ ID NO: 6634505 - DNA, 20 bp, Homo sapiens
agccataacgttagactgca

SEQ ID NO: 6634506 - DNA, 14 bp, Homo sapiens
agccataataataa

SEQ ID NO: 6634507 - DNA, 13 bp, Homo sapiens
agccataattttg

SEQ ID NO: 6634508 - DNA, 16 bp, Homo sapiens
agccataattttgcat

SEQ ID NO: 6634509 - DNA, 17 bp, Homo sapiens
agccataattttgcata

SEQ ID NO: 6634510 - DNA, 22 bp, Homo sapiens
agccataccgaccatcgtccag

SEQ ID NO: 6634511 - DNA, 16 bp, Homo sapiens
agccatactgcgtcca

SEQ ID NO: 6634512 - DNA, 21 bp, Homo sapiens
agccatactgcgtccaccctg

SEQ ID NO: 6634513 - DNA, 17 bp, Homo sapiens
agccatagaccctgagg

SEQ ID NO: 6634514 - DNA, 19 bp, Homo sapiens
agccatagacctacagacc

SEQ ID NO: 6634515 - DNA, 20 bp, Homo sapiens
agccatagagatatttaaaa

SEQ ID NO: 6634516 - DNA, 14 bp, Homo sapiens
agccatagatgctg

SEQ ID NO: 6634517 - DNA, 14 bp, Homo sapiens
agccatagccccag

SEQ ID NO: 6634518 - DNA, 22 bp, Homo sapiens
agccatagccccaggcccgccc

SEQ ID NO: 6634519 - DNA, 19 bp, Homo sapiens
agccatagcctccacggag

SEQ ID NO: 6634520 - DNA, 22 bp, Homo sapiens
agccatagggggctgcacggga

SEQ ID NO: 6634521 - DNA, 16 bp, Homo sapiens
agccataggtgcagtt

SEQ ID NO: 6634522 - DNA, 21 bp, Homo sapiens
agccatataagtttgaaggaa

SEQ ID NO: 6634523 - DNA, 20 bp, Homo sapiens
agccatatattttctgagta

SEQ ID NO: 6634524 - DNA, 10 bp, Homo sapiens
agccatatca

SEQ ID NO: 6634525 - DNA, 20 bp, Homo sapiens
agccatatcatgctaaaatt

SEQ ID NO: 6634526 - DNA, 23 bp, Homo sapiens
agccatatgacaagcctttgtgc

SEQ ID NO: 6634527 - DNA, 17 bp, Homo sapiens
agccatatggacactgt

SEQ ID NO: 6634528 - DNA, 18 bp, Homo sapiens
agccatatggacactgtg

SEQ ID NO: 6634529 - DNA, 16 bp, Homo sapiens
agccatattaattgcc

SEQ ID NO: 6634530 - DNA, 12 bp, Homo sapiens
agccatattcca

SEQ ID NO: 6634531 - DNA, 13 bp, Homo sapiens
agccatcaaaatg

SEQ ID NO: 6634532 - DNA, 15 bp, Homo sapiens
agccatcaaaatgct

SEQ ID NO: 6634533 - DNA, 18 bp, Homo sapiens
agccatcaaaatgctttt

SEQ ID NO: 6634534 - DNA, 14 bp, Homo sapiens
agccatcaagcact

SEQ ID NO: 6634535 - DNA, 20 bp, Homo sapiens
agccatcaagcacttcccag

SEQ ID NO: 6634536 - DNA, 17 bp, Homo sapiens
agccatcaattttaaca

SEQ ID NO: 6634537 - DNA, 20 bp, Homo sapiens
agccatcaattttaacattt

SEQ ID NO: 6634538 - DNA, 14 bp, Homo sapiens
agccatcacaaggg

SEQ ID NO: 6634539 - DNA, 12 bp, Homo sapiens
agccatcaccct

SEQ ID NO: 6634540 - DNA, 16 bp, Homo sapiens
agccatcaccctcacc

SEQ ID NO: 6634541 - DNA, 16 bp, Homo sapiens
agccatcacctaggac

SEQ ID NO: 6634542 - DNA, 16 bp, Homo sapiens
agccatcacctcagat

SEQ ID NO: 6634543 - DNA, 19 bp, Homo sapiens
agccatcacctcagatggc

SEQ ID NO: 6634544 - DNA, 18 bp, Homo sapiens
agccatcaccttagacca

SEQ ID NO: 6634545 - DNA, 20 bp, Homo sapiens
agccatcactagaagaaaag

SEQ ID NO: 6634546 - DNA, 21 bp, Homo sapiens
agccatcactagaagaaaagc

SEQ ID NO: 6634547 - DNA, 23 bp, Homo sapiens
agccatcactagaagaaaagccc

SEQ ID NO: 6634548 - DNA, 16 bp, Homo sapiens
agccatcacttctccc

SEQ ID NO: 6634549 - DNA, 18 bp, Homo sapiens
agccatcacttctccccg

SEQ ID NO: 6634550 - DNA, 20 bp, Homo sapiens
agccatcacttctccccgca

SEQ ID NO: 6634551 - DNA, 18 bp, Homo sapiens
agccatcataggaaggga

SEQ ID NO: 6634552 - DNA, 21 bp, Homo sapiens
agccatcatatcccctgtgcc

SEQ ID NO: 6634553 - DNA, 20 bp, Homo sapiens
agccatccaccctgaggagt

SEQ ID NO: 6634554 - DNA, 15 bp, Homo sapiens
agccatccatttgtg

SEQ ID NO: 6634555 - DNA, 20 bp, Homo sapiens
agccatcccactccctttcc

SEQ ID NO: 6634556 - DNA, 17 bp, Homo sapiens
agccatcccagccttgg

SEQ ID NO: 6634557 - DNA, 17 bp, Homo sapiens
agccatcccgcttagcc

SEQ ID NO: 6634558 - DNA, 21 bp, Homo sapiens
agccatcccgcttagcctgcc

SEQ ID NO: 6634559 - DNA, 16 bp, Homo sapiens
agccatcccttgggga

SEQ ID NO: 6634560 - DNA, 20 bp, Homo sapiens
agccatccctttttttacat

SEQ ID NO: 6634561 - DNA, 22 bp, Homo sapiens
agccatcgattgtgtacttttc

SEQ ID NO: 6634562 - DNA, 22 bp, Homo sapiens
agccatcggtgaaactaacaga

SEQ ID NO: 6634563 - DNA, 14 bp, Homo sapiens
agccatcgtcctgg

SEQ ID NO: 6634564 - DNA, 18 bp, Homo sapiens
agccatcgtcctgggact

SEQ ID NO: 6634565 - DNA, 23 bp, Homo sapiens
agccatctaatgcttgtttatga

SEQ ID NO: 6634566 - DNA, 15 bp, Homo sapiens
agccatctactggat

SEQ ID NO: 6634567 - DNA, 15 bp, Homo sapiens
agccatctcaagcaa

SEQ ID NO: 6634568 - DNA, 16 bp, Homo sapiens
agccatctcaagcaag

SEQ ID NO: 6634569 - DNA, 17 bp, Homo sapiens
agccatctcagattctg

SEQ ID NO: 6634570 - DNA, 22 bp, Homo sapiens
agccatctccatcttgaaggaa

SEQ ID NO: 6634571 - DNA, 23 bp, Homo sapiens
agccatctgacagcaggccacta

SEQ ID NO: 6634572 - DNA, 19 bp, Homo sapiens
agccatctgcccaggggtg

SEQ ID NO: 6634573 - DNA, 18 bp, Homo sapiens
agccatctgcgacaccac

SEQ ID NO: 6634574 - DNA, 16 bp, Homo sapiens
agccatcttggcaggg

SEQ ID NO: 6634575 - DNA, 17 bp, Homo sapiens
agccatcttggcagggt

SEQ ID NO: 6634576 - DNA, 15 bp, Homo sapiens
agccatgaagcatta

SEQ ID NO: 6634577 - DNA, 22 bp, Homo sapiens
agccatgaccagttctggccag

SEQ ID NO: 6634578 - DNA, 18 bp, Homo sapiens
agccatgaccttacattt

SEQ ID NO: 6634579 - DNA, 12 bp, Homo sapiens
agccatgaggag

SEQ ID NO: 6634580 - DNA, 22 bp, Homo sapiens
agccatgagtgtgggccatcgc

SEQ ID NO: 6634581 - DNA, 14 bp, Homo sapiens
agccatgataatag

SEQ ID NO: 6634582 - DNA, 19 bp, Homo sapiens
agccatgatcgagccactg

SEQ ID NO: 6634583 - DNA, 16 bp, Homo sapiens
agccatgatctgcagg

SEQ ID NO: 6634584 - DNA, 17 bp, Homo sapiens
agccatgatctgcaggg

SEQ ID NO: 6634585 - DNA, 15 bp, Homo sapiens
agccatgatggcaac

SEQ ID NO: 6634586 - DNA, 15 bp, Homo sapiens
agccatgattttcta

SEQ ID NO: 6634587 - DNA, 20 bp, Homo sapiens
agccatgccaataaagtgat

SEQ ID NO: 6634588 - DNA, 19 bp, Homo sapiens
agccatgcccacgcccctc

SEQ ID NO: 6634589 - DNA, 20 bp, Homo sapiens
agccatgcccacgcccctcc

SEQ ID NO: 6634590 - DNA, 13 bp, Homo sapiens
agccatgcccagg

SEQ ID NO: 6634591 - DNA, 14 bp, Homo sapiens
agccatgcccagga

SEQ ID NO: 6634592 - DNA, 15 bp, Homo sapiens
agccatgcctccctg

SEQ ID NO: 6634593 - DNA, 18 bp, Homo sapiens
agccatgcctccctgggc

SEQ ID NO: 6634594 - DNA, 21 bp, Homo sapiens
agccatgcgcgcgctctctct

SEQ ID NO: 6634595 - DNA, 24 bp, Homo sapiens
agccatgcgcgcgctctctctctt

SEQ ID NO: 6634596 - DNA, 16 bp, Homo sapiens
agccatgctacagtta

SEQ ID NO: 6634597 - DNA, 19 bp, Homo sapiens
agccatgctacagttagtc

SEQ ID NO: 6634598 - DNA, 20 bp, Homo sapiens
agccatgctacagttagtct

SEQ ID NO: 6634599 - DNA, 21 bp, Homo sapiens
agccatgctacagttagtctt

SEQ ID NO: 6634600 - DNA, 19 bp, Homo sapiens
agccatgctgggaagacgc

SEQ ID NO: 6634601 - DNA, 15 bp, Homo sapiens
agccatgctttatgt

SEQ ID NO: 6634602 - DNA, 16 bp, Homo sapiens
agccatggaaggtgcc

SEQ ID NO: 6634603 - DNA, 18 bp, Homo sapiens
agccatggaaggtgccag

SEQ ID NO: 6634604 - DNA, 22 bp, Homo sapiens
agccatggaaggtgccagaagg

SEQ ID NO: 6634605 - DNA, 18 bp, Homo sapiens
agccatggactctacact

SEQ ID NO: 6634606 - DNA, 19 bp, Homo sapiens
agccatggagattctcata

SEQ ID NO: 6634607 - DNA, 22 bp, Homo sapiens
agccatggagattctcataact

SEQ ID NO: 6634608 - DNA, 21 bp, Homo sapiens
agccatggagtgagacccagg

SEQ ID NO: 6634609 - DNA, 19 bp, Homo sapiens
agccatggcggcccctcag

SEQ ID NO: 6634610 - DNA, 12 bp, Homo sapiens
agccatggctca

SEQ ID NO: 6634611 - DNA, 19 bp, Homo sapiens
agccatggctcaggcaagc

SEQ ID NO: 6634612 - DNA, 21 bp, Homo sapiens
agccatggctcaggcaagccc

SEQ ID NO: 6634613 - DNA, 22 bp, Homo sapiens
agccatggctcaggcaagcccc

SEQ ID NO: 6634614 - DNA, 14 bp, Homo sapiens
agccatggctggca

SEQ ID NO: 6634615 - DNA, 13 bp, Homo sapiens
agccatggctggg

SEQ ID NO: 6634616 - DNA, 18 bp, Homo sapiens
agccatgggaacctcata

SEQ ID NO: 6634617 - DNA, 16 bp, Homo sapiens
agccatgggaccaaac

SEQ ID NO: 6634618 - DNA, 17 bp, Homo sapiens
agccatgggaccaaacc

SEQ ID NO: 6634619 - DNA, 13 bp, Homo sapiens
agccatgggacct

SEQ ID NO: 6634620 - DNA, 17 bp, Homo sapiens
agccatgggacctcctc

SEQ ID NO: 6634621 - DNA, 21 bp, Homo sapiens
agccatgggacctcctccctc

SEQ ID NO: 6634622 - DNA, 22 bp, Homo sapiens
agccatgggcacaaagggccca

SEQ ID NO: 6634623 - DNA, 14 bp, Homo sapiens
agccatgggccctc

SEQ ID NO: 6634624 - DNA, 14 bp, Homo sapiens
agccatgggcctgg

SEQ ID NO: 6634625 - DNA, 16 bp, Homo sapiens
agccatgggcctgggc

SEQ ID NO: 6634626 - DNA, 19 bp, Homo sapiens
agccatgggcctgggcctg

SEQ ID NO: 6634627 - DNA, 20 bp, Homo sapiens
agccatgggcctgggcctgc

SEQ ID NO: 6634628 - DNA, 21 bp, Homo sapiens
agccatgggcctgggcctgct

SEQ ID NO: 6634629 - DNA, 16 bp, Homo sapiens
agccatgggggtttgg

SEQ ID NO: 6634630 - DNA, 20 bp, Homo sapiens
agccatgtacagacagagaa

SEQ ID NO: 6634631 - DNA, 23 bp, Homo sapiens
agccatgtacagacagagaatat

SEQ ID NO: 6634632 - DNA, 19 bp, Homo sapiens
agccatgtaccagtgtact

SEQ ID NO: 6634633 - DNA, 21 bp, Homo sapiens
agccatgtaccagtgtactgc

SEQ ID NO: 6634634 - DNA, 22 bp, Homo sapiens
agccatgtaccagtgtactgct

SEQ ID NO: 6634635 - DNA, 16 bp, Homo sapiens
agccatgtagccaccc

SEQ ID NO: 6634636 - DNA, 21 bp, Homo sapiens
agccatgtatttcagggacct

SEQ ID NO: 6634637 - DNA, 22 bp, Homo sapiens
agccatgtatttcagggacctc

SEQ ID NO: 6634638 - DNA, 21 bp, Homo sapiens
agccatgtcttctccctggaa

SEQ ID NO: 6634639 - DNA, 22 bp, Homo sapiens
agccatgtgaaactcatctcat

SEQ ID NO: 6634640 - DNA, 12 bp, Homo sapiens
agccatgtgctg

SEQ ID NO: 6634641 - DNA, 16 bp, Homo sapiens
agccatgttaaatgac

SEQ ID NO: 6634642 - DNA, 17 bp, Homo sapiens
agccatgttaaatgact

SEQ ID NO: 6634643 - DNA, 17 bp, Homo sapiens
agccatgttaacatgac

SEQ ID NO: 6634644 - DNA, 14 bp, Homo sapiens
agccatgtttaaga

SEQ ID NO: 6634645 - DNA, 19 bp, Homo sapiens
agccatgtttaagatttaa

SEQ ID NO: 6634646 - DNA, 13 bp, Homo sapiens
agccatgtttatt

SEQ ID NO: 6634647 - DNA, 14 bp, Homo sapiens
agccattaaaataa

SEQ ID NO: 6634648 - DNA, 19 bp, Homo sapiens
agccattaaaataaaacaa

SEQ ID NO: 6634649 - DNA, 18 bp, Homo sapiens
agccattaaatgaatatt

SEQ ID NO: 6634650 - DNA, 21 bp, Homo sapiens
agccattaaatgaatattttg

SEQ ID NO: 6634651 - DNA, 22 bp, Homo sapiens
agccattaaatgaatattttga

SEQ ID NO: 6634652 - DNA, 18 bp, Homo sapiens
agccattaccatggagac

SEQ ID NO: 6634653 - DNA, 17 bp, Homo sapiens
agccattacccacgtga

SEQ ID NO: 6634654 - DNA, 23 bp, Homo sapiens
agccattagagcacagcttcttc

SEQ ID NO: 6634655 - DNA, 14 bp, Homo sapiens
agccattcatctgg

SEQ ID NO: 6634656 - DNA, 20 bp, Homo sapiens
agccattcatctgggctggc

SEQ ID NO: 6634657 - DNA, 12 bp, Homo sapiens
agccattcctgg

SEQ ID NO: 6634658 - DNA, 16 bp, Homo sapiens
agccattcctgttctc

SEQ ID NO: 6634659 - DNA, 17 bp, Homo sapiens
agccattcctgttctct

SEQ ID NO: 6634660 - DNA, 15 bp, Homo sapiens
agccattctgcctca

SEQ ID NO: 6634661 - DNA, 15 bp, Homo sapiens
agccattctgtccca

SEQ ID NO: 6634662 - DNA, 22 bp, Homo sapiens
agccattctgtgtgtgactctg

SEQ ID NO: 6634663 - DNA, 11 bp, Homo sapiens
agccattcttt

SEQ ID NO: 6634664 - DNA, 20 bp, Homo sapiens
agccattgaacagctgtgag

SEQ ID NO: 6634665 - DNA, 16 bp, Homo sapiens
agccattgcacccagc

SEQ ID NO: 6634666 - DNA, 22 bp, Homo sapiens
agccattgcttctccctcactt

SEQ ID NO: 6634667 - DNA, 18 bp, Homo sapiens
agccattgttggctttcc

SEQ ID NO: 6634668 - DNA, 17 bp, Homo sapiens
agccatttaactggagc

SEQ ID NO: 6634669 - DNA, 18 bp, Homo sapiens
agccatttaactggagct

SEQ ID NO: 6634670 - DNA, 23 bp, Homo sapiens
agccatttaatttttaaatgttt

SEQ ID NO: 6634671 - DNA, 21 bp, Homo sapiens
agccatttatacctttgaaat

SEQ ID NO: 6634672 - DNA, 22 bp, Homo sapiens
agccatttatacctttgaaata

SEQ ID NO: 6634673 - DNA, 19 bp, Homo sapiens
agccatttccccctcctca

SEQ ID NO: 6634674 - DNA, 13 bp, Homo sapiens
agccatttcttat

SEQ ID NO: 6634675 - DNA, 14 bp, Homo sapiens
agccatttcttata

SEQ ID NO: 6634676 - DNA, 12 bp, Homo sapiens
agccatttgaga

SEQ ID NO: 6634677 - DNA, 19 bp, Homo sapiens
agccatttgccccaactta

SEQ ID NO: 6634678 - DNA, 18 bp, Homo sapiens
agccatttgttggggcag

SEQ ID NO: 6634679 - DNA, 14 bp, Homo sapiens
agccattttccaac

SEQ ID NO: 6634680 - DNA, 14 bp, Homo sapiens
agccattttccagt

SEQ ID NO: 6634681 - DNA, 14 bp, Homo sapiens
agccattttggttt

SEQ ID NO: 6634682 - DNA, 17 bp, Homo sapiens
agccattttgtgaatgg

SEQ ID NO: 6634683 - DNA, 14 bp, Homo sapiens
agccatttttaatg

SEQ ID NO: 6634684 - DNA, 16 bp, Homo sapiens
agccatttttaatgat

SEQ ID NO: 6634685 - DNA, 15 bp, Homo sapiens
agccatttttactgt

SEQ ID NO: 6634686 - DNA, 13 bp, Homo sapiens
agccatttttaga

SEQ ID NO: 6634687 - DNA, 16 bp, Homo sapiens
agccatttttcaaagc

SEQ ID NO: 6634688 - DNA, 15 bp, Homo sapiens
agcccaaaatttgat

SEQ ID NO: 6634689 - DNA, 17 bp, Homo sapiens
agcccaaacctgggaag

SEQ ID NO: 6634690 - DNA, 14 bp, Homo sapiens
agcccaaaccttgg

SEQ ID NO: 6634691 - DNA, 16 bp, Homo sapiens
agcccaaaccttgggc

SEQ ID NO: 6634692 - DNA, 19 bp, Homo sapiens
agcccaaaccttgggccct

SEQ ID NO: 6634693 - DNA, 17 bp, Homo sapiens
agcccaaagcctgagga

SEQ ID NO: 6634694 - DNA, 18 bp, Homo sapiens
agcccaaagctggagcca

SEQ ID NO: 6634695 - DNA, 23 bp, Homo sapiens
agcccaaaggggacaggcctcac

SEQ ID NO: 6634696 - DNA, 20 bp, Homo sapiens
agcccaaagtggtatagaaa

SEQ ID NO: 6634697 - DNA, 23 bp, Homo sapiens
agcccaaagtggtatagaaatgc

SEQ ID NO: 6634698 - DNA, 16 bp, Homo sapiens
agcccaaatggctctg

SEQ ID NO: 6634699 - DNA, 20 bp, Homo sapiens
agcccaaattcatataaaag

SEQ ID NO: 6634700 - DNA, 21 bp, Homo sapiens
agcccaaattcatataaaagt

SEQ ID NO: 6634701 - DNA, 17 bp, Homo sapiens
agcccaaattctcctct

SEQ ID NO: 6634702 - DNA, 21 bp, Homo sapiens
agcccaacacacactcgggtt

SEQ ID NO: 6634703 - DNA, 14 bp, Homo sapiens
agcccaacccttct

SEQ ID NO: 6634704 - DNA, 17 bp, Homo sapiens
agcccaacctacattcc

SEQ ID NO: 6634705 - DNA, 16 bp, Homo sapiens
agcccaacctcttcct

SEQ ID NO: 6634706 - DNA, 21 bp, Homo sapiens
agcccaacgggaagcaacctc

SEQ ID NO: 6634707 - DNA, 17 bp, Homo sapiens
agcccaacttcttaccc

SEQ ID NO: 6634708 - DNA, 15 bp, Homo sapiens
agcccaagcttccct

SEQ ID NO: 6634709 - DNA, 19 bp, Homo sapiens
agcccaagcttccctccat

SEQ ID NO: 6634710 - DNA, 22 bp, Homo sapiens
agcccaagggatctggtcctac

SEQ ID NO: 6634711 - DNA, 16 bp, Homo sapiens
agcccaaggtcaggga

SEQ ID NO: 6634712 - DNA, 17 bp, Homo sapiens
agcccaaggtcagggag

SEQ ID NO: 6634713 - DNA, 18 bp, Homo sapiens
agcccaaggtcagggagg

SEQ ID NO: 6634714 - DNA, 22 bp, Homo sapiens
agcccaaggtttaaacttctct

SEQ ID NO: 6634715 - DNA, 23 bp, Homo sapiens
agcccaaggtttaaacttctctg

SEQ ID NO: 6634716 - DNA, 17 bp, Homo sapiens
agcccaagtccaaatgt

SEQ ID NO: 6634717 - DNA, 23 bp, Homo sapiens
agcccaagtgccatcccacattc

SEQ ID NO: 6634718 - DNA, 11 bp, Homo sapiens
agcccaataaa

SEQ ID NO: 6634719 - DNA, 13 bp, Homo sapiens
agcccaataaagg

SEQ ID NO: 6634720 - DNA, 16 bp, Homo sapiens
agcccaatattataat

SEQ ID NO: 6634721 - DNA, 16 bp, Homo sapiens
agcccaatcactgcct

SEQ ID NO: 6634722 - DNA, 17 bp, Homo sapiens
agcccaatcactgccta

SEQ ID NO: 6634723 - DNA, 16 bp, Homo sapiens
agcccaatccaggtac

SEQ ID NO: 6634724 - DNA, 21 bp, Homo sapiens
agcccaatccaggtacgcaca

SEQ ID NO: 6634725 - DNA, 21 bp, Homo sapiens
agcccaatgcatagagccctg

SEQ ID NO: 6634726 - DNA, 16 bp, Homo sapiens
agcccaatggagaaat

SEQ ID NO: 6634727 - DNA, 19 bp, Homo sapiens
agcccaatggagaaatgaa

SEQ ID NO: 6634728 - DNA, 16 bp, Homo sapiens
agcccacaaagcctta

SEQ ID NO: 6634729 - DNA, 22 bp, Homo sapiens
agcccacaaccttcggctccgg

SEQ ID NO: 6634730 - DNA, 20 bp, Homo sapiens
agcccacaagatccaggcag

SEQ ID NO: 6634731 - DNA, 10 bp, Homo sapiens
agcccacacc

SEQ ID NO: 6634732 - DNA, 16 bp, Homo sapiens
agcccacaccatctgg

SEQ ID NO: 6634733 - DNA, 17 bp, Homo sapiens
agcccacaccatctggc

SEQ ID NO: 6634734 - DNA, 16 bp, Homo sapiens
agcccacactatgcac

SEQ ID NO: 6634735 - DNA, 23 bp, Homo sapiens
agcccacacttgagaggatgaat

SEQ ID NO: 6634736 - DNA, 16 bp, Homo sapiens
agcccacagaggacag

SEQ ID NO: 6634737 - DNA, 17 bp, Homo sapiens
agcccacagaggacagt

SEQ ID NO: 6634738 - DNA, 17 bp, Homo sapiens
agcccacaggcctgttc

SEQ ID NO: 6634739 - DNA, 19 bp, Homo sapiens
agcccacaggtgtccccag

SEQ ID NO: 6634740 - DNA, 22 bp, Homo sapiens
agcccacaggtgtccccagccc

SEQ ID NO: 6634741 - DNA, 15 bp, Homo sapiens
agcccacatattcta

SEQ ID NO: 6634742 - DNA, 17 bp, Homo sapiens
agcccaccaatctgccc

SEQ ID NO: 6634743 - DNA, 18 bp, Homo sapiens
agcccaccaatctgccct

SEQ ID NO: 6634744 - DNA, 16 bp, Homo sapiens
agcccaccaccctggc

SEQ ID NO: 6634745 - DNA, 23 bp, Homo sapiens
agcccaccagacgtcaggccctg

SEQ ID NO: 6634746 - DNA, 17 bp, Homo sapiens
agcccaccagccagccc

SEQ ID NO: 6634747 - DNA, 22 bp, Homo sapiens
agcccaccagccagccctggcc

SEQ ID NO: 6634748 - DNA, 14 bp, Homo sapiens
agcccaccaggagc

SEQ ID NO: 6634749 - DNA, 15 bp, Homo sapiens
agcccaccaggagca

SEQ ID NO: 6634750 - DNA, 16 bp, Homo sapiens
agcccaccaggtgtca

SEQ ID NO: 6634751 - DNA, 14 bp, Homo sapiens
agcccacccccctc

SEQ ID NO: 6634752 - DNA, 15 bp, Homo sapiens
agcccacccctcaac

SEQ ID NO: 6634753 - DNA, 21 bp, Homo sapiens
agcccacccgccccagagact

SEQ ID NO: 6634754 - DNA, 13 bp, Homo sapiens
agcccaccctcct

SEQ ID NO: 6634755 - DNA, 14 bp, Homo sapiens
agcccaccctcctg

SEQ ID NO: 6634756 - DNA, 19 bp, Homo sapiens
agcccaccctcctgtcttc

SEQ ID NO: 6634757 - DNA, 12 bp, Homo sapiens
agcccaccctgg

SEQ ID NO: 6634758 - DNA, 18 bp, Homo sapiens
agcccacctcggccctcc

SEQ ID NO: 6634759 - DNA, 11 bp, Homo sapiens
agcccacctga

SEQ ID NO: 6634760 - DNA, 17 bp, Homo sapiens
agcccacctgctcccag

SEQ ID NO: 6634761 - DNA, 18 bp, Homo sapiens
agcccacctgctgcccgt

SEQ ID NO: 6634762 - DNA, 12 bp, Homo sapiens
agcccacctggg

SEQ ID NO: 6634763 - DNA, 20 bp, Homo sapiens
agcccacctgggctgggcgc

SEQ ID NO: 6634764 - DNA, 14 bp, Homo sapiens
agcccaccttggct

SEQ ID NO: 6634765 - DNA, 15 bp, Homo sapiens
agcccacgcccccac

SEQ ID NO: 6634766 - DNA, 18 bp, Homo sapiens
agcccacgcccccactgg

SEQ ID NO: 6634767 - DNA, 23 bp, Homo sapiens
agcccacgcccccactggtgaca

SEQ ID NO: 6634768 - DNA, 22 bp, Homo sapiens
agcccacgcccgactagcaggc

SEQ ID NO: 6634769 - DNA, 18 bp, Homo sapiens
agcccacgctcaccccct

SEQ ID NO: 6634770 - DNA, 20 bp, Homo sapiens
agcccacgctgactacaggg

SEQ ID NO: 6634771 - DNA, 21 bp, Homo sapiens
agcccacgctgactacagggc

SEQ ID NO: 6634772 - DNA, 20 bp, Homo sapiens
agcccacggctaagaggctg

SEQ ID NO: 6634773 - DNA, 21 bp, Homo sapiens
agcccacggctaagaggctgc

SEQ ID NO: 6634774 - DNA, 22 bp, Homo sapiens
agcccacggctaagaggctgct

SEQ ID NO: 6634775 - DNA, 15 bp, Homo sapiens
agcccacggggcaaa

SEQ ID NO: 6634776 - DNA, 20 bp, Homo sapiens
agcccacggtctggaggccg

SEQ ID NO: 6634777 - DNA, 22 bp, Homo sapiens
agcccacgtcaggcctggcctc

SEQ ID NO: 6634778 - DNA, 14 bp, Homo sapiens
agcccacgtcctgt

SEQ ID NO: 6634779 - DNA, 19 bp, Homo sapiens
agcccacgtcctgtcagtg

SEQ ID NO: 6634780 - DNA, 21 bp, Homo sapiens
agcccacgtcctgtcagtgcc

SEQ ID NO: 6634781 - DNA, 22 bp, Homo sapiens
agcccacgttctctctgcctgt

SEQ ID NO: 6634782 - DNA, 14 bp, Homo sapiens
agcccactctgctc

SEQ ID NO: 6634783 - DNA, 11 bp, Homo sapiens
agcccactgag

SEQ ID NO: 6634784 - DNA, 16 bp, Homo sapiens
agcccactgaggggcc

SEQ ID NO: 6634785 - DNA, 17 bp, Homo sapiens
agcccactgaggggcca

SEQ ID NO: 6634786 - DNA, 21 bp, Homo sapiens
agcccactgaggggccaggga

SEQ ID NO: 6634787 - DNA, 20 bp, Homo sapiens
agcccactgcccaccccctc

SEQ ID NO: 6634788 - DNA, 12 bp, Homo sapiens
agcccactgcct

SEQ ID NO: 6634789 - DNA, 17 bp, Homo sapiens
agcccactgcctcctgc

SEQ ID NO: 6634790 - DNA, 21 bp, Homo sapiens
agcccactgcctcctgcctgg

SEQ ID NO: 6634791 - DNA, 14 bp, Homo sapiens
agcccactgcctgg

SEQ ID NO: 6634792 - DNA, 12 bp, Homo sapiens
agcccactgctc

SEQ ID NO: 6634793 - DNA, 11 bp, Homo sapiens
agcccactggg

SEQ ID NO: 6634794 - DNA, 20 bp, Homo sapiens
agcccactgggccctggggc

SEQ ID NO: 6634795 - DNA, 16 bp, Homo sapiens
agcccactgtacttgc

SEQ ID NO: 6634796 - DNA, 14 bp, Homo sapiens
agcccactgtcctg

SEQ ID NO: 6634797 - DNA, 17 bp, Homo sapiens
agcccactgtcctgggc

SEQ ID NO: 6634798 - DNA, 22 bp, Homo sapiens
agcccactgtcctgggcctgca

SEQ ID NO: 6634799 - DNA, 15 bp, Homo sapiens
agcccacttcacaca

SEQ ID NO: 6634800 - DNA, 17 bp, Homo sapiens
agcccacttcacacatt

SEQ ID NO: 6634801 - DNA, 14 bp, Homo sapiens
agcccacttctgcc

SEQ ID NO: 6634802 - DNA, 18 bp, Homo sapiens
agcccagaaaaaaggact

SEQ ID NO: 6634803 - DNA, 17 bp, Homo sapiens
agcccagaaaaggacag

SEQ ID NO: 6634804 - DNA, 24 bp, Homo sapiens
agcccagaaagtgataagtgcagg

SEQ ID NO: 6634805 - DNA, 17 bp, Homo sapiens
agcccagaacaaaaaga

SEQ ID NO: 6634806 - DNA, 14 bp, Homo sapiens
agcccagaacaccc

SEQ ID NO: 6634807 - DNA, 15 bp, Homo sapiens
agcccagaacgggcc

SEQ ID NO: 6634808 - DNA, 21 bp, Homo sapiens
agcccagaagctcaaggctgc

SEQ ID NO: 6634809 - DNA, 18 bp, Homo sapiens
agcccagaatccccaagt

SEQ ID NO: 6634810 - DNA, 21 bp, Homo sapiens
agcccagacagcaaggtgtgg

SEQ ID NO: 6634811 - DNA, 22 bp, Homo sapiens
agcccagacctccgtgcccagg

SEQ ID NO: 6634812 - DNA, 13 bp, Homo sapiens
agcccagactctg

SEQ ID NO: 6634813 - DNA, 21 bp, Homo sapiens
agcccagactttagtgccctg

SEQ ID NO: 6634814 - DNA, 15 bp, Homo sapiens
agcccagagaacagc

SEQ ID NO: 6634815 - DNA, 12 bp, Homo sapiens
agcccagagaca

SEQ ID NO: 6634816 - DNA, 12 bp, Homo sapiens
agcccagagact

SEQ ID NO: 6634817 - DNA, 15 bp, Homo sapiens
agcccagagactgaa

SEQ ID NO: 6634818 - DNA, 20 bp, Homo sapiens
agcccagagactttgtagat

SEQ ID NO: 6634819 - DNA, 11 bp, Homo sapiens
agcccagagag

SEQ ID NO: 6634820 - DNA, 12 bp, Homo sapiens
agcccagagaga

SEQ ID NO: 6634821 - DNA, 20 bp, Homo sapiens
agcccagagagaccctgcca

SEQ ID NO: 6634822 - DNA, 16 bp, Homo sapiens
agcccagagccacctg

SEQ ID NO: 6634823 - DNA, 18 bp, Homo sapiens
agcccagagccacctgga

SEQ ID NO: 6634824 - DNA, 17 bp, Homo sapiens
agcccagagcctggctg

SEQ ID NO: 6634825 - DNA, 12 bp, Homo sapiens
agcccagaggag

SEQ ID NO: 6634826 - DNA, 14 bp, Homo sapiens
agcccagaggaggg

SEQ ID NO: 6634827 - DNA, 16 bp, Homo sapiens
agcccagaggagggca

SEQ ID NO: 6634828 - DNA, 23 bp, Homo sapiens
agcccagagggccaagagagaca

SEQ ID NO: 6634829 - DNA, 17 bp, Homo sapiens
agcccagagggtctggg

SEQ ID NO: 6634830 - DNA, 20 bp, Homo sapiens
agcccagagggtctgggggc

SEQ ID NO: 6634831 - DNA, 21 bp, Homo sapiens
agcccagaggtaacagaacag

SEQ ID NO: 6634832 - DNA, 17 bp, Homo sapiens
agcccagagtcccccca

SEQ ID NO: 6634833 - DNA, 16 bp, Homo sapiens
agcccagatcagctcc

SEQ ID NO: 6634834 - DNA, 22 bp, Homo sapiens
agcccagatggctccctgggct

SEQ ID NO: 6634835 - DNA, 23 bp, Homo sapiens
agcccagatggctccctgggctg

SEQ ID NO: 6634836 - DNA, 17 bp, Homo sapiens
agcccagattcccctgt

SEQ ID NO: 6634837 - DNA, 21 bp, Homo sapiens
agcccagattcccctgtgtca

SEQ ID NO: 6634838 - DNA, 20 bp, Homo sapiens
agcccagattgtgccactgc

SEQ ID NO: 6634839 - DNA, 21 bp, Homo sapiens
agcccagattgtgccactgct

SEQ ID NO: 6634840 - DNA, 15 bp, Homo sapiens
agcccagcacccctt

SEQ ID NO: 6634841 - DNA, 16 bp, Homo sapiens
agcccagcacctgctc

SEQ ID NO: 6634842 - DNA, 17 bp, Homo sapiens
agcccagcacctgctcc

SEQ ID NO: 6634843 - DNA, 12 bp, Homo sapiens
agcccagcactg

SEQ ID NO: 6634844 - DNA, 17 bp, Homo sapiens
agcccagcactgtgaag

SEQ ID NO: 6634845 - DNA, 15 bp, Homo sapiens
agcccagcagggcct

SEQ ID NO: 6634846 - DNA, 16 bp, Homo sapiens
agcccagccacctccc

SEQ ID NO: 6634847 - DNA, 13 bp, Homo sapiens
agcccagccacgt

SEQ ID NO: 6634848 - DNA, 15 bp, Homo sapiens
agcccagccaggcca

SEQ ID NO: 6634849 - DNA, 11 bp, Homo sapiens
agcccagccca

SEQ ID NO: 6634850 - DNA, 14 bp, Homo sapiens
agcccagcccagct

SEQ ID NO: 6634851 - DNA, 17 bp, Homo sapiens
agcccagcccagctgct

SEQ ID NO: 6634852 - DNA, 16 bp, Homo sapiens
agcccagcccagctgg

SEQ ID NO: 6634853 - DNA, 13 bp, Homo sapiens
agcccagcccagg

SEQ ID NO: 6634854 - DNA, 14 bp, Homo sapiens
agcccagcccggca

SEQ ID NO: 6634855 - DNA, 16 bp, Homo sapiens
agcccagcccggctga

SEQ ID NO: 6634856 - DNA, 13 bp, Homo sapiens
agcccagccctcc

SEQ ID NO: 6634857 - DNA, 21 bp, Homo sapiens
agcccagcctagtcagggcac

SEQ ID NO: 6634858 - DNA, 17 bp, Homo sapiens
agcccagcctctgtccc

SEQ ID NO: 6634859 - DNA, 23 bp, Homo sapiens
agcccagcctctgtccctctttg

SEQ ID NO: 6634860 - DNA, 11 bp, Homo sapiens
agcccagcctg

SEQ ID NO: 6634861 - DNA, 15 bp, Homo sapiens
agcccagcctgcccc

SEQ ID NO: 6634862 - DNA, 17 bp, Homo sapiens
agcccagcctgccccct

SEQ ID NO: 6634863 - DNA, 14 bp, Homo sapiens
agcccagcctggga

SEQ ID NO: 6634864 - DNA, 16 bp, Homo sapiens
agcccagcctgggagc

SEQ ID NO: 6634865 - DNA, 17 bp, Homo sapiens
agcccagccttttgaga

SEQ ID NO: 6634866 - DNA, 16 bp, Homo sapiens
agcccagcgccatcct

SEQ ID NO: 6634867 - DNA, 16 bp, Homo sapiens
agcccagctacattcc

SEQ ID NO: 6634868 - DNA, 17 bp, Homo sapiens
agcccagctacattcct

SEQ ID NO: 6634869 - DNA, 19 bp, Homo sapiens
agcccagctacattcctca

SEQ ID NO: 6634870 - DNA, 23 bp, Homo sapiens
agcccagctacattcctcagctg

SEQ ID NO: 6634871 - DNA, 13 bp, Homo sapiens
agcccagctccag

SEQ ID NO: 6634872 - DNA, 16 bp, Homo sapiens
agcccagctccagggc

SEQ ID NO: 6634873 - DNA, 18 bp, Homo sapiens
agcccagctccagggcca

SEQ ID NO: 6634874 - DNA, 12 bp, Homo sapiens
agcccagctctg

SEQ ID NO: 6634875 - DNA, 14 bp, Homo sapiens
agcccagctctgaa

SEQ ID NO: 6634876 - DNA, 13 bp, Homo sapiens
agcccagctcttg

SEQ ID NO: 6634877 - DNA, 14 bp, Homo sapiens
agcccagctcttgc

SEQ ID NO: 6634878 - DNA, 15 bp, Homo sapiens
agcccagctgcctgg

SEQ ID NO: 6634879 - DNA, 15 bp, Homo sapiens
agcccagctggccac

SEQ ID NO: 6634880 - DNA, 16 bp, Homo sapiens
agcccagctggccgga

SEQ ID NO: 6634881 - DNA, 19 bp, Homo sapiens
agcccagctggccggaagg

SEQ ID NO: 6634882 - DNA, 20 bp, Homo sapiens
agcccagctgggtcaggcag

SEQ ID NO: 6634883 - DNA, 21 bp, Homo sapiens
agcccagctgggtcaggcagg

SEQ ID NO: 6634884 - DNA, 13 bp, Homo sapiens
agcccagctggtg

SEQ ID NO: 6634885 - DNA, 22 bp, Homo sapiens
agcccagctgtgggcggctcct

SEQ ID NO: 6634886 - DNA, 17 bp, Homo sapiens
agcccagcttcctggtg

SEQ ID NO: 6634887 - DNA, 18 bp, Homo sapiens
agcccagcttcctggtgt

SEQ ID NO: 6634888 - DNA, 21 bp, Homo sapiens
agcccagcttttcctgggaca

SEQ ID NO: 6634889 - DNA, 21 bp, Homo sapiens
agcccaggaaaggctccagga

SEQ ID NO: 6634890 - DNA, 11 bp, Homo sapiens
agcccaggaga

SEQ ID NO: 6634891 - DNA, 14 bp, Homo sapiens
agcccaggagagag

SEQ ID NO: 6634892 - DNA, 22 bp, Homo sapiens
agcccaggagagagaaagccag

SEQ ID NO: 6634893 - DNA, 12 bp, Homo sapiens
agcccaggagca

SEQ ID NO: 6634894 - DNA, 12 bp, Homo sapiens
agcccaggagcc

SEQ ID NO: 6634895 - DNA, 17 bp, Homo sapiens
agcccaggagcctcact

SEQ ID NO: 6634896 - DNA, 23 bp, Homo sapiens
agcccaggagctcccctccccaa

SEQ ID NO: 6634897 - DNA, 16 bp, Homo sapiens
agcccaggagctgagt

SEQ ID NO: 6634898 - DNA, 21 bp, Homo sapiens
agcccaggagctgagtcacct

SEQ ID NO: 6634899 - DNA, 23 bp, Homo sapiens
agcccaggagctgagtcacctcc

SEQ ID NO: 6634900 - DNA, 12 bp, Homo sapiens
agcccaggaggg

SEQ ID NO: 6634901 - DNA, 22 bp, Homo sapiens
agcccaggagggcatccatacc

SEQ ID NO: 6634902 - DNA, 11 bp, Homo sapiens
agcccaggagt

SEQ ID NO: 6634903 - DNA, 20 bp, Homo sapiens
agcccaggagtcccactcca

SEQ ID NO: 6634904 - DNA, 16 bp, Homo sapiens
agcccaggagtctgag

SEQ ID NO: 6634905 - DNA, 22 bp, Homo sapiens
agcccaggagttcaagaccagc

SEQ ID NO: 6634906 - DNA, 20 bp, Homo sapiens
agcccaggagtttgagacaa

SEQ ID NO: 6634907 - DNA, 21 bp, Homo sapiens
agcccaggatactggcacaga

SEQ ID NO: 6634908 - DNA, 23 bp, Homo sapiens
agcccaggatactggcacagagg

SEQ ID NO: 6634909 - DNA, 19 bp, Homo sapiens
agcccaggcagctatttca

SEQ ID NO: 6634910 - DNA, 16 bp, Homo sapiens
agcccaggccaggact

SEQ ID NO: 6634911 - DNA, 23 bp, Homo sapiens
agcccaggccaggactctgcagc

SEQ ID NO: 6634912 - DNA, 13 bp, Homo sapiens
agcccaggcccct

SEQ ID NO: 6634913 - DNA, 21 bp, Homo sapiens
agcccaggccgttccccttgg

SEQ ID NO: 6634914 - DNA, 19 bp, Homo sapiens
agcccaggcctccagctca

SEQ ID NO: 6634915 - DNA, 22 bp, Homo sapiens
agcccaggcctccagctcagca

SEQ ID NO: 6634916 - DNA, 12 bp, Homo sapiens
agcccaggcctg

SEQ ID NO: 6634917 - DNA, 21 bp, Homo sapiens
agcccaggcgggagcggtggc

SEQ ID NO: 6634918 - DNA, 22 bp, Homo sapiens
agcccaggctgatgcttgaagt

SEQ ID NO: 6634919 - DNA, 18 bp, Homo sapiens
agcccagggagcggaaag

SEQ ID NO: 6634920 - DNA, 19 bp, Homo sapiens
agcccagggagcggaaagc

SEQ ID NO: 6634921 - DNA, 21 bp, Homo sapiens
agcccagggagcggaaagcag

SEQ ID NO: 6634922 - DNA, 23 bp, Homo sapiens
agcccagggagcggaaagcagct

SEQ ID NO: 6634923 - DNA, 23 bp, Homo sapiens
agcccagggcatcttgctggcta

SEQ ID NO: 6634924 - DNA, 14 bp, Homo sapiens
agcccagggctcct

SEQ ID NO: 6634925 - DNA, 16 bp, Homo sapiens
agcccagggctcctgc

SEQ ID NO: 6634926 - DNA, 14 bp, Homo sapiens
agcccaggggagaa

SEQ ID NO: 6634927 - DNA, 15 bp, Homo sapiens
agcccaggggagcag

SEQ ID NO: 6634928 - DNA, 11 bp, Homo sapiens
agcccagggtg

SEQ ID NO: 6634929 - DNA, 15 bp, Homo sapiens
agcccagggtgctgg

SEQ ID NO: 6634930 - DNA, 18 bp, Homo sapiens
agcccagggttcccccag

SEQ ID NO: 6634931 - DNA, 22 bp, Homo sapiens
agcccagggttcccccagccct

SEQ ID NO: 6634932 - DNA, 23 bp, Homo sapiens
agcccaggtcctctgatacccag

SEQ ID NO: 6634933 - DNA, 14 bp, Homo sapiens
agcccaggtctcct

SEQ ID NO: 6634934 - DNA, 16 bp, Homo sapiens
agcccaggtctcctgg

SEQ ID NO: 6634935 - DNA, 17 bp, Homo sapiens
agcccaggtgccagcct

SEQ ID NO: 6634936 - DNA, 22 bp, Homo sapiens
agcccaggtgccagcctgaggc

SEQ ID NO: 6634937 - DNA, 15 bp, Homo sapiens
agcccagtagacctt

SEQ ID NO: 6634938 - DNA, 15 bp, Homo sapiens
agcccagtgaagcct

SEQ ID NO: 6634939 - DNA, 17 bp, Homo sapiens
agcccagtgacctgacc

SEQ ID NO: 6634940 - DNA, 14 bp, Homo sapiens
agcccagtgcaaac

SEQ ID NO: 6634941 - DNA, 18 bp, Homo sapiens
agcccagtgcactgaaag

SEQ ID NO: 6634942 - DNA, 17 bp, Homo sapiens
agcccagtgctgctgta

SEQ ID NO: 6634943 - DNA, 19 bp, Homo sapiens
agcccagtgggctgcacgc

SEQ ID NO: 6634944 - DNA, 20 bp, Homo sapiens
agcccagtgggctgcacgct

SEQ ID NO: 6634945 - DNA, 17 bp, Homo sapiens
agcccagttgttgcagt

SEQ ID NO: 6634946 - DNA, 19 bp, Homo sapiens
agcccagttgttgcagtga

SEQ ID NO: 6634947 - DNA, 22 bp, Homo sapiens
agcccataaagtctgagaaata

SEQ ID NO: 6634948 - DNA, 14 bp, Homo sapiens
agcccataaccagt

SEQ ID NO: 6634949 - DNA, 14 bp, Homo sapiens
agcccataaggcca

SEQ ID NO: 6634950 - DNA, 18 bp, Homo sapiens
agcccatactcagcctgc

SEQ ID NO: 6634951 - DNA, 19 bp, Homo sapiens
agcccataggccaccccct

SEQ ID NO: 6634952 - DNA, 24 bp, Homo sapiens
agcccataggccaccccctatcct

SEQ ID NO: 6634953 - DNA, 13 bp, Homo sapiens
agcccatcacctc

SEQ ID NO: 6634954 - DNA, 15 bp, Homo sapiens
agcccatcacctcta

SEQ ID NO: 6634955 - DNA, 17 bp, Homo sapiens
agcccatccaaacactg

SEQ ID NO: 6634956 - DNA, 17 bp, Homo sapiens
agcccatcccctgcctc

SEQ ID NO: 6634957 - DNA, 13 bp, Homo sapiens
agcccatccctgc

SEQ ID NO: 6634958 - DNA, 17 bp, Homo sapiens
agcccatcctctcgcca

SEQ ID NO: 6634959 - DNA, 23 bp, Homo sapiens
agcccatcctgaccagctgctcc

SEQ ID NO: 6634960 - DNA, 15 bp, Homo sapiens
agcccatctcggagc

SEQ ID NO: 6634961 - DNA, 11 bp, Homo sapiens
agcccatctct

SEQ ID NO: 6634962 - DNA, 17 bp, Homo sapiens
agcccatgagtccttga

SEQ ID NO: 6634963 - DNA, 11 bp, Homo sapiens
agcccatgccc

SEQ ID NO: 6634964 - DNA, 16 bp, Homo sapiens
agcccatgcccacctg

SEQ ID NO: 6634965 - DNA, 20 bp, Homo sapiens
agcccatgcccacctgccca

SEQ ID NO: 6634966 - DNA, 19 bp, Homo sapiens
agcccatgctcaaccactg

SEQ ID NO: 6634967 - DNA, 13 bp, Homo sapiens
agcccatgctggc

SEQ ID NO: 6634968 - DNA, 15 bp, Homo sapiens
agcccatgctggctg

SEQ ID NO: 6634969 - DNA, 17 bp, Homo sapiens
agcccatgctggctggg

SEQ ID NO: 6634970 - DNA, 18 bp, Homo sapiens
agcccatgctggctgggg

SEQ ID NO: 6634971 - DNA, 17 bp, Homo sapiens
agcccatggagattgac

SEQ ID NO: 6634972 - DNA, 21 bp, Homo sapiens
agcccatggagattgacctgg

SEQ ID NO: 6634973 - DNA, 14 bp, Homo sapiens
agcccatggagcag

SEQ ID NO: 6634974 - DNA, 17 bp, Homo sapiens
agcccatggagcaggga

SEQ ID NO: 6634975 - DNA, 20 bp, Homo sapiens
agcccatggcccccaataaa

SEQ ID NO: 6634976 - DNA, 22 bp, Homo sapiens
agcccatggcccccaataaagg

SEQ ID NO: 6634977 - DNA, 23 bp, Homo sapiens
agcccatggtgaatgtatgtttc

SEQ ID NO: 6634978 - DNA, 16 bp, Homo sapiens
agcccatgtcaatcaa

SEQ ID NO: 6634979 - DNA, 17 bp, Homo sapiens
agcccatgtcaatcaag

SEQ ID NO: 6634980 - DNA, 17 bp, Homo sapiens
agcccatgttctgcccc

SEQ ID NO: 6634981 - DNA, 20 bp, Homo sapiens
agcccatgttctgcccccag

SEQ ID NO: 6634982 - DNA, 22 bp, Homo sapiens
agcccatgttctgcccccagcc

SEQ ID NO: 6634983 - DNA, 14 bp, Homo sapiens
agcccattaaaata

SEQ ID NO: 6634984 - DNA, 15 bp, Homo sapiens
agcccattaatcttg

SEQ ID NO: 6634985 - DNA, 17 bp, Homo sapiens
agcccattcattccatt

SEQ ID NO: 6634986 - DNA, 16 bp, Homo sapiens
agcccattcccaaggg

SEQ ID NO: 6634987 - DNA, 15 bp, Homo sapiens
agcccattctcatgt

SEQ ID NO: 6634988 - DNA, 17 bp, Homo sapiens
agcccattctcatgttt

SEQ ID NO: 6634989 - DNA, 16 bp, Homo sapiens
agcccattcttctggg

SEQ ID NO: 6634990 - DNA, 20 bp, Homo sapiens
agcccattggccgagctcct

SEQ ID NO: 6634991 - DNA, 19 bp, Homo sapiens
agcccattgtggcctaaga

SEQ ID NO: 6634992 - DNA, 19 bp, Homo sapiens
agcccatttggagggcctg

SEQ ID NO: 6634993 - DNA, 21 bp, Homo sapiens
agcccatttggagggcctggg

SEQ ID NO: 6634994 - DNA, 19 bp, Homo sapiens
agcccattttgaggccaga

SEQ ID NO: 6634995 - DNA, 20 bp, Homo sapiens
agccccaacccaaacctgga

SEQ ID NO: 6634996 - DNA, 22 bp, Homo sapiens
agccccaacccaaacctggaga

SEQ ID NO: 6634997 - DNA, 19 bp, Homo sapiens
agccccaactccaggggca

SEQ ID NO: 6634998 - DNA, 21 bp, Homo sapiens
agccccaactccaggggcacc

SEQ ID NO: 6634999 - DNA, 19 bp, Homo sapiens
agccccaagactctgctct

SEQ ID NO: 6635000 - DNA, 14 bp, Homo sapiens
agccccaagctggg

SEQ ID NO: 6635001 - DNA, 15 bp, Homo sapiens
agccccaaggggtgg

SEQ ID NO: 6635002 - DNA, 16 bp, Homo sapiens
agccccaaggggtggc

SEQ ID NO: 6635003 - DNA, 15 bp, Homo sapiens
agccccaagtcctga

SEQ ID NO: 6635004 - DNA, 21 bp, Homo sapiens
agccccaatatggtggccctg

SEQ ID NO: 6635005 - DNA, 15 bp, Homo sapiens
agccccaatccagag

SEQ ID NO: 6635006 - DNA, 12 bp, Homo sapiens
agccccacacag

SEQ ID NO: 6635007 - DNA, 14 bp, Homo sapiens
agccccacacagct

SEQ ID NO: 6635008 - DNA, 12 bp, Homo sapiens
agccccacaccc

SEQ ID NO: 6635009 - DNA, 14 bp, Homo sapiens
agccccacacccta

SEQ ID NO: 6635010 - DNA, 20 bp, Homo sapiens
agccccacactggggtgccg

SEQ ID NO: 6635011 - DNA, 19 bp, Homo sapiens
agccccacagcacccaggc

SEQ ID NO: 6635012 - DNA, 22 bp, Homo sapiens
agccccacagcacccaggctcc

SEQ ID NO: 6635013 - DNA, 16 bp, Homo sapiens
agccccacagcccacg

SEQ ID NO: 6635014 - DNA, 22 bp, Homo sapiens
agccccacagcctggcacgaag

SEQ ID NO: 6635015 - DNA, 15 bp, Homo sapiens
agccccacagttctt

SEQ ID NO: 6635016 - DNA, 13 bp, Homo sapiens
agccccacccagg

SEQ ID NO: 6635017 - DNA, 16 bp, Homo sapiens
agccccacccaggagg

SEQ ID NO: 6635018 - DNA, 20 bp, Homo sapiens
agccccacccccagccaggc

SEQ ID NO: 6635019 - DNA, 21 bp, Homo sapiens
agccccacccccagccaggct

SEQ ID NO: 6635020 - DNA, 22 bp, Homo sapiens
agccccacccctaagtgcccaa

SEQ ID NO: 6635021 - DNA, 23 bp, Homo sapiens
agccccaccctccttgagactgg

SEQ ID NO: 6635022 - DNA, 19 bp, Homo sapiens
agccccacctctccaagtc

SEQ ID NO: 6635023 - DNA, 22 bp, Homo sapiens
agccccacctctccaagtctct

SEQ ID NO: 6635024 - DNA, 13 bp, Homo sapiens
agccccactcctc

SEQ ID NO: 6635025 - DNA, 15 bp, Homo sapiens
agccccactctcaga

SEQ ID NO: 6635026 - DNA, 16 bp, Homo sapiens
agccccactctcagag

SEQ ID NO: 6635027 - DNA, 21 bp, Homo sapiens
agccccactctcagaggcccc

SEQ ID NO: 6635028 - DNA, 20 bp, Homo sapiens
agccccactgccagcagcag

SEQ ID NO: 6635029 - DNA, 15 bp, Homo sapiens
agccccactgccctc

SEQ ID NO: 6635030 - DNA, 19 bp, Homo sapiens
agccccactgccctccagg

SEQ ID NO: 6635031 - DNA, 15 bp, Homo sapiens
agccccactgccctt

SEQ ID NO: 6635032 - DNA, 12 bp, Homo sapiens
agccccacttca

SEQ ID NO: 6635033 - DNA, 20 bp, Homo sapiens
agccccacttcacccccaac

SEQ ID NO: 6635034 - DNA, 13 bp, Homo sapiens
agccccacttctg

SEQ ID NO: 6635035 - DNA, 15 bp, Homo sapiens
agccccagaacccca

SEQ ID NO: 6635036 - DNA, 16 bp, Homo sapiens
agccccagactgggcc

SEQ ID NO: 6635037 - DNA, 19 bp, Homo sapiens
agccccagactgggcccag

SEQ ID NO: 6635038 - DNA, 11 bp, Homo sapiens
agccccagaga

SEQ ID NO: 6635039 - DNA, 18 bp, Homo sapiens
agccccagagatgccagc

SEQ ID NO: 6635040 - DNA, 20 bp, Homo sapiens
agccccagagatgccagccc

SEQ ID NO: 6635041 - DNA, 12 bp, Homo sapiens
agccccagagca

SEQ ID NO: 6635042 - DNA, 16 bp, Homo sapiens
agccccagagcagggt

SEQ ID NO: 6635043 - DNA, 12 bp, Homo sapiens
agccccagcaag

SEQ ID NO: 6635044 - DNA, 12 bp, Homo sapiens
agccccagcact

SEQ ID NO: 6635045 - DNA, 12 bp, Homo sapiens
agccccagccag

SEQ ID NO: 6635046 - DNA, 17 bp, Homo sapiens
agccccagccagccctt

SEQ ID NO: 6635047 - DNA, 18 bp, Homo sapiens
agccccagccagcccttc

SEQ ID NO: 6635048 - DNA, 13 bp, Homo sapiens
agccccagcccag

SEQ ID NO: 6635049 - DNA, 14 bp, Homo sapiens
agccccagcccaga

SEQ ID NO: 6635050 - DNA, 14 bp, Homo sapiens
agccccagcccagc

SEQ ID NO: 6635051 - DNA, 23 bp, Homo sapiens
agccccagcccagcccagctgct

SEQ ID NO: 6635052 - DNA, 13 bp, Homo sapiens
agccccagcccca

SEQ ID NO: 6635053 - DNA, 15 bp, Homo sapiens
agccccagccccaat

SEQ ID NO: 6635054 - DNA, 15 bp, Homo sapiens
agccccagccccgtc

SEQ ID NO: 6635055 - DNA, 13 bp, Homo sapiens
agccccagcccct

SEQ ID NO: 6635056 - DNA, 16 bp, Homo sapiens
agccccagccccttcc

SEQ ID NO: 6635057 - DNA, 15 bp, Homo sapiens
agccccagcctgcta

SEQ ID NO: 6635058 - DNA, 12 bp, Homo sapiens
agccccagctga

SEQ ID NO: 6635059 - DNA, 19 bp, Homo sapiens
agccccagcttatctcctc

SEQ ID NO: 6635060 - DNA, 12 bp, Homo sapiens
agccccagcttg

SEQ ID NO: 6635061 - DNA, 16 bp, Homo sapiens
agccccaggcaggctg

SEQ ID NO: 6635062 - DNA, 21 bp, Homo sapiens
agccccaggcccgccctgccc

SEQ ID NO: 6635063 - DNA, 15 bp, Homo sapiens
agccccaggcctggc

SEQ ID NO: 6635064 - DNA, 18 bp, Homo sapiens
agccccaggcctggcctc

SEQ ID NO: 6635065 - DNA, 15 bp, Homo sapiens
agccccagggcccta

SEQ ID NO: 6635066 - DNA, 17 bp, Homo sapiens
agccccagggccctgct

SEQ ID NO: 6635067 - DNA, 13 bp, Homo sapiens
agccccagggcct

SEQ ID NO: 6635068 - DNA, 16 bp, Homo sapiens
agccccagggcctggg

SEQ ID NO: 6635069 - DNA, 14 bp, Homo sapiens
agccccaggggggc

SEQ ID NO: 6635070 - DNA, 18 bp, Homo sapiens
agccccaggggggcctcc

SEQ ID NO: 6635071 - DNA, 19 bp, Homo sapiens
agccccaggggggcctcct

SEQ ID NO: 6635072 - DNA, 20 bp, Homo sapiens
agccccagggtcttccctac

SEQ ID NO: 6635073 - DNA, 14 bp, Homo sapiens
agccccagggtgag

SEQ ID NO: 6635074 - DNA, 23 bp, Homo sapiens
agccccagggtttacatgaagca

SEQ ID NO: 6635075 - DNA, 15 bp, Homo sapiens
agccccagtcttcct

SEQ ID NO: 6635076 - DNA, 16 bp, Homo sapiens
agccccagtcttcctt

SEQ ID NO: 6635077 - DNA, 17 bp, Homo sapiens
agccccagtgacagcta

SEQ ID NO: 6635078 - DNA, 13 bp, Homo sapiens
agccccagtgcca

SEQ ID NO: 6635079 - DNA, 20 bp, Homo sapiens
agccccagtgccaagcacag

SEQ ID NO: 6635080 - DNA, 23 bp, Homo sapiens
agccccagtgccaagcacagtgc

SEQ ID NO: 6635081 - DNA, 15 bp, Homo sapiens
agccccagtgcccac

SEQ ID NO: 6635082 - DNA, 15 bp, Homo sapiens
agccccatagaaaac

SEQ ID NO: 6635083 - DNA, 20 bp, Homo sapiens
agccccatcagaacctgagc

SEQ ID NO: 6635084 - DNA, 20 bp, Homo sapiens
agccccatcccaaacccttc

SEQ ID NO: 6635085 - DNA, 15 bp, Homo sapiens
agccccatccctgtc

SEQ ID NO: 6635086 - DNA, 15 bp, Homo sapiens
agccccatccttccc

SEQ ID NO: 6635087 - DNA, 19 bp, Homo sapiens
agccccatccttcccgcag

SEQ ID NO: 6635088 - DNA, 19 bp, Homo sapiens
agccccatcgccccaactc

SEQ ID NO: 6635089 - DNA, 17 bp, Homo sapiens
agccccatctcatcctg

SEQ ID NO: 6635090 - DNA, 21 bp, Homo sapiens
agccccatctcatcctggcac

SEQ ID NO: 6635091 - DNA, 15 bp, Homo sapiens
agccccatctgtgca

SEQ ID NO: 6635092 - DNA, 19 bp, Homo sapiens
agccccatcttggtcctgt

SEQ ID NO: 6635093 - DNA, 18 bp, Homo sapiens
agccccatgctggagcct

SEQ ID NO: 6635094 - DNA, 23 bp, Homo sapiens
agccccatgtgccttgtccagga

SEQ ID NO: 6635095 - DNA, 18 bp, Homo sapiens
agccccattcacggcctg

SEQ ID NO: 6635096 - DNA, 16 bp, Homo sapiens
agccccattcctggga

SEQ ID NO: 6635097 - DNA, 16 bp, Homo sapiens
agccccattctgcctg

SEQ ID NO: 6635098 - DNA, 18 bp, Homo sapiens
agccccattctgcctgcc

SEQ ID NO: 6635099 - DNA, 19 bp, Homo sapiens
agcccccaaagagctgtgg

SEQ ID NO: 6635100 - DNA, 21 bp, Homo sapiens
agcccccaagcctctgcccca

SEQ ID NO: 6635101 - DNA, 16 bp, Homo sapiens
agcccccacagtgctg

SEQ ID NO: 6635102 - DNA, 18 bp, Homo sapiens
agcccccaccacaaactt

SEQ ID NO: 6635103 - DNA, 13 bp, Homo sapiens
agcccccaccagc

SEQ ID NO: 6635104 - DNA, 16 bp, Homo sapiens
agcccccaccagcagc

SEQ ID NO: 6635105 - DNA, 18 bp, Homo sapiens
agcccccaccaggggaag

SEQ ID NO: 6635106 - DNA, 20 bp, Homo sapiens
agcccccaccaggggaagga

SEQ ID NO: 6635107 - DNA, 11 bp, Homo sapiens
agcccccaccc

SEQ ID NO: 6635108 - DNA, 19 bp, Homo sapiens
agcccccacccacttccct

SEQ ID NO: 6635109 - DNA, 21 bp, Homo sapiens
agcccccacccatgccagcgc

SEQ ID NO: 6635110 - DNA, 16 bp, Homo sapiens
agcccccaccccagca

SEQ ID NO: 6635111 - DNA, 20 bp, Homo sapiens
agcccccaccccagcacagc

SEQ ID NO: 6635112 - DNA, 20 bp, Homo sapiens
agcccccacccccgtcaccc

SEQ ID NO: 6635113 - DNA, 14 bp, Homo sapiens
agcccccacccggg

SEQ ID NO: 6635114 - DNA, 22 bp, Homo sapiens
agcccccaccctgttcctgctg

SEQ ID NO: 6635115 - DNA, 19 bp, Homo sapiens
agcccccaccggaactggg

SEQ ID NO: 6635116 - DNA, 22 bp, Homo sapiens
agcccccaccggaactgggctg

SEQ ID NO: 6635117 - DNA, 17 bp, Homo sapiens
agcccccactgacctgc

SEQ ID NO: 6635118 - DNA, 20 bp, Homo sapiens
agcccccactgacctgccca

SEQ ID NO: 6635119 - DNA, 23 bp, Homo sapiens
agcccccactgacctgcccatgt

SEQ ID NO: 6635120 - DNA, 16 bp, Homo sapiens
agcccccactgcctgg

SEQ ID NO: 6635121 - DNA, 16 bp, Homo sapiens
agcccccacttctctc

SEQ ID NO: 6635122 - DNA, 12 bp, Homo sapiens
agcccccagagc

SEQ ID NO: 6635123 - DNA, 18 bp, Homo sapiens
agcccccagcagaggcag

SEQ ID NO: 6635124 - DNA, 13 bp, Homo sapiens
agcccccagccct

SEQ ID NO: 6635125 - DNA, 12 bp, Homo sapiens
agcccccagcct

SEQ ID NO: 6635126 - DNA, 15 bp, Homo sapiens
agcccccagcctgtc

SEQ ID NO: 6635127 - DNA, 13 bp, Homo sapiens
agcccccagcctt

SEQ ID NO: 6635128 - DNA, 12 bp, Homo sapiens
agcccccagcta

SEQ ID NO: 6635129 - DNA, 19 bp, Homo sapiens
agcccccagctaagaacct

SEQ ID NO: 6635130 - DNA, 20 bp, Homo sapiens
agcccccagctaagaacctg

SEQ ID NO: 6635131 - DNA, 21 bp, Homo sapiens
agcccccagcttccagcagga

SEQ ID NO: 6635132 - DNA, 22 bp, Homo sapiens
agcccccagcttccagcaggag

SEQ ID NO: 6635133 - DNA, 13 bp, Homo sapiens
agcccccaggatc

SEQ ID NO: 6635134 - DNA, 11 bp, Homo sapiens
agcccccaggc

SEQ ID NO: 6635135 - DNA, 13 bp, Homo sapiens
agcccccagggcc

SEQ ID NO: 6635136 - DNA, 18 bp, Homo sapiens
agcccccatcacccaagc

SEQ ID NO: 6635137 - DNA, 22 bp, Homo sapiens
agcccccatgggctcctgcccc

SEQ ID NO: 6635138 - DNA, 20 bp, Homo sapiens
agccccccacgcttctggag

SEQ ID NO: 6635139 - DNA, 14 bp, Homo sapiens
agccccccactcag

SEQ ID NO: 6635140 - DNA, 14 bp, Homo sapiens
agccccccagctcc

SEQ ID NO: 6635141 - DNA, 18 bp, Homo sapiens
agccccccagctcccaca

SEQ ID NO: 6635142 - DNA, 20 bp, Homo sapiens
agccccccagctcccacacc

SEQ ID NO: 6635143 - DNA, 23 bp, Homo sapiens
agccccccaggctgcccagagct

SEQ ID NO: 6635144 - DNA, 19 bp, Homo sapiens
agccccccagtgtccccag

SEQ ID NO: 6635145 - DNA, 23 bp, Homo sapiens
agccccccatgcccctcccctcc

SEQ ID NO: 6635146 - DNA, 23 bp, Homo sapiens
agcccccccaacactgtgccctg

SEQ ID NO: 6635147 - DNA, 18 bp, Homo sapiens
agcccccccacccacccc

SEQ ID NO: 6635148 - DNA, 21 bp, Homo sapiens
agcccccccacccacccccag

SEQ ID NO: 6635149 - DNA, 22 bp, Homo sapiens
agcccccccacccacccccagg

SEQ ID NO: 6635150 - DNA, 19 bp, Homo sapiens
agcccccccactccagccc

SEQ ID NO: 6635151 - DNA, 14 bp, Homo sapiens
agcccccccctcaa

SEQ ID NO: 6635152 - DNA, 23 bp, Homo sapiens
agcccccccctcaaggggcaggg

SEQ ID NO: 6635153 - DNA, 13 bp, Homo sapiens
agcccccccttcc

SEQ ID NO: 6635154 - DNA, 15 bp, Homo sapiens
agcccccctttggca

SEQ ID NO: 6635155 - DNA, 22 bp, Homo sapiens
agcccccgcagtcgtcagcctc

SEQ ID NO: 6635156 - DNA, 15 bp, Homo sapiens
agcccccgccccaga

SEQ ID NO: 6635157 - DNA, 22 bp, Homo sapiens
agcccccgcccctccccctaca

SEQ ID NO: 6635158 - DNA, 13 bp, Homo sapiens
agccccctcatct

SEQ ID NO: 6635159 - DNA, 23 bp, Homo sapiens
agccccctcatctgcaggacaga

SEQ ID NO: 6635160 - DNA, 15 bp, Homo sapiens
agccccctccacacc

SEQ ID NO: 6635161 - DNA, 22 bp, Homo sapiens
agccccctccacaccagtggcc

SEQ ID NO: 6635162 - DNA, 17 bp, Homo sapiens
agccccctccagctcat

SEQ ID NO: 6635163 - DNA, 19 bp, Homo sapiens
agccccctcccaccgctgc

SEQ ID NO: 6635164 - DNA, 13 bp, Homo sapiens
agccccctcccta

SEQ ID NO: 6635165 - DNA, 12 bp, Homo sapiens
agccccctcctg

SEQ ID NO: 6635166 - DNA, 16 bp, Homo sapiens
agccccctcctgaccc

SEQ ID NO: 6635167 - DNA, 17 bp, Homo sapiens
agccccctcctgacccc

SEQ ID NO: 6635168 - DNA, 14 bp, Homo sapiens
agccccctctcctg

SEQ ID NO: 6635169 - DNA, 19 bp, Homo sapiens
agccccctgaccactcaga

SEQ ID NO: 6635170 - DNA, 20 bp, Homo sapiens
agccccctgaccactcagag

SEQ ID NO: 6635171 - DNA, 13 bp, Homo sapiens
agccccctgcacc

SEQ ID NO: 6635172 - DNA, 15 bp, Homo sapiens
agccccctgcaccca

SEQ ID NO: 6635173 - DNA, 21 bp, Homo sapiens
agccccctgcacccacccctg

SEQ ID NO: 6635174 - DNA, 22 bp, Homo sapiens
agccccctgcacccacccctgc

SEQ ID NO: 6635175 - DNA, 11 bp, Homo sapiens
agccccctgct

SEQ ID NO: 6635176 - DNA, 15 bp, Homo sapiens
agccccctgcttctc

SEQ ID NO: 6635177 - DNA, 23 bp, Homo sapiens
agccccctggatgtcccctgtcc

SEQ ID NO: 6635178 - DNA, 14 bp, Homo sapiens
agccccctggcagc

SEQ ID NO: 6635179 - DNA, 15 bp, Homo sapiens
agccccctggcagct

SEQ ID NO: 6635180 - DNA, 19 bp, Homo sapiens
agccccctggcagctgccc

SEQ ID NO: 6635181 - DNA, 21 bp, Homo sapiens
agccccctggcagctgcccct

SEQ ID NO: 6635182 - DNA, 23 bp, Homo sapiens
agccccctggcagctgcccctcc

SEQ ID NO: 6635183 - DNA, 14 bp, Homo sapiens
agccccctggcatg

SEQ ID NO: 6635184 - DNA, 16 bp, Homo sapiens
agccccctggcctctg

SEQ ID NO: 6635185 - DNA, 13 bp, Homo sapiens
agccccctgtcct

SEQ ID NO: 6635186 - DNA, 17 bp, Homo sapiens
agccccctttgattgag

SEQ ID NO: 6635187 - DNA, 18 bp, Homo sapiens
agccccctttgggcccag

SEQ ID NO: 6635188 - DNA, 17 bp, Homo sapiens
agccccgacccctgtcc

SEQ ID NO: 6635189 - DNA, 14 bp, Homo sapiens
agccccgactccag

SEQ ID NO: 6635190 - DNA, 16 bp, Homo sapiens
agccccgactccagcc

SEQ ID NO: 6635191 - DNA, 17 bp, Homo sapiens
agccccgactccagcca

SEQ ID NO: 6635192 - DNA, 21 bp, Homo sapiens
agccccgactccagccagcgc

SEQ ID NO: 6635193 - DNA, 15 bp, Homo sapiens
agccccgacttcctg

SEQ ID NO: 6635194 - DNA, 24 bp, Homo sapiens
agccccgagacaccatcctgagcc

SEQ ID NO: 6635195 - DNA, 17 bp, Homo sapiens
agccccgaggccttctc

SEQ ID NO: 6635196 - DNA, 13 bp, Homo sapiens
agccccgcacggg

SEQ ID NO: 6635197 - DNA, 14 bp, Homo sapiens
agccccgcagacct

SEQ ID NO: 6635198 - DNA, 16 bp, Homo sapiens
agccccgccaggtgcc

SEQ ID NO: 6635199 - DNA, 18 bp, Homo sapiens
agccccgccccagccctc

SEQ ID NO: 6635200 - DNA, 21 bp, Homo sapiens
agccccgccccagccctcagt

SEQ ID NO: 6635201 - DNA, 23 bp, Homo sapiens
agccccgccccgttgtgagctgg

SEQ ID NO: 6635202 - DNA, 13 bp, Homo sapiens
agccccgcctgtc

SEQ ID NO: 6635203 - DNA, 16 bp, Homo sapiens
agccccgcctgtcaca

SEQ ID NO: 6635204 - DNA, 22 bp, Homo sapiens
agccccgcgaccacccctgtgc

SEQ ID NO: 6635205 - DNA, 18 bp, Homo sapiens
agccccgcgcctccttcc

SEQ ID NO: 6635206 - DNA, 22 bp, Homo sapiens
agccccgcggatcaaccaggca

SEQ ID NO: 6635207 - DNA, 23 bp, Homo sapiens
agccccgctcaggtagccaccac

SEQ ID NO: 6635208 - DNA, 20 bp, Homo sapiens
agccccgctcctcccctctt

SEQ ID NO: 6635209 - DNA, 13 bp, Homo sapiens
agccccggccact

SEQ ID NO: 6635210 - DNA, 14 bp, Homo sapiens
agccccggccactc

SEQ ID NO: 6635211 - DNA, 22 bp, Homo sapiens
agccccggccactccctgccaa

SEQ ID NO: 6635212 - DNA, 21 bp, Homo sapiens
agccccggccctgggctcgga

SEQ ID NO: 6635213 - DNA, 16 bp, Homo sapiens
agccccgggcctgcct

SEQ ID NO: 6635214 - DNA, 16 bp, Homo sapiens
agccccgggctgaccc

SEQ ID NO: 6635215 - DNA, 24 bp, Homo sapiens
agccccggggtgagtccattctcc

SEQ ID NO: 6635216 - DNA, 18 bp, Homo sapiens
agccccgtcccagaggcc

SEQ ID NO: 6635217 - DNA, 23 bp, Homo sapiens
agccccgtcccagaggccgctgc

SEQ ID NO: 6635218 - DNA, 13 bp, Homo sapiens
agccccgtctgac

SEQ ID NO: 6635219 - DNA, 16 bp, Homo sapiens
agccccgtctgcccac

SEQ ID NO: 6635220 - DNA, 16 bp, Homo sapiens
agccccgttttgggga

SEQ ID NO: 6635221 - DNA, 21 bp, Homo sapiens
agcccctaccttgagaccctc

SEQ ID NO: 6635222 - DNA, 12 bp, Homo sapiens
agcccctagaaa

SEQ ID NO: 6635223 - DNA, 18 bp, Homo sapiens
agcccctagcccaggaga

SEQ ID NO: 6635224 - DNA, 21 bp, Homo sapiens
agcccctatagcactgagctc

SEQ ID NO: 6635225 - DNA, 20 bp, Homo sapiens
agcccctatcctgcaccctc

SEQ ID NO: 6635226 - DNA, 21 bp, Homo sapiens
agcccctatcctgcaccctct

SEQ ID NO: 6635227 - DNA, 13 bp, Homo sapiens
agcccctcaaaga

SEQ ID NO: 6635228 - DNA, 15 bp, Homo sapiens
agcccctcacctcag

SEQ ID NO: 6635229 - DNA, 16 bp, Homo sapiens
agcccctcacctcagg

SEQ ID NO: 6635230 - DNA, 20 bp, Homo sapiens
agcccctcacctcaggaccc

SEQ ID NO: 6635231 - DNA, 15 bp, Homo sapiens
agcccctcagccctt

SEQ ID NO: 6635232 - DNA, 17 bp, Homo sapiens
agcccctcatcagcctt

SEQ ID NO: 6635233 - DNA, 18 bp, Homo sapiens
agcccctcatcagccttt

SEQ ID NO: 6635234 - DNA, 13 bp, Homo sapiens
agcccctcccaag

SEQ ID NO: 6635235 - DNA, 21 bp, Homo sapiens
agcccctcccaagctggctgg

SEQ ID NO: 6635236 - DNA, 13 bp, Homo sapiens
agcccctcccacc

SEQ ID NO: 6635237 - DNA, 18 bp, Homo sapiens
agcccctcccaccacagc

SEQ ID NO: 6635238 - DNA, 22 bp, Homo sapiens
agcccctccccagactctcagg

SEQ ID NO: 6635239 - DNA, 21 bp, Homo sapiens
agcccctcccccatctcccac

SEQ ID NO: 6635240 - DNA, 17 bp, Homo sapiens
agcccctccccgcctcc

SEQ ID NO: 6635241 - DNA, 18 bp, Homo sapiens
agcccctccctcctctga

SEQ ID NO: 6635242 - DNA, 13 bp, Homo sapiens
agcccctcctcca

SEQ ID NO: 6635243 - DNA, 23 bp, Homo sapiens
agcccctcctccagcccctgtcc

SEQ ID NO: 6635244 - DNA, 13 bp, Homo sapiens
agcccctcctccc

SEQ ID NO: 6635245 - DNA, 19 bp, Homo sapiens
agcccctcctcccccggct

SEQ ID NO: 6635246 - DNA, 17 bp, Homo sapiens
agcccctcctccccttc

SEQ ID NO: 6635247 - DNA, 19 bp, Homo sapiens
agcccctcctccctcaggc

SEQ ID NO: 6635248 - DNA, 19 bp, Homo sapiens
agcccctcctccctgccct

SEQ ID NO: 6635249 - DNA, 13 bp, Homo sapiens
agcccctcctctc

SEQ ID NO: 6635250 - DNA, 18 bp, Homo sapiens
agcccctcctctcctcgt

SEQ ID NO: 6635251 - DNA, 17 bp, Homo sapiens
agcccctcctctgagca

SEQ ID NO: 6635252 - DNA, 14 bp, Homo sapiens
agcccctcctctgc

SEQ ID NO: 6635253 - DNA, 15 bp, Homo sapiens
agcccctcctctgcc

SEQ ID NO: 6635254 - DNA, 17 bp, Homo sapiens
agcccctcctctgccac

SEQ ID NO: 6635255 - DNA, 18 bp, Homo sapiens
agcccctcctctgccacc

SEQ ID NO: 6635256 - DNA, 21 bp, Homo sapiens
agcccctcctctgccacctcc

SEQ ID NO: 6635257 - DNA, 22 bp, Homo sapiens
agcccctcctctgccacctccc

SEQ ID NO: 6635258 - DNA, 14 bp, Homo sapiens
agcccctccttctc

SEQ ID NO: 6635259 - DNA, 14 bp, Homo sapiens
agcccctcgaggcc

SEQ ID NO: 6635260 - DNA, 18 bp, Homo sapiens
agcccctcgaggcctaca

SEQ ID NO: 6635261 - DNA, 21 bp, Homo sapiens
agcccctctcccctctctgct

SEQ ID NO: 6635262 - DNA, 15 bp, Homo sapiens
agcccctctctcaca

SEQ ID NO: 6635263 - DNA, 22 bp, Homo sapiens
agcccctctggtcgctcctgcc

SEQ ID NO: 6635264 - DNA, 12 bp, Homo sapiens
agcccctcttcc

SEQ ID NO: 6635265 - DNA, 17 bp, Homo sapiens
agcccctcttcccttcc

SEQ ID NO: 6635266 - DNA, 18 bp, Homo sapiens
agcccctcttcccttcct

SEQ ID NO: 6635267 - DNA, 23 bp, Homo sapiens
agcccctcttgccccccacccca

SEQ ID NO: 6635268 - DNA, 15 bp, Homo sapiens
agcccctcttggaga

SEQ ID NO: 6635269 - DNA, 23 bp, Homo sapiens
agcccctcttggagaagtctcag

SEQ ID NO: 6635270 - DNA, 21 bp, Homo sapiens
agcccctcttttcccacattc

SEQ ID NO: 6635271 - DNA, 12 bp, Homo sapiens
agcccctgagag

SEQ ID NO: 6635272 - DNA, 10 bp, Homo sapiens
agcccctgcc

SEQ ID NO: 6635273 - DNA, 14 bp, Homo sapiens
agcccctgccattg

SEQ ID NO: 6635274 - DNA, 12 bp, Homo sapiens
agcccctgcccc

SEQ ID NO: 6635275 - DNA, 15 bp, Homo sapiens
agcccctgccccagc

SEQ ID NO: 6635276 - DNA, 16 bp, Homo sapiens
agcccctgccccagcc

SEQ ID NO: 6635277 - DNA, 13 bp, Homo sapiens
agcccctgccctg

SEQ ID NO: 6635278 - DNA, 12 bp, Homo sapiens
agcccctgcctg

SEQ ID NO: 6635279 - DNA, 21 bp, Homo sapiens
agcccctggacatgcctgtcc

SEQ ID NO: 6635280 - DNA, 23 bp, Homo sapiens
agcccctggacatgcctgtcctg

SEQ ID NO: 6635281 - DNA, 15 bp, Homo sapiens
agcccctggacccct

SEQ ID NO: 6635282 - DNA, 21 bp, Homo sapiens
agcccctggacccctggggtg

SEQ ID NO: 6635283 - DNA, 20 bp, Homo sapiens
agcccctggagctcctgctg

SEQ ID NO: 6635284 - DNA, 17 bp, Homo sapiens
agcccctggatgcagcc

SEQ ID NO: 6635285 - DNA, 17 bp, Homo sapiens
agcccctggcactgcag

SEQ ID NO: 6635286 - DNA, 19 bp, Homo sapiens
agcccctgggaacaggccc

SEQ ID NO: 6635287 - DNA, 21 bp, Homo sapiens
agcccctgggaacaggcccca

SEQ ID NO: 6635288 - DNA, 12 bp, Homo sapiens
agcccctgggac

SEQ ID NO: 6635289 - DNA, 17 bp, Homo sapiens
agcccctgggcccttgt

SEQ ID NO: 6635290 - DNA, 12 bp, Homo sapiens
agcccctggggc

SEQ ID NO: 6635291 - DNA, 17 bp, Homo sapiens
agcccctggggcccagc

SEQ ID NO: 6635292 - DNA, 20 bp, Homo sapiens
agcccctggggcccagcccc

SEQ ID NO: 6635293 - DNA, 13 bp, Homo sapiens
agcccctggtctt

SEQ ID NO: 6635294 - DNA, 17 bp, Homo sapiens
agcccctggtcttctct

SEQ ID NO: 6635295 - DNA, 13 bp, Homo sapiens
agcccctgtctaa

SEQ ID NO: 6635296 - DNA, 12 bp, Homo sapiens
agcccctgtgtc

SEQ ID NO: 6635297 - DNA, 23 bp, Homo sapiens
agcccctgtgtgggagggcgagg

SEQ ID NO: 6635298 - DNA, 20 bp, Homo sapiens
agcccctgtttactggttct

SEQ ID NO: 6635299 - DNA, 18 bp, Homo sapiens
agcccctgttttctgctg

SEQ ID NO: 6635300 - DNA, 22 bp, Homo sapiens
agccccttactatgatctcagg

SEQ ID NO: 6635301 - DNA, 21 bp, Homo sapiens
agccccttcatccgcctgtgg

SEQ ID NO: 6635302 - DNA, 13 bp, Homo sapiens
agccccttcccca

SEQ ID NO: 6635303 - DNA, 17 bp, Homo sapiens
agccccttccccatggg

SEQ ID NO: 6635304 - DNA, 13 bp, Homo sapiens
agccccttcccct

SEQ ID NO: 6635305 - DNA, 18 bp, Homo sapiens
agccccttcccctgggaa

SEQ ID NO: 6635306 - DNA, 19 bp, Homo sapiens
agccccttcccctgggaac

SEQ ID NO: 6635307 - DNA, 16 bp, Homo sapiens
agccccttcctgggta

SEQ ID NO: 6635308 - DNA, 17 bp, Homo sapiens
agccccttccttgctct

SEQ ID NO: 6635309 - DNA, 23 bp, Homo sapiens
agccccttccttgctctgcaccc

SEQ ID NO: 6635310 - DNA, 20 bp, Homo sapiens
agccccttcgaggttgcccc

SEQ ID NO: 6635311 - DNA, 22 bp, Homo sapiens
agccccttcgggagcagggctg

SEQ ID NO: 6635312 - DNA, 19 bp, Homo sapiens
agccccttctcagaatcta

SEQ ID NO: 6635313 - DNA, 14 bp, Homo sapiens
agccccttctctca

SEQ ID NO: 6635314 - DNA, 20 bp, Homo sapiens
agccccttctctcaatccct

SEQ ID NO: 6635315 - DNA, 15 bp, Homo sapiens
agccccttctgaccc

SEQ ID NO: 6635316 - DNA, 17 bp, Homo sapiens
agccccttgagaaacct

SEQ ID NO: 6635317 - DNA, 15 bp, Homo sapiens
agccccttggagaga

SEQ ID NO: 6635318 - DNA, 19 bp, Homo sapiens
agccccttggattcctgca

SEQ ID NO: 6635319 - DNA, 18 bp, Homo sapiens
agccccttgtcctctccc

SEQ ID NO: 6635320 - DNA, 19 bp, Homo sapiens
agccccttgtcctctcccg

SEQ ID NO: 6635321 - DNA, 14 bp, Homo sapiens
agcccctttgcctc

SEQ ID NO: 6635322 - DNA, 16 bp, Homo sapiens
agcccctttgcctctg

SEQ ID NO: 6635323 - DNA, 23 bp, Homo sapiens
agcccctttttcatatgttgctc

SEQ ID NO: 6635324 - DNA, 14 bp, Homo sapiens
agcccgaagcccag

SEQ ID NO: 6635325 - DNA, 15 bp, Homo sapiens
agcccgaagcccagt

SEQ ID NO: 6635326 - DNA, 21 bp, Homo sapiens
agcccgacagtgccatcccca

SEQ ID NO: 6635327 - DNA, 13 bp, Homo sapiens
agcccgagcccct

SEQ ID NO: 6635328 - DNA, 18 bp, Homo sapiens
agcccgaggaccgggctg

SEQ ID NO: 6635329 - DNA, 19 bp, Homo sapiens
agcccgaggaccgggctgg

SEQ ID NO: 6635330 - DNA, 19 bp, Homo sapiens
agcccgatattctccctga

SEQ ID NO: 6635331 - DNA, 20 bp, Homo sapiens
agcccgatattctccctgac

SEQ ID NO: 6635332 - DNA, 23 bp, Homo sapiens
agcccgatattctccctgacctt

SEQ ID NO: 6635333 - DNA, 19 bp, Homo sapiens
agcccgatgtccctgtccc

SEQ ID NO: 6635334 - DNA, 15 bp, Homo sapiens
agcccgcaactctcc

SEQ ID NO: 6635335 - DNA, 16 bp, Homo sapiens
agcccgcacccccacc

SEQ ID NO: 6635336 - DNA, 17 bp, Homo sapiens
agcccgcacccccaccc

SEQ ID NO: 6635337 - DNA, 19 bp, Homo sapiens
agcccgcacccccaccctt

SEQ ID NO: 6635338 - DNA, 21 bp, Homo sapiens
agcccgcacccccaccctttg

SEQ ID NO: 6635339 - DNA, 13 bp, Homo sapiens
agcccgcagaggt

SEQ ID NO: 6635340 - DNA, 14 bp, Homo sapiens
agcccgcagaggtg

SEQ ID NO: 6635341 - DNA, 12 bp, Homo sapiens
agcccgcagcac

SEQ ID NO: 6635342 - DNA, 13 bp, Homo sapiens
agcccgcagccca

SEQ ID NO: 6635343 - DNA, 14 bp, Homo sapiens
agcccgcatgcagc

SEQ ID NO: 6635344 - DNA, 20 bp, Homo sapiens
agcccgcatgcagcagcttg

SEQ ID NO: 6635345 - DNA, 21 bp, Homo sapiens
agcccgcatgcagcagcttgc

SEQ ID NO: 6635346 - DNA, 16 bp, Homo sapiens
agcccgcccacctggg

SEQ ID NO: 6635347 - DNA, 19 bp, Homo sapiens
agcccgccgtctgcagggg

SEQ ID NO: 6635348 - DNA, 13 bp, Homo sapiens
agcccgcctgcca

SEQ ID NO: 6635349 - DNA, 23 bp, Homo sapiens
agcccgcctgccagtcctagctg

SEQ ID NO: 6635350 - DNA, 17 bp, Homo sapiens
agcccgcctgcgccccc

SEQ ID NO: 6635351 - DNA, 15 bp, Homo sapiens
agcccgcggcctgga

SEQ ID NO: 6635352 - DNA, 16 bp, Homo sapiens
agcccgcggcctggac

SEQ ID NO: 6635353 - DNA, 17 bp, Homo sapiens
agcccgcggcctggacc

SEQ ID NO: 6635354 - DNA, 13 bp, Homo sapiens
agcccgcgtgctg

SEQ ID NO: 6635355 - DNA, 14 bp, Homo sapiens
agcccgctaggctc

SEQ ID NO: 6635356 - DNA, 21 bp, Homo sapiens
agcccgctggagcatgagctc

SEQ ID NO: 6635357 - DNA, 12 bp, Homo sapiens
agcccgcttgct

SEQ ID NO: 6635358 - DNA, 13 bp, Homo sapiens
agcccgcttggcc

SEQ ID NO: 6635359 - DNA, 13 bp, Homo sapiens
agcccgcttttgt

SEQ ID NO: 6635360 - DNA, 13 bp, Homo sapiens
agcccggagctcc

SEQ ID NO: 6635361 - DNA, 14 bp, Homo sapiens
agcccggatgccca

SEQ ID NO: 6635362 - DNA, 14 bp, Homo sapiens
agcccggccaagga

SEQ ID NO: 6635363 - DNA, 21 bp, Homo sapiens
agcccggccaaggacactgat

SEQ ID NO: 6635364 - DNA, 15 bp, Homo sapiens
agcccggccagggcc

SEQ ID NO: 6635365 - DNA, 16 bp, Homo sapiens
agcccggccagggcct

SEQ ID NO: 6635366 - DNA, 21 bp, Homo sapiens
agcccggccagggcctggtgt

SEQ ID NO: 6635367 - DNA, 22 bp, Homo sapiens
agcccggccccacctccctgcg

SEQ ID NO: 6635368 - DNA, 19 bp, Homo sapiens
agcccggccctcccccagc

SEQ ID NO: 6635369 - DNA, 22 bp, Homo sapiens
agcccggccctcccccagctcc

SEQ ID NO: 6635370 - DNA, 22 bp, Homo sapiens
agcccggcctgctcccagcagc

SEQ ID NO: 6635371 - DNA, 18 bp, Homo sapiens
agcccggcgcccctgcca

SEQ ID NO: 6635372 - DNA, 20 bp, Homo sapiens
agcccggcggggaccttggt

SEQ ID NO: 6635373 - DNA, 13 bp, Homo sapiens
agcccggctcctg

SEQ ID NO: 6635374 - DNA, 17 bp, Homo sapiens
agcccggctcggcccag

SEQ ID NO: 6635375 - DNA, 14 bp, Homo sapiens
agcccggctgctgc

SEQ ID NO: 6635376 - DNA, 16 bp, Homo sapiens
agcccggctgctgctt

SEQ ID NO: 6635377 - DNA, 13 bp, Homo sapiens
agcccgggacagg

SEQ ID NO: 6635378 - DNA, 16 bp, Homo sapiens
agcccgggagcctagg

SEQ ID NO: 6635379 - DNA, 17 bp, Homo sapiens
agcccgggctctgcctc

SEQ ID NO: 6635380 - DNA, 21 bp, Homo sapiens
agcccgggctctgcctcccat

SEQ ID NO: 6635381 - DNA, 15 bp, Homo sapiens
agcccgggctgcctg

SEQ ID NO: 6635382 - DNA, 16 bp, Homo sapiens
agcccgggctgcctgg

SEQ ID NO: 6635383 - DNA, 18 bp, Homo sapiens
agcccgggctgcctgggc

SEQ ID NO: 6635384 - DNA, 20 bp, Homo sapiens
agcccgggctgcctgggctg

SEQ ID NO: 6635385 - DNA, 22 bp, Homo sapiens
agcccggggcagagctcagagg

SEQ ID NO: 6635386 - DNA, 22 bp, Homo sapiens
agcccgggtgtgcctgccctgg

SEQ ID NO: 6635387 - DNA, 16 bp, Homo sapiens
agcccggtaagagcaa

SEQ ID NO: 6635388 - DNA, 21 bp, Homo sapiens
agcccggtaagagcaaaagaa

SEQ ID NO: 6635389 - DNA, 16 bp, Homo sapiens
agcccggtgtgaggag

SEQ ID NO: 6635390 - DNA, 22 bp, Homo sapiens
agcccgtcacccttatttatta

SEQ ID NO: 6635391 - DNA, 17 bp, Homo sapiens
agcccgtcaggccacag

SEQ ID NO: 6635392 - DNA, 18 bp, Homo sapiens
agcccgtcaggccacagc

SEQ ID NO: 6635393 - DNA, 23 bp, Homo sapiens
agcccgtcatcttccctttcctc

SEQ ID NO: 6635394 - DNA, 15 bp, Homo sapiens
agcccgtcctcctct

SEQ ID NO: 6635395 - DNA, 20 bp, Homo sapiens
agcccgtcgcgctggacagc

SEQ ID NO: 6635396 - DNA, 17 bp, Homo sapiens
agcccgtgaagcagtgc

SEQ ID NO: 6635397 - DNA, 15 bp, Homo sapiens
agcccgtgacagatg

SEQ ID NO: 6635398 - DNA, 21 bp, Homo sapiens
agcccgtgacagatgccaact

SEQ ID NO: 6635399 - DNA, 18 bp, Homo sapiens
agcccgtgatcccctgct

SEQ ID NO: 6635400 - DNA, 23 bp, Homo sapiens
agcccgtgtccaggagccccgcc

SEQ ID NO: 6635401 - DNA, 17 bp, Homo sapiens
agcccgtgtcctgcctt

SEQ ID NO: 6635402 - DNA, 19 bp, Homo sapiens
agcccgtgtggccccttca

SEQ ID NO: 6635403 - DNA, 15 bp, Homo sapiens
agccctaaacatcat

SEQ ID NO: 6635404 - DNA, 18 bp, Homo sapiens
agccctaaataaatctaa

SEQ ID NO: 6635405 - DNA, 18 bp, Homo sapiens
agccctaacatagtgtct

SEQ ID NO: 6635406 - DNA, 21 bp, Homo sapiens
agccctaaccccttccagatc

SEQ ID NO: 6635407 - DNA, 17 bp, Homo sapiens
agccctaacttctgtaa

SEQ ID NO: 6635408 - DNA, 15 bp, Homo sapiens
agccctaagcctgtc

SEQ ID NO: 6635409 - DNA, 19 bp, Homo sapiens
agccctaaggtcctaaggc

SEQ ID NO: 6635410 - DNA, 22 bp, Homo sapiens
agccctaagtggctgccttctt

SEQ ID NO: 6635411 - DNA, 17 bp, Homo sapiens
agccctacagagctgtg

SEQ ID NO: 6635412 - DNA, 20 bp, Homo sapiens
agccctacatcttcagctcc

SEQ ID NO: 6635413 - DNA, 15 bp, Homo sapiens
agccctactcctgcg

SEQ ID NO: 6635414 - DNA, 16 bp, Homo sapiens
agccctactctgtgta

SEQ ID NO: 6635415 - DNA, 14 bp, Homo sapiens
agccctagagcctg

SEQ ID NO: 6635416 - DNA, 15 bp, Homo sapiens
agccctagagcctgc

SEQ ID NO: 6635417 - DNA, 17 bp, Homo sapiens
agccctagagcctgcct

SEQ ID NO: 6635418 - DNA, 20 bp, Homo sapiens
agccctagagcctgcctgga

SEQ ID NO: 6635419 - DNA, 22 bp, Homo sapiens
agccctagagcctgcctggagc

SEQ ID NO: 6635420 - DNA, 14 bp, Homo sapiens
agccctagccctgc

SEQ ID NO: 6635421 - DNA, 15 bp, Homo sapiens
agccctagccctgct

SEQ ID NO: 6635422 - DNA, 16 bp, Homo sapiens
agccctagccctgctc

SEQ ID NO: 6635423 - DNA, 17 bp, Homo sapiens
agccctagccctgctcc

SEQ ID NO: 6635424 - DNA, 18 bp, Homo sapiens
agccctagccctgctcca

SEQ ID NO: 6635425 - DNA, 21 bp, Homo sapiens
agccctagctgtcccatgggg

SEQ ID NO: 6635426 - DNA, 20 bp, Homo sapiens
agccctagggtggagagcca

SEQ ID NO: 6635427 - DNA, 21 bp, Homo sapiens
agccctagtgggagcccagca

SEQ ID NO: 6635428 - DNA, 23 bp, Homo sapiens
agccctagtgggagcccagcaca

SEQ ID NO: 6635429 - DNA, 17 bp, Homo sapiens
agccctatctatgtcct

SEQ ID NO: 6635430 - DNA, 20 bp, Homo sapiens
agccctatctatgtcctgga

SEQ ID NO: 6635431 - DNA, 21 bp, Homo sapiens
agccctatctatgtcctggaa

SEQ ID NO: 6635432 - DNA, 12 bp, Homo sapiens
agccctatggat

SEQ ID NO: 6635433 - DNA, 15 bp, Homo sapiens
agccctatggatgtg

SEQ ID NO: 6635434 - DNA, 23 bp, Homo sapiens
agccctattggcttactgaaaga

SEQ ID NO: 6635435 - DNA, 17 bp, Homo sapiens
agccctcaacaggccca

SEQ ID NO: 6635436 - DNA, 20 bp, Homo sapiens
agccctcaacaggcccaggg

SEQ ID NO: 6635437 - DNA, 21 bp, Homo sapiens
agccctcaacaggcccaggga

SEQ ID NO: 6635438 - DNA, 22 bp, Homo sapiens
agccctcaactattctgttcca

SEQ ID NO: 6635439 - DNA, 16 bp, Homo sapiens
agccctcacaccctgg

SEQ ID NO: 6635440 - DNA, 13 bp, Homo sapiens
agccctcaccaca

SEQ ID NO: 6635441 - DNA, 14 bp, Homo sapiens
agccctcaccacag

SEQ ID NO: 6635442 - DNA, 22 bp, Homo sapiens
agccctcacccctggttctcat

SEQ ID NO: 6635443 - DNA, 11 bp, Homo sapiens
agccctcacct

SEQ ID NO: 6635444 - DNA, 20 bp, Homo sapiens
agccctcacctctgaggaca

SEQ ID NO: 6635445 - DNA, 18 bp, Homo sapiens
agccctcagaacccttgg

SEQ ID NO: 6635446 - DNA, 19 bp, Homo sapiens
agccctcagaacccttggc

SEQ ID NO: 6635447 - DNA, 11 bp, Homo sapiens
agccctcagat

SEQ ID NO: 6635448 - DNA, 14 bp, Homo sapiens
agccctcagatccc

SEQ ID NO: 6635449 - DNA, 19 bp, Homo sapiens
agccctcagatcccagggt

SEQ ID NO: 6635450 - DNA, 22 bp, Homo sapiens
agccctcagatcccagggtaca

SEQ ID NO: 6635451 - DNA, 13 bp, Homo sapiens
agccctcagccca

SEQ ID NO: 6635452 - DNA, 19 bp, Homo sapiens
agccctcagctggtcctga

SEQ ID NO: 6635453 - DNA, 23 bp, Homo sapiens
agccctcagctggtcctgaccag

SEQ ID NO: 6635454 - DNA, 11 bp, Homo sapiens
agccctcaggc

SEQ ID NO: 6635455 - DNA, 15 bp, Homo sapiens
agccctcaggccagt

SEQ ID NO: 6635456 - DNA, 12 bp, Homo sapiens
agccctcaggct

SEQ ID NO: 6635457 - DNA, 13 bp, Homo sapiens
agccctcaggctc

SEQ ID NO: 6635458 - DNA, 23 bp, Homo sapiens
agccctcaggctccccagaactg

SEQ ID NO: 6635459 - DNA, 18 bp, Homo sapiens
agccctcagtcaccccca

SEQ ID NO: 6635460 - DNA, 17 bp, Homo sapiens
agccctcagtcagttcc

SEQ ID NO: 6635461 - DNA, 17 bp, Homo sapiens
agccctcagttccttca

SEQ ID NO: 6635462 - DNA, 21 bp, Homo sapiens
agccctcatcccacttccttt

SEQ ID NO: 6635463 - DNA, 23 bp, Homo sapiens
agccctcatcccacttcctttcc

SEQ ID NO: 6635464 - DNA, 23 bp, Homo sapiens
agccctcatcttgaagggcccag

SEQ ID NO: 6635465 - DNA, 15 bp, Homo sapiens
agccctccaaaagca

SEQ ID NO: 6635466 - DNA, 19 bp, Homo sapiens
agccctccacttctggtat

SEQ ID NO: 6635467 - DNA, 14 bp, Homo sapiens
agccctccagagca

SEQ ID NO: 6635468 - DNA, 15 bp, Homo sapiens
agccctccaggcctg

SEQ ID NO: 6635469 - DNA, 16 bp, Homo sapiens
agccctccaggcctgc

SEQ ID NO: 6635470 - DNA, 19 bp, Homo sapiens
agccctccatggcctggca

SEQ ID NO: 6635471 - DNA, 13 bp, Homo sapiens
agccctccatggt

SEQ ID NO: 6635472 - DNA, 20 bp, Homo sapiens
agccctccatggtcctgtct

SEQ ID NO: 6635473 - DNA, 13 bp, Homo sapiens
agccctcccactt

SEQ ID NO: 6635474 - DNA, 14 bp, Homo sapiens
agccctcccagctg

SEQ ID NO: 6635475 - DNA, 22 bp, Homo sapiens
agccctccccacctgctcacca

SEQ ID NO: 6635476 - DNA, 22 bp, Homo sapiens
agccctccccatctcggggctg

SEQ ID NO: 6635477 - DNA, 16 bp, Homo sapiens
agccctccccccagct

SEQ ID NO: 6635478 - DNA, 21 bp, Homo sapiens
agccctccccccagctccctg

SEQ ID NO: 6635479 - DNA, 16 bp, Homo sapiens
agccctccccctcaac

SEQ ID NO: 6635480 - DNA, 19 bp, Homo sapiens
agccctccccctcaacctc

SEQ ID NO: 6635481 - DNA, 23 bp, Homo sapiens
agccctccccctcaacctcacca

SEQ ID NO: 6635482 - DNA, 15 bp, Homo sapiens
agccctccctgcccc

SEQ ID NO: 6635483 - DNA, 23 bp, Homo sapiens
agccctccctgcccctcccttca

SEQ ID NO: 6635484 - DNA, 21 bp, Homo sapiens
agccctccctggcatgtcaga

SEQ ID NO: 6635485 - DNA, 14 bp, Homo sapiens
agccctccctggct

SEQ ID NO: 6635486 - DNA, 18 bp, Homo sapiens
agccctccctggctgtga

SEQ ID NO: 6635487 - DNA, 23 bp, Homo sapiens
agccctccctggctgtgagcagc

SEQ ID NO: 6635488 - DNA, 17 bp, Homo sapiens
agccctccctgtcctcc

SEQ ID NO: 6635489 - DNA, 22 bp, Homo sapiens
agccctccctgtcctcctcgga

SEQ ID NO: 6635490 - DNA, 17 bp, Homo sapiens
agccctccgccagccct

SEQ ID NO: 6635491 - DNA, 12 bp, Homo sapiens
agccctcctcac

SEQ ID NO: 6635492 - DNA, 14 bp, Homo sapiens
agccctcctcaccc

SEQ ID NO: 6635493 - DNA, 20 bp, Homo sapiens
agccctcctccccagagctg

SEQ ID NO: 6635494 - DNA, 15 bp, Homo sapiens
agccctcctgagcac

SEQ ID NO: 6635495 - DNA, 20 bp, Homo sapiens
agccctcctgagggccggtt

SEQ ID NO: 6635496 - DNA, 21 bp, Homo sapiens
agccctcctggaatggagctg

SEQ ID NO: 6635497 - DNA, 17 bp, Homo sapiens
agccctccttaccactg

SEQ ID NO: 6635498 - DNA, 12 bp, Homo sapiens
agccctccttca

SEQ ID NO: 6635499 - DNA, 15 bp, Homo sapiens
agccctccttcaggg

SEQ ID NO: 6635500 - DNA, 17 bp, Homo sapiens
agccctccttgccaccc

SEQ ID NO: 6635501 - DNA, 13 bp, Homo sapiens
agccctcctttgg

SEQ ID NO: 6635502 - DNA, 20 bp, Homo sapiens
agccctcctttggagcaaag

SEQ ID NO: 6635503 - DNA, 19 bp, Homo sapiens
agccctcgaaccaaggcag

SEQ ID NO: 6635504 - DNA, 22 bp, Homo sapiens
agccctcgaaccaaggcagcct

SEQ ID NO: 6635505 - DNA, 23 bp, Homo sapiens
agccctcgaaccaaggcagcctc

SEQ ID NO: 6635506 - DNA, 13 bp, Homo sapiens
agccctcggcctc

SEQ ID NO: 6635507 - DNA, 20 bp, Homo sapiens
agccctcggcctccgaggct

SEQ ID NO: 6635508 - DNA, 23 bp, Homo sapiens
agccctcgggtccatagagatga

SEQ ID NO: 6635509 - DNA, 14 bp, Homo sapiens
agccctcgtctccc

SEQ ID NO: 6635510 - DNA, 19 bp, Homo sapiens
agccctctcactccagcca

SEQ ID NO: 6635511 - DNA, 21 bp, Homo sapiens
agccctctcactccagccaaa

SEQ ID NO: 6635512 - DNA, 17 bp, Homo sapiens
agccctctcactgtgtc

SEQ ID NO: 6635513 - DNA, 18 bp, Homo sapiens
agccctctcactgtgtcc

SEQ ID NO: 6635514 - DNA, 15 bp, Homo sapiens
agccctctccaccca

SEQ ID NO: 6635515 - DNA, 23 bp, Homo sapiens
agccctctccacccagaggtctc

SEQ ID NO: 6635516 - DNA, 16 bp, Homo sapiens
agccctctccaccctc

SEQ ID NO: 6635517 - DNA, 14 bp, Homo sapiens
agccctctccctca

SEQ ID NO: 6635518 - DNA, 21 bp, Homo sapiens
agccctctcctccctctgtcc

SEQ ID NO: 6635519 - DNA, 15 bp, Homo sapiens
agccctctctctcac

SEQ ID NO: 6635520 - DNA, 18 bp, Homo sapiens
agccctctctctcactcc

SEQ ID NO: 6635521 - DNA, 23 bp, Homo sapiens
agccctctctggctaaggacagg

SEQ ID NO: 6635522 - DNA, 12 bp, Homo sapiens
agccctctgcct

SEQ ID NO: 6635523 - DNA, 22 bp, Homo sapiens
agccctctgcctcctccccagg

SEQ ID NO: 6635524 - DNA, 15 bp, Homo sapiens
agccctctgtggcca

SEQ ID NO: 6635525 - DNA, 17 bp, Homo sapiens
agccctctgtggccagg

SEQ ID NO: 6635526 - DNA, 21 bp, Homo sapiens
agccctctgtggccaggagcc

SEQ ID NO: 6635527 - DNA, 13 bp, Homo sapiens
agccctcttccat

SEQ ID NO: 6635528 - DNA, 23 bp, Homo sapiens
agccctcttccatcatgtcccca

SEQ ID NO: 6635529 - DNA, 16 bp, Homo sapiens
agccctcttgcccgca

SEQ ID NO: 6635530 - DNA, 21 bp, Homo sapiens
agccctcttgggggcactgct

SEQ ID NO: 6635531 - DNA, 22 bp, Homo sapiens
agccctcttgggggcactgctc

SEQ ID NO: 6635532 - DNA, 22 bp, Homo sapiens
agccctctttaatgctgtcttt

SEQ ID NO: 6635533 - DNA, 13 bp, Homo sapiens
agccctctttctc

SEQ ID NO: 6635534 - DNA, 18 bp, Homo sapiens
agccctctttctctctgt

SEQ ID NO: 6635535 - DNA, 21 bp, Homo sapiens
agccctctttctctctgtgtg

SEQ ID NO: 6635536 - DNA, 23 bp, Homo sapiens
agccctgaaacgagaagtgccct

SEQ ID NO: 6635537 - DNA, 21 bp, Homo sapiens
agccctgaacaaagcacctca

SEQ ID NO: 6635538 - DNA, 18 bp, Homo sapiens
agccctgaacatttcatg

SEQ ID NO: 6635539 - DNA, 16 bp, Homo sapiens
agccctgaatttcttc

SEQ ID NO: 6635540 - DNA, 19 bp, Homo sapiens
agccctgaatttcttcttt

SEQ ID NO: 6635541 - DNA, 19 bp, Homo sapiens
agccctgaccttggctgac

SEQ ID NO: 6635542 - DNA, 20 bp, Homo sapiens
agccctgactaaactaccac

SEQ ID NO: 6635543 - DNA, 18 bp, Homo sapiens
agccctgagaaagccctg

SEQ ID NO: 6635544 - DNA, 19 bp, Homo sapiens
agccctgagaaagccctgt

SEQ ID NO: 6635545 - DNA, 17 bp, Homo sapiens
agccctgagactcccgc

SEQ ID NO: 6635546 - DNA, 17 bp, Homo sapiens
agccctgagccatggcg

SEQ ID NO: 6635547 - DNA, 19 bp, Homo sapiens
agccctgagccatggcggc

SEQ ID NO: 6635548 - DNA, 14 bp, Homo sapiens
agccctgagcccgg

SEQ ID NO: 6635549 - DNA, 19 bp, Homo sapiens
agccctgagctcaggctga

SEQ ID NO: 6635550 - DNA, 22 bp, Homo sapiens
agccctgagctcaggctgagcc

SEQ ID NO: 6635551 - DNA, 23 bp, Homo sapiens
agccctgagctcaggctgagccc

SEQ ID NO: 6635552 - DNA, 16 bp, Homo sapiens
agccctgagctggcct

SEQ ID NO: 6635553 - DNA, 10 bp, Homo sapiens
agccctgagg

SEQ ID NO: 6635554 - DNA, 23 bp, Homo sapiens
agccctgaggacagatgcctcct

SEQ ID NO: 6635555 - DNA, 20 bp, Homo sapiens
agccctgaggcctgaggcct

SEQ ID NO: 6635556 - DNA, 15 bp, Homo sapiens
agccctgaggggctg

SEQ ID NO: 6635557 - DNA, 22 bp, Homo sapiens
agccctgaggtttgaatctgac

SEQ ID NO: 6635558 - DNA, 15 bp, Homo sapiens
agccctgagtggtca

SEQ ID NO: 6635559 - DNA, 23 bp, Homo sapiens
agccctgagtggtcactggtcag

SEQ ID NO: 6635560 - DNA, 24 bp, Homo sapiens
agccctgagtggtcactggtcagg

SEQ ID NO: 6635561 - DNA, 18 bp, Homo sapiens
agccctgagtgtcccaag

SEQ ID NO: 6635562 - DNA, 14 bp, Homo sapiens
agccctgagttcct

SEQ ID NO: 6635563 - DNA, 16 bp, Homo sapiens
agccctgattgtgcca

SEQ ID NO: 6635564 - DNA, 17 bp, Homo sapiens
agccctgattgtgccag

SEQ ID NO: 6635565 - DNA, 22 bp, Homo sapiens
agccctgcaccatgctgctggg

SEQ ID NO: 6635566 - DNA, 13 bp, Homo sapiens
agccctgcacgcc

SEQ ID NO: 6635567 - DNA, 19 bp, Homo sapiens
agccctgcagagggcacag

SEQ ID NO: 6635568 - DNA, 21 bp, Homo sapiens
agccctgcagccaaacagagc

SEQ ID NO: 6635569 - DNA, 20 bp, Homo sapiens
agccctgcagtcacgtgagg

SEQ ID NO: 6635570 - DNA, 22 bp, Homo sapiens
agccctgccactcaatgggaga

SEQ ID NO: 6635571 - DNA, 13 bp, Homo sapiens
agccctgccagga

SEQ ID NO: 6635572 - DNA, 12 bp, Homo sapiens
agccctgcccac

SEQ ID NO: 6635573 - DNA, 14 bp, Homo sapiens
agccctgcccacag

SEQ ID NO: 6635574 - DNA, 15 bp, Homo sapiens
agccctgcccacaga

SEQ ID NO: 6635575 - DNA, 12 bp, Homo sapiens
agccctgcccca

SEQ ID NO: 6635576 - DNA, 13 bp, Homo sapiens
agccctgccccac

SEQ ID NO: 6635577 - DNA, 17 bp, Homo sapiens
agccctgcccctcctgt

SEQ ID NO: 6635578 - DNA, 16 bp, Homo sapiens
agccctgccctcactc

SEQ ID NO: 6635579 - DNA, 17 bp, Homo sapiens
agccctgccctcactcc

SEQ ID NO: 6635580 - DNA, 23 bp, Homo sapiens
agccctgccctcactccactccc

SEQ ID NO: 6635581 - DNA, 18 bp, Homo sapiens
agccctgccctcccaagt

SEQ ID NO: 6635582 - DNA, 20 bp, Homo sapiens
agccctgcctatcctctgta

SEQ ID NO: 6635583 - DNA, 13 bp, Homo sapiens
agccctgcctctc

SEQ ID NO: 6635584 - DNA, 16 bp, Homo sapiens
agccctgcctctccgc

SEQ ID NO: 6635585 - DNA, 22 bp, Homo sapiens
agccctgcctctccgcccctga

SEQ ID NO: 6635586 - DNA, 14 bp, Homo sapiens
agccctgcctctgt

SEQ ID NO: 6635587 - DNA, 15 bp, Homo sapiens
agccctgcctctgtg

SEQ ID NO: 6635588 - DNA, 17 bp, Homo sapiens
agccctgcctctgtgta

SEQ ID NO: 6635589 - DNA, 14 bp, Homo sapiens
agccctgcctgaga

SEQ ID NO: 6635590 - DNA, 19 bp, Homo sapiens
agccctgcctggaggacct

SEQ ID NO: 6635591 - DNA, 22 bp, Homo sapiens
agccctgcctggaggacctgag

SEQ ID NO: 6635592 - DNA, 23 bp, Homo sapiens
agccctgcctggaggacctgagc

SEQ ID NO: 6635593 - DNA, 19 bp, Homo sapiens
agccctgcggagccggcac

SEQ ID NO: 6635594 - DNA, 20 bp, Homo sapiens
agccctgcggagccggcacc

SEQ ID NO: 6635595 - DNA, 11 bp, Homo sapiens
agccctgctag

SEQ ID NO: 6635596 - DNA, 10 bp, Homo sapiens
agccctgctc

SEQ ID NO: 6635597 - DNA, 11 bp, Homo sapiens
agccctgctct

SEQ ID NO: 6635598 - DNA, 20 bp, Homo sapiens
agccctgctcttctctcccc

SEQ ID NO: 6635599 - DNA, 15 bp, Homo sapiens
agccctgctctttct

SEQ ID NO: 6635600 - DNA, 17 bp, Homo sapiens
agccctgctctttctct

SEQ ID NO: 6635601 - DNA, 16 bp, Homo sapiens
agccctgctggccgcc

SEQ ID NO: 6635602 - DNA, 21 bp, Homo sapiens
agccctgctggccgcctcacc

SEQ ID NO: 6635603 - DNA, 20 bp, Homo sapiens
agccctgctgggcccatgtg

SEQ ID NO: 6635604 - DNA, 21 bp, Homo sapiens
agccctgctgggcccatgtga

SEQ ID NO: 6635605 - DNA, 19 bp, Homo sapiens
agccctgctggggatcccc

SEQ ID NO: 6635606 - DNA, 15 bp, Homo sapiens
agccctgctgtggga

SEQ ID NO: 6635607 - DNA, 13 bp, Homo sapiens
agccctgcttgct

SEQ ID NO: 6635608 - DNA, 19 bp, Homo sapiens
agccctgctttgggctgcc

SEQ ID NO: 6635609 - DNA, 23 bp, Homo sapiens
agccctgctttgggctgccctgg

SEQ ID NO: 6635610 - DNA, 16 bp, Homo sapiens
agccctgcttttgcat

SEQ ID NO: 6635611 - DNA, 17 bp, Homo sapiens
agccctggacacccctg

SEQ ID NO: 6635612 - DNA, 15 bp, Homo sapiens
agccctggaccccag

SEQ ID NO: 6635613 - DNA, 12 bp, Homo sapiens
agccctggagag

SEQ ID NO: 6635614 - DNA, 17 bp, Homo sapiens
agccctggagagcccca

SEQ ID NO: 6635615 - DNA, 21 bp, Homo sapiens
agccctggagccaactgctgc

SEQ ID NO: 6635616 - DNA, 11 bp, Homo sapiens
agccctggagg

SEQ ID NO: 6635617 - DNA, 14 bp, Homo sapiens
agccctggaggctg

SEQ ID NO: 6635618 - DNA, 18 bp, Homo sapiens
agccctggaggctggatg

SEQ ID NO: 6635619 - DNA, 22 bp, Homo sapiens
agccctggaggtgccagcaaag

SEQ ID NO: 6635620 - DNA, 19 bp, Homo sapiens
agccctggagtcatgccaa

SEQ ID NO: 6635621 - DNA, 23 bp, Homo sapiens
agccctggatttcagaaagagca

SEQ ID NO: 6635622 - DNA, 19 bp, Homo sapiens
agccctggcaaatgcctga

SEQ ID NO: 6635623 - DNA, 17 bp, Homo sapiens
agccctggcaggatgac

SEQ ID NO: 6635624 - DNA, 13 bp, Homo sapiens
agccctggccaga

SEQ ID NO: 6635625 - DNA, 15 bp, Homo sapiens
agccctggccagccc

SEQ ID NO: 6635626 - DNA, 19 bp, Homo sapiens
agccctggccagcccttcc

SEQ ID NO: 6635627 - DNA, 14 bp, Homo sapiens
agccctggcccacc

SEQ ID NO: 6635628 - DNA, 13 bp, Homo sapiens
agccctggcccag

SEQ ID NO: 6635629 - DNA, 14 bp, Homo sapiens
agccctggcccagg

SEQ ID NO: 6635630 - DNA, 19 bp, Homo sapiens
agccctggcccccacagcg

SEQ ID NO: 6635631 - DNA, 15 bp, Homo sapiens
agccctggccccctg

SEQ ID NO: 6635632 - DNA, 16 bp, Homo sapiens
agccctggcccctcca

SEQ ID NO: 6635633 - DNA, 12 bp, Homo sapiens
agccctggcccg

SEQ ID NO: 6635634 - DNA, 18 bp, Homo sapiens
agccctggcccggtccca

SEQ ID NO: 6635635 - DNA, 22 bp, Homo sapiens
agccctggcccggtcccagtcc

SEQ ID NO: 6635636 - DNA, 13 bp, Homo sapiens
agccctggccctg

SEQ ID NO: 6635637 - DNA, 19 bp, Homo sapiens
agccctggccctgcccagc

SEQ ID NO: 6635638 - DNA, 16 bp, Homo sapiens
agccctggcctttttc

SEQ ID NO: 6635639 - DNA, 12 bp, Homo sapiens
agccctggctcc

SEQ ID NO: 6635640 - DNA, 15 bp, Homo sapiens
agccctggctcccac

SEQ ID NO: 6635641 - DNA, 14 bp, Homo sapiens
agccctggctctgc

SEQ ID NO: 6635642 - DNA, 17 bp, Homo sapiens
agccctggctctgcccc

SEQ ID NO: 6635643 - DNA, 19 bp, Homo sapiens
agccctggctctgcccctc

SEQ ID NO: 6635644 - DNA, 15 bp, Homo sapiens
agccctggctgaagg

SEQ ID NO: 6635645 - DNA, 13 bp, Homo sapiens
agccctggctggg

SEQ ID NO: 6635646 - DNA, 16 bp, Homo sapiens
agccctggctgggttc

SEQ ID NO: 6635647 - DNA, 24 bp, Homo sapiens
agccctggctgggttcaggtccca

SEQ ID NO: 6635648 - DNA, 13 bp, Homo sapiens
agccctggcttcc

SEQ ID NO: 6635649 - DNA, 20 bp, Homo sapiens
agccctgggaaccactccca

SEQ ID NO: 6635650 - DNA, 11 bp, Homo sapiens
agccctgggac

SEQ ID NO: 6635651 - DNA, 14 bp, Homo sapiens
agccctgggaccgc

SEQ ID NO: 6635652 - DNA, 17 bp, Homo sapiens
agccctgggaggctctg

SEQ ID NO: 6635653 - DNA, 20 bp, Homo sapiens
agccctgggaggctctggag

SEQ ID NO: 6635654 - DNA, 18 bp, Homo sapiens
agccctgggatcactgtg

SEQ ID NO: 6635655 - DNA, 13 bp, Homo sapiens
agccctgggcaag

SEQ ID NO: 6635656 - DNA, 14 bp, Homo sapiens
agccctgggcaagg

SEQ ID NO: 6635657 - DNA, 23 bp, Homo sapiens
agccctgggcacatagcataggc

SEQ ID NO: 6635658 - DNA, 15 bp, Homo sapiens
agccctgggcctggg

SEQ ID NO: 6635659 - DNA, 12 bp, Homo sapiens
agccctggggac

SEQ ID NO: 6635660 - DNA, 21 bp, Homo sapiens
agccctggggactgttccaaa

SEQ ID NO: 6635661 - DNA, 14 bp, Homo sapiens
agccctggggcagg

SEQ ID NO: 6635662 - DNA, 12 bp, Homo sapiens
agccctggggct

SEQ ID NO: 6635663 - DNA, 14 bp, Homo sapiens
agccctggggctgg

SEQ ID NO: 6635664 - DNA, 18 bp, Homo sapiens
agccctggggctgggccc

SEQ ID NO: 6635665 - DNA, 18 bp, Homo sapiens
agccctgggggagcctct

SEQ ID NO: 6635666 - DNA, 22 bp, Homo sapiens
agccctgggggattcctgagct

SEQ ID NO: 6635667 - DNA, 12 bp, Homo sapiens
agccctgggggc

SEQ ID NO: 6635668 - DNA, 17 bp, Homo sapiens
agccctgggggccagct

SEQ ID NO: 6635669 - DNA, 21 bp, Homo sapiens
agccctgggtgacttcaggtg

SEQ ID NO: 6635670 - DNA, 15 bp, Homo sapiens
agccctggtggcagt

SEQ ID NO: 6635671 - DNA, 22 bp, Homo sapiens
agccctggtggcagtgggagct

SEQ ID NO: 6635672 - DNA, 21 bp, Homo sapiens
agccctggtggccaagcctgc

SEQ ID NO: 6635673 - DNA, 19 bp, Homo sapiens
agccctggttagctgacag

SEQ ID NO: 6635674 - DNA, 15 bp, Homo sapiens
agccctggtttgaaa

SEQ ID NO: 6635675 - DNA, 18 bp, Homo sapiens
agccctggtttgaaattt

SEQ ID NO: 6635676 - DNA, 15 bp, Homo sapiens
agccctgtaattttt

SEQ ID NO: 6635677 - DNA, 15 bp, Homo sapiens
agccctgtacccacc

SEQ ID NO: 6635678 - DNA, 17 bp, Homo sapiens
agccctgtacccacccc

SEQ ID NO: 6635679 - DNA, 21 bp, Homo sapiens
agccctgtacccaccccagca

SEQ ID NO: 6635680 - DNA, 23 bp, Homo sapiens
agccctgtacccaccccagcaca

SEQ ID NO: 6635681 - DNA, 22 bp, Homo sapiens
agccctgtatcgtattcacctt

SEQ ID NO: 6635682 - DNA, 20 bp, Homo sapiens
agccctgtcagcatgaattt

SEQ ID NO: 6635683 - DNA, 14 bp, Homo sapiens
agccctgtcagtgc

SEQ ID NO: 6635684 - DNA, 11 bp, Homo sapiens
agccctgtcct

SEQ ID NO: 6635685 - DNA, 16 bp, Homo sapiens
agccctgtcctggtgg

SEQ ID NO: 6635686 - DNA, 23 bp, Homo sapiens
agccctgtcctggtggtattttc

SEQ ID NO: 6635687 - DNA, 18 bp, Homo sapiens
agccctgtcgagacactt

SEQ ID NO: 6635688 - DNA, 14 bp, Homo sapiens
agccctgtcgggct

SEQ ID NO: 6635689 - DNA, 22 bp, Homo sapiens
agccctgtcgggctttgtgtga

SEQ ID NO: 6635690 - DNA, 12 bp, Homo sapiens
agccctgtggaa

SEQ ID NO: 6635691 - DNA, 18 bp, Homo sapiens
agccctgtggatgagccc

SEQ ID NO: 6635692 - DNA, 23 bp, Homo sapiens
agccctgtggatgagccctcaga

SEQ ID NO: 6635693 - DNA, 16 bp, Homo sapiens
agccctgtggccgcca

SEQ ID NO: 6635694 - DNA, 18 bp, Homo sapiens
agccctgttccgcctcac

SEQ ID NO: 6635695 - DNA, 21 bp, Homo sapiens
agccctgttcctccctcccac

SEQ ID NO: 6635696 - DNA, 16 bp, Homo sapiens
agccctgttctcctgt

SEQ ID NO: 6635697 - DNA, 17 bp, Homo sapiens
agccctgttctcctgtc

SEQ ID NO: 6635698 - DNA, 19 bp, Homo sapiens
agccctgttctcctgtccc

SEQ ID NO: 6635699 - DNA, 15 bp, Homo sapiens
agccctgttctcgtt

SEQ ID NO: 6635700 - DNA, 21 bp, Homo sapiens
agccctgttctcgttgcccta

SEQ ID NO: 6635701 - DNA, 21 bp, Homo sapiens
agccctgttgacacaggtctt

SEQ ID NO: 6635702 - DNA, 23 bp, Homo sapiens
agccctgttgacacaggtctttc

SEQ ID NO: 6635703 - DNA, 14 bp, Homo sapiens
agccctgttgacct

SEQ ID NO: 6635704 - DNA, 16 bp, Homo sapiens
agccctgttgacctgc

SEQ ID NO: 6635705 - DNA, 15 bp, Homo sapiens
agccctgttggcagc

SEQ ID NO: 6635706 - DNA, 17 bp, Homo sapiens
agccctgttggcagctc

SEQ ID NO: 6635707 - DNA, 19 bp, Homo sapiens
agccctgttgtgccacaga

SEQ ID NO: 6635708 - DNA, 10 bp, Homo sapiens
agcccttagc

SEQ ID NO: 6635709 - DNA, 16 bp, Homo sapiens
agcccttagcacagag

SEQ ID NO: 6635710 - DNA, 17 bp, Homo sapiens
agcccttagcacagaga

SEQ ID NO: 6635711 - DNA, 22 bp, Homo sapiens
agcccttagcacagagagggac

SEQ ID NO: 6635712 - DNA, 23 bp, Homo sapiens
agcccttagcacagagagggaca

SEQ ID NO: 6635713 - DNA, 16 bp, Homo sapiens
agcccttagcagggaa

SEQ ID NO: 6635714 - DNA, 21 bp, Homo sapiens
agcccttagcagggaaacagc

SEQ ID NO: 6635715 - DNA, 23 bp, Homo sapiens
agcccttagccttgctgtagaga

SEQ ID NO: 6635716 - DNA, 15 bp, Homo sapiens
agcccttagggagag

SEQ ID NO: 6635717 - DNA, 18 bp, Homo sapiens
agcccttatctgtgctca

SEQ ID NO: 6635718 - DNA, 22 bp, Homo sapiens
agcccttatgcggttaattttg

SEQ ID NO: 6635719 - DNA, 16 bp, Homo sapiens
agcccttcaggaagca

SEQ ID NO: 6635720 - DNA, 16 bp, Homo sapiens
agcccttcatgggtgg

SEQ ID NO: 6635721 - DNA, 13 bp, Homo sapiens
agcccttcatttg

SEQ ID NO: 6635722 - DNA, 16 bp, Homo sapiens
agcccttccaggagtg

SEQ ID NO: 6635723 - DNA, 19 bp, Homo sapiens
agcccttccaggagtgggt

SEQ ID NO: 6635724 - DNA, 14 bp, Homo sapiens
agcccttcccaggc

SEQ ID NO: 6635725 - DNA, 16 bp, Homo sapiens
agcccttcccaggcca

SEQ ID NO: 6635726 - DNA, 21 bp, Homo sapiens
agcccttcccagggcacccag

SEQ ID NO: 6635727 - DNA, 14 bp, Homo sapiens
agcccttccctgag

SEQ ID NO: 6635728 - DNA, 15 bp, Homo sapiens
agcccttccctgagt

SEQ ID NO: 6635729 - DNA, 23 bp, Homo sapiens
agcccttccctgagtgcgggctg

SEQ ID NO: 6635730 - DNA, 14 bp, Homo sapiens
agcccttccctgcc

SEQ ID NO: 6635731 - DNA, 16 bp, Homo sapiens
agcccttccctgcctt

SEQ ID NO: 6635732 - DNA, 14 bp, Homo sapiens
agcccttccctgct

SEQ ID NO: 6635733 - DNA, 15 bp, Homo sapiens
agcccttccctgctt

SEQ ID NO: 6635734 - DNA, 18 bp, Homo sapiens
agcccttcctacctctgg

SEQ ID NO: 6635735 - DNA, 15 bp, Homo sapiens
agcccttcctcctga

SEQ ID NO: 6635736 - DNA, 14 bp, Homo sapiens
agcccttcctctca

SEQ ID NO: 6635737 - DNA, 15 bp, Homo sapiens
agcccttcctctcac

SEQ ID NO: 6635738 - DNA, 21 bp, Homo sapiens
agcccttcctctcactcctgc

SEQ ID NO: 6635739 - DNA, 15 bp, Homo sapiens
agcccttcctctgct

SEQ ID NO: 6635740 - DNA, 11 bp, Homo sapiens
agcccttcctt

SEQ ID NO: 6635741 - DNA, 17 bp, Homo sapiens
agcccttccttgggcgt

SEQ ID NO: 6635742 - DNA, 20 bp, Homo sapiens
agcccttccttgggcgtctc

SEQ ID NO: 6635743 - DNA, 22 bp, Homo sapiens
agcccttcggaggaccagggct

SEQ ID NO: 6635744 - DNA, 19 bp, Homo sapiens
agcccttctaccccacctg

SEQ ID NO: 6635745 - DNA, 23 bp, Homo sapiens
agcccttctatacccacccagaa

SEQ ID NO: 6635746 - DNA, 21 bp, Homo sapiens
agcccttctccatggccctgc

SEQ ID NO: 6635747 - DNA, 17 bp, Homo sapiens
agcccttctgcctttct

SEQ ID NO: 6635748 - DNA, 18 bp, Homo sapiens
agcccttctgcctttctc

SEQ ID NO: 6635749 - DNA, 22 bp, Homo sapiens
agcccttgcacagctggagaaa

SEQ ID NO: 6635750 - DNA, 17 bp, Homo sapiens
agcccttgcacaggcca

SEQ ID NO: 6635751 - DNA, 23 bp, Homo sapiens
agcccttgcactcctactgagtt

SEQ ID NO: 6635752 - DNA, 17 bp, Homo sapiens
agcccttgcattgcaga

SEQ ID NO: 6635753 - DNA, 15 bp, Homo sapiens
agcccttgcccccat

SEQ ID NO: 6635754 - DNA, 19 bp, Homo sapiens
agcccttgcccccatccct

SEQ ID NO: 6635755 - DNA, 20 bp, Homo sapiens
agcccttgcccccatccctc

SEQ ID NO: 6635756 - DNA, 12 bp, Homo sapiens
agcccttgcctc

SEQ ID NO: 6635757 - DNA, 18 bp, Homo sapiens
agcccttgctctacctgg

SEQ ID NO: 6635758 - DNA, 15 bp, Homo sapiens
agcccttggcttctg

SEQ ID NO: 6635759 - DNA, 13 bp, Homo sapiens
agcccttgggcag

SEQ ID NO: 6635760 - DNA, 14 bp, Homo sapiens
agcccttgggcagt

SEQ ID NO: 6635761 - DNA, 14 bp, Homo sapiens
agcccttgggggtc

SEQ ID NO: 6635762 - DNA, 21 bp, Homo sapiens
agcccttgggggtcctcctcc

SEQ ID NO: 6635763 - DNA, 14 bp, Homo sapiens
agcccttgtccctt

SEQ ID NO: 6635764 - DNA, 13 bp, Homo sapiens
agcccttgtttat

SEQ ID NO: 6635765 - DNA, 21 bp, Homo sapiens
agccctttccccactcagctg

SEQ ID NO: 6635766 - DNA, 16 bp, Homo sapiens
agccctttctgtgtgc

SEQ ID NO: 6635767 - DNA, 12 bp, Homo sapiens
agccctttgcct

SEQ ID NO: 6635768 - DNA, 15 bp, Homo sapiens
agccctttgcctgta

SEQ ID NO: 6635769 - DNA, 17 bp, Homo sapiens
agccctttgcctgtaga

SEQ ID NO: 6635770 - DNA, 22 bp, Homo sapiens
agccctttgcctgtagagccag

SEQ ID NO: 6635771 - DNA, 15 bp, Homo sapiens
agccctttgctctga

SEQ ID NO: 6635772 - DNA, 17 bp, Homo sapiens
agccctttgctctggag

SEQ ID NO: 6635773 - DNA, 23 bp, Homo sapiens
agcccttttgttgagccaggcct

SEQ ID NO: 6635774 - DNA, 14 bp, Homo sapiens
agccgaactccagg

SEQ ID NO: 6635775 - DNA, 19 bp, Homo sapiens
agccgaactccaggctggg

SEQ ID NO: 6635776 - DNA, 21 bp, Homo sapiens
agccgaactccaggctgggct

SEQ ID NO: 6635777 - DNA, 15 bp, Homo sapiens
agccgaccctcctgg

SEQ ID NO: 6635778 - DNA, 16 bp, Homo sapiens
agccgaccctcctggc

SEQ ID NO: 6635779 - DNA, 19 bp, Homo sapiens
agccgacctgaggacatgg

SEQ ID NO: 6635780 - DNA, 12 bp, Homo sapiens
agccgactctgg

SEQ ID NO: 6635781 - DNA, 19 bp, Homo sapiens
agccgactctggccctggc

SEQ ID NO: 6635782 - DNA, 20 bp, Homo sapiens
agccgactctggccctggcc

SEQ ID NO: 6635783 - DNA, 17 bp, Homo sapiens
agccgactctttgatat

SEQ ID NO: 6635784 - DNA, 16 bp, Homo sapiens
agccgactgcgctgct

SEQ ID NO: 6635785 - DNA, 17 bp, Homo sapiens
agccgactgcgctgctt

SEQ ID NO: 6635786 - DNA, 15 bp, Homo sapiens
agccgagagcctgct

SEQ ID NO: 6635787 - DNA, 17 bp, Homo sapiens
agccgagagcctgctcc

SEQ ID NO: 6635788 - DNA, 21 bp, Homo sapiens
agccgagagcctgctccccca

SEQ ID NO: 6635789 - DNA, 17 bp, Homo sapiens
agccgagatcacgccac

SEQ ID NO: 6635790 - DNA, 19 bp, Homo sapiens
agccgagatcacgccactg

SEQ ID NO: 6635791 - DNA, 21 bp, Homo sapiens
agccgagatcacgccactgca

SEQ ID NO: 6635792 - DNA, 22 bp, Homo sapiens
agccgagatcggggtggcagaa

SEQ ID NO: 6635793 - DNA, 17 bp, Homo sapiens
agccgagattgcaccac

SEQ ID NO: 6635794 - DNA, 22 bp, Homo sapiens
agccgagattgcaccactgcac

SEQ ID NO: 6635795 - DNA, 14 bp, Homo sapiens
agccgagcaggagg

SEQ ID NO: 6635796 - DNA, 17 bp, Homo sapiens
agccgagccccaggagc

SEQ ID NO: 6635797 - DNA, 17 bp, Homo sapiens
agccgagccgggcctgg

SEQ ID NO: 6635798 - DNA, 18 bp, Homo sapiens
agccgagccgggcctggg

SEQ ID NO: 6635799 - DNA, 21 bp, Homo sapiens
agccgagccgggcctggggct

SEQ ID NO: 6635800 - DNA, 15 bp, Homo sapiens
agccgagctctcctg

SEQ ID NO: 6635801 - DNA, 22 bp, Homo sapiens
agccgagctctcctgggccagg

SEQ ID NO: 6635802 - DNA, 14 bp, Homo sapiens
agccgaggcctggc

SEQ ID NO: 6635803 - DNA, 15 bp, Homo sapiens
agccgaggcctggcc

SEQ ID NO: 6635804 - DNA, 16 bp, Homo sapiens
agccgaggggagagag

SEQ ID NO: 6635805 - DNA, 21 bp, Homo sapiens
agccgaggtccctgctgccag

SEQ ID NO: 6635806 - DNA, 23 bp, Homo sapiens
agccgaggtccctgctgccagct

SEQ ID NO: 6635807 - DNA, 19 bp, Homo sapiens
agccgattcctccagccct

SEQ ID NO: 6635808 - DNA, 14 bp, Homo sapiens
agccgattctctgc

SEQ ID NO: 6635809 - DNA, 15 bp, Homo sapiens
agccgattctctgcc

SEQ ID NO: 6635810 - DNA, 22 bp, Homo sapiens
agccgcaccctgcacctgctgc

SEQ ID NO: 6635811 - DNA, 17 bp, Homo sapiens
agccgcaccctggctgg

SEQ ID NO: 6635812 - DNA, 16 bp, Homo sapiens
agccgcagacctggag

SEQ ID NO: 6635813 - DNA, 13 bp, Homo sapiens
agccgcagagaaa

SEQ ID NO: 6635814 - DNA, 14 bp, Homo sapiens
agccgcagagaaat

SEQ ID NO: 6635815 - DNA, 15 bp, Homo sapiens
agccgcagagcctga

SEQ ID NO: 6635816 - DNA, 17 bp, Homo sapiens
agccgcagaggcccgag

SEQ ID NO: 6635817 - DNA, 20 bp, Homo sapiens
agccgcaggggcccctcctc

SEQ ID NO: 6635818 - DNA, 21 bp, Homo sapiens
agccgcatcttctccatctgg

SEQ ID NO: 6635819 - DNA, 13 bp, Homo sapiens
agccgccacatcc

SEQ ID NO: 6635820 - DNA, 23 bp, Homo sapiens
agccgccactcccgggccaagac

SEQ ID NO: 6635821 - DNA, 21 bp, Homo sapiens
agccgccatgctcctggccca

SEQ ID NO: 6635822 - DNA, 19 bp, Homo sapiens
agccgccattgccaccagg

SEQ ID NO: 6635823 - DNA, 21 bp, Homo sapiens
agccgccattgccaccaggag

SEQ ID NO: 6635824 - DNA, 23 bp, Homo sapiens
agccgcccagtgggacccacagt

SEQ ID NO: 6635825 - DNA, 13 bp, Homo sapiens
agccgccctgaga

SEQ ID NO: 6635826 - DNA, 14 bp, Homo sapiens
agccgccctgagag

SEQ ID NO: 6635827 - DNA, 22 bp, Homo sapiens
agccgccctgggctgtctgtca

SEQ ID NO: 6635828 - DNA, 18 bp, Homo sapiens
agccgccgggcaggcctg

SEQ ID NO: 6635829 - DNA, 13 bp, Homo sapiens
agccgcctccctt

SEQ ID NO: 6635830 - DNA, 23 bp, Homo sapiens
agccgcctctggttccactcagc

SEQ ID NO: 6635831 - DNA, 21 bp, Homo sapiens
agccgcctgaaagccacaatg

SEQ ID NO: 6635832 - DNA, 22 bp, Homo sapiens
agccgcctgcttcttctctcca

SEQ ID NO: 6635833 - DNA, 15 bp, Homo sapiens
agccgccttccttga

SEQ ID NO: 6635834 - DNA, 17 bp, Homo sapiens
agccgccttccttgacc

SEQ ID NO: 6635835 - DNA, 14 bp, Homo sapiens
agccgcctttgggt

SEQ ID NO: 6635836 - DNA, 18 bp, Homo sapiens
agccgcctttgggttcca

SEQ ID NO: 6635837 - DNA, 22 bp, Homo sapiens
agccgcgcggggccgctgtcca

SEQ ID NO: 6635838 - DNA, 19 bp, Homo sapiens
agccgcgctctgcccctcc

SEQ ID NO: 6635839 - DNA, 18 bp, Homo sapiens
agccgcgggccaggaggc

SEQ ID NO: 6635840 - DNA, 21 bp, Homo sapiens
agccgcgggcgctcgctcagg

SEQ ID NO: 6635841 - DNA, 21 bp, Homo sapiens
agccgcggggacaccgggaag

SEQ ID NO: 6635842 - DNA, 22 bp, Homo sapiens
agccgcggtgcccaaccacact

SEQ ID NO: 6635843 - DNA, 18 bp, Homo sapiens
agccgctaggagagactg

SEQ ID NO: 6635844 - DNA, 22 bp, Homo sapiens
agccgctcccggttccctcccc

SEQ ID NO: 6635845 - DNA, 16 bp, Homo sapiens
agccgctcctgtctgc

SEQ ID NO: 6635846 - DNA, 19 bp, Homo sapiens
agccgctcctgtctgccag

SEQ ID NO: 6635847 - DNA, 22 bp, Homo sapiens
agccgctcctgtctgccagcca

SEQ ID NO: 6635848 - DNA, 12 bp, Homo sapiens
agccgctcggag

SEQ ID NO: 6635849 - DNA, 15 bp, Homo sapiens
agccgctctcctgcc

SEQ ID NO: 6635850 - DNA, 19 bp, Homo sapiens
agccgctgagcgaggagat

SEQ ID NO: 6635851 - DNA, 12 bp, Homo sapiens
agccgctgccct

SEQ ID NO: 6635852 - DNA, 13 bp, Homo sapiens
agccgctgccctg

SEQ ID NO: 6635853 - DNA, 15 bp, Homo sapiens
agccgctgccctggg

SEQ ID NO: 6635854 - DNA, 18 bp, Homo sapiens
agccgctggtgcccacca

SEQ ID NO: 6635855 - DNA, 23 bp, Homo sapiens
agccgctggtgcccaccagctgg

SEQ ID NO: 6635856 - DNA, 16 bp, Homo sapiens
agccgctgtgagcccc

SEQ ID NO: 6635857 - DNA, 22 bp, Homo sapiens
agccgctgtgagcccctggtcc

SEQ ID NO: 6635858 - DNA, 20 bp, Homo sapiens
agccggacacggcttcactg

SEQ ID NO: 6635859 - DNA, 15 bp, Homo sapiens
agccggacagctgcc

SEQ ID NO: 6635860 - DNA, 17 bp, Homo sapiens
agccggacagctgccca

SEQ ID NO: 6635861 - DNA, 18 bp, Homo sapiens
agccggacagctgcccag

SEQ ID NO: 6635862 - DNA, 20 bp, Homo sapiens
agccggaccaagatgggcac

SEQ ID NO: 6635863 - DNA, 23 bp, Homo sapiens
agccggagcagttggcctgtgct

SEQ ID NO: 6635864 - DNA, 15 bp, Homo sapiens
agccggaggaggaga

SEQ ID NO: 6635865 - DNA, 20 bp, Homo sapiens
agccggagggcaccagggac

SEQ ID NO: 6635866 - DNA, 18 bp, Homo sapiens
agccggcatccttgcctg

SEQ ID NO: 6635867 - DNA, 16 bp, Homo sapiens
agccggcatggctggg

SEQ ID NO: 6635868 - DNA, 17 bp, Homo sapiens
agccggccgccttctcc

SEQ ID NO: 6635869 - DNA, 20 bp, Homo sapiens
agccggccgccttctcccct

SEQ ID NO: 6635870 - DNA, 22 bp, Homo sapiens
agccggccgccttctcccctct

SEQ ID NO: 6635871 - DNA, 16 bp, Homo sapiens
agccggccgtggaagg

SEQ ID NO: 6635872 - DNA, 18 bp, Homo sapiens
agccggcctctctggcct

SEQ ID NO: 6635873 - DNA, 19 bp, Homo sapiens
agccggcctctctggcctc

SEQ ID NO: 6635874 - DNA, 23 bp, Homo sapiens
agccggcctctctggcctcccac

SEQ ID NO: 6635875 - DNA, 20 bp, Homo sapiens
agccggcggagctctggctt

SEQ ID NO: 6635876 - DNA, 15 bp, Homo sapiens
agccggcggcctctc

SEQ ID NO: 6635877 - DNA, 21 bp, Homo sapiens
agccggcgtggcaaatataaa

SEQ ID NO: 6635878 - DNA, 16 bp, Homo sapiens
agccgggaccctcagg

SEQ ID NO: 6635879 - DNA, 16 bp, Homo sapiens
agccgggagcttggct

SEQ ID NO: 6635880 - DNA, 13 bp, Homo sapiens
agccgggcaagtc

SEQ ID NO: 6635881 - DNA, 21 bp, Homo sapiens
agccgggccccatggtcacag

SEQ ID NO: 6635882 - DNA, 14 bp, Homo sapiens
agccgggcccctgg

SEQ ID NO: 6635883 - DNA, 18 bp, Homo sapiens
agccgggcccctgggctt

SEQ ID NO: 6635884 - DNA, 14 bp, Homo sapiens
agccgggccgcaga

SEQ ID NO: 6635885 - DNA, 16 bp, Homo sapiens
agccgggcctcccacc

SEQ ID NO: 6635886 - DNA, 13 bp, Homo sapiens
agccgggcctggg

SEQ ID NO: 6635887 - DNA, 16 bp, Homo sapiens
agccgggctccaggga

SEQ ID NO: 6635888 - DNA, 13 bp, Homo sapiens
agccggggagctg

SEQ ID NO: 6635889 - DNA, 14 bp, Homo sapiens
agccggggagctga

SEQ ID NO: 6635890 - DNA, 23 bp, Homo sapiens
agccggggagctgaggggcaggg

SEQ ID NO: 6635891 - DNA, 20 bp, Homo sapiens
agccggggagtttctttcct

SEQ ID NO: 6635892 - DNA, 19 bp, Homo sapiens
agccggggcctgcctagca

SEQ ID NO: 6635893 - DNA, 14 bp, Homo sapiens
agccgggggagggg

SEQ ID NO: 6635894 - DNA, 15 bp, Homo sapiens
agccgggggaggggc

SEQ ID NO: 6635895 - DNA, 21 bp, Homo sapiens
agccgggggaggggccctcag

SEQ ID NO: 6635896 - DNA, 22 bp, Homo sapiens
agccgggggaggggccctcagg

SEQ ID NO: 6635897 - DNA, 15 bp, Homo sapiens
agccgggggctggcc

SEQ ID NO: 6635898 - DNA, 24 bp, Homo sapiens
agccggggtggggtggctgcagcc

SEQ ID NO: 6635899 - DNA, 12 bp, Homo sapiens
agccgggtccgg

SEQ ID NO: 6635900 - DNA, 21 bp, Homo sapiens
agccgggtctgcctcttctgg

SEQ ID NO: 6635901 - DNA, 23 bp, Homo sapiens
agccgggtgtggcacgcacctgt

SEQ ID NO: 6635902 - DNA, 16 bp, Homo sapiens
agccggtaactgtcct

SEQ ID NO: 6635903 - DNA, 17 bp, Homo sapiens
agccggtaactgtcctg

SEQ ID NO: 6635904 - DNA, 13 bp, Homo sapiens
agccggtgcccac

SEQ ID NO: 6635905 - DNA, 18 bp, Homo sapiens
agccggtgggctagaaag

SEQ ID NO: 6635906 - DNA, 14 bp, Homo sapiens
agccggttcctgtc

SEQ ID NO: 6635907 - DNA, 18 bp, Homo sapiens
agccggtttgggagagac

SEQ ID NO: 6635908 - DNA, 16 bp, Homo sapiens
agccgtaaaaactgaa

SEQ ID NO: 6635909 - DNA, 17 bp, Homo sapiens
agccgtagagggtggcc

SEQ ID NO: 6635910 - DNA, 14 bp, Homo sapiens
agccgtcagccatc

SEQ ID NO: 6635911 - DNA, 15 bp, Homo sapiens
agccgtcagcctgtg

SEQ ID NO: 6635912 - DNA, 15 bp, Homo sapiens
agccgtccatggcac

SEQ ID NO: 6635913 - DNA, 16 bp, Homo sapiens
agccgtccatggcacc

SEQ ID NO: 6635914 - DNA, 18 bp, Homo sapiens
agccgtccatggcaccag

SEQ ID NO: 6635915 - DNA, 21 bp, Homo sapiens
agccgtccatggcaccagccc

SEQ ID NO: 6635916 - DNA, 14 bp, Homo sapiens
agccgtcccaggcc

SEQ ID NO: 6635917 - DNA, 15 bp, Homo sapiens
agccgtcccaggcca

SEQ ID NO: 6635918 - DNA, 17 bp, Homo sapiens
agccgtcccaggccacc

SEQ ID NO: 6635919 - DNA, 12 bp, Homo sapiens
agccgtcctggc

SEQ ID NO: 6635920 - DNA, 22 bp, Homo sapiens
agccgtctgactccagagtctg

SEQ ID NO: 6635921 - DNA, 23 bp, Homo sapiens
agccgtctgactccagagtctga

SEQ ID NO: 6635922 - DNA, 16 bp, Homo sapiens
agccgtgacctccagg

SEQ ID NO: 6635923 - DNA, 14 bp, Homo sapiens
agccgtgagtgcag

SEQ ID NO: 6635924 - DNA, 19 bp, Homo sapiens
agccgtgatgctcaggctt

SEQ ID NO: 6635925 - DNA, 17 bp, Homo sapiens
agccgtgcctgtagcct

SEQ ID NO: 6635926 - DNA, 15 bp, Homo sapiens
agccgtgccttcagc

SEQ ID NO: 6635927 - DNA, 23 bp, Homo sapiens
agccgtgctcgcccacaaactga

SEQ ID NO: 6635928 - DNA, 14 bp, Homo sapiens
agccgtggcttccc

SEQ ID NO: 6635929 - DNA, 23 bp, Homo sapiens
agccgtgttttatgactaatcct

SEQ ID NO: 6635930 - DNA, 13 bp, Homo sapiens
agccgttcctggg

SEQ ID NO: 6635931 - DNA, 14 bp, Homo sapiens
agccgttcctggga

SEQ ID NO: 6635932 - DNA, 21 bp, Homo sapiens
agccgtttgaatatattttat

SEQ ID NO: 6635933 - DNA, 13 bp, Homo sapiens
agccgttttcctc

SEQ ID NO: 6635934 - DNA, 16 bp, Homo sapiens
agccgttttcctcatc

SEQ ID NO: 6635935 - DNA, 18 bp, Homo sapiens
agcctaaaaataaagcac

SEQ ID NO: 6635936 - DNA, 23 bp, Homo sapiens
agcctaaaattaaataaatcttt

SEQ ID NO: 6635937 - DNA, 19 bp, Homo sapiens
agcctaaagaccatttaat

SEQ ID NO: 6635938 - DNA, 16 bp, Homo sapiens
agcctaaagattttga

SEQ ID NO: 6635939 - DNA, 20 bp, Homo sapiens
agcctaaagattttgatctc

SEQ ID NO: 6635940 - DNA, 18 bp, Homo sapiens
agcctaaagggcagggcc

SEQ ID NO: 6635941 - DNA, 22 bp, Homo sapiens
agcctaaagggcagggcccacg

SEQ ID NO: 6635942 - DNA, 23 bp, Homo sapiens
agcctaaagggcagggcccacgt

SEQ ID NO: 6635943 - DNA, 20 bp, Homo sapiens
agcctaacccccagcccctc

SEQ ID NO: 6635944 - DNA, 13 bp, Homo sapiens
agcctaagaaaaa

SEQ ID NO: 6635945 - DNA, 18 bp, Homo sapiens
agcctaagaaaaaggaaa

SEQ ID NO: 6635946 - DNA, 13 bp, Homo sapiens
agcctaagaagct

SEQ ID NO: 6635947 - DNA, 18 bp, Homo sapiens
agcctaagatatacttgt

SEQ ID NO: 6635948 - DNA, 18 bp, Homo sapiens
agcctaagatgaagagga

SEQ ID NO: 6635949 - DNA, 19 bp, Homo sapiens
agcctaagcggctgtttac

SEQ ID NO: 6635950 - DNA, 21 bp, Homo sapiens
agcctaagggagacaggcctt

SEQ ID NO: 6635951 - DNA, 21 bp, Homo sapiens
agcctaagggatcctgcctgc

SEQ ID NO: 6635952 - DNA, 16 bp, Homo sapiens
agcctaatattcatgc

SEQ ID NO: 6635953 - DNA, 22 bp, Homo sapiens
agcctaatccctgggcattgct

SEQ ID NO: 6635954 - DNA, 14 bp, Homo sapiens
agcctaatgaaagg

SEQ ID NO: 6635955 - DNA, 22 bp, Homo sapiens
agcctaattgtcacatcaagca

SEQ ID NO: 6635956 - DNA, 16 bp, Homo sapiens
agcctacaaagagatg

SEQ ID NO: 6635957 - DNA, 14 bp, Homo sapiens
agcctacactgcca

SEQ ID NO: 6635958 - DNA, 15 bp, Homo sapiens
agcctacactgccag

SEQ ID NO: 6635959 - DNA, 16 bp, Homo sapiens
agcctacactgccagc

SEQ ID NO: 6635960 - DNA, 18 bp, Homo sapiens
agcctacactgccagccg

SEQ ID NO: 6635961 - DNA, 19 bp, Homo sapiens
agcctacactgccagccgc

SEQ ID NO: 6635962 - DNA, 13 bp, Homo sapiens
agcctacaggcct

SEQ ID NO: 6635963 - DNA, 20 bp, Homo sapiens
agcctacattgatgccaagc

SEQ ID NO: 6635964 - DNA, 23 bp, Homo sapiens
agcctacccttcctgcatttctc

SEQ ID NO: 6635965 - DNA, 18 bp, Homo sapiens
agcctaccgctggccctg

SEQ ID NO: 6635966 - DNA, 21 bp, Homo sapiens
agcctaccgctggccctgccg

SEQ ID NO: 6635967 - DNA, 16 bp, Homo sapiens
agcctaccgtatttca

SEQ ID NO: 6635968 - DNA, 12 bp, Homo sapiens
agcctacctctc

SEQ ID NO: 6635969 - DNA, 16 bp, Homo sapiens
agcctacctctgtctg

SEQ ID NO: 6635970 - DNA, 16 bp, Homo sapiens
agcctacctgctctcc

SEQ ID NO: 6635971 - DNA, 17 bp, Homo sapiens
agcctacctgctctcca

SEQ ID NO: 6635972 - DNA, 19 bp, Homo sapiens
agcctactagggacctggg

SEQ ID NO: 6635973 - DNA, 13 bp, Homo sapiens
agcctactctcct

SEQ ID NO: 6635974 - DNA, 14 bp, Homo sapiens
agcctactgtctcc

SEQ ID NO: 6635975 - DNA, 17 bp, Homo sapiens
agcctagaacatccctg

SEQ ID NO: 6635976 - DNA, 18 bp, Homo sapiens
agcctagaacatccctgg

SEQ ID NO: 6635977 - DNA, 22 bp, Homo sapiens
agcctagaacatccctgggcaa

SEQ ID NO: 6635978 - DNA, 17 bp, Homo sapiens
agcctagaagagcttct

SEQ ID NO: 6635979 - DNA, 19 bp, Homo sapiens
agcctagacaacctttctg

SEQ ID NO: 6635980 - DNA, 15 bp, Homo sapiens
agcctagaccctcct

SEQ ID NO: 6635981 - DNA, 18 bp, Homo sapiens
agcctagaccctcctcct

SEQ ID NO: 6635982 - DNA, 16 bp, Homo sapiens
agcctagccacctccc

SEQ ID NO: 6635983 - DNA, 20 bp, Homo sapiens
agcctagccacctcccaccc

SEQ ID NO: 6635984 - DNA, 22 bp, Homo sapiens
agcctagccacctcccacccca

SEQ ID NO: 6635985 - DNA, 13 bp, Homo sapiens
agcctagccctgg

SEQ ID NO: 6635986 - DNA, 19 bp, Homo sapiens
agcctagccgacctcagcc

SEQ ID NO: 6635987 - DNA, 16 bp, Homo sapiens
agcctagcctatgtct

SEQ ID NO: 6635988 - DNA, 22 bp, Homo sapiens
agcctagcctatgtctggcaga

SEQ ID NO: 6635989 - DNA, 17 bp, Homo sapiens
agcctagcggagcccag

SEQ ID NO: 6635990 - DNA, 17 bp, Homo sapiens
agcctagctcctgccac

SEQ ID NO: 6635991 - DNA, 15 bp, Homo sapiens
agcctaggaccactc

SEQ ID NO: 6635992 - DNA, 20 bp, Homo sapiens
agcctaggaccactcagccc

SEQ ID NO: 6635993 - DNA, 14 bp, Homo sapiens
agcctaggccaggt

SEQ ID NO: 6635994 - DNA, 12 bp, Homo sapiens
agcctagggtga

SEQ ID NO: 6635995 - DNA, 17 bp, Homo sapiens
agcctaggtgacagagt

SEQ ID NO: 6635996 - DNA, 16 bp, Homo sapiens
agcctaggtggaggca

SEQ ID NO: 6635997 - DNA, 14 bp, Homo sapiens
agcctaggtgttgt

SEQ ID NO: 6635998 - DNA, 22 bp, Homo sapiens
agcctaggtgttgtcagcaggc

SEQ ID NO: 6635999 - DNA, 19 bp, Homo sapiens
agcctagtggcttgtcctc

SEQ ID NO: 6636000 - DNA, 19 bp, Homo sapiens
agcctagtgtgtgtgcttt

SEQ ID NO: 6636001 - DNA, 17 bp, Homo sapiens
agcctagttatcaaggg

SEQ ID NO: 6636002 - DNA, 21 bp, Homo sapiens
agcctagttatcaaggggatg

SEQ ID NO: 6636003 - DNA, 14 bp, Homo sapiens
agcctagttcatcc

SEQ ID NO: 6636004 - DNA, 19 bp, Homo sapiens
agcctagtttttaatagct

SEQ ID NO: 6636005 - DNA, 20 bp, Homo sapiens
agcctatatatatagtcaaa

SEQ ID NO: 6636006 - DNA, 16 bp, Homo sapiens
agcctatatcaaacat

SEQ ID NO: 6636007 - DNA, 22 bp, Homo sapiens
agcctatatcagtcgttttagt

SEQ ID NO: 6636008 - DNA, 14 bp, Homo sapiens
agcctatatttaca

SEQ ID NO: 6636009 - DNA, 16 bp, Homo sapiens
agcctatatttcctct

SEQ ID NO: 6636010 - DNA, 18 bp, Homo sapiens
agcctatatttcctcttc

SEQ ID NO: 6636011 - DNA, 20 bp, Homo sapiens
agcctatatttcctcttctg

SEQ ID NO: 6636012 - DNA, 21 bp, Homo sapiens
agcctatatttcctcttctgt

SEQ ID NO: 6636013 - DNA, 17 bp, Homo sapiens
agcctatcaaagacctt

SEQ ID NO: 6636014 - DNA, 18 bp, Homo sapiens
agcctatctctcttctgc

SEQ ID NO: 6636015 - DNA, 18 bp, Homo sapiens
agcctatgagcatcctga

SEQ ID NO: 6636016 - DNA, 21 bp, Homo sapiens
agcctatgagcatcctgagcc

SEQ ID NO: 6636017 - DNA, 14 bp, Homo sapiens
agcctatggcagaa

SEQ ID NO: 6636018 - DNA, 14 bp, Homo sapiens
agcctatgtctggc

SEQ ID NO: 6636019 - DNA, 15 bp, Homo sapiens
agcctatgtctggca

SEQ ID NO: 6636020 - DNA, 18 bp, Homo sapiens
agcctatgtctggcagat

SEQ ID NO: 6636021 - DNA, 19 bp, Homo sapiens
agcctatgtctggcagatg

SEQ ID NO: 6636022 - DNA, 15 bp, Homo sapiens
agcctatgtcttgta

SEQ ID NO: 6636023 - DNA, 13 bp, Homo sapiens
agcctatgttgtg

SEQ ID NO: 6636024 - DNA, 22 bp, Homo sapiens
agcctatttatttgaaagtcct

SEQ ID NO: 6636025 - DNA, 15 bp, Homo sapiens
agcctatttttcaaa

SEQ ID NO: 6636026 - DNA, 17 bp, Homo sapiens
agcctatttttttagat

SEQ ID NO: 6636027 - DNA, 18 bp, Homo sapiens
agcctcaaaacaaaggcc

SEQ ID NO: 6636028 - DNA, 24 bp, Homo sapiens
agcctcaaagtcccttgagactcc

SEQ ID NO: 6636029 - DNA, 18 bp, Homo sapiens
agcctcaaatccaggacc

SEQ ID NO: 6636030 - DNA, 14 bp, Homo sapiens
agcctcaaatgcag

SEQ ID NO: 6636031 - DNA, 15 bp, Homo sapiens
agcctcaacctccct

SEQ ID NO: 6636032 - DNA, 23 bp, Homo sapiens
agcctcaaggccctcggagctgg

SEQ ID NO: 6636033 - DNA, 21 bp, Homo sapiens
agcctcaaggttttaggttct

SEQ ID NO: 6636034 - DNA, 16 bp, Homo sapiens
agcctcacactggcgt

SEQ ID NO: 6636035 - DNA, 18 bp, Homo sapiens
agcctcacagatgctggc

SEQ ID NO: 6636036 - DNA, 20 bp, Homo sapiens
agcctcacagatgctggcct

SEQ ID NO: 6636037 - DNA, 17 bp, Homo sapiens
agcctcacagtccttac

SEQ ID NO: 6636038 - DNA, 18 bp, Homo sapiens
agcctcacagtccttacc

SEQ ID NO: 6636039 - DNA, 16 bp, Homo sapiens
agcctcacccctgcag

SEQ ID NO: 6636040 - DNA, 17 bp, Homo sapiens
agcctcacccctgcccc

SEQ ID NO: 6636041 - DNA, 19 bp, Homo sapiens
agcctcacccctgcccctg

SEQ ID NO: 6636042 - DNA, 21 bp, Homo sapiens
agcctcacccctgcccctgtg

SEQ ID NO: 6636043 - DNA, 24 bp, Homo sapiens
agcctcacccctgcccctgtggga

SEQ ID NO: 6636044 - DNA, 13 bp, Homo sapiens
agcctcacctcat

SEQ ID NO: 6636045 - DNA, 16 bp, Homo sapiens
agcctcacgaaactgg

SEQ ID NO: 6636046 - DNA, 19 bp, Homo sapiens
agcctcacgaaactggaat

SEQ ID NO: 6636047 - DNA, 19 bp, Homo sapiens
agcctcacgcccccaggaa

SEQ ID NO: 6636048 - DNA, 23 bp, Homo sapiens
agcctcacgctcctttctgatct

SEQ ID NO: 6636049 - DNA, 16 bp, Homo sapiens
agcctcacggagggcc

SEQ ID NO: 6636050 - DNA, 21 bp, Homo sapiens
agcctcacgtatttcacagag

SEQ ID NO: 6636051 - DNA, 22 bp, Homo sapiens
agcctcacgtatttcacagagc

SEQ ID NO: 6636052 - DNA, 12 bp, Homo sapiens
agcctcactcca

SEQ ID NO: 6636053 - DNA, 18 bp, Homo sapiens
agcctcactccatttccc

SEQ ID NO: 6636054 - DNA, 13 bp, Homo sapiens
agcctcacttcct

SEQ ID NO: 6636055 - DNA, 21 bp, Homo sapiens
agcctcacttctagggtatgg

SEQ ID NO: 6636056 - DNA, 19 bp, Homo sapiens
agcctcagaagccttcttg

SEQ ID NO: 6636057 - DNA, 20 bp, Homo sapiens
agcctcagaagccttcttgc

SEQ ID NO: 6636058 - DNA, 17 bp, Homo sapiens
agcctcagaaggcccca

SEQ ID NO: 6636059 - DNA, 17 bp, Homo sapiens
agcctcagactcattgt

SEQ ID NO: 6636060 - DNA, 13 bp, Homo sapiens
agcctcagactgg

SEQ ID NO: 6636061 - DNA, 20 bp, Homo sapiens
agcctcagagacatcagccc

SEQ ID NO: 6636062 - DNA, 23 bp, Homo sapiens
agcctcagagacatcagcccttg

SEQ ID NO: 6636063 - DNA, 12 bp, Homo sapiens
agcctcagagga

SEQ ID NO: 6636064 - DNA, 21 bp, Homo sapiens
agcctcagaggccccttgctg

SEQ ID NO: 6636065 - DNA, 20 bp, Homo sapiens
agcctcagagtcctgccgac

SEQ ID NO: 6636066 - DNA, 18 bp, Homo sapiens
agcctcagattccttccc

SEQ ID NO: 6636067 - DNA, 23 bp, Homo sapiens
agcctcagattccttcccatgga

SEQ ID NO: 6636068 - DNA, 13 bp, Homo sapiens
agcctcagcagca

SEQ ID NO: 6636069 - DNA, 13 bp, Homo sapiens
agcctcagcatcc

SEQ ID NO: 6636070 - DNA, 17 bp, Homo sapiens
agcctcagcatcctggc

SEQ ID NO: 6636071 - DNA, 21 bp, Homo sapiens
agcctcagcatcctggcaccc

SEQ ID NO: 6636072 - DNA, 22 bp, Homo sapiens
agcctcagcatcctggcacccg

SEQ ID NO: 6636073 - DNA, 11 bp, Homo sapiens
agcctcagccc

SEQ ID NO: 6636074 - DNA, 12 bp, Homo sapiens
agcctcagccca

SEQ ID NO: 6636075 - DNA, 14 bp, Homo sapiens
agcctcagcccaac

SEQ ID NO: 6636076 - DNA, 22 bp, Homo sapiens
agcctcagccccctgcttcagt

SEQ ID NO: 6636077 - DNA, 15 bp, Homo sapiens
agcctcagcctactc

SEQ ID NO: 6636078 - DNA, 19 bp, Homo sapiens
agcctcagcgcggccctcc

SEQ ID NO: 6636079 - DNA, 20 bp, Homo sapiens
agcctcagcggaccactctt

SEQ ID NO: 6636080 - DNA, 16 bp, Homo sapiens
agcctcagctcagcct

SEQ ID NO: 6636081 - DNA, 14 bp, Homo sapiens
agcctcaggcctgg

SEQ ID NO: 6636082 - DNA, 17 bp, Homo sapiens
agcctcaggcctggccc

SEQ ID NO: 6636083 - DNA, 13 bp, Homo sapiens
agcctcagggctt

SEQ ID NO: 6636084 - DNA, 17 bp, Homo sapiens
agcctcagggcttcctt

SEQ ID NO: 6636085 - DNA, 18 bp, Homo sapiens
agcctcagggcttcctta

SEQ ID NO: 6636086 - DNA, 18 bp, Homo sapiens
agcctcagtcctcccctc

SEQ ID NO: 6636087 - DNA, 13 bp, Homo sapiens
agcctcagtctcc

SEQ ID NO: 6636088 - DNA, 19 bp, Homo sapiens
agcctcagtctccctccct

SEQ ID NO: 6636089 - DNA, 20 bp, Homo sapiens
agcctcagtgaccctggctc

SEQ ID NO: 6636090 - DNA, 13 bp, Homo sapiens
agcctcagtgcca

SEQ ID NO: 6636091 - DNA, 15 bp, Homo sapiens
agcctcagtgccact

SEQ ID NO: 6636092 - DNA, 18 bp, Homo sapiens
agcctcagtggccagagg

SEQ ID NO: 6636093 - DNA, 16 bp, Homo sapiens
agcctcatactcctgg

SEQ ID NO: 6636094 - DNA, 18 bp, Homo sapiens
agcctcatactcctgggc

SEQ ID NO: 6636095 - DNA, 20 bp, Homo sapiens
agcctcatagttattatcca

SEQ ID NO: 6636096 - DNA, 16 bp, Homo sapiens
agcctcatatttaaag

SEQ ID NO: 6636097 - DNA, 19 bp, Homo sapiens
agcctcatatttaaagaca

SEQ ID NO: 6636098 - DNA, 15 bp, Homo sapiens
agcctcatccagcct

SEQ ID NO: 6636099 - DNA, 18 bp, Homo sapiens
agcctcatccagcctcag

SEQ ID NO: 6636100 - DNA, 19 bp, Homo sapiens
agcctcatccgaggcaggg

SEQ ID NO: 6636101 - DNA, 20 bp, Homo sapiens
agcctcatccgaggcagggt

SEQ ID NO: 6636102 - DNA, 15 bp, Homo sapiens
agcctcatgacttta

SEQ ID NO: 6636103 - DNA, 17 bp, Homo sapiens
agcctcatgctctgatt

SEQ ID NO: 6636104 - DNA, 23 bp, Homo sapiens
agcctcatgggaagtcctggcac

SEQ ID NO: 6636105 - DNA, 14 bp, Homo sapiens
agcctcatgttctc

SEQ ID NO: 6636106 - DNA, 21 bp, Homo sapiens
agcctcatgttctcttcccag

SEQ ID NO: 6636107 - DNA, 16 bp, Homo sapiens
agcctcattgtgccaa

SEQ ID NO: 6636108 - DNA, 19 bp, Homo sapiens
agcctcattgtgccaagcc

SEQ ID NO: 6636109 - DNA, 22 bp, Homo sapiens
agcctcattgtgccaagccttc

SEQ ID NO: 6636110 - DNA, 20 bp, Homo sapiens
agcctccaaagtggagctgg

SEQ ID NO: 6636111 - DNA, 15 bp, Homo sapiens
agcctccaagaaact

SEQ ID NO: 6636112 - DNA, 20 bp, Homo sapiens
agcctccaagcacagagcct

SEQ ID NO: 6636113 - DNA, 23 bp, Homo sapiens
agcctccaagcacagagcctggc

SEQ ID NO: 6636114 - DNA, 19 bp, Homo sapiens
agcctccaagcctgcctcc

SEQ ID NO: 6636115 - DNA, 21 bp, Homo sapiens
agcctccaagctccatctcca

SEQ ID NO: 6636116 - DNA, 23 bp, Homo sapiens
agcctccaatgcattggcctctg

SEQ ID NO: 6636117 - DNA, 14 bp, Homo sapiens
agcctccacagcga

SEQ ID NO: 6636118 - DNA, 21 bp, Homo sapiens
agcctccacagcgagggcagc

SEQ ID NO: 6636119 - DNA, 14 bp, Homo sapiens
agcctccacctgca

SEQ ID NO: 6636120 - DNA, 17 bp, Homo sapiens
agcctccacctgcagcc

SEQ ID NO: 6636121 - DNA, 18 bp, Homo sapiens
agcctccactccctgtct

SEQ ID NO: 6636122 - DNA, 20 bp, Homo sapiens
agcctccactccctgtctga

SEQ ID NO: 6636123 - DNA, 20 bp, Homo sapiens
agcctccactgcctctggaa

SEQ ID NO: 6636124 - DNA, 16 bp, Homo sapiens
agcctccacttccctc

SEQ ID NO: 6636125 - DNA, 13 bp, Homo sapiens
agcctccagagcc

SEQ ID NO: 6636126 - DNA, 18 bp, Homo sapiens
agcctccagagccagcct

SEQ ID NO: 6636127 - DNA, 22 bp, Homo sapiens
agcctccagagccagcctggga

SEQ ID NO: 6636128 - DNA, 14 bp, Homo sapiens
agcctccagcatct

SEQ ID NO: 6636129 - DNA, 13 bp, Homo sapiens
agcctccagcctc

SEQ ID NO: 6636130 - DNA, 16 bp, Homo sapiens
agcctccagcctctgt

SEQ ID NO: 6636131 - DNA, 20 bp, Homo sapiens
agcctccaggcccccaactc

SEQ ID NO: 6636132 - DNA, 21 bp, Homo sapiens
agcctccaggcccccaactcc

SEQ ID NO: 6636133 - DNA, 12 bp, Homo sapiens
agcctccagggc

SEQ ID NO: 6636134 - DNA, 14 bp, Homo sapiens
agcctccagggcat

SEQ ID NO: 6636135 - DNA, 22 bp, Homo sapiens
agcctccagggcattgctcagc

SEQ ID NO: 6636136 - DNA, 14 bp, Homo sapiens
agcctccagtctgc

SEQ ID NO: 6636137 - DNA, 23 bp, Homo sapiens
agcctccagtctgctctcagctt

SEQ ID NO: 6636138 - DNA, 15 bp, Homo sapiens
agcctccagtgctgg

SEQ ID NO: 6636139 - DNA, 17 bp, Homo sapiens
agcctccagtgctggct

SEQ ID NO: 6636140 - DNA, 17 bp, Homo sapiens
agcctccatgctgcctc

SEQ ID NO: 6636141 - DNA, 19 bp, Homo sapiens
agcctcccaaaatggtggg

SEQ ID NO: 6636142 - DNA, 19 bp, Homo sapiens
agcctcccaaggagaacaa

SEQ ID NO: 6636143 - DNA, 20 bp, Homo sapiens
agcctcccaaggagaacaaa

SEQ ID NO: 6636144 - DNA, 21 bp, Homo sapiens
agcctcccaaggagaacaaat

SEQ ID NO: 6636145 - DNA, 18 bp, Homo sapiens
agcctcccaagtagctgg

SEQ ID NO: 6636146 - DNA, 21 bp, Homo sapiens
agcctcccaagtagctgggat

SEQ ID NO: 6636147 - DNA, 11 bp, Homo sapiens
agcctcccaca

SEQ ID NO: 6636148 - DNA, 14 bp, Homo sapiens
agcctcccacagtg

SEQ ID NO: 6636149 - DNA, 21 bp, Homo sapiens
agcctcccaccagagccggga

SEQ ID NO: 6636150 - DNA, 22 bp, Homo sapiens
agcctcccacgactgcccggca

SEQ ID NO: 6636151 - DNA, 11 bp, Homo sapiens
agcctcccaga

SEQ ID NO: 6636152 - DNA, 22 bp, Homo sapiens
agcctcccagctttctgtgtgc

SEQ ID NO: 6636153 - DNA, 21 bp, Homo sapiens
agcctcccaggtagctgggat

SEQ ID NO: 6636154 - DNA, 18 bp, Homo sapiens
agcctcccatagctggga

SEQ ID NO: 6636155 - DNA, 17 bp, Homo sapiens
agcctcccatccagggc

SEQ ID NO: 6636156 - DNA, 21 bp, Homo sapiens
agcctccccatctgtccagct

SEQ ID NO: 6636157 - DNA, 21 bp, Homo sapiens
agcctccccccgctggggagc

SEQ ID NO: 6636158 - DNA, 18 bp, Homo sapiens
agcctcccccgccagccc

SEQ ID NO: 6636159 - DNA, 15 bp, Homo sapiens
agcctccccctgctg

SEQ ID NO: 6636160 - DNA, 17 bp, Homo sapiens
agcctccccctgctgct

SEQ ID NO: 6636161 - DNA, 16 bp, Homo sapiens
agcctcccctcccctg

SEQ ID NO: 6636162 - DNA, 17 bp, Homo sapiens
agcctcccctcccctgg

SEQ ID NO: 6636163 - DNA, 20 bp, Homo sapiens
agcctcccctcccctgggga

SEQ ID NO: 6636164 - DNA, 20 bp, Homo sapiens
agcctcccctccctgtatca

SEQ ID NO: 6636165 - DNA, 15 bp, Homo sapiens
agcctcccctgccag

SEQ ID NO: 6636166 - DNA, 13 bp, Homo sapiens
agcctccccttct

SEQ ID NO: 6636167 - DNA, 15 bp, Homo sapiens
agcctccccttcttc

SEQ ID NO: 6636168 - DNA, 21 bp, Homo sapiens
agcctcccgagtagctgggat

SEQ ID NO: 6636169 - DNA, 11 bp, Homo sapiens
agcctccctca

SEQ ID NO: 6636170 - DNA, 12 bp, Homo sapiens
agcctccctcag

SEQ ID NO: 6636171 - DNA, 16 bp, Homo sapiens
agcctccctcagcccc

SEQ ID NO: 6636172 - DNA, 13 bp, Homo sapiens
agcctccctccgc

SEQ ID NO: 6636173 - DNA, 18 bp, Homo sapiens
agcctccctcctcgtccc

SEQ ID NO: 6636174 - DNA, 24 bp, Homo sapiens
agcctccctcctcgtcccctgcct

SEQ ID NO: 6636175 - DNA, 17 bp, Homo sapiens
agcctccctctcctctg

SEQ ID NO: 6636176 - DNA, 15 bp, Homo sapiens
agcctccctctgacc

SEQ ID NO: 6636177 - DNA, 21 bp, Homo sapiens
agcctccctctgacctgcagg

SEQ ID NO: 6636178 - DNA, 22 bp, Homo sapiens
agcctccctctgacctgcaggc

SEQ ID NO: 6636179 - DNA, 11 bp, Homo sapiens
agcctccctga

SEQ ID NO: 6636180 - DNA, 12 bp, Homo sapiens
agcctccctgaa

SEQ ID NO: 6636181 - DNA, 16 bp, Homo sapiens
agcctccctgagcctg

SEQ ID NO: 6636182 - DNA, 13 bp, Homo sapiens
agcctccctgcct

SEQ ID NO: 6636183 - DNA, 14 bp, Homo sapiens
agcctccctgcctc

SEQ ID NO: 6636184 - DNA, 15 bp, Homo sapiens
agcctccctgtctcc

SEQ ID NO: 6636185 - DNA, 17 bp, Homo sapiens
agcctccctgtctccag

SEQ ID NO: 6636186 - DNA, 20 bp, Homo sapiens
agcctcccttccatgcccca

SEQ ID NO: 6636187 - DNA, 21 bp, Homo sapiens
agcctcccttccatgccccag

SEQ ID NO: 6636188 - DNA, 22 bp, Homo sapiens
agcctcccttccatgccccagg

SEQ ID NO: 6636189 - DNA, 16 bp, Homo sapiens
agcctccgagagggag

SEQ ID NO: 6636190 - DNA, 17 bp, Homo sapiens
agcctccgagagggaga

SEQ ID NO: 6636191 - DNA, 22 bp, Homo sapiens
agcctccgctgggcttcattcc

SEQ ID NO: 6636192 - DNA, 22 bp, Homo sapiens
agcctccgcttccctggttcaa

SEQ ID NO: 6636193 - DNA, 13 bp, Homo sapiens
agcctccggaagc

SEQ ID NO: 6636194 - DNA, 22 bp, Homo sapiens
agcctccggtttccactactgt

SEQ ID NO: 6636195 - DNA, 15 bp, Homo sapiens
agcctccgtcaggag

SEQ ID NO: 6636196 - DNA, 16 bp, Homo sapiens
agcctccgtcatccat

SEQ ID NO: 6636197 - DNA, 14 bp, Homo sapiens
agcctccgtggaac

SEQ ID NO: 6636198 - DNA, 19 bp, Homo sapiens
agcctccgtttatgggcct

SEQ ID NO: 6636199 - DNA, 21 bp, Homo sapiens
agcctccgtttatgggccttg

SEQ ID NO: 6636200 - DNA, 22 bp, Homo sapiens
agcctccgtttatgggccttgc

SEQ ID NO: 6636201 - DNA, 20 bp, Homo sapiens
agcctcctaggctccctgag

SEQ ID NO: 6636202 - DNA, 22 bp, Homo sapiens
agcctcctaggctccctgaggt

SEQ ID NO: 6636203 - DNA, 13 bp, Homo sapiens
agcctcctcaggg

SEQ ID NO: 6636204 - DNA, 16 bp, Homo sapiens
agcctcctcccaccac

SEQ ID NO: 6636205 - DNA, 14 bp, Homo sapiens
agcctcctcctccg

SEQ ID NO: 6636206 - DNA, 18 bp, Homo sapiens
agcctcctctggacggca

SEQ ID NO: 6636207 - DNA, 15 bp, Homo sapiens
agcctcctctggaga

SEQ ID NO: 6636208 - DNA, 18 bp, Homo sapiens
agcctcctctgtctgccc

SEQ ID NO: 6636209 - DNA, 20 bp, Homo sapiens
agcctcctgaacagctggga

SEQ ID NO: 6636210 - DNA, 15 bp, Homo sapiens
agcctcctgaccctg

SEQ ID NO: 6636211 - DNA, 22 bp, Homo sapiens
agcctcctgacctgaggctcct

SEQ ID NO: 6636212 - DNA, 11 bp, Homo sapiens
agcctcctgag

SEQ ID NO: 6636213 - DNA, 20 bp, Homo sapiens
agcctcctgagtagctgaga

SEQ ID NO: 6636214 - DNA, 18 bp, Homo sapiens
agcctcctgagtagctgg

SEQ ID NO: 6636215 - DNA, 19 bp, Homo sapiens
agcctcctgagtagctgga

SEQ ID NO: 6636216 - DNA, 20 bp, Homo sapiens
agcctcctgagtagctggga

SEQ ID NO: 6636217 - DNA, 21 bp, Homo sapiens
agcctcctgagtagctgggac

SEQ ID NO: 6636218 - DNA, 16 bp, Homo sapiens
agcctcctgcccagtc

SEQ ID NO: 6636219 - DNA, 19 bp, Homo sapiens
agcctcctgccccctgcca

SEQ ID NO: 6636220 - DNA, 14 bp, Homo sapiens
agcctcctgccctt

SEQ ID NO: 6636221 - DNA, 12 bp, Homo sapiens
agcctcctgctg

SEQ ID NO: 6636222 - DNA, 17 bp, Homo sapiens
agcctcctgctgccaca

SEQ ID NO: 6636223 - DNA, 11 bp, Homo sapiens
agcctcctggg

SEQ ID NO: 6636224 - DNA, 12 bp, Homo sapiens
agcctcctggga

SEQ ID NO: 6636225 - DNA, 13 bp, Homo sapiens
agcctcctgggta

SEQ ID NO: 6636226 - DNA, 14 bp, Homo sapiens
agcctcctgtacct

SEQ ID NO: 6636227 - DNA, 17 bp, Homo sapiens
agcctccttagaaaaaa

SEQ ID NO: 6636228 - DNA, 10 bp, Homo sapiens
agcctccttg

SEQ ID NO: 6636229 - DNA, 12 bp, Homo sapiens
agcctccttgct

SEQ ID NO: 6636230 - DNA, 15 bp, Homo sapiens
agcctccttgctgac

SEQ ID NO: 6636231 - DNA, 16 bp, Homo sapiens
agcctcgaactcctgg

SEQ ID NO: 6636232 - DNA, 19 bp, Homo sapiens
agcctcgaactcctgggct

SEQ ID NO: 6636233 - DNA, 18 bp, Homo sapiens
agcctcgacaccccccca

SEQ ID NO: 6636234 - DNA, 13 bp, Homo sapiens
agcctcgaggctg

SEQ ID NO: 6636235 - DNA, 15 bp, Homo sapiens
agcctcgaggctggt

SEQ ID NO: 6636236 - DNA, 18 bp, Homo sapiens
agcctcgaggctggtggt

SEQ ID NO: 6636237 - DNA, 16 bp, Homo sapiens
agcctcgaggtgcctt

SEQ ID NO: 6636238 - DNA, 22 bp, Homo sapiens
agcctcgaggtgccttcttcag

SEQ ID NO: 6636239 - DNA, 13 bp, Homo sapiens
agcctcgagtgcc

SEQ ID NO: 6636240 - DNA, 21 bp, Homo sapiens
agcctcgagtgcccctgtccc

SEQ ID NO: 6636241 - DNA, 20 bp, Homo sapiens
agcctcgatgtcctcctctg

SEQ ID NO: 6636242 - DNA, 16 bp, Homo sapiens
agcctcgcacaggccc

SEQ ID NO: 6636243 - DNA, 14 bp, Homo sapiens
agcctcgcatgcca

SEQ ID NO: 6636244 - DNA, 15 bp, Homo sapiens
agcctcgcccctcca

SEQ ID NO: 6636245 - DNA, 20 bp, Homo sapiens
agcctcgcccctggcagaga

SEQ ID NO: 6636246 - DNA, 20 bp, Homo sapiens
agcctcgccgtctgtgaatt

SEQ ID NO: 6636247 - DNA, 12 bp, Homo sapiens
agcctcgcctgt

SEQ ID NO: 6636248 - DNA, 13 bp, Homo sapiens
agcctcgcctgtc

SEQ ID NO: 6636249 - DNA, 15 bp, Homo sapiens
agcctcgcctgtcac

SEQ ID NO: 6636250 - DNA, 22 bp, Homo sapiens
agcctcgcggtcttgggcactg

SEQ ID NO: 6636251 - DNA, 13 bp, Homo sapiens
agcctcgctctgt

SEQ ID NO: 6636252 - DNA, 23 bp, Homo sapiens
agcctcgctctgttacccagggt

SEQ ID NO: 6636253 - DNA, 20 bp, Homo sapiens
agcctcgctttttcatcctt

SEQ ID NO: 6636254 - DNA, 20 bp, Homo sapiens
agcctcggtggccatgcttc

SEQ ID NO: 6636255 - DNA, 22 bp, Homo sapiens
agcctcggtggccatgcttctt

SEQ ID NO: 6636256 - DNA, 23 bp, Homo sapiens
agcctcgtaggatgtatgttgga

SEQ ID NO: 6636257 - DNA, 13 bp, Homo sapiens
agcctcgtccctc

SEQ ID NO: 6636258 - DNA, 16 bp, Homo sapiens
agcctcgtcttcatta

SEQ ID NO: 6636259 - DNA, 21 bp, Homo sapiens
agcctcgtggagctcgcccct

SEQ ID NO: 6636260 - DNA, 22 bp, Homo sapiens
agcctcgtggagctcgcccctc

SEQ ID NO: 6636261 - DNA, 23 bp, Homo sapiens
agcctcgtggagctcgcccctcc

SEQ ID NO: 6636262 - DNA, 22 bp, Homo sapiens
agcctcgttaggacaaggctgt

SEQ ID NO: 6636263 - DNA, 23 bp, Homo sapiens
agcctcgttaggacaaggctgtg

SEQ ID NO: 6636264 - DNA, 18 bp, Homo sapiens
agcctcgttggagagcag

SEQ ID NO: 6636265 - DNA, 20 bp, Homo sapiens
agcctcgttggagagcagca

SEQ ID NO: 6636266 - DNA, 22 bp, Homo sapiens
agcctcgttggagagcagcagg

SEQ ID NO: 6636267 - DNA, 16 bp, Homo sapiens
agcctctaaacagaca

SEQ ID NO: 6636268 - DNA, 17 bp, Homo sapiens
agcctctacagccgtcc

SEQ ID NO: 6636269 - DNA, 23 bp, Homo sapiens
agcctctacagccgtcccgcgtt

SEQ ID NO: 6636270 - DNA, 21 bp, Homo sapiens
agcctctagggacccctcctc

SEQ ID NO: 6636271 - DNA, 21 bp, Homo sapiens
agcctctagtgtaccaagtgc

SEQ ID NO: 6636272 - DNA, 16 bp, Homo sapiens
agcctctattgcccag

SEQ ID NO: 6636273 - DNA, 18 bp, Homo sapiens
agcctctcacctgtactc

SEQ ID NO: 6636274 - DNA, 20 bp, Homo sapiens
agcctctcagtgccctccag

SEQ ID NO: 6636275 - DNA, 23 bp, Homo sapiens
agcctctccaggaatgcctcctc

SEQ ID NO: 6636276 - DNA, 10 bp, Homo sapiens
agcctctccc

SEQ ID NO: 6636277 - DNA, 14 bp, Homo sapiens
agcctctcccaccc

SEQ ID NO: 6636278 - DNA, 15 bp, Homo sapiens
agcctctcccacccg

SEQ ID NO: 6636279 - DNA, 16 bp, Homo sapiens
agcctctccccaggtc

SEQ ID NO: 6636280 - DNA, 22 bp, Homo sapiens
agcctctccccaggtccagctc

SEQ ID NO: 6636281 - DNA, 23 bp, Homo sapiens
agcctctccccaggtccagctct

SEQ ID NO: 6636282 - DNA, 14 bp, Homo sapiens
agcctctcccggct

SEQ ID NO: 6636283 - DNA, 16 bp, Homo sapiens
agcctctcccggctgc

SEQ ID NO: 6636284 - DNA, 17 bp, Homo sapiens
agcctctcccggctgcc

SEQ ID NO: 6636285 - DNA, 18 bp, Homo sapiens
agcctctcccggctgcct

SEQ ID NO: 6636286 - DNA, 17 bp, Homo sapiens
agcctctccgactctgc

SEQ ID NO: 6636287 - DNA, 13 bp, Homo sapiens
agcctctcctcct

SEQ ID NO: 6636288 - DNA, 20 bp, Homo sapiens
agcctctcctccttgggcag

SEQ ID NO: 6636289 - DNA, 13 bp, Homo sapiens
agcctctcctgta

SEQ ID NO: 6636290 - DNA, 23 bp, Homo sapiens
agcctctccttgccccagtcctg

SEQ ID NO: 6636291 - DNA, 13 bp, Homo sapiens
agcctctcctttg

SEQ ID NO: 6636292 - DNA, 23 bp, Homo sapiens
agcctctcgtcccgtccctccct

SEQ ID NO: 6636293 - DNA, 22 bp, Homo sapiens
agcctctctccttggccacaga

SEQ ID NO: 6636294 - DNA, 12 bp, Homo sapiens
agcctctctctc

SEQ ID NO: 6636295 - DNA, 20 bp, Homo sapiens
agcctctctctccctccctc

SEQ ID NO: 6636296 - DNA, 17 bp, Homo sapiens
agcctctctggctcagc

SEQ ID NO: 6636297 - DNA, 14 bp, Homo sapiens
agcctctctggctg

SEQ ID NO: 6636298 - DNA, 18 bp, Homo sapiens
agcctctctggctggtct

SEQ ID NO: 6636299 - DNA, 23 bp, Homo sapiens
agcctctctggctggtcttcact

SEQ ID NO: 6636300 - DNA, 13 bp, Homo sapiens
agcctctctttgt

SEQ ID NO: 6636301 - DNA, 23 bp, Homo sapiens
agcctctgaaaaccaatgttctc

SEQ ID NO: 6636302 - DNA, 20 bp, Homo sapiens
agcctctgaagttggacagc

SEQ ID NO: 6636303 - DNA, 17 bp, Homo sapiens
agcctctgacccctcct

SEQ ID NO: 6636304 - DNA, 18 bp, Homo sapiens
agcctctgacccctcctc

SEQ ID NO: 6636305 - DNA, 16 bp, Homo sapiens
agcctctgatctgtgc

SEQ ID NO: 6636306 - DNA, 18 bp, Homo sapiens
agcctctgcaactgcaag

SEQ ID NO: 6636307 - DNA, 22 bp, Homo sapiens
agcctctgcagcggaatctgtt

SEQ ID NO: 6636308 - DNA, 12 bp, Homo sapiens
agcctctgcagt

SEQ ID NO: 6636309 - DNA, 23 bp, Homo sapiens
agcctctgcagtcgcttgccaaa

SEQ ID NO: 6636310 - DNA, 16 bp, Homo sapiens
agcctctgccccaagg

SEQ ID NO: 6636311 - DNA, 18 bp, Homo sapiens
agcctctgccccaagggg

SEQ ID NO: 6636312 - DNA, 13 bp, Homo sapiens
agcctctgccctg

SEQ ID NO: 6636313 - DNA, 17 bp, Homo sapiens
agcctctgccctgcctc

SEQ ID NO: 6636314 - DNA, 19 bp, Homo sapiens
agcctctgccctgcctccc

SEQ ID NO: 6636315 - DNA, 11 bp, Homo sapiens
agcctctgccg

SEQ ID NO: 6636316 - DNA, 16 bp, Homo sapiens
agcctctgccgctgcc

SEQ ID NO: 6636317 - DNA, 15 bp, Homo sapiens
agcctctgcctccca

SEQ ID NO: 6636318 - DNA, 16 bp, Homo sapiens
agcctctgcctcccta

SEQ ID NO: 6636319 - DNA, 15 bp, Homo sapiens
agcctctgctcccca

SEQ ID NO: 6636320 - DNA, 18 bp, Homo sapiens
agcctctgctgccatggc

SEQ ID NO: 6636321 - DNA, 19 bp, Homo sapiens
agcctctggaatgcatggg

SEQ ID NO: 6636322 - DNA, 19 bp, Homo sapiens
agcctctggacagccagtg

SEQ ID NO: 6636323 - DNA, 16 bp, Homo sapiens
agcctctggactggaa

SEQ ID NO: 6636324 - DNA, 19 bp, Homo sapiens
agcctctggactggaaagc

SEQ ID NO: 6636325 - DNA, 20 bp, Homo sapiens
agcctctggatgcatttcca

SEQ ID NO: 6636326 - DNA, 15 bp, Homo sapiens
agcctctggccagac

SEQ ID NO: 6636327 - DNA, 14 bp, Homo sapiens
agcctctggctcca

SEQ ID NO: 6636328 - DNA, 14 bp, Homo sapiens
agcctctggcttcc

SEQ ID NO: 6636329 - DNA, 16 bp, Homo sapiens
agcctctggcttccct

SEQ ID NO: 6636330 - DNA, 23 bp, Homo sapiens
agcctctggcttccctaaactgc

SEQ ID NO: 6636331 - DNA, 13 bp, Homo sapiens
agcctctgggccc

SEQ ID NO: 6636332 - DNA, 11 bp, Homo sapiens
agcctctgggg

SEQ ID NO: 6636333 - DNA, 13 bp, Homo sapiens
agcctctggggca

SEQ ID NO: 6636334 - DNA, 14 bp, Homo sapiens
agcctctggggcag

SEQ ID NO: 6636335 - DNA, 20 bp, Homo sapiens
agcctctggggcagagcttg

SEQ ID NO: 6636336 - DNA, 14 bp, Homo sapiens
agcctctgtcactg

SEQ ID NO: 6636337 - DNA, 22 bp, Homo sapiens
agcctctgtcactgcaggcact

SEQ ID NO: 6636338 - DNA, 17 bp, Homo sapiens
agcctctgtcaggcctt

SEQ ID NO: 6636339 - DNA, 22 bp, Homo sapiens
agcctctgtcccccttggagga

SEQ ID NO: 6636340 - DNA, 15 bp, Homo sapiens
agcctctgtccctct

SEQ ID NO: 6636341 - DNA, 16 bp, Homo sapiens
agcctctgtccctctt

SEQ ID NO: 6636342 - DNA, 21 bp, Homo sapiens
agcctctgtcctggctgtgca

SEQ ID NO: 6636343 - DNA, 22 bp, Homo sapiens
agcctctgtcctggctgtgcac

SEQ ID NO: 6636344 - DNA, 19 bp, Homo sapiens
agcctctgtgtcactggct

SEQ ID NO: 6636345 - DNA, 17 bp, Homo sapiens
agcctctgttttgatat

SEQ ID NO: 6636346 - DNA, 20 bp, Homo sapiens
agcctcttaaagctgcctgt

SEQ ID NO: 6636347 - DNA, 17 bp, Homo sapiens
agcctcttatgggggtg

SEQ ID NO: 6636348 - DNA, 18 bp, Homo sapiens
agcctcttattccaggag

SEQ ID NO: 6636349 - DNA, 19 bp, Homo sapiens
agcctcttattccaggaga

SEQ ID NO: 6636350 - DNA, 21 bp, Homo sapiens
agcctcttcaaaaagcagagt

SEQ ID NO: 6636351 - DNA, 20 bp, Homo sapiens
agcctcttcagccccttctc

SEQ ID NO: 6636352 - DNA, 13 bp, Homo sapiens
agcctcttccctc

SEQ ID NO: 6636353 - DNA, 17 bp, Homo sapiens
agcctcttccctctgat

SEQ ID NO: 6636354 - DNA, 15 bp, Homo sapiens
agcctcttctgaaga

SEQ ID NO: 6636355 - DNA, 17 bp, Homo sapiens
agcctcttctgaagatg

SEQ ID NO: 6636356 - DNA, 16 bp, Homo sapiens
agcctcttctgtccca

SEQ ID NO: 6636357 - DNA, 20 bp, Homo sapiens
agcctcttctgtcccaagtc

SEQ ID NO: 6636358 - DNA, 21 bp, Homo sapiens
agcctcttgagctgaagtaat

SEQ ID NO: 6636359 - DNA, 23 bp, Homo sapiens
agcctcttgcccgtcggccctgc

SEQ ID NO: 6636360 - DNA, 19 bp, Homo sapiens
agcctcttgcgtattggct

SEQ ID NO: 6636361 - DNA, 18 bp, Homo sapiens
agcctcttgctcagagct

SEQ ID NO: 6636362 - DNA, 16 bp, Homo sapiens
agcctcttggaaatca

SEQ ID NO: 6636363 - DNA, 23 bp, Homo sapiens
agcctcttggggaaggggcacct

SEQ ID NO: 6636364 - DNA, 12 bp, Homo sapiens
agcctctttccc

SEQ ID NO: 6636365 - DNA, 13 bp, Homo sapiens
agcctctttccct

SEQ ID NO: 6636366 - DNA, 15 bp, Homo sapiens
agcctctttctccct

SEQ ID NO: 6636367 - DNA, 18 bp, Homo sapiens
agcctctttctgtccctt

SEQ ID NO: 6636368 - DNA, 21 bp, Homo sapiens
agcctctttctgtcccttctg

SEQ ID NO: 6636369 - DNA, 16 bp, Homo sapiens
agcctctttttgatac

SEQ ID NO: 6636370 - DNA, 17 bp, Homo sapiens
agcctgaaaattccaat

SEQ ID NO: 6636371 - DNA, 20 bp, Homo sapiens
agcctgaaagtaatttcaag

SEQ ID NO: 6636372 - DNA, 23 bp, Homo sapiens
agcctgaaagtaatttcaagaat

SEQ ID NO: 6636373 - DNA, 15 bp, Homo sapiens
agcctgaaagtttag

SEQ ID NO: 6636374 - DNA, 19 bp, Homo sapiens
agcctgaaatcatctttgt

SEQ ID NO: 6636375 - DNA, 17 bp, Homo sapiens
agcctgaaccgtgtgct

SEQ ID NO: 6636376 - DNA, 14 bp, Homo sapiens
agcctgaagcctgg

SEQ ID NO: 6636377 - DNA, 18 bp, Homo sapiens
agcctgaagcctggattc

SEQ ID NO: 6636378 - DNA, 16 bp, Homo sapiens
agcctgaaggattctg

SEQ ID NO: 6636379 - DNA, 20 bp, Homo sapiens
agcctgaagggcctcccagc

SEQ ID NO: 6636380 - DNA, 18 bp, Homo sapiens
agcctgaattgctttctg

SEQ ID NO: 6636381 - DNA, 22 bp, Homo sapiens
agcctgaattgctttctgctct

SEQ ID NO: 6636382 - DNA, 23 bp, Homo sapiens
agcctgaattgctttctgctctt

SEQ ID NO: 6636383 - DNA, 21 bp, Homo sapiens
agcctgaattttgttgctgtt

SEQ ID NO: 6636384 - DNA, 20 bp, Homo sapiens
agcctgacaacagcctgaga

SEQ ID NO: 6636385 - DNA, 21 bp, Homo sapiens
agcctgacaacagcctgagaa

SEQ ID NO: 6636386 - DNA, 17 bp, Homo sapiens
agcctgacaacatttct

SEQ ID NO: 6636387 - DNA, 15 bp, Homo sapiens
agcctgacagccaga

SEQ ID NO: 6636388 - DNA, 18 bp, Homo sapiens
agcctgaccaaaagtgag

SEQ ID NO: 6636389 - DNA, 20 bp, Homo sapiens
agcctgaccaacatggagaa

SEQ ID NO: 6636390 - DNA, 17 bp, Homo sapiens
agcctgacccggaggaa

SEQ ID NO: 6636391 - DNA, 15 bp, Homo sapiens
agcctgacctgagag

SEQ ID NO: 6636392 - DNA, 16 bp, Homo sapiens
agcctgaccttccttc

SEQ ID NO: 6636393 - DNA, 19 bp, Homo sapiens
agcctgaccttccttcctg

SEQ ID NO: 6636394 - DNA, 23 bp, Homo sapiens
agcctgacctttctgagtgacat

SEQ ID NO: 6636395 - DNA, 20 bp, Homo sapiens
agcctgacgctcagccccag

SEQ ID NO: 6636396 - DNA, 14 bp, Homo sapiens
agcctgactagaac

SEQ ID NO: 6636397 - DNA, 20 bp, Homo sapiens
agcctgactagaactcctgt

SEQ ID NO: 6636398 - DNA, 18 bp, Homo sapiens
agcctgactcttcccttc

SEQ ID NO: 6636399 - DNA, 11 bp, Homo sapiens
agcctgactgc

SEQ ID NO: 6636400 - DNA, 17 bp, Homo sapiens
agcctgactgccaggac

SEQ ID NO: 6636401 - DNA, 12 bp, Homo sapiens
agcctgactttg

SEQ ID NO: 6636402 - DNA, 14 bp, Homo sapiens
agcctgagaatgac

SEQ ID NO: 6636403 - DNA, 17 bp, Homo sapiens
agcctgagaatgacctg

SEQ ID NO: 6636404 - DNA, 13 bp, Homo sapiens
agcctgagagtct

SEQ ID NO: 6636405 - DNA, 23 bp, Homo sapiens
agcctgagatgtaggctccacct

SEQ ID NO: 6636406 - DNA, 16 bp, Homo sapiens
agcctgagcaggcagg

SEQ ID NO: 6636407 - DNA, 13 bp, Homo sapiens
agcctgagcccca

SEQ ID NO: 6636408 - DNA, 15 bp, Homo sapiens
agcctgagccttagc

SEQ ID NO: 6636409 - DNA, 13 bp, Homo sapiens
agcctgaggaagt

SEQ ID NO: 6636410 - DNA, 22 bp, Homo sapiens
agcctgaggacagaaagaccct

SEQ ID NO: 6636411 - DNA, 14 bp, Homo sapiens
agcctgaggccttc

SEQ ID NO: 6636412 - DNA, 21 bp, Homo sapiens
agcctgagggaaaggccagca

SEQ ID NO: 6636413 - DNA, 22 bp, Homo sapiens
agcctgagggaaaggccagcac

SEQ ID NO: 6636414 - DNA, 17 bp, Homo sapiens
agcctgaggtcccctcg

SEQ ID NO: 6636415 - DNA, 14 bp, Homo sapiens
agcctgaggtgccc

SEQ ID NO: 6636416 - DNA, 22 bp, Homo sapiens
agcctgagtactccacactgca

SEQ ID NO: 6636417 - DNA, 17 bp, Homo sapiens
agcctgagtctcctgtg

SEQ ID NO: 6636418 - DNA, 15 bp, Homo sapiens
agcctgagtgacaga

SEQ ID NO: 6636419 - DNA, 16 bp, Homo sapiens
agcctgatattgatat

SEQ ID NO: 6636420 - DNA, 17 bp, Homo sapiens
agcctgatccagccttt

SEQ ID NO: 6636421 - DNA, 18 bp, Homo sapiens
agcctgatctcttcctgt

SEQ ID NO: 6636422 - DNA, 17 bp, Homo sapiens
agcctgatctttctaga

SEQ ID NO: 6636423 - DNA, 23 bp, Homo sapiens
agcctgatctttgggcatcagaa

SEQ ID NO: 6636424 - DNA, 16 bp, Homo sapiens
agcctgatggccaagg

SEQ ID NO: 6636425 - DNA, 20 bp, Homo sapiens
agcctgatttaggcactgct

SEQ ID NO: 6636426 - DNA, 15 bp, Homo sapiens
agcctgattttttga

SEQ ID NO: 6636427 - DNA, 19 bp, Homo sapiens
agcctgcaaactcactgct

SEQ ID NO: 6636428 - DNA, 19 bp, Homo sapiens
agcctgcaatttcatatgc

SEQ ID NO: 6636429 - DNA, 21 bp, Homo sapiens
agcctgcaatttcatatgctg

SEQ ID NO: 6636430 - DNA, 20 bp, Homo sapiens
agcctgcacacacctgcctg

SEQ ID NO: 6636431 - DNA, 22 bp, Homo sapiens
agcctgcaccctcttctcctct

SEQ ID NO: 6636432 - DNA, 23 bp, Homo sapiens
agcctgcaccgccgccaccctgc

SEQ ID NO: 6636433 - DNA, 13 bp, Homo sapiens
agcctgcacctgc

SEQ ID NO: 6636434 - DNA, 16 bp, Homo sapiens
agcctgcacctgcccc

SEQ ID NO: 6636435 - DNA, 17 bp, Homo sapiens
agcctgcacctgccccg

SEQ ID NO: 6636436 - DNA, 18 bp, Homo sapiens
agcctgcacggtgaatgg

SEQ ID NO: 6636437 - DNA, 20 bp, Homo sapiens
agcctgcaggacctcgtgcc

SEQ ID NO: 6636438 - DNA, 23 bp, Homo sapiens
agcctgcagggaagccccacatg

SEQ ID NO: 6636439 - DNA, 12 bp, Homo sapiens
agcctgcagggt

SEQ ID NO: 6636440 - DNA, 18 bp, Homo sapiens
agcctgcagggtgacctg

SEQ ID NO: 6636441 - DNA, 23 bp, Homo sapiens
agcctgcaggtccggggaggagg

SEQ ID NO: 6636442 - DNA, 18 bp, Homo sapiens
agcctgcaggtgctgctg

SEQ ID NO: 6636443 - DNA, 19 bp, Homo sapiens
agcctgcaggtgctgctgc

SEQ ID NO: 6636444 - DNA, 22 bp, Homo sapiens
agcctgcaggtgctgctgcgtg

SEQ ID NO: 6636445 - DNA, 19 bp, Homo sapiens
agcctgcatcttcttgcat

SEQ ID NO: 6636446 - DNA, 14 bp, Homo sapiens
agcctgcattctta

SEQ ID NO: 6636447 - DNA, 15 bp, Homo sapiens
agcctgcattcttaa

SEQ ID NO: 6636448 - DNA, 22 bp, Homo sapiens
agcctgcattgagcttgcatgc

SEQ ID NO: 6636449 - DNA, 23 bp, Homo sapiens
agcctgcattgagcttgcatgct

SEQ ID NO: 6636450 - DNA, 19 bp, Homo sapiens
agcctgccaaagtgcctgg

SEQ ID NO: 6636451 - DNA, 20 bp, Homo sapiens
agcctgccaaagtgcctggg

SEQ ID NO: 6636452 - DNA, 15 bp, Homo sapiens
agcctgccaggccct

SEQ ID NO: 6636453 - DNA, 17 bp, Homo sapiens
agcctgcccacctctcc

SEQ ID NO: 6636454 - DNA, 21 bp, Homo sapiens
agcctgcccacctctccctgc

SEQ ID NO: 6636455 - DNA, 20 bp, Homo sapiens
agcctgcccagttggaggag

SEQ ID NO: 6636456 - DNA, 21 bp, Homo sapiens
agcctgccccagcctcccagc

SEQ ID NO: 6636457 - DNA, 14 bp, Homo sapiens
agcctgccccagcg

SEQ ID NO: 6636458 - DNA, 16 bp, Homo sapiens
agcctgccccagcgct

SEQ ID NO: 6636459 - DNA, 20 bp, Homo sapiens
agcctgcccctgactgtgtt

SEQ ID NO: 6636460 - DNA, 18 bp, Homo sapiens
agcctgcccgctgcaatg

SEQ ID NO: 6636461 - DNA, 18 bp, Homo sapiens
agcctgcccggccggaga

SEQ ID NO: 6636462 - DNA, 19 bp, Homo sapiens
agcctgccctcagcacaga

SEQ ID NO: 6636463 - DNA, 12 bp, Homo sapiens
agcctgccctcc

SEQ ID NO: 6636464 - DNA, 19 bp, Homo sapiens
agcctgccctccagctgct

SEQ ID NO: 6636465 - DNA, 13 bp, Homo sapiens
agcctgcccttgt

SEQ ID NO: 6636466 - DNA, 23 bp, Homo sapiens
agcctgcccttgtctgagatgct

SEQ ID NO: 6636467 - DNA, 17 bp, Homo sapiens
agcctgccgagcaaccg

SEQ ID NO: 6636468 - DNA, 21 bp, Homo sapiens
agcctgccgcccccgcctggg

SEQ ID NO: 6636469 - DNA, 22 bp, Homo sapiens
agcctgccgcccccgcctgggc

SEQ ID NO: 6636470 - DNA, 13 bp, Homo sapiens
agcctgcctaacc

SEQ ID NO: 6636471 - DNA, 18 bp, Homo sapiens
agcctgcctaaccaggcc

SEQ ID NO: 6636472 - DNA, 22 bp, Homo sapiens
agcctgcctaaccaggcccagc

SEQ ID NO: 6636473 - DNA, 13 bp, Homo sapiens
agcctgcctcacc

SEQ ID NO: 6636474 - DNA, 13 bp, Homo sapiens
agcctgcctcagt

SEQ ID NO: 6636475 - DNA, 15 bp, Homo sapiens
agcctgcctcagtgg

SEQ ID NO: 6636476 - DNA, 21 bp, Homo sapiens
agcctgcctcagtggcagcat

SEQ ID NO: 6636477 - DNA, 18 bp, Homo sapiens
agcctgcctcgccttgtg

SEQ ID NO: 6636478 - DNA, 21 bp, Homo sapiens
agcctgcctcgccttgtgtta

SEQ ID NO: 6636479 - DNA, 19 bp, Homo sapiens
agcctgcctgaagagagga

SEQ ID NO: 6636480 - DNA, 11 bp, Homo sapiens
agcctgcctgg

SEQ ID NO: 6636481 - DNA, 15 bp, Homo sapiens
agcctgcctggagcg

SEQ ID NO: 6636482 - DNA, 14 bp, Homo sapiens
agcctgcgcctgct

SEQ ID NO: 6636483 - DNA, 15 bp, Homo sapiens
agcctgcgcctgctg

SEQ ID NO: 6636484 - DNA, 20 bp, Homo sapiens
agcctgcgctcggcaggaag

SEQ ID NO: 6636485 - DNA, 18 bp, Homo sapiens
agcctgcggcctgctgga

SEQ ID NO: 6636486 - DNA, 18 bp, Homo sapiens
agcctgcggcgccagcct

SEQ ID NO: 6636487 - DNA, 20 bp, Homo sapiens
agcctgcggcgccagcctca

SEQ ID NO: 6636488 - DNA, 18 bp, Homo sapiens
agcctgcggctgctggca

SEQ ID NO: 6636489 - DNA, 21 bp, Homo sapiens
agcctgcgggaagctgacctt

SEQ ID NO: 6636490 - DNA, 17 bp, Homo sapiens
agcctgcggggcagcag

SEQ ID NO: 6636491 - DNA, 19 bp, Homo sapiens
agcctgcggggcagcaggg

SEQ ID NO: 6636492 - DNA, 15 bp, Homo sapiens
agcctgcgtggcctg

SEQ ID NO: 6636493 - DNA, 16 bp, Homo sapiens
agcctgcgtggcctgg

SEQ ID NO: 6636494 - DNA, 17 bp, Homo sapiens
agcctgcgtggcctggg

SEQ ID NO: 6636495 - DNA, 18 bp, Homo sapiens
agcctgcgtggctgaccc

SEQ ID NO: 6636496 - DNA, 23 bp, Homo sapiens
agcctgcgtggctgacccccctc

SEQ ID NO: 6636497 - DNA, 20 bp, Homo sapiens
agcctgcgttctcatcccag

SEQ ID NO: 6636498 - DNA, 21 bp, Homo sapiens
agcctgcgttggtccagagcg

SEQ ID NO: 6636499 - DNA, 9 bp, Homo sapiens
agcctgcta

SEQ ID NO: 6636500 - DNA, 16 bp, Homo sapiens
agcctgctaaatgaag

SEQ ID NO: 6636501 - DNA, 22 bp, Homo sapiens
agcctgctaaggaacaatgccg

SEQ ID NO: 6636502 - DNA, 19 bp, Homo sapiens
agcctgctcccccaccccc

SEQ ID NO: 6636503 - DNA, 13 bp, Homo sapiens
agcctgctctgcc

SEQ ID NO: 6636504 - DNA, 11 bp, Homo sapiens
agcctgctgca

SEQ ID NO: 6636505 - DNA, 12 bp, Homo sapiens
agcctgctgcat

SEQ ID NO: 6636506 - DNA, 17 bp, Homo sapiens
agcctgctgcctgcttt

SEQ ID NO: 6636507 - DNA, 10 bp, Homo sapiens
agcctgctgg

SEQ ID NO: 6636508 - DNA, 12 bp, Homo sapiens
agcctgctggaa

SEQ ID NO: 6636509 - DNA, 22 bp, Homo sapiens
agcctgctggtcacagcctcct

SEQ ID NO: 6636510 - DNA, 20 bp, Homo sapiens
agcctgctgtgtccttcctc

SEQ ID NO: 6636511 - DNA, 14 bp, Homo sapiens
agcctgcttcccac

SEQ ID NO: 6636512 - DNA, 15 bp, Homo sapiens
agcctgcttcccaca

SEQ ID NO: 6636513 - DNA, 22 bp, Homo sapiens
agcctgcttcccacctccctgc

SEQ ID NO: 6636514 - DNA, 19 bp, Homo sapiens
agcctggaacatcatcaag

SEQ ID NO: 6636515 - DNA, 17 bp, Homo sapiens
agcctggaagcactaca

SEQ ID NO: 6636516 - DNA, 23 bp, Homo sapiens
agcctggaagccatcctgccctt

SEQ ID NO: 6636517 - DNA, 10 bp, Homo sapiens
agcctggacc

SEQ ID NO: 6636518 - DNA, 17 bp, Homo sapiens
agcctggacccccagct

SEQ ID NO: 6636519 - DNA, 19 bp, Homo sapiens
agcctggacctctgacagc

SEQ ID NO: 6636520 - DNA, 21 bp, Homo sapiens
agcctggactaaaggcatcct

SEQ ID NO: 6636521 - DNA, 20 bp, Homo sapiens
agcctggactctaagctgga

SEQ ID NO: 6636522 - DNA, 14 bp, Homo sapiens
agcctggactctgc

SEQ ID NO: 6636523 - DNA, 16 bp, Homo sapiens
agcctggactctgccc

SEQ ID NO: 6636524 - DNA, 14 bp, Homo sapiens
agcctggactttgg

SEQ ID NO: 6636525 - DNA, 10 bp, Homo sapiens
agcctggagc

SEQ ID NO: 6636526 - DNA, 14 bp, Homo sapiens
agcctggagctttc

SEQ ID NO: 6636527 - DNA, 15 bp, Homo sapiens
agcctggagctttcc

SEQ ID NO: 6636528 - DNA, 16 bp, Homo sapiens
agcctggagtaggcct

SEQ ID NO: 6636529 - DNA, 16 bp, Homo sapiens
agcctggatagccttg

SEQ ID NO: 6636530 - DNA, 22 bp, Homo sapiens
agcctggatagccttgaaaaca

SEQ ID NO: 6636531 - DNA, 12 bp, Homo sapiens
agcctggatggc

SEQ ID NO: 6636532 - DNA, 14 bp, Homo sapiens
agcctggatggccc

SEQ ID NO: 6636533 - DNA, 21 bp, Homo sapiens
agcctggatggcccctccttg

SEQ ID NO: 6636534 - DNA, 17 bp, Homo sapiens
agcctggattccagcag

SEQ ID NO: 6636535 - DNA, 20 bp, Homo sapiens
agcctggattccagcagtga

SEQ ID NO: 6636536 - DNA, 9 bp, Homo sapiens
agcctggca

SEQ ID NO: 6636537 - DNA, 22 bp, Homo sapiens
agcctggcaaggcattcctcat

SEQ ID NO: 6636538 - DNA, 16 bp, Homo sapiens
agcctggcacaggact

SEQ ID NO: 6636539 - DNA, 19 bp, Homo sapiens
agcctggcacaggactgat

SEQ ID NO: 6636540 - DNA, 21 bp, Homo sapiens
agcctggcacaggccgaggca

SEQ ID NO: 6636541 - DNA, 18 bp, Homo sapiens
agcctggcacagggcagt

SEQ ID NO: 6636542 - DNA, 19 bp, Homo sapiens
agcctggcaggtcccctgc

SEQ ID NO: 6636543 - DNA, 13 bp, Homo sapiens
agcctggcatcag

SEQ ID NO: 6636544 - DNA, 15 bp, Homo sapiens
agcctggcatcagtt

SEQ ID NO: 6636545 - DNA, 17 bp, Homo sapiens
agcctggccaacatggt

SEQ ID NO: 6636546 - DNA, 15 bp, Homo sapiens
agcctggccaccagc

SEQ ID NO: 6636547 - DNA, 20 bp, Homo sapiens
agcctggccacgcagccagg

SEQ ID NO: 6636548 - DNA, 21 bp, Homo sapiens
agcctggccacgcagccagga

SEQ ID NO: 6636549 - DNA, 22 bp, Homo sapiens
agcctggccacgcagccaggac

SEQ ID NO: 6636550 - DNA, 23 bp, Homo sapiens
agcctggccacgcagccaggaca

SEQ ID NO: 6636551 - DNA, 14 bp, Homo sapiens
agcctggccagaca

SEQ ID NO: 6636552 - DNA, 19 bp, Homo sapiens
agcctggccagacaagaag

SEQ ID NO: 6636553 - DNA, 21 bp, Homo sapiens
agcctggccagacacaggccc

SEQ ID NO: 6636554 - DNA, 22 bp, Homo sapiens
agcctggccagacacaggccct

SEQ ID NO: 6636555 - DNA, 13 bp, Homo sapiens
agcctggccaggc

SEQ ID NO: 6636556 - DNA, 14 bp, Homo sapiens
agcctggccaggca

SEQ ID NO: 6636557 - DNA, 16 bp, Homo sapiens
agcctggccatcatgg

SEQ ID NO: 6636558 - DNA, 18 bp, Homo sapiens
agcctggcccagctcccc

SEQ ID NO: 6636559 - DNA, 16 bp, Homo sapiens
agcctggcccagtgag

SEQ ID NO: 6636560 - DNA, 17 bp, Homo sapiens
agcctggcccagtgaga

SEQ ID NO: 6636561 - DNA, 17 bp, Homo sapiens
agcctggcccatagaaa

SEQ ID NO: 6636562 - DNA, 19 bp, Homo sapiens
agcctggcccatagaaaca

SEQ ID NO: 6636563 - DNA, 23 bp, Homo sapiens
agcctggcccccgacccagctct

SEQ ID NO: 6636564 - DNA, 17 bp, Homo sapiens
agcctggcctcccctgc

SEQ ID NO: 6636565 - DNA, 13 bp, Homo sapiens
agcctggcctcct

SEQ ID NO: 6636566 - DNA, 19 bp, Homo sapiens
agcctggcctcctgcctct

SEQ ID NO: 6636567 - DNA, 20 bp, Homo sapiens
agcctggcctcctgcctcta

SEQ ID NO: 6636568 - DNA, 13 bp, Homo sapiens
agcctggcctgcc

SEQ ID NO: 6636569 - DNA, 14 bp, Homo sapiens
agcctggcctgccc

SEQ ID NO: 6636570 - DNA, 17 bp, Homo sapiens
agcctggcctgcccgtg

SEQ ID NO: 6636571 - DNA, 20 bp, Homo sapiens
agcctggcggggcaggaggc

SEQ ID NO: 6636572 - DNA, 15 bp, Homo sapiens
agcctggcgtctgga

SEQ ID NO: 6636573 - DNA, 19 bp, Homo sapiens
agcctggctatgtcctaat

SEQ ID NO: 6636574 - DNA, 20 bp, Homo sapiens
agcctggctccaaaccctcg

SEQ ID NO: 6636575 - DNA, 21 bp, Homo sapiens
agcctggctcccacaggcagc

SEQ ID NO: 6636576 - DNA, 16 bp, Homo sapiens
agcctggctcccctgg

SEQ ID NO: 6636577 - DNA, 11 bp, Homo sapiens
agcctggctct

SEQ ID NO: 6636578 - DNA, 13 bp, Homo sapiens
agcctggctctgc

SEQ ID NO: 6636579 - DNA, 17 bp, Homo sapiens
agcctggctctgccccc

SEQ ID NO: 6636580 - DNA, 17 bp, Homo sapiens
agcctggctgcccatca

SEQ ID NO: 6636581 - DNA, 14 bp, Homo sapiens
agcctggctgggct

SEQ ID NO: 6636582 - DNA, 14 bp, Homo sapiens
agcctggctgtcca

SEQ ID NO: 6636583 - DNA, 21 bp, Homo sapiens
agcctggctgtccaaccagac

SEQ ID NO: 6636584 - DNA, 14 bp, Homo sapiens
agcctggcttctta

SEQ ID NO: 6636585 - DNA, 15 bp, Homo sapiens
agcctggcttgggtt

SEQ ID NO: 6636586 - DNA, 18 bp, Homo sapiens
agcctggcttttctggct

SEQ ID NO: 6636587 - DNA, 17 bp, Homo sapiens
agcctgggaaagcccct

SEQ ID NO: 6636588 - DNA, 10 bp, Homo sapiens
agcctgggac

SEQ ID NO: 6636589 - DNA, 14 bp, Homo sapiens
agcctgggacacac

SEQ ID NO: 6636590 - DNA, 21 bp, Homo sapiens
agcctgggacagtttatcatg

SEQ ID NO: 6636591 - DNA, 15 bp, Homo sapiens
agcctgggaccaggg

SEQ ID NO: 6636592 - DNA, 18 bp, Homo sapiens
agcctgggaccagggcat

SEQ ID NO: 6636593 - DNA, 18 bp, Homo sapiens
agcctgggagcccagagg

SEQ ID NO: 6636594 - DNA, 19 bp, Homo sapiens
agcctgggagcccagaggg

SEQ ID NO: 6636595 - DNA, 20 bp, Homo sapiens
agcctgggataggggcagag

SEQ ID NO: 6636596 - DNA, 13 bp, Homo sapiens
agcctgggcaaca

SEQ ID NO: 6636597 - DNA, 16 bp, Homo sapiens
agcctgggcaacagag

SEQ ID NO: 6636598 - DNA, 20 bp, Homo sapiens
agcctgggcaacagagcaag

SEQ ID NO: 6636599 - DNA, 17 bp, Homo sapiens
agcctgggcagaaatgt

SEQ ID NO: 6636600 - DNA, 16 bp, Homo sapiens
agcctgggcagcttct

SEQ ID NO: 6636601 - DNA, 11 bp, Homo sapiens
agcctgggcca

SEQ ID NO: 6636602 - DNA, 13 bp, Homo sapiens
agcctgggccaga

SEQ ID NO: 6636603 - DNA, 11 bp, Homo sapiens
agcctgggccc

SEQ ID NO: 6636604 - DNA, 21 bp, Homo sapiens
agcctgggcccatctccctgc

SEQ ID NO: 6636605 - DNA, 23 bp, Homo sapiens
agcctgggcccatctccctgctt

SEQ ID NO: 6636606 - DNA, 16 bp, Homo sapiens
agcctgggccccagct

SEQ ID NO: 6636607 - DNA, 17 bp, Homo sapiens
agcctgggcccctcagc

SEQ ID NO: 6636608 - DNA, 18 bp, Homo sapiens
agcctgggcccctcagcc

SEQ ID NO: 6636609 - DNA, 20 bp, Homo sapiens
agcctgggcctatggagagc

SEQ ID NO: 6636610 - DNA, 23 bp, Homo sapiens
agcctgggcctcctcctagctgg

SEQ ID NO: 6636611 - DNA, 18 bp, Homo sapiens
agcctgggcgacagagca

SEQ ID NO: 6636612 - DNA, 20 bp, Homo sapiens
agcctgggcgacagagcaag

SEQ ID NO: 6636613 - DNA, 19 bp, Homo sapiens
agcctgggctcactgtgct

SEQ ID NO: 6636614 - DNA, 20 bp, Homo sapiens
agcctgggctcactgtgctg

SEQ ID NO: 6636615 - DNA, 12 bp, Homo sapiens
agcctgggctcc

SEQ ID NO: 6636616 - DNA, 21 bp, Homo sapiens
agcctgggctccctcttgtgg

SEQ ID NO: 6636617 - DNA, 14 bp, Homo sapiens
agcctgggctcctc

SEQ ID NO: 6636618 - DNA, 20 bp, Homo sapiens
agcctgggcttgagctgcag

SEQ ID NO: 6636619 - DNA, 15 bp, Homo sapiens
agcctggggacccca

SEQ ID NO: 6636620 - DNA, 17 bp, Homo sapiens
agcctggggcaaaccta

SEQ ID NO: 6636621 - DNA, 18 bp, Homo sapiens
agcctggggcctggcagg

SEQ ID NO: 6636622 - DNA, 19 bp, Homo sapiens
agcctggggcctggcaggg

SEQ ID NO: 6636623 - DNA, 20 bp, Homo sapiens
agcctggggccttcctggct

SEQ ID NO: 6636624 - DNA, 13 bp, Homo sapiens
agcctggggctct

SEQ ID NO: 6636625 - DNA, 15 bp, Homo sapiens
agcctggggctctaa

SEQ ID NO: 6636626 - DNA, 16 bp, Homo sapiens
agcctggggctctctg

SEQ ID NO: 6636627 - DNA, 19 bp, Homo sapiens
agcctggggctctctgacc

SEQ ID NO: 6636628 - DNA, 20 bp, Homo sapiens
agcctggggcttgaatttgc

SEQ ID NO: 6636629 - DNA, 22 bp, Homo sapiens
agcctggggcttgaatttgcat

SEQ ID NO: 6636630 - DNA, 16 bp, Homo sapiens
agcctgggggcctggc

SEQ ID NO: 6636631 - DNA, 17 bp, Homo sapiens
agcctgggggctcctca

SEQ ID NO: 6636632 - DNA, 15 bp, Homo sapiens
agcctgggggctggg

SEQ ID NO: 6636633 - DNA, 10 bp, Homo sapiens
agcctggggt

SEQ ID NO: 6636634 - DNA, 15 bp, Homo sapiens
agcctggggtctgga

SEQ ID NO: 6636635 - DNA, 20 bp, Homo sapiens
agcctggggtgatagaacaa

SEQ ID NO: 6636636 - DNA, 23 bp, Homo sapiens
agcctggggtggggtcatgccct

SEQ ID NO: 6636637 - DNA, 16 bp, Homo sapiens
agcctggggtgttctc

SEQ ID NO: 6636638 - DNA, 23 bp, Homo sapiens
agcctggggttgtccccgctggc

SEQ ID NO: 6636639 - DNA, 12 bp, Homo sapiens
agcctgggtcac

SEQ ID NO: 6636640 - DNA, 15 bp, Homo sapiens
agcctgggtcacaga

SEQ ID NO: 6636641 - DNA, 18 bp, Homo sapiens
agcctgggtcacagagtg

SEQ ID NO: 6636642 - DNA, 14 bp, Homo sapiens
agcctgggtctgga

SEQ ID NO: 6636643 - DNA, 21 bp, Homo sapiens
agcctgggtctggatgggagg

SEQ ID NO: 6636644 - DNA, 21 bp, Homo sapiens
agcctggtagagactagggaa

SEQ ID NO: 6636645 - DNA, 21 bp, Homo sapiens
agcctggtaggaaagggcaag

SEQ ID NO: 6636646 - DNA, 22 bp, Homo sapiens
agcctggtccttccctgatggc

SEQ ID NO: 6636647 - DNA, 21 bp, Homo sapiens
agcctggtctcaaactcccca

SEQ ID NO: 6636648 - DNA, 15 bp, Homo sapiens
agcctggtctcctcc

SEQ ID NO: 6636649 - DNA, 16 bp, Homo sapiens
agcctggtctgtgcat

SEQ ID NO: 6636650 - DNA, 21 bp, Homo sapiens
agcctggtgacaggcagacac

SEQ ID NO: 6636651 - DNA, 15 bp, Homo sapiens
agcctggtggcccag

SEQ ID NO: 6636652 - DNA, 17 bp, Homo sapiens
agcctggtggcccagct

SEQ ID NO: 6636653 - DNA, 17 bp, Homo sapiens
agcctggttcagaataa

SEQ ID NO: 6636654 - DNA, 16 bp, Homo sapiens
agcctggttcagacac

SEQ ID NO: 6636655 - DNA, 20 bp, Homo sapiens
agcctggttcagacacagct

SEQ ID NO: 6636656 - DNA, 16 bp, Homo sapiens
agcctggttccctctt

SEQ ID NO: 6636657 - DNA, 19 bp, Homo sapiens
agcctggttccctctttcc

SEQ ID NO: 6636658 - DNA, 20 bp, Homo sapiens
agcctggttccctctttcct

SEQ ID NO: 6636659 - DNA, 20 bp, Homo sapiens
agcctggtttgcaaagacca

SEQ ID NO: 6636660 - DNA, 21 bp, Homo sapiens
agcctggtttgcaaagaccac

SEQ ID NO: 6636661 - DNA, 17 bp, Homo sapiens
agcctggttttcacata

SEQ ID NO: 6636662 - DNA, 15 bp, Homo sapiens
agcctgtaatcccag

SEQ ID NO: 6636663 - DNA, 17 bp, Homo sapiens
agcctgtaatcccagct

SEQ ID NO: 6636664 - DNA, 18 bp, Homo sapiens
agcctgtatgtggtgtgg

SEQ ID NO: 6636665 - DNA, 13 bp, Homo sapiens
agcctgtcaccag

SEQ ID NO: 6636666 - DNA, 16 bp, Homo sapiens
agcctgtcaccagagc

SEQ ID NO: 6636667 - DNA, 20 bp, Homo sapiens
agcctgtcaccagagcttct

SEQ ID NO: 6636668 - DNA, 19 bp, Homo sapiens
agcctgtcacccagctcct

SEQ ID NO: 6636669 - DNA, 22 bp, Homo sapiens
agcctgtcagatccaggagctc

SEQ ID NO: 6636670 - DNA, 21 bp, Homo sapiens
agcctgtcataggttttaaat

SEQ ID NO: 6636671 - DNA, 11 bp, Homo sapiens
agcctgtccaa

SEQ ID NO: 6636672 - DNA, 23 bp, Homo sapiens
agcctgtccactaacttgtcttt

SEQ ID NO: 6636673 - DNA, 16 bp, Homo sapiens
agcctgtcccactggc

SEQ ID NO: 6636674 - DNA, 17 bp, Homo sapiens
agcctgtcccactggct

SEQ ID NO: 6636675 - DNA, 22 bp, Homo sapiens
agcctgtcccactggctcctcc

SEQ ID NO: 6636676 - DNA, 13 bp, Homo sapiens
agcctgtcccagg

SEQ ID NO: 6636677 - DNA, 16 bp, Homo sapiens
agcctgtcccaggact

SEQ ID NO: 6636678 - DNA, 14 bp, Homo sapiens
agcctgtccccaga

SEQ ID NO: 6636679 - DNA, 15 bp, Homo sapiens
agcctgtccccagac

SEQ ID NO: 6636680 - DNA, 13 bp, Homo sapiens
agcctgtcctcac

SEQ ID NO: 6636681 - DNA, 14 bp, Homo sapiens
agcctgtcctcacc

SEQ ID NO: 6636682 - DNA, 15 bp, Homo sapiens
agcctgtcctgcctg

SEQ ID NO: 6636683 - DNA, 16 bp, Homo sapiens
agcctgtcctgcctgt

SEQ ID NO: 6636684 - DNA, 24 bp, Homo sapiens
agcctgtcctgcctgtggccatga

SEQ ID NO: 6636685 - DNA, 12 bp, Homo sapiens
agcctgtcctgg

SEQ ID NO: 6636686 - DNA, 17 bp, Homo sapiens
agcctgtcctgggctgg

SEQ ID NO: 6636687 - DNA, 18 bp, Homo sapiens
agcctgtcctgggctggt

SEQ ID NO: 6636688 - DNA, 16 bp, Homo sapiens
agcctgtcggccacac

SEQ ID NO: 6636689 - DNA, 20 bp, Homo sapiens
agcctgtcggccacacccca

SEQ ID NO: 6636690 - DNA, 21 bp, Homo sapiens
agcctgtcggccacaccccag

SEQ ID NO: 6636691 - DNA, 19 bp, Homo sapiens
agcctgtcgtgtccagcct

SEQ ID NO: 6636692 - DNA, 16 bp, Homo sapiens
agcctgtcgtgttctc

SEQ ID NO: 6636693 - DNA, 16 bp, Homo sapiens
agcctgtctcgggctg

SEQ ID NO: 6636694 - DNA, 22 bp, Homo sapiens
agcctgtctcgggctgaccctt

SEQ ID NO: 6636695 - DNA, 14 bp, Homo sapiens
agcctgtctcttcc

SEQ ID NO: 6636696 - DNA, 15 bp, Homo sapiens
agcctgtctcttcca

SEQ ID NO: 6636697 - DNA, 17 bp, Homo sapiens
agcctgtgaacccagga

SEQ ID NO: 6636698 - DNA, 19 bp, Homo sapiens
agcctgtgacataccccct

SEQ ID NO: 6636699 - DNA, 20 bp, Homo sapiens
agcctgtgagggagtgcaga

SEQ ID NO: 6636700 - DNA, 21 bp, Homo sapiens
agcctgtgcatgtatgtcttg

SEQ ID NO: 6636701 - DNA, 15 bp, Homo sapiens
agcctgtgcctccca

SEQ ID NO: 6636702 - DNA, 17 bp, Homo sapiens
agcctgtgcctctggga

SEQ ID NO: 6636703 - DNA, 18 bp, Homo sapiens
agcctgtgcctctgggac

SEQ ID NO: 6636704 - DNA, 19 bp, Homo sapiens
agcctgtgcctctgggact

SEQ ID NO: 6636705 - DNA, 21 bp, Homo sapiens
agcctgtgcctctgggactgg

SEQ ID NO: 6636706 - DNA, 17 bp, Homo sapiens
agcctgtgcgtcccagc

SEQ ID NO: 6636707 - DNA, 20 bp, Homo sapiens
agcctgtgctgtggcataga

SEQ ID NO: 6636708 - DNA, 22 bp, Homo sapiens
agcctgtgctgtggcatagaca

SEQ ID NO: 6636709 - DNA, 11 bp, Homo sapiens
agcctgtggca

SEQ ID NO: 6636710 - DNA, 22 bp, Homo sapiens
agcctgtggcagtaaagagaaa

SEQ ID NO: 6636711 - DNA, 21 bp, Homo sapiens
agcctgtggcatctttgcctt

SEQ ID NO: 6636712 - DNA, 21 bp, Homo sapiens
agcctgtggccccgaggctgg

SEQ ID NO: 6636713 - DNA, 14 bp, Homo sapiens
agcctgtggccctg

SEQ ID NO: 6636714 - DNA, 16 bp, Homo sapiens
agcctgtggcctcagc

SEQ ID NO: 6636715 - DNA, 17 bp, Homo sapiens
agcctgtggcctcagca

SEQ ID NO: 6636716 - DNA, 18 bp, Homo sapiens
agcctgtggcggtgcctg

SEQ ID NO: 6636717 - DNA, 20 bp, Homo sapiens
agcctgtggcggtgcctggg

SEQ ID NO: 6636718 - DNA, 15 bp, Homo sapiens
agcctgtggctgtgg

SEQ ID NO: 6636719 - DNA, 18 bp, Homo sapiens
agcctgtggctgtggaga

SEQ ID NO: 6636720 - DNA, 11 bp, Homo sapiens
agcctgtggga

SEQ ID NO: 6636721 - DNA, 19 bp, Homo sapiens
agcctgtgggcagcatgcc

SEQ ID NO: 6636722 - DNA, 20 bp, Homo sapiens
agcctgtgggcagcatgccc

SEQ ID NO: 6636723 - DNA, 19 bp, Homo sapiens
agcctgtgggtttggtcct

SEQ ID NO: 6636724 - DNA, 13 bp, Homo sapiens
agcctgtgtaaca

SEQ ID NO: 6636725 - DNA, 20 bp, Homo sapiens
agcctgtgtaacagctcctt

SEQ ID NO: 6636726 - DNA, 17 bp, Homo sapiens
agcctgtgtgaaaatac

SEQ ID NO: 6636727 - DNA, 22 bp, Homo sapiens
agcctgtgtgcagtggagctgg

SEQ ID NO: 6636728 - DNA, 21 bp, Homo sapiens
agcctgtgttagtgtctgtcc

SEQ ID NO: 6636729 - DNA, 16 bp, Homo sapiens
agcctgttacaggaat

SEQ ID NO: 6636730 - DNA, 14 bp, Homo sapiens
agcctgttcatggc

SEQ ID NO: 6636731 - DNA, 17 bp, Homo sapiens
agcctgttcatggcaga

SEQ ID NO: 6636732 - DNA, 19 bp, Homo sapiens
agcctgttcatggcagatg

SEQ ID NO: 6636733 - DNA, 16 bp, Homo sapiens
agcctgttcattctga

SEQ ID NO: 6636734 - DNA, 16 bp, Homo sapiens
agcctgttcccactca

SEQ ID NO: 6636735 - DNA, 18 bp, Homo sapiens
agcctgttcccctcactg

SEQ ID NO: 6636736 - DNA, 17 bp, Homo sapiens
agcctgttccttcctgc

SEQ ID NO: 6636737 - DNA, 20 bp, Homo sapiens
agcctgttcttttaccactg

SEQ ID NO: 6636738 - DNA, 16 bp, Homo sapiens
agcctgttgtttaagt

SEQ ID NO: 6636739 - DNA, 11 bp, Homo sapiens
agcctgtttat

SEQ ID NO: 6636740 - DNA, 22 bp, Homo sapiens
agcctgtttattgccattatag

SEQ ID NO: 6636741 - DNA, 15 bp, Homo sapiens
agcctgtttctatcc

SEQ ID NO: 6636742 - DNA, 23 bp, Homo sapiens
agcctgtttctatcctgtttaat

SEQ ID NO: 6636743 - DNA, 18 bp, Homo sapiens
agcctgtttcttcctgtt

SEQ ID NO: 6636744 - DNA, 23 bp, Homo sapiens
agcctgtttgggaggctggagtg

SEQ ID NO: 6636745 - DNA, 23 bp, Homo sapiens
agcctgttttaaaaaatacagta

SEQ ID NO: 6636746 - DNA, 20 bp, Homo sapiens
agcctgttttaagttctgga

SEQ ID NO: 6636747 - DNA, 15 bp, Homo sapiens
agcctgttttcactc

SEQ ID NO: 6636748 - DNA, 11 bp, Homo sapiens
agccttaaaaa

SEQ ID NO: 6636749 - DNA, 13 bp, Homo sapiens
agccttaaactgt

SEQ ID NO: 6636750 - DNA, 15 bp, Homo sapiens
agccttaactaagac

SEQ ID NO: 6636751 - DNA, 19 bp, Homo sapiens
agccttaactaagactccc

SEQ ID NO: 6636752 - DNA, 14 bp, Homo sapiens
agccttaactttaa

SEQ ID NO: 6636753 - DNA, 13 bp, Homo sapiens
agccttaagctta

SEQ ID NO: 6636754 - DNA, 17 bp, Homo sapiens
agccttaagtcttactg

SEQ ID NO: 6636755 - DNA, 18 bp, Homo sapiens
agccttaatagacttctc

SEQ ID NO: 6636756 - DNA, 20 bp, Homo sapiens
agccttaatagacttctctt

SEQ ID NO: 6636757 - DNA, 12 bp, Homo sapiens
agccttaatttt

SEQ ID NO: 6636758 - DNA, 14 bp, Homo sapiens
agccttacacaggg

SEQ ID NO: 6636759 - DNA, 10 bp, Homo sapiens
agccttacag

SEQ ID NO: 6636760 - DNA, 14 bp, Homo sapiens
agccttacatttgt

SEQ ID NO: 6636761 - DNA, 15 bp, Homo sapiens
agccttacatttgtg

SEQ ID NO: 6636762 - DNA, 20 bp, Homo sapiens
agccttaccaagactcctgc

SEQ ID NO: 6636763 - DNA, 14 bp, Homo sapiens
agccttaccacgca

SEQ ID NO: 6636764 - DNA, 15 bp, Homo sapiens
agccttaccttgaaa

SEQ ID NO: 6636765 - DNA, 20 bp, Homo sapiens
agccttaccttgaaatgctg

SEQ ID NO: 6636766 - DNA, 21 bp, Homo sapiens
agccttagacgaagaagctgg

SEQ ID NO: 6636767 - DNA, 13 bp, Homo sapiens
agccttagagctc

SEQ ID NO: 6636768 - DNA, 16 bp, Homo sapiens
agccttagagctcttg

SEQ ID NO: 6636769 - DNA, 18 bp, Homo sapiens
agccttagagctcttgtg

SEQ ID NO: 6636770 - DNA, 16 bp, Homo sapiens
agccttagaggtcttt

SEQ ID NO: 6636771 - DNA, 12 bp, Homo sapiens
agccttagatgc

SEQ ID NO: 6636772 - DNA, 20 bp, Homo sapiens
agccttagcactatggacat

SEQ ID NO: 6636773 - DNA, 22 bp, Homo sapiens
agccttagcagccctggatggt

SEQ ID NO: 6636774 - DNA, 15 bp, Homo sapiens
agccttagcatcccc

SEQ ID NO: 6636775 - DNA, 15 bp, Homo sapiens
agccttagctcccag

SEQ ID NO: 6636776 - DNA, 16 bp, Homo sapiens
agccttagtcaataaa

SEQ ID NO: 6636777 - DNA, 21 bp, Homo sapiens
agccttagtttcagctgacca

SEQ ID NO: 6636778 - DNA, 21 bp, Homo sapiens
agccttataaaccaatcttaa

SEQ ID NO: 6636779 - DNA, 17 bp, Homo sapiens
agccttatgaaaattat

SEQ ID NO: 6636780 - DNA, 17 bp, Homo sapiens
agccttatgtgttacat

SEQ ID NO: 6636781 - DNA, 12 bp, Homo sapiens
agccttattaaa

SEQ ID NO: 6636782 - DNA, 14 bp, Homo sapiens
agccttattaaaat

SEQ ID NO: 6636783 - DNA, 15 bp, Homo sapiens
agccttattaaaata

SEQ ID NO: 6636784 - DNA, 16 bp, Homo sapiens
agccttatttacctag

SEQ ID NO: 6636785 - DNA, 19 bp, Homo sapiens
agccttatttctagaagca

SEQ ID NO: 6636786 - DNA, 19 bp, Homo sapiens
agccttcaaaaagagagat

SEQ ID NO: 6636787 - DNA, 21 bp, Homo sapiens
agccttcaaaactatagcttg

SEQ ID NO: 6636788 - DNA, 13 bp, Homo sapiens
agccttcaagctc

SEQ ID NO: 6636789 - DNA, 12 bp, Homo sapiens
agccttcaagtg

SEQ ID NO: 6636790 - DNA, 16 bp, Homo sapiens
agccttcaagtgccaa

SEQ ID NO: 6636791 - DNA, 17 bp, Homo sapiens
agccttcaagtgccaaa

SEQ ID NO: 6636792 - DNA, 19 bp, Homo sapiens
agccttcacaaccagccac

SEQ ID NO: 6636793 - DNA, 23 bp, Homo sapiens
agccttcacaaccagccacacag

SEQ ID NO: 6636794 - DNA, 18 bp, Homo sapiens
agccttcacatgaaatta

SEQ ID NO: 6636795 - DNA, 19 bp, Homo sapiens
agccttcacatgaaattag

SEQ ID NO: 6636796 - DNA, 20 bp, Homo sapiens
agccttcactggttctgcat

SEQ ID NO: 6636797 - DNA, 15 bp, Homo sapiens
agccttcagaatgct

SEQ ID NO: 6636798 - DNA, 21 bp, Homo sapiens
agccttcagaatgctcctgag

SEQ ID NO: 6636799 - DNA, 20 bp, Homo sapiens
agccttcagagtacgtcctg

SEQ ID NO: 6636800 - DNA, 21 bp, Homo sapiens
agccttcagagtacgtcctgc

SEQ ID NO: 6636801 - DNA, 12 bp, Homo sapiens
agccttcagatt

SEQ ID NO: 6636802 - DNA, 16 bp, Homo sapiens
agccttcagcactaac

SEQ ID NO: 6636803 - DNA, 14 bp, Homo sapiens
agccttcagctcca

SEQ ID NO: 6636804 - DNA, 16 bp, Homo sapiens
agccttcatcagaact

SEQ ID NO: 6636805 - DNA, 23 bp, Homo sapiens
agccttcatcagaactcttcctc

SEQ ID NO: 6636806 - DNA, 22 bp, Homo sapiens
agccttcattaggaggccgagg

SEQ ID NO: 6636807 - DNA, 17 bp, Homo sapiens
agccttccaactagctg

SEQ ID NO: 6636808 - DNA, 19 bp, Homo sapiens
agccttccaccggcactca

SEQ ID NO: 6636809 - DNA, 20 bp, Homo sapiens
agccttccaccggcactcat

SEQ ID NO: 6636810 - DNA, 22 bp, Homo sapiens
agccttccaccggcactcatga

SEQ ID NO: 6636811 - DNA, 22 bp, Homo sapiens
agccttccagggatttgcctca

SEQ ID NO: 6636812 - DNA, 23 bp, Homo sapiens
agccttccagggatttgcctcac

SEQ ID NO: 6636813 - DNA, 21 bp, Homo sapiens
agccttccagtggcttctccc

SEQ ID NO: 6636814 - DNA, 14 bp, Homo sapiens
agccttccagtttt

SEQ ID NO: 6636815 - DNA, 17 bp, Homo sapiens
agccttccatgacctcc

SEQ ID NO: 6636816 - DNA, 14 bp, Homo sapiens
agccttccccagct

SEQ ID NO: 6636817 - DNA, 20 bp, Homo sapiens
agccttcccctaccccttgt

SEQ ID NO: 6636818 - DNA, 23 bp, Homo sapiens
agccttccccttatcctccctgt

SEQ ID NO: 6636819 - DNA, 22 bp, Homo sapiens
agccttccccttgcccagggct

SEQ ID NO: 6636820 - DNA, 19 bp, Homo sapiens
agccttcctccacatcctt

SEQ ID NO: 6636821 - DNA, 21 bp, Homo sapiens
agccttcctctgcagctgacc

SEQ ID NO: 6636822 - DNA, 23 bp, Homo sapiens
agccttcctctgcagctgacctc

SEQ ID NO: 6636823 - DNA, 18 bp, Homo sapiens
agccttccttctgctccc

SEQ ID NO: 6636824 - DNA, 13 bp, Homo sapiens
agccttcctttct

SEQ ID NO: 6636825 - DNA, 17 bp, Homo sapiens
agccttcctttctcctg

SEQ ID NO: 6636826 - DNA, 18 bp, Homo sapiens
agccttcctttctcctgc

SEQ ID NO: 6636827 - DNA, 20 bp, Homo sapiens
agccttcctttctcctgccc

SEQ ID NO: 6636828 - DNA, 22 bp, Homo sapiens
agccttcctttctcctgcccca

SEQ ID NO: 6636829 - DNA, 23 bp, Homo sapiens
agccttcctttctcctgccccaa

SEQ ID NO: 6636830 - DNA, 21 bp, Homo sapiens
agccttcggagcgttctctgt

SEQ ID NO: 6636831 - DNA, 18 bp, Homo sapiens
agccttcgtgtggctcct

SEQ ID NO: 6636832 - DNA, 24 bp, Homo sapiens
agccttctccatatctccatggcc

SEQ ID NO: 6636833 - DNA, 13 bp, Homo sapiens
agccttctctctc

SEQ ID NO: 6636834 - DNA, 21 bp, Homo sapiens
agccttctctgttcatttcct

SEQ ID NO: 6636835 - DNA, 13 bp, Homo sapiens
agccttctgagct

SEQ ID NO: 6636836 - DNA, 12 bp, Homo sapiens
agccttctgcag

SEQ ID NO: 6636837 - DNA, 13 bp, Homo sapiens
agccttctgcagc

SEQ ID NO: 6636838 - DNA, 20 bp, Homo sapiens
agccttctgcagcaggaact

SEQ ID NO: 6636839 - DNA, 17 bp, Homo sapiens
agccttctgccaccagc

SEQ ID NO: 6636840 - DNA, 21 bp, Homo sapiens
agccttctgccaccagcccct

SEQ ID NO: 6636841 - DNA, 20 bp, Homo sapiens
agccttcttccatcccagga

SEQ ID NO: 6636842 - DNA, 14 bp, Homo sapiens
agccttcttctgcc

SEQ ID NO: 6636843 - DNA, 13 bp, Homo sapiens
agccttcttgctg

SEQ ID NO: 6636844 - DNA, 20 bp, Homo sapiens
agccttcttgctgcccacaa

SEQ ID NO: 6636845 - DNA, 15 bp, Homo sapiens
agccttgaaaaacaa

SEQ ID NO: 6636846 - DNA, 20 bp, Homo sapiens
agccttgaactgtggccacc

SEQ ID NO: 6636847 - DNA, 22 bp, Homo sapiens
agccttgaactttgacctctgc

SEQ ID NO: 6636848 - DNA, 15 bp, Homo sapiens
agccttgaagaaaat

SEQ ID NO: 6636849 - DNA, 21 bp, Homo sapiens
agccttgaagaaaatgacttt

SEQ ID NO: 6636850 - DNA, 22 bp, Homo sapiens
agccttgaccattctccacctg

SEQ ID NO: 6636851 - DNA, 23 bp, Homo sapiens
agccttgaccattctccacctgc

SEQ ID NO: 6636852 - DNA, 22 bp, Homo sapiens
agccttgacctaatgaggtagc

SEQ ID NO: 6636853 - DNA, 13 bp, Homo sapiens
agccttgactatg

SEQ ID NO: 6636854 - DNA, 18 bp, Homo sapiens
agccttgcaaatagccag

SEQ ID NO: 6636855 - DNA, 16 bp, Homo sapiens
agccttgcacacccac

SEQ ID NO: 6636856 - DNA, 19 bp, Homo sapiens
agccttgcactaggttgca

SEQ ID NO: 6636857 - DNA, 19 bp, Homo sapiens
agccttgcagcggctcctg

SEQ ID NO: 6636858 - DNA, 17 bp, Homo sapiens
agccttgcatgtacttg

SEQ ID NO: 6636859 - DNA, 14 bp, Homo sapiens
agccttgccagaga

SEQ ID NO: 6636860 - DNA, 12 bp, Homo sapiens
agccttgcccag

SEQ ID NO: 6636861 - DNA, 14 bp, Homo sapiens
agccttgcccagca

SEQ ID NO: 6636862 - DNA, 17 bp, Homo sapiens
agccttgctctcttcaa

SEQ ID NO: 6636863 - DNA, 18 bp, Homo sapiens
agccttgctctcttcaat

SEQ ID NO: 6636864 - DNA, 22 bp, Homo sapiens
agccttgctctcttcaataaac

SEQ ID NO: 6636865 - DNA, 15 bp, Homo sapiens
agccttgctctgttg

SEQ ID NO: 6636866 - DNA, 10 bp, Homo sapiens
agccttgctg

SEQ ID NO: 6636867 - DNA, 13 bp, Homo sapiens
agccttgctgacc

SEQ ID NO: 6636868 - DNA, 15 bp, Homo sapiens
agccttgctgccaag

SEQ ID NO: 6636869 - DNA, 15 bp, Homo sapiens
agccttgctgctctg

SEQ ID NO: 6636870 - DNA, 16 bp, Homo sapiens
agccttgctgctctgc

SEQ ID NO: 6636871 - DNA, 16 bp, Homo sapiens
agccttgctgggccag

SEQ ID NO: 6636872 - DNA, 18 bp, Homo sapiens
agccttgctgggccaggg

SEQ ID NO: 6636873 - DNA, 14 bp, Homo sapiens
agccttgctgtaga

SEQ ID NO: 6636874 - DNA, 15 bp, Homo sapiens
agccttggaaccagc

SEQ ID NO: 6636875 - DNA, 23 bp, Homo sapiens
agccttggataatgctgttgcct

SEQ ID NO: 6636876 - DNA, 16 bp, Homo sapiens
agccttggcatctaga

SEQ ID NO: 6636877 - DNA, 21 bp, Homo sapiens
agccttggcctgacctggcac

SEQ ID NO: 6636878 - DNA, 21 bp, Homo sapiens
agccttggcgagggcagcagg

SEQ ID NO: 6636879 - DNA, 23 bp, Homo sapiens
agccttggcgagggcagcagggt

SEQ ID NO: 6636880 - DNA, 12 bp, Homo sapiens
agccttggctcc

SEQ ID NO: 6636881 - DNA, 19 bp, Homo sapiens
agccttggctcctgagaaa

SEQ ID NO: 6636882 - DNA, 16 bp, Homo sapiens
agccttgggagccact

SEQ ID NO: 6636883 - DNA, 18 bp, Homo sapiens
agccttgggagccactgc

SEQ ID NO: 6636884 - DNA, 19 bp, Homo sapiens
agccttgggagccactgcc

SEQ ID NO: 6636885 - DNA, 21 bp, Homo sapiens
agccttgggagccactgccac

SEQ ID NO: 6636886 - DNA, 22 bp, Homo sapiens
agccttgggagccactgccact

SEQ ID NO: 6636887 - DNA, 16 bp, Homo sapiens
agccttgggcctttca

SEQ ID NO: 6636888 - DNA, 16 bp, Homo sapiens
agccttggggattctt

SEQ ID NO: 6636889 - DNA, 23 bp, Homo sapiens
agccttggggattcttccatctg

SEQ ID NO: 6636890 - DNA, 20 bp, Homo sapiens
agccttgggggggctgcctt

SEQ ID NO: 6636891 - DNA, 23 bp, Homo sapiens
agccttggggggtgggggctgtc

SEQ ID NO: 6636892 - DNA, 15 bp, Homo sapiens
agccttggggttgga

SEQ ID NO: 6636893 - DNA, 16 bp, Homo sapiens
agccttggtgccacca

SEQ ID NO: 6636894 - DNA, 16 bp, Homo sapiens
agccttggtgtccacc

SEQ ID NO: 6636895 - DNA, 21 bp, Homo sapiens
agccttggtgtccacctggcc

SEQ ID NO: 6636896 - DNA, 14 bp, Homo sapiens
agccttggttcctg

SEQ ID NO: 6636897 - DNA, 17 bp, Homo sapiens
agccttgtacagtctgc

SEQ ID NO: 6636898 - DNA, 22 bp, Homo sapiens
agccttgtcagtgtgtcagttt

SEQ ID NO: 6636899 - DNA, 13 bp, Homo sapiens
agccttgtgagat

SEQ ID NO: 6636900 - DNA, 23 bp, Homo sapiens
agccttgtgatcactttctgaaa

SEQ ID NO: 6636901 - DNA, 21 bp, Homo sapiens
agccttgtgatgtcatacaga

SEQ ID NO: 6636902 - DNA, 13 bp, Homo sapiens
agccttgtgccct

SEQ ID NO: 6636903 - DNA, 19 bp, Homo sapiens
agccttgtgccctgccccc

SEQ ID NO: 6636904 - DNA, 10 bp, Homo sapiens
agccttgtgt

SEQ ID NO: 6636905 - DNA, 17 bp, Homo sapiens
agccttgtgtttctgtg

SEQ ID NO: 6636906 - DNA, 13 bp, Homo sapiens
agccttgttgtga

SEQ ID NO: 6636907 - DNA, 17 bp, Homo sapiens
agccttgtttctgatga

SEQ ID NO: 6636908 - DNA, 17 bp, Homo sapiens
agcctttaaaaccagta

SEQ ID NO: 6636909 - DNA, 12 bp, Homo sapiens
agcctttaaatt

SEQ ID NO: 6636910 - DNA, 23 bp, Homo sapiens
agcctttaatggacttatttctt

SEQ ID NO: 6636911 - DNA, 22 bp, Homo sapiens
agcctttaccctcctctatttc

SEQ ID NO: 6636912 - DNA, 18 bp, Homo sapiens
agcctttacctgtgaagt

SEQ ID NO: 6636913 - DNA, 14 bp, Homo sapiens
agcctttatacaat

SEQ ID NO: 6636914 - DNA, 22 bp, Homo sapiens
agcctttatggctgctgggctg

SEQ ID NO: 6636915 - DNA, 12 bp, Homo sapiens
agcctttattat

SEQ ID NO: 6636916 - DNA, 19 bp, Homo sapiens
agcctttattattactgtt

SEQ ID NO: 6636917 - DNA, 17 bp, Homo sapiens
agcctttcattttgctt

SEQ ID NO: 6636918 - DNA, 18 bp, Homo sapiens
agcctttcattttgcttt

SEQ ID NO: 6636919 - DNA, 23 bp, Homo sapiens
agcctttcattttgctttaattt

SEQ ID NO: 6636920 - DNA, 16 bp, Homo sapiens
agcctttccaagtcac

SEQ ID NO: 6636921 - DNA, 14 bp, Homo sapiens
agcctttccataag

SEQ ID NO: 6636922 - DNA, 13 bp, Homo sapiens
agcctttcctcgg

SEQ ID NO: 6636923 - DNA, 13 bp, Homo sapiens
agcctttcctgat

SEQ ID NO: 6636924 - DNA, 20 bp, Homo sapiens
agcctttctccagcccatgc

SEQ ID NO: 6636925 - DNA, 23 bp, Homo sapiens
agcctttctctctttatacagct

SEQ ID NO: 6636926 - DNA, 12 bp, Homo sapiens
agcctttctgta

SEQ ID NO: 6636927 - DNA, 13 bp, Homo sapiens
agcctttctgtat

SEQ ID NO: 6636928 - DNA, 14 bp, Homo sapiens
agcctttctgtatc

SEQ ID NO: 6636929 - DNA, 13 bp, Homo sapiens
agcctttctgtgg

SEQ ID NO: 6636930 - DNA, 19 bp, Homo sapiens
agcctttcttttctttctt

SEQ ID NO: 6636931 - DNA, 12 bp, Homo sapiens
agcctttgaagt

SEQ ID NO: 6636932 - DNA, 13 bp, Homo sapiens
agcctttgccctg

SEQ ID NO: 6636933 - DNA, 17 bp, Homo sapiens
agcctttgccgtgagca

SEQ ID NO: 6636934 - DNA, 16 bp, Homo sapiens
agcctttgcctccccg

SEQ ID NO: 6636935 - DNA, 18 bp, Homo sapiens
agcctttgcgctctgggt

SEQ ID NO: 6636936 - DNA, 22 bp, Homo sapiens
agcctttggaagtctgcgccct

SEQ ID NO: 6636937 - DNA, 20 bp, Homo sapiens
agcctttggatgaccagaac

SEQ ID NO: 6636938 - DNA, 23 bp, Homo sapiens
agcctttggatggctatggagag

SEQ ID NO: 6636939 - DNA, 19 bp, Homo sapiens
agcctttgggtcctgggca

SEQ ID NO: 6636940 - DNA, 21 bp, Homo sapiens
agcctttgggtcctgggcagg

SEQ ID NO: 6636941 - DNA, 19 bp, Homo sapiens
agcctttggtgaataacct

SEQ ID NO: 6636942 - DNA, 20 bp, Homo sapiens
agcctttggtgaattccttc

SEQ ID NO: 6636943 - DNA, 19 bp, Homo sapiens
agcctttggttctggccag

SEQ ID NO: 6636944 - DNA, 23 bp, Homo sapiens
agcctttgtcaataaacctgtca

SEQ ID NO: 6636945 - DNA, 13 bp, Homo sapiens
agcctttgtgctt

SEQ ID NO: 6636946 - DNA, 23 bp, Homo sapiens
agcctttgtgctttttgtcatgt

SEQ ID NO: 6636947 - DNA, 16 bp, Homo sapiens
agcctttgtggtttag

SEQ ID NO: 6636948 - DNA, 14 bp, Homo sapiens
agcctttgttcccc

SEQ ID NO: 6636949 - DNA, 20 bp, Homo sapiens
agcctttgttccccactgga

SEQ ID NO: 6636950 - DNA, 15 bp, Homo sapiens
agcctttgttgaact

SEQ ID NO: 6636951 - DNA, 19 bp, Homo sapiens
agcctttgttgaactgtta

SEQ ID NO: 6636952 - DNA, 21 bp, Homo sapiens
agcctttgttgaactgttaga

SEQ ID NO: 6636953 - DNA, 19 bp, Homo sapiens
agccttttattaacatata

SEQ ID NO: 6636954 - DNA, 21 bp, Homo sapiens
agccttttctggtccctcttc

SEQ ID NO: 6636955 - DNA, 13 bp, Homo sapiens
agccttttgaaag

SEQ ID NO: 6636956 - DNA, 13 bp, Homo sapiens
agccttttgctct

SEQ ID NO: 6636957 - DNA, 21 bp, Homo sapiens
agcctttttaaaacacatgtt

SEQ ID NO: 6636958 - DNA, 20 bp, Homo sapiens
agcctttttcaccatggcaa

SEQ ID NO: 6636959 - DNA, 20 bp, Homo sapiens
agccttttttccccagactt

SEQ ID NO: 6636960 - DNA, 21 bp, Homo sapiens
agcctttttttagtaaatcct

SEQ ID NO: 6636961 - DNA, 17 bp, Homo sapiens
agcgaaactccatctca

SEQ ID NO: 6636962 - DNA, 12 bp, Homo sapiens
agcgaaactccg

SEQ ID NO: 6636963 - DNA, 14 bp, Homo sapiens
agcgaaagtttctt

SEQ ID NO: 6636964 - DNA, 15 bp, Homo sapiens
agcgaaataaaaatg

SEQ ID NO: 6636965 - DNA, 19 bp, Homo sapiens
agcgaaatctaaatttctt

SEQ ID NO: 6636966 - DNA, 16 bp, Homo sapiens
agcgaacagccttaga

SEQ ID NO: 6636967 - DNA, 18 bp, Homo sapiens
agcgaaccaatatttgta

SEQ ID NO: 6636968 - DNA, 16 bp, Homo sapiens
agcgaaggaacctctc

SEQ ID NO: 6636969 - DNA, 12 bp, Homo sapiens
agcgaagggagt

SEQ ID NO: 6636970 - DNA, 20 bp, Homo sapiens
agcgaatgctaggtctcgga

SEQ ID NO: 6636971 - DNA, 15 bp, Homo sapiens
agcgaattcagaaag

SEQ ID NO: 6636972 - DNA, 20 bp, Homo sapiens
agcgacaccctttctgtttg

SEQ ID NO: 6636973 - DNA, 12 bp, Homo sapiens
agcgacagattc

SEQ ID NO: 6636974 - DNA, 24 bp, Homo sapiens
agcgacagcattttaaggttctca

SEQ ID NO: 6636975 - DNA, 14 bp, Homo sapiens
agcgacagcctggg

SEQ ID NO: 6636976 - DNA, 21 bp, Homo sapiens
agcgacagtaggatttttcaa

SEQ ID NO: 6636977 - DNA, 17 bp, Homo sapiens
agcgacagtgagactct

SEQ ID NO: 6636978 - DNA, 15 bp, Homo sapiens
agcgacatttctcca

SEQ ID NO: 6636979 - DNA, 12 bp, Homo sapiens
agcgaccccaga

SEQ ID NO: 6636980 - DNA, 15 bp, Homo sapiens
agcgaccccagactg

SEQ ID NO: 6636981 - DNA, 14 bp, Homo sapiens
agcgaccccaggac

SEQ ID NO: 6636982 - DNA, 22 bp, Homo sapiens
agcgaccccaggacctcttctg

SEQ ID NO: 6636983 - DNA, 13 bp, Homo sapiens
agcgaccctggct

SEQ ID NO: 6636984 - DNA, 15 bp, Homo sapiens
agcgaccctggctct

SEQ ID NO: 6636985 - DNA, 22 bp, Homo sapiens
agcgaccttcctcatccacccc

SEQ ID NO: 6636986 - DNA, 14 bp, Homo sapiens
agcgactctcctgc

SEQ ID NO: 6636987 - DNA, 14 bp, Homo sapiens
agcgactctcctgt

SEQ ID NO: 6636988 - DNA, 13 bp, Homo sapiens
agcgacttcaggt

SEQ ID NO: 6636989 - DNA, 18 bp, Homo sapiens
agcgacttcaggtcaggt

SEQ ID NO: 6636990 - DNA, 20 bp, Homo sapiens
agcgacttttgttctcttct

SEQ ID NO: 6636991 - DNA, 22 bp, Homo sapiens
agcgagacccttgcattagaaa

SEQ ID NO: 6636992 - DNA, 23 bp, Homo sapiens
agcgagacccttgcattagaaac

SEQ ID NO: 6636993 - DNA, 13 bp, Homo sapiens
agcgagactccat

SEQ ID NO: 6636994 - DNA, 13 bp, Homo sapiens
agcgagaggcagc

SEQ ID NO: 6636995 - DNA, 16 bp, Homo sapiens
agcgagaggcagcaag

SEQ ID NO: 6636996 - DNA, 17 bp, Homo sapiens
agcgagaggcagcaagg

SEQ ID NO: 6636997 - DNA, 21 bp, Homo sapiens
agcgagattccgtctcaaaaa

SEQ ID NO: 6636998 - DNA, 18 bp, Homo sapiens
agcgagcaagccggcaag

SEQ ID NO: 6636999 - DNA, 19 bp, Homo sapiens
agcgagcatcccccaaagt

SEQ ID NO: 6637000 - DNA, 14 bp, Homo sapiens
agcgagccacagga

SEQ ID NO: 6637001 - DNA, 19 bp, Homo sapiens
agcgagccacaggaacggc

SEQ ID NO: 6637002 - DNA, 22 bp, Homo sapiens
agcgagccacaggaacggccct

SEQ ID NO: 6637003 - DNA, 19 bp, Homo sapiens
agcgagccctggtggcagt

SEQ ID NO: 6637004 - DNA, 19 bp, Homo sapiens
agcgagcgcccagctcctg

SEQ ID NO: 6637005 - DNA, 23 bp, Homo sapiens
agcgagctgagatcacaccactg

SEQ ID NO: 6637006 - DNA, 15 bp, Homo sapiens
agcgagctgctctgc

SEQ ID NO: 6637007 - DNA, 17 bp, Homo sapiens
agcgagctgctctgcta

SEQ ID NO: 6637008 - DNA, 18 bp, Homo sapiens
agcgagctgctctgctat

SEQ ID NO: 6637009 - DNA, 15 bp, Homo sapiens
agcgagctgggccgg

SEQ ID NO: 6637010 - DNA, 18 bp, Homo sapiens
agcgaggaggcgcggcct

SEQ ID NO: 6637011 - DNA, 21 bp, Homo sapiens
agcgaggcagaatggtgggct

SEQ ID NO: 6637012 - DNA, 18 bp, Homo sapiens
agcgaggcgaggctgcct

SEQ ID NO: 6637013 - DNA, 21 bp, Homo sapiens
agcgaggcgaggctgcctctg

SEQ ID NO: 6637014 - DNA, 22 bp, Homo sapiens
agcgaggcgaggctgcctctgg

SEQ ID NO: 6637015 - DNA, 22 bp, Homo sapiens
agcgagggccccagcgtgaagc

SEQ ID NO: 6637016 - DNA, 15 bp, Homo sapiens
agcgagggcgtgtct

SEQ ID NO: 6637017 - DNA, 22 bp, Homo sapiens
agcgaggtcaacagagaaggca

SEQ ID NO: 6637018 - DNA, 21 bp, Homo sapiens
agcgagtaaagtctgggccag

SEQ ID NO: 6637019 - DNA, 22 bp, Homo sapiens
agcgagtaaagtctgggccagg

SEQ ID NO: 6637020 - DNA, 18 bp, Homo sapiens
agcgagtctggagaccag

SEQ ID NO: 6637021 - DNA, 17 bp, Homo sapiens
agcgagtggatgctgtg

SEQ ID NO: 6637022 - DNA, 14 bp, Homo sapiens
agcgagttgtggaa

SEQ ID NO: 6637023 - DNA, 16 bp, Homo sapiens
agcgataatacactat

SEQ ID NO: 6637024 - DNA, 17 bp, Homo sapiens
agcgatatacagatgaa

SEQ ID NO: 6637025 - DNA, 14 bp, Homo sapiens
agcgatcatttatt

SEQ ID NO: 6637026 - DNA, 22 bp, Homo sapiens
agcgatccctcccctcagcctc

SEQ ID NO: 6637027 - DNA, 21 bp, Homo sapiens
agcgatcctccttcctcatcc

SEQ ID NO: 6637028 - DNA, 16 bp, Homo sapiens
agcgatctctccactg

SEQ ID NO: 6637029 - DNA, 18 bp, Homo sapiens
agcgatgaatttggagac

SEQ ID NO: 6637030 - DNA, 19 bp, Homo sapiens
agcgatggcaggcctgacc

SEQ ID NO: 6637031 - DNA, 19 bp, Homo sapiens
agcgatgggcccctggccc

SEQ ID NO: 6637032 - DNA, 21 bp, Homo sapiens
agcgattccctctcccaggcc

SEQ ID NO: 6637033 - DNA, 22 bp, Homo sapiens
agcgattccctctcccaggccc

SEQ ID NO: 6637034 - DNA, 23 bp, Homo sapiens
agcgattccctctcccaggcccc

SEQ ID NO: 6637035 - DNA, 17 bp, Homo sapiens
agcgattcctgccaagt

SEQ ID NO: 6637036 - DNA, 14 bp, Homo sapiens
agcgattctcctgc

SEQ ID NO: 6637037 - DNA, 15 bp, Homo sapiens
agcgattctcctgcc

SEQ ID NO: 6637038 - DNA, 18 bp, Homo sapiens
agcgattctcctgcctca

SEQ ID NO: 6637039 - DNA, 19 bp, Homo sapiens
agcgattctcttgcctcag

SEQ ID NO: 6637040 - DNA, 22 bp, Homo sapiens
agcgattgattgatgtacagaa

SEQ ID NO: 6637041 - DNA, 14 bp, Homo sapiens
agcgcaagccacag

SEQ ID NO: 6637042 - DNA, 15 bp, Homo sapiens
agcgcaagccacagc

SEQ ID NO: 6637043 - DNA, 17 bp, Homo sapiens
agcgcaagccacagcct

SEQ ID NO: 6637044 - DNA, 13 bp, Homo sapiens
agcgcacagctgc

SEQ ID NO: 6637045 - DNA, 14 bp, Homo sapiens
agcgcacagctgct

SEQ ID NO: 6637046 - DNA, 17 bp, Homo sapiens
agcgcacctgccccctg

SEQ ID NO: 6637047 - DNA, 18 bp, Homo sapiens
agcgcacctgccccctgg

SEQ ID NO: 6637048 - DNA, 12 bp, Homo sapiens
agcgcacctgct

SEQ ID NO: 6637049 - DNA, 18 bp, Homo sapiens
agcgcacgcgcgcacaca

SEQ ID NO: 6637050 - DNA, 13 bp, Homo sapiens
agcgcacttccca

SEQ ID NO: 6637051 - DNA, 13 bp, Homo sapiens
agcgcagagaaat

SEQ ID NO: 6637052 - DNA, 20 bp, Homo sapiens
agcgcagcagcgggagctag

SEQ ID NO: 6637053 - DNA, 17 bp, Homo sapiens
agcgcagcccccacgcc

SEQ ID NO: 6637054 - DNA, 17 bp, Homo sapiens
agcgcagccgagcccca

SEQ ID NO: 6637055 - DNA, 22 bp, Homo sapiens
agcgcagccgccgggcaggcct

SEQ ID NO: 6637056 - DNA, 21 bp, Homo sapiens
agcgcagccgccttcacagca

SEQ ID NO: 6637057 - DNA, 14 bp, Homo sapiens
agcgcagctgcatt

SEQ ID NO: 6637058 - DNA, 21 bp, Homo sapiens
agcgcagctggactctgcatc

SEQ ID NO: 6637059 - DNA, 12 bp, Homo sapiens
agcgcaggcagc

SEQ ID NO: 6637060 - DNA, 21 bp, Homo sapiens
agcgcaggcagcgcagggctg

SEQ ID NO: 6637061 - DNA, 20 bp, Homo sapiens
agcgcaggctgcagagcccg

SEQ ID NO: 6637062 - DNA, 17 bp, Homo sapiens
agcgcagggaggatgcc

SEQ ID NO: 6637063 - DNA, 20 bp, Homo sapiens
agcgcagggaggatgccaca

SEQ ID NO: 6637064 - DNA, 16 bp, Homo sapiens
agcgcagggctggcac

SEQ ID NO: 6637065 - DNA, 14 bp, Homo sapiens
agcgcagttttttt

SEQ ID NO: 6637066 - DNA, 17 bp, Homo sapiens
agcgcatggcgccccgg

SEQ ID NO: 6637067 - DNA, 21 bp, Homo sapiens
agcgcatgtgtgcatgtgctg

SEQ ID NO: 6637068 - DNA, 13 bp, Homo sapiens
agcgcattgtttt

SEQ ID NO: 6637069 - DNA, 17 bp, Homo sapiens
agcgcattgttttgcat

SEQ ID NO: 6637070 - DNA, 18 bp, Homo sapiens
agcgccaagcaacctggg

SEQ ID NO: 6637071 - DNA, 20 bp, Homo sapiens
agcgccaagtgcgtgccgtg

SEQ ID NO: 6637072 - DNA, 20 bp, Homo sapiens
agcgccaagtggccactggc

SEQ ID NO: 6637073 - DNA, 13 bp, Homo sapiens
agcgccactgtcc

SEQ ID NO: 6637074 - DNA, 18 bp, Homo sapiens
agcgccactgtccgctgt

SEQ ID NO: 6637075 - DNA, 22 bp, Homo sapiens
agcgccactgtccgctgtctcc

SEQ ID NO: 6637076 - DNA, 18 bp, Homo sapiens
agcgccaggaagccagag

SEQ ID NO: 6637077 - DNA, 21 bp, Homo sapiens
agcgccaggaagccagagccc

SEQ ID NO: 6637078 - DNA, 14 bp, Homo sapiens
agcgccaggctgga

SEQ ID NO: 6637079 - DNA, 13 bp, Homo sapiens
agcgccagggccc

SEQ ID NO: 6637080 - DNA, 23 bp, Homo sapiens
agcgccagggcccaggccatgtg

SEQ ID NO: 6637081 - DNA, 15 bp, Homo sapiens
agcgccagggctcag

SEQ ID NO: 6637082 - DNA, 14 bp, Homo sapiens
agcgcccacccagg

SEQ ID NO: 6637083 - DNA, 15 bp, Homo sapiens
agcgcccacccaggt

SEQ ID NO: 6637084 - DNA, 20 bp, Homo sapiens
agcgcccactagacccactg

SEQ ID NO: 6637085 - DNA, 14 bp, Homo sapiens
agcgcccaggcctg

SEQ ID NO: 6637086 - DNA, 16 bp, Homo sapiens
agcgcccccactcctc

SEQ ID NO: 6637087 - DNA, 12 bp, Homo sapiens
agcgcccccagg

SEQ ID NO: 6637088 - DNA, 14 bp, Homo sapiens
agcgcccccaggcc

SEQ ID NO: 6637089 - DNA, 21 bp, Homo sapiens
agcgcccccaggcctgccctg

SEQ ID NO: 6637090 - DNA, 16 bp, Homo sapiens
agcgcccccgagccct

SEQ ID NO: 6637091 - DNA, 16 bp, Homo sapiens
agcgccccgcccccac

SEQ ID NO: 6637092 - DNA, 20 bp, Homo sapiens
agcgcccctcactcctgcgc

SEQ ID NO: 6637093 - DNA, 17 bp, Homo sapiens
agcgcccctcagcctct

SEQ ID NO: 6637094 - DNA, 22 bp, Homo sapiens
agcgcccctcagcctctgccac

SEQ ID NO: 6637095 - DNA, 15 bp, Homo sapiens
agcgcccctccctag

SEQ ID NO: 6637096 - DNA, 13 bp, Homo sapiens
agcgcccctgctg

SEQ ID NO: 6637097 - DNA, 15 bp, Homo sapiens
agcgcccctgctgtc

SEQ ID NO: 6637098 - DNA, 16 bp, Homo sapiens
agcgcccctgctgtct

SEQ ID NO: 6637099 - DNA, 20 bp, Homo sapiens
agcgcccgaggccagggccg

SEQ ID NO: 6637100 - DNA, 22 bp, Homo sapiens
agcgccctcactattcttggac

SEQ ID NO: 6637101 - DNA, 13 bp, Homo sapiens
agcgccctgcaga

SEQ ID NO: 6637102 - DNA, 13 bp, Homo sapiens
agcgccctggccc

SEQ ID NO: 6637103 - DNA, 16 bp, Homo sapiens
agcgccctggccccca

SEQ ID NO: 6637104 - DNA, 18 bp, Homo sapiens
agcgccctggcccccaca

SEQ ID NO: 6637105 - DNA, 14 bp, Homo sapiens
agcgccgactccct

SEQ ID NO: 6637106 - DNA, 15 bp, Homo sapiens
agcgccgactccctg

SEQ ID NO: 6637107 - DNA, 21 bp, Homo sapiens
agcgccggggggagggaggag

SEQ ID NO: 6637108 - DNA, 17 bp, Homo sapiens
agcgccgtgagttctca

SEQ ID NO: 6637109 - DNA, 21 bp, Homo sapiens
agcgccgtgagttctcagggc

SEQ ID NO: 6637110 - DNA, 14 bp, Homo sapiens
agcgcctccaccct

SEQ ID NO: 6637111 - DNA, 18 bp, Homo sapiens
agcgcctccatccaaggc

SEQ ID NO: 6637112 - DNA, 23 bp, Homo sapiens
agcgcctccatccaaggccaggt

SEQ ID NO: 6637113 - DNA, 17 bp, Homo sapiens
agcgcctcccgccgcct

SEQ ID NO: 6637114 - DNA, 23 bp, Homo sapiens
agcgcctccctccaccccaggac

SEQ ID NO: 6637115 - DNA, 11 bp, Homo sapiens
agcgcctcctg

SEQ ID NO: 6637116 - DNA, 19 bp, Homo sapiens
agcgcctccttaggagtgg

SEQ ID NO: 6637117 - DNA, 12 bp, Homo sapiens
agcgcctcttcc

SEQ ID NO: 6637118 - DNA, 15 bp, Homo sapiens
agcgcctcttcctct

SEQ ID NO: 6637119 - DNA, 20 bp, Homo sapiens
agcgcctcttcctctgggca

SEQ ID NO: 6637120 - DNA, 12 bp, Homo sapiens
agcgcctgcccg

SEQ ID NO: 6637121 - DNA, 13 bp, Homo sapiens
agcgcctggccta

SEQ ID NO: 6637122 - DNA, 13 bp, Homo sapiens
agcgcctggcctt

SEQ ID NO: 6637123 - DNA, 13 bp, Homo sapiens
agcgcctgtataa

SEQ ID NO: 6637124 - DNA, 14 bp, Homo sapiens
agcgcctgtataag

SEQ ID NO: 6637125 - DNA, 12 bp, Homo sapiens
agcgcgccactc

SEQ ID NO: 6637126 - DNA, 12 bp, Homo sapiens
agcgcgctcctg

SEQ ID NO: 6637127 - DNA, 14 bp, Homo sapiens
agcgcgctcctgac

SEQ ID NO: 6637128 - DNA, 23 bp, Homo sapiens
agcgcggacccttctgggtccag

SEQ ID NO: 6637129 - DNA, 13 bp, Homo sapiens
agcgcggaggagg

SEQ ID NO: 6637130 - DNA, 12 bp, Homo sapiens
agcgcggccagc

SEQ ID NO: 6637131 - DNA, 15 bp, Homo sapiens
agcgcggccagcgtc

SEQ ID NO: 6637132 - DNA, 14 bp, Homo sapiens
agcgcggctggctc

SEQ ID NO: 6637133 - DNA, 14 bp, Homo sapiens
agcgcgggagagag

SEQ ID NO: 6637134 - DNA, 18 bp, Homo sapiens
agcgcgggcggaggcggc

SEQ ID NO: 6637135 - DNA, 19 bp, Homo sapiens
agcgctagaggaagcagcc

SEQ ID NO: 6637136 - DNA, 15 bp, Homo sapiens
agcgctagtggaggg

SEQ ID NO: 6637137 - DNA, 15 bp, Homo sapiens
agcgctcccagcctg

SEQ ID NO: 6637138 - DNA, 13 bp, Homo sapiens
agcgctccctgtc

SEQ ID NO: 6637139 - DNA, 11 bp, Homo sapiens
agcgctccctt

SEQ ID NO: 6637140 - DNA, 21 bp, Homo sapiens
agcgctcctgccgcagagctg

SEQ ID NO: 6637141 - DNA, 21 bp, Homo sapiens
agcgctcgatggacctcagca

SEQ ID NO: 6637142 - DNA, 22 bp, Homo sapiens
agcgctcgatggacctcagcaa

SEQ ID NO: 6637143 - DNA, 14 bp, Homo sapiens
agcgctcgccacgc

SEQ ID NO: 6637144 - DNA, 14 bp, Homo sapiens
agcgctcggcccgg

SEQ ID NO: 6637145 - DNA, 15 bp, Homo sapiens
agcgctctcctggac

SEQ ID NO: 6637146 - DNA, 20 bp, Homo sapiens
agcgctctcttccagaagat

SEQ ID NO: 6637147 - DNA, 14 bp, Homo sapiens
agcgctgcccacac

SEQ ID NO: 6637148 - DNA, 20 bp, Homo sapiens
agcgctggcccccccagccc

SEQ ID NO: 6637149 - DNA, 22 bp, Homo sapiens
agcgctggcccccccagcccca

SEQ ID NO: 6637150 - DNA, 16 bp, Homo sapiens
agcgctggccgggacc

SEQ ID NO: 6637151 - DNA, 12 bp, Homo sapiens
agcgctggcctc

SEQ ID NO: 6637152 - DNA, 16 bp, Homo sapiens
agcgctggcctcttcc

SEQ ID NO: 6637153 - DNA, 15 bp, Homo sapiens
agcgctggctccagg

SEQ ID NO: 6637154 - DNA, 21 bp, Homo sapiens
agcgctgtcaggattgcgaga

SEQ ID NO: 6637155 - DNA, 19 bp, Homo sapiens
agcgctgtggactgtcctg

SEQ ID NO: 6637156 - DNA, 20 bp, Homo sapiens
agcgctgttgatcccctctc

SEQ ID NO: 6637157 - DNA, 21 bp, Homo sapiens
agcgctgttgcccgccctcca

SEQ ID NO: 6637158 - DNA, 19 bp, Homo sapiens
agcgcttcagttcagcttt

SEQ ID NO: 6637159 - DNA, 15 bp, Homo sapiens
agcgcttctgctgaa

SEQ ID NO: 6637160 - DNA, 23 bp, Homo sapiens
agcgcttgggcgccgtgctgggc

SEQ ID NO: 6637161 - DNA, 16 bp, Homo sapiens
agcgctttctggaaaa

SEQ ID NO: 6637162 - DNA, 17 bp, Homo sapiens
agcgctttctggaaaag

SEQ ID NO: 6637163 - DNA, 16 bp, Homo sapiens
agcgctttgcttacca

SEQ ID NO: 6637164 - DNA, 22 bp, Homo sapiens
agcgctttgcttaccaaaagct

SEQ ID NO: 6637165 - DNA, 19 bp, Homo sapiens
agcgctttgggaggcggag

SEQ ID NO: 6637166 - DNA, 18 bp, Homo sapiens
agcggaagggactctggg

SEQ ID NO: 6637167 - DNA, 14 bp, Homo sapiens
agcggagagagcca

SEQ ID NO: 6637168 - DNA, 18 bp, Homo sapiens
agcggagagagccaagac

SEQ ID NO: 6637169 - DNA, 20 bp, Homo sapiens
agcggagaggaagccagctg

SEQ ID NO: 6637170 - DNA, 13 bp, Homo sapiens
agcggagaggacc

SEQ ID NO: 6637171 - DNA, 16 bp, Homo sapiens
agcggagcccagcctg

SEQ ID NO: 6637172 - DNA, 18 bp, Homo sapiens
agcggagcttgcctgcct

SEQ ID NO: 6637173 - DNA, 19 bp, Homo sapiens
agcggagcttgcctgcctg

SEQ ID NO: 6637174 - DNA, 16 bp, Homo sapiens
agcggagcttggccct

SEQ ID NO: 6637175 - DNA, 18 bp, Homo sapiens
agcggagcttggccctgc

SEQ ID NO: 6637176 - DNA, 22 bp, Homo sapiens
agcggagcttggccctgcgccc

SEQ ID NO: 6637177 - DNA, 15 bp, Homo sapiens
agcggaggctgtgtg

SEQ ID NO: 6637178 - DNA, 23 bp, Homo sapiens
agcggaggttgcagggagccgag

SEQ ID NO: 6637179 - DNA, 16 bp, Homo sapiens
agcggattgcaaagca

SEQ ID NO: 6637180 - DNA, 13 bp, Homo sapiens
agcggatttccag

SEQ ID NO: 6637181 - DNA, 17 bp, Homo sapiens
agcggcaccctggtctg

SEQ ID NO: 6637182 - DNA, 12 bp, Homo sapiens
agcggcagagca

SEQ ID NO: 6637183 - DNA, 19 bp, Homo sapiens
agcggcagtgggcctgctg

SEQ ID NO: 6637184 - DNA, 14 bp, Homo sapiens
agcggcccaagagc

SEQ ID NO: 6637185 - DNA, 19 bp, Homo sapiens
agcggcccaagagcccgtg

SEQ ID NO: 6637186 - DNA, 21 bp, Homo sapiens
agcggccccgcacccctcctc

SEQ ID NO: 6637187 - DNA, 19 bp, Homo sapiens
agcggccccgcggagcccc

SEQ ID NO: 6637188 - DNA, 23 bp, Homo sapiens
agcggccccttgactctggggac

SEQ ID NO: 6637189 - DNA, 14 bp, Homo sapiens
agcggcccggccca

SEQ ID NO: 6637190 - DNA, 19 bp, Homo sapiens
agcggcccggcccacgcag

SEQ ID NO: 6637191 - DNA, 23 bp, Homo sapiens
agcggcccggcccacgcagagcc

SEQ ID NO: 6637192 - DNA, 12 bp, Homo sapiens
agcggccctccc

SEQ ID NO: 6637193 - DNA, 14 bp, Homo sapiens
agcggccctcccag

SEQ ID NO: 6637194 - DNA, 13 bp, Homo sapiens
agcggccctgaca

SEQ ID NO: 6637195 - DNA, 12 bp, Homo sapiens
agcggccctgga

SEQ ID NO: 6637196 - DNA, 14 bp, Homo sapiens
agcggccctggagg

SEQ ID NO: 6637197 - DNA, 11 bp, Homo sapiens
agcggccctgt

SEQ ID NO: 6637198 - DNA, 21 bp, Homo sapiens
agcggccgatgggagtctccc

SEQ ID NO: 6637199 - DNA, 17 bp, Homo sapiens
agcggccgcctgtcctt

SEQ ID NO: 6637200 - DNA, 12 bp, Homo sapiens
agcggcctcagg

SEQ ID NO: 6637201 - DNA, 22 bp, Homo sapiens
agcggcctccggcgtcttgccc

SEQ ID NO: 6637202 - DNA, 14 bp, Homo sapiens
agcggcctggagtc

SEQ ID NO: 6637203 - DNA, 13 bp, Homo sapiens
agcggcctgggga

SEQ ID NO: 6637204 - DNA, 23 bp, Homo sapiens
agcggcctggggacggagcactg

SEQ ID NO: 6637205 - DNA, 13 bp, Homo sapiens
agcggccttgaag

SEQ ID NO: 6637206 - DNA, 20 bp, Homo sapiens
agcggccttgaagacagagc

SEQ ID NO: 6637207 - DNA, 21 bp, Homo sapiens
agcggccttgaagacagagca

SEQ ID NO: 6637208 - DNA, 13 bp, Homo sapiens
agcggcgcagagc

SEQ ID NO: 6637209 - DNA, 14 bp, Homo sapiens
agcggcgcagagcc

SEQ ID NO: 6637210 - DNA, 16 bp, Homo sapiens
agcggcgcagagccct

SEQ ID NO: 6637211 - DNA, 14 bp, Homo sapiens
agcggctcccctct

SEQ ID NO: 6637212 - DNA, 21 bp, Homo sapiens
agcggctcccctctgcttctc

SEQ ID NO: 6637213 - DNA, 20 bp, Homo sapiens
agcggctctggtcctcggag

SEQ ID NO: 6637214 - DNA, 23 bp, Homo sapiens
agcggctgaggacggggcagagc

SEQ ID NO: 6637215 - DNA, 14 bp, Homo sapiens
agcggctgctcctt

SEQ ID NO: 6637216 - DNA, 16 bp, Homo sapiens
agcggctgctccttca

SEQ ID NO: 6637217 - DNA, 19 bp, Homo sapiens
agcggctgctcgcccagga

SEQ ID NO: 6637218 - DNA, 20 bp, Homo sapiens
agcggctgctcgcccaggaa

SEQ ID NO: 6637219 - DNA, 20 bp, Homo sapiens
agcggctggaattgggtggg

SEQ ID NO: 6637220 - DNA, 17 bp, Homo sapiens
agcggctggacttggag

SEQ ID NO: 6637221 - DNA, 13 bp, Homo sapiens
agcggctggagaa

SEQ ID NO: 6637222 - DNA, 19 bp, Homo sapiens
agcggctggtgcagggcct

SEQ ID NO: 6637223 - DNA, 20 bp, Homo sapiens
agcggctgttccccctgccg

SEQ ID NO: 6637224 - DNA, 16 bp, Homo sapiens
agcgggacaccctggt

SEQ ID NO: 6637225 - DNA, 14 bp, Homo sapiens
agcgggacctgtgg

SEQ ID NO: 6637226 - DNA, 20 bp, Homo sapiens
agcgggacgccgcaggtgtt

SEQ ID NO: 6637227 - DNA, 12 bp, Homo sapiens
agcgggaggaag

SEQ ID NO: 6637228 - DNA, 12 bp, Homo sapiens
agcgggaggcag

SEQ ID NO: 6637229 - DNA, 13 bp, Homo sapiens
agcgggagggagt

SEQ ID NO: 6637230 - DNA, 23 bp, Homo sapiens
agcgggagtcagggacctgctgc

SEQ ID NO: 6637231 - DNA, 15 bp, Homo sapiens
agcgggagtctcctc

SEQ ID NO: 6637232 - DNA, 22 bp, Homo sapiens
agcgggatctcgtatctttaaa

SEQ ID NO: 6637233 - DNA, 13 bp, Homo sapiens
agcgggcacaggg

SEQ ID NO: 6637234 - DNA, 16 bp, Homo sapiens
agcgggcacagggcac

SEQ ID NO: 6637235 - DNA, 18 bp, Homo sapiens
agcgggcacagggcacca

SEQ ID NO: 6637236 - DNA, 14 bp, Homo sapiens
agcgggcagccccg

SEQ ID NO: 6637237 - DNA, 11 bp, Homo sapiens
agcgggcaggg

SEQ ID NO: 6637238 - DNA, 14 bp, Homo sapiens
agcgggcagggccg

SEQ ID NO: 6637239 - DNA, 14 bp, Homo sapiens
agcgggccaggccc

SEQ ID NO: 6637240 - DNA, 20 bp, Homo sapiens
agcgggcgcgggacaggact

SEQ ID NO: 6637241 - DNA, 22 bp, Homo sapiens
agcgggcggaggggatccagcc

SEQ ID NO: 6637242 - DNA, 21 bp, Homo sapiens
agcgggctaacgggaggctgg

SEQ ID NO: 6637243 - DNA, 22 bp, Homo sapiens
agcgggctaacgggaggctggg

SEQ ID NO: 6637244 - DNA, 21 bp, Homo sapiens
agcgggctgtgcccggcccca

SEQ ID NO: 6637245 - DNA, 14 bp, Homo sapiens
agcggggaggtgcc

SEQ ID NO: 6637246 - DNA, 20 bp, Homo sapiens
agcgggggaggcccgcagag

SEQ ID NO: 6637247 - DNA, 15 bp, Homo sapiens
agcgggggcgtggct

SEQ ID NO: 6637248 - DNA, 13 bp, Homo sapiens
agcgggggctaac

SEQ ID NO: 6637249 - DNA, 15 bp, Homo sapiens
agcgggtaaaaagag

SEQ ID NO: 6637250 - DNA, 19 bp, Homo sapiens
agcggtaccaatgcagaac

SEQ ID NO: 6637251 - DNA, 15 bp, Homo sapiens
agcggtatgtgcgtg

SEQ ID NO: 6637252 - DNA, 13 bp, Homo sapiens
agcggtcagactg

SEQ ID NO: 6637253 - DNA, 22 bp, Homo sapiens
agcggtccaacgccgccttggc

SEQ ID NO: 6637254 - DNA, 14 bp, Homo sapiens
agcggtcccagggg

SEQ ID NO: 6637255 - DNA, 22 bp, Homo sapiens
agcggtccctgcagaagccaga

SEQ ID NO: 6637256 - DNA, 23 bp, Homo sapiens
agcggtctcaggctggtgggagg

SEQ ID NO: 6637257 - DNA, 14 bp, Homo sapiens
agcggtgaccagcc

SEQ ID NO: 6637258 - DNA, 16 bp, Homo sapiens
agcggtgaccagcctg

SEQ ID NO: 6637259 - DNA, 19 bp, Homo sapiens
agcggtgaccagcctgtca

SEQ ID NO: 6637260 - DNA, 20 bp, Homo sapiens
agcggtgaccagcctgtcac

SEQ ID NO: 6637261 - DNA, 21 bp, Homo sapiens
agcggtgaccagcctgtcacc

SEQ ID NO: 6637262 - DNA, 20 bp, Homo sapiens
agcggtggaaggagcctgcg

SEQ ID NO: 6637263 - DNA, 22 bp, Homo sapiens
agcggtggaaggagcctgcggc

SEQ ID NO: 6637264 - DNA, 20 bp, Homo sapiens
agcggtggaggaaggctctg

SEQ ID NO: 6637265 - DNA, 23 bp, Homo sapiens
agcggtggataactagccagaca

SEQ ID NO: 6637266 - DNA, 12 bp, Homo sapiens
agcggtggccct

SEQ ID NO: 6637267 - DNA, 15 bp, Homo sapiens
agcggtgggaaggaa

SEQ ID NO: 6637268 - DNA, 18 bp, Homo sapiens
agcggtgtggaccgagga

SEQ ID NO: 6637269 - DNA, 13 bp, Homo sapiens
agcggttgcttct

SEQ ID NO: 6637270 - DNA, 19 bp, Homo sapiens
agcggttgcttctggctcc

SEQ ID NO: 6637271 - DNA, 17 bp, Homo sapiens
agcggttgtaaatacaa

SEQ ID NO: 6637272 - DNA, 16 bp, Homo sapiens
agcggtttccaggcca

SEQ ID NO: 6637273 - DNA, 19 bp, Homo sapiens
agcggtttccaggccaccg

SEQ ID NO: 6637274 - DNA, 14 bp, Homo sapiens
agcggtttggggag

SEQ ID NO: 6637275 - DNA, 15 bp, Homo sapiens
agcgtagacatatat

SEQ ID NO: 6637276 - DNA, 15 bp, Homo sapiens
agcgtagtgcagcag

SEQ ID NO: 6637277 - DNA, 21 bp, Homo sapiens
agcgtatatataagaaagaca

SEQ ID NO: 6637278 - DNA, 16 bp, Homo sapiens
agcgtatggctttatt

SEQ ID NO: 6637279 - DNA, 14 bp, Homo sapiens
agcgtcaagacatt

SEQ ID NO: 6637280 - DNA, 17 bp, Homo sapiens
agcgtcagaggccctgg

SEQ ID NO: 6637281 - DNA, 21 bp, Homo sapiens
agcgtcagcgggcgctgctgg

SEQ ID NO: 6637282 - DNA, 13 bp, Homo sapiens
agcgtcaggccta

SEQ ID NO: 6637283 - DNA, 16 bp, Homo sapiens
agcgtcagtttcactc

SEQ ID NO: 6637284 - DNA, 21 bp, Homo sapiens
agcgtcagtttcactccctct

SEQ ID NO: 6637285 - DNA, 22 bp, Homo sapiens
agcgtcagtttcactccctctt

SEQ ID NO: 6637286 - DNA, 17 bp, Homo sapiens
agcgtcccagggtaccc

SEQ ID NO: 6637287 - DNA, 14 bp, Homo sapiens
agcgtcccccgccg

SEQ ID NO: 6637288 - DNA, 17 bp, Homo sapiens
agcgtcccccgccgcgc

SEQ ID NO: 6637289 - DNA, 20 bp, Homo sapiens
agcgtcccctgctactcctg

SEQ ID NO: 6637290 - DNA, 18 bp, Homo sapiens
agcgtccctagcagtgaa

SEQ ID NO: 6637291 - DNA, 15 bp, Homo sapiens
agcgtcctcctctgt

SEQ ID NO: 6637292 - DNA, 16 bp, Homo sapiens
agcgtcctcctctgtg

SEQ ID NO: 6637293 - DNA, 19 bp, Homo sapiens
agcgtcctcctctgtgacc

SEQ ID NO: 6637294 - DNA, 23 bp, Homo sapiens
agcgtcctcgttcaaaacattcc

SEQ ID NO: 6637295 - DNA, 16 bp, Homo sapiens
agcgtcctctcagtaa

SEQ ID NO: 6637296 - DNA, 12 bp, Homo sapiens
agcgtcctgccc

SEQ ID NO: 6637297 - DNA, 15 bp, Homo sapiens
agcgtcctgccctgc

SEQ ID NO: 6637298 - DNA, 21 bp, Homo sapiens
agcgtcctgccctgccccctc

SEQ ID NO: 6637299 - DNA, 18 bp, Homo sapiens
agcgtccttggctgccgt

SEQ ID NO: 6637300 - DNA, 17 bp, Homo sapiens
agcgtccttgtccccgc

SEQ ID NO: 6637301 - DNA, 14 bp, Homo sapiens
agcgtcgccccagt

SEQ ID NO: 6637302 - DNA, 15 bp, Homo sapiens
agcgtcggtctgtgc

SEQ ID NO: 6637303 - DNA, 16 bp, Homo sapiens
agcgtctccccatgct

SEQ ID NO: 6637304 - DNA, 19 bp, Homo sapiens
agcgtctccccatgctggg

SEQ ID NO: 6637305 - DNA, 21 bp, Homo sapiens
agcgtctccccatgctgggct

SEQ ID NO: 6637306 - DNA, 22 bp, Homo sapiens
agcgtctccccatgctgggctc

SEQ ID NO: 6637307 - DNA, 12 bp, Homo sapiens
agcgtctgcagg

SEQ ID NO: 6637308 - DNA, 15 bp, Homo sapiens
agcgtctgcagggtg

SEQ ID NO: 6637309 - DNA, 22 bp, Homo sapiens
agcgtctttaagagactcactg

SEQ ID NO: 6637310 - DNA, 18 bp, Homo sapiens
agcgtctttcttttttgg

SEQ ID NO: 6637311 - DNA, 19 bp, Homo sapiens
agcgtgaagccagggcccg

SEQ ID NO: 6637312 - DNA, 18 bp, Homo sapiens
agcgtgaaggacttagcc

SEQ ID NO: 6637313 - DNA, 22 bp, Homo sapiens
agcgtgaaggccgagaagcaag

SEQ ID NO: 6637314 - DNA, 17 bp, Homo sapiens
agcgtgacggagcccac

SEQ ID NO: 6637315 - DNA, 17 bp, Homo sapiens
agcgtgagccactgcac

SEQ ID NO: 6637316 - DNA, 15 bp, Homo sapiens
agcgtgagctgagca

SEQ ID NO: 6637317 - DNA, 19 bp, Homo sapiens
agcgtgattcctgctgcct

SEQ ID NO: 6637318 - DNA, 19 bp, Homo sapiens
agcgtgcaccatccctttt

SEQ ID NO: 6637319 - DNA, 20 bp, Homo sapiens
agcgtgccgagccagcaaga

SEQ ID NO: 6637320 - DNA, 14 bp, Homo sapiens
agcgtgcgcactgc

SEQ ID NO: 6637321 - DNA, 15 bp, Homo sapiens
agcgtgcgcactgca

SEQ ID NO: 6637322 - DNA, 17 bp, Homo sapiens
agcgtgcggggccccgg

SEQ ID NO: 6637323 - DNA, 15 bp, Homo sapiens
agcgtgctgcctctc

SEQ ID NO: 6637324 - DNA, 17 bp, Homo sapiens
agcgtgctttaaaaaat

SEQ ID NO: 6637325 - DNA, 14 bp, Homo sapiens
agcgtggaaggggg

SEQ ID NO: 6637326 - DNA, 18 bp, Homo sapiens
agcgtggaagggggagga

SEQ ID NO: 6637327 - DNA, 15 bp, Homo sapiens
agcgtggactctgct

SEQ ID NO: 6637328 - DNA, 13 bp, Homo sapiens
agcgtggactggt

SEQ ID NO: 6637329 - DNA, 14 bp, Homo sapiens
agcgtggcccaggc

SEQ ID NO: 6637330 - DNA, 23 bp, Homo sapiens
agcgtggccttgggaggacatgc

SEQ ID NO: 6637331 - DNA, 15 bp, Homo sapiens
agcgtgggctcagca

SEQ ID NO: 6637332 - DNA, 17 bp, Homo sapiens
agcgtgggctcagcagg

SEQ ID NO: 6637333 - DNA, 22 bp, Homo sapiens
agcgtgggctcagcagggctgg

SEQ ID NO: 6637334 - DNA, 14 bp, Homo sapiens
agcgtgggctctgc

SEQ ID NO: 6637335 - DNA, 15 bp, Homo sapiens
agcgtgggctctgcc

SEQ ID NO: 6637336 - DNA, 17 bp, Homo sapiens
agcgtggggacttctgg

SEQ ID NO: 6637337 - DNA, 19 bp, Homo sapiens
agcgtggggaggggctgag

SEQ ID NO: 6637338 - DNA, 16 bp, Homo sapiens
agcgtggggtagcaga

SEQ ID NO: 6637339 - DNA, 15 bp, Homo sapiens
agcgtggtcccgagg

SEQ ID NO: 6637340 - DNA, 20 bp, Homo sapiens
agcgtggtggacatgcacag

SEQ ID NO: 6637341 - DNA, 20 bp, Homo sapiens
agcgtggtttttatgtgtat

SEQ ID NO: 6637342 - DNA, 20 bp, Homo sapiens
agcgtgtagcgtcctgagga

SEQ ID NO: 6637343 - DNA, 15 bp, Homo sapiens
agcgtgtcctatccc

SEQ ID NO: 6637344 - DNA, 21 bp, Homo sapiens
agcgtgtcctatccccggacc

SEQ ID NO: 6637345 - DNA, 21 bp, Homo sapiens
agcgtgtgcggctccagccca

SEQ ID NO: 6637346 - DNA, 22 bp, Homo sapiens
agcgtgtgcggctccagcccag

SEQ ID NO: 6637347 - DNA, 12 bp, Homo sapiens
agcgtgtggagc

SEQ ID NO: 6637348 - DNA, 20 bp, Homo sapiens
agcgtgtggagcagagctct

SEQ ID NO: 6637349 - DNA, 16 bp, Homo sapiens
agcgtgtggctgtgcc

SEQ ID NO: 6637350 - DNA, 15 bp, Homo sapiens
agcgtgttctcagca

SEQ ID NO: 6637351 - DNA, 16 bp, Homo sapiens
agcgtgttctcagcac

SEQ ID NO: 6637352 - DNA, 16 bp, Homo sapiens
agcgttcccttctccc

SEQ ID NO: 6637353 - DNA, 17 bp, Homo sapiens
agcgttcccttctcccc

SEQ ID NO: 6637354 - DNA, 20 bp, Homo sapiens
agcgttctaaatatgaatga

SEQ ID NO: 6637355 - DNA, 21 bp, Homo sapiens
agcgttctaaatatgaatgaa

SEQ ID NO: 6637356 - DNA, 21 bp, Homo sapiens
agcgttctggactctgcccca

SEQ ID NO: 6637357 - DNA, 15 bp, Homo sapiens
agcgtttaaagtact

SEQ ID NO: 6637358 - DNA, 20 bp, Homo sapiens
agcgtttaaagtactgagca

SEQ ID NO: 6637359 - DNA, 21 bp, Homo sapiens
agcgtttgaggggctggcctt

SEQ ID NO: 6637360 - DNA, 20 bp, Homo sapiens
agcgttttttaaatgtatac

SEQ ID NO: 6637361 - DNA, 23 bp, Homo sapiens
agcgttttttaaatgtatactat

SEQ ID NO: 6637362 - DNA, 14 bp, Homo sapiens
agctaaaaatatat

SEQ ID NO: 6637363 - DNA, 19 bp, Homo sapiens
agctaaaaatatatataac

SEQ ID NO: 6637364 - DNA, 16 bp, Homo sapiens
agctaaaaatattact

SEQ ID NO: 6637365 - DNA, 15 bp, Homo sapiens
agctaaaaatgaacc

SEQ ID NO: 6637366 - DNA, 15 bp, Homo sapiens
agctaaaacacttct

SEQ ID NO: 6637367 - DNA, 13 bp, Homo sapiens
agctaaaagacaa

SEQ ID NO: 6637368 - DNA, 17 bp, Homo sapiens
agctaaaagaggcctgt

SEQ ID NO: 6637369 - DNA, 22 bp, Homo sapiens
agctaaaagcatggccctgctg

SEQ ID NO: 6637370 - DNA, 23 bp, Homo sapiens
agctaaaagcatggccctgctgc

SEQ ID NO: 6637371 - DNA, 14 bp, Homo sapiens
agctaaaaggaaaa

SEQ ID NO: 6637372 - DNA, 16 bp, Homo sapiens
agctaaaatatataat

SEQ ID NO: 6637373 - DNA, 23 bp, Homo sapiens
agctaaaatcaggaaagaaaagg

SEQ ID NO: 6637374 - DNA, 15 bp, Homo sapiens
agctaaaatggtggt

SEQ ID NO: 6637375 - DNA, 18 bp, Homo sapiens
agctaaacggattccaaa

SEQ ID NO: 6637376 - DNA, 18 bp, Homo sapiens
agctaaagaaactgctta

SEQ ID NO: 6637377 - DNA, 21 bp, Homo sapiens
agctaaagaggctgaaagagg

SEQ ID NO: 6637378 - DNA, 21 bp, Homo sapiens
agctaaagtgatcctaaatat

SEQ ID NO: 6637379 - DNA, 23 bp, Homo sapiens
agctaaataaatgtaatagccaa

SEQ ID NO: 6637380 - DNA, 20 bp, Homo sapiens
agctaaataagtcaccattg

SEQ ID NO: 6637381 - DNA, 19 bp, Homo sapiens
agctaaatgcagggaaact

SEQ ID NO: 6637382 - DNA, 20 bp, Homo sapiens
agctaaatgcagggaaactc

SEQ ID NO: 6637383 - DNA, 11 bp, Homo sapiens
agctaaattac

SEQ ID NO: 6637384 - DNA, 15 bp, Homo sapiens
agctaaattttgtta

SEQ ID NO: 6637385 - DNA, 19 bp, Homo sapiens
agctaacaaaagatatgaa

SEQ ID NO: 6637386 - DNA, 14 bp, Homo sapiens
agctaacaataaag

SEQ ID NO: 6637387 - DNA, 19 bp, Homo sapiens
agctaacacacagctccca

SEQ ID NO: 6637388 - DNA, 17 bp, Homo sapiens
agctaacactggcccct

SEQ ID NO: 6637389 - DNA, 18 bp, Homo sapiens
agctaacactggccccta

SEQ ID NO: 6637390 - DNA, 12 bp, Homo sapiens
agctaacagaca

SEQ ID NO: 6637391 - DNA, 12 bp, Homo sapiens
agctaacagtga

SEQ ID NO: 6637392 - DNA, 17 bp, Homo sapiens
agctaacagtgaagatt

SEQ ID NO: 6637393 - DNA, 14 bp, Homo sapiens
agctaacatcttta

SEQ ID NO: 6637394 - DNA, 23 bp, Homo sapiens
agctaacatctttacgtactgta

SEQ ID NO: 6637395 - DNA, 22 bp, Homo sapiens
agctaacatgagtatcatcaga

SEQ ID NO: 6637396 - DNA, 20 bp, Homo sapiens
agctaacattttaaataaaa

SEQ ID NO: 6637397 - DNA, 19 bp, Homo sapiens
agctaacccaggtcccctc

SEQ ID NO: 6637398 - DNA, 23 bp, Homo sapiens
agctaactccagtctcctgacat

SEQ ID NO: 6637399 - DNA, 19 bp, Homo sapiens
agctaactgggttacagtg

SEQ ID NO: 6637400 - DNA, 15 bp, Homo sapiens
agctaagaaataaaa

SEQ ID NO: 6637401 - DNA, 19 bp, Homo sapiens
agctaagaaataaaactgt

SEQ ID NO: 6637402 - DNA, 14 bp, Homo sapiens
agctaagaacctgg

SEQ ID NO: 6637403 - DNA, 17 bp, Homo sapiens
agctaagaacctggaac

SEQ ID NO: 6637404 - DNA, 16 bp, Homo sapiens
agctaagatagaaagc

SEQ ID NO: 6637405 - DNA, 23 bp, Homo sapiens
agctaagatagaaagctggactg

SEQ ID NO: 6637406 - DNA, 13 bp, Homo sapiens
agctaagcaagcc

SEQ ID NO: 6637407 - DNA, 15 bp, Homo sapiens
agctaagcaagccag

SEQ ID NO: 6637408 - DNA, 16 bp, Homo sapiens
agctaagcaagccagg

SEQ ID NO: 6637409 - DNA, 19 bp, Homo sapiens
agctaagcaagccaggaga

SEQ ID NO: 6637410 - DNA, 17 bp, Homo sapiens
agctaagcattttctcc

SEQ ID NO: 6637411 - DNA, 17 bp, Homo sapiens
agctaagctcaaatgta

SEQ ID NO: 6637412 - DNA, 23 bp, Homo sapiens
agctaagctcacgtcctgagaaa

SEQ ID NO: 6637413 - DNA, 22 bp, Homo sapiens
agctaaggaagggaaagggaag

SEQ ID NO: 6637414 - DNA, 19 bp, Homo sapiens
agctaaggacatttcccag

SEQ ID NO: 6637415 - DNA, 13 bp, Homo sapiens
agctaaggccagc

SEQ ID NO: 6637416 - DNA, 18 bp, Homo sapiens
agctaaggggtggggctg

SEQ ID NO: 6637417 - DNA, 19 bp, Homo sapiens
agctaaggggtggggctgc

SEQ ID NO: 6637418 - DNA, 19 bp, Homo sapiens
agctaaggtttagataaat

SEQ ID NO: 6637419 - DNA, 23 bp, Homo sapiens
agctaagtcacccagagcacagg

SEQ ID NO: 6637420 - DNA, 19 bp, Homo sapiens
agctaagtgaaaaggtcat

SEQ ID NO: 6637421 - DNA, 16 bp, Homo sapiens
agctaataaaaagctt

SEQ ID NO: 6637422 - DNA, 23 bp, Homo sapiens
agctaataaaaagcttttgtcta

SEQ ID NO: 6637423 - DNA, 23 bp, Homo sapiens
agctaataaaagtcagagctcag

SEQ ID NO: 6637424 - DNA, 18 bp, Homo sapiens
agctaataaaatatcatt

SEQ ID NO: 6637425 - DNA, 19 bp, Homo sapiens
agctaataaaatatcattc

SEQ ID NO: 6637426 - DNA, 21 bp, Homo sapiens
agctaataaaatatcattcag

SEQ ID NO: 6637427 - DNA, 12 bp, Homo sapiens
agctaataaacc

SEQ ID NO: 6637428 - DNA, 19 bp, Homo sapiens
agctaataaatctcttctt

SEQ ID NO: 6637429 - DNA, 20 bp, Homo sapiens
agctaataaatctcttcttt

SEQ ID NO: 6637430 - DNA, 14 bp, Homo sapiens
agctaataataaat

SEQ ID NO: 6637431 - DNA, 15 bp, Homo sapiens
agctaataataaatg

SEQ ID NO: 6637432 - DNA, 21 bp, Homo sapiens
agctaataatgttaaccaagg

SEQ ID NO: 6637433 - DNA, 22 bp, Homo sapiens
agctaatacccagagcacccag

SEQ ID NO: 6637434 - DNA, 22 bp, Homo sapiens
agctaatctccacccaatgaat

SEQ ID NO: 6637435 - DNA, 20 bp, Homo sapiens
agctaatctgcctggtttta

SEQ ID NO: 6637436 - DNA, 23 bp, Homo sapiens
agctaatctgcctggttttattt

SEQ ID NO: 6637437 - DNA, 13 bp, Homo sapiens
agctaatctgtag

SEQ ID NO: 6637438 - DNA, 17 bp, Homo sapiens
agctaatctgtagggct

SEQ ID NO: 6637439 - DNA, 19 bp, Homo sapiens
agctaatctgtagggctgg

SEQ ID NO: 6637440 - DNA, 13 bp, Homo sapiens
agctaatgaaatt

SEQ ID NO: 6637441 - DNA, 20 bp, Homo sapiens
agctaatgaactctttcaaa

SEQ ID NO: 6637442 - DNA, 16 bp, Homo sapiens
agctaatgaagctatt

SEQ ID NO: 6637443 - DNA, 14 bp, Homo sapiens
agctaatgggacac

SEQ ID NO: 6637444 - DNA, 15 bp, Homo sapiens
agctaatgggacact

SEQ ID NO: 6637445 - DNA, 22 bp, Homo sapiens
agctaatggtcctgttatgtca

SEQ ID NO: 6637446 - DNA, 22 bp, Homo sapiens
agctaatgtcacaacatggtgc

SEQ ID NO: 6637447 - DNA, 18 bp, Homo sapiens
agctaatgtgcagggata

SEQ ID NO: 6637448 - DNA, 22 bp, Homo sapiens
agctaatgtggtagtgaaaatc

SEQ ID NO: 6637449 - DNA, 16 bp, Homo sapiens
agctaattattttaat

SEQ ID NO: 6637450 - DNA, 13 bp, Homo sapiens
agctaattcaggt

SEQ ID NO: 6637451 - DNA, 19 bp, Homo sapiens
agctaattgggagtccagg

SEQ ID NO: 6637452 - DNA, 22 bp, Homo sapiens
agctaattgtactaatctgaga

SEQ ID NO: 6637453 - DNA, 17 bp, Homo sapiens
agctaatttatttcccc

SEQ ID NO: 6637454 - DNA, 22 bp, Homo sapiens
agctaatttgcattaaattcac

SEQ ID NO: 6637455 - DNA, 14 bp, Homo sapiens
agctaatttgtgaa

SEQ ID NO: 6637456 - DNA, 12 bp, Homo sapiens
agctaatttttg

SEQ ID NO: 6637457 - DNA, 16 bp, Homo sapiens
agctacaaacttttaa

SEQ ID NO: 6637458 - DNA, 18 bp, Homo sapiens
agctacaaacttttaaga

SEQ ID NO: 6637459 - DNA, 12 bp, Homo sapiens
agctacaaatgc

SEQ ID NO: 6637460 - DNA, 13 bp, Homo sapiens
agctacaaatgca

SEQ ID NO: 6637461 - DNA, 17 bp, Homo sapiens
agctacaactaataaca

SEQ ID NO: 6637462 - DNA, 20 bp, Homo sapiens
agctacacagtgcagaggct

SEQ ID NO: 6637463 - DNA, 21 bp, Homo sapiens
agctacactattgcattgttc

SEQ ID NO: 6637464 - DNA, 22 bp, Homo sapiens
agctacactcattgaaatgtaa

SEQ ID NO: 6637465 - DNA, 14 bp, Homo sapiens
agctacagagaaac

SEQ ID NO: 6637466 - DNA, 22 bp, Homo sapiens
agctacagagaaaccagcttcc

SEQ ID NO: 6637467 - DNA, 23 bp, Homo sapiens
agctacagagaaaccagcttcct

SEQ ID NO: 6637468 - DNA, 14 bp, Homo sapiens
agctacagcaaata

SEQ ID NO: 6637469 - DNA, 23 bp, Homo sapiens
agctacagcaaataaaacagtga

SEQ ID NO: 6637470 - DNA, 18 bp, Homo sapiens
agctacagccagcggcat

SEQ ID NO: 6637471 - DNA, 22 bp, Homo sapiens
agctacagcttgtttaacggca

SEQ ID NO: 6637472 - DNA, 20 bp, Homo sapiens
agctacagctttcttgctcc

SEQ ID NO: 6637473 - DNA, 13 bp, Homo sapiens
agctacaggactg

SEQ ID NO: 6637474 - DNA, 17 bp, Homo sapiens
agctacaggggaggctg

SEQ ID NO: 6637475 - DNA, 14 bp, Homo sapiens
agctacataagact

SEQ ID NO: 6637476 - DNA, 19 bp, Homo sapiens
agctacatatgtaggaaaa

SEQ ID NO: 6637477 - DNA, 14 bp, Homo sapiens
agctacatgaagtt

SEQ ID NO: 6637478 - DNA, 17 bp, Homo sapiens
agctacatgttctttgt

SEQ ID NO: 6637479 - DNA, 18 bp, Homo sapiens
agctacatgttctttgta

SEQ ID NO: 6637480 - DNA, 13 bp, Homo sapiens
agctacattcctc

SEQ ID NO: 6637481 - DNA, 16 bp, Homo sapiens
agctacattcctcagc

SEQ ID NO: 6637482 - DNA, 20 bp, Homo sapiens
agctacattcctcagctgcc

SEQ ID NO: 6637483 - DNA, 14 bp, Homo sapiens
agctacattttcag

SEQ ID NO: 6637484 - DNA, 21 bp, Homo sapiens
agctacattttcagaagttaa

SEQ ID NO: 6637485 - DNA, 22 bp, Homo sapiens
agctaccaactaagttgtattt

SEQ ID NO: 6637486 - DNA, 22 bp, Homo sapiens
agctaccacccttaggggtaat

SEQ ID NO: 6637487 - DNA, 12 bp, Homo sapiens
agctaccaggaa

SEQ ID NO: 6637488 - DNA, 14 bp, Homo sapiens
agctaccatgacaa

SEQ ID NO: 6637489 - DNA, 21 bp, Homo sapiens
agctaccattttacatttcta

SEQ ID NO: 6637490 - DNA, 20 bp, Homo sapiens
agctacccaaaagagaaaaa

SEQ ID NO: 6637491 - DNA, 16 bp, Homo sapiens
agctacccacagagca

SEQ ID NO: 6637492 - DNA, 14 bp, Homo sapiens
agctacccaggagg

SEQ ID NO: 6637493 - DNA, 16 bp, Homo sapiens
agctacccctcaaact

SEQ ID NO: 6637494 - DNA, 17 bp, Homo sapiens
agctacccctcaaactg

SEQ ID NO: 6637495 - DNA, 19 bp, Homo sapiens
agctacccctcaaactgca

SEQ ID NO: 6637496 - DNA, 13 bp, Homo sapiens
agctaccccttct

SEQ ID NO: 6637497 - DNA, 15 bp, Homo sapiens
agctaccctgtgtat

SEQ ID NO: 6637498 - DNA, 15 bp, Homo sapiens
agctacccttttcct

SEQ ID NO: 6637499 - DNA, 21 bp, Homo sapiens
agctacccttttcctttgtgg

SEQ ID NO: 6637500 - DNA, 20 bp, Homo sapiens
agctaccctttttctccagc

SEQ ID NO: 6637501 - DNA, 23 bp, Homo sapiens
agctaccgtggatctccttccct

SEQ ID NO: 6637502 - DNA, 14 bp, Homo sapiens
agctacctcaacca

SEQ ID NO: 6637503 - DNA, 21 bp, Homo sapiens
agctacctgagacgggcatcg

SEQ ID NO: 6637504 - DNA, 11 bp, Homo sapiens
agctacctggg

SEQ ID NO: 6637505 - DNA, 19 bp, Homo sapiens
agctacctgggaggctgcg

SEQ ID NO: 6637506 - DNA, 14 bp, Homo sapiens
agctacctggggtg

SEQ ID NO: 6637507 - DNA, 19 bp, Homo sapiens
agctacctgtgtggacagg

SEQ ID NO: 6637508 - DNA, 16 bp, Homo sapiens
agctacctttttatat

SEQ ID NO: 6637509 - DNA, 21 bp, Homo sapiens
agctacgaaaggatgagcaga

SEQ ID NO: 6637510 - DNA, 16 bp, Homo sapiens
agctacggttccctgc

SEQ ID NO: 6637511 - DNA, 18 bp, Homo sapiens
agctacggttccctgcct

SEQ ID NO: 6637512 - DNA, 16 bp, Homo sapiens
agctactaacctggag

SEQ ID NO: 6637513 - DNA, 18 bp, Homo sapiens
agctactaaggtgctagg

SEQ ID NO: 6637514 - DNA, 18 bp, Homo sapiens
agctactataaatataca

SEQ ID NO: 6637515 - DNA, 21 bp, Homo sapiens
agctactcaagaggctgaggc

SEQ ID NO: 6637516 - DNA, 14 bp, Homo sapiens
agctactcagaagc

SEQ ID NO: 6637517 - DNA, 15 bp, Homo sapiens
agctactcagaagcc

SEQ ID NO: 6637518 - DNA, 18 bp, Homo sapiens
agctactcagaagcctga

SEQ ID NO: 6637519 - DNA, 17 bp, Homo sapiens
agctactcagatctgca

SEQ ID NO: 6637520 - DNA, 19 bp, Homo sapiens
agctactcaggaggctgag

SEQ ID NO: 6637521 - DNA, 21 bp, Homo sapiens
agctactcagtggggctggca

SEQ ID NO: 6637522 - DNA, 22 bp, Homo sapiens
agctactcagtggggctggcat

SEQ ID NO: 6637523 - DNA, 23 bp, Homo sapiens
agctactcagtggggctggcatc

SEQ ID NO: 6637524 - DNA, 22 bp, Homo sapiens
agctactcatgaggctgaggca

SEQ ID NO: 6637525 - DNA, 18 bp, Homo sapiens
agctactcccctttcttc

SEQ ID NO: 6637526 - DNA, 19 bp, Homo sapiens
agctactcgggaggctgag

SEQ ID NO: 6637527 - DNA, 21 bp, Homo sapiens
agctactctagttctgttgtt

SEQ ID NO: 6637528 - DNA, 22 bp, Homo sapiens
agctactctccccacgagggct

SEQ ID NO: 6637529 - DNA, 13 bp, Homo sapiens
agctactctcttg

SEQ ID NO: 6637530 - DNA, 14 bp, Homo sapiens
agctactctcttgc

SEQ ID NO: 6637531 - DNA, 21 bp, Homo sapiens
agctactctgtccaggccact

SEQ ID NO: 6637532 - DNA, 22 bp, Homo sapiens
agctactctgtccaggccactg

SEQ ID NO: 6637533 - DNA, 23 bp, Homo sapiens
agctactctgtccaggccactgt

SEQ ID NO: 6637534 - DNA, 17 bp, Homo sapiens
agctactgaaccagcca

SEQ ID NO: 6637535 - DNA, 20 bp, Homo sapiens
agctactgaatttattgccg

SEQ ID NO: 6637536 - DNA, 13 bp, Homo sapiens
agctactgatgaa

SEQ ID NO: 6637537 - DNA, 12 bp, Homo sapiens
agctactgccat

SEQ ID NO: 6637538 - DNA, 14 bp, Homo sapiens
agctactgccatcc

SEQ ID NO: 6637539 - DNA, 16 bp, Homo sapiens
agctactgccatcctg

SEQ ID NO: 6637540 - DNA, 19 bp, Homo sapiens
agctactgcggaaaaggaa

SEQ ID NO: 6637541 - DNA, 17 bp, Homo sapiens
agctactggaatggtgt

SEQ ID NO: 6637542 - DNA, 13 bp, Homo sapiens
agctactggggag

SEQ ID NO: 6637543 - DNA, 13 bp, Homo sapiens
agctactgtagaa

SEQ ID NO: 6637544 - DNA, 16 bp, Homo sapiens
agctactgtagaaaca

SEQ ID NO: 6637545 - DNA, 19 bp, Homo sapiens
agctactgtagaaaggaaa

SEQ ID NO: 6637546 - DNA, 19 bp, Homo sapiens
agctactgtgtgtgtgaat

SEQ ID NO: 6637547 - DNA, 15 bp, Homo sapiens
agctacttaagagaa

SEQ ID NO: 6637548 - DNA, 18 bp, Homo sapiens
agctacttaagagaaatg

SEQ ID NO: 6637549 - DNA, 19 bp, Homo sapiens
agctacttaagagaaatgg

SEQ ID NO: 6637550 - DNA, 16 bp, Homo sapiens
agctacttagctggcc

SEQ ID NO: 6637551 - DNA, 20 bp, Homo sapiens
agctacttagctggccaagg

SEQ ID NO: 6637552 - DNA, 21 bp, Homo sapiens
agctacttcctcctccccact

SEQ ID NO: 6637553 - DNA, 21 bp, Homo sapiens
agctacttcttattcactttt

SEQ ID NO: 6637554 - DNA, 12 bp, Homo sapiens
agctacttggca

SEQ ID NO: 6637555 - DNA, 16 bp, Homo sapiens
agctacttgggaggct

SEQ ID NO: 6637556 - DNA, 18 bp, Homo sapiens
agctacttgggaggctga

SEQ ID NO: 6637557 - DNA, 23 bp, Homo sapiens
agctacttgggaggttgaagcag

SEQ ID NO: 6637558 - DNA, 14 bp, Homo sapiens
agctacttgggcca

SEQ ID NO: 6637559 - DNA, 15 bp, Homo sapiens
agctacttgggccat

SEQ ID NO: 6637560 - DNA, 22 bp, Homo sapiens
agctacttgggccatagctcct

SEQ ID NO: 6637561 - DNA, 14 bp, Homo sapiens
agctacttggtttg

SEQ ID NO: 6637562 - DNA, 16 bp, Homo sapiens
agctacttggtttgtg

SEQ ID NO: 6637563 - DNA, 21 bp, Homo sapiens
agctacttggtttgtgttctt

SEQ ID NO: 6637564 - DNA, 17 bp, Homo sapiens
agctactttccatttgg

SEQ ID NO: 6637565 - DNA, 13 bp, Homo sapiens
agctactttgttt

SEQ ID NO: 6637566 - DNA, 16 bp, Homo sapiens
agctagaaagtggcag

SEQ ID NO: 6637567 - DNA, 14 bp, Homo sapiens
agctagaaatcaca

SEQ ID NO: 6637568 - DNA, 12 bp, Homo sapiens
agctagaaatga

SEQ ID NO: 6637569 - DNA, 22 bp, Homo sapiens
agctagaacattccatttgctt

SEQ ID NO: 6637570 - DNA, 15 bp, Homo sapiens
agctagaacctggag

SEQ ID NO: 6637571 - DNA, 18 bp, Homo sapiens
agctagaacctggagagc

SEQ ID NO: 6637572 - DNA, 21 bp, Homo sapiens
agctagaacttctctaagcct

SEQ ID NO: 6637573 - DNA, 19 bp, Homo sapiens
agctagaactttgaaggac

SEQ ID NO: 6637574 - DNA, 15 bp, Homo sapiens
agctagaaggccaca

SEQ ID NO: 6637575 - DNA, 19 bp, Homo sapiens
agctagaagtgggccagga

SEQ ID NO: 6637576 - DNA, 21 bp, Homo sapiens
agctagaagtgggccaggaca

SEQ ID NO: 6637577 - DNA, 21 bp, Homo sapiens
agctagaatccacacatatat

SEQ ID NO: 6637578 - DNA, 22 bp, Homo sapiens
agctagaattccctctctctga

SEQ ID NO: 6637579 - DNA, 14 bp, Homo sapiens
agctagaattgagt

SEQ ID NO: 6637580 - DNA, 14 bp, Homo sapiens
agctagaatttctg

SEQ ID NO: 6637581 - DNA, 18 bp, Homo sapiens
agctagacaaaggcccag

SEQ ID NO: 6637582 - DNA, 20 bp, Homo sapiens
agctagacaaaggcccagaa

SEQ ID NO: 6637583 - DNA, 16 bp, Homo sapiens
agctagacacatgaag

SEQ ID NO: 6637584 - DNA, 18 bp, Homo sapiens
agctagacgagcaggctt

SEQ ID NO: 6637585 - DNA, 15 bp, Homo sapiens
agctagactggagtg

SEQ ID NO: 6637586 - DNA, 15 bp, Homo sapiens
agctagagaaattct

SEQ ID NO: 6637587 - DNA, 17 bp, Homo sapiens
agctagagagaaaaaga

SEQ ID NO: 6637588 - DNA, 22 bp, Homo sapiens
agctagagaggggcctctggct

SEQ ID NO: 6637589 - DNA, 23 bp, Homo sapiens
agctagagaggggcctctggctg

SEQ ID NO: 6637590 - DNA, 20 bp, Homo sapiens
agctagatacgaaatcagtt

SEQ ID NO: 6637591 - DNA, 22 bp, Homo sapiens
agctagcaataggtttgtaaaa

SEQ ID NO: 6637592 - DNA, 21 bp, Homo sapiens
agctagccaactcctccttgc

SEQ ID NO: 6637593 - DNA, 12 bp, Homo sapiens
agctagccagag

SEQ ID NO: 6637594 - DNA, 19 bp, Homo sapiens
agctagccagaggactgtg

SEQ ID NO: 6637595 - DNA, 12 bp, Homo sapiens
agctagcctcca

SEQ ID NO: 6637596 - DNA, 14 bp, Homo sapiens
agctagcctccagc

SEQ ID NO: 6637597 - DNA, 18 bp, Homo sapiens
agctagcgctgccgcacc

SEQ ID NO: 6637598 - DNA, 21 bp, Homo sapiens
agctagcgctgccgcacccca

SEQ ID NO: 6637599 - DNA, 21 bp, Homo sapiens
agctagcgtctcggcccttgc

SEQ ID NO: 6637600 - DNA, 19 bp, Homo sapiens
agctagcgtgtgccaggca

SEQ ID NO: 6637601 - DNA, 15 bp, Homo sapiens
agctagctcccctcc

SEQ ID NO: 6637602 - DNA, 23 bp, Homo sapiens
agctagctcccctcctctcccct

SEQ ID NO: 6637603 - DNA, 13 bp, Homo sapiens
agctagctctttg

SEQ ID NO: 6637604 - DNA, 17 bp, Homo sapiens
agctagctgcagagcca

SEQ ID NO: 6637605 - DNA, 12 bp, Homo sapiens
agctagctgcca

SEQ ID NO: 6637606 - DNA, 13 bp, Homo sapiens
agctagctgcttt

SEQ ID NO: 6637607 - DNA, 14 bp, Homo sapiens
agctagcttgaaaa

SEQ ID NO: 6637608 - DNA, 16 bp, Homo sapiens
agctaggaacaaatct

SEQ ID NO: 6637609 - DNA, 23 bp, Homo sapiens
agctaggaacaaatcttcctggt

SEQ ID NO: 6637610 - DNA, 19 bp, Homo sapiens
agctaggaaccctggaggt

SEQ ID NO: 6637611 - DNA, 15 bp, Homo sapiens
agctaggaagcaaga

SEQ ID NO: 6637612 - DNA, 13 bp, Homo sapiens
agctaggaatgaa

SEQ ID NO: 6637613 - DNA, 15 bp, Homo sapiens
agctaggactgagga

SEQ ID NO: 6637614 - DNA, 15 bp, Homo sapiens
agctaggagcaaagc

SEQ ID NO: 6637615 - DNA, 19 bp, Homo sapiens
agctaggagcaaagcctgt

SEQ ID NO: 6637616 - DNA, 16 bp, Homo sapiens
agctaggccccagagg

SEQ ID NO: 6637617 - DNA, 16 bp, Homo sapiens
agctagggctgctgct

SEQ ID NO: 6637618 - DNA, 20 bp, Homo sapiens
agctagggctgctgcttctg

SEQ ID NO: 6637619 - DNA, 21 bp, Homo sapiens
agctagggctgctgcttctgc

SEQ ID NO: 6637620 - DNA, 20 bp, Homo sapiens
agctagggggcgttatttat

SEQ ID NO: 6637621 - DNA, 14 bp, Homo sapiens
agctaggtgacata

SEQ ID NO: 6637622 - DNA, 21 bp, Homo sapiens
agctaggtgctaattaataaa

SEQ ID NO: 6637623 - DNA, 22 bp, Homo sapiens
agctagtatcttcaaactttca

SEQ ID NO: 6637624 - DNA, 14 bp, Homo sapiens
agctagtcaacagt

SEQ ID NO: 6637625 - DNA, 17 bp, Homo sapiens
agctagtgacccacatg

SEQ ID NO: 6637626 - DNA, 14 bp, Homo sapiens
agctagtgccaaat

SEQ ID NO: 6637627 - DNA, 23 bp, Homo sapiens
agctagtgtacctcctctcagtg

SEQ ID NO: 6637628 - DNA, 16 bp, Homo sapiens
agctagtgtcacctgc

SEQ ID NO: 6637629 - DNA, 15 bp, Homo sapiens
agctagtgtctcctc

SEQ ID NO: 6637630 - DNA, 16 bp, Homo sapiens
agctagtgtcttatgg

SEQ ID NO: 6637631 - DNA, 19 bp, Homo sapiens
agctagtgttaatccagag

SEQ ID NO: 6637632 - DNA, 14 bp, Homo sapiens
agctagttaataat

SEQ ID NO: 6637633 - DNA, 17 bp, Homo sapiens
agctagttaataattct

SEQ ID NO: 6637634 - DNA, 23 bp, Homo sapiens
agctagttagagactcgcctggg

SEQ ID NO: 6637635 - DNA, 16 bp, Homo sapiens
agctagttagctcaca

SEQ ID NO: 6637636 - DNA, 16 bp, Homo sapiens
agctagttatgtgaga

SEQ ID NO: 6637637 - DNA, 16 bp, Homo sapiens
agctagttgaatactt

SEQ ID NO: 6637638 - DNA, 22 bp, Homo sapiens
agctagttgaatacttgaacca

SEQ ID NO: 6637639 - DNA, 17 bp, Homo sapiens
agctagtttaaaattat

SEQ ID NO: 6637640 - DNA, 21 bp, Homo sapiens
agctagtttaaaattattaaa

SEQ ID NO: 6637641 - DNA, 22 bp, Homo sapiens
agctagtttaaaattattaaaa

SEQ ID NO: 6637642 - DNA, 12 bp, Homo sapiens
agctagtttgct

SEQ ID NO: 6637643 - DNA, 21 bp, Homo sapiens
agctataaaagcccatgctta

SEQ ID NO: 6637644 - DNA, 22 bp, Homo sapiens
agctataaaagcccatgcttaa

SEQ ID NO: 6637645 - DNA, 18 bp, Homo sapiens
agctataacaactctatt

SEQ ID NO: 6637646 - DNA, 13 bp, Homo sapiens
agctataacatat

SEQ ID NO: 6637647 - DNA, 16 bp, Homo sapiens
agctataacatattta

SEQ ID NO: 6637648 - DNA, 15 bp, Homo sapiens
agctataacatttgc

SEQ ID NO: 6637649 - DNA, 21 bp, Homo sapiens
agctataacatttgctgaata

SEQ ID NO: 6637650 - DNA, 18 bp, Homo sapiens
agctataattattattca

SEQ ID NO: 6637651 - DNA, 15 bp, Homo sapiens
agctataattctgtt

SEQ ID NO: 6637652 - DNA, 18 bp, Homo sapiens
agctatacctcacaataa

SEQ ID NO: 6637653 - DNA, 22 bp, Homo sapiens
agctatacctgcacgttcataa

SEQ ID NO: 6637654 - DNA, 17 bp, Homo sapiens
agctatacctgtgcctc

SEQ ID NO: 6637655 - DNA, 17 bp, Homo sapiens
agctatagttgcagccc

SEQ ID NO: 6637656 - DNA, 18 bp, Homo sapiens
agctatagttgcagccca

SEQ ID NO: 6637657 - DNA, 16 bp, Homo sapiens
agctatatatgaataa

SEQ ID NO: 6637658 - DNA, 16 bp, Homo sapiens
agctatatatttagga

SEQ ID NO: 6637659 - DNA, 16 bp, Homo sapiens
agctatatcctgatgc

SEQ ID NO: 6637660 - DNA, 23 bp, Homo sapiens
agctatatcgaatatagttctgt

SEQ ID NO: 6637661 - DNA, 15 bp, Homo sapiens
agctatatctatata

SEQ ID NO: 6637662 - DNA, 13 bp, Homo sapiens
agctatatttgat

SEQ ID NO: 6637663 - DNA, 16 bp, Homo sapiens
agctatatttgattat

SEQ ID NO: 6637664 - DNA, 23 bp, Homo sapiens
agctatcacgttgaaccacgtga

SEQ ID NO: 6637665 - DNA, 20 bp, Homo sapiens
agctatcagaagaccacaaa

SEQ ID NO: 6637666 - DNA, 18 bp, Homo sapiens
agctatcagtaggctaat

SEQ ID NO: 6637667 - DNA, 15 bp, Homo sapiens
agctatcagtgcttt

SEQ ID NO: 6637668 - DNA, 16 bp, Homo sapiens
agctatcagtgttctt

SEQ ID NO: 6637669 - DNA, 23 bp, Homo sapiens
agctatccagtgacttgttctga

SEQ ID NO: 6637670 - DNA, 18 bp, Homo sapiens
agctatccggacagagca

SEQ ID NO: 6637671 - DNA, 15 bp, Homo sapiens
agctatcctttcaaa

SEQ ID NO: 6637672 - DNA, 17 bp, Homo sapiens
agctatctagatagctg

SEQ ID NO: 6637673 - DNA, 15 bp, Homo sapiens
agctatctaggtgga

SEQ ID NO: 6637674 - DNA, 17 bp, Homo sapiens
agctatctctcagtgaa

SEQ ID NO: 6637675 - DNA, 21 bp, Homo sapiens
agctatctgcactctaaactg

SEQ ID NO: 6637676 - DNA, 14 bp, Homo sapiens
agctatctgcctga

SEQ ID NO: 6637677 - DNA, 15 bp, Homo sapiens
agctatcttaaaata

SEQ ID NO: 6637678 - DNA, 15 bp, Homo sapiens
agctatcttcatgta

SEQ ID NO: 6637679 - DNA, 16 bp, Homo sapiens
agctatcttcatgtaa

SEQ ID NO: 6637680 - DNA, 20 bp, Homo sapiens
agctatcttcatgtaaattg

SEQ ID NO: 6637681 - DNA, 12 bp, Homo sapiens
agctatgactta

SEQ ID NO: 6637682 - DNA, 13 bp, Homo sapiens
agctatgagaata

SEQ ID NO: 6637683 - DNA, 17 bp, Homo sapiens
agctatgagaataactt

SEQ ID NO: 6637684 - DNA, 15 bp, Homo sapiens
agctatgagagatgt

SEQ ID NO: 6637685 - DNA, 22 bp, Homo sapiens
agctatgataagattgaaattc

SEQ ID NO: 6637686 - DNA, 17 bp, Homo sapiens
agctatgatatgtgctt

SEQ ID NO: 6637687 - DNA, 13 bp, Homo sapiens
agctatgcaaaaa

SEQ ID NO: 6637688 - DNA, 14 bp, Homo sapiens
agctatgcacacca

SEQ ID NO: 6637689 - DNA, 15 bp, Homo sapiens
agctatgcagggagg

SEQ ID NO: 6637690 - DNA, 17 bp, Homo sapiens
agctatgcgcaatgtgg

SEQ ID NO: 6637691 - DNA, 22 bp, Homo sapiens
agctatggagagaattaaaact

SEQ ID NO: 6637692 - DNA, 16 bp, Homo sapiens
agctatggcccagaaa

SEQ ID NO: 6637693 - DNA, 18 bp, Homo sapiens
agctatgggagccccagg

SEQ ID NO: 6637694 - DNA, 17 bp, Homo sapiens
agctatgtcaagaggct

SEQ ID NO: 6637695 - DNA, 24 bp, Homo sapiens
agctatgtgattttgagcaaacca

SEQ ID NO: 6637696 - DNA, 18 bp, Homo sapiens
agctatgttatattgaaa

SEQ ID NO: 6637697 - DNA, 18 bp, Homo sapiens
agctatgttccctccagc

SEQ ID NO: 6637698 - DNA, 15 bp, Homo sapiens
agctatgtttttaaa

SEQ ID NO: 6637699 - DNA, 20 bp, Homo sapiens
agctatgtttttaaagtgta

SEQ ID NO: 6637700 - DNA, 14 bp, Homo sapiens
agctattaaaatgt

SEQ ID NO: 6637701 - DNA, 15 bp, Homo sapiens
agctattactgtctg

SEQ ID NO: 6637702 - DNA, 20 bp, Homo sapiens
agctattactgtctggtttt

SEQ ID NO: 6637703 - DNA, 19 bp, Homo sapiens
agctattacttggcaaatt

SEQ ID NO: 6637704 - DNA, 16 bp, Homo sapiens
agctattcacacacac

SEQ ID NO: 6637705 - DNA, 17 bp, Homo sapiens
agctattcaggaggctg

SEQ ID NO: 6637706 - DNA, 13 bp, Homo sapiens
agctattcctttc

SEQ ID NO: 6637707 - DNA, 14 bp, Homo sapiens
agctattcctttcc

SEQ ID NO: 6637708 - DNA, 16 bp, Homo sapiens
agctattcctttccct

SEQ ID NO: 6637709 - DNA, 11 bp, Homo sapiens
agctattcttt

SEQ ID NO: 6637710 - DNA, 17 bp, Homo sapiens
agctattctttgaccaa

SEQ ID NO: 6637711 - DNA, 22 bp, Homo sapiens
agctattctttgaccaaactgt

SEQ ID NO: 6637712 - DNA, 17 bp, Homo sapiens
agctattgatataaata

SEQ ID NO: 6637713 - DNA, 23 bp, Homo sapiens
agctattgatataaataaaacat

SEQ ID NO: 6637714 - DNA, 17 bp, Homo sapiens
agctattgcatgtaaaa

SEQ ID NO: 6637715 - DNA, 20 bp, Homo sapiens
agctattgcatgtaaaatgc

SEQ ID NO: 6637716 - DNA, 19 bp, Homo sapiens
agctattggcaagttttaa

SEQ ID NO: 6637717 - DNA, 14 bp, Homo sapiens
agctatttaagggg

SEQ ID NO: 6637718 - DNA, 23 bp, Homo sapiens
agctatttaagtggactgtattt

SEQ ID NO: 6637719 - DNA, 23 bp, Homo sapiens
agctatttatccctttcctggtt

SEQ ID NO: 6637720 - DNA, 13 bp, Homo sapiens
agctatttcatct

SEQ ID NO: 6637721 - DNA, 21 bp, Homo sapiens
agctatttcatctatttttgg

SEQ ID NO: 6637722 - DNA, 18 bp, Homo sapiens
agctatttccattccaga

SEQ ID NO: 6637723 - DNA, 20 bp, Homo sapiens
agctatttccttccagcctt

SEQ ID NO: 6637724 - DNA, 15 bp, Homo sapiens
agctatttctatgta

SEQ ID NO: 6637725 - DNA, 17 bp, Homo sapiens
agctatttgatatgcac

SEQ ID NO: 6637726 - DNA, 22 bp, Homo sapiens
agctatttggcaggctgaggca

SEQ ID NO: 6637727 - DNA, 16 bp, Homo sapiens
agctattttaagccat

SEQ ID NO: 6637728 - DNA, 18 bp, Homo sapiens
agctattttagaaagcta

SEQ ID NO: 6637729 - DNA, 14 bp, Homo sapiens
agctattttccttg

SEQ ID NO: 6637730 - DNA, 18 bp, Homo sapiens
agctattttctgaccaaa

SEQ ID NO: 6637731 - DNA, 19 bp, Homo sapiens
agctattttctgaccaaaa

SEQ ID NO: 6637732 - DNA, 20 bp, Homo sapiens
agctattttctgaccaaaat

SEQ ID NO: 6637733 - DNA, 19 bp, Homo sapiens
agctatttttatacactgt

SEQ ID NO: 6637734 - DNA, 22 bp, Homo sapiens
agctatttttatacactgtaag

SEQ ID NO: 6637735 - DNA, 22 bp, Homo sapiens
agctatttttatttgtttgtgc

SEQ ID NO: 6637736 - DNA, 15 bp, Homo sapiens
agctatttttctaac

SEQ ID NO: 6637737 - DNA, 23 bp, Homo sapiens
agctatttttttcctaagacatt

SEQ ID NO: 6637738 - DNA, 20 bp, Homo sapiens
agctcaaaaatactcttgat

SEQ ID NO: 6637739 - DNA, 21 bp, Homo sapiens
agctcaaaggtttggaaggag

SEQ ID NO: 6637740 - DNA, 17 bp, Homo sapiens
agctcaaataaaaataa

SEQ ID NO: 6637741 - DNA, 22 bp, Homo sapiens
agctcaaataggtcatcatgaa

SEQ ID NO: 6637742 - DNA, 16 bp, Homo sapiens
agctcaaatgaaatgt

SEQ ID NO: 6637743 - DNA, 23 bp, Homo sapiens
agctcaaatgaaatgtatgcatt

SEQ ID NO: 6637744 - DNA, 13 bp, Homo sapiens
agctcaaatgtat

SEQ ID NO: 6637745 - DNA, 21 bp, Homo sapiens
agctcaacggtctggcagggc

SEQ ID NO: 6637746 - DNA, 24 bp, Homo sapiens
agctcaactcacagcttctccaag

SEQ ID NO: 6637747 - DNA, 21 bp, Homo sapiens
agctcaactgttgccaggaga

SEQ ID NO: 6637748 - DNA, 23 bp, Homo sapiens
agctcaagaattgttagcaaatg

SEQ ID NO: 6637749 - DNA, 20 bp, Homo sapiens
agctcaagaggaaaagctaa

SEQ ID NO: 6637750 - DNA, 19 bp, Homo sapiens
agctcaagatgacagctct

SEQ ID NO: 6637751 - DNA, 19 bp, Homo sapiens
agctcaagcattctgttta

SEQ ID NO: 6637752 - DNA, 19 bp, Homo sapiens
agctcaagcccttggggag

SEQ ID NO: 6637753 - DNA, 19 bp, Homo sapiens
agctcaaggaaaggcctga

SEQ ID NO: 6637754 - DNA, 19 bp, Homo sapiens
agctcaaggcaatgggcta

SEQ ID NO: 6637755 - DNA, 14 bp, Homo sapiens
agctcaaggctgca

SEQ ID NO: 6637756 - DNA, 15 bp, Homo sapiens
agctcaaggctgcag

SEQ ID NO: 6637757 - DNA, 23 bp, Homo sapiens
agctcaagggaccctgggtggga

SEQ ID NO: 6637758 - DNA, 20 bp, Homo sapiens
agctcaagggctggcacttt

SEQ ID NO: 6637759 - DNA, 17 bp, Homo sapiens
agctcaagtttaaaagc

SEQ ID NO: 6637760 - DNA, 13 bp, Homo sapiens
agctcaataaaag

SEQ ID NO: 6637761 - DNA, 15 bp, Homo sapiens
agctcaataaaagaa

SEQ ID NO: 6637762 - DNA, 16 bp, Homo sapiens
agctcaattcaagtga

SEQ ID NO: 6637763 - DNA, 16 bp, Homo sapiens
agctcacaaggcagca

SEQ ID NO: 6637764 - DNA, 19 bp, Homo sapiens
agctcacaaggcagcaagg

SEQ ID NO: 6637765 - DNA, 20 bp, Homo sapiens
agctcacaaggcagcaaggc

SEQ ID NO: 6637766 - DNA, 16 bp, Homo sapiens
agctcacacagcagga

SEQ ID NO: 6637767 - DNA, 19 bp, Homo sapiens
agctcacacatcctgtcag

SEQ ID NO: 6637768 - DNA, 15 bp, Homo sapiens
agctcacacctgtcc

SEQ ID NO: 6637769 - DNA, 16 bp, Homo sapiens
agctcacactcatcca

SEQ ID NO: 6637770 - DNA, 21 bp, Homo sapiens
agctcacactccagtggcaga

SEQ ID NO: 6637771 - DNA, 21 bp, Homo sapiens
agctcacactgatgggctggg

SEQ ID NO: 6637772 - DNA, 19 bp, Homo sapiens
agctcacagcacatttgtt

SEQ ID NO: 6637773 - DNA, 12 bp, Homo sapiens
agctcacaggac

SEQ ID NO: 6637774 - DNA, 20 bp, Homo sapiens
agctcacagttcctcgccct

SEQ ID NO: 6637775 - DNA, 21 bp, Homo sapiens
agctcacagttcctcgccctg

SEQ ID NO: 6637776 - DNA, 16 bp, Homo sapiens
agctcacatgggactg

SEQ ID NO: 6637777 - DNA, 19 bp, Homo sapiens
agctcacatgggactggga

SEQ ID NO: 6637778 - DNA, 15 bp, Homo sapiens
agctcaccagcccca

SEQ ID NO: 6637779 - DNA, 16 bp, Homo sapiens
agctcaccagccccag

SEQ ID NO: 6637780 - DNA, 21 bp, Homo sapiens
agctcaccagccccagtgccc

SEQ ID NO: 6637781 - DNA, 23 bp, Homo sapiens
agctcaccagccccagtgcccac

SEQ ID NO: 6637782 - DNA, 14 bp, Homo sapiens
agctcaccaggcct

SEQ ID NO: 6637783 - DNA, 16 bp, Homo sapiens
agctcaccaggcctgg

SEQ ID NO: 6637784 - DNA, 23 bp, Homo sapiens
agctcaccaggcctggcctctgg

SEQ ID NO: 6637785 - DNA, 21 bp, Homo sapiens
agctcacccaataaacattaa

SEQ ID NO: 6637786 - DNA, 15 bp, Homo sapiens
agctcaccccccaca

SEQ ID NO: 6637787 - DNA, 17 bp, Homo sapiens
agctcacccctgggcag

SEQ ID NO: 6637788 - DNA, 19 bp, Homo sapiens
agctcacccctgggcaggc

SEQ ID NO: 6637789 - DNA, 20 bp, Homo sapiens
agctcacccctgggcaggcg

SEQ ID NO: 6637790 - DNA, 17 bp, Homo sapiens
agctcaccctgcccgct

SEQ ID NO: 6637791 - DNA, 18 bp, Homo sapiens
agctcaccctgcccgctc

SEQ ID NO: 6637792 - DNA, 12 bp, Homo sapiens
agctcacctctc

SEQ ID NO: 6637793 - DNA, 18 bp, Homo sapiens
agctcacctctcccttgg

SEQ ID NO: 6637794 - DNA, 19 bp, Homo sapiens
agctcacctctcccttgga

SEQ ID NO: 6637795 - DNA, 15 bp, Homo sapiens
agctcacctctgaag

SEQ ID NO: 6637796 - DNA, 22 bp, Homo sapiens
agctcacctgttgcttacaatt

SEQ ID NO: 6637797 - DNA, 12 bp, Homo sapiens
agctcacggcag

SEQ ID NO: 6637798 - DNA, 23 bp, Homo sapiens
agctcacgtaatgcattgcctgt

SEQ ID NO: 6637799 - DNA, 13 bp, Homo sapiens
agctcactaccct

SEQ ID NO: 6637800 - DNA, 14 bp, Homo sapiens
agctcactccctgg

SEQ ID NO: 6637801 - DNA, 17 bp, Homo sapiens
agctcactgaatcttca

SEQ ID NO: 6637802 - DNA, 14 bp, Homo sapiens
agctcactgcaagc

SEQ ID NO: 6637803 - DNA, 13 bp, Homo sapiens
agctcactgcacc

SEQ ID NO: 6637804 - DNA, 14 bp, Homo sapiens
agctcactgcagcc

SEQ ID NO: 6637805 - DNA, 16 bp, Homo sapiens
agctcactgcagcctc

SEQ ID NO: 6637806 - DNA, 18 bp, Homo sapiens
agctcactgcagcctcga

SEQ ID NO: 6637807 - DNA, 17 bp, Homo sapiens
agctcactgctgctgcc

SEQ ID NO: 6637808 - DNA, 22 bp, Homo sapiens
agctcactgctgctgcctctga

SEQ ID NO: 6637809 - DNA, 21 bp, Homo sapiens
agctcactggtccatttctca

SEQ ID NO: 6637810 - DNA, 19 bp, Homo sapiens
agctcactggtttacaaat

SEQ ID NO: 6637811 - DNA, 21 bp, Homo sapiens
agctcactgtaacctcaaact

SEQ ID NO: 6637812 - DNA, 21 bp, Homo sapiens
agctcacttcaagctcaccct

SEQ ID NO: 6637813 - DNA, 19 bp, Homo sapiens
agctcagaaaatatccctc

SEQ ID NO: 6637814 - DNA, 21 bp, Homo sapiens
agctcagaaaatatccctcct

SEQ ID NO: 6637815 - DNA, 11 bp, Homo sapiens
agctcagaaag

SEQ ID NO: 6637816 - DNA, 15 bp, Homo sapiens
agctcagaaccacag

SEQ ID NO: 6637817 - DNA, 18 bp, Homo sapiens
agctcagaacccagggct

SEQ ID NO: 6637818 - DNA, 19 bp, Homo sapiens
agctcagaacccagggctc

SEQ ID NO: 6637819 - DNA, 16 bp, Homo sapiens
agctcagaatccaagt

SEQ ID NO: 6637820 - DNA, 15 bp, Homo sapiens
agctcagacattttc

SEQ ID NO: 6637821 - DNA, 19 bp, Homo sapiens
agctcagacattttctttt

SEQ ID NO: 6637822 - DNA, 17 bp, Homo sapiens
agctcagagagggcagg

SEQ ID NO: 6637823 - DNA, 21 bp, Homo sapiens
agctcagagagggcaggcatg

SEQ ID NO: 6637824 - DNA, 18 bp, Homo sapiens
agctcagagagggtggga

SEQ ID NO: 6637825 - DNA, 15 bp, Homo sapiens
agctcagagccccgc

SEQ ID NO: 6637826 - DNA, 17 bp, Homo sapiens
agctcagaggagaggag

SEQ ID NO: 6637827 - DNA, 17 bp, Homo sapiens
agctcagaggcccagga

SEQ ID NO: 6637828 - DNA, 14 bp, Homo sapiens
agctcagcacagcc

SEQ ID NO: 6637829 - DNA, 16 bp, Homo sapiens
agctcagcacagcctc

SEQ ID NO: 6637830 - DNA, 17 bp, Homo sapiens
agctcagcactgcctgc

SEQ ID NO: 6637831 - DNA, 23 bp, Homo sapiens
agctcagcactgcctgctcccat

SEQ ID NO: 6637832 - DNA, 21 bp, Homo sapiens
agctcagccaccactcagtgc

SEQ ID NO: 6637833 - DNA, 11 bp, Homo sapiens
agctcagccca

SEQ ID NO: 6637834 - DNA, 14 bp, Homo sapiens
agctcagcccaccc

SEQ ID NO: 6637835 - DNA, 15 bp, Homo sapiens
agctcagcccacccc

SEQ ID NO: 6637836 - DNA, 16 bp, Homo sapiens
agctcagcccaccccc

SEQ ID NO: 6637837 - DNA, 15 bp, Homo sapiens
agctcagccccagcc

SEQ ID NO: 6637838 - DNA, 20 bp, Homo sapiens
agctcagccccagcccagcc

SEQ ID NO: 6637839 - DNA, 16 bp, Homo sapiens
agctcagccccggcca

SEQ ID NO: 6637840 - DNA, 18 bp, Homo sapiens
agctcagccccggccact

SEQ ID NO: 6637841 - DNA, 14 bp, Homo sapiens
agctcagccctggc

SEQ ID NO: 6637842 - DNA, 17 bp, Homo sapiens
agctcagccctggcctg

SEQ ID NO: 6637843 - DNA, 13 bp, Homo sapiens
agctcagcctccc

SEQ ID NO: 6637844 - DNA, 14 bp, Homo sapiens
agctcagcctcccc

SEQ ID NO: 6637845 - DNA, 21 bp, Homo sapiens
agctcagcctcgctttgaggt

SEQ ID NO: 6637846 - DNA, 18 bp, Homo sapiens
agctcagcctgcctggga

SEQ ID NO: 6637847 - DNA, 20 bp, Homo sapiens
agctcagctcgctgcccagg

SEQ ID NO: 6637848 - DNA, 22 bp, Homo sapiens
agctcagctgggccactcctct

SEQ ID NO: 6637849 - DNA, 20 bp, Homo sapiens
agctcaggaaccgaggcagg

SEQ ID NO: 6637850 - DNA, 16 bp, Homo sapiens
agctcaggaagaagag

SEQ ID NO: 6637851 - DNA, 21 bp, Homo sapiens
agctcaggaagaagagatgca

SEQ ID NO: 6637852 - DNA, 18 bp, Homo sapiens
agctcaggacagatgcca

SEQ ID NO: 6637853 - DNA, 18 bp, Homo sapiens
agctcaggacctgggacc

SEQ ID NO: 6637854 - DNA, 18 bp, Homo sapiens
agctcaggagaaggcctg

SEQ ID NO: 6637855 - DNA, 19 bp, Homo sapiens
agctcaggagaaggcctgc

SEQ ID NO: 6637856 - DNA, 13 bp, Homo sapiens
agctcaggagaga

SEQ ID NO: 6637857 - DNA, 22 bp, Homo sapiens
agctcaggagagagcttcctgt

SEQ ID NO: 6637858 - DNA, 17 bp, Homo sapiens
agctcaggaggcttgga

SEQ ID NO: 6637859 - DNA, 12 bp, Homo sapiens
agctcaggaggg

SEQ ID NO: 6637860 - DNA, 22 bp, Homo sapiens
agctcaggagggtgacgcccag

SEQ ID NO: 6637861 - DNA, 16 bp, Homo sapiens
agctcaggaggtcaag

SEQ ID NO: 6637862 - DNA, 22 bp, Homo sapiens
agctcaggatgagggaaaagaa

SEQ ID NO: 6637863 - DNA, 24 bp, Homo sapiens
agctcaggcagcgttagggctgct

SEQ ID NO: 6637864 - DNA, 21 bp, Homo sapiens
agctcaggcatttgaggctgt

SEQ ID NO: 6637865 - DNA, 16 bp, Homo sapiens
agctcaggccctggtg

SEQ ID NO: 6637866 - DNA, 17 bp, Homo sapiens
agctcaggcgcagccct

SEQ ID NO: 6637867 - DNA, 16 bp, Homo sapiens
agctcaggctgagccc

SEQ ID NO: 6637868 - DNA, 18 bp, Homo sapiens
agctcaggctgagcccag

SEQ ID NO: 6637869 - DNA, 19 bp, Homo sapiens
agctcaggctgagcccagc

SEQ ID NO: 6637870 - DNA, 20 bp, Homo sapiens
agctcaggctgagcccagcc

SEQ ID NO: 6637871 - DNA, 16 bp, Homo sapiens
agctcaggcttttcca

SEQ ID NO: 6637872 - DNA, 15 bp, Homo sapiens
agctcagggcctggc

SEQ ID NO: 6637873 - DNA, 19 bp, Homo sapiens
agctcagggcctggctcag

SEQ ID NO: 6637874 - DNA, 16 bp, Homo sapiens
agctcaggggacactg

SEQ ID NO: 6637875 - DNA, 14 bp, Homo sapiens
agctcaggggcagc

SEQ ID NO: 6637876 - DNA, 22 bp, Homo sapiens
agctcagggtgctccctcctca

SEQ ID NO: 6637877 - DNA, 20 bp, Homo sapiens
agctcaggtcctgctgcctc

SEQ ID NO: 6637878 - DNA, 14 bp, Homo sapiens
agctcaggtgcctt

SEQ ID NO: 6637879 - DNA, 18 bp, Homo sapiens
agctcaggtgtccctgca

SEQ ID NO: 6637880 - DNA, 20 bp, Homo sapiens
agctcaggttccctgccaca

SEQ ID NO: 6637881 - DNA, 17 bp, Homo sapiens
agctcagtacagggcag

SEQ ID NO: 6637882 - DNA, 18 bp, Homo sapiens
agctcagtacagggcagg

SEQ ID NO: 6637883 - DNA, 22 bp, Homo sapiens
agctcagtcatcaaagcagaag

SEQ ID NO: 6637884 - DNA, 15 bp, Homo sapiens
agctcagtcccacag

SEQ ID NO: 6637885 - DNA, 16 bp, Homo sapiens
agctcagtcccacagc

SEQ ID NO: 6637886 - DNA, 17 bp, Homo sapiens
agctcagtcccacagcc

SEQ ID NO: 6637887 - DNA, 20 bp, Homo sapiens
agctcagttgagaaacagtt

SEQ ID NO: 6637888 - DNA, 22 bp, Homo sapiens
agctcagttgagaaacagttcc

SEQ ID NO: 6637889 - DNA, 15 bp, Homo sapiens
agctcagttgggttt

SEQ ID NO: 6637890 - DNA, 16 bp, Homo sapiens
agctcagttgggtttc

SEQ ID NO: 6637891 - DNA, 17 bp, Homo sapiens
agctcataaaatggaag

SEQ ID NO: 6637892 - DNA, 18 bp, Homo sapiens
agctcataaaatggaagc

SEQ ID NO: 6637893 - DNA, 14 bp, Homo sapiens
agctcataagagta

SEQ ID NO: 6637894 - DNA, 18 bp, Homo sapiens
agctcataagctgtagaa

SEQ ID NO: 6637895 - DNA, 23 bp, Homo sapiens
agctcatagaattttgagtattc

SEQ ID NO: 6637896 - DNA, 21 bp, Homo sapiens
agctcatagaggtgagaaaac

SEQ ID NO: 6637897 - DNA, 20 bp, Homo sapiens
agctcatagtgaacacagca

SEQ ID NO: 6637898 - DNA, 20 bp, Homo sapiens
agctcatatgctgacagctc

SEQ ID NO: 6637899 - DNA, 18 bp, Homo sapiens
agctcatattttgtatat

SEQ ID NO: 6637900 - DNA, 15 bp, Homo sapiens
agctcatcactgtgc

SEQ ID NO: 6637901 - DNA, 17 bp, Homo sapiens
agctcatcatcagtctt

SEQ ID NO: 6637902 - DNA, 21 bp, Homo sapiens
agctcatccatgcctcagaag

SEQ ID NO: 6637903 - DNA, 18 bp, Homo sapiens
agctcatcccccctgctg

SEQ ID NO: 6637904 - DNA, 24 bp, Homo sapiens
agctcatcccccctgctgcccagt

SEQ ID NO: 6637905 - DNA, 20 bp, Homo sapiens
agctcatccctctcacccag

SEQ ID NO: 6637906 - DNA, 16 bp, Homo sapiens
agctcatctgccaaaa

SEQ ID NO: 6637907 - DNA, 12 bp, Homo sapiens
agctcatcttca

SEQ ID NO: 6637908 - DNA, 21 bp, Homo sapiens
agctcatgatgcgcttcaaag

SEQ ID NO: 6637909 - DNA, 23 bp, Homo sapiens
agctcatgtaggtgagcctgggc

SEQ ID NO: 6637910 - DNA, 18 bp, Homo sapiens
agctcatgtcattatgac

SEQ ID NO: 6637911 - DNA, 21 bp, Homo sapiens
agctcatgtcattatgacatt

SEQ ID NO: 6637912 - DNA, 22 bp, Homo sapiens
agctcatgtgcattattttcca

SEQ ID NO: 6637913 - DNA, 22 bp, Homo sapiens
agctcattatgaaaaacatccc

SEQ ID NO: 6637914 - DNA, 19 bp, Homo sapiens
agctcatttaatcccagga

SEQ ID NO: 6637915 - DNA, 23 bp, Homo sapiens
agctcatttgagataaagtcaaa

SEQ ID NO: 6637916 - DNA, 17 bp, Homo sapiens
agctcattttccacatg

SEQ ID NO: 6637917 - DNA, 19 bp, Homo sapiens
agctccaaatccaaggaaa

SEQ ID NO: 6637918 - DNA, 13 bp, Homo sapiens
agctccaacctgc

SEQ ID NO: 6637919 - DNA, 15 bp, Homo sapiens
agctccaacctggag

SEQ ID NO: 6637920 - DNA, 17 bp, Homo sapiens
agctccaacctggaggc

SEQ ID NO: 6637921 - DNA, 18 bp, Homo sapiens
agctccaacctggaggct

SEQ ID NO: 6637922 - DNA, 21 bp, Homo sapiens
agctccaacctggaggctgga

SEQ ID NO: 6637923 - DNA, 15 bp, Homo sapiens
agctccaagaatttc

SEQ ID NO: 6637924 - DNA, 15 bp, Homo sapiens
agctccaagctccca

SEQ ID NO: 6637925 - DNA, 16 bp, Homo sapiens
agctccaagctcccag

SEQ ID NO: 6637926 - DNA, 17 bp, Homo sapiens
agctccaagctcccagg

SEQ ID NO: 6637927 - DNA, 15 bp, Homo sapiens
agctccaagctgtta

SEQ ID NO: 6637928 - DNA, 20 bp, Homo sapiens
agctccacacattccagcca

SEQ ID NO: 6637929 - DNA, 21 bp, Homo sapiens
agctccacacattccagccag

SEQ ID NO: 6637930 - DNA, 18 bp, Homo sapiens
agctccacacgccccggt

SEQ ID NO: 6637931 - DNA, 19 bp, Homo sapiens
agctccaccactgtgcact

SEQ ID NO: 6637932 - DNA, 22 bp, Homo sapiens
agctccaccctcaccaggatga

SEQ ID NO: 6637933 - DNA, 17 bp, Homo sapiens
agctccaccctggccga

SEQ ID NO: 6637934 - DNA, 19 bp, Homo sapiens
agctccacctctggtggct

SEQ ID NO: 6637935 - DNA, 23 bp, Homo sapiens
agctccacggtgcgtggctgtgg

SEQ ID NO: 6637936 - DNA, 22 bp, Homo sapiens
agctccactcagggctggcccg

SEQ ID NO: 6637937 - DNA, 16 bp, Homo sapiens
agctccactggcctgc

SEQ ID NO: 6637938 - DNA, 21 bp, Homo sapiens
agctccactgtcaccctccac

SEQ ID NO: 6637939 - DNA, 19 bp, Homo sapiens
agctccagaataccttctt

SEQ ID NO: 6637940 - DNA, 14 bp, Homo sapiens
agctccagaccccc

SEQ ID NO: 6637941 - DNA, 21 bp, Homo sapiens
agctccagcaggaaggacccc

SEQ ID NO: 6637942 - DNA, 16 bp, Homo sapiens
agctccagcccctttc

SEQ ID NO: 6637943 - DNA, 15 bp, Homo sapiens
agctccagcctgaca

SEQ ID NO: 6637944 - DNA, 16 bp, Homo sapiens
agctccagcctgacat

SEQ ID NO: 6637945 - DNA, 20 bp, Homo sapiens
agctccagcgatggtgctgc

SEQ ID NO: 6637946 - DNA, 13 bp, Homo sapiens
agctccaggatgg

SEQ ID NO: 6637947 - DNA, 14 bp, Homo sapiens
agctccaggcagga

SEQ ID NO: 6637948 - DNA, 14 bp, Homo sapiens
agctccagggactg

SEQ ID NO: 6637949 - DNA, 13 bp, Homo sapiens
agctccagggcca

SEQ ID NO: 6637950 - DNA, 20 bp, Homo sapiens
agctccaggggcccttggga

SEQ ID NO: 6637951 - DNA, 20 bp, Homo sapiens
agctccaggtgccctgtggg

SEQ ID NO: 6637952 - DNA, 14 bp, Homo sapiens
agctccagtcctgc

SEQ ID NO: 6637953 - DNA, 15 bp, Homo sapiens
agctccagtcctgct

SEQ ID NO: 6637954 - DNA, 22 bp, Homo sapiens
agctccagtgccgctcctgctt

SEQ ID NO: 6637955 - DNA, 22 bp, Homo sapiens
agctccagtgctttatccacat

SEQ ID NO: 6637956 - DNA, 23 bp, Homo sapiens
agctccagtggaagaagaaaaca

SEQ ID NO: 6637957 - DNA, 19 bp, Homo sapiens
agctccagtgtcctgagct

SEQ ID NO: 6637958 - DNA, 16 bp, Homo sapiens
agctccagtttgcatt

SEQ ID NO: 6637959 - DNA, 19 bp, Homo sapiens
agctccataattgcaaggg

SEQ ID NO: 6637960 - DNA, 23 bp, Homo sapiens
agctccatacacacgctgccttc

SEQ ID NO: 6637961 - DNA, 13 bp, Homo sapiens
agctccatctcca

SEQ ID NO: 6637962 - DNA, 15 bp, Homo sapiens
agctccatctccact

SEQ ID NO: 6637963 - DNA, 16 bp, Homo sapiens
agctccatgctgttct

SEQ ID NO: 6637964 - DNA, 10 bp, Homo sapiens
agctccatgt

SEQ ID NO: 6637965 - DNA, 19 bp, Homo sapiens
agctccatgtgcctctttg

SEQ ID NO: 6637966 - DNA, 17 bp, Homo sapiens
agctccatgttctccca

SEQ ID NO: 6637967 - DNA, 15 bp, Homo sapiens
agctccatttaaaca

SEQ ID NO: 6637968 - DNA, 21 bp, Homo sapiens
agctccatttaaacagatgtc

SEQ ID NO: 6637969 - DNA, 20 bp, Homo sapiens
agctcccaacgagcctcctc

SEQ ID NO: 6637970 - DNA, 18 bp, Homo sapiens
agctcccaagggatggtg

SEQ ID NO: 6637971 - DNA, 17 bp, Homo sapiens
agctcccacaagcctct

SEQ ID NO: 6637972 - DNA, 20 bp, Homo sapiens
agctcccacaagcctctgcc

SEQ ID NO: 6637973 - DNA, 22 bp, Homo sapiens
agctcccacaccgcgtcccagc

SEQ ID NO: 6637974 - DNA, 23 bp, Homo sapiens
agctcccacaccgcgtcccagct

SEQ ID NO: 6637975 - DNA, 17 bp, Homo sapiens
agctcccaccccacccc

SEQ ID NO: 6637976 - DNA, 17 bp, Homo sapiens
agctcccagcactcaac

SEQ ID NO: 6637977 - DNA, 13 bp, Homo sapiens
agctcccaggaac

SEQ ID NO: 6637978 - DNA, 23 bp, Homo sapiens
agctcccaggaccacaggctcag

SEQ ID NO: 6637979 - DNA, 17 bp, Homo sapiens
agctcccaggaggggct

SEQ ID NO: 6637980 - DNA, 23 bp, Homo sapiens
agctcccaggcattccccaggag

SEQ ID NO: 6637981 - DNA, 14 bp, Homo sapiens
agctcccaggccaa

SEQ ID NO: 6637982 - DNA, 13 bp, Homo sapiens
agctcccaggccg

SEQ ID NO: 6637983 - DNA, 21 bp, Homo sapiens
agctcccaggtgcagccagag

SEQ ID NO: 6637984 - DNA, 16 bp, Homo sapiens
agctcccatagcgctg

SEQ ID NO: 6637985 - DNA, 23 bp, Homo sapiens
agctcccatttctactctcccat

SEQ ID NO: 6637986 - DNA, 22 bp, Homo sapiens
agctccccaaaaacctcacccg

SEQ ID NO: 6637987 - DNA, 16 bp, Homo sapiens
agctccccaatccctg

SEQ ID NO: 6637988 - DNA, 20 bp, Homo sapiens
agctccccaattctgcctgc

SEQ ID NO: 6637989 - DNA, 17 bp, Homo sapiens
agctccccaccacccca

SEQ ID NO: 6637990 - DNA, 10 bp, Homo sapiens
agctccccag

SEQ ID NO: 6637991 - DNA, 13 bp, Homo sapiens
agctccccagagt

SEQ ID NO: 6637992 - DNA, 18 bp, Homo sapiens
agctccccagatctccca

SEQ ID NO: 6637993 - DNA, 16 bp, Homo sapiens
agctccccagcccacc

SEQ ID NO: 6637994 - DNA, 17 bp, Homo sapiens
agctccccagcccacct

SEQ ID NO: 6637995 - DNA, 20 bp, Homo sapiens
agctccccagcccacctgct

SEQ ID NO: 6637996 - DNA, 22 bp, Homo sapiens
agctccccagcccacctgctcc

SEQ ID NO: 6637997 - DNA, 12 bp, Homo sapiens
agctccccagga

SEQ ID NO: 6637998 - DNA, 20 bp, Homo sapiens
agctccccaggactcaccct

SEQ ID NO: 6637999 - DNA, 22 bp, Homo sapiens
agctccccaggactcaccctca

SEQ ID NO: 6638000 - DNA, 20 bp, Homo sapiens
agctccccatcaccatggga

SEQ ID NO: 6638001 - DNA, 19 bp, Homo sapiens
agctcccccagcaaagccc

SEQ ID NO: 6638002 - DNA, 23 bp, Homo sapiens
agctcccccagcaaagcccccag

SEQ ID NO: 6638003 - DNA, 15 bp, Homo sapiens
agctcccccagctcc

SEQ ID NO: 6638004 - DNA, 15 bp, Homo sapiens
agctcccccaggcag

SEQ ID NO: 6638005 - DNA, 21 bp, Homo sapiens
agctcccccaggctgttctcc

SEQ ID NO: 6638006 - DNA, 23 bp, Homo sapiens
agctcccccaggctgttctccag

SEQ ID NO: 6638007 - DNA, 19 bp, Homo sapiens
agctccccccgcccaccca

SEQ ID NO: 6638008 - DNA, 18 bp, Homo sapiens
agctcccccgtggtgcct

SEQ ID NO: 6638009 - DNA, 21 bp, Homo sapiens
agctcccccgtggtgcctgca

SEQ ID NO: 6638010 - DNA, 15 bp, Homo sapiens
agctccccctgtccc

SEQ ID NO: 6638011 - DNA, 16 bp, Homo sapiens
agctccccctgtcccc

SEQ ID NO: 6638012 - DNA, 17 bp, Homo sapiens
agctccccctgtcccct

SEQ ID NO: 6638013 - DNA, 17 bp, Homo sapiens
agctcccctccacagct

SEQ ID NO: 6638014 - DNA, 19 bp, Homo sapiens
agctcccctccacagctgc

SEQ ID NO: 6638015 - DNA, 14 bp, Homo sapiens
agctcccctcccca

SEQ ID NO: 6638016 - DNA, 19 bp, Homo sapiens
agctcccctcctctcccct

SEQ ID NO: 6638017 - DNA, 19 bp, Homo sapiens
agctcccctcggagaagag

SEQ ID NO: 6638018 - DNA, 20 bp, Homo sapiens
agctcccctcttttgtaagt

SEQ ID NO: 6638019 - DNA, 22 bp, Homo sapiens
agctcccctcttttgtaagtat

SEQ ID NO: 6638020 - DNA, 13 bp, Homo sapiens
agctcccctgcct

SEQ ID NO: 6638021 - DNA, 15 bp, Homo sapiens
agctcccctgcctta

SEQ ID NO: 6638022 - DNA, 12 bp, Homo sapiens
agctcccctgga

SEQ ID NO: 6638023 - DNA, 17 bp, Homo sapiens
agctcccctggagccag

SEQ ID NO: 6638024 - DNA, 12 bp, Homo sapiens
agctcccctggc

SEQ ID NO: 6638025 - DNA, 18 bp, Homo sapiens
agctcccctggctggctc

SEQ ID NO: 6638026 - DNA, 17 bp, Homo sapiens
agctccctaggagacca

SEQ ID NO: 6638027 - DNA, 20 bp, Homo sapiens
agctccctcaaagaggcagt

SEQ ID NO: 6638028 - DNA, 19 bp, Homo sapiens
agctccctcccctgctcag

SEQ ID NO: 6638029 - DNA, 13 bp, Homo sapiens
agctccctcctcc

SEQ ID NO: 6638030 - DNA, 15 bp, Homo sapiens
agctccctcctccca

SEQ ID NO: 6638031 - DNA, 12 bp, Homo sapiens
agctccctcctg

SEQ ID NO: 6638032 - DNA, 21 bp, Homo sapiens
agctccctcctgcacacagaa

SEQ ID NO: 6638033 - DNA, 22 bp, Homo sapiens
agctccctcctgcacacagaat

SEQ ID NO: 6638034 - DNA, 13 bp, Homo sapiens
agctccctcgctg

SEQ ID NO: 6638035 - DNA, 13 bp, Homo sapiens
agctccctctgcc

SEQ ID NO: 6638036 - DNA, 18 bp, Homo sapiens
agctccctgaatctgacc

SEQ ID NO: 6638037 - DNA, 19 bp, Homo sapiens
agctccctgaatctgacca

SEQ ID NO: 6638038 - DNA, 18 bp, Homo sapiens
agctccctgcaccgccgc

SEQ ID NO: 6638039 - DNA, 15 bp, Homo sapiens
agctccctgcctgtt

SEQ ID NO: 6638040 - DNA, 16 bp, Homo sapiens
agctccctgcctgttt

SEQ ID NO: 6638041 - DNA, 16 bp, Homo sapiens
agctccctggcttctg

SEQ ID NO: 6638042 - DNA, 23 bp, Homo sapiens
agctccctggcttctgtggggcc

SEQ ID NO: 6638043 - DNA, 18 bp, Homo sapiens
agctccctgtggggcagg

SEQ ID NO: 6638044 - DNA, 12 bp, Homo sapiens
agctcccttccc

SEQ ID NO: 6638045 - DNA, 18 bp, Homo sapiens
agctcccttcccctgcct

SEQ ID NO: 6638046 - DNA, 20 bp, Homo sapiens
agctcccttcccctgcctgg

SEQ ID NO: 6638047 - DNA, 14 bp, Homo sapiens
agctcccttctctg

SEQ ID NO: 6638048 - DNA, 23 bp, Homo sapiens
agctcccttctctgtagggaact

SEQ ID NO: 6638049 - DNA, 16 bp, Homo sapiens
agctcccttcttccct

SEQ ID NO: 6638050 - DNA, 14 bp, Homo sapiens
agctcccttgagct

SEQ ID NO: 6638051 - DNA, 22 bp, Homo sapiens
agctcccttgggaaggacacag

SEQ ID NO: 6638052 - DNA, 17 bp, Homo sapiens
agctccctttctcagga

SEQ ID NO: 6638053 - DNA, 19 bp, Homo sapiens
agctcccttttctttttcc

SEQ ID NO: 6638054 - DNA, 18 bp, Homo sapiens
agctccgagctgtaggag

SEQ ID NO: 6638055 - DNA, 22 bp, Homo sapiens
agctccgagctgtaggagagtc

SEQ ID NO: 6638056 - DNA, 17 bp, Homo sapiens
agctccgcctcccgggt

SEQ ID NO: 6638057 - DNA, 13 bp, Homo sapiens
agctccgcctgct

SEQ ID NO: 6638058 - DNA, 16 bp, Homo sapiens
agctccgcctgctggg

SEQ ID NO: 6638059 - DNA, 20 bp, Homo sapiens
agctccgcctggcacccact

SEQ ID NO: 6638060 - DNA, 20 bp, Homo sapiens
agctccgcgctcggggctgg

SEQ ID NO: 6638061 - DNA, 23 bp, Homo sapiens
agctccgctttctacccagcgag

SEQ ID NO: 6638062 - DNA, 18 bp, Homo sapiens
agctccggaatagatgtc

SEQ ID NO: 6638063 - DNA, 22 bp, Homo sapiens
agctccggagggggtcctcctc

SEQ ID NO: 6638064 - DNA, 15 bp, Homo sapiens
agctccgggatcagc

SEQ ID NO: 6638065 - DNA, 20 bp, Homo sapiens
agctccgggggtacagccct

SEQ ID NO: 6638066 - DNA, 14 bp, Homo sapiens
agctccgtcatctg

SEQ ID NO: 6638067 - DNA, 20 bp, Homo sapiens
agctccgtttctaccaccgc

SEQ ID NO: 6638068 - DNA, 16 bp, Homo sapiens
agctcctaagctgcca

SEQ ID NO: 6638069 - DNA, 16 bp, Homo sapiens
agctcctacctctgtg

SEQ ID NO: 6638070 - DNA, 17 bp, Homo sapiens
agctcctacctctgtgc

SEQ ID NO: 6638071 - DNA, 19 bp, Homo sapiens
agctcctacctctgtgcca

SEQ ID NO: 6638072 - DNA, 20 bp, Homo sapiens
agctcctacctctgtgccag

SEQ ID NO: 6638073 - DNA, 19 bp, Homo sapiens
agctcctataaagggccca

SEQ ID NO: 6638074 - DNA, 14 bp, Homo sapiens
agctcctcacccag

SEQ ID NO: 6638075 - DNA, 20 bp, Homo sapiens
agctcctcacccagggcccc

SEQ ID NO: 6638076 - DNA, 12 bp, Homo sapiens
agctcctcccac

SEQ ID NO: 6638077 - DNA, 22 bp, Homo sapiens
agctcctcccacggggtccccg

SEQ ID NO: 6638078 - DNA, 19 bp, Homo sapiens
agctcctccccttcctctt

SEQ ID NO: 6638079 - DNA, 11 bp, Homo sapiens
agctcctccct

SEQ ID NO: 6638080 - DNA, 15 bp, Homo sapiens
agctcctccctccag

SEQ ID NO: 6638081 - DNA, 19 bp, Homo sapiens
agctcctccctccagctgc

SEQ ID NO: 6638082 - DNA, 14 bp, Homo sapiens
agctcctccctgtg

SEQ ID NO: 6638083 - DNA, 14 bp, Homo sapiens
agctcctcccttga

SEQ ID NO: 6638084 - DNA, 16 bp, Homo sapiens
agctcctcccttgttc

SEQ ID NO: 6638085 - DNA, 20 bp, Homo sapiens
agctcctcccttgttctcta

SEQ ID NO: 6638086 - DNA, 15 bp, Homo sapiens
agctcctccgcagaa

SEQ ID NO: 6638087 - DNA, 13 bp, Homo sapiens
agctcctcctccc

SEQ ID NO: 6638088 - DNA, 16 bp, Homo sapiens
agctcctcctccctgc

SEQ ID NO: 6638089 - DNA, 23 bp, Homo sapiens
agctcctcctcttggagctgaga

SEQ ID NO: 6638090 - DNA, 20 bp, Homo sapiens
agctcctcgagggcagggac

SEQ ID NO: 6638091 - DNA, 21 bp, Homo sapiens
agctcctcgggtggggcctgc

SEQ ID NO: 6638092 - DNA, 17 bp, Homo sapiens
agctcctctaggggcag

SEQ ID NO: 6638093 - DNA, 18 bp, Homo sapiens
agctcctctaggggcagc

SEQ ID NO: 6638094 - DNA, 21 bp, Homo sapiens
agctcctctccccagcccaga

SEQ ID NO: 6638095 - DNA, 23 bp, Homo sapiens
agctcctctccccagcccagaga

SEQ ID NO: 6638096 - DNA, 24 bp, Homo sapiens
agctcctctccccagcccagagac

SEQ ID NO: 6638097 - DNA, 14 bp, Homo sapiens
agctcctctcctgg

SEQ ID NO: 6638098 - DNA, 18 bp, Homo sapiens
agctcctctcctggagga

SEQ ID NO: 6638099 - DNA, 14 bp, Homo sapiens
agctcctctccttg

SEQ ID NO: 6638100 - DNA, 20 bp, Homo sapiens
agctcctctccttgggctcc

SEQ ID NO: 6638101 - DNA, 18 bp, Homo sapiens
agctcctctctgaagcga

SEQ ID NO: 6638102 - DNA, 19 bp, Homo sapiens
agctcctctctgaagcgac

SEQ ID NO: 6638103 - DNA, 15 bp, Homo sapiens
agctcctctgctcca

SEQ ID NO: 6638104 - DNA, 17 bp, Homo sapiens
agctcctctgggcagga

SEQ ID NO: 6638105 - DNA, 21 bp, Homo sapiens
agctcctctgtcctgcttctg

SEQ ID NO: 6638106 - DNA, 18 bp, Homo sapiens
agctcctgacactgctgg

SEQ ID NO: 6638107 - DNA, 12 bp, Homo sapiens
agctcctgacca

SEQ ID NO: 6638108 - DNA, 14 bp, Homo sapiens
agctcctgaccaaa

SEQ ID NO: 6638109 - DNA, 14 bp, Homo sapiens
agctcctgaccagt

SEQ ID NO: 6638110 - DNA, 16 bp, Homo sapiens
agctcctgaccttggg

SEQ ID NO: 6638111 - DNA, 16 bp, Homo sapiens
agctcctgagtagctg

SEQ ID NO: 6638112 - DNA, 13 bp, Homo sapiens
agctcctgatcag

SEQ ID NO: 6638113 - DNA, 18 bp, Homo sapiens
agctcctgatcagaggca

SEQ ID NO: 6638114 - DNA, 13 bp, Homo sapiens
agctcctgccaca

SEQ ID NO: 6638115 - DNA, 20 bp, Homo sapiens
agctcctgccacatggagcc

SEQ ID NO: 6638116 - DNA, 13 bp, Homo sapiens
agctcctgccccg

SEQ ID NO: 6638117 - DNA, 14 bp, Homo sapiens
agctcctgccccgc

SEQ ID NO: 6638118 - DNA, 16 bp, Homo sapiens
agctcctgccccgccg

SEQ ID NO: 6638119 - DNA, 23 bp, Homo sapiens
agctcctgctccacagccatccc

SEQ ID NO: 6638120 - DNA, 14 bp, Homo sapiens
agctcctgctgcgg

SEQ ID NO: 6638121 - DNA, 12 bp, Homo sapiens
agctcctgctgg

SEQ ID NO: 6638122 - DNA, 14 bp, Homo sapiens
agctcctggccagg

SEQ ID NO: 6638123 - DNA, 16 bp, Homo sapiens
agctcctgggaaggct

SEQ ID NO: 6638124 - DNA, 16 bp, Homo sapiens
agctcctgggcagctt

SEQ ID NO: 6638125 - DNA, 11 bp, Homo sapiens
agctcctgtaa

SEQ ID NO: 6638126 - DNA, 17 bp, Homo sapiens
agctcctgtcccctgct

SEQ ID NO: 6638127 - DNA, 18 bp, Homo sapiens
agctcctgtcccctgcta

SEQ ID NO: 6638128 - DNA, 19 bp, Homo sapiens
agctcctgtccctacccac

SEQ ID NO: 6638129 - DNA, 14 bp, Homo sapiens
agctcctgtcctcc

SEQ ID NO: 6638130 - DNA, 15 bp, Homo sapiens
agctcctgtggcccc

SEQ ID NO: 6638131 - DNA, 19 bp, Homo sapiens
agctcctgtggccccaccc

SEQ ID NO: 6638132 - DNA, 22 bp, Homo sapiens
agctcctgtggccccaccctgg

SEQ ID NO: 6638133 - DNA, 16 bp, Homo sapiens
agctccttcatgcttt

SEQ ID NO: 6638134 - DNA, 13 bp, Homo sapiens
agctccttcccta

SEQ ID NO: 6638135 - DNA, 13 bp, Homo sapiens
agctccttcctgg

SEQ ID NO: 6638136 - DNA, 15 bp, Homo sapiens
agctccttcctggag

SEQ ID NO: 6638137 - DNA, 22 bp, Homo sapiens
agctccttgagggcaagagcca

SEQ ID NO: 6638138 - DNA, 14 bp, Homo sapiens
agctccttggagca

SEQ ID NO: 6638139 - DNA, 18 bp, Homo sapiens
agctccttggctgcagcc

SEQ ID NO: 6638140 - DNA, 22 bp, Homo sapiens
agctccttggctgcagccatcc

SEQ ID NO: 6638141 - DNA, 20 bp, Homo sapiens
agctccttgggaggaagcag

SEQ ID NO: 6638142 - DNA, 21 bp, Homo sapiens
agctccttggggcagggcctg

SEQ ID NO: 6638143 - DNA, 22 bp, Homo sapiens
agctccttggggcagggcctgg

SEQ ID NO: 6638144 - DNA, 17 bp, Homo sapiens
agctcctttctcctgtg

SEQ ID NO: 6638145 - DNA, 18 bp, Homo sapiens
agctcctttctcctgtga

SEQ ID NO: 6638146 - DNA, 19 bp, Homo sapiens
agctcctttctcctgtgaa

SEQ ID NO: 6638147 - DNA, 20 bp, Homo sapiens
agctcctttctcctgtgaat

SEQ ID NO: 6638148 - DNA, 19 bp, Homo sapiens
agctccttttgtccccagg

SEQ ID NO: 6638149 - DNA, 22 bp, Homo sapiens
agctccttttgtccccagggcc

SEQ ID NO: 6638150 - DNA, 23 bp, Homo sapiens
agctccttttgtccccagggccc

SEQ ID NO: 6638151 - DNA, 17 bp, Homo sapiens
agctcgaattaagaata

SEQ ID NO: 6638152 - DNA, 20 bp, Homo sapiens
agctcgcacccccctgttct

SEQ ID NO: 6638153 - DNA, 15 bp, Homo sapiens
agctcgcagcccccg

SEQ ID NO: 6638154 - DNA, 18 bp, Homo sapiens
agctcgcatccagacagt

SEQ ID NO: 6638155 - DNA, 14 bp, Homo sapiens
agctcgccccacct

SEQ ID NO: 6638156 - DNA, 13 bp, Homo sapiens
agctcgcccctcc

SEQ ID NO: 6638157 - DNA, 14 bp, Homo sapiens
agctcgcccctccc

SEQ ID NO: 6638158 - DNA, 15 bp, Homo sapiens
agctcgctcttggga

SEQ ID NO: 6638159 - DNA, 20 bp, Homo sapiens
agctcgctggctttctctct

SEQ ID NO: 6638160 - DNA, 22 bp, Homo sapiens
agctcgctggctttctctctgg

SEQ ID NO: 6638161 - DNA, 15 bp, Homo sapiens
agctcggcaccaact

SEQ ID NO: 6638162 - DNA, 14 bp, Homo sapiens
agctcggctcagct

SEQ ID NO: 6638163 - DNA, 21 bp, Homo sapiens
agctcggggctgggggctgca

SEQ ID NO: 6638164 - DNA, 19 bp, Homo sapiens
agctcggggggctctgcct

SEQ ID NO: 6638165 - DNA, 15 bp, Homo sapiens
agctcggtacccggg

SEQ ID NO: 6638166 - DNA, 17 bp, Homo sapiens
agctcggtggacccagg

SEQ ID NO: 6638167 - DNA, 18 bp, Homo sapiens
agctcggtggacccaggg

SEQ ID NO: 6638168 - DNA, 17 bp, Homo sapiens
agctcgtgtatcctggg

SEQ ID NO: 6638169 - DNA, 19 bp, Homo sapiens
agctcgtgtatcctggggc

SEQ ID NO: 6638170 - DNA, 20 bp, Homo sapiens
agctcgtgtatcctggggct

SEQ ID NO: 6638171 - DNA, 14 bp, Homo sapiens
agctcgtgtgctta

SEQ ID NO: 6638172 - DNA, 18 bp, Homo sapiens
agctcgttacttcagccc

SEQ ID NO: 6638173 - DNA, 22 bp, Homo sapiens
agctcgtttttcagcaccccca

SEQ ID NO: 6638174 - DNA, 18 bp, Homo sapiens
agctctaaagcagagatg

SEQ ID NO: 6638175 - DNA, 21 bp, Homo sapiens
agctctaaagcagagatgtat

SEQ ID NO: 6638176 - DNA, 21 bp, Homo sapiens
agctctaaagtagcaactgct

SEQ ID NO: 6638177 - DNA, 17 bp, Homo sapiens
agctctaagagcaattc

SEQ ID NO: 6638178 - DNA, 17 bp, Homo sapiens
agctctaataagtttgt

SEQ ID NO: 6638179 - DNA, 14 bp, Homo sapiens
agctctaatgtttg

SEQ ID NO: 6638180 - DNA, 21 bp, Homo sapiens
agctctaatgtttgcatataa

SEQ ID NO: 6638181 - DNA, 18 bp, Homo sapiens
agctctacacaacatgta

SEQ ID NO: 6638182 - DNA, 23 bp, Homo sapiens
agctctacaggcctgcagcccct

SEQ ID NO: 6638183 - DNA, 20 bp, Homo sapiens
agctctacattctgctctgc

SEQ ID NO: 6638184 - DNA, 21 bp, Homo sapiens
agctctacattctgctctgcc

SEQ ID NO: 6638185 - DNA, 19 bp, Homo sapiens
agctctacccagggcctgc

SEQ ID NO: 6638186 - DNA, 18 bp, Homo sapiens
agctctaccctgctccct

SEQ ID NO: 6638187 - DNA, 16 bp, Homo sapiens
agctctacgtcccaca

SEQ ID NO: 6638188 - DNA, 13 bp, Homo sapiens
agctctactccag

SEQ ID NO: 6638189 - DNA, 14 bp, Homo sapiens
agctctagcctctg

SEQ ID NO: 6638190 - DNA, 18 bp, Homo sapiens
agctctaggctgttctgt

SEQ ID NO: 6638191 - DNA, 21 bp, Homo sapiens
agctctaggctgttctgtagc

SEQ ID NO: 6638192 - DNA, 17 bp, Homo sapiens
agctctagtcctttata

SEQ ID NO: 6638193 - DNA, 18 bp, Homo sapiens
agctctagtcctttataa

SEQ ID NO: 6638194 - DNA, 20 bp, Homo sapiens
agctctagttttcagccttg

SEQ ID NO: 6638195 - DNA, 13 bp, Homo sapiens
agctctatctgca

SEQ ID NO: 6638196 - DNA, 22 bp, Homo sapiens
agctctatgtttacaaatggac

SEQ ID NO: 6638197 - DNA, 22 bp, Homo sapiens
agctctattaagatttccaagt

SEQ ID NO: 6638198 - DNA, 17 bp, Homo sapiens
agctctattttaaagta

SEQ ID NO: 6638199 - DNA, 22 bp, Homo sapiens
agctctcaaatgtgtgttcctg

SEQ ID NO: 6638200 - DNA, 14 bp, Homo sapiens
agctctcacagaca

SEQ ID NO: 6638201 - DNA, 21 bp, Homo sapiens
agctctcagcaagtgcccagt

SEQ ID NO: 6638202 - DNA, 13 bp, Homo sapiens
agctctcagccaa

SEQ ID NO: 6638203 - DNA, 20 bp, Homo sapiens
agctctcaggaccgtgccct

SEQ ID NO: 6638204 - DNA, 17 bp, Homo sapiens
agctctcaggccgagag

SEQ ID NO: 6638205 - DNA, 18 bp, Homo sapiens
agctctcagggctgtctt

SEQ ID NO: 6638206 - DNA, 21 bp, Homo sapiens
agctctcagttgcagccctgc

SEQ ID NO: 6638207 - DNA, 14 bp, Homo sapiens
agctctcatagctc

SEQ ID NO: 6638208 - DNA, 16 bp, Homo sapiens
agctctccagctccaa

SEQ ID NO: 6638209 - DNA, 14 bp, Homo sapiens
agctctccaggcca

SEQ ID NO: 6638210 - DNA, 16 bp, Homo sapiens
agctctccaggccagg

SEQ ID NO: 6638211 - DNA, 19 bp, Homo sapiens
agctctccaggccaggtgg

SEQ ID NO: 6638212 - DNA, 17 bp, Homo sapiens
agctctccatctattga

SEQ ID NO: 6638213 - DNA, 22 bp, Homo sapiens
agctctcccctcccttgtcctt

SEQ ID NO: 6638214 - DNA, 23 bp, Homo sapiens
agctctcccctcctgctgggcgt

SEQ ID NO: 6638215 - DNA, 21 bp, Homo sapiens
agctctcccctgcgcaggccc

SEQ ID NO: 6638216 - DNA, 22 bp, Homo sapiens
agctctcccctgcgcaggccct

SEQ ID NO: 6638217 - DNA, 14 bp, Homo sapiens
agctctccctcaca

SEQ ID NO: 6638218 - DNA, 13 bp, Homo sapiens
agctctccctctg

SEQ ID NO: 6638219 - DNA, 18 bp, Homo sapiens
agctctccctctggccct

SEQ ID NO: 6638220 - DNA, 19 bp, Homo sapiens
agctctccctctggccctg

SEQ ID NO: 6638221 - DNA, 20 bp, Homo sapiens
agctctccctctggccctgc

SEQ ID NO: 6638222 - DNA, 13 bp, Homo sapiens
agctctcctccag

SEQ ID NO: 6638223 - DNA, 15 bp, Homo sapiens
agctctcctccagcc

SEQ ID NO: 6638224 - DNA, 20 bp, Homo sapiens
agctctcctccagccctggg

SEQ ID NO: 6638225 - DNA, 16 bp, Homo sapiens
agctctcctccgcctt

SEQ ID NO: 6638226 - DNA, 14 bp, Homo sapiens
agctctcctgggcc

SEQ ID NO: 6638227 - DNA, 21 bp, Homo sapiens
agctctcgcctcaggcttttt

SEQ ID NO: 6638228 - DNA, 18 bp, Homo sapiens
agctctcggaactgcatg

SEQ ID NO: 6638229 - DNA, 22 bp, Homo sapiens
agctctcggaactgcatgctgc

SEQ ID NO: 6638230 - DNA, 16 bp, Homo sapiens
agctctcgttctcctt

SEQ ID NO: 6638231 - DNA, 13 bp, Homo sapiens
agctctctaggcc

SEQ ID NO: 6638232 - DNA, 16 bp, Homo sapiens
agctctctaggcctct

SEQ ID NO: 6638233 - DNA, 18 bp, Homo sapiens
agctctctaggcctctcc

SEQ ID NO: 6638234 - DNA, 22 bp, Homo sapiens
agctctctaggcctctccagtt

SEQ ID NO: 6638235 - DNA, 12 bp, Homo sapiens
agctctctcaga

SEQ ID NO: 6638236 - DNA, 18 bp, Homo sapiens
agctctctctagaatgag

SEQ ID NO: 6638237 - DNA, 14 bp, Homo sapiens
agctctctctcctg

SEQ ID NO: 6638238 - DNA, 16 bp, Homo sapiens
agctctctctcctgga

SEQ ID NO: 6638239 - DNA, 23 bp, Homo sapiens
agctctctgacgcttgtgacagt

SEQ ID NO: 6638240 - DNA, 17 bp, Homo sapiens
agctctctgactgcttt

SEQ ID NO: 6638241 - DNA, 15 bp, Homo sapiens
agctctctgcatcta

SEQ ID NO: 6638242 - DNA, 14 bp, Homo sapiens
agctctctgccctg

SEQ ID NO: 6638243 - DNA, 17 bp, Homo sapiens
agctctctgccctgtgt

SEQ ID NO: 6638244 - DNA, 17 bp, Homo sapiens
agctctctgctgagcag

SEQ ID NO: 6638245 - DNA, 14 bp, Homo sapiens
agctctctgctggg

SEQ ID NO: 6638246 - DNA, 19 bp, Homo sapiens
agctctctgtataaacatt

SEQ ID NO: 6638247 - DNA, 16 bp, Homo sapiens
agctctcttcttactc

SEQ ID NO: 6638248 - DNA, 18 bp, Homo sapiens
agctctctttggaatgaa

SEQ ID NO: 6638249 - DNA, 11 bp, Homo sapiens
agctctgaaaa

SEQ ID NO: 6638250 - DNA, 22 bp, Homo sapiens
agctctgaaatcaactctcttc

SEQ ID NO: 6638251 - DNA, 13 bp, Homo sapiens
agctctgaaatct

SEQ ID NO: 6638252 - DNA, 16 bp, Homo sapiens
agctctgaaatcttcc

SEQ ID NO: 6638253 - DNA, 21 bp, Homo sapiens
agctctgaagaactctctgga

SEQ ID NO: 6638254 - DNA, 20 bp, Homo sapiens
agctctgaagttaaaatgat

SEQ ID NO: 6638255 - DNA, 21 bp, Homo sapiens
agctctgaatagttaaaaatt

SEQ ID NO: 6638256 - DNA, 21 bp, Homo sapiens
agctctgacatcccttcctgg

SEQ ID NO: 6638257 - DNA, 22 bp, Homo sapiens
agctctgacatcccttcctgga

SEQ ID NO: 6638258 - DNA, 15 bp, Homo sapiens
agctctgacccacag

SEQ ID NO: 6638259 - DNA, 13 bp, Homo sapiens
agctctgaccctt

SEQ ID NO: 6638260 - DNA, 10 bp, Homo sapiens
agctctgaga

SEQ ID NO: 6638261 - DNA, 19 bp, Homo sapiens
agctctgagacccttttct

SEQ ID NO: 6638262 - DNA, 20 bp, Homo sapiens
agctctgagacccttttctc

SEQ ID NO: 6638263 - DNA, 15 bp, Homo sapiens
agctctgagaggccc

SEQ ID NO: 6638264 - DNA, 17 bp, Homo sapiens
agctctgagatcctgga

SEQ ID NO: 6638265 - DNA, 15 bp, Homo sapiens
agctctgagcagaca

SEQ ID NO: 6638266 - DNA, 17 bp, Homo sapiens
agctctgagccagatta

SEQ ID NO: 6638267 - DNA, 12 bp, Homo sapiens
agctctgagccc

SEQ ID NO: 6638268 - DNA, 14 bp, Homo sapiens
agctctgagccctc

SEQ ID NO: 6638269 - DNA, 16 bp, Homo sapiens
agctctgagctgtcaa

SEQ ID NO: 6638270 - DNA, 13 bp, Homo sapiens
agctctgagggga

SEQ ID NO: 6638271 - DNA, 15 bp, Homo sapiens
agctctgaggggagg

SEQ ID NO: 6638272 - DNA, 17 bp, Homo sapiens
agctctgaggggaggca

SEQ ID NO: 6638273 - DNA, 20 bp, Homo sapiens
agctctgaggggaggcacct

SEQ ID NO: 6638274 - DNA, 23 bp, Homo sapiens
agctctgaggggaggcacctcca

SEQ ID NO: 6638275 - DNA, 12 bp, Homo sapiens
agctctgcaggc

SEQ ID NO: 6638276 - DNA, 19 bp, Homo sapiens
agctctgcataagattata

SEQ ID NO: 6638277 - DNA, 23 bp, Homo sapiens
agctctgcccatcctgcccctga

SEQ ID NO: 6638278 - DNA, 12 bp, Homo sapiens
agctctgccccc

SEQ ID NO: 6638279 - DNA, 19 bp, Homo sapiens
agctctgccccttccccat

SEQ ID NO: 6638280 - DNA, 14 bp, Homo sapiens
agctctgccctggc

SEQ ID NO: 6638281 - DNA, 17 bp, Homo sapiens
agctctgccgcaatggc

SEQ ID NO: 6638282 - DNA, 19 bp, Homo sapiens
agctctgccgtctctggag

SEQ ID NO: 6638283 - DNA, 20 bp, Homo sapiens
agctctgccgtctctggagc

SEQ ID NO: 6638284 - DNA, 13 bp, Homo sapiens
agctctgcgccag

SEQ ID NO: 6638285 - DNA, 19 bp, Homo sapiens
agctctgcgccaggcagag

SEQ ID NO: 6638286 - DNA, 12 bp, Homo sapiens
agctctgctgga

SEQ ID NO: 6638287 - DNA, 17 bp, Homo sapiens
agctctgctggaagaac

SEQ ID NO: 6638288 - DNA, 13 bp, Homo sapiens
agctctgcttgcc

SEQ ID NO: 6638289 - DNA, 21 bp, Homo sapiens
agctctgcttgccgaaactgg

SEQ ID NO: 6638290 - DNA, 22 bp, Homo sapiens
agctctgcttgccgaaactgga

SEQ ID NO: 6638291 - DNA, 23 bp, Homo sapiens
agctctgcttgccgaaactggaa

SEQ ID NO: 6638292 - DNA, 17 bp, Homo sapiens
agctctggaattgttga

SEQ ID NO: 6638293 - DNA, 20 bp, Homo sapiens
agctctggaattgttgaatg

SEQ ID NO: 6638294 - DNA, 21 bp, Homo sapiens
agctctggaattgttgaatgt

SEQ ID NO: 6638295 - DNA, 17 bp, Homo sapiens
agctctggacagcccca

SEQ ID NO: 6638296 - DNA, 12 bp, Homo sapiens
agctctggacca

SEQ ID NO: 6638297 - DNA, 17 bp, Homo sapiens
agctctggaggggaggg

SEQ ID NO: 6638298 - DNA, 19 bp, Homo sapiens
agctctggaggggaggggg

SEQ ID NO: 6638299 - DNA, 17 bp, Homo sapiens
agctctggatgaaggca

SEQ ID NO: 6638300 - DNA, 15 bp, Homo sapiens
agctctggccccagg

SEQ ID NO: 6638301 - DNA, 20 bp, Homo sapiens
agctctggccccaggcttgt

SEQ ID NO: 6638302 - DNA, 13 bp, Homo sapiens
agctctggccccg

SEQ ID NO: 6638303 - DNA, 19 bp, Homo sapiens
agctctggctcacagactg

SEQ ID NO: 6638304 - DNA, 22 bp, Homo sapiens
agctctggctgaaccctgtgct

SEQ ID NO: 6638305 - DNA, 23 bp, Homo sapiens
agctctggcttagacaccacctg

SEQ ID NO: 6638306 - DNA, 20 bp, Homo sapiens
agctctggcttcctgctgag

SEQ ID NO: 6638307 - DNA, 14 bp, Homo sapiens
agctctgggcctct

SEQ ID NO: 6638308 - DNA, 11 bp, Homo sapiens
agctctgggga

SEQ ID NO: 6638309 - DNA, 12 bp, Homo sapiens
agctctggggac

SEQ ID NO: 6638310 - DNA, 14 bp, Homo sapiens
agctctggggatgg

SEQ ID NO: 6638311 - DNA, 18 bp, Homo sapiens
agctctggggatgggtgg

SEQ ID NO: 6638312 - DNA, 21 bp, Homo sapiens
agctctggggatgggtgggga

SEQ ID NO: 6638313 - DNA, 12 bp, Homo sapiens
agctctgggggg

SEQ ID NO: 6638314 - DNA, 20 bp, Homo sapiens
agctctggggtgggcagttt

SEQ ID NO: 6638315 - DNA, 22 bp, Homo sapiens
agctctgggttgtgcacatttc

SEQ ID NO: 6638316 - DNA, 12 bp, Homo sapiens
agctctggtcca

SEQ ID NO: 6638317 - DNA, 21 bp, Homo sapiens
agctctggtgacaccagcctt

SEQ ID NO: 6638318 - DNA, 13 bp, Homo sapiens
agctctggtgctt

SEQ ID NO: 6638319 - DNA, 12 bp, Homo sapiens
agctctggtggg

SEQ ID NO: 6638320 - DNA, 18 bp, Homo sapiens
agctctggttatttttct

SEQ ID NO: 6638321 - DNA, 21 bp, Homo sapiens
agctctggttatttttctctt

SEQ ID NO: 6638322 - DNA, 22 bp, Homo sapiens
agctctggttatttttctcttg

SEQ ID NO: 6638323 - DNA, 13 bp, Homo sapiens
agctctgtaactt

SEQ ID NO: 6638324 - DNA, 22 bp, Homo sapiens
agctctgtaacttacacctgga

SEQ ID NO: 6638325 - DNA, 22 bp, Homo sapiens
agctctgtatcaggacccagag

SEQ ID NO: 6638326 - DNA, 16 bp, Homo sapiens
agctctgtatggtcag

SEQ ID NO: 6638327 - DNA, 18 bp, Homo sapiens
agctctgtcaccctggcc

SEQ ID NO: 6638328 - DNA, 20 bp, Homo sapiens
agctctgtcaccctggccac

SEQ ID NO: 6638329 - DNA, 13 bp, Homo sapiens
agctctgtcccca

SEQ ID NO: 6638330 - DNA, 15 bp, Homo sapiens
agctctgtcctctgt

SEQ ID NO: 6638331 - DNA, 19 bp, Homo sapiens
agctctgtcctcttggcca

SEQ ID NO: 6638332 - DNA, 12 bp, Homo sapiens
agctctgtcctg

SEQ ID NO: 6638333 - DNA, 12 bp, Homo sapiens
agctctgtctgt

SEQ ID NO: 6638334 - DNA, 14 bp, Homo sapiens
agctctgtggaatt

SEQ ID NO: 6638335 - DNA, 17 bp, Homo sapiens
agctctgtggcctgtgt

SEQ ID NO: 6638336 - DNA, 18 bp, Homo sapiens
agctctgtggcctgtgtc

SEQ ID NO: 6638337 - DNA, 23 bp, Homo sapiens
agctctgtgggaaaaaagaaaaa

SEQ ID NO: 6638338 - DNA, 22 bp, Homo sapiens
agctctgttcttcctcagccag

SEQ ID NO: 6638339 - DNA, 23 bp, Homo sapiens
agctctgttcttcctcagccagc

SEQ ID NO: 6638340 - DNA, 16 bp, Homo sapiens
agctctgttgcaatta

SEQ ID NO: 6638341 - DNA, 21 bp, Homo sapiens
agctctgttgcaattaggatt

SEQ ID NO: 6638342 - DNA, 15 bp, Homo sapiens
agctctgtttcggtt

SEQ ID NO: 6638343 - DNA, 18 bp, Homo sapiens
agctcttactctttccta

SEQ ID NO: 6638344 - DNA, 20 bp, Homo sapiens
agctcttagactcgcctatc

SEQ ID NO: 6638345 - DNA, 23 bp, Homo sapiens
agctcttagactcgcctatctta

SEQ ID NO: 6638346 - DNA, 16 bp, Homo sapiens
agctcttagtctcttt

SEQ ID NO: 6638347 - DNA, 18 bp, Homo sapiens
agctcttagtctctttgg

SEQ ID NO: 6638348 - DNA, 14 bp, Homo sapiens
agctcttcaagctg

SEQ ID NO: 6638349 - DNA, 13 bp, Homo sapiens
agctcttcaatag

SEQ ID NO: 6638350 - DNA, 15 bp, Homo sapiens
agctcttcacaccat

SEQ ID NO: 6638351 - DNA, 16 bp, Homo sapiens
agctcttcaggcctcc

SEQ ID NO: 6638352 - DNA, 17 bp, Homo sapiens
agctcttcaggcctccc

SEQ ID NO: 6638353 - DNA, 10 bp, Homo sapiens
agctcttcat

SEQ ID NO: 6638354 - DNA, 23 bp, Homo sapiens
agctcttcatctgcccaactgtg

SEQ ID NO: 6638355 - DNA, 16 bp, Homo sapiens
agctcttcatgtttca

SEQ ID NO: 6638356 - DNA, 11 bp, Homo sapiens
agctcttcatt

SEQ ID NO: 6638357 - DNA, 16 bp, Homo sapiens
agctcttcatttctgg

SEQ ID NO: 6638358 - DNA, 15 bp, Homo sapiens
agctcttcccctttc

SEQ ID NO: 6638359 - DNA, 14 bp, Homo sapiens
agctcttcctagct

SEQ ID NO: 6638360 - DNA, 19 bp, Homo sapiens
agctcttcctatccctctc

SEQ ID NO: 6638361 - DNA, 19 bp, Homo sapiens
agctcttcctccccaggac

SEQ ID NO: 6638362 - DNA, 18 bp, Homo sapiens
agctcttcggtttctgag

SEQ ID NO: 6638363 - DNA, 13 bp, Homo sapiens
agctcttctattt

SEQ ID NO: 6638364 - DNA, 17 bp, Homo sapiens
agctcttctatttaaaa

SEQ ID NO: 6638365 - DNA, 21 bp, Homo sapiens
agctcttctatttaaaaaata

SEQ ID NO: 6638366 - DNA, 17 bp, Homo sapiens
agctcttctcagtgtct

SEQ ID NO: 6638367 - DNA, 14 bp, Homo sapiens
agctcttctcttcc

SEQ ID NO: 6638368 - DNA, 16 bp, Homo sapiens
agctcttctcttccta

SEQ ID NO: 6638369 - DNA, 20 bp, Homo sapiens
agctcttctgccggccctgg

SEQ ID NO: 6638370 - DNA, 21 bp, Homo sapiens
agctcttctgccggccctggg

SEQ ID NO: 6638371 - DNA, 16 bp, Homo sapiens
agctcttctgggcaga

SEQ ID NO: 6638372 - DNA, 17 bp, Homo sapiens
agctcttctgggcagag

SEQ ID NO: 6638373 - DNA, 20 bp, Homo sapiens
agctcttctgggcagagcct

SEQ ID NO: 6638374 - DNA, 16 bp, Homo sapiens
agctcttcttgtgaaa

SEQ ID NO: 6638375 - DNA, 23 bp, Homo sapiens
agctcttcttgtgaaatgtctgt

SEQ ID NO: 6638376 - DNA, 12 bp, Homo sapiens
agctcttgccct

SEQ ID NO: 6638377 - DNA, 21 bp, Homo sapiens
agctcttgcccttccctgtcc

SEQ ID NO: 6638378 - DNA, 21 bp, Homo sapiens
agctcttgctaatcagtgtct

SEQ ID NO: 6638379 - DNA, 13 bp, Homo sapiens
agctcttgctatc

SEQ ID NO: 6638380 - DNA, 14 bp, Homo sapiens
agctcttgctctct

SEQ ID NO: 6638381 - DNA, 18 bp, Homo sapiens
agctcttgctctcttgtg

SEQ ID NO: 6638382 - DNA, 14 bp, Homo sapiens
agctcttggccttt

SEQ ID NO: 6638383 - DNA, 18 bp, Homo sapiens
agctcttggcctttgcat

SEQ ID NO: 6638384 - DNA, 23 bp, Homo sapiens
agctcttggcctttgcatttatt

SEQ ID NO: 6638385 - DNA, 17 bp, Homo sapiens
agctcttgggcctgacc

SEQ ID NO: 6638386 - DNA, 24 bp, Homo sapiens
agctcttgggcctgacctccagtc

SEQ ID NO: 6638387 - DNA, 15 bp, Homo sapiens
agctcttgggtcaga

SEQ ID NO: 6638388 - DNA, 20 bp, Homo sapiens
agctcttgggtcagagaaaa

SEQ ID NO: 6638389 - DNA, 23 bp, Homo sapiens
agctcttgtcctcagtccattta

SEQ ID NO: 6638390 - DNA, 12 bp, Homo sapiens
agctcttgtgag

SEQ ID NO: 6638391 - DNA, 21 bp, Homo sapiens
agctcttgtgttcagaagaat

SEQ ID NO: 6638392 - DNA, 13 bp, Homo sapiens
agctcttgtttct

SEQ ID NO: 6638393 - DNA, 12 bp, Homo sapiens
agctcttgtttg

SEQ ID NO: 6638394 - DNA, 13 bp, Homo sapiens
agctctttccaaa

SEQ ID NO: 6638395 - DNA, 17 bp, Homo sapiens
agctctttccaaattaa

SEQ ID NO: 6638396 - DNA, 22 bp, Homo sapiens
agctctttggcagtctatatgt

SEQ ID NO: 6638397 - DNA, 14 bp, Homo sapiens
agctctttggtcta

SEQ ID NO: 6638398 - DNA, 15 bp, Homo sapiens
agctctttgtcaggg

SEQ ID NO: 6638399 - DNA, 19 bp, Homo sapiens
agctcttttctcctgcaga

SEQ ID NO: 6638400 - DNA, 21 bp, Homo sapiens
agctcttttttagctctctta

SEQ ID NO: 6638401 - DNA, 14 bp, Homo sapiens
agctgaaaaaacta

SEQ ID NO: 6638402 - DNA, 21 bp, Homo sapiens
agctgaaaaatcacatcctgg

SEQ ID NO: 6638403 - DNA, 22 bp, Homo sapiens
agctgaaaaatcacatcctggc

SEQ ID NO: 6638404 - DNA, 23 bp, Homo sapiens
agctgaaaaatcacatcctggcc

SEQ ID NO: 6638405 - DNA, 14 bp, Homo sapiens
agctgaaaactaat

SEQ ID NO: 6638406 - DNA, 20 bp, Homo sapiens
agctgaaaactaatgtactg

SEQ ID NO: 6638407 - DNA, 13 bp, Homo sapiens
agctgaaaagcat

SEQ ID NO: 6638408 - DNA, 22 bp, Homo sapiens
agctgaaaaggatcgaggcatg

SEQ ID NO: 6638409 - DNA, 19 bp, Homo sapiens
agctgaaaagggcactccc

SEQ ID NO: 6638410 - DNA, 22 bp, Homo sapiens
agctgaaaagggcactcccaac

SEQ ID NO: 6638411 - DNA, 18 bp, Homo sapiens
agctgaaaatagcacggg

SEQ ID NO: 6638412 - DNA, 15 bp, Homo sapiens
agctgaaacaaaaat

SEQ ID NO: 6638413 - DNA, 14 bp, Homo sapiens
agctgaaagagtat

SEQ ID NO: 6638414 - DNA, 20 bp, Homo sapiens
agctgaaagggaaggacagc

SEQ ID NO: 6638415 - DNA, 18 bp, Homo sapiens
agctgaaagggagcccct

SEQ ID NO: 6638416 - DNA, 20 bp, Homo sapiens
agctgaaatgctgcatttta

SEQ ID NO: 6638417 - DNA, 17 bp, Homo sapiens
agctgaaattccagttt

SEQ ID NO: 6638418 - DNA, 23 bp, Homo sapiens
agctgaacaataggctgttccca

SEQ ID NO: 6638419 - DNA, 16 bp, Homo sapiens
agctgaacaatgaatg

SEQ ID NO: 6638420 - DNA, 14 bp, Homo sapiens
agctgaaccaaagc

SEQ ID NO: 6638421 - DNA, 15 bp, Homo sapiens
agctgaaccacagaa

SEQ ID NO: 6638422 - DNA, 15 bp, Homo sapiens
agctgaacctgttca

SEQ ID NO: 6638423 - DNA, 12 bp, Homo sapiens
agctgaagaaaa

SEQ ID NO: 6638424 - DNA, 15 bp, Homo sapiens
agctgaagaaaaaat

SEQ ID NO: 6638425 - DNA, 12 bp, Homo sapiens
agctgaagaaat

SEQ ID NO: 6638426 - DNA, 16 bp, Homo sapiens
agctgaagaaattata

SEQ ID NO: 6638427 - DNA, 23 bp, Homo sapiens
agctgaagaaattatacgtacat

SEQ ID NO: 6638428 - DNA, 15 bp, Homo sapiens
agctgaagagcaagg

SEQ ID NO: 6638429 - DNA, 22 bp, Homo sapiens
agctgaagaggttgaagctaaa

SEQ ID NO: 6638430 - DNA, 23 bp, Homo sapiens
agctgaagagtgaggatatgagt

SEQ ID NO: 6638431 - DNA, 19 bp, Homo sapiens
agctgaagagttgccccgt

SEQ ID NO: 6638432 - DNA, 21 bp, Homo sapiens
agctgaagattaggcacacag

SEQ ID NO: 6638433 - DNA, 16 bp, Homo sapiens
agctgaagattttgga

SEQ ID NO: 6638434 - DNA, 12 bp, Homo sapiens
agctgaagccag

SEQ ID NO: 6638435 - DNA, 19 bp, Homo sapiens
agctgaagccgccaggacc

SEQ ID NO: 6638436 - DNA, 12 bp, Homo sapiens
agctgaagcctg

SEQ ID NO: 6638437 - DNA, 13 bp, Homo sapiens
agctgaagcctgg

SEQ ID NO: 6638438 - DNA, 15 bp, Homo sapiens
agctgaaggctgagg

SEQ ID NO: 6638439 - DNA, 17 bp, Homo sapiens
agctgaagtgaaggaga

SEQ ID NO: 6638440 - DNA, 19 bp, Homo sapiens
agctgaatgagtctgcttt

SEQ ID NO: 6638441 - DNA, 20 bp, Homo sapiens
agctgaatgcctcctgtggg

SEQ ID NO: 6638442 - DNA, 21 bp, Homo sapiens
agctgaatgcctcctgtgggg

SEQ ID NO: 6638443 - DNA, 22 bp, Homo sapiens
agctgaatgcctcctgtgggga

SEQ ID NO: 6638444 - DNA, 23 bp, Homo sapiens
agctgaatgtcaaacagtgccaa

SEQ ID NO: 6638445 - DNA, 17 bp, Homo sapiens
agctgaatgttcttgaa

SEQ ID NO: 6638446 - DNA, 11 bp, Homo sapiens
agctgaattca

SEQ ID NO: 6638447 - DNA, 19 bp, Homo sapiens
agctgaattcacttaagtt

SEQ ID NO: 6638448 - DNA, 18 bp, Homo sapiens
agctgaattttctggaaa

SEQ ID NO: 6638449 - DNA, 16 bp, Homo sapiens
agctgacaaaatactt

SEQ ID NO: 6638450 - DNA, 16 bp, Homo sapiens
agctgacaaaattttg

SEQ ID NO: 6638451 - DNA, 14 bp, Homo sapiens
agctgacacaaacc

SEQ ID NO: 6638452 - DNA, 21 bp, Homo sapiens
agctgacacaaacctgcctgg

SEQ ID NO: 6638453 - DNA, 15 bp, Homo sapiens
agctgacagagccag

SEQ ID NO: 6638454 - DNA, 16 bp, Homo sapiens
agctgacagagccaga

SEQ ID NO: 6638455 - DNA, 19 bp, Homo sapiens
agctgacagagccagaggc

SEQ ID NO: 6638456 - DNA, 14 bp, Homo sapiens
agctgacagataca

SEQ ID NO: 6638457 - DNA, 15 bp, Homo sapiens
agctgacagccacac

SEQ ID NO: 6638458 - DNA, 17 bp, Homo sapiens
agctgacagccacaccg

SEQ ID NO: 6638459 - DNA, 14 bp, Homo sapiens
agctgacagtcagc

SEQ ID NO: 6638460 - DNA, 18 bp, Homo sapiens
agctgacattgccaaaaa

SEQ ID NO: 6638461 - DNA, 17 bp, Homo sapiens
agctgaccagaagtggc

SEQ ID NO: 6638462 - DNA, 16 bp, Homo sapiens
agctgaccagccgtga

SEQ ID NO: 6638463 - DNA, 23 bp, Homo sapiens
agctgacccagccccttgagaaa

SEQ ID NO: 6638464 - DNA, 16 bp, Homo sapiens
agctgaccccctcccc

SEQ ID NO: 6638465 - DNA, 17 bp, Homo sapiens
agctgacccggcctctc

SEQ ID NO: 6638466 - DNA, 22 bp, Homo sapiens
agctgacccggcctctctgccc

SEQ ID NO: 6638467 - DNA, 22 bp, Homo sapiens
agctgacctctgttgtcctccc

SEQ ID NO: 6638468 - DNA, 18 bp, Homo sapiens
agctgacgaggctgggcc

SEQ ID NO: 6638469 - DNA, 19 bp, Homo sapiens
agctgacgggaggccccag

SEQ ID NO: 6638470 - DNA, 22 bp, Homo sapiens
agctgacgggaggccccagctc

SEQ ID NO: 6638471 - DNA, 23 bp, Homo sapiens
agctgactaaactttttttctgt

SEQ ID NO: 6638472 - DNA, 19 bp, Homo sapiens
agctgactagatctctgga

SEQ ID NO: 6638473 - DNA, 22 bp, Homo sapiens
agctgactccagtataatctcc

SEQ ID NO: 6638474 - DNA, 18 bp, Homo sapiens
agctgactggccccaggg

SEQ ID NO: 6638475 - DNA, 11 bp, Homo sapiens
agctgactgtg

SEQ ID NO: 6638476 - DNA, 18 bp, Homo sapiens
agctgactgtggccccct

SEQ ID NO: 6638477 - DNA, 16 bp, Homo sapiens
agctgactgttggctc

SEQ ID NO: 6638478 - DNA, 20 bp, Homo sapiens
agctgacttggcacttaagt

SEQ ID NO: 6638479 - DNA, 23 bp, Homo sapiens
agctgacttggcacttaagtgca

SEQ ID NO: 6638480 - DNA, 14 bp, Homo sapiens
agctgacttggctg

SEQ ID NO: 6638481 - DNA, 18 bp, Homo sapiens
agctgacttggctggtgt

SEQ ID NO: 6638482 - DNA, 19 bp, Homo sapiens
agctgactttcaaagtgga

SEQ ID NO: 6638483 - DNA, 15 bp, Homo sapiens
agctgacttttctgt

SEQ ID NO: 6638484 - DNA, 18 bp, Homo sapiens
agctgagaactcctgact

SEQ ID NO: 6638485 - DNA, 19 bp, Homo sapiens
agctgagaactcctgactg

SEQ ID NO: 6638486 - DNA, 21 bp, Homo sapiens
agctgagaagactcaagtccc

SEQ ID NO: 6638487 - DNA, 17 bp, Homo sapiens
agctgagaagaggagga

SEQ ID NO: 6638488 - DNA, 20 bp, Homo sapiens
agctgagaagaggaggaggt

SEQ ID NO: 6638489 - DNA, 20 bp, Homo sapiens
agctgagaaggccagccctc

SEQ ID NO: 6638490 - DNA, 16 bp, Homo sapiens
agctgagaatagaagg

SEQ ID NO: 6638491 - DNA, 23 bp, Homo sapiens
agctgagaatagaaggaaactag

SEQ ID NO: 6638492 - DNA, 11 bp, Homo sapiens
agctgagacca

SEQ ID NO: 6638493 - DNA, 19 bp, Homo sapiens
agctgagacccttatttaa

SEQ ID NO: 6638494 - DNA, 15 bp, Homo sapiens
agctgagaccggtgg

SEQ ID NO: 6638495 - DNA, 19 bp, Homo sapiens
agctgagactacaagtgtg

SEQ ID NO: 6638496 - DNA, 16 bp, Homo sapiens
agctgagactacaggt

SEQ ID NO: 6638497 - DNA, 14 bp, Homo sapiens
agctgagagacttt

SEQ ID NO: 6638498 - DNA, 15 bp, Homo sapiens
agctgagagactttt

SEQ ID NO: 6638499 - DNA, 16 bp, Homo sapiens
agctgagagccctgct

SEQ ID NO: 6638500 - DNA, 18 bp, Homo sapiens
agctgagagccctgctgt

SEQ ID NO: 6638501 - DNA, 21 bp, Homo sapiens
agctgagatcgtgccactgca

SEQ ID NO: 6638502 - DNA, 20 bp, Homo sapiens
agctgagatgaaccctggca

SEQ ID NO: 6638503 - DNA, 16 bp, Homo sapiens
agctgagatgagcccc

SEQ ID NO: 6638504 - DNA, 15 bp, Homo sapiens
agctgagatgtggac

SEQ ID NO: 6638505 - DNA, 23 bp, Homo sapiens
agctgagattataggcacctacc

SEQ ID NO: 6638506 - DNA, 16 bp, Homo sapiens
agctgagcaaatcacc

SEQ ID NO: 6638507 - DNA, 18 bp, Homo sapiens
agctgagcaacctcttca

SEQ ID NO: 6638508 - DNA, 20 bp, Homo sapiens
agctgagcaacctcttcagc

SEQ ID NO: 6638509 - DNA, 18 bp, Homo sapiens
agctgagcagcctctgga

SEQ ID NO: 6638510 - DNA, 15 bp, Homo sapiens
agctgagcaggacag

SEQ ID NO: 6638511 - DNA, 19 bp, Homo sapiens
agctgagcaggacagccag

SEQ ID NO: 6638512 - DNA, 13 bp, Homo sapiens
agctgagcaggcc

SEQ ID NO: 6638513 - DNA, 16 bp, Homo sapiens
agctgagcatggagac

SEQ ID NO: 6638514 - DNA, 10 bp, Homo sapiens
agctgagccc

SEQ ID NO: 6638515 - DNA, 14 bp, Homo sapiens
agctgagccctggg

SEQ ID NO: 6638516 - DNA, 16 bp, Homo sapiens
agctgagcctgcaggg

SEQ ID NO: 6638517 - DNA, 15 bp, Homo sapiens
agctgagccttctga

SEQ ID NO: 6638518 - DNA, 12 bp, Homo sapiens
agctgagcgcca

SEQ ID NO: 6638519 - DNA, 15 bp, Homo sapiens
agctgagcgccagga

SEQ ID NO: 6638520 - DNA, 13 bp, Homo sapiens
agctgagctggcc

SEQ ID NO: 6638521 - DNA, 13 bp, Homo sapiens
agctgagctggct

SEQ ID NO: 6638522 - DNA, 23 bp, Homo sapiens
agctgagcttcggttctccagaa

SEQ ID NO: 6638523 - DNA, 17 bp, Homo sapiens
agctgagcttgagctcc

SEQ ID NO: 6638524 - DNA, 18 bp, Homo sapiens
agctgagcttgagctccc

SEQ ID NO: 6638525 - DNA, 17 bp, Homo sapiens
agctgaggaacaggttc

SEQ ID NO: 6638526 - DNA, 20 bp, Homo sapiens
agctgaggacacaccccaca

SEQ ID NO: 6638527 - DNA, 16 bp, Homo sapiens
agctgaggatgacaga

SEQ ID NO: 6638528 - DNA, 17 bp, Homo sapiens
agctgaggcaattctaa

SEQ ID NO: 6638529 - DNA, 15 bp, Homo sapiens
agctgaggcagcagt

SEQ ID NO: 6638530 - DNA, 12 bp, Homo sapiens
agctgaggcagg

SEQ ID NO: 6638531 - DNA, 13 bp, Homo sapiens
agctgaggccaca

SEQ ID NO: 6638532 - DNA, 17 bp, Homo sapiens
agctgaggccacactca

SEQ ID NO: 6638533 - DNA, 11 bp, Homo sapiens
agctgaggccc

SEQ ID NO: 6638534 - DNA, 21 bp, Homo sapiens
agctgaggcccatggccacat

SEQ ID NO: 6638535 - DNA, 14 bp, Homo sapiens
agctgaggccccag

SEQ ID NO: 6638536 - DNA, 16 bp, Homo sapiens
agctgaggcctatgca

SEQ ID NO: 6638537 - DNA, 20 bp, Homo sapiens
agctgaggcctatgcagaca

SEQ ID NO: 6638538 - DNA, 12 bp, Homo sapiens
agctgaggcctc

SEQ ID NO: 6638539 - DNA, 13 bp, Homo sapiens
agctgaggcctcc

SEQ ID NO: 6638540 - DNA, 14 bp, Homo sapiens
agctgaggcctccc

SEQ ID NO: 6638541 - DNA, 16 bp, Homo sapiens
agctgaggcctccctt

SEQ ID NO: 6638542 - DNA, 19 bp, Homo sapiens
agctgaggctgagaaagct

SEQ ID NO: 6638543 - DNA, 15 bp, Homo sapiens
agctgagggccctgt

SEQ ID NO: 6638544 - DNA, 21 bp, Homo sapiens
agctgagggccctgtggagtc

SEQ ID NO: 6638545 - DNA, 24 bp, Homo sapiens
agctgagggccctgtggagtccag

SEQ ID NO: 6638546 - DNA, 14 bp, Homo sapiens
agctgaggggacgg

SEQ ID NO: 6638547 - DNA, 18 bp, Homo sapiens
agctgaggtctcttgagg

SEQ ID NO: 6638548 - DNA, 21 bp, Homo sapiens
agctgaggtctcttgagggag

SEQ ID NO: 6638549 - DNA, 12 bp, Homo sapiens
agctgaggtgcc

SEQ ID NO: 6638550 - DNA, 15 bp, Homo sapiens
agctgaggtgcccag

SEQ ID NO: 6638551 - DNA, 18 bp, Homo sapiens
agctgaggtgcccaggag

SEQ ID NO: 6638552 - DNA, 14 bp, Homo sapiens
agctgagtcacctc

SEQ ID NO: 6638553 - DNA, 23 bp, Homo sapiens
agctgagtcctggggttggggag

SEQ ID NO: 6638554 - DNA, 19 bp, Homo sapiens
agctgagtcggctgggcag

SEQ ID NO: 6638555 - DNA, 20 bp, Homo sapiens
agctgagtcggctgggcagg

SEQ ID NO: 6638556 - DNA, 12 bp, Homo sapiens
agctgagtctga

SEQ ID NO: 6638557 - DNA, 23 bp, Homo sapiens
agctgagtgactgtaggcaggga

SEQ ID NO: 6638558 - DNA, 18 bp, Homo sapiens
agctgagtgagagggttt

SEQ ID NO: 6638559 - DNA, 15 bp, Homo sapiens
agctgagtgagctga

SEQ ID NO: 6638560 - DNA, 16 bp, Homo sapiens
agctgagttatgatgt

SEQ ID NO: 6638561 - DNA, 19 bp, Homo sapiens
agctgataaagaaaccttt

SEQ ID NO: 6638562 - DNA, 22 bp, Homo sapiens
agctgataaccgtccttcatca

SEQ ID NO: 6638563 - DNA, 15 bp, Homo sapiens
agctgatagtgtttc

SEQ ID NO: 6638564 - DNA, 23 bp, Homo sapiens
agctgatattatttcttctctta

SEQ ID NO: 6638565 - DNA, 15 bp, Homo sapiens
agctgatccagagca

SEQ ID NO: 6638566 - DNA, 19 bp, Homo sapiens
agctgatccagagcacaga

SEQ ID NO: 6638567 - DNA, 23 bp, Homo sapiens
agctgatccagtaacctcggaga

SEQ ID NO: 6638568 - DNA, 22 bp, Homo sapiens
agctgatccagtttccggaaac

SEQ ID NO: 6638569 - DNA, 15 bp, Homo sapiens
agctgatccatagga

SEQ ID NO: 6638570 - DNA, 21 bp, Homo sapiens
agctgatccttcaactctgtg

SEQ ID NO: 6638571 - DNA, 13 bp, Homo sapiens
agctgatgaaact

SEQ ID NO: 6638572 - DNA, 22 bp, Homo sapiens
agctgatgaaactcacaaatga

SEQ ID NO: 6638573 - DNA, 22 bp, Homo sapiens
agctgatgaaactcctgatttt

SEQ ID NO: 6638574 - DNA, 11 bp, Homo sapiens
agctgatgact

SEQ ID NO: 6638575 - DNA, 21 bp, Homo sapiens
agctgatgatgtctcttgtag

SEQ ID NO: 6638576 - DNA, 16 bp, Homo sapiens
agctgatggagaagga

SEQ ID NO: 6638577 - DNA, 16 bp, Homo sapiens
agctgatggcagctgg

SEQ ID NO: 6638578 - DNA, 22 bp, Homo sapiens
agctgatgtgagtgtgtgtgat

SEQ ID NO: 6638579 - DNA, 17 bp, Homo sapiens
agctgatgttggaagag

SEQ ID NO: 6638580 - DNA, 20 bp, Homo sapiens
agctgatgttggaagagaaa

SEQ ID NO: 6638581 - DNA, 18 bp, Homo sapiens
agctgattactgtcaata

SEQ ID NO: 6638582 - DNA, 14 bp, Homo sapiens
agctgattagtgtc

SEQ ID NO: 6638583 - DNA, 14 bp, Homo sapiens
agctgatttccagg

SEQ ID NO: 6638584 - DNA, 18 bp, Homo sapiens
agctgatttccctttttt

SEQ ID NO: 6638585 - DNA, 22 bp, Homo sapiens
agctgatttcccttttttcttc

SEQ ID NO: 6638586 - DNA, 14 bp, Homo sapiens
agctgatttgtata

SEQ ID NO: 6638587 - DNA, 15 bp, Homo sapiens
agctgattttattca

SEQ ID NO: 6638588 - DNA, 21 bp, Homo sapiens
agctgattttgagggttttta

SEQ ID NO: 6638589 - DNA, 19 bp, Homo sapiens
agctgattttgtcactgtc

SEQ ID NO: 6638590 - DNA, 16 bp, Homo sapiens
agctgcaaaaataatc

SEQ ID NO: 6638591 - DNA, 21 bp, Homo sapiens
agctgcaaaaggcctgtgatc

SEQ ID NO: 6638592 - DNA, 14 bp, Homo sapiens
agctgcaaaggaca

SEQ ID NO: 6638593 - DNA, 16 bp, Homo sapiens
agctgcaaaggacaga

SEQ ID NO: 6638594 - DNA, 11 bp, Homo sapiens
agctgcaaagt

SEQ ID NO: 6638595 - DNA, 14 bp, Homo sapiens
agctgcaaagtgtt

SEQ ID NO: 6638596 - DNA, 19 bp, Homo sapiens
agctgcaaagtgttttgta

SEQ ID NO: 6638597 - DNA, 20 bp, Homo sapiens
agctgcaaagtgttttgtac

SEQ ID NO: 6638598 - DNA, 21 bp, Homo sapiens
agctgcaaggtactctggtga

SEQ ID NO: 6638599 - DNA, 15 bp, Homo sapiens
agctgcaagtgacat

SEQ ID NO: 6638600 - DNA, 21 bp, Homo sapiens
agctgcaagtgacatctcttt

SEQ ID NO: 6638601 - DNA, 17 bp, Homo sapiens
agctgcaattccctgga

SEQ ID NO: 6638602 - DNA, 15 bp, Homo sapiens
agctgcacaatttaa

SEQ ID NO: 6638603 - DNA, 23 bp, Homo sapiens
agctgcacacacctgggtggaca

SEQ ID NO: 6638604 - DNA, 21 bp, Homo sapiens
agctgcacatgtgccacacag

SEQ ID NO: 6638605 - DNA, 22 bp, Homo sapiens
agctgcacattcctggccccgg

SEQ ID NO: 6638606 - DNA, 16 bp, Homo sapiens
agctgcaccagagcaa

SEQ ID NO: 6638607 - DNA, 23 bp, Homo sapiens
agctgcaccagagcaacctctca

SEQ ID NO: 6638608 - DNA, 17 bp, Homo sapiens
agctgcaccatcacaca

SEQ ID NO: 6638609 - DNA, 22 bp, Homo sapiens
agctgcaccccagcgtcaggcc

SEQ ID NO: 6638610 - DNA, 13 bp, Homo sapiens
agctgcaccctca

SEQ ID NO: 6638611 - DNA, 18 bp, Homo sapiens
agctgcaccctcaggcag

SEQ ID NO: 6638612 - DNA, 12 bp, Homo sapiens
agctgcacggca

SEQ ID NO: 6638613 - DNA, 20 bp, Homo sapiens
agctgcactgatgctgcccc

SEQ ID NO: 6638614 - DNA, 13 bp, Homo sapiens
agctgcactgtga

SEQ ID NO: 6638615 - DNA, 23 bp, Homo sapiens
agctgcactgtttatggaaatac

SEQ ID NO: 6638616 - DNA, 18 bp, Homo sapiens
agctgcacttggcctcag

SEQ ID NO: 6638617 - DNA, 13 bp, Homo sapiens
agctgcactttaa

SEQ ID NO: 6638618 - DNA, 19 bp, Homo sapiens
agctgcactttaaccctag

SEQ ID NO: 6638619 - DNA, 21 bp, Homo sapiens
agctgcagaaacgaagccatc

SEQ ID NO: 6638620 - DNA, 19 bp, Homo sapiens
agctgcagaaccagtccct

SEQ ID NO: 6638621 - DNA, 17 bp, Homo sapiens
agctgcagagacagaga

SEQ ID NO: 6638622 - DNA, 20 bp, Homo sapiens
agctgcagagagcacctggt

SEQ ID NO: 6638623 - DNA, 19 bp, Homo sapiens
agctgcagagatttctcat

SEQ ID NO: 6638624 - DNA, 16 bp, Homo sapiens
agctgcagagccaccc

SEQ ID NO: 6638625 - DNA, 22 bp, Homo sapiens
agctgcagaggccacctggatt

SEQ ID NO: 6638626 - DNA, 14 bp, Homo sapiens
agctgcagccagtc

SEQ ID NO: 6638627 - DNA, 16 bp, Homo sapiens
agctgcagccagtcag

SEQ ID NO: 6638628 - DNA, 24 bp, Homo sapiens
agctgcagccccttgctctcagct

SEQ ID NO: 6638629 - DNA, 11 bp, Homo sapiens
agctgcagcct

SEQ ID NO: 6638630 - DNA, 21 bp, Homo sapiens
agctgcagcctggctggtcct

SEQ ID NO: 6638631 - DNA, 13 bp, Homo sapiens
agctgcagccttc

SEQ ID NO: 6638632 - DNA, 22 bp, Homo sapiens
agctgcagccttcatcagaact

SEQ ID NO: 6638633 - DNA, 21 bp, Homo sapiens
agctgcagcgcctcctggaca

SEQ ID NO: 6638634 - DNA, 19 bp, Homo sapiens
agctgcagctgggccccat

SEQ ID NO: 6638635 - DNA, 22 bp, Homo sapiens
agctgcagctgggccccatgct

SEQ ID NO: 6638636 - DNA, 16 bp, Homo sapiens
agctgcagcttcctgt

SEQ ID NO: 6638637 - DNA, 17 bp, Homo sapiens
agctgcagcttcctgtc

SEQ ID NO: 6638638 - DNA, 23 bp, Homo sapiens
agctgcaggaatcaaaaattgaa

SEQ ID NO: 6638639 - DNA, 21 bp, Homo sapiens
agctgcaggaatcacccctct

SEQ ID NO: 6638640 - DNA, 15 bp, Homo sapiens
agctgcagggcacgg

SEQ ID NO: 6638641 - DNA, 20 bp, Homo sapiens
agctgcagggcacggggacc

SEQ ID NO: 6638642 - DNA, 13 bp, Homo sapiens
agctgcaggggca

SEQ ID NO: 6638643 - DNA, 14 bp, Homo sapiens
agctgcaggggcag

SEQ ID NO: 6638644 - DNA, 14 bp, Homo sapiens
agctgcaggggcat

SEQ ID NO: 6638645 - DNA, 15 bp, Homo sapiens
agctgcaggtgccag

SEQ ID NO: 6638646 - DNA, 22 bp, Homo sapiens
agctgcaggtgccagggcccac

SEQ ID NO: 6638647 - DNA, 21 bp, Homo sapiens
agctgcagttcttgtggaaga

SEQ ID NO: 6638648 - DNA, 15 bp, Homo sapiens
agctgcataatgtcc

SEQ ID NO: 6638649 - DNA, 18 bp, Homo sapiens
agctgcatacagtttgca

SEQ ID NO: 6638650 - DNA, 18 bp, Homo sapiens
agctgcatcctccaagaa

SEQ ID NO: 6638651 - DNA, 15 bp, Homo sapiens
agctgcatctgtctg

SEQ ID NO: 6638652 - DNA, 16 bp, Homo sapiens
agctgcatggacgcct

SEQ ID NO: 6638653 - DNA, 22 bp, Homo sapiens
agctgcatggacgcctggctcc

SEQ ID NO: 6638654 - DNA, 18 bp, Homo sapiens
agctgcattccgcagccc

SEQ ID NO: 6638655 - DNA, 20 bp, Homo sapiens
agctgcatttcacatgcctt

SEQ ID NO: 6638656 - DNA, 23 bp, Homo sapiens
agctgcatttcacatgccttgca

SEQ ID NO: 6638657 - DNA, 17 bp, Homo sapiens
agctgccaaaatcgtag

SEQ ID NO: 6638658 - DNA, 18 bp, Homo sapiens
agctgccaaccctcccgg

SEQ ID NO: 6638659 - DNA, 15 bp, Homo sapiens
agctgccaagtaaat

SEQ ID NO: 6638660 - DNA, 20 bp, Homo sapiens
agctgccaagtgctctttgt

SEQ ID NO: 6638661 - DNA, 18 bp, Homo sapiens
agctgccacccctcttct

SEQ ID NO: 6638662 - DNA, 10 bp, Homo sapiens
agctgccact

SEQ ID NO: 6638663 - DNA, 14 bp, Homo sapiens
agctgccactgggc

SEQ ID NO: 6638664 - DNA, 16 bp, Homo sapiens
agctgccactgggcac

SEQ ID NO: 6638665 - DNA, 19 bp, Homo sapiens
agctgccactgggcacctg

SEQ ID NO: 6638666 - DNA, 20 bp, Homo sapiens
agctgccactgggcacctgc

SEQ ID NO: 6638667 - DNA, 23 bp, Homo sapiens
agctgccactgggcacctgcgca

SEQ ID NO: 6638668 - DNA, 13 bp, Homo sapiens
agctgccagagaa

SEQ ID NO: 6638669 - DNA, 12 bp, Homo sapiens
agctgccagagc

SEQ ID NO: 6638670 - DNA, 12 bp, Homo sapiens
agctgccagccc

SEQ ID NO: 6638671 - DNA, 14 bp, Homo sapiens
agctgccagcccag

SEQ ID NO: 6638672 - DNA, 19 bp, Homo sapiens
agctgccagcccagaacac

SEQ ID NO: 6638673 - DNA, 20 bp, Homo sapiens
agctgccagcccagaacacc

SEQ ID NO: 6638674 - DNA, 20 bp, Homo sapiens
agctgccagccgagatagcc

SEQ ID NO: 6638675 - DNA, 12 bp, Homo sapiens
agctgccaggcg

SEQ ID NO: 6638676 - DNA, 19 bp, Homo sapiens
agctgccaggcggccctgg

SEQ ID NO: 6638677 - DNA, 23 bp, Homo sapiens
agctgccaggcggccctggggag

SEQ ID NO: 6638678 - DNA, 19 bp, Homo sapiens
agctgccagggaagacaga

SEQ ID NO: 6638679 - DNA, 21 bp, Homo sapiens
agctgccagggaagacagagc

SEQ ID NO: 6638680 - DNA, 11 bp, Homo sapiens
agctgccagtg

SEQ ID NO: 6638681 - DNA, 13 bp, Homo sapiens
agctgccagtgct

SEQ ID NO: 6638682 - DNA, 15 bp, Homo sapiens
agctgccagtgctgg

SEQ ID NO: 6638683 - DNA, 23 bp, Homo sapiens
agctgccagtgtgttactcatct

SEQ ID NO: 6638684 - DNA, 22 bp, Homo sapiens
agctgccatccttgctgcagct

SEQ ID NO: 6638685 - DNA, 19 bp, Homo sapiens
agctgccatcgctgtgatg

SEQ ID NO: 6638686 - DNA, 15 bp, Homo sapiens
agctgccatggctag

SEQ ID NO: 6638687 - DNA, 21 bp, Homo sapiens
agctgcccaatttcacagagt

SEQ ID NO: 6638688 - DNA, 22 bp, Homo sapiens
agctgcccaatttcacagagta

SEQ ID NO: 6638689 - DNA, 23 bp, Homo sapiens
agctgcccacaagccataaacca

SEQ ID NO: 6638690 - DNA, 17 bp, Homo sapiens
agctgcccacagcaggc

SEQ ID NO: 6638691 - DNA, 24 bp, Homo sapiens
agctgcccactgtttctcttgagc

SEQ ID NO: 6638692 - DNA, 13 bp, Homo sapiens
agctgcccagaca

SEQ ID NO: 6638693 - DNA, 15 bp, Homo sapiens
agctgccccagccag

SEQ ID NO: 6638694 - DNA, 16 bp, Homo sapiens
agctgcccccagagcc

SEQ ID NO: 6638695 - DNA, 17 bp, Homo sapiens
agctgcccccagagcca

SEQ ID NO: 6638696 - DNA, 21 bp, Homo sapiens
agctgcccccagagccacagt

SEQ ID NO: 6638697 - DNA, 17 bp, Homo sapiens
agctgcccctccctcag

SEQ ID NO: 6638698 - DNA, 16 bp, Homo sapiens
agctgcccctccctgc

SEQ ID NO: 6638699 - DNA, 16 bp, Homo sapiens
agctgcccctcctgga

SEQ ID NO: 6638700 - DNA, 14 bp, Homo sapiens
agctgcccctctct

SEQ ID NO: 6638701 - DNA, 15 bp, Homo sapiens
agctgcccctctctg

SEQ ID NO: 6638702 - DNA, 13 bp, Homo sapiens
agctgcccctgct

SEQ ID NO: 6638703 - DNA, 18 bp, Homo sapiens
agctgcccctgctgctta

SEQ ID NO: 6638704 - DNA, 16 bp, Homo sapiens
agctgccctaaataac

SEQ ID NO: 6638705 - DNA, 22 bp, Homo sapiens
agctgccctaaataacccttca

SEQ ID NO: 6638706 - DNA, 14 bp, Homo sapiens
agctgccctagctg

SEQ ID NO: 6638707 - DNA, 16 bp, Homo sapiens
agctgccctagctgac

SEQ ID NO: 6638708 - DNA, 17 bp, Homo sapiens
agctgccctatgggcct

SEQ ID NO: 6638709 - DNA, 11 bp, Homo sapiens
agctgccctcc

SEQ ID NO: 6638710 - DNA, 23 bp, Homo sapiens
agctgccctcccctccggactgg

SEQ ID NO: 6638711 - DNA, 14 bp, Homo sapiens
agctgccctctcct

SEQ ID NO: 6638712 - DNA, 17 bp, Homo sapiens
agctgccctctcctggg

SEQ ID NO: 6638713 - DNA, 22 bp, Homo sapiens
agctgccctctcctgggcagct

SEQ ID NO: 6638714 - DNA, 13 bp, Homo sapiens
agctgccctgagg

SEQ ID NO: 6638715 - DNA, 13 bp, Homo sapiens
agctgccctgctg

SEQ ID NO: 6638716 - DNA, 14 bp, Homo sapiens
agctgccctgctgc

SEQ ID NO: 6638717 - DNA, 20 bp, Homo sapiens
agctgccctgctgccacagc

SEQ ID NO: 6638718 - DNA, 15 bp, Homo sapiens
agctgcccttgcagg

SEQ ID NO: 6638719 - DNA, 16 bp, Homo sapiens
agctgcccttgcaggg

SEQ ID NO: 6638720 - DNA, 19 bp, Homo sapiens
agctgcccttgcagggtgg

SEQ ID NO: 6638721 - DNA, 13 bp, Homo sapiens
agctgccgaccag

SEQ ID NO: 6638722 - DNA, 17 bp, Homo sapiens
agctgccgaccagagcc

SEQ ID NO: 6638723 - DNA, 17 bp, Homo sapiens
agctgccgacttggaga

SEQ ID NO: 6638724 - DNA, 22 bp, Homo sapiens
agctgccgcaaggccctgtccc

SEQ ID NO: 6638725 - DNA, 17 bp, Homo sapiens
agctgccgcaccagccc

SEQ ID NO: 6638726 - DNA, 16 bp, Homo sapiens
agctgccggcagtgct

SEQ ID NO: 6638727 - DNA, 16 bp, Homo sapiens
agctgccggtcgccct

SEQ ID NO: 6638728 - DNA, 21 bp, Homo sapiens
agctgccgtagcttcagccag

SEQ ID NO: 6638729 - DNA, 22 bp, Homo sapiens
agctgccgtagcttcagccagg

SEQ ID NO: 6638730 - DNA, 23 bp, Homo sapiens
agctgccgtagcttcagccaggc

SEQ ID NO: 6638731 - DNA, 13 bp, Homo sapiens
agctgcctaagag

SEQ ID NO: 6638732 - DNA, 14 bp, Homo sapiens
agctgcctaagagg

SEQ ID NO: 6638733 - DNA, 15 bp, Homo sapiens
agctgcctagcaagc

SEQ ID NO: 6638734 - DNA, 21 bp, Homo sapiens
agctgcctaggtcccccaagc

SEQ ID NO: 6638735 - DNA, 22 bp, Homo sapiens
agctgcctatgcccagcctcca

SEQ ID NO: 6638736 - DNA, 13 bp, Homo sapiens
agctgcctcactt

SEQ ID NO: 6638737 - DNA, 19 bp, Homo sapiens
agctgcctccagcctggtg

SEQ ID NO: 6638738 - DNA, 18 bp, Homo sapiens
agctgcctccccaatcca

SEQ ID NO: 6638739 - DNA, 15 bp, Homo sapiens
agctgcctcccctcc

SEQ ID NO: 6638740 - DNA, 18 bp, Homo sapiens
agctgcctcccctcctct

SEQ ID NO: 6638741 - DNA, 20 bp, Homo sapiens
agctgcctcccctctccttc

SEQ ID NO: 6638742 - DNA, 23 bp, Homo sapiens
agctgcctcccctctccttcctg

SEQ ID NO: 6638743 - DNA, 18 bp, Homo sapiens
agctgcctccctgtccac

SEQ ID NO: 6638744 - DNA, 14 bp, Homo sapiens
agctgcctccgggc

SEQ ID NO: 6638745 - DNA, 15 bp, Homo sapiens
agctgcctccgggcc

SEQ ID NO: 6638746 - DNA, 16 bp, Homo sapiens
agctgcctccgggcct

SEQ ID NO: 6638747 - DNA, 20 bp, Homo sapiens
agctgcctccgggcctcggc

SEQ ID NO: 6638748 - DNA, 21 bp, Homo sapiens
agctgcctccgggcctcggcc

SEQ ID NO: 6638749 - DNA, 22 bp, Homo sapiens
agctgcctctgacagcagcctg

SEQ ID NO: 6638750 - DNA, 12 bp, Homo sapiens
agctgcctctgc

SEQ ID NO: 6638751 - DNA, 13 bp, Homo sapiens
agctgcctctgct

SEQ ID NO: 6638752 - DNA, 14 bp, Homo sapiens
agctgcctctgctc

SEQ ID NO: 6638753 - DNA, 18 bp, Homo sapiens
agctgcctctgctccctc

SEQ ID NO: 6638754 - DNA, 15 bp, Homo sapiens
agctgcctctgggcc

SEQ ID NO: 6638755 - DNA, 15 bp, Homo sapiens
agctgcctcttccct

SEQ ID NO: 6638756 - DNA, 19 bp, Homo sapiens
agctgcctcttccctcttc

SEQ ID NO: 6638757 - DNA, 17 bp, Homo sapiens
agctgcctcttctcttg

SEQ ID NO: 6638758 - DNA, 18 bp, Homo sapiens
agctgcctctttgctgct

SEQ ID NO: 6638759 - DNA, 22 bp, Homo sapiens
agctgcctctttgctgctttgt

SEQ ID NO: 6638760 - DNA, 22 bp, Homo sapiens
agctgcctgaaacagccatgtc

SEQ ID NO: 6638761 - DNA, 14 bp, Homo sapiens
agctgcctgctctg

SEQ ID NO: 6638762 - DNA, 19 bp, Homo sapiens
agctgcctgcttggcccgg

SEQ ID NO: 6638763 - DNA, 15 bp, Homo sapiens
agctgcctggacccg

SEQ ID NO: 6638764 - DNA, 14 bp, Homo sapiens
agctgcctggatga

SEQ ID NO: 6638765 - DNA, 17 bp, Homo sapiens
agctgcctggatgagaa

SEQ ID NO: 6638766 - DNA, 23 bp, Homo sapiens
agctgcctggccatgctgtccct

SEQ ID NO: 6638767 - DNA, 13 bp, Homo sapiens
agctgcctggcgg

SEQ ID NO: 6638768 - DNA, 11 bp, Homo sapiens
agctgcctggg

SEQ ID NO: 6638769 - DNA, 18 bp, Homo sapiens
agctgcctggggcccaag

SEQ ID NO: 6638770 - DNA, 19 bp, Homo sapiens
agctgcctggggcccaagt

SEQ ID NO: 6638771 - DNA, 19 bp, Homo sapiens
agctgcctgtagttaggaa

SEQ ID NO: 6638772 - DNA, 23 bp, Homo sapiens
agctgcctgtccctaccccatgg

SEQ ID NO: 6638773 - DNA, 14 bp, Homo sapiens
agctgcctgtgcct

SEQ ID NO: 6638774 - DNA, 17 bp, Homo sapiens
agctgcctgtgcctgcc

SEQ ID NO: 6638775 - DNA, 18 bp, Homo sapiens
agctgcctgtgcctgcca

SEQ ID NO: 6638776 - DNA, 20 bp, Homo sapiens
agctgcctgtgcctgccatg

SEQ ID NO: 6638777 - DNA, 24 bp, Homo sapiens
agctgcctgtgcctgccatgggcc

SEQ ID NO: 6638778 - DNA, 16 bp, Homo sapiens
agctgcctgttcagct

SEQ ID NO: 6638779 - DNA, 18 bp, Homo sapiens
agctgcctgttcagctcc

SEQ ID NO: 6638780 - DNA, 19 bp, Homo sapiens
agctgcctgttcagctcca

SEQ ID NO: 6638781 - DNA, 16 bp, Homo sapiens
agctgccttagcttca

SEQ ID NO: 6638782 - DNA, 13 bp, Homo sapiens
agctgccttccct

SEQ ID NO: 6638783 - DNA, 19 bp, Homo sapiens
agctgccttcctcatcccc

SEQ ID NO: 6638784 - DNA, 14 bp, Homo sapiens
agctgccttgagct

SEQ ID NO: 6638785 - DNA, 16 bp, Homo sapiens
agctgccttggctcag

SEQ ID NO: 6638786 - DNA, 19 bp, Homo sapiens
agctgccttggctcagaca

SEQ ID NO: 6638787 - DNA, 21 bp, Homo sapiens
agctgcgccggacagagtggg

SEQ ID NO: 6638788 - DNA, 18 bp, Homo sapiens
agctgcgcttgcttttct

SEQ ID NO: 6638789 - DNA, 17 bp, Homo sapiens
agctgcggattggggtg

SEQ ID NO: 6638790 - DNA, 16 bp, Homo sapiens
agctgcggcatccctg

SEQ ID NO: 6638791 - DNA, 20 bp, Homo sapiens
agctgcggcatccctgtgtt

SEQ ID NO: 6638792 - DNA, 16 bp, Homo sapiens
agctgcggccaggcct

SEQ ID NO: 6638793 - DNA, 19 bp, Homo sapiens
agctgcgggctccctggca

SEQ ID NO: 6638794 - DNA, 20 bp, Homo sapiens
agctgcgggctccctggcag

SEQ ID NO: 6638795 - DNA, 22 bp, Homo sapiens
agctgcgggctgagggcatctc

SEQ ID NO: 6638796 - DNA, 24 bp, Homo sapiens
agctgcgggctgagggcatctctg

SEQ ID NO: 6638797 - DNA, 16 bp, Homo sapiens
agctgcgggggcaggc

SEQ ID NO: 6638798 - DNA, 17 bp, Homo sapiens
agctgcgggggcaggcc

SEQ ID NO: 6638799 - DNA, 18 bp, Homo sapiens
agctgcgggggcaggccg

SEQ ID NO: 6638800 - DNA, 14 bp, Homo sapiens
agctgcgggtctga

SEQ ID NO: 6638801 - DNA, 18 bp, Homo sapiens
agctgcggtccacccagg

SEQ ID NO: 6638802 - DNA, 20 bp, Homo sapiens
agctgcggtccacccaggag

SEQ ID NO: 6638803 - DNA, 22 bp, Homo sapiens
agctgcgtttattaatgcctct

SEQ ID NO: 6638804 - DNA, 14 bp, Homo sapiens
agctgctaagctaa

SEQ ID NO: 6638805 - DNA, 23 bp, Homo sapiens
agctgctaattggcagcacccac

SEQ ID NO: 6638806 - DNA, 17 bp, Homo sapiens
agctgctacaaagaaga

SEQ ID NO: 6638807 - DNA, 18 bp, Homo sapiens
agctgctacaaagaagac

SEQ ID NO: 6638808 - DNA, 22 bp, Homo sapiens
agctgctacaaagaagacatgt

SEQ ID NO: 6638809 - DNA, 23 bp, Homo sapiens
agctgctaggaacctcatttgtc

SEQ ID NO: 6638810 - DNA, 15 bp, Homo sapiens
agctgctagtgagcc

SEQ ID NO: 6638811 - DNA, 10 bp, Homo sapiens
agctgctata

SEQ ID NO: 6638812 - DNA, 21 bp, Homo sapiens
agctgctatccaatgatatag

SEQ ID NO: 6638813 - DNA, 16 bp, Homo sapiens
agctgctcaacttgca

SEQ ID NO: 6638814 - DNA, 10 bp, Homo sapiens
agctgctcag

SEQ ID NO: 6638815 - DNA, 13 bp, Homo sapiens
agctgctcagaat

SEQ ID NO: 6638816 - DNA, 22 bp, Homo sapiens
agctgctcattacagttctttc

SEQ ID NO: 6638817 - DNA, 18 bp, Homo sapiens
agctgctccaggcctgca

SEQ ID NO: 6638818 - DNA, 17 bp, Homo sapiens
agctgctccccacgtca

SEQ ID NO: 6638819 - DNA, 20 bp, Homo sapiens
agctgctccccagcagcgga

SEQ ID NO: 6638820 - DNA, 17 bp, Homo sapiens
agctgctccctggcatt

SEQ ID NO: 6638821 - DNA, 18 bp, Homo sapiens
agctgctccgaggaccca

SEQ ID NO: 6638822 - DNA, 19 bp, Homo sapiens
agctgctccgaggacccag

SEQ ID NO: 6638823 - DNA, 20 bp, Homo sapiens
agctgctccgaggacccagg

SEQ ID NO: 6638824 - DNA, 12 bp, Homo sapiens
agctgctcctag

SEQ ID NO: 6638825 - DNA, 17 bp, Homo sapiens
agctgctcctagaggga

SEQ ID NO: 6638826 - DNA, 18 bp, Homo sapiens
agctgctcctttaccctc

SEQ ID NO: 6638827 - DNA, 15 bp, Homo sapiens
agctgctcctttggg

SEQ ID NO: 6638828 - DNA, 20 bp, Homo sapiens
agctgctctaagcccaggat

SEQ ID NO: 6638829 - DNA, 21 bp, Homo sapiens
agctgctctaagcccaggatc

SEQ ID NO: 6638830 - DNA, 23 bp, Homo sapiens
agctgctctaagcccaggatctc

SEQ ID NO: 6638831 - DNA, 21 bp, Homo sapiens
agctgctctgaaatctccttt

SEQ ID NO: 6638832 - DNA, 23 bp, Homo sapiens
agctgctctgaattagtccttgc

SEQ ID NO: 6638833 - DNA, 11 bp, Homo sapiens
agctgctctgc

SEQ ID NO: 6638834 - DNA, 18 bp, Homo sapiens
agctgctctgcccagagc

SEQ ID NO: 6638835 - DNA, 19 bp, Homo sapiens
agctgctctgcccagagct

SEQ ID NO: 6638836 - DNA, 15 bp, Homo sapiens
agctgctgaaacaac

SEQ ID NO: 6638837 - DNA, 20 bp, Homo sapiens
agctgctgaaacaacaaata

SEQ ID NO: 6638838 - DNA, 12 bp, Homo sapiens
agctgctgaaga

SEQ ID NO: 6638839 - DNA, 23 bp, Homo sapiens
agctgctgaagaggcaagagaca

SEQ ID NO: 6638840 - DNA, 19 bp, Homo sapiens
agctgctgaagttctgagc

SEQ ID NO: 6638841 - DNA, 20 bp, Homo sapiens
agctgctgaagttctgagcc

SEQ ID NO: 6638842 - DNA, 20 bp, Homo sapiens
agctgctgaccaattgtgct

SEQ ID NO: 6638843 - DNA, 19 bp, Homo sapiens
agctgctgagatcctggac

SEQ ID NO: 6638844 - DNA, 20 bp, Homo sapiens
agctgctgagatcctggact

SEQ ID NO: 6638845 - DNA, 21 bp, Homo sapiens
agctgctgagatcctggactg

SEQ ID NO: 6638846 - DNA, 12 bp, Homo sapiens
agctgctgagca

SEQ ID NO: 6638847 - DNA, 13 bp, Homo sapiens
agctgctgagccg

SEQ ID NO: 6638848 - DNA, 17 bp, Homo sapiens
agctgctgagccgcaga

SEQ ID NO: 6638849 - DNA, 14 bp, Homo sapiens
agctgctgcacagc

SEQ ID NO: 6638850 - DNA, 21 bp, Homo sapiens
agctgctgcagccctgccagt

SEQ ID NO: 6638851 - DNA, 18 bp, Homo sapiens
agctgctgccactctgct

SEQ ID NO: 6638852 - DNA, 19 bp, Homo sapiens
agctgctgccgcctcacct

SEQ ID NO: 6638853 - DNA, 22 bp, Homo sapiens
agctgctgccgcctcaccttcc

SEQ ID NO: 6638854 - DNA, 23 bp, Homo sapiens
agctgctgccgcctcaccttcct

SEQ ID NO: 6638855 - DNA, 20 bp, Homo sapiens
agctgctggagcccgcactg

SEQ ID NO: 6638856 - DNA, 15 bp, Homo sapiens
agctgctggatgact

SEQ ID NO: 6638857 - DNA, 20 bp, Homo sapiens
agctgctggatgacttgaga

SEQ ID NO: 6638858 - DNA, 17 bp, Homo sapiens
agctgctgggacccacc

SEQ ID NO: 6638859 - DNA, 19 bp, Homo sapiens
agctgctgggacccacctc

SEQ ID NO: 6638860 - DNA, 14 bp, Homo sapiens
agctgctgtatttg

SEQ ID NO: 6638861 - DNA, 18 bp, Homo sapiens
agctgctgtcttctggac

SEQ ID NO: 6638862 - DNA, 15 bp, Homo sapiens
agctgctgtgcccag

SEQ ID NO: 6638863 - DNA, 16 bp, Homo sapiens
agctgctgtgcccagc

SEQ ID NO: 6638864 - DNA, 16 bp, Homo sapiens
agctgctgtgccccac

SEQ ID NO: 6638865 - DNA, 19 bp, Homo sapiens
agctgctgtgccccaccac

SEQ ID NO: 6638866 - DNA, 14 bp, Homo sapiens
agctgctgtgtcct

SEQ ID NO: 6638867 - DNA, 20 bp, Homo sapiens
agctgctgttctcaggacag

SEQ ID NO: 6638868 - DNA, 15 bp, Homo sapiens
agctgctgttgaact

SEQ ID NO: 6638869 - DNA, 16 bp, Homo sapiens
agctgctgttgaactt

SEQ ID NO: 6638870 - DNA, 14 bp, Homo sapiens
agctgcttccagtg

SEQ ID NO: 6638871 - DNA, 15 bp, Homo sapiens
agctgcttccagtgt

SEQ ID NO: 6638872 - DNA, 22 bp, Homo sapiens
agctgcttccccaggctgccca

SEQ ID NO: 6638873 - DNA, 11 bp, Homo sapiens
agctgcttctc

SEQ ID NO: 6638874 - DNA, 13 bp, Homo sapiens
agctgcttctccc

SEQ ID NO: 6638875 - DNA, 22 bp, Homo sapiens
agctgcttctcccacttggcca

SEQ ID NO: 6638876 - DNA, 17 bp, Homo sapiens
agctgcttctcccccca

SEQ ID NO: 6638877 - DNA, 19 bp, Homo sapiens
agctgcttctccccccatc

SEQ ID NO: 6638878 - DNA, 23 bp, Homo sapiens
agctgcttctccccccatcccag

SEQ ID NO: 6638879 - DNA, 18 bp, Homo sapiens
agctgcttctgctgccta

SEQ ID NO: 6638880 - DNA, 20 bp, Homo sapiens
agctgcttctgggggatttc

SEQ ID NO: 6638881 - DNA, 16 bp, Homo sapiens
agctgcttgactatca

SEQ ID NO: 6638882 - DNA, 19 bp, Homo sapiens
agctgcttgccattctctt

SEQ ID NO: 6638883 - DNA, 24 bp, Homo sapiens
agctgcttgtcctgctctcttcag

SEQ ID NO: 6638884 - DNA, 21 bp, Homo sapiens
agctgcttgtgtccctcctgg

SEQ ID NO: 6638885 - DNA, 21 bp, Homo sapiens
agctgcttgttgtcaagtata

SEQ ID NO: 6638886 - DNA, 23 bp, Homo sapiens
agctgcttgttgtcaagtataaa

SEQ ID NO: 6638887 - DNA, 18 bp, Homo sapiens
agctgctttcttctctgc

SEQ ID NO: 6638888 - DNA, 23 bp, Homo sapiens
agctgctttcttctctgcctcct

SEQ ID NO: 6638889 - DNA, 16 bp, Homo sapiens
agctgctttgttacct

SEQ ID NO: 6638890 - DNA, 22 bp, Homo sapiens
agctgctttgttaccttaaaac

SEQ ID NO: 6638891 - DNA, 23 bp, Homo sapiens
agctgcttttgtctatgggactc

SEQ ID NO: 6638892 - DNA, 23 bp, Homo sapiens
agctgctttttttgaaactttga

SEQ ID NO: 6638893 - DNA, 15 bp, Homo sapiens
agctggaaagcagcc

SEQ ID NO: 6638894 - DNA, 10 bp, Homo sapiens
agctggaaat

SEQ ID NO: 6638895 - DNA, 18 bp, Homo sapiens
agctggaaataaacctgg

SEQ ID NO: 6638896 - DNA, 14 bp, Homo sapiens
agctggaacacaat

SEQ ID NO: 6638897 - DNA, 17 bp, Homo sapiens
agctggaacatttgata

SEQ ID NO: 6638898 - DNA, 18 bp, Homo sapiens
agctggaagactgtgcag

SEQ ID NO: 6638899 - DNA, 18 bp, Homo sapiens
agctggaagcactgctgt

SEQ ID NO: 6638900 - DNA, 17 bp, Homo sapiens
agctggaaggcagggca

SEQ ID NO: 6638901 - DNA, 18 bp, Homo sapiens
agctggaaggcagggcag

SEQ ID NO: 6638902 - DNA, 19 bp, Homo sapiens
agctggaaggcagggcaga

SEQ ID NO: 6638903 - DNA, 20 bp, Homo sapiens
agctggaaggggccacgtgg

SEQ ID NO: 6638904 - DNA, 19 bp, Homo sapiens
agctggaagtctacctgct

SEQ ID NO: 6638905 - DNA, 21 bp, Homo sapiens
agctggaagtctacctgctgg

SEQ ID NO: 6638906 - DNA, 22 bp, Homo sapiens
agctggaagtggctctggggtc

SEQ ID NO: 6638907 - DNA, 16 bp, Homo sapiens
agctggaatgtgccac

SEQ ID NO: 6638908 - DNA, 20 bp, Homo sapiens
agctggaatgtgccacagag

SEQ ID NO: 6638909 - DNA, 16 bp, Homo sapiens
agctggaattctaaat

SEQ ID NO: 6638910 - DNA, 22 bp, Homo sapiens
agctggaattgctgctctctga

SEQ ID NO: 6638911 - DNA, 12 bp, Homo sapiens
agctggacagag

SEQ ID NO: 6638912 - DNA, 17 bp, Homo sapiens
agctggaccatctctgt

SEQ ID NO: 6638913 - DNA, 18 bp, Homo sapiens
agctggaccatctctgta

SEQ ID NO: 6638914 - DNA, 14 bp, Homo sapiens
agctggaccctgac

SEQ ID NO: 6638915 - DNA, 15 bp, Homo sapiens
agctggaccctgacc

SEQ ID NO: 6638916 - DNA, 16 bp, Homo sapiens
agctggacctcaccaa

SEQ ID NO: 6638917 - DNA, 19 bp, Homo sapiens
agctggactctgcatccca

SEQ ID NO: 6638918 - DNA, 12 bp, Homo sapiens
agctggactgac

SEQ ID NO: 6638919 - DNA, 17 bp, Homo sapiens
agctggactgaccaaag

SEQ ID NO: 6638920 - DNA, 14 bp, Homo sapiens
agctggacttctgt

SEQ ID NO: 6638921 - DNA, 20 bp, Homo sapiens
agctggacttctgtgggccc

SEQ ID NO: 6638922 - DNA, 21 bp, Homo sapiens
agctggacttctgtgggcccc

SEQ ID NO: 6638923 - DNA, 17 bp, Homo sapiens
agctggagaggagccct

SEQ ID NO: 6638924 - DNA, 22 bp, Homo sapiens
agctggagaggagccctgcctc

SEQ ID NO: 6638925 - DNA, 23 bp, Homo sapiens
agctggagaggagccctgcctct

SEQ ID NO: 6638926 - DNA, 22 bp, Homo sapiens
agctggagatctgaacccagct

SEQ ID NO: 6638927 - DNA, 22 bp, Homo sapiens
agctggagatgaggccagacca

SEQ ID NO: 6638928 - DNA, 14 bp, Homo sapiens
agctggagcagcgg

SEQ ID NO: 6638929 - DNA, 15 bp, Homo sapiens
agctggagcccccag

SEQ ID NO: 6638930 - DNA, 23 bp, Homo sapiens
agctggagcccccagcagaggca

SEQ ID NO: 6638931 - DNA, 15 bp, Homo sapiens
agctggagccccgca

SEQ ID NO: 6638932 - DNA, 15 bp, Homo sapiens
agctggagcctggtg

SEQ ID NO: 6638933 - DNA, 11 bp, Homo sapiens
agctggagcta

SEQ ID NO: 6638934 - DNA, 18 bp, Homo sapiens
agctggagctaaggccag

SEQ ID NO: 6638935 - DNA, 11 bp, Homo sapiens
agctggaggaa

SEQ ID NO: 6638936 - DNA, 14 bp, Homo sapiens
agctggaggaacat

SEQ ID NO: 6638937 - DNA, 16 bp, Homo sapiens
agctggaggctccagg

SEQ ID NO: 6638938 - DNA, 18 bp, Homo sapiens
agctggaggctccaggac

SEQ ID NO: 6638939 - DNA, 19 bp, Homo sapiens
agctggaggctccaggact

SEQ ID NO: 6638940 - DNA, 21 bp, Homo sapiens
agctggaggctccaggactcc

SEQ ID NO: 6638941 - DNA, 14 bp, Homo sapiens
agctggagggaggt

SEQ ID NO: 6638942 - DNA, 14 bp, Homo sapiens
agctggaggggtgg

SEQ ID NO: 6638943 - DNA, 17 bp, Homo sapiens
agctggaggggtgggga

SEQ ID NO: 6638944 - DNA, 16 bp, Homo sapiens
agctggagtctgggct

SEQ ID NO: 6638945 - DNA, 15 bp, Homo sapiens
agctggagtgcagtg

SEQ ID NO: 6638946 - DNA, 19 bp, Homo sapiens
agctggagtgcagtggcat

SEQ ID NO: 6638947 - DNA, 13 bp, Homo sapiens
agctggagtgcca

SEQ ID NO: 6638948 - DNA, 15 bp, Homo sapiens
agctggagtgccatg

SEQ ID NO: 6638949 - DNA, 18 bp, Homo sapiens
agctggagtgccatggct

SEQ ID NO: 6638950 - DNA, 14 bp, Homo sapiens
agctggagtgctgc

SEQ ID NO: 6638951 - DNA, 15 bp, Homo sapiens
agctggagtgctgct

SEQ ID NO: 6638952 - DNA, 22 bp, Homo sapiens
agctggagtggggtttgctttt

SEQ ID NO: 6638953 - DNA, 18 bp, Homo sapiens
agctggatagacttggga

SEQ ID NO: 6638954 - DNA, 20 bp, Homo sapiens
agctggatgatggtcttcag

SEQ ID NO: 6638955 - DNA, 15 bp, Homo sapiens
agctggatggggcgg

SEQ ID NO: 6638956 - DNA, 13 bp, Homo sapiens
agctggcaagctg

SEQ ID NO: 6638957 - DNA, 15 bp, Homo sapiens
agctggcaagctgca

SEQ ID NO: 6638958 - DNA, 20 bp, Homo sapiens
agctggcacaaaagacagct

SEQ ID NO: 6638959 - DNA, 23 bp, Homo sapiens
agctggcactgacagcctggggg

SEQ ID NO: 6638960 - DNA, 12 bp, Homo sapiens
agctggcagaga

SEQ ID NO: 6638961 - DNA, 14 bp, Homo sapiens
agctggcagagagc

SEQ ID NO: 6638962 - DNA, 16 bp, Homo sapiens
agctggcagcagagtg

SEQ ID NO: 6638963 - DNA, 12 bp, Homo sapiens
agctggcagcgc

SEQ ID NO: 6638964 - DNA, 15 bp, Homo sapiens
agctggcaggacaca

SEQ ID NO: 6638965 - DNA, 19 bp, Homo sapiens
agctggcaggacacatccc

SEQ ID NO: 6638966 - DNA, 17 bp, Homo sapiens
agctggcaggagggtgg

SEQ ID NO: 6638967 - DNA, 18 bp, Homo sapiens
agctggcagtgcaatgct

SEQ ID NO: 6638968 - DNA, 15 bp, Homo sapiens
agctggcattacagc

SEQ ID NO: 6638969 - DNA, 18 bp, Homo sapiens
agctggccaaagagcctt

SEQ ID NO: 6638970 - DNA, 23 bp, Homo sapiens
agctggccaaagtcacttcccca

SEQ ID NO: 6638971 - DNA, 15 bp, Homo sapiens
agctggccaaggaga

SEQ ID NO: 6638972 - DNA, 21 bp, Homo sapiens
agctggcccactgctggctgc

SEQ ID NO: 6638973 - DNA, 13 bp, Homo sapiens
agctggcccaggg

SEQ ID NO: 6638974 - DNA, 20 bp, Homo sapiens
agctggcccagggggcctgg

SEQ ID NO: 6638975 - DNA, 19 bp, Homo sapiens
agctggcccagttgtccat

SEQ ID NO: 6638976 - DNA, 14 bp, Homo sapiens
agctggccccgccg

SEQ ID NO: 6638977 - DNA, 21 bp, Homo sapiens
agctggccccgcttggtggcc

SEQ ID NO: 6638978 - DNA, 18 bp, Homo sapiens
agctggcccgtgacagac

SEQ ID NO: 6638979 - DNA, 22 bp, Homo sapiens
agctggccctcagctccctgac

SEQ ID NO: 6638980 - DNA, 11 bp, Homo sapiens
agctggccctg

SEQ ID NO: 6638981 - DNA, 21 bp, Homo sapiens
agctggccctgcctcctggga

SEQ ID NO: 6638982 - DNA, 15 bp, Homo sapiens
agctggccctttcca

SEQ ID NO: 6638983 - DNA, 20 bp, Homo sapiens
agctggccgagggtcctggc

SEQ ID NO: 6638984 - DNA, 20 bp, Homo sapiens
agctggccggaaggagactg

SEQ ID NO: 6638985 - DNA, 22 bp, Homo sapiens
agctggccgtggagtcgagctg

SEQ ID NO: 6638986 - DNA, 17 bp, Homo sapiens
agctggccgtgggcctg

SEQ ID NO: 6638987 - DNA, 21 bp, Homo sapiens
agctggcctaatcactctgag

SEQ ID NO: 6638988 - DNA, 15 bp, Homo sapiens
agctggcctccccca

SEQ ID NO: 6638989 - DNA, 14 bp, Homo sapiens
agctggcctctacc

SEQ ID NO: 6638990 - DNA, 11 bp, Homo sapiens
agctggcctgg

SEQ ID NO: 6638991 - DNA, 20 bp, Homo sapiens
agctggcctggcccccagct

SEQ ID NO: 6638992 - DNA, 22 bp, Homo sapiens
agctggcctggggtccctctga

SEQ ID NO: 6638993 - DNA, 13 bp, Homo sapiens
agctggcctgtgg

SEQ ID NO: 6638994 - DNA, 18 bp, Homo sapiens
agctggcctgtggcacag

SEQ ID NO: 6638995 - DNA, 20 bp, Homo sapiens
agctggcctgtggcacagcc

SEQ ID NO: 6638996 - DNA, 22 bp, Homo sapiens
agctggcctgtggcacagccct

SEQ ID NO: 6638997 - DNA, 19 bp, Homo sapiens
agctggcgcgtgtgtggcc

SEQ ID NO: 6638998 - DNA, 16 bp, Homo sapiens
agctggcggaacctgg

SEQ ID NO: 6638999 - DNA, 15 bp, Homo sapiens
agctggcgtctgtct

SEQ ID NO: 6639000 - DNA, 13 bp, Homo sapiens
agctggctagcat

SEQ ID NO: 6639001 - DNA, 14 bp, Homo sapiens
agctggctcacctt

SEQ ID NO: 6639002 - DNA, 17 bp, Homo sapiens
agctggctccagcctgg

SEQ ID NO: 6639003 - DNA, 14 bp, Homo sapiens
agctggctctgcag

SEQ ID NO: 6639004 - DNA, 16 bp, Homo sapiens
agctggctctgcagca

SEQ ID NO: 6639005 - DNA, 19 bp, Homo sapiens
agctggctctgcagcacat

SEQ ID NO: 6639006 - DNA, 22 bp, Homo sapiens
agctggctctgtgagggtgctg

SEQ ID NO: 6639007 - DNA, 12 bp, Homo sapiens
agctggctgact

SEQ ID NO: 6639008 - DNA, 12 bp, Homo sapiens
agctggctgctg

SEQ ID NO: 6639009 - DNA, 15 bp, Homo sapiens
agctggctgctgaca

SEQ ID NO: 6639010 - DNA, 17 bp, Homo sapiens
agctggctgctgacagg

SEQ ID NO: 6639011 - DNA, 20 bp, Homo sapiens
agctggctgctgacaggatg

SEQ ID NO: 6639012 - DNA, 22 bp, Homo sapiens
agctggctgctgacaggatgtg

SEQ ID NO: 6639013 - DNA, 19 bp, Homo sapiens
agctggctgggctggctga

SEQ ID NO: 6639014 - DNA, 21 bp, Homo sapiens
agctggctggggtggcctgtg

SEQ ID NO: 6639015 - DNA, 23 bp, Homo sapiens
agctggctggggtggcctgtgtg

SEQ ID NO: 6639016 - DNA, 17 bp, Homo sapiens
agctggctgtactgcca

SEQ ID NO: 6639017 - DNA, 20 bp, Homo sapiens
agctggcttacactggcaat

SEQ ID NO: 6639018 - DNA, 15 bp, Homo sapiens
agctggcttcctagc

SEQ ID NO: 6639019 - DNA, 11 bp, Homo sapiens
agctggctttc

SEQ ID NO: 6639020 - DNA, 22 bp, Homo sapiens
agctggctttgaaacctcaggg

SEQ ID NO: 6639021 - DNA, 15 bp, Homo sapiens
agctgggaaacaggg

SEQ ID NO: 6639022 - DNA, 15 bp, Homo sapiens
agctgggaaagcata

SEQ ID NO: 6639023 - DNA, 14 bp, Homo sapiens
agctgggaaattca

SEQ ID NO: 6639024 - DNA, 21 bp, Homo sapiens
agctgggaacccgactgtgaa

SEQ ID NO: 6639025 - DNA, 22 bp, Homo sapiens
agctgggaacgtgtgtccaggc

SEQ ID NO: 6639026 - DNA, 18 bp, Homo sapiens
agctgggaccacaggtgc

SEQ ID NO: 6639027 - DNA, 18 bp, Homo sapiens
agctgggacctaatgctg

SEQ ID NO: 6639028 - DNA, 19 bp, Homo sapiens
agctgggactacaggcacc

SEQ ID NO: 6639029 - DNA, 23 bp, Homo sapiens
agctgggactacaggcacccacc

SEQ ID NO: 6639030 - DNA, 18 bp, Homo sapiens
agctgggactacaggtgc

SEQ ID NO: 6639031 - DNA, 19 bp, Homo sapiens
agctgggactacaggtgtg

SEQ ID NO: 6639032 - DNA, 22 bp, Homo sapiens
agctgggactcagttcttggcc

SEQ ID NO: 6639033 - DNA, 13 bp, Homo sapiens
agctgggagacaa

SEQ ID NO: 6639034 - DNA, 15 bp, Homo sapiens
agctgggagccaggc

SEQ ID NO: 6639035 - DNA, 21 bp, Homo sapiens
agctgggagccagtgtgccca

SEQ ID NO: 6639036 - DNA, 22 bp, Homo sapiens
agctgggagccagtgtgcccaa

SEQ ID NO: 6639037 - DNA, 14 bp, Homo sapiens
agctgggagccggg

SEQ ID NO: 6639038 - DNA, 19 bp, Homo sapiens
agctgggagcctggttcag

SEQ ID NO: 6639039 - DNA, 13 bp, Homo sapiens
agctgggaggaaa

SEQ ID NO: 6639040 - DNA, 15 bp, Homo sapiens
agctgggaggaaaag

SEQ ID NO: 6639041 - DNA, 18 bp, Homo sapiens
agctgggaggaaaagaaa

SEQ ID NO: 6639042 - DNA, 21 bp, Homo sapiens
agctgggaggcatggccctgg

SEQ ID NO: 6639043 - DNA, 14 bp, Homo sapiens
agctgggagggagg

SEQ ID NO: 6639044 - DNA, 13 bp, Homo sapiens
agctgggaggtct

SEQ ID NO: 6639045 - DNA, 23 bp, Homo sapiens
agctgggaggtctcgtcccagcc

SEQ ID NO: 6639046 - DNA, 16 bp, Homo sapiens
agctgggatctgactg

SEQ ID NO: 6639047 - DNA, 21 bp, Homo sapiens
agctgggatctgactgcacgt

SEQ ID NO: 6639048 - DNA, 23 bp, Homo sapiens
agctgggatgattggagggggga

SEQ ID NO: 6639049 - DNA, 15 bp, Homo sapiens
agctgggattacagg

SEQ ID NO: 6639050 - DNA, 22 bp, Homo sapiens
agctgggattacaggcgcctgc

SEQ ID NO: 6639051 - DNA, 18 bp, Homo sapiens
agctgggattacaggtgt

SEQ ID NO: 6639052 - DNA, 13 bp, Homo sapiens
agctgggatttga

SEQ ID NO: 6639053 - DNA, 10 bp, Homo sapiens
agctgggcaa

SEQ ID NO: 6639054 - DNA, 17 bp, Homo sapiens
agctgggcagtgccagc

SEQ ID NO: 6639055 - DNA, 18 bp, Homo sapiens
agctgggcagtgccagcc

SEQ ID NO: 6639056 - DNA, 22 bp, Homo sapiens
agctgggcatggtaccagccct

SEQ ID NO: 6639057 - DNA, 14 bp, Homo sapiens
agctgggccactcc

SEQ ID NO: 6639058 - DNA, 19 bp, Homo sapiens
agctgggccactcctcttc

SEQ ID NO: 6639059 - DNA, 23 bp, Homo sapiens
agctgggcccaaaggcccaggga

SEQ ID NO: 6639060 - DNA, 15 bp, Homo sapiens
agctgggcccaaccc

SEQ ID NO: 6639061 - DNA, 21 bp, Homo sapiens
agctgggcccaaccctgtctg

SEQ ID NO: 6639062 - DNA, 16 bp, Homo sapiens
agctgggcccacagcc

SEQ ID NO: 6639063 - DNA, 14 bp, Homo sapiens
agctgggcccagca

SEQ ID NO: 6639064 - DNA, 16 bp, Homo sapiens
agctgggccccatgct

SEQ ID NO: 6639065 - DNA, 17 bp, Homo sapiens
agctgggcccctgcaca

SEQ ID NO: 6639066 - DNA, 11 bp, Homo sapiens
agctgggcccg

SEQ ID NO: 6639067 - DNA, 16 bp, Homo sapiens
agctgggcccgacatg

SEQ ID NO: 6639068 - DNA, 21 bp, Homo sapiens
agctgggcccgacatggctcc

SEQ ID NO: 6639069 - DNA, 19 bp, Homo sapiens
agctgggccctgcctgcag

SEQ ID NO: 6639070 - DNA, 16 bp, Homo sapiens
agctgggcctcctgcc

SEQ ID NO: 6639071 - DNA, 21 bp, Homo sapiens
agctgggcctcctgcctccgg

SEQ ID NO: 6639072 - DNA, 18 bp, Homo sapiens
agctgggcctgtgcactg

SEQ ID NO: 6639073 - DNA, 22 bp, Homo sapiens
agctgggcctgtgcactgggca

SEQ ID NO: 6639074 - DNA, 23 bp, Homo sapiens
agctgggcctgtgcactgggcag

SEQ ID NO: 6639075 - DNA, 21 bp, Homo sapiens
agctgggctagaggctgagca

SEQ ID NO: 6639076 - DNA, 22 bp, Homo sapiens
agctgggctctgccaccctacc

SEQ ID NO: 6639077 - DNA, 20 bp, Homo sapiens
agctgggctggggaggacct

SEQ ID NO: 6639078 - DNA, 15 bp, Homo sapiens
agctgggctgtctct

SEQ ID NO: 6639079 - DNA, 16 bp, Homo sapiens
agctgggctgtctctc

SEQ ID NO: 6639080 - DNA, 19 bp, Homo sapiens
agctggggacaactgcggt

SEQ ID NO: 6639081 - DNA, 23 bp, Homo sapiens
agctggggacagctttcctgggt

SEQ ID NO: 6639082 - DNA, 19 bp, Homo sapiens
agctggggagatgggggct

SEQ ID NO: 6639083 - DNA, 22 bp, Homo sapiens
agctggggagccctattgctgc

SEQ ID NO: 6639084 - DNA, 11 bp, Homo sapiens
agctggggagg

SEQ ID NO: 6639085 - DNA, 14 bp, Homo sapiens
agctggggccagag

SEQ ID NO: 6639086 - DNA, 13 bp, Homo sapiens
agctggggcccct

SEQ ID NO: 6639087 - DNA, 16 bp, Homo sapiens
agctggggcccctcgg

SEQ ID NO: 6639088 - DNA, 14 bp, Homo sapiens
agctggggccggag

SEQ ID NO: 6639089 - DNA, 13 bp, Homo sapiens
agctggggccggt

SEQ ID NO: 6639090 - DNA, 14 bp, Homo sapiens
agctggggccggtt

SEQ ID NO: 6639091 - DNA, 16 bp, Homo sapiens
agctggggcctggaga

SEQ ID NO: 6639092 - DNA, 20 bp, Homo sapiens
agctggggcgtggggagggc

SEQ ID NO: 6639093 - DNA, 17 bp, Homo sapiens
agctggggctgccagcc

SEQ ID NO: 6639094 - DNA, 20 bp, Homo sapiens
agctggggcttatgggtggc

SEQ ID NO: 6639095 - DNA, 14 bp, Homo sapiens
agctggggcttctt

SEQ ID NO: 6639096 - DNA, 23 bp, Homo sapiens
agctggggcttctttctgctggc

SEQ ID NO: 6639097 - DNA, 22 bp, Homo sapiens
agctggggctttgatgttcctt

SEQ ID NO: 6639098 - DNA, 19 bp, Homo sapiens
agctgggggaaggcaggag

SEQ ID NO: 6639099 - DNA, 21 bp, Homo sapiens
agctgggggaaggcaggagcc

SEQ ID NO: 6639100 - DNA, 18 bp, Homo sapiens
agctgggggaagggtggt

SEQ ID NO: 6639101 - DNA, 16 bp, Homo sapiens
agctgggggccatgag

SEQ ID NO: 6639102 - DNA, 19 bp, Homo sapiens
agctgggggcgagaaaggc

SEQ ID NO: 6639103 - DNA, 20 bp, Homo sapiens
agctgggggcgcagaggaca

SEQ ID NO: 6639104 - DNA, 22 bp, Homo sapiens
agctggggggcaccggctcagg

SEQ ID NO: 6639105 - DNA, 22 bp, Homo sapiens
agctggggggttggcagcccac

SEQ ID NO: 6639106 - DNA, 17 bp, Homo sapiens
agctgggggtgggccag

SEQ ID NO: 6639107 - DNA, 20 bp, Homo sapiens
agctgggggtgggccaggct

SEQ ID NO: 6639108 - DNA, 14 bp, Homo sapiens
agctggggtacagg

SEQ ID NO: 6639109 - DNA, 14 bp, Homo sapiens
agctggggtctggg

SEQ ID NO: 6639110 - DNA, 15 bp, Homo sapiens
agctggggtctgggc

SEQ ID NO: 6639111 - DNA, 23 bp, Homo sapiens
agctggggtgcagggatgtgggt

SEQ ID NO: 6639112 - DNA, 22 bp, Homo sapiens
agctggggtggggacctcaggc

SEQ ID NO: 6639113 - DNA, 23 bp, Homo sapiens
agctggggtggggacctcaggcc

SEQ ID NO: 6639114 - DNA, 15 bp, Homo sapiens
agctgggtaccaggc

SEQ ID NO: 6639115 - DNA, 18 bp, Homo sapiens
agctgggtaccaggccac

SEQ ID NO: 6639116 - DNA, 20 bp, Homo sapiens
agctgggtcacatccatccc

SEQ ID NO: 6639117 - DNA, 14 bp, Homo sapiens
agctgggtcaggca

SEQ ID NO: 6639118 - DNA, 16 bp, Homo sapiens
agctgggtctaatcct

SEQ ID NO: 6639119 - DNA, 17 bp, Homo sapiens
agctgggtgagccaagg

SEQ ID NO: 6639120 - DNA, 13 bp, Homo sapiens
agctgggtgcccc

SEQ ID NO: 6639121 - DNA, 19 bp, Homo sapiens
agctgggtggcactgccat

SEQ ID NO: 6639122 - DNA, 20 bp, Homo sapiens
agctgggtggggacagtgat

SEQ ID NO: 6639123 - DNA, 16 bp, Homo sapiens
agctgggttggaaaac

SEQ ID NO: 6639124 - DNA, 21 bp, Homo sapiens
agctgggttggtatggagttg

SEQ ID NO: 6639125 - DNA, 19 bp, Homo sapiens
agctgggtttagcccgagg

SEQ ID NO: 6639126 - DNA, 12 bp, Homo sapiens
agctggtactga

SEQ ID NO: 6639127 - DNA, 23 bp, Homo sapiens
agctggtatattgtgtaaatatt

SEQ ID NO: 6639128 - DNA, 21 bp, Homo sapiens
agctggtcacacaaggaactc

SEQ ID NO: 6639129 - DNA, 23 bp, Homo sapiens
agctggtcagtctttgctcagtg

SEQ ID NO: 6639130 - DNA, 14 bp, Homo sapiens
agctggtcagttgc

SEQ ID NO: 6639131 - DNA, 17 bp, Homo sapiens
agctggtccagggcctg

SEQ ID NO: 6639132 - DNA, 16 bp, Homo sapiens
agctggtcccactcag

SEQ ID NO: 6639133 - DNA, 21 bp, Homo sapiens
agctggtcccactcagtccat

SEQ ID NO: 6639134 - DNA, 21 bp, Homo sapiens
agctggtcctccactttgctg

SEQ ID NO: 6639135 - DNA, 14 bp, Homo sapiens
agctggtcctgacc

SEQ ID NO: 6639136 - DNA, 15 bp, Homo sapiens
agctggtcctgacca

SEQ ID NO: 6639137 - DNA, 16 bp, Homo sapiens
agctggtcctgaccag

SEQ ID NO: 6639138 - DNA, 14 bp, Homo sapiens
agctggtcctgtgg

SEQ ID NO: 6639139 - DNA, 21 bp, Homo sapiens
agctggtctgccaggggcttc

SEQ ID NO: 6639140 - DNA, 18 bp, Homo sapiens
agctggtcttaaactcct

SEQ ID NO: 6639141 - DNA, 14 bp, Homo sapiens
agctggtgaatcca

SEQ ID NO: 6639142 - DNA, 10 bp, Homo sapiens
agctggtgca

SEQ ID NO: 6639143 - DNA, 12 bp, Homo sapiens
agctggtgcatt

SEQ ID NO: 6639144 - DNA, 13 bp, Homo sapiens
agctggtgcatta

SEQ ID NO: 6639145 - DNA, 14 bp, Homo sapiens
agctggtgcattac

SEQ ID NO: 6639146 - DNA, 17 bp, Homo sapiens
agctggtgcattacaga

SEQ ID NO: 6639147 - DNA, 18 bp, Homo sapiens
agctggtgcattacagag

SEQ ID NO: 6639148 - DNA, 19 bp, Homo sapiens
agctggtgcattacagaga

SEQ ID NO: 6639149 - DNA, 21 bp, Homo sapiens
agctggtgcattacagagagg

SEQ ID NO: 6639150 - DNA, 22 bp, Homo sapiens
agctggtgcattacagagagga

SEQ ID NO: 6639151 - DNA, 12 bp, Homo sapiens
agctggtgccaa

SEQ ID NO: 6639152 - DNA, 15 bp, Homo sapiens
agctggtgccccacc

SEQ ID NO: 6639153 - DNA, 23 bp, Homo sapiens
agctggtgccccacctgcctggt

SEQ ID NO: 6639154 - DNA, 21 bp, Homo sapiens
agctggtgcccccagacagct

SEQ ID NO: 6639155 - DNA, 23 bp, Homo sapiens
agctggtgcccccagacagctgc

SEQ ID NO: 6639156 - DNA, 14 bp, Homo sapiens
agctggtgccctgc

SEQ ID NO: 6639157 - DNA, 20 bp, Homo sapiens
agctggtgcccttcctcaca

SEQ ID NO: 6639158 - DNA, 13 bp, Homo sapiens
agctggtgcctgc

SEQ ID NO: 6639159 - DNA, 17 bp, Homo sapiens
agctggtgcggctggcc

SEQ ID NO: 6639160 - DNA, 18 bp, Homo sapiens
agctggtggccctgtgcc

SEQ ID NO: 6639161 - DNA, 21 bp, Homo sapiens
agctggtggccctgtgcctgg

SEQ ID NO: 6639162 - DNA, 18 bp, Homo sapiens
agctggtggcctctgcag

SEQ ID NO: 6639163 - DNA, 15 bp, Homo sapiens
agctggtgggaagcg

SEQ ID NO: 6639164 - DNA, 20 bp, Homo sapiens
agctggtgggtgaaagaaat

SEQ ID NO: 6639165 - DNA, 21 bp, Homo sapiens
agctggtgggtgaaagaaatc

SEQ ID NO: 6639166 - DNA, 21 bp, Homo sapiens
agctggtggtgcagccttccc

SEQ ID NO: 6639167 - DNA, 18 bp, Homo sapiens
agctggtggttgtgcctt

SEQ ID NO: 6639168 - DNA, 14 bp, Homo sapiens
agctggtggtttca

SEQ ID NO: 6639169 - DNA, 16 bp, Homo sapiens
agctggtggtttcacg

SEQ ID NO: 6639170 - DNA, 22 bp, Homo sapiens
agctggtggtttgatcatttct

SEQ ID NO: 6639171 - DNA, 23 bp, Homo sapiens
agctggtggtttgatcatttctg

SEQ ID NO: 6639172 - DNA, 19 bp, Homo sapiens
agctggtgtagctacagag

SEQ ID NO: 6639173 - DNA, 17 bp, Homo sapiens
agctggtgtcagcccct

SEQ ID NO: 6639174 - DNA, 17 bp, Homo sapiens
agctggttaatggcagc

SEQ ID NO: 6639175 - DNA, 18 bp, Homo sapiens
agctggttaatggcagca

SEQ ID NO: 6639176 - DNA, 18 bp, Homo sapiens
agctggttactcagggtt

SEQ ID NO: 6639177 - DNA, 15 bp, Homo sapiens
agctggttagaaatg

SEQ ID NO: 6639178 - DNA, 23 bp, Homo sapiens
agctggttgctacattttcagga

SEQ ID NO: 6639179 - DNA, 13 bp, Homo sapiens
agctggttgctcc

SEQ ID NO: 6639180 - DNA, 22 bp, Homo sapiens
agctggttgtaccctctccagg

SEQ ID NO: 6639181 - DNA, 20 bp, Homo sapiens
agctggtttaatgttttggc

SEQ ID NO: 6639182 - DNA, 17 bp, Homo sapiens
agctggtttacagatgt

SEQ ID NO: 6639183 - DNA, 16 bp, Homo sapiens
agctggtttcctgccc

SEQ ID NO: 6639184 - DNA, 22 bp, Homo sapiens
agctggtttcctgcccagcctg

SEQ ID NO: 6639185 - DNA, 12 bp, Homo sapiens
agctggttttct

SEQ ID NO: 6639186 - DNA, 23 bp, Homo sapiens
agctggttttctctgatggcact

SEQ ID NO: 6639187 - DNA, 18 bp, Homo sapiens
agctggtttttcccacca

SEQ ID NO: 6639188 - DNA, 13 bp, Homo sapiens
agctgtaaaaatg

SEQ ID NO: 6639189 - DNA, 18 bp, Homo sapiens
agctgtaaaacgctgtca

SEQ ID NO: 6639190 - DNA, 15 bp, Homo sapiens
agctgtaaaatggaa

SEQ ID NO: 6639191 - DNA, 16 bp, Homo sapiens
agctgtaaaccagaga

SEQ ID NO: 6639192 - DNA, 22 bp, Homo sapiens
agctgtaaacttccaatttcta

SEQ ID NO: 6639193 - DNA, 16 bp, Homo sapiens
agctgtaaatataaat

SEQ ID NO: 6639194 - DNA, 16 bp, Homo sapiens
agctgtaacagttctt

SEQ ID NO: 6639195 - DNA, 23 bp, Homo sapiens
agctgtaagaagagactgggaag

SEQ ID NO: 6639196 - DNA, 18 bp, Homo sapiens
agctgtaaggcatgaagg

SEQ ID NO: 6639197 - DNA, 18 bp, Homo sapiens
agctgtaagggcagtgcc

SEQ ID NO: 6639198 - DNA, 22 bp, Homo sapiens
agctgtaatttcgccttaaact

SEQ ID NO: 6639199 - DNA, 20 bp, Homo sapiens
agctgtacaaagggaagcag

SEQ ID NO: 6639200 - DNA, 22 bp, Homo sapiens
agctgtacaaagggaagcagag

SEQ ID NO: 6639201 - DNA, 17 bp, Homo sapiens
agctgtacaaatataag

SEQ ID NO: 6639202 - DNA, 22 bp, Homo sapiens
agctgtacaaatataagaataa

SEQ ID NO: 6639203 - DNA, 23 bp, Homo sapiens
agctgtacaaatataagaataaa

SEQ ID NO: 6639204 - DNA, 16 bp, Homo sapiens
agctgtacccttgaga

SEQ ID NO: 6639205 - DNA, 18 bp, Homo sapiens
agctgtactagtgccatt

SEQ ID NO: 6639206 - DNA, 23 bp, Homo sapiens
agctgtactataagtagttggtt

SEQ ID NO: 6639207 - DNA, 15 bp, Homo sapiens
agctgtactcagagc

SEQ ID NO: 6639208 - DNA, 17 bp, Homo sapiens
agctgtactcagagcag

SEQ ID NO: 6639209 - DNA, 23 bp, Homo sapiens
agctgtactcttctgactgcccc

SEQ ID NO: 6639210 - DNA, 19 bp, Homo sapiens
agctgtacttcttgaatat

SEQ ID NO: 6639211 - DNA, 14 bp, Homo sapiens
agctgtagaaaggt

SEQ ID NO: 6639212 - DNA, 16 bp, Homo sapiens
agctgtagaaatgtat

SEQ ID NO: 6639213 - DNA, 15 bp, Homo sapiens
agctgtagaactctg

SEQ ID NO: 6639214 - DNA, 16 bp, Homo sapiens
agctgtagaactctgc

SEQ ID NO: 6639215 - DNA, 15 bp, Homo sapiens
agctgtagccatggc

SEQ ID NO: 6639216 - DNA, 22 bp, Homo sapiens
agctgtagccatggctcaggca

SEQ ID NO: 6639217 - DNA, 16 bp, Homo sapiens
agctgtagctggagaa

SEQ ID NO: 6639218 - DNA, 20 bp, Homo sapiens
agctgtaggtgtgcgggacc

SEQ ID NO: 6639219 - DNA, 20 bp, Homo sapiens
agctgtagtagccctttctg

SEQ ID NO: 6639220 - DNA, 20 bp, Homo sapiens
agctgtatatatatatgtgt

SEQ ID NO: 6639221 - DNA, 21 bp, Homo sapiens
agctgtatatatttttcttat

SEQ ID NO: 6639222 - DNA, 22 bp, Homo sapiens
agctgtatcttgatgtttagaa

SEQ ID NO: 6639223 - DNA, 18 bp, Homo sapiens
agctgtatgattcccagc

SEQ ID NO: 6639224 - DNA, 13 bp, Homo sapiens
agctgtatgattt

SEQ ID NO: 6639225 - DNA, 22 bp, Homo sapiens
agctgtattagcagcaaaacaa

SEQ ID NO: 6639226 - DNA, 10 bp, Homo sapiens
agctgtattc

SEQ ID NO: 6639227 - DNA, 15 bp, Homo sapiens
agctgtattttgaaa

SEQ ID NO: 6639228 - DNA, 21 bp, Homo sapiens
agctgtattttggctttctcc

SEQ ID NO: 6639229 - DNA, 16 bp, Homo sapiens
agctgtcaaggctcag

SEQ ID NO: 6639230 - DNA, 17 bp, Homo sapiens
agctgtcaccaaggaaa

SEQ ID NO: 6639231 - DNA, 12 bp, Homo sapiens
agctgtcacctc

SEQ ID NO: 6639232 - DNA, 15 bp, Homo sapiens
agctgtcacctctca

SEQ ID NO: 6639233 - DNA, 21 bp, Homo sapiens
agctgtcacctctcagctgct

SEQ ID NO: 6639234 - DNA, 22 bp, Homo sapiens
agctgtcacctctcagctgctg

SEQ ID NO: 6639235 - DNA, 18 bp, Homo sapiens
agctgtcacctgctcaca

SEQ ID NO: 6639236 - DNA, 15 bp, Homo sapiens
agctgtcagaagttt

SEQ ID NO: 6639237 - DNA, 14 bp, Homo sapiens
agctgtcagcctgg

SEQ ID NO: 6639238 - DNA, 13 bp, Homo sapiens
agctgtcaggcag

SEQ ID NO: 6639239 - DNA, 17 bp, Homo sapiens
agctgtcatcactcaac

SEQ ID NO: 6639240 - DNA, 19 bp, Homo sapiens
agctgtcatggaaaagccc

SEQ ID NO: 6639241 - DNA, 22 bp, Homo sapiens
agctgtcatggaaaagcccagt

SEQ ID NO: 6639242 - DNA, 23 bp, Homo sapiens
agctgtcatggaaaagcccagtg

SEQ ID NO: 6639243 - DNA, 18 bp, Homo sapiens
agctgtcatggtgcaatt

SEQ ID NO: 6639244 - DNA, 21 bp, Homo sapiens
agctgtccaaaataataacat

SEQ ID NO: 6639245 - DNA, 15 bp, Homo sapiens
agctgtcccatgggg

SEQ ID NO: 6639246 - DNA, 14 bp, Homo sapiens
agctgtccccccac

SEQ ID NO: 6639247 - DNA, 23 bp, Homo sapiens
agctgtccccccactccctcaca

SEQ ID NO: 6639248 - DNA, 15 bp, Homo sapiens
agctgtcccctctcc

SEQ ID NO: 6639249 - DNA, 17 bp, Homo sapiens
agctgtcccctctccct

SEQ ID NO: 6639250 - DNA, 19 bp, Homo sapiens
agctgtcccctctccctgg

SEQ ID NO: 6639251 - DNA, 17 bp, Homo sapiens
agctgtcccctggagaa

SEQ ID NO: 6639252 - DNA, 16 bp, Homo sapiens
agctgtccctgcaggg

SEQ ID NO: 6639253 - DNA, 20 bp, Homo sapiens
agctgtccctgcagggccat

SEQ ID NO: 6639254 - DNA, 16 bp, Homo sapiens
agctgtccctgccctt

SEQ ID NO: 6639255 - DNA, 22 bp, Homo sapiens
agctgtccctgtcaccaagctc

SEQ ID NO: 6639256 - DNA, 15 bp, Homo sapiens
agctgtcctccctcc

SEQ ID NO: 6639257 - DNA, 16 bp, Homo sapiens
agctgtcctctcagaa

SEQ ID NO: 6639258 - DNA, 16 bp, Homo sapiens
agctgtcctgcagcaa

SEQ ID NO: 6639259 - DNA, 16 bp, Homo sapiens
agctgtcctgtgatgt

SEQ ID NO: 6639260 - DNA, 14 bp, Homo sapiens
agctgtcgcatctc

SEQ ID NO: 6639261 - DNA, 17 bp, Homo sapiens
agctgtcgctgcctcca

SEQ ID NO: 6639262 - DNA, 21 bp, Homo sapiens
agctgtcgctgcctccatggc

SEQ ID NO: 6639263 - DNA, 13 bp, Homo sapiens
agctgtcggaggg

SEQ ID NO: 6639264 - DNA, 14 bp, Homo sapiens
agctgtcgggggcc

SEQ ID NO: 6639265 - DNA, 12 bp, Homo sapiens
agctgtcgtctg

SEQ ID NO: 6639266 - DNA, 16 bp, Homo sapiens
agctgtctaaccccca

SEQ ID NO: 6639267 - DNA, 17 bp, Homo sapiens
agctgtctaacccccag

SEQ ID NO: 6639268 - DNA, 20 bp, Homo sapiens
agctgtctatgcagcctgct

SEQ ID NO: 6639269 - DNA, 16 bp, Homo sapiens
agctgtctctcttgtt

SEQ ID NO: 6639270 - DNA, 22 bp, Homo sapiens
agctgtctcttcggcagggagg

SEQ ID NO: 6639271 - DNA, 13 bp, Homo sapiens
agctgtctgaagc

SEQ ID NO: 6639272 - DNA, 14 bp, Homo sapiens
agctgtctgccagg

SEQ ID NO: 6639273 - DNA, 17 bp, Homo sapiens
agctgtctgccaggcac

SEQ ID NO: 6639274 - DNA, 22 bp, Homo sapiens
agctgtctgcggagccagcgcc

SEQ ID NO: 6639275 - DNA, 19 bp, Homo sapiens
agctgtctggtgatcactt

SEQ ID NO: 6639276 - DNA, 19 bp, Homo sapiens
agctgtctgtcatctgctg

SEQ ID NO: 6639277 - DNA, 14 bp, Homo sapiens
agctgtctgtgaat

SEQ ID NO: 6639278 - DNA, 15 bp, Homo sapiens
agctgtctgtgaata

SEQ ID NO: 6639279 - DNA, 23 bp, Homo sapiens
agctgtcttggaagtctgtctca

SEQ ID NO: 6639280 - DNA, 20 bp, Homo sapiens
agctgtcttgtccttgctgg

SEQ ID NO: 6639281 - DNA, 15 bp, Homo sapiens
agctgtgaaatgtgc

SEQ ID NO: 6639282 - DNA, 15 bp, Homo sapiens
agctgtgaaattgaa

SEQ ID NO: 6639283 - DNA, 22 bp, Homo sapiens
agctgtgaatggctgtgcccca

SEQ ID NO: 6639284 - DNA, 21 bp, Homo sapiens
agctgtgacattgctggtcat

SEQ ID NO: 6639285 - DNA, 13 bp, Homo sapiens
agctgtgacccag

SEQ ID NO: 6639286 - DNA, 19 bp, Homo sapiens
agctgtgacctgctgagct

SEQ ID NO: 6639287 - DNA, 23 bp, Homo sapiens
agctgtgacctgctgagctctga

SEQ ID NO: 6639288 - DNA, 19 bp, Homo sapiens
agctgtgacttctatttta

SEQ ID NO: 6639289 - DNA, 18 bp, Homo sapiens
agctgtgacttctccagg

SEQ ID NO: 6639290 - DNA, 12 bp, Homo sapiens
agctgtgagcaa

SEQ ID NO: 6639291 - DNA, 15 bp, Homo sapiens
agctgtgagcaaaca

SEQ ID NO: 6639292 - DNA, 17 bp, Homo sapiens
agctgtgagccatgcct

SEQ ID NO: 6639293 - DNA, 20 bp, Homo sapiens
agctgtgagccatgcctccc

SEQ ID NO: 6639294 - DNA, 16 bp, Homo sapiens
agctgtgagccttggc

SEQ ID NO: 6639295 - DNA, 18 bp, Homo sapiens
agctgtgagccttggctg

SEQ ID NO: 6639296 - DNA, 14 bp, Homo sapiens
agctgtgaggacag

SEQ ID NO: 6639297 - DNA, 16 bp, Homo sapiens
agctgtgattatgcca

SEQ ID NO: 6639298 - DNA, 12 bp, Homo sapiens
agctgtgatttt

SEQ ID NO: 6639299 - DNA, 22 bp, Homo sapiens
agctgtgcaattactgcctgca

SEQ ID NO: 6639300 - DNA, 20 bp, Homo sapiens
agctgtgcacaaagtggcat

SEQ ID NO: 6639301 - DNA, 17 bp, Homo sapiens
agctgtgcaggcatggt

SEQ ID NO: 6639302 - DNA, 18 bp, Homo sapiens
agctgtgcaggtggggag

SEQ ID NO: 6639303 - DNA, 14 bp, Homo sapiens
agctgtgccagctg

SEQ ID NO: 6639304 - DNA, 20 bp, Homo sapiens
agctgtgccagctgcttctg

SEQ ID NO: 6639305 - DNA, 15 bp, Homo sapiens
agctgtgcctgctca

SEQ ID NO: 6639306 - DNA, 19 bp, Homo sapiens
agctgtgccttcagctgtt

SEQ ID NO: 6639307 - DNA, 23 bp, Homo sapiens
agctgtgccttcagctgttgcag

SEQ ID NO: 6639308 - DNA, 15 bp, Homo sapiens
agctgtgccttccct

SEQ ID NO: 6639309 - DNA, 20 bp, Homo sapiens
agctgtgccttttttagctt

SEQ ID NO: 6639310 - DNA, 23 bp, Homo sapiens
agctgtgcgagaacacaagccac

SEQ ID NO: 6639311 - DNA, 18 bp, Homo sapiens
agctgtgctctggacagg

SEQ ID NO: 6639312 - DNA, 19 bp, Homo sapiens
agctgtgctctggacaggc

SEQ ID NO: 6639313 - DNA, 20 bp, Homo sapiens
agctgtgctctggacaggca

SEQ ID NO: 6639314 - DNA, 23 bp, Homo sapiens
agctgtgctctggacaggcatgt

SEQ ID NO: 6639315 - DNA, 14 bp, Homo sapiens
agctgtgctgggag

SEQ ID NO: 6639316 - DNA, 15 bp, Homo sapiens
agctgtgctgggagg

SEQ ID NO: 6639317 - DNA, 18 bp, Homo sapiens
agctgtggcagagttaca

SEQ ID NO: 6639318 - DNA, 18 bp, Homo sapiens
agctgtggcctcaccctg

SEQ ID NO: 6639319 - DNA, 12 bp, Homo sapiens
agctgtggctcc

SEQ ID NO: 6639320 - DNA, 18 bp, Homo sapiens
agctgtggctccctcctc

SEQ ID NO: 6639321 - DNA, 20 bp, Homo sapiens
agctgtggctccctcctcct

SEQ ID NO: 6639322 - DNA, 21 bp, Homo sapiens
agctgtggctcgtttgaggga

SEQ ID NO: 6639323 - DNA, 12 bp, Homo sapiens
agctgtggctgg

SEQ ID NO: 6639324 - DNA, 16 bp, Homo sapiens
agctgtggctggagga

SEQ ID NO: 6639325 - DNA, 17 bp, Homo sapiens
agctgtggctggaggag

SEQ ID NO: 6639326 - DNA, 14 bp, Homo sapiens
agctgtggctgggg

SEQ ID NO: 6639327 - DNA, 22 bp, Homo sapiens
agctgtggggaacacagctaca

SEQ ID NO: 6639328 - DNA, 15 bp, Homo sapiens
agctgtggggagctg

SEQ ID NO: 6639329 - DNA, 16 bp, Homo sapiens
agctgtggggagctgg

SEQ ID NO: 6639330 - DNA, 17 bp, Homo sapiens
agctgtggtcccaccca

SEQ ID NO: 6639331 - DNA, 15 bp, Homo sapiens
agctgtggttttctt

SEQ ID NO: 6639332 - DNA, 20 bp, Homo sapiens
agctgtgtaccaatcgtctc

SEQ ID NO: 6639333 - DNA, 14 bp, Homo sapiens
agctgtgtatctgt

SEQ ID NO: 6639334 - DNA, 23 bp, Homo sapiens
agctgtgtcctagttcttgaaca

SEQ ID NO: 6639335 - DNA, 14 bp, Homo sapiens
agctgtgtctctgt

SEQ ID NO: 6639336 - DNA, 12 bp, Homo sapiens
agctgtgtctga

SEQ ID NO: 6639337 - DNA, 18 bp, Homo sapiens
agctgtgtctgagcccaa

SEQ ID NO: 6639338 - DNA, 23 bp, Homo sapiens
agctgtgtgaaataccagtgtgg

SEQ ID NO: 6639339 - DNA, 21 bp, Homo sapiens
agctgtgtgaatacctgctca

SEQ ID NO: 6639340 - DNA, 13 bp, Homo sapiens
agctgtgtgcagg

SEQ ID NO: 6639341 - DNA, 18 bp, Homo sapiens
agctgtgtgctctccaag

SEQ ID NO: 6639342 - DNA, 22 bp, Homo sapiens
agctgtgtgtgttagcttgtat

SEQ ID NO: 6639343 - DNA, 22 bp, Homo sapiens
agctgtgtgtttggaagactat

SEQ ID NO: 6639344 - DNA, 16 bp, Homo sapiens
agctgtgtgttttcaa

SEQ ID NO: 6639345 - DNA, 16 bp, Homo sapiens
agctgtgttaccgtta

SEQ ID NO: 6639346 - DNA, 19 bp, Homo sapiens
agctgtgttgaaacagaaa

SEQ ID NO: 6639347 - DNA, 15 bp, Homo sapiens
agctgtgttgttgct

SEQ ID NO: 6639348 - DNA, 22 bp, Homo sapiens
agctgtgttttgtctgagcctc

SEQ ID NO: 6639349 - DNA, 15 bp, Homo sapiens
agctgttaaactgtt

SEQ ID NO: 6639350 - DNA, 19 bp, Homo sapiens
agctgttaaactgttagca

SEQ ID NO: 6639351 - DNA, 16 bp, Homo sapiens
agctgttaaagatatt

SEQ ID NO: 6639352 - DNA, 17 bp, Homo sapiens
agctgttaccattcaca

SEQ ID NO: 6639353 - DNA, 16 bp, Homo sapiens
agctgttactttcttt

SEQ ID NO: 6639354 - DNA, 15 bp, Homo sapiens
agctgttagttaaaa

SEQ ID NO: 6639355 - DNA, 14 bp, Homo sapiens
agctgttagttgct

SEQ ID NO: 6639356 - DNA, 14 bp, Homo sapiens
agctgttatcttgt

SEQ ID NO: 6639357 - DNA, 17 bp, Homo sapiens
agctgttatgctgtttc

SEQ ID NO: 6639358 - DNA, 17 bp, Homo sapiens
agctgttatttcttccc

SEQ ID NO: 6639359 - DNA, 20 bp, Homo sapiens
agctgttatttcttccctgc

SEQ ID NO: 6639360 - DNA, 21 bp, Homo sapiens
agctgttatttcttccctgct

SEQ ID NO: 6639361 - DNA, 14 bp, Homo sapiens
agctgttcacagcc

SEQ ID NO: 6639362 - DNA, 16 bp, Homo sapiens
agctgttcacagccag

SEQ ID NO: 6639363 - DNA, 14 bp, Homo sapiens
agctgttccacagg

SEQ ID NO: 6639364 - DNA, 21 bp, Homo sapiens
agctgttccattacaccacag

SEQ ID NO: 6639365 - DNA, 23 bp, Homo sapiens
agctgttccattacaccacagca

SEQ ID NO: 6639366 - DNA, 14 bp, Homo sapiens
agctgttcctgtgt

SEQ ID NO: 6639367 - DNA, 16 bp, Homo sapiens
agctgttcctgtgttc

SEQ ID NO: 6639368 - DNA, 19 bp, Homo sapiens
agctgttcctgttcagtaa

SEQ ID NO: 6639369 - DNA, 19 bp, Homo sapiens
agctgttcgctcctcccag

SEQ ID NO: 6639370 - DNA, 14 bp, Homo sapiens
agctgttctaatta

SEQ ID NO: 6639371 - DNA, 22 bp, Homo sapiens
agctgttctaattaagaaaact

SEQ ID NO: 6639372 - DNA, 23 bp, Homo sapiens
agctgttctcattcctgttcttt

SEQ ID NO: 6639373 - DNA, 13 bp, Homo sapiens
agctgttcttcct

SEQ ID NO: 6639374 - DNA, 22 bp, Homo sapiens
agctgttgaagtctcaggagtc

SEQ ID NO: 6639375 - DNA, 23 bp, Homo sapiens
agctgttgactctagtactgtga

SEQ ID NO: 6639376 - DNA, 12 bp, Homo sapiens
agctgttgagaa

SEQ ID NO: 6639377 - DNA, 14 bp, Homo sapiens
agctgttgagaaaa

SEQ ID NO: 6639378 - DNA, 13 bp, Homo sapiens
agctgttgagctg

SEQ ID NO: 6639379 - DNA, 17 bp, Homo sapiens
agctgttgagctgtttt

SEQ ID NO: 6639380 - DNA, 17 bp, Homo sapiens
agctgttgatgggatga

SEQ ID NO: 6639381 - DNA, 21 bp, Homo sapiens
agctgttgcagatgaaatgtt

SEQ ID NO: 6639382 - DNA, 23 bp, Homo sapiens
agctgttgcagatgaaatgttct

SEQ ID NO: 6639383 - DNA, 13 bp, Homo sapiens
agctgttgcaggc

SEQ ID NO: 6639384 - DNA, 13 bp, Homo sapiens
agctgttgcctca

SEQ ID NO: 6639385 - DNA, 14 bp, Homo sapiens
agctgttggcctcg

SEQ ID NO: 6639386 - DNA, 19 bp, Homo sapiens
agctgttgggagaaagcaa

SEQ ID NO: 6639387 - DNA, 14 bp, Homo sapiens
agctgttggggcag

SEQ ID NO: 6639388 - DNA, 14 bp, Homo sapiens
agctgttgtaaaga

SEQ ID NO: 6639389 - DNA, 15 bp, Homo sapiens
agctgttgtacattt

SEQ ID NO: 6639390 - DNA, 21 bp, Homo sapiens
agctgttgtctcttctcctta

SEQ ID NO: 6639391 - DNA, 19 bp, Homo sapiens
agctgttgtgagctttgaa

SEQ ID NO: 6639392 - DNA, 18 bp, Homo sapiens
agctgtttatggcctcag

SEQ ID NO: 6639393 - DNA, 20 bp, Homo sapiens
agctgtttatggcctcagct

SEQ ID NO: 6639394 - DNA, 18 bp, Homo sapiens
agctgtttatgtttttat

SEQ ID NO: 6639395 - DNA, 17 bp, Homo sapiens
agctgtttatttattca

SEQ ID NO: 6639396 - DNA, 19 bp, Homo sapiens
agctgtttatttattcact

SEQ ID NO: 6639397 - DNA, 19 bp, Homo sapiens
agctgtttcatttgtgtca

SEQ ID NO: 6639398 - DNA, 15 bp, Homo sapiens
agctgtttctcatga

SEQ ID NO: 6639399 - DNA, 18 bp, Homo sapiens
agctgtttctcatgaagc

SEQ ID NO: 6639400 - DNA, 19 bp, Homo sapiens
agctgtttgccaagctgaa

SEQ ID NO: 6639401 - DNA, 16 bp, Homo sapiens
agctgtttggaaaaga

SEQ ID NO: 6639402 - DNA, 17 bp, Homo sapiens
agctgtttggttttaaa

SEQ ID NO: 6639403 - DNA, 20 bp, Homo sapiens
agctgtttggttttaaaata

SEQ ID NO: 6639404 - DNA, 19 bp, Homo sapiens
agctgttttagctgaggga

SEQ ID NO: 6639405 - DNA, 20 bp, Homo sapiens
agctgttttagttaaatttc

SEQ ID NO: 6639406 - DNA, 17 bp, Homo sapiens
agctgttttgaataaca

SEQ ID NO: 6639407 - DNA, 14 bp, Homo sapiens
agctgttttgttga

SEQ ID NO: 6639408 - DNA, 17 bp, Homo sapiens
agctgtttttgacagcc

SEQ ID NO: 6639409 - DNA, 20 bp, Homo sapiens
agctgtttttgacagccttc

SEQ ID NO: 6639410 - DNA, 14 bp, Homo sapiens
agcttaaaaaaaac

SEQ ID NO: 6639411 - DNA, 19 bp, Homo sapiens
agcttaaaaaaaggaaaac

SEQ ID NO: 6639412 - DNA, 15 bp, Homo sapiens
agcttaaaaaaatta

SEQ ID NO: 6639413 - DNA, 22 bp, Homo sapiens
agcttaaaactttgaagttagc

SEQ ID NO: 6639414 - DNA, 21 bp, Homo sapiens
agcttaaaataaagttaaact

SEQ ID NO: 6639415 - DNA, 17 bp, Homo sapiens
agcttaaaatacaagac

SEQ ID NO: 6639416 - DNA, 18 bp, Homo sapiens
agcttaaaatacaagact

SEQ ID NO: 6639417 - DNA, 18 bp, Homo sapiens
agcttaaacccatacaat

SEQ ID NO: 6639418 - DNA, 19 bp, Homo sapiens
agcttaaacccatacaatg

SEQ ID NO: 6639419 - DNA, 13 bp, Homo sapiens
agcttaaataaat

SEQ ID NO: 6639420 - DNA, 16 bp, Homo sapiens
agcttaaattcctact

SEQ ID NO: 6639421 - DNA, 15 bp, Homo sapiens
agcttaaattgtcat

SEQ ID NO: 6639422 - DNA, 20 bp, Homo sapiens
agcttaaattttatatcatt

SEQ ID NO: 6639423 - DNA, 17 bp, Homo sapiens
agcttaacatttcatgt

SEQ ID NO: 6639424 - DNA, 16 bp, Homo sapiens
agcttaactaatttga

SEQ ID NO: 6639425 - DNA, 17 bp, Homo sapiens
agcttaactaatttgaa

SEQ ID NO: 6639426 - DNA, 17 bp, Homo sapiens
agcttaagaaagaacat

SEQ ID NO: 6639427 - DNA, 20 bp, Homo sapiens
agcttaagaaatttgtggaa

SEQ ID NO: 6639428 - DNA, 19 bp, Homo sapiens
agcttaagaagtatccctg

SEQ ID NO: 6639429 - DNA, 15 bp, Homo sapiens
agcttaaggagagga

SEQ ID NO: 6639430 - DNA, 16 bp, Homo sapiens
agcttaagggtcatat

SEQ ID NO: 6639431 - DNA, 18 bp, Homo sapiens
agcttaagtataattaat

SEQ ID NO: 6639432 - DNA, 23 bp, Homo sapiens
agcttaagtccagctcatttcag

SEQ ID NO: 6639433 - DNA, 13 bp, Homo sapiens
agcttaataaatt

SEQ ID NO: 6639434 - DNA, 14 bp, Homo sapiens
agcttaataatggt

SEQ ID NO: 6639435 - DNA, 16 bp, Homo sapiens
agcttaatagccctcc

SEQ ID NO: 6639436 - DNA, 17 bp, Homo sapiens
agcttaatagccctccc

SEQ ID NO: 6639437 - DNA, 20 bp, Homo sapiens
agcttaatagctgtagtttt

SEQ ID NO: 6639438 - DNA, 17 bp, Homo sapiens
agcttaatcaacagaag

SEQ ID NO: 6639439 - DNA, 22 bp, Homo sapiens
agcttaatcttaatgtctggtg

SEQ ID NO: 6639440 - DNA, 22 bp, Homo sapiens
agcttacaaatactaaaaagaa

SEQ ID NO: 6639441 - DNA, 21 bp, Homo sapiens
agcttacaatcgcaaatcaaa

SEQ ID NO: 6639442 - DNA, 20 bp, Homo sapiens
agcttacacaaatctattta

SEQ ID NO: 6639443 - DNA, 16 bp, Homo sapiens
agcttacactgaggac

SEQ ID NO: 6639444 - DNA, 15 bp, Homo sapiens
agcttacaggagcca

SEQ ID NO: 6639445 - DNA, 22 bp, Homo sapiens
agcttacatagttttaaactca

SEQ ID NO: 6639446 - DNA, 21 bp, Homo sapiens
agcttacattgaaaacagata

SEQ ID NO: 6639447 - DNA, 16 bp, Homo sapiens
agcttacattttcctg

SEQ ID NO: 6639448 - DNA, 22 bp, Homo sapiens
agcttaccagaagcttccatag

SEQ ID NO: 6639449 - DNA, 15 bp, Homo sapiens
agcttacccaagctg

SEQ ID NO: 6639450 - DNA, 18 bp, Homo sapiens
agcttacctgggcacaaa

SEQ ID NO: 6639451 - DNA, 15 bp, Homo sapiens
agcttactgatgatg

SEQ ID NO: 6639452 - DNA, 14 bp, Homo sapiens
agcttagacctcag

SEQ ID NO: 6639453 - DNA, 18 bp, Homo sapiens
agcttagacctcagcctg

SEQ ID NO: 6639454 - DNA, 13 bp, Homo sapiens
agcttagagttct

SEQ ID NO: 6639455 - DNA, 14 bp, Homo sapiens
agcttagagttctt

SEQ ID NO: 6639456 - DNA, 16 bp, Homo sapiens
agcttagatttcatag

SEQ ID NO: 6639457 - DNA, 14 bp, Homo sapiens
agcttagatttccc

SEQ ID NO: 6639458 - DNA, 16 bp, Homo sapiens
agcttagattttctgt

SEQ ID NO: 6639459 - DNA, 15 bp, Homo sapiens
agcttagccttgtgc

SEQ ID NO: 6639460 - DNA, 22 bp, Homo sapiens
agcttagccttgtgccctgccc

SEQ ID NO: 6639461 - DNA, 14 bp, Homo sapiens
agcttagctctgcc

SEQ ID NO: 6639462 - DNA, 21 bp, Homo sapiens
agcttagctttagaaacagtg

SEQ ID NO: 6639463 - DNA, 22 bp, Homo sapiens
agcttaggtcaaagttcataga

SEQ ID NO: 6639464 - DNA, 15 bp, Homo sapiens
agcttagtcctggga

SEQ ID NO: 6639465 - DNA, 13 bp, Homo sapiens
agcttagtgagca

SEQ ID NO: 6639466 - DNA, 19 bp, Homo sapiens
agcttagtttcagagacct

SEQ ID NO: 6639467 - DNA, 14 bp, Homo sapiens
agcttatagaataa

SEQ ID NO: 6639468 - DNA, 21 bp, Homo sapiens
agcttatagaataaaagctat

SEQ ID NO: 6639469 - DNA, 15 bp, Homo sapiens
agcttatcaatttgt

SEQ ID NO: 6639470 - DNA, 17 bp, Homo sapiens
agcttatcaatttgtca

SEQ ID NO: 6639471 - DNA, 23 bp, Homo sapiens
agcttatcaatttgtcattttga

SEQ ID NO: 6639472 - DNA, 22 bp, Homo sapiens
agcttatcctaaggctgtccac

SEQ ID NO: 6639473 - DNA, 17 bp, Homo sapiens
agcttatctccctgctt

SEQ ID NO: 6639474 - DNA, 18 bp, Homo sapiens
agcttatctccctgcttc

SEQ ID NO: 6639475 - DNA, 19 bp, Homo sapiens
agcttatctccctgcttca

SEQ ID NO: 6639476 - DNA, 20 bp, Homo sapiens
agcttatctccctgcttcat

SEQ ID NO: 6639477 - DNA, 12 bp, Homo sapiens
agcttatctcct

SEQ ID NO: 6639478 - DNA, 13 bp, Homo sapiens
agcttatctcctc

SEQ ID NO: 6639479 - DNA, 11 bp, Homo sapiens
agcttatctct

SEQ ID NO: 6639480 - DNA, 14 bp, Homo sapiens
agcttatctgcccc

SEQ ID NO: 6639481 - DNA, 15 bp, Homo sapiens
agcttatctgcccct

SEQ ID NO: 6639482 - DNA, 19 bp, Homo sapiens
agcttatctgcccctcccc

SEQ ID NO: 6639483 - DNA, 21 bp, Homo sapiens
agcttatctgcccctccccca

SEQ ID NO: 6639484 - DNA, 15 bp, Homo sapiens
agcttatctttcttt

SEQ ID NO: 6639485 - DNA, 16 bp, Homo sapiens
agcttatgaaaagaat

SEQ ID NO: 6639486 - DNA, 16 bp, Homo sapiens
agcttatggcatctca

SEQ ID NO: 6639487 - DNA, 15 bp, Homo sapiens
agcttattaaaactc

SEQ ID NO: 6639488 - DNA, 15 bp, Homo sapiens
agcttattaatgcta

SEQ ID NO: 6639489 - DNA, 16 bp, Homo sapiens
agcttattacagaaaa

SEQ ID NO: 6639490 - DNA, 17 bp, Homo sapiens
agcttattacagaaaaa

SEQ ID NO: 6639491 - DNA, 15 bp, Homo sapiens
agcttattgatccca

SEQ ID NO: 6639492 - DNA, 19 bp, Homo sapiens
agcttattgatcccacatt

SEQ ID NO: 6639493 - DNA, 21 bp, Homo sapiens
agcttattgtctagtgaaact

SEQ ID NO: 6639494 - DNA, 23 bp, Homo sapiens
agcttattgtttttattctgtat

SEQ ID NO: 6639495 - DNA, 18 bp, Homo sapiens
agcttatttagcacattt

SEQ ID NO: 6639496 - DNA, 21 bp, Homo sapiens
agcttatttagcacattttga

SEQ ID NO: 6639497 - DNA, 20 bp, Homo sapiens
agcttatttcctcattttta

SEQ ID NO: 6639498 - DNA, 14 bp, Homo sapiens
agcttatttttaca

SEQ ID NO: 6639499 - DNA, 22 bp, Homo sapiens
agcttatttttacagttataga

SEQ ID NO: 6639500 - DNA, 20 bp, Homo sapiens
agcttatttttttctacata

SEQ ID NO: 6639501 - DNA, 12 bp, Homo sapiens
agcttcaaaaca

SEQ ID NO: 6639502 - DNA, 13 bp, Homo sapiens
agcttcaaaacag

SEQ ID NO: 6639503 - DNA, 16 bp, Homo sapiens
agcttcaaaacagaac

SEQ ID NO: 6639504 - DNA, 15 bp, Homo sapiens
agcttcaacttttct

SEQ ID NO: 6639505 - DNA, 18 bp, Homo sapiens
agcttcaagtcagtgagg

SEQ ID NO: 6639506 - DNA, 17 bp, Homo sapiens
agcttcaagtctgtgcc

SEQ ID NO: 6639507 - DNA, 21 bp, Homo sapiens
agcttcaagtctgtgcctgga

SEQ ID NO: 6639508 - DNA, 21 bp, Homo sapiens
agcttcaagtgatatatgtat

SEQ ID NO: 6639509 - DNA, 14 bp, Homo sapiens
agcttcaatataag

SEQ ID NO: 6639510 - DNA, 15 bp, Homo sapiens
agcttcaatataaga

SEQ ID NO: 6639511 - DNA, 18 bp, Homo sapiens
agcttcacccaccaggcc

SEQ ID NO: 6639512 - DNA, 19 bp, Homo sapiens
agcttcacccaccaggcca

SEQ ID NO: 6639513 - DNA, 18 bp, Homo sapiens
agcttcaccccaatccca

SEQ ID NO: 6639514 - DNA, 20 bp, Homo sapiens
agcttcaccccaatcccagc

SEQ ID NO: 6639515 - DNA, 16 bp, Homo sapiens
agcttcaccctgtcaa

SEQ ID NO: 6639516 - DNA, 13 bp, Homo sapiens
agcttcacttctg

SEQ ID NO: 6639517 - DNA, 23 bp, Homo sapiens
agcttcacttctgactcttcccc

SEQ ID NO: 6639518 - DNA, 21 bp, Homo sapiens
agcttcagactcaagtaccca

SEQ ID NO: 6639519 - DNA, 23 bp, Homo sapiens
agcttcagacttttatcaaaatc

SEQ ID NO: 6639520 - DNA, 13 bp, Homo sapiens
agcttcagagcct

SEQ ID NO: 6639521 - DNA, 15 bp, Homo sapiens
agcttcagagcctag

SEQ ID NO: 6639522 - DNA, 16 bp, Homo sapiens
agcttcagagcctagc

SEQ ID NO: 6639523 - DNA, 17 bp, Homo sapiens
agcttcagagcctagcc

SEQ ID NO: 6639524 - DNA, 20 bp, Homo sapiens
agcttcagagcctagccacc

SEQ ID NO: 6639525 - DNA, 16 bp, Homo sapiens
agcttcagcaggaggc

SEQ ID NO: 6639526 - DNA, 19 bp, Homo sapiens
agcttcagccaggagctgg

SEQ ID NO: 6639527 - DNA, 14 bp, Homo sapiens
agcttcagccaggc

SEQ ID NO: 6639528 - DNA, 14 bp, Homo sapiens
agcttcagccaggt

SEQ ID NO: 6639529 - DNA, 16 bp, Homo sapiens
agcttcaggaacctcg

SEQ ID NO: 6639530 - DNA, 23 bp, Homo sapiens
agcttcaggaacctcgagtactg

SEQ ID NO: 6639531 - DNA, 17 bp, Homo sapiens
agcttcaggcaccagca

SEQ ID NO: 6639532 - DNA, 18 bp, Homo sapiens
agcttcaggcaccagcat

SEQ ID NO: 6639533 - DNA, 19 bp, Homo sapiens
agcttcaggtgagccaagg

SEQ ID NO: 6639534 - DNA, 23 bp, Homo sapiens
agcttcagttgcttgtcttctgg

SEQ ID NO: 6639535 - DNA, 17 bp, Homo sapiens
agcttcagttgttcttt

SEQ ID NO: 6639536 - DNA, 19 bp, Homo sapiens
agcttcagttgttttcccg

SEQ ID NO: 6639537 - DNA, 18 bp, Homo sapiens
agcttcatcggggtggtg

SEQ ID NO: 6639538 - DNA, 17 bp, Homo sapiens
agcttcatgcctcagtt

SEQ ID NO: 6639539 - DNA, 18 bp, Homo sapiens
agcttcatgcctcagttt

SEQ ID NO: 6639540 - DNA, 21 bp, Homo sapiens
agcttcatgcctcagtttccc

SEQ ID NO: 6639541 - DNA, 17 bp, Homo sapiens
agcttcatgcctttgta

SEQ ID NO: 6639542 - DNA, 21 bp, Homo sapiens
agcttcatgcctttgtaagtt

SEQ ID NO: 6639543 - DNA, 20 bp, Homo sapiens
agcttcatgtggcttccctt

SEQ ID NO: 6639544 - DNA, 22 bp, Homo sapiens
agcttcattctcactctgcttt

SEQ ID NO: 6639545 - DNA, 21 bp, Homo sapiens
agcttcattctccttgttgtt

SEQ ID NO: 6639546 - DNA, 18 bp, Homo sapiens
agcttcatttcctgtgtc

SEQ ID NO: 6639547 - DNA, 20 bp, Homo sapiens
agcttcatttgtgtcaatgg

SEQ ID NO: 6639548 - DNA, 11 bp, Homo sapiens
agcttccaaag

SEQ ID NO: 6639549 - DNA, 13 bp, Homo sapiens
agcttccaaagcc

SEQ ID NO: 6639550 - DNA, 19 bp, Homo sapiens
agcttccaaagcctagaca

SEQ ID NO: 6639551 - DNA, 11 bp, Homo sapiens
agcttccaaat

SEQ ID NO: 6639552 - DNA, 21 bp, Homo sapiens
agcttccaaatgtgtcagaat

SEQ ID NO: 6639553 - DNA, 18 bp, Homo sapiens
agcttccaattttccttc

SEQ ID NO: 6639554 - DNA, 23 bp, Homo sapiens
agcttccacaaacaccatcttca

SEQ ID NO: 6639555 - DNA, 19 bp, Homo sapiens
agcttccagaaatgccaca

SEQ ID NO: 6639556 - DNA, 12 bp, Homo sapiens
agcttccagagc

SEQ ID NO: 6639557 - DNA, 18 bp, Homo sapiens
agcttccatagctgctgc

SEQ ID NO: 6639558 - DNA, 12 bp, Homo sapiens
agcttccatgat

SEQ ID NO: 6639559 - DNA, 23 bp, Homo sapiens
agcttccattccaagcctgacca

SEQ ID NO: 6639560 - DNA, 11 bp, Homo sapiens
agcttcccaac

SEQ ID NO: 6639561 - DNA, 14 bp, Homo sapiens
agcttcccaacaat

SEQ ID NO: 6639562 - DNA, 14 bp, Homo sapiens
agcttcccaacaga

SEQ ID NO: 6639563 - DNA, 17 bp, Homo sapiens
agcttcccaagtagctg

SEQ ID NO: 6639564 - DNA, 22 bp, Homo sapiens
agcttcccacacctgcctgcgt

SEQ ID NO: 6639565 - DNA, 14 bp, Homo sapiens
agcttcccagccat

SEQ ID NO: 6639566 - DNA, 20 bp, Homo sapiens
agcttcccagccatgcccag

SEQ ID NO: 6639567 - DNA, 14 bp, Homo sapiens
agcttcccatgccg

SEQ ID NO: 6639568 - DNA, 18 bp, Homo sapiens
agcttccccagtagctgg

SEQ ID NO: 6639569 - DNA, 15 bp, Homo sapiens
agcttcccctcgctg

SEQ ID NO: 6639570 - DNA, 21 bp, Homo sapiens
agcttccccttatcgtcccct

SEQ ID NO: 6639571 - DNA, 15 bp, Homo sapiens
agcttccctccctgc

SEQ ID NO: 6639572 - DNA, 16 bp, Homo sapiens
agcttccctccctgct

SEQ ID NO: 6639573 - DNA, 15 bp, Homo sapiens
agcttccctctcagc

SEQ ID NO: 6639574 - DNA, 16 bp, Homo sapiens
agcttccgagaatagc

SEQ ID NO: 6639575 - DNA, 20 bp, Homo sapiens
agcttcctagcttatctccc

SEQ ID NO: 6639576 - DNA, 13 bp, Homo sapiens
agcttcctcacac

SEQ ID NO: 6639577 - DNA, 14 bp, Homo sapiens
agcttcctcacacc

SEQ ID NO: 6639578 - DNA, 18 bp, Homo sapiens
agcttcctcacacccctg

SEQ ID NO: 6639579 - DNA, 14 bp, Homo sapiens
agcttcctccagag

SEQ ID NO: 6639580 - DNA, 13 bp, Homo sapiens
agcttcctggctc

SEQ ID NO: 6639581 - DNA, 18 bp, Homo sapiens
agcttcctggctctgggg

SEQ ID NO: 6639582 - DNA, 15 bp, Homo sapiens
agcttcctgtcaaca

SEQ ID NO: 6639583 - DNA, 14 bp, Homo sapiens
agcttcctgtctgt

SEQ ID NO: 6639584 - DNA, 16 bp, Homo sapiens
agcttcctgtgccctc

SEQ ID NO: 6639585 - DNA, 21 bp, Homo sapiens
agcttcctgttactgagatgt

SEQ ID NO: 6639586 - DNA, 18 bp, Homo sapiens
agcttcctgtttctaagt

SEQ ID NO: 6639587 - DNA, 22 bp, Homo sapiens
agcttccttaagtatatcatgt

SEQ ID NO: 6639588 - DNA, 14 bp, Homo sapiens
agcttccttcaacc

SEQ ID NO: 6639589 - DNA, 14 bp, Homo sapiens
agcttccttcagag

SEQ ID NO: 6639590 - DNA, 18 bp, Homo sapiens
agcttccttcagagagca

SEQ ID NO: 6639591 - DNA, 14 bp, Homo sapiens
agcttccttggctt

SEQ ID NO: 6639592 - DNA, 15 bp, Homo sapiens
agcttcgaggacagg

SEQ ID NO: 6639593 - DNA, 19 bp, Homo sapiens
agcttcgaggacaggaaag

SEQ ID NO: 6639594 - DNA, 14 bp, Homo sapiens
agcttcgcgtgaga

SEQ ID NO: 6639595 - DNA, 17 bp, Homo sapiens
agcttcggggcaagtga

SEQ ID NO: 6639596 - DNA, 15 bp, Homo sapiens
agcttcggggccggt

SEQ ID NO: 6639597 - DNA, 16 bp, Homo sapiens
agcttcggtgtgcaga

SEQ ID NO: 6639598 - DNA, 20 bp, Homo sapiens
agcttcggtgtgcagatcat

SEQ ID NO: 6639599 - DNA, 17 bp, Homo sapiens
agcttcgtcagctccag

SEQ ID NO: 6639600 - DNA, 20 bp, Homo sapiens
agcttcgtcagctccagcgt

SEQ ID NO: 6639601 - DNA, 17 bp, Homo sapiens
agcttcgtgctggagga

SEQ ID NO: 6639602 - DNA, 20 bp, Homo sapiens
agcttctaattttgtgctct

SEQ ID NO: 6639603 - DNA, 17 bp, Homo sapiens
agcttctaccatgaaca

SEQ ID NO: 6639604 - DNA, 18 bp, Homo sapiens
agcttctaccatgaacag

SEQ ID NO: 6639605 - DNA, 20 bp, Homo sapiens
agcttctagacactccttga

SEQ ID NO: 6639606 - DNA, 18 bp, Homo sapiens
agcttctagacagagttg

SEQ ID NO: 6639607 - DNA, 22 bp, Homo sapiens
agcttctagaggctcatggccc

SEQ ID NO: 6639608 - DNA, 23 bp, Homo sapiens
agcttctagtctggaactgctgc

SEQ ID NO: 6639609 - DNA, 15 bp, Homo sapiens
agcttctcagtttct

SEQ ID NO: 6639610 - DNA, 20 bp, Homo sapiens
agcttctcagtttctgcctg

SEQ ID NO: 6639611 - DNA, 15 bp, Homo sapiens
agcttctccaagcat

SEQ ID NO: 6639612 - DNA, 17 bp, Homo sapiens
agcttctccagccacca

SEQ ID NO: 6639613 - DNA, 13 bp, Homo sapiens
agcttctcccaag

SEQ ID NO: 6639614 - DNA, 16 bp, Homo sapiens
agcttctcccaagccc

SEQ ID NO: 6639615 - DNA, 17 bp, Homo sapiens
agcttctcccagtgtga

SEQ ID NO: 6639616 - DNA, 21 bp, Homo sapiens
agcttctcctgcgccccgccc

SEQ ID NO: 6639617 - DNA, 16 bp, Homo sapiens
agcttctcctgtgtga

SEQ ID NO: 6639618 - DNA, 16 bp, Homo sapiens
agcttctctctccagg

SEQ ID NO: 6639619 - DNA, 18 bp, Homo sapiens
agcttctctctccctgtc

SEQ ID NO: 6639620 - DNA, 14 bp, Homo sapiens
agcttctctctgag

SEQ ID NO: 6639621 - DNA, 15 bp, Homo sapiens
agcttctctctgagc

SEQ ID NO: 6639622 - DNA, 17 bp, Homo sapiens
agcttctctctgagctg

SEQ ID NO: 6639623 - DNA, 13 bp, Homo sapiens
agcttctctgcag

SEQ ID NO: 6639624 - DNA, 22 bp, Homo sapiens
agcttctctgctagatttctac

SEQ ID NO: 6639625 - DNA, 23 bp, Homo sapiens
agcttctctgctagatttctaca

SEQ ID NO: 6639626 - DNA, 13 bp, Homo sapiens
agcttctctgtga

SEQ ID NO: 6639627 - DNA, 14 bp, Homo sapiens
agcttctctgtgaa

SEQ ID NO: 6639628 - DNA, 17 bp, Homo sapiens
agcttctcttgaaaact

SEQ ID NO: 6639629 - DNA, 14 bp, Homo sapiens
agcttctctttaac

SEQ ID NO: 6639630 - DNA, 18 bp, Homo sapiens
agcttctctttaactcag

SEQ ID NO: 6639631 - DNA, 20 bp, Homo sapiens
agcttctgaaaggtgctttc

SEQ ID NO: 6639632 - DNA, 21 bp, Homo sapiens
agcttctgaaaggtgctttct

SEQ ID NO: 6639633 - DNA, 18 bp, Homo sapiens
agcttctgacctcagcat

SEQ ID NO: 6639634 - DNA, 12 bp, Homo sapiens
agcttctgagac

SEQ ID NO: 6639635 - DNA, 13 bp, Homo sapiens
agcttctgagaca

SEQ ID NO: 6639636 - DNA, 18 bp, Homo sapiens
agcttctgaggcgctgct

SEQ ID NO: 6639637 - DNA, 13 bp, Homo sapiens
agcttctgagtct

SEQ ID NO: 6639638 - DNA, 15 bp, Homo sapiens
agcttctgccccctg

SEQ ID NO: 6639639 - DNA, 17 bp, Homo sapiens
agcttctgccttctgga

SEQ ID NO: 6639640 - DNA, 19 bp, Homo sapiens
agcttctgcttttctgccc

SEQ ID NO: 6639641 - DNA, 21 bp, Homo sapiens
agcttctgcttttctgccctg

SEQ ID NO: 6639642 - DNA, 21 bp, Homo sapiens
agcttctggaatttgttcaag

SEQ ID NO: 6639643 - DNA, 19 bp, Homo sapiens
agcttctgggagatttttt

SEQ ID NO: 6639644 - DNA, 18 bp, Homo sapiens
agcttctggggtccccag

SEQ ID NO: 6639645 - DNA, 22 bp, Homo sapiens
agcttctggggtccccagggct

SEQ ID NO: 6639646 - DNA, 17 bp, Homo sapiens
agcttctggtactctcc

SEQ ID NO: 6639647 - DNA, 19 bp, Homo sapiens
agcttctggtactctccta

SEQ ID NO: 6639648 - DNA, 21 bp, Homo sapiens
agcttctggtactctcctaga

SEQ ID NO: 6639649 - DNA, 19 bp, Homo sapiens
agcttctgtattttcaaag

SEQ ID NO: 6639650 - DNA, 20 bp, Homo sapiens
agcttctgtattttcaaaga

SEQ ID NO: 6639651 - DNA, 17 bp, Homo sapiens
agcttctgtcctgcccc

SEQ ID NO: 6639652 - DNA, 19 bp, Homo sapiens
agcttctgttgctgcctca

SEQ ID NO: 6639653 - DNA, 16 bp, Homo sapiens
agcttcttaaatgaga

SEQ ID NO: 6639654 - DNA, 22 bp, Homo sapiens
agcttcttaatataactgcctt

SEQ ID NO: 6639655 - DNA, 23 bp, Homo sapiens
agcttcttaatataactgcctta

SEQ ID NO: 6639656 - DNA, 18 bp, Homo sapiens
agcttcttaattaatttg

SEQ ID NO: 6639657 - DNA, 12 bp, Homo sapiens
agcttcttcaga

SEQ ID NO: 6639658 - DNA, 13 bp, Homo sapiens
agcttcttctgcc

SEQ ID NO: 6639659 - DNA, 19 bp, Homo sapiens
agcttcttgcactccttcc

SEQ ID NO: 6639660 - DNA, 14 bp, Homo sapiens
agcttcttgctcct

SEQ ID NO: 6639661 - DNA, 20 bp, Homo sapiens
agcttcttgggctgagtgca

SEQ ID NO: 6639662 - DNA, 16 bp, Homo sapiens
agcttcttgtttcctt

SEQ ID NO: 6639663 - DNA, 17 bp, Homo sapiens
agcttcttgtttccttg

SEQ ID NO: 6639664 - DNA, 13 bp, Homo sapiens
agcttctttccct

SEQ ID NO: 6639665 - DNA, 13 bp, Homo sapiens
agcttctttctcg

SEQ ID NO: 6639666 - DNA, 18 bp, Homo sapiens
agcttctttctcggtggc

SEQ ID NO: 6639667 - DNA, 14 bp, Homo sapiens
agcttgaaaacttg

SEQ ID NO: 6639668 - DNA, 23 bp, Homo sapiens
agcttgaaagcagttaaactgat

SEQ ID NO: 6639669 - DNA, 17 bp, Homo sapiens
agcttgaaagttttcag

SEQ ID NO: 6639670 - DNA, 19 bp, Homo sapiens
agcttgaaatagtgtctga

SEQ ID NO: 6639671 - DNA, 13 bp, Homo sapiens
agcttgaacctgc

SEQ ID NO: 6639672 - DNA, 23 bp, Homo sapiens
agcttgaagattaggagaaacac

SEQ ID NO: 6639673 - DNA, 12 bp, Homo sapiens
agcttgaatgtc

SEQ ID NO: 6639674 - DNA, 23 bp, Homo sapiens
agcttgaatgtccccattctata

SEQ ID NO: 6639675 - DNA, 17 bp, Homo sapiens
agcttgacacagtcagc

SEQ ID NO: 6639676 - DNA, 22 bp, Homo sapiens
agcttgacacagtcagcatgct

SEQ ID NO: 6639677 - DNA, 17 bp, Homo sapiens
agcttgacattatgttt

SEQ ID NO: 6639678 - DNA, 18 bp, Homo sapiens
agcttgacattatgtttt

SEQ ID NO: 6639679 - DNA, 19 bp, Homo sapiens
agcttgacattatgtttta

SEQ ID NO: 6639680 - DNA, 13 bp, Homo sapiens
agcttgaccagac

SEQ ID NO: 6639681 - DNA, 15 bp, Homo sapiens
agcttgaccagacct

SEQ ID NO: 6639682 - DNA, 22 bp, Homo sapiens
agcttgaccagacctagacctg

SEQ ID NO: 6639683 - DNA, 20 bp, Homo sapiens
agcttgaccgtgaggccaga

SEQ ID NO: 6639684 - DNA, 23 bp, Homo sapiens
agcttgaccgtgaggccagagac

SEQ ID NO: 6639685 - DNA, 14 bp, Homo sapiens
agcttgacctgagg

SEQ ID NO: 6639686 - DNA, 19 bp, Homo sapiens
agcttgacttgtggggcag

SEQ ID NO: 6639687 - DNA, 16 bp, Homo sapiens
agcttgagagttttct

SEQ ID NO: 6639688 - DNA, 21 bp, Homo sapiens
agcttgagccgggcccctggg

SEQ ID NO: 6639689 - DNA, 24 bp, Homo sapiens
agcttgagccgggcccctgggctt

SEQ ID NO: 6639690 - DNA, 13 bp, Homo sapiens
agcttgagcctcc

SEQ ID NO: 6639691 - DNA, 14 bp, Homo sapiens
agcttgagcctccc

SEQ ID NO: 6639692 - DNA, 13 bp, Homo sapiens
agcttgagcctgt

SEQ ID NO: 6639693 - DNA, 14 bp, Homo sapiens
agcttgagcctgtc

SEQ ID NO: 6639694 - DNA, 23 bp, Homo sapiens
agcttgagcctgtcacgtggtca

SEQ ID NO: 6639695 - DNA, 16 bp, Homo sapiens
agcttgagggacaatg

SEQ ID NO: 6639696 - DNA, 22 bp, Homo sapiens
agcttgagggttgggctggtgt

SEQ ID NO: 6639697 - DNA, 15 bp, Homo sapiens
agcttgagttctgca

SEQ ID NO: 6639698 - DNA, 16 bp, Homo sapiens
agcttgagttctgcac

SEQ ID NO: 6639699 - DNA, 22 bp, Homo sapiens
agcttgatctgtgatttcttct

SEQ ID NO: 6639700 - DNA, 23 bp, Homo sapiens
agcttgatctgtgatttcttctc

SEQ ID NO: 6639701 - DNA, 15 bp, Homo sapiens
agcttgatttgatct

SEQ ID NO: 6639702 - DNA, 18 bp, Homo sapiens
agcttgatttgatctttg

SEQ ID NO: 6639703 - DNA, 19 bp, Homo sapiens
agcttgatttgatctttgt

SEQ ID NO: 6639704 - DNA, 14 bp, Homo sapiens
agcttgcacagcca

SEQ ID NO: 6639705 - DNA, 14 bp, Homo sapiens
agcttgcacatgaa

SEQ ID NO: 6639706 - DNA, 18 bp, Homo sapiens
agcttgcagtgaagtgtt

SEQ ID NO: 6639707 - DNA, 23 bp, Homo sapiens
agcttgccacactcttcttcaag

SEQ ID NO: 6639708 - DNA, 16 bp, Homo sapiens
agcttgccagatgctg

SEQ ID NO: 6639709 - DNA, 19 bp, Homo sapiens
agcttgccagatgctgcag

SEQ ID NO: 6639710 - DNA, 20 bp, Homo sapiens
agcttgccagggatgggcag

SEQ ID NO: 6639711 - DNA, 14 bp, Homo sapiens
agcttgccccggcc

SEQ ID NO: 6639712 - DNA, 18 bp, Homo sapiens
agcttgccccggccccgg

SEQ ID NO: 6639713 - DNA, 16 bp, Homo sapiens
agcttgccctgttaaa

SEQ ID NO: 6639714 - DNA, 15 bp, Homo sapiens
agcttgcctcagggc

SEQ ID NO: 6639715 - DNA, 17 bp, Homo sapiens
agcttgcctcagggcca

SEQ ID NO: 6639716 - DNA, 19 bp, Homo sapiens
agcttgcctcagggccaag

SEQ ID NO: 6639717 - DNA, 15 bp, Homo sapiens
agcttgctcacatct

SEQ ID NO: 6639718 - DNA, 21 bp, Homo sapiens
agcttgctcagatagatctgt

SEQ ID NO: 6639719 - DNA, 14 bp, Homo sapiens
agcttgctccagat

SEQ ID NO: 6639720 - DNA, 19 bp, Homo sapiens
agcttgctccagattctga

SEQ ID NO: 6639721 - DNA, 23 bp, Homo sapiens
agcttgctccagattctgatgca

SEQ ID NO: 6639722 - DNA, 15 bp, Homo sapiens
agcttgctgtcactt

SEQ ID NO: 6639723 - DNA, 17 bp, Homo sapiens
agcttgctgtcacttct

SEQ ID NO: 6639724 - DNA, 18 bp, Homo sapiens
agcttgctgtcacttctt

SEQ ID NO: 6639725 - DNA, 23 bp, Homo sapiens
agcttgctgtcacttcttcacct

SEQ ID NO: 6639726 - DNA, 22 bp, Homo sapiens
agcttgctttgatttacagcaa

SEQ ID NO: 6639727 - DNA, 17 bp, Homo sapiens
agcttggaaaggaccag

SEQ ID NO: 6639728 - DNA, 19 bp, Homo sapiens
agcttggacagtctgagct

SEQ ID NO: 6639729 - DNA, 17 bp, Homo sapiens
agcttggagacaggatt

SEQ ID NO: 6639730 - DNA, 17 bp, Homo sapiens
agcttggagccccctgg

SEQ ID NO: 6639731 - DNA, 12 bp, Homo sapiens
agcttggaggag

SEQ ID NO: 6639732 - DNA, 22 bp, Homo sapiens
agcttggaggtcacagctggat

SEQ ID NO: 6639733 - DNA, 17 bp, Homo sapiens
agcttggagtgccacgt

SEQ ID NO: 6639734 - DNA, 14 bp, Homo sapiens
agcttggcagccga

SEQ ID NO: 6639735 - DNA, 20 bp, Homo sapiens
agcttggccctgcgccctgt

SEQ ID NO: 6639736 - DNA, 12 bp, Homo sapiens
agcttggccttg

SEQ ID NO: 6639737 - DNA, 21 bp, Homo sapiens
agcttggctcacaaggcccag

SEQ ID NO: 6639738 - DNA, 22 bp, Homo sapiens
agcttggctcacaaggcccagg

SEQ ID NO: 6639739 - DNA, 16 bp, Homo sapiens
agcttggctcaggctg

SEQ ID NO: 6639740 - DNA, 21 bp, Homo sapiens
agcttggctcgatgtttgcca

SEQ ID NO: 6639741 - DNA, 18 bp, Homo sapiens
agcttggctctcctctgg

SEQ ID NO: 6639742 - DNA, 21 bp, Homo sapiens
agcttggctgagccccctctc

SEQ ID NO: 6639743 - DNA, 15 bp, Homo sapiens
agcttggctgctcag

SEQ ID NO: 6639744 - DNA, 23 bp, Homo sapiens
agcttggctgtagaaggagacag

SEQ ID NO: 6639745 - DNA, 16 bp, Homo sapiens
agcttggctgtaggac

SEQ ID NO: 6639746 - DNA, 23 bp, Homo sapiens
agcttggcttcctcttcttgttg

SEQ ID NO: 6639747 - DNA, 22 bp, Homo sapiens
agcttgggaagtcgaggctgca

SEQ ID NO: 6639748 - DNA, 12 bp, Homo sapiens
agcttgggaatg

SEQ ID NO: 6639749 - DNA, 12 bp, Homo sapiens
agcttgggactc

SEQ ID NO: 6639750 - DNA, 22 bp, Homo sapiens
agcttgggagagcccctggggc

SEQ ID NO: 6639751 - DNA, 18 bp, Homo sapiens
agcttgggaggcttcccc

SEQ ID NO: 6639752 - DNA, 23 bp, Homo sapiens
agcttgggcagatctcccacatg

SEQ ID NO: 6639753 - DNA, 10 bp, Homo sapiens
agcttgggcc

SEQ ID NO: 6639754 - DNA, 18 bp, Homo sapiens
agcttgggcccagctggg

SEQ ID NO: 6639755 - DNA, 19 bp, Homo sapiens
agcttgggcccagctgggc

SEQ ID NO: 6639756 - DNA, 20 bp, Homo sapiens
agcttgggcccagctgggct

SEQ ID NO: 6639757 - DNA, 12 bp, Homo sapiens
agcttgggctgg

SEQ ID NO: 6639758 - DNA, 17 bp, Homo sapiens
agcttgggcttcttcct

SEQ ID NO: 6639759 - DNA, 16 bp, Homo sapiens
agcttggggagaggga

SEQ ID NO: 6639760 - DNA, 17 bp, Homo sapiens
agcttggggcaacattg

SEQ ID NO: 6639761 - DNA, 20 bp, Homo sapiens
agcttggggccaccaaagct

SEQ ID NO: 6639762 - DNA, 15 bp, Homo sapiens
agcttggggccaggg

SEQ ID NO: 6639763 - DNA, 17 bp, Homo sapiens
agcttgggtcaggttct

SEQ ID NO: 6639764 - DNA, 21 bp, Homo sapiens
agcttgggtcaggttcttgcc

SEQ ID NO: 6639765 - DNA, 23 bp, Homo sapiens
agcttgggtcaggttcttgcctt

SEQ ID NO: 6639766 - DNA, 23 bp, Homo sapiens
agcttgggtctctctcggcccct

SEQ ID NO: 6639767 - DNA, 17 bp, Homo sapiens
agcttggtcaaactttt

SEQ ID NO: 6639768 - DNA, 17 bp, Homo sapiens
agcttggtggttatgtc

SEQ ID NO: 6639769 - DNA, 16 bp, Homo sapiens
agcttgtacacatata

SEQ ID NO: 6639770 - DNA, 14 bp, Homo sapiens
agcttgtagccagc

SEQ ID NO: 6639771 - DNA, 16 bp, Homo sapiens
agcttgtagccagccg

SEQ ID NO: 6639772 - DNA, 15 bp, Homo sapiens
agcttgtagccctgg

SEQ ID NO: 6639773 - DNA, 17 bp, Homo sapiens
agcttgtagccctggat

SEQ ID NO: 6639774 - DNA, 14 bp, Homo sapiens
agcttgtatataca

SEQ ID NO: 6639775 - DNA, 15 bp, Homo sapiens
agcttgtatatacat

SEQ ID NO: 6639776 - DNA, 22 bp, Homo sapiens
agcttgtatatacatattataa

SEQ ID NO: 6639777 - DNA, 17 bp, Homo sapiens
agcttgtatcaaatgtt

SEQ ID NO: 6639778 - DNA, 18 bp, Homo sapiens
agcttgtatgcaatggat

SEQ ID NO: 6639779 - DNA, 16 bp, Homo sapiens
agcttgtattatcagt

SEQ ID NO: 6639780 - DNA, 22 bp, Homo sapiens
agcttgtattttgtgaagactg

SEQ ID NO: 6639781 - DNA, 20 bp, Homo sapiens
agcttgtcaatgatttcaaa

SEQ ID NO: 6639782 - DNA, 22 bp, Homo sapiens
agcttgtccaacccgaggcccg

SEQ ID NO: 6639783 - DNA, 22 bp, Homo sapiens
agcttgtccttgctcctggaac

SEQ ID NO: 6639784 - DNA, 22 bp, Homo sapiens
agcttgtctatggtacaaaaat

SEQ ID NO: 6639785 - DNA, 14 bp, Homo sapiens
agcttgtctcttgc

SEQ ID NO: 6639786 - DNA, 16 bp, Homo sapiens
agcttgtgagagctgg

SEQ ID NO: 6639787 - DNA, 20 bp, Homo sapiens
agcttgtgattcctacccct

SEQ ID NO: 6639788 - DNA, 21 bp, Homo sapiens
agcttgtgctgagcctgccca

SEQ ID NO: 6639789 - DNA, 14 bp, Homo sapiens
agcttgtggagccc

SEQ ID NO: 6639790 - DNA, 23 bp, Homo sapiens
agcttgtggaggagggagagccc

SEQ ID NO: 6639791 - DNA, 18 bp, Homo sapiens
agcttgtggcaagtgaat

SEQ ID NO: 6639792 - DNA, 18 bp, Homo sapiens
agcttgtggcccctttta

SEQ ID NO: 6639793 - DNA, 19 bp, Homo sapiens
agcttgtggtggggcagga

SEQ ID NO: 6639794 - DNA, 21 bp, Homo sapiens
agcttgtgtatcttgattaat

SEQ ID NO: 6639795 - DNA, 17 bp, Homo sapiens
agcttgttgactcagct

SEQ ID NO: 6639796 - DNA, 22 bp, Homo sapiens
agcttgttgtctccacttgtat

SEQ ID NO: 6639797 - DNA, 19 bp, Homo sapiens
agcttgtttacatgcttat

SEQ ID NO: 6639798 - DNA, 13 bp, Homo sapiens
agcttgtttccct

SEQ ID NO: 6639799 - DNA, 14 bp, Homo sapiens
agcttgtttctata

SEQ ID NO: 6639800 - DNA, 17 bp, Homo sapiens
agcttgtttctatactg

SEQ ID NO: 6639801 - DNA, 22 bp, Homo sapiens
agcttgttttgtttcatcctgt

SEQ ID NO: 6639802 - DNA, 23 bp, Homo sapiens
agctttaaaaccacagctgggca

SEQ ID NO: 6639803 - DNA, 15 bp, Homo sapiens
agctttaaaagaaaa

SEQ ID NO: 6639804 - DNA, 20 bp, Homo sapiens
agctttaaaagtatctttaa

SEQ ID NO: 6639805 - DNA, 19 bp, Homo sapiens
agctttaaactcagggaca

SEQ ID NO: 6639806 - DNA, 15 bp, Homo sapiens
agctttaaagagcag

SEQ ID NO: 6639807 - DNA, 16 bp, Homo sapiens
agctttaaatcattag

SEQ ID NO: 6639808 - DNA, 19 bp, Homo sapiens
agctttaaattcatggttt

SEQ ID NO: 6639809 - DNA, 14 bp, Homo sapiens
agctttaacatttt

SEQ ID NO: 6639810 - DNA, 18 bp, Homo sapiens
agctttaacttaaatagt

SEQ ID NO: 6639811 - DNA, 22 bp, Homo sapiens
agctttaagcaccctagaggac

SEQ ID NO: 6639812 - DNA, 21 bp, Homo sapiens
agctttaatcaatcatgccct

SEQ ID NO: 6639813 - DNA, 14 bp, Homo sapiens
agctttaatgttac

SEQ ID NO: 6639814 - DNA, 18 bp, Homo sapiens
agctttaattaagctctc

SEQ ID NO: 6639815 - DNA, 22 bp, Homo sapiens
agctttacactgcctggtactg

SEQ ID NO: 6639816 - DNA, 18 bp, Homo sapiens
agctttacagatgtagat

SEQ ID NO: 6639817 - DNA, 19 bp, Homo sapiens
agctttacatattcctttg

SEQ ID NO: 6639818 - DNA, 14 bp, Homo sapiens
agctttaccagctg

SEQ ID NO: 6639819 - DNA, 17 bp, Homo sapiens
agctttaccctcaggca

SEQ ID NO: 6639820 - DNA, 18 bp, Homo sapiens
agctttaccctcaggcat

SEQ ID NO: 6639821 - DNA, 22 bp, Homo sapiens
agctttactactgtggaaagac

SEQ ID NO: 6639822 - DNA, 18 bp, Homo sapiens
agctttactgtttctcaa

SEQ ID NO: 6639823 - DNA, 23 bp, Homo sapiens
agctttactttgtggatatattt

SEQ ID NO: 6639824 - DNA, 15 bp, Homo sapiens
agctttagattgaaa

SEQ ID NO: 6639825 - DNA, 18 bp, Homo sapiens
agctttagattgaaattt

SEQ ID NO: 6639826 - DNA, 16 bp, Homo sapiens
agctttagcttctctg

SEQ ID NO: 6639827 - DNA, 22 bp, Homo sapiens
agctttaggcagagccataatg

SEQ ID NO: 6639828 - DNA, 17 bp, Homo sapiens
agctttaggtaaggaga

SEQ ID NO: 6639829 - DNA, 14 bp, Homo sapiens
agctttataataaa

SEQ ID NO: 6639830 - DNA, 18 bp, Homo sapiens
agctttataataaactgt

SEQ ID NO: 6639831 - DNA, 20 bp, Homo sapiens
agctttataataaactgttt

SEQ ID NO: 6639832 - DNA, 18 bp, Homo sapiens
agctttatcgaacgtggt

SEQ ID NO: 6639833 - DNA, 17 bp, Homo sapiens
agctttatctttgtgta

SEQ ID NO: 6639834 - DNA, 10 bp, Homo sapiens
agctttatga

SEQ ID NO: 6639835 - DNA, 12 bp, Homo sapiens
agctttatgatt

SEQ ID NO: 6639836 - DNA, 23 bp, Homo sapiens
agctttatgattttcataactta

SEQ ID NO: 6639837 - DNA, 22 bp, Homo sapiens
agctttatgtaataatgtgaat

SEQ ID NO: 6639838 - DNA, 18 bp, Homo sapiens
agctttatgttcatttgt

SEQ ID NO: 6639839 - DNA, 16 bp, Homo sapiens
agctttattatggctt

SEQ ID NO: 6639840 - DNA, 21 bp, Homo sapiens
agctttattatggcttgtgaa

SEQ ID NO: 6639841 - DNA, 14 bp, Homo sapiens
agctttattcttca

SEQ ID NO: 6639842 - DNA, 17 bp, Homo sapiens
agctttattgctgcatt

SEQ ID NO: 6639843 - DNA, 20 bp, Homo sapiens
agctttattgctgcatttta

SEQ ID NO: 6639844 - DNA, 20 bp, Homo sapiens
agctttatttatagaaatga

SEQ ID NO: 6639845 - DNA, 20 bp, Homo sapiens
agctttatttgcatatttat

SEQ ID NO: 6639846 - DNA, 18 bp, Homo sapiens
agctttattttaaatgtg

SEQ ID NO: 6639847 - DNA, 15 bp, Homo sapiens
agctttcaacatgta

SEQ ID NO: 6639848 - DNA, 17 bp, Homo sapiens
agctttcagaatatgtc

SEQ ID NO: 6639849 - DNA, 17 bp, Homo sapiens
agctttcagagccagtg

SEQ ID NO: 6639850 - DNA, 22 bp, Homo sapiens
agctttcatgtaaactgtgcac

SEQ ID NO: 6639851 - DNA, 16 bp, Homo sapiens
agctttcatttgacac

SEQ ID NO: 6639852 - DNA, 20 bp, Homo sapiens
agctttccaaggaagcagaa

SEQ ID NO: 6639853 - DNA, 13 bp, Homo sapiens
agctttccacagg

SEQ ID NO: 6639854 - DNA, 18 bp, Homo sapiens
agctttcccagagacccg

SEQ ID NO: 6639855 - DNA, 15 bp, Homo sapiens
agctttccccagccc

SEQ ID NO: 6639856 - DNA, 17 bp, Homo sapiens
agctttccccagggtga

SEQ ID NO: 6639857 - DNA, 21 bp, Homo sapiens
agctttcccctctgaataaat

SEQ ID NO: 6639858 - DNA, 17 bp, Homo sapiens
agctttccctgccaggc

SEQ ID NO: 6639859 - DNA, 13 bp, Homo sapiens
agctttccctggc

SEQ ID NO: 6639860 - DNA, 14 bp, Homo sapiens
agctttccctggct

SEQ ID NO: 6639861 - DNA, 15 bp, Homo sapiens
agctttccctggctc

SEQ ID NO: 6639862 - DNA, 16 bp, Homo sapiens
agctttccctgtgcca

SEQ ID NO: 6639863 - DNA, 18 bp, Homo sapiens
agctttccggggaggagc

SEQ ID NO: 6639864 - DNA, 21 bp, Homo sapiens
agctttcctgatgatgctggc

SEQ ID NO: 6639865 - DNA, 15 bp, Homo sapiens
agctttcctgcccca

SEQ ID NO: 6639866 - DNA, 23 bp, Homo sapiens
agctttcctgccccaggcctgaa

SEQ ID NO: 6639867 - DNA, 15 bp, Homo sapiens
agctttcctgggtga

SEQ ID NO: 6639868 - DNA, 15 bp, Homo sapiens
agctttcctgtttcc

SEQ ID NO: 6639869 - DNA, 22 bp, Homo sapiens
agctttccttctgcccttcctc

SEQ ID NO: 6639870 - DNA, 22 bp, Homo sapiens
agctttcctttttcccaataaa

SEQ ID NO: 6639871 - DNA, 23 bp, Homo sapiens
agctttcctttttcccaataaat

SEQ ID NO: 6639872 - DNA, 12 bp, Homo sapiens
agctttctcaat

SEQ ID NO: 6639873 - DNA, 20 bp, Homo sapiens
agctttctcaatgtcttccc

SEQ ID NO: 6639874 - DNA, 16 bp, Homo sapiens
agctttctcagggggt

SEQ ID NO: 6639875 - DNA, 21 bp, Homo sapiens
agctttctcataaatttctct

SEQ ID NO: 6639876 - DNA, 13 bp, Homo sapiens
agctttctccaga

SEQ ID NO: 6639877 - DNA, 18 bp, Homo sapiens
agctttctcctcatccat

SEQ ID NO: 6639878 - DNA, 13 bp, Homo sapiens
agctttctccttt

SEQ ID NO: 6639879 - DNA, 14 bp, Homo sapiens
agctttctcctttg

SEQ ID NO: 6639880 - DNA, 19 bp, Homo sapiens
agctttctctttgttcttc

SEQ ID NO: 6639881 - DNA, 20 bp, Homo sapiens
agctttctctttgttcttca

SEQ ID NO: 6639882 - DNA, 15 bp, Homo sapiens
agctttctgaacagc

SEQ ID NO: 6639883 - DNA, 20 bp, Homo sapiens
agctttctgaacagctggtg

SEQ ID NO: 6639884 - DNA, 22 bp, Homo sapiens
agctttctgagcaagaggattt

SEQ ID NO: 6639885 - DNA, 22 bp, Homo sapiens
agctttctgaggccctgagcat

SEQ ID NO: 6639886 - DNA, 16 bp, Homo sapiens
agctttctgatactta

SEQ ID NO: 6639887 - DNA, 13 bp, Homo sapiens
agctttctgccac

SEQ ID NO: 6639888 - DNA, 20 bp, Homo sapiens
agctttctgtccttttggca

SEQ ID NO: 6639889 - DNA, 22 bp, Homo sapiens
agctttctgtccttttggcact

SEQ ID NO: 6639890 - DNA, 12 bp, Homo sapiens
agctttcttatt

SEQ ID NO: 6639891 - DNA, 14 bp, Homo sapiens
agctttcttcagct

SEQ ID NO: 6639892 - DNA, 11 bp, Homo sapiens
agctttcttct

SEQ ID NO: 6639893 - DNA, 20 bp, Homo sapiens
agctttcttctacaaccaga

SEQ ID NO: 6639894 - DNA, 22 bp, Homo sapiens
agctttcttctacaaccagagc

SEQ ID NO: 6639895 - DNA, 20 bp, Homo sapiens
agctttctttcacaaaaaag

SEQ ID NO: 6639896 - DNA, 12 bp, Homo sapiens
agctttcttttt

SEQ ID NO: 6639897 - DNA, 16 bp, Homo sapiens
agctttgaaaattcag

SEQ ID NO: 6639898 - DNA, 19 bp, Homo sapiens
agctttgaaaattcagtgg

SEQ ID NO: 6639899 - DNA, 19 bp, Homo sapiens
agctttgaaggccgaaggc

SEQ ID NO: 6639900 - DNA, 12 bp, Homo sapiens
agctttgaagta

SEQ ID NO: 6639901 - DNA, 20 bp, Homo sapiens
agctttgacgtattatctgt

SEQ ID NO: 6639902 - DNA, 20 bp, Homo sapiens
agctttgactcaggagcctg

SEQ ID NO: 6639903 - DNA, 21 bp, Homo sapiens
agctttgagacaggtgcctgg

SEQ ID NO: 6639904 - DNA, 21 bp, Homo sapiens
agctttgaggttgacctgttt

SEQ ID NO: 6639905 - DNA, 21 bp, Homo sapiens
agctttgcaaacccattaagg

SEQ ID NO: 6639906 - DNA, 14 bp, Homo sapiens
agctttgcacccct

SEQ ID NO: 6639907 - DNA, 18 bp, Homo sapiens
agctttgcagccaaggtg

SEQ ID NO: 6639908 - DNA, 17 bp, Homo sapiens
agctttgccagctgctg

SEQ ID NO: 6639909 - DNA, 15 bp, Homo sapiens
agctttgcccaacac

SEQ ID NO: 6639910 - DNA, 10 bp, Homo sapiens
agctttgcta

SEQ ID NO: 6639911 - DNA, 18 bp, Homo sapiens
agctttgctacaaattta

SEQ ID NO: 6639912 - DNA, 20 bp, Homo sapiens
agctttgctacaaatttatg

SEQ ID NO: 6639913 - DNA, 21 bp, Homo sapiens
agctttgctaccaaagcacct

SEQ ID NO: 6639914 - DNA, 13 bp, Homo sapiens
agctttgctcata

SEQ ID NO: 6639915 - DNA, 20 bp, Homo sapiens
agctttgctcatatttccca

SEQ ID NO: 6639916 - DNA, 21 bp, Homo sapiens
agctttgctcatatttcccat

SEQ ID NO: 6639917 - DNA, 18 bp, Homo sapiens
agctttgctccgctccca

SEQ ID NO: 6639918 - DNA, 20 bp, Homo sapiens
agctttgcttctctctctaa

SEQ ID NO: 6639919 - DNA, 16 bp, Homo sapiens
agctttggaaacagga

SEQ ID NO: 6639920 - DNA, 22 bp, Homo sapiens
agctttggaaagttactgtaaa

SEQ ID NO: 6639921 - DNA, 14 bp, Homo sapiens
agctttggaagcag

SEQ ID NO: 6639922 - DNA, 18 bp, Homo sapiens
agctttggaagtttagct

SEQ ID NO: 6639923 - DNA, 22 bp, Homo sapiens
agctttggaatattttatcctg

SEQ ID NO: 6639924 - DNA, 12 bp, Homo sapiens
agctttggacac

SEQ ID NO: 6639925 - DNA, 15 bp, Homo sapiens
agctttgggatccca

SEQ ID NO: 6639926 - DNA, 16 bp, Homo sapiens
agctttgggcagattt

SEQ ID NO: 6639927 - DNA, 21 bp, Homo sapiens
agctttgggcagatttgcaac

SEQ ID NO: 6639928 - DNA, 16 bp, Homo sapiens
agctttgggtgccttt

SEQ ID NO: 6639929 - DNA, 20 bp, Homo sapiens
agctttgggttggagctgtt

SEQ ID NO: 6639930 - DNA, 15 bp, Homo sapiens
agctttggttatgaa

SEQ ID NO: 6639931 - DNA, 20 bp, Homo sapiens
agctttgtaactgttttcaa

SEQ ID NO: 6639932 - DNA, 19 bp, Homo sapiens
agctttgtaattcagaaat

SEQ ID NO: 6639933 - DNA, 16 bp, Homo sapiens
agctttgtatgtttat

SEQ ID NO: 6639934 - DNA, 12 bp, Homo sapiens
agctttgtcact

SEQ ID NO: 6639935 - DNA, 17 bp, Homo sapiens
agctttgtcacttgcca

SEQ ID NO: 6639936 - DNA, 19 bp, Homo sapiens
agctttgtcacttgccaca

SEQ ID NO: 6639937 - DNA, 22 bp, Homo sapiens
agctttgtcatagttatgtgat

SEQ ID NO: 6639938 - DNA, 22 bp, Homo sapiens
agctttgtctccaaagaagata

SEQ ID NO: 6639939 - DNA, 21 bp, Homo sapiens
agctttgtgactgtatataaa

SEQ ID NO: 6639940 - DNA, 12 bp, Homo sapiens
agctttgtgttt

SEQ ID NO: 6639941 - DNA, 16 bp, Homo sapiens
agctttgtgtttactt

SEQ ID NO: 6639942 - DNA, 19 bp, Homo sapiens
agctttgtgtttacttttt

SEQ ID NO: 6639943 - DNA, 21 bp, Homo sapiens
agctttgttctgggagttgct

SEQ ID NO: 6639944 - DNA, 12 bp, Homo sapiens
agctttgttctt

SEQ ID NO: 6639945 - DNA, 18 bp, Homo sapiens
agctttgttcttcttaaa

SEQ ID NO: 6639946 - DNA, 15 bp, Homo sapiens
agctttgttgtcctc

SEQ ID NO: 6639947 - DNA, 22 bp, Homo sapiens
agctttgttgtcctcccaggaa

SEQ ID NO: 6639948 - DNA, 18 bp, Homo sapiens
agctttgtttagtcttta

SEQ ID NO: 6639949 - DNA, 14 bp, Homo sapiens
agctttgtttcttg

SEQ ID NO: 6639950 - DNA, 17 bp, Homo sapiens
agctttgtttgaaaatt

SEQ ID NO: 6639951 - DNA, 16 bp, Homo sapiens
agctttgtttgttctt

SEQ ID NO: 6639952 - DNA, 22 bp, Homo sapiens
agctttgtttgttgtcagctga

SEQ ID NO: 6639953 - DNA, 18 bp, Homo sapiens
agcttttaaaaaatattt

SEQ ID NO: 6639954 - DNA, 14 bp, Homo sapiens
agcttttaaaaatg

SEQ ID NO: 6639955 - DNA, 16 bp, Homo sapiens
agcttttaaaatgtag

SEQ ID NO: 6639956 - DNA, 20 bp, Homo sapiens
agcttttaagaaaaacaaag

SEQ ID NO: 6639957 - DNA, 19 bp, Homo sapiens
agcttttaccttaaatgct

SEQ ID NO: 6639958 - DNA, 14 bp, Homo sapiens
agcttttactgttt

SEQ ID NO: 6639959 - DNA, 16 bp, Homo sapiens
agcttttagcctggct

SEQ ID NO: 6639960 - DNA, 22 bp, Homo sapiens
agcttttagcctggctgtcacc

SEQ ID NO: 6639961 - DNA, 17 bp, Homo sapiens
agcttttatggatgatt

SEQ ID NO: 6639962 - DNA, 21 bp, Homo sapiens
agcttttatgtgaaacatgtt

SEQ ID NO: 6639963 - DNA, 21 bp, Homo sapiens
agcttttatgtgatatgtttt

SEQ ID NO: 6639964 - DNA, 19 bp, Homo sapiens
agcttttattcctttgaat

SEQ ID NO: 6639965 - DNA, 23 bp, Homo sapiens
agcttttattcctttgaatattt

SEQ ID NO: 6639966 - DNA, 20 bp, Homo sapiens
agcttttcacaaacattagt

SEQ ID NO: 6639967 - DNA, 16 bp, Homo sapiens
agcttttcatggaagt

SEQ ID NO: 6639968 - DNA, 23 bp, Homo sapiens
agcttttcatggaagtggcagtg

SEQ ID NO: 6639969 - DNA, 13 bp, Homo sapiens
agcttttccctgt

SEQ ID NO: 6639970 - DNA, 21 bp, Homo sapiens
agcttttccctttttttaagt

SEQ ID NO: 6639971 - DNA, 16 bp, Homo sapiens
agcttttcctttcttt

SEQ ID NO: 6639972 - DNA, 18 bp, Homo sapiens
agcttttcgaactgtgct

SEQ ID NO: 6639973 - DNA, 14 bp, Homo sapiens
agcttttctgtaga

SEQ ID NO: 6639974 - DNA, 21 bp, Homo sapiens
agcttttcttattccttttta

SEQ ID NO: 6639975 - DNA, 13 bp, Homo sapiens
agcttttcttgat

SEQ ID NO: 6639976 - DNA, 23 bp, Homo sapiens
agcttttcttgataggcctagta

SEQ ID NO: 6639977 - DNA, 15 bp, Homo sapiens
agcttttctttcttt

SEQ ID NO: 6639978 - DNA, 18 bp, Homo sapiens
agcttttgaataaaaact

SEQ ID NO: 6639979 - DNA, 12 bp, Homo sapiens
agcttttgcata

SEQ ID NO: 6639980 - DNA, 21 bp, Homo sapiens
agcttttgcatagaataatga

SEQ ID NO: 6639981 - DNA, 13 bp, Homo sapiens
agcttttgctttt

SEQ ID NO: 6639982 - DNA, 16 bp, Homo sapiens
agcttttggggaggga

SEQ ID NO: 6639983 - DNA, 17 bp, Homo sapiens
agcttttggtctccttg

SEQ ID NO: 6639984 - DNA, 22 bp, Homo sapiens
agcttttgtatagaaaattctt

SEQ ID NO: 6639985 - DNA, 13 bp, Homo sapiens
agcttttgtctac

SEQ ID NO: 6639986 - DNA, 22 bp, Homo sapiens
agcttttgtgggggactgtaag

SEQ ID NO: 6639987 - DNA, 24 bp, Homo sapiens
agcttttgtgggggactgtaagtt

SEQ ID NO: 6639988 - DNA, 22 bp, Homo sapiens
agcttttgttttgcttacaaag

SEQ ID NO: 6639989 - DNA, 21 bp, Homo sapiens
agctttttaccgttcacttcc

SEQ ID NO: 6639990 - DNA, 15 bp, Homo sapiens
agctttttctgtgga

SEQ ID NO: 6639991 - DNA, 16 bp, Homo sapiens
agctttttgatgtata

SEQ ID NO: 6639992 - DNA, 19 bp, Homo sapiens
agctttttgtattaacaaa

SEQ ID NO: 6639993 - DNA, 17 bp, Homo sapiens
agcttttttattttaat

SEQ ID NO: 6639994 - DNA, 20 bp, Homo sapiens
agcttttttattttttatac

SEQ ID NO: 6639995 - DNA, 22 bp, Homo sapiens
agcttttttattttttatacag

SEQ ID NO: 6639996 - DNA, 16 bp, Homo sapiens
agctttttttcttgct

SEQ ID NO: 6639997 - DNA, 20 bp, Homo sapiens
agcttttttttcagccattc

SEQ ID NO: 6639998 - DNA, 22 bp, Homo sapiens
agctttttttttttaattttgt

SEQ ID NO: 6639999 - DNA, 22 bp, Homo sapiens
aggaaaaaaaaaaaaagaaatt

SEQ ID NO: 6640000 - DNA, 13 bp, Homo sapiens
aggaaaaaaaaca

SEQ ID NO: 6640001 - DNA, 13 bp, Homo sapiens
aggaaaaaaaata

SEQ ID NO: 6640002 - DNA, 14 bp, Homo sapiens
aggaaaaaaaataa

SEQ ID NO: 6640003 - DNA, 24 bp, Homo sapiens
aggaaaaaaactattaaggatgta

SEQ ID NO: 6640004 - DNA, 13 bp, Homo sapiens
aggaaaaaaactg

SEQ ID NO: 6640005 - DNA, 19 bp, Homo sapiens
aggaaaaaaactgggataa

SEQ ID NO: 6640006 - DNA, 14 bp, Homo sapiens
aggaaaaaaacttt

SEQ ID NO: 6640007 - DNA, 15 bp, Homo sapiens
aggaaaaaaactttt

SEQ ID NO: 6640008 - DNA, 16 bp, Homo sapiens
aggaaaaaaactttta

SEQ ID NO: 6640009 - DNA, 13 bp, Homo sapiens
aggaaaaaaatag

SEQ ID NO: 6640010 - DNA, 21 bp, Homo sapiens
aggaaaaaaatcgtccaggga

SEQ ID NO: 6640011 - DNA, 14 bp, Homo sapiens
aggaaaaaaatgac

SEQ ID NO: 6640012 - DNA, 15 bp, Homo sapiens
aggaaaaaaatgact

SEQ ID NO: 6640013 - DNA, 13 bp, Homo sapiens
aggaaaaaagaaa

SEQ ID NO: 6640014 - DNA, 19 bp, Homo sapiens
aggaaaaaaggaggataga

SEQ ID NO: 6640015 - DNA, 12 bp, Homo sapiens
aggaaaaaataa

SEQ ID NO: 6640016 - DNA, 18 bp, Homo sapiens
aggaaaaaataacaatga

SEQ ID NO: 6640017 - DNA, 18 bp, Homo sapiens
aggaaaaaataagagata

SEQ ID NO: 6640018 - DNA, 14 bp, Homo sapiens
aggaaaaaataata

SEQ ID NO: 6640019 - DNA, 18 bp, Homo sapiens
aggaaaaaatggtataaa

SEQ ID NO: 6640020 - DNA, 23 bp, Homo sapiens
aggaaaaaatgttggatttataa

SEQ ID NO: 6640021 - DNA, 19 bp, Homo sapiens
aggaaaaacaacaaataat

SEQ ID NO: 6640022 - DNA, 20 bp, Homo sapiens
aggaaaaacagaacatttct

SEQ ID NO: 6640023 - DNA, 23 bp, Homo sapiens
aggaaaaacagaggatgctgaag

SEQ ID NO: 6640024 - DNA, 13 bp, Homo sapiens
aggaaaaactgat

SEQ ID NO: 6640025 - DNA, 14 bp, Homo sapiens
aggaaaaagaaaaa

SEQ ID NO: 6640026 - DNA, 16 bp, Homo sapiens
aggaaaaagaaaaaca

SEQ ID NO: 6640027 - DNA, 14 bp, Homo sapiens
aggaaaaagaaaat

SEQ ID NO: 6640028 - DNA, 17 bp, Homo sapiens
aggaaaaagcacaagaa

SEQ ID NO: 6640029 - DNA, 12 bp, Homo sapiens
aggaaaaagctc

SEQ ID NO: 6640030 - DNA, 12 bp, Homo sapiens
aggaaaaaggac

SEQ ID NO: 6640031 - DNA, 23 bp, Homo sapiens
aggaaaaagtatcatggaaatat

SEQ ID NO: 6640032 - DNA, 13 bp, Homo sapiens
aggaaaaataaaa

SEQ ID NO: 6640033 - DNA, 14 bp, Homo sapiens
aggaaaaataaacg

SEQ ID NO: 6640034 - DNA, 14 bp, Homo sapiens
aggaaaaatatgtg

SEQ ID NO: 6640035 - DNA, 14 bp, Homo sapiens
aggaaaaatattta

SEQ ID NO: 6640036 - DNA, 13 bp, Homo sapiens
aggaaaaatgagg

SEQ ID NO: 6640037 - DNA, 18 bp, Homo sapiens
aggaaaaatgccactccc

SEQ ID NO: 6640038 - DNA, 20 bp, Homo sapiens
aggaaaaatgggagccagga

SEQ ID NO: 6640039 - DNA, 14 bp, Homo sapiens
aggaaaaatgtaga

SEQ ID NO: 6640040 - DNA, 14 bp, Homo sapiens
aggaaaaatgtgta

SEQ ID NO: 6640041 - DNA, 19 bp, Homo sapiens
aggaaaaatgtgtaatttt

SEQ ID NO: 6640042 - DNA, 14 bp, Homo sapiens
aggaaaacaaaaaa

SEQ ID NO: 6640043 - DNA, 22 bp, Homo sapiens
aggaaaacaattcaagctgaga

SEQ ID NO: 6640044 - DNA, 20 bp, Homo sapiens
aggaaaacacagcctccctg

SEQ ID NO: 6640045 - DNA, 20 bp, Homo sapiens
aggaaaacactatttccaaa

SEQ ID NO: 6640046 - DNA, 16 bp, Homo sapiens
aggaaaacagctagta

SEQ ID NO: 6640047 - DNA, 21 bp, Homo sapiens
aggaaaaccaagccgtggctt

SEQ ID NO: 6640048 - DNA, 13 bp, Homo sapiens
aggaaaactattc

SEQ ID NO: 6640049 - DNA, 18 bp, Homo sapiens
aggaaaactcttggcctc

SEQ ID NO: 6640050 - DNA, 22 bp, Homo sapiens
aggaaaactcttggcctctgct

SEQ ID NO: 6640051 - DNA, 23 bp, Homo sapiens
aggaaaactgaatccatctttgt

SEQ ID NO: 6640052 - DNA, 13 bp, Homo sapiens
aggaaaagaaaaa

SEQ ID NO: 6640053 - DNA, 14 bp, Homo sapiens
aggaaaagaaaaaa

SEQ ID NO: 6640054 - DNA, 15 bp, Homo sapiens
aggaaaagaaaaaaa

SEQ ID NO: 6640055 - DNA, 14 bp, Homo sapiens
aggaaaagaaaaga

SEQ ID NO: 6640056 - DNA, 17 bp, Homo sapiens
aggaaaagaaatctata

SEQ ID NO: 6640057 - DNA, 14 bp, Homo sapiens
aggaaaagaaggct

SEQ ID NO: 6640058 - DNA, 17 bp, Homo sapiens
aggaaaagaatctcctt

SEQ ID NO: 6640059 - DNA, 14 bp, Homo sapiens
aggaaaagacacat

SEQ ID NO: 6640060 - DNA, 13 bp, Homo sapiens
aggaaaagacaga

SEQ ID NO: 6640061 - DNA, 12 bp, Homo sapiens
aggaaaagagaa

SEQ ID NO: 6640062 - DNA, 15 bp, Homo sapiens
aggaaaagagaaaca

SEQ ID NO: 6640063 - DNA, 23 bp, Homo sapiens
aggaaaagagtatcaaaggcaga

SEQ ID NO: 6640064 - DNA, 13 bp, Homo sapiens
aggaaaagatatt

SEQ ID NO: 6640065 - DNA, 18 bp, Homo sapiens
aggaaaagattcaaagct

SEQ ID NO: 6640066 - DNA, 21 bp, Homo sapiens
aggaaaagcaagaaacagttt

SEQ ID NO: 6640067 - DNA, 12 bp, Homo sapiens
aggaaaagcaca

SEQ ID NO: 6640068 - DNA, 14 bp, Homo sapiens
aggaaaagcacaag

SEQ ID NO: 6640069 - DNA, 14 bp, Homo sapiens
aggaaaagcctctg

SEQ ID NO: 6640070 - DNA, 19 bp, Homo sapiens
aggaaaagcctctgtgtca

SEQ ID NO: 6640071 - DNA, 20 bp, Homo sapiens
aggaaaagcggacatcagct

SEQ ID NO: 6640072 - DNA, 14 bp, Homo sapiens
aggaaaagctgctg

SEQ ID NO: 6640073 - DNA, 16 bp, Homo sapiens
aggaaaagctgctgac

SEQ ID NO: 6640074 - DNA, 21 bp, Homo sapiens
aggaaaaggcccctgcaatgt

SEQ ID NO: 6640075 - DNA, 22 bp, Homo sapiens
aggaaaaggcccctgcaatgtg

SEQ ID NO: 6640076 - DNA, 15 bp, Homo sapiens
aggaaaaggcctggg

SEQ ID NO: 6640077 - DNA, 16 bp, Homo sapiens
aggaaaaggcctgggg

SEQ ID NO: 6640078 - DNA, 16 bp, Homo sapiens
aggaaaaggctgcagc

SEQ ID NO: 6640079 - DNA, 14 bp, Homo sapiens
aggaaaaggcttga

SEQ ID NO: 6640080 - DNA, 22 bp, Homo sapiens
aggaaaaggtccttgcctcctg

SEQ ID NO: 6640081 - DNA, 18 bp, Homo sapiens
aggaaaaggtgatatcca

SEQ ID NO: 6640082 - DNA, 21 bp, Homo sapiens
aggaaaaggtgatatccattc

SEQ ID NO: 6640083 - DNA, 17 bp, Homo sapiens
aggaaaaggttgaataa

SEQ ID NO: 6640084 - DNA, 19 bp, Homo sapiens
aggaaaagtacatttaata

SEQ ID NO: 6640085 - DNA, 22 bp, Homo sapiens
aggaaaagtacatttaatacag

SEQ ID NO: 6640086 - DNA, 19 bp, Homo sapiens
aggaaaagtcaacatcttc

SEQ ID NO: 6640087 - DNA, 22 bp, Homo sapiens
aggaaaagtccacaagaacaat

SEQ ID NO: 6640088 - DNA, 16 bp, Homo sapiens
aggaaaagtcttccta

SEQ ID NO: 6640089 - DNA, 17 bp, Homo sapiens
aggaaaagtgcaatgcg

SEQ ID NO: 6640090 - DNA, 16 bp, Homo sapiens
aggaaaagttctttca

SEQ ID NO: 6640091 - DNA, 23 bp, Homo sapiens
aggaaaagtttaatattaaagcc

SEQ ID NO: 6640092 - DNA, 15 bp, Homo sapiens
aggaaaataagtgaa

SEQ ID NO: 6640093 - DNA, 20 bp, Homo sapiens
aggaaaataatacttatctt

SEQ ID NO: 6640094 - DNA, 16 bp, Homo sapiens
aggaaaatagtttagg

SEQ ID NO: 6640095 - DNA, 20 bp, Homo sapiens
aggaaaatgacttgtaaggt

SEQ ID NO: 6640096 - DNA, 22 bp, Homo sapiens
aggaaaatgcttctgttgtaat

SEQ ID NO: 6640097 - DNA, 14 bp, Homo sapiens
aggaaaatgtctgt

SEQ ID NO: 6640098 - DNA, 20 bp, Homo sapiens
aggaaaatgtctgtaataat

SEQ ID NO: 6640099 - DNA, 23 bp, Homo sapiens
aggaaaatgtctgtaataataga

SEQ ID NO: 6640100 - DNA, 14 bp, Homo sapiens
aggaaaatgtgagg

SEQ ID NO: 6640101 - DNA, 18 bp, Homo sapiens
aggaaaattgaaagtatt

SEQ ID NO: 6640102 - DNA, 16 bp, Homo sapiens
aggaaaattgaatgca

SEQ ID NO: 6640103 - DNA, 19 bp, Homo sapiens
aggaaacaacaaaggaagt

SEQ ID NO: 6640104 - DNA, 22 bp, Homo sapiens
aggaaacaacaaaggaagtgag

SEQ ID NO: 6640105 - DNA, 16 bp, Homo sapiens
aggaaacaagggaagg

SEQ ID NO: 6640106 - DNA, 17 bp, Homo sapiens
aggaaacaagggaaggg

SEQ ID NO: 6640107 - DNA, 18 bp, Homo sapiens
aggaaacacgtttagaaa

SEQ ID NO: 6640108 - DNA, 18 bp, Homo sapiens
aggaaacagaaaagagaa

SEQ ID NO: 6640109 - DNA, 19 bp, Homo sapiens
aggaaacagttgcatgtag

SEQ ID NO: 6640110 - DNA, 13 bp, Homo sapiens
aggaaacatagaa

SEQ ID NO: 6640111 - DNA, 14 bp, Homo sapiens
aggaaacatagaaa

SEQ ID NO: 6640112 - DNA, 18 bp, Homo sapiens
aggaaacatatttaagaa

SEQ ID NO: 6640113 - DNA, 21 bp, Homo sapiens
aggaaacattggcataatttt

SEQ ID NO: 6640114 - DNA, 12 bp, Homo sapiens
aggaaaccaaag

SEQ ID NO: 6640115 - DNA, 11 bp, Homo sapiens
aggaaaccaag

SEQ ID NO: 6640116 - DNA, 19 bp, Homo sapiens
aggaaaccacaaccttgca

SEQ ID NO: 6640117 - DNA, 15 bp, Homo sapiens
aggaaaccagctcgt

SEQ ID NO: 6640118 - DNA, 17 bp, Homo sapiens
aggaaaccagctcgtgg

SEQ ID NO: 6640119 - DNA, 23 bp, Homo sapiens
aggaaaccagttaggtctcaata

SEQ ID NO: 6640120 - DNA, 16 bp, Homo sapiens
aggaaacccagctctg

SEQ ID NO: 6640121 - DNA, 21 bp, Homo sapiens
aggaaacccagctctggtcca

SEQ ID NO: 6640122 - DNA, 21 bp, Homo sapiens
aggaaaccgcctagtttactg

SEQ ID NO: 6640123 - DNA, 22 bp, Homo sapiens
aggaaaccgcctagtttactgt

SEQ ID NO: 6640124 - DNA, 22 bp, Homo sapiens
aggaaacgccccgggcaaaggg

SEQ ID NO: 6640125 - DNA, 19 bp, Homo sapiens
aggaaactaagcattgtat

SEQ ID NO: 6640126 - DNA, 22 bp, Homo sapiens
aggaaactcacctgctggcccc

SEQ ID NO: 6640127 - DNA, 23 bp, Homo sapiens
aggaaactcacctgctggcccct

SEQ ID NO: 6640128 - DNA, 21 bp, Homo sapiens
aggaaactctgcattctagta

SEQ ID NO: 6640129 - DNA, 18 bp, Homo sapiens
aggaaactgagtcactca

SEQ ID NO: 6640130 - DNA, 15 bp, Homo sapiens
aggaaacttccaact

SEQ ID NO: 6640131 - DNA, 20 bp, Homo sapiens
aggaaactttatttaaatgc

SEQ ID NO: 6640132 - DNA, 22 bp, Homo sapiens
aggaaactttatttaaatgcat

SEQ ID NO: 6640133 - DNA, 24 bp, Homo sapiens
aggaaactttatttaaatgcatgt

SEQ ID NO: 6640134 - DNA, 12 bp, Homo sapiens
aggaaagaaaac

SEQ ID NO: 6640135 - DNA, 14 bp, Homo sapiens
aggaaagaaccgaa

SEQ ID NO: 6640136 - DNA, 12 bp, Homo sapiens
aggaaagaacta

SEQ ID NO: 6640137 - DNA, 12 bp, Homo sapiens
aggaaagaagga

SEQ ID NO: 6640138 - DNA, 13 bp, Homo sapiens
aggaaagaaggag

SEQ ID NO: 6640139 - DNA, 17 bp, Homo sapiens
aggaaagaaggagatga

SEQ ID NO: 6640140 - DNA, 21 bp, Homo sapiens
aggaaagaagggggccctgct

SEQ ID NO: 6640141 - DNA, 23 bp, Homo sapiens
aggaaagaatttgtatcatgttt

SEQ ID NO: 6640142 - DNA, 15 bp, Homo sapiens
aggaaagacaacaca

SEQ ID NO: 6640143 - DNA, 17 bp, Homo sapiens
aggaaagagaggaacca

SEQ ID NO: 6640144 - DNA, 18 bp, Homo sapiens
aggaaagagcagtcagag

SEQ ID NO: 6640145 - DNA, 17 bp, Homo sapiens
aggaaagaggaagcaaa

SEQ ID NO: 6640146 - DNA, 13 bp, Homo sapiens
aggaaagaggagg

SEQ ID NO: 6640147 - DNA, 12 bp, Homo sapiens
aggaaagaggct

SEQ ID NO: 6640148 - DNA, 22 bp, Homo sapiens
aggaaagatttttgttgttatt

SEQ ID NO: 6640149 - DNA, 19 bp, Homo sapiens
aggaaagcaaaggagattg

SEQ ID NO: 6640150 - DNA, 19 bp, Homo sapiens
aggaaagcaataaatgaat

SEQ ID NO: 6640151 - DNA, 13 bp, Homo sapiens
aggaaagcacaga

SEQ ID NO: 6640152 - DNA, 16 bp, Homo sapiens
aggaaagcagtgtgtc

SEQ ID NO: 6640153 - DNA, 19 bp, Homo sapiens
aggaaagcagttgaaatga

SEQ ID NO: 6640154 - DNA, 16 bp, Homo sapiens
aggaaagccacatctt

SEQ ID NO: 6640155 - DNA, 14 bp, Homo sapiens
aggaaagccctccc

SEQ ID NO: 6640156 - DNA, 16 bp, Homo sapiens
aggaaagcctcactga

SEQ ID NO: 6640157 - DNA, 24 bp, Homo sapiens
aggaaagcgcctccaaccctagca

SEQ ID NO: 6640158 - DNA, 22 bp, Homo sapiens
aggaaagctttggcagtgtttt

SEQ ID NO: 6640159 - DNA, 13 bp, Homo sapiens
aggaaaggaggac

SEQ ID NO: 6640160 - DNA, 15 bp, Homo sapiens
aggaaaggattttac

SEQ ID NO: 6640161 - DNA, 23 bp, Homo sapiens
aggaaaggattttaccaaagcat

SEQ ID NO: 6640162 - DNA, 13 bp, Homo sapiens
aggaaaggcagaa

SEQ ID NO: 6640163 - DNA, 14 bp, Homo sapiens
aggaaaggcagaaa

SEQ ID NO: 6640164 - DNA, 13 bp, Homo sapiens
aggaaaggccagc

SEQ ID NO: 6640165 - DNA, 16 bp, Homo sapiens
aggaaaggccagctgg

SEQ ID NO: 6640166 - DNA, 17 bp, Homo sapiens
aggaaaggccagctggc

SEQ ID NO: 6640167 - DNA, 18 bp, Homo sapiens
aggaaaggccagctggca

SEQ ID NO: 6640168 - DNA, 21 bp, Homo sapiens
aggaaaggccagctggcagca

SEQ ID NO: 6640169 - DNA, 21 bp, Homo sapiens
aggaaaggctcatttaaaaca

SEQ ID NO: 6640170 - DNA, 20 bp, Homo sapiens
aggaaaggctccaggagcag

SEQ ID NO: 6640171 - DNA, 20 bp, Homo sapiens
aggaaaggcttggctggtgt

SEQ ID NO: 6640172 - DNA, 21 bp, Homo sapiens
aggaaagggaagcctgactgc

SEQ ID NO: 6640173 - DNA, 22 bp, Homo sapiens
aggaaagggaagcctgactgct

SEQ ID NO: 6640174 - DNA, 17 bp, Homo sapiens
aggaaagggctggctcc

SEQ ID NO: 6640175 - DNA, 22 bp, Homo sapiens
aggaaagggctggctccccctc

SEQ ID NO: 6640176 - DNA, 21 bp, Homo sapiens
aggaaagggggtcccagtggg

SEQ ID NO: 6640177 - DNA, 20 bp, Homo sapiens
aggaaagggttcacataggc

SEQ ID NO: 6640178 - DNA, 18 bp, Homo sapiens
aggaaagtagtccaggct

SEQ ID NO: 6640179 - DNA, 22 bp, Homo sapiens
aggaaagtggcacctgtctgct

SEQ ID NO: 6640180 - DNA, 15 bp, Homo sapiens
aggaaagtgtatgag

SEQ ID NO: 6640181 - DNA, 15 bp, Homo sapiens
aggaaagtgtgaaga

SEQ ID NO: 6640182 - DNA, 17 bp, Homo sapiens
aggaaagtgtgaagacc

SEQ ID NO: 6640183 - DNA, 13 bp, Homo sapiens
aggaaagttctat

SEQ ID NO: 6640184 - DNA, 19 bp, Homo sapiens
aggaaagttctattatctg

SEQ ID NO: 6640185 - DNA, 21 bp, Homo sapiens
aggaaagtttacccatgaaga

SEQ ID NO: 6640186 - DNA, 20 bp, Homo sapiens
aggaaagtttgccaggagga

SEQ ID NO: 6640187 - DNA, 20 bp, Homo sapiens
aggaaataaaaaagtctcta

SEQ ID NO: 6640188 - DNA, 22 bp, Homo sapiens
aggaaataaaaaagtctctatt

SEQ ID NO: 6640189 - DNA, 21 bp, Homo sapiens
aggaaataaaacctttcaaat

SEQ ID NO: 6640190 - DNA, 22 bp, Homo sapiens
aggaaataaaggtaaaatcact

SEQ ID NO: 6640191 - DNA, 19 bp, Homo sapiens
aggaaataacagagagaat

SEQ ID NO: 6640192 - DNA, 12 bp, Homo sapiens
aggaaataacat

SEQ ID NO: 6640193 - DNA, 17 bp, Homo sapiens
aggaaataacattgcac

SEQ ID NO: 6640194 - DNA, 17 bp, Homo sapiens
aggaaataactaagaga

SEQ ID NO: 6640195 - DNA, 18 bp, Homo sapiens
aggaaataagaaaaatca

SEQ ID NO: 6640196 - DNA, 18 bp, Homo sapiens
aggaaataagacttttag

SEQ ID NO: 6640197 - DNA, 21 bp, Homo sapiens
aggaaataagagcagtcacaa

SEQ ID NO: 6640198 - DNA, 16 bp, Homo sapiens
aggaaatagtgttctt

SEQ ID NO: 6640199 - DNA, 18 bp, Homo sapiens
aggaaatagtgttctttt

SEQ ID NO: 6640200 - DNA, 19 bp, Homo sapiens
aggaaatatatttgtaaaa

SEQ ID NO: 6640201 - DNA, 13 bp, Homo sapiens
aggaaatatctgt

SEQ ID NO: 6640202 - DNA, 14 bp, Homo sapiens
aggaaatattaatt

SEQ ID NO: 6640203 - DNA, 13 bp, Homo sapiens
aggaaatcaaagt

SEQ ID NO: 6640204 - DNA, 23 bp, Homo sapiens
aggaaatcaaatatgcaaagcac

SEQ ID NO: 6640205 - DNA, 15 bp, Homo sapiens
aggaaatcagagctg

SEQ ID NO: 6640206 - DNA, 11 bp, Homo sapiens
aggaaatccat

SEQ ID NO: 6640207 - DNA, 16 bp, Homo sapiens
aggaaatccattgttt

SEQ ID NO: 6640208 - DNA, 19 bp, Homo sapiens
aggaaatccattgtttaaa

SEQ ID NO: 6640209 - DNA, 14 bp, Homo sapiens
aggaaatcccttca

SEQ ID NO: 6640210 - DNA, 21 bp, Homo sapiens
aggaaatccggtcagccaagt

SEQ ID NO: 6640211 - DNA, 14 bp, Homo sapiens
aggaaatctcaccc

SEQ ID NO: 6640212 - DNA, 22 bp, Homo sapiens
aggaaatcttgtccagagacaa

SEQ ID NO: 6640213 - DNA, 19 bp, Homo sapiens
aggaaatgaaaatgtcttg

SEQ ID NO: 6640214 - DNA, 14 bp, Homo sapiens
aggaaatgaatgtg

SEQ ID NO: 6640215 - DNA, 17 bp, Homo sapiens
aggaaatgaatgtgtgt

SEQ ID NO: 6640216 - DNA, 16 bp, Homo sapiens
aggaaatgaatttctc

SEQ ID NO: 6640217 - DNA, 20 bp, Homo sapiens
aggaaatggctgtggagtgt

SEQ ID NO: 6640218 - DNA, 14 bp, Homo sapiens
aggaaatgtgctca

SEQ ID NO: 6640219 - DNA, 21 bp, Homo sapiens
aggaaatgtgctcaaattact

SEQ ID NO: 6640220 - DNA, 23 bp, Homo sapiens
aggaaatgtggtagcctcacttt

SEQ ID NO: 6640221 - DNA, 16 bp, Homo sapiens
aggaaatgttggaact

SEQ ID NO: 6640222 - DNA, 22 bp, Homo sapiens
aggaaatgtttttaataaaaga

SEQ ID NO: 6640223 - DNA, 13 bp, Homo sapiens
aggaaattaaata

SEQ ID NO: 6640224 - DNA, 14 bp, Homo sapiens
aggaaattaaataa

SEQ ID NO: 6640225 - DNA, 13 bp, Homo sapiens
aggaaattaagaa

SEQ ID NO: 6640226 - DNA, 19 bp, Homo sapiens
aggaaattaagaactgaat

SEQ ID NO: 6640227 - DNA, 17 bp, Homo sapiens
aggaaattgattttgaa

SEQ ID NO: 6640228 - DNA, 18 bp, Homo sapiens
aggaaattgattttgaaa

SEQ ID NO: 6640229 - DNA, 14 bp, Homo sapiens
aggaaatttgcagc

SEQ ID NO: 6640230 - DNA, 15 bp, Homo sapiens
aggaaatttttgcat

SEQ ID NO: 6640231 - DNA, 16 bp, Homo sapiens
aggaacaaaaaaacca

SEQ ID NO: 6640232 - DNA, 18 bp, Homo sapiens
aggaacaaaaaaaccaca

SEQ ID NO: 6640233 - DNA, 14 bp, Homo sapiens
aggaacaaagacag

SEQ ID NO: 6640234 - DNA, 13 bp, Homo sapiens
aggaacaaatctt

SEQ ID NO: 6640235 - DNA, 15 bp, Homo sapiens
aggaacaaatcttcc

SEQ ID NO: 6640236 - DNA, 17 bp, Homo sapiens
aggaacaaatcttcctg

SEQ ID NO: 6640237 - DNA, 14 bp, Homo sapiens
aggaacaagctggc

SEQ ID NO: 6640238 - DNA, 18 bp, Homo sapiens
aggaacaagctggcttct

SEQ ID NO: 6640239 - DNA, 22 bp, Homo sapiens
aggaacaagctggcttctgtga

SEQ ID NO: 6640240 - DNA, 23 bp, Homo sapiens
aggaacaaggcaaggctgtcaat

SEQ ID NO: 6640241 - DNA, 17 bp, Homo sapiens
aggaacaatcggctgca

SEQ ID NO: 6640242 - DNA, 23 bp, Homo sapiens
aggaacacaggcgctgagtatgg

SEQ ID NO: 6640243 - DNA, 13 bp, Homo sapiens
aggaacacatgca

SEQ ID NO: 6640244 - DNA, 16 bp, Homo sapiens
aggaacacatgcacac

SEQ ID NO: 6640245 - DNA, 19 bp, Homo sapiens
aggaacacatgcacacaca

SEQ ID NO: 6640246 - DNA, 16 bp, Homo sapiens
aggaacacccagcccc

SEQ ID NO: 6640247 - DNA, 17 bp, Homo sapiens
aggaacacccagcccca

SEQ ID NO: 6640248 - DNA, 18 bp, Homo sapiens
aggaacacccggaaagac

SEQ ID NO: 6640249 - DNA, 13 bp, Homo sapiens
aggaacacctgat

SEQ ID NO: 6640250 - DNA, 12 bp, Homo sapiens
aggaacactcct

SEQ ID NO: 6640251 - DNA, 15 bp, Homo sapiens
aggaacactccttca

SEQ ID NO: 6640252 - DNA, 12 bp, Homo sapiens
aggaacactgac

SEQ ID NO: 6640253 - DNA, 12 bp, Homo sapiens
aggaacactggc

SEQ ID NO: 6640254 - DNA, 14 bp, Homo sapiens
aggaacagaaggat

SEQ ID NO: 6640255 - DNA, 13 bp, Homo sapiens
aggaacagagact

SEQ ID NO: 6640256 - DNA, 17 bp, Homo sapiens
aggaacagagactctgg

SEQ ID NO: 6640257 - DNA, 21 bp, Homo sapiens
aggaacagagactctggaagc

SEQ ID NO: 6640258 - DNA, 16 bp, Homo sapiens
aggaacagagtatata

SEQ ID NO: 6640259 - DNA, 13 bp, Homo sapiens
aggaacagccaca

SEQ ID NO: 6640260 - DNA, 13 bp, Homo sapiens
aggaacagcccag

SEQ ID NO: 6640261 - DNA, 14 bp, Homo sapiens
aggaacagcccagc

SEQ ID NO: 6640262 - DNA, 16 bp, Homo sapiens
aggaacagcccagcac

SEQ ID NO: 6640263 - DNA, 21 bp, Homo sapiens
aggaacagctatgggagcccc

SEQ ID NO: 6640264 - DNA, 11 bp, Homo sapiens
aggaacaggga

SEQ ID NO: 6640265 - DNA, 14 bp, Homo sapiens
aggaacagggacca

SEQ ID NO: 6640266 - DNA, 15 bp, Homo sapiens
aggaacagtggctgg

SEQ ID NO: 6640267 - DNA, 16 bp, Homo sapiens
aggaacagtggctggg

SEQ ID NO: 6640268 - DNA, 21 bp, Homo sapiens
aggaacagtgtggtttgggaa

SEQ ID NO: 6640269 - DNA, 16 bp, Homo sapiens
aggaacatatgaaaat

SEQ ID NO: 6640270 - DNA, 22 bp, Homo sapiens
aggaacatccggaacagccaaa

SEQ ID NO: 6640271 - DNA, 20 bp, Homo sapiens
aggaacatgacccgtacaca

SEQ ID NO: 6640272 - DNA, 17 bp, Homo sapiens
aggaacattcccacata

SEQ ID NO: 6640273 - DNA, 20 bp, Homo sapiens
aggaacattgggaaggaagc

SEQ ID NO: 6640274 - DNA, 11 bp, Homo sapiens
aggaaccaaaa

SEQ ID NO: 6640275 - DNA, 12 bp, Homo sapiens
aggaaccaaaaa

SEQ ID NO: 6640276 - DNA, 13 bp, Homo sapiens
aggaaccaacaat

SEQ ID NO: 6640277 - DNA, 23 bp, Homo sapiens
aggaaccacaatgtttcttcatt

SEQ ID NO: 6640278 - DNA, 15 bp, Homo sapiens
aggaaccacaccaca

SEQ ID NO: 6640279 - DNA, 16 bp, Homo sapiens
aggaaccataatcaat

SEQ ID NO: 6640280 - DNA, 13 bp, Homo sapiens
aggaacccaagat

SEQ ID NO: 6640281 - DNA, 16 bp, Homo sapiens
aggaacccagctctca

SEQ ID NO: 6640282 - DNA, 21 bp, Homo sapiens
aggaacccagctctcagggct

SEQ ID NO: 6640283 - DNA, 20 bp, Homo sapiens
aggaacccatcactgtgtct

SEQ ID NO: 6640284 - DNA, 22 bp, Homo sapiens
aggaacccatctaaaccagaag

SEQ ID NO: 6640285 - DNA, 16 bp, Homo sapiens
aggaacccccaccaga

SEQ ID NO: 6640286 - DNA, 21 bp, Homo sapiens
aggaacccttgcatccattgt

SEQ ID NO: 6640287 - DNA, 20 bp, Homo sapiens
aggaaccgtggtatgtctgc

SEQ ID NO: 6640288 - DNA, 15 bp, Homo sapiens
aggaacctaattgaa

SEQ ID NO: 6640289 - DNA, 16 bp, Homo sapiens
aggaacctcaaactgg

SEQ ID NO: 6640290 - DNA, 14 bp, Homo sapiens
aggaacctctgatt

SEQ ID NO: 6640291 - DNA, 14 bp, Homo sapiens
aggaacctgaacct

SEQ ID NO: 6640292 - DNA, 13 bp, Homo sapiens
aggaacctggacc

SEQ ID NO: 6640293 - DNA, 20 bp, Homo sapiens
aggaacctggaccaaagctg

SEQ ID NO: 6640294 - DNA, 13 bp, Homo sapiens
aggaacctgtcct

SEQ ID NO: 6640295 - DNA, 19 bp, Homo sapiens
aggaaccttccttcctgct

SEQ ID NO: 6640296 - DNA, 22 bp, Homo sapiens
aggaaccttccttcctgcttga

SEQ ID NO: 6640297 - DNA, 14 bp, Homo sapiens
aggaacgagcactg

SEQ ID NO: 6640298 - DNA, 21 bp, Homo sapiens
aggaacgctaacaatttctca

SEQ ID NO: 6640299 - DNA, 14 bp, Homo sapiens
aggaacggccctgc

SEQ ID NO: 6640300 - DNA, 15 bp, Homo sapiens
aggaacggcttcctc

SEQ ID NO: 6640301 - DNA, 16 bp, Homo sapiens
aggaacggcttcctca

SEQ ID NO: 6640302 - DNA, 15 bp, Homo sapiens
aggaacgggcagcca

SEQ ID NO: 6640303 - DNA, 16 bp, Homo sapiens
aggaacggtaaatttc

SEQ ID NO: 6640304 - DNA, 22 bp, Homo sapiens
aggaacgtaatcgtgtccccta

SEQ ID NO: 6640305 - DNA, 20 bp, Homo sapiens
aggaacgtggttcagagact

SEQ ID NO: 6640306 - DNA, 23 bp, Homo sapiens
aggaactagaaagaaggacccag

SEQ ID NO: 6640307 - DNA, 22 bp, Homo sapiens
aggaactaggatagatgtgatt

SEQ ID NO: 6640308 - DNA, 12 bp, Homo sapiens
aggaactcacat

SEQ ID NO: 6640309 - DNA, 22 bp, Homo sapiens
aggaactccccttcttcctgga

SEQ ID NO: 6640310 - DNA, 12 bp, Homo sapiens
aggaactctaga

SEQ ID NO: 6640311 - DNA, 17 bp, Homo sapiens
aggaactctagagggcg

SEQ ID NO: 6640312 - DNA, 14 bp, Homo sapiens
aggaactctggacc

SEQ ID NO: 6640313 - DNA, 16 bp, Homo sapiens
aggaactctggcttcc

SEQ ID NO: 6640314 - DNA, 17 bp, Homo sapiens
aggaactctgtgtgaga

SEQ ID NO: 6640315 - DNA, 16 bp, Homo sapiens
aggaactgcctgggcc

SEQ ID NO: 6640316 - DNA, 18 bp, Homo sapiens
aggaactggctcctttgc

SEQ ID NO: 6640317 - DNA, 20 bp, Homo sapiens
aggaactggctcctttgcct

SEQ ID NO: 6640318 - DNA, 21 bp, Homo sapiens
aggaactggctcctttgcctc

SEQ ID NO: 6640319 - DNA, 13 bp, Homo sapiens
aggaactgggcct

SEQ ID NO: 6640320 - DNA, 18 bp, Homo sapiens
aggaactgggcctgttgc

SEQ ID NO: 6640321 - DNA, 13 bp, Homo sapiens
aggaactgggctg

SEQ ID NO: 6640322 - DNA, 16 bp, Homo sapiens
aggaactgggctgggc

SEQ ID NO: 6640323 - DNA, 18 bp, Homo sapiens
aggaactgggctgggcct

SEQ ID NO: 6640324 - DNA, 19 bp, Homo sapiens
aggaactgggtgactggag

SEQ ID NO: 6640325 - DNA, 20 bp, Homo sapiens
aggaactggtccaggccagg

SEQ ID NO: 6640326 - DNA, 15 bp, Homo sapiens
aggaactgtacagaa

SEQ ID NO: 6640327 - DNA, 19 bp, Homo sapiens
aggaactgtccagagagca

SEQ ID NO: 6640328 - DNA, 20 bp, Homo sapiens
aggaactgtccagagagcaa

SEQ ID NO: 6640329 - DNA, 17 bp, Homo sapiens
aggaactgtctcaaaag

SEQ ID NO: 6640330 - DNA, 20 bp, Homo sapiens
aggaactgtctcaaaaggat

SEQ ID NO: 6640331 - DNA, 16 bp, Homo sapiens
aggaactgtgtgtgtc

SEQ ID NO: 6640332 - DNA, 14 bp, Homo sapiens
aggaacttccaggt

SEQ ID NO: 6640333 - DNA, 15 bp, Homo sapiens
aggaacttctagctc

SEQ ID NO: 6640334 - DNA, 18 bp, Homo sapiens
aggaacttgaaaaatact

SEQ ID NO: 6640335 - DNA, 15 bp, Homo sapiens
aggaacttgccctga

SEQ ID NO: 6640336 - DNA, 19 bp, Homo sapiens
aggaacttgctgctgtgcc

SEQ ID NO: 6640337 - DNA, 15 bp, Homo sapiens
aggaacttttgttag

SEQ ID NO: 6640338 - DNA, 20 bp, Homo sapiens
aggaagaaaccccaagcagc

SEQ ID NO: 6640339 - DNA, 21 bp, Homo sapiens
aggaagaaaccccaagcagca

SEQ ID NO: 6640340 - DNA, 15 bp, Homo sapiens
aggaagaaagaatgt

SEQ ID NO: 6640341 - DNA, 19 bp, Homo sapiens
aggaagaaattcaggtaca

SEQ ID NO: 6640342 - DNA, 17 bp, Homo sapiens
aggaagaacagtacatt

SEQ ID NO: 6640343 - DNA, 21 bp, Homo sapiens
aggaagaacgcggtgtgtaac

SEQ ID NO: 6640344 - DNA, 18 bp, Homo sapiens
aggaagaacggggctctt

SEQ ID NO: 6640345 - DNA, 19 bp, Homo sapiens
aggaagaacttgaagtgaa

SEQ ID NO: 6640346 - DNA, 17 bp, Homo sapiens
aggaagaagcttaggca

SEQ ID NO: 6640347 - DNA, 18 bp, Homo sapiens
aggaagaagcttaggcag

SEQ ID NO: 6640348 - DNA, 15 bp, Homo sapiens
aggaagaaggcagtg

SEQ ID NO: 6640349 - DNA, 18 bp, Homo sapiens
aggaagaaggcccgggag

SEQ ID NO: 6640350 - DNA, 18 bp, Homo sapiens
aggaagaatagggcccat

SEQ ID NO: 6640351 - DNA, 19 bp, Homo sapiens
aggaagaatataatgggaa

SEQ ID NO: 6640352 - DNA, 21 bp, Homo sapiens
aggaagaatgggctgcagaag

SEQ ID NO: 6640353 - DNA, 15 bp, Homo sapiens
aggaagaattttaaa

SEQ ID NO: 6640354 - DNA, 20 bp, Homo sapiens
aggaagaattttaaaaatga

SEQ ID NO: 6640355 - DNA, 16 bp, Homo sapiens
aggaagacacagccca

SEQ ID NO: 6640356 - DNA, 17 bp, Homo sapiens
aggaagacagttctaca

SEQ ID NO: 6640357 - DNA, 14 bp, Homo sapiens
aggaagacataaaa

SEQ ID NO: 6640358 - DNA, 17 bp, Homo sapiens
aggaagacataaaactt

SEQ ID NO: 6640359 - DNA, 20 bp, Homo sapiens
aggaagacataaaactttaa

SEQ ID NO: 6640360 - DNA, 18 bp, Homo sapiens
aggaagacccaacacatg

SEQ ID NO: 6640361 - DNA, 16 bp, Homo sapiens
aggaagaccctgccat

SEQ ID NO: 6640362 - DNA, 17 bp, Homo sapiens
aggaagacctcaagaaa

SEQ ID NO: 6640363 - DNA, 20 bp, Homo sapiens
aggaagactctggagccaag

SEQ ID NO: 6640364 - DNA, 14 bp, Homo sapiens
aggaagactggaga

SEQ ID NO: 6640365 - DNA, 21 bp, Homo sapiens
aggaagacttccagctttctc

SEQ ID NO: 6640366 - DNA, 13 bp, Homo sapiens
aggaagactttgt

SEQ ID NO: 6640367 - DNA, 14 bp, Homo sapiens
aggaagagaaacca

SEQ ID NO: 6640368 - DNA, 23 bp, Homo sapiens
aggaagagacatgagaaagggag

SEQ ID NO: 6640369 - DNA, 19 bp, Homo sapiens
aggaagagagagagagagg

SEQ ID NO: 6640370 - DNA, 20 bp, Homo sapiens
aggaagagcaggcacatgga

SEQ ID NO: 6640371 - DNA, 23 bp, Homo sapiens
aggaagagcaggcacatggagga

SEQ ID NO: 6640372 - DNA, 13 bp, Homo sapiens
aggaagagccacc

SEQ ID NO: 6640373 - DNA, 16 bp, Homo sapiens
aggaagagccacctgc

SEQ ID NO: 6640374 - DNA, 17 bp, Homo sapiens
aggaagagccacctgca

SEQ ID NO: 6640375 - DNA, 15 bp, Homo sapiens
aggaagagccagccg

SEQ ID NO: 6640376 - DNA, 21 bp, Homo sapiens
aggaagagccttccacccagg

SEQ ID NO: 6640377 - DNA, 12 bp, Homo sapiens
aggaagaggccc

SEQ ID NO: 6640378 - DNA, 17 bp, Homo sapiens
aggaagaggcccactag

SEQ ID NO: 6640379 - DNA, 21 bp, Homo sapiens
aggaagaggcccactagaggg

SEQ ID NO: 6640380 - DNA, 23 bp, Homo sapiens
aggaagaggcccactagagggcc

SEQ ID NO: 6640381 - DNA, 14 bp, Homo sapiens
aggaagagtttatg

SEQ ID NO: 6640382 - DNA, 14 bp, Homo sapiens
aggaagataaaaat

SEQ ID NO: 6640383 - DNA, 23 bp, Homo sapiens
aggaagatattggtggccggtgg

SEQ ID NO: 6640384 - DNA, 20 bp, Homo sapiens
aggaagatcactttgctctg

SEQ ID NO: 6640385 - DNA, 20 bp, Homo sapiens
aggaagatctctgcagggcc

SEQ ID NO: 6640386 - DNA, 17 bp, Homo sapiens
aggaagatgggaggtgg

SEQ ID NO: 6640387 - DNA, 19 bp, Homo sapiens
aggaagatgggggcaagaa

SEQ ID NO: 6640388 - DNA, 22 bp, Homo sapiens
aggaagatgggggcaagaagat

SEQ ID NO: 6640389 - DNA, 17 bp, Homo sapiens
aggaagatgtttacatt

SEQ ID NO: 6640390 - DNA, 23 bp, Homo sapiens
aggaagattaaaaccacagaaca

SEQ ID NO: 6640391 - DNA, 23 bp, Homo sapiens
aggaagatttgacgttgttgtca

SEQ ID NO: 6640392 - DNA, 16 bp, Homo sapiens
aggaagcaaactaagc

SEQ ID NO: 6640393 - DNA, 16 bp, Homo sapiens
aggaagcaaagagtga

SEQ ID NO: 6640394 - DNA, 17 bp, Homo sapiens
aggaagcaaggccagcc

SEQ ID NO: 6640395 - DNA, 17 bp, Homo sapiens
aggaagcacaaaagaca

SEQ ID NO: 6640396 - DNA, 18 bp, Homo sapiens
aggaagcacaagaagtgg

SEQ ID NO: 6640397 - DNA, 17 bp, Homo sapiens
aggaagcacactgcagg

SEQ ID NO: 6640398 - DNA, 11 bp, Homo sapiens
aggaagcacat

SEQ ID NO: 6640399 - DNA, 22 bp, Homo sapiens
aggaagcacatgcctctctcag

SEQ ID NO: 6640400 - DNA, 23 bp, Homo sapiens
aggaagcactgaaaatagtgttc

SEQ ID NO: 6640401 - DNA, 11 bp, Homo sapiens
aggaagcagaa

SEQ ID NO: 6640402 - DNA, 12 bp, Homo sapiens
aggaagcagaag

SEQ ID NO: 6640403 - DNA, 15 bp, Homo sapiens
aggaagcagaagacg

SEQ ID NO: 6640404 - DNA, 18 bp, Homo sapiens
aggaagcagaagacggga

SEQ ID NO: 6640405 - DNA, 22 bp, Homo sapiens
aggaagcagaagacgggagggg

SEQ ID NO: 6640406 - DNA, 14 bp, Homo sapiens
aggaagcagaataa

SEQ ID NO: 6640407 - DNA, 15 bp, Homo sapiens
aggaagcagaataaa

SEQ ID NO: 6640408 - DNA, 18 bp, Homo sapiens
aggaagcagaataaagca

SEQ ID NO: 6640409 - DNA, 21 bp, Homo sapiens
aggaagcagaataaagcaatt

SEQ ID NO: 6640410 - DNA, 22 bp, Homo sapiens
aggaagcagaataaagcaattt

SEQ ID NO: 6640411 - DNA, 23 bp, Homo sapiens
aggaagcagaataaagcaatttt

SEQ ID NO: 6640412 - DNA, 21 bp, Homo sapiens
aggaagcagagcactgtgtaa

SEQ ID NO: 6640413 - DNA, 17 bp, Homo sapiens
aggaagcagcctcagag

SEQ ID NO: 6640414 - DNA, 14 bp, Homo sapiens
aggaagcagggaga

SEQ ID NO: 6640415 - DNA, 14 bp, Homo sapiens
aggaagcagttggg

SEQ ID NO: 6640416 - DNA, 16 bp, Homo sapiens
aggaagcagttggggc

SEQ ID NO: 6640417 - DNA, 19 bp, Homo sapiens
aggaagcattcagagagca

SEQ ID NO: 6640418 - DNA, 15 bp, Homo sapiens
aggaagcattgcttt

SEQ ID NO: 6640419 - DNA, 22 bp, Homo sapiens
aggaagcattgtaaaataattc

SEQ ID NO: 6640420 - DNA, 15 bp, Homo sapiens
aggaagccaaagagt

SEQ ID NO: 6640421 - DNA, 18 bp, Homo sapiens
aggaagccacagctggtg

SEQ ID NO: 6640422 - DNA, 11 bp, Homo sapiens
aggaagccaga

SEQ ID NO: 6640423 - DNA, 13 bp, Homo sapiens
aggaagccagcag

SEQ ID NO: 6640424 - DNA, 15 bp, Homo sapiens
aggaagccagcaggc

SEQ ID NO: 6640425 - DNA, 18 bp, Homo sapiens
aggaagccagcaggctct

SEQ ID NO: 6640426 - DNA, 14 bp, Homo sapiens
aggaagccagctgg

SEQ ID NO: 6640427 - DNA, 18 bp, Homo sapiens
aggaagccaggctgagtg

SEQ ID NO: 6640428 - DNA, 20 bp, Homo sapiens
aggaagccaggctgagtgag

SEQ ID NO: 6640429 - DNA, 20 bp, Homo sapiens
aggaagccagtcaccttctg

SEQ ID NO: 6640430 - DNA, 21 bp, Homo sapiens
aggaagccagtcaccttctgg

SEQ ID NO: 6640431 - DNA, 20 bp, Homo sapiens
aggaagccatagatgctggc

SEQ ID NO: 6640432 - DNA, 19 bp, Homo sapiens
aggaagcccaattgctgga

SEQ ID NO: 6640433 - DNA, 11 bp, Homo sapiens
aggaagcccac

SEQ ID NO: 6640434 - DNA, 13 bp, Homo sapiens
aggaagcccacac

SEQ ID NO: 6640435 - DNA, 14 bp, Homo sapiens
aggaagcccacact

SEQ ID NO: 6640436 - DNA, 23 bp, Homo sapiens
aggaagcccaccaatctgccctt

SEQ ID NO: 6640437 - DNA, 17 bp, Homo sapiens
aggaagcccactgcctc

SEQ ID NO: 6640438 - DNA, 18 bp, Homo sapiens
aggaagcccactgcctcc

SEQ ID NO: 6640439 - DNA, 19 bp, Homo sapiens
aggaagcccagtagccatt

SEQ ID NO: 6640440 - DNA, 16 bp, Homo sapiens
aggaagccccaagcca

SEQ ID NO: 6640441 - DNA, 22 bp, Homo sapiens
aggaagcccccaccgtgggcag

SEQ ID NO: 6640442 - DNA, 21 bp, Homo sapiens
aggaagcccggtggcgtggca

SEQ ID NO: 6640443 - DNA, 16 bp, Homo sapiens
aggaagccctctcaga

SEQ ID NO: 6640444 - DNA, 18 bp, Homo sapiens
aggaagccgccagtactt

SEQ ID NO: 6640445 - DNA, 22 bp, Homo sapiens
aggaagccgccagtacttgtca

SEQ ID NO: 6640446 - DNA, 19 bp, Homo sapiens
aggaagccgcctagtgcag

SEQ ID NO: 6640447 - DNA, 20 bp, Homo sapiens
aggaagccgcctagtgcaga

SEQ ID NO: 6640448 - DNA, 18 bp, Homo sapiens
aggaagccgctggggcca

SEQ ID NO: 6640449 - DNA, 19 bp, Homo sapiens
aggaagccggtgcctgggt

SEQ ID NO: 6640450 - DNA, 20 bp, Homo sapiens
aggaagccgtgccctgcccc

SEQ ID NO: 6640451 - DNA, 16 bp, Homo sapiens
aggaagcctaaataaa

SEQ ID NO: 6640452 - DNA, 20 bp, Homo sapiens
aggaagcctcaagttccagt

SEQ ID NO: 6640453 - DNA, 22 bp, Homo sapiens
aggaagcctcagattccttccc

SEQ ID NO: 6640454 - DNA, 18 bp, Homo sapiens
aggaagcctcctgctgag

SEQ ID NO: 6640455 - DNA, 12 bp, Homo sapiens
aggaagccttcc

SEQ ID NO: 6640456 - DNA, 15 bp, Homo sapiens
aggaagccttgctca

SEQ ID NO: 6640457 - DNA, 14 bp, Homo sapiens
aggaagctcagact

SEQ ID NO: 6640458 - DNA, 12 bp, Homo sapiens
aggaagctcagg

SEQ ID NO: 6640459 - DNA, 17 bp, Homo sapiens
aggaagctcagggcctg

SEQ ID NO: 6640460 - DNA, 18 bp, Homo sapiens
aggaagctcagggcctgg

SEQ ID NO: 6640461 - DNA, 15 bp, Homo sapiens
aggaagctccactgt

SEQ ID NO: 6640462 - DNA, 21 bp, Homo sapiens
aggaagctccagtcctgctct

SEQ ID NO: 6640463 - DNA, 22 bp, Homo sapiens
aggaagctccagtcctgctctc

SEQ ID NO: 6640464 - DNA, 16 bp, Homo sapiens
aggaagctgagatgaa

SEQ ID NO: 6640465 - DNA, 18 bp, Homo sapiens
aggaagctgtgagagcag

SEQ ID NO: 6640466 - DNA, 17 bp, Homo sapiens
aggaagctgtgttgaaa

SEQ ID NO: 6640467 - DNA, 21 bp, Homo sapiens
aggaagctgtgttgaaacaga

SEQ ID NO: 6640468 - DNA, 23 bp, Homo sapiens
aggaagcttggcttcctcttctt

SEQ ID NO: 6640469 - DNA, 19 bp, Homo sapiens
aggaagctttctctgcttc

SEQ ID NO: 6640470 - DNA, 20 bp, Homo sapiens
aggaagctttctctgcttca

SEQ ID NO: 6640471 - DNA, 18 bp, Homo sapiens
aggaagctttggaagcag

SEQ ID NO: 6640472 - DNA, 22 bp, Homo sapiens
aggaagctttggtgagaacctg

SEQ ID NO: 6640473 - DNA, 14 bp, Homo sapiens
aggaaggaaaacta

SEQ ID NO: 6640474 - DNA, 14 bp, Homo sapiens
aggaaggaaaagaa

SEQ ID NO: 6640475 - DNA, 22 bp, Homo sapiens
aggaaggaaacaacaaaggaag

SEQ ID NO: 6640476 - DNA, 23 bp, Homo sapiens
aggaaggaaacccagctctggtc

SEQ ID NO: 6640477 - DNA, 12 bp, Homo sapiens
aggaaggaaaga

SEQ ID NO: 6640478 - DNA, 23 bp, Homo sapiens
aggaaggaagagcaagctgtaca

SEQ ID NO: 6640479 - DNA, 11 bp, Homo sapiens
aggaaggaagc

SEQ ID NO: 6640480 - DNA, 13 bp, Homo sapiens
aggaaggacccca

SEQ ID NO: 6640481 - DNA, 15 bp, Homo sapiens
aggaaggacccctca

SEQ ID NO: 6640482 - DNA, 14 bp, Homo sapiens
aggaaggaccctga

SEQ ID NO: 6640483 - DNA, 13 bp, Homo sapiens
aggaaggagagat

SEQ ID NO: 6640484 - DNA, 18 bp, Homo sapiens
aggaaggagagcctgctg

SEQ ID NO: 6640485 - DNA, 16 bp, Homo sapiens
aggaaggagcccctga

SEQ ID NO: 6640486 - DNA, 23 bp, Homo sapiens
aggaaggagcggcgccctggact

SEQ ID NO: 6640487 - DNA, 15 bp, Homo sapiens
aggaaggagctgcct

SEQ ID NO: 6640488 - DNA, 17 bp, Homo sapiens
aggaaggagctgcctgg

SEQ ID NO: 6640489 - DNA, 18 bp, Homo sapiens
aggaaggagctgcctgga

SEQ ID NO: 6640490 - DNA, 21 bp, Homo sapiens
aggaaggagctgcctggaccc

SEQ ID NO: 6640491 - DNA, 22 bp, Homo sapiens
aggaaggagctgcctggacccg

SEQ ID NO: 6640492 - DNA, 18 bp, Homo sapiens
aggaaggaggacccagga

SEQ ID NO: 6640493 - DNA, 20 bp, Homo sapiens
aggaaggaggacccaggaca

SEQ ID NO: 6640494 - DNA, 22 bp, Homo sapiens
aggaaggaggacccaggacagg

SEQ ID NO: 6640495 - DNA, 15 bp, Homo sapiens
aggaaggagggcaca

SEQ ID NO: 6640496 - DNA, 21 bp, Homo sapiens
aggaaggaggggaagctgcag

SEQ ID NO: 6640497 - DNA, 14 bp, Homo sapiens
aggaaggaggggag

SEQ ID NO: 6640498 - DNA, 20 bp, Homo sapiens
aggaaggaggggagagacag

SEQ ID NO: 6640499 - DNA, 16 bp, Homo sapiens
aggaaggattgtaaaa

SEQ ID NO: 6640500 - DNA, 19 bp, Homo sapiens
aggaaggattttcttttta

SEQ ID NO: 6640501 - DNA, 21 bp, Homo sapiens
aggaaggcaaagcccctggaa

SEQ ID NO: 6640502 - DNA, 15 bp, Homo sapiens
aggaaggcacttctg

SEQ ID NO: 6640503 - DNA, 18 bp, Homo sapiens
aggaaggcagctgctctt

SEQ ID NO: 6640504 - DNA, 14 bp, Homo sapiens
aggaaggccaaaat

SEQ ID NO: 6640505 - DNA, 20 bp, Homo sapiens
aggaaggccatggggcagcc

SEQ ID NO: 6640506 - DNA, 21 bp, Homo sapiens
aggaaggccatggggcagcct

SEQ ID NO: 6640507 - DNA, 23 bp, Homo sapiens
aggaaggccatggggcagcctcc

SEQ ID NO: 6640508 - DNA, 14 bp, Homo sapiens
aggaaggcctgggt

SEQ ID NO: 6640509 - DNA, 16 bp, Homo sapiens
aggaaggcctttcttc

SEQ ID NO: 6640510 - DNA, 19 bp, Homo sapiens
aggaaggcctttcttctgt

SEQ ID NO: 6640511 - DNA, 15 bp, Homo sapiens
aggaaggcggcaggc

SEQ ID NO: 6640512 - DNA, 16 bp, Homo sapiens
aggaaggcggcaggca

SEQ ID NO: 6640513 - DNA, 17 bp, Homo sapiens
aggaaggcggcaggcag

SEQ ID NO: 6640514 - DNA, 21 bp, Homo sapiens
aggaaggctcttctccccaga

SEQ ID NO: 6640515 - DNA, 20 bp, Homo sapiens
aggaaggctgtctcagataa

SEQ ID NO: 6640516 - DNA, 15 bp, Homo sapiens
aggaaggctttgaaa

SEQ ID NO: 6640517 - DNA, 13 bp, Homo sapiens
aggaagggactgg

SEQ ID NO: 6640518 - DNA, 14 bp, Homo sapiens
aggaagggactggt

SEQ ID NO: 6640519 - DNA, 16 bp, Homo sapiens
aggaagggactggtcc

SEQ ID NO: 6640520 - DNA, 24 bp, Homo sapiens
aggaagggactggtccaggcatgg

SEQ ID NO: 6640521 - DNA, 15 bp, Homo sapiens
aggaagggaggcctg

SEQ ID NO: 6640522 - DNA, 17 bp, Homo sapiens
aggaagggaggcctgag

SEQ ID NO: 6640523 - DNA, 21 bp, Homo sapiens
aggaagggaggcctgaggggc

SEQ ID NO: 6640524 - DNA, 14 bp, Homo sapiens
aggaagggagggag

SEQ ID NO: 6640525 - DNA, 19 bp, Homo sapiens
aggaagggatgtatttgta

SEQ ID NO: 6640526 - DNA, 19 bp, Homo sapiens
aggaagggccagagcctgg

SEQ ID NO: 6640527 - DNA, 20 bp, Homo sapiens
aggaagggccaggagagaga

SEQ ID NO: 6640528 - DNA, 13 bp, Homo sapiens
aggaagggctggg

SEQ ID NO: 6640529 - DNA, 17 bp, Homo sapiens
aggaagggctgggccac

SEQ ID NO: 6640530 - DNA, 16 bp, Homo sapiens
aggaaggggccagagg

SEQ ID NO: 6640531 - DNA, 20 bp, Homo sapiens
aggaaggggccagaggctcg

SEQ ID NO: 6640532 - DNA, 20 bp, Homo sapiens
aggaaggggctatcctggga

SEQ ID NO: 6640533 - DNA, 21 bp, Homo sapiens
aggaaggggctatcctgggac

SEQ ID NO: 6640534 - DNA, 12 bp, Homo sapiens
aggaaggggctg

SEQ ID NO: 6640535 - DNA, 23 bp, Homo sapiens
aggaaggggctggactggctgtc

SEQ ID NO: 6640536 - DNA, 20 bp, Homo sapiens
aggaaggggttggattgcaa

SEQ ID NO: 6640537 - DNA, 13 bp, Homo sapiens
aggaagggtggga

SEQ ID NO: 6640538 - DNA, 17 bp, Homo sapiens
aggaaggtactgtatga

SEQ ID NO: 6640539 - DNA, 14 bp, Homo sapiens
aggaaggtagaaat

SEQ ID NO: 6640540 - DNA, 18 bp, Homo sapiens
aggaaggtcatttccatg

SEQ ID NO: 6640541 - DNA, 19 bp, Homo sapiens
aggaaggtctcatgcctga

SEQ ID NO: 6640542 - DNA, 20 bp, Homo sapiens
aggaaggtctcatgcctgag

SEQ ID NO: 6640543 - DNA, 14 bp, Homo sapiens
aggaaggtgctgag

SEQ ID NO: 6640544 - DNA, 16 bp, Homo sapiens
aggaaggtgctgagct

SEQ ID NO: 6640545 - DNA, 15 bp, Homo sapiens
aggaaggtggatggc

SEQ ID NO: 6640546 - DNA, 16 bp, Homo sapiens
aggaaggtggatggcc

SEQ ID NO: 6640547 - DNA, 22 bp, Homo sapiens
aggaaggtggcttaccaagatc

SEQ ID NO: 6640548 - DNA, 16 bp, Homo sapiens
aggaaggtgtgatgtc

SEQ ID NO: 6640549 - DNA, 16 bp, Homo sapiens
aggaaggttctggtgt

SEQ ID NO: 6640550 - DNA, 14 bp, Homo sapiens
aggaaggttttctc

SEQ ID NO: 6640551 - DNA, 18 bp, Homo sapiens
aggaaggttttctccact

SEQ ID NO: 6640552 - DNA, 15 bp, Homo sapiens
aggaaggtttttaag

SEQ ID NO: 6640553 - DNA, 17 bp, Homo sapiens
aggaagtaattttcttc

SEQ ID NO: 6640554 - DNA, 15 bp, Homo sapiens
aggaagtagcaggcc

SEQ ID NO: 6640555 - DNA, 21 bp, Homo sapiens
aggaagtatgagtgctgattc

SEQ ID NO: 6640556 - DNA, 18 bp, Homo sapiens
aggaagtcaaagcaagga

SEQ ID NO: 6640557 - DNA, 15 bp, Homo sapiens
aggaagtcaggagcc

SEQ ID NO: 6640558 - DNA, 16 bp, Homo sapiens
aggaagtcaggagcca

SEQ ID NO: 6640559 - DNA, 20 bp, Homo sapiens
aggaagtcaggagccagcag

SEQ ID NO: 6640560 - DNA, 22 bp, Homo sapiens
aggaagtcaggagccagcaggg

SEQ ID NO: 6640561 - DNA, 16 bp, Homo sapiens
aggaagtcatcctgca

SEQ ID NO: 6640562 - DNA, 15 bp, Homo sapiens
aggaagtccagccac

SEQ ID NO: 6640563 - DNA, 20 bp, Homo sapiens
aggaagtcctaagaagtggg

SEQ ID NO: 6640564 - DNA, 14 bp, Homo sapiens
aggaagtctgtgtc

SEQ ID NO: 6640565 - DNA, 17 bp, Homo sapiens
aggaagtgaaaataggt

SEQ ID NO: 6640566 - DNA, 14 bp, Homo sapiens
aggaagtgaagaat

SEQ ID NO: 6640567 - DNA, 15 bp, Homo sapiens
aggaagtgataacac

SEQ ID NO: 6640568 - DNA, 18 bp, Homo sapiens
aggaagtgataacactgg

SEQ ID NO: 6640569 - DNA, 23 bp, Homo sapiens
aggaagtgatttttgagcccttg

SEQ ID NO: 6640570 - DNA, 15 bp, Homo sapiens
aggaagtgccccctc

SEQ ID NO: 6640571 - DNA, 17 bp, Homo sapiens
aggaagtggcagttctt

SEQ ID NO: 6640572 - DNA, 16 bp, Homo sapiens
aggaagtggctcagac

SEQ ID NO: 6640573 - DNA, 14 bp, Homo sapiens
aggaagtggctggt

SEQ ID NO: 6640574 - DNA, 17 bp, Homo sapiens
aggaagtggctggtctg

SEQ ID NO: 6640575 - DNA, 18 bp, Homo sapiens
aggaagtggctgtccctg

SEQ ID NO: 6640576 - DNA, 20 bp, Homo sapiens
aggaagtgggagaagtggcc

SEQ ID NO: 6640577 - DNA, 17 bp, Homo sapiens
aggaagtgggggccgct

SEQ ID NO: 6640578 - DNA, 23 bp, Homo sapiens
aggaagtgggggccgctggccca

SEQ ID NO: 6640579 - DNA, 21 bp, Homo sapiens
aggaagtggggtctggcctgt

SEQ ID NO: 6640580 - DNA, 16 bp, Homo sapiens
aggaagtgtggaaaaa

SEQ ID NO: 6640581 - DNA, 16 bp, Homo sapiens
aggaagtgtgtttgcc

SEQ ID NO: 6640582 - DNA, 13 bp, Homo sapiens
aggaagtgtttat

SEQ ID NO: 6640583 - DNA, 17 bp, Homo sapiens
aggaagtgtttatgagg

SEQ ID NO: 6640584 - DNA, 21 bp, Homo sapiens
aggaagttcttttttgtacag

SEQ ID NO: 6640585 - DNA, 18 bp, Homo sapiens
aggaagttgacttatagt

SEQ ID NO: 6640586 - DNA, 22 bp, Homo sapiens
aggaagttgacttatagtacat

SEQ ID NO: 6640587 - DNA, 16 bp, Homo sapiens
aggaagttttgtctaa

SEQ ID NO: 6640588 - DNA, 12 bp, Homo sapiens
aggaataaagac

SEQ ID NO: 6640589 - DNA, 22 bp, Homo sapiens
aggaataaagtttttttcctta

SEQ ID NO: 6640590 - DNA, 13 bp, Homo sapiens
aggaataaataaa

SEQ ID NO: 6640591 - DNA, 19 bp, Homo sapiens
aggaataaataaaaatgga

SEQ ID NO: 6640592 - DNA, 21 bp, Homo sapiens
aggaataaataaaaatggata

SEQ ID NO: 6640593 - DNA, 21 bp, Homo sapiens
aggaataaatgagagggaatc

SEQ ID NO: 6640594 - DNA, 14 bp, Homo sapiens
aggaataacactgc

SEQ ID NO: 6640595 - DNA, 17 bp, Homo sapiens
aggaataacactgcagc

SEQ ID NO: 6640596 - DNA, 16 bp, Homo sapiens
aggaataacctttctg

SEQ ID NO: 6640597 - DNA, 13 bp, Homo sapiens
aggaataataaat

SEQ ID NO: 6640598 - DNA, 18 bp, Homo sapiens
aggaataataaattcatc

SEQ ID NO: 6640599 - DNA, 18 bp, Homo sapiens
aggaataatgcggacact

SEQ ID NO: 6640600 - DNA, 17 bp, Homo sapiens
aggaataattatttatt

SEQ ID NO: 6640601 - DNA, 22 bp, Homo sapiens
aggaataattatttatttaata

SEQ ID NO: 6640602 - DNA, 18 bp, Homo sapiens
aggaatacctgtccccct

SEQ ID NO: 6640603 - DNA, 16 bp, Homo sapiens
aggaatagaagcaaat

SEQ ID NO: 6640604 - DNA, 14 bp, Homo sapiens
aggaatagaggaag

SEQ ID NO: 6640605 - DNA, 16 bp, Homo sapiens
aggaatagaggaagaa

SEQ ID NO: 6640606 - DNA, 19 bp, Homo sapiens
aggaatagcaaaattcctg

SEQ ID NO: 6640607 - DNA, 15 bp, Homo sapiens
aggaatagccagaga

SEQ ID NO: 6640608 - DNA, 17 bp, Homo sapiens
aggaataggtaggagac

SEQ ID NO: 6640609 - DNA, 18 bp, Homo sapiens
aggaataggtaggagacc

SEQ ID NO: 6640610 - DNA, 14 bp, Homo sapiens
aggaatagttttct

SEQ ID NO: 6640611 - DNA, 15 bp, Homo sapiens
aggaatataaatatt

SEQ ID NO: 6640612 - DNA, 17 bp, Homo sapiens
aggaatataagaaaagt

SEQ ID NO: 6640613 - DNA, 17 bp, Homo sapiens
aggaatatatggcagag

SEQ ID NO: 6640614 - DNA, 18 bp, Homo sapiens
aggaatatgggagaaata

SEQ ID NO: 6640615 - DNA, 14 bp, Homo sapiens
aggaatattatatt

SEQ ID NO: 6640616 - DNA, 22 bp, Homo sapiens
aggaatattatatttggatgca

SEQ ID NO: 6640617 - DNA, 22 bp, Homo sapiens
aggaatatttagcagtattgtt

SEQ ID NO: 6640618 - DNA, 15 bp, Homo sapiens
aggaatattttccaa

SEQ ID NO: 6640619 - DNA, 17 bp, Homo sapiens
aggaatcaaatcttaca

SEQ ID NO: 6640620 - DNA, 17 bp, Homo sapiens
aggaatcaagagctgcc

SEQ ID NO: 6640621 - DNA, 19 bp, Homo sapiens
aggaatcaagagctgccct

SEQ ID NO: 6640622 - DNA, 20 bp, Homo sapiens
aggaatcaagagctgccctc

SEQ ID NO: 6640623 - DNA, 19 bp, Homo sapiens
aggaatcaattatttatga

SEQ ID NO: 6640624 - DNA, 15 bp, Homo sapiens
aggaatcaccccatt

SEQ ID NO: 6640625 - DNA, 23 bp, Homo sapiens
aggaatcacccctctgcccctgc

SEQ ID NO: 6640626 - DNA, 16 bp, Homo sapiens
aggaatcaccctccta

SEQ ID NO: 6640627 - DNA, 19 bp, Homo sapiens
aggaatcacgttagaggaa

SEQ ID NO: 6640628 - DNA, 16 bp, Homo sapiens
aggaatcactcttgtg

SEQ ID NO: 6640629 - DNA, 15 bp, Homo sapiens
aggaatcagacttca

SEQ ID NO: 6640630 - DNA, 15 bp, Homo sapiens
aggaatcagctgcag

SEQ ID NO: 6640631 - DNA, 21 bp, Homo sapiens
aggaatcatgtcaggcctgtg

SEQ ID NO: 6640632 - DNA, 21 bp, Homo sapiens
aggaatcatgtgccaagcaga

SEQ ID NO: 6640633 - DNA, 17 bp, Homo sapiens
aggaatcattcagaaat

SEQ ID NO: 6640634 - DNA, 22 bp, Homo sapiens
aggaatcattcagaaatgttga

SEQ ID NO: 6640635 - DNA, 22 bp, Homo sapiens
aggaatcctacgctatgtagaa

SEQ ID NO: 6640636 - DNA, 13 bp, Homo sapiens
aggaatcctggca

SEQ ID NO: 6640637 - DNA, 16 bp, Homo sapiens
aggaatcctggcagcc

SEQ ID NO: 6640638 - DNA, 18 bp, Homo sapiens
aggaatcctggcagccca

SEQ ID NO: 6640639 - DNA, 20 bp, Homo sapiens
aggaatcctggcagcccaga

SEQ ID NO: 6640640 - DNA, 19 bp, Homo sapiens
aggaatcgaggaaccagag

SEQ ID NO: 6640641 - DNA, 17 bp, Homo sapiens
aggaatcggctggggac

SEQ ID NO: 6640642 - DNA, 16 bp, Homo sapiens
aggaatctacctgtgg

SEQ ID NO: 6640643 - DNA, 17 bp, Homo sapiens
aggaatctacctgtggt

SEQ ID NO: 6640644 - DNA, 18 bp, Homo sapiens
aggaatctacctgtggtg

SEQ ID NO: 6640645 - DNA, 14 bp, Homo sapiens
aggaatctcagaga

SEQ ID NO: 6640646 - DNA, 17 bp, Homo sapiens
aggaatctcagagacag

SEQ ID NO: 6640647 - DNA, 18 bp, Homo sapiens
aggaatctcagagacagg

SEQ ID NO: 6640648 - DNA, 23 bp, Homo sapiens
aggaatctcttcactaccctgat

SEQ ID NO: 6640649 - DNA, 22 bp, Homo sapiens
aggaatctgaaagtatattttc

SEQ ID NO: 6640650 - DNA, 12 bp, Homo sapiens
aggaatctgcct

SEQ ID NO: 6640651 - DNA, 15 bp, Homo sapiens
aggaatctgccttcc

SEQ ID NO: 6640652 - DNA, 22 bp, Homo sapiens
aggaatctgccttccagcccag

SEQ ID NO: 6640653 - DNA, 23 bp, Homo sapiens
aggaatctgccttccagcccaga

SEQ ID NO: 6640654 - DNA, 13 bp, Homo sapiens
aggaatctgtgtg

SEQ ID NO: 6640655 - DNA, 20 bp, Homo sapiens
aggaatctgtttctctgctg

SEQ ID NO: 6640656 - DNA, 21 bp, Homo sapiens
aggaatctgtttctctgctgt

SEQ ID NO: 6640657 - DNA, 23 bp, Homo sapiens
aggaatctgtttctctgctgtca

SEQ ID NO: 6640658 - DNA, 15 bp, Homo sapiens
aggaatgaaagagag

SEQ ID NO: 6640659 - DNA, 23 bp, Homo sapiens
aggaatgaacttgttacttgcag

SEQ ID NO: 6640660 - DNA, 13 bp, Homo sapiens
aggaatgaagaac

SEQ ID NO: 6640661 - DNA, 14 bp, Homo sapiens
aggaatgaagaact

SEQ ID NO: 6640662 - DNA, 23 bp, Homo sapiens
aggaatgagtcaatcagccttta

SEQ ID NO: 6640663 - DNA, 17 bp, Homo sapiens
aggaatgcaaagatgaa

SEQ ID NO: 6640664 - DNA, 17 bp, Homo sapiens
aggaatgcaagagaagg

SEQ ID NO: 6640665 - DNA, 22 bp, Homo sapiens
aggaatgcacaaattgaaaaca

SEQ ID NO: 6640666 - DNA, 19 bp, Homo sapiens
aggaatgcacatggaatat

SEQ ID NO: 6640667 - DNA, 16 bp, Homo sapiens
aggaatgcctgtgcca

SEQ ID NO: 6640668 - DNA, 13 bp, Homo sapiens
aggaatgctaaca

SEQ ID NO: 6640669 - DNA, 20 bp, Homo sapiens
aggaatgctcaatgtgctgt

SEQ ID NO: 6640670 - DNA, 22 bp, Homo sapiens
aggaatgctcccccatcctccc

SEQ ID NO: 6640671 - DNA, 16 bp, Homo sapiens
aggaatgctctgtgcc

SEQ ID NO: 6640672 - DNA, 15 bp, Homo sapiens
aggaatgctgggccc

SEQ ID NO: 6640673 - DNA, 20 bp, Homo sapiens
aggaatgctgggcccccagc

SEQ ID NO: 6640674 - DNA, 17 bp, Homo sapiens
aggaatggaggagccag

SEQ ID NO: 6640675 - DNA, 19 bp, Homo sapiens
aggaatggaggagccaggc

SEQ ID NO: 6640676 - DNA, 21 bp, Homo sapiens
aggaatggaggagtctcaaca

SEQ ID NO: 6640677 - DNA, 20 bp, Homo sapiens
aggaatggaggctctaattg

SEQ ID NO: 6640678 - DNA, 13 bp, Homo sapiens
aggaatggccctc

SEQ ID NO: 6640679 - DNA, 16 bp, Homo sapiens
aggaatggccctcatt

SEQ ID NO: 6640680 - DNA, 18 bp, Homo sapiens
aggaatggccctcattca

SEQ ID NO: 6640681 - DNA, 20 bp, Homo sapiens
aggaatgggccaagccaggg

SEQ ID NO: 6640682 - DNA, 21 bp, Homo sapiens
aggaatgggggcctcttcaaa

SEQ ID NO: 6640683 - DNA, 22 bp, Homo sapiens
aggaatggggggcgggccaggg

SEQ ID NO: 6640684 - DNA, 13 bp, Homo sapiens
aggaatgtctgga

SEQ ID NO: 6640685 - DNA, 15 bp, Homo sapiens
aggaatgtctggagt

SEQ ID NO: 6640686 - DNA, 17 bp, Homo sapiens
aggaatgtgaaatttaa

SEQ ID NO: 6640687 - DNA, 17 bp, Homo sapiens
aggaatgtgcttttcca

SEQ ID NO: 6640688 - DNA, 16 bp, Homo sapiens
aggaatgtgtccaaga

SEQ ID NO: 6640689 - DNA, 16 bp, Homo sapiens
aggaatgttatcagta

SEQ ID NO: 6640690 - DNA, 21 bp, Homo sapiens
aggaatgtttcagctgcagtt

SEQ ID NO: 6640691 - DNA, 21 bp, Homo sapiens
aggaattaaactaaaatacaa

SEQ ID NO: 6640692 - DNA, 14 bp, Homo sapiens
aggaattaaagaca

SEQ ID NO: 6640693 - DNA, 17 bp, Homo sapiens
aggaattactttattat

SEQ ID NO: 6640694 - DNA, 18 bp, Homo sapiens
aggaattccaattaaatt

SEQ ID NO: 6640695 - DNA, 13 bp, Homo sapiens
aggaattcctctt

SEQ ID NO: 6640696 - DNA, 17 bp, Homo sapiens
aggaattctattgagtg

SEQ ID NO: 6640697 - DNA, 13 bp, Homo sapiens
aggaattctgtat

SEQ ID NO: 6640698 - DNA, 20 bp, Homo sapiens
aggaattgaattaataataa

SEQ ID NO: 6640699 - DNA, 17 bp, Homo sapiens
aggaattgacttcagca

SEQ ID NO: 6640700 - DNA, 20 bp, Homo sapiens
aggaattgacttcagcaggg

SEQ ID NO: 6640701 - DNA, 13 bp, Homo sapiens
aggaattggaaat

SEQ ID NO: 6640702 - DNA, 21 bp, Homo sapiens
aggaattggaggctgcagtga

SEQ ID NO: 6640703 - DNA, 23 bp, Homo sapiens
aggaattgtgtttataattttaa

SEQ ID NO: 6640704 - DNA, 15 bp, Homo sapiens
aggaattgtttatac

SEQ ID NO: 6640705 - DNA, 16 bp, Homo sapiens
aggaattgtttataca

SEQ ID NO: 6640706 - DNA, 13 bp, Homo sapiens
aggaatttaattt

SEQ ID NO: 6640707 - DNA, 15 bp, Homo sapiens
aggaatttcccagga

SEQ ID NO: 6640708 - DNA, 18 bp, Homo sapiens
aggaatttcccaggaccc

SEQ ID NO: 6640709 - DNA, 20 bp, Homo sapiens
aggaatttcccaggaccctg

SEQ ID NO: 6640710 - DNA, 18 bp, Homo sapiens
aggaatttccctgtgtgg

SEQ ID NO: 6640711 - DNA, 19 bp, Homo sapiens
aggaatttccctgtgtgga

SEQ ID NO: 6640712 - DNA, 15 bp, Homo sapiens
aggaatttcctccca

SEQ ID NO: 6640713 - DNA, 22 bp, Homo sapiens
aggaatttctcctactttacac

SEQ ID NO: 6640714 - DNA, 21 bp, Homo sapiens
aggaatttgaagctcagaaag

SEQ ID NO: 6640715 - DNA, 20 bp, Homo sapiens
aggaatttgatgattttcat

SEQ ID NO: 6640716 - DNA, 21 bp, Homo sapiens
aggaatttgcatccagcagca

SEQ ID NO: 6640717 - DNA, 16 bp, Homo sapiens
aggaatttggctgctt

SEQ ID NO: 6640718 - DNA, 20 bp, Homo sapiens
aggaatttgggaccctgctt

SEQ ID NO: 6640719 - DNA, 19 bp, Homo sapiens
aggaatttgtacttcttat

SEQ ID NO: 6640720 - DNA, 14 bp, Homo sapiens
aggaatttgtattt

SEQ ID NO: 6640721 - DNA, 14 bp, Homo sapiens
aggaattttagaag

SEQ ID NO: 6640722 - DNA, 20 bp, Homo sapiens
aggaattttatttttttctg

SEQ ID NO: 6640723 - DNA, 22 bp, Homo sapiens
aggaattttatttttttctgaa

SEQ ID NO: 6640724 - DNA, 11 bp, Homo sapiens
aggaattttgt

SEQ ID NO: 6640725 - DNA, 22 bp, Homo sapiens
aggacaaaaagaccttctccct

SEQ ID NO: 6640726 - DNA, 19 bp, Homo sapiens
aggacaaaaatgaactgaa

SEQ ID NO: 6640727 - DNA, 17 bp, Homo sapiens
aggacaaaacagcggga

SEQ ID NO: 6640728 - DNA, 13 bp, Homo sapiens
aggacaaaacttc

SEQ ID NO: 6640729 - DNA, 14 bp, Homo sapiens
aggacaaaacttct

SEQ ID NO: 6640730 - DNA, 15 bp, Homo sapiens
aggacaaaataaagt

SEQ ID NO: 6640731 - DNA, 16 bp, Homo sapiens
aggacaaaataaagtg

SEQ ID NO: 6640732 - DNA, 11 bp, Homo sapiens
aggacaaacag

SEQ ID NO: 6640733 - DNA, 22 bp, Homo sapiens
aggacaaacgggctcgggtctg

SEQ ID NO: 6640734 - DNA, 19 bp, Homo sapiens
aggacaaagggagggagca

SEQ ID NO: 6640735 - DNA, 16 bp, Homo sapiens
aggacaaagtctccag

SEQ ID NO: 6640736 - DNA, 17 bp, Homo sapiens
aggacaaagtctccagc

SEQ ID NO: 6640737 - DNA, 21 bp, Homo sapiens
aggacaaagtgccaaagaaag

SEQ ID NO: 6640738 - DNA, 18 bp, Homo sapiens
aggacaaattagcatgca

SEQ ID NO: 6640739 - DNA, 20 bp, Homo sapiens
aggacaaattagcatgcaag

SEQ ID NO: 6640740 - DNA, 23 bp, Homo sapiens
aggacaaattgagacagtgcaca

SEQ ID NO: 6640741 - DNA, 18 bp, Homo sapiens
aggacaacacttcatttt

SEQ ID NO: 6640742 - DNA, 22 bp, Homo sapiens
aggacaacagttctgagctgta

SEQ ID NO: 6640743 - DNA, 16 bp, Homo sapiens
aggacaacgaggaagc

SEQ ID NO: 6640744 - DNA, 18 bp, Homo sapiens
aggacaacgaggaagccc

SEQ ID NO: 6640745 - DNA, 23 bp, Homo sapiens
aggacaactttatgtagagaaaa

SEQ ID NO: 6640746 - DNA, 13 bp, Homo sapiens
aggacaagaccct

SEQ ID NO: 6640747 - DNA, 16 bp, Homo sapiens
aggacaagaccctctc

SEQ ID NO: 6640748 - DNA, 13 bp, Homo sapiens
aggacaaggctgt

SEQ ID NO: 6640749 - DNA, 15 bp, Homo sapiens
aggacaaggctgtgc

SEQ ID NO: 6640750 - DNA, 16 bp, Homo sapiens
aggacaaggctgtgcc

SEQ ID NO: 6640751 - DNA, 21 bp, Homo sapiens
aggacaaggctgtgccaggct

SEQ ID NO: 6640752 - DNA, 23 bp, Homo sapiens
aggacaaggctgtgccaggctgg

SEQ ID NO: 6640753 - DNA, 12 bp, Homo sapiens
aggacaaggggc

SEQ ID NO: 6640754 - DNA, 18 bp, Homo sapiens
aggacaaggggtggaagg

SEQ ID NO: 6640755 - DNA, 19 bp, Homo sapiens
aggacaaggtgcaggcagg

SEQ ID NO: 6640756 - DNA, 15 bp, Homo sapiens
aggacaagtgtaata

SEQ ID NO: 6640757 - DNA, 19 bp, Homo sapiens
aggacaatcagtcccctcc

SEQ ID NO: 6640758 - DNA, 21 bp, Homo sapiens
aggacaatcagtcccctccca

SEQ ID NO: 6640759 - DNA, 22 bp, Homo sapiens
aggacaatcagtcccctcccat

SEQ ID NO: 6640760 - DNA, 23 bp, Homo sapiens
aggacaatcagtcccctcccatc

SEQ ID NO: 6640761 - DNA, 15 bp, Homo sapiens
aggacaatgccttgg

SEQ ID NO: 6640762 - DNA, 14 bp, Homo sapiens
aggacaatttcaaa

SEQ ID NO: 6640763 - DNA, 15 bp, Homo sapiens
aggacaatttcaaaa

SEQ ID NO: 6640764 - DNA, 21 bp, Homo sapiens
aggacacaagggtgcaagccc

SEQ ID NO: 6640765 - DNA, 20 bp, Homo sapiens
aggacacacagtctcagtcc

SEQ ID NO: 6640766 - DNA, 18 bp, Homo sapiens
aggacacagatcccgggg

SEQ ID NO: 6640767 - DNA, 13 bp, Homo sapiens
aggacacagatct

SEQ ID NO: 6640768 - DNA, 22 bp, Homo sapiens
aggacacagcacaagggcacat

SEQ ID NO: 6640769 - DNA, 15 bp, Homo sapiens
aggacacagcagtat

SEQ ID NO: 6640770 - DNA, 16 bp, Homo sapiens
aggacacagcagtatt

SEQ ID NO: 6640771 - DNA, 12 bp, Homo sapiens
aggacacaggcc

SEQ ID NO: 6640772 - DNA, 12 bp, Homo sapiens
aggacacagtga

SEQ ID NO: 6640773 - DNA, 16 bp, Homo sapiens
aggacacagttcctgg

SEQ ID NO: 6640774 - DNA, 23 bp, Homo sapiens
aggacacatcccggcctcttcca

SEQ ID NO: 6640775 - DNA, 15 bp, Homo sapiens
aggacacatctattg

SEQ ID NO: 6640776 - DNA, 13 bp, Homo sapiens
aggacacatttgg

SEQ ID NO: 6640777 - DNA, 15 bp, Homo sapiens
aggacaccacaccca

SEQ ID NO: 6640778 - DNA, 21 bp, Homo sapiens
aggacaccacacccagcctca

SEQ ID NO: 6640779 - DNA, 17 bp, Homo sapiens
aggacaccagtgaaaga

SEQ ID NO: 6640780 - DNA, 19 bp, Homo sapiens
aggacaccagtgaaagaag

SEQ ID NO: 6640781 - DNA, 22 bp, Homo sapiens
aggacaccctccctccagggtc

SEQ ID NO: 6640782 - DNA, 23 bp, Homo sapiens
aggacaccctccctccagggtcc

SEQ ID NO: 6640783 - DNA, 24 bp, Homo sapiens
aggacaccctccctccagggtcct

SEQ ID NO: 6640784 - DNA, 15 bp, Homo sapiens
aggacacctgcccca

SEQ ID NO: 6640785 - DNA, 23 bp, Homo sapiens
aggacacctggccgcctccagga

SEQ ID NO: 6640786 - DNA, 20 bp, Homo sapiens
aggacacgaaggctgcccct

SEQ ID NO: 6640787 - DNA, 18 bp, Homo sapiens
aggacacggaccctgtgt

SEQ ID NO: 6640788 - DNA, 19 bp, Homo sapiens
aggacacggaccctgtgtg

SEQ ID NO: 6640789 - DNA, 20 bp, Homo sapiens
aggacacggaccctgtgtgg

SEQ ID NO: 6640790 - DNA, 12 bp, Homo sapiens
aggacactcccg

SEQ ID NO: 6640791 - DNA, 17 bp, Homo sapiens
aggacactgcagaacag

SEQ ID NO: 6640792 - DNA, 16 bp, Homo sapiens
aggacactgcctttgc

SEQ ID NO: 6640793 - DNA, 18 bp, Homo sapiens
aggacactgcctttgctg

SEQ ID NO: 6640794 - DNA, 17 bp, Homo sapiens
aggacactggggtctgt

SEQ ID NO: 6640795 - DNA, 14 bp, Homo sapiens
aggacacttccgta

SEQ ID NO: 6640796 - DNA, 17 bp, Homo sapiens
aggacagaacagtgttt

SEQ ID NO: 6640797 - DNA, 15 bp, Homo sapiens
aggacagaacattgc

SEQ ID NO: 6640798 - DNA, 17 bp, Homo sapiens
aggacagaaggctcctg

SEQ ID NO: 6640799 - DNA, 22 bp, Homo sapiens
aggacagaaggctcctgccccc

SEQ ID NO: 6640800 - DNA, 13 bp, Homo sapiens
aggacagaatgtg

SEQ ID NO: 6640801 - DNA, 17 bp, Homo sapiens
aggacagaatgtgttct

SEQ ID NO: 6640802 - DNA, 22 bp, Homo sapiens
aggacagacatcaagtgccaga

SEQ ID NO: 6640803 - DNA, 18 bp, Homo sapiens
aggacagactggccgggc

SEQ ID NO: 6640804 - DNA, 22 bp, Homo sapiens
aggacagactggccgggcaggc

SEQ ID NO: 6640805 - DNA, 17 bp, Homo sapiens
aggacagagcaggggct

SEQ ID NO: 6640806 - DNA, 21 bp, Homo sapiens
aggacagagcaggggctccag

SEQ ID NO: 6640807 - DNA, 12 bp, Homo sapiens
aggacagagcca

SEQ ID NO: 6640808 - DNA, 19 bp, Homo sapiens
aggacagagctggctgtct

SEQ ID NO: 6640809 - DNA, 22 bp, Homo sapiens
aggacagagcttgaagcctcca

SEQ ID NO: 6640810 - DNA, 22 bp, Homo sapiens
aggacagaggccggggtccagg

SEQ ID NO: 6640811 - DNA, 17 bp, Homo sapiens
aggacagagggaagcca

SEQ ID NO: 6640812 - DNA, 16 bp, Homo sapiens
aggacagagggcacat

SEQ ID NO: 6640813 - DNA, 20 bp, Homo sapiens
aggacagagtgccctggggc

SEQ ID NO: 6640814 - DNA, 17 bp, Homo sapiens
aggacagagttcacagg

SEQ ID NO: 6640815 - DNA, 18 bp, Homo sapiens
aggacagagttcacagga

SEQ ID NO: 6640816 - DNA, 20 bp, Homo sapiens
aggacagatgcctccttcct

SEQ ID NO: 6640817 - DNA, 15 bp, Homo sapiens
aggacagcagcactc

SEQ ID NO: 6640818 - DNA, 16 bp, Homo sapiens
aggacagcagcactcc

SEQ ID NO: 6640819 - DNA, 12 bp, Homo sapiens
aggacagcagct

SEQ ID NO: 6640820 - DNA, 13 bp, Homo sapiens
aggacagcagctg

SEQ ID NO: 6640821 - DNA, 14 bp, Homo sapiens
aggacagcctgcct

SEQ ID NO: 6640822 - DNA, 22 bp, Homo sapiens
aggacagcctgtggcggtgcct

SEQ ID NO: 6640823 - DNA, 23 bp, Homo sapiens
aggacagcctgtggcggtgcctg

SEQ ID NO: 6640824 - DNA, 14 bp, Homo sapiens
aggacagctctggg

SEQ ID NO: 6640825 - DNA, 13 bp, Homo sapiens
aggacagctcttg

SEQ ID NO: 6640826 - DNA, 14 bp, Homo sapiens
aggacagctgcagg

SEQ ID NO: 6640827 - DNA, 18 bp, Homo sapiens
aggacagctgcaggtgcc

SEQ ID NO: 6640828 - DNA, 17 bp, Homo sapiens
aggacagctggctgctg

SEQ ID NO: 6640829 - DNA, 12 bp, Homo sapiens
aggacagctgtg

SEQ ID NO: 6640830 - DNA, 15 bp, Homo sapiens
aggacagctgtgccc

SEQ ID NO: 6640831 - DNA, 11 bp, Homo sapiens
aggacaggaaa

SEQ ID NO: 6640832 - DNA, 18 bp, Homo sapiens
aggacaggaaaggcccca

SEQ ID NO: 6640833 - DNA, 19 bp, Homo sapiens
aggacaggaagctggcaga

SEQ ID NO: 6640834 - DNA, 18 bp, Homo sapiens
aggacaggaccctcagga

SEQ ID NO: 6640835 - DNA, 14 bp, Homo sapiens
aggacaggagcctg

SEQ ID NO: 6640836 - DNA, 15 bp, Homo sapiens
aggacaggagcctgg

SEQ ID NO: 6640837 - DNA, 18 bp, Homo sapiens
aggacaggagcctggtcc

SEQ ID NO: 6640838 - DNA, 12 bp, Homo sapiens
aggacaggaggc

SEQ ID NO: 6640839 - DNA, 17 bp, Homo sapiens
aggacaggcagaaagag

SEQ ID NO: 6640840 - DNA, 17 bp, Homo sapiens
aggacaggctctagaga

SEQ ID NO: 6640841 - DNA, 12 bp, Homo sapiens
aggacaggctgc

SEQ ID NO: 6640842 - DNA, 17 bp, Homo sapiens
aggacaggctggtgcta

SEQ ID NO: 6640843 - DNA, 17 bp, Homo sapiens
aggacagggagggaaca

SEQ ID NO: 6640844 - DNA, 12 bp, Homo sapiens
aggacagggctg

SEQ ID NO: 6640845 - DNA, 20 bp, Homo sapiens
aggacagggtggccttactc

SEQ ID NO: 6640846 - DNA, 13 bp, Homo sapiens
aggacaggtcctg

SEQ ID NO: 6640847 - DNA, 17 bp, Homo sapiens
aggacaggtctctgaga

SEQ ID NO: 6640848 - DNA, 22 bp, Homo sapiens
aggacaggtggaggcgagccag

SEQ ID NO: 6640849 - DNA, 15 bp, Homo sapiens
aggacagtccctgct

SEQ ID NO: 6640850 - DNA, 19 bp, Homo sapiens
aggacagtccctgctgggg

SEQ ID NO: 6640851 - DNA, 20 bp, Homo sapiens
aggacagtccctgctgggga

SEQ ID NO: 6640852 - DNA, 13 bp, Homo sapiens
aggacagtctgga

SEQ ID NO: 6640853 - DNA, 15 bp, Homo sapiens
aggacagtctggaga

SEQ ID NO: 6640854 - DNA, 17 bp, Homo sapiens
aggacagtctggagaag

SEQ ID NO: 6640855 - DNA, 18 bp, Homo sapiens
aggacagtctggagaagg

SEQ ID NO: 6640856 - DNA, 20 bp, Homo sapiens
aggacagtgctgaccccagg

SEQ ID NO: 6640857 - DNA, 19 bp, Homo sapiens
aggacagtgcttcagcctg

SEQ ID NO: 6640858 - DNA, 21 bp, Homo sapiens
aggacagtgttcaaattctga

SEQ ID NO: 6640859 - DNA, 22 bp, Homo sapiens
aggacagttgatggagccccag

SEQ ID NO: 6640860 - DNA, 21 bp, Homo sapiens
aggacataaaatttaaaaact

SEQ ID NO: 6640861 - DNA, 20 bp, Homo sapiens
aggacataaattagaggtct

SEQ ID NO: 6640862 - DNA, 24 bp, Homo sapiens
aggacataatggggtcctggccat

SEQ ID NO: 6640863 - DNA, 16 bp, Homo sapiens
aggacatacatttaat

SEQ ID NO: 6640864 - DNA, 21 bp, Homo sapiens
aggacatagaggtatattgga

SEQ ID NO: 6640865 - DNA, 15 bp, Homo sapiens
aggacatcagcaaac

SEQ ID NO: 6640866 - DNA, 12 bp, Homo sapiens
aggacatcataa

SEQ ID NO: 6640867 - DNA, 20 bp, Homo sapiens
aggacatccccccgccaaaa

SEQ ID NO: 6640868 - DNA, 23 bp, Homo sapiens
aggacatcttaaatctaaacaaa

SEQ ID NO: 6640869 - DNA, 14 bp, Homo sapiens
aggacatgaacaga

SEQ ID NO: 6640870 - DNA, 19 bp, Homo sapiens
aggacatgagactaagaga

SEQ ID NO: 6640871 - DNA, 19 bp, Homo sapiens
aggacatgagatcagggcc

SEQ ID NO: 6640872 - DNA, 22 bp, Homo sapiens
aggacatgagtctgtaggagca

SEQ ID NO: 6640873 - DNA, 13 bp, Homo sapiens
aggacatgcaata

SEQ ID NO: 6640874 - DNA, 20 bp, Homo sapiens
aggacatgcaataaaattta

SEQ ID NO: 6640875 - DNA, 21 bp, Homo sapiens
aggacatgcaataaaatttaa

SEQ ID NO: 6640876 - DNA, 20 bp, Homo sapiens
aggacatgcggtagccagca

SEQ ID NO: 6640877 - DNA, 23 bp, Homo sapiens
aggacatgcgtgtgtcagggatg

SEQ ID NO: 6640878 - DNA, 18 bp, Homo sapiens
aggacatggagagagact

SEQ ID NO: 6640879 - DNA, 16 bp, Homo sapiens
aggacatggggcatag

SEQ ID NO: 6640880 - DNA, 18 bp, Homo sapiens
aggacatggggcatagaa

SEQ ID NO: 6640881 - DNA, 23 bp, Homo sapiens
aggacatggtgagtctattttta

SEQ ID NO: 6640882 - DNA, 16 bp, Homo sapiens
aggacatgttcccttc

SEQ ID NO: 6640883 - DNA, 16 bp, Homo sapiens
aggacatgtttttgtt

SEQ ID NO: 6640884 - DNA, 17 bp, Homo sapiens
aggacattatgtgtgca

SEQ ID NO: 6640885 - DNA, 18 bp, Homo sapiens
aggacattccaagacagt

SEQ ID NO: 6640886 - DNA, 12 bp, Homo sapiens
aggacattgccc

SEQ ID NO: 6640887 - DNA, 17 bp, Homo sapiens
aggacattgccccaaga

SEQ ID NO: 6640888 - DNA, 15 bp, Homo sapiens
aggacattgcggaca

SEQ ID NO: 6640889 - DNA, 21 bp, Homo sapiens
aggaccaaaaaacctcactgg

SEQ ID NO: 6640890 - DNA, 22 bp, Homo sapiens
aggaccaaagggggccctggct

SEQ ID NO: 6640891 - DNA, 18 bp, Homo sapiens
aggaccaacatccagtcc

SEQ ID NO: 6640892 - DNA, 18 bp, Homo sapiens
aggaccaacccatgccct

SEQ ID NO: 6640893 - DNA, 19 bp, Homo sapiens
aggaccaacccatgccctg

SEQ ID NO: 6640894 - DNA, 21 bp, Homo sapiens
aggaccaacccatgccctgcc

SEQ ID NO: 6640895 - DNA, 23 bp, Homo sapiens
aggaccaactggcttctgtgcac

SEQ ID NO: 6640896 - DNA, 19 bp, Homo sapiens
aggaccaagcatcttgggg

SEQ ID NO: 6640897 - DNA, 19 bp, Homo sapiens
aggaccaagcttaaggaga

SEQ ID NO: 6640898 - DNA, 20 bp, Homo sapiens
aggaccaagcttaaggagag

SEQ ID NO: 6640899 - DNA, 14 bp, Homo sapiens
aggaccaagggggc

SEQ ID NO: 6640900 - DNA, 19 bp, Homo sapiens
aggaccaagggggcgggga

SEQ ID NO: 6640901 - DNA, 23 bp, Homo sapiens
aggaccaataaaatttctaagag

SEQ ID NO: 6640902 - DNA, 14 bp, Homo sapiens
aggaccaatgttgt

SEQ ID NO: 6640903 - DNA, 13 bp, Homo sapiens
aggaccacacagt

SEQ ID NO: 6640904 - DNA, 15 bp, Homo sapiens
aggaccacacagtcc

SEQ ID NO: 6640905 - DNA, 18 bp, Homo sapiens
aggaccacacagtcccca

SEQ ID NO: 6640906 - DNA, 22 bp, Homo sapiens
aggaccacacagtccccagact

SEQ ID NO: 6640907 - DNA, 22 bp, Homo sapiens
aggaccacacgcaggcctccct

SEQ ID NO: 6640908 - DNA, 23 bp, Homo sapiens
aggaccacagagctcctggccct

SEQ ID NO: 6640909 - DNA, 13 bp, Homo sapiens
aggaccaccagca

SEQ ID NO: 6640910 - DNA, 16 bp, Homo sapiens
aggaccaccagcaggc

SEQ ID NO: 6640911 - DNA, 22 bp, Homo sapiens
aggaccaccctgccaaggcaga

SEQ ID NO: 6640912 - DNA, 15 bp, Homo sapiens
aggaccactcagccc

SEQ ID NO: 6640913 - DNA, 18 bp, Homo sapiens
aggaccactcagccccta

SEQ ID NO: 6640914 - DNA, 14 bp, Homo sapiens
aggaccagaaggca

SEQ ID NO: 6640915 - DNA, 15 bp, Homo sapiens
aggaccagagaaggg

SEQ ID NO: 6640916 - DNA, 20 bp, Homo sapiens
aggaccagagcggtatctct

SEQ ID NO: 6640917 - DNA, 23 bp, Homo sapiens
aggaccagagcggtatctctggc

SEQ ID NO: 6640918 - DNA, 12 bp, Homo sapiens
aggaccagccca

SEQ ID NO: 6640919 - DNA, 24 bp, Homo sapiens
aggaccagctcaggacagatgcca

SEQ ID NO: 6640920 - DNA, 13 bp, Homo sapiens
aggaccagctggg

SEQ ID NO: 6640921 - DNA, 15 bp, Homo sapiens
aggaccagctggggc

SEQ ID NO: 6640922 - DNA, 18 bp, Homo sapiens
aggaccaggacccaggga

SEQ ID NO: 6640923 - DNA, 16 bp, Homo sapiens
aggaccaggactccct

SEQ ID NO: 6640924 - DNA, 18 bp, Homo sapiens
aggaccaggactccctcc

SEQ ID NO: 6640925 - DNA, 19 bp, Homo sapiens
aggaccaggactccctcct

SEQ ID NO: 6640926 - DNA, 21 bp, Homo sapiens
aggaccaggactccctcctca

SEQ ID NO: 6640927 - DNA, 14 bp, Homo sapiens
aggaccaggagcca

SEQ ID NO: 6640928 - DNA, 17 bp, Homo sapiens
aggaccaggagccaggt

SEQ ID NO: 6640929 - DNA, 18 bp, Homo sapiens
aggaccaggatccagcct

SEQ ID NO: 6640930 - DNA, 20 bp, Homo sapiens
aggaccaggctggggccagg

SEQ ID NO: 6640931 - DNA, 12 bp, Homo sapiens
aggaccagggct

SEQ ID NO: 6640932 - DNA, 13 bp, Homo sapiens
aggaccaggggcc

SEQ ID NO: 6640933 - DNA, 14 bp, Homo sapiens
aggaccagggtgga

SEQ ID NO: 6640934 - DNA, 17 bp, Homo sapiens
aggaccagggtggagct

SEQ ID NO: 6640935 - DNA, 22 bp, Homo sapiens
aggaccagggttggcaccttcc

SEQ ID NO: 6640936 - DNA, 20 bp, Homo sapiens
aggaccagtcaacctgggca

SEQ ID NO: 6640937 - DNA, 22 bp, Homo sapiens
aggaccagtttatgtttgtggt

SEQ ID NO: 6640938 - DNA, 13 bp, Homo sapiens
aggaccattttag

SEQ ID NO: 6640939 - DNA, 15 bp, Homo sapiens
aggaccattttagaa

SEQ ID NO: 6640940 - DNA, 19 bp, Homo sapiens
aggacccaaatttccctgg

SEQ ID NO: 6640941 - DNA, 15 bp, Homo sapiens
aggacccaagcagag

SEQ ID NO: 6640942 - DNA, 13 bp, Homo sapiens
aggacccaaggtg

SEQ ID NO: 6640943 - DNA, 20 bp, Homo sapiens
aggacccaaggtggtcttgg

SEQ ID NO: 6640944 - DNA, 21 bp, Homo sapiens
aggacccaaggtggtcttgga

SEQ ID NO: 6640945 - DNA, 13 bp, Homo sapiens
aggacccacctgg

SEQ ID NO: 6640946 - DNA, 13 bp, Homo sapiens
aggacccagaccc

SEQ ID NO: 6640947 - DNA, 15 bp, Homo sapiens
aggacccagacccag

SEQ ID NO: 6640948 - DNA, 13 bp, Homo sapiens
aggacccagccct

SEQ ID NO: 6640949 - DNA, 15 bp, Homo sapiens
aggacccaggccctc

SEQ ID NO: 6640950 - DNA, 16 bp, Homo sapiens
aggacccaggccctcc

SEQ ID NO: 6640951 - DNA, 19 bp, Homo sapiens
aggacccaggccctccatg

SEQ ID NO: 6640952 - DNA, 13 bp, Homo sapiens
aggacccaggccg

SEQ ID NO: 6640953 - DNA, 14 bp, Homo sapiens
aggacccaggcgct

SEQ ID NO: 6640954 - DNA, 15 bp, Homo sapiens
aggacccaggcgctg

SEQ ID NO: 6640955 - DNA, 13 bp, Homo sapiens
aggacccagggag

SEQ ID NO: 6640956 - DNA, 17 bp, Homo sapiens
aggacccagggctctgt

SEQ ID NO: 6640957 - DNA, 22 bp, Homo sapiens
aggacccagggtcccctcccca

SEQ ID NO: 6640958 - DNA, 17 bp, Homo sapiens
aggacccagtggtcagc

SEQ ID NO: 6640959 - DNA, 18 bp, Homo sapiens
aggacccatccctgcctg

SEQ ID NO: 6640960 - DNA, 20 bp, Homo sapiens
aggacccatgaaacagcagc

SEQ ID NO: 6640961 - DNA, 15 bp, Homo sapiens
aggaccccacatcct

SEQ ID NO: 6640962 - DNA, 14 bp, Homo sapiens
aggaccccagaggg

SEQ ID NO: 6640963 - DNA, 21 bp, Homo sapiens
aggaccccagagggaccagct

SEQ ID NO: 6640964 - DNA, 17 bp, Homo sapiens
aggaccccagctctgcg

SEQ ID NO: 6640965 - DNA, 23 bp, Homo sapiens
aggaccccagcttttcttgccag

SEQ ID NO: 6640966 - DNA, 13 bp, Homo sapiens
aggaccccagggt

SEQ ID NO: 6640967 - DNA, 12 bp, Homo sapiens
aggaccccaggt

SEQ ID NO: 6640968 - DNA, 20 bp, Homo sapiens
aggaccccaggtcaggggct

SEQ ID NO: 6640969 - DNA, 17 bp, Homo sapiens
aggaccccatctgctga

SEQ ID NO: 6640970 - DNA, 20 bp, Homo sapiens
aggaccccattctgggactg

SEQ ID NO: 6640971 - DNA, 21 bp, Homo sapiens
aggacccccccagtccgcccc

SEQ ID NO: 6640972 - DNA, 15 bp, Homo sapiens
aggaccccgagggct

SEQ ID NO: 6640973 - DNA, 16 bp, Homo sapiens
aggaccccgagggctg

SEQ ID NO: 6640974 - DNA, 17 bp, Homo sapiens
aggacccctcaccaccc

SEQ ID NO: 6640975 - DNA, 19 bp, Homo sapiens
aggacccctcaccaccccc

SEQ ID NO: 6640976 - DNA, 20 bp, Homo sapiens
aggacccctcaccaccccca

SEQ ID NO: 6640977 - DNA, 22 bp, Homo sapiens
aggacccctcaccacccccact

SEQ ID NO: 6640978 - DNA, 23 bp, Homo sapiens
aggacccctcaccttgcaacaca

SEQ ID NO: 6640979 - DNA, 17 bp, Homo sapiens
aggacccctcagctccc

SEQ ID NO: 6640980 - DNA, 20 bp, Homo sapiens
aggacccctccatgtgggct

SEQ ID NO: 6640981 - DNA, 20 bp, Homo sapiens
aggacccctgcagttcccct

SEQ ID NO: 6640982 - DNA, 13 bp, Homo sapiens
aggacccctgccc

SEQ ID NO: 6640983 - DNA, 15 bp, Homo sapiens
aggacccctgccttc

SEQ ID NO: 6640984 - DNA, 16 bp, Homo sapiens
aggacccctgccttcc

SEQ ID NO: 6640985 - DNA, 21 bp, Homo sapiens
aggacccctgccttcctctga

SEQ ID NO: 6640986 - DNA, 23 bp, Homo sapiens
aggacccctgccttcctctgagg

SEQ ID NO: 6640987 - DNA, 20 bp, Homo sapiens
aggaccccttaatcttgctt

SEQ ID NO: 6640988 - DNA, 14 bp, Homo sapiens
aggacccgccagcc

SEQ ID NO: 6640989 - DNA, 16 bp, Homo sapiens
aggacccgccagcccc

SEQ ID NO: 6640990 - DNA, 18 bp, Homo sapiens
aggacccggaggggcctg

SEQ ID NO: 6640991 - DNA, 21 bp, Homo sapiens
aggacccggaggggcctggca

SEQ ID NO: 6640992 - DNA, 20 bp, Homo sapiens
aggacccgggaccacagctg

SEQ ID NO: 6640993 - DNA, 22 bp, Homo sapiens
aggacccgggaccacagctgct

SEQ ID NO: 6640994 - DNA, 17 bp, Homo sapiens
aggaccctcagccccag

SEQ ID NO: 6640995 - DNA, 23 bp, Homo sapiens
aggaccctcagccccaggagaag

SEQ ID NO: 6640996 - DNA, 24 bp, Homo sapiens
aggaccctcagccccaggagaagg

SEQ ID NO: 6640997 - DNA, 22 bp, Homo sapiens
aggaccctccactcactgctgt

SEQ ID NO: 6640998 - DNA, 14 bp, Homo sapiens
aggaccctcccagg

SEQ ID NO: 6640999 - DNA, 16 bp, Homo sapiens
aggaccctcgctggcc

SEQ ID NO: 6641000 - DNA, 13 bp, Homo sapiens
aggaccctgccag

SEQ ID NO: 6641001 - DNA, 21 bp, Homo sapiens
aggaccctgccaggcacaggc

SEQ ID NO: 6641002 - DNA, 17 bp, Homo sapiens
aggaccctggacccagc

SEQ ID NO: 6641003 - DNA, 16 bp, Homo sapiens
aggaccctggctcttc

SEQ ID NO: 6641004 - DNA, 19 bp, Homo sapiens
aggaccctggctcttctct

SEQ ID NO: 6641005 - DNA, 12 bp, Homo sapiens
aggaccctgggt

SEQ ID NO: 6641006 - DNA, 16 bp, Homo sapiens
aggaccctgggtcacc

SEQ ID NO: 6641007 - DNA, 16 bp, Homo sapiens
aggaccctgtcctgca

SEQ ID NO: 6641008 - DNA, 18 bp, Homo sapiens
aggaccctgtgccctcct

SEQ ID NO: 6641009 - DNA, 23 bp, Homo sapiens
aggaccctgtgccctccttccca

SEQ ID NO: 6641010 - DNA, 14 bp, Homo sapiens
aggaccctgtttct

SEQ ID NO: 6641011 - DNA, 15 bp, Homo sapiens
aggaccctgtttctg

SEQ ID NO: 6641012 - DNA, 20 bp, Homo sapiens
aggaccctgttttccacacc

SEQ ID NO: 6641013 - DNA, 23 bp, Homo sapiens
aggacccttctactttttccttc

SEQ ID NO: 6641014 - DNA, 17 bp, Homo sapiens
aggacccttttaagcat

SEQ ID NO: 6641015 - DNA, 14 bp, Homo sapiens
aggaccgaggctac

SEQ ID NO: 6641016 - DNA, 20 bp, Homo sapiens
aggaccgccatggtgctggg

SEQ ID NO: 6641017 - DNA, 15 bp, Homo sapiens
aggaccgccccaacc

SEQ ID NO: 6641018 - DNA, 18 bp, Homo sapiens
aggaccgccccaaccctc

SEQ ID NO: 6641019 - DNA, 16 bp, Homo sapiens
aggaccggcggctcgg

SEQ ID NO: 6641020 - DNA, 23 bp, Homo sapiens
aggaccgttttgtattgcttcct

SEQ ID NO: 6641021 - DNA, 16 bp, Homo sapiens
aggacctatgtttgct

SEQ ID NO: 6641022 - DNA, 15 bp, Homo sapiens
aggacctcagctgct

SEQ ID NO: 6641023 - DNA, 18 bp, Homo sapiens
aggacctcagctgcttct

SEQ ID NO: 6641024 - DNA, 18 bp, Homo sapiens
aggacctcaggcggggag

SEQ ID NO: 6641025 - DNA, 21 bp, Homo sapiens
aggacctcaggcggggaggag

SEQ ID NO: 6641026 - DNA, 14 bp, Homo sapiens
aggacctcaggtga

SEQ ID NO: 6641027 - DNA, 23 bp, Homo sapiens
aggacctcatatcttcctcatca

SEQ ID NO: 6641028 - DNA, 23 bp, Homo sapiens
aggacctcatccaaacaatttaa

SEQ ID NO: 6641029 - DNA, 21 bp, Homo sapiens
aggacctccaagccactgagc

SEQ ID NO: 6641030 - DNA, 13 bp, Homo sapiens
aggacctccatgc

SEQ ID NO: 6641031 - DNA, 14 bp, Homo sapiens
aggacctccatgcc

SEQ ID NO: 6641032 - DNA, 15 bp, Homo sapiens
aggacctccatgccc

SEQ ID NO: 6641033 - DNA, 23 bp, Homo sapiens
aggacctccctgtctcccggctc

SEQ ID NO: 6641034 - DNA, 22 bp, Homo sapiens
aggacctccggagcgccctgca

SEQ ID NO: 6641035 - DNA, 17 bp, Homo sapiens
aggacctccggggagag

SEQ ID NO: 6641036 - DNA, 18 bp, Homo sapiens
aggacctcctcttccccc

SEQ ID NO: 6641037 - DNA, 19 bp, Homo sapiens
aggacctcctcttccccct

SEQ ID NO: 6641038 - DNA, 21 bp, Homo sapiens
aggacctcggggaataaaaca

SEQ ID NO: 6641039 - DNA, 13 bp, Homo sapiens
aggacctctcagc

SEQ ID NO: 6641040 - DNA, 20 bp, Homo sapiens
aggacctctgaaaccctgga

SEQ ID NO: 6641041 - DNA, 13 bp, Homo sapiens
aggacctctgctt

SEQ ID NO: 6641042 - DNA, 23 bp, Homo sapiens
aggacctctgcttttgcacacct

SEQ ID NO: 6641043 - DNA, 19 bp, Homo sapiens
aggacctctgtaggcagca

SEQ ID NO: 6641044 - DNA, 15 bp, Homo sapiens
aggacctcttcagct

SEQ ID NO: 6641045 - DNA, 19 bp, Homo sapiens
aggacctctttactctctc

SEQ ID NO: 6641046 - DNA, 17 bp, Homo sapiens
aggacctgaaattccaa

SEQ ID NO: 6641047 - DNA, 20 bp, Homo sapiens
aggacctgaaattccaaagt

SEQ ID NO: 6641048 - DNA, 13 bp, Homo sapiens
aggacctgagcct

SEQ ID NO: 6641049 - DNA, 17 bp, Homo sapiens
aggacctgagcctgccg

SEQ ID NO: 6641050 - DNA, 18 bp, Homo sapiens
aggacctgagcctgccga

SEQ ID NO: 6641051 - DNA, 18 bp, Homo sapiens
aggacctgagctggccag

SEQ ID NO: 6641052 - DNA, 18 bp, Homo sapiens
aggacctgcatccttcct

SEQ ID NO: 6641053 - DNA, 20 bp, Homo sapiens
aggacctgcatccttcctgg

SEQ ID NO: 6641054 - DNA, 14 bp, Homo sapiens
aggacctgcctagc

SEQ ID NO: 6641055 - DNA, 13 bp, Homo sapiens
aggacctgcctcc

SEQ ID NO: 6641056 - DNA, 13 bp, Homo sapiens
aggacctgcctgt

SEQ ID NO: 6641057 - DNA, 19 bp, Homo sapiens
aggacctggcatcatggtg

SEQ ID NO: 6641058 - DNA, 23 bp, Homo sapiens
aggacctggcgtgctcagaccca

SEQ ID NO: 6641059 - DNA, 20 bp, Homo sapiens
aggacctgtatttaagcaaa

SEQ ID NO: 6641060 - DNA, 21 bp, Homo sapiens
aggacctgtatttaagcaaat

SEQ ID NO: 6641061 - DNA, 13 bp, Homo sapiens
aggacctgtgtcc

SEQ ID NO: 6641062 - DNA, 19 bp, Homo sapiens
aggaccttcgggctgtgcc

SEQ ID NO: 6641063 - DNA, 19 bp, Homo sapiens
aggaccttgcttccttctc

SEQ ID NO: 6641064 - DNA, 20 bp, Homo sapiens
aggaccttgcttccttctca

SEQ ID NO: 6641065 - DNA, 21 bp, Homo sapiens
aggacctttccaccacagcca

SEQ ID NO: 6641066 - DNA, 18 bp, Homo sapiens
aggacgacgaatcttctc

SEQ ID NO: 6641067 - DNA, 17 bp, Homo sapiens
aggacgagacccccatc

SEQ ID NO: 6641068 - DNA, 20 bp, Homo sapiens
aggacgagacccccatccag

SEQ ID NO: 6641069 - DNA, 14 bp, Homo sapiens
aggacgaggcagaa

SEQ ID NO: 6641070 - DNA, 14 bp, Homo sapiens
aggacgcactgagc

SEQ ID NO: 6641071 - DNA, 21 bp, Homo sapiens
aggacgcagggagaccctggg

SEQ ID NO: 6641072 - DNA, 12 bp, Homo sapiens
aggacgcatgca

SEQ ID NO: 6641073 - DNA, 13 bp, Homo sapiens
aggacgcatgcag

SEQ ID NO: 6641074 - DNA, 16 bp, Homo sapiens
aggacgcatgcagggc

SEQ ID NO: 6641075 - DNA, 17 bp, Homo sapiens
aggacgccaacttctcc

SEQ ID NO: 6641076 - DNA, 20 bp, Homo sapiens
aggacgccaacttctcccac

SEQ ID NO: 6641077 - DNA, 16 bp, Homo sapiens
aggacgccactcattt

SEQ ID NO: 6641078 - DNA, 22 bp, Homo sapiens
aggacgcgacctcagttgtcct

SEQ ID NO: 6641079 - DNA, 14 bp, Homo sapiens
aggacgctctctgg

SEQ ID NO: 6641080 - DNA, 15 bp, Homo sapiens
aggacgctggctact

SEQ ID NO: 6641081 - DNA, 17 bp, Homo sapiens
aggacgcttcacaggac

SEQ ID NO: 6641082 - DNA, 13 bp, Homo sapiens
aggacgcttctga

SEQ ID NO: 6641083 - DNA, 15 bp, Homo sapiens
aggacgcttctgaat

SEQ ID NO: 6641084 - DNA, 20 bp, Homo sapiens
aggacggccctgcctgcctc

SEQ ID NO: 6641085 - DNA, 16 bp, Homo sapiens
aggacggggcagagct

SEQ ID NO: 6641086 - DNA, 21 bp, Homo sapiens
aggacggggccggccaggtgg

SEQ ID NO: 6641087 - DNA, 22 bp, Homo sapiens
aggacggggccggccaggtggg

SEQ ID NO: 6641088 - DNA, 14 bp, Homo sapiens
aggacggtctgtgc

SEQ ID NO: 6641089 - DNA, 20 bp, Homo sapiens
aggacggtgccaagggcccc

SEQ ID NO: 6641090 - DNA, 19 bp, Homo sapiens
aggacgtaaaatttacagt

SEQ ID NO: 6641091 - DNA, 21 bp, Homo sapiens
aggacgtcatcggaggctggg

SEQ ID NO: 6641092 - DNA, 20 bp, Homo sapiens
aggacgtgggcggcagagag

SEQ ID NO: 6641093 - DNA, 15 bp, Homo sapiens
aggacgtgggctggg

SEQ ID NO: 6641094 - DNA, 15 bp, Homo sapiens
aggacgttggcctca

SEQ ID NO: 6641095 - DNA, 20 bp, Homo sapiens
aggacgttggcctcagggcc

SEQ ID NO: 6641096 - DNA, 20 bp, Homo sapiens
aggactaacataaaatctgt

SEQ ID NO: 6641097 - DNA, 18 bp, Homo sapiens
aggactaatccaatacct

SEQ ID NO: 6641098 - DNA, 18 bp, Homo sapiens
aggactaccgcaggcccg

SEQ ID NO: 6641099 - DNA, 19 bp, Homo sapiens
aggactaccgcaggcccgg

SEQ ID NO: 6641100 - DNA, 15 bp, Homo sapiens
aggactactcagcac

SEQ ID NO: 6641101 - DNA, 17 bp, Homo sapiens
aggactagatactactt

SEQ ID NO: 6641102 - DNA, 18 bp, Homo sapiens
aggactagatactacttt

SEQ ID NO: 6641103 - DNA, 15 bp, Homo sapiens
aggactagggtcctg

SEQ ID NO: 6641104 - DNA, 18 bp, Homo sapiens
aggactagggtcctgggg

SEQ ID NO: 6641105 - DNA, 13 bp, Homo sapiens
aggactatataaa

SEQ ID NO: 6641106 - DNA, 15 bp, Homo sapiens
aggactatataaagt

SEQ ID NO: 6641107 - DNA, 22 bp, Homo sapiens
aggactattacatattttttgt

SEQ ID NO: 6641108 - DNA, 17 bp, Homo sapiens
aggactcaccactgccc

SEQ ID NO: 6641109 - DNA, 16 bp, Homo sapiens
aggactcaccctccac

SEQ ID NO: 6641110 - DNA, 18 bp, Homo sapiens
aggactcagaagcctctg

SEQ ID NO: 6641111 - DNA, 16 bp, Homo sapiens
aggactcaggcctgcc

SEQ ID NO: 6641112 - DNA, 21 bp, Homo sapiens
aggactcaggcctgccaatgc

SEQ ID NO: 6641113 - DNA, 21 bp, Homo sapiens
aggactcagggactcaggcca

SEQ ID NO: 6641114 - DNA, 14 bp, Homo sapiens
aggactccactgga

SEQ ID NO: 6641115 - DNA, 16 bp, Homo sapiens
aggactccaggggctg

SEQ ID NO: 6641116 - DNA, 21 bp, Homo sapiens
aggactccattggatctgcaa

SEQ ID NO: 6641117 - DNA, 14 bp, Homo sapiens
aggactcccaccta

SEQ ID NO: 6641118 - DNA, 19 bp, Homo sapiens
aggactccccaggccaggc

SEQ ID NO: 6641119 - DNA, 17 bp, Homo sapiens
aggactccctccatgtg

SEQ ID NO: 6641120 - DNA, 13 bp, Homo sapiens
aggactccctcct

SEQ ID NO: 6641121 - DNA, 15 bp, Homo sapiens
aggactcctccccac

SEQ ID NO: 6641122 - DNA, 23 bp, Homo sapiens
aggactcctccccaccctcctgg

SEQ ID NO: 6641123 - DNA, 14 bp, Homo sapiens
aggactcctgaaaa

SEQ ID NO: 6641124 - DNA, 17 bp, Homo sapiens
aggactcctgaaaaaaa

SEQ ID NO: 6641125 - DNA, 15 bp, Homo sapiens
aggactcctggcagg

SEQ ID NO: 6641126 - DNA, 14 bp, Homo sapiens
aggactcgcttgta

SEQ ID NO: 6641127 - DNA, 21 bp, Homo sapiens
aggactcgcttgtaaatacca

SEQ ID NO: 6641128 - DNA, 23 bp, Homo sapiens
aggactcggccactgtgtctctg

SEQ ID NO: 6641129 - DNA, 19 bp, Homo sapiens
aggactctagaagctcagg

SEQ ID NO: 6641130 - DNA, 12 bp, Homo sapiens
aggactctcagg

SEQ ID NO: 6641131 - DNA, 12 bp, Homo sapiens
aggactctcctc

SEQ ID NO: 6641132 - DNA, 22 bp, Homo sapiens
aggactctctccaggagggctc

SEQ ID NO: 6641133 - DNA, 23 bp, Homo sapiens
aggactctctccaggagggctcg

SEQ ID NO: 6641134 - DNA, 15 bp, Homo sapiens
aggactctctttctt

SEQ ID NO: 6641135 - DNA, 13 bp, Homo sapiens
aggactctgcagc

SEQ ID NO: 6641136 - DNA, 15 bp, Homo sapiens
aggactctgcagcct

SEQ ID NO: 6641137 - DNA, 18 bp, Homo sapiens
aggactctgcccagacca

SEQ ID NO: 6641138 - DNA, 21 bp, Homo sapiens
aggactctgccccttctgttt

SEQ ID NO: 6641139 - DNA, 13 bp, Homo sapiens
aggactctgcctc

SEQ ID NO: 6641140 - DNA, 17 bp, Homo sapiens
aggactctgcctcctct

SEQ ID NO: 6641141 - DNA, 14 bp, Homo sapiens
aggactctgcggga

SEQ ID NO: 6641142 - DNA, 20 bp, Homo sapiens
aggactctgcgggaggctgg

SEQ ID NO: 6641143 - DNA, 15 bp, Homo sapiens
aggactctgcttaaa

SEQ ID NO: 6641144 - DNA, 13 bp, Homo sapiens
aggactctggaag

SEQ ID NO: 6641145 - DNA, 21 bp, Homo sapiens
aggactctggaagattttcat

SEQ ID NO: 6641146 - DNA, 22 bp, Homo sapiens
aggactctggaagattttcatt

SEQ ID NO: 6641147 - DNA, 14 bp, Homo sapiens
aggactctggacaa

SEQ ID NO: 6641148 - DNA, 11 bp, Homo sapiens
aggactctggc

SEQ ID NO: 6641149 - DNA, 14 bp, Homo sapiens
aggactctggcctc

SEQ ID NO: 6641150 - DNA, 15 bp, Homo sapiens
aggactctggcctct

SEQ ID NO: 6641151 - DNA, 13 bp, Homo sapiens
aggactgaaagaa

SEQ ID NO: 6641152 - DNA, 13 bp, Homo sapiens
aggactgaagaaa

SEQ ID NO: 6641153 - DNA, 14 bp, Homo sapiens
aggactgaagctgg

SEQ ID NO: 6641154 - DNA, 17 bp, Homo sapiens
aggactgaagctggggc

SEQ ID NO: 6641155 - DNA, 15 bp, Homo sapiens
aggactgactgaggc

SEQ ID NO: 6641156 - DNA, 14 bp, Homo sapiens
aggactgagccccc

SEQ ID NO: 6641157 - DNA, 16 bp, Homo sapiens
aggactgagccctctc

SEQ ID NO: 6641158 - DNA, 14 bp, Homo sapiens
aggactgaggagtg

SEQ ID NO: 6641159 - DNA, 11 bp, Homo sapiens
aggactgaggg

SEQ ID NO: 6641160 - DNA, 12 bp, Homo sapiens
aggactgaggga

SEQ ID NO: 6641161 - DNA, 18 bp, Homo sapiens
aggactgagggactctga

SEQ ID NO: 6641162 - DNA, 15 bp, Homo sapiens
aggactgagggcagt

SEQ ID NO: 6641163 - DNA, 21 bp, Homo sapiens
aggactgagtcccctccagga

SEQ ID NO: 6641164 - DNA, 15 bp, Homo sapiens
aggactgatgtctcc

SEQ ID NO: 6641165 - DNA, 16 bp, Homo sapiens
aggactgatgtctcct

SEQ ID NO: 6641166 - DNA, 19 bp, Homo sapiens
aggactgatttgatgcctc

SEQ ID NO: 6641167 - DNA, 23 bp, Homo sapiens
aggactgcacagcgtcctgtcca

SEQ ID NO: 6641168 - DNA, 21 bp, Homo sapiens
aggactgcaccattgctgctc

SEQ ID NO: 6641169 - DNA, 16 bp, Homo sapiens
aggactgcagagcaga

SEQ ID NO: 6641170 - DNA, 19 bp, Homo sapiens
aggactgcagagcagatgg

SEQ ID NO: 6641171 - DNA, 23 bp, Homo sapiens
aggactgcagagggctccagagt

SEQ ID NO: 6641172 - DNA, 23 bp, Homo sapiens
aggactgcagccactgattctct

SEQ ID NO: 6641173 - DNA, 16 bp, Homo sapiens
aggactgcagtgtgga

SEQ ID NO: 6641174 - DNA, 19 bp, Homo sapiens
aggactgcatggtaattta

SEQ ID NO: 6641175 - DNA, 12 bp, Homo sapiens
aggactgcattg

SEQ ID NO: 6641176 - DNA, 21 bp, Homo sapiens
aggactgccccgtgcagactg

SEQ ID NO: 6641177 - DNA, 13 bp, Homo sapiens
aggactgccgacc

SEQ ID NO: 6641178 - DNA, 21 bp, Homo sapiens
aggactgccgaccgaggctgg

SEQ ID NO: 6641179 - DNA, 22 bp, Homo sapiens
aggactgccgaccgaggctgga

SEQ ID NO: 6641180 - DNA, 15 bp, Homo sapiens
aggactggactgttt

SEQ ID NO: 6641181 - DNA, 17 bp, Homo sapiens
aggactggattggccaa

SEQ ID NO: 6641182 - DNA, 14 bp, Homo sapiens
aggactggctcacc

SEQ ID NO: 6641183 - DNA, 22 bp, Homo sapiens
aggactggctttgtcccacagc

SEQ ID NO: 6641184 - DNA, 19 bp, Homo sapiens
aggactgggagcccccagc

SEQ ID NO: 6641185 - DNA, 22 bp, Homo sapiens
aggactgggagcccccagcctg

SEQ ID NO: 6641186 - DNA, 12 bp, Homo sapiens
aggactgggccc

SEQ ID NO: 6641187 - DNA, 12 bp, Homo sapiens
aggactgggccg

SEQ ID NO: 6641188 - DNA, 20 bp, Homo sapiens
aggactggtaggaaaaagct

SEQ ID NO: 6641189 - DNA, 21 bp, Homo sapiens
aggactggtgaatataaatga

SEQ ID NO: 6641190 - DNA, 15 bp, Homo sapiens
aggactggtgcctgg

SEQ ID NO: 6641191 - DNA, 18 bp, Homo sapiens
aggactggttctgaggcc

SEQ ID NO: 6641192 - DNA, 19 bp, Homo sapiens
aggactggttctgaggcca

SEQ ID NO: 6641193 - DNA, 14 bp, Homo sapiens
aggactgtaaacat

SEQ ID NO: 6641194 - DNA, 12 bp, Homo sapiens
aggactgtataa

SEQ ID NO: 6641195 - DNA, 15 bp, Homo sapiens
aggactgtataagta

SEQ ID NO: 6641196 - DNA, 23 bp, Homo sapiens
aggactgtatagtttaaagggag

SEQ ID NO: 6641197 - DNA, 15 bp, Homo sapiens
aggactgtatttgtg

SEQ ID NO: 6641198 - DNA, 22 bp, Homo sapiens
aggactgtatttgtgactaatt

SEQ ID NO: 6641199 - DNA, 21 bp, Homo sapiens
aggactgtccccttgaaggag

SEQ ID NO: 6641200 - DNA, 17 bp, Homo sapiens
aggactgtcctcccaca

SEQ ID NO: 6641201 - DNA, 17 bp, Homo sapiens
aggactgtgaccaaagc

SEQ ID NO: 6641202 - DNA, 13 bp, Homo sapiens
aggactgtggagg

SEQ ID NO: 6641203 - DNA, 21 bp, Homo sapiens
aggactgtggaggggagctgc

SEQ ID NO: 6641204 - DNA, 12 bp, Homo sapiens
aggactgtggct

SEQ ID NO: 6641205 - DNA, 14 bp, Homo sapiens
aggactgtgtgaga

SEQ ID NO: 6641206 - DNA, 22 bp, Homo sapiens
aggactgttggctgattggaaa

SEQ ID NO: 6641207 - DNA, 15 bp, Homo sapiens
aggactgtttcaaac

SEQ ID NO: 6641208 - DNA, 14 bp, Homo sapiens
aggactgtttcagt

SEQ ID NO: 6641209 - DNA, 22 bp, Homo sapiens
aggactgttttttcctgagctt

SEQ ID NO: 6641210 - DNA, 15 bp, Homo sapiens
aggacttaaaattag

SEQ ID NO: 6641211 - DNA, 20 bp, Homo sapiens
aggacttaacggctccagga

SEQ ID NO: 6641212 - DNA, 21 bp, Homo sapiens
aggacttaacggctccaggat

SEQ ID NO: 6641213 - DNA, 17 bp, Homo sapiens
aggacttcaaaaggtga

SEQ ID NO: 6641214 - DNA, 21 bp, Homo sapiens
aggacttcccccaccccagaa

SEQ ID NO: 6641215 - DNA, 23 bp, Homo sapiens
aggacttcccccaccccagaaga

SEQ ID NO: 6641216 - DNA, 21 bp, Homo sapiens
aggacttccccggagggctgc

SEQ ID NO: 6641217 - DNA, 15 bp, Homo sapiens
aggacttccctgtgt

SEQ ID NO: 6641218 - DNA, 21 bp, Homo sapiens
aggacttcctgtccagctcca

SEQ ID NO: 6641219 - DNA, 22 bp, Homo sapiens
aggacttcctgtccagctccaa

SEQ ID NO: 6641220 - DNA, 23 bp, Homo sapiens
aggacttcggggtagaggctggg

SEQ ID NO: 6641221 - DNA, 13 bp, Homo sapiens
aggacttctgcag

SEQ ID NO: 6641222 - DNA, 15 bp, Homo sapiens
aggacttctgcagct

SEQ ID NO: 6641223 - DNA, 13 bp, Homo sapiens
aggacttgaaaga

SEQ ID NO: 6641224 - DNA, 13 bp, Homo sapiens
aggacttgccctc

SEQ ID NO: 6641225 - DNA, 17 bp, Homo sapiens
aggacttggagggtctg

SEQ ID NO: 6641226 - DNA, 18 bp, Homo sapiens
aggacttggagggtctgg

SEQ ID NO: 6641227 - DNA, 19 bp, Homo sapiens
aggacttggagggtctggg

SEQ ID NO: 6641228 - DNA, 21 bp, Homo sapiens
aggacttggagggtctggggg

SEQ ID NO: 6641229 - DNA, 22 bp, Homo sapiens
aggacttggtaagatgactctg

SEQ ID NO: 6641230 - DNA, 20 bp, Homo sapiens
aggacttggtcttttttctg

SEQ ID NO: 6641231 - DNA, 21 bp, Homo sapiens
aggacttgtctccatgtgtat

SEQ ID NO: 6641232 - DNA, 13 bp, Homo sapiens
aggacttgtgcct

SEQ ID NO: 6641233 - DNA, 14 bp, Homo sapiens
aggacttgtgcctc

SEQ ID NO: 6641234 - DNA, 15 bp, Homo sapiens
aggacttgtgcctct

SEQ ID NO: 6641235 - DNA, 16 bp, Homo sapiens
aggacttgtgcctctt

SEQ ID NO: 6641236 - DNA, 21 bp, Homo sapiens
aggacttgtgcctcttgggag

SEQ ID NO: 6641237 - DNA, 23 bp, Homo sapiens
aggacttgtgcctcttgggagac

SEQ ID NO: 6641238 - DNA, 13 bp, Homo sapiens
aggacttgtgtct

SEQ ID NO: 6641239 - DNA, 16 bp, Homo sapiens
aggacttgttaaagag

SEQ ID NO: 6641240 - DNA, 16 bp, Homo sapiens
aggactttagggatct

SEQ ID NO: 6641241 - DNA, 20 bp, Homo sapiens
aggactttatagatcagcca

SEQ ID NO: 6641242 - DNA, 21 bp, Homo sapiens
aggactttcctaaatgtttaa

SEQ ID NO: 6641243 - DNA, 18 bp, Homo sapiens
aggactttgaggcaagtg

SEQ ID NO: 6641244 - DNA, 20 bp, Homo sapiens
aggactttgatgcatttcca

SEQ ID NO: 6641245 - DNA, 11 bp, Homo sapiens
aggactttgca

SEQ ID NO: 6641246 - DNA, 20 bp, Homo sapiens
aggactttggcttacatttg

SEQ ID NO: 6641247 - DNA, 18 bp, Homo sapiens
aggacttttaaacaaaag

SEQ ID NO: 6641248 - DNA, 17 bp, Homo sapiens
aggacttttttgattaa

SEQ ID NO: 6641249 - DNA, 12 bp, Homo sapiens
aggagaaaaaaa

SEQ ID NO: 6641250 - DNA, 20 bp, Homo sapiens
aggagaaaaaaaaagtgaaa

SEQ ID NO: 6641251 - DNA, 16 bp, Homo sapiens
aggagaaaaagaagaa

SEQ ID NO: 6641252 - DNA, 16 bp, Homo sapiens
aggagaaaagtgggct

SEQ ID NO: 6641253 - DNA, 13 bp, Homo sapiens
aggagaaaatgaa

SEQ ID NO: 6641254 - DNA, 22 bp, Homo sapiens
aggagaaaatgcaatttgataa

SEQ ID NO: 6641255 - DNA, 14 bp, Homo sapiens
aggagaaaatgcat

SEQ ID NO: 6641256 - DNA, 13 bp, Homo sapiens
aggagaaacacat

SEQ ID NO: 6641257 - DNA, 17 bp, Homo sapiens
aggagaaacacttgaac

SEQ ID NO: 6641258 - DNA, 20 bp, Homo sapiens
aggagaaagccgggggaggg

SEQ ID NO: 6641259 - DNA, 15 bp, Homo sapiens
aggagaaagcttaat

SEQ ID NO: 6641260 - DNA, 13 bp, Homo sapiens
aggagaaaggagc

SEQ ID NO: 6641261 - DNA, 17 bp, Homo sapiens
aggagaaaggagccgga

SEQ ID NO: 6641262 - DNA, 18 bp, Homo sapiens
aggagaaagtaccctctt

SEQ ID NO: 6641263 - DNA, 11 bp, Homo sapiens
aggagaaataa

SEQ ID NO: 6641264 - DNA, 12 bp, Homo sapiens
aggagaaatctg

SEQ ID NO: 6641265 - DNA, 12 bp, Homo sapiens
aggagaaatgca

SEQ ID NO: 6641266 - DNA, 20 bp, Homo sapiens
aggagaaatgcaataactct

SEQ ID NO: 6641267 - DNA, 16 bp, Homo sapiens
aggagaaatgcatcca

SEQ ID NO: 6641268 - DNA, 13 bp, Homo sapiens
aggagaacaaata

SEQ ID NO: 6641269 - DNA, 16 bp, Homo sapiens
aggagaacccaatttt

SEQ ID NO: 6641270 - DNA, 18 bp, Homo sapiens
aggagaacttgctgcctc

SEQ ID NO: 6641271 - DNA, 19 bp, Homo sapiens
aggagaacttgctgcctcg

SEQ ID NO: 6641272 - DNA, 20 bp, Homo sapiens
aggagaagaaggaaatgaat

SEQ ID NO: 6641273 - DNA, 18 bp, Homo sapiens
aggagaagacccctgccc

SEQ ID NO: 6641274 - DNA, 13 bp, Homo sapiens
aggagaagaggca

SEQ ID NO: 6641275 - DNA, 21 bp, Homo sapiens
aggagaagaggcatcctgcct

SEQ ID NO: 6641276 - DNA, 22 bp, Homo sapiens
aggagaagaggcatcctgcctg

SEQ ID NO: 6641277 - DNA, 23 bp, Homo sapiens
aggagaagaggcatcctgcctgg

SEQ ID NO: 6641278 - DNA, 18 bp, Homo sapiens
aggagaagagttgaggaa

SEQ ID NO: 6641279 - DNA, 18 bp, Homo sapiens
aggagaagcacagctcct

SEQ ID NO: 6641280 - DNA, 22 bp, Homo sapiens
aggagaagcacagctcctgcca

SEQ ID NO: 6641281 - DNA, 13 bp, Homo sapiens
aggagaagccagt

SEQ ID NO: 6641282 - DNA, 12 bp, Homo sapiens
aggagaagctca

SEQ ID NO: 6641283 - DNA, 15 bp, Homo sapiens
aggagaagctcagct

SEQ ID NO: 6641284 - DNA, 19 bp, Homo sapiens
aggagaagctcagctgcat

SEQ ID NO: 6641285 - DNA, 18 bp, Homo sapiens
aggagaagctgatccagt

SEQ ID NO: 6641286 - DNA, 12 bp, Homo sapiens
aggagaaggaag

SEQ ID NO: 6641287 - DNA, 16 bp, Homo sapiens
aggagaaggcctgccc

SEQ ID NO: 6641288 - DNA, 17 bp, Homo sapiens
aggagaaggcctgcccc

SEQ ID NO: 6641289 - DNA, 19 bp, Homo sapiens
aggagaaggctggagaagg

SEQ ID NO: 6641290 - DNA, 14 bp, Homo sapiens
aggagaagggctga

SEQ ID NO: 6641291 - DNA, 21 bp, Homo sapiens
aggagaaggtcagcgagaagg

SEQ ID NO: 6641292 - DNA, 16 bp, Homo sapiens
aggagaagtattcctg

SEQ ID NO: 6641293 - DNA, 19 bp, Homo sapiens
aggagaagtattcctgttg

SEQ ID NO: 6641294 - DNA, 21 bp, Homo sapiens
aggagaagtattcctgttgct

SEQ ID NO: 6641295 - DNA, 17 bp, Homo sapiens
aggagaagtgctccctg

SEQ ID NO: 6641296 - DNA, 18 bp, Homo sapiens
aggagaagtgctccctgg

SEQ ID NO: 6641297 - DNA, 11 bp, Homo sapiens
aggagaagttg

SEQ ID NO: 6641298 - DNA, 13 bp, Homo sapiens
aggagaagttggt

SEQ ID NO: 6641299 - DNA, 14 bp, Homo sapiens
aggagaatcactcg

SEQ ID NO: 6641300 - DNA, 20 bp, Homo sapiens
aggagaatcactcgaacccg

SEQ ID NO: 6641301 - DNA, 20 bp, Homo sapiens
aggagaatcacttgaacccg

SEQ ID NO: 6641302 - DNA, 16 bp, Homo sapiens
aggagaatccaagcga

SEQ ID NO: 6641303 - DNA, 11 bp, Homo sapiens
aggagaatggc

SEQ ID NO: 6641304 - DNA, 22 bp, Homo sapiens
aggagaatggcgtgaacccggg

SEQ ID NO: 6641305 - DNA, 23 bp, Homo sapiens
aggagaattaagtcctactttta

SEQ ID NO: 6641306 - DNA, 13 bp, Homo sapiens
aggagaattgctt

SEQ ID NO: 6641307 - DNA, 13 bp, Homo sapiens
aggagacaaaaga

SEQ ID NO: 6641308 - DNA, 21 bp, Homo sapiens
aggagacaaagcaggagtgga

SEQ ID NO: 6641309 - DNA, 22 bp, Homo sapiens
aggagacaaagcaggagtggaa

SEQ ID NO: 6641310 - DNA, 13 bp, Homo sapiens
aggagacacagat

SEQ ID NO: 6641311 - DNA, 16 bp, Homo sapiens
aggagacacagatggc

SEQ ID NO: 6641312 - DNA, 13 bp, Homo sapiens
aggagacactggt

SEQ ID NO: 6641313 - DNA, 17 bp, Homo sapiens
aggagacagaaagcctc

SEQ ID NO: 6641314 - DNA, 18 bp, Homo sapiens
aggagacaggcagagctg

SEQ ID NO: 6641315 - DNA, 20 bp, Homo sapiens
aggagacaggttagctgctc

SEQ ID NO: 6641316 - DNA, 18 bp, Homo sapiens
aggagacagtcaggaagc

SEQ ID NO: 6641317 - DNA, 21 bp, Homo sapiens
aggagacatatcactgctgct

SEQ ID NO: 6641318 - DNA, 19 bp, Homo sapiens
aggagacattgctctatgt

SEQ ID NO: 6641319 - DNA, 14 bp, Homo sapiens
aggagaccaaggcg

SEQ ID NO: 6641320 - DNA, 12 bp, Homo sapiens
aggagaccaccc

SEQ ID NO: 6641321 - DNA, 13 bp, Homo sapiens
aggagaccacccc

SEQ ID NO: 6641322 - DNA, 15 bp, Homo sapiens
aggagaccacccccg

SEQ ID NO: 6641323 - DNA, 12 bp, Homo sapiens
aggagaccacgg

SEQ ID NO: 6641324 - DNA, 16 bp, Homo sapiens
aggagaccagaagtga

SEQ ID NO: 6641325 - DNA, 13 bp, Homo sapiens
aggagaccagctc

SEQ ID NO: 6641326 - DNA, 21 bp, Homo sapiens
aggagaccctcccctgcctcc

SEQ ID NO: 6641327 - DNA, 15 bp, Homo sapiens
aggagaccctggaat

SEQ ID NO: 6641328 - DNA, 14 bp, Homo sapiens
aggagaccctgtct

SEQ ID NO: 6641329 - DNA, 15 bp, Homo sapiens
aggagaccctgtctt

SEQ ID NO: 6641330 - DNA, 13 bp, Homo sapiens
aggagacctccag

SEQ ID NO: 6641331 - DNA, 15 bp, Homo sapiens
aggagacctccagct

SEQ ID NO: 6641332 - DNA, 15 bp, Homo sapiens
aggagacctgctctc

SEQ ID NO: 6641333 - DNA, 15 bp, Homo sapiens
aggagactcacctct

SEQ ID NO: 6641334 - DNA, 16 bp, Homo sapiens
aggagactcacctctg

SEQ ID NO: 6641335 - DNA, 19 bp, Homo sapiens
aggagactcacctctgcct

SEQ ID NO: 6641336 - DNA, 14 bp, Homo sapiens
aggagactcaggcc

SEQ ID NO: 6641337 - DNA, 19 bp, Homo sapiens
aggagactcaggcccacat

SEQ ID NO: 6641338 - DNA, 13 bp, Homo sapiens
aggagactgaggc

SEQ ID NO: 6641339 - DNA, 21 bp, Homo sapiens
aggagactgggcacccctgcc

SEQ ID NO: 6641340 - DNA, 22 bp, Homo sapiens
aggagactggtaggaggaggca

SEQ ID NO: 6641341 - DNA, 20 bp, Homo sapiens
aggagactgtttggaaattg

SEQ ID NO: 6641342 - DNA, 15 bp, Homo sapiens
aggagacttaatttc

SEQ ID NO: 6641343 - DNA, 15 bp, Homo sapiens
aggagacttgtacag

SEQ ID NO: 6641344 - DNA, 14 bp, Homo sapiens
aggagagaaaatat

SEQ ID NO: 6641345 - DNA, 15 bp, Homo sapiens
aggagagaaaatata

SEQ ID NO: 6641346 - DNA, 16 bp, Homo sapiens
aggagagaaaatatat

SEQ ID NO: 6641347 - DNA, 22 bp, Homo sapiens
aggagagaaaatatatgtattt

SEQ ID NO: 6641348 - DNA, 16 bp, Homo sapiens
aggagagaagaaagtg

SEQ ID NO: 6641349 - DNA, 15 bp, Homo sapiens
aggagagaagaatga

SEQ ID NO: 6641350 - DNA, 14 bp, Homo sapiens
aggagagacactgg

SEQ ID NO: 6641351 - DNA, 23 bp, Homo sapiens
aggagagacccctcccctcccac

SEQ ID NO: 6641352 - DNA, 14 bp, Homo sapiens
aggagagagacaga

SEQ ID NO: 6641353 - DNA, 12 bp, Homo sapiens
aggagagagacc

SEQ ID NO: 6641354 - DNA, 22 bp, Homo sapiens
aggagagagagagagaaagaat

SEQ ID NO: 6641355 - DNA, 18 bp, Homo sapiens
aggagagagatcatgaga

SEQ ID NO: 6641356 - DNA, 20 bp, Homo sapiens
aggagagagatcatgagaaa

SEQ ID NO: 6641357 - DNA, 13 bp, Homo sapiens
aggagagagccag

SEQ ID NO: 6641358 - DNA, 14 bp, Homo sapiens
aggagagagccttg

SEQ ID NO: 6641359 - DNA, 15 bp, Homo sapiens
aggagagaggaggaa

SEQ ID NO: 6641360 - DNA, 14 bp, Homo sapiens
aggagagaggcaga

SEQ ID NO: 6641361 - DNA, 18 bp, Homo sapiens
aggagagaggcagagagc

SEQ ID NO: 6641362 - DNA, 24 bp, Homo sapiens
aggagagaggttgaggatgcactg

SEQ ID NO: 6641363 - DNA, 15 bp, Homo sapiens
aggagagagtcccag

SEQ ID NO: 6641364 - DNA, 18 bp, Homo sapiens
aggagagagtcccagagc

SEQ ID NO: 6641365 - DNA, 13 bp, Homo sapiens
aggagagatgacc

SEQ ID NO: 6641366 - DNA, 17 bp, Homo sapiens
aggagagcactgcctct

SEQ ID NO: 6641367 - DNA, 12 bp, Homo sapiens
aggagagcagcg

SEQ ID NO: 6641368 - DNA, 17 bp, Homo sapiens
aggagagcatcaccacc

SEQ ID NO: 6641369 - DNA, 20 bp, Homo sapiens
aggagagcatcaccaccaca

SEQ ID NO: 6641370 - DNA, 21 bp, Homo sapiens
aggagagcatcaccaccacac

SEQ ID NO: 6641371 - DNA, 19 bp, Homo sapiens
aggagagcatctgctctga

SEQ ID NO: 6641372 - DNA, 21 bp, Homo sapiens
aggagagcatctgctctgaga

SEQ ID NO: 6641373 - DNA, 18 bp, Homo sapiens
aggagagccaacctcggc

SEQ ID NO: 6641374 - DNA, 14 bp, Homo sapiens
aggagagccagccc

SEQ ID NO: 6641375 - DNA, 14 bp, Homo sapiens
aggagagcccccac

SEQ ID NO: 6641376 - DNA, 17 bp, Homo sapiens
aggagagccctctgctg

SEQ ID NO: 6641377 - DNA, 18 bp, Homo sapiens
aggagagccctctgctgc

SEQ ID NO: 6641378 - DNA, 21 bp, Homo sapiens
aggagagccctctgctgcttt

SEQ ID NO: 6641379 - DNA, 13 bp, Homo sapiens
aggagagcctggg

SEQ ID NO: 6641380 - DNA, 20 bp, Homo sapiens
aggagagcttcaggccccag

SEQ ID NO: 6641381 - DNA, 21 bp, Homo sapiens
aggagagcttcaggccccagg

SEQ ID NO: 6641382 - DNA, 22 bp, Homo sapiens
aggagagcttcaggccccagga

SEQ ID NO: 6641383 - DNA, 11 bp, Homo sapiens
aggagaggaaa

SEQ ID NO: 6641384 - DNA, 16 bp, Homo sapiens
aggagaggaaaactat

SEQ ID NO: 6641385 - DNA, 20 bp, Homo sapiens
aggagaggaaaagtaaggtg

SEQ ID NO: 6641386 - DNA, 12 bp, Homo sapiens
aggagaggaaag

SEQ ID NO: 6641387 - DNA, 12 bp, Homo sapiens
aggagaggagaa

SEQ ID NO: 6641388 - DNA, 13 bp, Homo sapiens
aggagaggagaaa

SEQ ID NO: 6641389 - DNA, 16 bp, Homo sapiens
aggagaggagaaaaaa

SEQ ID NO: 6641390 - DNA, 14 bp, Homo sapiens
aggagaggagacag

SEQ ID NO: 6641391 - DNA, 13 bp, Homo sapiens
aggagaggagaga

SEQ ID NO: 6641392 - DNA, 16 bp, Homo sapiens
aggagaggagagaggc

SEQ ID NO: 6641393 - DNA, 18 bp, Homo sapiens
aggagaggagagaggcag

SEQ ID NO: 6641394 - DNA, 15 bp, Homo sapiens
aggagaggagagcat

SEQ ID NO: 6641395 - DNA, 18 bp, Homo sapiens
aggagaggagagcatctg

SEQ ID NO: 6641396 - DNA, 14 bp, Homo sapiens
aggagaggagagcc

SEQ ID NO: 6641397 - DNA, 16 bp, Homo sapiens
aggagaggagagccag

SEQ ID NO: 6641398 - DNA, 17 bp, Homo sapiens
aggagaggagagccaga

SEQ ID NO: 6641399 - DNA, 15 bp, Homo sapiens
aggagaggatgagag

SEQ ID NO: 6641400 - DNA, 21 bp, Homo sapiens
aggagaggatgagagcccaga

SEQ ID NO: 6641401 - DNA, 14 bp, Homo sapiens
aggagaggctctga

SEQ ID NO: 6641402 - DNA, 15 bp, Homo sapiens
aggagaggctgggct

SEQ ID NO: 6641403 - DNA, 16 bp, Homo sapiens
aggagagggaaaatgt

SEQ ID NO: 6641404 - DNA, 18 bp, Homo sapiens
aggagagggaaaatgttt

SEQ ID NO: 6641405 - DNA, 19 bp, Homo sapiens
aggagagggaaaatgtttt

SEQ ID NO: 6641406 - DNA, 11 bp, Homo sapiens
aggagagggcc

SEQ ID NO: 6641407 - DNA, 20 bp, Homo sapiens
aggagagggcgctcctctct

SEQ ID NO: 6641408 - DNA, 22 bp, Homo sapiens
aggagaggggaagggccagtct

SEQ ID NO: 6641409 - DNA, 18 bp, Homo sapiens
aggagaggggcagaacag

SEQ ID NO: 6641410 - DNA, 20 bp, Homo sapiens
aggagaggtgataatgaatg

SEQ ID NO: 6641411 - DNA, 23 bp, Homo sapiens
aggagagtacccccctgagagca

SEQ ID NO: 6641412 - DNA, 15 bp, Homo sapiens
aggagagtcctggga

SEQ ID NO: 6641413 - DNA, 22 bp, Homo sapiens
aggagagtcggtctgctttgga

SEQ ID NO: 6641414 - DNA, 19 bp, Homo sapiens
aggagagtctgaatatttt

SEQ ID NO: 6641415 - DNA, 16 bp, Homo sapiens
aggagagtggaagaga

SEQ ID NO: 6641416 - DNA, 13 bp, Homo sapiens
aggagagtggcag

SEQ ID NO: 6641417 - DNA, 18 bp, Homo sapiens
aggagagtggcaggtggg

SEQ ID NO: 6641418 - DNA, 15 bp, Homo sapiens
aggagagtggcctgg

SEQ ID NO: 6641419 - DNA, 16 bp, Homo sapiens
aggagagtggcctggg

SEQ ID NO: 6641420 - DNA, 12 bp, Homo sapiens
aggagagtgtgc

SEQ ID NO: 6641421 - DNA, 13 bp, Homo sapiens
aggagagtgtgca

SEQ ID NO: 6641422 - DNA, 16 bp, Homo sapiens
aggagataaactgaaa

SEQ ID NO: 6641423 - DNA, 17 bp, Homo sapiens
aggagataaactgaaat

SEQ ID NO: 6641424 - DNA, 14 bp, Homo sapiens
aggagataagaaag

SEQ ID NO: 6641425 - DNA, 19 bp, Homo sapiens
aggagataaggtggcttct

SEQ ID NO: 6641426 - DNA, 23 bp, Homo sapiens
aggagataatgtggattaaaacc

SEQ ID NO: 6641427 - DNA, 22 bp, Homo sapiens
aggagatagacgggttgaaaga

SEQ ID NO: 6641428 - DNA, 23 bp, Homo sapiens
aggagatagacgggttgaaagac

SEQ ID NO: 6641429 - DNA, 12 bp, Homo sapiens
aggagatataaa

SEQ ID NO: 6641430 - DNA, 19 bp, Homo sapiens
aggagatataaaatctaga

SEQ ID NO: 6641431 - DNA, 14 bp, Homo sapiens
aggagatgaccagg

SEQ ID NO: 6641432 - DNA, 23 bp, Homo sapiens
aggagatgatgtgatggaacaca

SEQ ID NO: 6641433 - DNA, 19 bp, Homo sapiens
aggagatgtaatgacagag

SEQ ID NO: 6641434 - DNA, 21 bp, Homo sapiens
aggagatgtcatcaagctcca

SEQ ID NO: 6641435 - DNA, 18 bp, Homo sapiens
aggagatgtgatcaggcc

SEQ ID NO: 6641436 - DNA, 20 bp, Homo sapiens
aggagattaacacactgaac

SEQ ID NO: 6641437 - DNA, 11 bp, Homo sapiens
aggagattcca

SEQ ID NO: 6641438 - DNA, 21 bp, Homo sapiens
aggagattcccaccttccata

SEQ ID NO: 6641439 - DNA, 16 bp, Homo sapiens
aggagattgagaagga

SEQ ID NO: 6641440 - DNA, 15 bp, Homo sapiens
aggagattgctctgg

SEQ ID NO: 6641441 - DNA, 17 bp, Homo sapiens
aggagattggaaggaac

SEQ ID NO: 6641442 - DNA, 20 bp, Homo sapiens
aggagattggatttgctgtg

SEQ ID NO: 6641443 - DNA, 17 bp, Homo sapiens
aggagattggccagtga

SEQ ID NO: 6641444 - DNA, 15 bp, Homo sapiens
aggagatttcttagt

SEQ ID NO: 6641445 - DNA, 12 bp, Homo sapiens
aggagcaaagca

SEQ ID NO: 6641446 - DNA, 16 bp, Homo sapiens
aggagcaaagcctgtt

SEQ ID NO: 6641447 - DNA, 16 bp, Homo sapiens
aggagcaaaggctgag

SEQ ID NO: 6641448 - DNA, 20 bp, Homo sapiens
aggagcaaataccttagctc

SEQ ID NO: 6641449 - DNA, 13 bp, Homo sapiens
aggagcaaatgct

SEQ ID NO: 6641450 - DNA, 15 bp, Homo sapiens
aggagcaagaagaaa

SEQ ID NO: 6641451 - DNA, 20 bp, Homo sapiens
aggagcaaggctgccctgtc

SEQ ID NO: 6641452 - DNA, 23 bp, Homo sapiens
aggagcaagggtggccttgaaga

SEQ ID NO: 6641453 - DNA, 22 bp, Homo sapiens
aggagcaaggtgagaaatcaca

SEQ ID NO: 6641454 - DNA, 15 bp, Homo sapiens
aggagcaatcacagg

SEQ ID NO: 6641455 - DNA, 17 bp, Homo sapiens
aggagcaatgaagatcc

SEQ ID NO: 6641456 - DNA, 20 bp, Homo sapiens
aggagcaatgggactggagt

SEQ ID NO: 6641457 - DNA, 18 bp, Homo sapiens
aggagcaatttgcacatg

SEQ ID NO: 6641458 - DNA, 17 bp, Homo sapiens
aggagcacaataatttg

SEQ ID NO: 6641459 - DNA, 23 bp, Homo sapiens
aggagcacaataatttgttttca

SEQ ID NO: 6641460 - DNA, 17 bp, Homo sapiens
aggagcacacatccaag

SEQ ID NO: 6641461 - DNA, 13 bp, Homo sapiens
aggagcacacggc

SEQ ID NO: 6641462 - DNA, 15 bp, Homo sapiens
aggagcacacggccc

SEQ ID NO: 6641463 - DNA, 16 bp, Homo sapiens
aggagcacacggccct

SEQ ID NO: 6641464 - DNA, 22 bp, Homo sapiens
aggagcacaggcagctggatga

SEQ ID NO: 6641465 - DNA, 22 bp, Homo sapiens
aggagcacatactacctagaag

SEQ ID NO: 6641466 - DNA, 11 bp, Homo sapiens
aggagcacccc

SEQ ID NO: 6641467 - DNA, 13 bp, Homo sapiens
aggagcaccccca

SEQ ID NO: 6641468 - DNA, 21 bp, Homo sapiens
aggagcacccccagcctcccc

SEQ ID NO: 6641469 - DNA, 22 bp, Homo sapiens
aggagcacccccagcctccccc

SEQ ID NO: 6641470 - DNA, 17 bp, Homo sapiens
aggagcaccctgtcttc

SEQ ID NO: 6641471 - DNA, 18 bp, Homo sapiens
aggagcaccctgtcttct

SEQ ID NO: 6641472 - DNA, 20 bp, Homo sapiens
aggagcactagaatgagaaa

SEQ ID NO: 6641473 - DNA, 15 bp, Homo sapiens
aggagcactgaaagt

SEQ ID NO: 6641474 - DNA, 19 bp, Homo sapiens
aggagcactggggtggggg

SEQ ID NO: 6641475 - DNA, 14 bp, Homo sapiens
aggagcagacagag

SEQ ID NO: 6641476 - DNA, 17 bp, Homo sapiens
aggagcagagaggtggc

SEQ ID NO: 6641477 - DNA, 13 bp, Homo sapiens
aggagcagcagcc

SEQ ID NO: 6641478 - DNA, 19 bp, Homo sapiens
aggagcagcagccagcacc

SEQ ID NO: 6641479 - DNA, 13 bp, Homo sapiens
aggagcagcagct

SEQ ID NO: 6641480 - DNA, 12 bp, Homo sapiens
aggagcagccac

SEQ ID NO: 6641481 - DNA, 14 bp, Homo sapiens
aggagcagccagga

SEQ ID NO: 6641482 - DNA, 18 bp, Homo sapiens
aggagcagccaggacccg

SEQ ID NO: 6641483 - DNA, 19 bp, Homo sapiens
aggagcagcccggggagga

SEQ ID NO: 6641484 - DNA, 12 bp, Homo sapiens
aggagcagccct

SEQ ID NO: 6641485 - DNA, 12 bp, Homo sapiens
aggagcagcctc

SEQ ID NO: 6641486 - DNA, 16 bp, Homo sapiens
aggagcagcctcagaa

SEQ ID NO: 6641487 - DNA, 13 bp, Homo sapiens
aggagcagcctcg

SEQ ID NO: 6641488 - DNA, 14 bp, Homo sapiens
aggagcagctgtgc

SEQ ID NO: 6641489 - DNA, 20 bp, Homo sapiens
aggagcagctgtgctgcacc

SEQ ID NO: 6641490 - DNA, 11 bp, Homo sapiens
aggagcagctt

SEQ ID NO: 6641491 - DNA, 19 bp, Homo sapiens
aggagcaggagcctgagcc

SEQ ID NO: 6641492 - DNA, 17 bp, Homo sapiens
aggagcaggccctgggc

SEQ ID NO: 6641493 - DNA, 18 bp, Homo sapiens
aggagcaggcttgtggca

SEQ ID NO: 6641494 - DNA, 19 bp, Homo sapiens
aggagcagggcggctgccg

SEQ ID NO: 6641495 - DNA, 19 bp, Homo sapiens
aggagcagtgcaggcacag

SEQ ID NO: 6641496 - DNA, 21 bp, Homo sapiens
aggagcagtgggccctggctc

SEQ ID NO: 6641497 - DNA, 16 bp, Homo sapiens
aggagcatagaagcca

SEQ ID NO: 6641498 - DNA, 17 bp, Homo sapiens
aggagcatagaagccac

SEQ ID NO: 6641499 - DNA, 18 bp, Homo sapiens
aggagcatatgtcctaga

SEQ ID NO: 6641500 - DNA, 17 bp, Homo sapiens
aggagcatccttggcag

SEQ ID NO: 6641501 - DNA, 19 bp, Homo sapiens
aggagcatccttggcagtg

SEQ ID NO: 6641502 - DNA, 21 bp, Homo sapiens
aggagcatttggagagaaggc

SEQ ID NO: 6641503 - DNA, 19 bp, Homo sapiens
aggagcatttttttattca

SEQ ID NO: 6641504 - DNA, 17 bp, Homo sapiens
aggagccacctgggctg

SEQ ID NO: 6641505 - DNA, 15 bp, Homo sapiens
aggagccagacagac

SEQ ID NO: 6641506 - DNA, 16 bp, Homo sapiens
aggagccagcctgctt

SEQ ID NO: 6641507 - DNA, 19 bp, Homo sapiens
aggagccaggcaacttcag

SEQ ID NO: 6641508 - DNA, 13 bp, Homo sapiens
aggagccaggccc

SEQ ID NO: 6641509 - DNA, 24 bp, Homo sapiens
aggagccagtgaacttggctttcc

SEQ ID NO: 6641510 - DNA, 22 bp, Homo sapiens
aggagcccacggggcaaagctg

SEQ ID NO: 6641511 - DNA, 10 bp, Homo sapiens
aggagcccag

SEQ ID NO: 6641512 - DNA, 13 bp, Homo sapiens
aggagcccaggcc

SEQ ID NO: 6641513 - DNA, 15 bp, Homo sapiens
aggagcccaggccag

SEQ ID NO: 6641514 - DNA, 16 bp, Homo sapiens
aggagcccaggccagg

SEQ ID NO: 6641515 - DNA, 18 bp, Homo sapiens
aggagccccagccagccc

SEQ ID NO: 6641516 - DNA, 14 bp, Homo sapiens
aggagccccagccc

SEQ ID NO: 6641517 - DNA, 13 bp, Homo sapiens
aggagccccaggc

SEQ ID NO: 6641518 - DNA, 18 bp, Homo sapiens
aggagccccagtggtgag

SEQ ID NO: 6641519 - DNA, 17 bp, Homo sapiens
aggagccccatctgtct

SEQ ID NO: 6641520 - DNA, 18 bp, Homo sapiens
aggagccccattcctggg

SEQ ID NO: 6641521 - DNA, 12 bp, Homo sapiens
aggagcccccac

SEQ ID NO: 6641522 - DNA, 22 bp, Homo sapiens
aggagcccccaccctgttcctg

SEQ ID NO: 6641523 - DNA, 18 bp, Homo sapiens
aggagcccccagctgcca

SEQ ID NO: 6641524 - DNA, 16 bp, Homo sapiens
aggagcccctgagtcc

SEQ ID NO: 6641525 - DNA, 15 bp, Homo sapiens
aggagcccctggaca

SEQ ID NO: 6641526 - DNA, 22 bp, Homo sapiens
aggagcccctggacatgcctgt

SEQ ID NO: 6641527 - DNA, 23 bp, Homo sapiens
aggagcccgaagtctgctgctgt

SEQ ID NO: 6641528 - DNA, 12 bp, Homo sapiens
aggagcccgtca

SEQ ID NO: 6641529 - DNA, 10 bp, Homo sapiens
aggagccctg

SEQ ID NO: 6641530 - DNA, 17 bp, Homo sapiens
aggagccctgcctctcc

SEQ ID NO: 6641531 - DNA, 19 bp, Homo sapiens
aggagccctgggaggctct

SEQ ID NO: 6641532 - DNA, 16 bp, Homo sapiens
aggagccgaagcccag

SEQ ID NO: 6641533 - DNA, 18 bp, Homo sapiens
aggagccgaagcccaggg

SEQ ID NO: 6641534 - DNA, 16 bp, Homo sapiens
aggagccgggcctccc

SEQ ID NO: 6641535 - DNA, 16 bp, Homo sapiens
aggagcctagaggagg

SEQ ID NO: 6641536 - DNA, 18 bp, Homo sapiens
aggagcctagcggagccc

SEQ ID NO: 6641537 - DNA, 16 bp, Homo sapiens
aggagcctaggccagg

SEQ ID NO: 6641538 - DNA, 10 bp, Homo sapiens
aggagcctca

SEQ ID NO: 6641539 - DNA, 14 bp, Homo sapiens
aggagcctccctgc

SEQ ID NO: 6641540 - DNA, 13 bp, Homo sapiens
aggagcctcgtgt

SEQ ID NO: 6641541 - DNA, 12 bp, Homo sapiens
aggagcctctgg

SEQ ID NO: 6641542 - DNA, 13 bp, Homo sapiens
aggagcctctggc

SEQ ID NO: 6641543 - DNA, 14 bp, Homo sapiens
aggagcctgcccag

SEQ ID NO: 6641544 - DNA, 14 bp, Homo sapiens
aggagcctgcggct

SEQ ID NO: 6641545 - DNA, 19 bp, Homo sapiens
aggagcctgcggctgctgg

SEQ ID NO: 6641546 - DNA, 13 bp, Homo sapiens
aggagcctgctaa

SEQ ID NO: 6641547 - DNA, 22 bp, Homo sapiens
aggagcctgctggtcacagcct

SEQ ID NO: 6641548 - DNA, 16 bp, Homo sapiens
aggagcctggccaggc

SEQ ID NO: 6641549 - DNA, 18 bp, Homo sapiens
aggagcctggccaggcag

SEQ ID NO: 6641550 - DNA, 12 bp, Homo sapiens
aggagcctgtga

SEQ ID NO: 6641551 - DNA, 21 bp, Homo sapiens
aggagcctgtgaacccaggac

SEQ ID NO: 6641552 - DNA, 14 bp, Homo sapiens
aggagcctgtgaca

SEQ ID NO: 6641553 - DNA, 13 bp, Homo sapiens
aggagcctgtgcg

SEQ ID NO: 6641554 - DNA, 21 bp, Homo sapiens
aggagcctgtgcgtcccagct

SEQ ID NO: 6641555 - DNA, 23 bp, Homo sapiens
aggagcctgtgcgtcccagctga

SEQ ID NO: 6641556 - DNA, 22 bp, Homo sapiens
aggagccttcctttctcctgcc

SEQ ID NO: 6641557 - DNA, 23 bp, Homo sapiens
aggagccttcctttctcctgccc

SEQ ID NO: 6641558 - DNA, 14 bp, Homo sapiens
aggagccttggagt

SEQ ID NO: 6641559 - DNA, 19 bp, Homo sapiens
aggagccttttgctctctg

SEQ ID NO: 6641560 - DNA, 17 bp, Homo sapiens
aggagcgcaagatagat

SEQ ID NO: 6641561 - DNA, 15 bp, Homo sapiens
aggagcgcaggcagc

SEQ ID NO: 6641562 - DNA, 23 bp, Homo sapiens
aggagcgcgcgtgatagaagaaa

SEQ ID NO: 6641563 - DNA, 14 bp, Homo sapiens
aggagcgctccctt

SEQ ID NO: 6641564 - DNA, 15 bp, Homo sapiens
aggagcgggcagggc

SEQ ID NO: 6641565 - DNA, 18 bp, Homo sapiens
aggagcgtgaaggactta

SEQ ID NO: 6641566 - DNA, 14 bp, Homo sapiens
aggagcgtggactc

SEQ ID NO: 6641567 - DNA, 12 bp, Homo sapiens
aggagctaaggc

SEQ ID NO: 6641568 - DNA, 15 bp, Homo sapiens
aggagctacctgtgt

SEQ ID NO: 6641569 - DNA, 18 bp, Homo sapiens
aggagctacctgtgtgga

SEQ ID NO: 6641570 - DNA, 23 bp, Homo sapiens
aggagctagtgttaatccagaga

SEQ ID NO: 6641571 - DNA, 19 bp, Homo sapiens
aggagctcaacggtctggc

SEQ ID NO: 6641572 - DNA, 22 bp, Homo sapiens
aggagctcaacggtctggcagg

SEQ ID NO: 6641573 - DNA, 17 bp, Homo sapiens
aggagctcaactaaaag

SEQ ID NO: 6641574 - DNA, 18 bp, Homo sapiens
aggagctcacaccgcacc

SEQ ID NO: 6641575 - DNA, 15 bp, Homo sapiens
aggagctcaccctgc

SEQ ID NO: 6641576 - DNA, 20 bp, Homo sapiens
aggagctcaccctgcccgct

SEQ ID NO: 6641577 - DNA, 21 bp, Homo sapiens
aggagctcaccctgcccgctc

SEQ ID NO: 6641578 - DNA, 19 bp, Homo sapiens
aggagctcaggaagaagag

SEQ ID NO: 6641579 - DNA, 22 bp, Homo sapiens
aggagctcaggaagaagagatg

SEQ ID NO: 6641580 - DNA, 15 bp, Homo sapiens
aggagctcaggtggg

SEQ ID NO: 6641581 - DNA, 22 bp, Homo sapiens
aggagctccagtgtcctgagct

SEQ ID NO: 6641582 - DNA, 22 bp, Homo sapiens
aggagctccatacacacgctgc

SEQ ID NO: 6641583 - DNA, 12 bp, Homo sapiens
aggagctcccct

SEQ ID NO: 6641584 - DNA, 17 bp, Homo sapiens
aggagctctcaatttta

SEQ ID NO: 6641585 - DNA, 15 bp, Homo sapiens
aggagctctctgctg

SEQ ID NO: 6641586 - DNA, 16 bp, Homo sapiens
aggagctctctgctga

SEQ ID NO: 6641587 - DNA, 17 bp, Homo sapiens
aggagctctgcgccagg

SEQ ID NO: 6641588 - DNA, 19 bp, Homo sapiens
aggagctctgcgccaggca

SEQ ID NO: 6641589 - DNA, 21 bp, Homo sapiens
aggagctcttcaggcctccct

SEQ ID NO: 6641590 - DNA, 19 bp, Homo sapiens
aggagctcttcttgtgaaa

SEQ ID NO: 6641591 - DNA, 19 bp, Homo sapiens
aggagctgacagagccaga

SEQ ID NO: 6641592 - DNA, 11 bp, Homo sapiens
aggagctgaga

SEQ ID NO: 6641593 - DNA, 18 bp, Homo sapiens
aggagctgagaatagaag

SEQ ID NO: 6641594 - DNA, 15 bp, Homo sapiens
aggagctgaggtttc

SEQ ID NO: 6641595 - DNA, 16 bp, Homo sapiens
aggagctgagtcacct

SEQ ID NO: 6641596 - DNA, 15 bp, Homo sapiens
aggagctgatacttt

SEQ ID NO: 6641597 - DNA, 18 bp, Homo sapiens
aggagctgatttccaggc

SEQ ID NO: 6641598 - DNA, 21 bp, Homo sapiens
aggagctgatttccaggcccc

SEQ ID NO: 6641599 - DNA, 16 bp, Homo sapiens
aggagctgcagttctt

SEQ ID NO: 6641600 - DNA, 14 bp, Homo sapiens
aggagctgcctctt

SEQ ID NO: 6641601 - DNA, 14 bp, Homo sapiens
aggagctgcctgga

SEQ ID NO: 6641602 - DNA, 17 bp, Homo sapiens
aggagctgcctggaccc

SEQ ID NO: 6641603 - DNA, 18 bp, Homo sapiens
aggagctgccttggctca

SEQ ID NO: 6641604 - DNA, 11 bp, Homo sapiens
aggagctgcta

SEQ ID NO: 6641605 - DNA, 12 bp, Homo sapiens
aggagctgctgg

SEQ ID NO: 6641606 - DNA, 14 bp, Homo sapiens
aggagctgctggct

SEQ ID NO: 6641607 - DNA, 14 bp, Homo sapiens
aggagctggagggg

SEQ ID NO: 6641608 - DNA, 18 bp, Homo sapiens
aggagctggaggggtggg

SEQ ID NO: 6641609 - DNA, 17 bp, Homo sapiens
aggagctggcctgtggc

SEQ ID NO: 6641610 - DNA, 19 bp, Homo sapiens
aggagctggctggcaggtg

SEQ ID NO: 6641611 - DNA, 17 bp, Homo sapiens
aggagctgggagccggg

SEQ ID NO: 6641612 - DNA, 20 bp, Homo sapiens
aggagctgggcagaaggcca

SEQ ID NO: 6641613 - DNA, 12 bp, Homo sapiens
aggagctgggcc

SEQ ID NO: 6641614 - DNA, 18 bp, Homo sapiens
aggagctggggagggaga

SEQ ID NO: 6641615 - DNA, 12 bp, Homo sapiens
aggagctggggg

SEQ ID NO: 6641616 - DNA, 19 bp, Homo sapiens
aggagctgggggcagcctg

SEQ ID NO: 6641617 - DNA, 15 bp, Homo sapiens
aggagcttacccaag

SEQ ID NO: 6641618 - DNA, 22 bp, Homo sapiens
aggagcttacccaagctgtggc

SEQ ID NO: 6641619 - DNA, 20 bp, Homo sapiens
aggagcttacctcccacctt

SEQ ID NO: 6641620 - DNA, 17 bp, Homo sapiens
aggagcttcagtattgt

SEQ ID NO: 6641621 - DNA, 13 bp, Homo sapiens
aggagcttccaga

SEQ ID NO: 6641622 - DNA, 14 bp, Homo sapiens
aggagcttccagat

SEQ ID NO: 6641623 - DNA, 21 bp, Homo sapiens
aggagcttccagtgcatgttg

SEQ ID NO: 6641624 - DNA, 13 bp, Homo sapiens
aggagcttctctg

SEQ ID NO: 6641625 - DNA, 19 bp, Homo sapiens
aggagcttgggcagtgccc

SEQ ID NO: 6641626 - DNA, 21 bp, Homo sapiens
aggagcttgggtctctctcgg

SEQ ID NO: 6641627 - DNA, 17 bp, Homo sapiens
aggagctttcttgtttc

SEQ ID NO: 6641628 - DNA, 19 bp, Homo sapiens
aggagctttcttgtttctt

SEQ ID NO: 6641629 - DNA, 18 bp, Homo sapiens
aggagctttgactcagga

SEQ ID NO: 6641630 - DNA, 23 bp, Homo sapiens
aggagctttgactcaggagcctg

SEQ ID NO: 6641631 - DNA, 14 bp, Homo sapiens
aggagctttgctct

SEQ ID NO: 6641632 - DNA, 15 bp, Homo sapiens
aggagcttttctgga

SEQ ID NO: 6641633 - DNA, 17 bp, Homo sapiens
aggagcttttgtgtgcc

SEQ ID NO: 6641634 - DNA, 17 bp, Homo sapiens
aggagcttttttacaca

SEQ ID NO: 6641635 - DNA, 16 bp, Homo sapiens
aggaggaaaaaggctg

SEQ ID NO: 6641636 - DNA, 18 bp, Homo sapiens
aggaggaaaacacagcct

SEQ ID NO: 6641637 - DNA, 23 bp, Homo sapiens
aggaggaaaacacagcctccctg

SEQ ID NO: 6641638 - DNA, 13 bp, Homo sapiens
aggaggaaaagac

SEQ ID NO: 6641639 - DNA, 16 bp, Homo sapiens
aggaggaaaagacaga

SEQ ID NO: 6641640 - DNA, 16 bp, Homo sapiens
aggaggaaaaggaaaa

SEQ ID NO: 6641641 - DNA, 13 bp, Homo sapiens
aggaggaaaagtc

SEQ ID NO: 6641642 - DNA, 14 bp, Homo sapiens
aggaggaaaattcc

SEQ ID NO: 6641643 - DNA, 22 bp, Homo sapiens
aggaggaaaattccattagaga

SEQ ID NO: 6641644 - DNA, 20 bp, Homo sapiens
aggaggaaataactaagaga

SEQ ID NO: 6641645 - DNA, 16 bp, Homo sapiens
aggaggaaccaggcta

SEQ ID NO: 6641646 - DNA, 19 bp, Homo sapiens
aggaggaacgggcagccac

SEQ ID NO: 6641647 - DNA, 15 bp, Homo sapiens
aggaggaactggtcc

SEQ ID NO: 6641648 - DNA, 14 bp, Homo sapiens
aggaggaagactct

SEQ ID NO: 6641649 - DNA, 15 bp, Homo sapiens
aggaggaagcagaat

SEQ ID NO: 6641650 - DNA, 14 bp, Homo sapiens
aggaggaaggcaag

SEQ ID NO: 6641651 - DNA, 17 bp, Homo sapiens
aggaggaaggcaagagg

SEQ ID NO: 6641652 - DNA, 20 bp, Homo sapiens
aggaggaagggactggtcca

SEQ ID NO: 6641653 - DNA, 18 bp, Homo sapiens
aggaggaatagtgcttgc

SEQ ID NO: 6641654 - DNA, 19 bp, Homo sapiens
aggaggaatagtgcttgct

SEQ ID NO: 6641655 - DNA, 15 bp, Homo sapiens
aggaggaatcagacc

SEQ ID NO: 6641656 - DNA, 23 bp, Homo sapiens
aggaggaatcatgtcaggcctgt

SEQ ID NO: 6641657 - DNA, 16 bp, Homo sapiens
aggaggacaaaaggaa

SEQ ID NO: 6641658 - DNA, 14 bp, Homo sapiens
aggaggacaattca

SEQ ID NO: 6641659 - DNA, 22 bp, Homo sapiens
aggaggacaattcatgaacttc

SEQ ID NO: 6641660 - DNA, 19 bp, Homo sapiens
aggaggacacttggatttt

SEQ ID NO: 6641661 - DNA, 11 bp, Homo sapiens
aggaggacagg

SEQ ID NO: 6641662 - DNA, 18 bp, Homo sapiens
aggaggacccaggacagg

SEQ ID NO: 6641663 - DNA, 17 bp, Homo sapiens
aggaggacccagggctc

SEQ ID NO: 6641664 - DNA, 15 bp, Homo sapiens
aggaggacccctgcc

SEQ ID NO: 6641665 - DNA, 18 bp, Homo sapiens
aggaggacccctgccttc

SEQ ID NO: 6641666 - DNA, 14 bp, Homo sapiens
aggaggacttggag

SEQ ID NO: 6641667 - DNA, 19 bp, Homo sapiens
aggaggacttggagggtct

SEQ ID NO: 6641668 - DNA, 17 bp, Homo sapiens
aggaggagaaaagaaat

SEQ ID NO: 6641669 - DNA, 13 bp, Homo sapiens
aggaggagaaaat

SEQ ID NO: 6641670 - DNA, 21 bp, Homo sapiens
aggaggagacagtcaggaagc

SEQ ID NO: 6641671 - DNA, 14 bp, Homo sapiens
aggaggagaccctc

SEQ ID NO: 6641672 - DNA, 11 bp, Homo sapiens
aggaggagaga

SEQ ID NO: 6641673 - DNA, 15 bp, Homo sapiens
aggaggagagagatg

SEQ ID NO: 6641674 - DNA, 16 bp, Homo sapiens
aggaggagaggaaagg

SEQ ID NO: 6641675 - DNA, 11 bp, Homo sapiens
aggaggagcct

SEQ ID NO: 6641676 - DNA, 14 bp, Homo sapiens
aggaggagcctgtc

SEQ ID NO: 6641677 - DNA, 22 bp, Homo sapiens
aggaggagcctgtcctgcctgt

SEQ ID NO: 6641678 - DNA, 21 bp, Homo sapiens
aggaggagccttgctgggcca

SEQ ID NO: 6641679 - DNA, 13 bp, Homo sapiens
aggaggagctgcc

SEQ ID NO: 6641680 - DNA, 23 bp, Homo sapiens
aggaggagctgccgcaaggccct

SEQ ID NO: 6641681 - DNA, 15 bp, Homo sapiens
aggaggaggaaggca

SEQ ID NO: 6641682 - DNA, 16 bp, Homo sapiens
aggaggaggaaggcaa

SEQ ID NO: 6641683 - DNA, 14 bp, Homo sapiens
aggaggaggagccg

SEQ ID NO: 6641684 - DNA, 13 bp, Homo sapiens
aggaggaggagga

SEQ ID NO: 6641685 - DNA, 15 bp, Homo sapiens
aggaggaggaggaag

SEQ ID NO: 6641686 - DNA, 15 bp, Homo sapiens
aggaggaggaggagg

SEQ ID NO: 6641687 - DNA, 14 bp, Homo sapiens
aggaggaggagggt

SEQ ID NO: 6641688 - DNA, 18 bp, Homo sapiens
aggaggaggattgtgctg

SEQ ID NO: 6641689 - DNA, 12 bp, Homo sapiens
aggaggaggcat

SEQ ID NO: 6641690 - DNA, 14 bp, Homo sapiens
aggaggaggcatgg

SEQ ID NO: 6641691 - DNA, 15 bp, Homo sapiens
aggaggaggctccca

SEQ ID NO: 6641692 - DNA, 15 bp, Homo sapiens
aggaggagggaggcc

SEQ ID NO: 6641693 - DNA, 23 bp, Homo sapiens
aggaggagggtcggtgccttcaa

SEQ ID NO: 6641694 - DNA, 22 bp, Homo sapiens
aggaggagtcagatgaggccct

SEQ ID NO: 6641695 - DNA, 19 bp, Homo sapiens
aggaggagtgggacagaca

SEQ ID NO: 6641696 - DNA, 18 bp, Homo sapiens
aggaggatcccctgaggt

SEQ ID NO: 6641697 - DNA, 21 bp, Homo sapiens
aggaggatgactaacaagatt

SEQ ID NO: 6641698 - DNA, 16 bp, Homo sapiens
aggaggatgctgtgcc

SEQ ID NO: 6641699 - DNA, 17 bp, Homo sapiens
aggaggatgctgtgcct

SEQ ID NO: 6641700 - DNA, 18 bp, Homo sapiens
aggaggatggacgaacag

SEQ ID NO: 6641701 - DNA, 14 bp, Homo sapiens
aggaggatgggctc

SEQ ID NO: 6641702 - DNA, 22 bp, Homo sapiens
aggaggatgggctcgcccacca

SEQ ID NO: 6641703 - DNA, 17 bp, Homo sapiens
aggaggatgtaaggcct

SEQ ID NO: 6641704 - DNA, 21 bp, Homo sapiens
aggaggatgtccctgggccag

SEQ ID NO: 6641705 - DNA, 18 bp, Homo sapiens
aggaggattcgagcatca

SEQ ID NO: 6641706 - DNA, 14 bp, Homo sapiens
aggaggattgcctt

SEQ ID NO: 6641707 - DNA, 20 bp, Homo sapiens
aggaggattgcttcttgtga

SEQ ID NO: 6641708 - DNA, 23 bp, Homo sapiens
aggaggattgcttgagcccagga

SEQ ID NO: 6641709 - DNA, 14 bp, Homo sapiens
aggaggattgtgct

SEQ ID NO: 6641710 - DNA, 21 bp, Homo sapiens
aggaggcaaatggcactgcag

SEQ ID NO: 6641711 - DNA, 21 bp, Homo sapiens
aggaggcaagcgtgttctcag

SEQ ID NO: 6641712 - DNA, 21 bp, Homo sapiens
aggaggcacaagccaaggaag

SEQ ID NO: 6641713 - DNA, 13 bp, Homo sapiens
aggaggcacagca

SEQ ID NO: 6641714 - DNA, 14 bp, Homo sapiens
aggaggcagaaagc

SEQ ID NO: 6641715 - DNA, 20 bp, Homo sapiens
aggaggcagaaagcagaggc

SEQ ID NO: 6641716 - DNA, 22 bp, Homo sapiens
aggaggcagaaagcagaggctg

SEQ ID NO: 6641717 - DNA, 16 bp, Homo sapiens
aggaggcagaaccagc

SEQ ID NO: 6641718 - DNA, 21 bp, Homo sapiens
aggaggcagagggttgcagtg

SEQ ID NO: 6641719 - DNA, 20 bp, Homo sapiens
aggaggcagaggttgcagtg

SEQ ID NO: 6641720 - DNA, 14 bp, Homo sapiens
aggaggcagcagga

SEQ ID NO: 6641721 - DNA, 11 bp, Homo sapiens
aggaggcagcc

SEQ ID NO: 6641722 - DNA, 14 bp, Homo sapiens
aggaggcagccccc

SEQ ID NO: 6641723 - DNA, 17 bp, Homo sapiens
aggaggcaggaggagca

SEQ ID NO: 6641724 - DNA, 21 bp, Homo sapiens
aggaggcaggatatccccagg

SEQ ID NO: 6641725 - DNA, 20 bp, Homo sapiens
aggaggcaggcatggccctg

SEQ ID NO: 6641726 - DNA, 22 bp, Homo sapiens
aggaggcaggcatggccctggg

SEQ ID NO: 6641727 - DNA, 20 bp, Homo sapiens
aggaggcagtggcttggagc

SEQ ID NO: 6641728 - DNA, 19 bp, Homo sapiens
aggaggcatctggaaaggg

SEQ ID NO: 6641729 - DNA, 18 bp, Homo sapiens
aggaggccaaccagcccg

SEQ ID NO: 6641730 - DNA, 18 bp, Homo sapiens
aggaggccaataaaaagt

SEQ ID NO: 6641731 - DNA, 20 bp, Homo sapiens
aggaggccaataaaaagttc

SEQ ID NO: 6641732 - DNA, 22 bp, Homo sapiens
aggaggccaataaaaagttcag

SEQ ID NO: 6641733 - DNA, 11 bp, Homo sapiens
aggaggccacc

SEQ ID NO: 6641734 - DNA, 13 bp, Homo sapiens
aggaggccacctc

SEQ ID NO: 6641735 - DNA, 14 bp, Homo sapiens
aggaggccacctct

SEQ ID NO: 6641736 - DNA, 19 bp, Homo sapiens
aggaggccacctctccaag

SEQ ID NO: 6641737 - DNA, 13 bp, Homo sapiens
aggaggccacgga

SEQ ID NO: 6641738 - DNA, 14 bp, Homo sapiens
aggaggccagcctc

SEQ ID NO: 6641739 - DNA, 14 bp, Homo sapiens
aggaggccagtggg

SEQ ID NO: 6641740 - DNA, 15 bp, Homo sapiens
aggaggccagtgggc

SEQ ID NO: 6641741 - DNA, 22 bp, Homo sapiens
aggaggccataagctacacaga

SEQ ID NO: 6641742 - DNA, 14 bp, Homo sapiens
aggaggccccaggc

SEQ ID NO: 6641743 - DNA, 21 bp, Homo sapiens
aggaggccccaggctgagagc

SEQ ID NO: 6641744 - DNA, 12 bp, Homo sapiens
aggaggcccctg

SEQ ID NO: 6641745 - DNA, 18 bp, Homo sapiens
aggaggcccctggcccag

SEQ ID NO: 6641746 - DNA, 19 bp, Homo sapiens
aggaggccctggtgtcagg

SEQ ID NO: 6641747 - DNA, 23 bp, Homo sapiens
aggaggccctggtgtcaggcagg

SEQ ID NO: 6641748 - DNA, 17 bp, Homo sapiens
aggaggccgactgggct

SEQ ID NO: 6641749 - DNA, 21 bp, Homo sapiens
aggaggccgactgggctgctg

SEQ ID NO: 6641750 - DNA, 12 bp, Homo sapiens
aggaggcctcca

SEQ ID NO: 6641751 - DNA, 22 bp, Homo sapiens
aggaggcctccactccttccat

SEQ ID NO: 6641752 - DNA, 17 bp, Homo sapiens
aggaggcctccatctca

SEQ ID NO: 6641753 - DNA, 16 bp, Homo sapiens
aggaggcctgcacagg

SEQ ID NO: 6641754 - DNA, 15 bp, Homo sapiens
aggaggcctgggagg

SEQ ID NO: 6641755 - DNA, 16 bp, Homo sapiens
aggaggcctgggaggg

SEQ ID NO: 6641756 - DNA, 17 bp, Homo sapiens
aggaggcctgggagggc

SEQ ID NO: 6641757 - DNA, 14 bp, Homo sapiens
aggaggcctgggga

SEQ ID NO: 6641758 - DNA, 22 bp, Homo sapiens
aggaggcctggggaggccctag

SEQ ID NO: 6641759 - DNA, 14 bp, Homo sapiens
aggaggcctgtccc

SEQ ID NO: 6641760 - DNA, 20 bp, Homo sapiens
aggaggccttgggctctgct

SEQ ID NO: 6641761 - DNA, 15 bp, Homo sapiens
aggaggcgaataaat

SEQ ID NO: 6641762 - DNA, 19 bp, Homo sapiens
aggaggcggcccggccagc

SEQ ID NO: 6641763 - DNA, 15 bp, Homo sapiens
aggaggcggggctct

SEQ ID NO: 6641764 - DNA, 16 bp, Homo sapiens
aggaggcggggctcta

SEQ ID NO: 6641765 - DNA, 21 bp, Homo sapiens
aggaggcgtctcgggagagga

SEQ ID NO: 6641766 - DNA, 20 bp, Homo sapiens
aggaggctcaacaataaaac

SEQ ID NO: 6641767 - DNA, 20 bp, Homo sapiens
aggaggctcaggtgatctgt

SEQ ID NO: 6641768 - DNA, 13 bp, Homo sapiens
aggaggctccaga

SEQ ID NO: 6641769 - DNA, 16 bp, Homo sapiens
aggaggctccagaggg

SEQ ID NO: 6641770 - DNA, 18 bp, Homo sapiens
aggaggctccaggcagca

SEQ ID NO: 6641771 - DNA, 21 bp, Homo sapiens
aggaggctccggcccacaggt

SEQ ID NO: 6641772 - DNA, 16 bp, Homo sapiens
aggaggctccgtgagc

SEQ ID NO: 6641773 - DNA, 18 bp, Homo sapiens
aggaggctccgtgagccc

SEQ ID NO: 6641774 - DNA, 14 bp, Homo sapiens
aggaggctgagaca

SEQ ID NO: 6641775 - DNA, 17 bp, Homo sapiens
aggaggctgaggcagaa

SEQ ID NO: 6641776 - DNA, 16 bp, Homo sapiens
aggaggctgaggcagg

SEQ ID NO: 6641777 - DNA, 20 bp, Homo sapiens
aggaggctgaggcaggagaa

SEQ ID NO: 6641778 - DNA, 19 bp, Homo sapiens
aggaggctgaggcaggagg

SEQ ID NO: 6641779 - DNA, 16 bp, Homo sapiens
aggaggctgaggtggc

SEQ ID NO: 6641780 - DNA, 15 bp, Homo sapiens
aggaggctgcatgct

SEQ ID NO: 6641781 - DNA, 13 bp, Homo sapiens
aggaggctgccct

SEQ ID NO: 6641782 - DNA, 15 bp, Homo sapiens
aggaggctgccctga

SEQ ID NO: 6641783 - DNA, 18 bp, Homo sapiens
aggaggctggaggaaggg

SEQ ID NO: 6641784 - DNA, 14 bp, Homo sapiens
aggaggctggcagt

SEQ ID NO: 6641785 - DNA, 13 bp, Homo sapiens
aggaggctggcca

SEQ ID NO: 6641786 - DNA, 14 bp, Homo sapiens
aggaggctggccaa

SEQ ID NO: 6641787 - DNA, 13 bp, Homo sapiens
aggaggctggctt

SEQ ID NO: 6641788 - DNA, 22 bp, Homo sapiens
aggaggctggtgacaggccaaa

SEQ ID NO: 6641789 - DNA, 23 bp, Homo sapiens
aggaggctttaagctccagcttt

SEQ ID NO: 6641790 - DNA, 19 bp, Homo sapiens
aggaggctttctgggctct

SEQ ID NO: 6641791 - DNA, 15 bp, Homo sapiens
aggagggaaaccttt

SEQ ID NO: 6641792 - DNA, 23 bp, Homo sapiens
aggagggaaagttccagcagttt

SEQ ID NO: 6641793 - DNA, 18 bp, Homo sapiens
aggagggacaaaggagcc

SEQ ID NO: 6641794 - DNA, 18 bp, Homo sapiens
aggagggaccaccctccc

SEQ ID NO: 6641795 - DNA, 13 bp, Homo sapiens
aggagggactctg

SEQ ID NO: 6641796 - DNA, 22 bp, Homo sapiens
aggagggactctgtctggccag

SEQ ID NO: 6641797 - DNA, 20 bp, Homo sapiens
aggagggacttggctgtcct

SEQ ID NO: 6641798 - DNA, 14 bp, Homo sapiens
aggagggagaaagg

SEQ ID NO: 6641799 - DNA, 13 bp, Homo sapiens
aggagggagaaga

SEQ ID NO: 6641800 - DNA, 14 bp, Homo sapiens
aggagggagaagag

SEQ ID NO: 6641801 - DNA, 15 bp, Homo sapiens
aggagggagaagaga

SEQ ID NO: 6641802 - DNA, 14 bp, Homo sapiens
aggagggagactgt

SEQ ID NO: 6641803 - DNA, 15 bp, Homo sapiens
aggagggagagggag

SEQ ID NO: 6641804 - DNA, 17 bp, Homo sapiens
aggagggagccttgtga

SEQ ID NO: 6641805 - DNA, 23 bp, Homo sapiens
aggagggaggtattcgtgcagca

SEQ ID NO: 6641806 - DNA, 14 bp, Homo sapiens
aggagggatgctgc

SEQ ID NO: 6641807 - DNA, 21 bp, Homo sapiens
aggagggatgctgctccgccc

SEQ ID NO: 6641808 - DNA, 18 bp, Homo sapiens
aggagggatgttccagtg

SEQ ID NO: 6641809 - DNA, 12 bp, Homo sapiens
aggagggcactg

SEQ ID NO: 6641810 - DNA, 22 bp, Homo sapiens
aggagggcactggagctgggag

SEQ ID NO: 6641811 - DNA, 14 bp, Homo sapiens
aggagggcagagcc

SEQ ID NO: 6641812 - DNA, 15 bp, Homo sapiens
aggagggcagagcca

SEQ ID NO: 6641813 - DNA, 17 bp, Homo sapiens
aggagggcagagccatg

SEQ ID NO: 6641814 - DNA, 18 bp, Homo sapiens
aggagggcagagccatgg

SEQ ID NO: 6641815 - DNA, 14 bp, Homo sapiens
aggagggcagaggg

SEQ ID NO: 6641816 - DNA, 15 bp, Homo sapiens
aggagggcagaggga

SEQ ID NO: 6641817 - DNA, 22 bp, Homo sapiens
aggagggcatccataccagctc

SEQ ID NO: 6641818 - DNA, 16 bp, Homo sapiens
aggagggcatgggagg

SEQ ID NO: 6641819 - DNA, 14 bp, Homo sapiens
aggagggcatgtgc

SEQ ID NO: 6641820 - DNA, 12 bp, Homo sapiens
aggagggccagc

SEQ ID NO: 6641821 - DNA, 22 bp, Homo sapiens
aggagggcccggagaaactgag

SEQ ID NO: 6641822 - DNA, 20 bp, Homo sapiens
aggagggccctacctgattg

SEQ ID NO: 6641823 - DNA, 13 bp, Homo sapiens
aggagggccctga

SEQ ID NO: 6641824 - DNA, 14 bp, Homo sapiens
aggagggccctgag

SEQ ID NO: 6641825 - DNA, 20 bp, Homo sapiens
aggagggccctgaggaataa

SEQ ID NO: 6641826 - DNA, 15 bp, Homo sapiens
aggagggcctcagag

SEQ ID NO: 6641827 - DNA, 14 bp, Homo sapiens
aggagggcctctgg

SEQ ID NO: 6641828 - DNA, 17 bp, Homo sapiens
aggagggctttgtgtct

SEQ ID NO: 6641829 - DNA, 18 bp, Homo sapiens
aggaggggaaacaatgaa

SEQ ID NO: 6641830 - DNA, 12 bp, Homo sapiens
aggaggggaaga

SEQ ID NO: 6641831 - DNA, 18 bp, Homo sapiens
aggaggggaagaggcctg

SEQ ID NO: 6641832 - DNA, 14 bp, Homo sapiens
aggaggggaagggg

SEQ ID NO: 6641833 - DNA, 21 bp, Homo sapiens
aggaggggaaggggctgagga

SEQ ID NO: 6641834 - DNA, 18 bp, Homo sapiens
aggaggggacgggacaga

SEQ ID NO: 6641835 - DNA, 14 bp, Homo sapiens
aggaggggagcaag

SEQ ID NO: 6641836 - DNA, 18 bp, Homo sapiens
aggaggggagcaaggctg

SEQ ID NO: 6641837 - DNA, 16 bp, Homo sapiens
aggaggggagccttac

SEQ ID NO: 6641838 - DNA, 15 bp, Homo sapiens
aggaggggcacctgc

SEQ ID NO: 6641839 - DNA, 18 bp, Homo sapiens
aggaggggcacctgccac

SEQ ID NO: 6641840 - DNA, 14 bp, Homo sapiens
aggaggggcctctg

SEQ ID NO: 6641841 - DNA, 15 bp, Homo sapiens
aggaggggcctgggc

SEQ ID NO: 6641842 - DNA, 23 bp, Homo sapiens
aggaggggcctgggcagccccac

SEQ ID NO: 6641843 - DNA, 18 bp, Homo sapiens
aggagggggaggacggag

SEQ ID NO: 6641844 - DNA, 13 bp, Homo sapiens
aggagggggaggg

SEQ ID NO: 6641845 - DNA, 18 bp, Homo sapiens
aggagggggcaggctgag

SEQ ID NO: 6641846 - DNA, 19 bp, Homo sapiens
aggagggggcaggctgagg

SEQ ID NO: 6641847 - DNA, 15 bp, Homo sapiens
aggagggggcccggc

SEQ ID NO: 6641848 - DNA, 14 bp, Homo sapiens
aggaggggggaggg

SEQ ID NO: 6641849 - DNA, 21 bp, Homo sapiens
aggagggggtcgtggagagct

SEQ ID NO: 6641850 - DNA, 15 bp, Homo sapiens
aggaggggtaaatat

SEQ ID NO: 6641851 - DNA, 20 bp, Homo sapiens
aggaggggtaaatatatgtt

SEQ ID NO: 6641852 - DNA, 13 bp, Homo sapiens
aggaggggtctca

SEQ ID NO: 6641853 - DNA, 15 bp, Homo sapiens
aggaggggtctgcct

SEQ ID NO: 6641854 - DNA, 14 bp, Homo sapiens
aggagggtcaggaa

SEQ ID NO: 6641855 - DNA, 17 bp, Homo sapiens
aggagggtcaggaagga

SEQ ID NO: 6641856 - DNA, 16 bp, Homo sapiens
aggagggtcggtgcct

SEQ ID NO: 6641857 - DNA, 15 bp, Homo sapiens
aggagggtctagagg

SEQ ID NO: 6641858 - DNA, 20 bp, Homo sapiens
aggagggtctagaggcctga

SEQ ID NO: 6641859 - DNA, 14 bp, Homo sapiens
aggagggtgcccct

SEQ ID NO: 6641860 - DNA, 15 bp, Homo sapiens
aggagggtgcccctg

SEQ ID NO: 6641861 - DNA, 13 bp, Homo sapiens
aggagggtgccct

SEQ ID NO: 6641862 - DNA, 14 bp, Homo sapiens
aggagggtgccctc

SEQ ID NO: 6641863 - DNA, 14 bp, Homo sapiens
aggagggtggcact

SEQ ID NO: 6641864 - DNA, 21 bp, Homo sapiens
aggagggtgggggagggaggt

SEQ ID NO: 6641865 - DNA, 23 bp, Homo sapiens
aggagggttcctcttaggtcaga

SEQ ID NO: 6641866 - DNA, 19 bp, Homo sapiens
aggagggttggagtgctct

SEQ ID NO: 6641867 - DNA, 17 bp, Homo sapiens
aggagggtttgggcaga

SEQ ID NO: 6641868 - DNA, 22 bp, Homo sapiens
aggaggtaatgaccatgaaaga

SEQ ID NO: 6641869 - DNA, 15 bp, Homo sapiens
aggaggtagagaggg

SEQ ID NO: 6641870 - DNA, 14 bp, Homo sapiens
aggaggtagctccc

SEQ ID NO: 6641871 - DNA, 21 bp, Homo sapiens
aggaggtagctcccagcactc

SEQ ID NO: 6641872 - DNA, 21 bp, Homo sapiens
aggaggtcaagcctgcagcga

SEQ ID NO: 6641873 - DNA, 20 bp, Homo sapiens
aggaggtcaaggcttcagtg

SEQ ID NO: 6641874 - DNA, 21 bp, Homo sapiens
aggaggtcatctgaccttcac

SEQ ID NO: 6641875 - DNA, 16 bp, Homo sapiens
aggaggtcccaggaag

SEQ ID NO: 6641876 - DNA, 23 bp, Homo sapiens
aggaggtgaaagaaagggaccca

SEQ ID NO: 6641877 - DNA, 13 bp, Homo sapiens
aggaggtgcagtg

SEQ ID NO: 6641878 - DNA, 16 bp, Homo sapiens
aggaggtgccaacagt

SEQ ID NO: 6641879 - DNA, 14 bp, Homo sapiens
aggaggtgccactg

SEQ ID NO: 6641880 - DNA, 13 bp, Homo sapiens
aggaggtggagaa

SEQ ID NO: 6641881 - DNA, 18 bp, Homo sapiens
aggaggtggcagccctgt

SEQ ID NO: 6641882 - DNA, 15 bp, Homo sapiens
aggaggtgggccaca

SEQ ID NO: 6641883 - DNA, 22 bp, Homo sapiens
aggaggtgggggctggaggtgc

SEQ ID NO: 6641884 - DNA, 13 bp, Homo sapiens
aggaggtgggtga

SEQ ID NO: 6641885 - DNA, 15 bp, Homo sapiens
aggaggtgggtgagc

SEQ ID NO: 6641886 - DNA, 19 bp, Homo sapiens
aggaggtgtctcaggctgc

SEQ ID NO: 6641887 - DNA, 20 bp, Homo sapiens
aggaggtgtctcaggctgcc

SEQ ID NO: 6641888 - DNA, 22 bp, Homo sapiens
aggaggtgtctcaggctgcctg

SEQ ID NO: 6641889 - DNA, 21 bp, Homo sapiens
aggaggtgtgatagagccttt

SEQ ID NO: 6641890 - DNA, 20 bp, Homo sapiens
aggaggtgtggagtggaggg

SEQ ID NO: 6641891 - DNA, 19 bp, Homo sapiens
aggaggttgggaattcttg

SEQ ID NO: 6641892 - DNA, 15 bp, Homo sapiens
aggaggttgtggatg

SEQ ID NO: 6641893 - DNA, 23 bp, Homo sapiens
aggaggttgtggatgctccaggg

SEQ ID NO: 6641894 - DNA, 18 bp, Homo sapiens
aggaggttgtgtcactga

SEQ ID NO: 6641895 - DNA, 16 bp, Homo sapiens
aggaggtttgcctgtg

SEQ ID NO: 6641896 - DNA, 21 bp, Homo sapiens
aggagtaaaattcagtttttt

SEQ ID NO: 6641897 - DNA, 16 bp, Homo sapiens
aggagtaacttgcaag

SEQ ID NO: 6641898 - DNA, 15 bp, Homo sapiens
aggagtaagacaagt

SEQ ID NO: 6641899 - DNA, 16 bp, Homo sapiens
aggagtaagtgtacaa

SEQ ID NO: 6641900 - DNA, 18 bp, Homo sapiens
aggagtacccccagccca

SEQ ID NO: 6641901 - DNA, 14 bp, Homo sapiens
aggagtagctgagc

SEQ ID NO: 6641902 - DNA, 19 bp, Homo sapiens
aggagtcaccatgcaaggg

SEQ ID NO: 6641903 - DNA, 16 bp, Homo sapiens
aggagtcagatgaggc

SEQ ID NO: 6641904 - DNA, 18 bp, Homo sapiens
aggagtcagatgaggccc

SEQ ID NO: 6641905 - DNA, 19 bp, Homo sapiens
aggagtcagatgaggccct

SEQ ID NO: 6641906 - DNA, 23 bp, Homo sapiens
aggagtcagatgaggccctgcac

SEQ ID NO: 6641907 - DNA, 23 bp, Homo sapiens
aggagtcagccatgtctgtgctg

SEQ ID NO: 6641908 - DNA, 17 bp, Homo sapiens
aggagtcaggggctctg

SEQ ID NO: 6641909 - DNA, 21 bp, Homo sapiens
aggagtcagtctctttctgta

SEQ ID NO: 6641910 - DNA, 14 bp, Homo sapiens
aggagtcagtgtct

SEQ ID NO: 6641911 - DNA, 14 bp, Homo sapiens
aggagtccaaacct

SEQ ID NO: 6641912 - DNA, 16 bp, Homo sapiens
aggagtccaaaccttc

SEQ ID NO: 6641913 - DNA, 11 bp, Homo sapiens
aggagtccaga

SEQ ID NO: 6641914 - DNA, 15 bp, Homo sapiens
aggagtccagacccc

SEQ ID NO: 6641915 - DNA, 16 bp, Homo sapiens
aggagtccagcccctc

SEQ ID NO: 6641916 - DNA, 17 bp, Homo sapiens
aggagtccagcccctcc

SEQ ID NO: 6641917 - DNA, 15 bp, Homo sapiens
aggagtccaggcccc

SEQ ID NO: 6641918 - DNA, 17 bp, Homo sapiens
aggagtccagggcggga

SEQ ID NO: 6641919 - DNA, 14 bp, Homo sapiens
aggagtcccaagga

SEQ ID NO: 6641920 - DNA, 14 bp, Homo sapiens
aggagtctctgcca

SEQ ID NO: 6641921 - DNA, 20 bp, Homo sapiens
aggagtctctgccagttact

SEQ ID NO: 6641922 - DNA, 13 bp, Homo sapiens
aggagtctgagga

SEQ ID NO: 6641923 - DNA, 13 bp, Homo sapiens
aggagtctgaggt

SEQ ID NO: 6641924 - DNA, 15 bp, Homo sapiens
aggagtctgaggtcc

SEQ ID NO: 6641925 - DNA, 16 bp, Homo sapiens
aggagtctgaggtcct

SEQ ID NO: 6641926 - DNA, 19 bp, Homo sapiens
aggagtctgccacttgtca

SEQ ID NO: 6641927 - DNA, 20 bp, Homo sapiens
aggagtctgggtccatcctg

SEQ ID NO: 6641928 - DNA, 20 bp, Homo sapiens
aggagtcttctaatgtaaat

SEQ ID NO: 6641929 - DNA, 22 bp, Homo sapiens
aggagtgactctggctgccaag

SEQ ID NO: 6641930 - DNA, 14 bp, Homo sapiens
aggagtgagatcat

SEQ ID NO: 6641931 - DNA, 12 bp, Homo sapiens
aggagtgagcac

SEQ ID NO: 6641932 - DNA, 12 bp, Homo sapiens
aggagtgaggaa

SEQ ID NO: 6641933 - DNA, 23 bp, Homo sapiens
aggagtgagtgaaactcccaccc

SEQ ID NO: 6641934 - DNA, 12 bp, Homo sapiens
aggagtgatggg

SEQ ID NO: 6641935 - DNA, 22 bp, Homo sapiens
aggagtgattgaaccagctcat

SEQ ID NO: 6641936 - DNA, 15 bp, Homo sapiens
aggagtgcatggcca

SEQ ID NO: 6641937 - DNA, 21 bp, Homo sapiens
aggagtgcatggccacagcca

SEQ ID NO: 6641938 - DNA, 14 bp, Homo sapiens
aggagtgccaggac

SEQ ID NO: 6641939 - DNA, 17 bp, Homo sapiens
aggagtgccaggaccag

SEQ ID NO: 6641940 - DNA, 21 bp, Homo sapiens
aggagtgccaggaccagcctg

SEQ ID NO: 6641941 - DNA, 16 bp, Homo sapiens
aggagtgcccgccttg

SEQ ID NO: 6641942 - DNA, 22 bp, Homo sapiens
aggagtggagttctctgttcta

SEQ ID NO: 6641943 - DNA, 12 bp, Homo sapiens
aggagtggattc

SEQ ID NO: 6641944 - DNA, 14 bp, Homo sapiens
aggagtggattcct

SEQ ID NO: 6641945 - DNA, 17 bp, Homo sapiens
aggagtggattcctccc

SEQ ID NO: 6641946 - DNA, 18 bp, Homo sapiens
aggagtggattcctcccc

SEQ ID NO: 6641947 - DNA, 21 bp, Homo sapiens
aggagtggccctgatccagga

SEQ ID NO: 6641948 - DNA, 13 bp, Homo sapiens
aggagtggctgac

SEQ ID NO: 6641949 - DNA, 19 bp, Homo sapiens
aggagtgggacagacagca

SEQ ID NO: 6641950 - DNA, 23 bp, Homo sapiens
aggagtgggacagacagcagctg

SEQ ID NO: 6641951 - DNA, 18 bp, Homo sapiens
aggagtgggctctgagca

SEQ ID NO: 6641952 - DNA, 21 bp, Homo sapiens
aggagtgggtgacaagagcct

SEQ ID NO: 6641953 - DNA, 23 bp, Homo sapiens
aggagtgggtgacaagagcctga

SEQ ID NO: 6641954 - DNA, 19 bp, Homo sapiens
aggagtgggtgggacacag

SEQ ID NO: 6641955 - DNA, 22 bp, Homo sapiens
aggagtgggtttccctgcgtct

SEQ ID NO: 6641956 - DNA, 23 bp, Homo sapiens
aggagtgggttttattgtccttc

SEQ ID NO: 6641957 - DNA, 12 bp, Homo sapiens
aggagtggttct

SEQ ID NO: 6641958 - DNA, 18 bp, Homo sapiens
aggagtgtcctgcccatg

SEQ ID NO: 6641959 - DNA, 18 bp, Homo sapiens
aggagtgtcctgtctgct

SEQ ID NO: 6641960 - DNA, 19 bp, Homo sapiens
aggagtgtcctgtctgctg

SEQ ID NO: 6641961 - DNA, 16 bp, Homo sapiens
aggagttaagagtagc

SEQ ID NO: 6641962 - DNA, 23 bp, Homo sapiens
aggagttagaaatctccagtgtg

SEQ ID NO: 6641963 - DNA, 18 bp, Homo sapiens
aggagttagaaccacagc

SEQ ID NO: 6641964 - DNA, 23 bp, Homo sapiens
aggagttagaaccacagcagaca

SEQ ID NO: 6641965 - DNA, 23 bp, Homo sapiens
aggagttattaaagtaatttaca

SEQ ID NO: 6641966 - DNA, 13 bp, Homo sapiens
aggagttcaagac

SEQ ID NO: 6641967 - DNA, 19 bp, Homo sapiens
aggagttcaatgatctagg

SEQ ID NO: 6641968 - DNA, 23 bp, Homo sapiens
aggagttcagggtcatagcatgc

SEQ ID NO: 6641969 - DNA, 19 bp, Homo sapiens
aggagttccacagattgtt

SEQ ID NO: 6641970 - DNA, 22 bp, Homo sapiens
aggagttcgagaccagcctggc

SEQ ID NO: 6641971 - DNA, 21 bp, Homo sapiens
aggagttcgaggcgagcctgg

SEQ ID NO: 6641972 - DNA, 20 bp, Homo sapiens
aggagttctgaagctgacag

SEQ ID NO: 6641973 - DNA, 22 bp, Homo sapiens
aggagttctgaagctgacagca

SEQ ID NO: 6641974 - DNA, 14 bp, Homo sapiens
aggagttctgctca

SEQ ID NO: 6641975 - DNA, 15 bp, Homo sapiens
aggagttctgctcat

SEQ ID NO: 6641976 - DNA, 16 bp, Homo sapiens
aggagttgcctgactc

SEQ ID NO: 6641977 - DNA, 22 bp, Homo sapiens
aggagttgcctgactcctgggt

SEQ ID NO: 6641978 - DNA, 21 bp, Homo sapiens
aggagttgtcgtttttagctt

SEQ ID NO: 6641979 - DNA, 17 bp, Homo sapiens
aggagttgtgagccctc

SEQ ID NO: 6641980 - DNA, 20 bp, Homo sapiens
aggagttgtttctgacccac

SEQ ID NO: 6641981 - DNA, 18 bp, Homo sapiens
aggagtttatccatcctg

SEQ ID NO: 6641982 - DNA, 22 bp, Homo sapiens
aggagtttatctatcggaagaa

SEQ ID NO: 6641983 - DNA, 17 bp, Homo sapiens
aggagtttgagacaagc

SEQ ID NO: 6641984 - DNA, 17 bp, Homo sapiens
aggagtttgaggctgca

SEQ ID NO: 6641985 - DNA, 17 bp, Homo sapiens
aggagtttggccagaag

SEQ ID NO: 6641986 - DNA, 21 bp, Homo sapiens
aggagtttgtgtgtcttttat

SEQ ID NO: 6641987 - DNA, 21 bp, Homo sapiens
aggagttttaagtccagcttg

SEQ ID NO: 6641988 - DNA, 21 bp, Homo sapiens
aggagttttctccatatcaaa

SEQ ID NO: 6641989 - DNA, 15 bp, Homo sapiens
aggagttttgcaaag

SEQ ID NO: 6641990 - DNA, 21 bp, Homo sapiens
aggataaaaagccagggctgg

SEQ ID NO: 6641991 - DNA, 15 bp, Homo sapiens
aggataaaatggtac

SEQ ID NO: 6641992 - DNA, 21 bp, Homo sapiens
aggataaacttttagaaactt

SEQ ID NO: 6641993 - DNA, 16 bp, Homo sapiens
aggataaataataaag

SEQ ID NO: 6641994 - DNA, 16 bp, Homo sapiens
aggataaattgccata

SEQ ID NO: 6641995 - DNA, 13 bp, Homo sapiens
aggataaattttt

SEQ ID NO: 6641996 - DNA, 18 bp, Homo sapiens
aggataacttccttgccc

SEQ ID NO: 6641997 - DNA, 17 bp, Homo sapiens
aggataacttgctttct

SEQ ID NO: 6641998 - DNA, 13 bp, Homo sapiens
aggataagaaagc

SEQ ID NO: 6641999 - DNA, 21 bp, Homo sapiens
aggataataattttatagaaa

SEQ ID NO: 6642000 - DNA, 19 bp, Homo sapiens
aggataatgagatgtaata

SEQ ID NO: 6642001 - DNA, 18 bp, Homo sapiens
aggataattagcatctca

SEQ ID NO: 6642002 - DNA, 22 bp, Homo sapiens
aggataattttcctcaatcaca

SEQ ID NO: 6642003 - DNA, 12 bp, Homo sapiens
aggatacagctc

SEQ ID NO: 6642004 - DNA, 15 bp, Homo sapiens
aggatacaggctgga

SEQ ID NO: 6642005 - DNA, 18 bp, Homo sapiens
aggatacaggtgacagtg

SEQ ID NO: 6642006 - DNA, 21 bp, Homo sapiens
aggatacatgtgccgaatgtg

SEQ ID NO: 6642007 - DNA, 18 bp, Homo sapiens
aggatacatttaataaaa

SEQ ID NO: 6642008 - DNA, 22 bp, Homo sapiens
aggatacatttaataaaactgc

SEQ ID NO: 6642009 - DNA, 18 bp, Homo sapiens
aggatactatattttagg

SEQ ID NO: 6642010 - DNA, 16 bp, Homo sapiens
aggatactctgtcaga

SEQ ID NO: 6642011 - DNA, 18 bp, Homo sapiens
aggatactgcctccccca

SEQ ID NO: 6642012 - DNA, 13 bp, Homo sapiens
aggatactgctgc

SEQ ID NO: 6642013 - DNA, 13 bp, Homo sapiens
aggatagaaaaag

SEQ ID NO: 6642014 - DNA, 23 bp, Homo sapiens
aggatagaagtatacctgatttt

SEQ ID NO: 6642015 - DNA, 14 bp, Homo sapiens
aggatagacactgg

SEQ ID NO: 6642016 - DNA, 20 bp, Homo sapiens
aggatagacactggacatgg

SEQ ID NO: 6642017 - DNA, 18 bp, Homo sapiens
aggatagatgctggccca

SEQ ID NO: 6642018 - DNA, 15 bp, Homo sapiens
aggatagcagagaag

SEQ ID NO: 6642019 - DNA, 17 bp, Homo sapiens
aggatagcctcagccac

SEQ ID NO: 6642020 - DNA, 14 bp, Homo sapiens
aggatagcctttgt

SEQ ID NO: 6642021 - DNA, 17 bp, Homo sapiens
aggatagcgctcccctt

SEQ ID NO: 6642022 - DNA, 17 bp, Homo sapiens
aggatagctaactgtaa

SEQ ID NO: 6642023 - DNA, 22 bp, Homo sapiens
aggatagctcttcctccccagg

SEQ ID NO: 6642024 - DNA, 12 bp, Homo sapiens
aggataggaaaa

SEQ ID NO: 6642025 - DNA, 15 bp, Homo sapiens
aggataggaaaagat

SEQ ID NO: 6642026 - DNA, 21 bp, Homo sapiens
aggatataagagggcttttta

SEQ ID NO: 6642027 - DNA, 23 bp, Homo sapiens
aggatataagagggctttttaaa

SEQ ID NO: 6642028 - DNA, 18 bp, Homo sapiens
aggatatactgcagcttt

SEQ ID NO: 6642029 - DNA, 14 bp, Homo sapiens
aggatatattttat

SEQ ID NO: 6642030 - DNA, 15 bp, Homo sapiens
aggatatcagagctg

SEQ ID NO: 6642031 - DNA, 18 bp, Homo sapiens
aggatatcagagctggga

SEQ ID NO: 6642032 - DNA, 18 bp, Homo sapiens
aggatatcatcttgagta

SEQ ID NO: 6642033 - DNA, 22 bp, Homo sapiens
aggatatcatcttttctaatct

SEQ ID NO: 6642034 - DNA, 20 bp, Homo sapiens
aggatatccttatcagagct

SEQ ID NO: 6642035 - DNA, 22 bp, Homo sapiens
aggatatccttatcagagctaa

SEQ ID NO: 6642036 - DNA, 17 bp, Homo sapiens
aggatatcggcatttgt

SEQ ID NO: 6642037 - DNA, 16 bp, Homo sapiens
aggatatctgaaaata

SEQ ID NO: 6642038 - DNA, 16 bp, Homo sapiens
aggatatggacactgg

SEQ ID NO: 6642039 - DNA, 19 bp, Homo sapiens
aggatatggcagggaagct

SEQ ID NO: 6642040 - DNA, 19 bp, Homo sapiens
aggatatgtatattttaat

SEQ ID NO: 6642041 - DNA, 14 bp, Homo sapiens
aggatattaaaatg

SEQ ID NO: 6642042 - DNA, 16 bp, Homo sapiens
aggatattaaaatgct

SEQ ID NO: 6642043 - DNA, 18 bp, Homo sapiens
aggatattaaacgtgtaa

SEQ ID NO: 6642044 - DNA, 20 bp, Homo sapiens
aggatattacaatggccagc

SEQ ID NO: 6642045 - DNA, 15 bp, Homo sapiens
aggatattatctacc

SEQ ID NO: 6642046 - DNA, 18 bp, Homo sapiens
aggatattatctacctgt

SEQ ID NO: 6642047 - DNA, 22 bp, Homo sapiens
aggatattatctacctgttctg

SEQ ID NO: 6642048 - DNA, 22 bp, Homo sapiens
aggatattctactgtacttttt

SEQ ID NO: 6642049 - DNA, 17 bp, Homo sapiens
aggatattggcatttgt

SEQ ID NO: 6642050 - DNA, 20 bp, Homo sapiens
aggatattggttcttcccct

SEQ ID NO: 6642051 - DNA, 21 bp, Homo sapiens
aggatattggttcttcccctc

SEQ ID NO: 6642052 - DNA, 14 bp, Homo sapiens
aggatatttaagaa

SEQ ID NO: 6642053 - DNA, 16 bp, Homo sapiens
aggatatttaagaaaa

SEQ ID NO: 6642054 - DNA, 18 bp, Homo sapiens
aggatatttaagaaaata

SEQ ID NO: 6642055 - DNA, 14 bp, Homo sapiens
aggatatttctaca

SEQ ID NO: 6642056 - DNA, 15 bp, Homo sapiens
aggatatttgcacta

SEQ ID NO: 6642057 - DNA, 19 bp, Homo sapiens
aggatattttcaacaatta

SEQ ID NO: 6642058 - DNA, 13 bp, Homo sapiens
aggatcaagggct

SEQ ID NO: 6642059 - DNA, 15 bp, Homo sapiens
aggatcaccccagcc

SEQ ID NO: 6642060 - DNA, 16 bp, Homo sapiens
aggatcaccccagccc

SEQ ID NO: 6642061 - DNA, 15 bp, Homo sapiens
aggatcacctgaggt

SEQ ID NO: 6642062 - DNA, 19 bp, Homo sapiens
aggatcacctgaggtcagg

SEQ ID NO: 6642063 - DNA, 15 bp, Homo sapiens
aggatcactggagcc

SEQ ID NO: 6642064 - DNA, 16 bp, Homo sapiens
aggatcactggagccc

SEQ ID NO: 6642065 - DNA, 18 bp, Homo sapiens
aggatcactggagcccag

SEQ ID NO: 6642066 - DNA, 20 bp, Homo sapiens
aggatcacttgggcccagga

SEQ ID NO: 6642067 - DNA, 22 bp, Homo sapiens
aggatcacttgggcccaggagg

SEQ ID NO: 6642068 - DNA, 23 bp, Homo sapiens
aggatcacttgggcccaggaggt

SEQ ID NO: 6642069 - DNA, 12 bp, Homo sapiens
aggatcagaaag

SEQ ID NO: 6642070 - DNA, 18 bp, Homo sapiens
aggatcagaaagtaattt

SEQ ID NO: 6642071 - DNA, 21 bp, Homo sapiens
aggatcagatgactctctcca

SEQ ID NO: 6642072 - DNA, 16 bp, Homo sapiens
aggatcagattgcatg

SEQ ID NO: 6642073 - DNA, 12 bp, Homo sapiens
aggatcagtctg

SEQ ID NO: 6642074 - DNA, 16 bp, Homo sapiens
aggatcatatgaattg

SEQ ID NO: 6642075 - DNA, 17 bp, Homo sapiens
aggatcatcatttaaaa

SEQ ID NO: 6642076 - DNA, 13 bp, Homo sapiens
aggatcatctgaa

SEQ ID NO: 6642077 - DNA, 17 bp, Homo sapiens
aggatcatggtgtaata

SEQ ID NO: 6642078 - DNA, 22 bp, Homo sapiens
aggatcatggtgtaataagaca

SEQ ID NO: 6642079 - DNA, 19 bp, Homo sapiens
aggatcatttgagcccagg

SEQ ID NO: 6642080 - DNA, 13 bp, Homo sapiens
aggatccagagag

SEQ ID NO: 6642081 - DNA, 17 bp, Homo sapiens
aggatccaggaatatga

SEQ ID NO: 6642082 - DNA, 14 bp, Homo sapiens
aggatccagggcag

SEQ ID NO: 6642083 - DNA, 20 bp, Homo sapiens
aggatccagggcagcaggcc

SEQ ID NO: 6642084 - DNA, 14 bp, Homo sapiens
aggatccagtgaca

SEQ ID NO: 6642085 - DNA, 14 bp, Homo sapiens
aggatcccactggc

SEQ ID NO: 6642086 - DNA, 14 bp, Homo sapiens
aggatccccctctt

SEQ ID NO: 6642087 - DNA, 16 bp, Homo sapiens
aggatccccctctttg

SEQ ID NO: 6642088 - DNA, 19 bp, Homo sapiens
aggatcccctgtcccctgg

SEQ ID NO: 6642089 - DNA, 13 bp, Homo sapiens
aggatccctcctg

SEQ ID NO: 6642090 - DNA, 15 bp, Homo sapiens
aggatccctcctgag

SEQ ID NO: 6642091 - DNA, 16 bp, Homo sapiens
aggatccctcctgagc

SEQ ID NO: 6642092 - DNA, 15 bp, Homo sapiens
aggatccctctctgg

SEQ ID NO: 6642093 - DNA, 17 bp, Homo sapiens
aggatccctctctggat

SEQ ID NO: 6642094 - DNA, 22 bp, Homo sapiens
aggatccgtgctgtctcctttg

SEQ ID NO: 6642095 - DNA, 16 bp, Homo sapiens
aggatcctcacaggag

SEQ ID NO: 6642096 - DNA, 17 bp, Homo sapiens
aggatcctcacaggagc

SEQ ID NO: 6642097 - DNA, 19 bp, Homo sapiens
aggatcctcacaggagcag

SEQ ID NO: 6642098 - DNA, 18 bp, Homo sapiens
aggatcctctccactcca

SEQ ID NO: 6642099 - DNA, 15 bp, Homo sapiens
aggatcctgagccag

SEQ ID NO: 6642100 - DNA, 12 bp, Homo sapiens
aggatcctgcag

SEQ ID NO: 6642101 - DNA, 13 bp, Homo sapiens
aggatcctgcagg

SEQ ID NO: 6642102 - DNA, 14 bp, Homo sapiens
aggatcctgcagga

SEQ ID NO: 6642103 - DNA, 18 bp, Homo sapiens
aggatcctggagaagtgg

SEQ ID NO: 6642104 - DNA, 15 bp, Homo sapiens
aggatcctggaggct

SEQ ID NO: 6642105 - DNA, 18 bp, Homo sapiens
aggatcctggcctgagaa

SEQ ID NO: 6642106 - DNA, 18 bp, Homo sapiens
aggatcctggtattgtaa

SEQ ID NO: 6642107 - DNA, 24 bp, Homo sapiens
aggatcctggtattgtaatattaa

SEQ ID NO: 6642108 - DNA, 22 bp, Homo sapiens
aggatcgaagggtttttagaga

SEQ ID NO: 6642109 - DNA, 16 bp, Homo sapiens
aggatctaagggaaga

SEQ ID NO: 6642110 - DNA, 22 bp, Homo sapiens
aggatctagaatgtgttttctg

SEQ ID NO: 6642111 - DNA, 14 bp, Homo sapiens
aggatctagcttca

SEQ ID NO: 6642112 - DNA, 15 bp, Homo sapiens
aggatctaggatggg

SEQ ID NO: 6642113 - DNA, 23 bp, Homo sapiens
aggatctataggcagcttctaag

SEQ ID NO: 6642114 - DNA, 16 bp, Homo sapiens
aggatctatgcaattt

SEQ ID NO: 6642115 - DNA, 21 bp, Homo sapiens
aggatctatgcaatttttaaa

SEQ ID NO: 6642116 - DNA, 21 bp, Homo sapiens
aggatctatttttggaggttt

SEQ ID NO: 6642117 - DNA, 15 bp, Homo sapiens
aggatctcaagccag

SEQ ID NO: 6642118 - DNA, 19 bp, Homo sapiens
aggatctcaagccagcccc

SEQ ID NO: 6642119 - DNA, 17 bp, Homo sapiens
aggatctcaccaggcag

SEQ ID NO: 6642120 - DNA, 18 bp, Homo sapiens
aggatctcaccaggcagc

SEQ ID NO: 6642121 - DNA, 18 bp, Homo sapiens
aggatctcatgacattat

SEQ ID NO: 6642122 - DNA, 22 bp, Homo sapiens
aggatctccactgataagactg

SEQ ID NO: 6642123 - DNA, 19 bp, Homo sapiens
aggatctcctgccagccca

SEQ ID NO: 6642124 - DNA, 20 bp, Homo sapiens
aggatctcctgccagcccag

SEQ ID NO: 6642125 - DNA, 19 bp, Homo sapiens
aggatctctcaggagcaca

SEQ ID NO: 6642126 - DNA, 17 bp, Homo sapiens
aggatctctgaaacata

SEQ ID NO: 6642127 - DNA, 17 bp, Homo sapiens
aggatctcttgagcctg

SEQ ID NO: 6642128 - DNA, 14 bp, Homo sapiens
aggatctgaaaact

SEQ ID NO: 6642129 - DNA, 15 bp, Homo sapiens
aggatctgaaaactt

SEQ ID NO: 6642130 - DNA, 23 bp, Homo sapiens
aggatctgctgaggcccagtgca

SEQ ID NO: 6642131 - DNA, 12 bp, Homo sapiens
aggatctgtgat

SEQ ID NO: 6642132 - DNA, 19 bp, Homo sapiens
aggatctgtgattggctgg

SEQ ID NO: 6642133 - DNA, 20 bp, Homo sapiens
aggatctgtgattggctggt

SEQ ID NO: 6642134 - DNA, 13 bp, Homo sapiens
aggatctttgtgg

SEQ ID NO: 6642135 - DNA, 20 bp, Homo sapiens
aggatctttgtggccaagga

SEQ ID NO: 6642136 - DNA, 21 bp, Homo sapiens
aggatgaaagacaaagaagga

SEQ ID NO: 6642137 - DNA, 16 bp, Homo sapiens
aggatgaaagtctgag

SEQ ID NO: 6642138 - DNA, 17 bp, Homo sapiens
aggatgaactagccatg

SEQ ID NO: 6642139 - DNA, 20 bp, Homo sapiens
aggatgaactagccatgact

SEQ ID NO: 6642140 - DNA, 20 bp, Homo sapiens
aggatgaagaacacagcatg

SEQ ID NO: 6642141 - DNA, 20 bp, Homo sapiens
aggatgaatgtatgtgcact

SEQ ID NO: 6642142 - DNA, 19 bp, Homo sapiens
aggatgacccggggcagct

SEQ ID NO: 6642143 - DNA, 21 bp, Homo sapiens
aggatgacccggggcagctgg

SEQ ID NO: 6642144 - DNA, 23 bp, Homo sapiens
aggatgacctcagggctatgtgg

SEQ ID NO: 6642145 - DNA, 14 bp, Homo sapiens
aggatgagacccag

SEQ ID NO: 6642146 - DNA, 14 bp, Homo sapiens
aggatgagagccca

SEQ ID NO: 6642147 - DNA, 16 bp, Homo sapiens
aggatgagagcccaga

SEQ ID NO: 6642148 - DNA, 20 bp, Homo sapiens
aggatgagagcccagaggta

SEQ ID NO: 6642149 - DNA, 23 bp, Homo sapiens
aggatgagagcccagaggtaaca

SEQ ID NO: 6642150 - DNA, 17 bp, Homo sapiens
aggatgagcaaaacatt

SEQ ID NO: 6642151 - DNA, 20 bp, Homo sapiens
aggatgagcagaccagcttt

SEQ ID NO: 6642152 - DNA, 16 bp, Homo sapiens
aggatgagctggaagg

SEQ ID NO: 6642153 - DNA, 22 bp, Homo sapiens
aggatgaggaacctcaaactgg

SEQ ID NO: 6642154 - DNA, 13 bp, Homo sapiens
aggatgaggacag

SEQ ID NO: 6642155 - DNA, 21 bp, Homo sapiens
aggatgaggacagagggcaca

SEQ ID NO: 6642156 - DNA, 23 bp, Homo sapiens
aggatgaggacagagggcacatg

SEQ ID NO: 6642157 - DNA, 15 bp, Homo sapiens
aggatgaggccccgc

SEQ ID NO: 6642158 - DNA, 11 bp, Homo sapiens
aggatgagggt

SEQ ID NO: 6642159 - DNA, 13 bp, Homo sapiens
aggatgatgtaat

SEQ ID NO: 6642160 - DNA, 22 bp, Homo sapiens
aggatgatttcagaaggagaag

SEQ ID NO: 6642161 - DNA, 16 bp, Homo sapiens
aggatgcaacaaatat

SEQ ID NO: 6642162 - DNA, 22 bp, Homo sapiens
aggatgcaattgttgaaagctt

SEQ ID NO: 6642163 - DNA, 22 bp, Homo sapiens
aggatgcacagagttgttacat

SEQ ID NO: 6642164 - DNA, 16 bp, Homo sapiens
aggatgcactggcctg

SEQ ID NO: 6642165 - DNA, 19 bp, Homo sapiens
aggatgcatattaaagaaa

SEQ ID NO: 6642166 - DNA, 22 bp, Homo sapiens
aggatgcattctgataggaggg

SEQ ID NO: 6642167 - DNA, 15 bp, Homo sapiens
aggatgccacagccc

SEQ ID NO: 6642168 - DNA, 21 bp, Homo sapiens
aggatgccacgcacttcctct

SEQ ID NO: 6642169 - DNA, 14 bp, Homo sapiens
aggatgccagcccc

SEQ ID NO: 6642170 - DNA, 21 bp, Homo sapiens
aggatgccagcccctgcctgg

SEQ ID NO: 6642171 - DNA, 13 bp, Homo sapiens
aggatgcccaggg

SEQ ID NO: 6642172 - DNA, 22 bp, Homo sapiens
aggatgcccagggccactctgc

SEQ ID NO: 6642173 - DNA, 15 bp, Homo sapiens
aggatgccctgttgg

SEQ ID NO: 6642174 - DNA, 18 bp, Homo sapiens
aggatgccttatctcttc

SEQ ID NO: 6642175 - DNA, 21 bp, Homo sapiens
aggatgccttatctcttctca

SEQ ID NO: 6642176 - DNA, 12 bp, Homo sapiens
aggatgcctttt

SEQ ID NO: 6642177 - DNA, 19 bp, Homo sapiens
aggatgcggctttctctgc

SEQ ID NO: 6642178 - DNA, 16 bp, Homo sapiens
aggatgctaacatcta

SEQ ID NO: 6642179 - DNA, 17 bp, Homo sapiens
aggatgctaacatctaa

SEQ ID NO: 6642180 - DNA, 14 bp, Homo sapiens
aggatgctcagttg

SEQ ID NO: 6642181 - DNA, 20 bp, Homo sapiens
aggatgctcccccagggaag

SEQ ID NO: 6642182 - DNA, 16 bp, Homo sapiens
aggatgctgacatcat

SEQ ID NO: 6642183 - DNA, 18 bp, Homo sapiens
aggatgctgacatcattt

SEQ ID NO: 6642184 - DNA, 16 bp, Homo sapiens
aggatgctgcagcaga

SEQ ID NO: 6642185 - DNA, 21 bp, Homo sapiens
aggatgctgcagtgaggctgt

SEQ ID NO: 6642186 - DNA, 22 bp, Homo sapiens
aggatgctgggctctgttcttg

SEQ ID NO: 6642187 - DNA, 13 bp, Homo sapiens
aggatgctgtgcc

SEQ ID NO: 6642188 - DNA, 21 bp, Homo sapiens
aggatgcttgtacataatgcg

SEQ ID NO: 6642189 - DNA, 14 bp, Homo sapiens
aggatgctttggtt

SEQ ID NO: 6642190 - DNA, 19 bp, Homo sapiens
aggatggaacacggccaca

SEQ ID NO: 6642191 - DNA, 18 bp, Homo sapiens
aggatggaagaaagaagc

SEQ ID NO: 6642192 - DNA, 16 bp, Homo sapiens
aggatggagagcagcc

SEQ ID NO: 6642193 - DNA, 14 bp, Homo sapiens
aggatggatggcac

SEQ ID NO: 6642194 - DNA, 17 bp, Homo sapiens
aggatggatggcaccct

SEQ ID NO: 6642195 - DNA, 18 bp, Homo sapiens
aggatggatggcaccctg

SEQ ID NO: 6642196 - DNA, 20 bp, Homo sapiens
aggatggatggcaccctgga

SEQ ID NO: 6642197 - DNA, 23 bp, Homo sapiens
aggatggatttagaaaaaaacat

SEQ ID NO: 6642198 - DNA, 23 bp, Homo sapiens
aggatggcctggccagggcctgg

SEQ ID NO: 6642199 - DNA, 19 bp, Homo sapiens
aggatggcttgagcccagg

SEQ ID NO: 6642200 - DNA, 20 bp, Homo sapiens
aggatggcttgagcccagga

SEQ ID NO: 6642201 - DNA, 15 bp, Homo sapiens
aggatgggaaaaact

SEQ ID NO: 6642202 - DNA, 19 bp, Homo sapiens
aggatgggaacaaggaagg

SEQ ID NO: 6642203 - DNA, 15 bp, Homo sapiens
aggatgggaagaaaa

SEQ ID NO: 6642204 - DNA, 21 bp, Homo sapiens
aggatgggaagaaaaaggaaa

SEQ ID NO: 6642205 - DNA, 21 bp, Homo sapiens
aggatgggaatcaggcatgtg

SEQ ID NO: 6642206 - DNA, 22 bp, Homo sapiens
aggatgggatctttctgggagc

SEQ ID NO: 6642207 - DNA, 21 bp, Homo sapiens
aggatgggccaaacccagaca

SEQ ID NO: 6642208 - DNA, 17 bp, Homo sapiens
aggatgggcttctgtgc

SEQ ID NO: 6642209 - DNA, 12 bp, Homo sapiens
aggatggggcac

SEQ ID NO: 6642210 - DNA, 20 bp, Homo sapiens
aggatggggcacggctctgg

SEQ ID NO: 6642211 - DNA, 22 bp, Homo sapiens
aggatggggctcccagctcctt

SEQ ID NO: 6642212 - DNA, 16 bp, Homo sapiens
aggatgggggaaagaa

SEQ ID NO: 6642213 - DNA, 15 bp, Homo sapiens
aggatgggggagagg

SEQ ID NO: 6642214 - DNA, 16 bp, Homo sapiens
aggatgggggagaggg

SEQ ID NO: 6642215 - DNA, 20 bp, Homo sapiens
aggatgggggctcctggcag

SEQ ID NO: 6642216 - DNA, 18 bp, Homo sapiens
aggatggggttctggaaa

SEQ ID NO: 6642217 - DNA, 18 bp, Homo sapiens
aggatggggttcttgtcc

SEQ ID NO: 6642218 - DNA, 20 bp, Homo sapiens
aggatgggtcccctccgcca

SEQ ID NO: 6642219 - DNA, 23 bp, Homo sapiens
aggatggtctcgatctcctgacc

SEQ ID NO: 6642220 - DNA, 19 bp, Homo sapiens
aggatggtcttacagcagg

SEQ ID NO: 6642221 - DNA, 23 bp, Homo sapiens
aggatggtgctgagtaaacataa

SEQ ID NO: 6642222 - DNA, 14 bp, Homo sapiens
aggatggtgggcag

SEQ ID NO: 6642223 - DNA, 19 bp, Homo sapiens
aggatggtgggcaggatct

SEQ ID NO: 6642224 - DNA, 21 bp, Homo sapiens
aggatggtgtcctgaggcctc

SEQ ID NO: 6642225 - DNA, 21 bp, Homo sapiens
aggatgtaaacagtgcctgct

SEQ ID NO: 6642226 - DNA, 19 bp, Homo sapiens
aggatgtaaagatcaataa

SEQ ID NO: 6642227 - DNA, 14 bp, Homo sapiens
aggatgtaaggcct

SEQ ID NO: 6642228 - DNA, 22 bp, Homo sapiens
aggatgtacaaggacagcccct

SEQ ID NO: 6642229 - DNA, 16 bp, Homo sapiens
aggatgtagaaacaat

SEQ ID NO: 6642230 - DNA, 23 bp, Homo sapiens
aggatgtaggggttaacttggtc

SEQ ID NO: 6642231 - DNA, 16 bp, Homo sapiens
aggatgtatattttat

SEQ ID NO: 6642232 - DNA, 20 bp, Homo sapiens
aggatgtatcgggaagattt

SEQ ID NO: 6642233 - DNA, 15 bp, Homo sapiens
aggatgtatgtgtat

SEQ ID NO: 6642234 - DNA, 18 bp, Homo sapiens
aggatgtcacagggccaa

SEQ ID NO: 6642235 - DNA, 22 bp, Homo sapiens
aggatgtccctgggccagggtc

SEQ ID NO: 6642236 - DNA, 18 bp, Homo sapiens
aggatgtccgttccagga

SEQ ID NO: 6642237 - DNA, 22 bp, Homo sapiens
aggatgtcgggagcatcctgct

SEQ ID NO: 6642238 - DNA, 23 bp, Homo sapiens
aggatgtcgggagcatcctgctg

SEQ ID NO: 6642239 - DNA, 19 bp, Homo sapiens
aggatgtggaaagcacttt

SEQ ID NO: 6642240 - DNA, 18 bp, Homo sapiens
aggatgtggaagagcatt

SEQ ID NO: 6642241 - DNA, 14 bp, Homo sapiens
aggatgtggcacaa

SEQ ID NO: 6642242 - DNA, 13 bp, Homo sapiens
aggatgtggcagg

SEQ ID NO: 6642243 - DNA, 18 bp, Homo sapiens
aggatgtggcaggggcag

SEQ ID NO: 6642244 - DNA, 22 bp, Homo sapiens
aggatgtggcaggggcagtggc

SEQ ID NO: 6642245 - DNA, 14 bp, Homo sapiens
aggatgtgtgcatg

SEQ ID NO: 6642246 - DNA, 15 bp, Homo sapiens
aggatgtgtgcatgt

SEQ ID NO: 6642247 - DNA, 20 bp, Homo sapiens
aggatgttacaagtttgcta

SEQ ID NO: 6642248 - DNA, 15 bp, Homo sapiens
aggatgttagaaagt

SEQ ID NO: 6642249 - DNA, 20 bp, Homo sapiens
aggatgttagacttgctccc

SEQ ID NO: 6642250 - DNA, 22 bp, Homo sapiens
aggatgttctagcatggctgcc

SEQ ID NO: 6642251 - DNA, 15 bp, Homo sapiens
aggatgttctgggac

SEQ ID NO: 6642252 - DNA, 16 bp, Homo sapiens
aggatgttctgggaca

SEQ ID NO: 6642253 - DNA, 18 bp, Homo sapiens
aggatgttctgggacaca

SEQ ID NO: 6642254 - DNA, 14 bp, Homo sapiens
aggatgttgaaaaa

SEQ ID NO: 6642255 - DNA, 19 bp, Homo sapiens
aggatgtttcaccaaggaa

SEQ ID NO: 6642256 - DNA, 20 bp, Homo sapiens
aggatgtttcaccaaggaaa

SEQ ID NO: 6642257 - DNA, 15 bp, Homo sapiens
aggatgtttttaatg

SEQ ID NO: 6642258 - DNA, 14 bp, Homo sapiens
aggattaaataatg

SEQ ID NO: 6642259 - DNA, 16 bp, Homo sapiens
aggattaactaaagaa

SEQ ID NO: 6642260 - DNA, 20 bp, Homo sapiens
aggattaagggacgggggtg

SEQ ID NO: 6642261 - DNA, 17 bp, Homo sapiens
aggattaatctctaaaa

SEQ ID NO: 6642262 - DNA, 14 bp, Homo sapiens
aggattaatgaaaa

SEQ ID NO: 6642263 - DNA, 14 bp, Homo sapiens
aggattaatttatt

SEQ ID NO: 6642264 - DNA, 14 bp, Homo sapiens
aggattacagaaac

SEQ ID NO: 6642265 - DNA, 18 bp, Homo sapiens
aggattacagaaactgat

SEQ ID NO: 6642266 - DNA, 14 bp, Homo sapiens
aggattagaaaatt

SEQ ID NO: 6642267 - DNA, 17 bp, Homo sapiens
aggattagataaggctg

SEQ ID NO: 6642268 - DNA, 19 bp, Homo sapiens
aggattaggtttagaatca

SEQ ID NO: 6642269 - DNA, 14 bp, Homo sapiens
aggattataaatga

SEQ ID NO: 6642270 - DNA, 17 bp, Homo sapiens
aggattataaatgaaat

SEQ ID NO: 6642271 - DNA, 22 bp, Homo sapiens
aggattataaatgaaatttgca

SEQ ID NO: 6642272 - DNA, 15 bp, Homo sapiens
aggattatatgtatt

SEQ ID NO: 6642273 - DNA, 14 bp, Homo sapiens
aggattatcagtat

SEQ ID NO: 6642274 - DNA, 12 bp, Homo sapiens
aggattatggaa

SEQ ID NO: 6642275 - DNA, 19 bp, Homo sapiens
aggattatgggtcctgcaa

SEQ ID NO: 6642276 - DNA, 21 bp, Homo sapiens
aggattattactaattctatt

SEQ ID NO: 6642277 - DNA, 17 bp, Homo sapiens
aggattcaggcagcagt

SEQ ID NO: 6642278 - DNA, 23 bp, Homo sapiens
aggattcaggcagcagtgtctgt

SEQ ID NO: 6642279 - DNA, 13 bp, Homo sapiens
aggattcaggcct

SEQ ID NO: 6642280 - DNA, 20 bp, Homo sapiens
aggattcagtggaggctggc

SEQ ID NO: 6642281 - DNA, 15 bp, Homo sapiens
aggattccaaagttt

SEQ ID NO: 6642282 - DNA, 19 bp, Homo sapiens
aggattccagttgcgtgtc

SEQ ID NO: 6642283 - DNA, 14 bp, Homo sapiens
aggattcccagaga

SEQ ID NO: 6642284 - DNA, 15 bp, Homo sapiens
aggattcccagagag

SEQ ID NO: 6642285 - DNA, 15 bp, Homo sapiens
aggattcctctttgt

SEQ ID NO: 6642286 - DNA, 16 bp, Homo sapiens
aggattccttaaacct

SEQ ID NO: 6642287 - DNA, 18 bp, Homo sapiens
aggattctcaccagctgt

SEQ ID NO: 6642288 - DNA, 18 bp, Homo sapiens
aggattctctaattagaa

SEQ ID NO: 6642289 - DNA, 22 bp, Homo sapiens
aggattctctgcagcccattcc

SEQ ID NO: 6642290 - DNA, 15 bp, Homo sapiens
aggattctgcagaaa

SEQ ID NO: 6642291 - DNA, 22 bp, Homo sapiens
aggattctgctggcctctgcga

SEQ ID NO: 6642292 - DNA, 19 bp, Homo sapiens
aggattctgggaatcatgt

SEQ ID NO: 6642293 - DNA, 18 bp, Homo sapiens
aggattctgttccctggg

SEQ ID NO: 6642294 - DNA, 12 bp, Homo sapiens
aggattcttcct

SEQ ID NO: 6642295 - DNA, 21 bp, Homo sapiens
aggattctttccccagaggct

SEQ ID NO: 6642296 - DNA, 24 bp, Homo sapiens
aggattctttccccagaggctccc

SEQ ID NO: 6642297 - DNA, 17 bp, Homo sapiens
aggattcttttttcaat

SEQ ID NO: 6642298 - DNA, 19 bp, Homo sapiens
aggattcttttttcaatgt

SEQ ID NO: 6642299 - DNA, 24 bp, Homo sapiens
aggattgaaaatgtccaggaaagt

SEQ ID NO: 6642300 - DNA, 22 bp, Homo sapiens
aggattgacattctacagttgt

SEQ ID NO: 6642301 - DNA, 21 bp, Homo sapiens
aggattgatggtgctcccctt

SEQ ID NO: 6642302 - DNA, 16 bp, Homo sapiens
aggattgcaggtgcct

SEQ ID NO: 6642303 - DNA, 17 bp, Homo sapiens
aggattgcatcctgctg

SEQ ID NO: 6642304 - DNA, 19 bp, Homo sapiens
aggattgcatcctgctggg

SEQ ID NO: 6642305 - DNA, 16 bp, Homo sapiens
aggattgcgagagatg

SEQ ID NO: 6642306 - DNA, 18 bp, Homo sapiens
aggattgcgagagatgtg

SEQ ID NO: 6642307 - DNA, 19 bp, Homo sapiens
aggattgcgagagatgtgt

SEQ ID NO: 6642308 - DNA, 20 bp, Homo sapiens
aggattgcgagagatgtgtg

SEQ ID NO: 6642309 - DNA, 23 bp, Homo sapiens
aggattgcgagagatgtgtgttg

SEQ ID NO: 6642310 - DNA, 19 bp, Homo sapiens
aggattgctgccagagaag

SEQ ID NO: 6642311 - DNA, 18 bp, Homo sapiens
aggattgcttgagcccag

SEQ ID NO: 6642312 - DNA, 20 bp, Homo sapiens
aggattgcttgagcccagga

SEQ ID NO: 6642313 - DNA, 14 bp, Homo sapiens
aggattggatgatt

SEQ ID NO: 6642314 - DNA, 12 bp, Homo sapiens
aggattggggaa

SEQ ID NO: 6642315 - DNA, 15 bp, Homo sapiens
aggattgggggatgt

SEQ ID NO: 6642316 - DNA, 13 bp, Homo sapiens
aggattgtaaaaa

SEQ ID NO: 6642317 - DNA, 19 bp, Homo sapiens
aggattgtaaaaaaaaatg

SEQ ID NO: 6642318 - DNA, 19 bp, Homo sapiens
aggattgtacgtgggagag

SEQ ID NO: 6642319 - DNA, 21 bp, Homo sapiens
aggattgtacgtgggagaggc

SEQ ID NO: 6642320 - DNA, 23 bp, Homo sapiens
aggattgtccaccttctgccaag

SEQ ID NO: 6642321 - DNA, 15 bp, Homo sapiens
aggattgtggaaaac

SEQ ID NO: 6642322 - DNA, 19 bp, Homo sapiens
aggattgtggaaaaccagg

SEQ ID NO: 6642323 - DNA, 23 bp, Homo sapiens
aggattgtttctggtgactgcag

SEQ ID NO: 6642324 - DNA, 16 bp, Homo sapiens
aggatttaacagtcat

SEQ ID NO: 6642325 - DNA, 20 bp, Homo sapiens
aggatttaaggaggtgaagt

SEQ ID NO: 6642326 - DNA, 13 bp, Homo sapiens
aggatttagaagt

SEQ ID NO: 6642327 - DNA, 15 bp, Homo sapiens
aggatttaggcctta

SEQ ID NO: 6642328 - DNA, 11 bp, Homo sapiens
aggatttatac

SEQ ID NO: 6642329 - DNA, 20 bp, Homo sapiens
aggatttatgtattttgaaa

SEQ ID NO: 6642330 - DNA, 15 bp, Homo sapiens
aggatttattctcag

SEQ ID NO: 6642331 - DNA, 16 bp, Homo sapiens
aggatttcagccatgc

SEQ ID NO: 6642332 - DNA, 19 bp, Homo sapiens
aggatttcatgatttcatt

SEQ ID NO: 6642333 - DNA, 21 bp, Homo sapiens
aggatttcattgactgaactg

SEQ ID NO: 6642334 - DNA, 19 bp, Homo sapiens
aggatttccctgaagctat

SEQ ID NO: 6642335 - DNA, 21 bp, Homo sapiens
aggatttcctggagtgccctg

SEQ ID NO: 6642336 - DNA, 18 bp, Homo sapiens
aggatttctaatcaaaag

SEQ ID NO: 6642337 - DNA, 12 bp, Homo sapiens
aggatttctgct

SEQ ID NO: 6642338 - DNA, 19 bp, Homo sapiens
aggatttctttatgaggca

SEQ ID NO: 6642339 - DNA, 11 bp, Homo sapiens
aggatttgaaa

SEQ ID NO: 6642340 - DNA, 21 bp, Homo sapiens
aggatttgatgcttttctctc

SEQ ID NO: 6642341 - DNA, 14 bp, Homo sapiens
aggatttgatttct

SEQ ID NO: 6642342 - DNA, 18 bp, Homo sapiens
aggatttgcactgcttta

SEQ ID NO: 6642343 - DNA, 16 bp, Homo sapiens
aggatttgctgggaga

SEQ ID NO: 6642344 - DNA, 14 bp, Homo sapiens
aggatttggccaca

SEQ ID NO: 6642345 - DNA, 19 bp, Homo sapiens
aggatttggctcgctgtgg

SEQ ID NO: 6642346 - DNA, 14 bp, Homo sapiens
aggatttggttttt

SEQ ID NO: 6642347 - DNA, 20 bp, Homo sapiens
aggatttgtgttttacagta

SEQ ID NO: 6642348 - DNA, 23 bp, Homo sapiens
aggattttaacttaactgaaatg

SEQ ID NO: 6642349 - DNA, 16 bp, Homo sapiens
aggattttaatttcag

SEQ ID NO: 6642350 - DNA, 17 bp, Homo sapiens
aggattttaatttcagg

SEQ ID NO: 6642351 - DNA, 14 bp, Homo sapiens
aggattttaccaaa

SEQ ID NO: 6642352 - DNA, 16 bp, Homo sapiens
aggattttaccaaagc

SEQ ID NO: 6642353 - DNA, 19 bp, Homo sapiens
aggattttaccaaagcatc

SEQ ID NO: 6642354 - DNA, 22 bp, Homo sapiens
aggattttagctaggatttgaa

SEQ ID NO: 6642355 - DNA, 13 bp, Homo sapiens
aggattttatacc

SEQ ID NO: 6642356 - DNA, 13 bp, Homo sapiens
aggattttcaagt

SEQ ID NO: 6642357 - DNA, 15 bp, Homo sapiens
aggattttcaagtta

SEQ ID NO: 6642358 - DNA, 17 bp, Homo sapiens
aggattttggaaaagaa

SEQ ID NO: 6642359 - DNA, 23 bp, Homo sapiens
aggatttttaaaactcagattta

SEQ ID NO: 6642360 - DNA, 17 bp, Homo sapiens
aggatttttagagcatt

SEQ ID NO: 6642361 - DNA, 14 bp, Homo sapiens
aggatttttccatg

SEQ ID NO: 6642362 - DNA, 19 bp, Homo sapiens
aggatttttttcctcccca

SEQ ID NO: 6642363 - DNA, 21 bp, Homo sapiens
aggattttttttttttcttca

SEQ ID NO: 6642364 - DNA, 21 bp, Homo sapiens
aggatttttttttttttttga

SEQ ID NO: 6642365 - DNA, 15 bp, Homo sapiens
aggcaaaaaactctt

SEQ ID NO: 6642366 - DNA, 16 bp, Homo sapiens
aggcaaaaaactctta

SEQ ID NO: 6642367 - DNA, 15 bp, Homo sapiens
aggcaaaaaaggatg

SEQ ID NO: 6642368 - DNA, 20 bp, Homo sapiens
aggcaaaaaagggacagcat

SEQ ID NO: 6642369 - DNA, 19 bp, Homo sapiens
aggcaaaaactgtactgtg

SEQ ID NO: 6642370 - DNA, 13 bp, Homo sapiens
aggcaaaaataat

SEQ ID NO: 6642371 - DNA, 23 bp, Homo sapiens
aggcaaaaataatttattttgct

SEQ ID NO: 6642372 - DNA, 15 bp, Homo sapiens
aggcaaaaatgtaaa

SEQ ID NO: 6642373 - DNA, 23 bp, Homo sapiens
aggcaaaaggcagtggggctggg

SEQ ID NO: 6642374 - DNA, 16 bp, Homo sapiens
aggcaaaagtgtaaca

SEQ ID NO: 6642375 - DNA, 17 bp, Homo sapiens
aggcaaaatccttgctt

SEQ ID NO: 6642376 - DNA, 19 bp, Homo sapiens
aggcaaaattgcaaatctt

SEQ ID NO: 6642377 - DNA, 20 bp, Homo sapiens
aggcaaacattgcaactcag

SEQ ID NO: 6642378 - DNA, 19 bp, Homo sapiens
aggcaaacattttctctta

SEQ ID NO: 6642379 - DNA, 22 bp, Homo sapiens
aggcaaacattttctcttagaa

SEQ ID NO: 6642380 - DNA, 23 bp, Homo sapiens
aggcaaacattttctcttagaaa

SEQ ID NO: 6642381 - DNA, 22 bp, Homo sapiens
aggcaaacctttctataatttt

SEQ ID NO: 6642382 - DNA, 18 bp, Homo sapiens
aggcaaacttttatgcag

SEQ ID NO: 6642383 - DNA, 14 bp, Homo sapiens
aggcaaagaatcaa

SEQ ID NO: 6642384 - DNA, 16 bp, Homo sapiens
aggcaaagaatcaaca

SEQ ID NO: 6642385 - DNA, 22 bp, Homo sapiens
aggcaaagataatttatttcaa

SEQ ID NO: 6642386 - DNA, 13 bp, Homo sapiens
aggcaaagctgga

SEQ ID NO: 6642387 - DNA, 14 bp, Homo sapiens
aggcaaagctggct

SEQ ID NO: 6642388 - DNA, 23 bp, Homo sapiens
aggcaaaggaggggaaacaatga

SEQ ID NO: 6642389 - DNA, 12 bp, Homo sapiens
aggcaaaggcag

SEQ ID NO: 6642390 - DNA, 14 bp, Homo sapiens
aggcaaaggccccc

SEQ ID NO: 6642391 - DNA, 14 bp, Homo sapiens
aggcaaaggcctgg

SEQ ID NO: 6642392 - DNA, 20 bp, Homo sapiens
aggcaaagggtccagaagga

SEQ ID NO: 6642393 - DNA, 13 bp, Homo sapiens
aggcaaagtacaa

SEQ ID NO: 6642394 - DNA, 15 bp, Homo sapiens
aggcaaagtccagct

SEQ ID NO: 6642395 - DNA, 22 bp, Homo sapiens
aggcaaagtttacagatgtttt

SEQ ID NO: 6642396 - DNA, 16 bp, Homo sapiens
aggcaaagttttccat

SEQ ID NO: 6642397 - DNA, 17 bp, Homo sapiens
aggcaaataatggaaaa

SEQ ID NO: 6642398 - DNA, 16 bp, Homo sapiens
aggcaaatattgaagt

SEQ ID NO: 6642399 - DNA, 16 bp, Homo sapiens
aggcaaatcaggtaaa

SEQ ID NO: 6642400 - DNA, 16 bp, Homo sapiens
aggcaaatctgacttt

SEQ ID NO: 6642401 - DNA, 18 bp, Homo sapiens
aggcaaatgactttggac

SEQ ID NO: 6642402 - DNA, 15 bp, Homo sapiens
aggcaaatggcactg

SEQ ID NO: 6642403 - DNA, 15 bp, Homo sapiens
aggcaaatgggatgg

SEQ ID NO: 6642404 - DNA, 17 bp, Homo sapiens
aggcaaatgtaaagtct

SEQ ID NO: 6642405 - DNA, 13 bp, Homo sapiens
aggcaaatgtgta

SEQ ID NO: 6642406 - DNA, 14 bp, Homo sapiens
aggcaaatgtgtac

SEQ ID NO: 6642407 - DNA, 23 bp, Homo sapiens
aggcaaattaactgtatgtgtgt

SEQ ID NO: 6642408 - DNA, 21 bp, Homo sapiens
aggcaacacctgtggataaaa

SEQ ID NO: 6642409 - DNA, 18 bp, Homo sapiens
aggcaacactgctgtcca

SEQ ID NO: 6642410 - DNA, 23 bp, Homo sapiens
aggcaacagggccatgtgctgcc

SEQ ID NO: 6642411 - DNA, 21 bp, Homo sapiens
aggcaacagtgttctgagccc

SEQ ID NO: 6642412 - DNA, 19 bp, Homo sapiens
aggcaacagtttgacattt

SEQ ID NO: 6642413 - DNA, 13 bp, Homo sapiens
aggcaacattcct

SEQ ID NO: 6642414 - DNA, 14 bp, Homo sapiens
aggcaacattcctt

SEQ ID NO: 6642415 - DNA, 16 bp, Homo sapiens
aggcaaccaataaaag

SEQ ID NO: 6642416 - DNA, 13 bp, Homo sapiens
aggcaacctccca

SEQ ID NO: 6642417 - DNA, 21 bp, Homo sapiens
aggcaacctcccatcccaccc

SEQ ID NO: 6642418 - DNA, 15 bp, Homo sapiens
aggcaacctgattgt

SEQ ID NO: 6642419 - DNA, 19 bp, Homo sapiens
aggcaacctgattgtaaac

SEQ ID NO: 6642420 - DNA, 17 bp, Homo sapiens
aggcaactagtggagag

SEQ ID NO: 6642421 - DNA, 22 bp, Homo sapiens
aggcaactagtggagagaactg

SEQ ID NO: 6642422 - DNA, 12 bp, Homo sapiens
aggcaactcagc

SEQ ID NO: 6642423 - DNA, 17 bp, Homo sapiens
aggcaactcatcttagg

SEQ ID NO: 6642424 - DNA, 24 bp, Homo sapiens
aggcaactgacttcatttgtgcca

SEQ ID NO: 6642425 - DNA, 15 bp, Homo sapiens
aggcaactgaggcag

SEQ ID NO: 6642426 - DNA, 16 bp, Homo sapiens
aggcaactgaggcaga

SEQ ID NO: 6642427 - DNA, 17 bp, Homo sapiens
aggcaactgaggcagac

SEQ ID NO: 6642428 - DNA, 22 bp, Homo sapiens
aggcaacttcagtcctgggaga

SEQ ID NO: 6642429 - DNA, 15 bp, Homo sapiens
aggcaacttttaaag

SEQ ID NO: 6642430 - DNA, 18 bp, Homo sapiens
aggcaagaaaagcgcaga

SEQ ID NO: 6642431 - DNA, 20 bp, Homo sapiens
aggcaagaaaagcgcagaga

SEQ ID NO: 6642432 - DNA, 21 bp, Homo sapiens
aggcaagaaaagcgcagagaa

SEQ ID NO: 6642433 - DNA, 21 bp, Homo sapiens
aggcaagacaccttcccagct

SEQ ID NO: 6642434 - DNA, 13 bp, Homo sapiens
aggcaagagacag

SEQ ID NO: 6642435 - DNA, 15 bp, Homo sapiens
aggcaagagatgaat

SEQ ID NO: 6642436 - DNA, 15 bp, Homo sapiens
aggcaagagctcaag

SEQ ID NO: 6642437 - DNA, 21 bp, Homo sapiens
aggcaagagggggtggagggg

SEQ ID NO: 6642438 - DNA, 13 bp, Homo sapiens
aggcaagaggggt

SEQ ID NO: 6642439 - DNA, 16 bp, Homo sapiens
aggcaagattgatgtt

SEQ ID NO: 6642440 - DNA, 19 bp, Homo sapiens
aggcaagattggaaagaca

SEQ ID NO: 6642441 - DNA, 18 bp, Homo sapiens
aggcaagcaagctctctt

SEQ ID NO: 6642442 - DNA, 23 bp, Homo sapiens
aggcaagcacaatggtttcaaag

SEQ ID NO: 6642443 - DNA, 14 bp, Homo sapiens
aggcaagcacctcc

SEQ ID NO: 6642444 - DNA, 16 bp, Homo sapiens
aggcaagcaggacctg

SEQ ID NO: 6642445 - DNA, 13 bp, Homo sapiens
aggcaagcatgaa

SEQ ID NO: 6642446 - DNA, 16 bp, Homo sapiens
aggcaagcatgaataa

SEQ ID NO: 6642447 - DNA, 15 bp, Homo sapiens
aggcaagccacagaa

SEQ ID NO: 6642448 - DNA, 17 bp, Homo sapiens
aggcaagccagcatgtg

SEQ ID NO: 6642449 - DNA, 16 bp, Homo sapiens
aggcaagccaggctca

SEQ ID NO: 6642450 - DNA, 22 bp, Homo sapiens
aggcaagccaggctcactcaca

SEQ ID NO: 6642451 - DNA, 17 bp, Homo sapiens
aggcaagccatggagtg

SEQ ID NO: 6642452 - DNA, 23 bp, Homo sapiens
aggcaagcccctcagcccttgcc

SEQ ID NO: 6642453 - DNA, 15 bp, Homo sapiens
aggcaagccctgcct

SEQ ID NO: 6642454 - DNA, 17 bp, Homo sapiens
aggcaagcgaccgaggc

SEQ ID NO: 6642455 - DNA, 21 bp, Homo sapiens
aggcaagcgaccgaggccctc

SEQ ID NO: 6642456 - DNA, 23 bp, Homo sapiens
aggcaagcgaccgaggccctccc

SEQ ID NO: 6642457 - DNA, 17 bp, Homo sapiens
aggcaagcgtgttctca

SEQ ID NO: 6642458 - DNA, 19 bp, Homo sapiens
aggcaagcgtgttctcagc

SEQ ID NO: 6642459 - DNA, 20 bp, Homo sapiens
aggcaagcgtgttctcagca

SEQ ID NO: 6642460 - DNA, 21 bp, Homo sapiens
aggcaagcgtgttctcagcac

SEQ ID NO: 6642461 - DNA, 14 bp, Homo sapiens
aggcaagctggcag

SEQ ID NO: 6642462 - DNA, 12 bp, Homo sapiens
aggcaagcttga

SEQ ID NO: 6642463 - DNA, 15 bp, Homo sapiens
aggcaagcttgaggc

SEQ ID NO: 6642464 - DNA, 17 bp, Homo sapiens
aggcaagcttgaggcca

SEQ ID NO: 6642465 - DNA, 18 bp, Homo sapiens
aggcaagcttgaggccaa

SEQ ID NO: 6642466 - DNA, 14 bp, Homo sapiens
aggcaaggcaggtg

SEQ ID NO: 6642467 - DNA, 19 bp, Homo sapiens
aggcaaggcaggtgcctcc

SEQ ID NO: 6642468 - DNA, 12 bp, Homo sapiens
aggcaaggccca

SEQ ID NO: 6642469 - DNA, 13 bp, Homo sapiens
aggcaaggccctg

SEQ ID NO: 6642470 - DNA, 17 bp, Homo sapiens
aggcaaggccctgccct

SEQ ID NO: 6642471 - DNA, 18 bp, Homo sapiens
aggcaaggccctgccctg

SEQ ID NO: 6642472 - DNA, 20 bp, Homo sapiens
aggcaaggctatgtgattac

SEQ ID NO: 6642473 - DNA, 15 bp, Homo sapiens
aggcaaggctgactt

SEQ ID NO: 6642474 - DNA, 19 bp, Homo sapiens
aggcaaggctgccggctgc

SEQ ID NO: 6642475 - DNA, 17 bp, Homo sapiens
aggcaaggctgtcaatt

SEQ ID NO: 6642476 - DNA, 15 bp, Homo sapiens
aggcaaggtttacac

SEQ ID NO: 6642477 - DNA, 13 bp, Homo sapiens
aggcaagtgaaga

SEQ ID NO: 6642478 - DNA, 18 bp, Homo sapiens
aggcaagtgtatattttg

SEQ ID NO: 6642479 - DNA, 20 bp, Homo sapiens
aggcaataagaattactttg

SEQ ID NO: 6642480 - DNA, 14 bp, Homo sapiens
aggcaatcacatag

SEQ ID NO: 6642481 - DNA, 18 bp, Homo sapiens
aggcaatcacttgaggtc

SEQ ID NO: 6642482 - DNA, 13 bp, Homo sapiens
aggcaatcatggt

SEQ ID NO: 6642483 - DNA, 16 bp, Homo sapiens
aggcaatcgttctgct

SEQ ID NO: 6642484 - DNA, 18 bp, Homo sapiens
aggcaatcttaaaacaga

SEQ ID NO: 6642485 - DNA, 17 bp, Homo sapiens
aggcaatcttgccttct

SEQ ID NO: 6642486 - DNA, 14 bp, Homo sapiens
aggcaatgaagaat

SEQ ID NO: 6642487 - DNA, 23 bp, Homo sapiens
aggcaatgactcgttacctgccg

SEQ ID NO: 6642488 - DNA, 21 bp, Homo sapiens
aggcaatgattcacgcttttg

SEQ ID NO: 6642489 - DNA, 13 bp, Homo sapiens
aggcaatgccctg

SEQ ID NO: 6642490 - DNA, 16 bp, Homo sapiens
aggcaatgccctgcgg

SEQ ID NO: 6642491 - DNA, 18 bp, Homo sapiens
aggcaatgccctgcggct

SEQ ID NO: 6642492 - DNA, 21 bp, Homo sapiens
aggcaatgccctgcggctctg

SEQ ID NO: 6642493 - DNA, 14 bp, Homo sapiens
aggcaatgctcacc

SEQ ID NO: 6642494 - DNA, 19 bp, Homo sapiens
aggcaatggcctaaacttc

SEQ ID NO: 6642495 - DNA, 22 bp, Homo sapiens
aggcaatgtcaggaacagaagg

SEQ ID NO: 6642496 - DNA, 23 bp, Homo sapiens
aggcaatgtcaggaacagaagga

SEQ ID NO: 6642497 - DNA, 12 bp, Homo sapiens
aggcaattagac

SEQ ID NO: 6642498 - DNA, 21 bp, Homo sapiens
aggcaattagacactttggaa

SEQ ID NO: 6642499 - DNA, 15 bp, Homo sapiens
aggcaattatatcta

SEQ ID NO: 6642500 - DNA, 19 bp, Homo sapiens
aggcaattcagtcctgggc

SEQ ID NO: 6642501 - DNA, 17 bp, Homo sapiens
aggcaattcctacctct

SEQ ID NO: 6642502 - DNA, 19 bp, Homo sapiens
aggcaattctcctgccttt

SEQ ID NO: 6642503 - DNA, 14 bp, Homo sapiens
aggcaattgattgt

SEQ ID NO: 6642504 - DNA, 21 bp, Homo sapiens
aggcaattttaatcccctgca

SEQ ID NO: 6642505 - DNA, 17 bp, Homo sapiens
aggcaattttagtgtat

SEQ ID NO: 6642506 - DNA, 13 bp, Homo sapiens
aggcacaaaatga

SEQ ID NO: 6642507 - DNA, 15 bp, Homo sapiens
aggcacaaaatgtga

SEQ ID NO: 6642508 - DNA, 20 bp, Homo sapiens
aggcacaaaattttgtttaa

SEQ ID NO: 6642509 - DNA, 19 bp, Homo sapiens
aggcacacaaggggccctt

SEQ ID NO: 6642510 - DNA, 22 bp, Homo sapiens
aggcacacaaggggcccttgga

SEQ ID NO: 6642511 - DNA, 23 bp, Homo sapiens
aggcacacagagattctggatct

SEQ ID NO: 6642512 - DNA, 12 bp, Homo sapiens
aggcacacagat

SEQ ID NO: 6642513 - DNA, 15 bp, Homo sapiens
aggcacacagatccc

SEQ ID NO: 6642514 - DNA, 15 bp, Homo sapiens
aggcacacagggccc

SEQ ID NO: 6642515 - DNA, 18 bp, Homo sapiens
aggcacaccagtgcaagc

SEQ ID NO: 6642516 - DNA, 19 bp, Homo sapiens
aggcacactgctaaattta

SEQ ID NO: 6642517 - DNA, 14 bp, Homo sapiens
aggcacactttctg

SEQ ID NO: 6642518 - DNA, 19 bp, Homo sapiens
aggcacactttctggcaaa

SEQ ID NO: 6642519 - DNA, 19 bp, Homo sapiens
aggcacagaggaggtcagc

SEQ ID NO: 6642520 - DNA, 21 bp, Homo sapiens
aggcacagccggggcctgcct

SEQ ID NO: 6642521 - DNA, 13 bp, Homo sapiens
aggcacagctgag

SEQ ID NO: 6642522 - DNA, 18 bp, Homo sapiens
aggcacaggacacctggc

SEQ ID NO: 6642523 - DNA, 21 bp, Homo sapiens
aggcacaggcaggaagagaga

SEQ ID NO: 6642524 - DNA, 15 bp, Homo sapiens
aggcacaggcagggc

SEQ ID NO: 6642525 - DNA, 16 bp, Homo sapiens
aggcacaggcagggca

SEQ ID NO: 6642526 - DNA, 17 bp, Homo sapiens
aggcacaggcagggcag

SEQ ID NO: 6642527 - DNA, 14 bp, Homo sapiens
aggcacagggcccg

SEQ ID NO: 6642528 - DNA, 22 bp, Homo sapiens
aggcacagggcccgcagtgctg

SEQ ID NO: 6642529 - DNA, 17 bp, Homo sapiens
aggcacaggtgtaaata

SEQ ID NO: 6642530 - DNA, 18 bp, Homo sapiens
aggcacagtaagcatgct

SEQ ID NO: 6642531 - DNA, 18 bp, Homo sapiens
aggcacagtgggagctga

SEQ ID NO: 6642532 - DNA, 23 bp, Homo sapiens
aggcacatgcaccacgcccggct

SEQ ID NO: 6642533 - DNA, 18 bp, Homo sapiens
aggcacatggaatatatt

SEQ ID NO: 6642534 - DNA, 14 bp, Homo sapiens
aggcacatggagga

SEQ ID NO: 6642535 - DNA, 16 bp, Homo sapiens
aggcacatggctgggg

SEQ ID NO: 6642536 - DNA, 18 bp, Homo sapiens
aggcacatggctggggga

SEQ ID NO: 6642537 - DNA, 14 bp, Homo sapiens
aggcacatgtgttc

SEQ ID NO: 6642538 - DNA, 16 bp, Homo sapiens
aggcacattaactgtt

SEQ ID NO: 6642539 - DNA, 17 bp, Homo sapiens
aggcaccaaaagaagta

SEQ ID NO: 6642540 - DNA, 18 bp, Homo sapiens
aggcaccaaaagaagtaa

SEQ ID NO: 6642541 - DNA, 20 bp, Homo sapiens
aggcaccaaaagaagtaaaa

SEQ ID NO: 6642542 - DNA, 22 bp, Homo sapiens
aggcaccaacaactcagaatgg

SEQ ID NO: 6642543 - DNA, 17 bp, Homo sapiens
aggcaccacagcctcca

SEQ ID NO: 6642544 - DNA, 17 bp, Homo sapiens
aggcaccaccaggagca

SEQ ID NO: 6642545 - DNA, 20 bp, Homo sapiens
aggcaccaccaggagcagca

SEQ ID NO: 6642546 - DNA, 21 bp, Homo sapiens
aggcaccaccaggagcagcag

SEQ ID NO: 6642547 - DNA, 23 bp, Homo sapiens
aggcaccaccaggagcagcagcc

SEQ ID NO: 6642548 - DNA, 13 bp, Homo sapiens
aggcaccagaaga

SEQ ID NO: 6642549 - DNA, 13 bp, Homo sapiens
aggcaccagcatc

SEQ ID NO: 6642550 - DNA, 17 bp, Homo sapiens
aggcaccagctctgtgg

SEQ ID NO: 6642551 - DNA, 20 bp, Homo sapiens
aggcaccagctctgtggcct

SEQ ID NO: 6642552 - DNA, 11 bp, Homo sapiens
aggcaccagga

SEQ ID NO: 6642553 - DNA, 12 bp, Homo sapiens
aggcaccaggaa

SEQ ID NO: 6642554 - DNA, 15 bp, Homo sapiens
aggcaccaggaagcc

SEQ ID NO: 6642555 - DNA, 13 bp, Homo sapiens
aggcaccagtcca

SEQ ID NO: 6642556 - DNA, 14 bp, Homo sapiens
aggcaccagtgtcc

SEQ ID NO: 6642557 - DNA, 23 bp, Homo sapiens
aggcaccatagaagaacagcaga

SEQ ID NO: 6642558 - DNA, 24 bp, Homo sapiens
aggcaccatctgccaatgccatga

SEQ ID NO: 6642559 - DNA, 13 bp, Homo sapiens
aggcaccatgctg

SEQ ID NO: 6642560 - DNA, 20 bp, Homo sapiens
aggcacccaccatcatgtct

SEQ ID NO: 6642561 - DNA, 22 bp, Homo sapiens
aggcacccatcctagagaaaac

SEQ ID NO: 6642562 - DNA, 20 bp, Homo sapiens
aggcaccccctggagagaag

SEQ ID NO: 6642563 - DNA, 20 bp, Homo sapiens
aggcacccctttccccagcc

SEQ ID NO: 6642564 - DNA, 21 bp, Homo sapiens
aggcacccctttccccagcct

SEQ ID NO: 6642565 - DNA, 20 bp, Homo sapiens
aggcacccggggccagagac

SEQ ID NO: 6642566 - DNA, 13 bp, Homo sapiens
aggcaccctcagg

SEQ ID NO: 6642567 - DNA, 15 bp, Homo sapiens
aggcaccctcaggga

SEQ ID NO: 6642568 - DNA, 22 bp, Homo sapiens
aggcaccctcagggagcctccc

SEQ ID NO: 6642569 - DNA, 21 bp, Homo sapiens
aggcaccgccacgtcccagca

SEQ ID NO: 6642570 - DNA, 16 bp, Homo sapiens
aggcaccgcctgcccc

SEQ ID NO: 6642571 - DNA, 16 bp, Homo sapiens
aggcaccgctgggttc

SEQ ID NO: 6642572 - DNA, 18 bp, Homo sapiens
aggcaccggacgctggag

SEQ ID NO: 6642573 - DNA, 14 bp, Homo sapiens
aggcaccggcgctg

SEQ ID NO: 6642574 - DNA, 17 bp, Homo sapiens
aggcaccgtccaggccc

SEQ ID NO: 6642575 - DNA, 21 bp, Homo sapiens
aggcacctataaaacaggtca

SEQ ID NO: 6642576 - DNA, 22 bp, Homo sapiens
aggcacctcacagaaatgagat

SEQ ID NO: 6642577 - DNA, 14 bp, Homo sapiens
aggcacctccccgc

SEQ ID NO: 6642578 - DNA, 19 bp, Homo sapiens
aggcacctccccgctctcc

SEQ ID NO: 6642579 - DNA, 22 bp, Homo sapiens
aggcacctccccgctctccctg

SEQ ID NO: 6642580 - DNA, 21 bp, Homo sapiens
aggcacctgcaggttgggcca

SEQ ID NO: 6642581 - DNA, 20 bp, Homo sapiens
aggcacctggcctgctggga

SEQ ID NO: 6642582 - DNA, 22 bp, Homo sapiens
aggcacctggcctgctgggaac

SEQ ID NO: 6642583 - DNA, 13 bp, Homo sapiens
aggcacctgggct

SEQ ID NO: 6642584 - DNA, 17 bp, Homo sapiens
aggcaccttaactggag

SEQ ID NO: 6642585 - DNA, 18 bp, Homo sapiens
aggcaccttaactggaga

SEQ ID NO: 6642586 - DNA, 17 bp, Homo sapiens
aggcaccttttactgtg

SEQ ID NO: 6642587 - DNA, 17 bp, Homo sapiens
aggcacgaacccacctg

SEQ ID NO: 6642588 - DNA, 18 bp, Homo sapiens
aggcacgaacccacctgc

SEQ ID NO: 6642589 - DNA, 20 bp, Homo sapiens
aggcacgaacccacctgctg

SEQ ID NO: 6642590 - DNA, 15 bp, Homo sapiens
aggcacgcaccactg

SEQ ID NO: 6642591 - DNA, 21 bp, Homo sapiens
aggcacgccagtttcaccatt

SEQ ID NO: 6642592 - DNA, 22 bp, Homo sapiens
aggcacgccagtttcaccattt

SEQ ID NO: 6642593 - DNA, 23 bp, Homo sapiens
aggcacgccagtttcaccatttc

SEQ ID NO: 6642594 - DNA, 16 bp, Homo sapiens
aggcacgggtggtccc

SEQ ID NO: 6642595 - DNA, 19 bp, Homo sapiens
aggcacgtctcctgctgcg

SEQ ID NO: 6642596 - DNA, 20 bp, Homo sapiens
aggcacgtctcctgctgcgt

SEQ ID NO: 6642597 - DNA, 23 bp, Homo sapiens
aggcactaagaggggctggacct

SEQ ID NO: 6642598 - DNA, 13 bp, Homo sapiens
aggcactagcctt

SEQ ID NO: 6642599 - DNA, 22 bp, Homo sapiens
aggcactataatttctgtaaca

SEQ ID NO: 6642600 - DNA, 18 bp, Homo sapiens
aggcactctcctgtctga

SEQ ID NO: 6642601 - DNA, 19 bp, Homo sapiens
aggcactctgttatttaga

SEQ ID NO: 6642602 - DNA, 19 bp, Homo sapiens
aggcactgaacaggctggg

SEQ ID NO: 6642603 - DNA, 18 bp, Homo sapiens
aggcactgaagctgcggc

SEQ ID NO: 6642604 - DNA, 16 bp, Homo sapiens
aggcactgagaatgat

SEQ ID NO: 6642605 - DNA, 13 bp, Homo sapiens
aggcactgagcgc

SEQ ID NO: 6642606 - DNA, 13 bp, Homo sapiens
aggcactgaggga

SEQ ID NO: 6642607 - DNA, 14 bp, Homo sapiens
aggcactgagggat

SEQ ID NO: 6642608 - DNA, 17 bp, Homo sapiens
aggcactgagggatctg

SEQ ID NO: 6642609 - DNA, 14 bp, Homo sapiens
aggcactgccctgg

SEQ ID NO: 6642610 - DNA, 21 bp, Homo sapiens
aggcactgccctggtggccct

SEQ ID NO: 6642611 - DNA, 22 bp, Homo sapiens
aggcactgccctggtggccctc

SEQ ID NO: 6642612 - DNA, 13 bp, Homo sapiens
aggcactgccctt

SEQ ID NO: 6642613 - DNA, 18 bp, Homo sapiens
aggcactgcccttttcag

SEQ ID NO: 6642614 - DNA, 22 bp, Homo sapiens
aggcactgctgcccagcctcca

SEQ ID NO: 6642615 - DNA, 13 bp, Homo sapiens
aggcactgggcat

SEQ ID NO: 6642616 - DNA, 16 bp, Homo sapiens
aggcactgtagttcta

SEQ ID NO: 6642617 - DNA, 17 bp, Homo sapiens
aggcactgtagttctaa

SEQ ID NO: 6642618 - DNA, 13 bp, Homo sapiens
aggcactgtgaac

SEQ ID NO: 6642619 - DNA, 15 bp, Homo sapiens
aggcactgtggccct

SEQ ID NO: 6642620 - DNA, 20 bp, Homo sapiens
aggcactgttcaatactgta

SEQ ID NO: 6642621 - DNA, 17 bp, Homo sapiens
aggcactgttcatctca

SEQ ID NO: 6642622 - DNA, 22 bp, Homo sapiens
aggcacttatcagcatgaagaa

SEQ ID NO: 6642623 - DNA, 17 bp, Homo sapiens
aggcacttcatgtaaag

SEQ ID NO: 6642624 - DNA, 17 bp, Homo sapiens
aggcacttggcagcctt

SEQ ID NO: 6642625 - DNA, 14 bp, Homo sapiens
aggcactttagaaa

SEQ ID NO: 6642626 - DNA, 17 bp, Homo sapiens
aggcactttgagatgtg

SEQ ID NO: 6642627 - DNA, 20 bp, Homo sapiens
aggcactttgagatgtgttc

SEQ ID NO: 6642628 - DNA, 23 bp, Homo sapiens
aggcactttgggggtttgagggt

SEQ ID NO: 6642629 - DNA, 20 bp, Homo sapiens
aggcacttttattttcattg

SEQ ID NO: 6642630 - DNA, 20 bp, Homo sapiens
aggcactttttaacattctc

SEQ ID NO: 6642631 - DNA, 16 bp, Homo sapiens
aggcagaaaactggca

SEQ ID NO: 6642632 - DNA, 18 bp, Homo sapiens
aggcagaaaactggcagt

SEQ ID NO: 6642633 - DNA, 16 bp, Homo sapiens
aggcagaaaattgcac

SEQ ID NO: 6642634 - DNA, 22 bp, Homo sapiens
aggcagaaacctatctcaggga

SEQ ID NO: 6642635 - DNA, 15 bp, Homo sapiens
aggcagaaaggagat

SEQ ID NO: 6642636 - DNA, 14 bp, Homo sapiens
aggcagaaccctgg

SEQ ID NO: 6642637 - DNA, 22 bp, Homo sapiens
aggcagaaccctggtgaggaag

SEQ ID NO: 6642638 - DNA, 15 bp, Homo sapiens
aggcagaactcagaa

SEQ ID NO: 6642639 - DNA, 18 bp, Homo sapiens
aggcagaagaagctggga

SEQ ID NO: 6642640 - DNA, 19 bp, Homo sapiens
aggcagaagaagctgggag

SEQ ID NO: 6642641 - DNA, 21 bp, Homo sapiens
aggcagaagaatctttcttct

SEQ ID NO: 6642642 - DNA, 14 bp, Homo sapiens
aggcagaaggcagt

SEQ ID NO: 6642643 - DNA, 16 bp, Homo sapiens
aggcagaaggccagga

SEQ ID NO: 6642644 - DNA, 22 bp, Homo sapiens
aggcagaatgaacccataggga

SEQ ID NO: 6642645 - DNA, 15 bp, Homo sapiens
aggcagaatggctgc

SEQ ID NO: 6642646 - DNA, 15 bp, Homo sapiens
aggcagaatggtggg

SEQ ID NO: 6642647 - DNA, 21 bp, Homo sapiens
aggcagaatggtgggctccag

SEQ ID NO: 6642648 - DNA, 19 bp, Homo sapiens
aggcagacaagagctgctg

SEQ ID NO: 6642649 - DNA, 15 bp, Homo sapiens
aggcagacacaccgc

SEQ ID NO: 6642650 - DNA, 15 bp, Homo sapiens
aggcagacacatgct

SEQ ID NO: 6642651 - DNA, 11 bp, Homo sapiens
aggcagacacg

SEQ ID NO: 6642652 - DNA, 15 bp, Homo sapiens
aggcagacagcagct

SEQ ID NO: 6642653 - DNA, 20 bp, Homo sapiens
aggcagacagcagctcaggc

SEQ ID NO: 6642654 - DNA, 19 bp, Homo sapiens
aggcagacagcaggcagcg

SEQ ID NO: 6642655 - DNA, 17 bp, Homo sapiens
aggcagacaggaaggaa

SEQ ID NO: 6642656 - DNA, 23 bp, Homo sapiens
aggcagacctgaatcacaacggg

SEQ ID NO: 6642657 - DNA, 21 bp, Homo sapiens
aggcagacgtggggagggtgg

SEQ ID NO: 6642658 - DNA, 18 bp, Homo sapiens
aggcagactacacaggat

SEQ ID NO: 6642659 - DNA, 22 bp, Homo sapiens
aggcagacttccctgaatgtat

SEQ ID NO: 6642660 - DNA, 23 bp, Homo sapiens
aggcagagaaaacacacgctcct

SEQ ID NO: 6642661 - DNA, 15 bp, Homo sapiens
aggcagagaaagaag

SEQ ID NO: 6642662 - DNA, 17 bp, Homo sapiens
aggcagagaaagaagag

SEQ ID NO: 6642663 - DNA, 21 bp, Homo sapiens
aggcagagaaagaagagacag

SEQ ID NO: 6642664 - DNA, 14 bp, Homo sapiens
aggcagagaagaaa

SEQ ID NO: 6642665 - DNA, 12 bp, Homo sapiens
aggcagagaagt

SEQ ID NO: 6642666 - DNA, 17 bp, Homo sapiens
aggcagagaagtggagt

SEQ ID NO: 6642667 - DNA, 14 bp, Homo sapiens
aggcagagaatcat

SEQ ID NO: 6642668 - DNA, 19 bp, Homo sapiens
aggcagagaatctcttggg

SEQ ID NO: 6642669 - DNA, 18 bp, Homo sapiens
aggcagagacctccaata

SEQ ID NO: 6642670 - DNA, 13 bp, Homo sapiens
aggcagagagcgg

SEQ ID NO: 6642671 - DNA, 20 bp, Homo sapiens
aggcagagagcggtctcagg

SEQ ID NO: 6642672 - DNA, 14 bp, Homo sapiens
aggcagagcccaga

SEQ ID NO: 6642673 - DNA, 17 bp, Homo sapiens
aggcagagcgggaggga

SEQ ID NO: 6642674 - DNA, 19 bp, Homo sapiens
aggcagagcgggagggagt

SEQ ID NO: 6642675 - DNA, 20 bp, Homo sapiens
aggcagagcggggaggtgcc

SEQ ID NO: 6642676 - DNA, 22 bp, Homo sapiens
aggcagagcggggaggtgcctg

SEQ ID NO: 6642677 - DNA, 20 bp, Homo sapiens
aggcagagctggagccccca

SEQ ID NO: 6642678 - DNA, 20 bp, Homo sapiens
aggcagaggaatttggctgc

SEQ ID NO: 6642679 - DNA, 17 bp, Homo sapiens
aggcagaggcagacagg

SEQ ID NO: 6642680 - DNA, 21 bp, Homo sapiens
aggcagaggcccaggctgccg

SEQ ID NO: 6642681 - DNA, 17 bp, Homo sapiens
aggcagaggcctgggct

SEQ ID NO: 6642682 - DNA, 22 bp, Homo sapiens
aggcagaggcctgggctgggaa

SEQ ID NO: 6642683 - DNA, 13 bp, Homo sapiens
aggcagaggctgg

SEQ ID NO: 6642684 - DNA, 20 bp, Homo sapiens
aggcagaggggagcttgagg

SEQ ID NO: 6642685 - DNA, 15 bp, Homo sapiens
aggcagaggttgcag

SEQ ID NO: 6642686 - DNA, 16 bp, Homo sapiens
aggcagagtgaaataa

SEQ ID NO: 6642687 - DNA, 17 bp, Homo sapiens
aggcagagtgccccacc

SEQ ID NO: 6642688 - DNA, 21 bp, Homo sapiens
aggcagagtgccccacctgcc

SEQ ID NO: 6642689 - DNA, 20 bp, Homo sapiens
aggcagagtggcgtggcctc

SEQ ID NO: 6642690 - DNA, 22 bp, Homo sapiens
aggcagagtggcgtggcctccc

SEQ ID NO: 6642691 - DNA, 17 bp, Homo sapiens
aggcagataagaaggtg

SEQ ID NO: 6642692 - DNA, 13 bp, Homo sapiens
aggcagatacagg

SEQ ID NO: 6642693 - DNA, 15 bp, Homo sapiens
aggcagatccaggac

SEQ ID NO: 6642694 - DNA, 18 bp, Homo sapiens
aggcagatcctctggaca

SEQ ID NO: 6642695 - DNA, 20 bp, Homo sapiens
aggcagatctgtgccccatg

SEQ ID NO: 6642696 - DNA, 22 bp, Homo sapiens
aggcagatctgtgccccatgcc

SEQ ID NO: 6642697 - DNA, 23 bp, Homo sapiens
aggcagatgacctcgtactcagg

SEQ ID NO: 6642698 - DNA, 13 bp, Homo sapiens
aggcagatgccct

SEQ ID NO: 6642699 - DNA, 18 bp, Homo sapiens
aggcagatgtttgcctca

SEQ ID NO: 6642700 - DNA, 21 bp, Homo sapiens
aggcagattaataacagaaat

SEQ ID NO: 6642701 - DNA, 16 bp, Homo sapiens
aggcagattcaatttt

SEQ ID NO: 6642702 - DNA, 15 bp, Homo sapiens
aggcagattgaaaag

SEQ ID NO: 6642703 - DNA, 20 bp, Homo sapiens
aggcagattttacagagcgc

SEQ ID NO: 6642704 - DNA, 17 bp, Homo sapiens
aggcagcaacagcagag

SEQ ID NO: 6642705 - DNA, 19 bp, Homo sapiens
aggcagcaacaggaccagg

SEQ ID NO: 6642706 - DNA, 19 bp, Homo sapiens
aggcagcaaggcagtgagc

SEQ ID NO: 6642707 - DNA, 13 bp, Homo sapiens
aggcagcaccaca

SEQ ID NO: 6642708 - DNA, 19 bp, Homo sapiens
aggcagcaccacactgggt

SEQ ID NO: 6642709 - DNA, 18 bp, Homo sapiens
aggcagcaggggctgctg

SEQ ID NO: 6642710 - DNA, 20 bp, Homo sapiens
aggcagcagtgtgaggccag

SEQ ID NO: 6642711 - DNA, 19 bp, Homo sapiens
aggcagcatgcttgggctg

SEQ ID NO: 6642712 - DNA, 20 bp, Homo sapiens
aggcagcatgcttgggctga

SEQ ID NO: 6642713 - DNA, 12 bp, Homo sapiens
aggcagcattta

SEQ ID NO: 6642714 - DNA, 14 bp, Homo sapiens
aggcagccacggcc

SEQ ID NO: 6642715 - DNA, 22 bp, Homo sapiens
aggcagccacggccccgggtcc

SEQ ID NO: 6642716 - DNA, 13 bp, Homo sapiens
aggcagccagatc

SEQ ID NO: 6642717 - DNA, 15 bp, Homo sapiens
aggcagccagatccc

SEQ ID NO: 6642718 - DNA, 18 bp, Homo sapiens
aggcagccagatccccag

SEQ ID NO: 6642719 - DNA, 19 bp, Homo sapiens
aggcagccagtgccctgag

SEQ ID NO: 6642720 - DNA, 13 bp, Homo sapiens
aggcagcccagca

SEQ ID NO: 6642721 - DNA, 15 bp, Homo sapiens
aggcagcccagccct

SEQ ID NO: 6642722 - DNA, 21 bp, Homo sapiens
aggcagcccagctcctgaata

SEQ ID NO: 6642723 - DNA, 12 bp, Homo sapiens
aggcagcccagg

SEQ ID NO: 6642724 - DNA, 19 bp, Homo sapiens
aggcagccccattctgcct

SEQ ID NO: 6642725 - DNA, 15 bp, Homo sapiens
aggcagccctcacct

SEQ ID NO: 6642726 - DNA, 15 bp, Homo sapiens
aggcagccctgccat

SEQ ID NO: 6642727 - DNA, 16 bp, Homo sapiens
aggcagccgaggcctg

SEQ ID NO: 6642728 - DNA, 17 bp, Homo sapiens
aggcagccgaggcctgg

SEQ ID NO: 6642729 - DNA, 18 bp, Homo sapiens
aggcagccgaggcctggc

SEQ ID NO: 6642730 - DNA, 19 bp, Homo sapiens
aggcagccgaggtccctgc

SEQ ID NO: 6642731 - DNA, 23 bp, Homo sapiens
aggcagcctagcctatgtctggc

SEQ ID NO: 6642732 - DNA, 20 bp, Homo sapiens
aggcagcctcaaggccctcg

SEQ ID NO: 6642733 - DNA, 11 bp, Homo sapiens
aggcagcctcc

SEQ ID NO: 6642734 - DNA, 12 bp, Homo sapiens
aggcagcctcca

SEQ ID NO: 6642735 - DNA, 14 bp, Homo sapiens
aggcagcctccaga

SEQ ID NO: 6642736 - DNA, 19 bp, Homo sapiens
aggcagcctccagagccag

SEQ ID NO: 6642737 - DNA, 13 bp, Homo sapiens
aggcagcctctgg

SEQ ID NO: 6642738 - DNA, 15 bp, Homo sapiens
aggcagcctctgggg

SEQ ID NO: 6642739 - DNA, 21 bp, Homo sapiens
aggcagcctctgtcaggcctt

SEQ ID NO: 6642740 - DNA, 17 bp, Homo sapiens
aggcagcctgaacactc

SEQ ID NO: 6642741 - DNA, 12 bp, Homo sapiens
aggcagcctgag

SEQ ID NO: 6642742 - DNA, 20 bp, Homo sapiens
aggcagcctgagagctggcc

SEQ ID NO: 6642743 - DNA, 17 bp, Homo sapiens
aggcagcctgagagtct

SEQ ID NO: 6642744 - DNA, 15 bp, Homo sapiens
aggcagcctggacca

SEQ ID NO: 6642745 - DNA, 12 bp, Homo sapiens
aggcagcctgtg

SEQ ID NO: 6642746 - DNA, 12 bp, Homo sapiens
aggcagccttga

SEQ ID NO: 6642747 - DNA, 23 bp, Homo sapiens
aggcagcctttttctggccttga

SEQ ID NO: 6642748 - DNA, 16 bp, Homo sapiens
aggcagcgaccccagg

SEQ ID NO: 6642749 - DNA, 16 bp, Homo sapiens
aggcagcgacctcaag

SEQ ID NO: 6642750 - DNA, 23 bp, Homo sapiens
aggcagcgacctcaagtgtcctg

SEQ ID NO: 6642751 - DNA, 13 bp, Homo sapiens
aggcagcgcaggg

SEQ ID NO: 6642752 - DNA, 16 bp, Homo sapiens
aggcagcgcattgttt

SEQ ID NO: 6642753 - DNA, 20 bp, Homo sapiens
aggcagcgccaagcaacctg

SEQ ID NO: 6642754 - DNA, 19 bp, Homo sapiens
aggcagcgccaagtgcgtg

SEQ ID NO: 6642755 - DNA, 17 bp, Homo sapiens
aggcagcgcctgtcccc

SEQ ID NO: 6642756 - DNA, 14 bp, Homo sapiens
aggcagcgggatct

SEQ ID NO: 6642757 - DNA, 19 bp, Homo sapiens
aggcagcgtgccgagccag

SEQ ID NO: 6642758 - DNA, 21 bp, Homo sapiens
aggcagcgtgccgagccagca

SEQ ID NO: 6642759 - DNA, 22 bp, Homo sapiens
aggcagctaagatagaaagctg

SEQ ID NO: 6642760 - DNA, 23 bp, Homo sapiens
aggcagctaagatagaaagctgg

SEQ ID NO: 6642761 - DNA, 16 bp, Homo sapiens
aggcagctaaggggca

SEQ ID NO: 6642762 - DNA, 20 bp, Homo sapiens
aggcagctaggcagggaggg

SEQ ID NO: 6642763 - DNA, 15 bp, Homo sapiens
aggcagctcacccct

SEQ ID NO: 6642764 - DNA, 20 bp, Homo sapiens
aggcagctcacccctgggca

SEQ ID NO: 6642765 - DNA, 22 bp, Homo sapiens
aggcagctcacccctgggcagg

SEQ ID NO: 6642766 - DNA, 13 bp, Homo sapiens
aggcagctcagga

SEQ ID NO: 6642767 - DNA, 15 bp, Homo sapiens
aggcagctcaggata

SEQ ID NO: 6642768 - DNA, 13 bp, Homo sapiens
aggcagctccaac

SEQ ID NO: 6642769 - DNA, 20 bp, Homo sapiens
aggcagctcccaggtttaga

SEQ ID NO: 6642770 - DNA, 14 bp, Homo sapiens
aggcagctccctcc

SEQ ID NO: 6642771 - DNA, 16 bp, Homo sapiens
aggcagctcctgtttg

SEQ ID NO: 6642772 - DNA, 14 bp, Homo sapiens
aggcagctcgagca

SEQ ID NO: 6642773 - DNA, 17 bp, Homo sapiens
aggcagctcttctggag

SEQ ID NO: 6642774 - DNA, 17 bp, Homo sapiens
aggcagctgaaaagtaa

SEQ ID NO: 6642775 - DNA, 19 bp, Homo sapiens
aggcagctgaaaagtaaat

SEQ ID NO: 6642776 - DNA, 15 bp, Homo sapiens
aggcagctgaaattc

SEQ ID NO: 6642777 - DNA, 18 bp, Homo sapiens
aggcagctgatccaggca

SEQ ID NO: 6642778 - DNA, 12 bp, Homo sapiens
aggcagctgcct

SEQ ID NO: 6642779 - DNA, 18 bp, Homo sapiens
aggcagctgcctctgctc

SEQ ID NO: 6642780 - DNA, 20 bp, Homo sapiens
aggcagctgcctctgctccc

SEQ ID NO: 6642781 - DNA, 22 bp, Homo sapiens
aggcagctgcctctgctccctc

SEQ ID NO: 6642782 - DNA, 14 bp, Homo sapiens
aggcagctgctctt

SEQ ID NO: 6642783 - DNA, 18 bp, Homo sapiens
aggcagctggatgagact

SEQ ID NO: 6642784 - DNA, 14 bp, Homo sapiens
aggcagctggattg

SEQ ID NO: 6642785 - DNA, 13 bp, Homo sapiens
aggcagctggcag

SEQ ID NO: 6642786 - DNA, 15 bp, Homo sapiens
aggcagctgtgtctg

SEQ ID NO: 6642787 - DNA, 16 bp, Homo sapiens
aggcagctgtgtctga

SEQ ID NO: 6642788 - DNA, 19 bp, Homo sapiens
aggcagctgtgtctgagcc

SEQ ID NO: 6642789 - DNA, 21 bp, Homo sapiens
aggcagctgtgtctgagccca

SEQ ID NO: 6642790 - DNA, 18 bp, Homo sapiens
aggcagcttcaagtgcct

SEQ ID NO: 6642791 - DNA, 13 bp, Homo sapiens
aggcagcttctaa

SEQ ID NO: 6642792 - DNA, 21 bp, Homo sapiens
aggcagcttctactcctgcct

SEQ ID NO: 6642793 - DNA, 15 bp, Homo sapiens
aggcagcttctctgt

SEQ ID NO: 6642794 - DNA, 16 bp, Homo sapiens
aggcagcttctctgta

SEQ ID NO: 6642795 - DNA, 15 bp, Homo sapiens
aggcaggaacataca

SEQ ID NO: 6642796 - DNA, 21 bp, Homo sapiens
aggcaggaaggaactcaaggt

SEQ ID NO: 6642797 - DNA, 12 bp, Homo sapiens
aggcaggaaggg

SEQ ID NO: 6642798 - DNA, 17 bp, Homo sapiens
aggcaggaagggcagga

SEQ ID NO: 6642799 - DNA, 18 bp, Homo sapiens
aggcaggaagtcaggagc

SEQ ID NO: 6642800 - DNA, 16 bp, Homo sapiens
aggcaggaatgggggt

SEQ ID NO: 6642801 - DNA, 20 bp, Homo sapiens
aggcaggaatgggggtcaga

SEQ ID NO: 6642802 - DNA, 18 bp, Homo sapiens
aggcaggaccagaaggca

SEQ ID NO: 6642803 - DNA, 22 bp, Homo sapiens
aggcaggaccagaaggcaatca

SEQ ID NO: 6642804 - DNA, 23 bp, Homo sapiens
aggcaggaccttcgggctgtgcc

SEQ ID NO: 6642805 - DNA, 17 bp, Homo sapiens
aggcaggagaatcactt

SEQ ID NO: 6642806 - DNA, 15 bp, Homo sapiens
aggcaggagactggc

SEQ ID NO: 6642807 - DNA, 18 bp, Homo sapiens
aggcaggagactggcgtg

SEQ ID NO: 6642808 - DNA, 11 bp, Homo sapiens
aggcaggagca

SEQ ID NO: 6642809 - DNA, 18 bp, Homo sapiens
aggcaggagggcatgtgc

SEQ ID NO: 6642810 - DNA, 21 bp, Homo sapiens
aggcaggagtgctgccctctc

SEQ ID NO: 6642811 - DNA, 23 bp, Homo sapiens
aggcaggagttgggggcaggtca

SEQ ID NO: 6642812 - DNA, 20 bp, Homo sapiens
aggcaggagtttcgttttca

SEQ ID NO: 6642813 - DNA, 18 bp, Homo sapiens
aggcaggatatccccagg

SEQ ID NO: 6642814 - DNA, 18 bp, Homo sapiens
aggcaggattgaaaatgt

SEQ ID NO: 6642815 - DNA, 23 bp, Homo sapiens
aggcaggattggggaagagagcc

SEQ ID NO: 6642816 - DNA, 17 bp, Homo sapiens
aggcaggcactgtggcc

SEQ ID NO: 6642817 - DNA, 23 bp, Homo sapiens
aggcaggcagcctgagagctggc

SEQ ID NO: 6642818 - DNA, 13 bp, Homo sapiens
aggcaggcagggc

SEQ ID NO: 6642819 - DNA, 16 bp, Homo sapiens
aggcaggcagggctct

SEQ ID NO: 6642820 - DNA, 14 bp, Homo sapiens
aggcaggcatggcc

SEQ ID NO: 6642821 - DNA, 19 bp, Homo sapiens
aggcaggcatggccctggg

SEQ ID NO: 6642822 - DNA, 14 bp, Homo sapiens
aggcaggcattgag

SEQ ID NO: 6642823 - DNA, 22 bp, Homo sapiens
aggcaggccaaggccttctcct

SEQ ID NO: 6642824 - DNA, 14 bp, Homo sapiens
aggcaggccagatg

SEQ ID NO: 6642825 - DNA, 15 bp, Homo sapiens
aggcaggccagatgg

SEQ ID NO: 6642826 - DNA, 22 bp, Homo sapiens
aggcaggccagatggcccctcc

SEQ ID NO: 6642827 - DNA, 20 bp, Homo sapiens
aggcaggcccagcctctgcc

SEQ ID NO: 6642828 - DNA, 14 bp, Homo sapiens
aggcaggccgactg

SEQ ID NO: 6642829 - DNA, 20 bp, Homo sapiens
aggcaggcctccgtcttccc

SEQ ID NO: 6642830 - DNA, 16 bp, Homo sapiens
aggcaggcctgaggca

SEQ ID NO: 6642831 - DNA, 15 bp, Homo sapiens
aggcaggcggctcct

SEQ ID NO: 6642832 - DNA, 18 bp, Homo sapiens
aggcaggcggctcctcct

SEQ ID NO: 6642833 - DNA, 22 bp, Homo sapiens
aggcaggctaaggcgtggagct

SEQ ID NO: 6642834 - DNA, 23 bp, Homo sapiens
aggcaggctaaggcgtggagctg

SEQ ID NO: 6642835 - DNA, 17 bp, Homo sapiens
aggcaggctgggacgga

SEQ ID NO: 6642836 - DNA, 20 bp, Homo sapiens
aggcaggctggggaggccag

SEQ ID NO: 6642837 - DNA, 13 bp, Homo sapiens
aggcagggaagtc

SEQ ID NO: 6642838 - DNA, 19 bp, Homo sapiens
aggcagggaagtccccagg

SEQ ID NO: 6642839 - DNA, 23 bp, Homo sapiens
aggcagggaagtccccaggcccc

SEQ ID NO: 6642840 - DNA, 18 bp, Homo sapiens
aggcagggaatgcctgga

SEQ ID NO: 6642841 - DNA, 19 bp, Homo sapiens
aggcagggaatgcctggag

SEQ ID NO: 6642842 - DNA, 18 bp, Homo sapiens
aggcagggacctaaaggg

SEQ ID NO: 6642843 - DNA, 19 bp, Homo sapiens
aggcagggaggcagccgcc

SEQ ID NO: 6642844 - DNA, 13 bp, Homo sapiens
aggcagggcagag

SEQ ID NO: 6642845 - DNA, 15 bp, Homo sapiens
aggcagggcagaggg

SEQ ID NO: 6642846 - DNA, 16 bp, Homo sapiens
aggcagggcagaggga

SEQ ID NO: 6642847 - DNA, 19 bp, Homo sapiens
aggcagggcagagggaatg

SEQ ID NO: 6642848 - DNA, 12 bp, Homo sapiens
aggcagggcagg

SEQ ID NO: 6642849 - DNA, 14 bp, Homo sapiens
aggcagggccactt

SEQ ID NO: 6642850 - DNA, 21 bp, Homo sapiens
aggcagggcccttggggctgg

SEQ ID NO: 6642851 - DNA, 11 bp, Homo sapiens
aggcagggctc

SEQ ID NO: 6642852 - DNA, 12 bp, Homo sapiens
aggcagggctcc

SEQ ID NO: 6642853 - DNA, 18 bp, Homo sapiens
aggcagggctcctccctg

SEQ ID NO: 6642854 - DNA, 14 bp, Homo sapiens
aggcagggctctcc

SEQ ID NO: 6642855 - DNA, 15 bp, Homo sapiens
aggcagggctctccc

SEQ ID NO: 6642856 - DNA, 17 bp, Homo sapiens
aggcagggctgcattgg

SEQ ID NO: 6642857 - DNA, 16 bp, Homo sapiens
aggcagggctgggcca

SEQ ID NO: 6642858 - DNA, 21 bp, Homo sapiens
aggcagggctgggccaggtct

SEQ ID NO: 6642859 - DNA, 16 bp, Homo sapiens
aggcaggggaatgtat

SEQ ID NO: 6642860 - DNA, 18 bp, Homo sapiens
aggcaggggacaagggag

SEQ ID NO: 6642861 - DNA, 17 bp, Homo sapiens
aggcaggggagtagtgg

SEQ ID NO: 6642862 - DNA, 15 bp, Homo sapiens
aggcaggggagtctg

SEQ ID NO: 6642863 - DNA, 17 bp, Homo sapiens
aggcaggggagtctgct

SEQ ID NO: 6642864 - DNA, 11 bp, Homo sapiens
aggcaggggct

SEQ ID NO: 6642865 - DNA, 21 bp, Homo sapiens
aggcaggggctctgcttcctc

SEQ ID NO: 6642866 - DNA, 17 bp, Homo sapiens
aggcaggggctgctgcc

SEQ ID NO: 6642867 - DNA, 18 bp, Homo sapiens
aggcaggggctgctgcct

SEQ ID NO: 6642868 - DNA, 18 bp, Homo sapiens
aggcaggggctgggcaga

SEQ ID NO: 6642869 - DNA, 17 bp, Homo sapiens
aggcaggggcttcctgg

SEQ ID NO: 6642870 - DNA, 20 bp, Homo sapiens
aggcaggggcttggctgccc

SEQ ID NO: 6642871 - DNA, 19 bp, Homo sapiens
aggcaggggtcctgcaggt

SEQ ID NO: 6642872 - DNA, 17 bp, Homo sapiens
aggcaggggtgagagca

SEQ ID NO: 6642873 - DNA, 15 bp, Homo sapiens
aggcaggggtgggag

SEQ ID NO: 6642874 - DNA, 16 bp, Homo sapiens
aggcaggggtgggaga

SEQ ID NO: 6642875 - DNA, 20 bp, Homo sapiens
aggcaggggtgggggtggag

SEQ ID NO: 6642876 - DNA, 14 bp, Homo sapiens
aggcagggtcagga

SEQ ID NO: 6642877 - DNA, 19 bp, Homo sapiens
aggcagggtcaggagaggg

SEQ ID NO: 6642878 - DNA, 12 bp, Homo sapiens
aggcagggtctc

SEQ ID NO: 6642879 - DNA, 20 bp, Homo sapiens
aggcagggtctcactctgtc

SEQ ID NO: 6642880 - DNA, 21 bp, Homo sapiens
aggcagggtctcactctgtcg

SEQ ID NO: 6642881 - DNA, 15 bp, Homo sapiens
aggcagggtgtctgc

SEQ ID NO: 6642882 - DNA, 22 bp, Homo sapiens
aggcagggttttatctctgtct

SEQ ID NO: 6642883 - DNA, 14 bp, Homo sapiens
aggcaggtagccag

SEQ ID NO: 6642884 - DNA, 13 bp, Homo sapiens
aggcaggtcacag

SEQ ID NO: 6642885 - DNA, 16 bp, Homo sapiens
aggcaggtcacagaaa

SEQ ID NO: 6642886 - DNA, 12 bp, Homo sapiens
aggcaggtcccc

SEQ ID NO: 6642887 - DNA, 15 bp, Homo sapiens
aggcaggtccccaga

SEQ ID NO: 6642888 - DNA, 19 bp, Homo sapiens
aggcaggtcgggctgccag

SEQ ID NO: 6642889 - DNA, 16 bp, Homo sapiens
aggcaggtctgggcca

SEQ ID NO: 6642890 - DNA, 16 bp, Homo sapiens
aggcaggtgacagtga

SEQ ID NO: 6642891 - DNA, 23 bp, Homo sapiens
aggcaggtgcagggaagtgcaga

SEQ ID NO: 6642892 - DNA, 21 bp, Homo sapiens
aggcaggtgcccctctctcca

SEQ ID NO: 6642893 - DNA, 15 bp, Homo sapiens
aggcaggtgcctcca

SEQ ID NO: 6642894 - DNA, 15 bp, Homo sapiens
aggcaggtgcctgga

SEQ ID NO: 6642895 - DNA, 11 bp, Homo sapiens
aggcaggtgct

SEQ ID NO: 6642896 - DNA, 22 bp, Homo sapiens
aggcaggtgcttttggcagaga

SEQ ID NO: 6642897 - DNA, 15 bp, Homo sapiens
aggcaggtggagaga

SEQ ID NO: 6642898 - DNA, 12 bp, Homo sapiens
aggcaggtttca

SEQ ID NO: 6642899 - DNA, 22 bp, Homo sapiens
aggcaggtttgccagtgaagac

SEQ ID NO: 6642900 - DNA, 17 bp, Homo sapiens
aggcagtaaggtagaaa

SEQ ID NO: 6642901 - DNA, 19 bp, Homo sapiens
aggcagtaataaaaagatt

SEQ ID NO: 6642902 - DNA, 23 bp, Homo sapiens
aggcagtaggacaaggtgcaggc

SEQ ID NO: 6642903 - DNA, 23 bp, Homo sapiens
aggcagtattccctttttaaatg

SEQ ID NO: 6642904 - DNA, 14 bp, Homo sapiens
aggcagtcccggga

SEQ ID NO: 6642905 - DNA, 19 bp, Homo sapiens
aggcagtcgggggctggcc

SEQ ID NO: 6642906 - DNA, 21 bp, Homo sapiens
aggcagtcgggggctggccta

SEQ ID NO: 6642907 - DNA, 13 bp, Homo sapiens
aggcagtctctat

SEQ ID NO: 6642908 - DNA, 14 bp, Homo sapiens
aggcagtctgaacc

SEQ ID NO: 6642909 - DNA, 15 bp, Homo sapiens
aggcagtctgaaccc

SEQ ID NO: 6642910 - DNA, 14 bp, Homo sapiens
aggcagtctttgct

SEQ ID NO: 6642911 - DNA, 21 bp, Homo sapiens
aggcagtgaacacactcagca

SEQ ID NO: 6642912 - DNA, 20 bp, Homo sapiens
aggcagtgatgacttgctgt

SEQ ID NO: 6642913 - DNA, 22 bp, Homo sapiens
aggcagtgcaagagactctggc

SEQ ID NO: 6642914 - DNA, 17 bp, Homo sapiens
aggcagtgcatgcatgt

SEQ ID NO: 6642915 - DNA, 18 bp, Homo sapiens
aggcagtgcatgcatgtt

SEQ ID NO: 6642916 - DNA, 15 bp, Homo sapiens
aggcagtgcatgtga

SEQ ID NO: 6642917 - DNA, 19 bp, Homo sapiens
aggcagtgcatgtgaagca

SEQ ID NO: 6642918 - DNA, 22 bp, Homo sapiens
aggcagtgcctgctctgctgtg

SEQ ID NO: 6642919 - DNA, 20 bp, Homo sapiens
aggcagtggcaggggagcag

SEQ ID NO: 6642920 - DNA, 13 bp, Homo sapiens
aggcagtggccca

SEQ ID NO: 6642921 - DNA, 13 bp, Homo sapiens
aggcagtgggagg

SEQ ID NO: 6642922 - DNA, 16 bp, Homo sapiens
aggcagtgggaggcaa

SEQ ID NO: 6642923 - DNA, 13 bp, Homo sapiens
aggcagtggggct

SEQ ID NO: 6642924 - DNA, 14 bp, Homo sapiens
aggcagtgtcattt

SEQ ID NO: 6642925 - DNA, 21 bp, Homo sapiens
aggcagtgtcatttgctctgc

SEQ ID NO: 6642926 - DNA, 15 bp, Homo sapiens
aggcagtgtcttaag

SEQ ID NO: 6642927 - DNA, 18 bp, Homo sapiens
aggcagttaccattaaac

SEQ ID NO: 6642928 - DNA, 22 bp, Homo sapiens
aggcagttaccattaaaccatc

SEQ ID NO: 6642929 - DNA, 18 bp, Homo sapiens
aggcagttcaaagcagga

SEQ ID NO: 6642930 - DNA, 19 bp, Homo sapiens
aggcagttcaaagcaggat

SEQ ID NO: 6642931 - DNA, 13 bp, Homo sapiens
aggcagttctaga

SEQ ID NO: 6642932 - DNA, 14 bp, Homo sapiens
aggcagttctagaa

SEQ ID NO: 6642933 - DNA, 15 bp, Homo sapiens
aggcagttctagaag

SEQ ID NO: 6642934 - DNA, 18 bp, Homo sapiens
aggcagttctgtgtcctc

SEQ ID NO: 6642935 - DNA, 21 bp, Homo sapiens
aggcagttctgtgtcctcgca

SEQ ID NO: 6642936 - DNA, 16 bp, Homo sapiens
aggcagttgaacctga

SEQ ID NO: 6642937 - DNA, 19 bp, Homo sapiens
aggcagttgcccagcctct

SEQ ID NO: 6642938 - DNA, 23 bp, Homo sapiens
aggcagtttcagagatggacaga

SEQ ID NO: 6642939 - DNA, 20 bp, Homo sapiens
aggcagtttgaggattagtt

SEQ ID NO: 6642940 - DNA, 23 bp, Homo sapiens
aggcagtttgaggattagtttag

SEQ ID NO: 6642941 - DNA, 12 bp, Homo sapiens
aggcagttttct

SEQ ID NO: 6642942 - DNA, 18 bp, Homo sapiens
aggcataaacctgtgctg

SEQ ID NO: 6642943 - DNA, 15 bp, Homo sapiens
aggcataaagtcagg

SEQ ID NO: 6642944 - DNA, 13 bp, Homo sapiens
aggcatactagta

SEQ ID NO: 6642945 - DNA, 21 bp, Homo sapiens
aggcatactgccttgtttaat

SEQ ID NO: 6642946 - DNA, 14 bp, Homo sapiens
aggcatacttttaa

SEQ ID NO: 6642947 - DNA, 16 bp, Homo sapiens
aggcatacttttaatc

SEQ ID NO: 6642948 - DNA, 13 bp, Homo sapiens
aggcatagaggga

SEQ ID NO: 6642949 - DNA, 13 bp, Homo sapiens
aggcataggcctg

SEQ ID NO: 6642950 - DNA, 18 bp, Homo sapiens
aggcataggcctgggtgc

SEQ ID NO: 6642951 - DNA, 20 bp, Homo sapiens
aggcataggcctgggtgctg

SEQ ID NO: 6642952 - DNA, 18 bp, Homo sapiens
aggcatatcatgctttga

SEQ ID NO: 6642953 - DNA, 19 bp, Homo sapiens
aggcatatgcttctttaaa

SEQ ID NO: 6642954 - DNA, 19 bp, Homo sapiens
aggcatatgtttccccatc

SEQ ID NO: 6642955 - DNA, 15 bp, Homo sapiens
aggcatattattttc

SEQ ID NO: 6642956 - DNA, 14 bp, Homo sapiens
aggcatcacagcta

SEQ ID NO: 6642957 - DNA, 14 bp, Homo sapiens
aggcatcactgatt

SEQ ID NO: 6642958 - DNA, 16 bp, Homo sapiens
aggcatcactttcctg

SEQ ID NO: 6642959 - DNA, 18 bp, Homo sapiens
aggcatcactttcctgga

SEQ ID NO: 6642960 - DNA, 11 bp, Homo sapiens
aggcatcagga

SEQ ID NO: 6642961 - DNA, 20 bp, Homo sapiens
aggcatcagtccctatgtat

SEQ ID NO: 6642962 - DNA, 16 bp, Homo sapiens
aggcatcatgcagagt

SEQ ID NO: 6642963 - DNA, 21 bp, Homo sapiens
aggcatcatggaaagactggg

SEQ ID NO: 6642964 - DNA, 18 bp, Homo sapiens
aggcatcattttcacctc

SEQ ID NO: 6642965 - DNA, 20 bp, Homo sapiens
aggcatccagcagtctctgc

SEQ ID NO: 6642966 - DNA, 16 bp, Homo sapiens
aggcatccaggccagg

SEQ ID NO: 6642967 - DNA, 21 bp, Homo sapiens
aggcatccatagtgcactagc

SEQ ID NO: 6642968 - DNA, 12 bp, Homo sapiens
aggcatcccaag

SEQ ID NO: 6642969 - DNA, 23 bp, Homo sapiens
aggcatcccagcctgggggccag

SEQ ID NO: 6642970 - DNA, 16 bp, Homo sapiens
aggcatcccaggggac

SEQ ID NO: 6642971 - DNA, 17 bp, Homo sapiens
aggcatcccaggggacc

SEQ ID NO: 6642972 - DNA, 14 bp, Homo sapiens
aggcatccccagtg

SEQ ID NO: 6642973 - DNA, 20 bp, Homo sapiens
aggcatccccagtgccagct

SEQ ID NO: 6642974 - DNA, 21 bp, Homo sapiens
aggcatccccagtgccagctg

SEQ ID NO: 6642975 - DNA, 20 bp, Homo sapiens
aggcatccttcctcacacca

SEQ ID NO: 6642976 - DNA, 18 bp, Homo sapiens
aggcatctaagacattca

SEQ ID NO: 6642977 - DNA, 20 bp, Homo sapiens
aggcatctacacagcctgga

SEQ ID NO: 6642978 - DNA, 13 bp, Homo sapiens
aggcatctatctg

SEQ ID NO: 6642979 - DNA, 13 bp, Homo sapiens
aggcatctccctt

SEQ ID NO: 6642980 - DNA, 17 bp, Homo sapiens
aggcatctcctctcccc

SEQ ID NO: 6642981 - DNA, 17 bp, Homo sapiens
aggcatctctctgggat

SEQ ID NO: 6642982 - DNA, 17 bp, Homo sapiens
aggcatctgaactttta

SEQ ID NO: 6642983 - DNA, 14 bp, Homo sapiens
aggcatctgagggg

SEQ ID NO: 6642984 - DNA, 14 bp, Homo sapiens
aggcatctgcaccc

SEQ ID NO: 6642985 - DNA, 19 bp, Homo sapiens
aggcatctgtaagaagtag

SEQ ID NO: 6642986 - DNA, 23 bp, Homo sapiens
aggcatctgttagcagagtctgt

SEQ ID NO: 6642987 - DNA, 23 bp, Homo sapiens
aggcatcttttctagagacacat

SEQ ID NO: 6642988 - DNA, 19 bp, Homo sapiens
aggcatgaacacacatgga

SEQ ID NO: 6642989 - DNA, 19 bp, Homo sapiens
aggcatgaatcactgtgct

SEQ ID NO: 6642990 - DNA, 21 bp, Homo sapiens
aggcatgaccctggagcccgg

SEQ ID NO: 6642991 - DNA, 21 bp, Homo sapiens
aggcatgagccactgtgcctg

SEQ ID NO: 6642992 - DNA, 15 bp, Homo sapiens
aggcatgagggatca

SEQ ID NO: 6642993 - DNA, 20 bp, Homo sapiens
aggcatgatgatctgcctct

SEQ ID NO: 6642994 - DNA, 18 bp, Homo sapiens
aggcatgcacatctggaa

SEQ ID NO: 6642995 - DNA, 13 bp, Homo sapiens
aggcatgcagctg

SEQ ID NO: 6642996 - DNA, 15 bp, Homo sapiens
aggcatgcagctgcc

SEQ ID NO: 6642997 - DNA, 21 bp, Homo sapiens
aggcatgcagctgcctggggc

SEQ ID NO: 6642998 - DNA, 21 bp, Homo sapiens
aggcatgcagtcatgagaatt

SEQ ID NO: 6642999 - DNA, 23 bp, Homo sapiens
aggcatgcctctgatatgggact

SEQ ID NO: 6643000 - DNA, 15 bp, Homo sapiens
aggcatgcctgtgtg

SEQ ID NO: 6643001 - DNA, 20 bp, Homo sapiens
aggcatgcgaatgagctggg

SEQ ID NO: 6643002 - DNA, 22 bp, Homo sapiens
aggcatgctggagtacccagcc

SEQ ID NO: 6643003 - DNA, 23 bp, Homo sapiens
aggcatgctggagtacccagcct

SEQ ID NO: 6643004 - DNA, 14 bp, Homo sapiens
aggcatgctggcct

SEQ ID NO: 6643005 - DNA, 16 bp, Homo sapiens
aggcatgctggcctcc

SEQ ID NO: 6643006 - DNA, 15 bp, Homo sapiens
aggcatggaaaccaa

SEQ ID NO: 6643007 - DNA, 17 bp, Homo sapiens
aggcatggaaagatggg

SEQ ID NO: 6643008 - DNA, 18 bp, Homo sapiens
aggcatggaaagatgggg

SEQ ID NO: 6643009 - DNA, 21 bp, Homo sapiens
aggcatggaaagatggggagc

SEQ ID NO: 6643010 - DNA, 22 bp, Homo sapiens
aggcatggcaattctggaagct

SEQ ID NO: 6643011 - DNA, 14 bp, Homo sapiens
aggcatggccctgg

SEQ ID NO: 6643012 - DNA, 23 bp, Homo sapiens
aggcatggctcagagcttgaaga

SEQ ID NO: 6643013 - DNA, 21 bp, Homo sapiens
aggcatggctcagatcggcca

SEQ ID NO: 6643014 - DNA, 22 bp, Homo sapiens
aggcatggctggtgcctgaaga

SEQ ID NO: 6643015 - DNA, 13 bp, Homo sapiens
aggcatggcttcc

SEQ ID NO: 6643016 - DNA, 17 bp, Homo sapiens
aggcatgggccaccacg

SEQ ID NO: 6643017 - DNA, 22 bp, Homo sapiens
aggcatggggcatgtcctttcc

SEQ ID NO: 6643018 - DNA, 20 bp, Homo sapiens
aggcatgggtgcaaggaaaa

SEQ ID NO: 6643019 - DNA, 20 bp, Homo sapiens
aggcatggtcccttaaggca

SEQ ID NO: 6643020 - DNA, 21 bp, Homo sapiens
aggcatggtcccttaaggcac

SEQ ID NO: 6643021 - DNA, 22 bp, Homo sapiens
aggcatggtcgggggagagggc

SEQ ID NO: 6643022 - DNA, 12 bp, Homo sapiens
aggcatggtgga

SEQ ID NO: 6643023 - DNA, 20 bp, Homo sapiens
aggcatggtggcacacgcct

SEQ ID NO: 6643024 - DNA, 19 bp, Homo sapiens
aggcatgtcagaggacccc

SEQ ID NO: 6643025 - DNA, 17 bp, Homo sapiens
aggcatgtcccacccac

SEQ ID NO: 6643026 - DNA, 18 bp, Homo sapiens
aggcatgtcccacccacc

SEQ ID NO: 6643027 - DNA, 15 bp, Homo sapiens
aggcatgtcttacgt

SEQ ID NO: 6643028 - DNA, 19 bp, Homo sapiens
aggcatgtgatgagaggaa

SEQ ID NO: 6643029 - DNA, 24 bp, Homo sapiens
aggcatgtgatgagaggaaatcac

SEQ ID NO: 6643030 - DNA, 14 bp, Homo sapiens
aggcatgtgctggt

SEQ ID NO: 6643031 - DNA, 14 bp, Homo sapiens
aggcatgtggcctt

SEQ ID NO: 6643032 - DNA, 17 bp, Homo sapiens
aggcatgtgtctggccc

SEQ ID NO: 6643033 - DNA, 18 bp, Homo sapiens
aggcatgtgtctggccct

SEQ ID NO: 6643034 - DNA, 18 bp, Homo sapiens
aggcatgtgtgaaacata

SEQ ID NO: 6643035 - DNA, 21 bp, Homo sapiens
aggcatgttcagggatgctca

SEQ ID NO: 6643036 - DNA, 18 bp, Homo sapiens
aggcatgttctctgagga

SEQ ID NO: 6643037 - DNA, 19 bp, Homo sapiens
aggcatgttttaaaatcta

SEQ ID NO: 6643038 - DNA, 17 bp, Homo sapiens
aggcattaaatgcaaaa

SEQ ID NO: 6643039 - DNA, 21 bp, Homo sapiens
aggcattaaatgcaaaaatat

SEQ ID NO: 6643040 - DNA, 14 bp, Homo sapiens
aggcattaaatttt

SEQ ID NO: 6643041 - DNA, 16 bp, Homo sapiens
aggcattaatgtttct

SEQ ID NO: 6643042 - DNA, 20 bp, Homo sapiens
aggcattaatgtttctatct

SEQ ID NO: 6643043 - DNA, 23 bp, Homo sapiens
aggcattactggccttttcactg

SEQ ID NO: 6643044 - DNA, 15 bp, Homo sapiens
aggcattatttaatg

SEQ ID NO: 6643045 - DNA, 20 bp, Homo sapiens
aggcattatttaatgtttga

SEQ ID NO: 6643046 - DNA, 12 bp, Homo sapiens
aggcattcaagt

SEQ ID NO: 6643047 - DNA, 14 bp, Homo sapiens
aggcattccacagg

SEQ ID NO: 6643048 - DNA, 24 bp, Homo sapiens
aggcattccagctcctccgtgctt

SEQ ID NO: 6643049 - DNA, 22 bp, Homo sapiens
aggcattcccagaggtggggaa

SEQ ID NO: 6643050 - DNA, 18 bp, Homo sapiens
aggcattcctgaagggaa

SEQ ID NO: 6643051 - DNA, 15 bp, Homo sapiens
aggcattctcccagc

SEQ ID NO: 6643052 - DNA, 15 bp, Homo sapiens
aggcattctggacct

SEQ ID NO: 6643053 - DNA, 16 bp, Homo sapiens
aggcattctggacctc

SEQ ID NO: 6643054 - DNA, 22 bp, Homo sapiens
aggcattgacataggtcataaa

SEQ ID NO: 6643055 - DNA, 16 bp, Homo sapiens
aggcattgagggctct

SEQ ID NO: 6643056 - DNA, 13 bp, Homo sapiens
aggcattgcacag

SEQ ID NO: 6643057 - DNA, 22 bp, Homo sapiens
aggcattgcactaaaagtgatg

SEQ ID NO: 6643058 - DNA, 22 bp, Homo sapiens
aggcattgctttgccctggagc

SEQ ID NO: 6643059 - DNA, 16 bp, Homo sapiens
aggcattgtcctgtga

SEQ ID NO: 6643060 - DNA, 19 bp, Homo sapiens
aggcattgtgatgtttagg

SEQ ID NO: 6643061 - DNA, 18 bp, Homo sapiens
aggcatttcccaccctga

SEQ ID NO: 6643062 - DNA, 14 bp, Homo sapiens
aggcatttcctgct

SEQ ID NO: 6643063 - DNA, 22 bp, Homo sapiens
aggcatttcctgctgaacgttt

SEQ ID NO: 6643064 - DNA, 13 bp, Homo sapiens
aggcatttcctgg

SEQ ID NO: 6643065 - DNA, 16 bp, Homo sapiens
aggcatttcctgggtg

SEQ ID NO: 6643066 - DNA, 20 bp, Homo sapiens
aggcatttctatcacatatt

SEQ ID NO: 6643067 - DNA, 18 bp, Homo sapiens
aggcatttgagcagctga

SEQ ID NO: 6643068 - DNA, 23 bp, Homo sapiens
aggcatttgcctaattcctggca

SEQ ID NO: 6643069 - DNA, 20 bp, Homo sapiens
aggcatttgctgaatacaga

SEQ ID NO: 6643070 - DNA, 19 bp, Homo sapiens
aggcatttgtaaatattaa

SEQ ID NO: 6643071 - DNA, 22 bp, Homo sapiens
aggcatttgtcttagagagaga

SEQ ID NO: 6643072 - DNA, 14 bp, Homo sapiens
aggcatttgtcttt

SEQ ID NO: 6643073 - DNA, 15 bp, Homo sapiens
aggcatttttaccat

SEQ ID NO: 6643074 - DNA, 23 bp, Homo sapiens
aggcatttttactactattctgt

SEQ ID NO: 6643075 - DNA, 13 bp, Homo sapiens
aggccaaaaaaat

SEQ ID NO: 6643076 - DNA, 13 bp, Homo sapiens
aggccaaaacaga

SEQ ID NO: 6643077 - DNA, 19 bp, Homo sapiens
aggccaaacacccaagcac

SEQ ID NO: 6643078 - DNA, 14 bp, Homo sapiens
aggccaaacctctg

SEQ ID NO: 6643079 - DNA, 15 bp, Homo sapiens
aggccaaacctctgt

SEQ ID NO: 6643080 - DNA, 19 bp, Homo sapiens
aggccaaactgtccctccc

SEQ ID NO: 6643081 - DNA, 20 bp, Homo sapiens
aggccaaactgtccctccct

SEQ ID NO: 6643082 - DNA, 17 bp, Homo sapiens
aggccaaagacaaatag

SEQ ID NO: 6643083 - DNA, 19 bp, Homo sapiens
aggccaaagacctcccaag

SEQ ID NO: 6643084 - DNA, 14 bp, Homo sapiens
aggccaaagataaa

SEQ ID NO: 6643085 - DNA, 15 bp, Homo sapiens
aggccaaagataaaa

SEQ ID NO: 6643086 - DNA, 12 bp, Homo sapiens
aggccaaagccc

SEQ ID NO: 6643087 - DNA, 15 bp, Homo sapiens
aggccaaagccccat

SEQ ID NO: 6643088 - DNA, 20 bp, Homo sapiens
aggccaaagccccatgtgcc

SEQ ID NO: 6643089 - DNA, 16 bp, Homo sapiens
aggccaaaggctggtg

SEQ ID NO: 6643090 - DNA, 21 bp, Homo sapiens
aggccaaatattgatctgtat

SEQ ID NO: 6643091 - DNA, 16 bp, Homo sapiens
aggccaaatgcacaag

SEQ ID NO: 6643092 - DNA, 14 bp, Homo sapiens
aggccaacagcatt

SEQ ID NO: 6643093 - DNA, 15 bp, Homo sapiens
aggccaaccctcctc

SEQ ID NO: 6643094 - DNA, 15 bp, Homo sapiens
aggccaactgccccg

SEQ ID NO: 6643095 - DNA, 19 bp, Homo sapiens
aggccaagaatattgcaaa

SEQ ID NO: 6643096 - DNA, 18 bp, Homo sapiens
aggccaagagcagaggca

SEQ ID NO: 6643097 - DNA, 15 bp, Homo sapiens
aggccaagagtggcc

SEQ ID NO: 6643098 - DNA, 18 bp, Homo sapiens
aggccaagagtggcccca

SEQ ID NO: 6643099 - DNA, 22 bp, Homo sapiens
aggccaagagtggccccacctg

SEQ ID NO: 6643100 - DNA, 19 bp, Homo sapiens
aggccaagcagtgcctgcc

SEQ ID NO: 6643101 - DNA, 13 bp, Homo sapiens
aggccaagcctgc

SEQ ID NO: 6643102 - DNA, 17 bp, Homo sapiens
aggccaagctgaagtga

SEQ ID NO: 6643103 - DNA, 22 bp, Homo sapiens
aggccaagctgaagtgaaggag

SEQ ID NO: 6643104 - DNA, 11 bp, Homo sapiens
aggccaaggcc

SEQ ID NO: 6643105 - DNA, 16 bp, Homo sapiens
aggccaaggcccaact

SEQ ID NO: 6643106 - DNA, 12 bp, Homo sapiens
aggccaaggcct

SEQ ID NO: 6643107 - DNA, 13 bp, Homo sapiens
aggccaaggcctc

SEQ ID NO: 6643108 - DNA, 14 bp, Homo sapiens
aggccaaggcctca

SEQ ID NO: 6643109 - DNA, 17 bp, Homo sapiens
aggccaaggccttctcc

SEQ ID NO: 6643110 - DNA, 13 bp, Homo sapiens
aggccaaggcggg

SEQ ID NO: 6643111 - DNA, 16 bp, Homo sapiens
aggccaaggcgggtgg

SEQ ID NO: 6643112 - DNA, 19 bp, Homo sapiens
aggccaagtctaatgaaga

SEQ ID NO: 6643113 - DNA, 21 bp, Homo sapiens
aggccaagtctaatgaagaga

SEQ ID NO: 6643114 - DNA, 14 bp, Homo sapiens
aggccaagtgcagg

SEQ ID NO: 6643115 - DNA, 19 bp, Homo sapiens
aggccaataataaagacat

SEQ ID NO: 6643116 - DNA, 20 bp, Homo sapiens
aggccaatcagaagctaaca

SEQ ID NO: 6643117 - DNA, 15 bp, Homo sapiens
aggccaatcccttct

SEQ ID NO: 6643118 - DNA, 16 bp, Homo sapiens
aggccaatcccttctc

SEQ ID NO: 6643119 - DNA, 21 bp, Homo sapiens
aggccaatgggctagagggtg

SEQ ID NO: 6643120 - DNA, 16 bp, Homo sapiens
aggccaatgttgctga

SEQ ID NO: 6643121 - DNA, 15 bp, Homo sapiens
aggccacaagaccct

SEQ ID NO: 6643122 - DNA, 20 bp, Homo sapiens
aggccacaagacccttgtgg

SEQ ID NO: 6643123 - DNA, 16 bp, Homo sapiens
aggccacacccagagt

SEQ ID NO: 6643124 - DNA, 21 bp, Homo sapiens
aggccacacgcactggtgcca

SEQ ID NO: 6643125 - DNA, 15 bp, Homo sapiens
aggccacacgctgcc

SEQ ID NO: 6643126 - DNA, 16 bp, Homo sapiens
aggccacacgctgccc

SEQ ID NO: 6643127 - DNA, 17 bp, Homo sapiens
aggccacacgctgccca

SEQ ID NO: 6643128 - DNA, 17 bp, Homo sapiens
aggccacactcagcaca

SEQ ID NO: 6643129 - DNA, 18 bp, Homo sapiens
aggccacactcagcacaa

SEQ ID NO: 6643130 - DNA, 19 bp, Homo sapiens
aggccacactttctgggaa

SEQ ID NO: 6643131 - DNA, 23 bp, Homo sapiens
aggccacagaaggtgaactttgt

SEQ ID NO: 6643132 - DNA, 13 bp, Homo sapiens
aggccacaggaga

SEQ ID NO: 6643133 - DNA, 18 bp, Homo sapiens
aggccacaggagacatta

SEQ ID NO: 6643134 - DNA, 14 bp, Homo sapiens
aggccacaggcagt

SEQ ID NO: 6643135 - DNA, 17 bp, Homo sapiens
aggccacaggcagtcca

SEQ ID NO: 6643136 - DNA, 17 bp, Homo sapiens
aggccacagtggggctg

SEQ ID NO: 6643137 - DNA, 23 bp, Homo sapiens
aggccacagtggggctgcaggca

SEQ ID NO: 6643138 - DNA, 14 bp, Homo sapiens
aggccacatgggag

SEQ ID NO: 6643139 - DNA, 15 bp, Homo sapiens
aggccacattgctgg

SEQ ID NO: 6643140 - DNA, 17 bp, Homo sapiens
aggccacattgctggct

SEQ ID NO: 6643141 - DNA, 14 bp, Homo sapiens
aggccaccagctgc

SEQ ID NO: 6643142 - DNA, 20 bp, Homo sapiens
aggccaccattataatttat

SEQ ID NO: 6643143 - DNA, 21 bp, Homo sapiens
aggccaccattataatttata

SEQ ID NO: 6643144 - DNA, 15 bp, Homo sapiens
aggccacccactgac

SEQ ID NO: 6643145 - DNA, 17 bp, Homo sapiens
aggccacccactgaccc

SEQ ID NO: 6643146 - DNA, 18 bp, Homo sapiens
aggccacccactgtgggg

SEQ ID NO: 6643147 - DNA, 13 bp, Homo sapiens
aggccaccccaaa

SEQ ID NO: 6643148 - DNA, 21 bp, Homo sapiens
aggccaccccaaaccccagcc

SEQ ID NO: 6643149 - DNA, 15 bp, Homo sapiens
aggccaccccaacct

SEQ ID NO: 6643150 - DNA, 21 bp, Homo sapiens
aggccaccccaacctctgttc

SEQ ID NO: 6643151 - DNA, 21 bp, Homo sapiens
aggccaccccctatcctctga

SEQ ID NO: 6643152 - DNA, 17 bp, Homo sapiens
aggccacccgggctgcc

SEQ ID NO: 6643153 - DNA, 19 bp, Homo sapiens
aggccacccgggctgcctg

SEQ ID NO: 6643154 - DNA, 21 bp, Homo sapiens
aggccaccgggacagacctgg

SEQ ID NO: 6643155 - DNA, 15 bp, Homo sapiens
aggccacctatgcca

SEQ ID NO: 6643156 - DNA, 14 bp, Homo sapiens
aggccacctcagtc

SEQ ID NO: 6643157 - DNA, 21 bp, Homo sapiens
aggccacctcccactcctgct

SEQ ID NO: 6643158 - DNA, 14 bp, Homo sapiens
aggccacctcccca

SEQ ID NO: 6643159 - DNA, 17 bp, Homo sapiens
aggccacctccccagca

SEQ ID NO: 6643160 - DNA, 12 bp, Homo sapiens
aggccacctcct

SEQ ID NO: 6643161 - DNA, 13 bp, Homo sapiens
aggccacctccta

SEQ ID NO: 6643162 - DNA, 21 bp, Homo sapiens
aggccacctcctaaaaggccc

SEQ ID NO: 6643163 - DNA, 23 bp, Homo sapiens
aggccacctcctaaaaggcccag

SEQ ID NO: 6643164 - DNA, 11 bp, Homo sapiens
aggccacctct

SEQ ID NO: 6643165 - DNA, 12 bp, Homo sapiens
aggccacctctc

SEQ ID NO: 6643166 - DNA, 15 bp, Homo sapiens
aggccacctctccaa

SEQ ID NO: 6643167 - DNA, 18 bp, Homo sapiens
aggccacctctccaaggg

SEQ ID NO: 6643168 - DNA, 19 bp, Homo sapiens
aggccacctctccaagggc

SEQ ID NO: 6643169 - DNA, 21 bp, Homo sapiens
aggccacctcttcctggccgg

SEQ ID NO: 6643170 - DNA, 19 bp, Homo sapiens
aggccacctgcccccttct

SEQ ID NO: 6643171 - DNA, 21 bp, Homo sapiens
aggccacctgcccccttctcc

SEQ ID NO: 6643172 - DNA, 22 bp, Homo sapiens
aggccacctgcccccttctccc

SEQ ID NO: 6643173 - DNA, 18 bp, Homo sapiens
aggccacgctcaggcccg

SEQ ID NO: 6643174 - DNA, 16 bp, Homo sapiens
aggccacgggggaggc

SEQ ID NO: 6643175 - DNA, 22 bp, Homo sapiens
aggccacgggggaggccgaggc

SEQ ID NO: 6643176 - DNA, 20 bp, Homo sapiens
aggccacgtatagtcctagc

SEQ ID NO: 6643177 - DNA, 14 bp, Homo sapiens
aggccactcagagg

SEQ ID NO: 6643178 - DNA, 15 bp, Homo sapiens
aggccactcagaggc

SEQ ID NO: 6643179 - DNA, 21 bp, Homo sapiens
aggccactcagaggcccccag

SEQ ID NO: 6643180 - DNA, 23 bp, Homo sapiens
aggccactcagaggcccccagtg

SEQ ID NO: 6643181 - DNA, 16 bp, Homo sapiens
aggccactgaagagga

SEQ ID NO: 6643182 - DNA, 12 bp, Homo sapiens
aggccactgacc

SEQ ID NO: 6643183 - DNA, 16 bp, Homo sapiens
aggccactgggccctg

SEQ ID NO: 6643184 - DNA, 17 bp, Homo sapiens
aggccactgtggccaga

SEQ ID NO: 6643185 - DNA, 20 bp, Homo sapiens
aggccactgtggccagagct

SEQ ID NO: 6643186 - DNA, 14 bp, Homo sapiens
aggccactgtgttc

SEQ ID NO: 6643187 - DNA, 20 bp, Homo sapiens
aggccactgtgttccttccg

SEQ ID NO: 6643188 - DNA, 13 bp, Homo sapiens
aggccacttgctc

SEQ ID NO: 6643189 - DNA, 14 bp, Homo sapiens
aggccacttgctca

SEQ ID NO: 6643190 - DNA, 15 bp, Homo sapiens
aggccacttgctcag

SEQ ID NO: 6643191 - DNA, 19 bp, Homo sapiens
aggccacttgctcagacga

SEQ ID NO: 6643192 - DNA, 17 bp, Homo sapiens
aggccacttgcttgctg

SEQ ID NO: 6643193 - DNA, 16 bp, Homo sapiens
aggccagaaaaggcag

SEQ ID NO: 6643194 - DNA, 20 bp, Homo sapiens
aggccagaaaaggcagccag

SEQ ID NO: 6643195 - DNA, 21 bp, Homo sapiens
aggccagaaaaggcagccaga

SEQ ID NO: 6643196 - DNA, 22 bp, Homo sapiens
aggccagaaaaggcagccagat

SEQ ID NO: 6643197 - DNA, 22 bp, Homo sapiens
aggccagaaaggtgtgaggaga

SEQ ID NO: 6643198 - DNA, 15 bp, Homo sapiens
aggccagaaggaggg

SEQ ID NO: 6643199 - DNA, 16 bp, Homo sapiens
aggccagacacaggcc

SEQ ID NO: 6643200 - DNA, 17 bp, Homo sapiens
aggccagacacaggccg

SEQ ID NO: 6643201 - DNA, 22 bp, Homo sapiens
aggccagacatggtgtctcaca

SEQ ID NO: 6643202 - DNA, 21 bp, Homo sapiens
aggccagacttggtcctaagc

SEQ ID NO: 6643203 - DNA, 12 bp, Homo sapiens
aggccagagaaa

SEQ ID NO: 6643204 - DNA, 15 bp, Homo sapiens
aggccagagaaagca

SEQ ID NO: 6643205 - DNA, 17 bp, Homo sapiens
aggccagagaaagcaaa

SEQ ID NO: 6643206 - DNA, 12 bp, Homo sapiens
aggccagagaca

SEQ ID NO: 6643207 - DNA, 23 bp, Homo sapiens
aggccagagacacaagccttcgg

SEQ ID NO: 6643208 - DNA, 15 bp, Homo sapiens
aggccagagagggaa

SEQ ID NO: 6643209 - DNA, 21 bp, Homo sapiens
aggccagagcaaacagaaaaa

SEQ ID NO: 6643210 - DNA, 14 bp, Homo sapiens
aggccagagcccac

SEQ ID NO: 6643211 - DNA, 18 bp, Homo sapiens
aggccagaggcccccagc

SEQ ID NO: 6643212 - DNA, 20 bp, Homo sapiens
aggccagaggtgctgtcagc

SEQ ID NO: 6643213 - DNA, 20 bp, Homo sapiens
aggccagagtctcccagtgg

SEQ ID NO: 6643214 - DNA, 20 bp, Homo sapiens
aggccagagtggcctggcca

SEQ ID NO: 6643215 - DNA, 15 bp, Homo sapiens
aggccagatggcccc

SEQ ID NO: 6643216 - DNA, 13 bp, Homo sapiens
aggccagcaacgc

SEQ ID NO: 6643217 - DNA, 15 bp, Homo sapiens
aggccagcaaggtgg

SEQ ID NO: 6643218 - DNA, 18 bp, Homo sapiens
aggccagcaaggtggagt

SEQ ID NO: 6643219 - DNA, 20 bp, Homo sapiens
aggccagcaaggtggagtgg

SEQ ID NO: 6643220 - DNA, 20 bp, Homo sapiens
aggccagcagccttccagtg

SEQ ID NO: 6643221 - DNA, 22 bp, Homo sapiens
aggccagccagtgacctgagga

SEQ ID NO: 6643222 - DNA, 23 bp, Homo sapiens
aggccagcccactgggccctggg

SEQ ID NO: 6643223 - DNA, 16 bp, Homo sapiens
aggccagcccagccag

SEQ ID NO: 6643224 - DNA, 14 bp, Homo sapiens
aggccagccccacc

SEQ ID NO: 6643225 - DNA, 21 bp, Homo sapiens
aggccagccccatcttggtcc

SEQ ID NO: 6643226 - DNA, 22 bp, Homo sapiens
aggccagccccatcttggtcct

SEQ ID NO: 6643227 - DNA, 18 bp, Homo sapiens
aggccagcccccccaccc

SEQ ID NO: 6643228 - DNA, 19 bp, Homo sapiens
aggccagcccccccaccca

SEQ ID NO: 6643229 - DNA, 21 bp, Homo sapiens
aggccagcccccccacccacc

SEQ ID NO: 6643230 - DNA, 22 bp, Homo sapiens
aggccagccgcgcatcagactg

SEQ ID NO: 6643231 - DNA, 11 bp, Homo sapiens
aggccagcctc

SEQ ID NO: 6643232 - DNA, 17 bp, Homo sapiens
aggccagcctccgagag

SEQ ID NO: 6643233 - DNA, 16 bp, Homo sapiens
aggccagcctgcggga

SEQ ID NO: 6643234 - DNA, 13 bp, Homo sapiens
aggccagcctggc

SEQ ID NO: 6643235 - DNA, 16 bp, Homo sapiens
aggccagcctggcctc

SEQ ID NO: 6643236 - DNA, 18 bp, Homo sapiens
aggccagcctggcctcct

SEQ ID NO: 6643237 - DNA, 21 bp, Homo sapiens
aggccagcctggcctcctgcc

SEQ ID NO: 6643238 - DNA, 12 bp, Homo sapiens
aggccagccttg

SEQ ID NO: 6643239 - DNA, 13 bp, Homo sapiens
aggccagccttgg

SEQ ID NO: 6643240 - DNA, 23 bp, Homo sapiens
aggccagccttgtacagtctgct

SEQ ID NO: 6643241 - DNA, 20 bp, Homo sapiens
aggccagcgaggcgaggctg

SEQ ID NO: 6643242 - DNA, 22 bp, Homo sapiens
aggccagcgaggcgaggctgcc

SEQ ID NO: 6643243 - DNA, 19 bp, Homo sapiens
aggccagctatctgcctga

SEQ ID NO: 6643244 - DNA, 11 bp, Homo sapiens
aggccagctca

SEQ ID NO: 6643245 - DNA, 12 bp, Homo sapiens
aggccagctcag

SEQ ID NO: 6643246 - DNA, 15 bp, Homo sapiens
aggccagctccttag

SEQ ID NO: 6643247 - DNA, 20 bp, Homo sapiens
aggccagctccttttctgtg

SEQ ID NO: 6643248 - DNA, 11 bp, Homo sapiens
aggccagctgc

SEQ ID NO: 6643249 - DNA, 22 bp, Homo sapiens
aggccagctgcggccaggcctg

SEQ ID NO: 6643250 - DNA, 16 bp, Homo sapiens
aggccagctgcttggg

SEQ ID NO: 6643251 - DNA, 15 bp, Homo sapiens
aggccagctggcagc

SEQ ID NO: 6643252 - DNA, 16 bp, Homo sapiens
aggccagctggcagca

SEQ ID NO: 6643253 - DNA, 20 bp, Homo sapiens
aggccagctggcagcagagt

SEQ ID NO: 6643254 - DNA, 16 bp, Homo sapiens
aggccagctgtggttt

SEQ ID NO: 6643255 - DNA, 21 bp, Homo sapiens
aggccagctgtggttttcttt

SEQ ID NO: 6643256 - DNA, 23 bp, Homo sapiens
aggccagctgtggttttcttttg

SEQ ID NO: 6643257 - DNA, 22 bp, Homo sapiens
aggccagcttcgtgctggagga

SEQ ID NO: 6643258 - DNA, 12 bp, Homo sapiens
aggccaggacca

SEQ ID NO: 6643259 - DNA, 18 bp, Homo sapiens
aggccaggaccacacagt

SEQ ID NO: 6643260 - DNA, 17 bp, Homo sapiens
aggccaggacgggccac

SEQ ID NO: 6643261 - DNA, 19 bp, Homo sapiens
aggccaggacgggccacac

SEQ ID NO: 6643262 - DNA, 21 bp, Homo sapiens
aggccaggactctgcagcctc

SEQ ID NO: 6643263 - DNA, 21 bp, Homo sapiens
aggccaggagtaagcccaagc

SEQ ID NO: 6643264 - DNA, 19 bp, Homo sapiens
aggccaggatgcctgagcc

SEQ ID NO: 6643265 - DNA, 13 bp, Homo sapiens
aggccaggccagc

SEQ ID NO: 6643266 - DNA, 17 bp, Homo sapiens
aggccaggccagcttcc

SEQ ID NO: 6643267 - DNA, 18 bp, Homo sapiens
aggccaggccagcttccc

SEQ ID NO: 6643268 - DNA, 21 bp, Homo sapiens
aggccaggccctcctgctggc

SEQ ID NO: 6643269 - DNA, 22 bp, Homo sapiens
aggccaggccctcctgctggct

SEQ ID NO: 6643270 - DNA, 23 bp, Homo sapiens
aggccaggccctctgcccactcc

SEQ ID NO: 6643271 - DNA, 20 bp, Homo sapiens
aggccaggcgagcctgactc

SEQ ID NO: 6643272 - DNA, 20 bp, Homo sapiens
aggccaggcgcggtggctca

SEQ ID NO: 6643273 - DNA, 12 bp, Homo sapiens
aggccaggctcc

SEQ ID NO: 6643274 - DNA, 13 bp, Homo sapiens
aggccaggctccc

SEQ ID NO: 6643275 - DNA, 17 bp, Homo sapiens
aggccaggctccttcct

SEQ ID NO: 6643276 - DNA, 14 bp, Homo sapiens
aggccagggaaagc

SEQ ID NO: 6643277 - DNA, 17 bp, Homo sapiens
aggccagggcacagctg

SEQ ID NO: 6643278 - DNA, 17 bp, Homo sapiens
aggccagggctcctgtg

SEQ ID NO: 6643279 - DNA, 11 bp, Homo sapiens
aggccagggga

SEQ ID NO: 6643280 - DNA, 9 bp, Homo sapiens
aggccaggt

SEQ ID NO: 6643281 - DNA, 23 bp, Homo sapiens
aggccaggtagcaagagagcagc

SEQ ID NO: 6643282 - DNA, 11 bp, Homo sapiens
aggccaggtcc

SEQ ID NO: 6643283 - DNA, 16 bp, Homo sapiens
aggccaggtccctgga

SEQ ID NO: 6643284 - DNA, 15 bp, Homo sapiens
aggccaggtgcaggt

SEQ ID NO: 6643285 - DNA, 14 bp, Homo sapiens
aggccaggtgcagt

SEQ ID NO: 6643286 - DNA, 12 bp, Homo sapiens
aggccaggtgcc

SEQ ID NO: 6643287 - DNA, 15 bp, Homo sapiens
aggccaggtgcccag

SEQ ID NO: 6643288 - DNA, 11 bp, Homo sapiens
aggccaggtgg

SEQ ID NO: 6643289 - DNA, 23 bp, Homo sapiens
aggccaggtgggaacggctgatg

SEQ ID NO: 6643290 - DNA, 13 bp, Homo sapiens
aggccaggtgggc

SEQ ID NO: 6643291 - DNA, 21 bp, Homo sapiens
aggccagtaagggaaatagaa

SEQ ID NO: 6643292 - DNA, 19 bp, Homo sapiens
aggccagtactttgccatc

SEQ ID NO: 6643293 - DNA, 18 bp, Homo sapiens
aggccagtagttctcaaa

SEQ ID NO: 6643294 - DNA, 19 bp, Homo sapiens
aggccagtagttctcaaag

SEQ ID NO: 6643295 - DNA, 21 bp, Homo sapiens
aggccagtcagacgccaggca

SEQ ID NO: 6643296 - DNA, 17 bp, Homo sapiens
aggccagtcccacggct

SEQ ID NO: 6643297 - DNA, 22 bp, Homo sapiens
aggccagtccccatttctgcct

SEQ ID NO: 6643298 - DNA, 19 bp, Homo sapiens
aggccagtgccaggacagc

SEQ ID NO: 6643299 - DNA, 19 bp, Homo sapiens
aggccagtgctgtgagcag

SEQ ID NO: 6643300 - DNA, 16 bp, Homo sapiens
aggccagtggaagaaa

SEQ ID NO: 6643301 - DNA, 15 bp, Homo sapiens
aggccagtggacaga

SEQ ID NO: 6643302 - DNA, 13 bp, Homo sapiens
aggccagtggccc

SEQ ID NO: 6643303 - DNA, 14 bp, Homo sapiens
aggccagtggcccc

SEQ ID NO: 6643304 - DNA, 23 bp, Homo sapiens
aggccagtggcccccgggcctgc

SEQ ID NO: 6643305 - DNA, 18 bp, Homo sapiens
aggccagtgggcctggta

SEQ ID NO: 6643306 - DNA, 18 bp, Homo sapiens
aggccagtgggcgggcca

SEQ ID NO: 6643307 - DNA, 23 bp, Homo sapiens
aggccagttaaagtagatcacct

SEQ ID NO: 6643308 - DNA, 18 bp, Homo sapiens
aggccagttgatctgctc

SEQ ID NO: 6643309 - DNA, 20 bp, Homo sapiens
aggccagttgatctgctctg

SEQ ID NO: 6643310 - DNA, 22 bp, Homo sapiens
aggccataagctacacagaggc

SEQ ID NO: 6643311 - DNA, 15 bp, Homo sapiens
aggccatatttccat

SEQ ID NO: 6643312 - DNA, 18 bp, Homo sapiens
aggccatcagggccctgc

SEQ ID NO: 6643313 - DNA, 16 bp, Homo sapiens
aggccatctcaggaga

SEQ ID NO: 6643314 - DNA, 20 bp, Homo sapiens
aggccatctggagagcccag

SEQ ID NO: 6643315 - DNA, 21 bp, Homo sapiens
aggccatctgggctcctccag

SEQ ID NO: 6643316 - DNA, 14 bp, Homo sapiens
aggccatctgtaaa

SEQ ID NO: 6643317 - DNA, 15 bp, Homo sapiens
aggccatctgtaaat

SEQ ID NO: 6643318 - DNA, 15 bp, Homo sapiens
aggccatgcccaccg

SEQ ID NO: 6643319 - DNA, 22 bp, Homo sapiens
aggccatggactctgtcctgaa

SEQ ID NO: 6643320 - DNA, 18 bp, Homo sapiens
aggccatgggcctcctgt

SEQ ID NO: 6643321 - DNA, 13 bp, Homo sapiens
aggccatggggca

SEQ ID NO: 6643322 - DNA, 17 bp, Homo sapiens
aggccatgggggcccct

SEQ ID NO: 6643323 - DNA, 18 bp, Homo sapiens
aggccatgggtggaaagt

SEQ ID NO: 6643324 - DNA, 19 bp, Homo sapiens
aggccatgtgagccaccgc

SEQ ID NO: 6643325 - DNA, 14 bp, Homo sapiens
aggccatgtgcata

SEQ ID NO: 6643326 - DNA, 22 bp, Homo sapiens
aggccatgtggcctgcccagcc

SEQ ID NO: 6643327 - DNA, 21 bp, Homo sapiens
aggccatgttccaataaacag

SEQ ID NO: 6643328 - DNA, 17 bp, Homo sapiens
aggccattatgcctggc

SEQ ID NO: 6643329 - DNA, 23 bp, Homo sapiens
aggccattcagtctatgctgtgt

SEQ ID NO: 6643330 - DNA, 15 bp, Homo sapiens
aggccattccccaac

SEQ ID NO: 6643331 - DNA, 14 bp, Homo sapiens
aggccattccctgt

SEQ ID NO: 6643332 - DNA, 22 bp, Homo sapiens
aggccattccctgtaggagtaa

SEQ ID NO: 6643333 - DNA, 18 bp, Homo sapiens
aggccattctttcccaac

SEQ ID NO: 6643334 - DNA, 14 bp, Homo sapiens
aggccattgggttt

SEQ ID NO: 6643335 - DNA, 20 bp, Homo sapiens
aggccattgggtttggggcc

SEQ ID NO: 6643336 - DNA, 14 bp, Homo sapiens
aggccattgtgaac

SEQ ID NO: 6643337 - DNA, 17 bp, Homo sapiens
aggccattgtgaaccaa

SEQ ID NO: 6643338 - DNA, 18 bp, Homo sapiens
aggccattgtgaaccaat

SEQ ID NO: 6643339 - DNA, 15 bp, Homo sapiens
aggccatttgctgcc

SEQ ID NO: 6643340 - DNA, 17 bp, Homo sapiens
aggccatttgctgccct

SEQ ID NO: 6643341 - DNA, 22 bp, Homo sapiens
aggccatttgctgccctggggc

SEQ ID NO: 6643342 - DNA, 14 bp, Homo sapiens
aggccatttttggt

SEQ ID NO: 6643343 - DNA, 16 bp, Homo sapiens
aggcccaaaccagggg

SEQ ID NO: 6643344 - DNA, 17 bp, Homo sapiens
aggcccaaaccaggggg

SEQ ID NO: 6643345 - DNA, 15 bp, Homo sapiens
aggcccaaagcctcg

SEQ ID NO: 6643346 - DNA, 21 bp, Homo sapiens
aggcccaaattatcaagctaa

SEQ ID NO: 6643347 - DNA, 21 bp, Homo sapiens
aggcccaagagcagagtctgg

SEQ ID NO: 6643348 - DNA, 19 bp, Homo sapiens
aggcccaaggagggtccag

SEQ ID NO: 6643349 - DNA, 20 bp, Homo sapiens
aggcccaaggtcccctccac

SEQ ID NO: 6643350 - DNA, 15 bp, Homo sapiens
aggcccaagtctcct

SEQ ID NO: 6643351 - DNA, 15 bp, Homo sapiens
aggcccaatgctgct

SEQ ID NO: 6643352 - DNA, 12 bp, Homo sapiens
aggcccacacac

SEQ ID NO: 6643353 - DNA, 13 bp, Homo sapiens
aggcccacacaca

SEQ ID NO: 6643354 - DNA, 19 bp, Homo sapiens
aggcccacattgcccacac

SEQ ID NO: 6643355 - DNA, 17 bp, Homo sapiens
aggcccacattggaaga

SEQ ID NO: 6643356 - DNA, 19 bp, Homo sapiens
aggcccaccatcaccaccg

SEQ ID NO: 6643357 - DNA, 15 bp, Homo sapiens
aggcccaccctgctt

SEQ ID NO: 6643358 - DNA, 22 bp, Homo sapiens
aggcccaccctgcttggcccag

SEQ ID NO: 6643359 - DNA, 23 bp, Homo sapiens
aggcccaccctgcttggcccagg

SEQ ID NO: 6643360 - DNA, 20 bp, Homo sapiens
aggcccacgcgcttccctgg

SEQ ID NO: 6643361 - DNA, 20 bp, Homo sapiens
aggcccactagagggcccat

SEQ ID NO: 6643362 - DNA, 12 bp, Homo sapiens
aggcccactccc

SEQ ID NO: 6643363 - DNA, 16 bp, Homo sapiens
aggcccactccccagc

SEQ ID NO: 6643364 - DNA, 18 bp, Homo sapiens
aggcccactccccagccc

SEQ ID NO: 6643365 - DNA, 18 bp, Homo sapiens
aggcccactgcagagatg

SEQ ID NO: 6643366 - DNA, 13 bp, Homo sapiens
aggcccagacctg

SEQ ID NO: 6643367 - DNA, 17 bp, Homo sapiens
aggcccagacctggcct

SEQ ID NO: 6643368 - DNA, 22 bp, Homo sapiens
aggcccagagagaagagcccca

SEQ ID NO: 6643369 - DNA, 16 bp, Homo sapiens
aggcccagagagggaa

SEQ ID NO: 6643370 - DNA, 16 bp, Homo sapiens
aggcccagagcgagga

SEQ ID NO: 6643371 - DNA, 13 bp, Homo sapiens
aggcccagagggc

SEQ ID NO: 6643372 - DNA, 17 bp, Homo sapiens
aggcccagatccaaggc

SEQ ID NO: 6643373 - DNA, 12 bp, Homo sapiens
aggcccagcacc

SEQ ID NO: 6643374 - DNA, 16 bp, Homo sapiens
aggcccagcatgcagg

SEQ ID NO: 6643375 - DNA, 13 bp, Homo sapiens
aggcccagcattg

SEQ ID NO: 6643376 - DNA, 19 bp, Homo sapiens
aggcccagcattgctggtt

SEQ ID NO: 6643377 - DNA, 13 bp, Homo sapiens
aggcccagccagt

SEQ ID NO: 6643378 - DNA, 23 bp, Homo sapiens
aggcccagccagttggtggggcc

SEQ ID NO: 6643379 - DNA, 14 bp, Homo sapiens
aggcccagccccta

SEQ ID NO: 6643380 - DNA, 17 bp, Homo sapiens
aggcccagcccctagaa

SEQ ID NO: 6643381 - DNA, 14 bp, Homo sapiens
aggcccagcccctc

SEQ ID NO: 6643382 - DNA, 15 bp, Homo sapiens
aggcccagccctcag

SEQ ID NO: 6643383 - DNA, 17 bp, Homo sapiens
aggcccagccctcagaa

SEQ ID NO: 6643384 - DNA, 19 bp, Homo sapiens
aggcccagccctgggcaag

SEQ ID NO: 6643385 - DNA, 12 bp, Homo sapiens
aggcccagcctc

SEQ ID NO: 6643386 - DNA, 22 bp, Homo sapiens
aggcccagcctctctggctcag

SEQ ID NO: 6643387 - DNA, 20 bp, Homo sapiens
aggcccagcctcttgttctt

SEQ ID NO: 6643388 - DNA, 13 bp, Homo sapiens
aggcccagcctgg

SEQ ID NO: 6643389 - DNA, 18 bp, Homo sapiens
aggcccagcctggcccca

SEQ ID NO: 6643390 - DNA, 21 bp, Homo sapiens
aggcccagcctgtcctggtac

SEQ ID NO: 6643391 - DNA, 20 bp, Homo sapiens
aggcccagcgcggccagcgt

SEQ ID NO: 6643392 - DNA, 18 bp, Homo sapiens
aggcccagcgggcagatg

SEQ ID NO: 6643393 - DNA, 21 bp, Homo sapiens
aggcccagctatggccccagg

SEQ ID NO: 6643394 - DNA, 15 bp, Homo sapiens
aggcccagctgccag

SEQ ID NO: 6643395 - DNA, 16 bp, Homo sapiens
aggcccagctgccagg

SEQ ID NO: 6643396 - DNA, 14 bp, Homo sapiens
aggcccaggaaggc

SEQ ID NO: 6643397 - DNA, 22 bp, Homo sapiens
aggcccaggagaattaggaagg

SEQ ID NO: 6643398 - DNA, 19 bp, Homo sapiens
aggcccaggagtccaggcc

SEQ ID NO: 6643399 - DNA, 21 bp, Homo sapiens
aggcccaggatatttctgaga

SEQ ID NO: 6643400 - DNA, 12 bp, Homo sapiens
aggcccaggcag

SEQ ID NO: 6643401 - DNA, 19 bp, Homo sapiens
aggcccaggcaggcccagc

SEQ ID NO: 6643402 - DNA, 20 bp, Homo sapiens
aggcccaggcaggcccagcc

SEQ ID NO: 6643403 - DNA, 22 bp, Homo sapiens
aggcccaggcaggcccagcctc

SEQ ID NO: 6643404 - DNA, 15 bp, Homo sapiens
aggcccaggccagcc

SEQ ID NO: 6643405 - DNA, 14 bp, Homo sapiens
aggcccaggcctca

SEQ ID NO: 6643406 - DNA, 15 bp, Homo sapiens
aggcccaggcctcac

SEQ ID NO: 6643407 - DNA, 22 bp, Homo sapiens
aggcccaggcctcaccacctga

SEQ ID NO: 6643408 - DNA, 17 bp, Homo sapiens
aggcccaggcctgggtt

SEQ ID NO: 6643409 - DNA, 15 bp, Homo sapiens
aggcccaggctgccg

SEQ ID NO: 6643410 - DNA, 17 bp, Homo sapiens
aggcccaggctgggaac

SEQ ID NO: 6643411 - DNA, 14 bp, Homo sapiens
aggcccagggagca

SEQ ID NO: 6643412 - DNA, 18 bp, Homo sapiens
aggcccagggaggcagcg

SEQ ID NO: 6643413 - DNA, 23 bp, Homo sapiens
aggcccagggagggaagtgtgag

SEQ ID NO: 6643414 - DNA, 19 bp, Homo sapiens
aggcccagtgcatatgcaa

SEQ ID NO: 6643415 - DNA, 13 bp, Homo sapiens
aggcccatagcag

SEQ ID NO: 6643416 - DNA, 23 bp, Homo sapiens
aggcccatcccccacctgccagc

SEQ ID NO: 6643417 - DNA, 18 bp, Homo sapiens
aggcccatctcaggtgcc

SEQ ID NO: 6643418 - DNA, 19 bp, Homo sapiens
aggcccatctcaggtgcca

SEQ ID NO: 6643419 - DNA, 22 bp, Homo sapiens
aggcccatctcaggtgccactc

SEQ ID NO: 6643420 - DNA, 15 bp, Homo sapiens
aggcccatgccccct

SEQ ID NO: 6643421 - DNA, 20 bp, Homo sapiens
aggcccatgcccccttcgct

SEQ ID NO: 6643422 - DNA, 12 bp, Homo sapiens
aggcccatgcta

SEQ ID NO: 6643423 - DNA, 17 bp, Homo sapiens
aggcccatgctatgagt

SEQ ID NO: 6643424 - DNA, 21 bp, Homo sapiens
aggcccatgggaggctggagt

SEQ ID NO: 6643425 - DNA, 18 bp, Homo sapiens
aggcccatggttgagaaa

SEQ ID NO: 6643426 - DNA, 18 bp, Homo sapiens
aggccccaaaaccacagc

SEQ ID NO: 6643427 - DNA, 21 bp, Homo sapiens
aggccccaactcaagtgtcac

SEQ ID NO: 6643428 - DNA, 16 bp, Homo sapiens
aggccccacaaggcct

SEQ ID NO: 6643429 - DNA, 14 bp, Homo sapiens
aggccccacccctg

SEQ ID NO: 6643430 - DNA, 16 bp, Homo sapiens
aggccccaccccttcc

SEQ ID NO: 6643431 - DNA, 19 bp, Homo sapiens
aggccccaccccttcccta

SEQ ID NO: 6643432 - DNA, 21 bp, Homo sapiens
aggccccaccggccaggccgc

SEQ ID NO: 6643433 - DNA, 13 bp, Homo sapiens
aggccccactgat

SEQ ID NO: 6643434 - DNA, 15 bp, Homo sapiens
aggccccactgggga

SEQ ID NO: 6643435 - DNA, 11 bp, Homo sapiens
aggccccagac

SEQ ID NO: 6643436 - DNA, 22 bp, Homo sapiens
aggccccagagagaccctgcaa

SEQ ID NO: 6643437 - DNA, 12 bp, Homo sapiens
aggccccagagc

SEQ ID NO: 6643438 - DNA, 13 bp, Homo sapiens
aggccccagccaa

SEQ ID NO: 6643439 - DNA, 23 bp, Homo sapiens
aggccccagccaagtgccttccg

SEQ ID NO: 6643440 - DNA, 14 bp, Homo sapiens
aggccccagcctcc

SEQ ID NO: 6643441 - DNA, 21 bp, Homo sapiens
aggccccagctctgaggggag

SEQ ID NO: 6643442 - DNA, 13 bp, Homo sapiens
aggccccaggaag

SEQ ID NO: 6643443 - DNA, 14 bp, Homo sapiens
aggccccaggaagc

SEQ ID NO: 6643444 - DNA, 15 bp, Homo sapiens
aggccccaggaagcc

SEQ ID NO: 6643445 - DNA, 11 bp, Homo sapiens
aggccccaggc

SEQ ID NO: 6643446 - DNA, 15 bp, Homo sapiens
aggccccaggctgag

SEQ ID NO: 6643447 - DNA, 22 bp, Homo sapiens
aggccccaggctggatgctggg

SEQ ID NO: 6643448 - DNA, 18 bp, Homo sapiens
aggccccagggacagagg

SEQ ID NO: 6643449 - DNA, 21 bp, Homo sapiens
aggccccatcagcatcccacg

SEQ ID NO: 6643450 - DNA, 19 bp, Homo sapiens
aggcccccaaacatagccc

SEQ ID NO: 6643451 - DNA, 20 bp, Homo sapiens
aggcccccaaattgccttca

SEQ ID NO: 6643452 - DNA, 17 bp, Homo sapiens
aggcccccaacccctcc

SEQ ID NO: 6643453 - DNA, 23 bp, Homo sapiens
aggcccccaacccctcctccctc

SEQ ID NO: 6643454 - DNA, 22 bp, Homo sapiens
aggcccccaccacacatcccag

SEQ ID NO: 6643455 - DNA, 23 bp, Homo sapiens
aggcccccaccacacatcccagc

SEQ ID NO: 6643456 - DNA, 14 bp, Homo sapiens
aggcccccaccctt

SEQ ID NO: 6643457 - DNA, 18 bp, Homo sapiens
aggcccccacttgcctct

SEQ ID NO: 6643458 - DNA, 23 bp, Homo sapiens
aggcccccagcccagggctcctg

SEQ ID NO: 6643459 - DNA, 16 bp, Homo sapiens
aggcccccagcccctc

SEQ ID NO: 6643460 - DNA, 17 bp, Homo sapiens
aggcccccagcccctcc

SEQ ID NO: 6643461 - DNA, 20 bp, Homo sapiens
aggcccccagcccctcctcc

SEQ ID NO: 6643462 - DNA, 21 bp, Homo sapiens
aggcccccagcccctcctccc

SEQ ID NO: 6643463 - DNA, 13 bp, Homo sapiens
aggcccccagtgg

SEQ ID NO: 6643464 - DNA, 23 bp, Homo sapiens
aggcccccagtgggaccacatgc

SEQ ID NO: 6643465 - DNA, 16 bp, Homo sapiens
aggcccccagtgggga

SEQ ID NO: 6643466 - DNA, 21 bp, Homo sapiens
aggcccccagtggggacaggg

SEQ ID NO: 6643467 - DNA, 20 bp, Homo sapiens
aggcccccatcatcctctgg

SEQ ID NO: 6643468 - DNA, 20 bp, Homo sapiens
aggccccccagaaagctgcc

SEQ ID NO: 6643469 - DNA, 22 bp, Homo sapiens
aggccccccagaaagctgccag

SEQ ID NO: 6643470 - DNA, 16 bp, Homo sapiens
aggccccccgcagcac

SEQ ID NO: 6643471 - DNA, 13 bp, Homo sapiens
aggcccccctctg

SEQ ID NO: 6643472 - DNA, 16 bp, Homo sapiens
aggcccccctctgcct

SEQ ID NO: 6643473 - DNA, 24 bp, Homo sapiens
aggcccccgcacgcaagcctcagc

SEQ ID NO: 6643474 - DNA, 19 bp, Homo sapiens
aggcccccgccttggcctg

SEQ ID NO: 6643475 - DNA, 19 bp, Homo sapiens
aggcccccggaggcgccca

SEQ ID NO: 6643476 - DNA, 18 bp, Homo sapiens
aggcccccggctttcctc

SEQ ID NO: 6643477 - DNA, 22 bp, Homo sapiens
aggcccccggctttcctccgga

SEQ ID NO: 6643478 - DNA, 17 bp, Homo sapiens
aggcccccgttgaagcc

SEQ ID NO: 6643479 - DNA, 16 bp, Homo sapiens
aggccccctcctcacg

SEQ ID NO: 6643480 - DNA, 13 bp, Homo sapiens
aggccccctgcat

SEQ ID NO: 6643481 - DNA, 16 bp, Homo sapiens
aggccccctgcatcta

SEQ ID NO: 6643482 - DNA, 21 bp, Homo sapiens
aggccccctgccagttgaagt

SEQ ID NO: 6643483 - DNA, 18 bp, Homo sapiens
aggccccgaggacccaga

SEQ ID NO: 6643484 - DNA, 19 bp, Homo sapiens
aggccccgaggacccagac

SEQ ID NO: 6643485 - DNA, 23 bp, Homo sapiens
aggccccgatggactcctgacca

SEQ ID NO: 6643486 - DNA, 19 bp, Homo sapiens
aggccccgcgcgccggtgc

SEQ ID NO: 6643487 - DNA, 17 bp, Homo sapiens
aggccccgcttgtccag

SEQ ID NO: 6643488 - DNA, 18 bp, Homo sapiens
aggccccgcttgtccagc

SEQ ID NO: 6643489 - DNA, 13 bp, Homo sapiens
aggccccggcgcc

SEQ ID NO: 6643490 - DNA, 23 bp, Homo sapiens
aggccccgggcttcccttctccc

SEQ ID NO: 6643491 - DNA, 18 bp, Homo sapiens
aggcccctaggtgcccag

SEQ ID NO: 6643492 - DNA, 18 bp, Homo sapiens
aggcccctctgtggagcg

SEQ ID NO: 6643493 - DNA, 13 bp, Homo sapiens
aggcccctgagga

SEQ ID NO: 6643494 - DNA, 17 bp, Homo sapiens
aggcccctgaggactgg

SEQ ID NO: 6643495 - DNA, 19 bp, Homo sapiens
aggcccctgaggcagccca

SEQ ID NO: 6643496 - DNA, 15 bp, Homo sapiens
aggcccctgccaccc

SEQ ID NO: 6643497 - DNA, 18 bp, Homo sapiens
aggcccctgccaccctgg

SEQ ID NO: 6643498 - DNA, 14 bp, Homo sapiens
aggcccctggagcc

SEQ ID NO: 6643499 - DNA, 14 bp, Homo sapiens
aggcccctggaggc

SEQ ID NO: 6643500 - DNA, 20 bp, Homo sapiens
aggcccctggaggctgcctc

SEQ ID NO: 6643501 - DNA, 21 bp, Homo sapiens
aggcccctggaggctgcctcc

SEQ ID NO: 6643502 - DNA, 13 bp, Homo sapiens
aggcccctgggct

SEQ ID NO: 6643503 - DNA, 18 bp, Homo sapiens
aggcccctgggctctcac

SEQ ID NO: 6643504 - DNA, 13 bp, Homo sapiens
aggcccctggggc

SEQ ID NO: 6643505 - DNA, 13 bp, Homo sapiens
aggcccctggtgg

SEQ ID NO: 6643506 - DNA, 21 bp, Homo sapiens
aggcccctgtctcagggtgag

SEQ ID NO: 6643507 - DNA, 13 bp, Homo sapiens
aggcccctgtgta

SEQ ID NO: 6643508 - DNA, 15 bp, Homo sapiens
aggcccctgtgtagt

SEQ ID NO: 6643509 - DNA, 13 bp, Homo sapiens
aggccccttccca

SEQ ID NO: 6643510 - DNA, 13 bp, Homo sapiens
aggccccttccct

SEQ ID NO: 6643511 - DNA, 13 bp, Homo sapiens
aggccccttgctg

SEQ ID NO: 6643512 - DNA, 21 bp, Homo sapiens
aggccccttgctgctggctcc

SEQ ID NO: 6643513 - DNA, 22 bp, Homo sapiens
aggccccttgctgctggctccc

SEQ ID NO: 6643514 - DNA, 16 bp, Homo sapiens
aggcccgacagagaga

SEQ ID NO: 6643515 - DNA, 19 bp, Homo sapiens
aggcccgacagagagatga

SEQ ID NO: 6643516 - DNA, 19 bp, Homo sapiens
aggcccgcaccccggcctc

SEQ ID NO: 6643517 - DNA, 22 bp, Homo sapiens
aggcccgcaccccggcctcagg

SEQ ID NO: 6643518 - DNA, 16 bp, Homo sapiens
aggcccgcccgcccac

SEQ ID NO: 6643519 - DNA, 19 bp, Homo sapiens
aggcccgccctctgcctcc

SEQ ID NO: 6643520 - DNA, 18 bp, Homo sapiens
aggcccgccctgcccggg

SEQ ID NO: 6643521 - DNA, 20 bp, Homo sapiens
aggcccgccctgcccgggct

SEQ ID NO: 6643522 - DNA, 23 bp, Homo sapiens
aggcccgccctgcccgggctccc

SEQ ID NO: 6643523 - DNA, 15 bp, Homo sapiens
aggcccgcgggcaca

SEQ ID NO: 6643524 - DNA, 20 bp, Homo sapiens
aggcccgcgggcacagccag

SEQ ID NO: 6643525 - DNA, 22 bp, Homo sapiens
aggcccgcttgctgggtacctg

SEQ ID NO: 6643526 - DNA, 23 bp, Homo sapiens
aggcccgcttgctgggtacctgg

SEQ ID NO: 6643527 - DNA, 15 bp, Homo sapiens
aggcccggagatgca

SEQ ID NO: 6643528 - DNA, 23 bp, Homo sapiens
aggcccggatgcagaggcctgca

SEQ ID NO: 6643529 - DNA, 22 bp, Homo sapiens
aggcccggccccatcagaggct

SEQ ID NO: 6643530 - DNA, 12 bp, Homo sapiens
aggcccggccta

SEQ ID NO: 6643531 - DNA, 14 bp, Homo sapiens
aggcccggcctctc

SEQ ID NO: 6643532 - DNA, 14 bp, Homo sapiens
aggcccggctccag

SEQ ID NO: 6643533 - DNA, 17 bp, Homo sapiens
aggcccggctgagcccc

SEQ ID NO: 6643534 - DNA, 19 bp, Homo sapiens
aggcccgggcccctggcac

SEQ ID NO: 6643535 - DNA, 13 bp, Homo sapiens
aggcccggggccc

SEQ ID NO: 6643536 - DNA, 19 bp, Homo sapiens
aggcccgtcagcatcactg

SEQ ID NO: 6643537 - DNA, 15 bp, Homo sapiens
aggcccgtccggcag

SEQ ID NO: 6643538 - DNA, 23 bp, Homo sapiens
aggcccgtcggagctgcctgcag

SEQ ID NO: 6643539 - DNA, 20 bp, Homo sapiens
aggccctacacacagaccgc

SEQ ID NO: 6643540 - DNA, 18 bp, Homo sapiens
aggccctcaagtctttct

SEQ ID NO: 6643541 - DNA, 22 bp, Homo sapiens
aggccctcagtcttcctgccgg

SEQ ID NO: 6643542 - DNA, 16 bp, Homo sapiens
aggccctccacacctg

SEQ ID NO: 6643543 - DNA, 23 bp, Homo sapiens
aggccctccacacctgcggccca

SEQ ID NO: 6643544 - DNA, 11 bp, Homo sapiens
aggccctccag

SEQ ID NO: 6643545 - DNA, 16 bp, Homo sapiens
aggccctccatgggct

SEQ ID NO: 6643546 - DNA, 10 bp, Homo sapiens
aggccctccc

SEQ ID NO: 6643547 - DNA, 12 bp, Homo sapiens
aggccctcccaa

SEQ ID NO: 6643548 - DNA, 16 bp, Homo sapiens
aggccctcccaccacc

SEQ ID NO: 6643549 - DNA, 17 bp, Homo sapiens
aggccctcccaccaccc

SEQ ID NO: 6643550 - DNA, 12 bp, Homo sapiens
aggccctccctc

SEQ ID NO: 6643551 - DNA, 13 bp, Homo sapiens
aggccctccctct

SEQ ID NO: 6643552 - DNA, 23 bp, Homo sapiens
aggccctccctctactcttcctg

SEQ ID NO: 6643553 - DNA, 14 bp, Homo sapiens
aggccctccctgac

SEQ ID NO: 6643554 - DNA, 13 bp, Homo sapiens
aggccctccctgt

SEQ ID NO: 6643555 - DNA, 15 bp, Homo sapiens
aggccctccctgtct

SEQ ID NO: 6643556 - DNA, 22 bp, Homo sapiens
aggccctcctccctcccagctc

SEQ ID NO: 6643557 - DNA, 15 bp, Homo sapiens
aggccctcctgtgct

SEQ ID NO: 6643558 - DNA, 15 bp, Homo sapiens
aggccctcgctgcca

SEQ ID NO: 6643559 - DNA, 20 bp, Homo sapiens
aggccctcggagctggctgt

SEQ ID NO: 6643560 - DNA, 16 bp, Homo sapiens
aggccctcgggcccag

SEQ ID NO: 6643561 - DNA, 16 bp, Homo sapiens
aggccctctctgcagt

SEQ ID NO: 6643562 - DNA, 23 bp, Homo sapiens
aggccctctgcccactccctgca

SEQ ID NO: 6643563 - DNA, 15 bp, Homo sapiens
aggccctctgcctgc

SEQ ID NO: 6643564 - DNA, 17 bp, Homo sapiens
aggccctctgcctgcac

SEQ ID NO: 6643565 - DNA, 18 bp, Homo sapiens
aggccctctgcctgcact

SEQ ID NO: 6643566 - DNA, 15 bp, Homo sapiens
aggccctctggaggg

SEQ ID NO: 6643567 - DNA, 20 bp, Homo sapiens
aggccctctggagtggccac

SEQ ID NO: 6643568 - DNA, 21 bp, Homo sapiens
aggccctctggagtggccact

SEQ ID NO: 6643569 - DNA, 22 bp, Homo sapiens
aggccctctggagtggccacta

SEQ ID NO: 6643570 - DNA, 14 bp, Homo sapiens
aggccctctgtggc

SEQ ID NO: 6643571 - DNA, 15 bp, Homo sapiens
aggccctgaagcctc

SEQ ID NO: 6643572 - DNA, 15 bp, Homo sapiens
aggccctgactcctc

SEQ ID NO: 6643573 - DNA, 18 bp, Homo sapiens
aggccctgagatggggga

SEQ ID NO: 6643574 - DNA, 13 bp, Homo sapiens
aggccctgcacct

SEQ ID NO: 6643575 - DNA, 15 bp, Homo sapiens
aggccctgcactgtc

SEQ ID NO: 6643576 - DNA, 22 bp, Homo sapiens
aggccctgcactgtcctgctcc

SEQ ID NO: 6643577 - DNA, 13 bp, Homo sapiens
aggccctgcagtg

SEQ ID NO: 6643578 - DNA, 23 bp, Homo sapiens
aggccctgccacgtcccgctgcc

SEQ ID NO: 6643579 - DNA, 13 bp, Homo sapiens
aggccctgccagt

SEQ ID NO: 6643580 - DNA, 16 bp, Homo sapiens
aggccctgcccagcca

SEQ ID NO: 6643581 - DNA, 21 bp, Homo sapiens
aggccctgccccctcccactc

SEQ ID NO: 6643582 - DNA, 16 bp, Homo sapiens
aggccctgccctgccc

SEQ ID NO: 6643583 - DNA, 22 bp, Homo sapiens
aggccctgccctgcccaacctc

SEQ ID NO: 6643584 - DNA, 15 bp, Homo sapiens
aggccctgcctgacc

SEQ ID NO: 6643585 - DNA, 16 bp, Homo sapiens
aggccctgcctgaccc

SEQ ID NO: 6643586 - DNA, 12 bp, Homo sapiens
aggccctgctcc

SEQ ID NO: 6643587 - DNA, 16 bp, Homo sapiens
aggccctgctgagtca

SEQ ID NO: 6643588 - DNA, 14 bp, Homo sapiens
aggccctgctgccc

SEQ ID NO: 6643589 - DNA, 22 bp, Homo sapiens
aggccctggagaggggctgtcc

SEQ ID NO: 6643590 - DNA, 21 bp, Homo sapiens
aggccctggagggaaggacag

SEQ ID NO: 6643591 - DNA, 13 bp, Homo sapiens
aggccctggaggt

SEQ ID NO: 6643592 - DNA, 20 bp, Homo sapiens
aggccctggaggtctccagg

SEQ ID NO: 6643593 - DNA, 21 bp, Homo sapiens
aggccctggatgtgcccacag

SEQ ID NO: 6643594 - DNA, 14 bp, Homo sapiens
aggccctggcagaa

SEQ ID NO: 6643595 - DNA, 15 bp, Homo sapiens
aggccctggcccttt

SEQ ID NO: 6643596 - DNA, 20 bp, Homo sapiens
aggccctggccctttcccct

SEQ ID NO: 6643597 - DNA, 14 bp, Homo sapiens
aggccctggcctcc

SEQ ID NO: 6643598 - DNA, 21 bp, Homo sapiens
aggccctggcctcccctgcca

SEQ ID NO: 6643599 - DNA, 16 bp, Homo sapiens
aggccctgggcctcca

SEQ ID NO: 6643600 - DNA, 12 bp, Homo sapiens
aggccctgggct

SEQ ID NO: 6643601 - DNA, 22 bp, Homo sapiens
aggccctgggctgggtgctggg

SEQ ID NO: 6643602 - DNA, 23 bp, Homo sapiens
aggccctggggagcttttgccca

SEQ ID NO: 6643603 - DNA, 18 bp, Homo sapiens
aggccctggtcctggcct

SEQ ID NO: 6643604 - DNA, 22 bp, Homo sapiens
aggccctggtgcgaatggactt

SEQ ID NO: 6643605 - DNA, 19 bp, Homo sapiens
aggccctggtggagaggcc

SEQ ID NO: 6643606 - DNA, 12 bp, Homo sapiens
aggccctggttc

SEQ ID NO: 6643607 - DNA, 22 bp, Homo sapiens
aggccctggttcctgctgtcct

SEQ ID NO: 6643608 - DNA, 16 bp, Homo sapiens
aggccctgtctctggc

SEQ ID NO: 6643609 - DNA, 13 bp, Homo sapiens
aggccctgtctgt

SEQ ID NO: 6643610 - DNA, 12 bp, Homo sapiens
aggccctgtgat

SEQ ID NO: 6643611 - DNA, 12 bp, Homo sapiens
aggccctgtggt

SEQ ID NO: 6643612 - DNA, 16 bp, Homo sapiens
aggccctgttccctgg

SEQ ID NO: 6643613 - DNA, 22 bp, Homo sapiens
aggcccttcctctccactgcct

SEQ ID NO: 6643614 - DNA, 17 bp, Homo sapiens
aggcccttcctctttgg

SEQ ID NO: 6643615 - DNA, 22 bp, Homo sapiens
aggcccttctctccagcccctg

SEQ ID NO: 6643616 - DNA, 16 bp, Homo sapiens
aggcccttggcgggca

SEQ ID NO: 6643617 - DNA, 19 bp, Homo sapiens
aggcccttggctgcaggca

SEQ ID NO: 6643618 - DNA, 17 bp, Homo sapiens
aggcccttggggtggcg

SEQ ID NO: 6643619 - DNA, 21 bp, Homo sapiens
aggcccttggggttcccccag

SEQ ID NO: 6643620 - DNA, 17 bp, Homo sapiens
aggcccttgtcattgcc

SEQ ID NO: 6643621 - DNA, 18 bp, Homo sapiens
aggcccttgtcattgcct

SEQ ID NO: 6643622 - DNA, 17 bp, Homo sapiens
aggcccttgtcctgcca

SEQ ID NO: 6643623 - DNA, 23 bp, Homo sapiens
aggcccttgtcctgccagctgcc

SEQ ID NO: 6643624 - DNA, 22 bp, Homo sapiens
aggcccttgtcggccccaccag

SEQ ID NO: 6643625 - DNA, 24 bp, Homo sapiens
aggccctttgaagcctcagctacc

SEQ ID NO: 6643626 - DNA, 13 bp, Homo sapiens
aggccctttgctg

SEQ ID NO: 6643627 - DNA, 15 bp, Homo sapiens
aggccctttgctgtc

SEQ ID NO: 6643628 - DNA, 15 bp, Homo sapiens
aggccctttggcttc

SEQ ID NO: 6643629 - DNA, 19 bp, Homo sapiens
aggccctttggcttctgat

SEQ ID NO: 6643630 - DNA, 22 bp, Homo sapiens
aggccctttggcttctgatttt

SEQ ID NO: 6643631 - DNA, 22 bp, Homo sapiens
aggcccttttctggctcctgtg

SEQ ID NO: 6643632 - DNA, 23 bp, Homo sapiens
aggccgaagctaacagggaaggc

SEQ ID NO: 6643633 - DNA, 19 bp, Homo sapiens
aggccgaagctctggctga

SEQ ID NO: 6643634 - DNA, 24 bp, Homo sapiens
aggccgaagctctggctgaaccct

SEQ ID NO: 6643635 - DNA, 16 bp, Homo sapiens
aggccgaagctgctgt

SEQ ID NO: 6643636 - DNA, 17 bp, Homo sapiens
aggccgaaggtgcctca

SEQ ID NO: 6643637 - DNA, 21 bp, Homo sapiens
aggccgaaggtgcctcagact

SEQ ID NO: 6643638 - DNA, 17 bp, Homo sapiens
aggccgacaccactcct

SEQ ID NO: 6643639 - DNA, 20 bp, Homo sapiens
aggccgacaccactcctgcc

SEQ ID NO: 6643640 - DNA, 20 bp, Homo sapiens
aggccgacgttttctccgca

SEQ ID NO: 6643641 - DNA, 14 bp, Homo sapiens
aggccgactgggct

SEQ ID NO: 6643642 - DNA, 15 bp, Homo sapiens
aggccgactgggctg

SEQ ID NO: 6643643 - DNA, 20 bp, Homo sapiens
aggccgactgggctgctggg

SEQ ID NO: 6643644 - DNA, 15 bp, Homo sapiens
aggccgagaagcaag

SEQ ID NO: 6643645 - DNA, 16 bp, Homo sapiens
aggccgagaagccagt

SEQ ID NO: 6643646 - DNA, 12 bp, Homo sapiens
aggccgagccaa

SEQ ID NO: 6643647 - DNA, 20 bp, Homo sapiens
aggccgagccaggttcacac

SEQ ID NO: 6643648 - DNA, 16 bp, Homo sapiens
aggccgagcggtggcc

SEQ ID NO: 6643649 - DNA, 16 bp, Homo sapiens
aggccgagctgtggac

SEQ ID NO: 6643650 - DNA, 21 bp, Homo sapiens
aggccgaggaccaccagcagg

SEQ ID NO: 6643651 - DNA, 22 bp, Homo sapiens
aggccgaggaccaccagcaggc

SEQ ID NO: 6643652 - DNA, 20 bp, Homo sapiens
aggccgaggataaagaaaag

SEQ ID NO: 6643653 - DNA, 13 bp, Homo sapiens
aggccgaggcagg

SEQ ID NO: 6643654 - DNA, 14 bp, Homo sapiens
aggccgaggcagga

SEQ ID NO: 6643655 - DNA, 19 bp, Homo sapiens
aggccgaggccatgtgcat

SEQ ID NO: 6643656 - DNA, 20 bp, Homo sapiens
aggccgaggccatgtgcata

SEQ ID NO: 6643657 - DNA, 16 bp, Homo sapiens
aggccgagggccaggc

SEQ ID NO: 6643658 - DNA, 19 bp, Homo sapiens
aggccgagggccaggcaga

SEQ ID NO: 6643659 - DNA, 15 bp, Homo sapiens
aggccgaggtcccat

SEQ ID NO: 6643660 - DNA, 17 bp, Homo sapiens
aggccgaggtgggcaga

SEQ ID NO: 6643661 - DNA, 16 bp, Homo sapiens
aggccgagtggctgcc

SEQ ID NO: 6643662 - DNA, 17 bp, Homo sapiens
aggccgagtggctgccg

SEQ ID NO: 6643663 - DNA, 20 bp, Homo sapiens
aggccgatggggaaggagaa

SEQ ID NO: 6643664 - DNA, 12 bp, Homo sapiens
aggccgcagctc

SEQ ID NO: 6643665 - DNA, 13 bp, Homo sapiens
aggccgcagctct

SEQ ID NO: 6643666 - DNA, 16 bp, Homo sapiens
aggccgcagctcttgc

SEQ ID NO: 6643667 - DNA, 15 bp, Homo sapiens
aggccgcatggcccc

SEQ ID NO: 6643668 - DNA, 23 bp, Homo sapiens
aggccgcatggcccctccaggaa

SEQ ID NO: 6643669 - DNA, 16 bp, Homo sapiens
aggccgccagcgtgtg

SEQ ID NO: 6643670 - DNA, 13 bp, Homo sapiens
aggccgcccacct

SEQ ID NO: 6643671 - DNA, 14 bp, Homo sapiens
aggccgcccacctg

SEQ ID NO: 6643672 - DNA, 15 bp, Homo sapiens
aggccgcccacctgc

SEQ ID NO: 6643673 - DNA, 22 bp, Homo sapiens
aggccgcccacctgcatcagcc

SEQ ID NO: 6643674 - DNA, 14 bp, Homo sapiens
aggccgccccagcc

SEQ ID NO: 6643675 - DNA, 19 bp, Homo sapiens
aggccgccccagcctctga

SEQ ID NO: 6643676 - DNA, 16 bp, Homo sapiens
aggccgccgtgaccta

SEQ ID NO: 6643677 - DNA, 13 bp, Homo sapiens
aggccgcgcccag

SEQ ID NO: 6643678 - DNA, 15 bp, Homo sapiens
aggccgcgcccagca

SEQ ID NO: 6643679 - DNA, 14 bp, Homo sapiens
aggccgctagaggc

SEQ ID NO: 6643680 - DNA, 20 bp, Homo sapiens
aggccgctagaggcctgagg

SEQ ID NO: 6643681 - DNA, 13 bp, Homo sapiens
aggccgctctggg

SEQ ID NO: 6643682 - DNA, 14 bp, Homo sapiens
aggccgctctgggg

SEQ ID NO: 6643683 - DNA, 13 bp, Homo sapiens
aggccgctgcagg

SEQ ID NO: 6643684 - DNA, 13 bp, Homo sapiens
aggccgctgcccc

SEQ ID NO: 6643685 - DNA, 20 bp, Homo sapiens
aggccgctgccccagccccg

SEQ ID NO: 6643686 - DNA, 19 bp, Homo sapiens
aggccgctgcccctgagtt

SEQ ID NO: 6643687 - DNA, 19 bp, Homo sapiens
aggccgcttagtgctgctt

SEQ ID NO: 6643688 - DNA, 14 bp, Homo sapiens
aggccggaaccaca

SEQ ID NO: 6643689 - DNA, 17 bp, Homo sapiens
aggccggaaccacaggg

SEQ ID NO: 6643690 - DNA, 18 bp, Homo sapiens
aggccggagacccacagc

SEQ ID NO: 6643691 - DNA, 18 bp, Homo sapiens
aggccggagagctggtga

SEQ ID NO: 6643692 - DNA, 19 bp, Homo sapiens
aggccggcagccccagcct

SEQ ID NO: 6643693 - DNA, 21 bp, Homo sapiens
aggccggcagccccagcctgc

SEQ ID NO: 6643694 - DNA, 16 bp, Homo sapiens
aggccggccagcctca

SEQ ID NO: 6643695 - DNA, 14 bp, Homo sapiens
aggccggccagctc

SEQ ID NO: 6643696 - DNA, 16 bp, Homo sapiens
aggccggccagctccc

SEQ ID NO: 6643697 - DNA, 19 bp, Homo sapiens
aggccggccagctccccct

SEQ ID NO: 6643698 - DNA, 12 bp, Homo sapiens
aggccggcccag

SEQ ID NO: 6643699 - DNA, 15 bp, Homo sapiens
aggccggcccagatg

SEQ ID NO: 6643700 - DNA, 13 bp, Homo sapiens
aggccggccctgc

SEQ ID NO: 6643701 - DNA, 22 bp, Homo sapiens
aggccggccctgcccctcccta

SEQ ID NO: 6643702 - DNA, 20 bp, Homo sapiens
aggccggcgagccctgtgga

SEQ ID NO: 6643703 - DNA, 20 bp, Homo sapiens
aggccggcttgccacacccc

SEQ ID NO: 6643704 - DNA, 16 bp, Homo sapiens
aggccgggcagagcac

SEQ ID NO: 6643705 - DNA, 19 bp, Homo sapiens
aggccgggcagagcacagc

SEQ ID NO: 6643706 - DNA, 18 bp, Homo sapiens
aggccgggcctgtacagt

SEQ ID NO: 6643707 - DNA, 22 bp, Homo sapiens
aggccgggcctgtacagtctgt

SEQ ID NO: 6643708 - DNA, 21 bp, Homo sapiens
aggccgggcttgggccctgca

SEQ ID NO: 6643709 - DNA, 23 bp, Homo sapiens
aggccgggctttccagaaggcca

SEQ ID NO: 6643710 - DNA, 15 bp, Homo sapiens
aggccggggccgggt

SEQ ID NO: 6643711 - DNA, 14 bp, Homo sapiens
aggccggtgggaag

SEQ ID NO: 6643712 - DNA, 15 bp, Homo sapiens
aggccgtcaccctgg

SEQ ID NO: 6643713 - DNA, 16 bp, Homo sapiens
aggccgtcctcccggg

SEQ ID NO: 6643714 - DNA, 17 bp, Homo sapiens
aggccgtcctcccgggc

SEQ ID NO: 6643715 - DNA, 21 bp, Homo sapiens
aggccgtcctcccgggccctc

SEQ ID NO: 6643716 - DNA, 22 bp, Homo sapiens
aggccgtcctcccgggccctcc

SEQ ID NO: 6643717 - DNA, 17 bp, Homo sapiens
aggccgtgacgtctggg

SEQ ID NO: 6643718 - DNA, 22 bp, Homo sapiens
aggccgtgacgtctgggtggcc

SEQ ID NO: 6643719 - DNA, 21 bp, Homo sapiens
aggccgtgggacccaggctcc

SEQ ID NO: 6643720 - DNA, 18 bp, Homo sapiens
aggccgttccccttggct

SEQ ID NO: 6643721 - DNA, 22 bp, Homo sapiens
aggccgttccccttggcttcct

SEQ ID NO: 6643722 - DNA, 23 bp, Homo sapiens
aggccgttccccttggcttcctc

SEQ ID NO: 6643723 - DNA, 21 bp, Homo sapiens
aggccgttgccgctgatgttt

SEQ ID NO: 6643724 - DNA, 22 bp, Homo sapiens
aggcctaattctatgcctgtct

SEQ ID NO: 6643725 - DNA, 14 bp, Homo sapiens
aggcctacagagga

SEQ ID NO: 6643726 - DNA, 22 bp, Homo sapiens
aggcctacatgctttgtgaaca

SEQ ID NO: 6643727 - DNA, 18 bp, Homo sapiens
aggcctaccccagttcct

SEQ ID NO: 6643728 - DNA, 13 bp, Homo sapiens
aggcctacctgct

SEQ ID NO: 6643729 - DNA, 15 bp, Homo sapiens
aggcctagaggcctg

SEQ ID NO: 6643730 - DNA, 15 bp, Homo sapiens
aggcctaggacctat

SEQ ID NO: 6643731 - DNA, 16 bp, Homo sapiens
aggcctaggaggcccc

SEQ ID NO: 6643732 - DNA, 23 bp, Homo sapiens
aggcctaggaggccccccgtgtg

SEQ ID NO: 6643733 - DNA, 16 bp, Homo sapiens
aggcctaggattctaa

SEQ ID NO: 6643734 - DNA, 15 bp, Homo sapiens
aggcctaggctagga

SEQ ID NO: 6643735 - DNA, 18 bp, Homo sapiens
aggcctaggtgcagctcc

SEQ ID NO: 6643736 - DNA, 20 bp, Homo sapiens
aggcctagtacaatcttggg

SEQ ID NO: 6643737 - DNA, 17 bp, Homo sapiens
aggcctagtcagccaca

SEQ ID NO: 6643738 - DNA, 16 bp, Homo sapiens
aggcctataatgaagc

SEQ ID NO: 6643739 - DNA, 11 bp, Homo sapiens
aggcctatcaa

SEQ ID NO: 6643740 - DNA, 15 bp, Homo sapiens
aggcctatctggaag

SEQ ID NO: 6643741 - DNA, 18 bp, Homo sapiens
aggcctatgttgatccat

SEQ ID NO: 6643742 - DNA, 20 bp, Homo sapiens
aggcctattgttgaataaat

SEQ ID NO: 6643743 - DNA, 21 bp, Homo sapiens
aggcctatttcatcacaagaa

SEQ ID NO: 6643744 - DNA, 20 bp, Homo sapiens
aggcctcaaagcaacccgct

SEQ ID NO: 6643745 - DNA, 18 bp, Homo sapiens
aggcctcaactcctccca

SEQ ID NO: 6643746 - DNA, 13 bp, Homo sapiens
aggcctcaagaac

SEQ ID NO: 6643747 - DNA, 15 bp, Homo sapiens
aggcctcaccacctg

SEQ ID NO: 6643748 - DNA, 22 bp, Homo sapiens
aggcctcacccctcccctggga

SEQ ID NO: 6643749 - DNA, 14 bp, Homo sapiens
aggcctcacctccc

SEQ ID NO: 6643750 - DNA, 15 bp, Homo sapiens
aggcctcacctccca

SEQ ID NO: 6643751 - DNA, 16 bp, Homo sapiens
aggcctcacctcccag

SEQ ID NO: 6643752 - DNA, 18 bp, Homo sapiens
aggcctcacctcccaggg

SEQ ID NO: 6643753 - DNA, 18 bp, Homo sapiens
aggcctcacctctaccca

SEQ ID NO: 6643754 - DNA, 16 bp, Homo sapiens
aggcctcacctggctt

SEQ ID NO: 6643755 - DNA, 23 bp, Homo sapiens
aggcctcacctggcttcccagga

SEQ ID NO: 6643756 - DNA, 14 bp, Homo sapiens
aggcctcactggct

SEQ ID NO: 6643757 - DNA, 15 bp, Homo sapiens
aggcctcactggctc

SEQ ID NO: 6643758 - DNA, 16 bp, Homo sapiens
aggcctcagccagaga

SEQ ID NO: 6643759 - DNA, 20 bp, Homo sapiens
aggcctcagctcttggtggg

SEQ ID NO: 6643760 - DNA, 14 bp, Homo sapiens
aggcctcaggagag

SEQ ID NO: 6643761 - DNA, 13 bp, Homo sapiens
aggcctcagggct

SEQ ID NO: 6643762 - DNA, 15 bp, Homo sapiens
aggcctcaggtgctg

SEQ ID NO: 6643763 - DNA, 15 bp, Homo sapiens
aggcctcagtggact

SEQ ID NO: 6643764 - DNA, 23 bp, Homo sapiens
aggcctcagtggactttccaccc

SEQ ID NO: 6643765 - DNA, 12 bp, Homo sapiens
aggcctcagttc

SEQ ID NO: 6643766 - DNA, 15 bp, Homo sapiens
aggcctcatccaggg

SEQ ID NO: 6643767 - DNA, 13 bp, Homo sapiens
aggcctcatccct

SEQ ID NO: 6643768 - DNA, 14 bp, Homo sapiens
aggcctcatccctc

SEQ ID NO: 6643769 - DNA, 18 bp, Homo sapiens
aggcctcatgcctgctga

SEQ ID NO: 6643770 - DNA, 19 bp, Homo sapiens
aggcctcatgcctgctgag

SEQ ID NO: 6643771 - DNA, 13 bp, Homo sapiens
aggcctccaagga

SEQ ID NO: 6643772 - DNA, 20 bp, Homo sapiens
aggcctccacgggggcggca

SEQ ID NO: 6643773 - DNA, 17 bp, Homo sapiens
aggcctccactccttcc

SEQ ID NO: 6643774 - DNA, 20 bp, Homo sapiens
aggcctccagaaccttactg

SEQ ID NO: 6643775 - DNA, 16 bp, Homo sapiens
aggcctccagcctctc

SEQ ID NO: 6643776 - DNA, 22 bp, Homo sapiens
aggcctccagcctctcccggct

SEQ ID NO: 6643777 - DNA, 14 bp, Homo sapiens
aggcctccagctca

SEQ ID NO: 6643778 - DNA, 20 bp, Homo sapiens
aggcctccagctcagcagtg

SEQ ID NO: 6643779 - DNA, 14 bp, Homo sapiens
aggcctcccaagtt

SEQ ID NO: 6643780 - DNA, 11 bp, Homo sapiens
aggcctcccca

SEQ ID NO: 6643781 - DNA, 18 bp, Homo sapiens
aggcctccccaatccagg

SEQ ID NO: 6643782 - DNA, 18 bp, Homo sapiens
aggcctcccccagccagg

SEQ ID NO: 6643783 - DNA, 14 bp, Homo sapiens
aggcctccctagca

SEQ ID NO: 6643784 - DNA, 13 bp, Homo sapiens
aggcctccctcag

SEQ ID NO: 6643785 - DNA, 23 bp, Homo sapiens
aggcctccctcaggctctgtgga

SEQ ID NO: 6643786 - DNA, 20 bp, Homo sapiens
aggcctccctcccccggggt

SEQ ID NO: 6643787 - DNA, 18 bp, Homo sapiens
aggcctccctcgggctgg

SEQ ID NO: 6643788 - DNA, 18 bp, Homo sapiens
aggcctccctgcagactc

SEQ ID NO: 6643789 - DNA, 19 bp, Homo sapiens
aggcctccctgcctcagct

SEQ ID NO: 6643790 - DNA, 13 bp, Homo sapiens
aggcctcctaggg

SEQ ID NO: 6643791 - DNA, 18 bp, Homo sapiens
aggcctcctaggggaagg

SEQ ID NO: 6643792 - DNA, 12 bp, Homo sapiens
aggcctcctccc

SEQ ID NO: 6643793 - DNA, 13 bp, Homo sapiens
aggcctcctcccc

SEQ ID NO: 6643794 - DNA, 18 bp, Homo sapiens
aggcctcctctctgccac

SEQ ID NO: 6643795 - DNA, 14 bp, Homo sapiens
aggcctcctggccc

SEQ ID NO: 6643796 - DNA, 23 bp, Homo sapiens
aggcctcctggctgtctgaggct

SEQ ID NO: 6643797 - DNA, 20 bp, Homo sapiens
aggcctcgaaaaccatcaca

SEQ ID NO: 6643798 - DNA, 15 bp, Homo sapiens
aggcctcgaggggcc

SEQ ID NO: 6643799 - DNA, 13 bp, Homo sapiens
aggcctcgcagga

SEQ ID NO: 6643800 - DNA, 14 bp, Homo sapiens
aggcctcgcctgcc

SEQ ID NO: 6643801 - DNA, 22 bp, Homo sapiens
aggcctcgcctgccctcctctc

SEQ ID NO: 6643802 - DNA, 14 bp, Homo sapiens
aggcctcggcagaa

SEQ ID NO: 6643803 - DNA, 17 bp, Homo sapiens
aggcctcggctgtctcc

SEQ ID NO: 6643804 - DNA, 19 bp, Homo sapiens
aggcctcggctgtctcctg

SEQ ID NO: 6643805 - DNA, 20 bp, Homo sapiens
aggcctctcacctctgtgcc

SEQ ID NO: 6643806 - DNA, 21 bp, Homo sapiens
aggcctctccatttgctcttc

SEQ ID NO: 6643807 - DNA, 18 bp, Homo sapiens
aggcctctctctgcctga

SEQ ID NO: 6643808 - DNA, 16 bp, Homo sapiens
aggcctctctctgctc

SEQ ID NO: 6643809 - DNA, 16 bp, Homo sapiens
aggcctctgagcccaa

SEQ ID NO: 6643810 - DNA, 13 bp, Homo sapiens
aggcctctgagga

SEQ ID NO: 6643811 - DNA, 16 bp, Homo sapiens
aggcctctgaggagcc

SEQ ID NO: 6643812 - DNA, 13 bp, Homo sapiens
aggcctctgcaag

SEQ ID NO: 6643813 - DNA, 16 bp, Homo sapiens
aggcctctgcagaagc

SEQ ID NO: 6643814 - DNA, 12 bp, Homo sapiens
aggcctctgccc

SEQ ID NO: 6643815 - DNA, 13 bp, Homo sapiens
aggcctctgcccc

SEQ ID NO: 6643816 - DNA, 20 bp, Homo sapiens
aggcctctgcctgctgggga

SEQ ID NO: 6643817 - DNA, 12 bp, Homo sapiens
aggcctctgctg

SEQ ID NO: 6643818 - DNA, 16 bp, Homo sapiens
aggcctctgctggctc

SEQ ID NO: 6643819 - DNA, 18 bp, Homo sapiens
aggcctctgctggctcag

SEQ ID NO: 6643820 - DNA, 19 bp, Homo sapiens
aggcctctggaaagcaaag

SEQ ID NO: 6643821 - DNA, 20 bp, Homo sapiens
aggcctctggactggcctgt

SEQ ID NO: 6643822 - DNA, 14 bp, Homo sapiens
aggcctctggccct

SEQ ID NO: 6643823 - DNA, 21 bp, Homo sapiens
aggcctctgggacccacagaa

SEQ ID NO: 6643824 - DNA, 18 bp, Homo sapiens
aggcctctgggcctcctc

SEQ ID NO: 6643825 - DNA, 16 bp, Homo sapiens
aggcctctgtgtcctt

SEQ ID NO: 6643826 - DNA, 23 bp, Homo sapiens
aggcctctgtgtccttccctgca

SEQ ID NO: 6643827 - DNA, 18 bp, Homo sapiens
aggcctcttgctgaaagc

SEQ ID NO: 6643828 - DNA, 14 bp, Homo sapiens
aggcctcttgctgg

SEQ ID NO: 6643829 - DNA, 15 bp, Homo sapiens
aggcctcttgctggt

SEQ ID NO: 6643830 - DNA, 17 bp, Homo sapiens
aggcctcttgctggtgc

SEQ ID NO: 6643831 - DNA, 18 bp, Homo sapiens
aggcctcttgctggtgca

SEQ ID NO: 6643832 - DNA, 15 bp, Homo sapiens
aggcctcttggagac

SEQ ID NO: 6643833 - DNA, 17 bp, Homo sapiens
aggcctcttggagacct

SEQ ID NO: 6643834 - DNA, 19 bp, Homo sapiens
aggcctcttgtaaagactg

SEQ ID NO: 6643835 - DNA, 14 bp, Homo sapiens
aggcctcttgtgct

SEQ ID NO: 6643836 - DNA, 20 bp, Homo sapiens
aggcctcttgtgctcacgct

SEQ ID NO: 6643837 - DNA, 19 bp, Homo sapiens
aggcctcttttcctgaaga

SEQ ID NO: 6643838 - DNA, 17 bp, Homo sapiens
aggcctgaaagaggctg

SEQ ID NO: 6643839 - DNA, 21 bp, Homo sapiens
aggcctgaaatgtttccaggc

SEQ ID NO: 6643840 - DNA, 21 bp, Homo sapiens
aggcctgaacccgtccattca

SEQ ID NO: 6643841 - DNA, 13 bp, Homo sapiens
aggcctgaagcca

SEQ ID NO: 6643842 - DNA, 16 bp, Homo sapiens
aggcctgaagctgagc

SEQ ID NO: 6643843 - DNA, 23 bp, Homo sapiens
aggcctgaatcatgagcctgctg

SEQ ID NO: 6643844 - DNA, 20 bp, Homo sapiens
aggcctgacccacggggcag

SEQ ID NO: 6643845 - DNA, 18 bp, Homo sapiens
aggcctgactgccaagcc

SEQ ID NO: 6643846 - DNA, 16 bp, Homo sapiens
aggcctgacttctgct

SEQ ID NO: 6643847 - DNA, 19 bp, Homo sapiens
aggcctgacttctgctggc

SEQ ID NO: 6643848 - DNA, 12 bp, Homo sapiens
aggcctgagaat

SEQ ID NO: 6643849 - DNA, 20 bp, Homo sapiens
aggcctgagaatgagtggga

SEQ ID NO: 6643850 - DNA, 22 bp, Homo sapiens
aggcctgagaatgagtgggaat

SEQ ID NO: 6643851 - DNA, 18 bp, Homo sapiens
aggcctgagacccaggac

SEQ ID NO: 6643852 - DNA, 19 bp, Homo sapiens
aggcctgagatttcatctg

SEQ ID NO: 6643853 - DNA, 20 bp, Homo sapiens
aggcctgagatttcatctgc

SEQ ID NO: 6643854 - DNA, 12 bp, Homo sapiens
aggcctgagccc

SEQ ID NO: 6643855 - DNA, 14 bp, Homo sapiens
aggcctgagcgctc

SEQ ID NO: 6643856 - DNA, 18 bp, Homo sapiens
aggcctgagcgctcctgc

SEQ ID NO: 6643857 - DNA, 14 bp, Homo sapiens
aggcctgagctgct

SEQ ID NO: 6643858 - DNA, 19 bp, Homo sapiens
aggcctgaggatgagctgg

SEQ ID NO: 6643859 - DNA, 23 bp, Homo sapiens
aggcctgaggatgagctggaagg

SEQ ID NO: 6643860 - DNA, 14 bp, Homo sapiens
aggcctgaggcctg

SEQ ID NO: 6643861 - DNA, 19 bp, Homo sapiens
aggcctgaggcctgtgcct

SEQ ID NO: 6643862 - DNA, 15 bp, Homo sapiens
aggcctgagggaagc

SEQ ID NO: 6643863 - DNA, 19 bp, Homo sapiens
aggcctgagggaagcccac

SEQ ID NO: 6643864 - DNA, 12 bp, Homo sapiens
aggcctgagggg

SEQ ID NO: 6643865 - DNA, 13 bp, Homo sapiens
aggcctgaggggc

SEQ ID NO: 6643866 - DNA, 17 bp, Homo sapiens
aggcctgatgctgcccc

SEQ ID NO: 6643867 - DNA, 19 bp, Homo sapiens
aggcctgcaaaccttcctg

SEQ ID NO: 6643868 - DNA, 22 bp, Homo sapiens
aggcctgcaaaccttcctggga

SEQ ID NO: 6643869 - DNA, 14 bp, Homo sapiens
aggcctgcacacaa

SEQ ID NO: 6643870 - DNA, 15 bp, Homo sapiens
aggcctgccaatgcc

SEQ ID NO: 6643871 - DNA, 23 bp, Homo sapiens
aggcctgccagacggcacccacc

SEQ ID NO: 6643872 - DNA, 18 bp, Homo sapiens
aggcctgccccccttccc

SEQ ID NO: 6643873 - DNA, 19 bp, Homo sapiens
aggcctgccccccttccca

SEQ ID NO: 6643874 - DNA, 17 bp, Homo sapiens
aggcctgccccctgggc

SEQ ID NO: 6643875 - DNA, 11 bp, Homo sapiens
aggcctgccct

SEQ ID NO: 6643876 - DNA, 12 bp, Homo sapiens
aggcctgccctc

SEQ ID NO: 6643877 - DNA, 16 bp, Homo sapiens
aggcctgccctcaggg

SEQ ID NO: 6643878 - DNA, 22 bp, Homo sapiens
aggcctgccctcagggatcttg

SEQ ID NO: 6643879 - DNA, 13 bp, Homo sapiens
aggcctgccctgc

SEQ ID NO: 6643880 - DNA, 15 bp, Homo sapiens
aggcctgccctgcta

SEQ ID NO: 6643881 - DNA, 22 bp, Homo sapiens
aggcctgccgctttgatggagg

SEQ ID NO: 6643882 - DNA, 13 bp, Homo sapiens
aggcctgcctgtt

SEQ ID NO: 6643883 - DNA, 15 bp, Homo sapiens
aggcctgcgggcccc

SEQ ID NO: 6643884 - DNA, 17 bp, Homo sapiens
aggcctgctagtcactg

SEQ ID NO: 6643885 - DNA, 18 bp, Homo sapiens
aggcctgctgccagtgca

SEQ ID NO: 6643886 - DNA, 15 bp, Homo sapiens
aggcctgctggcatc

SEQ ID NO: 6643887 - DNA, 19 bp, Homo sapiens
aggcctgctggcatcaggt

SEQ ID NO: 6643888 - DNA, 22 bp, Homo sapiens
aggcctgctggcatcaggtctg

SEQ ID NO: 6643889 - DNA, 21 bp, Homo sapiens
aggcctgcttgactttccaga

SEQ ID NO: 6643890 - DNA, 19 bp, Homo sapiens
aggcctgcttttgtgtccc

SEQ ID NO: 6643891 - DNA, 14 bp, Homo sapiens
aggcctggaaccag

SEQ ID NO: 6643892 - DNA, 17 bp, Homo sapiens
aggcctggaaccaggga

SEQ ID NO: 6643893 - DNA, 18 bp, Homo sapiens
aggcctggaaccagggag

SEQ ID NO: 6643894 - DNA, 15 bp, Homo sapiens
aggcctggaagagct

SEQ ID NO: 6643895 - DNA, 11 bp, Homo sapiens
aggcctggacc

SEQ ID NO: 6643896 - DNA, 13 bp, Homo sapiens
aggcctggaccga

SEQ ID NO: 6643897 - DNA, 17 bp, Homo sapiens
aggcctggacgggccct

SEQ ID NO: 6643898 - DNA, 18 bp, Homo sapiens
aggcctggacgggccctc

SEQ ID NO: 6643899 - DNA, 17 bp, Homo sapiens
aggcctggactttcctg

SEQ ID NO: 6643900 - DNA, 18 bp, Homo sapiens
aggcctggactttcctgc

SEQ ID NO: 6643901 - DNA, 15 bp, Homo sapiens
aggcctggagcccac

SEQ ID NO: 6643902 - DNA, 13 bp, Homo sapiens
aggcctggagggc

SEQ ID NO: 6643903 - DNA, 15 bp, Homo sapiens
aggcctggagggcac

SEQ ID NO: 6643904 - DNA, 16 bp, Homo sapiens
aggcctggagggcact

SEQ ID NO: 6643905 - DNA, 13 bp, Homo sapiens
aggcctggcacag

SEQ ID NO: 6643906 - DNA, 18 bp, Homo sapiens
aggcctggcatcttctgg

SEQ ID NO: 6643907 - DNA, 10 bp, Homo sapiens
aggcctggcc

SEQ ID NO: 6643908 - DNA, 15 bp, Homo sapiens
aggcctggccaatgc

SEQ ID NO: 6643909 - DNA, 22 bp, Homo sapiens
aggcctggccaatgcggcccac

SEQ ID NO: 6643910 - DNA, 12 bp, Homo sapiens
aggcctggccag

SEQ ID NO: 6643911 - DNA, 22 bp, Homo sapiens
aggcctggccagatgcaccagc

SEQ ID NO: 6643912 - DNA, 23 bp, Homo sapiens
aggcctggccagatgcaccagcc

SEQ ID NO: 6643913 - DNA, 15 bp, Homo sapiens
aggcctggccaggca

SEQ ID NO: 6643914 - DNA, 14 bp, Homo sapiens
aggcctggcccagc

SEQ ID NO: 6643915 - DNA, 22 bp, Homo sapiens
aggcctggcccagccagcaggt

SEQ ID NO: 6643916 - DNA, 17 bp, Homo sapiens
aggcctggccctttcac

SEQ ID NO: 6643917 - DNA, 21 bp, Homo sapiens
aggcctggcctcaactgagaa

SEQ ID NO: 6643918 - DNA, 15 bp, Homo sapiens
aggcctggcctcatc

SEQ ID NO: 6643919 - DNA, 13 bp, Homo sapiens
aggcctggcctcg

SEQ ID NO: 6643920 - DNA, 18 bp, Homo sapiens
aggcctggcctcgcctgc

SEQ ID NO: 6643921 - DNA, 15 bp, Homo sapiens
aggcctggcctctgg

SEQ ID NO: 6643922 - DNA, 16 bp, Homo sapiens
aggcctggccttgtca

SEQ ID NO: 6643923 - DNA, 20 bp, Homo sapiens
aggcctggccttgtcaggac

SEQ ID NO: 6643924 - DNA, 22 bp, Homo sapiens
aggcctggccttgtcaggaccc

SEQ ID NO: 6643925 - DNA, 18 bp, Homo sapiens
aggcctggcgtcggccag

SEQ ID NO: 6643926 - DNA, 20 bp, Homo sapiens
aggcctggcgtcggccagag

SEQ ID NO: 6643927 - DNA, 24 bp, Homo sapiens
aggcctggctccccgagggctcag

SEQ ID NO: 6643928 - DNA, 13 bp, Homo sapiens
aggcctggctgga

SEQ ID NO: 6643929 - DNA, 17 bp, Homo sapiens
aggcctggctggaagag

SEQ ID NO: 6643930 - DNA, 21 bp, Homo sapiens
aggcctggctggaggagcagc

SEQ ID NO: 6643931 - DNA, 19 bp, Homo sapiens
aggcctgggacccagctac

SEQ ID NO: 6643932 - DNA, 20 bp, Homo sapiens
aggcctgggagatgcagctg

SEQ ID NO: 6643933 - DNA, 15 bp, Homo sapiens
aggcctgggagggca

SEQ ID NO: 6643934 - DNA, 14 bp, Homo sapiens
aggcctgggcagga

SEQ ID NO: 6643935 - DNA, 16 bp, Homo sapiens
aggcctgggctgggaa

SEQ ID NO: 6643936 - DNA, 12 bp, Homo sapiens
aggcctggggac

SEQ ID NO: 6643937 - DNA, 18 bp, Homo sapiens
aggcctggggaggcccta

SEQ ID NO: 6643938 - DNA, 17 bp, Homo sapiens
aggcctgggggcaggga

SEQ ID NO: 6643939 - DNA, 18 bp, Homo sapiens
aggcctgggggctgggca

SEQ ID NO: 6643940 - DNA, 21 bp, Homo sapiens
aggcctggggtgacccggcac

SEQ ID NO: 6643941 - DNA, 20 bp, Homo sapiens
aggcctggggtgggacaggg

SEQ ID NO: 6643942 - DNA, 23 bp, Homo sapiens
aggcctggggtgggacagggagg

SEQ ID NO: 6643943 - DNA, 17 bp, Homo sapiens
aggcctgggtcacgctc

SEQ ID NO: 6643944 - DNA, 20 bp, Homo sapiens
aggcctgggtcacgctcaag

SEQ ID NO: 6643945 - DNA, 17 bp, Homo sapiens
aggcctgggtgctggct

SEQ ID NO: 6643946 - DNA, 12 bp, Homo sapiens
aggcctgggtgg

SEQ ID NO: 6643947 - DNA, 23 bp, Homo sapiens
aggcctgggtggatcggcctcct

SEQ ID NO: 6643948 - DNA, 19 bp, Homo sapiens
aggcctgggtgtgacctga

SEQ ID NO: 6643949 - DNA, 23 bp, Homo sapiens
aggcctgggtttgtacttccacc

SEQ ID NO: 6643950 - DNA, 20 bp, Homo sapiens
aggcctggtcagcagagccg

SEQ ID NO: 6643951 - DNA, 23 bp, Homo sapiens
aggcctggtcagcagagccgccc

SEQ ID NO: 6643952 - DNA, 15 bp, Homo sapiens
aggcctggtctggag

SEQ ID NO: 6643953 - DNA, 21 bp, Homo sapiens
aggcctggtctggagccccta

SEQ ID NO: 6643954 - DNA, 17 bp, Homo sapiens
aggcctggtctgggagt

SEQ ID NO: 6643955 - DNA, 15 bp, Homo sapiens
aggcctggtgccctg

SEQ ID NO: 6643956 - DNA, 18 bp, Homo sapiens
aggcctggtgccctggcc

SEQ ID NO: 6643957 - DNA, 21 bp, Homo sapiens
aggcctggtgccctggcccag

SEQ ID NO: 6643958 - DNA, 22 bp, Homo sapiens
aggcctggtgccctggcccagc

SEQ ID NO: 6643959 - DNA, 15 bp, Homo sapiens
aggcctggtggaggg

SEQ ID NO: 6643960 - DNA, 17 bp, Homo sapiens
aggcctggtgtttcttg

SEQ ID NO: 6643961 - DNA, 13 bp, Homo sapiens
aggcctgtcccaa

SEQ ID NO: 6643962 - DNA, 15 bp, Homo sapiens
aggcctgtccctggc

SEQ ID NO: 6643963 - DNA, 17 bp, Homo sapiens
aggcctgtccctggcca

SEQ ID NO: 6643964 - DNA, 17 bp, Homo sapiens
aggcctgtccctgggag

SEQ ID NO: 6643965 - DNA, 17 bp, Homo sapiens
aggcctgtcccttgcct

SEQ ID NO: 6643966 - DNA, 22 bp, Homo sapiens
aggcctgtcctgacctgtctca

SEQ ID NO: 6643967 - DNA, 17 bp, Homo sapiens
aggcctgtgatccagga

SEQ ID NO: 6643968 - DNA, 15 bp, Homo sapiens
aggcctgtgcctgtc

SEQ ID NO: 6643969 - DNA, 16 bp, Homo sapiens
aggcctgtgctgcatg

SEQ ID NO: 6643970 - DNA, 23 bp, Homo sapiens
aggcctgtggccccaccgagctg

SEQ ID NO: 6643971 - DNA, 14 bp, Homo sapiens
aggcctgtggggag

SEQ ID NO: 6643972 - DNA, 23 bp, Homo sapiens
aggcctgtgtgtgaaaggaagct

SEQ ID NO: 6643973 - DNA, 23 bp, Homo sapiens
aggcctgtgtgttgccaggcagg

SEQ ID NO: 6643974 - DNA, 12 bp, Homo sapiens
aggcctgttccc

SEQ ID NO: 6643975 - DNA, 16 bp, Homo sapiens
aggcctgttccctgag

SEQ ID NO: 6643976 - DNA, 19 bp, Homo sapiens
aggcctgttccctgaggac

SEQ ID NO: 6643977 - DNA, 20 bp, Homo sapiens
aggcctgttccctgaggacc

SEQ ID NO: 6643978 - DNA, 16 bp, Homo sapiens
aggcctgtttggcctc

SEQ ID NO: 6643979 - DNA, 17 bp, Homo sapiens
aggccttacatctggct

SEQ ID NO: 6643980 - DNA, 20 bp, Homo sapiens
aggccttagtacggctgctg

SEQ ID NO: 6643981 - DNA, 19 bp, Homo sapiens
aggccttatcattcattct

SEQ ID NO: 6643982 - DNA, 17 bp, Homo sapiens
aggccttatctccaaga

SEQ ID NO: 6643983 - DNA, 14 bp, Homo sapiens
aggccttcagaaaa

SEQ ID NO: 6643984 - DNA, 19 bp, Homo sapiens
aggccttcagaaaagacac

SEQ ID NO: 6643985 - DNA, 23 bp, Homo sapiens
aggccttcagaaaagacacttca

SEQ ID NO: 6643986 - DNA, 15 bp, Homo sapiens
aggccttcagacaca

SEQ ID NO: 6643987 - DNA, 18 bp, Homo sapiens
aggccttcagacacatgc

SEQ ID NO: 6643988 - DNA, 11 bp, Homo sapiens
aggccttcagt

SEQ ID NO: 6643989 - DNA, 11 bp, Homo sapiens
aggccttcatc

SEQ ID NO: 6643990 - DNA, 15 bp, Homo sapiens
aggccttccctgtca

SEQ ID NO: 6643991 - DNA, 15 bp, Homo sapiens
aggccttcctcctct

SEQ ID NO: 6643992 - DNA, 17 bp, Homo sapiens
aggccttcctcctctca

SEQ ID NO: 6643993 - DNA, 23 bp, Homo sapiens
aggccttcctcctctcaaacctg

SEQ ID NO: 6643994 - DNA, 17 bp, Homo sapiens
aggccttctcaggctgg

SEQ ID NO: 6643995 - DNA, 13 bp, Homo sapiens
aggccttctcctc

SEQ ID NO: 6643996 - DNA, 17 bp, Homo sapiens
aggccttctctgaagga

SEQ ID NO: 6643997 - DNA, 19 bp, Homo sapiens
aggccttctcttgaggcct

SEQ ID NO: 6643998 - DNA, 18 bp, Homo sapiens
aggccttctgatttcaag

SEQ ID NO: 6643999 - DNA, 15 bp, Homo sapiens
aggccttctgtgggg

SEQ ID NO: 6644000 - DNA, 19 bp, Homo sapiens
aggccttctgtggggctgg

SEQ ID NO: 6644001 - DNA, 23 bp, Homo sapiens
aggccttctgtggggctgggcac

SEQ ID NO: 6644002 - DNA, 21 bp, Homo sapiens
aggccttcttgtgatcttgct

SEQ ID NO: 6644003 - DNA, 16 bp, Homo sapiens
aggccttgctgactct

SEQ ID NO: 6644004 - DNA, 19 bp, Homo sapiens
aggccttgctgactctctg

SEQ ID NO: 6644005 - DNA, 15 bp, Homo sapiens
aggccttgctggggt

SEQ ID NO: 6644006 - DNA, 12 bp, Homo sapiens
aggccttgctgt

SEQ ID NO: 6644007 - DNA, 18 bp, Homo sapiens
aggccttgggctctgctg

SEQ ID NO: 6644008 - DNA, 20 bp, Homo sapiens
aggccttgggggtctgctct

SEQ ID NO: 6644009 - DNA, 17 bp, Homo sapiens
aggccttggggtggggg

SEQ ID NO: 6644010 - DNA, 21 bp, Homo sapiens
aggccttggggtgggggccag

SEQ ID NO: 6644011 - DNA, 22 bp, Homo sapiens
aggccttggggtgggggccagg

SEQ ID NO: 6644012 - DNA, 21 bp, Homo sapiens
aggccttgggtggccccctct

SEQ ID NO: 6644013 - DNA, 18 bp, Homo sapiens
aggccttggtggagcagc

SEQ ID NO: 6644014 - DNA, 20 bp, Homo sapiens
aggccttggtggagcagcca

SEQ ID NO: 6644015 - DNA, 23 bp, Homo sapiens
aggccttggtggagcagccagag

SEQ ID NO: 6644016 - DNA, 21 bp, Homo sapiens
aggcctttagatattattcat

SEQ ID NO: 6644017 - DNA, 14 bp, Homo sapiens
aggcctttcctaca

SEQ ID NO: 6644018 - DNA, 15 bp, Homo sapiens
aggcctttcctctgc

SEQ ID NO: 6644019 - DNA, 17 bp, Homo sapiens
aggcctttcctctgcac

SEQ ID NO: 6644020 - DNA, 15 bp, Homo sapiens
aggcctttctggcct

SEQ ID NO: 6644021 - DNA, 16 bp, Homo sapiens
aggcctttggagggga

SEQ ID NO: 6644022 - DNA, 13 bp, Homo sapiens
aggcctttgggat

SEQ ID NO: 6644023 - DNA, 18 bp, Homo sapiens
aggccttttaacattttg

SEQ ID NO: 6644024 - DNA, 16 bp, Homo sapiens
aggccttttgactctt

SEQ ID NO: 6644025 - DNA, 18 bp, Homo sapiens
aggcctttttcaaccaga

SEQ ID NO: 6644026 - DNA, 16 bp, Homo sapiens
aggcctttttgagcca

SEQ ID NO: 6644027 - DNA, 12 bp, Homo sapiens
aggcgaagctga

SEQ ID NO: 6644028 - DNA, 14 bp, Homo sapiens
aggcgaataaatgt

SEQ ID NO: 6644029 - DNA, 14 bp, Homo sapiens
aggcgactggaggc

SEQ ID NO: 6644030 - DNA, 19 bp, Homo sapiens
aggcgacttcctctccagc

SEQ ID NO: 6644031 - DNA, 21 bp, Homo sapiens
aggcgagccagattaggcctg

SEQ ID NO: 6644032 - DNA, 14 bp, Homo sapiens
aggcgagccaggca

SEQ ID NO: 6644033 - DNA, 15 bp, Homo sapiens
aggcgagccaggcaa

SEQ ID NO: 6644034 - DNA, 16 bp, Homo sapiens
aggcgagcctgactct

SEQ ID NO: 6644035 - DNA, 12 bp, Homo sapiens
aggcgagcctgg

SEQ ID NO: 6644036 - DNA, 19 bp, Homo sapiens
aggcgagctccttgaagaa

SEQ ID NO: 6644037 - DNA, 22 bp, Homo sapiens
aggcgaggaggccgttgccgct

SEQ ID NO: 6644038 - DNA, 16 bp, Homo sapiens
aggcgaggcgaagctg

SEQ ID NO: 6644039 - DNA, 18 bp, Homo sapiens
aggcgaggctgcctctgg

SEQ ID NO: 6644040 - DNA, 20 bp, Homo sapiens
aggcgaggctgcctctgggt

SEQ ID NO: 6644041 - DNA, 19 bp, Homo sapiens
aggcgatcacaacgtgcat

SEQ ID NO: 6644042 - DNA, 18 bp, Homo sapiens
aggcgatgtggtgacccc

SEQ ID NO: 6644043 - DNA, 22 bp, Homo sapiens
aggcgcactgtgacccccagct

SEQ ID NO: 6644044 - DNA, 23 bp, Homo sapiens
aggcgcactttcctcctggcaga

SEQ ID NO: 6644045 - DNA, 20 bp, Homo sapiens
aggcgcagaggtcccagccc

SEQ ID NO: 6644046 - DNA, 16 bp, Homo sapiens
aggcgcagcccgaagc

SEQ ID NO: 6644047 - DNA, 21 bp, Homo sapiens
aggcgcagcccgaagcccagt

SEQ ID NO: 6644048 - DNA, 13 bp, Homo sapiens
aggcgcagcccta

SEQ ID NO: 6644049 - DNA, 19 bp, Homo sapiens
aggcgcagccctagtggga

SEQ ID NO: 6644050 - DNA, 23 bp, Homo sapiens
aggcgcaggcgaccgggcctccc

SEQ ID NO: 6644051 - DNA, 13 bp, Homo sapiens
aggcgcagggaca

SEQ ID NO: 6644052 - DNA, 19 bp, Homo sapiens
aggcgcagggacatggggc

SEQ ID NO: 6644053 - DNA, 21 bp, Homo sapiens
aggcgcagtgcttctctacag

SEQ ID NO: 6644054 - DNA, 17 bp, Homo sapiens
aggcgcatgtctgcacc

SEQ ID NO: 6644055 - DNA, 21 bp, Homo sapiens
aggcgccccaacccgtggagg

SEQ ID NO: 6644056 - DNA, 14 bp, Homo sapiens
aggcgcccccgccc

SEQ ID NO: 6644057 - DNA, 18 bp, Homo sapiens
aggcgcccccgccccagg

SEQ ID NO: 6644058 - DNA, 20 bp, Homo sapiens
aggcgcccccgccccaggct

SEQ ID NO: 6644059 - DNA, 14 bp, Homo sapiens
aggcgcccctgggg

SEQ ID NO: 6644060 - DNA, 14 bp, Homo sapiens
aggcgccccttccc

SEQ ID NO: 6644061 - DNA, 16 bp, Homo sapiens
aggcgccgcctcgccc

SEQ ID NO: 6644062 - DNA, 14 bp, Homo sapiens
aggcgccggcgggc

SEQ ID NO: 6644063 - DNA, 18 bp, Homo sapiens
aggcgcctataatcccag

SEQ ID NO: 6644064 - DNA, 19 bp, Homo sapiens
aggcgcctataatcccagc

SEQ ID NO: 6644065 - DNA, 14 bp, Homo sapiens
aggcgcctggcaca

SEQ ID NO: 6644066 - DNA, 14 bp, Homo sapiens
aggcgccttcctgg

SEQ ID NO: 6644067 - DNA, 16 bp, Homo sapiens
aggcgcgcaccgccca

SEQ ID NO: 6644068 - DNA, 18 bp, Homo sapiens
aggcgcgccgacgcctgt

SEQ ID NO: 6644069 - DNA, 14 bp, Homo sapiens
aggcgcggcctccc

SEQ ID NO: 6644070 - DNA, 18 bp, Homo sapiens
aggcgcggcctcccgagg

SEQ ID NO: 6644071 - DNA, 22 bp, Homo sapiens
aggcgcggttcaggtcagggct

SEQ ID NO: 6644072 - DNA, 14 bp, Homo sapiens
aggcgctcagaggc

SEQ ID NO: 6644073 - DNA, 16 bp, Homo sapiens
aggcgctcagaggccg

SEQ ID NO: 6644074 - DNA, 17 bp, Homo sapiens
aggcgctcagaggccgc

SEQ ID NO: 6644075 - DNA, 18 bp, Homo sapiens
aggcgctcgctcccatgc

SEQ ID NO: 6644076 - DNA, 16 bp, Homo sapiens
aggcgctgcagggccg

SEQ ID NO: 6644077 - DNA, 22 bp, Homo sapiens
aggcgctgcccacctgccggcc

SEQ ID NO: 6644078 - DNA, 15 bp, Homo sapiens
aggcgctggacagag

SEQ ID NO: 6644079 - DNA, 22 bp, Homo sapiens
aggcgctggagcctgcggggca

SEQ ID NO: 6644080 - DNA, 22 bp, Homo sapiens
aggcgctgggggctggacctgc

SEQ ID NO: 6644081 - DNA, 13 bp, Homo sapiens
aggcgctgggtgc

SEQ ID NO: 6644082 - DNA, 17 bp, Homo sapiens
aggcgctgggtgcctgc

SEQ ID NO: 6644083 - DNA, 16 bp, Homo sapiens
aggcgcttctccaatg

SEQ ID NO: 6644084 - DNA, 15 bp, Homo sapiens
aggcggaaaccttgc

SEQ ID NO: 6644085 - DNA, 18 bp, Homo sapiens
aggcggacgttccagccg

SEQ ID NO: 6644086 - DNA, 17 bp, Homo sapiens
aggcggaggctgtgctc

SEQ ID NO: 6644087 - DNA, 19 bp, Homo sapiens
aggcggagggtctccctgg

SEQ ID NO: 6644088 - DNA, 24 bp, Homo sapiens
aggcggcacattggcagtgtgtca

SEQ ID NO: 6644089 - DNA, 13 bp, Homo sapiens
aggcggcagctgg

SEQ ID NO: 6644090 - DNA, 14 bp, Homo sapiens
aggcggcaggcaga

SEQ ID NO: 6644091 - DNA, 12 bp, Homo sapiens
aggcggccaggg

SEQ ID NO: 6644092 - DNA, 18 bp, Homo sapiens
aggcggccagggcggcca

SEQ ID NO: 6644093 - DNA, 16 bp, Homo sapiens
aggcggcccctcccgc

SEQ ID NO: 6644094 - DNA, 13 bp, Homo sapiens
aggcggcccggcc

SEQ ID NO: 6644095 - DNA, 17 bp, Homo sapiens
aggcggcccggccagcg

SEQ ID NO: 6644096 - DNA, 20 bp, Homo sapiens
aggcggcccggccagcgggc

SEQ ID NO: 6644097 - DNA, 16 bp, Homo sapiens
aggcggccctggggag

SEQ ID NO: 6644098 - DNA, 15 bp, Homo sapiens
aggcggctccaggtc

SEQ ID NO: 6644099 - DNA, 16 bp, Homo sapiens
aggcggctccaggtcc

SEQ ID NO: 6644100 - DNA, 17 bp, Homo sapiens
aggcggctccaggtccg

SEQ ID NO: 6644101 - DNA, 20 bp, Homo sapiens
aggcggctcctcctcaccca

SEQ ID NO: 6644102 - DNA, 21 bp, Homo sapiens
aggcgggaaaagcagcccttg

SEQ ID NO: 6644103 - DNA, 22 bp, Homo sapiens
aggcgggaaccctctggggccc

SEQ ID NO: 6644104 - DNA, 18 bp, Homo sapiens
aggcgggacagtgctgca

SEQ ID NO: 6644105 - DNA, 22 bp, Homo sapiens
aggcgggactatcaggagtcca

SEQ ID NO: 6644106 - DNA, 15 bp, Homo sapiens
aggcgggagatggac

SEQ ID NO: 6644107 - DNA, 15 bp, Homo sapiens
aggcgggagctctcc

SEQ ID NO: 6644108 - DNA, 21 bp, Homo sapiens
aggcgggaggggcagaacaga

SEQ ID NO: 6644109 - DNA, 15 bp, Homo sapiens
aggcgggccagccag

SEQ ID NO: 6644110 - DNA, 21 bp, Homo sapiens
aggcgggccagccaggcgggc

SEQ ID NO: 6644111 - DNA, 15 bp, Homo sapiens
aggcgggccccagac

SEQ ID NO: 6644112 - DNA, 19 bp, Homo sapiens
aggcgggctcggaggctac

SEQ ID NO: 6644113 - DNA, 22 bp, Homo sapiens
aggcggggaggaggagctgccg

SEQ ID NO: 6644114 - DNA, 13 bp, Homo sapiens
aggcggggctcct

SEQ ID NO: 6644115 - DNA, 14 bp, Homo sapiens
aggcggggcttgcc

SEQ ID NO: 6644116 - DNA, 15 bp, Homo sapiens
aggcgggggagcctg

SEQ ID NO: 6644117 - DNA, 21 bp, Homo sapiens
aggcgggggagcctggagccc

SEQ ID NO: 6644118 - DNA, 22 bp, Homo sapiens
aggcgggggagcctggagcccc

SEQ ID NO: 6644119 - DNA, 22 bp, Homo sapiens
aggcggggggggcgcctggaga

SEQ ID NO: 6644120 - DNA, 20 bp, Homo sapiens
aggcggggtattcccactca

SEQ ID NO: 6644121 - DNA, 16 bp, Homo sapiens
aggcggggtgctgtgg

SEQ ID NO: 6644122 - DNA, 18 bp, Homo sapiens
aggcggtatccagaggtg

SEQ ID NO: 6644123 - DNA, 17 bp, Homo sapiens
aggcggtcactgcccac

SEQ ID NO: 6644124 - DNA, 15 bp, Homo sapiens
aggcggtcatgtgtg

SEQ ID NO: 6644125 - DNA, 18 bp, Homo sapiens
aggcggtcatgtgtgcat

SEQ ID NO: 6644126 - DNA, 19 bp, Homo sapiens
aggcggtcatgtgtgcatg

SEQ ID NO: 6644127 - DNA, 21 bp, Homo sapiens
aggcggtcatgtgtgcatgtg

SEQ ID NO: 6644128 - DNA, 20 bp, Homo sapiens
aggcggtggacttgaacttt

SEQ ID NO: 6644129 - DNA, 21 bp, Homo sapiens
aggcggtgggcacccaccctg

SEQ ID NO: 6644130 - DNA, 21 bp, Homo sapiens
aggcggttgtaagaggatgtg

SEQ ID NO: 6644131 - DNA, 15 bp, Homo sapiens
aggcgtactacccag

SEQ ID NO: 6644132 - DNA, 15 bp, Homo sapiens
aggcgtagggccagg

SEQ ID NO: 6644133 - DNA, 22 bp, Homo sapiens
aggcgtagggccagggctctgg

SEQ ID NO: 6644134 - DNA, 19 bp, Homo sapiens
aggcgtcaccatccacctt

SEQ ID NO: 6644135 - DNA, 21 bp, Homo sapiens
aggcgtccgcgcgccagcaca

SEQ ID NO: 6644136 - DNA, 18 bp, Homo sapiens
aggcgtctgtatattttg

SEQ ID NO: 6644137 - DNA, 21 bp, Homo sapiens
aggcgtctgtatattttggga

SEQ ID NO: 6644138 - DNA, 22 bp, Homo sapiens
aggcgtcttcatctccctgcca

SEQ ID NO: 6644139 - DNA, 23 bp, Homo sapiens
aggcgtcttcatctccctgccat

SEQ ID NO: 6644140 - DNA, 13 bp, Homo sapiens
aggcgtcttgtat

SEQ ID NO: 6644141 - DNA, 17 bp, Homo sapiens
aggcgtcttgtattttc

SEQ ID NO: 6644142 - DNA, 19 bp, Homo sapiens
aggcgtgactcagcagcct

SEQ ID NO: 6644143 - DNA, 17 bp, Homo sapiens
aggcgtgagccacctcg

SEQ ID NO: 6644144 - DNA, 16 bp, Homo sapiens
aggcgtgagccactgc

SEQ ID NO: 6644145 - DNA, 13 bp, Homo sapiens
aggcgtgaggatg

SEQ ID NO: 6644146 - DNA, 17 bp, Homo sapiens
aggcgtggagctgcctg

SEQ ID NO: 6644147 - DNA, 18 bp, Homo sapiens
aggcgtggagctgcctga

SEQ ID NO: 6644148 - DNA, 15 bp, Homo sapiens
aggcgtggaggagag

SEQ ID NO: 6644149 - DNA, 16 bp, Homo sapiens
aggcgtggaggagagg

SEQ ID NO: 6644150 - DNA, 17 bp, Homo sapiens
aggcgtggcttctgcag

SEQ ID NO: 6644151 - DNA, 17 bp, Homo sapiens
aggcgtgggatcagatt

SEQ ID NO: 6644152 - DNA, 13 bp, Homo sapiens
aggcgtgggatcc

SEQ ID NO: 6644153 - DNA, 17 bp, Homo sapiens
aggcgtgggatccagag

SEQ ID NO: 6644154 - DNA, 18 bp, Homo sapiens
aggcgtgggatccagaga

SEQ ID NO: 6644155 - DNA, 20 bp, Homo sapiens
aggcgtgggctgaccaggct

SEQ ID NO: 6644156 - DNA, 18 bp, Homo sapiens
aggcgtggtggtgcatgc

SEQ ID NO: 6644157 - DNA, 13 bp, Homo sapiens
aggcgtgtgcagg

SEQ ID NO: 6644158 - DNA, 22 bp, Homo sapiens
aggcgtgtggcagccacacgca

SEQ ID NO: 6644159 - DNA, 16 bp, Homo sapiens
aggcgttagtgggcag

SEQ ID NO: 6644160 - DNA, 20 bp, Homo sapiens
aggcgttagtgggcaggtgg

SEQ ID NO: 6644161 - DNA, 18 bp, Homo sapiens
aggcgttctcctgcttgt

SEQ ID NO: 6644162 - DNA, 15 bp, Homo sapiens
aggcgttggtgccac

SEQ ID NO: 6644163 - DNA, 13 bp, Homo sapiens
aggctaaaaacat

SEQ ID NO: 6644164 - DNA, 14 bp, Homo sapiens
aggctaaaaagcaa

SEQ ID NO: 6644165 - DNA, 20 bp, Homo sapiens
aggctaaaaggcttccaggc

SEQ ID NO: 6644166 - DNA, 16 bp, Homo sapiens
aggctaaaatgttttc

SEQ ID NO: 6644167 - DNA, 19 bp, Homo sapiens
aggctaaaatgttttcagc

SEQ ID NO: 6644168 - DNA, 13 bp, Homo sapiens
aggctaaacatcc

SEQ ID NO: 6644169 - DNA, 16 bp, Homo sapiens
aggctaaactggtgca

SEQ ID NO: 6644170 - DNA, 18 bp, Homo sapiens
aggctaaagcccagagac

SEQ ID NO: 6644171 - DNA, 14 bp, Homo sapiens
aggctaagaaaaag

SEQ ID NO: 6644172 - DNA, 15 bp, Homo sapiens
aggctaagaaaaagg

SEQ ID NO: 6644173 - DNA, 17 bp, Homo sapiens
aggctaagaaaaaggaa

SEQ ID NO: 6644174 - DNA, 20 bp, Homo sapiens
aggctaagaccctgtgtcct

SEQ ID NO: 6644175 - DNA, 21 bp, Homo sapiens
aggctaagatgagatttgcca

SEQ ID NO: 6644176 - DNA, 22 bp, Homo sapiens
aggctaagatgagatttgccag

SEQ ID NO: 6644177 - DNA, 15 bp, Homo sapiens
aggctaagcatggcc

SEQ ID NO: 6644178 - DNA, 16 bp, Homo sapiens
aggctaagcctggaca

SEQ ID NO: 6644179 - DNA, 15 bp, Homo sapiens
aggctaaggcgtgga

SEQ ID NO: 6644180 - DNA, 13 bp, Homo sapiens
aggctaagttggg

SEQ ID NO: 6644181 - DNA, 24 bp, Homo sapiens
aggctaagttgggatctaggagag

SEQ ID NO: 6644182 - DNA, 13 bp, Homo sapiens
aggctaatgtcaa

SEQ ID NO: 6644183 - DNA, 14 bp, Homo sapiens
aggctaatgtcaaa

SEQ ID NO: 6644184 - DNA, 19 bp, Homo sapiens
aggctaattcagtgtcaca

SEQ ID NO: 6644185 - DNA, 20 bp, Homo sapiens
aggctaattttttatccttt

SEQ ID NO: 6644186 - DNA, 18 bp, Homo sapiens
aggctacaattttctccc

SEQ ID NO: 6644187 - DNA, 22 bp, Homo sapiens
aggctacaattttctcccagga

SEQ ID NO: 6644188 - DNA, 18 bp, Homo sapiens
aggctacactgacactgg

SEQ ID NO: 6644189 - DNA, 14 bp, Homo sapiens
aggctacagaatga

SEQ ID NO: 6644190 - DNA, 13 bp, Homo sapiens
aggctacagagaa

SEQ ID NO: 6644191 - DNA, 22 bp, Homo sapiens
aggctacagagaagccttcaag

SEQ ID NO: 6644192 - DNA, 18 bp, Homo sapiens
aggctacaggtgccccac

SEQ ID NO: 6644193 - DNA, 16 bp, Homo sapiens
aggctacccgctgtgg

SEQ ID NO: 6644194 - DNA, 18 bp, Homo sapiens
aggctactagaattctgt

SEQ ID NO: 6644195 - DNA, 13 bp, Homo sapiens
aggctactctgcc

SEQ ID NO: 6644196 - DNA, 15 bp, Homo sapiens
aggctactctgccca

SEQ ID NO: 6644197 - DNA, 13 bp, Homo sapiens
aggctactgccac

SEQ ID NO: 6644198 - DNA, 14 bp, Homo sapiens
aggctactgtaatg

SEQ ID NO: 6644199 - DNA, 14 bp, Homo sapiens
aggctactgttctt

SEQ ID NO: 6644200 - DNA, 20 bp, Homo sapiens
aggctacttcggggctggga

SEQ ID NO: 6644201 - DNA, 16 bp, Homo sapiens
aggctagagacagatg

SEQ ID NO: 6644202 - DNA, 19 bp, Homo sapiens
aggctagagacagatgctg

SEQ ID NO: 6644203 - DNA, 17 bp, Homo sapiens
aggctagagtgcaatgg

SEQ ID NO: 6644204 - DNA, 21 bp, Homo sapiens
aggctagagtgcaatggtgca

SEQ ID NO: 6644205 - DNA, 14 bp, Homo sapiens
aggctagagtgcag

SEQ ID NO: 6644206 - DNA, 17 bp, Homo sapiens
aggctagagtgcagtgg

SEQ ID NO: 6644207 - DNA, 17 bp, Homo sapiens
aggctagctggagcctg

SEQ ID NO: 6644208 - DNA, 17 bp, Homo sapiens
aggctagcttctgcttt

SEQ ID NO: 6644209 - DNA, 14 bp, Homo sapiens
aggctaggccagca

SEQ ID NO: 6644210 - DNA, 14 bp, Homo sapiens
aggctagggtgggg

SEQ ID NO: 6644211 - DNA, 22 bp, Homo sapiens
aggctagtccggacccacctca

SEQ ID NO: 6644212 - DNA, 21 bp, Homo sapiens
aggctagtctcttctcagagc

SEQ ID NO: 6644213 - DNA, 23 bp, Homo sapiens
aggctagtctcttctcagagcag

SEQ ID NO: 6644214 - DNA, 17 bp, Homo sapiens
aggctatgaagggacag

SEQ ID NO: 6644215 - DNA, 21 bp, Homo sapiens
aggctatgaggaaactgagtc

SEQ ID NO: 6644216 - DNA, 17 bp, Homo sapiens
aggctatgccatgtgcg

SEQ ID NO: 6644217 - DNA, 21 bp, Homo sapiens
aggctatggagggtcctcctc

SEQ ID NO: 6644218 - DNA, 22 bp, Homo sapiens
aggctatggggtaggagaaaag

SEQ ID NO: 6644219 - DNA, 19 bp, Homo sapiens
aggctatgtaatgtaaata

SEQ ID NO: 6644220 - DNA, 22 bp, Homo sapiens
aggctatgtaatgtaaatacat

SEQ ID NO: 6644221 - DNA, 14 bp, Homo sapiens
aggctatgtgatta

SEQ ID NO: 6644222 - DNA, 15 bp, Homo sapiens
aggctattaaaaaag

SEQ ID NO: 6644223 - DNA, 17 bp, Homo sapiens
aggctattaaaagaatc

SEQ ID NO: 6644224 - DNA, 16 bp, Homo sapiens
aggctattataatata

SEQ ID NO: 6644225 - DNA, 16 bp, Homo sapiens
aggctattatttattg

SEQ ID NO: 6644226 - DNA, 18 bp, Homo sapiens
aggctattatttattgta

SEQ ID NO: 6644227 - DNA, 19 bp, Homo sapiens
aggctattcctaggcctca

SEQ ID NO: 6644228 - DNA, 20 bp, Homo sapiens
aggctattcctgagagctgc

SEQ ID NO: 6644229 - DNA, 15 bp, Homo sapiens
aggctatttctacat

SEQ ID NO: 6644230 - DNA, 16 bp, Homo sapiens
aggctatttgtaaatc

SEQ ID NO: 6644231 - DNA, 17 bp, Homo sapiens
aggctatttgtaaatct

SEQ ID NO: 6644232 - DNA, 19 bp, Homo sapiens
aggctatttgttcagagag

SEQ ID NO: 6644233 - DNA, 19 bp, Homo sapiens
aggctattttctaaagact

SEQ ID NO: 6644234 - DNA, 14 bp, Homo sapiens
aggctcaaattttg

SEQ ID NO: 6644235 - DNA, 19 bp, Homo sapiens
aggctcaacaataaaacat

SEQ ID NO: 6644236 - DNA, 14 bp, Homo sapiens
aggctcaagaggcc

SEQ ID NO: 6644237 - DNA, 16 bp, Homo sapiens
aggctcaagaggccca

SEQ ID NO: 6644238 - DNA, 17 bp, Homo sapiens
aggctcaagaggcccag

SEQ ID NO: 6644239 - DNA, 20 bp, Homo sapiens
aggctcaagctatccttgca

SEQ ID NO: 6644240 - DNA, 21 bp, Homo sapiens
aggctcacaactgtttttgaa

SEQ ID NO: 6644241 - DNA, 23 bp, Homo sapiens
aggctcacaactgtttttgaaga

SEQ ID NO: 6644242 - DNA, 14 bp, Homo sapiens
aggctcacatgctc

SEQ ID NO: 6644243 - DNA, 20 bp, Homo sapiens
aggctcacctttagaacagg

SEQ ID NO: 6644244 - DNA, 21 bp, Homo sapiens
aggctcacctttagaacagga

SEQ ID NO: 6644245 - DNA, 16 bp, Homo sapiens
aggctcacgaagggca

SEQ ID NO: 6644246 - DNA, 21 bp, Homo sapiens
aggctcactgagtgatacttt

SEQ ID NO: 6644247 - DNA, 12 bp, Homo sapiens
aggctcactgcc

SEQ ID NO: 6644248 - DNA, 14 bp, Homo sapiens
aggctcactgccag

SEQ ID NO: 6644249 - DNA, 17 bp, Homo sapiens
aggctcactgccaggcc

SEQ ID NO: 6644250 - DNA, 22 bp, Homo sapiens
aggctcactgccaggccagcct

SEQ ID NO: 6644251 - DNA, 24 bp, Homo sapiens
aggctcactgccaggccagcctcc

SEQ ID NO: 6644252 - DNA, 13 bp, Homo sapiens
aggctcagaagga

SEQ ID NO: 6644253 - DNA, 19 bp, Homo sapiens
aggctcagactgggcactg

SEQ ID NO: 6644254 - DNA, 21 bp, Homo sapiens
aggctcagagactgcaagctg

SEQ ID NO: 6644255 - DNA, 23 bp, Homo sapiens
aggctcagagactgcaagctgct

SEQ ID NO: 6644256 - DNA, 17 bp, Homo sapiens
aggctcagcatgcagaa

SEQ ID NO: 6644257 - DNA, 13 bp, Homo sapiens
aggctcagcccac

SEQ ID NO: 6644258 - DNA, 13 bp, Homo sapiens
aggctcagcccca

SEQ ID NO: 6644259 - DNA, 14 bp, Homo sapiens
aggctcagccccac

SEQ ID NO: 6644260 - DNA, 13 bp, Homo sapiens
aggctcagcccta

SEQ ID NO: 6644261 - DNA, 14 bp, Homo sapiens
aggctcagccctag

SEQ ID NO: 6644262 - DNA, 14 bp, Homo sapiens
aggctcagccttgg

SEQ ID NO: 6644263 - DNA, 13 bp, Homo sapiens
aggctcaggagaa

SEQ ID NO: 6644264 - DNA, 14 bp, Homo sapiens
aggctcaggagaag

SEQ ID NO: 6644265 - DNA, 17 bp, Homo sapiens
aggctcaggagaagcca

SEQ ID NO: 6644266 - DNA, 14 bp, Homo sapiens
aggctcaggctgcc

SEQ ID NO: 6644267 - DNA, 16 bp, Homo sapiens
aggctcagtctcagga

SEQ ID NO: 6644268 - DNA, 18 bp, Homo sapiens
aggctcagtctcaggagc

SEQ ID NO: 6644269 - DNA, 19 bp, Homo sapiens
aggctcagtggtagctctg

SEQ ID NO: 6644270 - DNA, 21 bp, Homo sapiens
aggctcatagggaagacctgc

SEQ ID NO: 6644271 - DNA, 15 bp, Homo sapiens
aggctcatggccctg

SEQ ID NO: 6644272 - DNA, 19 bp, Homo sapiens
aggctcatggccctgtagt

SEQ ID NO: 6644273 - DNA, 13 bp, Homo sapiens
aggctcatttaaa

SEQ ID NO: 6644274 - DNA, 18 bp, Homo sapiens
aggctcatttaaaacagg

SEQ ID NO: 6644275 - DNA, 15 bp, Homo sapiens
aggctcatttactgt

SEQ ID NO: 6644276 - DNA, 20 bp, Homo sapiens
aggctcatttacttgaaatg

SEQ ID NO: 6644277 - DNA, 18 bp, Homo sapiens
aggctcatttcactaagc

SEQ ID NO: 6644278 - DNA, 16 bp, Homo sapiens
aggctccaagaggctg

SEQ ID NO: 6644279 - DNA, 14 bp, Homo sapiens
aggctccagacagg

SEQ ID NO: 6644280 - DNA, 15 bp, Homo sapiens
aggctccagacagga

SEQ ID NO: 6644281 - DNA, 17 bp, Homo sapiens
aggctccagacaggagg

SEQ ID NO: 6644282 - DNA, 18 bp, Homo sapiens
aggctccagacaggagga

SEQ ID NO: 6644283 - DNA, 16 bp, Homo sapiens
aggctccagagggcac

SEQ ID NO: 6644284 - DNA, 13 bp, Homo sapiens
aggctccagcaca

SEQ ID NO: 6644285 - DNA, 12 bp, Homo sapiens
aggctccaggac

SEQ ID NO: 6644286 - DNA, 13 bp, Homo sapiens
aggctccaggact

SEQ ID NO: 6644287 - DNA, 15 bp, Homo sapiens
aggctccaggactcc

SEQ ID NO: 6644288 - DNA, 21 bp, Homo sapiens
aggctccaggactccactgga

SEQ ID NO: 6644289 - DNA, 13 bp, Homo sapiens
aggctccaggcag

SEQ ID NO: 6644290 - DNA, 18 bp, Homo sapiens
aggctccaggctgactgg

SEQ ID NO: 6644291 - DNA, 17 bp, Homo sapiens
aggctccatccttctcc

SEQ ID NO: 6644292 - DNA, 16 bp, Homo sapiens
aggctccatgcacctc

SEQ ID NO: 6644293 - DNA, 13 bp, Homo sapiens
aggctccatgggg

SEQ ID NO: 6644294 - DNA, 17 bp, Homo sapiens
aggctccatggggaagt

SEQ ID NO: 6644295 - DNA, 16 bp, Homo sapiens
aggctcccaaactcag

SEQ ID NO: 6644296 - DNA, 20 bp, Homo sapiens
aggctcccactgcccctgca

SEQ ID NO: 6644297 - DNA, 22 bp, Homo sapiens
aggctcccagacccagggcagt

SEQ ID NO: 6644298 - DNA, 22 bp, Homo sapiens
aggctcccatgtgagtccctgt

SEQ ID NO: 6644299 - DNA, 13 bp, Homo sapiens
aggctccccaccc

SEQ ID NO: 6644300 - DNA, 14 bp, Homo sapiens
aggctccccacccc

SEQ ID NO: 6644301 - DNA, 16 bp, Homo sapiens
aggctccccaccccga

SEQ ID NO: 6644302 - DNA, 12 bp, Homo sapiens
aggctccccaga

SEQ ID NO: 6644303 - DNA, 15 bp, Homo sapiens
aggctccccagggct

SEQ ID NO: 6644304 - DNA, 18 bp, Homo sapiens
aggctccccctaaacaca

SEQ ID NO: 6644305 - DNA, 16 bp, Homo sapiens
aggctcccctggtctc

SEQ ID NO: 6644306 - DNA, 17 bp, Homo sapiens
aggctcccgaccccatc

SEQ ID NO: 6644307 - DNA, 20 bp, Homo sapiens
aggctcccgaggggaagggg

SEQ ID NO: 6644308 - DNA, 17 bp, Homo sapiens
aggctcccggggcctgg

SEQ ID NO: 6644309 - DNA, 20 bp, Homo sapiens
aggctcccggggcctggaca

SEQ ID NO: 6644310 - DNA, 22 bp, Homo sapiens
aggctccctccctcccagatcc

SEQ ID NO: 6644311 - DNA, 15 bp, Homo sapiens
aggctccctgaccac

SEQ ID NO: 6644312 - DNA, 16 bp, Homo sapiens
aggctccctgaggtac

SEQ ID NO: 6644313 - DNA, 23 bp, Homo sapiens
aggctccgggcaccaggggccaa

SEQ ID NO: 6644314 - DNA, 17 bp, Homo sapiens
aggctccgtgagccctt

SEQ ID NO: 6644315 - DNA, 22 bp, Homo sapiens
aggctcctacctgtctgctgcc

SEQ ID NO: 6644316 - DNA, 23 bp, Homo sapiens
aggctcctacctgtctgctgcca

SEQ ID NO: 6644317 - DNA, 21 bp, Homo sapiens
aggctcctcagccctctcttg

SEQ ID NO: 6644318 - DNA, 24 bp, Homo sapiens
aggctcctcagccctctcttgcca

SEQ ID NO: 6644319 - DNA, 14 bp, Homo sapiens
aggctcctcagcct

SEQ ID NO: 6644320 - DNA, 16 bp, Homo sapiens
aggctcctccctctgc

SEQ ID NO: 6644321 - DNA, 18 bp, Homo sapiens
aggctcctccctctgcct

SEQ ID NO: 6644322 - DNA, 21 bp, Homo sapiens
aggctcctccctctgcctcat

SEQ ID NO: 6644323 - DNA, 12 bp, Homo sapiens
aggctcctcctc

SEQ ID NO: 6644324 - DNA, 12 bp, Homo sapiens
aggctcctcctt

SEQ ID NO: 6644325 - DNA, 17 bp, Homo sapiens
aggctcctctaggccct

SEQ ID NO: 6644326 - DNA, 23 bp, Homo sapiens
aggctcctgagacacatgggtgc

SEQ ID NO: 6644327 - DNA, 20 bp, Homo sapiens
aggctcctgccaccacgccc

SEQ ID NO: 6644328 - DNA, 21 bp, Homo sapiens
aggctcctgccagtgtggaac

SEQ ID NO: 6644329 - DNA, 13 bp, Homo sapiens
aggctcctggagc

SEQ ID NO: 6644330 - DNA, 14 bp, Homo sapiens
aggctcctggagcc

SEQ ID NO: 6644331 - DNA, 13 bp, Homo sapiens
aggctcctgggag

SEQ ID NO: 6644332 - DNA, 23 bp, Homo sapiens
aggctcctgggaggccctggcag

SEQ ID NO: 6644333 - DNA, 13 bp, Homo sapiens
aggctcctggtgg

SEQ ID NO: 6644334 - DNA, 17 bp, Homo sapiens
aggctcctggtggggca

SEQ ID NO: 6644335 - DNA, 18 bp, Homo sapiens
aggctcctggtggggcag

SEQ ID NO: 6644336 - DNA, 12 bp, Homo sapiens
aggctcctgtcc

SEQ ID NO: 6644337 - DNA, 13 bp, Homo sapiens
aggctcctgtggt

SEQ ID NO: 6644338 - DNA, 12 bp, Homo sapiens
aggctcctgtta

SEQ ID NO: 6644339 - DNA, 21 bp, Homo sapiens
aggctcctgttagctcctcac

SEQ ID NO: 6644340 - DNA, 22 bp, Homo sapiens
aggctccttagggttttctctc

SEQ ID NO: 6644341 - DNA, 23 bp, Homo sapiens
aggctccttagggttttctctct

SEQ ID NO: 6644342 - DNA, 20 bp, Homo sapiens
aggctccttcaacaaggctt

SEQ ID NO: 6644343 - DNA, 20 bp, Homo sapiens
aggctccttcctgtgggtgg

SEQ ID NO: 6644344 - DNA, 19 bp, Homo sapiens
aggctcctttagcgcccag

SEQ ID NO: 6644345 - DNA, 12 bp, Homo sapiens
aggctcgagcat

SEQ ID NO: 6644346 - DNA, 17 bp, Homo sapiens
aggctcgagcatgcctg

SEQ ID NO: 6644347 - DNA, 19 bp, Homo sapiens
aggctcgagcatgcctgga

SEQ ID NO: 6644348 - DNA, 19 bp, Homo sapiens
aggctcgagctcggggctg

SEQ ID NO: 6644349 - DNA, 17 bp, Homo sapiens
aggctcgattttgtatc

SEQ ID NO: 6644350 - DNA, 14 bp, Homo sapiens
aggctcgccaaggc

SEQ ID NO: 6644351 - DNA, 18 bp, Homo sapiens
aggctcgccaaggcctag

SEQ ID NO: 6644352 - DNA, 18 bp, Homo sapiens
aggctcgccttccctcct

SEQ ID NO: 6644353 - DNA, 19 bp, Homo sapiens
aggctcgccttccctcctg

SEQ ID NO: 6644354 - DNA, 20 bp, Homo sapiens
aggctcgccttccctcctgc

SEQ ID NO: 6644355 - DNA, 15 bp, Homo sapiens
aggctcggagcaccc

SEQ ID NO: 6644356 - DNA, 17 bp, Homo sapiens
aggctcggagcaccctt

SEQ ID NO: 6644357 - DNA, 22 bp, Homo sapiens
aggctcggggctccccacgccc

SEQ ID NO: 6644358 - DNA, 16 bp, Homo sapiens
aggctcgtcagccacc

SEQ ID NO: 6644359 - DNA, 21 bp, Homo sapiens
aggctcgtcagccacctggga

SEQ ID NO: 6644360 - DNA, 18 bp, Homo sapiens
aggctcgtggactgagtg

SEQ ID NO: 6644361 - DNA, 19 bp, Homo sapiens
aggctctatctgctgggct

SEQ ID NO: 6644362 - DNA, 21 bp, Homo sapiens
aggctctatgagtctagatgt

SEQ ID NO: 6644363 - DNA, 15 bp, Homo sapiens
aggctctattgagcc

SEQ ID NO: 6644364 - DNA, 17 bp, Homo sapiens
aggctctattgagccaa

SEQ ID NO: 6644365 - DNA, 18 bp, Homo sapiens
aggctctattgagccaag

SEQ ID NO: 6644366 - DNA, 24 bp, Homo sapiens
aggctctatttcggaaatacacta

SEQ ID NO: 6644367 - DNA, 20 bp, Homo sapiens
aggctctcaacaggggagag

SEQ ID NO: 6644368 - DNA, 11 bp, Homo sapiens
aggctctcagg

SEQ ID NO: 6644369 - DNA, 15 bp, Homo sapiens
aggctctcaggccag

SEQ ID NO: 6644370 - DNA, 18 bp, Homo sapiens
aggctctcaggccagctg

SEQ ID NO: 6644371 - DNA, 21 bp, Homo sapiens
aggctctcaggccagctgctt

SEQ ID NO: 6644372 - DNA, 15 bp, Homo sapiens
aggctctcaggtgcc

SEQ ID NO: 6644373 - DNA, 11 bp, Homo sapiens
aggctctccaa

SEQ ID NO: 6644374 - DNA, 21 bp, Homo sapiens
aggctctccctctctgcacct

SEQ ID NO: 6644375 - DNA, 14 bp, Homo sapiens
aggctctcctggct

SEQ ID NO: 6644376 - DNA, 23 bp, Homo sapiens
aggctctccttgctcctggcctt

SEQ ID NO: 6644377 - DNA, 20 bp, Homo sapiens
aggctctcgctgccctgtgg

SEQ ID NO: 6644378 - DNA, 16 bp, Homo sapiens
aggctctctaagaaaa

SEQ ID NO: 6644379 - DNA, 22 bp, Homo sapiens
aggctctctctttctagaggtg

SEQ ID NO: 6644380 - DNA, 23 bp, Homo sapiens
aggctctctctttctagaggtgc

SEQ ID NO: 6644381 - DNA, 18 bp, Homo sapiens
aggctctctttgcccagt

SEQ ID NO: 6644382 - DNA, 18 bp, Homo sapiens
aggctctgaaagccagct

SEQ ID NO: 6644383 - DNA, 20 bp, Homo sapiens
aggctctgaaagctgcttct

SEQ ID NO: 6644384 - DNA, 13 bp, Homo sapiens
aggctctgaaata

SEQ ID NO: 6644385 - DNA, 18 bp, Homo sapiens
aggctctgaaataaaatg

SEQ ID NO: 6644386 - DNA, 19 bp, Homo sapiens
aggctctgaatctctcaaa

SEQ ID NO: 6644387 - DNA, 14 bp, Homo sapiens
aggctctgagacac

SEQ ID NO: 6644388 - DNA, 21 bp, Homo sapiens
aggctctgagactaaatgaga

SEQ ID NO: 6644389 - DNA, 16 bp, Homo sapiens
aggctctgaggggcac

SEQ ID NO: 6644390 - DNA, 13 bp, Homo sapiens
aggctctgcacag

SEQ ID NO: 6644391 - DNA, 22 bp, Homo sapiens
aggctctgcacagacaagcagc

SEQ ID NO: 6644392 - DNA, 23 bp, Homo sapiens
aggctctgcacagacaagcagcc

SEQ ID NO: 6644393 - DNA, 17 bp, Homo sapiens
aggctctgcacagatgg

SEQ ID NO: 6644394 - DNA, 11 bp, Homo sapiens
aggctctgccc

SEQ ID NO: 6644395 - DNA, 12 bp, Homo sapiens
aggctctgccct

SEQ ID NO: 6644396 - DNA, 17 bp, Homo sapiens
aggctctgccctgccct

SEQ ID NO: 6644397 - DNA, 13 bp, Homo sapiens
aggctctgccttc

SEQ ID NO: 6644398 - DNA, 18 bp, Homo sapiens
aggctctgcgcctgcccc

SEQ ID NO: 6644399 - DNA, 12 bp, Homo sapiens
aggctctgctga

SEQ ID NO: 6644400 - DNA, 14 bp, Homo sapiens
aggctctgctgact

SEQ ID NO: 6644401 - DNA, 16 bp, Homo sapiens
aggctctgcttctcca

SEQ ID NO: 6644402 - DNA, 17 bp, Homo sapiens
aggctctggcccttgcc

SEQ ID NO: 6644403 - DNA, 12 bp, Homo sapiens
aggctctgggaa

SEQ ID NO: 6644404 - DNA, 17 bp, Homo sapiens
aggctctgggaaggggt

SEQ ID NO: 6644405 - DNA, 12 bp, Homo sapiens
aggctctgggca

SEQ ID NO: 6644406 - DNA, 13 bp, Homo sapiens
aggctctgggcac

SEQ ID NO: 6644407 - DNA, 23 bp, Homo sapiens
aggctctgggctcagggctggag

SEQ ID NO: 6644408 - DNA, 20 bp, Homo sapiens
aggctctggggcagccccca

SEQ ID NO: 6644409 - DNA, 18 bp, Homo sapiens
aggctctgtcactgagca

SEQ ID NO: 6644410 - DNA, 15 bp, Homo sapiens
aggctctgtgccttg

SEQ ID NO: 6644411 - DNA, 16 bp, Homo sapiens
aggctctgtgccttgg

SEQ ID NO: 6644412 - DNA, 21 bp, Homo sapiens
aggctctgtgccttggtctct

SEQ ID NO: 6644413 - DNA, 18 bp, Homo sapiens
aggctctgtgctgaccct

SEQ ID NO: 6644414 - DNA, 17 bp, Homo sapiens
aggctctgtgtgttaaa

SEQ ID NO: 6644415 - DNA, 18 bp, Homo sapiens
aggctctgtgtgttaaaa

SEQ ID NO: 6644416 - DNA, 18 bp, Homo sapiens
aggctctgtttatgcttt

SEQ ID NO: 6644417 - DNA, 19 bp, Homo sapiens
aggctcttaagcagcatgg

SEQ ID NO: 6644418 - DNA, 22 bp, Homo sapiens
aggctcttaagcagcatggaaa

SEQ ID NO: 6644419 - DNA, 19 bp, Homo sapiens
aggctcttcctggacctga

SEQ ID NO: 6644420 - DNA, 20 bp, Homo sapiens
aggctcttcctggacctgag

SEQ ID NO: 6644421 - DNA, 18 bp, Homo sapiens
aggctcttctccccagag

SEQ ID NO: 6644422 - DNA, 14 bp, Homo sapiens
aggctcttctcctt

SEQ ID NO: 6644423 - DNA, 20 bp, Homo sapiens
aggctcttctccttggagga

SEQ ID NO: 6644424 - DNA, 17 bp, Homo sapiens
aggctcttctttcccaa

SEQ ID NO: 6644425 - DNA, 20 bp, Homo sapiens
aggctcttctttcccaaaat

SEQ ID NO: 6644426 - DNA, 15 bp, Homo sapiens
aggctctttctgggc

SEQ ID NO: 6644427 - DNA, 18 bp, Homo sapiens
aggctctttctgggccaa

SEQ ID NO: 6644428 - DNA, 20 bp, Homo sapiens
aggctctttctgggccaagt

SEQ ID NO: 6644429 - DNA, 21 bp, Homo sapiens
aggctctttggggtcagccag

SEQ ID NO: 6644430 - DNA, 23 bp, Homo sapiens
aggctctttggggtcagccaggg

SEQ ID NO: 6644431 - DNA, 14 bp, Homo sapiens
aggctgaaaacaat

SEQ ID NO: 6644432 - DNA, 14 bp, Homo sapiens
aggctgaaaagtgc

SEQ ID NO: 6644433 - DNA, 20 bp, Homo sapiens
aggctgaaatatccacccag

SEQ ID NO: 6644434 - DNA, 20 bp, Homo sapiens
aggctgaactcttcagaaca

SEQ ID NO: 6644435 - DNA, 12 bp, Homo sapiens
aggctgaagagt

SEQ ID NO: 6644436 - DNA, 19 bp, Homo sapiens
aggctgaatcaaagacatt

SEQ ID NO: 6644437 - DNA, 23 bp, Homo sapiens
aggctgacactgacatttcactt

SEQ ID NO: 6644438 - DNA, 20 bp, Homo sapiens
aggctgaccaagagagaaag

SEQ ID NO: 6644439 - DNA, 16 bp, Homo sapiens
aggctgaccacagcac

SEQ ID NO: 6644440 - DNA, 17 bp, Homo sapiens
aggctgaccacagcaca

SEQ ID NO: 6644441 - DNA, 18 bp, Homo sapiens
aggctgaccacagcacag

SEQ ID NO: 6644442 - DNA, 21 bp, Homo sapiens
aggctgaccacagcacagcca

SEQ ID NO: 6644443 - DNA, 20 bp, Homo sapiens
aggctgacgtgtgagggagg

SEQ ID NO: 6644444 - DNA, 17 bp, Homo sapiens
aggctgacgttccgggc

SEQ ID NO: 6644445 - DNA, 15 bp, Homo sapiens
aggctgactcctggt

SEQ ID NO: 6644446 - DNA, 16 bp, Homo sapiens
aggctgactcctggtc

SEQ ID NO: 6644447 - DNA, 22 bp, Homo sapiens
aggctgactcttactaaccacc

SEQ ID NO: 6644448 - DNA, 20 bp, Homo sapiens
aggctgactggatgtccaga

SEQ ID NO: 6644449 - DNA, 23 bp, Homo sapiens
aggctgactggatgtccagagct

SEQ ID NO: 6644450 - DNA, 15 bp, Homo sapiens
aggctgacttctctg

SEQ ID NO: 6644451 - DNA, 21 bp, Homo sapiens
aggctgagaaagctaaagttt

SEQ ID NO: 6644452 - DNA, 19 bp, Homo sapiens
aggctgagaacactgtgaa

SEQ ID NO: 6644453 - DNA, 21 bp, Homo sapiens
aggctgagacacagcccagag

SEQ ID NO: 6644454 - DNA, 13 bp, Homo sapiens
aggctgagacagg

SEQ ID NO: 6644455 - DNA, 15 bp, Homo sapiens
aggctgagacaggag

SEQ ID NO: 6644456 - DNA, 16 bp, Homo sapiens
aggctgagactgcggg

SEQ ID NO: 6644457 - DNA, 22 bp, Homo sapiens
aggctgagagccggccgtggaa

SEQ ID NO: 6644458 - DNA, 16 bp, Homo sapiens
aggctgagcacctttg

SEQ ID NO: 6644459 - DNA, 19 bp, Homo sapiens
aggctgagcacctttggaa

SEQ ID NO: 6644460 - DNA, 14 bp, Homo sapiens
aggctgagccatga

SEQ ID NO: 6644461 - DNA, 17 bp, Homo sapiens
aggctgagccatgagga

SEQ ID NO: 6644462 - DNA, 12 bp, Homo sapiens
aggctgagccca

SEQ ID NO: 6644463 - DNA, 17 bp, Homo sapiens
aggctgagcccagccac

SEQ ID NO: 6644464 - DNA, 19 bp, Homo sapiens
aggctgagcccagccacct

SEQ ID NO: 6644465 - DNA, 23 bp, Homo sapiens
aggctgagcccagccacctccca

SEQ ID NO: 6644466 - DNA, 14 bp, Homo sapiens
aggctgagccctgt

SEQ ID NO: 6644467 - DNA, 22 bp, Homo sapiens
aggctgagccctgtacccaccc

SEQ ID NO: 6644468 - DNA, 21 bp, Homo sapiens
aggctgagccgaagctgcggg

SEQ ID NO: 6644469 - DNA, 15 bp, Homo sapiens
aggctgagccgatct

SEQ ID NO: 6644470 - DNA, 18 bp, Homo sapiens
aggctgagccgatctggt

SEQ ID NO: 6644471 - DNA, 18 bp, Homo sapiens
aggctgaggaaaggccag

SEQ ID NO: 6644472 - DNA, 11 bp, Homo sapiens
aggctgaggca

SEQ ID NO: 6644473 - DNA, 14 bp, Homo sapiens
aggctgaggcacaa

SEQ ID NO: 6644474 - DNA, 13 bp, Homo sapiens
aggctgaggcagg

SEQ ID NO: 6644475 - DNA, 14 bp, Homo sapiens
aggctgaggcagga

SEQ ID NO: 6644476 - DNA, 13 bp, Homo sapiens
aggctgaggcctg

SEQ ID NO: 6644477 - DNA, 16 bp, Homo sapiens
aggctgaggcgggtgg

SEQ ID NO: 6644478 - DNA, 14 bp, Homo sapiens
aggctgaggctggc

SEQ ID NO: 6644479 - DNA, 15 bp, Homo sapiens
aggctgaggctggca

SEQ ID NO: 6644480 - DNA, 16 bp, Homo sapiens
aggctgaggctggcac

SEQ ID NO: 6644481 - DNA, 14 bp, Homo sapiens
aggctgagggaggc

SEQ ID NO: 6644482 - DNA, 17 bp, Homo sapiens
aggctgagggctgccag

SEQ ID NO: 6644483 - DNA, 23 bp, Homo sapiens
aggctgagggtcgtgggaaaggg

SEQ ID NO: 6644484 - DNA, 15 bp, Homo sapiens
aggctgaggtgagaa

SEQ ID NO: 6644485 - DNA, 13 bp, Homo sapiens
aggctgaggtggc

SEQ ID NO: 6644486 - DNA, 17 bp, Homo sapiens
aggctgaggtgggcaga

SEQ ID NO: 6644487 - DNA, 18 bp, Homo sapiens
aggctgaggtggggaagg

SEQ ID NO: 6644488 - DNA, 19 bp, Homo sapiens
aggctgaggtggggaagga

SEQ ID NO: 6644489 - DNA, 19 bp, Homo sapiens
aggctgaggttagagagat

SEQ ID NO: 6644490 - DNA, 19 bp, Homo sapiens
aggctgagtgcactggcag

SEQ ID NO: 6644491 - DNA, 14 bp, Homo sapiens
aggctgagtgcagg

SEQ ID NO: 6644492 - DNA, 15 bp, Homo sapiens
aggctgagtgcaggc

SEQ ID NO: 6644493 - DNA, 21 bp, Homo sapiens
aggctgagtgcaggcccaccc

SEQ ID NO: 6644494 - DNA, 17 bp, Homo sapiens
aggctgagttttctctt

SEQ ID NO: 6644495 - DNA, 17 bp, Homo sapiens
aggctgataattccagt

SEQ ID NO: 6644496 - DNA, 14 bp, Homo sapiens
aggctgatgccact

SEQ ID NO: 6644497 - DNA, 21 bp, Homo sapiens
aggctgatgtcaatttctgtg

SEQ ID NO: 6644498 - DNA, 12 bp, Homo sapiens
aggctgatttat

SEQ ID NO: 6644499 - DNA, 22 bp, Homo sapiens
aggctgatttatggtcagaatt

SEQ ID NO: 6644500 - DNA, 23 bp, Homo sapiens
aggctgatttatggtcagaattt

SEQ ID NO: 6644501 - DNA, 15 bp, Homo sapiens
aggctgatttctagg

SEQ ID NO: 6644502 - DNA, 18 bp, Homo sapiens
aggctgcaaccctggtgt

SEQ ID NO: 6644503 - DNA, 14 bp, Homo sapiens
aggctgcaagctgc

SEQ ID NO: 6644504 - DNA, 21 bp, Homo sapiens
aggctgcaaggtttaggctgg

SEQ ID NO: 6644505 - DNA, 19 bp, Homo sapiens
aggctgcaatgagccatga

SEQ ID NO: 6644506 - DNA, 20 bp, Homo sapiens
aggctgcacagcatttgctt

SEQ ID NO: 6644507 - DNA, 19 bp, Homo sapiens
aggctgcacccctgggcca

SEQ ID NO: 6644508 - DNA, 17 bp, Homo sapiens
aggctgcactgcagtga

SEQ ID NO: 6644509 - DNA, 19 bp, Homo sapiens
aggctgcactgcagtgatg

SEQ ID NO: 6644510 - DNA, 14 bp, Homo sapiens
aggctgcactggag

SEQ ID NO: 6644511 - DNA, 15 bp, Homo sapiens
aggctgcactggagc

SEQ ID NO: 6644512 - DNA, 16 bp, Homo sapiens
aggctgcactggagcc

SEQ ID NO: 6644513 - DNA, 13 bp, Homo sapiens
aggctgcagagcc

SEQ ID NO: 6644514 - DNA, 17 bp, Homo sapiens
aggctgcagagcccggc

SEQ ID NO: 6644515 - DNA, 18 bp, Homo sapiens
aggctgcagcaggcagag

SEQ ID NO: 6644516 - DNA, 11 bp, Homo sapiens
aggctgcagcc

SEQ ID NO: 6644517 - DNA, 12 bp, Homo sapiens
aggctgcagcca

SEQ ID NO: 6644518 - DNA, 18 bp, Homo sapiens
aggctgcagccaggcctc

SEQ ID NO: 6644519 - DNA, 20 bp, Homo sapiens
aggctgcagctaatttgtga

SEQ ID NO: 6644520 - DNA, 23 bp, Homo sapiens
aggctgcagctaatttgtgaaag

SEQ ID NO: 6644521 - DNA, 18 bp, Homo sapiens
aggctgcagctggacaga

SEQ ID NO: 6644522 - DNA, 22 bp, Homo sapiens
aggctgcaggacttctgcctga

SEQ ID NO: 6644523 - DNA, 13 bp, Homo sapiens
aggctgcaggagg

SEQ ID NO: 6644524 - DNA, 18 bp, Homo sapiens
aggctgcaggagggcact

SEQ ID NO: 6644525 - DNA, 17 bp, Homo sapiens
aggctgcagtgagccaa

SEQ ID NO: 6644526 - DNA, 18 bp, Homo sapiens
aggctgcatgctctggaa

SEQ ID NO: 6644527 - DNA, 20 bp, Homo sapiens
aggctgcattgaaaagagct

SEQ ID NO: 6644528 - DNA, 14 bp, Homo sapiens
aggctgccagacat

SEQ ID NO: 6644529 - DNA, 18 bp, Homo sapiens
aggctgccaggcaccatc

SEQ ID NO: 6644530 - DNA, 11 bp, Homo sapiens
aggctgccagt

SEQ ID NO: 6644531 - DNA, 15 bp, Homo sapiens
aggctgccagtgcct

SEQ ID NO: 6644532 - DNA, 19 bp, Homo sapiens
aggctgcccaatctgagca

SEQ ID NO: 6644533 - DNA, 18 bp, Homo sapiens
aggctgcccactctgggg

SEQ ID NO: 6644534 - DNA, 20 bp, Homo sapiens
aggctgcccactctggggac

SEQ ID NO: 6644535 - DNA, 14 bp, Homo sapiens
aggctgcccagagc

SEQ ID NO: 6644536 - DNA, 18 bp, Homo sapiens
aggctgcccagagctgct

SEQ ID NO: 6644537 - DNA, 21 bp, Homo sapiens
aggctgccccacccctccatg

SEQ ID NO: 6644538 - DNA, 17 bp, Homo sapiens
aggctgccccaggccgg

SEQ ID NO: 6644539 - DNA, 22 bp, Homo sapiens
aggctgccccaggccggagccc

SEQ ID NO: 6644540 - DNA, 23 bp, Homo sapiens
aggctgccccaggccggagccca

SEQ ID NO: 6644541 - DNA, 17 bp, Homo sapiens
aggctgcccccaacact

SEQ ID NO: 6644542 - DNA, 19 bp, Homo sapiens
aggctgcccccatccagcc

SEQ ID NO: 6644543 - DNA, 20 bp, Homo sapiens
aggctgcccccatccagcca

SEQ ID NO: 6644544 - DNA, 21 bp, Homo sapiens
aggctgcccccatccagccac

SEQ ID NO: 6644545 - DNA, 17 bp, Homo sapiens
aggctgcccctctcacc

SEQ ID NO: 6644546 - DNA, 19 bp, Homo sapiens
aggctgcccggcctccctc

SEQ ID NO: 6644547 - DNA, 13 bp, Homo sapiens
aggctgccctcct

SEQ ID NO: 6644548 - DNA, 22 bp, Homo sapiens
aggctgccctcctgtgctcagc

SEQ ID NO: 6644549 - DNA, 19 bp, Homo sapiens
aggctgccctgacccttcc

SEQ ID NO: 6644550 - DNA, 15 bp, Homo sapiens
aggctgccctgaggg

SEQ ID NO: 6644551 - DNA, 19 bp, Homo sapiens
aggctgccctgaggggctg

SEQ ID NO: 6644552 - DNA, 18 bp, Homo sapiens
aggctgccgaggaccctc

SEQ ID NO: 6644553 - DNA, 17 bp, Homo sapiens
aggctgccgccaccacg

SEQ ID NO: 6644554 - DNA, 22 bp, Homo sapiens
aggctgccgctgctctcccagg

SEQ ID NO: 6644555 - DNA, 23 bp, Homo sapiens
aggctgccgctgctctcccaggt

SEQ ID NO: 6644556 - DNA, 17 bp, Homo sapiens
aggctgccggagggagc

SEQ ID NO: 6644557 - DNA, 17 bp, Homo sapiens
aggctgccggctcccct

SEQ ID NO: 6644558 - DNA, 15 bp, Homo sapiens
aggctgccggctgca

SEQ ID NO: 6644559 - DNA, 23 bp, Homo sapiens
aggctgccgggtggggggagggc

SEQ ID NO: 6644560 - DNA, 19 bp, Homo sapiens
aggctgcctatgttggggg

SEQ ID NO: 6644561 - DNA, 14 bp, Homo sapiens
aggctgcctcctgc

SEQ ID NO: 6644562 - DNA, 17 bp, Homo sapiens
aggctgcctcctgccct

SEQ ID NO: 6644563 - DNA, 18 bp, Homo sapiens
aggctgcctctcccatca

SEQ ID NO: 6644564 - DNA, 18 bp, Homo sapiens
aggctgcctctgggtgag

SEQ ID NO: 6644565 - DNA, 21 bp, Homo sapiens
aggctgcctctgggtgagtgg

SEQ ID NO: 6644566 - DNA, 12 bp, Homo sapiens
aggctgcctgag

SEQ ID NO: 6644567 - DNA, 11 bp, Homo sapiens
aggctgcctgc

SEQ ID NO: 6644568 - DNA, 15 bp, Homo sapiens
aggctgcctgcccca

SEQ ID NO: 6644569 - DNA, 19 bp, Homo sapiens
aggctgcctggagaaagga

SEQ ID NO: 6644570 - DNA, 12 bp, Homo sapiens
aggctgcctggg

SEQ ID NO: 6644571 - DNA, 15 bp, Homo sapiens
aggctgcgcctgccc

SEQ ID NO: 6644572 - DNA, 18 bp, Homo sapiens
aggctgcgcctgcccgcc

SEQ ID NO: 6644573 - DNA, 19 bp, Homo sapiens
aggctgcggcccctccccc

SEQ ID NO: 6644574 - DNA, 22 bp, Homo sapiens
aggctgctaagtggaagacaga

SEQ ID NO: 6644575 - DNA, 22 bp, Homo sapiens
aggctgctaatattaaaccttt

SEQ ID NO: 6644576 - DNA, 15 bp, Homo sapiens
aggctgctcagggct

SEQ ID NO: 6644577 - DNA, 16 bp, Homo sapiens
aggctgctcagggctg

SEQ ID NO: 6644578 - DNA, 15 bp, Homo sapiens
aggctgctccctgag

SEQ ID NO: 6644579 - DNA, 21 bp, Homo sapiens
aggctgctcggggtgcacagg

SEQ ID NO: 6644580 - DNA, 22 bp, Homo sapiens
aggctgctcggggtgcacagga

SEQ ID NO: 6644581 - DNA, 13 bp, Homo sapiens
aggctgctgccag

SEQ ID NO: 6644582 - DNA, 12 bp, Homo sapiens
aggctgctgccc

SEQ ID NO: 6644583 - DNA, 14 bp, Homo sapiens
aggctgctggagtg

SEQ ID NO: 6644584 - DNA, 18 bp, Homo sapiens
aggctgctggagtgcagt

SEQ ID NO: 6644585 - DNA, 20 bp, Homo sapiens
aggctgctggcgcctctgca

SEQ ID NO: 6644586 - DNA, 19 bp, Homo sapiens
aggctgctgggagatgcca

SEQ ID NO: 6644587 - DNA, 22 bp, Homo sapiens
aggctgctgggatggtgggctt

SEQ ID NO: 6644588 - DNA, 20 bp, Homo sapiens
aggctgctggggcctcagac

SEQ ID NO: 6644589 - DNA, 12 bp, Homo sapiens
aggctgctgtga

SEQ ID NO: 6644590 - DNA, 19 bp, Homo sapiens
aggctgctgtgtagctctg

SEQ ID NO: 6644591 - DNA, 23 bp, Homo sapiens
aggctgcttagatttctagcagt

SEQ ID NO: 6644592 - DNA, 13 bp, Homo sapiens
aggctgctttcca

SEQ ID NO: 6644593 - DNA, 14 bp, Homo sapiens
aggctgctttctgc

SEQ ID NO: 6644594 - DNA, 14 bp, Homo sapiens
aggctggaaatggt

SEQ ID NO: 6644595 - DNA, 18 bp, Homo sapiens
aggctggaagctgggagg

SEQ ID NO: 6644596 - DNA, 13 bp, Homo sapiens
aggctggaaggag

SEQ ID NO: 6644597 - DNA, 15 bp, Homo sapiens
aggctggaaggagga

SEQ ID NO: 6644598 - DNA, 16 bp, Homo sapiens
aggctggaaggaggaa

SEQ ID NO: 6644599 - DNA, 14 bp, Homo sapiens
aggctggaaggcag

SEQ ID NO: 6644600 - DNA, 15 bp, Homo sapiens
aggctggaagtactt

SEQ ID NO: 6644601 - DNA, 16 bp, Homo sapiens
aggctggaatgaggga

SEQ ID NO: 6644602 - DNA, 20 bp, Homo sapiens
aggctggaatgagggaggcg

SEQ ID NO: 6644603 - DNA, 19 bp, Homo sapiens
aggctggacaccctctgcc

SEQ ID NO: 6644604 - DNA, 17 bp, Homo sapiens
aggctggacatgctgac

SEQ ID NO: 6644605 - DNA, 17 bp, Homo sapiens
aggctggaccaactgct

SEQ ID NO: 6644606 - DNA, 16 bp, Homo sapiens
aggctggactccagat

SEQ ID NO: 6644607 - DNA, 17 bp, Homo sapiens
aggctggactccagatc

SEQ ID NO: 6644608 - DNA, 16 bp, Homo sapiens
aggctggactgcagtg

SEQ ID NO: 6644609 - DNA, 21 bp, Homo sapiens
aggctggactgcagtggcctg

SEQ ID NO: 6644610 - DNA, 14 bp, Homo sapiens
aggctggagacagg

SEQ ID NO: 6644611 - DNA, 17 bp, Homo sapiens
aggctggagacaggtgc

SEQ ID NO: 6644612 - DNA, 12 bp, Homo sapiens
aggctggagacc

SEQ ID NO: 6644613 - DNA, 15 bp, Homo sapiens
aggctggagaccccc

SEQ ID NO: 6644614 - DNA, 15 bp, Homo sapiens
aggctggagcccagg

SEQ ID NO: 6644615 - DNA, 18 bp, Homo sapiens
aggctggagcccagggag

SEQ ID NO: 6644616 - DNA, 12 bp, Homo sapiens
aggctggagctg

SEQ ID NO: 6644617 - DNA, 14 bp, Homo sapiens
aggctggagctggc

SEQ ID NO: 6644618 - DNA, 17 bp, Homo sapiens
aggctggagctggcgtc

SEQ ID NO: 6644619 - DNA, 14 bp, Homo sapiens
aggctggaggcagg

SEQ ID NO: 6644620 - DNA, 11 bp, Homo sapiens
aggctggagtg

SEQ ID NO: 6644621 - DNA, 23 bp, Homo sapiens
aggctggagtgatctcagctcac

SEQ ID NO: 6644622 - DNA, 13 bp, Homo sapiens
aggctggagtgca

SEQ ID NO: 6644623 - DNA, 17 bp, Homo sapiens
aggctggagtgcagtgg

SEQ ID NO: 6644624 - DNA, 20 bp, Homo sapiens
aggctggagtgcagtggcac

SEQ ID NO: 6644625 - DNA, 20 bp, Homo sapiens
aggctggagtgtagtggcat

SEQ ID NO: 6644626 - DNA, 23 bp, Homo sapiens
aggctggagttgtcactgctttt

SEQ ID NO: 6644627 - DNA, 20 bp, Homo sapiens
aggctggataggagaggaaa

SEQ ID NO: 6644628 - DNA, 23 bp, Homo sapiens
aggctggatcttggagaatgtga

SEQ ID NO: 6644629 - DNA, 12 bp, Homo sapiens
aggctggatgac

SEQ ID NO: 6644630 - DNA, 17 bp, Homo sapiens
aggctggatgacttgct

SEQ ID NO: 6644631 - DNA, 17 bp, Homo sapiens
aggctggatgctgggtt

SEQ ID NO: 6644632 - DNA, 14 bp, Homo sapiens
aggctggcacagga

SEQ ID NO: 6644633 - DNA, 12 bp, Homo sapiens
aggctggcacca

SEQ ID NO: 6644634 - DNA, 20 bp, Homo sapiens
aggctggcaccgccttctct

SEQ ID NO: 6644635 - DNA, 17 bp, Homo sapiens
aggctggcactcccctg

SEQ ID NO: 6644636 - DNA, 16 bp, Homo sapiens
aggctggcagctctcc

SEQ ID NO: 6644637 - DNA, 17 bp, Homo sapiens
aggctggcagctctcca

SEQ ID NO: 6644638 - DNA, 20 bp, Homo sapiens
aggctggcagctctccagtc

SEQ ID NO: 6644639 - DNA, 21 bp, Homo sapiens
aggctggcagctctccagtca

SEQ ID NO: 6644640 - DNA, 12 bp, Homo sapiens
aggctggcatct

SEQ ID NO: 6644641 - DNA, 18 bp, Homo sapiens
aggctggcatctccccca

SEQ ID NO: 6644642 - DNA, 18 bp, Homo sapiens
aggctggccaaggtgtcc

SEQ ID NO: 6644643 - DNA, 13 bp, Homo sapiens
aggctggccagca

SEQ ID NO: 6644644 - DNA, 20 bp, Homo sapiens
aggctggccagcaaggcagg

SEQ ID NO: 6644645 - DNA, 13 bp, Homo sapiens
aggctggccagcc

SEQ ID NO: 6644646 - DNA, 14 bp, Homo sapiens
aggctggccagccc

SEQ ID NO: 6644647 - DNA, 17 bp, Homo sapiens
aggctggccagccccac

SEQ ID NO: 6644648 - DNA, 20 bp, Homo sapiens
aggctggccagccccacagc

SEQ ID NO: 6644649 - DNA, 15 bp, Homo sapiens
aggctggccagtcca

SEQ ID NO: 6644650 - DNA, 17 bp, Homo sapiens
aggctggccagtccagg

SEQ ID NO: 6644651 - DNA, 21 bp, Homo sapiens
aggctggccagtccaggctgc

SEQ ID NO: 6644652 - DNA, 15 bp, Homo sapiens
aggctggccctgccc

SEQ ID NO: 6644653 - DNA, 17 bp, Homo sapiens
aggctggccctgccctg

SEQ ID NO: 6644654 - DNA, 18 bp, Homo sapiens
aggctggccctgccctgg

SEQ ID NO: 6644655 - DNA, 22 bp, Homo sapiens
aggctggcgcagccaaggccga

SEQ ID NO: 6644656 - DNA, 20 bp, Homo sapiens
aggctggcgtgcagtggtgc

SEQ ID NO: 6644657 - DNA, 19 bp, Homo sapiens
aggctggctcgtaggcctg

SEQ ID NO: 6644658 - DNA, 11 bp, Homo sapiens
aggctggctga

SEQ ID NO: 6644659 - DNA, 15 bp, Homo sapiens
aggctggctgaaaat

SEQ ID NO: 6644660 - DNA, 19 bp, Homo sapiens
aggctggctgggggcagga

SEQ ID NO: 6644661 - DNA, 12 bp, Homo sapiens
aggctgggacac

SEQ ID NO: 6644662 - DNA, 17 bp, Homo sapiens
aggctgggaccacgtga

SEQ ID NO: 6644663 - DNA, 19 bp, Homo sapiens
aggctgggacggaccagca

SEQ ID NO: 6644664 - DNA, 21 bp, Homo sapiens
aggctgggagagccttccagg

SEQ ID NO: 6644665 - DNA, 13 bp, Homo sapiens
aggctgggagcat

SEQ ID NO: 6644666 - DNA, 14 bp, Homo sapiens
aggctgggaggctc

SEQ ID NO: 6644667 - DNA, 22 bp, Homo sapiens
aggctgggagtccctacctgct

SEQ ID NO: 6644668 - DNA, 13 bp, Homo sapiens
aggctgggcaagg

SEQ ID NO: 6644669 - DNA, 13 bp, Homo sapiens
aggctgggcacag

SEQ ID NO: 6644670 - DNA, 17 bp, Homo sapiens
aggctgggcagccccag

SEQ ID NO: 6644671 - DNA, 23 bp, Homo sapiens
aggctgggcagccccagagagag

SEQ ID NO: 6644672 - DNA, 12 bp, Homo sapiens
aggctgggcagg

SEQ ID NO: 6644673 - DNA, 16 bp, Homo sapiens
aggctgggcagggcct

SEQ ID NO: 6644674 - DNA, 13 bp, Homo sapiens
aggctgggcatca

SEQ ID NO: 6644675 - DNA, 10 bp, Homo sapiens
aggctgggcc

SEQ ID NO: 6644676 - DNA, 13 bp, Homo sapiens
aggctgggccaag

SEQ ID NO: 6644677 - DNA, 20 bp, Homo sapiens
aggctgggccaagccaggga

SEQ ID NO: 6644678 - DNA, 20 bp, Homo sapiens
aggctgggccagcctcagct

SEQ ID NO: 6644679 - DNA, 18 bp, Homo sapiens
aggctgggccatgtccaa

SEQ ID NO: 6644680 - DNA, 20 bp, Homo sapiens
aggctgggccatgtccaaag

SEQ ID NO: 6644681 - DNA, 13 bp, Homo sapiens
aggctgggcccag

SEQ ID NO: 6644682 - DNA, 17 bp, Homo sapiens
aggctgggcccagaggc

SEQ ID NO: 6644683 - DNA, 20 bp, Homo sapiens
aggctgggcccagaggcaca

SEQ ID NO: 6644684 - DNA, 21 bp, Homo sapiens
aggctgggcccagaggcacag

SEQ ID NO: 6644685 - DNA, 14 bp, Homo sapiens
aggctgggcccctg

SEQ ID NO: 6644686 - DNA, 23 bp, Homo sapiens
aggctgggccgcaagggcctgga

SEQ ID NO: 6644687 - DNA, 18 bp, Homo sapiens
aggctgggcctcccctgg

SEQ ID NO: 6644688 - DNA, 20 bp, Homo sapiens
aggctgggcctcccctgggc

SEQ ID NO: 6644689 - DNA, 18 bp, Homo sapiens
aggctgggcgtagtggct

SEQ ID NO: 6644690 - DNA, 10 bp, Homo sapiens
aggctgggct

SEQ ID NO: 6644691 - DNA, 21 bp, Homo sapiens
aggctgggctcccttcccacc

SEQ ID NO: 6644692 - DNA, 18 bp, Homo sapiens
aggctgggctctgcctgt

SEQ ID NO: 6644693 - DNA, 14 bp, Homo sapiens
aggctgggctgagc

SEQ ID NO: 6644694 - DNA, 21 bp, Homo sapiens
aggctgggctgagccaaagcc

SEQ ID NO: 6644695 - DNA, 15 bp, Homo sapiens
aggctgggctggcca

SEQ ID NO: 6644696 - DNA, 16 bp, Homo sapiens
aggctgggctgggcac

SEQ ID NO: 6644697 - DNA, 22 bp, Homo sapiens
aggctgggctgggcactgctct

SEQ ID NO: 6644698 - DNA, 19 bp, Homo sapiens
aggctgggctgggtggcac

SEQ ID NO: 6644699 - DNA, 20 bp, Homo sapiens
aggctgggcttcagtggcag

SEQ ID NO: 6644700 - DNA, 22 bp, Homo sapiens
aggctggggacacaggatcctg

SEQ ID NO: 6644701 - DNA, 16 bp, Homo sapiens
aggctggggacccaga

SEQ ID NO: 6644702 - DNA, 13 bp, Homo sapiens
aggctggggaggt

SEQ ID NO: 6644703 - DNA, 22 bp, Homo sapiens
aggctggggaggtgctggggga

SEQ ID NO: 6644704 - DNA, 11 bp, Homo sapiens
aggctggggcc

SEQ ID NO: 6644705 - DNA, 16 bp, Homo sapiens
aggctggggccagggg

SEQ ID NO: 6644706 - DNA, 22 bp, Homo sapiens
aggctggggccccatcttgatc

SEQ ID NO: 6644707 - DNA, 14 bp, Homo sapiens
aggctggggcctgg

SEQ ID NO: 6644708 - DNA, 22 bp, Homo sapiens
aggctggggcctggcctattta

SEQ ID NO: 6644709 - DNA, 23 bp, Homo sapiens
aggctggggcctggcctatttaa

SEQ ID NO: 6644710 - DNA, 16 bp, Homo sapiens
aggctggggcggggcc

SEQ ID NO: 6644711 - DNA, 21 bp, Homo sapiens
aggctggggcggggcccagga

SEQ ID NO: 6644712 - DNA, 20 bp, Homo sapiens
aggctggggctcgtaaatat

SEQ ID NO: 6644713 - DNA, 21 bp, Homo sapiens
aggctggggctgaccttcctc

SEQ ID NO: 6644714 - DNA, 21 bp, Homo sapiens
aggctggggcttttgtgccag

SEQ ID NO: 6644715 - DNA, 21 bp, Homo sapiens
aggctgggtcaaaagagccct

SEQ ID NO: 6644716 - DNA, 23 bp, Homo sapiens
aggctgggtcaaaagagccctgg

SEQ ID NO: 6644717 - DNA, 16 bp, Homo sapiens
aggctgggtccagggg

SEQ ID NO: 6644718 - DNA, 12 bp, Homo sapiens
aggctgggtcct

SEQ ID NO: 6644719 - DNA, 18 bp, Homo sapiens
aggctgggtcctgccagc

SEQ ID NO: 6644720 - DNA, 15 bp, Homo sapiens
aggctgggtgacaga

SEQ ID NO: 6644721 - DNA, 11 bp, Homo sapiens
aggctgggtgc

SEQ ID NO: 6644722 - DNA, 15 bp, Homo sapiens
aggctgggtgcccac

SEQ ID NO: 6644723 - DNA, 19 bp, Homo sapiens
aggctgggtgcccacagcc

SEQ ID NO: 6644724 - DNA, 20 bp, Homo sapiens
aggctgggtggccggccctg

SEQ ID NO: 6644725 - DNA, 21 bp, Homo sapiens
aggctgggtggccggccctgc

SEQ ID NO: 6644726 - DNA, 17 bp, Homo sapiens
aggctgggttctgatcc

SEQ ID NO: 6644727 - DNA, 18 bp, Homo sapiens
aggctgggttctgatcct

SEQ ID NO: 6644728 - DNA, 18 bp, Homo sapiens
aggctggtaagagaagtg

SEQ ID NO: 6644729 - DNA, 19 bp, Homo sapiens
aggctggtaagagaagtga

SEQ ID NO: 6644730 - DNA, 19 bp, Homo sapiens
aggctggtacaacggaggc

SEQ ID NO: 6644731 - DNA, 21 bp, Homo sapiens
aggctggtacaacggaggcct

SEQ ID NO: 6644732 - DNA, 21 bp, Homo sapiens
aggctggtatttatctgcaag

SEQ ID NO: 6644733 - DNA, 18 bp, Homo sapiens
aggctggtcgtgaactcc

SEQ ID NO: 6644734 - DNA, 23 bp, Homo sapiens
aggctggtcgtgaactcctgagc

SEQ ID NO: 6644735 - DNA, 16 bp, Homo sapiens
aggctggtctcaaact

SEQ ID NO: 6644736 - DNA, 21 bp, Homo sapiens
aggctggtctcaaactcctga

SEQ ID NO: 6644737 - DNA, 22 bp, Homo sapiens
aggctggtctcaaactcctgac

SEQ ID NO: 6644738 - DNA, 22 bp, Homo sapiens
aggctggtctcgaactcctgac

SEQ ID NO: 6644739 - DNA, 22 bp, Homo sapiens
aggctggtcttgaactcctaga

SEQ ID NO: 6644740 - DNA, 23 bp, Homo sapiens
aggctggtcttgaactcttggcc

SEQ ID NO: 6644741 - DNA, 23 bp, Homo sapiens
aggctggtcttgaactgggctca

SEQ ID NO: 6644742 - DNA, 12 bp, Homo sapiens
aggctggtgaca

SEQ ID NO: 6644743 - DNA, 12 bp, Homo sapiens
aggctggtgcca

SEQ ID NO: 6644744 - DNA, 13 bp, Homo sapiens
aggctggtgccag

SEQ ID NO: 6644745 - DNA, 22 bp, Homo sapiens
aggctggtgctgtggccagggt

SEQ ID NO: 6644746 - DNA, 19 bp, Homo sapiens
aggctggtggacagaccca

SEQ ID NO: 6644747 - DNA, 20 bp, Homo sapiens
aggctggtggagaactctgg

SEQ ID NO: 6644748 - DNA, 21 bp, Homo sapiens
aggctggtggccttgggcctt

SEQ ID NO: 6644749 - DNA, 12 bp, Homo sapiens
aggctggtggga

SEQ ID NO: 6644750 - DNA, 17 bp, Homo sapiens
aggctggtggttttcag

SEQ ID NO: 6644751 - DNA, 22 bp, Homo sapiens
aggctggtgtatgcactgctca

SEQ ID NO: 6644752 - DNA, 20 bp, Homo sapiens
aggctggttcttgggctagg

SEQ ID NO: 6644753 - DNA, 18 bp, Homo sapiens
aggctggtttcaaactcc

SEQ ID NO: 6644754 - DNA, 22 bp, Homo sapiens
aggctggtttcaaactcctgac

SEQ ID NO: 6644755 - DNA, 23 bp, Homo sapiens
aggctggtttcaaactcctgacc

SEQ ID NO: 6644756 - DNA, 21 bp, Homo sapiens
aggctggttttggcatctctg

SEQ ID NO: 6644757 - DNA, 16 bp, Homo sapiens
aggctgtaaattgaac

SEQ ID NO: 6644758 - DNA, 14 bp, Homo sapiens
aggctgtacatagt

SEQ ID NO: 6644759 - DNA, 22 bp, Homo sapiens
aggctgtagaaaggggagaatg

SEQ ID NO: 6644760 - DNA, 17 bp, Homo sapiens
aggctgtagccaggaaa

SEQ ID NO: 6644761 - DNA, 21 bp, Homo sapiens
aggctgtatcccatgagcctc

SEQ ID NO: 6644762 - DNA, 22 bp, Homo sapiens
aggctgtatcccatgagcctca

SEQ ID NO: 6644763 - DNA, 24 bp, Homo sapiens
aggctgtatcccatgagcctcagc

SEQ ID NO: 6644764 - DNA, 18 bp, Homo sapiens
aggctgtattttctttta

SEQ ID NO: 6644765 - DNA, 22 bp, Homo sapiens
aggctgtattttcttttatatc

SEQ ID NO: 6644766 - DNA, 23 bp, Homo sapiens
aggctgtattttcttttatatct

SEQ ID NO: 6644767 - DNA, 20 bp, Homo sapiens
aggctgtcacagtcctgagt

SEQ ID NO: 6644768 - DNA, 17 bp, Homo sapiens
aggctgtcagcgcctca

SEQ ID NO: 6644769 - DNA, 20 bp, Homo sapiens
aggctgtcagtgtttggtgc

SEQ ID NO: 6644770 - DNA, 22 bp, Homo sapiens
aggctgtccttaacccacctct

SEQ ID NO: 6644771 - DNA, 19 bp, Homo sapiens
aggctgtccttacccatct

SEQ ID NO: 6644772 - DNA, 19 bp, Homo sapiens
aggctgtcgtccccctcca

SEQ ID NO: 6644773 - DNA, 15 bp, Homo sapiens
aggctgtctggggcc

SEQ ID NO: 6644774 - DNA, 16 bp, Homo sapiens
aggctgtctggggcct

SEQ ID NO: 6644775 - DNA, 15 bp, Homo sapiens
aggctgtctgtgcca

SEQ ID NO: 6644776 - DNA, 20 bp, Homo sapiens
aggctgtcttctcaggctct

SEQ ID NO: 6644777 - DNA, 18 bp, Homo sapiens
aggctgtcttctcccaga

SEQ ID NO: 6644778 - DNA, 19 bp, Homo sapiens
aggctgtcttctcccagag

SEQ ID NO: 6644779 - DNA, 22 bp, Homo sapiens
aggctgtcttctcccagagcac

SEQ ID NO: 6644780 - DNA, 15 bp, Homo sapiens
aggctgtgactcttc

SEQ ID NO: 6644781 - DNA, 19 bp, Homo sapiens
aggctgtgactcttctctc

SEQ ID NO: 6644782 - DNA, 15 bp, Homo sapiens
aggctgtgccaggct

SEQ ID NO: 6644783 - DNA, 22 bp, Homo sapiens
aggctgtgccaggctgggaggc

SEQ ID NO: 6644784 - DNA, 13 bp, Homo sapiens
aggctgtgctccc

SEQ ID NO: 6644785 - DNA, 14 bp, Homo sapiens
aggctgtgctcttc

SEQ ID NO: 6644786 - DNA, 21 bp, Homo sapiens
aggctgtgctcttcctctggt

SEQ ID NO: 6644787 - DNA, 16 bp, Homo sapiens
aggctgtgctgccctg

SEQ ID NO: 6644788 - DNA, 20 bp, Homo sapiens
aggctgtgctgccctgaaga

SEQ ID NO: 6644789 - DNA, 21 bp, Homo sapiens
aggctgtgctgccctgaagaa

SEQ ID NO: 6644790 - DNA, 18 bp, Homo sapiens
aggctgtggaccatggag

SEQ ID NO: 6644791 - DNA, 14 bp, Homo sapiens
aggctgtggagaga

SEQ ID NO: 6644792 - DNA, 14 bp, Homo sapiens
aggctgtggctggt

SEQ ID NO: 6644793 - DNA, 10 bp, Homo sapiens
aggctgtggg

SEQ ID NO: 6644794 - DNA, 18 bp, Homo sapiens
aggctgtgggcctcaagg

SEQ ID NO: 6644795 - DNA, 20 bp, Homo sapiens
aggctgtggggtctggctgt

SEQ ID NO: 6644796 - DNA, 15 bp, Homo sapiens
aggctgtggggtggg

SEQ ID NO: 6644797 - DNA, 16 bp, Homo sapiens
aggctgtggtcacagc

SEQ ID NO: 6644798 - DNA, 14 bp, Homo sapiens
aggctgtggtcaga

SEQ ID NO: 6644799 - DNA, 11 bp, Homo sapiens
aggctgtgtcc

SEQ ID NO: 6644800 - DNA, 13 bp, Homo sapiens
aggctgtgtccct

SEQ ID NO: 6644801 - DNA, 20 bp, Homo sapiens
aggctgtgtccctgctgggg

SEQ ID NO: 6644802 - DNA, 16 bp, Homo sapiens
aggctgtgtgaatttt

SEQ ID NO: 6644803 - DNA, 20 bp, Homo sapiens
aggctgtgtgaatttttcta

SEQ ID NO: 6644804 - DNA, 21 bp, Homo sapiens
aggctgtgtgaatttttctaa

SEQ ID NO: 6644805 - DNA, 14 bp, Homo sapiens
aggctgtgtggcca

SEQ ID NO: 6644806 - DNA, 16 bp, Homo sapiens
aggctgtgtggccaac

SEQ ID NO: 6644807 - DNA, 23 bp, Homo sapiens
aggctgtgtggccaaccaggacc

SEQ ID NO: 6644808 - DNA, 18 bp, Homo sapiens
aggctgtgtgtcttctgc

SEQ ID NO: 6644809 - DNA, 20 bp, Homo sapiens
aggctgtgtttggctttcag

SEQ ID NO: 6644810 - DNA, 19 bp, Homo sapiens
aggctgttaaatacaggaa

SEQ ID NO: 6644811 - DNA, 20 bp, Homo sapiens
aggctgttaaatacaggaaa

SEQ ID NO: 6644812 - DNA, 17 bp, Homo sapiens
aggctgttattatgaag

SEQ ID NO: 6644813 - DNA, 22 bp, Homo sapiens
aggctgttccatgttctatttt

SEQ ID NO: 6644814 - DNA, 14 bp, Homo sapiens
aggctgttccttgt

SEQ ID NO: 6644815 - DNA, 11 bp, Homo sapiens
aggctgttctc

SEQ ID NO: 6644816 - DNA, 12 bp, Homo sapiens
aggctgttctcc

SEQ ID NO: 6644817 - DNA, 13 bp, Homo sapiens
aggctgttctcca

SEQ ID NO: 6644818 - DNA, 14 bp, Homo sapiens
aggctgttctccag

SEQ ID NO: 6644819 - DNA, 19 bp, Homo sapiens
aggctgttctccaggcttc

SEQ ID NO: 6644820 - DNA, 16 bp, Homo sapiens
aggctgttctgcactg

SEQ ID NO: 6644821 - DNA, 12 bp, Homo sapiens
aggctgttctgt

SEQ ID NO: 6644822 - DNA, 16 bp, Homo sapiens
aggctgttctttaaat

SEQ ID NO: 6644823 - DNA, 23 bp, Homo sapiens
aggctgtttttggctgttttccc

SEQ ID NO: 6644824 - DNA, 16 bp, Homo sapiens
aggctgtttttgggtg

SEQ ID NO: 6644825 - DNA, 17 bp, Homo sapiens
aggctgtttttgggtgc

SEQ ID NO: 6644826 - DNA, 15 bp, Homo sapiens
aggcttaaaagagta

SEQ ID NO: 6644827 - DNA, 14 bp, Homo sapiens
aggcttaaacccat

SEQ ID NO: 6644828 - DNA, 22 bp, Homo sapiens
aggcttaaggagaggagaaact

SEQ ID NO: 6644829 - DNA, 17 bp, Homo sapiens
aggcttaataaaaatga

SEQ ID NO: 6644830 - DNA, 21 bp, Homo sapiens
aggcttaataaaaatgacaga

SEQ ID NO: 6644831 - DNA, 18 bp, Homo sapiens
aggcttaatacctgggtg

SEQ ID NO: 6644832 - DNA, 16 bp, Homo sapiens
aggcttacgctgctct

SEQ ID NO: 6644833 - DNA, 20 bp, Homo sapiens
aggcttacgctgctctcctg

SEQ ID NO: 6644834 - DNA, 14 bp, Homo sapiens
aggcttagagagga

SEQ ID NO: 6644835 - DNA, 15 bp, Homo sapiens
aggcttagctttgct

SEQ ID NO: 6644836 - DNA, 19 bp, Homo sapiens
aggcttagctttgctctgc

SEQ ID NO: 6644837 - DNA, 16 bp, Homo sapiens
aggcttaggcatgttc

SEQ ID NO: 6644838 - DNA, 23 bp, Homo sapiens
aggcttagggacaggaccccagc

SEQ ID NO: 6644839 - DNA, 17 bp, Homo sapiens
aggcttaggtcctcact

SEQ ID NO: 6644840 - DNA, 18 bp, Homo sapiens
aggcttagtcactgagac

SEQ ID NO: 6644841 - DNA, 21 bp, Homo sapiens
aggcttagtcactgagacagc

SEQ ID NO: 6644842 - DNA, 22 bp, Homo sapiens
aggcttagtcactgagacagcc

SEQ ID NO: 6644843 - DNA, 15 bp, Homo sapiens
aggcttatattcaac

SEQ ID NO: 6644844 - DNA, 17 bp, Homo sapiens
aggcttatattcaacca

SEQ ID NO: 6644845 - DNA, 21 bp, Homo sapiens
aggcttatattcaaccatgga

SEQ ID NO: 6644846 - DNA, 15 bp, Homo sapiens
aggcttatcaaaatc

SEQ ID NO: 6644847 - DNA, 17 bp, Homo sapiens
aggcttatcaaaatctt

SEQ ID NO: 6644848 - DNA, 21 bp, Homo sapiens
aggcttatttttaaaataaaa

SEQ ID NO: 6644849 - DNA, 17 bp, Homo sapiens
aggcttcaattggtgga

SEQ ID NO: 6644850 - DNA, 20 bp, Homo sapiens
aggcttcagcatatttatag

SEQ ID NO: 6644851 - DNA, 19 bp, Homo sapiens
aggcttcattgcactgatc

SEQ ID NO: 6644852 - DNA, 15 bp, Homo sapiens
aggcttccaatgtgg

SEQ ID NO: 6644853 - DNA, 13 bp, Homo sapiens
aggcttccacact

SEQ ID NO: 6644854 - DNA, 14 bp, Homo sapiens
aggcttccacactt

SEQ ID NO: 6644855 - DNA, 13 bp, Homo sapiens
aggcttccagaga

SEQ ID NO: 6644856 - DNA, 16 bp, Homo sapiens
aggcttccagaggaga

SEQ ID NO: 6644857 - DNA, 15 bp, Homo sapiens
aggcttccaggctct

SEQ ID NO: 6644858 - DNA, 23 bp, Homo sapiens
aggcttccctacacagggcctgc

SEQ ID NO: 6644859 - DNA, 10 bp, Homo sapiens
aggcttccgc

SEQ ID NO: 6644860 - DNA, 21 bp, Homo sapiens
aggcttccggctgagctgtgc

SEQ ID NO: 6644861 - DNA, 10 bp, Homo sapiens
aggcttcctg

SEQ ID NO: 6644862 - DNA, 15 bp, Homo sapiens
aggcttcctgactga

SEQ ID NO: 6644863 - DNA, 24 bp, Homo sapiens
aggcttcctgactgacacaggcca

SEQ ID NO: 6644864 - DNA, 21 bp, Homo sapiens
aggcttcctgcaattttctaa

SEQ ID NO: 6644865 - DNA, 22 bp, Homo sapiens
aggcttcctgcaattttctaag

SEQ ID NO: 6644866 - DNA, 20 bp, Homo sapiens
aggcttcctgcgtcctcctc

SEQ ID NO: 6644867 - DNA, 21 bp, Homo sapiens
aggcttcctgcgtcctcctca

SEQ ID NO: 6644868 - DNA, 18 bp, Homo sapiens
aggcttcctgggtcctgc

SEQ ID NO: 6644869 - DNA, 19 bp, Homo sapiens
aggcttcctggtgagaact

SEQ ID NO: 6644870 - DNA, 21 bp, Homo sapiens
aggcttccttcatttcctccg

SEQ ID NO: 6644871 - DNA, 15 bp, Homo sapiens
aggcttcgtctcaga

SEQ ID NO: 6644872 - DNA, 18 bp, Homo sapiens
aggcttcgtttgcctcca

SEQ ID NO: 6644873 - DNA, 14 bp, Homo sapiens
aggcttctacctgc

SEQ ID NO: 6644874 - DNA, 15 bp, Homo sapiens
aggcttctacctgca

SEQ ID NO: 6644875 - DNA, 23 bp, Homo sapiens
aggcttctagttagctgctttaa

SEQ ID NO: 6644876 - DNA, 18 bp, Homo sapiens
aggcttctatgtccaaca

SEQ ID NO: 6644877 - DNA, 15 bp, Homo sapiens
aggcttctattacct

SEQ ID NO: 6644878 - DNA, 20 bp, Homo sapiens
aggcttctccgccagcctcc

SEQ ID NO: 6644879 - DNA, 12 bp, Homo sapiens
aggcttctcctt

SEQ ID NO: 6644880 - DNA, 13 bp, Homo sapiens
aggcttctctcca

SEQ ID NO: 6644881 - DNA, 16 bp, Homo sapiens
aggcttctctgttcta

SEQ ID NO: 6644882 - DNA, 17 bp, Homo sapiens
aggcttctgctggggcc

SEQ ID NO: 6644883 - DNA, 19 bp, Homo sapiens
aggcttctgggacttgaaa

SEQ ID NO: 6644884 - DNA, 23 bp, Homo sapiens
aggcttctggttgatgcctgtga

SEQ ID NO: 6644885 - DNA, 23 bp, Homo sapiens
aggcttcttcagatcagtgcttg

SEQ ID NO: 6644886 - DNA, 15 bp, Homo sapiens
aggcttcttcctaca

SEQ ID NO: 6644887 - DNA, 14 bp, Homo sapiens
aggcttcttcctgg

SEQ ID NO: 6644888 - DNA, 15 bp, Homo sapiens
aggcttcttcctgga

SEQ ID NO: 6644889 - DNA, 15 bp, Homo sapiens
aggcttgaaatctcc

SEQ ID NO: 6644890 - DNA, 22 bp, Homo sapiens
aggcttgagttttcatttcata

SEQ ID NO: 6644891 - DNA, 18 bp, Homo sapiens
aggcttgattccaacagg

SEQ ID NO: 6644892 - DNA, 19 bp, Homo sapiens
aggcttgattccaacaggc

SEQ ID NO: 6644893 - DNA, 15 bp, Homo sapiens
aggcttgcccaggag

SEQ ID NO: 6644894 - DNA, 16 bp, Homo sapiens
aggcttgcctgcaggc

SEQ ID NO: 6644895 - DNA, 13 bp, Homo sapiens
aggcttgcctggg

SEQ ID NO: 6644896 - DNA, 20 bp, Homo sapiens
aggcttgcctgggctgggca

SEQ ID NO: 6644897 - DNA, 14 bp, Homo sapiens
aggcttgctgagag

SEQ ID NO: 6644898 - DNA, 13 bp, Homo sapiens
aggcttggctcct

SEQ ID NO: 6644899 - DNA, 22 bp, Homo sapiens
aggcttgggaccgccagatggg

SEQ ID NO: 6644900 - DNA, 19 bp, Homo sapiens
aggcttggggaaaatggcc

SEQ ID NO: 6644901 - DNA, 23 bp, Homo sapiens
aggcttgtcaaatagcaaggcca

SEQ ID NO: 6644902 - DNA, 22 bp, Homo sapiens
aggcttgtcactagcagctgca

SEQ ID NO: 6644903 - DNA, 21 bp, Homo sapiens
aggcttgtgtaatttcctgct

SEQ ID NO: 6644904 - DNA, 21 bp, Homo sapiens
aggcttgtttacctttctctc

SEQ ID NO: 6644905 - DNA, 15 bp, Homo sapiens
aggctttaaaaagaa

SEQ ID NO: 6644906 - DNA, 13 bp, Homo sapiens
aggctttaaaagt

SEQ ID NO: 6644907 - DNA, 18 bp, Homo sapiens
aggctttaagctccagct

SEQ ID NO: 6644908 - DNA, 19 bp, Homo sapiens
aggctttaagctccagctt

SEQ ID NO: 6644909 - DNA, 17 bp, Homo sapiens
aggctttaataaaggcc

SEQ ID NO: 6644910 - DNA, 16 bp, Homo sapiens
aggctttagaagagat

SEQ ID NO: 6644911 - DNA, 16 bp, Homo sapiens
aggctttatgtacaaa

SEQ ID NO: 6644912 - DNA, 19 bp, Homo sapiens
aggctttcaattgtatttt

SEQ ID NO: 6644913 - DNA, 22 bp, Homo sapiens
aggctttcaattgtattttata

SEQ ID NO: 6644914 - DNA, 15 bp, Homo sapiens
aggctttcactattt

SEQ ID NO: 6644915 - DNA, 20 bp, Homo sapiens
aggctttcactatttccttt

SEQ ID NO: 6644916 - DNA, 13 bp, Homo sapiens
aggctttcatgtt

SEQ ID NO: 6644917 - DNA, 23 bp, Homo sapiens
aggctttcccacttcccaccctg

SEQ ID NO: 6644918 - DNA, 12 bp, Homo sapiens
aggctttctatt

SEQ ID NO: 6644919 - DNA, 15 bp, Homo sapiens
aggctttctgggctc

SEQ ID NO: 6644920 - DNA, 22 bp, Homo sapiens
aggctttctgttgccatggtga

SEQ ID NO: 6644921 - DNA, 18 bp, Homo sapiens
aggctttgccatgggcct

SEQ ID NO: 6644922 - DNA, 22 bp, Homo sapiens
aggctttggcaacagaaaacaa

SEQ ID NO: 6644923 - DNA, 20 bp, Homo sapiens
aggctttgggaacactggcc

SEQ ID NO: 6644924 - DNA, 23 bp, Homo sapiens
aggctttgggaacactggcctgg

SEQ ID NO: 6644925 - DNA, 15 bp, Homo sapiens
aggctttgggtggct

SEQ ID NO: 6644926 - DNA, 19 bp, Homo sapiens
aggctttgtgagagaggac

SEQ ID NO: 6644927 - DNA, 22 bp, Homo sapiens
aggctttgtgagagaggacctc

SEQ ID NO: 6644928 - DNA, 23 bp, Homo sapiens
aggctttgtgagagaggacctcc

SEQ ID NO: 6644929 - DNA, 16 bp, Homo sapiens
aggctttgtgttgtaa

SEQ ID NO: 6644930 - DNA, 13 bp, Homo sapiens
aggcttttattag

SEQ ID NO: 6644931 - DNA, 15 bp, Homo sapiens
aggcttttcactgcc

SEQ ID NO: 6644932 - DNA, 14 bp, Homo sapiens
aggcttttccaaat

SEQ ID NO: 6644933 - DNA, 15 bp, Homo sapiens
aggcttttccagtgt

SEQ ID NO: 6644934 - DNA, 17 bp, Homo sapiens
aggcttttccagtgtgt

SEQ ID NO: 6644935 - DNA, 20 bp, Homo sapiens
aggcttttctgcctgctcct

SEQ ID NO: 6644936 - DNA, 14 bp, Homo sapiens
aggcttttgctaga

SEQ ID NO: 6644937 - DNA, 14 bp, Homo sapiens
aggcttttgggcca

SEQ ID NO: 6644938 - DNA, 16 bp, Homo sapiens
aggctttttcagtgat

SEQ ID NO: 6644939 - DNA, 21 bp, Homo sapiens
aggcttttttatcatgtgaaa

SEQ ID NO: 6644940 - DNA, 15 bp, Homo sapiens
agggaaaaaaaatgt

SEQ ID NO: 6644941 - DNA, 19 bp, Homo sapiens
agggaaaaaagaaagaaaa

SEQ ID NO: 6644942 - DNA, 12 bp, Homo sapiens
agggaaaaagac

SEQ ID NO: 6644943 - DNA, 23 bp, Homo sapiens
agggaaaaatcaagtattataaa

SEQ ID NO: 6644944 - DNA, 14 bp, Homo sapiens
agggaaaacacaga

SEQ ID NO: 6644945 - DNA, 20 bp, Homo sapiens
agggaaaacacggccctcct

SEQ ID NO: 6644946 - DNA, 20 bp, Homo sapiens
agggaaaacataatatcttg

SEQ ID NO: 6644947 - DNA, 16 bp, Homo sapiens
agggaaaagctaagag

SEQ ID NO: 6644948 - DNA, 14 bp, Homo sapiens
agggaaaaggcagg

SEQ ID NO: 6644949 - DNA, 15 bp, Homo sapiens
agggaaaaggcaggt

SEQ ID NO: 6644950 - DNA, 20 bp, Homo sapiens
agggaaaataggcaggaagc

SEQ ID NO: 6644951 - DNA, 13 bp, Homo sapiens
agggaaaatatag

SEQ ID NO: 6644952 - DNA, 21 bp, Homo sapiens
agggaaaatcttcactttctt

SEQ ID NO: 6644953 - DNA, 14 bp, Homo sapiens
agggaaaatgaatt

SEQ ID NO: 6644954 - DNA, 17 bp, Homo sapiens
agggaaaatgcagcagg

SEQ ID NO: 6644955 - DNA, 13 bp, Homo sapiens
agggaaacagcct

SEQ ID NO: 6644956 - DNA, 19 bp, Homo sapiens
agggaaacccggggaactg

SEQ ID NO: 6644957 - DNA, 15 bp, Homo sapiens
agggaaacgtgccct

SEQ ID NO: 6644958 - DNA, 23 bp, Homo sapiens
agggaaactctggagagcctgca

SEQ ID NO: 6644959 - DNA, 19 bp, Homo sapiens
agggaaactgccagcaacg

SEQ ID NO: 6644960 - DNA, 13 bp, Homo sapiens
agggaaactggga

SEQ ID NO: 6644961 - DNA, 23 bp, Homo sapiens
agggaaactgtgaatgcttctga

SEQ ID NO: 6644962 - DNA, 12 bp, Homo sapiens
agggaaagaaaa

SEQ ID NO: 6644963 - DNA, 19 bp, Homo sapiens
agggaaagaaaaggaaggc

SEQ ID NO: 6644964 - DNA, 13 bp, Homo sapiens
agggaaagaaaat

SEQ ID NO: 6644965 - DNA, 23 bp, Homo sapiens
agggaaagaaagttgcacggctg

SEQ ID NO: 6644966 - DNA, 15 bp, Homo sapiens
agggaaagccagcct

SEQ ID NO: 6644967 - DNA, 13 bp, Homo sapiens
agggaaagcctct

SEQ ID NO: 6644968 - DNA, 13 bp, Homo sapiens
agggaaagcgggc

SEQ ID NO: 6644969 - DNA, 14 bp, Homo sapiens
agggaaagcgggca

SEQ ID NO: 6644970 - DNA, 13 bp, Homo sapiens
agggaaaggaaaa

SEQ ID NO: 6644971 - DNA, 22 bp, Homo sapiens
agggaaaggctctgaaagccag

SEQ ID NO: 6644972 - DNA, 15 bp, Homo sapiens
agggaaaggctgaac

SEQ ID NO: 6644973 - DNA, 18 bp, Homo sapiens
agggaaaggctgaacata

SEQ ID NO: 6644974 - DNA, 10 bp, Homo sapiens
agggaaaggg

SEQ ID NO: 6644975 - DNA, 23 bp, Homo sapiens
agggaaagggatggtcaggccca

SEQ ID NO: 6644976 - DNA, 18 bp, Homo sapiens
agggaaaggggtgctttt

SEQ ID NO: 6644977 - DNA, 23 bp, Homo sapiens
agggaaagggtcctgctttctcc

SEQ ID NO: 6644978 - DNA, 13 bp, Homo sapiens
agggaaagggtgg

SEQ ID NO: 6644979 - DNA, 19 bp, Homo sapiens
agggaaagttccagcagtt

SEQ ID NO: 6644980 - DNA, 17 bp, Homo sapiens
agggaaagttttgttct

SEQ ID NO: 6644981 - DNA, 23 bp, Homo sapiens
agggaaagttttgttctgtatat

SEQ ID NO: 6644982 - DNA, 21 bp, Homo sapiens
agggaaataatagggaaaata

SEQ ID NO: 6644983 - DNA, 22 bp, Homo sapiens
agggaaatagaaaaaccctgcc

SEQ ID NO: 6644984 - DNA, 23 bp, Homo sapiens
agggaaatagctaataatgttaa

SEQ ID NO: 6644985 - DNA, 14 bp, Homo sapiens
agggaaatcaattt

SEQ ID NO: 6644986 - DNA, 14 bp, Homo sapiens
agggaaatccaact

SEQ ID NO: 6644987 - DNA, 16 bp, Homo sapiens
agggaaatccaactcc

SEQ ID NO: 6644988 - DNA, 19 bp, Homo sapiens
agggaaatccaactccagg

SEQ ID NO: 6644989 - DNA, 14 bp, Homo sapiens
agggaaatgaaaga

SEQ ID NO: 6644990 - DNA, 18 bp, Homo sapiens
agggaaatgacttctcca

SEQ ID NO: 6644991 - DNA, 13 bp, Homo sapiens
agggaaatgctgt

SEQ ID NO: 6644992 - DNA, 16 bp, Homo sapiens
agggaaatggagggtg

SEQ ID NO: 6644993 - DNA, 17 bp, Homo sapiens
agggaaatgtatgtgtg

SEQ ID NO: 6644994 - DNA, 17 bp, Homo sapiens
agggaaatgtgactggt

SEQ ID NO: 6644995 - DNA, 23 bp, Homo sapiens
agggaaattcacactgtgcgttt

SEQ ID NO: 6644996 - DNA, 21 bp, Homo sapiens
agggaaattgtttatgtgtta

SEQ ID NO: 6644997 - DNA, 21 bp, Homo sapiens
agggaacaagttgagctatga

SEQ ID NO: 6644998 - DNA, 23 bp, Homo sapiens
agggaacaatttggcaattttgt

SEQ ID NO: 6644999 - DNA, 19 bp, Homo sapiens
agggaacacattcctttgc

SEQ ID NO: 6645000 - DNA, 18 bp, Homo sapiens
agggaacactcatccctg

SEQ ID NO: 6645001 - DNA, 13 bp, Homo sapiens
agggaacagacag

SEQ ID NO: 6645002 - DNA, 20 bp, Homo sapiens
agggaacagccccagggttg

SEQ ID NO: 6645003 - DNA, 16 bp, Homo sapiens
agggaacagcctgagc

SEQ ID NO: 6645004 - DNA, 18 bp, Homo sapiens
agggaacagcctgagccg

SEQ ID NO: 6645005 - DNA, 14 bp, Homo sapiens
agggaacaggaaaa

SEQ ID NO: 6645006 - DNA, 14 bp, Homo sapiens
agggaacagtgagg

SEQ ID NO: 6645007 - DNA, 18 bp, Homo sapiens
agggaacatatttaagga

SEQ ID NO: 6645008 - DNA, 23 bp, Homo sapiens
agggaacatttccgaataaagta

SEQ ID NO: 6645009 - DNA, 16 bp, Homo sapiens
agggaaccaccagcgt

SEQ ID NO: 6645010 - DNA, 17 bp, Homo sapiens
agggaaccagccctcca

SEQ ID NO: 6645011 - DNA, 18 bp, Homo sapiens
agggaacgtgattagtga

SEQ ID NO: 6645012 - DNA, 12 bp, Homo sapiens
agggaactagat

SEQ ID NO: 6645013 - DNA, 15 bp, Homo sapiens
agggaactagataac

SEQ ID NO: 6645014 - DNA, 15 bp, Homo sapiens
agggaactctggggt

SEQ ID NO: 6645015 - DNA, 16 bp, Homo sapiens
agggaactggcctgct

SEQ ID NO: 6645016 - DNA, 12 bp, Homo sapiens
agggaactggga

SEQ ID NO: 6645017 - DNA, 20 bp, Homo sapiens
agggaactgggaagatgctg

SEQ ID NO: 6645018 - DNA, 13 bp, Homo sapiens
agggaacttagta

SEQ ID NO: 6645019 - DNA, 22 bp, Homo sapiens
agggaactttctggactcccac

SEQ ID NO: 6645020 - DNA, 19 bp, Homo sapiens
agggaagaaaaagcaagtg

SEQ ID NO: 6645021 - DNA, 23 bp, Homo sapiens
agggaagaaaactatcctgcggg

SEQ ID NO: 6645022 - DNA, 16 bp, Homo sapiens
agggaagaaaagagct

SEQ ID NO: 6645023 - DNA, 12 bp, Homo sapiens
agggaagaaatc

SEQ ID NO: 6645024 - DNA, 15 bp, Homo sapiens
agggaagaactattg

SEQ ID NO: 6645025 - DNA, 17 bp, Homo sapiens
agggaagaaggggccat

SEQ ID NO: 6645026 - DNA, 18 bp, Homo sapiens
agggaagaaggggccatc

SEQ ID NO: 6645027 - DNA, 17 bp, Homo sapiens
agggaagacagagcagg

SEQ ID NO: 6645028 - DNA, 19 bp, Homo sapiens
agggaagacagagcaggct

SEQ ID NO: 6645029 - DNA, 14 bp, Homo sapiens
agggaagaccagaa

SEQ ID NO: 6645030 - DNA, 21 bp, Homo sapiens
agggaagacctgaaagagagg

SEQ ID NO: 6645031 - DNA, 14 bp, Homo sapiens
agggaagagaaaca

SEQ ID NO: 6645032 - DNA, 15 bp, Homo sapiens
agggaagagaaagtg

SEQ ID NO: 6645033 - DNA, 14 bp, Homo sapiens
agggaagagacagc

SEQ ID NO: 6645034 - DNA, 15 bp, Homo sapiens
agggaagagccttta

SEQ ID NO: 6645035 - DNA, 13 bp, Homo sapiens
agggaagagggca

SEQ ID NO: 6645036 - DNA, 16 bp, Homo sapiens
agggaagagggcagta

SEQ ID NO: 6645037 - DNA, 13 bp, Homo sapiens
agggaagagtttt

SEQ ID NO: 6645038 - DNA, 16 bp, Homo sapiens
agggaagataaagatg

SEQ ID NO: 6645039 - DNA, 19 bp, Homo sapiens
agggaagataagttggaaa

SEQ ID NO: 6645040 - DNA, 20 bp, Homo sapiens
agggaagataagttggaaac

SEQ ID NO: 6645041 - DNA, 21 bp, Homo sapiens
agggaagataagttggaaaca

SEQ ID NO: 6645042 - DNA, 17 bp, Homo sapiens
agggaagatgacctgcc

SEQ ID NO: 6645043 - DNA, 18 bp, Homo sapiens
agggaagatgacctgccc

SEQ ID NO: 6645044 - DNA, 19 bp, Homo sapiens
agggaagcactgcctccct

SEQ ID NO: 6645045 - DNA, 17 bp, Homo sapiens
agggaagcagcagcctc

SEQ ID NO: 6645046 - DNA, 12 bp, Homo sapiens
agggaagcaggc

SEQ ID NO: 6645047 - DNA, 15 bp, Homo sapiens
agggaagcaggcaga

SEQ ID NO: 6645048 - DNA, 19 bp, Homo sapiens
agggaagcccacccgcccc

SEQ ID NO: 6645049 - DNA, 24 bp, Homo sapiens
agggaagcccagctccagggccag

SEQ ID NO: 6645050 - DNA, 13 bp, Homo sapiens
agggaagcctgac

SEQ ID NO: 6645051 - DNA, 15 bp, Homo sapiens
agggaagcctgactg

SEQ ID NO: 6645052 - DNA, 18 bp, Homo sapiens
agggaagccttttgcaaa

SEQ ID NO: 6645053 - DNA, 23 bp, Homo sapiens
agggaagccttttgcaaatagta

SEQ ID NO: 6645054 - DNA, 21 bp, Homo sapiens
agggaagctacaggttacaac

SEQ ID NO: 6645055 - DNA, 14 bp, Homo sapiens
agggaagctcttgg

SEQ ID NO: 6645056 - DNA, 17 bp, Homo sapiens
agggaagctcttttctc

SEQ ID NO: 6645057 - DNA, 16 bp, Homo sapiens
agggaagctgaggccc

SEQ ID NO: 6645058 - DNA, 17 bp, Homo sapiens
agggaagctgaggccca

SEQ ID NO: 6645059 - DNA, 18 bp, Homo sapiens
agggaagctgaggcccat

SEQ ID NO: 6645060 - DNA, 19 bp, Homo sapiens
agggaagctgaggcccatg

SEQ ID NO: 6645061 - DNA, 22 bp, Homo sapiens
agggaagctgaggcccatggcc

SEQ ID NO: 6645062 - DNA, 16 bp, Homo sapiens
agggaagctggcctga

SEQ ID NO: 6645063 - DNA, 17 bp, Homo sapiens
agggaagctggcctgag

SEQ ID NO: 6645064 - DNA, 18 bp, Homo sapiens
agggaaggaactctggct

SEQ ID NO: 6645065 - DNA, 16 bp, Homo sapiens
agggaaggacagctgt

SEQ ID NO: 6645066 - DNA, 18 bp, Homo sapiens
agggaaggacagtccctg

SEQ ID NO: 6645067 - DNA, 21 bp, Homo sapiens
agggaaggacagtccctgctg

SEQ ID NO: 6645068 - DNA, 22 bp, Homo sapiens
agggaaggacagtccctgctgg

SEQ ID NO: 6645069 - DNA, 18 bp, Homo sapiens
agggaaggaccccctccc

SEQ ID NO: 6645070 - DNA, 13 bp, Homo sapiens
agggaaggagccc

SEQ ID NO: 6645071 - DNA, 17 bp, Homo sapiens
agggaaggaggagcctg

SEQ ID NO: 6645072 - DNA, 20 bp, Homo sapiens
agggaaggataaagccactt

SEQ ID NO: 6645073 - DNA, 22 bp, Homo sapiens
agggaaggatcccatgagctcc

SEQ ID NO: 6645074 - DNA, 23 bp, Homo sapiens
agggaaggatcccatgagctcct

SEQ ID NO: 6645075 - DNA, 18 bp, Homo sapiens
agggaaggcaggcagggc

SEQ ID NO: 6645076 - DNA, 12 bp, Homo sapiens
agggaaggcctg

SEQ ID NO: 6645077 - DNA, 14 bp, Homo sapiens
agggaaggcctgac

SEQ ID NO: 6645078 - DNA, 17 bp, Homo sapiens
agggaagggagaaagta

SEQ ID NO: 6645079 - DNA, 13 bp, Homo sapiens
agggaagggagcc

SEQ ID NO: 6645080 - DNA, 19 bp, Homo sapiens
agggaagggagccaaggga

SEQ ID NO: 6645081 - DNA, 20 bp, Homo sapiens
agggaagggagccaagggat

SEQ ID NO: 6645082 - DNA, 15 bp, Homo sapiens
agggaagggccaccc

SEQ ID NO: 6645083 - DNA, 18 bp, Homo sapiens
agggaagggccaccctgc

SEQ ID NO: 6645084 - DNA, 18 bp, Homo sapiens
agggaagggcctgccaca

SEQ ID NO: 6645085 - DNA, 15 bp, Homo sapiens
agggaaggggacaga

SEQ ID NO: 6645086 - DNA, 21 bp, Homo sapiens
agggaaggggaggcagccggc

SEQ ID NO: 6645087 - DNA, 20 bp, Homo sapiens
agggaaggggatggaggcca

SEQ ID NO: 6645088 - DNA, 21 bp, Homo sapiens
agggaaggggatggaggccag

SEQ ID NO: 6645089 - DNA, 22 bp, Homo sapiens
agggaaggggatggaggccaga

SEQ ID NO: 6645090 - DNA, 19 bp, Homo sapiens
agggaaggggcctccctcc

SEQ ID NO: 6645091 - DNA, 19 bp, Homo sapiens
agggaaggggggtcagaag

SEQ ID NO: 6645092 - DNA, 16 bp, Homo sapiens
agggaagggtgcctgg

SEQ ID NO: 6645093 - DNA, 22 bp, Homo sapiens
agggaagggtgcctggctgggc

SEQ ID NO: 6645094 - DNA, 20 bp, Homo sapiens
agggaaggtatatcaggagg

SEQ ID NO: 6645095 - DNA, 14 bp, Homo sapiens
agggaaggtgctga

SEQ ID NO: 6645096 - DNA, 19 bp, Homo sapiens
agggaaggtggggccctgc

SEQ ID NO: 6645097 - DNA, 23 bp, Homo sapiens
agggaaggtggggccctgcccct

SEQ ID NO: 6645098 - DNA, 14 bp, Homo sapiens
agggaaggttcttc

SEQ ID NO: 6645099 - DNA, 16 bp, Homo sapiens
agggaagtaacagtaa

SEQ ID NO: 6645100 - DNA, 22 bp, Homo sapiens
agggaagtaacagtaacgcagg

SEQ ID NO: 6645101 - DNA, 20 bp, Homo sapiens
agggaagtagttatcatgtt

SEQ ID NO: 6645102 - DNA, 15 bp, Homo sapiens
agggaagtcttactt

SEQ ID NO: 6645103 - DNA, 16 bp, Homo sapiens
agggaagtgaggccca

SEQ ID NO: 6645104 - DNA, 23 bp, Homo sapiens
agggaagtgaggcccaaggagct

SEQ ID NO: 6645105 - DNA, 17 bp, Homo sapiens
agggaagtgatatcata

SEQ ID NO: 6645106 - DNA, 21 bp, Homo sapiens
agggaagtggaggttgctgta

SEQ ID NO: 6645107 - DNA, 15 bp, Homo sapiens
agggaagtgtgagcg

SEQ ID NO: 6645108 - DNA, 22 bp, Homo sapiens
agggaagtgtgagcgccttggt

SEQ ID NO: 6645109 - DNA, 22 bp, Homo sapiens
agggaagtgtgtgtgtgtccat

SEQ ID NO: 6645110 - DNA, 16 bp, Homo sapiens
agggaagttgtctcct

SEQ ID NO: 6645111 - DNA, 17 bp, Homo sapiens
agggaagtttaaaaccc

SEQ ID NO: 6645112 - DNA, 13 bp, Homo sapiens
agggaagttttgt

SEQ ID NO: 6645113 - DNA, 21 bp, Homo sapiens
agggaataataggccacagaa

SEQ ID NO: 6645114 - DNA, 19 bp, Homo sapiens
agggaatactcacattttg

SEQ ID NO: 6645115 - DNA, 15 bp, Homo sapiens
agggaatagaaatgt

SEQ ID NO: 6645116 - DNA, 17 bp, Homo sapiens
agggaatagtatagaca

SEQ ID NO: 6645117 - DNA, 22 bp, Homo sapiens
agggaatatgtaagtcaggagt

SEQ ID NO: 6645118 - DNA, 21 bp, Homo sapiens
agggaatcagggaccagcttt

SEQ ID NO: 6645119 - DNA, 14 bp, Homo sapiens
agggaatcagggag

SEQ ID NO: 6645120 - DNA, 19 bp, Homo sapiens
agggaatcagggagcactg

SEQ ID NO: 6645121 - DNA, 16 bp, Homo sapiens
agggaatcatttttgt

SEQ ID NO: 6645122 - DNA, 19 bp, Homo sapiens
agggaatccaagcctccac

SEQ ID NO: 6645123 - DNA, 18 bp, Homo sapiens
agggaatccccgaaggtg

SEQ ID NO: 6645124 - DNA, 23 bp, Homo sapiens
agggaatccccgaaggtgctgga

SEQ ID NO: 6645125 - DNA, 15 bp, Homo sapiens
agggaatcctgacct

SEQ ID NO: 6645126 - DNA, 15 bp, Homo sapiens
agggaatcctgcggc

SEQ ID NO: 6645127 - DNA, 16 bp, Homo sapiens
agggaatcctgcggca

SEQ ID NO: 6645128 - DNA, 15 bp, Homo sapiens
agggaatctagccca

SEQ ID NO: 6645129 - DNA, 19 bp, Homo sapiens
agggaatctagcccaacct

SEQ ID NO: 6645130 - DNA, 20 bp, Homo sapiens
agggaatctagcccaaccta

SEQ ID NO: 6645131 - DNA, 23 bp, Homo sapiens
agggaatgagacaggacctagga

SEQ ID NO: 6645132 - DNA, 20 bp, Homo sapiens
agggaatgagagttccttct

SEQ ID NO: 6645133 - DNA, 13 bp, Homo sapiens
agggaatgcctga

SEQ ID NO: 6645134 - DNA, 18 bp, Homo sapiens
agggaatggagaatggtg

SEQ ID NO: 6645135 - DNA, 15 bp, Homo sapiens
agggaatggcacagc

SEQ ID NO: 6645136 - DNA, 18 bp, Homo sapiens
agggaattcctagctgta

SEQ ID NO: 6645137 - DNA, 18 bp, Homo sapiens
agggaattcttacagcca

SEQ ID NO: 6645138 - DNA, 23 bp, Homo sapiens
agggaattcttacagccaagttg

SEQ ID NO: 6645139 - DNA, 19 bp, Homo sapiens
agggaattgattcaagatt

SEQ ID NO: 6645140 - DNA, 13 bp, Homo sapiens
agggaattggggg

SEQ ID NO: 6645141 - DNA, 22 bp, Homo sapiens
agggaatttctatctaaatgat

SEQ ID NO: 6645142 - DNA, 21 bp, Homo sapiens
agggaatttcttcaactccct

SEQ ID NO: 6645143 - DNA, 21 bp, Homo sapiens
agggaattttcattggatgca

SEQ ID NO: 6645144 - DNA, 18 bp, Homo sapiens
agggacaaaggagcctgt

SEQ ID NO: 6645145 - DNA, 19 bp, Homo sapiens
agggacaaaggagcctgtg

SEQ ID NO: 6645146 - DNA, 15 bp, Homo sapiens
agggacaagccctgg

SEQ ID NO: 6645147 - DNA, 14 bp, Homo sapiens
agggacaagggatt

SEQ ID NO: 6645148 - DNA, 17 bp, Homo sapiens
agggacaagggggagga

SEQ ID NO: 6645149 - DNA, 13 bp, Homo sapiens
agggacacacaca

SEQ ID NO: 6645150 - DNA, 15 bp, Homo sapiens
agggacacacagcct

SEQ ID NO: 6645151 - DNA, 19 bp, Homo sapiens
agggacacacagtgacaaa

SEQ ID NO: 6645152 - DNA, 14 bp, Homo sapiens
agggacacatgccc

SEQ ID NO: 6645153 - DNA, 18 bp, Homo sapiens
agggacacatgcccctcc

SEQ ID NO: 6645154 - DNA, 17 bp, Homo sapiens
agggacacatttctctg

SEQ ID NO: 6645155 - DNA, 15 bp, Homo sapiens
agggacaccagccag

SEQ ID NO: 6645156 - DNA, 20 bp, Homo sapiens
agggacaccagccaggctct

SEQ ID NO: 6645157 - DNA, 20 bp, Homo sapiens
agggacacccctacacacac

SEQ ID NO: 6645158 - DNA, 23 bp, Homo sapiens
agggacacgggcagcctggctcc

SEQ ID NO: 6645159 - DNA, 15 bp, Homo sapiens
agggacactcctcct

SEQ ID NO: 6645160 - DNA, 20 bp, Homo sapiens
agggacagaaaccaaggccc

SEQ ID NO: 6645161 - DNA, 10 bp, Homo sapiens
agggacagag

SEQ ID NO: 6645162 - DNA, 19 bp, Homo sapiens
agggacagagacacctgca

SEQ ID NO: 6645163 - DNA, 20 bp, Homo sapiens
agggacagagacacctgcac

SEQ ID NO: 6645164 - DNA, 16 bp, Homo sapiens
agggacagaggcccca

SEQ ID NO: 6645165 - DNA, 11 bp, Homo sapiens
agggacagcaa

SEQ ID NO: 6645166 - DNA, 14 bp, Homo sapiens
agggacagcatgcc

SEQ ID NO: 6645167 - DNA, 21 bp, Homo sapiens
agggacagccaaaagtaagtg

SEQ ID NO: 6645168 - DNA, 12 bp, Homo sapiens
agggacagccca

SEQ ID NO: 6645169 - DNA, 23 bp, Homo sapiens
agggacagcccacggtctggagg

SEQ ID NO: 6645170 - DNA, 20 bp, Homo sapiens
agggacagcccactgagaag

SEQ ID NO: 6645171 - DNA, 19 bp, Homo sapiens
agggacagctgctgggacc

SEQ ID NO: 6645172 - DNA, 14 bp, Homo sapiens
agggacaggagaag

SEQ ID NO: 6645173 - DNA, 15 bp, Homo sapiens
agggacaggagaaga

SEQ ID NO: 6645174 - DNA, 13 bp, Homo sapiens
agggacagggcag

SEQ ID NO: 6645175 - DNA, 13 bp, Homo sapiens
agggacagggctt

SEQ ID NO: 6645176 - DNA, 14 bp, Homo sapiens
agggacagggcttg

SEQ ID NO: 6645177 - DNA, 17 bp, Homo sapiens
agggacaggtgggcctg

SEQ ID NO: 6645178 - DNA, 18 bp, Homo sapiens
agggacaggtgggcctgg

SEQ ID NO: 6645179 - DNA, 22 bp, Homo sapiens
agggacaggtgggcctggcggc

SEQ ID NO: 6645180 - DNA, 16 bp, Homo sapiens
agggacagtctcacca

SEQ ID NO: 6645181 - DNA, 13 bp, Homo sapiens
agggacagtgggc

SEQ ID NO: 6645182 - DNA, 16 bp, Homo sapiens
agggacataagataaa

SEQ ID NO: 6645183 - DNA, 17 bp, Homo sapiens
agggacatagaatctgt

SEQ ID NO: 6645184 - DNA, 13 bp, Homo sapiens
agggacatattca

SEQ ID NO: 6645185 - DNA, 15 bp, Homo sapiens
agggacatctgttct

SEQ ID NO: 6645186 - DNA, 19 bp, Homo sapiens
agggacatgctcacctcta

SEQ ID NO: 6645187 - DNA, 20 bp, Homo sapiens
agggacatggggcaagccag

SEQ ID NO: 6645188 - DNA, 21 bp, Homo sapiens
agggacatttctataaaaata

SEQ ID NO: 6645189 - DNA, 19 bp, Homo sapiens
agggaccaaattgcttcta

SEQ ID NO: 6645190 - DNA, 17 bp, Homo sapiens
agggaccaactgggccc

SEQ ID NO: 6645191 - DNA, 20 bp, Homo sapiens
agggaccaagcgaccaagga

SEQ ID NO: 6645192 - DNA, 21 bp, Homo sapiens
agggaccaagcgaccaaggat

SEQ ID NO: 6645193 - DNA, 21 bp, Homo sapiens
agggaccaaggacccctcacc

SEQ ID NO: 6645194 - DNA, 21 bp, Homo sapiens
agggaccaaggcaaggcaggt

SEQ ID NO: 6645195 - DNA, 23 bp, Homo sapiens
agggaccacagcaaggcacctgc

SEQ ID NO: 6645196 - DNA, 17 bp, Homo sapiens
agggaccacatccaccc

SEQ ID NO: 6645197 - DNA, 18 bp, Homo sapiens
agggaccacatccacccc

SEQ ID NO: 6645198 - DNA, 20 bp, Homo sapiens
agggaccacatccaccccag

SEQ ID NO: 6645199 - DNA, 18 bp, Homo sapiens
agggaccactgggtgaga

SEQ ID NO: 6645200 - DNA, 23 bp, Homo sapiens
agggaccactgggtgagagagga

SEQ ID NO: 6645201 - DNA, 15 bp, Homo sapiens
agggaccagccaaga

SEQ ID NO: 6645202 - DNA, 20 bp, Homo sapiens
agggaccagcccagcctgca

SEQ ID NO: 6645203 - DNA, 22 bp, Homo sapiens
agggaccagcccttcatgggtg

SEQ ID NO: 6645204 - DNA, 18 bp, Homo sapiens
agggaccatcaagaacct

SEQ ID NO: 6645205 - DNA, 14 bp, Homo sapiens
agggaccatctgct

SEQ ID NO: 6645206 - DNA, 15 bp, Homo sapiens
agggacccacatcca

SEQ ID NO: 6645207 - DNA, 13 bp, Homo sapiens
agggacccacctg

SEQ ID NO: 6645208 - DNA, 13 bp, Homo sapiens
agggacccagcta

SEQ ID NO: 6645209 - DNA, 14 bp, Homo sapiens
agggacccctcctc

SEQ ID NO: 6645210 - DNA, 17 bp, Homo sapiens
agggacccctcgcccca

SEQ ID NO: 6645211 - DNA, 21 bp, Homo sapiens
agggacccctcgccccagcct

SEQ ID NO: 6645212 - DNA, 23 bp, Homo sapiens
agggacccctgcccttgtcccac

SEQ ID NO: 6645213 - DNA, 22 bp, Homo sapiens
agggacccgaagcccaggctga

SEQ ID NO: 6645214 - DNA, 19 bp, Homo sapiens
agggacccggggtctcctg

SEQ ID NO: 6645215 - DNA, 20 bp, Homo sapiens
agggacccggggtctcctgg

SEQ ID NO: 6645216 - DNA, 15 bp, Homo sapiens
agggaccctccacca

SEQ ID NO: 6645217 - DNA, 19 bp, Homo sapiens
agggacccttggctcctgt

SEQ ID NO: 6645218 - DNA, 23 bp, Homo sapiens
agggaccctttgcctttcttctg

SEQ ID NO: 6645219 - DNA, 18 bp, Homo sapiens
agggaccgagcccagcag

SEQ ID NO: 6645220 - DNA, 16 bp, Homo sapiens
agggaccggcagagct

SEQ ID NO: 6645221 - DNA, 22 bp, Homo sapiens
agggaccggcagagctctacag

SEQ ID NO: 6645222 - DNA, 22 bp, Homo sapiens
agggaccggtgctgcaggagtg

SEQ ID NO: 6645223 - DNA, 17 bp, Homo sapiens
agggaccgtccagggga

SEQ ID NO: 6645224 - DNA, 20 bp, Homo sapiens
agggacctcaggggcacctc

SEQ ID NO: 6645225 - DNA, 13 bp, Homo sapiens
agggacctgagag

SEQ ID NO: 6645226 - DNA, 17 bp, Homo sapiens
agggacctgctgctcag

SEQ ID NO: 6645227 - DNA, 21 bp, Homo sapiens
agggaccttcagggagagctg

SEQ ID NO: 6645228 - DNA, 22 bp, Homo sapiens
agggaccttcatgcccttctga

SEQ ID NO: 6645229 - DNA, 23 bp, Homo sapiens
agggaccttcatgcccttctgat

SEQ ID NO: 6645230 - DNA, 15 bp, Homo sapiens
agggaccttggaaac

SEQ ID NO: 6645231 - DNA, 13 bp, Homo sapiens
agggaccttggag

SEQ ID NO: 6645232 - DNA, 21 bp, Homo sapiens
agggacgaagaagagccacag

SEQ ID NO: 6645233 - DNA, 19 bp, Homo sapiens
agggacgactttctttaac

SEQ ID NO: 6645234 - DNA, 15 bp, Homo sapiens
agggacgcggaggag

SEQ ID NO: 6645235 - DNA, 22 bp, Homo sapiens
agggacgcggctcccggggcag

SEQ ID NO: 6645236 - DNA, 17 bp, Homo sapiens
agggacgctttgtctgt

SEQ ID NO: 6645237 - DNA, 20 bp, Homo sapiens
agggacggctgtgggaccag

SEQ ID NO: 6645238 - DNA, 22 bp, Homo sapiens
agggacgggggtgggaggtagg

SEQ ID NO: 6645239 - DNA, 16 bp, Homo sapiens
agggacgtgataatgc

SEQ ID NO: 6645240 - DNA, 22 bp, Homo sapiens
agggactacccatagacatgaa

SEQ ID NO: 6645241 - DNA, 16 bp, Homo sapiens
agggactacctctgtg

SEQ ID NO: 6645242 - DNA, 18 bp, Homo sapiens
agggactacctctgtgcc

SEQ ID NO: 6645243 - DNA, 17 bp, Homo sapiens
agggactaggagcactg

SEQ ID NO: 6645244 - DNA, 19 bp, Homo sapiens
agggactagtgagtcagca

SEQ ID NO: 6645245 - DNA, 23 bp, Homo sapiens
agggactcaagggaaaggcaagc

SEQ ID NO: 6645246 - DNA, 21 bp, Homo sapiens
agggactcaagggtccagaag

SEQ ID NO: 6645247 - DNA, 19 bp, Homo sapiens
agggactcatctttccctc

SEQ ID NO: 6645248 - DNA, 21 bp, Homo sapiens
agggactcatctttccctcct

SEQ ID NO: 6645249 - DNA, 23 bp, Homo sapiens
agggactcatctttccctccttg

SEQ ID NO: 6645250 - DNA, 17 bp, Homo sapiens
agggactccaagccctg

SEQ ID NO: 6645251 - DNA, 18 bp, Homo sapiens
agggactccaagccctgg

SEQ ID NO: 6645252 - DNA, 19 bp, Homo sapiens
agggactcggcccagggcc

SEQ ID NO: 6645253 - DNA, 22 bp, Homo sapiens
agggactcgggtggcctgcgct

SEQ ID NO: 6645254 - DNA, 12 bp, Homo sapiens
agggactctggg

SEQ ID NO: 6645255 - DNA, 17 bp, Homo sapiens
agggactctgggctgtg

SEQ ID NO: 6645256 - DNA, 19 bp, Homo sapiens
agggactctgggctgtgcc

SEQ ID NO: 6645257 - DNA, 19 bp, Homo sapiens
agggactctgtctggccag

SEQ ID NO: 6645258 - DNA, 21 bp, Homo sapiens
agggactctgtctggccaggg

SEQ ID NO: 6645259 - DNA, 23 bp, Homo sapiens
agggactctgtctggccagggag

SEQ ID NO: 6645260 - DNA, 20 bp, Homo sapiens
agggactgagagatgcagaa

SEQ ID NO: 6645261 - DNA, 17 bp, Homo sapiens
agggactgccaggctgt

SEQ ID NO: 6645262 - DNA, 23 bp, Homo sapiens
agggactgccagtccccctgccc

SEQ ID NO: 6645263 - DNA, 12 bp, Homo sapiens
agggactgctga

SEQ ID NO: 6645264 - DNA, 20 bp, Homo sapiens
agggactgctgacccaccaa

SEQ ID NO: 6645265 - DNA, 14 bp, Homo sapiens
agggactggacagc

SEQ ID NO: 6645266 - DNA, 14 bp, Homo sapiens
agggactggatctg

SEQ ID NO: 6645267 - DNA, 20 bp, Homo sapiens
agggactgtaaacacagaca

SEQ ID NO: 6645268 - DNA, 14 bp, Homo sapiens
agggactgtacctg

SEQ ID NO: 6645269 - DNA, 23 bp, Homo sapiens
agggactgtacctgtaggaaaca

SEQ ID NO: 6645270 - DNA, 14 bp, Homo sapiens
agggactgtatttc

SEQ ID NO: 6645271 - DNA, 22 bp, Homo sapiens
agggactgtcacactggtgctg

SEQ ID NO: 6645272 - DNA, 16 bp, Homo sapiens
agggactgtcagctga

SEQ ID NO: 6645273 - DNA, 22 bp, Homo sapiens
agggactgtcctagccaggtct

SEQ ID NO: 6645274 - DNA, 16 bp, Homo sapiens
agggactgtcgctgct

SEQ ID NO: 6645275 - DNA, 17 bp, Homo sapiens
agggactgtgagactga

SEQ ID NO: 6645276 - DNA, 21 bp, Homo sapiens
agggactgtgagactgagagg

SEQ ID NO: 6645277 - DNA, 13 bp, Homo sapiens
agggacttaaaaa

SEQ ID NO: 6645278 - DNA, 16 bp, Homo sapiens
agggacttccctagaa

SEQ ID NO: 6645279 - DNA, 20 bp, Homo sapiens
agggacttggaagctccgct

SEQ ID NO: 6645280 - DNA, 14 bp, Homo sapiens
agggacttggctgt

SEQ ID NO: 6645281 - DNA, 15 bp, Homo sapiens
agggacttggctgtc

SEQ ID NO: 6645282 - DNA, 16 bp, Homo sapiens
agggacttgtttagag

SEQ ID NO: 6645283 - DNA, 16 bp, Homo sapiens
agggagaaaagagaaa

SEQ ID NO: 6645284 - DNA, 17 bp, Homo sapiens
agggagaaactccaaag

SEQ ID NO: 6645285 - DNA, 12 bp, Homo sapiens
agggagaaagga

SEQ ID NO: 6645286 - DNA, 14 bp, Homo sapiens
agggagaaaggcaa

SEQ ID NO: 6645287 - DNA, 14 bp, Homo sapiens
agggagaaatgcca

SEQ ID NO: 6645288 - DNA, 16 bp, Homo sapiens
agggagaagaaaggtg

SEQ ID NO: 6645289 - DNA, 20 bp, Homo sapiens
agggagaagacactgcagtg

SEQ ID NO: 6645290 - DNA, 15 bp, Homo sapiens
agggagaagagaaaa

SEQ ID NO: 6645291 - DNA, 11 bp, Homo sapiens
agggagaagga

SEQ ID NO: 6645292 - DNA, 16 bp, Homo sapiens
agggagaaggagaggc

SEQ ID NO: 6645293 - DNA, 21 bp, Homo sapiens
agggagaaggagaggctctga

SEQ ID NO: 6645294 - DNA, 12 bp, Homo sapiens
agggagaaggat

SEQ ID NO: 6645295 - DNA, 15 bp, Homo sapiens
agggagaaggatcta

SEQ ID NO: 6645296 - DNA, 16 bp, Homo sapiens
agggagaaggatctag

SEQ ID NO: 6645297 - DNA, 22 bp, Homo sapiens
agggagaaggatctagaatgtg

SEQ ID NO: 6645298 - DNA, 13 bp, Homo sapiens
agggagaagggag

SEQ ID NO: 6645299 - DNA, 19 bp, Homo sapiens
agggagaagggagaacagg

SEQ ID NO: 6645300 - DNA, 15 bp, Homo sapiens
agggagaatcctccc

SEQ ID NO: 6645301 - DNA, 19 bp, Homo sapiens
agggagaatcctcccttcc

SEQ ID NO: 6645302 - DNA, 20 bp, Homo sapiens
agggagaatcctcccttccc

SEQ ID NO: 6645303 - DNA, 21 bp, Homo sapiens
agggagaatcctcccttccca

SEQ ID NO: 6645304 - DNA, 14 bp, Homo sapiens
agggagaattgaga

SEQ ID NO: 6645305 - DNA, 14 bp, Homo sapiens
agggagacaccagt

SEQ ID NO: 6645306 - DNA, 13 bp, Homo sapiens
agggagacagaga

SEQ ID NO: 6645307 - DNA, 14 bp, Homo sapiens
agggagacagagat

SEQ ID NO: 6645308 - DNA, 14 bp, Homo sapiens
agggagacaggcct

SEQ ID NO: 6645309 - DNA, 15 bp, Homo sapiens
agggagacagggtag

SEQ ID NO: 6645310 - DNA, 16 bp, Homo sapiens
agggagacagggtagg

SEQ ID NO: 6645311 - DNA, 17 bp, Homo sapiens
agggagacccaataaag

SEQ ID NO: 6645312 - DNA, 12 bp, Homo sapiens
agggagacccag

SEQ ID NO: 6645313 - DNA, 20 bp, Homo sapiens
agggagacccagggggctga

SEQ ID NO: 6645314 - DNA, 19 bp, Homo sapiens
agggagacccgtccatttg

SEQ ID NO: 6645315 - DNA, 12 bp, Homo sapiens
agggagaccctg

SEQ ID NO: 6645316 - DNA, 14 bp, Homo sapiens
agggagaccctggg

SEQ ID NO: 6645317 - DNA, 19 bp, Homo sapiens
agggagacggccctgctgg

SEQ ID NO: 6645318 - DNA, 14 bp, Homo sapiens
agggagactgaccc

SEQ ID NO: 6645319 - DNA, 15 bp, Homo sapiens
agggagactgaccca

SEQ ID NO: 6645320 - DNA, 21 bp, Homo sapiens
agggagactgggtaggaaaga

SEQ ID NO: 6645321 - DNA, 17 bp, Homo sapiens
agggagagaaaactctt

SEQ ID NO: 6645322 - DNA, 23 bp, Homo sapiens
agggagagacctcatcaggatga

SEQ ID NO: 6645323 - DNA, 18 bp, Homo sapiens
agggagagagaagcaggc

SEQ ID NO: 6645324 - DNA, 13 bp, Homo sapiens
agggagagagtag

SEQ ID NO: 6645325 - DNA, 18 bp, Homo sapiens
agggagagatgagtgggt

SEQ ID NO: 6645326 - DNA, 24 bp, Homo sapiens
agggagagcacctgttgtgtgcct

SEQ ID NO: 6645327 - DNA, 12 bp, Homo sapiens
agggagagccca

SEQ ID NO: 6645328 - DNA, 13 bp, Homo sapiens
agggagagcccag

SEQ ID NO: 6645329 - DNA, 18 bp, Homo sapiens
agggagagcccaggagct

SEQ ID NO: 6645330 - DNA, 13 bp, Homo sapiens
agggagagccctg

SEQ ID NO: 6645331 - DNA, 17 bp, Homo sapiens
agggagagcgcctcttc

SEQ ID NO: 6645332 - DNA, 15 bp, Homo sapiens
agggagagctgagcc

SEQ ID NO: 6645333 - DNA, 13 bp, Homo sapiens
agggagaggagtg

SEQ ID NO: 6645334 - DNA, 21 bp, Homo sapiens
agggagaggctgtgtccctgc

SEQ ID NO: 6645335 - DNA, 14 bp, Homo sapiens
agggagagggaggt

SEQ ID NO: 6645336 - DNA, 21 bp, Homo sapiens
agggagagggcctctgcctgg

SEQ ID NO: 6645337 - DNA, 15 bp, Homo sapiens
agggagaggggaagg

SEQ ID NO: 6645338 - DNA, 17 bp, Homo sapiens
agggagaggggaagggc

SEQ ID NO: 6645339 - DNA, 16 bp, Homo sapiens
agggagagggggctgg

SEQ ID NO: 6645340 - DNA, 18 bp, Homo sapiens
agggagaggtcaccagct

SEQ ID NO: 6645341 - DNA, 20 bp, Homo sapiens
agggagaggtggcaggaata

SEQ ID NO: 6645342 - DNA, 13 bp, Homo sapiens
agggagataaaag

SEQ ID NO: 6645343 - DNA, 20 bp, Homo sapiens
agggagatgagttgcagttt

SEQ ID NO: 6645344 - DNA, 19 bp, Homo sapiens
agggagatgttggactgtg

SEQ ID NO: 6645345 - DNA, 18 bp, Homo sapiens
agggagcaagccctactc

SEQ ID NO: 6645346 - DNA, 21 bp, Homo sapiens
agggagcacaacccccagctc

SEQ ID NO: 6645347 - DNA, 22 bp, Homo sapiens
agggagcacaacccccagctcc

SEQ ID NO: 6645348 - DNA, 15 bp, Homo sapiens
agggagcactggagg

SEQ ID NO: 6645349 - DNA, 20 bp, Homo sapiens
agggagcactggaggcctct

SEQ ID NO: 6645350 - DNA, 21 bp, Homo sapiens
agggagcactggaggcctctg

SEQ ID NO: 6645351 - DNA, 13 bp, Homo sapiens
agggagcactggg

SEQ ID NO: 6645352 - DNA, 14 bp, Homo sapiens
agggagcagacagg

SEQ ID NO: 6645353 - DNA, 13 bp, Homo sapiens
agggagcagcacg

SEQ ID NO: 6645354 - DNA, 19 bp, Homo sapiens
agggagcagggaaggcctg

SEQ ID NO: 6645355 - DNA, 14 bp, Homo sapiens
agggagcaggtgcc

SEQ ID NO: 6645356 - DNA, 17 bp, Homo sapiens
agggagcaggtgccccc

SEQ ID NO: 6645357 - DNA, 21 bp, Homo sapiens
agggagcaggtgcccccaggt

SEQ ID NO: 6645358 - DNA, 20 bp, Homo sapiens
agggagcatagaaggcaggt

SEQ ID NO: 6645359 - DNA, 18 bp, Homo sapiens
agggagcatcagtgccct

SEQ ID NO: 6645360 - DNA, 17 bp, Homo sapiens
agggagcatgagaggag

SEQ ID NO: 6645361 - DNA, 14 bp, Homo sapiens
agggagcattgcag

SEQ ID NO: 6645362 - DNA, 17 bp, Homo sapiens
agggagcattgcagcct

SEQ ID NO: 6645363 - DNA, 15 bp, Homo sapiens
agggagcattttcct

SEQ ID NO: 6645364 - DNA, 11 bp, Homo sapiens
agggagccaag

SEQ ID NO: 6645365 - DNA, 13 bp, Homo sapiens
agggagccaaggg

SEQ ID NO: 6645366 - DNA, 15 bp, Homo sapiens
agggagccaagggat

SEQ ID NO: 6645367 - DNA, 20 bp, Homo sapiens
agggagccaagggatggaca

SEQ ID NO: 6645368 - DNA, 21 bp, Homo sapiens
agggagccaagggatggacat

SEQ ID NO: 6645369 - DNA, 18 bp, Homo sapiens
agggagccatggaaggtg

SEQ ID NO: 6645370 - DNA, 16 bp, Homo sapiens
agggagccatgtttca

SEQ ID NO: 6645371 - DNA, 15 bp, Homo sapiens
agggagccatttgag

SEQ ID NO: 6645372 - DNA, 17 bp, Homo sapiens
agggagcccctcctctg

SEQ ID NO: 6645373 - DNA, 21 bp, Homo sapiens
agggagccctgagcctggcag

SEQ ID NO: 6645374 - DNA, 22 bp, Homo sapiens
agggagccctgagcctggcagg

SEQ ID NO: 6645375 - DNA, 18 bp, Homo sapiens
agggagccctgggccagg

SEQ ID NO: 6645376 - DNA, 20 bp, Homo sapiens
agggagccggcggcctctcg

SEQ ID NO: 6645377 - DNA, 20 bp, Homo sapiens
agggagcctagaagctggtg

SEQ ID NO: 6645378 - DNA, 23 bp, Homo sapiens
agggagcctccccatctgtccag

SEQ ID NO: 6645379 - DNA, 18 bp, Homo sapiens
agggagcctttggttctg

SEQ ID NO: 6645380 - DNA, 16 bp, Homo sapiens
agggagcgagggagaa

SEQ ID NO: 6645381 - DNA, 19 bp, Homo sapiens
agggagcgcggcagccctg

SEQ ID NO: 6645382 - DNA, 14 bp, Homo sapiens
agggagcggaaagc

SEQ ID NO: 6645383 - DNA, 22 bp, Homo sapiens
agggagcggccggccagcccct

SEQ ID NO: 6645384 - DNA, 13 bp, Homo sapiens
agggagctaagga

SEQ ID NO: 6645385 - DNA, 23 bp, Homo sapiens
agggagctctggggacagcttcc

SEQ ID NO: 6645386 - DNA, 16 bp, Homo sapiens
agggagctgaggcctc

SEQ ID NO: 6645387 - DNA, 14 bp, Homo sapiens
agggagctgctcag

SEQ ID NO: 6645388 - DNA, 15 bp, Homo sapiens
agggagctgctcaga

SEQ ID NO: 6645389 - DNA, 16 bp, Homo sapiens
agggagctgctggctg

SEQ ID NO: 6645390 - DNA, 15 bp, Homo sapiens
agggagctggcaatg

SEQ ID NO: 6645391 - DNA, 20 bp, Homo sapiens
agggagctggctccagcctg

SEQ ID NO: 6645392 - DNA, 22 bp, Homo sapiens
agggagctggctccagcctgga

SEQ ID NO: 6645393 - DNA, 13 bp, Homo sapiens
agggagctgggac

SEQ ID NO: 6645394 - DNA, 19 bp, Homo sapiens
agggagcttcctggctctg

SEQ ID NO: 6645395 - DNA, 22 bp, Homo sapiens
agggagcttcctggctctgggg

SEQ ID NO: 6645396 - DNA, 11 bp, Homo sapiens
agggaggaaga

SEQ ID NO: 6645397 - DNA, 21 bp, Homo sapiens
agggaggaagaagcttaggca

SEQ ID NO: 6645398 - DNA, 12 bp, Homo sapiens
agggaggaagat

SEQ ID NO: 6645399 - DNA, 14 bp, Homo sapiens
agggaggaaggagg

SEQ ID NO: 6645400 - DNA, 15 bp, Homo sapiens
agggaggaaggaggc

SEQ ID NO: 6645401 - DNA, 22 bp, Homo sapiens
agggaggaaggcctttcttctg

SEQ ID NO: 6645402 - DNA, 21 bp, Homo sapiens
agggaggaatcgaggaaccag

SEQ ID NO: 6645403 - DNA, 23 bp, Homo sapiens
agggaggaatcgaggaaccagag

SEQ ID NO: 6645404 - DNA, 20 bp, Homo sapiens
agggaggaatgtgtgccttg

SEQ ID NO: 6645405 - DNA, 22 bp, Homo sapiens
agggaggaccaaagggatggta

SEQ ID NO: 6645406 - DNA, 22 bp, Homo sapiens
agggaggacccacactgctaca

SEQ ID NO: 6645407 - DNA, 21 bp, Homo sapiens
agggaggagcaacggccccag

SEQ ID NO: 6645408 - DNA, 23 bp, Homo sapiens
agggaggagcaacggccccagcg

SEQ ID NO: 6645409 - DNA, 15 bp, Homo sapiens
agggaggagccccag

SEQ ID NO: 6645410 - DNA, 20 bp, Homo sapiens
agggaggaggcagagaagaa

SEQ ID NO: 6645411 - DNA, 15 bp, Homo sapiens
agggaggaggccacc

SEQ ID NO: 6645412 - DNA, 17 bp, Homo sapiens
agggaggaggccacctc

SEQ ID NO: 6645413 - DNA, 16 bp, Homo sapiens
agggaggagtggaggt

SEQ ID NO: 6645414 - DNA, 18 bp, Homo sapiens
agggaggatgccacagcc

SEQ ID NO: 6645415 - DNA, 20 bp, Homo sapiens
agggaggcacttcctcccct

SEQ ID NO: 6645416 - DNA, 16 bp, Homo sapiens
agggaggcagcctagc

SEQ ID NO: 6645417 - DNA, 15 bp, Homo sapiens
agggaggcagcctcc

SEQ ID NO: 6645418 - DNA, 13 bp, Homo sapiens
agggaggcagggg

SEQ ID NO: 6645419 - DNA, 20 bp, Homo sapiens
agggaggccacgtcccaccc

SEQ ID NO: 6645420 - DNA, 17 bp, Homo sapiens
agggaggccatctgggg

SEQ ID NO: 6645421 - DNA, 16 bp, Homo sapiens
agggaggccccagggg

SEQ ID NO: 6645422 - DNA, 15 bp, Homo sapiens
agggaggcctgaggg

SEQ ID NO: 6645423 - DNA, 16 bp, Homo sapiens
agggaggcctgagggg

SEQ ID NO: 6645424 - DNA, 14 bp, Homo sapiens
agggaggcgcaggg

SEQ ID NO: 6645425 - DNA, 18 bp, Homo sapiens
agggaggcgcagggacat

SEQ ID NO: 6645426 - DNA, 14 bp, Homo sapiens
agggaggcggcctc

SEQ ID NO: 6645427 - DNA, 15 bp, Homo sapiens
agggaggcggggagg

SEQ ID NO: 6645428 - DNA, 20 bp, Homo sapiens
agggaggcgtcttcatctcc

SEQ ID NO: 6645429 - DNA, 23 bp, Homo sapiens
agggaggcgtcttcatctccctg

SEQ ID NO: 6645430 - DNA, 18 bp, Homo sapiens
agggaggctctgtgtgtt

SEQ ID NO: 6645431 - DNA, 22 bp, Homo sapiens
agggaggctctgtgtgttaaaa

SEQ ID NO: 6645432 - DNA, 17 bp, Homo sapiens
agggaggctgaggcagg

SEQ ID NO: 6645433 - DNA, 22 bp, Homo sapiens
agggaggctgctgctgctcttg

SEQ ID NO: 6645434 - DNA, 15 bp, Homo sapiens
agggaggctggtcct

SEQ ID NO: 6645435 - DNA, 19 bp, Homo sapiens
agggagggaaacccgggga

SEQ ID NO: 6645436 - DNA, 15 bp, Homo sapiens
agggagggaagggga

SEQ ID NO: 6645437 - DNA, 13 bp, Homo sapiens
agggagggaagtc

SEQ ID NO: 6645438 - DNA, 23 bp, Homo sapiens
agggagggaagtgtgagcgcctt

SEQ ID NO: 6645439 - DNA, 12 bp, Homo sapiens
agggagggagcc

SEQ ID NO: 6645440 - DNA, 13 bp, Homo sapiens
agggagggagcca

SEQ ID NO: 6645441 - DNA, 15 bp, Homo sapiens
agggagggagccatg

SEQ ID NO: 6645442 - DNA, 22 bp, Homo sapiens
agggagggagccatggaaggtg

SEQ ID NO: 6645443 - DNA, 12 bp, Homo sapiens
agggagggagtt

SEQ ID NO: 6645444 - DNA, 17 bp, Homo sapiens
agggagggatgaccttc

SEQ ID NO: 6645445 - DNA, 16 bp, Homo sapiens
agggagggcagagctg

SEQ ID NO: 6645446 - DNA, 21 bp, Homo sapiens
agggagggcagagctggtgcg

SEQ ID NO: 6645447 - DNA, 23 bp, Homo sapiens
agggagggcagctggcccccagc

SEQ ID NO: 6645448 - DNA, 17 bp, Homo sapiens
agggagggccagggagg

SEQ ID NO: 6645449 - DNA, 22 bp, Homo sapiens
agggagggccggcggctctgag

SEQ ID NO: 6645450 - DNA, 23 bp, Homo sapiens
agggagggccggcggctctgagc

SEQ ID NO: 6645451 - DNA, 12 bp, Homo sapiens
agggagggctct

SEQ ID NO: 6645452 - DNA, 20 bp, Homo sapiens
agggagggctctgaggcgcc

SEQ ID NO: 6645453 - DNA, 16 bp, Homo sapiens
agggaggggaaatgta

SEQ ID NO: 6645454 - DNA, 13 bp, Homo sapiens
agggaggggaagg

SEQ ID NO: 6645455 - DNA, 17 bp, Homo sapiens
agggaggggacagaggc

SEQ ID NO: 6645456 - DNA, 13 bp, Homo sapiens
agggaggggaggc

SEQ ID NO: 6645457 - DNA, 16 bp, Homo sapiens
agggaggggccctgtc

SEQ ID NO: 6645458 - DNA, 18 bp, Homo sapiens
agggaggggccggccctg

SEQ ID NO: 6645459 - DNA, 23 bp, Homo sapiens
agggaggggccggccctgtgtgc

SEQ ID NO: 6645460 - DNA, 22 bp, Homo sapiens
agggaggggccggctggcctgg

SEQ ID NO: 6645461 - DNA, 20 bp, Homo sapiens
agggaggggcctaggcctca

SEQ ID NO: 6645462 - DNA, 15 bp, Homo sapiens
agggaggggctgagt

SEQ ID NO: 6645463 - DNA, 13 bp, Homo sapiens
agggaggggctgt

SEQ ID NO: 6645464 - DNA, 16 bp, Homo sapiens
agggagggggaagtcg

SEQ ID NO: 6645465 - DNA, 12 bp, Homo sapiens
agggagggggag

SEQ ID NO: 6645466 - DNA, 24 bp, Homo sapiens
agggagggggcgctcaggacccag

SEQ ID NO: 6645467 - DNA, 14 bp, Homo sapiens
agggagggggctgg

SEQ ID NO: 6645468 - DNA, 15 bp, Homo sapiens
agggaggggtcctga

SEQ ID NO: 6645469 - DNA, 16 bp, Homo sapiens
agggaggggtggtatt

SEQ ID NO: 6645470 - DNA, 12 bp, Homo sapiens
agggagggtgag

SEQ ID NO: 6645471 - DNA, 11 bp, Homo sapiens
agggagggtgg

SEQ ID NO: 6645472 - DNA, 17 bp, Homo sapiens
agggagggtggcagaga

SEQ ID NO: 6645473 - DNA, 18 bp, Homo sapiens
agggagggttagcctgca

SEQ ID NO: 6645474 - DNA, 20 bp, Homo sapiens
agggagggttagcctgcacc

SEQ ID NO: 6645475 - DNA, 19 bp, Homo sapiens
agggaggtaacgggtgcct

SEQ ID NO: 6645476 - DNA, 21 bp, Homo sapiens
agggaggtcactggaaagggg

SEQ ID NO: 6645477 - DNA, 17 bp, Homo sapiens
agggaggtcaggccctg

SEQ ID NO: 6645478 - DNA, 18 bp, Homo sapiens
agggaggtcaggccctgg

SEQ ID NO: 6645479 - DNA, 18 bp, Homo sapiens
agggaggtggcagggaag

SEQ ID NO: 6645480 - DNA, 19 bp, Homo sapiens
agggaggtgtgaggcagga

SEQ ID NO: 6645481 - DNA, 20 bp, Homo sapiens
agggaggtgtttaaagagag

SEQ ID NO: 6645482 - DNA, 17 bp, Homo sapiens
agggaggtttgtgagag

SEQ ID NO: 6645483 - DNA, 20 bp, Homo sapiens
agggagtaagtagaggtggc

SEQ ID NO: 6645484 - DNA, 15 bp, Homo sapiens
agggagtagaaagct

SEQ ID NO: 6645485 - DNA, 15 bp, Homo sapiens
agggagtattctaat

SEQ ID NO: 6645486 - DNA, 12 bp, Homo sapiens
agggagtccagg

SEQ ID NO: 6645487 - DNA, 13 bp, Homo sapiens
agggagtccaggg

SEQ ID NO: 6645488 - DNA, 14 bp, Homo sapiens
agggagtcccctcc

SEQ ID NO: 6645489 - DNA, 16 bp, Homo sapiens
agggagtcccctcccc

SEQ ID NO: 6645490 - DNA, 14 bp, Homo sapiens
agggagtctgccag

SEQ ID NO: 6645491 - DNA, 18 bp, Homo sapiens
agggagtctgccagggcc

SEQ ID NO: 6645492 - DNA, 17 bp, Homo sapiens
agggagtgaagccacag

SEQ ID NO: 6645493 - DNA, 13 bp, Homo sapiens
agggagtgagcag

SEQ ID NO: 6645494 - DNA, 15 bp, Homo sapiens
agggagtgcagaaca

SEQ ID NO: 6645495 - DNA, 19 bp, Homo sapiens
agggagtgcagaacacctg

SEQ ID NO: 6645496 - DNA, 17 bp, Homo sapiens
agggagtgctggctcac

SEQ ID NO: 6645497 - DNA, 20 bp, Homo sapiens
agggagtgctggctcacagt

SEQ ID NO: 6645498 - DNA, 18 bp, Homo sapiens
agggagtggttcctgtgg

SEQ ID NO: 6645499 - DNA, 17 bp, Homo sapiens
agggagtgttccctatc

SEQ ID NO: 6645500 - DNA, 23 bp, Homo sapiens
agggagtgtttgtgtctgactca

SEQ ID NO: 6645501 - DNA, 16 bp, Homo sapiens
agggagttagggagag

SEQ ID NO: 6645502 - DNA, 17 bp, Homo sapiens
agggagttagggagaga

SEQ ID NO: 6645503 - DNA, 21 bp, Homo sapiens
agggagttatctaaaagaaat

SEQ ID NO: 6645504 - DNA, 19 bp, Homo sapiens
agggagttgctcactcagg

SEQ ID NO: 6645505 - DNA, 16 bp, Homo sapiens
agggagttggctggat

SEQ ID NO: 6645506 - DNA, 19 bp, Homo sapiens
agggagttttgtctgtctc

SEQ ID NO: 6645507 - DNA, 21 bp, Homo sapiens
agggataaagaaaaaaatact

SEQ ID NO: 6645508 - DNA, 23 bp, Homo sapiens
agggataaagaaaaaaatactat

SEQ ID NO: 6645509 - DNA, 15 bp, Homo sapiens
agggataaggcagtt

SEQ ID NO: 6645510 - DNA, 15 bp, Homo sapiens
agggataaggtacct

SEQ ID NO: 6645511 - DNA, 16 bp, Homo sapiens
agggatacccagtgat

SEQ ID NO: 6645512 - DNA, 21 bp, Homo sapiens
agggatagtcaccttttaaat

SEQ ID NO: 6645513 - DNA, 15 bp, Homo sapiens
agggatataaaaaca

SEQ ID NO: 6645514 - DNA, 16 bp, Homo sapiens
agggatataaaaacag

SEQ ID NO: 6645515 - DNA, 13 bp, Homo sapiens
agggatataaaat

SEQ ID NO: 6645516 - DNA, 22 bp, Homo sapiens
agggatatggcaggactcctgg

SEQ ID NO: 6645517 - DNA, 14 bp, Homo sapiens
agggatattgcctt

SEQ ID NO: 6645518 - DNA, 15 bp, Homo sapiens
agggatattgcctta

SEQ ID NO: 6645519 - DNA, 14 bp, Homo sapiens
agggatcacagggc

SEQ ID NO: 6645520 - DNA, 15 bp, Homo sapiens
agggatcacagggcc

SEQ ID NO: 6645521 - DNA, 22 bp, Homo sapiens
agggatcagccccgcctgtcac

SEQ ID NO: 6645522 - DNA, 23 bp, Homo sapiens
agggatcagccccgcctgtcaca

SEQ ID NO: 6645523 - DNA, 19 bp, Homo sapiens
agggatcatcatgcagctc

SEQ ID NO: 6645524 - DNA, 15 bp, Homo sapiens
agggatccagagacc

SEQ ID NO: 6645525 - DNA, 22 bp, Homo sapiens
agggatccagagacctgctcca

SEQ ID NO: 6645526 - DNA, 19 bp, Homo sapiens
agggatccctcatctgtcc

SEQ ID NO: 6645527 - DNA, 22 bp, Homo sapiens
agggatcctaatcccttcctct

SEQ ID NO: 6645528 - DNA, 19 bp, Homo sapiens
agggatctatacttgcttt

SEQ ID NO: 6645529 - DNA, 16 bp, Homo sapiens
agggatctctctacaa

SEQ ID NO: 6645530 - DNA, 20 bp, Homo sapiens
agggatctctctacaagagc

SEQ ID NO: 6645531 - DNA, 20 bp, Homo sapiens
agggatctgccattgggacc

SEQ ID NO: 6645532 - DNA, 15 bp, Homo sapiens
agggatgaacttttt

SEQ ID NO: 6645533 - DNA, 15 bp, Homo sapiens
agggatgactaaaat

SEQ ID NO: 6645534 - DNA, 21 bp, Homo sapiens
agggatgagcatggagctggc

SEQ ID NO: 6645535 - DNA, 17 bp, Homo sapiens
agggatgaggtgctggg

SEQ ID NO: 6645536 - DNA, 19 bp, Homo sapiens
agggatgaggtgctgggag

SEQ ID NO: 6645537 - DNA, 20 bp, Homo sapiens
agggatgatgagggaagcaa

SEQ ID NO: 6645538 - DNA, 19 bp, Homo sapiens
agggatgatggcagagcca

SEQ ID NO: 6645539 - DNA, 20 bp, Homo sapiens
agggatgatggcagagccag

SEQ ID NO: 6645540 - DNA, 20 bp, Homo sapiens
agggatgcaggctcccctga

SEQ ID NO: 6645541 - DNA, 16 bp, Homo sapiens
agggatgccacccagc

SEQ ID NO: 6645542 - DNA, 14 bp, Homo sapiens
agggatgcccccag

SEQ ID NO: 6645543 - DNA, 19 bp, Homo sapiens
agggatgcccccaggcagc

SEQ ID NO: 6645544 - DNA, 15 bp, Homo sapiens
agggatgccctggag

SEQ ID NO: 6645545 - DNA, 18 bp, Homo sapiens
agggatgcggatcctgct

SEQ ID NO: 6645546 - DNA, 19 bp, Homo sapiens
agggatgctgcctgagtca

SEQ ID NO: 6645547 - DNA, 18 bp, Homo sapiens
agggatgctgctccgccc

SEQ ID NO: 6645548 - DNA, 11 bp, Homo sapiens
agggatgctgg

SEQ ID NO: 6645549 - DNA, 14 bp, Homo sapiens
agggatgctgggct

SEQ ID NO: 6645550 - DNA, 22 bp, Homo sapiens
agggatggaaaaggaagactag

SEQ ID NO: 6645551 - DNA, 16 bp, Homo sapiens
agggatggacatcttg

SEQ ID NO: 6645552 - DNA, 18 bp, Homo sapiens
agggatggactgatgctt

SEQ ID NO: 6645553 - DNA, 20 bp, Homo sapiens
agggatggacttgtgattgg

SEQ ID NO: 6645554 - DNA, 23 bp, Homo sapiens
agggatggacttgtgattggctg

SEQ ID NO: 6645555 - DNA, 15 bp, Homo sapiens
agggatggagaaaga

SEQ ID NO: 6645556 - DNA, 16 bp, Homo sapiens
agggatggagaaagaa

SEQ ID NO: 6645557 - DNA, 18 bp, Homo sapiens
agggatggagaggcggcc

SEQ ID NO: 6645558 - DNA, 13 bp, Homo sapiens
agggatggcacca

SEQ ID NO: 6645559 - DNA, 15 bp, Homo sapiens
agggatggcaccact

SEQ ID NO: 6645560 - DNA, 19 bp, Homo sapiens
agggatggcaccacttatt

SEQ ID NO: 6645561 - DNA, 14 bp, Homo sapiens
agggatgggcagcc

SEQ ID NO: 6645562 - DNA, 19 bp, Homo sapiens
agggatggggaaaactaca

SEQ ID NO: 6645563 - DNA, 20 bp, Homo sapiens
agggatggggaaaactacaa

SEQ ID NO: 6645564 - DNA, 17 bp, Homo sapiens
agggatggggccacagc

SEQ ID NO: 6645565 - DNA, 12 bp, Homo sapiens
agggatggggga

SEQ ID NO: 6645566 - DNA, 16 bp, Homo sapiens
agggatgggggaagat

SEQ ID NO: 6645567 - DNA, 20 bp, Homo sapiens
agggatgggggatgggccag

SEQ ID NO: 6645568 - DNA, 18 bp, Homo sapiens
agggatggtaagttgaga

SEQ ID NO: 6645569 - DNA, 13 bp, Homo sapiens
agggatggtcagg

SEQ ID NO: 6645570 - DNA, 17 bp, Homo sapiens
agggatggtcaggccca

SEQ ID NO: 6645571 - DNA, 18 bp, Homo sapiens
agggatggtcaggcccag

SEQ ID NO: 6645572 - DNA, 17 bp, Homo sapiens
agggatgtctgttgaaa

SEQ ID NO: 6645573 - DNA, 20 bp, Homo sapiens
agggatgtgggtaagaggag

SEQ ID NO: 6645574 - DNA, 21 bp, Homo sapiens
agggatgtgggtaagaggagc

SEQ ID NO: 6645575 - DNA, 13 bp, Homo sapiens
agggatgtgggtt

SEQ ID NO: 6645576 - DNA, 21 bp, Homo sapiens
agggatgtgggttccacagac

SEQ ID NO: 6645577 - DNA, 15 bp, Homo sapiens
agggatgttgcaaag

SEQ ID NO: 6645578 - DNA, 17 bp, Homo sapiens
agggatgtttggaaaaa

SEQ ID NO: 6645579 - DNA, 17 bp, Homo sapiens
agggattaacctctgca

SEQ ID NO: 6645580 - DNA, 20 bp, Homo sapiens
agggattagggagagaagat

SEQ ID NO: 6645581 - DNA, 18 bp, Homo sapiens
agggattcagccctccct

SEQ ID NO: 6645582 - DNA, 18 bp, Homo sapiens
agggattcaggctgcttg

SEQ ID NO: 6645583 - DNA, 17 bp, Homo sapiens
agggattctcacaatag

SEQ ID NO: 6645584 - DNA, 23 bp, Homo sapiens
agggattctgggcttggggtgtg

SEQ ID NO: 6645585 - DNA, 21 bp, Homo sapiens
agggattctggtcttcactgc

SEQ ID NO: 6645586 - DNA, 19 bp, Homo sapiens
agggattgaagtttattat

SEQ ID NO: 6645587 - DNA, 22 bp, Homo sapiens
agggattgaggagttgcctgac

SEQ ID NO: 6645588 - DNA, 20 bp, Homo sapiens
agggattggaccgagctgga

SEQ ID NO: 6645589 - DNA, 17 bp, Homo sapiens
agggattgtttctgttt

SEQ ID NO: 6645590 - DNA, 14 bp, Homo sapiens
agggatttccctgc

SEQ ID NO: 6645591 - DNA, 16 bp, Homo sapiens
agggatttccctgcag

SEQ ID NO: 6645592 - DNA, 14 bp, Homo sapiens
agggatttcttagg

SEQ ID NO: 6645593 - DNA, 13 bp, Homo sapiens
agggatttctttg

SEQ ID NO: 6645594 - DNA, 16 bp, Homo sapiens
agggatttgcctcacc

SEQ ID NO: 6645595 - DNA, 17 bp, Homo sapiens
agggatttgcctcacct

SEQ ID NO: 6645596 - DNA, 22 bp, Homo sapiens
agggatttggggctcagagtgg

SEQ ID NO: 6645597 - DNA, 19 bp, Homo sapiens
agggattttagcctcttcc

SEQ ID NO: 6645598 - DNA, 22 bp, Homo sapiens
agggattttcagccctcagaat

SEQ ID NO: 6645599 - DNA, 20 bp, Homo sapiens
agggcaaaagggcagctgtg

SEQ ID NO: 6645600 - DNA, 20 bp, Homo sapiens
agggcaaaatcgccataggc

SEQ ID NO: 6645601 - DNA, 13 bp, Homo sapiens
agggcaaaatgaa

SEQ ID NO: 6645602 - DNA, 16 bp, Homo sapiens
agggcaaaccaggctg

SEQ ID NO: 6645603 - DNA, 19 bp, Homo sapiens
agggcaaaccaggctgcag

SEQ ID NO: 6645604 - DNA, 21 bp, Homo sapiens
agggcaaaccaggctgcaggt

SEQ ID NO: 6645605 - DNA, 16 bp, Homo sapiens
agggcaaacccaaaac

SEQ ID NO: 6645606 - DNA, 18 bp, Homo sapiens
agggcaaagatctcagca

SEQ ID NO: 6645607 - DNA, 20 bp, Homo sapiens
agggcaaagccaggtccctc

SEQ ID NO: 6645608 - DNA, 21 bp, Homo sapiens
agggcaaatgacatgcactga

SEQ ID NO: 6645609 - DNA, 13 bp, Homo sapiens
agggcaaatggaa

SEQ ID NO: 6645610 - DNA, 15 bp, Homo sapiens
agggcaaatggaaaa

SEQ ID NO: 6645611 - DNA, 17 bp, Homo sapiens
agggcaaattattttaa

SEQ ID NO: 6645612 - DNA, 17 bp, Homo sapiens
agggcaaattggagaaa

SEQ ID NO: 6645613 - DNA, 18 bp, Homo sapiens
agggcaacagatcagtaa

SEQ ID NO: 6645614 - DNA, 21 bp, Homo sapiens
agggcaacataataagacttt

SEQ ID NO: 6645615 - DNA, 23 bp, Homo sapiens
agggcaacctgacagcaaacaca

SEQ ID NO: 6645616 - DNA, 20 bp, Homo sapiens
agggcaactcttggaagaaa

SEQ ID NO: 6645617 - DNA, 14 bp, Homo sapiens
agggcaagaaatgg

SEQ ID NO: 6645618 - DNA, 15 bp, Homo sapiens
agggcaagaggatga

SEQ ID NO: 6645619 - DNA, 16 bp, Homo sapiens
agggcaagaggtgcct

SEQ ID NO: 6645620 - DNA, 13 bp, Homo sapiens
agggcaagcctct

SEQ ID NO: 6645621 - DNA, 21 bp, Homo sapiens
agggcaagggaggggtggtat

SEQ ID NO: 6645622 - DNA, 14 bp, Homo sapiens
agggcaagggccat

SEQ ID NO: 6645623 - DNA, 17 bp, Homo sapiens
agggcaaggggtgagga

SEQ ID NO: 6645624 - DNA, 17 bp, Homo sapiens
agggcaaggggtttcca

SEQ ID NO: 6645625 - DNA, 23 bp, Homo sapiens
agggcaagggtgcctcaggacct

SEQ ID NO: 6645626 - DNA, 20 bp, Homo sapiens
agggcaagggttaaggcctg

SEQ ID NO: 6645627 - DNA, 12 bp, Homo sapiens
agggcaagtctt

SEQ ID NO: 6645628 - DNA, 22 bp, Homo sapiens
agggcaataaatgccctctctg

SEQ ID NO: 6645629 - DNA, 20 bp, Homo sapiens
agggcaatcttgtccacagt

SEQ ID NO: 6645630 - DNA, 14 bp, Homo sapiens
agggcaatggacaa

SEQ ID NO: 6645631 - DNA, 17 bp, Homo sapiens
agggcaattggaacaaa

SEQ ID NO: 6645632 - DNA, 16 bp, Homo sapiens
agggcacaaagatgga

SEQ ID NO: 6645633 - DNA, 20 bp, Homo sapiens
agggcacaagtcctggatgt

SEQ ID NO: 6645634 - DNA, 17 bp, Homo sapiens
agggcacaatggctgga

SEQ ID NO: 6645635 - DNA, 22 bp, Homo sapiens
agggcacacccctggggctgag

SEQ ID NO: 6645636 - DNA, 14 bp, Homo sapiens
agggcacagatgac

SEQ ID NO: 6645637 - DNA, 19 bp, Homo sapiens
agggcacagcaggggagcc

SEQ ID NO: 6645638 - DNA, 16 bp, Homo sapiens
agggcacagccctccg

SEQ ID NO: 6645639 - DNA, 18 bp, Homo sapiens
agggcacagccctccgac

SEQ ID NO: 6645640 - DNA, 15 bp, Homo sapiens
agggcacaggagcta

SEQ ID NO: 6645641 - DNA, 19 bp, Homo sapiens
agggcacaggagctacctg

SEQ ID NO: 6645642 - DNA, 22 bp, Homo sapiens
agggcacaggagctacctgtgt

SEQ ID NO: 6645643 - DNA, 13 bp, Homo sapiens
agggcacagggcc

SEQ ID NO: 6645644 - DNA, 22 bp, Homo sapiens
agggcacattaactccctccac

SEQ ID NO: 6645645 - DNA, 19 bp, Homo sapiens
agggcacattccttgcctg

SEQ ID NO: 6645646 - DNA, 14 bp, Homo sapiens
agggcacattgccc

SEQ ID NO: 6645647 - DNA, 13 bp, Homo sapiens
agggcaccagagg

SEQ ID NO: 6645648 - DNA, 17 bp, Homo sapiens
agggcaccagaggccga

SEQ ID NO: 6645649 - DNA, 14 bp, Homo sapiens
agggcaccagggac

SEQ ID NO: 6645650 - DNA, 14 bp, Homo sapiens
agggcaccaggggt

SEQ ID NO: 6645651 - DNA, 18 bp, Homo sapiens
agggcaccatccagctcc

SEQ ID NO: 6645652 - DNA, 23 bp, Homo sapiens
agggcaccccttgtttctgttgt

SEQ ID NO: 6645653 - DNA, 21 bp, Homo sapiens
agggcaccctgtggccctggc

SEQ ID NO: 6645654 - DNA, 19 bp, Homo sapiens
agggcacctcttgtgctga

SEQ ID NO: 6645655 - DNA, 15 bp, Homo sapiens
agggcacggggacct

SEQ ID NO: 6645656 - DNA, 13 bp, Homo sapiens
agggcactaaact

SEQ ID NO: 6645657 - DNA, 17 bp, Homo sapiens
agggcactaaccccatt

SEQ ID NO: 6645658 - DNA, 13 bp, Homo sapiens
agggcactcagaa

SEQ ID NO: 6645659 - DNA, 15 bp, Homo sapiens
agggcactctctgcc

SEQ ID NO: 6645660 - DNA, 16 bp, Homo sapiens
agggcactctctgcca

SEQ ID NO: 6645661 - DNA, 14 bp, Homo sapiens
agggcactctgttc

SEQ ID NO: 6645662 - DNA, 18 bp, Homo sapiens
agggcactgacggactca

SEQ ID NO: 6645663 - DNA, 16 bp, Homo sapiens
agggcactgctgctgc

SEQ ID NO: 6645664 - DNA, 18 bp, Homo sapiens
agggcactggagctggga

SEQ ID NO: 6645665 - DNA, 16 bp, Homo sapiens
agggcactggtggccc

SEQ ID NO: 6645666 - DNA, 17 bp, Homo sapiens
agggcactggtggcccg

SEQ ID NO: 6645667 - DNA, 16 bp, Homo sapiens
agggcacttcacagag

SEQ ID NO: 6645668 - DNA, 23 bp, Homo sapiens
agggcacttcacagagtgtgctg

SEQ ID NO: 6645669 - DNA, 17 bp, Homo sapiens
agggcacttcctccaca

SEQ ID NO: 6645670 - DNA, 18 bp, Homo sapiens
agggcacttcctccacag

SEQ ID NO: 6645671 - DNA, 16 bp, Homo sapiens
agggcacttggccagt

SEQ ID NO: 6645672 - DNA, 23 bp, Homo sapiens
agggcagaaccaagaacataaac

SEQ ID NO: 6645673 - DNA, 22 bp, Homo sapiens
agggcagaagagaaaccatcct

SEQ ID NO: 6645674 - DNA, 21 bp, Homo sapiens
agggcagacatgccttggtgc

SEQ ID NO: 6645675 - DNA, 20 bp, Homo sapiens
agggcagaccacattgcttt

SEQ ID NO: 6645676 - DNA, 15 bp, Homo sapiens
agggcagactggggc

SEQ ID NO: 6645677 - DNA, 19 bp, Homo sapiens
agggcagagaatggctggg

SEQ ID NO: 6645678 - DNA, 13 bp, Homo sapiens
agggcagagccat

SEQ ID NO: 6645679 - DNA, 15 bp, Homo sapiens
agggcagagccatgg

SEQ ID NO: 6645680 - DNA, 18 bp, Homo sapiens
agggcagagccatgggcc

SEQ ID NO: 6645681 - DNA, 15 bp, Homo sapiens
agggcagagccggga

SEQ ID NO: 6645682 - DNA, 12 bp, Homo sapiens
agggcagagctg

SEQ ID NO: 6645683 - DNA, 17 bp, Homo sapiens
agggcagaggaagagac

SEQ ID NO: 6645684 - DNA, 15 bp, Homo sapiens
agggcagaggaatgt

SEQ ID NO: 6645685 - DNA, 16 bp, Homo sapiens
agggcagaggcaagga

SEQ ID NO: 6645686 - DNA, 23 bp, Homo sapiens
agggcagaggcaaggatggtggg

SEQ ID NO: 6645687 - DNA, 15 bp, Homo sapiens
agggcagaggctgga

SEQ ID NO: 6645688 - DNA, 13 bp, Homo sapiens
agggcagagggaa

SEQ ID NO: 6645689 - DNA, 19 bp, Homo sapiens
agggcagagggagaatcca

SEQ ID NO: 6645690 - DNA, 23 bp, Homo sapiens
agggcagaggtgctacctggcct

SEQ ID NO: 6645691 - DNA, 13 bp, Homo sapiens
agggcagagtatg

SEQ ID NO: 6645692 - DNA, 18 bp, Homo sapiens
agggcagagtatgttctt

SEQ ID NO: 6645693 - DNA, 12 bp, Homo sapiens
agggcagagtga

SEQ ID NO: 6645694 - DNA, 19 bp, Homo sapiens
agggcagagtgggctgcct

SEQ ID NO: 6645695 - DNA, 16 bp, Homo sapiens
agggcagatggacttc

SEQ ID NO: 6645696 - DNA, 17 bp, Homo sapiens
agggcagatggacttct

SEQ ID NO: 6645697 - DNA, 16 bp, Homo sapiens
agggcagatgtgggga

SEQ ID NO: 6645698 - DNA, 23 bp, Homo sapiens
agggcagatgtggggatgttttg

SEQ ID NO: 6645699 - DNA, 24 bp, Homo sapiens
agggcagattcggaccactaggcc

SEQ ID NO: 6645700 - DNA, 16 bp, Homo sapiens
agggcagattttagtt

SEQ ID NO: 6645701 - DNA, 22 bp, Homo sapiens
agggcagattttggttggtttt

SEQ ID NO: 6645702 - DNA, 14 bp, Homo sapiens
agggcagcagatct

SEQ ID NO: 6645703 - DNA, 17 bp, Homo sapiens
agggcagcagccagccc

SEQ ID NO: 6645704 - DNA, 20 bp, Homo sapiens
agggcagcagccagccctgc

SEQ ID NO: 6645705 - DNA, 22 bp, Homo sapiens
agggcagcagccagccctgcct

SEQ ID NO: 6645706 - DNA, 23 bp, Homo sapiens
agggcagcagccagccctgcctg

SEQ ID NO: 6645707 - DNA, 13 bp, Homo sapiens
agggcagcagccg

SEQ ID NO: 6645708 - DNA, 16 bp, Homo sapiens
agggcagcaggccaga

SEQ ID NO: 6645709 - DNA, 23 bp, Homo sapiens
agggcagcaggccagagaaagca

SEQ ID NO: 6645710 - DNA, 21 bp, Homo sapiens
agggcagccagggagagccca

SEQ ID NO: 6645711 - DNA, 22 bp, Homo sapiens
agggcagccagggagagcccag

SEQ ID NO: 6645712 - DNA, 16 bp, Homo sapiens
agggcagccaggggct

SEQ ID NO: 6645713 - DNA, 17 bp, Homo sapiens
agggcagccccctccct

SEQ ID NO: 6645714 - DNA, 21 bp, Homo sapiens
agggcagccccgcgaccaccc

SEQ ID NO: 6645715 - DNA, 17 bp, Homo sapiens
agggcagcccctcccca

SEQ ID NO: 6645716 - DNA, 13 bp, Homo sapiens
agggcagccctcc

SEQ ID NO: 6645717 - DNA, 19 bp, Homo sapiens
agggcagccctccacttct

SEQ ID NO: 6645718 - DNA, 15 bp, Homo sapiens
agggcagccctgcct

SEQ ID NO: 6645719 - DNA, 22 bp, Homo sapiens
agggcagcctccaccttgctct

SEQ ID NO: 6645720 - DNA, 15 bp, Homo sapiens
agggcagcctgcctg

SEQ ID NO: 6645721 - DNA, 17 bp, Homo sapiens
agggcagcctgcctgga

SEQ ID NO: 6645722 - DNA, 20 bp, Homo sapiens
agggcagcctgtgggagaag

SEQ ID NO: 6645723 - DNA, 23 bp, Homo sapiens
agggcagcgggagcctccctgcc

SEQ ID NO: 6645724 - DNA, 15 bp, Homo sapiens
agggcagctgcctgg

SEQ ID NO: 6645725 - DNA, 19 bp, Homo sapiens
agggcagctgcctggccat

SEQ ID NO: 6645726 - DNA, 14 bp, Homo sapiens
agggcagctgggcc

SEQ ID NO: 6645727 - DNA, 20 bp, Homo sapiens
agggcagctgggcccaaccc

SEQ ID NO: 6645728 - DNA, 17 bp, Homo sapiens
agggcagcttgccccgg

SEQ ID NO: 6645729 - DNA, 17 bp, Homo sapiens
agggcagctttgctcat

SEQ ID NO: 6645730 - DNA, 9 bp, Homo sapiens
agggcagga

SEQ ID NO: 6645731 - DNA, 23 bp, Homo sapiens
agggcaggaagacttccagcttt

SEQ ID NO: 6645732 - DNA, 13 bp, Homo sapiens
agggcaggaccag

SEQ ID NO: 6645733 - DNA, 12 bp, Homo sapiens
agggcaggagct

SEQ ID NO: 6645734 - DNA, 16 bp, Homo sapiens
agggcaggagctcaca

SEQ ID NO: 6645735 - DNA, 20 bp, Homo sapiens
agggcaggagctcacaccgc

SEQ ID NO: 6645736 - DNA, 11 bp, Homo sapiens
agggcaggcat

SEQ ID NO: 6645737 - DNA, 18 bp, Homo sapiens
agggcaggcccccgggga

SEQ ID NO: 6645738 - DNA, 16 bp, Homo sapiens
agggcaggcctgttcc

SEQ ID NO: 6645739 - DNA, 16 bp, Homo sapiens
agggcaggccttgctg

SEQ ID NO: 6645740 - DNA, 21 bp, Homo sapiens
agggcaggccttgctggggtc

SEQ ID NO: 6645741 - DNA, 14 bp, Homo sapiens
agggcaggcttggg

SEQ ID NO: 6645742 - DNA, 15 bp, Homo sapiens
agggcaggcttgggg

SEQ ID NO: 6645743 - DNA, 17 bp, Homo sapiens
agggcaggcttggggaa

SEQ ID NO: 6645744 - DNA, 22 bp, Homo sapiens
agggcaggcttggggaaaatgg

SEQ ID NO: 6645745 - DNA, 16 bp, Homo sapiens
agggcagggaaactgg

SEQ ID NO: 6645746 - DNA, 17 bp, Homo sapiens
agggcagggacaggata

SEQ ID NO: 6645747 - DNA, 12 bp, Homo sapiens
agggcagggcca

SEQ ID NO: 6645748 - DNA, 16 bp, Homo sapiens
agggcagggccacccc

SEQ ID NO: 6645749 - DNA, 17 bp, Homo sapiens
agggcagggcccacgtg

SEQ ID NO: 6645750 - DNA, 21 bp, Homo sapiens
agggcagggcgagctgcagga

SEQ ID NO: 6645751 - DNA, 23 bp, Homo sapiens
agggcagggcgagctgcaggaat

SEQ ID NO: 6645752 - DNA, 22 bp, Homo sapiens
agggcagggcggctaggccggc

SEQ ID NO: 6645753 - DNA, 22 bp, Homo sapiens
agggcaggggctgcatcctcag

SEQ ID NO: 6645754 - DNA, 18 bp, Homo sapiens
agggcagggtctgggctg

SEQ ID NO: 6645755 - DNA, 21 bp, Homo sapiens
agggcagggtgggcagcctat

SEQ ID NO: 6645756 - DNA, 17 bp, Homo sapiens
agggcagggttctagaa

SEQ ID NO: 6645757 - DNA, 22 bp, Homo sapiens
agggcagggttctagaaggggc

SEQ ID NO: 6645758 - DNA, 15 bp, Homo sapiens
agggcaggtccagct

SEQ ID NO: 6645759 - DNA, 19 bp, Homo sapiens
agggcaggtccagctctgt

SEQ ID NO: 6645760 - DNA, 20 bp, Homo sapiens
agggcaggtccagctctgtg

SEQ ID NO: 6645761 - DNA, 12 bp, Homo sapiens
agggcaggtggg

SEQ ID NO: 6645762 - DNA, 18 bp, Homo sapiens
agggcaggttagagacag

SEQ ID NO: 6645763 - DNA, 15 bp, Homo sapiens
agggcagtacctgag

SEQ ID NO: 6645764 - DNA, 18 bp, Homo sapiens
agggcagtacctgagggt

SEQ ID NO: 6645765 - DNA, 22 bp, Homo sapiens
agggcagtacctgagggtctgt

SEQ ID NO: 6645766 - DNA, 15 bp, Homo sapiens
agggcagtacctggg

SEQ ID NO: 6645767 - DNA, 18 bp, Homo sapiens
agggcagtacctgggaaa

SEQ ID NO: 6645768 - DNA, 18 bp, Homo sapiens
agggcagtgaaaatgaaa

SEQ ID NO: 6645769 - DNA, 15 bp, Homo sapiens
agggcagtgcccatg

SEQ ID NO: 6645770 - DNA, 21 bp, Homo sapiens
agggcagtgcccatgtgtaca

SEQ ID NO: 6645771 - DNA, 13 bp, Homo sapiens
agggcagtgccct

SEQ ID NO: 6645772 - DNA, 13 bp, Homo sapiens
agggcagtggacg

SEQ ID NO: 6645773 - DNA, 18 bp, Homo sapiens
agggcagtggacgtgctg

SEQ ID NO: 6645774 - DNA, 17 bp, Homo sapiens
agggcagtgtttccttt

SEQ ID NO: 6645775 - DNA, 16 bp, Homo sapiens
agggcagttcgcagcc

SEQ ID NO: 6645776 - DNA, 17 bp, Homo sapiens
agggcagttcgcagcca

SEQ ID NO: 6645777 - DNA, 18 bp, Homo sapiens
agggcagttcgcagccac

SEQ ID NO: 6645778 - DNA, 23 bp, Homo sapiens
agggcagttcgcagccaccctga

SEQ ID NO: 6645779 - DNA, 14 bp, Homo sapiens
agggcagttttgag

SEQ ID NO: 6645780 - DNA, 16 bp, Homo sapiens
agggcataaaacagct

SEQ ID NO: 6645781 - DNA, 13 bp, Homo sapiens
agggcataaagta

SEQ ID NO: 6645782 - DNA, 20 bp, Homo sapiens
agggcataaagtaaatacat

SEQ ID NO: 6645783 - DNA, 16 bp, Homo sapiens
agggcataaattattg

SEQ ID NO: 6645784 - DNA, 18 bp, Homo sapiens
agggcataccttgtgcat

SEQ ID NO: 6645785 - DNA, 22 bp, Homo sapiens
agggcataggaagaaaatgtca

SEQ ID NO: 6645786 - DNA, 16 bp, Homo sapiens
agggcatattaaaggc

SEQ ID NO: 6645787 - DNA, 17 bp, Homo sapiens
agggcatcaggcactgg

SEQ ID NO: 6645788 - DNA, 22 bp, Homo sapiens
agggcatcaggcactggtggca

SEQ ID NO: 6645789 - DNA, 21 bp, Homo sapiens
agggcatcatcctcagcagca

SEQ ID NO: 6645790 - DNA, 18 bp, Homo sapiens
agggcatccgcagcccag

SEQ ID NO: 6645791 - DNA, 18 bp, Homo sapiens
agggcatccttctgcctt

SEQ ID NO: 6645792 - DNA, 14 bp, Homo sapiens
agggcatcggggcc

SEQ ID NO: 6645793 - DNA, 12 bp, Homo sapiens
agggcatctcct

SEQ ID NO: 6645794 - DNA, 16 bp, Homo sapiens
agggcatctcctgtgc

SEQ ID NO: 6645795 - DNA, 23 bp, Homo sapiens
agggcatctctgagtgtctctgc

SEQ ID NO: 6645796 - DNA, 22 bp, Homo sapiens
agggcatgccacgtgggctcat

SEQ ID NO: 6645797 - DNA, 15 bp, Homo sapiens
agggcatgccccggc

SEQ ID NO: 6645798 - DNA, 20 bp, Homo sapiens
agggcatgccccggccacct

SEQ ID NO: 6645799 - DNA, 23 bp, Homo sapiens
agggcatgccccggccacctctg

SEQ ID NO: 6645800 - DNA, 16 bp, Homo sapiens
agggcatgccttgtgc

SEQ ID NO: 6645801 - DNA, 17 bp, Homo sapiens
agggcatggccaggtgg

SEQ ID NO: 6645802 - DNA, 19 bp, Homo sapiens
agggcatgggtcgggagag

SEQ ID NO: 6645803 - DNA, 20 bp, Homo sapiens
agggcatgggtcgggagagg

SEQ ID NO: 6645804 - DNA, 20 bp, Homo sapiens
agggcatgggttggcagggt

SEQ ID NO: 6645805 - DNA, 21 bp, Homo sapiens
agggcatgggttggcagggtg

SEQ ID NO: 6645806 - DNA, 13 bp, Homo sapiens
agggcatgtgata

SEQ ID NO: 6645807 - DNA, 22 bp, Homo sapiens
agggcatgtgatattttcacat

SEQ ID NO: 6645808 - DNA, 23 bp, Homo sapiens
agggcatgtgcggctgaactgag

SEQ ID NO: 6645809 - DNA, 21 bp, Homo sapiens
agggcattccatcccttcctg

SEQ ID NO: 6645810 - DNA, 19 bp, Homo sapiens
agggcattctttcccagtg

SEQ ID NO: 6645811 - DNA, 14 bp, Homo sapiens
agggcattgctcag

SEQ ID NO: 6645812 - DNA, 15 bp, Homo sapiens
agggcattgctcagc

SEQ ID NO: 6645813 - DNA, 20 bp, Homo sapiens
agggcattgctcagcccgct

SEQ ID NO: 6645814 - DNA, 23 bp, Homo sapiens
agggcattgtatctgtctttcca

SEQ ID NO: 6645815 - DNA, 19 bp, Homo sapiens
agggcatttgagaaatgca

SEQ ID NO: 6645816 - DNA, 17 bp, Homo sapiens
agggcatttggcttcct

SEQ ID NO: 6645817 - DNA, 20 bp, Homo sapiens
agggcatttggcttcctctg

SEQ ID NO: 6645818 - DNA, 21 bp, Homo sapiens
agggcatttggcttcctctgc

SEQ ID NO: 6645819 - DNA, 22 bp, Homo sapiens
agggcatttggcttcctctgct

SEQ ID NO: 6645820 - DNA, 13 bp, Homo sapiens
agggcattttaaa

SEQ ID NO: 6645821 - DNA, 18 bp, Homo sapiens
agggcatttttcttggat

SEQ ID NO: 6645822 - DNA, 21 bp, Homo sapiens
agggccaaaagcttccctccc

SEQ ID NO: 6645823 - DNA, 15 bp, Homo sapiens
agggccaaacccact

SEQ ID NO: 6645824 - DNA, 20 bp, Homo sapiens
agggccaaacccacttctgg

SEQ ID NO: 6645825 - DNA, 22 bp, Homo sapiens
agggccaaacccacttctggcc

SEQ ID NO: 6645826 - DNA, 23 bp, Homo sapiens
agggccaaacccacttctggcct

SEQ ID NO: 6645827 - DNA, 19 bp, Homo sapiens
agggccaaacgctgagcca

SEQ ID NO: 6645828 - DNA, 22 bp, Homo sapiens
agggccaaacgctgagccacct

SEQ ID NO: 6645829 - DNA, 12 bp, Homo sapiens
agggccaacaac

SEQ ID NO: 6645830 - DNA, 16 bp, Homo sapiens
agggccaagagagaca

SEQ ID NO: 6645831 - DNA, 21 bp, Homo sapiens
agggccaagagatctgtgtgg

SEQ ID NO: 6645832 - DNA, 21 bp, Homo sapiens
agggccaagcccagcactgct

SEQ ID NO: 6645833 - DNA, 20 bp, Homo sapiens
agggccaagcgggggcgtgg

SEQ ID NO: 6645834 - DNA, 16 bp, Homo sapiens
agggccaatccccagc

SEQ ID NO: 6645835 - DNA, 22 bp, Homo sapiens
agggccaatggagaaaatgaat

SEQ ID NO: 6645836 - DNA, 20 bp, Homo sapiens
agggccacatgggaggctca

SEQ ID NO: 6645837 - DNA, 19 bp, Homo sapiens
agggccaccaggaagcaca

SEQ ID NO: 6645838 - DNA, 16 bp, Homo sapiens
agggccaccctgagca

SEQ ID NO: 6645839 - DNA, 14 bp, Homo sapiens
agggccaccctgct

SEQ ID NO: 6645840 - DNA, 20 bp, Homo sapiens
agggccaccggtgggcagtg

SEQ ID NO: 6645841 - DNA, 14 bp, Homo sapiens
agggccacctgcag

SEQ ID NO: 6645842 - DNA, 15 bp, Homo sapiens
agggccacctgcagg

SEQ ID NO: 6645843 - DNA, 18 bp, Homo sapiens
agggccacctgcaggacc

SEQ ID NO: 6645844 - DNA, 19 bp, Homo sapiens
agggccacctgcaggaccc

SEQ ID NO: 6645845 - DNA, 17 bp, Homo sapiens
agggccacggggaggcc

SEQ ID NO: 6645846 - DNA, 15 bp, Homo sapiens
agggccacgtgccag

SEQ ID NO: 6645847 - DNA, 23 bp, Homo sapiens
agggccactcaacagagaggacc

SEQ ID NO: 6645848 - DNA, 15 bp, Homo sapiens
agggccactctgcct

SEQ ID NO: 6645849 - DNA, 18 bp, Homo sapiens
agggccactctgcctctg

SEQ ID NO: 6645850 - DNA, 20 bp, Homo sapiens
agggccactggaaggaacat

SEQ ID NO: 6645851 - DNA, 23 bp, Homo sapiens
agggccactttttttttatactg

SEQ ID NO: 6645852 - DNA, 17 bp, Homo sapiens
agggccagaaaaaagtg

SEQ ID NO: 6645853 - DNA, 17 bp, Homo sapiens
agggccagaaaaatttg

SEQ ID NO: 6645854 - DNA, 18 bp, Homo sapiens
agggccagagcagctcca

SEQ ID NO: 6645855 - DNA, 16 bp, Homo sapiens
agggccagatctgtta

SEQ ID NO: 6645856 - DNA, 13 bp, Homo sapiens
agggccagcaggc

SEQ ID NO: 6645857 - DNA, 14 bp, Homo sapiens
agggccagcaggct

SEQ ID NO: 6645858 - DNA, 11 bp, Homo sapiens
agggccagccc

SEQ ID NO: 6645859 - DNA, 12 bp, Homo sapiens
agggccagccct

SEQ ID NO: 6645860 - DNA, 13 bp, Homo sapiens
agggccagcccta

SEQ ID NO: 6645861 - DNA, 17 bp, Homo sapiens
agggccagccctacatc

SEQ ID NO: 6645862 - DNA, 13 bp, Homo sapiens
agggccaggaagg

SEQ ID NO: 6645863 - DNA, 23 bp, Homo sapiens
agggccaggaaggacagactggc

SEQ ID NO: 6645864 - DNA, 17 bp, Homo sapiens
agggccaggactgagcc

SEQ ID NO: 6645865 - DNA, 19 bp, Homo sapiens
agggccaggactgagcccc

SEQ ID NO: 6645866 - DNA, 13 bp, Homo sapiens
agggccaggcagg

SEQ ID NO: 6645867 - DNA, 16 bp, Homo sapiens
agggccaggcccaggc

SEQ ID NO: 6645868 - DNA, 17 bp, Homo sapiens
agggccaggcctctgct

SEQ ID NO: 6645869 - DNA, 21 bp, Homo sapiens
agggccaggcctctgctggct

SEQ ID NO: 6645870 - DNA, 22 bp, Homo sapiens
agggccaggcctctgctggctc

SEQ ID NO: 6645871 - DNA, 23 bp, Homo sapiens
agggccaggcctctgctggctca

SEQ ID NO: 6645872 - DNA, 16 bp, Homo sapiens
agggccagggacccag

SEQ ID NO: 6645873 - DNA, 12 bp, Homo sapiens
agggccagggca

SEQ ID NO: 6645874 - DNA, 17 bp, Homo sapiens
agggccagggcaatgcc

SEQ ID NO: 6645875 - DNA, 19 bp, Homo sapiens
agggccagggccctgcaga

SEQ ID NO: 6645876 - DNA, 17 bp, Homo sapiens
agggccagggctctggc

SEQ ID NO: 6645877 - DNA, 21 bp, Homo sapiens
agggccaggggtctccctgga

SEQ ID NO: 6645878 - DNA, 19 bp, Homo sapiens
agggccaggtcctcacagc

SEQ ID NO: 6645879 - DNA, 22 bp, Homo sapiens
agggccaggtcctcacagcagt

SEQ ID NO: 6645880 - DNA, 19 bp, Homo sapiens
agggccagtcatggctgtc

SEQ ID NO: 6645881 - DNA, 23 bp, Homo sapiens
agggccagtcctcctgggagccc

SEQ ID NO: 6645882 - DNA, 17 bp, Homo sapiens
agggccagtgatgatgt

SEQ ID NO: 6645883 - DNA, 19 bp, Homo sapiens
agggccagttggtgttcct

SEQ ID NO: 6645884 - DNA, 23 bp, Homo sapiens
agggccatacttttgagaggggt

SEQ ID NO: 6645885 - DNA, 15 bp, Homo sapiens
agggccatctcctcc

SEQ ID NO: 6645886 - DNA, 23 bp, Homo sapiens
agggccatctgactgccaagcca

SEQ ID NO: 6645887 - DNA, 16 bp, Homo sapiens
agggccatgcagacct

SEQ ID NO: 6645888 - DNA, 18 bp, Homo sapiens
agggccatgctgaaggga

SEQ ID NO: 6645889 - DNA, 19 bp, Homo sapiens
agggccatgctgaggcctg

SEQ ID NO: 6645890 - DNA, 22 bp, Homo sapiens
agggccatgctgaggcctgggc

SEQ ID NO: 6645891 - DNA, 23 bp, Homo sapiens
agggccatgctgaggcctgggcc

SEQ ID NO: 6645892 - DNA, 21 bp, Homo sapiens
agggccatggctcagggtggt

SEQ ID NO: 6645893 - DNA, 14 bp, Homo sapiens
agggccatgtgctg

SEQ ID NO: 6645894 - DNA, 18 bp, Homo sapiens
agggccatgtgctgccct

SEQ ID NO: 6645895 - DNA, 21 bp, Homo sapiens
agggcccaaagaattggaatc

SEQ ID NO: 6645896 - DNA, 22 bp, Homo sapiens
agggcccaagtccctgttttct

SEQ ID NO: 6645897 - DNA, 18 bp, Homo sapiens
agggcccacacctggtgg

SEQ ID NO: 6645898 - DNA, 19 bp, Homo sapiens
agggcccaccttggaccct

SEQ ID NO: 6645899 - DNA, 20 bp, Homo sapiens
agggcccaccttggaccctg

SEQ ID NO: 6645900 - DNA, 21 bp, Homo sapiens
agggcccaccttggaccctgg

SEQ ID NO: 6645901 - DNA, 17 bp, Homo sapiens
agggcccagaccctggg

SEQ ID NO: 6645902 - DNA, 11 bp, Homo sapiens
agggcccagag

SEQ ID NO: 6645903 - DNA, 13 bp, Homo sapiens
agggcccagagag

SEQ ID NO: 6645904 - DNA, 15 bp, Homo sapiens
agggcccagagccca

SEQ ID NO: 6645905 - DNA, 19 bp, Homo sapiens
agggcccagagcccagctc

SEQ ID NO: 6645906 - DNA, 21 bp, Homo sapiens
agggcccagagcccagctcca

SEQ ID NO: 6645907 - DNA, 15 bp, Homo sapiens
agggcccagagccct

SEQ ID NO: 6645908 - DNA, 17 bp, Homo sapiens
agggcccagagcccttg

SEQ ID NO: 6645909 - DNA, 15 bp, Homo sapiens
agggcccagaggctg

SEQ ID NO: 6645910 - DNA, 14 bp, Homo sapiens
agggcccagcaggc

SEQ ID NO: 6645911 - DNA, 15 bp, Homo sapiens
agggcccagcaggcg

SEQ ID NO: 6645912 - DNA, 13 bp, Homo sapiens
agggcccagccca

SEQ ID NO: 6645913 - DNA, 18 bp, Homo sapiens
agggcccagcccaagtga

SEQ ID NO: 6645914 - DNA, 15 bp, Homo sapiens
agggcccagctgtag

SEQ ID NO: 6645915 - DNA, 15 bp, Homo sapiens
agggcccaggcaggc

SEQ ID NO: 6645916 - DNA, 12 bp, Homo sapiens
agggcccaggcc

SEQ ID NO: 6645917 - DNA, 18 bp, Homo sapiens
agggcccagttaaatatg

SEQ ID NO: 6645918 - DNA, 16 bp, Homo sapiens
agggcccatcaggcag

SEQ ID NO: 6645919 - DNA, 19 bp, Homo sapiens
agggcccatgggagggagc

SEQ ID NO: 6645920 - DNA, 19 bp, Homo sapiens
agggcccatgtagctggca

SEQ ID NO: 6645921 - DNA, 20 bp, Homo sapiens
agggcccatgtagctggcaa

SEQ ID NO: 6645922 - DNA, 21 bp, Homo sapiens
agggccccaactacacacccc

SEQ ID NO: 6645923 - DNA, 13 bp, Homo sapiens
agggccccacgtc

SEQ ID NO: 6645924 - DNA, 23 bp, Homo sapiens
agggccccaggcccgcgggcaca

SEQ ID NO: 6645925 - DNA, 16 bp, Homo sapiens
agggccccaggggcag

SEQ ID NO: 6645926 - DNA, 19 bp, Homo sapiens
agggcccccaataaaccag

SEQ ID NO: 6645927 - DNA, 21 bp, Homo sapiens
agggcccccaataaaccagtg

SEQ ID NO: 6645928 - DNA, 22 bp, Homo sapiens
agggcccccaataaaccagtgt

SEQ ID NO: 6645929 - DNA, 23 bp, Homo sapiens
agggcccccaccgaggttcccag

SEQ ID NO: 6645930 - DNA, 13 bp, Homo sapiens
agggcccccactg

SEQ ID NO: 6645931 - DNA, 21 bp, Homo sapiens
agggcccccggctcggcctct

SEQ ID NO: 6645932 - DNA, 14 bp, Homo sapiens
agggccccggggcc

SEQ ID NO: 6645933 - DNA, 17 bp, Homo sapiens
agggcccctcactggct

SEQ ID NO: 6645934 - DNA, 18 bp, Homo sapiens
agggcccctcactggctg

SEQ ID NO: 6645935 - DNA, 11 bp, Homo sapiens
agggcccctcc

SEQ ID NO: 6645936 - DNA, 18 bp, Homo sapiens
agggcccctccctctgcc

SEQ ID NO: 6645937 - DNA, 13 bp, Homo sapiens
agggcccctctcc

SEQ ID NO: 6645938 - DNA, 23 bp, Homo sapiens
agggcccctctccaagcgcctgg

SEQ ID NO: 6645939 - DNA, 16 bp, Homo sapiens
agggcccctctgccca

SEQ ID NO: 6645940 - DNA, 21 bp, Homo sapiens
agggcccctctgcccagcttg

SEQ ID NO: 6645941 - DNA, 23 bp, Homo sapiens
agggcccctctgcccagcttggg

SEQ ID NO: 6645942 - DNA, 19 bp, Homo sapiens
agggcccctgcgtgggggc

SEQ ID NO: 6645943 - DNA, 14 bp, Homo sapiens
agggcccctggatc

SEQ ID NO: 6645944 - DNA, 20 bp, Homo sapiens
agggcccctgggcccctctt

SEQ ID NO: 6645945 - DNA, 17 bp, Homo sapiens
agggcccgcaccgacca

SEQ ID NO: 6645946 - DNA, 16 bp, Homo sapiens
agggcccgggaagcaa

SEQ ID NO: 6645947 - DNA, 18 bp, Homo sapiens
agggcccgggcacccaca

SEQ ID NO: 6645948 - DNA, 15 bp, Homo sapiens
agggcccgggcccag

SEQ ID NO: 6645949 - DNA, 13 bp, Homo sapiens
agggccctacctg

SEQ ID NO: 6645950 - DNA, 16 bp, Homo sapiens
agggccctcactcagg

SEQ ID NO: 6645951 - DNA, 15 bp, Homo sapiens
agggccctcagagga

SEQ ID NO: 6645952 - DNA, 14 bp, Homo sapiens
agggccctcccagc

SEQ ID NO: 6645953 - DNA, 15 bp, Homo sapiens
agggccctcccagcc

SEQ ID NO: 6645954 - DNA, 17 bp, Homo sapiens
agggccctcccagccca

SEQ ID NO: 6645955 - DNA, 15 bp, Homo sapiens
agggccctccttcct

SEQ ID NO: 6645956 - DNA, 14 bp, Homo sapiens
agggccctctgggg

SEQ ID NO: 6645957 - DNA, 17 bp, Homo sapiens
agggccctctggggctc

SEQ ID NO: 6645958 - DNA, 16 bp, Homo sapiens
agggccctgagctcgg

SEQ ID NO: 6645959 - DNA, 19 bp, Homo sapiens
agggccctgagctgagggc

SEQ ID NO: 6645960 - DNA, 14 bp, Homo sapiens
agggccctgaggaa

SEQ ID NO: 6645961 - DNA, 16 bp, Homo sapiens
agggccctgaggaata

SEQ ID NO: 6645962 - DNA, 18 bp, Homo sapiens
agggccctgaggaataaa

SEQ ID NO: 6645963 - DNA, 20 bp, Homo sapiens
agggccctgaggaataaagc

SEQ ID NO: 6645964 - DNA, 15 bp, Homo sapiens
agggccctgccctgt

SEQ ID NO: 6645965 - DNA, 16 bp, Homo sapiens
agggccctgccctgta

SEQ ID NO: 6645966 - DNA, 13 bp, Homo sapiens
agggccctgctca

SEQ ID NO: 6645967 - DNA, 15 bp, Homo sapiens
agggccctgctcagg

SEQ ID NO: 6645968 - DNA, 13 bp, Homo sapiens
agggccctggcca

SEQ ID NO: 6645969 - DNA, 18 bp, Homo sapiens
agggccctggccagccgg

SEQ ID NO: 6645970 - DNA, 16 bp, Homo sapiens
agggccctgggcaggg

SEQ ID NO: 6645971 - DNA, 24 bp, Homo sapiens
agggccctggtgtttctagcactg

SEQ ID NO: 6645972 - DNA, 15 bp, Homo sapiens
agggccctgtggagt

SEQ ID NO: 6645973 - DNA, 14 bp, Homo sapiens
agggcccttcccaa

SEQ ID NO: 6645974 - DNA, 18 bp, Homo sapiens
agggcccttcccaacctc

SEQ ID NO: 6645975 - DNA, 17 bp, Homo sapiens
agggcccttggggctgg

SEQ ID NO: 6645976 - DNA, 14 bp, Homo sapiens
agggccctttcatc

SEQ ID NO: 6645977 - DNA, 23 bp, Homo sapiens
agggccctttcttgcactgtcca

SEQ ID NO: 6645978 - DNA, 20 bp, Homo sapiens
agggccgactaagagaagtt

SEQ ID NO: 6645979 - DNA, 15 bp, Homo sapiens
agggccgagaggaca

SEQ ID NO: 6645980 - DNA, 18 bp, Homo sapiens
agggccgcagggcgctcc

SEQ ID NO: 6645981 - DNA, 23 bp, Homo sapiens
agggccgccagggagacctggac

SEQ ID NO: 6645982 - DNA, 20 bp, Homo sapiens
agggccgcccgggcccagag

SEQ ID NO: 6645983 - DNA, 22 bp, Homo sapiens
agggccgccgaagggcagcccc

SEQ ID NO: 6645984 - DNA, 15 bp, Homo sapiens
agggccgcctgcctt

SEQ ID NO: 6645985 - DNA, 19 bp, Homo sapiens
agggccggcggctctgagc

SEQ ID NO: 6645986 - DNA, 18 bp, Homo sapiens
agggccgggcagaggggc

SEQ ID NO: 6645987 - DNA, 17 bp, Homo sapiens
agggccgtaccccaccc

SEQ ID NO: 6645988 - DNA, 17 bp, Homo sapiens
agggccgtgcccttgcc

SEQ ID NO: 6645989 - DNA, 16 bp, Homo sapiens
agggcctagctgctac

SEQ ID NO: 6645990 - DNA, 20 bp, Homo sapiens
agggcctatatgccagcgcc

SEQ ID NO: 6645991 - DNA, 22 bp, Homo sapiens
agggcctcactctgttgctcag

SEQ ID NO: 6645992 - DNA, 23 bp, Homo sapiens
agggcctcactctgttgctcagg

SEQ ID NO: 6645993 - DNA, 17 bp, Homo sapiens
agggcctcatctcacct

SEQ ID NO: 6645994 - DNA, 15 bp, Homo sapiens
agggcctccagggcc

SEQ ID NO: 6645995 - DNA, 12 bp, Homo sapiens
agggcctccctg

SEQ ID NO: 6645996 - DNA, 12 bp, Homo sapiens
agggcctcctca

SEQ ID NO: 6645997 - DNA, 22 bp, Homo sapiens
agggcctcggaggctcctccct

SEQ ID NO: 6645998 - DNA, 22 bp, Homo sapiens
agggcctctccctttagtggag

SEQ ID NO: 6645999 - DNA, 17 bp, Homo sapiens
agggcctctccttggaa

SEQ ID NO: 6646000 - DNA, 18 bp, Homo sapiens
agggcctctccttggaag

SEQ ID NO: 6646001 - DNA, 14 bp, Homo sapiens
agggcctctgcctg

SEQ ID NO: 6646002 - DNA, 20 bp, Homo sapiens
agggcctgacaggttcccag

SEQ ID NO: 6646003 - DNA, 11 bp, Homo sapiens
agggcctgact

SEQ ID NO: 6646004 - DNA, 19 bp, Homo sapiens
agggcctgacttgagccac

SEQ ID NO: 6646005 - DNA, 22 bp, Homo sapiens
agggcctgacttgagccactcc

SEQ ID NO: 6646006 - DNA, 14 bp, Homo sapiens
agggcctgactttt

SEQ ID NO: 6646007 - DNA, 17 bp, Homo sapiens
agggcctgacttttaca

SEQ ID NO: 6646008 - DNA, 22 bp, Homo sapiens
agggcctgacttttacagcttt

SEQ ID NO: 6646009 - DNA, 17 bp, Homo sapiens
agggcctgagcagctgg

SEQ ID NO: 6646010 - DNA, 15 bp, Homo sapiens
agggcctgcaaggga

SEQ ID NO: 6646011 - DNA, 23 bp, Homo sapiens
agggcctgcaggacctgcctgta

SEQ ID NO: 6646012 - DNA, 16 bp, Homo sapiens
agggcctgcatggaga

SEQ ID NO: 6646013 - DNA, 12 bp, Homo sapiens
agggcctgcccc

SEQ ID NO: 6646014 - DNA, 13 bp, Homo sapiens
agggcctgccccc

SEQ ID NO: 6646015 - DNA, 18 bp, Homo sapiens
agggcctgccccctgggg

SEQ ID NO: 6646016 - DNA, 17 bp, Homo sapiens
agggcctgcgagggcag

SEQ ID NO: 6646017 - DNA, 20 bp, Homo sapiens
agggcctgctctgcttttcc

SEQ ID NO: 6646018 - DNA, 12 bp, Homo sapiens
agggcctgctgg

SEQ ID NO: 6646019 - DNA, 16 bp, Homo sapiens
agggcctgctggagaa

SEQ ID NO: 6646020 - DNA, 17 bp, Homo sapiens
agggcctggagccccat

SEQ ID NO: 6646021 - DNA, 19 bp, Homo sapiens
agggcctggcaggccagtg

SEQ ID NO: 6646022 - DNA, 17 bp, Homo sapiens
agggcctggccagtcct

SEQ ID NO: 6646023 - DNA, 20 bp, Homo sapiens
agggcctggccagtcctggt

SEQ ID NO: 6646024 - DNA, 21 bp, Homo sapiens
agggcctggccagtcctggtc

SEQ ID NO: 6646025 - DNA, 23 bp, Homo sapiens
agggcctggccagtcctggtcct

SEQ ID NO: 6646026 - DNA, 16 bp, Homo sapiens
agggcctggcccatgt

SEQ ID NO: 6646027 - DNA, 15 bp, Homo sapiens
agggcctggcctgag

SEQ ID NO: 6646028 - DNA, 15 bp, Homo sapiens
agggcctggcctggt

SEQ ID NO: 6646029 - DNA, 22 bp, Homo sapiens
agggcctggccttgtccccagc

SEQ ID NO: 6646030 - DNA, 13 bp, Homo sapiens
agggcctggctca

SEQ ID NO: 6646031 - DNA, 14 bp, Homo sapiens
agggcctggctcag

SEQ ID NO: 6646032 - DNA, 13 bp, Homo sapiens
agggcctggctcc

SEQ ID NO: 6646033 - DNA, 18 bp, Homo sapiens
agggcctggctccagtct

SEQ ID NO: 6646034 - DNA, 13 bp, Homo sapiens
agggcctgggcct

SEQ ID NO: 6646035 - DNA, 14 bp, Homo sapiens
agggcctgggcctc

SEQ ID NO: 6646036 - DNA, 20 bp, Homo sapiens
agggcctgggcctggctccc

SEQ ID NO: 6646037 - DNA, 21 bp, Homo sapiens
agggcctgggcctggctccct

SEQ ID NO: 6646038 - DNA, 21 bp, Homo sapiens
agggcctggggcctgagagaa

SEQ ID NO: 6646039 - DNA, 15 bp, Homo sapiens
agggcctgggggcag

SEQ ID NO: 6646040 - DNA, 13 bp, Homo sapiens
agggcctggtgtg

SEQ ID NO: 6646041 - DNA, 21 bp, Homo sapiens
agggcctggtgtgaggctggg

SEQ ID NO: 6646042 - DNA, 12 bp, Homo sapiens
agggcctggttg

SEQ ID NO: 6646043 - DNA, 14 bp, Homo sapiens
agggcctgtctccc

SEQ ID NO: 6646044 - DNA, 12 bp, Homo sapiens
agggcctgtggg

SEQ ID NO: 6646045 - DNA, 19 bp, Homo sapiens
agggccttcccctcccagc

SEQ ID NO: 6646046 - DNA, 21 bp, Homo sapiens
agggccttctgcctgctgacc

SEQ ID NO: 6646047 - DNA, 15 bp, Homo sapiens
agggccttgaatcct

SEQ ID NO: 6646048 - DNA, 18 bp, Homo sapiens
agggccttgacaagtaca

SEQ ID NO: 6646049 - DNA, 18 bp, Homo sapiens
agggccttgagcatctgg

SEQ ID NO: 6646050 - DNA, 12 bp, Homo sapiens
agggccttgccc

SEQ ID NO: 6646051 - DNA, 23 bp, Homo sapiens
agggccttgcccagagatgcctc

SEQ ID NO: 6646052 - DNA, 15 bp, Homo sapiens
agggccttgcttctc

SEQ ID NO: 6646053 - DNA, 21 bp, Homo sapiens
agggccttggaaattcctgta

SEQ ID NO: 6646054 - DNA, 16 bp, Homo sapiens
agggcctttctcctcc

SEQ ID NO: 6646055 - DNA, 22 bp, Homo sapiens
agggcctttctcctccccacct

SEQ ID NO: 6646056 - DNA, 15 bp, Homo sapiens
agggccttttctggc

SEQ ID NO: 6646057 - DNA, 20 bp, Homo sapiens
agggccttttctggcaccgc

SEQ ID NO: 6646058 - DNA, 21 bp, Homo sapiens
agggccttttctgtgccagac

SEQ ID NO: 6646059 - DNA, 21 bp, Homo sapiens
agggcgaccccgtcacagcct

SEQ ID NO: 6646060 - DNA, 16 bp, Homo sapiens
agggcgagctgcagga

SEQ ID NO: 6646061 - DNA, 22 bp, Homo sapiens
agggcgataaaactaaatatat

SEQ ID NO: 6646062 - DNA, 15 bp, Homo sapiens
agggcgcaaagggca

SEQ ID NO: 6646063 - DNA, 14 bp, Homo sapiens
agggcgcaggccgt

SEQ ID NO: 6646064 - DNA, 17 bp, Homo sapiens
agggcgcccagcagcct

SEQ ID NO: 6646065 - DNA, 15 bp, Homo sapiens
agggcgcccagccca

SEQ ID NO: 6646066 - DNA, 22 bp, Homo sapiens
agggcgcccagcccaggcctgg

SEQ ID NO: 6646067 - DNA, 17 bp, Homo sapiens
agggcgccgccggccct

SEQ ID NO: 6646068 - DNA, 14 bp, Homo sapiens
agggcgcctactct

SEQ ID NO: 6646069 - DNA, 13 bp, Homo sapiens
agggcgcctgggt

SEQ ID NO: 6646070 - DNA, 21 bp, Homo sapiens
agggcgcctgggtcctcccag

SEQ ID NO: 6646071 - DNA, 22 bp, Homo sapiens
agggcgcctgggtcctcccagc

SEQ ID NO: 6646072 - DNA, 13 bp, Homo sapiens
agggcgctcagac

SEQ ID NO: 6646073 - DNA, 13 bp, Homo sapiens
agggcgctcctgt

SEQ ID NO: 6646074 - DNA, 18 bp, Homo sapiens
agggcgctgagggcaggg

SEQ ID NO: 6646075 - DNA, 17 bp, Homo sapiens
agggcggaagagttaca

SEQ ID NO: 6646076 - DNA, 15 bp, Homo sapiens
agggcggagcgcctc

SEQ ID NO: 6646077 - DNA, 16 bp, Homo sapiens
agggcggcaggggcct

SEQ ID NO: 6646078 - DNA, 12 bp, Homo sapiens
agggcggccagg

SEQ ID NO: 6646079 - DNA, 16 bp, Homo sapiens
agggcggcggggcctg

SEQ ID NO: 6646080 - DNA, 19 bp, Homo sapiens
agggcgggaggatgttctg

SEQ ID NO: 6646081 - DNA, 15 bp, Homo sapiens
agggcgggagtgggg

SEQ ID NO: 6646082 - DNA, 17 bp, Homo sapiens
agggcgggcagagggct

SEQ ID NO: 6646083 - DNA, 20 bp, Homo sapiens
agggcgggcagagggctgga

SEQ ID NO: 6646084 - DNA, 15 bp, Homo sapiens
agggcgggccaggag

SEQ ID NO: 6646085 - DNA, 16 bp, Homo sapiens
agggcgggccaggaga

SEQ ID NO: 6646086 - DNA, 23 bp, Homo sapiens
agggcggggctatgccttgtctg

SEQ ID NO: 6646087 - DNA, 12 bp, Homo sapiens
agggcggggctg

SEQ ID NO: 6646088 - DNA, 17 bp, Homo sapiens
agggcggggctggccag

SEQ ID NO: 6646089 - DNA, 23 bp, Homo sapiens
agggcgggggcaacgattcacag

SEQ ID NO: 6646090 - DNA, 14 bp, Homo sapiens
agggcggggtgggg

SEQ ID NO: 6646091 - DNA, 21 bp, Homo sapiens
agggcggggtgtctgtcttcc

SEQ ID NO: 6646092 - DNA, 15 bp, Homo sapiens
agggcggtgctagct

SEQ ID NO: 6646093 - DNA, 12 bp, Homo sapiens
agggcgtcaggc

SEQ ID NO: 6646094 - DNA, 16 bp, Homo sapiens
agggcgtcaggcagag

SEQ ID NO: 6646095 - DNA, 22 bp, Homo sapiens
agggcgtgaaacacaatatcat

SEQ ID NO: 6646096 - DNA, 16 bp, Homo sapiens
agggcgtgactcaccc

SEQ ID NO: 6646097 - DNA, 17 bp, Homo sapiens
agggcgtgactcaccca

SEQ ID NO: 6646098 - DNA, 14 bp, Homo sapiens
agggcgtgaggaac

SEQ ID NO: 6646099 - DNA, 15 bp, Homo sapiens
agggcgtggctctgg

SEQ ID NO: 6646100 - DNA, 18 bp, Homo sapiens
agggcgtggctctgggtg

SEQ ID NO: 6646101 - DNA, 19 bp, Homo sapiens
agggcgtggctctgggtgg

SEQ ID NO: 6646102 - DNA, 22 bp, Homo sapiens
agggcgttctaggtaggaagag

SEQ ID NO: 6646103 - DNA, 23 bp, Homo sapiens
agggcgttctaggtaggaagagc

SEQ ID NO: 6646104 - DNA, 20 bp, Homo sapiens
agggcgttcttaggctgctg

SEQ ID NO: 6646105 - DNA, 21 bp, Homo sapiens
agggcgttcttaggctgctgg

SEQ ID NO: 6646106 - DNA, 20 bp, Homo sapiens
agggctaaaaaggtcctgta

SEQ ID NO: 6646107 - DNA, 20 bp, Homo sapiens
agggctaaataaagaggaga

SEQ ID NO: 6646108 - DNA, 23 bp, Homo sapiens
agggctaaataaagaggagataa

SEQ ID NO: 6646109 - DNA, 23 bp, Homo sapiens
agggctaagagctagcgctgccg

SEQ ID NO: 6646110 - DNA, 20 bp, Homo sapiens
agggctaattatatattttg

SEQ ID NO: 6646111 - DNA, 21 bp, Homo sapiens
agggctaattatatattttgt

SEQ ID NO: 6646112 - DNA, 23 bp, Homo sapiens
agggctacacagaccctgcccac

SEQ ID NO: 6646113 - DNA, 22 bp, Homo sapiens
agggctacccaaaacagttcta

SEQ ID NO: 6646114 - DNA, 15 bp, Homo sapiens
agggctaccctgagc

SEQ ID NO: 6646115 - DNA, 16 bp, Homo sapiens
agggctacctctgagt

SEQ ID NO: 6646116 - DNA, 14 bp, Homo sapiens
agggctactcagca

SEQ ID NO: 6646117 - DNA, 17 bp, Homo sapiens
agggctactcagcagta

SEQ ID NO: 6646118 - DNA, 21 bp, Homo sapiens
agggctagaacctagaagggc

SEQ ID NO: 6646119 - DNA, 22 bp, Homo sapiens
agggctagaacctagaagggct

SEQ ID NO: 6646120 - DNA, 18 bp, Homo sapiens
agggctagaacctggaag

SEQ ID NO: 6646121 - DNA, 19 bp, Homo sapiens
agggctagaacctggagaa

SEQ ID NO: 6646122 - DNA, 18 bp, Homo sapiens
agggctagaacctggagg

SEQ ID NO: 6646123 - DNA, 18 bp, Homo sapiens
agggctagaacctggcag

SEQ ID NO: 6646124 - DNA, 17 bp, Homo sapiens
agggctagaactggaga

SEQ ID NO: 6646125 - DNA, 15 bp, Homo sapiens
agggctagccctgag

SEQ ID NO: 6646126 - DNA, 19 bp, Homo sapiens
agggctatagctcaggacc

SEQ ID NO: 6646127 - DNA, 17 bp, Homo sapiens
agggctatatttcagtg

SEQ ID NO: 6646128 - DNA, 20 bp, Homo sapiens
agggctatatttcagtgaca

SEQ ID NO: 6646129 - DNA, 17 bp, Homo sapiens
agggctatgcctccatt

SEQ ID NO: 6646130 - DNA, 17 bp, Homo sapiens
agggctatggcctccct

SEQ ID NO: 6646131 - DNA, 14 bp, Homo sapiens
agggctcacactcc

SEQ ID NO: 6646132 - DNA, 15 bp, Homo sapiens
agggctcacagggca

SEQ ID NO: 6646133 - DNA, 18 bp, Homo sapiens
agggctcacagggcaggc

SEQ ID NO: 6646134 - DNA, 20 bp, Homo sapiens
agggctcacagggcaggcct

SEQ ID NO: 6646135 - DNA, 13 bp, Homo sapiens
agggctcactcag

SEQ ID NO: 6646136 - DNA, 11 bp, Homo sapiens
agggctcagag

SEQ ID NO: 6646137 - DNA, 14 bp, Homo sapiens
agggctcagcctgg

SEQ ID NO: 6646138 - DNA, 22 bp, Homo sapiens
agggctcagcggggacagctcc

SEQ ID NO: 6646139 - DNA, 12 bp, Homo sapiens
agggctccagac

SEQ ID NO: 6646140 - DNA, 22 bp, Homo sapiens
agggctccagcatccagcctgt

SEQ ID NO: 6646141 - DNA, 23 bp, Homo sapiens
agggctccagcatccagcctgtg

SEQ ID NO: 6646142 - DNA, 12 bp, Homo sapiens
agggctccagcc

SEQ ID NO: 6646143 - DNA, 14 bp, Homo sapiens
agggctccagcctg

SEQ ID NO: 6646144 - DNA, 16 bp, Homo sapiens
agggctccagcctgtc

SEQ ID NO: 6646145 - DNA, 22 bp, Homo sapiens
agggctccagcctgtcggccac

SEQ ID NO: 6646146 - DNA, 17 bp, Homo sapiens
agggctccagggccagg

SEQ ID NO: 6646147 - DNA, 18 bp, Homo sapiens
agggctccagggccaggg

SEQ ID NO: 6646148 - DNA, 11 bp, Homo sapiens
agggctcccca

SEQ ID NO: 6646149 - DNA, 21 bp, Homo sapiens
agggctccctatgttgcccag

SEQ ID NO: 6646150 - DNA, 14 bp, Homo sapiens
agggctccctcctg

SEQ ID NO: 6646151 - DNA, 17 bp, Homo sapiens
agggctccctcctggag

SEQ ID NO: 6646152 - DNA, 19 bp, Homo sapiens
agggctccctcctggagca

SEQ ID NO: 6646153 - DNA, 22 bp, Homo sapiens
agggctccctcctggagcatcc

SEQ ID NO: 6646154 - DNA, 15 bp, Homo sapiens
agggctccctgccat

SEQ ID NO: 6646155 - DNA, 20 bp, Homo sapiens
agggctccctgctccctccc

SEQ ID NO: 6646156 - DNA, 20 bp, Homo sapiens
agggctcccttatgtccacc

SEQ ID NO: 6646157 - DNA, 14 bp, Homo sapiens
agggctcctatctt

SEQ ID NO: 6646158 - DNA, 16 bp, Homo sapiens
agggctcctatctttc

SEQ ID NO: 6646159 - DNA, 15 bp, Homo sapiens
agggctcctattcaa

SEQ ID NO: 6646160 - DNA, 13 bp, Homo sapiens
agggctcctccat

SEQ ID NO: 6646161 - DNA, 14 bp, Homo sapiens
agggctcctccatg

SEQ ID NO: 6646162 - DNA, 23 bp, Homo sapiens
agggctcctccatggtgctgcat

SEQ ID NO: 6646163 - DNA, 18 bp, Homo sapiens
agggctcctcccagcttg

SEQ ID NO: 6646164 - DNA, 12 bp, Homo sapiens
agggctcctgcc

SEQ ID NO: 6646165 - DNA, 12 bp, Homo sapiens
agggctcctggg

SEQ ID NO: 6646166 - DNA, 21 bp, Homo sapiens
agggctccttgtgggcctggg

SEQ ID NO: 6646167 - DNA, 23 bp, Homo sapiens
agggctccttgtgggcctgggct

SEQ ID NO: 6646168 - DNA, 20 bp, Homo sapiens
agggctcgaggggtgggctg

SEQ ID NO: 6646169 - DNA, 17 bp, Homo sapiens
agggctcgggagccatg

SEQ ID NO: 6646170 - DNA, 15 bp, Homo sapiens
agggctcgggcgctg

SEQ ID NO: 6646171 - DNA, 16 bp, Homo sapiens
agggctcgggcgctgt

SEQ ID NO: 6646172 - DNA, 24 bp, Homo sapiens
agggctcgggcgctgtggctcctg

SEQ ID NO: 6646173 - DNA, 15 bp, Homo sapiens
agggctctaaaaaaa

SEQ ID NO: 6646174 - DNA, 23 bp, Homo sapiens
agggctctaaaaaaagccccaaa

SEQ ID NO: 6646175 - DNA, 23 bp, Homo sapiens
agggctctcaaagtataatcttt

SEQ ID NO: 6646176 - DNA, 18 bp, Homo sapiens
agggctctccaagcacta

SEQ ID NO: 6646177 - DNA, 14 bp, Homo sapiens
agggctctcctggc

SEQ ID NO: 6646178 - DNA, 16 bp, Homo sapiens
agggctctctggacca

SEQ ID NO: 6646179 - DNA, 19 bp, Homo sapiens
agggctctctttccttctt

SEQ ID NO: 6646180 - DNA, 17 bp, Homo sapiens
agggctctgacaaagct

SEQ ID NO: 6646181 - DNA, 14 bp, Homo sapiens
agggctctgaccag

SEQ ID NO: 6646182 - DNA, 18 bp, Homo sapiens
agggctctgagccaacct

SEQ ID NO: 6646183 - DNA, 12 bp, Homo sapiens
agggctctgagg

SEQ ID NO: 6646184 - DNA, 16 bp, Homo sapiens
agggctctgaggcgcc

SEQ ID NO: 6646185 - DNA, 19 bp, Homo sapiens
agggctctgatctaacaaa

SEQ ID NO: 6646186 - DNA, 12 bp, Homo sapiens
agggctctgcag

SEQ ID NO: 6646187 - DNA, 13 bp, Homo sapiens
agggctctgcagc

SEQ ID NO: 6646188 - DNA, 14 bp, Homo sapiens
agggctctgcagca

SEQ ID NO: 6646189 - DNA, 15 bp, Homo sapiens
agggctctgccccag

SEQ ID NO: 6646190 - DNA, 15 bp, Homo sapiens
agggctctggcaggt

SEQ ID NO: 6646191 - DNA, 15 bp, Homo sapiens
agggctctgggggca

SEQ ID NO: 6646192 - DNA, 16 bp, Homo sapiens
agggctctgggggcag

SEQ ID NO: 6646193 - DNA, 18 bp, Homo sapiens
agggctctgggggcagat

SEQ ID NO: 6646194 - DNA, 18 bp, Homo sapiens
agggctctgtgctgacat

SEQ ID NO: 6646195 - DNA, 14 bp, Homo sapiens
agggctgaaagcca

SEQ ID NO: 6646196 - DNA, 14 bp, Homo sapiens
agggctgaaccctc

SEQ ID NO: 6646197 - DNA, 14 bp, Homo sapiens
agggctgacaaggc

SEQ ID NO: 6646198 - DNA, 16 bp, Homo sapiens
agggctgacaaggcgt

SEQ ID NO: 6646199 - DNA, 17 bp, Homo sapiens
agggctgacctgcctct

SEQ ID NO: 6646200 - DNA, 16 bp, Homo sapiens
agggctgagagggctg

SEQ ID NO: 6646201 - DNA, 19 bp, Homo sapiens
agggctgagcacctctcag

SEQ ID NO: 6646202 - DNA, 16 bp, Homo sapiens
agggctgagcctggtc

SEQ ID NO: 6646203 - DNA, 14 bp, Homo sapiens
agggctgagcgtgg

SEQ ID NO: 6646204 - DNA, 15 bp, Homo sapiens
agggctgagcgtgga

SEQ ID NO: 6646205 - DNA, 19 bp, Homo sapiens
agggctgagcgtggaaggg

SEQ ID NO: 6646206 - DNA, 16 bp, Homo sapiens
agggctgagctgagct

SEQ ID NO: 6646207 - DNA, 15 bp, Homo sapiens
agggctgaggagcag

SEQ ID NO: 6646208 - DNA, 22 bp, Homo sapiens
agggctgaggagcagccaggac

SEQ ID NO: 6646209 - DNA, 23 bp, Homo sapiens
agggctgaggagcagccaggacc

SEQ ID NO: 6646210 - DNA, 16 bp, Homo sapiens
agggctgaggggcctg

SEQ ID NO: 6646211 - DNA, 19 bp, Homo sapiens
agggctgaggggcctgcgc

SEQ ID NO: 6646212 - DNA, 14 bp, Homo sapiens
agggctgagtcctt

SEQ ID NO: 6646213 - DNA, 22 bp, Homo sapiens
agggctgagtttgcacagtggt

SEQ ID NO: 6646214 - DNA, 20 bp, Homo sapiens
agggctgcaaaactggaagc

SEQ ID NO: 6646215 - DNA, 16 bp, Homo sapiens
agggctgcagagggag

SEQ ID NO: 6646216 - DNA, 23 bp, Homo sapiens
agggctgcaggggattctgtgtt

SEQ ID NO: 6646217 - DNA, 16 bp, Homo sapiens
agggctgcatgatgtt

SEQ ID NO: 6646218 - DNA, 22 bp, Homo sapiens
agggctgcatgatgtttgccca

SEQ ID NO: 6646219 - DNA, 13 bp, Homo sapiens
agggctgccacca

SEQ ID NO: 6646220 - DNA, 22 bp, Homo sapiens
agggctgccactaacctgtaga

SEQ ID NO: 6646221 - DNA, 23 bp, Homo sapiens
agggctgccactaacctgtagaa

SEQ ID NO: 6646222 - DNA, 14 bp, Homo sapiens
agggctgccagcag

SEQ ID NO: 6646223 - DNA, 16 bp, Homo sapiens
agggctgccagcagcc

SEQ ID NO: 6646224 - DNA, 21 bp, Homo sapiens
agggctgcccctaatctctgt

SEQ ID NO: 6646225 - DNA, 17 bp, Homo sapiens
agggctgccgggccagg

SEQ ID NO: 6646226 - DNA, 20 bp, Homo sapiens
agggctgcgagcatttccct

SEQ ID NO: 6646227 - DNA, 22 bp, Homo sapiens
agggctgctccccaacacctgc

SEQ ID NO: 6646228 - DNA, 18 bp, Homo sapiens
agggctgctgcttctgct

SEQ ID NO: 6646229 - DNA, 23 bp, Homo sapiens
agggctgctgcttctgctccagc

SEQ ID NO: 6646230 - DNA, 19 bp, Homo sapiens
agggctgctgggagcctct

SEQ ID NO: 6646231 - DNA, 13 bp, Homo sapiens
agggctgctgtga

SEQ ID NO: 6646232 - DNA, 15 bp, Homo sapiens
agggctgctgtggcc

SEQ ID NO: 6646233 - DNA, 15 bp, Homo sapiens
agggctgcttttctt

SEQ ID NO: 6646234 - DNA, 12 bp, Homo sapiens
agggctggacct

SEQ ID NO: 6646235 - DNA, 13 bp, Homo sapiens
agggctggaccta

SEQ ID NO: 6646236 - DNA, 22 bp, Homo sapiens
agggctggacctatgtcctaag

SEQ ID NO: 6646237 - DNA, 14 bp, Homo sapiens
agggctggagaaca

SEQ ID NO: 6646238 - DNA, 22 bp, Homo sapiens
agggctggagaccagaacagca

SEQ ID NO: 6646239 - DNA, 15 bp, Homo sapiens
agggctggagcctgg

SEQ ID NO: 6646240 - DNA, 17 bp, Homo sapiens
agggctggagcctgggg

SEQ ID NO: 6646241 - DNA, 16 bp, Homo sapiens
agggctggaggcccag

SEQ ID NO: 6646242 - DNA, 19 bp, Homo sapiens
agggctggaggcccaggct

SEQ ID NO: 6646243 - DNA, 19 bp, Homo sapiens
agggctggagtgcgctctt

SEQ ID NO: 6646244 - DNA, 21 bp, Homo sapiens
agggctggatggacagacacc

SEQ ID NO: 6646245 - DNA, 23 bp, Homo sapiens
agggctggatggacagacacctc

SEQ ID NO: 6646246 - DNA, 19 bp, Homo sapiens
agggctggattggcaggtg

SEQ ID NO: 6646247 - DNA, 21 bp, Homo sapiens
agggctggcacgtgacaggct

SEQ ID NO: 6646248 - DNA, 17 bp, Homo sapiens
agggctggcccagccct

SEQ ID NO: 6646249 - DNA, 18 bp, Homo sapiens
agggctggccccagggca

SEQ ID NO: 6646250 - DNA, 19 bp, Homo sapiens
agggctggccccagggcac

SEQ ID NO: 6646251 - DNA, 22 bp, Homo sapiens
agggctggccccagggcaccct

SEQ ID NO: 6646252 - DNA, 23 bp, Homo sapiens
agggctggcccggggagtccccg

SEQ ID NO: 6646253 - DNA, 20 bp, Homo sapiens
agggctggccctaggcactg

SEQ ID NO: 6646254 - DNA, 18 bp, Homo sapiens
agggctggccgggactgc

SEQ ID NO: 6646255 - DNA, 22 bp, Homo sapiens
agggctggccgggactgctgct

SEQ ID NO: 6646256 - DNA, 23 bp, Homo sapiens
agggctggccgggactgctgctc

SEQ ID NO: 6646257 - DNA, 12 bp, Homo sapiens
agggctggctcc

SEQ ID NO: 6646258 - DNA, 16 bp, Homo sapiens
agggctggctccccct

SEQ ID NO: 6646259 - DNA, 16 bp, Homo sapiens
agggctggctcctgat

SEQ ID NO: 6646260 - DNA, 17 bp, Homo sapiens
agggctggctcctgatc

SEQ ID NO: 6646261 - DNA, 12 bp, Homo sapiens
agggctggctct

SEQ ID NO: 6646262 - DNA, 13 bp, Homo sapiens
agggctggctctg

SEQ ID NO: 6646263 - DNA, 12 bp, Homo sapiens
agggctggctgg

SEQ ID NO: 6646264 - DNA, 16 bp, Homo sapiens
agggctgggaaacact

SEQ ID NO: 6646265 - DNA, 23 bp, Homo sapiens
agggctgggaaacactccttgca

SEQ ID NO: 6646266 - DNA, 14 bp, Homo sapiens
agggctgggaggaa

SEQ ID NO: 6646267 - DNA, 17 bp, Homo sapiens
agggctgggcagggccc

SEQ ID NO: 6646268 - DNA, 18 bp, Homo sapiens
agggctgggcagggccct

SEQ ID NO: 6646269 - DNA, 20 bp, Homo sapiens
agggctgggcagggccctgt

SEQ ID NO: 6646270 - DNA, 22 bp, Homo sapiens
agggctgggcagggccctgtgg

SEQ ID NO: 6646271 - DNA, 21 bp, Homo sapiens
agggctgggcaggtcctgggg

SEQ ID NO: 6646272 - DNA, 22 bp, Homo sapiens
agggctgggcaggtcctgggga

SEQ ID NO: 6646273 - DNA, 12 bp, Homo sapiens
agggctgggcca

SEQ ID NO: 6646274 - DNA, 15 bp, Homo sapiens
agggctgggccacca

SEQ ID NO: 6646275 - DNA, 23 bp, Homo sapiens
agggctgggctagaaagaccact

SEQ ID NO: 6646276 - DNA, 14 bp, Homo sapiens
agggctggggactg

SEQ ID NO: 6646277 - DNA, 15 bp, Homo sapiens
agggctggggcggag

SEQ ID NO: 6646278 - DNA, 16 bp, Homo sapiens
agggctggggctgagc

SEQ ID NO: 6646279 - DNA, 23 bp, Homo sapiens
agggctggggttgccagaggccc

SEQ ID NO: 6646280 - DNA, 17 bp, Homo sapiens
agggctgggtaggcagg

SEQ ID NO: 6646281 - DNA, 16 bp, Homo sapiens
agggctggtctctgct

SEQ ID NO: 6646282 - DNA, 15 bp, Homo sapiens
agggctggtggccac

SEQ ID NO: 6646283 - DNA, 21 bp, Homo sapiens
agggctggtgtggctgctccc

SEQ ID NO: 6646284 - DNA, 13 bp, Homo sapiens
agggctggtttgt

SEQ ID NO: 6646285 - DNA, 16 bp, Homo sapiens
agggctggtttgttct

SEQ ID NO: 6646286 - DNA, 18 bp, Homo sapiens
agggctgtcatctgtgca

SEQ ID NO: 6646287 - DNA, 19 bp, Homo sapiens
agggctgtcatctgtgcac

SEQ ID NO: 6646288 - DNA, 13 bp, Homo sapiens
agggctgtcccag

SEQ ID NO: 6646289 - DNA, 14 bp, Homo sapiens
agggctgtcccagc

SEQ ID NO: 6646290 - DNA, 12 bp, Homo sapiens
agggctgtcctt

SEQ ID NO: 6646291 - DNA, 23 bp, Homo sapiens
agggctgtgagcatcctggcagg

SEQ ID NO: 6646292 - DNA, 23 bp, Homo sapiens
agggctgtgcttgaaggccctgc

SEQ ID NO: 6646293 - DNA, 13 bp, Homo sapiens
agggctgtggctg

SEQ ID NO: 6646294 - DNA, 18 bp, Homo sapiens
agggctgtggctgggtgg

SEQ ID NO: 6646295 - DNA, 17 bp, Homo sapiens
agggctgtgggtgggga

SEQ ID NO: 6646296 - DNA, 16 bp, Homo sapiens
agggctgtgtgaaaca

SEQ ID NO: 6646297 - DNA, 19 bp, Homo sapiens
agggctgttccctccaggc

SEQ ID NO: 6646298 - DNA, 20 bp, Homo sapiens
agggctgttccctccaggca

SEQ ID NO: 6646299 - DNA, 23 bp, Homo sapiens
agggctgttgatttatgctttaa

SEQ ID NO: 6646300 - DNA, 18 bp, Homo sapiens
agggctgttgctagggag

SEQ ID NO: 6646301 - DNA, 21 bp, Homo sapiens
agggctgttgctagggagagg

SEQ ID NO: 6646302 - DNA, 19 bp, Homo sapiens
agggctgttggacagctgc

SEQ ID NO: 6646303 - DNA, 19 bp, Homo sapiens
agggcttacggccctggcc

SEQ ID NO: 6646304 - DNA, 19 bp, Homo sapiens
agggcttatctagccaaag

SEQ ID NO: 6646305 - DNA, 16 bp, Homo sapiens
agggcttcagatattt

SEQ ID NO: 6646306 - DNA, 20 bp, Homo sapiens
agggcttccccatcagctcc

SEQ ID NO: 6646307 - DNA, 16 bp, Homo sapiens
agggcttcctcaaata

SEQ ID NO: 6646308 - DNA, 13 bp, Homo sapiens
agggcttcctctt

SEQ ID NO: 6646309 - DNA, 15 bp, Homo sapiens
agggcttctcctctg

SEQ ID NO: 6646310 - DNA, 13 bp, Homo sapiens
agggcttctcctg

SEQ ID NO: 6646311 - DNA, 14 bp, Homo sapiens
agggcttctgcacc

SEQ ID NO: 6646312 - DNA, 17 bp, Homo sapiens
agggcttctgcaccctc

SEQ ID NO: 6646313 - DNA, 18 bp, Homo sapiens
agggcttctgcaccctcc

SEQ ID NO: 6646314 - DNA, 22 bp, Homo sapiens
agggcttctgcaccctccaccc

SEQ ID NO: 6646315 - DNA, 23 bp, Homo sapiens
agggcttctgccatttctgagat

SEQ ID NO: 6646316 - DNA, 15 bp, Homo sapiens
agggcttctgtggtt

SEQ ID NO: 6646317 - DNA, 18 bp, Homo sapiens
agggcttgacacctttga

SEQ ID NO: 6646318 - DNA, 14 bp, Homo sapiens
agggcttgagagct

SEQ ID NO: 6646319 - DNA, 13 bp, Homo sapiens
agggcttggggag

SEQ ID NO: 6646320 - DNA, 16 bp, Homo sapiens
agggcttggggctgca

SEQ ID NO: 6646321 - DNA, 19 bp, Homo sapiens
agggcttggtaaaacacag

SEQ ID NO: 6646322 - DNA, 19 bp, Homo sapiens
agggcttgtagttctttaa

SEQ ID NO: 6646323 - DNA, 20 bp, Homo sapiens
agggcttgtcacagtctcta

SEQ ID NO: 6646324 - DNA, 21 bp, Homo sapiens
agggcttgtggactctctgcc

SEQ ID NO: 6646325 - DNA, 20 bp, Homo sapiens
agggcttgtttttcttcagc

SEQ ID NO: 6646326 - DNA, 13 bp, Homo sapiens
agggctttaaata

SEQ ID NO: 6646327 - DNA, 14 bp, Homo sapiens
agggctttaaataa

SEQ ID NO: 6646328 - DNA, 16 bp, Homo sapiens
agggctttaaataaaa

SEQ ID NO: 6646329 - DNA, 20 bp, Homo sapiens
agggctttgaatctgggact

SEQ ID NO: 6646330 - DNA, 21 bp, Homo sapiens
agggctttgaatctgggactg

SEQ ID NO: 6646331 - DNA, 17 bp, Homo sapiens
agggctttgagggtgga

SEQ ID NO: 6646332 - DNA, 22 bp, Homo sapiens
agggctttgagggtggaaggat

SEQ ID NO: 6646333 - DNA, 17 bp, Homo sapiens
agggctttggttccttc

SEQ ID NO: 6646334 - DNA, 23 bp, Homo sapiens
agggctttttaaatttggtgccg

SEQ ID NO: 6646335 - DNA, 15 bp, Homo sapiens
aggggaaaaaaatgt

SEQ ID NO: 6646336 - DNA, 16 bp, Homo sapiens
aggggaaaaaaatgtt

SEQ ID NO: 6646337 - DNA, 16 bp, Homo sapiens
aggggaaaaaactcgg

SEQ ID NO: 6646338 - DNA, 16 bp, Homo sapiens
aggggaaaacctcagt

SEQ ID NO: 6646339 - DNA, 15 bp, Homo sapiens
aggggaaaactgtta

SEQ ID NO: 6646340 - DNA, 13 bp, Homo sapiens
aggggaaaagagg

SEQ ID NO: 6646341 - DNA, 23 bp, Homo sapiens
aggggaaaccttcacccagcacc

SEQ ID NO: 6646342 - DNA, 20 bp, Homo sapiens
aggggaaacgtctcccagat

SEQ ID NO: 6646343 - DNA, 14 bp, Homo sapiens
aggggaaactctgg

SEQ ID NO: 6646344 - DNA, 17 bp, Homo sapiens
aggggaaagacttccat

SEQ ID NO: 6646345 - DNA, 20 bp, Homo sapiens
aggggaaaggcctgtgggga

SEQ ID NO: 6646346 - DNA, 18 bp, Homo sapiens
aggggaaatggggaaagc

SEQ ID NO: 6646347 - DNA, 23 bp, Homo sapiens
aggggaacaaggagttctcttcc

SEQ ID NO: 6646348 - DNA, 15 bp, Homo sapiens
aggggaacctgccat

SEQ ID NO: 6646349 - DNA, 14 bp, Homo sapiens
aggggaagaaaaac

SEQ ID NO: 6646350 - DNA, 22 bp, Homo sapiens
aggggaagaaacactttctctt

SEQ ID NO: 6646351 - DNA, 13 bp, Homo sapiens
aggggaagaatga

SEQ ID NO: 6646352 - DNA, 14 bp, Homo sapiens
aggggaagaccaaa

SEQ ID NO: 6646353 - DNA, 18 bp, Homo sapiens
aggggaagaccaaagttt

SEQ ID NO: 6646354 - DNA, 15 bp, Homo sapiens
aggggaagagagagg

SEQ ID NO: 6646355 - DNA, 23 bp, Homo sapiens
aggggaagagggaaatgtacact

SEQ ID NO: 6646356 - DNA, 16 bp, Homo sapiens
aggggaagagtgtact

SEQ ID NO: 6646357 - DNA, 15 bp, Homo sapiens
aggggaagcaggacc

SEQ ID NO: 6646358 - DNA, 15 bp, Homo sapiens
aggggaagccagtga

SEQ ID NO: 6646359 - DNA, 17 bp, Homo sapiens
aggggaagccagtgaca

SEQ ID NO: 6646360 - DNA, 15 bp, Homo sapiens
aggggaagctgcagc

SEQ ID NO: 6646361 - DNA, 14 bp, Homo sapiens
aggggaagctgcta

SEQ ID NO: 6646362 - DNA, 16 bp, Homo sapiens
aggggaagctgggccc

SEQ ID NO: 6646363 - DNA, 17 bp, Homo sapiens
aggggaaggagaagtaa

SEQ ID NO: 6646364 - DNA, 14 bp, Homo sapiens
aggggaagggggtg

SEQ ID NO: 6646365 - DNA, 19 bp, Homo sapiens
aggggaagtgtgctgaggt

SEQ ID NO: 6646366 - DNA, 23 bp, Homo sapiens
aggggaagtgtgctgaggtgggc

SEQ ID NO: 6646367 - DNA, 14 bp, Homo sapiens
aggggaatgaacca

SEQ ID NO: 6646368 - DNA, 17 bp, Homo sapiens
aggggaatgagggggct

SEQ ID NO: 6646369 - DNA, 22 bp, Homo sapiens
aggggaatggaagagaaaagac

SEQ ID NO: 6646370 - DNA, 15 bp, Homo sapiens
aggggaatgtgtcct

SEQ ID NO: 6646371 - DNA, 19 bp, Homo sapiens
aggggaatgtgtcctcctg

SEQ ID NO: 6646372 - DNA, 23 bp, Homo sapiens
aggggaatgtgtcctcctgctct

SEQ ID NO: 6646373 - DNA, 13 bp, Homo sapiens
aggggaatgtttt

SEQ ID NO: 6646374 - DNA, 21 bp, Homo sapiens
aggggaattccctccccctcc

SEQ ID NO: 6646375 - DNA, 22 bp, Homo sapiens
aggggaattccctccccctcct

SEQ ID NO: 6646376 - DNA, 16 bp, Homo sapiens
aggggaattgaggaca

SEQ ID NO: 6646377 - DNA, 14 bp, Homo sapiens
aggggaatttcagg

SEQ ID NO: 6646378 - DNA, 18 bp, Homo sapiens
aggggacaagccaggccc

SEQ ID NO: 6646379 - DNA, 15 bp, Homo sapiens
aggggacaaggaagg

SEQ ID NO: 6646380 - DNA, 16 bp, Homo sapiens
aggggacactgaacct

SEQ ID NO: 6646381 - DNA, 12 bp, Homo sapiens
aggggacagagc

SEQ ID NO: 6646382 - DNA, 15 bp, Homo sapiens
aggggacagagctga

SEQ ID NO: 6646383 - DNA, 16 bp, Homo sapiens
aggggacagagctgag

SEQ ID NO: 6646384 - DNA, 16 bp, Homo sapiens
aggggacagaggccct

SEQ ID NO: 6646385 - DNA, 15 bp, Homo sapiens
aggggacagatcttg

SEQ ID NO: 6646386 - DNA, 21 bp, Homo sapiens
aggggacaggcctcacctcta

SEQ ID NO: 6646387 - DNA, 14 bp, Homo sapiens
aggggacatcgcca

SEQ ID NO: 6646388 - DNA, 19 bp, Homo sapiens
aggggacatttccctcctg

SEQ ID NO: 6646389 - DNA, 20 bp, Homo sapiens
aggggacatttccctcctgg

SEQ ID NO: 6646390 - DNA, 24 bp, Homo sapiens
aggggaccaattctggacagacag

SEQ ID NO: 6646391 - DNA, 15 bp, Homo sapiens
aggggaccagaggga

SEQ ID NO: 6646392 - DNA, 22 bp, Homo sapiens
aggggaccaggagtgggtgggg

SEQ ID NO: 6646393 - DNA, 13 bp, Homo sapiens
aggggacccaaga

SEQ ID NO: 6646394 - DNA, 13 bp, Homo sapiens
aggggacccagcg

SEQ ID NO: 6646395 - DNA, 16 bp, Homo sapiens
aggggacccagcgccg

SEQ ID NO: 6646396 - DNA, 16 bp, Homo sapiens
aggggacccagctcct

SEQ ID NO: 6646397 - DNA, 19 bp, Homo sapiens
aggggacccagctcctctg

SEQ ID NO: 6646398 - DNA, 21 bp, Homo sapiens
aggggacccagctcctctgag

SEQ ID NO: 6646399 - DNA, 13 bp, Homo sapiens
aggggacctggaa

SEQ ID NO: 6646400 - DNA, 19 bp, Homo sapiens
aggggacctggagctgcca

SEQ ID NO: 6646401 - DNA, 21 bp, Homo sapiens
aggggacctggagctgccagc

SEQ ID NO: 6646402 - DNA, 15 bp, Homo sapiens
aggggacgcaggccc

SEQ ID NO: 6646403 - DNA, 17 bp, Homo sapiens
aggggacgcaggcccct

SEQ ID NO: 6646404 - DNA, 22 bp, Homo sapiens
aggggacgcaggcccctctcct

SEQ ID NO: 6646405 - DNA, 17 bp, Homo sapiens
aggggacgctgaggaag

SEQ ID NO: 6646406 - DNA, 14 bp, Homo sapiens
aggggactcagccc

SEQ ID NO: 6646407 - DNA, 20 bp, Homo sapiens
aggggactgcatgcaagctc

SEQ ID NO: 6646408 - DNA, 18 bp, Homo sapiens
aggggactgggggactgg

SEQ ID NO: 6646409 - DNA, 14 bp, Homo sapiens
aggggactgttcct

SEQ ID NO: 6646410 - DNA, 15 bp, Homo sapiens
aggggacttggggat

SEQ ID NO: 6646411 - DNA, 15 bp, Homo sapiens
aggggacttgtgcca

SEQ ID NO: 6646412 - DNA, 21 bp, Homo sapiens
aggggagaaactgaaagtgtt

SEQ ID NO: 6646413 - DNA, 22 bp, Homo sapiens
aggggagaaactgaaagtgttt

SEQ ID NO: 6646414 - DNA, 16 bp, Homo sapiens
aggggagaagagccct

SEQ ID NO: 6646415 - DNA, 15 bp, Homo sapiens
aggggagaagctgaa

SEQ ID NO: 6646416 - DNA, 16 bp, Homo sapiens
aggggagaagctgaag

SEQ ID NO: 6646417 - DNA, 17 bp, Homo sapiens
aggggagaagctgaagc

SEQ ID NO: 6646418 - DNA, 16 bp, Homo sapiens
aggggagaagggccag

SEQ ID NO: 6646419 - DNA, 20 bp, Homo sapiens
aggggagaagggccagccct

SEQ ID NO: 6646420 - DNA, 17 bp, Homo sapiens
aggggagaatgcagccc

SEQ ID NO: 6646421 - DNA, 16 bp, Homo sapiens
aggggagacagagcaa

SEQ ID NO: 6646422 - DNA, 19 bp, Homo sapiens
aggggagacctcagaagta

SEQ ID NO: 6646423 - DNA, 12 bp, Homo sapiens
aggggagagaga

SEQ ID NO: 6646424 - DNA, 15 bp, Homo sapiens
aggggagagagggac

SEQ ID NO: 6646425 - DNA, 16 bp, Homo sapiens
aggggagagagggact

SEQ ID NO: 6646426 - DNA, 21 bp, Homo sapiens
aggggagagatctccaactct

SEQ ID NO: 6646427 - DNA, 16 bp, Homo sapiens
aggggagagggacgca

SEQ ID NO: 6646428 - DNA, 14 bp, Homo sapiens
aggggagaggtcag

SEQ ID NO: 6646429 - DNA, 20 bp, Homo sapiens
aggggagatgctgggatagc

SEQ ID NO: 6646430 - DNA, 23 bp, Homo sapiens
aggggagcaaaatcgatgcagtg

SEQ ID NO: 6646431 - DNA, 20 bp, Homo sapiens
aggggagcagaggggcagag

SEQ ID NO: 6646432 - DNA, 21 bp, Homo sapiens
aggggagcagcggctctggtc

SEQ ID NO: 6646433 - DNA, 18 bp, Homo sapiens
aggggagcatgggaagtg

SEQ ID NO: 6646434 - DNA, 17 bp, Homo sapiens
aggggagccaaggagga

SEQ ID NO: 6646435 - DNA, 13 bp, Homo sapiens
aggggagccagga

SEQ ID NO: 6646436 - DNA, 15 bp, Homo sapiens
aggggagccaggagg

SEQ ID NO: 6646437 - DNA, 16 bp, Homo sapiens
aggggagccagggtag

SEQ ID NO: 6646438 - DNA, 17 bp, Homo sapiens
aggggagcccactgtcc

SEQ ID NO: 6646439 - DNA, 21 bp, Homo sapiens
aggggagcccactgtcctggg

SEQ ID NO: 6646440 - DNA, 14 bp, Homo sapiens
aggggagctgctgg

SEQ ID NO: 6646441 - DNA, 23 bp, Homo sapiens
aggggagctgctggccatggctg

SEQ ID NO: 6646442 - DNA, 12 bp, Homo sapiens
aggggaggaaaa

SEQ ID NO: 6646443 - DNA, 23 bp, Homo sapiens
aggggaggaaaaaagaaccaaaa

SEQ ID NO: 6646444 - DNA, 16 bp, Homo sapiens
aggggaggacactggt

SEQ ID NO: 6646445 - DNA, 17 bp, Homo sapiens
aggggaggacctctggg

SEQ ID NO: 6646446 - DNA, 13 bp, Homo sapiens
aggggaggagatg

SEQ ID NO: 6646447 - DNA, 16 bp, Homo sapiens
aggggaggagcctgtg

SEQ ID NO: 6646448 - DNA, 23 bp, Homo sapiens
aggggaggcacactttctggcaa

SEQ ID NO: 6646449 - DNA, 13 bp, Homo sapiens
aggggaggcagcc

SEQ ID NO: 6646450 - DNA, 17 bp, Homo sapiens
aggggaggcatcagtgt

SEQ ID NO: 6646451 - DNA, 12 bp, Homo sapiens
aggggaggctga

SEQ ID NO: 6646452 - DNA, 14 bp, Homo sapiens
aggggagggcaggc

SEQ ID NO: 6646453 - DNA, 11 bp, Homo sapiens
aggggaggggc

SEQ ID NO: 6646454 - DNA, 15 bp, Homo sapiens
aggggaggggcctag

SEQ ID NO: 6646455 - DNA, 17 bp, Homo sapiens
aggggagggggcaaagg

SEQ ID NO: 6646456 - DNA, 14 bp, Homo sapiens
aggggaggggggag

SEQ ID NO: 6646457 - DNA, 22 bp, Homo sapiens
aggggaggggggagccagaggc

SEQ ID NO: 6646458 - DNA, 18 bp, Homo sapiens
aggggagggtcagccagg

SEQ ID NO: 6646459 - DNA, 19 bp, Homo sapiens
aggggagggtcagccaggg

SEQ ID NO: 6646460 - DNA, 19 bp, Homo sapiens
aggggaggtggccagcccg

SEQ ID NO: 6646461 - DNA, 21 bp, Homo sapiens
aggggaggtggccagcccgca

SEQ ID NO: 6646462 - DNA, 23 bp, Homo sapiens
aggggaggtggccagcccgcaga

SEQ ID NO: 6646463 - DNA, 12 bp, Homo sapiens
aggggagtagag

SEQ ID NO: 6646464 - DNA, 21 bp, Homo sapiens
aggggagtaggtgggggaaca

SEQ ID NO: 6646465 - DNA, 16 bp, Homo sapiens
aggggagtcaccttcc

SEQ ID NO: 6646466 - DNA, 18 bp, Homo sapiens
aggggagtctgcttgtct

SEQ ID NO: 6646467 - DNA, 16 bp, Homo sapiens
aggggagtgtgggtga

SEQ ID NO: 6646468 - DNA, 16 bp, Homo sapiens
aggggagttgtgtctg

SEQ ID NO: 6646469 - DNA, 23 bp, Homo sapiens
aggggatatagtgatggggctca

SEQ ID NO: 6646470 - DNA, 21 bp, Homo sapiens
aggggatatatgtttgtggaa

SEQ ID NO: 6646471 - DNA, 20 bp, Homo sapiens
aggggatatttactgctctt

SEQ ID NO: 6646472 - DNA, 20 bp, Homo sapiens
aggggatcataaagttagaa

SEQ ID NO: 6646473 - DNA, 23 bp, Homo sapiens
aggggatcatgttaaaaatagca

SEQ ID NO: 6646474 - DNA, 14 bp, Homo sapiens
aggggatccagcca

SEQ ID NO: 6646475 - DNA, 17 bp, Homo sapiens
aggggatccagccactt

SEQ ID NO: 6646476 - DNA, 22 bp, Homo sapiens
aggggatccagctcaagggagt

SEQ ID NO: 6646477 - DNA, 13 bp, Homo sapiens
aggggatctaaaa

SEQ ID NO: 6646478 - DNA, 23 bp, Homo sapiens
aggggatctaaaaggaggacagg

SEQ ID NO: 6646479 - DNA, 24 bp, Homo sapiens
aggggatctaaaaggaggacaggg

SEQ ID NO: 6646480 - DNA, 19 bp, Homo sapiens
aggggatgcccagaagagt

SEQ ID NO: 6646481 - DNA, 19 bp, Homo sapiens
aggggatggaattcttcct

SEQ ID NO: 6646482 - DNA, 21 bp, Homo sapiens
aggggatggacacccccagct

SEQ ID NO: 6646483 - DNA, 14 bp, Homo sapiens
aggggatggaggcc

SEQ ID NO: 6646484 - DNA, 16 bp, Homo sapiens
aggggatggaggccag

SEQ ID NO: 6646485 - DNA, 19 bp, Homo sapiens
aggggatggaggccagagt

SEQ ID NO: 6646486 - DNA, 21 bp, Homo sapiens
aggggatggagtgagcccatg

SEQ ID NO: 6646487 - DNA, 16 bp, Homo sapiens
aggggatggcagacag

SEQ ID NO: 6646488 - DNA, 18 bp, Homo sapiens
aggggatggggatagagg

SEQ ID NO: 6646489 - DNA, 16 bp, Homo sapiens
aggggatgggtgtgga

SEQ ID NO: 6646490 - DNA, 15 bp, Homo sapiens
aggggatggtgttgt

SEQ ID NO: 6646491 - DNA, 17 bp, Homo sapiens
aggggattgaagccctc

SEQ ID NO: 6646492 - DNA, 18 bp, Homo sapiens
aggggatttttatgtctg

SEQ ID NO: 6646493 - DNA, 20 bp, Homo sapiens
aggggcaaaagtcattgctg

SEQ ID NO: 6646494 - DNA, 19 bp, Homo sapiens
aggggcaaacacctgctga

SEQ ID NO: 6646495 - DNA, 14 bp, Homo sapiens
aggggcaaacatca

SEQ ID NO: 6646496 - DNA, 21 bp, Homo sapiens
aggggcaaccaactgccccag

SEQ ID NO: 6646497 - DNA, 22 bp, Homo sapiens
aggggcaaccaactgccccagg

SEQ ID NO: 6646498 - DNA, 23 bp, Homo sapiens
aggggcaaccaactgccccaggg

SEQ ID NO: 6646499 - DNA, 16 bp, Homo sapiens
aggggcaagctaggcc

SEQ ID NO: 6646500 - DNA, 19 bp, Homo sapiens
aggggcaaggggctggctg

SEQ ID NO: 6646501 - DNA, 22 bp, Homo sapiens
aggggcacctatgagatggcca

SEQ ID NO: 6646502 - DNA, 20 bp, Homo sapiens
aggggcacctccggctgcct

SEQ ID NO: 6646503 - DNA, 17 bp, Homo sapiens
aggggcacctgccaccg

SEQ ID NO: 6646504 - DNA, 19 bp, Homo sapiens
aggggcacctgccaccgcc

SEQ ID NO: 6646505 - DNA, 22 bp, Homo sapiens
aggggcacctgccaccgccaga

SEQ ID NO: 6646506 - DNA, 17 bp, Homo sapiens
aggggcacgcctgccca

SEQ ID NO: 6646507 - DNA, 20 bp, Homo sapiens
aggggcacgcctgcccagcc

SEQ ID NO: 6646508 - DNA, 13 bp, Homo sapiens
aggggcactctcc

SEQ ID NO: 6646509 - DNA, 20 bp, Homo sapiens
aggggcagaaggaggaaggg

SEQ ID NO: 6646510 - DNA, 16 bp, Homo sapiens
aggggcagagaggaag

SEQ ID NO: 6646511 - DNA, 13 bp, Homo sapiens
aggggcagagcca

SEQ ID NO: 6646512 - DNA, 15 bp, Homo sapiens
aggggcagagccagg

SEQ ID NO: 6646513 - DNA, 17 bp, Homo sapiens
aggggcagagccaggaa

SEQ ID NO: 6646514 - DNA, 15 bp, Homo sapiens
aggggcagatggaaa

SEQ ID NO: 6646515 - DNA, 20 bp, Homo sapiens
aggggcagatgttcccggag

SEQ ID NO: 6646516 - DNA, 15 bp, Homo sapiens
aggggcagcaaggcc

SEQ ID NO: 6646517 - DNA, 16 bp, Homo sapiens
aggggcagccagccct

SEQ ID NO: 6646518 - DNA, 13 bp, Homo sapiens
aggggcagccctg

SEQ ID NO: 6646519 - DNA, 16 bp, Homo sapiens
aggggcagcccttgct

SEQ ID NO: 6646520 - DNA, 13 bp, Homo sapiens
aggggcagccgct

SEQ ID NO: 6646521 - DNA, 18 bp, Homo sapiens
aggggcagcctgtgcctg

SEQ ID NO: 6646522 - DNA, 14 bp, Homo sapiens
aggggcagctgacc

SEQ ID NO: 6646523 - DNA, 15 bp, Homo sapiens
aggggcagcttctat

SEQ ID NO: 6646524 - DNA, 22 bp, Homo sapiens
aggggcaggaatcaaggagcct

SEQ ID NO: 6646525 - DNA, 20 bp, Homo sapiens
aggggcaggactgagtcccc

SEQ ID NO: 6646526 - DNA, 14 bp, Homo sapiens
aggggcaggagagg

SEQ ID NO: 6646527 - DNA, 20 bp, Homo sapiens
aggggcaggagctcagatga

SEQ ID NO: 6646528 - DNA, 12 bp, Homo sapiens
aggggcaggagg

SEQ ID NO: 6646529 - DNA, 13 bp, Homo sapiens
aggggcaggagga

SEQ ID NO: 6646530 - DNA, 16 bp, Homo sapiens
aggggcaggcacagca

SEQ ID NO: 6646531 - DNA, 17 bp, Homo sapiens
aggggcaggcacagcac

SEQ ID NO: 6646532 - DNA, 12 bp, Homo sapiens
aggggcaggcag

SEQ ID NO: 6646533 - DNA, 13 bp, Homo sapiens
aggggcaggcagc

SEQ ID NO: 6646534 - DNA, 15 bp, Homo sapiens
aggggcaggcagcta

SEQ ID NO: 6646535 - DNA, 15 bp, Homo sapiens
aggggcaggccctgc

SEQ ID NO: 6646536 - DNA, 23 bp, Homo sapiens
aggggcaggccctgcactgtcct

SEQ ID NO: 6646537 - DNA, 17 bp, Homo sapiens
aggggcaggcctgggac

SEQ ID NO: 6646538 - DNA, 22 bp, Homo sapiens
aggggcaggcctgggacccagc

SEQ ID NO: 6646539 - DNA, 23 bp, Homo sapiens
aggggcaggcctgggacccagct

SEQ ID NO: 6646540 - DNA, 22 bp, Homo sapiens
aggggcaggcctttttgagcca

SEQ ID NO: 6646541 - DNA, 20 bp, Homo sapiens
aggggcaggcgcagaggtcc

SEQ ID NO: 6646542 - DNA, 13 bp, Homo sapiens
aggggcaggctga

SEQ ID NO: 6646543 - DNA, 16 bp, Homo sapiens
aggggcagggaaggac

SEQ ID NO: 6646544 - DNA, 14 bp, Homo sapiens
aggggcagggagag

SEQ ID NO: 6646545 - DNA, 15 bp, Homo sapiens
aggggcagggagagc

SEQ ID NO: 6646546 - DNA, 13 bp, Homo sapiens
aggggcaggtcta

SEQ ID NO: 6646547 - DNA, 16 bp, Homo sapiens
aggggcagtctggagg

SEQ ID NO: 6646548 - DNA, 18 bp, Homo sapiens
aggggcagtctggagggg

SEQ ID NO: 6646549 - DNA, 16 bp, Homo sapiens
aggggcagtcttgcaa

SEQ ID NO: 6646550 - DNA, 15 bp, Homo sapiens
aggggcatctgcccc

SEQ ID NO: 6646551 - DNA, 19 bp, Homo sapiens
aggggcatctgcccctccc

SEQ ID NO: 6646552 - DNA, 21 bp, Homo sapiens
aggggcatctgcccctccccc

SEQ ID NO: 6646553 - DNA, 18 bp, Homo sapiens
aggggcatgactgtcgcc

SEQ ID NO: 6646554 - DNA, 13 bp, Homo sapiens
aggggcatgggaa

SEQ ID NO: 6646555 - DNA, 19 bp, Homo sapiens
aggggcatgtattggcctg

SEQ ID NO: 6646556 - DNA, 20 bp, Homo sapiens
aggggcatgtattggcctgg

SEQ ID NO: 6646557 - DNA, 22 bp, Homo sapiens
aggggcatgtattggcctggag

SEQ ID NO: 6646558 - DNA, 23 bp, Homo sapiens
aggggcatgtattggcctggagg

SEQ ID NO: 6646559 - DNA, 17 bp, Homo sapiens
aggggcattcacaaggc

SEQ ID NO: 6646560 - DNA, 23 bp, Homo sapiens
aggggcatttagggagcagatga

SEQ ID NO: 6646561 - DNA, 16 bp, Homo sapiens
aggggccaacctcagg

SEQ ID NO: 6646562 - DNA, 22 bp, Homo sapiens
aggggccaacctcaggctccta

SEQ ID NO: 6646563 - DNA, 20 bp, Homo sapiens
aggggccaccacctttggct

SEQ ID NO: 6646564 - DNA, 14 bp, Homo sapiens
aggggccacctcct

SEQ ID NO: 6646565 - DNA, 16 bp, Homo sapiens
aggggccacctcctcc

SEQ ID NO: 6646566 - DNA, 21 bp, Homo sapiens
aggggccacctcctccccctg

SEQ ID NO: 6646567 - DNA, 11 bp, Homo sapiens
aggggccactg

SEQ ID NO: 6646568 - DNA, 22 bp, Homo sapiens
aggggccactgacccacctgcg

SEQ ID NO: 6646569 - DNA, 14 bp, Homo sapiens
aggggccagaccac

SEQ ID NO: 6646570 - DNA, 21 bp, Homo sapiens
aggggccagagagcaggggag

SEQ ID NO: 6646571 - DNA, 13 bp, Homo sapiens
aggggccagagcc

SEQ ID NO: 6646572 - DNA, 22 bp, Homo sapiens
aggggccagagccttggaggac

SEQ ID NO: 6646573 - DNA, 14 bp, Homo sapiens
aggggccagaggct

SEQ ID NO: 6646574 - DNA, 15 bp, Homo sapiens
aggggccagaggctc

SEQ ID NO: 6646575 - DNA, 15 bp, Homo sapiens
aggggccagcagagg

SEQ ID NO: 6646576 - DNA, 23 bp, Homo sapiens
aggggccagcggccctcccaggc

SEQ ID NO: 6646577 - DNA, 13 bp, Homo sapiens
aggggccaggaag

SEQ ID NO: 6646578 - DNA, 13 bp, Homo sapiens
aggggccaggagt

SEQ ID NO: 6646579 - DNA, 12 bp, Homo sapiens
aggggccaggcc

SEQ ID NO: 6646580 - DNA, 14 bp, Homo sapiens
aggggccaggccat

SEQ ID NO: 6646581 - DNA, 15 bp, Homo sapiens
aggggccaggccatg

SEQ ID NO: 6646582 - DNA, 18 bp, Homo sapiens
aggggccaggccatggcc

SEQ ID NO: 6646583 - DNA, 13 bp, Homo sapiens
aggggccaggccc

SEQ ID NO: 6646584 - DNA, 16 bp, Homo sapiens
aggggccaggcccagg

SEQ ID NO: 6646585 - DNA, 18 bp, Homo sapiens
aggggccaggcccaggca

SEQ ID NO: 6646586 - DNA, 16 bp, Homo sapiens
aggggccaggggtggg

SEQ ID NO: 6646587 - DNA, 18 bp, Homo sapiens
aggggccagtgagggctg

SEQ ID NO: 6646588 - DNA, 19 bp, Homo sapiens
aggggccatcacaggatgc

SEQ ID NO: 6646589 - DNA, 15 bp, Homo sapiens
aggggccatgtcctc

SEQ ID NO: 6646590 - DNA, 20 bp, Homo sapiens
aggggcccaagagagacagc

SEQ ID NO: 6646591 - DNA, 18 bp, Homo sapiens
aggggcccaagccccatc

SEQ ID NO: 6646592 - DNA, 22 bp, Homo sapiens
aggggcccaaggcggcccctcc

SEQ ID NO: 6646593 - DNA, 20 bp, Homo sapiens
aggggcccacaaaggggaga

SEQ ID NO: 6646594 - DNA, 22 bp, Homo sapiens
aggggcccacaggaagctcagc

SEQ ID NO: 6646595 - DNA, 16 bp, Homo sapiens
aggggcccacccacat

SEQ ID NO: 6646596 - DNA, 18 bp, Homo sapiens
aggggcccacttggggcc

SEQ ID NO: 6646597 - DNA, 22 bp, Homo sapiens
aggggcccaggctcccctgccc

SEQ ID NO: 6646598 - DNA, 16 bp, Homo sapiens
aggggcccatgtgggc

SEQ ID NO: 6646599 - DNA, 19 bp, Homo sapiens
aggggcccattcagcctcg

SEQ ID NO: 6646600 - DNA, 19 bp, Homo sapiens
aggggccccagatctgcct

SEQ ID NO: 6646601 - DNA, 21 bp, Homo sapiens
aggggccccagatctgcctgg

SEQ ID NO: 6646602 - DNA, 22 bp, Homo sapiens
aggggccccagatctgcctggg

SEQ ID NO: 6646603 - DNA, 22 bp, Homo sapiens
aggggccccagcgtctgcaggg

SEQ ID NO: 6646604 - DNA, 16 bp, Homo sapiens
aggggccccatggcag

SEQ ID NO: 6646605 - DNA, 16 bp, Homo sapiens
aggggcccccctgccc

SEQ ID NO: 6646606 - DNA, 18 bp, Homo sapiens
aggggcccccctgccctg

SEQ ID NO: 6646607 - DNA, 20 bp, Homo sapiens
aggggcccccctgccctgtg

SEQ ID NO: 6646608 - DNA, 21 bp, Homo sapiens
aggggcccccctgccctgtgg

SEQ ID NO: 6646609 - DNA, 16 bp, Homo sapiens
aggggccccggggctg

SEQ ID NO: 6646610 - DNA, 19 bp, Homo sapiens
aggggccccggggctggca

SEQ ID NO: 6646611 - DNA, 22 bp, Homo sapiens
aggggccccggggctggcaagc

SEQ ID NO: 6646612 - DNA, 17 bp, Homo sapiens
aggggccccgtgtcctg

SEQ ID NO: 6646613 - DNA, 16 bp, Homo sapiens
aggggcccctccagct

SEQ ID NO: 6646614 - DNA, 16 bp, Homo sapiens
aggggcccctgcttct

SEQ ID NO: 6646615 - DNA, 20 bp, Homo sapiens
aggggcccctgcttctccag

SEQ ID NO: 6646616 - DNA, 20 bp, Homo sapiens
aggggcccctggcccaggag

SEQ ID NO: 6646617 - DNA, 15 bp, Homo sapiens
aggggcccggccagc

SEQ ID NO: 6646618 - DNA, 19 bp, Homo sapiens
aggggcccggccagccatg

SEQ ID NO: 6646619 - DNA, 21 bp, Homo sapiens
aggggcccggtggcggcaggg

SEQ ID NO: 6646620 - DNA, 21 bp, Homo sapiens
aggggcccgttgtctccctgg

SEQ ID NO: 6646621 - DNA, 16 bp, Homo sapiens
aggggccctacctggg

SEQ ID NO: 6646622 - DNA, 14 bp, Homo sapiens
aggggccctcactc

SEQ ID NO: 6646623 - DNA, 14 bp, Homo sapiens
aggggccctcaggc

SEQ ID NO: 6646624 - DNA, 21 bp, Homo sapiens
aggggccctcaggccattccc

SEQ ID NO: 6646625 - DNA, 12 bp, Homo sapiens
aggggccctgca

SEQ ID NO: 6646626 - DNA, 15 bp, Homo sapiens
aggggccctgtcact

SEQ ID NO: 6646627 - DNA, 23 bp, Homo sapiens
aggggccctgtcactgtccagag

SEQ ID NO: 6646628 - DNA, 13 bp, Homo sapiens
aggggcccttgga

SEQ ID NO: 6646629 - DNA, 16 bp, Homo sapiens
aggggccctttgcata

SEQ ID NO: 6646630 - DNA, 18 bp, Homo sapiens
aggggccgagtccaggag

SEQ ID NO: 6646631 - DNA, 22 bp, Homo sapiens
aggggccgagtccaggagcccc

SEQ ID NO: 6646632 - DNA, 23 bp, Homo sapiens
aggggccgagtccaggagcccca

SEQ ID NO: 6646633 - DNA, 19 bp, Homo sapiens
aggggccgatgcccagaga

SEQ ID NO: 6646634 - DNA, 15 bp, Homo sapiens
aggggccgctgccac

SEQ ID NO: 6646635 - DNA, 13 bp, Homo sapiens
aggggccggccct

SEQ ID NO: 6646636 - DNA, 15 bp, Homo sapiens
aggggccggccctgt

SEQ ID NO: 6646637 - DNA, 17 bp, Homo sapiens
aggggccggccctgtgt

SEQ ID NO: 6646638 - DNA, 15 bp, Homo sapiens
aggggccggctggcc

SEQ ID NO: 6646639 - DNA, 17 bp, Homo sapiens
aggggccggctgtttcc

SEQ ID NO: 6646640 - DNA, 17 bp, Homo sapiens
aggggccgggggcagtc

SEQ ID NO: 6646641 - DNA, 16 bp, Homo sapiens
aggggcctaggcctca

SEQ ID NO: 6646642 - DNA, 19 bp, Homo sapiens
aggggcctaggcctcagcc

SEQ ID NO: 6646643 - DNA, 12 bp, Homo sapiens
aggggcctaggg

SEQ ID NO: 6646644 - DNA, 15 bp, Homo sapiens
aggggcctagggagc

SEQ ID NO: 6646645 - DNA, 16 bp, Homo sapiens
aggggcctagggagcc

SEQ ID NO: 6646646 - DNA, 17 bp, Homo sapiens
aggggcctcccggggcc

SEQ ID NO: 6646647 - DNA, 22 bp, Homo sapiens
aggggcctcccggggcccagga

SEQ ID NO: 6646648 - DNA, 13 bp, Homo sapiens
aggggcctctctc

SEQ ID NO: 6646649 - DNA, 14 bp, Homo sapiens
aggggcctctctcc

SEQ ID NO: 6646650 - DNA, 19 bp, Homo sapiens
aggggcctctctcctgcct

SEQ ID NO: 6646651 - DNA, 16 bp, Homo sapiens
aggggcctctggctgc

SEQ ID NO: 6646652 - DNA, 17 bp, Homo sapiens
aggggcctctggctgcc

SEQ ID NO: 6646653 - DNA, 15 bp, Homo sapiens
aggggcctctgttcc

SEQ ID NO: 6646654 - DNA, 20 bp, Homo sapiens
aggggcctgaaaaggaagga

SEQ ID NO: 6646655 - DNA, 21 bp, Homo sapiens
aggggcctgaaaaggaaggac

SEQ ID NO: 6646656 - DNA, 12 bp, Homo sapiens
aggggcctgagc

SEQ ID NO: 6646657 - DNA, 14 bp, Homo sapiens
aggggcctgagcag

SEQ ID NO: 6646658 - DNA, 15 bp, Homo sapiens
aggggcctgcagaag

SEQ ID NO: 6646659 - DNA, 20 bp, Homo sapiens
aggggcctgcagaaggaaag

SEQ ID NO: 6646660 - DNA, 13 bp, Homo sapiens
aggggcctgccac

SEQ ID NO: 6646661 - DNA, 21 bp, Homo sapiens
aggggcctgccacctggaccc

SEQ ID NO: 6646662 - DNA, 15 bp, Homo sapiens
aggggcctgcgccca

SEQ ID NO: 6646663 - DNA, 19 bp, Homo sapiens
aggggcctgcgcccagagc

SEQ ID NO: 6646664 - DNA, 13 bp, Homo sapiens
aggggcctggaga

SEQ ID NO: 6646665 - DNA, 18 bp, Homo sapiens
aggggcctggagatcctc

SEQ ID NO: 6646666 - DNA, 22 bp, Homo sapiens
aggggcctggagatcctcctgc

SEQ ID NO: 6646667 - DNA, 12 bp, Homo sapiens
aggggcctggca

SEQ ID NO: 6646668 - DNA, 15 bp, Homo sapiens
aggggcctggcagcc

SEQ ID NO: 6646669 - DNA, 15 bp, Homo sapiens
aggggcctggcctgg

SEQ ID NO: 6646670 - DNA, 17 bp, Homo sapiens
aggggcctgggaaagga

SEQ ID NO: 6646671 - DNA, 19 bp, Homo sapiens
aggggcctgggaaaggaaa

SEQ ID NO: 6646672 - DNA, 21 bp, Homo sapiens
aggggcctgggaaaggaaaac

SEQ ID NO: 6646673 - DNA, 14 bp, Homo sapiens
aggggcctgggcag

SEQ ID NO: 6646674 - DNA, 18 bp, Homo sapiens
aggggcctgggcagcccc

SEQ ID NO: 6646675 - DNA, 14 bp, Homo sapiens
aggggcctgggccg

SEQ ID NO: 6646676 - DNA, 15 bp, Homo sapiens
aggggcctgggccgg

SEQ ID NO: 6646677 - DNA, 23 bp, Homo sapiens
aggggcctgggccggcgaggggg

SEQ ID NO: 6646678 - DNA, 13 bp, Homo sapiens
aggggcctgggct

SEQ ID NO: 6646679 - DNA, 16 bp, Homo sapiens
aggggcctgggctgtg

SEQ ID NO: 6646680 - DNA, 20 bp, Homo sapiens
aggggcctgggctgtgagga

SEQ ID NO: 6646681 - DNA, 21 bp, Homo sapiens
aggggccttagggcactgggc

SEQ ID NO: 6646682 - DNA, 22 bp, Homo sapiens
aggggccttagggcactgggct

SEQ ID NO: 6646683 - DNA, 22 bp, Homo sapiens
aggggccttcccctttagaata

SEQ ID NO: 6646684 - DNA, 16 bp, Homo sapiens
aggggccttgctctga

SEQ ID NO: 6646685 - DNA, 20 bp, Homo sapiens
aggggccttgctctgagcac

SEQ ID NO: 6646686 - DNA, 15 bp, Homo sapiens
aggggcctttgctgc

SEQ ID NO: 6646687 - DNA, 22 bp, Homo sapiens
aggggcgcaccccacagctggg

SEQ ID NO: 6646688 - DNA, 23 bp, Homo sapiens
aggggcgcaccccacagctgggg

SEQ ID NO: 6646689 - DNA, 16 bp, Homo sapiens
aggggcgcccacctcc

SEQ ID NO: 6646690 - DNA, 19 bp, Homo sapiens
aggggcgccttttcagccc

SEQ ID NO: 6646691 - DNA, 20 bp, Homo sapiens
aggggcgccttttcagccct

SEQ ID NO: 6646692 - DNA, 20 bp, Homo sapiens
aggggcgcgcgcccccagga

SEQ ID NO: 6646693 - DNA, 12 bp, Homo sapiens
aggggcgcggga

SEQ ID NO: 6646694 - DNA, 23 bp, Homo sapiens
aggggcgctcctcccagctgtac

SEQ ID NO: 6646695 - DNA, 22 bp, Homo sapiens
aggggcgctgcccccacagatc

SEQ ID NO: 6646696 - DNA, 19 bp, Homo sapiens
aggggcgctggcccagccg

SEQ ID NO: 6646697 - DNA, 22 bp, Homo sapiens
aggggcgctggcccagccggcc

SEQ ID NO: 6646698 - DNA, 17 bp, Homo sapiens
aggggcgctgtcctgcg

SEQ ID NO: 6646699 - DNA, 17 bp, Homo sapiens
aggggcgcttgggaggg

SEQ ID NO: 6646700 - DNA, 17 bp, Homo sapiens
aggggcgggaatattgt

SEQ ID NO: 6646701 - DNA, 22 bp, Homo sapiens
aggggcgggcggagggagggga

SEQ ID NO: 6646702 - DNA, 23 bp, Homo sapiens
aggggcgggcggagggaggggag

SEQ ID NO: 6646703 - DNA, 14 bp, Homo sapiens
aggggcgggctcag

SEQ ID NO: 6646704 - DNA, 15 bp, Homo sapiens
aggggcgggctcaga

SEQ ID NO: 6646705 - DNA, 13 bp, Homo sapiens
aggggcggggcag

SEQ ID NO: 6646706 - DNA, 16 bp, Homo sapiens
aggggcggggcaggaa

SEQ ID NO: 6646707 - DNA, 15 bp, Homo sapiens
aggggcggggccagg

SEQ ID NO: 6646708 - DNA, 15 bp, Homo sapiens
aggggcgggggcgga

SEQ ID NO: 6646709 - DNA, 19 bp, Homo sapiens
aggggcgggggcggaggag

SEQ ID NO: 6646710 - DNA, 20 bp, Homo sapiens
aggggcgggtgatgagacct

SEQ ID NO: 6646711 - DNA, 19 bp, Homo sapiens
aggggcgtctgttccccct

SEQ ID NO: 6646712 - DNA, 21 bp, Homo sapiens
aggggcgtctgttcccccttc

SEQ ID NO: 6646713 - DNA, 15 bp, Homo sapiens
aggggcgtgtccctc

SEQ ID NO: 6646714 - DNA, 23 bp, Homo sapiens
aggggcgtgtgttccccagctga

SEQ ID NO: 6646715 - DNA, 17 bp, Homo sapiens
aggggctaccaggaaag

SEQ ID NO: 6646716 - DNA, 21 bp, Homo sapiens
aggggctaccctgggaagctg

SEQ ID NO: 6646717 - DNA, 12 bp, Homo sapiens
aggggctaggga

SEQ ID NO: 6646718 - DNA, 18 bp, Homo sapiens
aggggctaggggctggtc

SEQ ID NO: 6646719 - DNA, 19 bp, Homo sapiens
aggggctatcccttctcag

SEQ ID NO: 6646720 - DNA, 15 bp, Homo sapiens
aggggctcagcaagg

SEQ ID NO: 6646721 - DNA, 15 bp, Homo sapiens
aggggctcaggatat

SEQ ID NO: 6646722 - DNA, 17 bp, Homo sapiens
aggggctccatgctggg

SEQ ID NO: 6646723 - DNA, 18 bp, Homo sapiens
aggggctccatgctgggt

SEQ ID NO: 6646724 - DNA, 20 bp, Homo sapiens
aggggctccatgctgggtct

SEQ ID NO: 6646725 - DNA, 20 bp, Homo sapiens
aggggctccgggtcactgct

SEQ ID NO: 6646726 - DNA, 13 bp, Homo sapiens
aggggctcctgag

SEQ ID NO: 6646727 - DNA, 14 bp, Homo sapiens
aggggctcctgagt

SEQ ID NO: 6646728 - DNA, 16 bp, Homo sapiens
aggggctcctgagtgt

SEQ ID NO: 6646729 - DNA, 13 bp, Homo sapiens
aggggctcctggg

SEQ ID NO: 6646730 - DNA, 16 bp, Homo sapiens
aggggctcctttccat

SEQ ID NO: 6646731 - DNA, 17 bp, Homo sapiens
aggggctctcagctcag

SEQ ID NO: 6646732 - DNA, 11 bp, Homo sapiens
aggggctctgc

SEQ ID NO: 6646733 - DNA, 17 bp, Homo sapiens
aggggctctggagagaa

SEQ ID NO: 6646734 - DNA, 21 bp, Homo sapiens
aggggctctggagagaaacaa

SEQ ID NO: 6646735 - DNA, 16 bp, Homo sapiens
aggggctctgtggcaa

SEQ ID NO: 6646736 - DNA, 24 bp, Homo sapiens
aggggctcttcatctgcctgcgct

SEQ ID NO: 6646737 - DNA, 20 bp, Homo sapiens
aggggctgactctccaggga

SEQ ID NO: 6646738 - DNA, 18 bp, Homo sapiens
aggggctgcagccccctg

SEQ ID NO: 6646739 - DNA, 19 bp, Homo sapiens
aggggctgcagccccctgc

SEQ ID NO: 6646740 - DNA, 21 bp, Homo sapiens
aggggctgcatcctcagcccc

SEQ ID NO: 6646741 - DNA, 12 bp, Homo sapiens
aggggctgcccg

SEQ ID NO: 6646742 - DNA, 16 bp, Homo sapiens
aggggctgcccgctcc

SEQ ID NO: 6646743 - DNA, 21 bp, Homo sapiens
aggggctgcgctagcagccct

SEQ ID NO: 6646744 - DNA, 23 bp, Homo sapiens
aggggctgctccagtgggcaggg

SEQ ID NO: 6646745 - DNA, 16 bp, Homo sapiens
aggggctgctgccttg

SEQ ID NO: 6646746 - DNA, 20 bp, Homo sapiens
aggggctgctggggcatgtg

SEQ ID NO: 6646747 - DNA, 17 bp, Homo sapiens
aggggctgctgggggct

SEQ ID NO: 6646748 - DNA, 20 bp, Homo sapiens
aggggctgctgggggctccc

SEQ ID NO: 6646749 - DNA, 22 bp, Homo sapiens
aggggctgctgggggctcccct

SEQ ID NO: 6646750 - DNA, 23 bp, Homo sapiens
aggggctgctgggggctcccctt

SEQ ID NO: 6646751 - DNA, 16 bp, Homo sapiens
aggggctggcttcagg

SEQ ID NO: 6646752 - DNA, 23 bp, Homo sapiens
aggggctgggcagaggggagagg

SEQ ID NO: 6646753 - DNA, 18 bp, Homo sapiens
aggggctgggcatcccag

SEQ ID NO: 6646754 - DNA, 16 bp, Homo sapiens
aggggctgggctccct

SEQ ID NO: 6646755 - DNA, 21 bp, Homo sapiens
aggggctgggctccctgatga

SEQ ID NO: 6646756 - DNA, 13 bp, Homo sapiens
aggggctgggctg

SEQ ID NO: 6646757 - DNA, 14 bp, Homo sapiens
aggggctgggctgg

SEQ ID NO: 6646758 - DNA, 19 bp, Homo sapiens
aggggctgggctgggctgg

SEQ ID NO: 6646759 - DNA, 13 bp, Homo sapiens
aggggctggggag

SEQ ID NO: 6646760 - DNA, 22 bp, Homo sapiens
aggggctggggcaggctctctc

SEQ ID NO: 6646761 - DNA, 23 bp, Homo sapiens
aggggctggggccaaataaagtc

SEQ ID NO: 6646762 - DNA, 17 bp, Homo sapiens
aggggctggtccttctc

SEQ ID NO: 6646763 - DNA, 18 bp, Homo sapiens
aggggctgtcctccttcc

SEQ ID NO: 6646764 - DNA, 20 bp, Homo sapiens
aggggctgtcctccttcctg

SEQ ID NO: 6646765 - DNA, 21 bp, Homo sapiens
aggggctgtggccgtctcctc

SEQ ID NO: 6646766 - DNA, 16 bp, Homo sapiens
aggggcttacaaagcc

SEQ ID NO: 6646767 - DNA, 21 bp, Homo sapiens
aggggcttataataaaggact

SEQ ID NO: 6646768 - DNA, 15 bp, Homo sapiens
aggggcttcaggtcc

SEQ ID NO: 6646769 - DNA, 23 bp, Homo sapiens
aggggcttcccacagcctcttcc

SEQ ID NO: 6646770 - DNA, 16 bp, Homo sapiens
aggggcttccctctgc

SEQ ID NO: 6646771 - DNA, 19 bp, Homo sapiens
aggggcttccctctgctcc

SEQ ID NO: 6646772 - DNA, 13 bp, Homo sapiens
aggggcttcctgg

SEQ ID NO: 6646773 - DNA, 14 bp, Homo sapiens
aggggcttcctggt

SEQ ID NO: 6646774 - DNA, 13 bp, Homo sapiens
aggggcttctaat

SEQ ID NO: 6646775 - DNA, 17 bp, Homo sapiens
aggggcttctaatgacc

SEQ ID NO: 6646776 - DNA, 20 bp, Homo sapiens
aggggcttctaatgacccag

SEQ ID NO: 6646777 - DNA, 16 bp, Homo sapiens
aggggcttgggcctgc

SEQ ID NO: 6646778 - DNA, 19 bp, Homo sapiens
aggggcttggtcctagggt

SEQ ID NO: 6646779 - DNA, 22 bp, Homo sapiens
aggggcttggtcctagggtggg

SEQ ID NO: 6646780 - DNA, 23 bp, Homo sapiens
aggggcttggtgtttgtaagaaa

SEQ ID NO: 6646781 - DNA, 16 bp, Homo sapiens
aggggctttctggaga

SEQ ID NO: 6646782 - DNA, 17 bp, Homo sapiens
aggggctttctggagag

SEQ ID NO: 6646783 - DNA, 20 bp, Homo sapiens
aggggctttggaagctctgt

SEQ ID NO: 6646784 - DNA, 23 bp, Homo sapiens
aggggctttgggcccaagaactg

SEQ ID NO: 6646785 - DNA, 19 bp, Homo sapiens
agggggaaaaagtgtcaac

SEQ ID NO: 6646786 - DNA, 18 bp, Homo sapiens
agggggaagaagcagaga

SEQ ID NO: 6646787 - DNA, 17 bp, Homo sapiens
agggggaagagaaattt

SEQ ID NO: 6646788 - DNA, 19 bp, Homo sapiens
agggggaagatgccaaggg

SEQ ID NO: 6646789 - DNA, 19 bp, Homo sapiens
agggggacagcagggaccg

SEQ ID NO: 6646790 - DNA, 22 bp, Homo sapiens
agggggaccatggggaggtggc

SEQ ID NO: 6646791 - DNA, 17 bp, Homo sapiens
agggggacctgtccccc

SEQ ID NO: 6646792 - DNA, 18 bp, Homo sapiens
agggggacggggctcagc

SEQ ID NO: 6646793 - DNA, 16 bp, Homo sapiens
agggggacggggctga

SEQ ID NO: 6646794 - DNA, 21 bp, Homo sapiens
agggggactgctgctgcctgg

SEQ ID NO: 6646795 - DNA, 20 bp, Homo sapiens
agggggagaaaaggaaaaga

SEQ ID NO: 6646796 - DNA, 11 bp, Homo sapiens
agggggagaag

SEQ ID NO: 6646797 - DNA, 12 bp, Homo sapiens
agggggagaccc

SEQ ID NO: 6646798 - DNA, 13 bp, Homo sapiens
agggggagacccc

SEQ ID NO: 6646799 - DNA, 15 bp, Homo sapiens
agggggagagggctg

SEQ ID NO: 6646800 - DNA, 21 bp, Homo sapiens
agggggagccattctgtccca

SEQ ID NO: 6646801 - DNA, 22 bp, Homo sapiens
agggggagctgggcctggtctc

SEQ ID NO: 6646802 - DNA, 16 bp, Homo sapiens
agggggaggggaagtc

SEQ ID NO: 6646803 - DNA, 16 bp, Homo sapiens
agggggagtgaaacag

SEQ ID NO: 6646804 - DNA, 20 bp, Homo sapiens
agggggatatgggtcctctg

SEQ ID NO: 6646805 - DNA, 17 bp, Homo sapiens
agggggattctgagcag

SEQ ID NO: 6646806 - DNA, 16 bp, Homo sapiens
agggggcaaatgagcc

SEQ ID NO: 6646807 - DNA, 15 bp, Homo sapiens
agggggcaacaaggt

SEQ ID NO: 6646808 - DNA, 16 bp, Homo sapiens
agggggcaacaaggtg

SEQ ID NO: 6646809 - DNA, 17 bp, Homo sapiens
agggggcaaggagaaag

SEQ ID NO: 6646810 - DNA, 16 bp, Homo sapiens
agggggcacgggcctg

SEQ ID NO: 6646811 - DNA, 23 bp, Homo sapiens
agggggcactgtggtcaggccca

SEQ ID NO: 6646812 - DNA, 18 bp, Homo sapiens
agggggcagagtggcctg

SEQ ID NO: 6646813 - DNA, 14 bp, Homo sapiens
agggggcaggggca

SEQ ID NO: 6646814 - DNA, 15 bp, Homo sapiens
agggggccacctccc

SEQ ID NO: 6646815 - DNA, 19 bp, Homo sapiens
agggggccacctccccagg

SEQ ID NO: 6646816 - DNA, 10 bp, Homo sapiens
agggggccag

SEQ ID NO: 6646817 - DNA, 15 bp, Homo sapiens
agggggccagaggga

SEQ ID NO: 6646818 - DNA, 18 bp, Homo sapiens
agggggccagagggactt

SEQ ID NO: 6646819 - DNA, 11 bp, Homo sapiens
agggggccagc

SEQ ID NO: 6646820 - DNA, 17 bp, Homo sapiens
agggggccagctgggga

SEQ ID NO: 6646821 - DNA, 23 bp, Homo sapiens
agggggcccctttgctgaccctc

SEQ ID NO: 6646822 - DNA, 16 bp, Homo sapiens
agggggcccggctggg

SEQ ID NO: 6646823 - DNA, 19 bp, Homo sapiens
agggggcccggctgggccc

SEQ ID NO: 6646824 - DNA, 21 bp, Homo sapiens
agggggcccggctgggcccga

SEQ ID NO: 6646825 - DNA, 12 bp, Homo sapiens
agggggccctgc

SEQ ID NO: 6646826 - DNA, 15 bp, Homo sapiens
agggggccctgcccc

SEQ ID NO: 6646827 - DNA, 17 bp, Homo sapiens
agggggccctgccccac

SEQ ID NO: 6646828 - DNA, 14 bp, Homo sapiens
agggggccctgcta

SEQ ID NO: 6646829 - DNA, 15 bp, Homo sapiens
agggggccctgctac

SEQ ID NO: 6646830 - DNA, 21 bp, Homo sapiens
agggggcctcattgtgtctcc

SEQ ID NO: 6646831 - DNA, 17 bp, Homo sapiens
agggggcctgcaggccc

SEQ ID NO: 6646832 - DNA, 15 bp, Homo sapiens
agggggcctggatgc

SEQ ID NO: 6646833 - DNA, 19 bp, Homo sapiens
agggggcctgggatgctag

SEQ ID NO: 6646834 - DNA, 22 bp, Homo sapiens
agggggccttgcggaagccata

SEQ ID NO: 6646835 - DNA, 23 bp, Homo sapiens
agggggccttgcggaagccatag

SEQ ID NO: 6646836 - DNA, 14 bp, Homo sapiens
agggggccttggaa

SEQ ID NO: 6646837 - DNA, 14 bp, Homo sapiens
agggggcggcaggg

SEQ ID NO: 6646838 - DNA, 22 bp, Homo sapiens
agggggcggcagggctgggcct

SEQ ID NO: 6646839 - DNA, 21 bp, Homo sapiens
agggggcggggactgctggct

SEQ ID NO: 6646840 - DNA, 23 bp, Homo sapiens
agggggcggtaggggctgcaggg

SEQ ID NO: 6646841 - DNA, 23 bp, Homo sapiens
agggggcgttatttatggaccac

SEQ ID NO: 6646842 - DNA, 16 bp, Homo sapiens
agggggctaagacttc

SEQ ID NO: 6646843 - DNA, 18 bp, Homo sapiens
agggggctattccctgga

SEQ ID NO: 6646844 - DNA, 13 bp, Homo sapiens
agggggctcctgg

SEQ ID NO: 6646845 - DNA, 15 bp, Homo sapiens
agggggctctgccca

SEQ ID NO: 6646846 - DNA, 17 bp, Homo sapiens
agggggctctgccccag

SEQ ID NO: 6646847 - DNA, 22 bp, Homo sapiens
agggggctctgccccaggccct

SEQ ID NO: 6646848 - DNA, 21 bp, Homo sapiens
agggggctcttttactgggtt

SEQ ID NO: 6646849 - DNA, 14 bp, Homo sapiens
agggggctgctccc

SEQ ID NO: 6646850 - DNA, 19 bp, Homo sapiens
agggggctgctcccacctg

SEQ ID NO: 6646851 - DNA, 20 bp, Homo sapiens
agggggctgctgctgggctc

SEQ ID NO: 6646852 - DNA, 17 bp, Homo sapiens
agggggctggaggagcc

SEQ ID NO: 6646853 - DNA, 18 bp, Homo sapiens
agggggctggaggagccc

SEQ ID NO: 6646854 - DNA, 13 bp, Homo sapiens
agggggctggcca

SEQ ID NO: 6646855 - DNA, 19 bp, Homo sapiens
agggggctggctctgagag

SEQ ID NO: 6646856 - DNA, 20 bp, Homo sapiens
agggggctgggaaagaactt

SEQ ID NO: 6646857 - DNA, 19 bp, Homo sapiens
agggggctgggctcacagg

SEQ ID NO: 6646858 - DNA, 17 bp, Homo sapiens
aggggggaagatcaggt

SEQ ID NO: 6646859 - DNA, 19 bp, Homo sapiens
aggggggagccagaggcca

SEQ ID NO: 6646860 - DNA, 17 bp, Homo sapiens
aggggggagggggaggg

SEQ ID NO: 6646861 - DNA, 13 bp, Homo sapiens
aggggggagggtc

SEQ ID NO: 6646862 - DNA, 12 bp, Homo sapiens
aggggggctgtg

SEQ ID NO: 6646863 - DNA, 14 bp, Homo sapiens
aggggggctgtgcc

SEQ ID NO: 6646864 - DNA, 21 bp, Homo sapiens
aggggggggcaatctctctct

SEQ ID NO: 6646865 - DNA, 13 bp, Homo sapiens
aggggggggtggg

SEQ ID NO: 6646866 - DNA, 19 bp, Homo sapiens
aggggggtaatagtgacat

SEQ ID NO: 6646867 - DNA, 22 bp, Homo sapiens
aggggggtcggaagcctgtcct

SEQ ID NO: 6646868 - DNA, 14 bp, Homo sapiens
aggggggtgggagg

SEQ ID NO: 6646869 - DNA, 20 bp, Homo sapiens
aggggggttgcagtggagag

SEQ ID NO: 6646870 - DNA, 12 bp, Homo sapiens
aggggggttggg

SEQ ID NO: 6646871 - DNA, 19 bp, Homo sapiens
aggggggttgggttccaga

SEQ ID NO: 6646872 - DNA, 13 bp, Homo sapiens
agggggtaaggcc

SEQ ID NO: 6646873 - DNA, 21 bp, Homo sapiens
agggggtaatggaggccaagc

SEQ ID NO: 6646874 - DNA, 22 bp, Homo sapiens
agggggtaatggaggccaagcc

SEQ ID NO: 6646875 - DNA, 16 bp, Homo sapiens
agggggtacctcatga

SEQ ID NO: 6646876 - DNA, 16 bp, Homo sapiens
agggggtcattgttct

SEQ ID NO: 6646877 - DNA, 21 bp, Homo sapiens
agggggtcatttcagagccct

SEQ ID NO: 6646878 - DNA, 16 bp, Homo sapiens
agggggtccctgtgct

SEQ ID NO: 6646879 - DNA, 23 bp, Homo sapiens
agggggtcgtggagagctaggag

SEQ ID NO: 6646880 - DNA, 13 bp, Homo sapiens
agggggtctctgt

SEQ ID NO: 6646881 - DNA, 17 bp, Homo sapiens
agggggtctggctggtg

SEQ ID NO: 6646882 - DNA, 14 bp, Homo sapiens
agggggtgaaggca

SEQ ID NO: 6646883 - DNA, 20 bp, Homo sapiens
agggggtgacctcttgcctc

SEQ ID NO: 6646884 - DNA, 15 bp, Homo sapiens
agggggtgactggaa

SEQ ID NO: 6646885 - DNA, 15 bp, Homo sapiens
agggggtggaggggt

SEQ ID NO: 6646886 - DNA, 17 bp, Homo sapiens
agggggtggcctcccaa

SEQ ID NO: 6646887 - DNA, 14 bp, Homo sapiens
agggggtgggaagg

SEQ ID NO: 6646888 - DNA, 17 bp, Homo sapiens
agggggtgggggtgccg

SEQ ID NO: 6646889 - DNA, 22 bp, Homo sapiens
agggggtgtcagaagctgggaa

SEQ ID NO: 6646890 - DNA, 17 bp, Homo sapiens
agggggtgtctgcacct

SEQ ID NO: 6646891 - DNA, 19 bp, Homo sapiens
agggggtgtgcgtgcgtgt

SEQ ID NO: 6646892 - DNA, 17 bp, Homo sapiens
agggggttcttcctcac

SEQ ID NO: 6646893 - DNA, 21 bp, Homo sapiens
agggggttgggtttggggaca

SEQ ID NO: 6646894 - DNA, 18 bp, Homo sapiens
aggggtaaatatatgttt

SEQ ID NO: 6646895 - DNA, 15 bp, Homo sapiens
aggggtaacctggcc

SEQ ID NO: 6646896 - DNA, 22 bp, Homo sapiens
aggggtacacagagctaaggcc

SEQ ID NO: 6646897 - DNA, 22 bp, Homo sapiens
aggggtacatttccctgtgctg

SEQ ID NO: 6646898 - DNA, 19 bp, Homo sapiens
aggggtaccactgaatctg

SEQ ID NO: 6646899 - DNA, 15 bp, Homo sapiens
aggggtaccaggcac

SEQ ID NO: 6646900 - DNA, 18 bp, Homo sapiens
aggggtagctggtggttg

SEQ ID NO: 6646901 - DNA, 17 bp, Homo sapiens
aggggtaggcagagcct

SEQ ID NO: 6646902 - DNA, 15 bp, Homo sapiens
aggggtagggagcct

SEQ ID NO: 6646903 - DNA, 14 bp, Homo sapiens
aggggtaggggctg

SEQ ID NO: 6646904 - DNA, 23 bp, Homo sapiens
aggggtataggacaaggggtgga

SEQ ID NO: 6646905 - DNA, 20 bp, Homo sapiens
aggggtatatttagaccctg

SEQ ID NO: 6646906 - DNA, 16 bp, Homo sapiens
aggggtcaaagaaatg

SEQ ID NO: 6646907 - DNA, 21 bp, Homo sapiens
aggggtcaagttattaatttc

SEQ ID NO: 6646908 - DNA, 22 bp, Homo sapiens
aggggtcagcaggggggttggg

SEQ ID NO: 6646909 - DNA, 16 bp, Homo sapiens
aggggtcagctctggc

SEQ ID NO: 6646910 - DNA, 20 bp, Homo sapiens
aggggtcagctctggccaca

SEQ ID NO: 6646911 - DNA, 20 bp, Homo sapiens
aggggtcagggaccaaggac

SEQ ID NO: 6646912 - DNA, 20 bp, Homo sapiens
aggggtcagtgcagcagagg

SEQ ID NO: 6646913 - DNA, 16 bp, Homo sapiens
aggggtcccctctgga

SEQ ID NO: 6646914 - DNA, 22 bp, Homo sapiens
aggggtcctgatttcagggaaa

SEQ ID NO: 6646915 - DNA, 15 bp, Homo sapiens
aggggtcctgcaggg

SEQ ID NO: 6646916 - DNA, 16 bp, Homo sapiens
aggggtcctgggggca

SEQ ID NO: 6646917 - DNA, 19 bp, Homo sapiens
aggggtcgcgatgatgggc

SEQ ID NO: 6646918 - DNA, 22 bp, Homo sapiens
aggggtcgcgatgatgggctgg

SEQ ID NO: 6646919 - DNA, 15 bp, Homo sapiens
aggggtcggctgacc

SEQ ID NO: 6646920 - DNA, 14 bp, Homo sapiens
aggggtctccctgg

SEQ ID NO: 6646921 - DNA, 16 bp, Homo sapiens
aggggtctccctggag

SEQ ID NO: 6646922 - DNA, 19 bp, Homo sapiens
aggggtctccctggctccc

SEQ ID NO: 6646923 - DNA, 14 bp, Homo sapiens
aggggtctgcctcc

SEQ ID NO: 6646924 - DNA, 15 bp, Homo sapiens
aggggtctgctcctg

SEQ ID NO: 6646925 - DNA, 19 bp, Homo sapiens
aggggtgaattgtgtagtg

SEQ ID NO: 6646926 - DNA, 15 bp, Homo sapiens
aggggtgacacagac

SEQ ID NO: 6646927 - DNA, 23 bp, Homo sapiens
aggggtgacacagactcatcctg

SEQ ID NO: 6646928 - DNA, 19 bp, Homo sapiens
aggggtgagagacctgctc

SEQ ID NO: 6646929 - DNA, 16 bp, Homo sapiens
aggggtgagagcaccc

SEQ ID NO: 6646930 - DNA, 13 bp, Homo sapiens
aggggtgagcccc

SEQ ID NO: 6646931 - DNA, 17 bp, Homo sapiens
aggggtgagccccgccg

SEQ ID NO: 6646932 - DNA, 18 bp, Homo sapiens
aggggtgattgaaagaaa

SEQ ID NO: 6646933 - DNA, 17 bp, Homo sapiens
aggggtgatttcagaga

SEQ ID NO: 6646934 - DNA, 22 bp, Homo sapiens
aggggtgatttcagagagggca

SEQ ID NO: 6646935 - DNA, 17 bp, Homo sapiens
aggggtgccccctcctc

SEQ ID NO: 6646936 - DNA, 14 bp, Homo sapiens
aggggtgccctctg

SEQ ID NO: 6646937 - DNA, 13 bp, Homo sapiens
aggggtgctcctg

SEQ ID NO: 6646938 - DNA, 14 bp, Homo sapiens
aggggtgctcctgt

SEQ ID NO: 6646939 - DNA, 15 bp, Homo sapiens
aggggtgctcctgtg

SEQ ID NO: 6646940 - DNA, 17 bp, Homo sapiens
aggggtgctgtgaggct

SEQ ID NO: 6646941 - DNA, 16 bp, Homo sapiens
aggggtgctttgcctg

SEQ ID NO: 6646942 - DNA, 19 bp, Homo sapiens
aggggtggaagggcaggag

SEQ ID NO: 6646943 - DNA, 15 bp, Homo sapiens
aggggtggaatgccg

SEQ ID NO: 6646944 - DNA, 13 bp, Homo sapiens
aggggtggaggct

SEQ ID NO: 6646945 - DNA, 12 bp, Homo sapiens
aggggtggaggg

SEQ ID NO: 6646946 - DNA, 13 bp, Homo sapiens
aggggtggcccag

SEQ ID NO: 6646947 - DNA, 14 bp, Homo sapiens
aggggtggcccaga

SEQ ID NO: 6646948 - DNA, 20 bp, Homo sapiens
aggggtggccgtcctgaggg

SEQ ID NO: 6646949 - DNA, 17 bp, Homo sapiens
aggggtggcgctcagac

SEQ ID NO: 6646950 - DNA, 21 bp, Homo sapiens
aggggtggcgctcagacccca

SEQ ID NO: 6646951 - DNA, 20 bp, Homo sapiens
aggggtggctgcctcattta

SEQ ID NO: 6646952 - DNA, 17 bp, Homo sapiens
aggggtggctgggtctt

SEQ ID NO: 6646953 - DNA, 12 bp, Homo sapiens
aggggtgggagc

SEQ ID NO: 6646954 - DNA, 18 bp, Homo sapiens
aggggtggggagatgctt

SEQ ID NO: 6646955 - DNA, 21 bp, Homo sapiens
aggggtgggttcctcttcccc

SEQ ID NO: 6646956 - DNA, 18 bp, Homo sapiens
aggggtggtcctgactca

SEQ ID NO: 6646957 - DNA, 18 bp, Homo sapiens
aggggtggtgtggtgttg

SEQ ID NO: 6646958 - DNA, 23 bp, Homo sapiens
aggggtggtttctacggtgacag

SEQ ID NO: 6646959 - DNA, 19 bp, Homo sapiens
aggggtgtcccagtcccag

SEQ ID NO: 6646960 - DNA, 16 bp, Homo sapiens
aggggtgtccgagagg

SEQ ID NO: 6646961 - DNA, 14 bp, Homo sapiens
aggggtgtcttggg

SEQ ID NO: 6646962 - DNA, 20 bp, Homo sapiens
aggggttcccttgagggctg

SEQ ID NO: 6646963 - DNA, 21 bp, Homo sapiens
aggggttcccttgagggctgc

SEQ ID NO: 6646964 - DNA, 14 bp, Homo sapiens
aggggttcctcaaa

SEQ ID NO: 6646965 - DNA, 14 bp, Homo sapiens
aggggttcctcccc

SEQ ID NO: 6646966 - DNA, 21 bp, Homo sapiens
aggggttccttccacttctgg

SEQ ID NO: 6646967 - DNA, 20 bp, Homo sapiens
aggggttctatttattcctg

SEQ ID NO: 6646968 - DNA, 22 bp, Homo sapiens
aggggttctgagaagcgctgcc

SEQ ID NO: 6646969 - DNA, 21 bp, Homo sapiens
aggggttgctccgcctggcct

SEQ ID NO: 6646970 - DNA, 18 bp, Homo sapiens
aggggttggggtgacagt

SEQ ID NO: 6646971 - DNA, 14 bp, Homo sapiens
aggggttggtggga

SEQ ID NO: 6646972 - DNA, 19 bp, Homo sapiens
aggggttggttgaggtgga

SEQ ID NO: 6646973 - DNA, 22 bp, Homo sapiens
aggggttgtcaagagagagtca

SEQ ID NO: 6646974 - DNA, 11 bp, Homo sapiens
aggggtttaca

SEQ ID NO: 6646975 - DNA, 14 bp, Homo sapiens
aggggtttacagtg

SEQ ID NO: 6646976 - DNA, 18 bp, Homo sapiens
aggggtttcttttggaaa

SEQ ID NO: 6646977 - DNA, 19 bp, Homo sapiens
aggggtttgccatttgata

SEQ ID NO: 6646978 - DNA, 17 bp, Homo sapiens
aggggtttgggtggggg

SEQ ID NO: 6646979 - DNA, 17 bp, Homo sapiens
aggggtttggtctggga

SEQ ID NO: 6646980 - DNA, 22 bp, Homo sapiens
aggggttttcgaagctcagccc

SEQ ID NO: 6646981 - DNA, 13 bp, Homo sapiens
agggtaaacaata

SEQ ID NO: 6646982 - DNA, 12 bp, Homo sapiens
agggtaaattat

SEQ ID NO: 6646983 - DNA, 14 bp, Homo sapiens
agggtaaattattc

SEQ ID NO: 6646984 - DNA, 14 bp, Homo sapiens
agggtaactcttgg

SEQ ID NO: 6646985 - DNA, 23 bp, Homo sapiens
agggtaagaagtttgtgtctttg

SEQ ID NO: 6646986 - DNA, 19 bp, Homo sapiens
agggtaagggagagggagg

SEQ ID NO: 6646987 - DNA, 15 bp, Homo sapiens
agggtaatagaaatg

SEQ ID NO: 6646988 - DNA, 13 bp, Homo sapiens
agggtaatatcat

SEQ ID NO: 6646989 - DNA, 21 bp, Homo sapiens
agggtaatctgacttctcact

SEQ ID NO: 6646990 - DNA, 19 bp, Homo sapiens
agggtacagatccccagcc

SEQ ID NO: 6646991 - DNA, 15 bp, Homo sapiens
agggtacagcccagg

SEQ ID NO: 6646992 - DNA, 14 bp, Homo sapiens
agggtacagctggg

SEQ ID NO: 6646993 - DNA, 15 bp, Homo sapiens
agggtacagctgggc

SEQ ID NO: 6646994 - DNA, 19 bp, Homo sapiens
agggtaccaggataaagcc

SEQ ID NO: 6646995 - DNA, 22 bp, Homo sapiens
agggtacccgcctgagctcctg

SEQ ID NO: 6646996 - DNA, 19 bp, Homo sapiens
agggtactaaggaatcttt

SEQ ID NO: 6646997 - DNA, 20 bp, Homo sapiens
agggtactttattttgcttt

SEQ ID NO: 6646998 - DNA, 15 bp, Homo sapiens
agggtagaaggaaag

SEQ ID NO: 6646999 - DNA, 22 bp, Homo sapiens
agggtagaatgattaatcaaag

SEQ ID NO: 6647000 - DNA, 14 bp, Homo sapiens
agggtagagcaaag

SEQ ID NO: 6647001 - DNA, 16 bp, Homo sapiens
agggtagatttctctt

SEQ ID NO: 6647002 - DNA, 18 bp, Homo sapiens
agggtagatttctcttgg

SEQ ID NO: 6647003 - DNA, 20 bp, Homo sapiens
agggtagcagcagaggcagg

SEQ ID NO: 6647004 - DNA, 15 bp, Homo sapiens
agggtagcaggtacc

SEQ ID NO: 6647005 - DNA, 23 bp, Homo sapiens
agggtagcccgcctgccagtcct

SEQ ID NO: 6647006 - DNA, 21 bp, Homo sapiens
agggtagcctggcttttctgg

SEQ ID NO: 6647007 - DNA, 17 bp, Homo sapiens
agggtagctgggcgggg

SEQ ID NO: 6647008 - DNA, 20 bp, Homo sapiens
agggtaggagggtgggaagg

SEQ ID NO: 6647009 - DNA, 15 bp, Homo sapiens
agggtaggcaggatt

SEQ ID NO: 6647010 - DNA, 19 bp, Homo sapiens
agggtagggataatttatt

SEQ ID NO: 6647011 - DNA, 20 bp, Homo sapiens
agggtaggggaagtgtgctg

SEQ ID NO: 6647012 - DNA, 19 bp, Homo sapiens
agggtaggggagtgtgggt

SEQ ID NO: 6647013 - DNA, 15 bp, Homo sapiens
agggtagggggcctg

SEQ ID NO: 6647014 - DNA, 16 bp, Homo sapiens
agggtagggggcctga

SEQ ID NO: 6647015 - DNA, 18 bp, Homo sapiens
agggtaggttagatgcta

SEQ ID NO: 6647016 - DNA, 17 bp, Homo sapiens
agggtaggtttgtgtct

SEQ ID NO: 6647017 - DNA, 22 bp, Homo sapiens
agggtagtttaattttaaaata

SEQ ID NO: 6647018 - DNA, 16 bp, Homo sapiens
agggtataagttgctg

SEQ ID NO: 6647019 - DNA, 19 bp, Homo sapiens
agggtatcaggtgctgcca

SEQ ID NO: 6647020 - DNA, 22 bp, Homo sapiens
agggtatctgctgcctctgaaa

SEQ ID NO: 6647021 - DNA, 21 bp, Homo sapiens
agggtatctggtgactttcct

SEQ ID NO: 6647022 - DNA, 16 bp, Homo sapiens
agggtatgggaagcca

SEQ ID NO: 6647023 - DNA, 21 bp, Homo sapiens
agggtatgtcacaaagagctg

SEQ ID NO: 6647024 - DNA, 14 bp, Homo sapiens
agggtatttattgg

SEQ ID NO: 6647025 - DNA, 18 bp, Homo sapiens
agggtcaacggccctgtt

SEQ ID NO: 6647026 - DNA, 15 bp, Homo sapiens
agggtcaactggcga

SEQ ID NO: 6647027 - DNA, 21 bp, Homo sapiens
agggtcaactggcgaagcctg

SEQ ID NO: 6647028 - DNA, 16 bp, Homo sapiens
agggtcaagggctggg

SEQ ID NO: 6647029 - DNA, 14 bp, Homo sapiens
agggtcaatgctat

SEQ ID NO: 6647030 - DNA, 16 bp, Homo sapiens
agggtcactggcctct

SEQ ID NO: 6647031 - DNA, 17 bp, Homo sapiens
agggtcactggcctctc

SEQ ID NO: 6647032 - DNA, 19 bp, Homo sapiens
agggtcagacgcctgagga

SEQ ID NO: 6647033 - DNA, 21 bp, Homo sapiens
agggtcagacgcctgaggaac

SEQ ID NO: 6647034 - DNA, 20 bp, Homo sapiens
agggtcagaggacctgtatt

SEQ ID NO: 6647035 - DNA, 21 bp, Homo sapiens
agggtcagaggacctgtattt

SEQ ID NO: 6647036 - DNA, 17 bp, Homo sapiens
agggtcagccagggcct

SEQ ID NO: 6647037 - DNA, 18 bp, Homo sapiens
agggtcagccagggcctg

SEQ ID NO: 6647038 - DNA, 19 bp, Homo sapiens
agggtcagccagggcctgc

SEQ ID NO: 6647039 - DNA, 18 bp, Homo sapiens
agggtcagccatttttaa

SEQ ID NO: 6647040 - DNA, 15 bp, Homo sapiens
agggtcaggagaggg

SEQ ID NO: 6647041 - DNA, 10 bp, Homo sapiens
agggtcaggc

SEQ ID NO: 6647042 - DNA, 20 bp, Homo sapiens
agggtcaggcccgtcagcat

SEQ ID NO: 6647043 - DNA, 12 bp, Homo sapiens
agggtcaggcct

SEQ ID NO: 6647044 - DNA, 21 bp, Homo sapiens
agggtcaggttagggctcctg

SEQ ID NO: 6647045 - DNA, 15 bp, Homo sapiens
agggtcagtgccaag

SEQ ID NO: 6647046 - DNA, 15 bp, Homo sapiens
agggtcagtggaagc

SEQ ID NO: 6647047 - DNA, 16 bp, Homo sapiens
agggtcataagtgggg

SEQ ID NO: 6647048 - DNA, 16 bp, Homo sapiens
agggtcattttccttt

SEQ ID NO: 6647049 - DNA, 17 bp, Homo sapiens
agggtcattttcctttc

SEQ ID NO: 6647050 - DNA, 23 bp, Homo sapiens
agggtcattttcctttctgtatt

SEQ ID NO: 6647051 - DNA, 19 bp, Homo sapiens
agggtccaaccagacctgg

SEQ ID NO: 6647052 - DNA, 16 bp, Homo sapiens
agggtccaccctagcc

SEQ ID NO: 6647053 - DNA, 22 bp, Homo sapiens
agggtccaccttcagccctttg

SEQ ID NO: 6647054 - DNA, 19 bp, Homo sapiens
agggtccagaagtccctcc

SEQ ID NO: 6647055 - DNA, 13 bp, Homo sapiens
agggtccagaccc

SEQ ID NO: 6647056 - DNA, 19 bp, Homo sapiens
agggtccaggagagcctgg

SEQ ID NO: 6647057 - DNA, 21 bp, Homo sapiens
agggtccaggagagcctgggg

SEQ ID NO: 6647058 - DNA, 22 bp, Homo sapiens
agggtccaggagagcctggggg

SEQ ID NO: 6647059 - DNA, 12 bp, Homo sapiens
agggtcccaagc

SEQ ID NO: 6647060 - DNA, 13 bp, Homo sapiens
agggtcccaagct

SEQ ID NO: 6647061 - DNA, 18 bp, Homo sapiens
agggtcccaagctgggcc

SEQ ID NO: 6647062 - DNA, 12 bp, Homo sapiens
agggtcccaccc

SEQ ID NO: 6647063 - DNA, 15 bp, Homo sapiens
agggtcccaccccca

SEQ ID NO: 6647064 - DNA, 17 bp, Homo sapiens
agggtcccacccccaac

SEQ ID NO: 6647065 - DNA, 16 bp, Homo sapiens
agggtcccagggctgc

SEQ ID NO: 6647066 - DNA, 16 bp, Homo sapiens
agggtccccagctggt

SEQ ID NO: 6647067 - DNA, 21 bp, Homo sapiens
agggtcccccttcgtggagct

SEQ ID NO: 6647068 - DNA, 19 bp, Homo sapiens
agggtccccgagtgcctag

SEQ ID NO: 6647069 - DNA, 17 bp, Homo sapiens
agggtccccgggagcac

SEQ ID NO: 6647070 - DNA, 17 bp, Homo sapiens
agggtcccctccccagc

SEQ ID NO: 6647071 - DNA, 19 bp, Homo sapiens
agggtcccctccccagctc

SEQ ID NO: 6647072 - DNA, 20 bp, Homo sapiens
agggtcccctccccagctcc

SEQ ID NO: 6647073 - DNA, 17 bp, Homo sapiens
agggtcccctgccaccg

SEQ ID NO: 6647074 - DNA, 24 bp, Homo sapiens
agggtcccggtgtatcctggccct

SEQ ID NO: 6647075 - DNA, 19 bp, Homo sapiens
agggtccctaattctcttc

SEQ ID NO: 6647076 - DNA, 16 bp, Homo sapiens
agggtccctcgcgccc

SEQ ID NO: 6647077 - DNA, 22 bp, Homo sapiens
agggtccctgaacgccctggta

SEQ ID NO: 6647078 - DNA, 20 bp, Homo sapiens
agggtccctggtggcagctc

SEQ ID NO: 6647079 - DNA, 20 bp, Homo sapiens
agggtcctacggagggacca

SEQ ID NO: 6647080 - DNA, 23 bp, Homo sapiens
agggtcctcaggcagtggcccag

SEQ ID NO: 6647081 - DNA, 18 bp, Homo sapiens
agggtcctctacttcagg

SEQ ID NO: 6647082 - DNA, 22 bp, Homo sapiens
agggtcctctagcccactccct

SEQ ID NO: 6647083 - DNA, 15 bp, Homo sapiens
agggtcctctcttcc

SEQ ID NO: 6647084 - DNA, 16 bp, Homo sapiens
agggtcctgcagcctg

SEQ ID NO: 6647085 - DNA, 19 bp, Homo sapiens
agggtcctgcagcctgcag

SEQ ID NO: 6647086 - DNA, 21 bp, Homo sapiens
agggtcctgcagcctgcagga

SEQ ID NO: 6647087 - DNA, 14 bp, Homo sapiens
agggtcctgccggt

SEQ ID NO: 6647088 - DNA, 22 bp, Homo sapiens
agggtcctgctatttcccaagc

SEQ ID NO: 6647089 - DNA, 15 bp, Homo sapiens
agggtcctgctttct

SEQ ID NO: 6647090 - DNA, 14 bp, Homo sapiens
agggtcctggctcc

SEQ ID NO: 6647091 - DNA, 16 bp, Homo sapiens
agggtcctggctcctg

SEQ ID NO: 6647092 - DNA, 16 bp, Homo sapiens
agggtccttccctctc

SEQ ID NO: 6647093 - DNA, 17 bp, Homo sapiens
agggtccttccctctcc

SEQ ID NO: 6647094 - DNA, 18 bp, Homo sapiens
agggtcctttagtacctg

SEQ ID NO: 6647095 - DNA, 18 bp, Homo sapiens
agggtcgaaagctctaga

SEQ ID NO: 6647096 - DNA, 17 bp, Homo sapiens
agggtcggaacccaagc

SEQ ID NO: 6647097 - DNA, 22 bp, Homo sapiens
agggtcggaacccaagcttaga

SEQ ID NO: 6647098 - DNA, 18 bp, Homo sapiens
agggtcggaggtgctgtc

SEQ ID NO: 6647099 - DNA, 20 bp, Homo sapiens
agggtcgtctttgtgtatgg

SEQ ID NO: 6647100 - DNA, 17 bp, Homo sapiens
agggtcgtgggaaaggg

SEQ ID NO: 6647101 - DNA, 14 bp, Homo sapiens
agggtctaaagaga

SEQ ID NO: 6647102 - DNA, 23 bp, Homo sapiens
agggtctaccaatacaaaatgta

SEQ ID NO: 6647103 - DNA, 16 bp, Homo sapiens
agggtctagccgctgc

SEQ ID NO: 6647104 - DNA, 19 bp, Homo sapiens
agggtctagggagagaccc

SEQ ID NO: 6647105 - DNA, 20 bp, Homo sapiens
agggtctcactatgttgccc

SEQ ID NO: 6647106 - DNA, 21 bp, Homo sapiens
agggtctcactatgttgccca

SEQ ID NO: 6647107 - DNA, 22 bp, Homo sapiens
agggtctcactatgttgcccag

SEQ ID NO: 6647108 - DNA, 22 bp, Homo sapiens
agggtctcactctgtcgcccag

SEQ ID NO: 6647109 - DNA, 22 bp, Homo sapiens
agggtctcactgtgttgcccag

SEQ ID NO: 6647110 - DNA, 16 bp, Homo sapiens
agggtctcagggtgtc

SEQ ID NO: 6647111 - DNA, 14 bp, Homo sapiens
agggtctcccctcc

SEQ ID NO: 6647112 - DNA, 19 bp, Homo sapiens
agggtctcccctcctgcac

SEQ ID NO: 6647113 - DNA, 23 bp, Homo sapiens
agggtctcccctcctgcacacag

SEQ ID NO: 6647114 - DNA, 22 bp, Homo sapiens
agggtctccctatgttgcccag

SEQ ID NO: 6647115 - DNA, 14 bp, Homo sapiens
agggtctccctggg

SEQ ID NO: 6647116 - DNA, 18 bp, Homo sapiens
agggtctccctgggcacc

SEQ ID NO: 6647117 - DNA, 19 bp, Homo sapiens
agggtctcgaactcctggc

SEQ ID NO: 6647118 - DNA, 21 bp, Homo sapiens
agggtctcgctgtcactggct

SEQ ID NO: 6647119 - DNA, 22 bp, Homo sapiens
agggtctcgctgtcactggctg

SEQ ID NO: 6647120 - DNA, 23 bp, Homo sapiens
agggtctcgtcaggaggtgcctg

SEQ ID NO: 6647121 - DNA, 18 bp, Homo sapiens
agggtctctagtgctgtg

SEQ ID NO: 6647122 - DNA, 20 bp, Homo sapiens
agggtctctagtgctgtgaa

SEQ ID NO: 6647123 - DNA, 23 bp, Homo sapiens
agggtctctctccaggtcagcct

SEQ ID NO: 6647124 - DNA, 11 bp, Homo sapiens
agggtctgaaa

SEQ ID NO: 6647125 - DNA, 14 bp, Homo sapiens
agggtctgaaaggg

SEQ ID NO: 6647126 - DNA, 17 bp, Homo sapiens
agggtctgaaaggggtg

SEQ ID NO: 6647127 - DNA, 15 bp, Homo sapiens
agggtctgcagggaa

SEQ ID NO: 6647128 - DNA, 14 bp, Homo sapiens
agggtctgcctcca

SEQ ID NO: 6647129 - DNA, 14 bp, Homo sapiens
agggtctgctcttt

SEQ ID NO: 6647130 - DNA, 22 bp, Homo sapiens
agggtctgctctttctctgcca

SEQ ID NO: 6647131 - DNA, 16 bp, Homo sapiens
agggtctggcagagcc

SEQ ID NO: 6647132 - DNA, 18 bp, Homo sapiens
agggtctggcagagcctc

SEQ ID NO: 6647133 - DNA, 18 bp, Homo sapiens
agggtctggctgtccctt

SEQ ID NO: 6647134 - DNA, 13 bp, Homo sapiens
agggtctgggaca

SEQ ID NO: 6647135 - DNA, 13 bp, Homo sapiens
agggtctgggggc

SEQ ID NO: 6647136 - DNA, 16 bp, Homo sapiens
agggtctgggggcagc

SEQ ID NO: 6647137 - DNA, 13 bp, Homo sapiens
agggtctgttgta

SEQ ID NO: 6647138 - DNA, 19 bp, Homo sapiens
agggtctgttgtaaatgac

SEQ ID NO: 6647139 - DNA, 20 bp, Homo sapiens
agggtctgttgtaaatgacc

SEQ ID NO: 6647140 - DNA, 14 bp, Homo sapiens
agggtcttcagggg

SEQ ID NO: 6647141 - DNA, 15 bp, Homo sapiens
agggtcttccctacc

SEQ ID NO: 6647142 - DNA, 21 bp, Homo sapiens
agggtcttgactctaaatgca

SEQ ID NO: 6647143 - DNA, 13 bp, Homo sapiens
agggtcttgcaag

SEQ ID NO: 6647144 - DNA, 14 bp, Homo sapiens
agggtcttgctctg

SEQ ID NO: 6647145 - DNA, 22 bp, Homo sapiens
agggtcttgctctgtcccccag

SEQ ID NO: 6647146 - DNA, 14 bp, Homo sapiens
agggtcttgggaaa

SEQ ID NO: 6647147 - DNA, 21 bp, Homo sapiens
agggtcttgggctactggcag

SEQ ID NO: 6647148 - DNA, 15 bp, Homo sapiens
agggtcttgtgttgc

SEQ ID NO: 6647149 - DNA, 15 bp, Homo sapiens
agggtctttactggg

SEQ ID NO: 6647150 - DNA, 18 bp, Homo sapiens
agggtctttactgggaag

SEQ ID NO: 6647151 - DNA, 19 bp, Homo sapiens
agggtctttactgggaagc

SEQ ID NO: 6647152 - DNA, 18 bp, Homo sapiens
agggtctttgtgtgctgt

SEQ ID NO: 6647153 - DNA, 18 bp, Homo sapiens
agggtcttttaccctgtg

SEQ ID NO: 6647154 - DNA, 13 bp, Homo sapiens
agggtcttttcat

SEQ ID NO: 6647155 - DNA, 21 bp, Homo sapiens
agggtcttttcatctgggaaa

SEQ ID NO: 6647156 - DNA, 15 bp, Homo sapiens
agggtcttttgcagc

SEQ ID NO: 6647157 - DNA, 20 bp, Homo sapiens
agggtcttttttcatttctt

SEQ ID NO: 6647158 - DNA, 17 bp, Homo sapiens
agggtgaacaaagaaaa

SEQ ID NO: 6647159 - DNA, 16 bp, Homo sapiens
agggtgacagagggac

SEQ ID NO: 6647160 - DNA, 15 bp, Homo sapiens
agggtgacatcccag

SEQ ID NO: 6647161 - DNA, 16 bp, Homo sapiens
agggtgacatcccagg

SEQ ID NO: 6647162 - DNA, 22 bp, Homo sapiens
agggtgacatggggaaggcaga

SEQ ID NO: 6647163 - DNA, 18 bp, Homo sapiens
agggtgacccacagctct

SEQ ID NO: 6647164 - DNA, 13 bp, Homo sapiens
agggtgacgccca

SEQ ID NO: 6647165 - DNA, 17 bp, Homo sapiens
agggtgacgcccagctc

SEQ ID NO: 6647166 - DNA, 20 bp, Homo sapiens
agggtgacgcctgagacagc

SEQ ID NO: 6647167 - DNA, 18 bp, Homo sapiens
agggtgacttttcctgct

SEQ ID NO: 6647168 - DNA, 19 bp, Homo sapiens
agggtgacttttcctgctg

SEQ ID NO: 6647169 - DNA, 22 bp, Homo sapiens
agggtgacttttcctgctgcct

SEQ ID NO: 6647170 - DNA, 15 bp, Homo sapiens
agggtgagacactgc

SEQ ID NO: 6647171 - DNA, 22 bp, Homo sapiens
agggtgagcactctggggtggg

SEQ ID NO: 6647172 - DNA, 14 bp, Homo sapiens
agggtgagctggtg

SEQ ID NO: 6647173 - DNA, 14 bp, Homo sapiens
agggtgaggcgtgg

SEQ ID NO: 6647174 - DNA, 19 bp, Homo sapiens
agggtgagggaggacaggc

SEQ ID NO: 6647175 - DNA, 17 bp, Homo sapiens
agggtgagggccacctc

SEQ ID NO: 6647176 - DNA, 16 bp, Homo sapiens
agggtgagggccttct

SEQ ID NO: 6647177 - DNA, 17 bp, Homo sapiens
agggtgagggccttctt

SEQ ID NO: 6647178 - DNA, 13 bp, Homo sapiens
agggtgagggtga

SEQ ID NO: 6647179 - DNA, 18 bp, Homo sapiens
agggtgagtcctccagaa

SEQ ID NO: 6647180 - DNA, 21 bp, Homo sapiens
agggtgagtgaatggcaaagc

SEQ ID NO: 6647181 - DNA, 19 bp, Homo sapiens
agggtgagttggcttacct

SEQ ID NO: 6647182 - DNA, 20 bp, Homo sapiens
agggtgagttggcttacctg

SEQ ID NO: 6647183 - DNA, 22 bp, Homo sapiens
agggtgatgcattaattaatgg

SEQ ID NO: 6647184 - DNA, 21 bp, Homo sapiens
agggtgatgggaaagcattgt

SEQ ID NO: 6647185 - DNA, 22 bp, Homo sapiens
agggtgatgggaaagcattgta

SEQ ID NO: 6647186 - DNA, 15 bp, Homo sapiens
agggtgcagccacac

SEQ ID NO: 6647187 - DNA, 20 bp, Homo sapiens
agggtgcagttttccaggaa

SEQ ID NO: 6647188 - DNA, 23 bp, Homo sapiens
agggtgccatccacattttaaca

SEQ ID NO: 6647189 - DNA, 21 bp, Homo sapiens
agggtgccccgcctgagtcag

SEQ ID NO: 6647190 - DNA, 13 bp, Homo sapiens
agggtgcccctgg

SEQ ID NO: 6647191 - DNA, 21 bp, Homo sapiens
agggtgccctcctagctccac

SEQ ID NO: 6647192 - DNA, 23 bp, Homo sapiens
agggtgccggaaagagagctgga

SEQ ID NO: 6647193 - DNA, 13 bp, Homo sapiens
agggtgcctcagg

SEQ ID NO: 6647194 - DNA, 15 bp, Homo sapiens
agggtgcctcaggac

SEQ ID NO: 6647195 - DNA, 17 bp, Homo sapiens
agggtgcctcaggacct

SEQ ID NO: 6647196 - DNA, 15 bp, Homo sapiens
agggtgcctgctctc

SEQ ID NO: 6647197 - DNA, 11 bp, Homo sapiens
agggtgcctgg

SEQ ID NO: 6647198 - DNA, 12 bp, Homo sapiens
agggtgcctggc

SEQ ID NO: 6647199 - DNA, 13 bp, Homo sapiens
agggtgcctggct

SEQ ID NO: 6647200 - DNA, 18 bp, Homo sapiens
agggtgcggggcctgcag

SEQ ID NO: 6647201 - DNA, 19 bp, Homo sapiens
agggtgcggggcctgcagg

SEQ ID NO: 6647202 - DNA, 23 bp, Homo sapiens
agggtgcggggcctgcaggccag

SEQ ID NO: 6647203 - DNA, 23 bp, Homo sapiens
agggtgctaaagccaaccagcct

SEQ ID NO: 6647204 - DNA, 17 bp, Homo sapiens
agggtgctcagtctcct

SEQ ID NO: 6647205 - DNA, 19 bp, Homo sapiens
agggtgctccctcctcagt

SEQ ID NO: 6647206 - DNA, 21 bp, Homo sapiens
agggtgctctgaatctgtaca

SEQ ID NO: 6647207 - DNA, 22 bp, Homo sapiens
agggtgctgccccatgaagcca

SEQ ID NO: 6647208 - DNA, 23 bp, Homo sapiens
agggtggacttagaaagcagggg

SEQ ID NO: 6647209 - DNA, 14 bp, Homo sapiens
agggtggacttcag

SEQ ID NO: 6647210 - DNA, 12 bp, Homo sapiens
agggtggagact

SEQ ID NO: 6647211 - DNA, 22 bp, Homo sapiens
agggtggagagggagactcctg

SEQ ID NO: 6647212 - DNA, 13 bp, Homo sapiens
agggtggagagtt

SEQ ID NO: 6647213 - DNA, 20 bp, Homo sapiens
agggtggagatgtcagtctg

SEQ ID NO: 6647214 - DNA, 22 bp, Homo sapiens
agggtggagctgagaagaggag

SEQ ID NO: 6647215 - DNA, 18 bp, Homo sapiens
agggtggaggaaggtgct

SEQ ID NO: 6647216 - DNA, 19 bp, Homo sapiens
agggtggaggaaggtgctg

SEQ ID NO: 6647217 - DNA, 21 bp, Homo sapiens
agggtggaggaaggtgctgag

SEQ ID NO: 6647218 - DNA, 18 bp, Homo sapiens
agggtggatgtgctggag

SEQ ID NO: 6647219 - DNA, 20 bp, Homo sapiens
agggtggatgtgctggaggg

SEQ ID NO: 6647220 - DNA, 23 bp, Homo sapiens
agggtggcacatctgtcctgaca

SEQ ID NO: 6647221 - DNA, 21 bp, Homo sapiens
agggtggcacccaccactctc

SEQ ID NO: 6647222 - DNA, 17 bp, Homo sapiens
agggtggcactgggagg

SEQ ID NO: 6647223 - DNA, 16 bp, Homo sapiens
agggtggcagaagtgt

SEQ ID NO: 6647224 - DNA, 15 bp, Homo sapiens
agggtggcagcaaca

SEQ ID NO: 6647225 - DNA, 18 bp, Homo sapiens
agggtggccacacaggca

SEQ ID NO: 6647226 - DNA, 19 bp, Homo sapiens
agggtggccacacaggcag

SEQ ID NO: 6647227 - DNA, 12 bp, Homo sapiens
agggtggcccag

SEQ ID NO: 6647228 - DNA, 23 bp, Homo sapiens
agggtggccccctgtgccagctc

SEQ ID NO: 6647229 - DNA, 11 bp, Homo sapiens
agggtggccct

SEQ ID NO: 6647230 - DNA, 14 bp, Homo sapiens
agggtggcccttgc

SEQ ID NO: 6647231 - DNA, 16 bp, Homo sapiens
agggtggcgccctgcg

SEQ ID NO: 6647232 - DNA, 14 bp, Homo sapiens
agggtggctgccag

SEQ ID NO: 6647233 - DNA, 20 bp, Homo sapiens
agggtggctgccagcccact

SEQ ID NO: 6647234 - DNA, 22 bp, Homo sapiens
agggtggctttaattgtataag

SEQ ID NO: 6647235 - DNA, 14 bp, Homo sapiens
agggtgggaagaga

SEQ ID NO: 6647236 - DNA, 16 bp, Homo sapiens
agggtgggaaggggct

SEQ ID NO: 6647237 - DNA, 18 bp, Homo sapiens
agggtgggagagcccagc

SEQ ID NO: 6647238 - DNA, 14 bp, Homo sapiens
agggtgggagccta

SEQ ID NO: 6647239 - DNA, 18 bp, Homo sapiens
agggtgggaggggccatg

SEQ ID NO: 6647240 - DNA, 13 bp, Homo sapiens
agggtgggagtgg

SEQ ID NO: 6647241 - DNA, 16 bp, Homo sapiens
agggtgggagtggggc

SEQ ID NO: 6647242 - DNA, 13 bp, Homo sapiens
agggtgggccagc

SEQ ID NO: 6647243 - DNA, 15 bp, Homo sapiens
agggtgggccccagc

SEQ ID NO: 6647244 - DNA, 21 bp, Homo sapiens
agggtgggccccagccgtggc

SEQ ID NO: 6647245 - DNA, 13 bp, Homo sapiens
agggtgggccctg

SEQ ID NO: 6647246 - DNA, 22 bp, Homo sapiens
agggtgggcgtttggggccctc

SEQ ID NO: 6647247 - DNA, 18 bp, Homo sapiens
agggtgggctctgaccca

SEQ ID NO: 6647248 - DNA, 18 bp, Homo sapiens
agggtgggcttcctgccc

SEQ ID NO: 6647249 - DNA, 17 bp, Homo sapiens
agggtgggcttgtgggg

SEQ ID NO: 6647250 - DNA, 15 bp, Homo sapiens
agggtggggagggag

SEQ ID NO: 6647251 - DNA, 22 bp, Homo sapiens
agggtggggccgggtgaaaatg

SEQ ID NO: 6647252 - DNA, 20 bp, Homo sapiens
agggtgggggccacctgcct

SEQ ID NO: 6647253 - DNA, 20 bp, Homo sapiens
agggtggggtaaggaggaga

SEQ ID NO: 6647254 - DNA, 21 bp, Homo sapiens
agggtggggtaaggaggagaa

SEQ ID NO: 6647255 - DNA, 20 bp, Homo sapiens
agggtggggtctgggagggg

SEQ ID NO: 6647256 - DNA, 20 bp, Homo sapiens
agggtgggtgctcagaataa

SEQ ID NO: 6647257 - DNA, 11 bp, Homo sapiens
agggtggtagt

SEQ ID NO: 6647258 - DNA, 17 bp, Homo sapiens
agggtggtgacctctgc

SEQ ID NO: 6647259 - DNA, 21 bp, Homo sapiens
agggtggtgacctctgcctga

SEQ ID NO: 6647260 - DNA, 16 bp, Homo sapiens
agggtggtgctgggac

SEQ ID NO: 6647261 - DNA, 15 bp, Homo sapiens
agggtggtggagcca

SEQ ID NO: 6647262 - DNA, 16 bp, Homo sapiens
agggtggtggggacag

SEQ ID NO: 6647263 - DNA, 18 bp, Homo sapiens
agggtggtggtattctgt

SEQ ID NO: 6647264 - DNA, 20 bp, Homo sapiens
agggtgtaggggccacctcc

SEQ ID NO: 6647265 - DNA, 14 bp, Homo sapiens
agggtgtatagtgt

SEQ ID NO: 6647266 - DNA, 19 bp, Homo sapiens
agggtgtctgcgtcgtcac

SEQ ID NO: 6647267 - DNA, 20 bp, Homo sapiens
agggtgtgactcgggagctg

SEQ ID NO: 6647268 - DNA, 22 bp, Homo sapiens
agggtgtgactcgggagctgca

SEQ ID NO: 6647269 - DNA, 13 bp, Homo sapiens
agggtgtgaggcc

SEQ ID NO: 6647270 - DNA, 18 bp, Homo sapiens
agggtgtggccctgccat

SEQ ID NO: 6647271 - DNA, 14 bp, Homo sapiens
agggtgtggctcct

SEQ ID NO: 6647272 - DNA, 20 bp, Homo sapiens
agggtgtggcttggaacatt

SEQ ID NO: 6647273 - DNA, 20 bp, Homo sapiens
agggtgtgggtcagggaggg

SEQ ID NO: 6647274 - DNA, 17 bp, Homo sapiens
agggtgtgtgttcacct

SEQ ID NO: 6647275 - DNA, 22 bp, Homo sapiens
agggtgttggcattggtgtctg

SEQ ID NO: 6647276 - DNA, 12 bp, Homo sapiens
agggtgtttcct

SEQ ID NO: 6647277 - DNA, 13 bp, Homo sapiens
agggtgtttcctc

SEQ ID NO: 6647278 - DNA, 15 bp, Homo sapiens
agggtgtttcctcta

SEQ ID NO: 6647279 - DNA, 17 bp, Homo sapiens
agggtgtttgcagctgt

SEQ ID NO: 6647280 - DNA, 13 bp, Homo sapiens
agggtgttttaaa

SEQ ID NO: 6647281 - DNA, 11 bp, Homo sapiens
agggtgttttt

SEQ ID NO: 6647282 - DNA, 14 bp, Homo sapiens
agggttaaactgca

SEQ ID NO: 6647283 - DNA, 19 bp, Homo sapiens
agggttaaagaaaggcaga

SEQ ID NO: 6647284 - DNA, 18 bp, Homo sapiens
agggttactatgcacaat

SEQ ID NO: 6647285 - DNA, 23 bp, Homo sapiens
agggttagacaagcctggaggac

SEQ ID NO: 6647286 - DNA, 17 bp, Homo sapiens
agggttagcctgcaccg

SEQ ID NO: 6647287 - DNA, 20 bp, Homo sapiens
agggttaggaatctcttcac

SEQ ID NO: 6647288 - DNA, 21 bp, Homo sapiens
agggttatacacagaaaaggg

SEQ ID NO: 6647289 - DNA, 17 bp, Homo sapiens
agggttatgattaagta

SEQ ID NO: 6647290 - DNA, 22 bp, Homo sapiens
agggttcaaaatgtctgtagct

SEQ ID NO: 6647291 - DNA, 16 bp, Homo sapiens
agggttcatctgtcca

SEQ ID NO: 6647292 - DNA, 13 bp, Homo sapiens
agggttccagaca

SEQ ID NO: 6647293 - DNA, 20 bp, Homo sapiens
agggttccagacagggtggg

SEQ ID NO: 6647294 - DNA, 17 bp, Homo sapiens
agggttcccctggcctt

SEQ ID NO: 6647295 - DNA, 16 bp, Homo sapiens
agggttccgccactcc

SEQ ID NO: 6647296 - DNA, 18 bp, Homo sapiens
agggttctaaatgcaata

SEQ ID NO: 6647297 - DNA, 15 bp, Homo sapiens
agggttctagaaggg

SEQ ID NO: 6647298 - DNA, 19 bp, Homo sapiens
agggttctccattacagtg

SEQ ID NO: 6647299 - DNA, 17 bp, Homo sapiens
agggttctcctctcccc

SEQ ID NO: 6647300 - DNA, 20 bp, Homo sapiens
agggttctcctctcccctct

SEQ ID NO: 6647301 - DNA, 13 bp, Homo sapiens
agggttctgccct

SEQ ID NO: 6647302 - DNA, 19 bp, Homo sapiens
agggttctgctcggcttct

SEQ ID NO: 6647303 - DNA, 13 bp, Homo sapiens
agggttctgtatt

SEQ ID NO: 6647304 - DNA, 21 bp, Homo sapiens
agggttgaaaatgtgtttgct

SEQ ID NO: 6647305 - DNA, 19 bp, Homo sapiens
agggttgaattctggagga

SEQ ID NO: 6647306 - DNA, 18 bp, Homo sapiens
agggttgaccccagagga

SEQ ID NO: 6647307 - DNA, 18 bp, Homo sapiens
agggttgattaaggcagt

SEQ ID NO: 6647308 - DNA, 20 bp, Homo sapiens
agggttgctgcctttcaagc

SEQ ID NO: 6647309 - DNA, 16 bp, Homo sapiens
agggttgctggagcct

SEQ ID NO: 6647310 - DNA, 17 bp, Homo sapiens
agggttgctggagcctg

SEQ ID NO: 6647311 - DNA, 19 bp, Homo sapiens
agggttgcttctgagtggt

SEQ ID NO: 6647312 - DNA, 21 bp, Homo sapiens
agggttgcttctgagtggtgt

SEQ ID NO: 6647313 - DNA, 20 bp, Homo sapiens
agggttggaaagtccaagcc

SEQ ID NO: 6647314 - DNA, 17 bp, Homo sapiens
agggttggagtgctctt

SEQ ID NO: 6647315 - DNA, 21 bp, Homo sapiens
agggttggagtgctcttccca

SEQ ID NO: 6647316 - DNA, 13 bp, Homo sapiens
agggttggcacct

SEQ ID NO: 6647317 - DNA, 15 bp, Homo sapiens
agggttggcacctgc

SEQ ID NO: 6647318 - DNA, 16 bp, Homo sapiens
agggttggcacctgca

SEQ ID NO: 6647319 - DNA, 17 bp, Homo sapiens
agggttggcaccttccc

SEQ ID NO: 6647320 - DNA, 20 bp, Homo sapiens
agggttggcaccttccccct

SEQ ID NO: 6647321 - DNA, 13 bp, Homo sapiens
agggttggcccct

SEQ ID NO: 6647322 - DNA, 19 bp, Homo sapiens
agggttgggaaaatccaaa

SEQ ID NO: 6647323 - DNA, 15 bp, Homo sapiens
agggttgggcccaga

SEQ ID NO: 6647324 - DNA, 15 bp, Homo sapiens
agggttgggctggtg

SEQ ID NO: 6647325 - DNA, 17 bp, Homo sapiens
agggttgggctggtgtc

SEQ ID NO: 6647326 - DNA, 15 bp, Homo sapiens
agggttggggagggg

SEQ ID NO: 6647327 - DNA, 17 bp, Homo sapiens
agggttggggaggggcg

SEQ ID NO: 6647328 - DNA, 13 bp, Homo sapiens
agggttggggggt

SEQ ID NO: 6647329 - DNA, 20 bp, Homo sapiens
agggttggggggtgccggca

SEQ ID NO: 6647330 - DNA, 20 bp, Homo sapiens
agggttggtcctcttgcctc

SEQ ID NO: 6647331 - DNA, 16 bp, Homo sapiens
agggttggtgggctgg

SEQ ID NO: 6647332 - DNA, 18 bp, Homo sapiens
agggttggtgggctggcc

SEQ ID NO: 6647333 - DNA, 21 bp, Homo sapiens
agggttggtgggctggcccag

SEQ ID NO: 6647334 - DNA, 20 bp, Homo sapiens
agggttgtactattgtttaa

SEQ ID NO: 6647335 - DNA, 14 bp, Homo sapiens
agggttgtgcccac

SEQ ID NO: 6647336 - DNA, 14 bp, Homo sapiens
agggtttaaagatg

SEQ ID NO: 6647337 - DNA, 15 bp, Homo sapiens
agggtttatcttttg

SEQ ID NO: 6647338 - DNA, 21 bp, Homo sapiens
agggtttcaccatgttggcca

SEQ ID NO: 6647339 - DNA, 14 bp, Homo sapiens
agggtttcattgtg

SEQ ID NO: 6647340 - DNA, 14 bp, Homo sapiens
agggtttcgactgg

SEQ ID NO: 6647341 - DNA, 21 bp, Homo sapiens
agggtttcgactggtccagct

SEQ ID NO: 6647342 - DNA, 19 bp, Homo sapiens
agggtttcgagaagctgct

SEQ ID NO: 6647343 - DNA, 15 bp, Homo sapiens
agggtttctctccca

SEQ ID NO: 6647344 - DNA, 18 bp, Homo sapiens
agggtttggacagaccca

SEQ ID NO: 6647345 - DNA, 23 bp, Homo sapiens
agggtttggctgtgtctaaactg

SEQ ID NO: 6647346 - DNA, 22 bp, Homo sapiens
agggtttggttagctcacagga

SEQ ID NO: 6647347 - DNA, 21 bp, Homo sapiens
agggtttgtgacagggcgggg

SEQ ID NO: 6647348 - DNA, 16 bp, Homo sapiens
agggtttgtgcccagt

SEQ ID NO: 6647349 - DNA, 14 bp, Homo sapiens
agggtttgtggctg

SEQ ID NO: 6647350 - DNA, 15 bp, Homo sapiens
agggttttaactttg

SEQ ID NO: 6647351 - DNA, 16 bp, Homo sapiens
agggttttaactttgt

SEQ ID NO: 6647352 - DNA, 17 bp, Homo sapiens
agggttttaatgtagat

SEQ ID NO: 6647353 - DNA, 19 bp, Homo sapiens
agggttttccaccctggaa

SEQ ID NO: 6647354 - DNA, 16 bp, Homo sapiens
agggttttccaggtgt

SEQ ID NO: 6647355 - DNA, 15 bp, Homo sapiens
agggttttctcttgg

SEQ ID NO: 6647356 - DNA, 18 bp, Homo sapiens
agggttttgcaataactt

SEQ ID NO: 6647357 - DNA, 22 bp, Homo sapiens
agggttttgccatgttggccag

SEQ ID NO: 6647358 - DNA, 12 bp, Homo sapiens
agggttttgccc

SEQ ID NO: 6647359 - DNA, 23 bp, Homo sapiens
agggttttggggtcctgggctgg

SEQ ID NO: 6647360 - DNA, 13 bp, Homo sapiens
agggtttttacct

SEQ ID NO: 6647361 - DNA, 14 bp, Homo sapiens
agggtttttagaga

SEQ ID NO: 6647362 - DNA, 17 bp, Homo sapiens
agggtttttagagaatg

SEQ ID NO: 6647363 - DNA, 20 bp, Homo sapiens
agggtttttagagaatgtgt

SEQ ID NO: 6647364 - DNA, 15 bp, Homo sapiens
agggttttttagaaa

SEQ ID NO: 6647365 - DNA, 16 bp, Homo sapiens
agggttttttagaaaa

SEQ ID NO: 6647366 - DNA, 20 bp, Homo sapiens
agggttttttttaatgtgaa

SEQ ID NO: 6647367 - DNA, 17 bp, Homo sapiens
aggtaaaaaaaagaagt

SEQ ID NO: 6647368 - DNA, 12 bp, Homo sapiens
aggtaaaaaccc

SEQ ID NO: 6647369 - DNA, 14 bp, Homo sapiens
aggtaaaacaaaac

SEQ ID NO: 6647370 - DNA, 15 bp, Homo sapiens
aggtaaaatcacttc

SEQ ID NO: 6647371 - DNA, 22 bp, Homo sapiens
aggtaaaatgccatgatgcctc

SEQ ID NO: 6647372 - DNA, 14 bp, Homo sapiens
aggtaaaatgtatt

SEQ ID NO: 6647373 - DNA, 15 bp, Homo sapiens
aggtaaaatgtattt

SEQ ID NO: 6647374 - DNA, 16 bp, Homo sapiens
aggtaaaatgtatttt

SEQ ID NO: 6647375 - DNA, 16 bp, Homo sapiens
aggtaaaattctaaat

SEQ ID NO: 6647376 - DNA, 13 bp, Homo sapiens
aggtaaacaaaga

SEQ ID NO: 6647377 - DNA, 14 bp, Homo sapiens
aggtaaacagttct

SEQ ID NO: 6647378 - DNA, 19 bp, Homo sapiens
aggtaaactgatgctttca

SEQ ID NO: 6647379 - DNA, 15 bp, Homo sapiens
aggtaaaggatgagg

SEQ ID NO: 6647380 - DNA, 16 bp, Homo sapiens
aggtaaaggatgaggg

SEQ ID NO: 6647381 - DNA, 17 bp, Homo sapiens
aggtaaagggacactgg

SEQ ID NO: 6647382 - DNA, 11 bp, Homo sapiens
aggtaaataaa

SEQ ID NO: 6647383 - DNA, 14 bp, Homo sapiens
aggtaaataaaaag

SEQ ID NO: 6647384 - DNA, 17 bp, Homo sapiens
aggtaaataaagctcaa

SEQ ID NO: 6647385 - DNA, 22 bp, Homo sapiens
aggtaaatctagagtttataca

SEQ ID NO: 6647386 - DNA, 22 bp, Homo sapiens
aggtaaatgggcagtgcctcct

SEQ ID NO: 6647387 - DNA, 22 bp, Homo sapiens
aggtaaatggttaaattttaca

SEQ ID NO: 6647388 - DNA, 12 bp, Homo sapiens
aggtaaatgtaa

SEQ ID NO: 6647389 - DNA, 22 bp, Homo sapiens
aggtaaatttttaggcaaagat

SEQ ID NO: 6647390 - DNA, 22 bp, Homo sapiens
aggtaacaagagtatgtggcaa

SEQ ID NO: 6647391 - DNA, 19 bp, Homo sapiens
aggtaacacgggaatcaca

SEQ ID NO: 6647392 - DNA, 12 bp, Homo sapiens
aggtaacactac

SEQ ID NO: 6647393 - DNA, 23 bp, Homo sapiens
aggtaacactagggccttggaaa

SEQ ID NO: 6647394 - DNA, 18 bp, Homo sapiens
aggtaacagaacagcttc

SEQ ID NO: 6647395 - DNA, 22 bp, Homo sapiens
aggtaacagaacagcttcaggt

SEQ ID NO: 6647396 - DNA, 13 bp, Homo sapiens
aggtaacaggcag

SEQ ID NO: 6647397 - DNA, 14 bp, Homo sapiens
aggtaacaggcaga

SEQ ID NO: 6647398 - DNA, 20 bp, Homo sapiens
aggtaacaggtgtgtatgta

SEQ ID NO: 6647399 - DNA, 24 bp, Homo sapiens
aggtaacatagatgcctgggcctg

SEQ ID NO: 6647400 - DNA, 18 bp, Homo sapiens
aggtaacattataaatga

SEQ ID NO: 6647401 - DNA, 12 bp, Homo sapiens
aggtaaccagtt

SEQ ID NO: 6647402 - DNA, 18 bp, Homo sapiens
aggtaaccagtttaaatt

SEQ ID NO: 6647403 - DNA, 18 bp, Homo sapiens
aggtaaccttatatttac

SEQ ID NO: 6647404 - DNA, 16 bp, Homo sapiens
aggtaactactgctaa

SEQ ID NO: 6647405 - DNA, 19 bp, Homo sapiens
aggtaactactgctaatgt

SEQ ID NO: 6647406 - DNA, 21 bp, Homo sapiens
aggtaacttattgtggcccag

SEQ ID NO: 6647407 - DNA, 15 bp, Homo sapiens
aggtaagaagtttta

SEQ ID NO: 6647408 - DNA, 17 bp, Homo sapiens
aggtaagagctgatgtg

SEQ ID NO: 6647409 - DNA, 18 bp, Homo sapiens
aggtaagatcataacaat

SEQ ID NO: 6647410 - DNA, 19 bp, Homo sapiens
aggtaagcaggaggaggtg

SEQ ID NO: 6647411 - DNA, 17 bp, Homo sapiens
aggtaaggaatacctgt

SEQ ID NO: 6647412 - DNA, 16 bp, Homo sapiens
aggtaaggtgaaggtg

SEQ ID NO: 6647413 - DNA, 14 bp, Homo sapiens
aggtaagtggcagg

SEQ ID NO: 6647414 - DNA, 13 bp, Homo sapiens
aggtaagtttttt

SEQ ID NO: 6647415 - DNA, 24 bp, Homo sapiens
aggtaataaaagctttgactccct

SEQ ID NO: 6647416 - DNA, 22 bp, Homo sapiens
aggtaataataaaggttgagtt

SEQ ID NO: 6647417 - DNA, 13 bp, Homo sapiens
aggtaatatacct

SEQ ID NO: 6647418 - DNA, 17 bp, Homo sapiens
aggtaatatacctggtt

SEQ ID NO: 6647419 - DNA, 15 bp, Homo sapiens
aggtaatatgtcttg

SEQ ID NO: 6647420 - DNA, 13 bp, Homo sapiens
aggtaatgaggga

SEQ ID NO: 6647421 - DNA, 16 bp, Homo sapiens
aggtaatgcacatcct

SEQ ID NO: 6647422 - DNA, 20 bp, Homo sapiens
aggtaatggttggtttttgt

SEQ ID NO: 6647423 - DNA, 15 bp, Homo sapiens
aggtaattaaagtag

SEQ ID NO: 6647424 - DNA, 14 bp, Homo sapiens
aggtaattattgct

SEQ ID NO: 6647425 - DNA, 17 bp, Homo sapiens
aggtaattccttagaga

SEQ ID NO: 6647426 - DNA, 16 bp, Homo sapiens
aggtaattctccctaa

SEQ ID NO: 6647427 - DNA, 11 bp, Homo sapiens
aggtaattgtt

SEQ ID NO: 6647428 - DNA, 22 bp, Homo sapiens
aggtaattgttttttaaagcaa

SEQ ID NO: 6647429 - DNA, 19 bp, Homo sapiens
aggtaatttcttgtgcctc

SEQ ID NO: 6647430 - DNA, 14 bp, Homo sapiens
aggtaatttttacc

SEQ ID NO: 6647431 - DNA, 20 bp, Homo sapiens
aggtaatttttttttgtaaa

SEQ ID NO: 6647432 - DNA, 20 bp, Homo sapiens
aggtacaacagaataatgca

SEQ ID NO: 6647433 - DNA, 20 bp, Homo sapiens
aggtacaaccggatgccagc

SEQ ID NO: 6647434 - DNA, 16 bp, Homo sapiens
aggtacaactgtattt

SEQ ID NO: 6647435 - DNA, 16 bp, Homo sapiens
aggtacaagaagcatt

SEQ ID NO: 6647436 - DNA, 15 bp, Homo sapiens
aggtacaatctttca

SEQ ID NO: 6647437 - DNA, 22 bp, Homo sapiens
aggtacaatctttcaccaagta

SEQ ID NO: 6647438 - DNA, 13 bp, Homo sapiens
aggtacacatatt

SEQ ID NO: 6647439 - DNA, 18 bp, Homo sapiens
aggtacacctccccctgc

SEQ ID NO: 6647440 - DNA, 19 bp, Homo sapiens
aggtacagcgggctgtgcc

SEQ ID NO: 6647441 - DNA, 14 bp, Homo sapiens
aggtacaggagagg

SEQ ID NO: 6647442 - DNA, 17 bp, Homo sapiens
aggtacaggagaggcag

SEQ ID NO: 6647443 - DNA, 18 bp, Homo sapiens
aggtacaggagaggcagc

SEQ ID NO: 6647444 - DNA, 11 bp, Homo sapiens
aggtacagggt

SEQ ID NO: 6647445 - DNA, 18 bp, Homo sapiens
aggtacagggtttttacc

SEQ ID NO: 6647446 - DNA, 14 bp, Homo sapiens
aggtacatttctga

SEQ ID NO: 6647447 - DNA, 16 bp, Homo sapiens
aggtacatttctgatt

SEQ ID NO: 6647448 - DNA, 18 bp, Homo sapiens
aggtaccaaacaaggaag

SEQ ID NO: 6647449 - DNA, 21 bp, Homo sapiens
aggtaccactgatttggagat

SEQ ID NO: 6647450 - DNA, 13 bp, Homo sapiens
aggtaccagctgc

SEQ ID NO: 6647451 - DNA, 23 bp, Homo sapiens
aggtaccagctgcgcttgctttt

SEQ ID NO: 6647452 - DNA, 21 bp, Homo sapiens
aggtaccatttgtgtctcttt

SEQ ID NO: 6647453 - DNA, 23 bp, Homo sapiens
aggtacccaatagctgcccattt

SEQ ID NO: 6647454 - DNA, 19 bp, Homo sapiens
aggtaccccaaaactctgt

SEQ ID NO: 6647455 - DNA, 19 bp, Homo sapiens
aggtaccccagctctgctt

SEQ ID NO: 6647456 - DNA, 20 bp, Homo sapiens
aggtaccccagctctgcttg

SEQ ID NO: 6647457 - DNA, 12 bp, Homo sapiens
aggtaccctggg

SEQ ID NO: 6647458 - DNA, 17 bp, Homo sapiens
aggtaccgatttctgct

SEQ ID NO: 6647459 - DNA, 19 bp, Homo sapiens
aggtaccgatttctgctaa

SEQ ID NO: 6647460 - DNA, 22 bp, Homo sapiens
aggtacctaggttggagtccag

SEQ ID NO: 6647461 - DNA, 12 bp, Homo sapiens
aggtacctcatg

SEQ ID NO: 6647462 - DNA, 16 bp, Homo sapiens
aggtaccttgtagcag

SEQ ID NO: 6647463 - DNA, 16 bp, Homo sapiens
aggtacctttcacata

SEQ ID NO: 6647464 - DNA, 22 bp, Homo sapiens
aggtacgaaaagaggggaagag

SEQ ID NO: 6647465 - DNA, 17 bp, Homo sapiens
aggtacgcacagacagg

SEQ ID NO: 6647466 - DNA, 17 bp, Homo sapiens
aggtacggtgagactct

SEQ ID NO: 6647467 - DNA, 20 bp, Homo sapiens
aggtactaattaacttaaac

SEQ ID NO: 6647468 - DNA, 17 bp, Homo sapiens
aggtactagaatgctta

SEQ ID NO: 6647469 - DNA, 22 bp, Homo sapiens
aggtactatctgtgaagttaca

SEQ ID NO: 6647470 - DNA, 14 bp, Homo sapiens
aggtactcctgcca

SEQ ID NO: 6647471 - DNA, 17 bp, Homo sapiens
aggtactcctgccaggg

SEQ ID NO: 6647472 - DNA, 15 bp, Homo sapiens
aggtactgagacagg

SEQ ID NO: 6647473 - DNA, 22 bp, Homo sapiens
aggtactgccatatttttctgt

SEQ ID NO: 6647474 - DNA, 16 bp, Homo sapiens
aggtactggtcccttc

SEQ ID NO: 6647475 - DNA, 23 bp, Homo sapiens
aggtactggtgagggcaagaggt

SEQ ID NO: 6647476 - DNA, 11 bp, Homo sapiens
aggtactgtat

SEQ ID NO: 6647477 - DNA, 15 bp, Homo sapiens
aggtactgtatgatc

SEQ ID NO: 6647478 - DNA, 23 bp, Homo sapiens
aggtactgtctgcttctctctct

SEQ ID NO: 6647479 - DNA, 17 bp, Homo sapiens
aggtactgtggggtgga

SEQ ID NO: 6647480 - DNA, 16 bp, Homo sapiens
aggtacttcctcctga

SEQ ID NO: 6647481 - DNA, 23 bp, Homo sapiens
aggtactttcatattttaaacag

SEQ ID NO: 6647482 - DNA, 23 bp, Homo sapiens
aggtactttgtctaagaaacatt

SEQ ID NO: 6647483 - DNA, 11 bp, Homo sapiens
aggtacttttg

SEQ ID NO: 6647484 - DNA, 14 bp, Homo sapiens
aggtagaaaaaggg

SEQ ID NO: 6647485 - DNA, 17 bp, Homo sapiens
aggtagaaatatctgaa

SEQ ID NO: 6647486 - DNA, 17 bp, Homo sapiens
aggtagaatgaccttgt

SEQ ID NO: 6647487 - DNA, 21 bp, Homo sapiens
aggtagaatgaccttgtaatg

SEQ ID NO: 6647488 - DNA, 20 bp, Homo sapiens
aggtagacctgtctcctggc

SEQ ID NO: 6647489 - DNA, 12 bp, Homo sapiens
aggtagagaaac

SEQ ID NO: 6647490 - DNA, 18 bp, Homo sapiens
aggtagagatgtgtgtgt

SEQ ID NO: 6647491 - DNA, 15 bp, Homo sapiens
aggtagaggaaaatc

SEQ ID NO: 6647492 - DNA, 16 bp, Homo sapiens
aggtagagtcttacaa

SEQ ID NO: 6647493 - DNA, 14 bp, Homo sapiens
aggtagagtggtca

SEQ ID NO: 6647494 - DNA, 17 bp, Homo sapiens
aggtagagtttgatcat

SEQ ID NO: 6647495 - DNA, 22 bp, Homo sapiens
aggtagatcatcttgaatattt

SEQ ID NO: 6647496 - DNA, 21 bp, Homo sapiens
aggtagatcgcttgagcccag

SEQ ID NO: 6647497 - DNA, 20 bp, Homo sapiens
aggtagatgttcagattgct

SEQ ID NO: 6647498 - DNA, 20 bp, Homo sapiens
aggtagattttaagaatggt

SEQ ID NO: 6647499 - DNA, 12 bp, Homo sapiens
aggtagcacagc

SEQ ID NO: 6647500 - DNA, 17 bp, Homo sapiens
aggtagcactctcagag

SEQ ID NO: 6647501 - DNA, 14 bp, Homo sapiens
aggtagcagcaaat

SEQ ID NO: 6647502 - DNA, 16 bp, Homo sapiens
aggtagccctggccag

SEQ ID NO: 6647503 - DNA, 21 bp, Homo sapiens
aggtagccctggccagaggct

SEQ ID NO: 6647504 - DNA, 16 bp, Homo sapiens
aggtagccgggctctg

SEQ ID NO: 6647505 - DNA, 16 bp, Homo sapiens
aggtagcctgctgtgg

SEQ ID NO: 6647506 - DNA, 19 bp, Homo sapiens
aggtagcctgctgtggggt

SEQ ID NO: 6647507 - DNA, 14 bp, Homo sapiens
aggtagcgagctgc

SEQ ID NO: 6647508 - DNA, 21 bp, Homo sapiens
aggtagcgagctgctctgcta

SEQ ID NO: 6647509 - DNA, 19 bp, Homo sapiens
aggtagctgcccctggctc

SEQ ID NO: 6647510 - DNA, 19 bp, Homo sapiens
aggtagcttacctgacaca

SEQ ID NO: 6647511 - DNA, 12 bp, Homo sapiens
aggtaggaagag

SEQ ID NO: 6647512 - DNA, 21 bp, Homo sapiens
aggtaggaagcaacagcttca

SEQ ID NO: 6647513 - DNA, 12 bp, Homo sapiens
aggtaggagacc

SEQ ID NO: 6647514 - DNA, 14 bp, Homo sapiens
aggtaggccaaggt

SEQ ID NO: 6647515 - DNA, 12 bp, Homo sapiens
aggtaggccctt

SEQ ID NO: 6647516 - DNA, 18 bp, Homo sapiens
aggtaggcccttgtcctg

SEQ ID NO: 6647517 - DNA, 19 bp, Homo sapiens
aggtaggcccttgtcctgc

SEQ ID NO: 6647518 - DNA, 18 bp, Homo sapiens
aggtaggggccgtgtccc

SEQ ID NO: 6647519 - DNA, 21 bp, Homo sapiens
aggtagggtgtgtatatataa

SEQ ID NO: 6647520 - DNA, 14 bp, Homo sapiens
aggtagtgggctca

SEQ ID NO: 6647521 - DNA, 17 bp, Homo sapiens
aggtagtgggtgaatgt

SEQ ID NO: 6647522 - DNA, 21 bp, Homo sapiens
aggtagtgggtgaatgtgtga

SEQ ID NO: 6647523 - DNA, 17 bp, Homo sapiens
aggtagtggttaattac

SEQ ID NO: 6647524 - DNA, 15 bp, Homo sapiens
aggtagttagcaata

SEQ ID NO: 6647525 - DNA, 17 bp, Homo sapiens
aggtagttcaagaaatg

SEQ ID NO: 6647526 - DNA, 22 bp, Homo sapiens
aggtagttcaagaaatgaagag

SEQ ID NO: 6647527 - DNA, 20 bp, Homo sapiens
aggtagttggaactttctgt

SEQ ID NO: 6647528 - DNA, 22 bp, Homo sapiens
aggtagttggtgaacagagaga

SEQ ID NO: 6647529 - DNA, 17 bp, Homo sapiens
aggtagtttttctgtca

SEQ ID NO: 6647530 - DNA, 20 bp, Homo sapiens
aggtataaaaaataagtaaa

SEQ ID NO: 6647531 - DNA, 13 bp, Homo sapiens
aggtataaagaca

SEQ ID NO: 6647532 - DNA, 22 bp, Homo sapiens
aggtataaggatcttttgtaaa

SEQ ID NO: 6647533 - DNA, 12 bp, Homo sapiens
aggtataattgt

SEQ ID NO: 6647534 - DNA, 11 bp, Homo sapiens
aggtataattt

SEQ ID NO: 6647535 - DNA, 22 bp, Homo sapiens
aggtatacaatgttctgttgta

SEQ ID NO: 6647536 - DNA, 13 bp, Homo sapiens
aggtatacctcac

SEQ ID NO: 6647537 - DNA, 15 bp, Homo sapiens
aggtatacctcagtt

SEQ ID NO: 6647538 - DNA, 17 bp, Homo sapiens
aggtatacctgggaaga

SEQ ID NO: 6647539 - DNA, 18 bp, Homo sapiens
aggtatacctgggaagat

SEQ ID NO: 6647540 - DNA, 14 bp, Homo sapiens
aggtatactatgta

SEQ ID NO: 6647541 - DNA, 17 bp, Homo sapiens
aggtatactttagtaga

SEQ ID NO: 6647542 - DNA, 23 bp, Homo sapiens
aggtataggggtcctgggggcag

SEQ ID NO: 6647543 - DNA, 17 bp, Homo sapiens
aggtatatagaacacaa

SEQ ID NO: 6647544 - DNA, 19 bp, Homo sapiens
aggtatatcattctaaaga

SEQ ID NO: 6647545 - DNA, 15 bp, Homo sapiens
aggtatattatagaa

SEQ ID NO: 6647546 - DNA, 17 bp, Homo sapiens
aggtatattggaagagg

SEQ ID NO: 6647547 - DNA, 15 bp, Homo sapiens
aggtatattgtgaac

SEQ ID NO: 6647548 - DNA, 15 bp, Homo sapiens
aggtatcaggcacag

SEQ ID NO: 6647549 - DNA, 16 bp, Homo sapiens
aggtatcaggcacagg

SEQ ID NO: 6647550 - DNA, 19 bp, Homo sapiens
aggtatcaggcacaggcag

SEQ ID NO: 6647551 - DNA, 19 bp, Homo sapiens
aggtatcagttatatgata

SEQ ID NO: 6647552 - DNA, 21 bp, Homo sapiens
aggtatcattttctgcattta

SEQ ID NO: 6647553 - DNA, 22 bp, Homo sapiens
aggtatccaatgtcgctgtaaa

SEQ ID NO: 6647554 - DNA, 20 bp, Homo sapiens
aggtatcctgggggaagagg

SEQ ID NO: 6647555 - DNA, 17 bp, Homo sapiens
aggtatctagcaatgga

SEQ ID NO: 6647556 - DNA, 15 bp, Homo sapiens
aggtatctccaggat

SEQ ID NO: 6647557 - DNA, 19 bp, Homo sapiens
aggtatctttatagttgta

SEQ ID NO: 6647558 - DNA, 13 bp, Homo sapiens
aggtatgaataag

SEQ ID NO: 6647559 - DNA, 18 bp, Homo sapiens
aggtatgacctatgtctg

SEQ ID NO: 6647560 - DNA, 16 bp, Homo sapiens
aggtatgaggtctagg

SEQ ID NO: 6647561 - DNA, 22 bp, Homo sapiens
aggtatggaagggtttgtggct

SEQ ID NO: 6647562 - DNA, 18 bp, Homo sapiens
aggtatggcagaggtgca

SEQ ID NO: 6647563 - DNA, 15 bp, Homo sapiens
aggtatggccatgcc

SEQ ID NO: 6647564 - DNA, 19 bp, Homo sapiens
aggtatgtaaactttcctg

SEQ ID NO: 6647565 - DNA, 15 bp, Homo sapiens
aggtatgtctgtgcc

SEQ ID NO: 6647566 - DNA, 22 bp, Homo sapiens
aggtatgtctgtgccatttctc

SEQ ID NO: 6647567 - DNA, 20 bp, Homo sapiens
aggtatgtttgtaacttttt

SEQ ID NO: 6647568 - DNA, 22 bp, Homo sapiens
aggtatgtttgtaactttttac

SEQ ID NO: 6647569 - DNA, 23 bp, Homo sapiens
aggtatgtttgtaactttttaca

SEQ ID NO: 6647570 - DNA, 19 bp, Homo sapiens
aggtattaaaactaaattt

SEQ ID NO: 6647571 - DNA, 20 bp, Homo sapiens
aggtattaaaactaaatttc

SEQ ID NO: 6647572 - DNA, 18 bp, Homo sapiens
aggtattaaagatgtgtt

SEQ ID NO: 6647573 - DNA, 14 bp, Homo sapiens
aggtattacactct

SEQ ID NO: 6647574 - DNA, 15 bp, Homo sapiens
aggtattagcaaagc

SEQ ID NO: 6647575 - DNA, 16 bp, Homo sapiens
aggtattattatcttt

SEQ ID NO: 6647576 - DNA, 22 bp, Homo sapiens
aggtattccttttgtgtacagt

SEQ ID NO: 6647577 - DNA, 18 bp, Homo sapiens
aggtattctattctaata

SEQ ID NO: 6647578 - DNA, 13 bp, Homo sapiens
aggtattgcaagg

SEQ ID NO: 6647579 - DNA, 22 bp, Homo sapiens
aggtattggagggaaaaaacaa

SEQ ID NO: 6647580 - DNA, 13 bp, Homo sapiens
aggtattggcctg

SEQ ID NO: 6647581 - DNA, 15 bp, Homo sapiens
aggtatttacacata

SEQ ID NO: 6647582 - DNA, 19 bp, Homo sapiens
aggtatttagaagcagagg

SEQ ID NO: 6647583 - DNA, 12 bp, Homo sapiens
aggtatttatca

SEQ ID NO: 6647584 - DNA, 14 bp, Homo sapiens
aggtatttatcttt

SEQ ID NO: 6647585 - DNA, 17 bp, Homo sapiens
aggtattttgaatacca

SEQ ID NO: 6647586 - DNA, 17 bp, Homo sapiens
aggtattttgtttcttt

SEQ ID NO: 6647587 - DNA, 13 bp, Homo sapiens
aggtatttttcca

SEQ ID NO: 6647588 - DNA, 21 bp, Homo sapiens
aggtatttttccaatcacagt

SEQ ID NO: 6647589 - DNA, 14 bp, Homo sapiens
aggtatttttctat

SEQ ID NO: 6647590 - DNA, 19 bp, Homo sapiens
aggtatttttctttaacca

SEQ ID NO: 6647591 - DNA, 15 bp, Homo sapiens
aggtcaaaactgaag

SEQ ID NO: 6647592 - DNA, 18 bp, Homo sapiens
aggtcaaaactgaagctt

SEQ ID NO: 6647593 - DNA, 14 bp, Homo sapiens
aggtcaaacaggct

SEQ ID NO: 6647594 - DNA, 20 bp, Homo sapiens
aggtcaaacaggctgtaatt

SEQ ID NO: 6647595 - DNA, 15 bp, Homo sapiens
aggtcaaagatgtgt

SEQ ID NO: 6647596 - DNA, 15 bp, Homo sapiens
aggtcaacagaatga

SEQ ID NO: 6647597 - DNA, 18 bp, Homo sapiens
aggtcaacatctaagcct

SEQ ID NO: 6647598 - DNA, 21 bp, Homo sapiens
aggtcaacatctaagcctgtt

SEQ ID NO: 6647599 - DNA, 21 bp, Homo sapiens
aggtcaagaaatgtgacttgg

SEQ ID NO: 6647600 - DNA, 19 bp, Homo sapiens
aggtcaagcccagaaagtg

SEQ ID NO: 6647601 - DNA, 20 bp, Homo sapiens
aggtcaaggcctgtccctgg

SEQ ID NO: 6647602 - DNA, 15 bp, Homo sapiens
aggtcaagtaataaa

SEQ ID NO: 6647603 - DNA, 20 bp, Homo sapiens
aggtcaataacactgtattt

SEQ ID NO: 6647604 - DNA, 22 bp, Homo sapiens
aggtcaatacagtacaggcagc

SEQ ID NO: 6647605 - DNA, 18 bp, Homo sapiens
aggtcaatgaaatatttg

SEQ ID NO: 6647606 - DNA, 23 bp, Homo sapiens
aggtcaatgacacccctggcctg

SEQ ID NO: 6647607 - DNA, 22 bp, Homo sapiens
aggtcacaacccttctctgttg

SEQ ID NO: 6647608 - DNA, 18 bp, Homo sapiens
aggtcacaataaagtgta

SEQ ID NO: 6647609 - DNA, 14 bp, Homo sapiens
aggtcacagctgga

SEQ ID NO: 6647610 - DNA, 17 bp, Homo sapiens
aggtcacagctggatct

SEQ ID NO: 6647611 - DNA, 15 bp, Homo sapiens
aggtcacataaaact

SEQ ID NO: 6647612 - DNA, 13 bp, Homo sapiens
aggtcaccagctg

SEQ ID NO: 6647613 - DNA, 18 bp, Homo sapiens
aggtcaccagctgctgtg

SEQ ID NO: 6647614 - DNA, 14 bp, Homo sapiens
aggtcaccagggga

SEQ ID NO: 6647615 - DNA, 15 bp, Homo sapiens
aggtcaccatcctca

SEQ ID NO: 6647616 - DNA, 17 bp, Homo sapiens
aggtcaccatcctcaga

SEQ ID NO: 6647617 - DNA, 19 bp, Homo sapiens
aggtcaccatcctcagagg

SEQ ID NO: 6647618 - DNA, 20 bp, Homo sapiens
aggtcaccttagttcaccta

SEQ ID NO: 6647619 - DNA, 17 bp, Homo sapiens
aggtcacgttggccctc

SEQ ID NO: 6647620 - DNA, 23 bp, Homo sapiens
aggtcactccaccatccccaccc

SEQ ID NO: 6647621 - DNA, 18 bp, Homo sapiens
aggtcactcctggggcct

SEQ ID NO: 6647622 - DNA, 19 bp, Homo sapiens
aggtcactcctggggcctc

SEQ ID NO: 6647623 - DNA, 19 bp, Homo sapiens
aggtcactctgggcctggg

SEQ ID NO: 6647624 - DNA, 13 bp, Homo sapiens
aggtcactcttgg

SEQ ID NO: 6647625 - DNA, 14 bp, Homo sapiens
aggtcactcttggt

SEQ ID NO: 6647626 - DNA, 15 bp, Homo sapiens
aggtcactcttggtc

SEQ ID NO: 6647627 - DNA, 21 bp, Homo sapiens
aggtcactggaaaggggagag

SEQ ID NO: 6647628 - DNA, 16 bp, Homo sapiens
aggtcactggctctcc

SEQ ID NO: 6647629 - DNA, 18 bp, Homo sapiens
aggtcactggctctccaa

SEQ ID NO: 6647630 - DNA, 20 bp, Homo sapiens
aggtcactggctctccaagt

SEQ ID NO: 6647631 - DNA, 21 bp, Homo sapiens
aggtcactggctctccaagtg

SEQ ID NO: 6647632 - DNA, 15 bp, Homo sapiens
aggtcactgggttct

SEQ ID NO: 6647633 - DNA, 17 bp, Homo sapiens
aggtcactgtcactgcc

SEQ ID NO: 6647634 - DNA, 19 bp, Homo sapiens
aggtcactgtcactgccga

SEQ ID NO: 6647635 - DNA, 14 bp, Homo sapiens
aggtcactgtttcc

SEQ ID NO: 6647636 - DNA, 18 bp, Homo sapiens
aggtcactgtttcctggg

SEQ ID NO: 6647637 - DNA, 15 bp, Homo sapiens
aggtcagaattttgt

SEQ ID NO: 6647638 - DNA, 12 bp, Homo sapiens
aggtcagagcct

SEQ ID NO: 6647639 - DNA, 18 bp, Homo sapiens
aggtcagaggagggcatg

SEQ ID NO: 6647640 - DNA, 13 bp, Homo sapiens
aggtcagatggag

SEQ ID NO: 6647641 - DNA, 15 bp, Homo sapiens
aggtcagccactgtt

SEQ ID NO: 6647642 - DNA, 20 bp, Homo sapiens
aggtcagcccatggaggcag

SEQ ID NO: 6647643 - DNA, 19 bp, Homo sapiens
aggtcagcccgtttcagaa

SEQ ID NO: 6647644 - DNA, 16 bp, Homo sapiens
aggtcagcctggaagg

SEQ ID NO: 6647645 - DNA, 21 bp, Homo sapiens
aggtcagcgcggtcctgactc

SEQ ID NO: 6647646 - DNA, 16 bp, Homo sapiens
aggtcagcttgctgcc

SEQ ID NO: 6647647 - DNA, 14 bp, Homo sapiens
aggtcaggaagcag

SEQ ID NO: 6647648 - DNA, 23 bp, Homo sapiens
aggtcaggacggctcctcagagc

SEQ ID NO: 6647649 - DNA, 19 bp, Homo sapiens
aggtcaggagttagaggcc

SEQ ID NO: 6647650 - DNA, 21 bp, Homo sapiens
aggtcaggagttagaggccag

SEQ ID NO: 6647651 - DNA, 16 bp, Homo sapiens
aggtcaggagttccta

SEQ ID NO: 6647652 - DNA, 18 bp, Homo sapiens
aggtcaggagttgtgtct

SEQ ID NO: 6647653 - DNA, 17 bp, Homo sapiens
aggtcaggatgcacatt

SEQ ID NO: 6647654 - DNA, 23 bp, Homo sapiens
aggtcaggatgcacatttctgga

SEQ ID NO: 6647655 - DNA, 16 bp, Homo sapiens
aggtcagggctcagag

SEQ ID NO: 6647656 - DNA, 17 bp, Homo sapiens
aggtcagggctcagagt

SEQ ID NO: 6647657 - DNA, 17 bp, Homo sapiens
aggtcagtacccacctg

SEQ ID NO: 6647658 - DNA, 18 bp, Homo sapiens
aggtcagtacccacctga

SEQ ID NO: 6647659 - DNA, 20 bp, Homo sapiens
aggtcagtgttataaaatct

SEQ ID NO: 6647660 - DNA, 12 bp, Homo sapiens
aggtcagtgttt

SEQ ID NO: 6647661 - DNA, 19 bp, Homo sapiens
aggtcagttgtgtttttta

SEQ ID NO: 6647662 - DNA, 19 bp, Homo sapiens
aggtcagtttagcaagaac

SEQ ID NO: 6647663 - DNA, 18 bp, Homo sapiens
aggtcagtttatgaaaca

SEQ ID NO: 6647664 - DNA, 13 bp, Homo sapiens
aggtcataaagca

SEQ ID NO: 6647665 - DNA, 14 bp, Homo sapiens
aggtcataaagcat

SEQ ID NO: 6647666 - DNA, 17 bp, Homo sapiens
aggtcataaagcattgg

SEQ ID NO: 6647667 - DNA, 15 bp, Homo sapiens
aggtcatcagatgcc

SEQ ID NO: 6647668 - DNA, 16 bp, Homo sapiens
aggtcatcagatgcct

SEQ ID NO: 6647669 - DNA, 17 bp, Homo sapiens
aggtcatcagatgcctg

SEQ ID NO: 6647670 - DNA, 17 bp, Homo sapiens
aggtcatcccggggcca

SEQ ID NO: 6647671 - DNA, 20 bp, Homo sapiens
aggtcatcccggggccatgg

SEQ ID NO: 6647672 - DNA, 15 bp, Homo sapiens
aggtcatctgacctt

SEQ ID NO: 6647673 - DNA, 17 bp, Homo sapiens
aggtcatctgaccttca

SEQ ID NO: 6647674 - DNA, 16 bp, Homo sapiens
aggtcatctgctggga

SEQ ID NO: 6647675 - DNA, 14 bp, Homo sapiens
aggtcatctgtaaa

SEQ ID NO: 6647676 - DNA, 17 bp, Homo sapiens
aggtcatctgtaaaata

SEQ ID NO: 6647677 - DNA, 17 bp, Homo sapiens
aggtcatgcaagtgaga

SEQ ID NO: 6647678 - DNA, 19 bp, Homo sapiens
aggtcatgcagttcctggc

SEQ ID NO: 6647679 - DNA, 16 bp, Homo sapiens
aggtcatgctggtggg

SEQ ID NO: 6647680 - DNA, 17 bp, Homo sapiens
aggtcatgctggtgggt

SEQ ID NO: 6647681 - DNA, 18 bp, Homo sapiens
aggtcatggagcagcccc

SEQ ID NO: 6647682 - DNA, 21 bp, Homo sapiens
aggtcatggccacactgtgac

SEQ ID NO: 6647683 - DNA, 14 bp, Homo sapiens
aggtcattaaaaca

SEQ ID NO: 6647684 - DNA, 18 bp, Homo sapiens
aggtcatttccatgtatg

SEQ ID NO: 6647685 - DNA, 18 bp, Homo sapiens
aggtcatttctttgctta

SEQ ID NO: 6647686 - DNA, 17 bp, Homo sapiens
aggtcattttttttaag

SEQ ID NO: 6647687 - DNA, 20 bp, Homo sapiens
aggtcattttttttaagaaa

SEQ ID NO: 6647688 - DNA, 22 bp, Homo sapiens
aggtcattttttttaagaaaaa

SEQ ID NO: 6647689 - DNA, 23 bp, Homo sapiens
aggtcattttttttaagaaaaag

SEQ ID NO: 6647690 - DNA, 17 bp, Homo sapiens
aggtccaaacccttcaa

SEQ ID NO: 6647691 - DNA, 22 bp, Homo sapiens
aggtccaaattcaccttcccct

SEQ ID NO: 6647692 - DNA, 16 bp, Homo sapiens
aggtccaagcagagtg

SEQ ID NO: 6647693 - DNA, 12 bp, Homo sapiens
aggtccaaggac

SEQ ID NO: 6647694 - DNA, 18 bp, Homo sapiens
aggtccaaggacaccctc

SEQ ID NO: 6647695 - DNA, 15 bp, Homo sapiens
aggtccaagggccat

SEQ ID NO: 6647696 - DNA, 18 bp, Homo sapiens
aggtccaagggccatact

SEQ ID NO: 6647697 - DNA, 15 bp, Homo sapiens
aggtccaatgagctt

SEQ ID NO: 6647698 - DNA, 17 bp, Homo sapiens
aggtccaatgagctttc

SEQ ID NO: 6647699 - DNA, 20 bp, Homo sapiens
aggtccaatgagctttctga

SEQ ID NO: 6647700 - DNA, 14 bp, Homo sapiens
aggtccaatgttgt

SEQ ID NO: 6647701 - DNA, 17 bp, Homo sapiens
aggtccacaacacacag

SEQ ID NO: 6647702 - DNA, 15 bp, Homo sapiens
aggtccacaggtcta

SEQ ID NO: 6647703 - DNA, 18 bp, Homo sapiens
aggtccacaggtctagac

SEQ ID NO: 6647704 - DNA, 17 bp, Homo sapiens
aggtccaccggcccctg

SEQ ID NO: 6647705 - DNA, 19 bp, Homo sapiens
aggtccaccggcccctggc

SEQ ID NO: 6647706 - DNA, 19 bp, Homo sapiens
aggtccactccctgctcca

SEQ ID NO: 6647707 - DNA, 20 bp, Homo sapiens
aggtccactccctgctccac

SEQ ID NO: 6647708 - DNA, 20 bp, Homo sapiens
aggtccagagagaccgagga

SEQ ID NO: 6647709 - DNA, 11 bp, Homo sapiens
aggtccagccc

SEQ ID NO: 6647710 - DNA, 14 bp, Homo sapiens
aggtccagcccatc

SEQ ID NO: 6647711 - DNA, 20 bp, Homo sapiens
aggtccagccccccaggctg

SEQ ID NO: 6647712 - DNA, 18 bp, Homo sapiens
aggtccagccctggctga

SEQ ID NO: 6647713 - DNA, 20 bp, Homo sapiens
aggtccagccctggctgaag

SEQ ID NO: 6647714 - DNA, 17 bp, Homo sapiens
aggtccagctctggagg

SEQ ID NO: 6647715 - DNA, 14 bp, Homo sapiens
aggtccagctctgt

SEQ ID NO: 6647716 - DNA, 20 bp, Homo sapiens
aggtccagctctgtgggccc

SEQ ID NO: 6647717 - DNA, 21 bp, Homo sapiens
aggtccatgaaccctgcccca

SEQ ID NO: 6647718 - DNA, 11 bp, Homo sapiens
aggtccatttt

SEQ ID NO: 6647719 - DNA, 13 bp, Homo sapiens
aggtccattttct

SEQ ID NO: 6647720 - DNA, 20 bp, Homo sapiens
aggtcccacagccctgagat

SEQ ID NO: 6647721 - DNA, 17 bp, Homo sapiens
aggtcccacctccagcc

SEQ ID NO: 6647722 - DNA, 19 bp, Homo sapiens
aggtcccacctccagcccg

SEQ ID NO: 6647723 - DNA, 16 bp, Homo sapiens
aggtcccagacatgct

SEQ ID NO: 6647724 - DNA, 22 bp, Homo sapiens
aggtcccagacatgctgcccac

SEQ ID NO: 6647725 - DNA, 24 bp, Homo sapiens
aggtcccagcccctcctccctcag

SEQ ID NO: 6647726 - DNA, 13 bp, Homo sapiens
aggtcccaggaag

SEQ ID NO: 6647727 - DNA, 14 bp, Homo sapiens
aggtcccaggaagt

SEQ ID NO: 6647728 - DNA, 14 bp, Homo sapiens
aggtcccagggccc

SEQ ID NO: 6647729 - DNA, 12 bp, Homo sapiens
aggtcccagtgc

SEQ ID NO: 6647730 - DNA, 22 bp, Homo sapiens
aggtcccatggcctgctgggct

SEQ ID NO: 6647731 - DNA, 22 bp, Homo sapiens
aggtcccattttccccctgtgt

SEQ ID NO: 6647732 - DNA, 14 bp, Homo sapiens
aggtccccaaactt

SEQ ID NO: 6647733 - DNA, 22 bp, Homo sapiens
aggtccccaaacttatggacac

SEQ ID NO: 6647734 - DNA, 14 bp, Homo sapiens
aggtccccccaccg

SEQ ID NO: 6647735 - DNA, 15 bp, Homo sapiens
aggtcccccgactgc

SEQ ID NO: 6647736 - DNA, 21 bp, Homo sapiens
aggtcccccgactgcctgtct

SEQ ID NO: 6647737 - DNA, 15 bp, Homo sapiens
aggtccccctgcagc

SEQ ID NO: 6647738 - DNA, 13 bp, Homo sapiens
aggtcccctgagg

SEQ ID NO: 6647739 - DNA, 16 bp, Homo sapiens
aggtcccctgccctga

SEQ ID NO: 6647740 - DNA, 13 bp, Homo sapiens
aggtcccctggca

SEQ ID NO: 6647741 - DNA, 14 bp, Homo sapiens
aggtcccctggcag

SEQ ID NO: 6647742 - DNA, 17 bp, Homo sapiens
aggtcccctggcagtgc

SEQ ID NO: 6647743 - DNA, 19 bp, Homo sapiens
aggtcccctggcccttcct

SEQ ID NO: 6647744 - DNA, 20 bp, Homo sapiens
aggtcccctggcccttcctt

SEQ ID NO: 6647745 - DNA, 22 bp, Homo sapiens
aggtcccctggcccttccttca

SEQ ID NO: 6647746 - DNA, 20 bp, Homo sapiens
aggtcccgagccccctgtcc

SEQ ID NO: 6647747 - DNA, 22 bp, Homo sapiens
aggtcccgagccccctgtcctt

SEQ ID NO: 6647748 - DNA, 14 bp, Homo sapiens
aggtcccggccagc

SEQ ID NO: 6647749 - DNA, 16 bp, Homo sapiens
aggtcccggccagctc

SEQ ID NO: 6647750 - DNA, 17 bp, Homo sapiens
aggtcccggccagctct

SEQ ID NO: 6647751 - DNA, 15 bp, Homo sapiens
aggtccctaataaag

SEQ ID NO: 6647752 - DNA, 16 bp, Homo sapiens
aggtccctaataaagc

SEQ ID NO: 6647753 - DNA, 20 bp, Homo sapiens
aggtccctaataaagctgtg

SEQ ID NO: 6647754 - DNA, 13 bp, Homo sapiens
aggtccctgctcg

SEQ ID NO: 6647755 - DNA, 17 bp, Homo sapiens
aggtccctgctgccagc

SEQ ID NO: 6647756 - DNA, 18 bp, Homo sapiens
aggtccctgctgccagct

SEQ ID NO: 6647757 - DNA, 16 bp, Homo sapiens
aggtccctgcttacct

SEQ ID NO: 6647758 - DNA, 20 bp, Homo sapiens
aggtccctggaccagcctcc

SEQ ID NO: 6647759 - DNA, 22 bp, Homo sapiens
aggtcccttcccgacccagcca

SEQ ID NO: 6647760 - DNA, 19 bp, Homo sapiens
aggtcccttggtctgtaca

SEQ ID NO: 6647761 - DNA, 19 bp, Homo sapiens
aggtccctttcatttgcta

SEQ ID NO: 6647762 - DNA, 17 bp, Homo sapiens
aggtccgagctctgtcc

SEQ ID NO: 6647763 - DNA, 20 bp, Homo sapiens
aggtccgcaccctgtcctgc

SEQ ID NO: 6647764 - DNA, 14 bp, Homo sapiens
aggtccggatgtca

SEQ ID NO: 6647765 - DNA, 16 bp, Homo sapiens
aggtccggggaggagg

SEQ ID NO: 6647766 - DNA, 18 bp, Homo sapiens
aggtccggtgttctaaga

SEQ ID NO: 6647767 - DNA, 16 bp, Homo sapiens
aggtccgtagctcccc

SEQ ID NO: 6647768 - DNA, 21 bp, Homo sapiens
aggtccgtagctcccctggct

SEQ ID NO: 6647769 - DNA, 20 bp, Homo sapiens
aggtccgtccggtgtgtcag

SEQ ID NO: 6647770 - DNA, 13 bp, Homo sapiens
aggtccgtttcct

SEQ ID NO: 6647771 - DNA, 22 bp, Homo sapiens
aggtcctcacttctgtctcctg

SEQ ID NO: 6647772 - DNA, 23 bp, Homo sapiens
aggtcctcaggtcagctgggagc

SEQ ID NO: 6647773 - DNA, 13 bp, Homo sapiens
aggtcctccatca

SEQ ID NO: 6647774 - DNA, 18 bp, Homo sapiens
aggtcctcccctctcttg

SEQ ID NO: 6647775 - DNA, 11 bp, Homo sapiens
aggtcctcctc

SEQ ID NO: 6647776 - DNA, 12 bp, Homo sapiens
aggtcctctcag

SEQ ID NO: 6647777 - DNA, 20 bp, Homo sapiens
aggtcctctggagccctaac

SEQ ID NO: 6647778 - DNA, 11 bp, Homo sapiens
aggtcctctta

SEQ ID NO: 6647779 - DNA, 20 bp, Homo sapiens
aggtcctgaaagtctgtgtc

SEQ ID NO: 6647780 - DNA, 15 bp, Homo sapiens
aggtcctgagcactg

SEQ ID NO: 6647781 - DNA, 17 bp, Homo sapiens
aggtcctgagcactgcc

SEQ ID NO: 6647782 - DNA, 21 bp, Homo sapiens
aggtcctgcagtctggctgag

SEQ ID NO: 6647783 - DNA, 22 bp, Homo sapiens
aggtcctgctccgctgcctgga

SEQ ID NO: 6647784 - DNA, 14 bp, Homo sapiens
aggtcctgctgtgg

SEQ ID NO: 6647785 - DNA, 16 bp, Homo sapiens
aggtcctgggggcctg

SEQ ID NO: 6647786 - DNA, 17 bp, Homo sapiens
aggtcctgggggcctga

SEQ ID NO: 6647787 - DNA, 21 bp, Homo sapiens
aggtcctgggggcctgacctc

SEQ ID NO: 6647788 - DNA, 17 bp, Homo sapiens
aggtcctggtggggcag

SEQ ID NO: 6647789 - DNA, 22 bp, Homo sapiens
aggtcctggtggggcagctcct

SEQ ID NO: 6647790 - DNA, 13 bp, Homo sapiens
aggtcctgtcctg

SEQ ID NO: 6647791 - DNA, 11 bp, Homo sapiens
aggtcctgtct

SEQ ID NO: 6647792 - DNA, 15 bp, Homo sapiens
aggtcctgtctctgc

SEQ ID NO: 6647793 - DNA, 16 bp, Homo sapiens
aggtcctgtctctgca

SEQ ID NO: 6647794 - DNA, 13 bp, Homo sapiens
aggtcctgtgagc

SEQ ID NO: 6647795 - DNA, 17 bp, Homo sapiens
aggtccttgccctttgt

SEQ ID NO: 6647796 - DNA, 22 bp, Homo sapiens
aggtccttggagtgctgcagct

SEQ ID NO: 6647797 - DNA, 20 bp, Homo sapiens
aggtcctttagtttgcttct

SEQ ID NO: 6647798 - DNA, 13 bp, Homo sapiens
aggtcctttcctt

SEQ ID NO: 6647799 - DNA, 13 bp, Homo sapiens
aggtcgaagcaat

SEQ ID NO: 6647800 - DNA, 15 bp, Homo sapiens
aggtcgaagcaatca

SEQ ID NO: 6647801 - DNA, 14 bp, Homo sapiens
aggtcgagctgtgc

SEQ ID NO: 6647802 - DNA, 17 bp, Homo sapiens
aggtcgaggctacagtg

SEQ ID NO: 6647803 - DNA, 21 bp, Homo sapiens
aggtcgcagctaccctcagcc

SEQ ID NO: 6647804 - DNA, 12 bp, Homo sapiens
aggtcgcccacc

SEQ ID NO: 6647805 - DNA, 16 bp, Homo sapiens
aggtcgcgctcttgca

SEQ ID NO: 6647806 - DNA, 12 bp, Homo sapiens
aggtcgctgcag

SEQ ID NO: 6647807 - DNA, 14 bp, Homo sapiens
aggtcgctgcagcc

SEQ ID NO: 6647808 - DNA, 17 bp, Homo sapiens
aggtcggaggcttggga

SEQ ID NO: 6647809 - DNA, 19 bp, Homo sapiens
aggtcgggagtttgagacc

SEQ ID NO: 6647810 - DNA, 13 bp, Homo sapiens
aggtcgggctcag

SEQ ID NO: 6647811 - DNA, 15 bp, Homo sapiens
aggtcgggctgccag

SEQ ID NO: 6647812 - DNA, 22 bp, Homo sapiens
aggtcggtaggttcagccaagg

SEQ ID NO: 6647813 - DNA, 16 bp, Homo sapiens
aggtcgtttatgtgtg

SEQ ID NO: 6647814 - DNA, 17 bp, Homo sapiens
aggtcgtttatgtgtgc

SEQ ID NO: 6647815 - DNA, 23 bp, Homo sapiens
aggtctaactgtggaatataaat

SEQ ID NO: 6647816 - DNA, 18 bp, Homo sapiens
aggtctaagcaagtgagt

SEQ ID NO: 6647817 - DNA, 21 bp, Homo sapiens
aggtctagaaggccaggcctc

SEQ ID NO: 6647818 - DNA, 15 bp, Homo sapiens
aggtctcaccttcgc

SEQ ID NO: 6647819 - DNA, 19 bp, Homo sapiens
aggtctcagaatctttcct

SEQ ID NO: 6647820 - DNA, 14 bp, Homo sapiens
aggtctcagcccct

SEQ ID NO: 6647821 - DNA, 16 bp, Homo sapiens
aggtctcatctcccag

SEQ ID NO: 6647822 - DNA, 18 bp, Homo sapiens
aggtctcatctcccaggc

SEQ ID NO: 6647823 - DNA, 14 bp, Homo sapiens
aggtctcatctctt

SEQ ID NO: 6647824 - DNA, 15 bp, Homo sapiens
aggtctcatctcttc

SEQ ID NO: 6647825 - DNA, 15 bp, Homo sapiens
aggtctcatgcccac

SEQ ID NO: 6647826 - DNA, 21 bp, Homo sapiens
aggtctcatgcccactccccc

SEQ ID NO: 6647827 - DNA, 22 bp, Homo sapiens
aggtctcatgcccactccccca

SEQ ID NO: 6647828 - DNA, 17 bp, Homo sapiens
aggtctcatgcctgaga

SEQ ID NO: 6647829 - DNA, 21 bp, Homo sapiens
aggtctcatggaccagtggct

SEQ ID NO: 6647830 - DNA, 20 bp, Homo sapiens
aggtctccaagggagggtgc

SEQ ID NO: 6647831 - DNA, 21 bp, Homo sapiens
aggtctccaagggagggtgca

SEQ ID NO: 6647832 - DNA, 16 bp, Homo sapiens
aggtctccacccctca

SEQ ID NO: 6647833 - DNA, 17 bp, Homo sapiens
aggtctccacccctcaa

SEQ ID NO: 6647834 - DNA, 23 bp, Homo sapiens
aggtctccacccctcaagccagg

SEQ ID NO: 6647835 - DNA, 21 bp, Homo sapiens
aggtctccccatgtgcctgca

SEQ ID NO: 6647836 - DNA, 13 bp, Homo sapiens
aggtctcctccac

SEQ ID NO: 6647837 - DNA, 12 bp, Homo sapiens
aggtctcctctt

SEQ ID NO: 6647838 - DNA, 23 bp, Homo sapiens
aggtctcctcttaaaaaataaaa

SEQ ID NO: 6647839 - DNA, 14 bp, Homo sapiens
aggtctcctgggaa

SEQ ID NO: 6647840 - DNA, 13 bp, Homo sapiens
aggtctcctgggc

SEQ ID NO: 6647841 - DNA, 19 bp, Homo sapiens
aggtctcctgggcatctgg

SEQ ID NO: 6647842 - DNA, 22 bp, Homo sapiens
aggtctcctgggcatctggccc

SEQ ID NO: 6647843 - DNA, 24 bp, Homo sapiens
aggtctcctgggcatctggccctg

SEQ ID NO: 6647844 - DNA, 15 bp, Homo sapiens
aggtctccttactct

SEQ ID NO: 6647845 - DNA, 15 bp, Homo sapiens
aggtctcgaccctgt

SEQ ID NO: 6647846 - DNA, 16 bp, Homo sapiens
aggtctcgaccctgtc

SEQ ID NO: 6647847 - DNA, 23 bp, Homo sapiens
aggtctcgaccctgtcccctagg

SEQ ID NO: 6647848 - DNA, 17 bp, Homo sapiens
aggtctcgctgatgctg

SEQ ID NO: 6647849 - DNA, 19 bp, Homo sapiens
aggtctcgtcccagccctc

SEQ ID NO: 6647850 - DNA, 20 bp, Homo sapiens
aggtctctccactgctctca

SEQ ID NO: 6647851 - DNA, 22 bp, Homo sapiens
aggtctctccactgctctcagc

SEQ ID NO: 6647852 - DNA, 15 bp, Homo sapiens
aggtctctgccggct

SEQ ID NO: 6647853 - DNA, 16 bp, Homo sapiens
aggtctctgccggctc

SEQ ID NO: 6647854 - DNA, 19 bp, Homo sapiens
aggtctctgggagcccaga

SEQ ID NO: 6647855 - DNA, 14 bp, Homo sapiens
aggtctctgtgggt

SEQ ID NO: 6647856 - DNA, 21 bp, Homo sapiens
aggtctctgttgactggctgt

SEQ ID NO: 6647857 - DNA, 14 bp, Homo sapiens
aggtctctgtttag

SEQ ID NO: 6647858 - DNA, 16 bp, Homo sapiens
aggtctcttctcccag

SEQ ID NO: 6647859 - DNA, 17 bp, Homo sapiens
aggtctcttctgggcgt

SEQ ID NO: 6647860 - DNA, 14 bp, Homo sapiens
aggtctcttttctc

SEQ ID NO: 6647861 - DNA, 16 bp, Homo sapiens
aggtctcttttctcta

SEQ ID NO: 6647862 - DNA, 21 bp, Homo sapiens
aggtctgaaatggaggtcctt

SEQ ID NO: 6647863 - DNA, 13 bp, Homo sapiens
aggtctgaaattt

SEQ ID NO: 6647864 - DNA, 16 bp, Homo sapiens
aggtctgaaggcctcc

SEQ ID NO: 6647865 - DNA, 15 bp, Homo sapiens
aggtctgagccctgg

SEQ ID NO: 6647866 - DNA, 22 bp, Homo sapiens
aggtctgagccctggtgtgttt

SEQ ID NO: 6647867 - DNA, 13 bp, Homo sapiens
aggtctgagtggt

SEQ ID NO: 6647868 - DNA, 13 bp, Homo sapiens
aggtctgagttgt

SEQ ID NO: 6647869 - DNA, 23 bp, Homo sapiens
aggtctgagttgttaccccaagc

SEQ ID NO: 6647870 - DNA, 19 bp, Homo sapiens
aggtctgatgccaaagctg

SEQ ID NO: 6647871 - DNA, 20 bp, Homo sapiens
aggtctgatgccaaagctgc

SEQ ID NO: 6647872 - DNA, 22 bp, Homo sapiens
aggtctgatgccaaagctgctt

SEQ ID NO: 6647873 - DNA, 17 bp, Homo sapiens
aggtctgattggctgct

SEQ ID NO: 6647874 - DNA, 20 bp, Homo sapiens
aggtctgattggctgcttaa

SEQ ID NO: 6647875 - DNA, 18 bp, Homo sapiens
aggtctgatttgcaggat

SEQ ID NO: 6647876 - DNA, 22 bp, Homo sapiens
aggtctgcaagggcccagagtg

SEQ ID NO: 6647877 - DNA, 22 bp, Homo sapiens
aggtctgcaggccaccagctgc

SEQ ID NO: 6647878 - DNA, 22 bp, Homo sapiens
aggtctggaaggtcacgctgaa

SEQ ID NO: 6647879 - DNA, 23 bp, Homo sapiens
aggtctggagaagctcccaggaa

SEQ ID NO: 6647880 - DNA, 16 bp, Homo sapiens
aggtctggattttcaa

SEQ ID NO: 6647881 - DNA, 15 bp, Homo sapiens
aggtctggcgccagg

SEQ ID NO: 6647882 - DNA, 19 bp, Homo sapiens
aggtctggcgccaggggca

SEQ ID NO: 6647883 - DNA, 24 bp, Homo sapiens
aggtctggcgccaggggcaggcag

SEQ ID NO: 6647884 - DNA, 21 bp, Homo sapiens
aggtctggctgagcccctggg

SEQ ID NO: 6647885 - DNA, 16 bp, Homo sapiens
aggtctggctgcttgc

SEQ ID NO: 6647886 - DNA, 16 bp, Homo sapiens
aggtctgggagaggca

SEQ ID NO: 6647887 - DNA, 21 bp, Homo sapiens
aggtctgggagaggcagagtg

SEQ ID NO: 6647888 - DNA, 12 bp, Homo sapiens
aggtctgggatg

SEQ ID NO: 6647889 - DNA, 17 bp, Homo sapiens
aggtctgggtctcagga

SEQ ID NO: 6647890 - DNA, 20 bp, Homo sapiens
aggtctgggtggggcccagg

SEQ ID NO: 6647891 - DNA, 12 bp, Homo sapiens
aggtctgtaact

SEQ ID NO: 6647892 - DNA, 21 bp, Homo sapiens
aggtctgtaactgcccagccc

SEQ ID NO: 6647893 - DNA, 22 bp, Homo sapiens
aggtctgtaactgcccagcccc

SEQ ID NO: 6647894 - DNA, 14 bp, Homo sapiens
aggtctgtagtata

SEQ ID NO: 6647895 - DNA, 15 bp, Homo sapiens
aggtctgtatgtcat

SEQ ID NO: 6647896 - DNA, 19 bp, Homo sapiens
aggtctgtatgtcatggat

SEQ ID NO: 6647897 - DNA, 23 bp, Homo sapiens
aggtctgtcataggactctggac

SEQ ID NO: 6647898 - DNA, 22 bp, Homo sapiens
aggtctgtggctcctcccgaaa

SEQ ID NO: 6647899 - DNA, 17 bp, Homo sapiens
aggtctgtggtgcagtg

SEQ ID NO: 6647900 - DNA, 19 bp, Homo sapiens
aggtctgtggtgcagtgtg

SEQ ID NO: 6647901 - DNA, 13 bp, Homo sapiens
aggtctgttcttt

SEQ ID NO: 6647902 - DNA, 23 bp, Homo sapiens
aggtctgttctttccaaagtaca

SEQ ID NO: 6647903 - DNA, 15 bp, Homo sapiens
aggtctgtttgctgt

SEQ ID NO: 6647904 - DNA, 17 bp, Homo sapiens
aggtcttcactgcccag

SEQ ID NO: 6647905 - DNA, 18 bp, Homo sapiens
aggtcttcactgcccagg

SEQ ID NO: 6647906 - DNA, 16 bp, Homo sapiens
aggtcttcagggctct

SEQ ID NO: 6647907 - DNA, 13 bp, Homo sapiens
aggtcttcctgct

SEQ ID NO: 6647908 - DNA, 16 bp, Homo sapiens
aggtcttcctgtggct

SEQ ID NO: 6647909 - DNA, 23 bp, Homo sapiens
aggtcttcctgtggctccctctc

SEQ ID NO: 6647910 - DNA, 17 bp, Homo sapiens
aggtcttgaactcctgg

SEQ ID NO: 6647911 - DNA, 23 bp, Homo sapiens
aggtcttgaactcctggcctcaa

SEQ ID NO: 6647912 - DNA, 23 bp, Homo sapiens
aggtcttgacctgaactctgcaa

SEQ ID NO: 6647913 - DNA, 18 bp, Homo sapiens
aggtcttgactcatggca

SEQ ID NO: 6647914 - DNA, 20 bp, Homo sapiens
aggtcttgactcatggcagc

SEQ ID NO: 6647915 - DNA, 23 bp, Homo sapiens
aggtcttgactcatggcagctgt

SEQ ID NO: 6647916 - DNA, 18 bp, Homo sapiens
aggtcttgcagtggcttt

SEQ ID NO: 6647917 - DNA, 11 bp, Homo sapiens
aggtcttgcta

SEQ ID NO: 6647918 - DNA, 18 bp, Homo sapiens
aggtcttgctggaagaca

SEQ ID NO: 6647919 - DNA, 19 bp, Homo sapiens
aggtcttggaacttgcctg

SEQ ID NO: 6647920 - DNA, 19 bp, Homo sapiens
aggtcttggagctgagcct

SEQ ID NO: 6647921 - DNA, 21 bp, Homo sapiens
aggtcttggagctgagcctct

SEQ ID NO: 6647922 - DNA, 19 bp, Homo sapiens
aggtcttggccgactcagg

SEQ ID NO: 6647923 - DNA, 21 bp, Homo sapiens
aggtcttggccgactcaggga

SEQ ID NO: 6647924 - DNA, 22 bp, Homo sapiens
aggtcttgggaggctttcaatt

SEQ ID NO: 6647925 - DNA, 13 bp, Homo sapiens
aggtcttggtgcc

SEQ ID NO: 6647926 - DNA, 18 bp, Homo sapiens
aggtcttggtgcctctgc

SEQ ID NO: 6647927 - DNA, 20 bp, Homo sapiens
aggtcttggttagagaagta

SEQ ID NO: 6647928 - DNA, 20 bp, Homo sapiens
aggtcttgtgaaaaggcttt

SEQ ID NO: 6647929 - DNA, 18 bp, Homo sapiens
aggtctttactgaatgtt

SEQ ID NO: 6647930 - DNA, 14 bp, Homo sapiens
aggtctttctcctc

SEQ ID NO: 6647931 - DNA, 18 bp, Homo sapiens
aggtctttctcctcagga

SEQ ID NO: 6647932 - DNA, 13 bp, Homo sapiens
aggtctttctctc

SEQ ID NO: 6647933 - DNA, 18 bp, Homo sapiens
aggtctttctttacttaa

SEQ ID NO: 6647934 - DNA, 17 bp, Homo sapiens
aggtctttgcacatgtg

SEQ ID NO: 6647935 - DNA, 20 bp, Homo sapiens
aggtctttgtaagaactaaa

SEQ ID NO: 6647936 - DNA, 18 bp, Homo sapiens
aggtcttttgacatgtgg

SEQ ID NO: 6647937 - DNA, 17 bp, Homo sapiens
aggtcttttgagggcta

SEQ ID NO: 6647938 - DNA, 21 bp, Homo sapiens
aggtctttttacattgtgaat

SEQ ID NO: 6647939 - DNA, 17 bp, Homo sapiens
aggtgaaaagggcagag

SEQ ID NO: 6647940 - DNA, 18 bp, Homo sapiens
aggtgaaaagggcagagg

SEQ ID NO: 6647941 - DNA, 15 bp, Homo sapiens
aggtgaaaatgaaga

SEQ ID NO: 6647942 - DNA, 19 bp, Homo sapiens
aggtgaaaatgaagaagga

SEQ ID NO: 6647943 - DNA, 21 bp, Homo sapiens
aggtgaaaattgtataaatta

SEQ ID NO: 6647944 - DNA, 13 bp, Homo sapiens
aggtgaaacacac

SEQ ID NO: 6647945 - DNA, 17 bp, Homo sapiens
aggtgaaacattttctc

SEQ ID NO: 6647946 - DNA, 19 bp, Homo sapiens
aggtgaaacgactcaaaat

SEQ ID NO: 6647947 - DNA, 21 bp, Homo sapiens
aggtgaaacgactcaaaatga

SEQ ID NO: 6647948 - DNA, 23 bp, Homo sapiens
aggtgaaacgactcaaaatgaca

SEQ ID NO: 6647949 - DNA, 19 bp, Homo sapiens
aggtgaaagaaagggaccc

SEQ ID NO: 6647950 - DNA, 22 bp, Homo sapiens
aggtgaaagaaagggacccacc

SEQ ID NO: 6647951 - DNA, 16 bp, Homo sapiens
aggtgaaagggagcta

SEQ ID NO: 6647952 - DNA, 14 bp, Homo sapiens
aggtgaaatgaatg

SEQ ID NO: 6647953 - DNA, 21 bp, Homo sapiens
aggtgaacagcaggatgccct

SEQ ID NO: 6647954 - DNA, 15 bp, Homo sapiens
aggtgaacattaaaa

SEQ ID NO: 6647955 - DNA, 16 bp, Homo sapiens
aggtgaactccaggca

SEQ ID NO: 6647956 - DNA, 19 bp, Homo sapiens
aggtgaactccaggcatgt

SEQ ID NO: 6647957 - DNA, 23 bp, Homo sapiens
aggtgaactccaggcatgtgtct

SEQ ID NO: 6647958 - DNA, 17 bp, Homo sapiens
aggtgaagatgaagaag

SEQ ID NO: 6647959 - DNA, 18 bp, Homo sapiens
aggtgaagcaaatttgtg

SEQ ID NO: 6647960 - DNA, 13 bp, Homo sapiens
aggtgaagcacat

SEQ ID NO: 6647961 - DNA, 16 bp, Homo sapiens
aggtgaaggaatatat

SEQ ID NO: 6647962 - DNA, 23 bp, Homo sapiens
aggtgaaggaggctccaggcagc

SEQ ID NO: 6647963 - DNA, 16 bp, Homo sapiens
aggtgaaggcagaagt

SEQ ID NO: 6647964 - DNA, 18 bp, Homo sapiens
aggtgaagggatggggga

SEQ ID NO: 6647965 - DNA, 15 bp, Homo sapiens
aggtgaattaatgga

SEQ ID NO: 6647966 - DNA, 18 bp, Homo sapiens
aggtgacacgcttctgag

SEQ ID NO: 6647967 - DNA, 19 bp, Homo sapiens
aggtgacacgcttctgagc

SEQ ID NO: 6647968 - DNA, 19 bp, Homo sapiens
aggtgacactatagtttaa

SEQ ID NO: 6647969 - DNA, 18 bp, Homo sapiens
aggtgacagaaggaccag

SEQ ID NO: 6647970 - DNA, 15 bp, Homo sapiens
aggtgacagagtgag

SEQ ID NO: 6647971 - DNA, 22 bp, Homo sapiens
aggtgacagagtgagactctgt

SEQ ID NO: 6647972 - DNA, 22 bp, Homo sapiens
aggtgacagatcataggaagtg

SEQ ID NO: 6647973 - DNA, 14 bp, Homo sapiens
aggtgacagtgaag

SEQ ID NO: 6647974 - DNA, 21 bp, Homo sapiens
aggtgacagtgaggtcctggg

SEQ ID NO: 6647975 - DNA, 20 bp, Homo sapiens
aggtgacagtggctgctctg

SEQ ID NO: 6647976 - DNA, 19 bp, Homo sapiens
aggtgacatcggaaaaata

SEQ ID NO: 6647977 - DNA, 15 bp, Homo sapiens
aggtgaccagaatga

SEQ ID NO: 6647978 - DNA, 13 bp, Homo sapiens
aggtgaccccagg

SEQ ID NO: 6647979 - DNA, 21 bp, Homo sapiens
aggtgaccccagggcacagga

SEQ ID NO: 6647980 - DNA, 20 bp, Homo sapiens
aggtgaccccatctctgctg

SEQ ID NO: 6647981 - DNA, 15 bp, Homo sapiens
aggtgacccttctgt

SEQ ID NO: 6647982 - DNA, 16 bp, Homo sapiens
aggtgacctcctgcag

SEQ ID NO: 6647983 - DNA, 15 bp, Homo sapiens
aggtgacctgttagg

SEQ ID NO: 6647984 - DNA, 16 bp, Homo sapiens
aggtgaccttctggga

SEQ ID NO: 6647985 - DNA, 15 bp, Homo sapiens
aggtgacggactcag

SEQ ID NO: 6647986 - DNA, 23 bp, Homo sapiens
aggtgacggactcagactcctgg

SEQ ID NO: 6647987 - DNA, 14 bp, Homo sapiens
aggtgactggagcc

SEQ ID NO: 6647988 - DNA, 15 bp, Homo sapiens
aggtgactgtgctgt

SEQ ID NO: 6647989 - DNA, 14 bp, Homo sapiens
aggtgactgtgtgt

SEQ ID NO: 6647990 - DNA, 19 bp, Homo sapiens
aggtgacttaggttctaga

SEQ ID NO: 6647991 - DNA, 17 bp, Homo sapiens
aggtgacttcctctggt

SEQ ID NO: 6647992 - DNA, 19 bp, Homo sapiens
aggtgacttctagcagaga

SEQ ID NO: 6647993 - DNA, 14 bp, Homo sapiens
aggtgacttgcctg

SEQ ID NO: 6647994 - DNA, 14 bp, Homo sapiens
aggtgactttctga

SEQ ID NO: 6647995 - DNA, 14 bp, Homo sapiens
aggtgagaaaaaaa

SEQ ID NO: 6647996 - DNA, 19 bp, Homo sapiens
aggtgagaactcagaagag

SEQ ID NO: 6647997 - DNA, 20 bp, Homo sapiens
aggtgagaactcagaagaga

SEQ ID NO: 6647998 - DNA, 23 bp, Homo sapiens
aggtgagaagcagaggaaggaga

SEQ ID NO: 6647999 - DNA, 20 bp, Homo sapiens
aggtgagaccaaaggatcca

SEQ ID NO: 6648000 - DNA, 15 bp, Homo sapiens
aggtgagaccacctc

SEQ ID NO: 6648001 - DNA, 12 bp, Homo sapiens
aggtgagaggcg

SEQ ID NO: 6648002 - DNA, 19 bp, Homo sapiens
aggtgagagtgggagggag

SEQ ID NO: 6648003 - DNA, 19 bp, Homo sapiens
aggtgagatcacagcctcc

SEQ ID NO: 6648004 - DNA, 22 bp, Homo sapiens
aggtgagatcacagcctccagg

SEQ ID NO: 6648005 - DNA, 14 bp, Homo sapiens
aggtgagatggcca

SEQ ID NO: 6648006 - DNA, 21 bp, Homo sapiens
aggtgagcaaccagttggcta

SEQ ID NO: 6648007 - DNA, 22 bp, Homo sapiens
aggtgagcacggccaacaaagc

SEQ ID NO: 6648008 - DNA, 14 bp, Homo sapiens
aggtgagcaggcag

SEQ ID NO: 6648009 - DNA, 13 bp, Homo sapiens
aggtgagcctggg

SEQ ID NO: 6648010 - DNA, 18 bp, Homo sapiens
aggtgagcctgggcagct

SEQ ID NO: 6648011 - DNA, 21 bp, Homo sapiens
aggtgagctagacccaaccct

SEQ ID NO: 6648012 - DNA, 13 bp, Homo sapiens
aggtgagctcagc

SEQ ID NO: 6648013 - DNA, 18 bp, Homo sapiens
aggtgagctcagctcact

SEQ ID NO: 6648014 - DNA, 22 bp, Homo sapiens
aggtgaggcatggcaattctgg

SEQ ID NO: 6648015 - DNA, 20 bp, Homo sapiens
aggtgaggcctgtctgtgac

SEQ ID NO: 6648016 - DNA, 20 bp, Homo sapiens
aggtgaggctacaaggggtg

SEQ ID NO: 6648017 - DNA, 13 bp, Homo sapiens
aggtgagggaagg

SEQ ID NO: 6648018 - DNA, 15 bp, Homo sapiens
aggtgagggaaggag

SEQ ID NO: 6648019 - DNA, 15 bp, Homo sapiens
aggtgagggatgcca

SEQ ID NO: 6648020 - DNA, 22 bp, Homo sapiens
aggtgaggggaagacaaagcac

SEQ ID NO: 6648021 - DNA, 20 bp, Homo sapiens
aggtgaggggcaggacctga

SEQ ID NO: 6648022 - DNA, 13 bp, Homo sapiens
aggtgaggggggc

SEQ ID NO: 6648023 - DNA, 21 bp, Homo sapiens
aggtgagggtggggtgcccca

SEQ ID NO: 6648024 - DNA, 13 bp, Homo sapiens
aggtgagggttgg

SEQ ID NO: 6648025 - DNA, 14 bp, Homo sapiens
aggtgaggtaccag

SEQ ID NO: 6648026 - DNA, 17 bp, Homo sapiens
aggtgaggtcagcacat

SEQ ID NO: 6648027 - DNA, 19 bp, Homo sapiens
aggtgaggtgaactccagg

SEQ ID NO: 6648028 - DNA, 18 bp, Homo sapiens
aggtgagtgtgagggcag

SEQ ID NO: 6648029 - DNA, 16 bp, Homo sapiens
aggtgataggaaaact

SEQ ID NO: 6648030 - DNA, 18 bp, Homo sapiens
aggtgataggaaaactga

SEQ ID NO: 6648031 - DNA, 15 bp, Homo sapiens
aggtgataggcaagg

SEQ ID NO: 6648032 - DNA, 19 bp, Homo sapiens
aggtgatatataatttcct

SEQ ID NO: 6648033 - DNA, 22 bp, Homo sapiens
aggtgatatataatttcctcac

SEQ ID NO: 6648034 - DNA, 16 bp, Homo sapiens
aggtgatatatttaaa

SEQ ID NO: 6648035 - DNA, 19 bp, Homo sapiens
aggtgatatccattctttc

SEQ ID NO: 6648036 - DNA, 22 bp, Homo sapiens
aggtgatatttttatgtgcagc

SEQ ID NO: 6648037 - DNA, 15 bp, Homo sapiens
aggtgatccatgtaa

SEQ ID NO: 6648038 - DNA, 18 bp, Homo sapiens
aggtgatccatgtaactg

SEQ ID NO: 6648039 - DNA, 23 bp, Homo sapiens
aggtgatcccgttttccccatga

SEQ ID NO: 6648040 - DNA, 23 bp, Homo sapiens
aggtgatccgcccgcctctgcct

SEQ ID NO: 6648041 - DNA, 18 bp, Homo sapiens
aggtgatctcctgtggct

SEQ ID NO: 6648042 - DNA, 22 bp, Homo sapiens
aggtgatctcctgtggctcatc

SEQ ID NO: 6648043 - DNA, 10 bp, Homo sapiens
aggtgatctt

SEQ ID NO: 6648044 - DNA, 18 bp, Homo sapiens
aggtgatgctctggcttg

SEQ ID NO: 6648045 - DNA, 13 bp, Homo sapiens
aggtgatgctgct

SEQ ID NO: 6648046 - DNA, 22 bp, Homo sapiens
aggtgatggtcatcgagatgga

SEQ ID NO: 6648047 - DNA, 17 bp, Homo sapiens
aggtgatgtttccagct

SEQ ID NO: 6648048 - DNA, 23 bp, Homo sapiens
aggtgatgtttccagctgccaag

SEQ ID NO: 6648049 - DNA, 16 bp, Homo sapiens
aggtgattaaatattt

SEQ ID NO: 6648050 - DNA, 16 bp, Homo sapiens
aggtgattaacttgga

SEQ ID NO: 6648051 - DNA, 20 bp, Homo sapiens
aggtgattatttttctcctg

SEQ ID NO: 6648052 - DNA, 19 bp, Homo sapiens
aggtgattctaatcatctg

SEQ ID NO: 6648053 - DNA, 17 bp, Homo sapiens
aggtgattctcagggct

SEQ ID NO: 6648054 - DNA, 18 bp, Homo sapiens
aggtgattctcagggctg

SEQ ID NO: 6648055 - DNA, 20 bp, Homo sapiens
aggtgattcttacatatgat

SEQ ID NO: 6648056 - DNA, 12 bp, Homo sapiens
aggtgatttcct

SEQ ID NO: 6648057 - DNA, 21 bp, Homo sapiens
aggtgcaaaaataaaaggaaa

SEQ ID NO: 6648058 - DNA, 13 bp, Homo sapiens
aggtgcaaccagg

SEQ ID NO: 6648059 - DNA, 18 bp, Homo sapiens
aggtgcaagagacagagc

SEQ ID NO: 6648060 - DNA, 21 bp, Homo sapiens
aggtgcaaggagtgtaaaatg

SEQ ID NO: 6648061 - DNA, 15 bp, Homo sapiens
aggtgcaatttcaag

SEQ ID NO: 6648062 - DNA, 20 bp, Homo sapiens
aggtgcacaagctccaagct

SEQ ID NO: 6648063 - DNA, 22 bp, Homo sapiens
aggtgcacagacgtccctccac

SEQ ID NO: 6648064 - DNA, 21 bp, Homo sapiens
aggtgcacattttccacggaa

SEQ ID NO: 6648065 - DNA, 15 bp, Homo sapiens
aggtgcacctgcccc

SEQ ID NO: 6648066 - DNA, 14 bp, Homo sapiens
aggtgcactccaga

SEQ ID NO: 6648067 - DNA, 15 bp, Homo sapiens
aggtgcactccagac

SEQ ID NO: 6648068 - DNA, 16 bp, Homo sapiens
aggtgcactccagact

SEQ ID NO: 6648069 - DNA, 17 bp, Homo sapiens
aggtgcactccagactc

SEQ ID NO: 6648070 - DNA, 19 bp, Homo sapiens
aggtgcactccagactctg

SEQ ID NO: 6648071 - DNA, 13 bp, Homo sapiens
aggtgcagaggaa

SEQ ID NO: 6648072 - DNA, 21 bp, Homo sapiens
aggtgcagaggtaccctgggt

SEQ ID NO: 6648073 - DNA, 17 bp, Homo sapiens
aggtgcagagtgcccag

SEQ ID NO: 6648074 - DNA, 19 bp, Homo sapiens
aggtgcagagtgcccagaa

SEQ ID NO: 6648075 - DNA, 14 bp, Homo sapiens
aggtgcagccagag

SEQ ID NO: 6648076 - DNA, 18 bp, Homo sapiens
aggtgcagccccagggcc

SEQ ID NO: 6648077 - DNA, 13 bp, Homo sapiens
aggtgcagctcct

SEQ ID NO: 6648078 - DNA, 22 bp, Homo sapiens
aggtgcagggaagtgcagagct

SEQ ID NO: 6648079 - DNA, 12 bp, Homo sapiens
aggtgcaggtgc

SEQ ID NO: 6648080 - DNA, 17 bp, Homo sapiens
aggtgcagtaggagcaa

SEQ ID NO: 6648081 - DNA, 15 bp, Homo sapiens
aggtgcagtggaggg

SEQ ID NO: 6648082 - DNA, 16 bp, Homo sapiens
aggtgcagtggagggg

SEQ ID NO: 6648083 - DNA, 16 bp, Homo sapiens
aggtgcatctgcaggc

SEQ ID NO: 6648084 - DNA, 15 bp, Homo sapiens
aggtgcatttttact

SEQ ID NO: 6648085 - DNA, 13 bp, Homo sapiens
aggtgccaaccca

SEQ ID NO: 6648086 - DNA, 14 bp, Homo sapiens
aggtgccaccaccc

SEQ ID NO: 6648087 - DNA, 20 bp, Homo sapiens
aggtgccaccaccctgcccc

SEQ ID NO: 6648088 - DNA, 22 bp, Homo sapiens
aggtgccaccaccctgcccccc

SEQ ID NO: 6648089 - DNA, 17 bp, Homo sapiens
aggtgccactccctgag

SEQ ID NO: 6648090 - DNA, 18 bp, Homo sapiens
aggtgccactccctgagc

SEQ ID NO: 6648091 - DNA, 14 bp, Homo sapiens
aggtgccagaagga

SEQ ID NO: 6648092 - DNA, 17 bp, Homo sapiens
aggtgccagaaggaagg

SEQ ID NO: 6648093 - DNA, 19 bp, Homo sapiens
aggtgccagcaaagcccca

SEQ ID NO: 6648094 - DNA, 20 bp, Homo sapiens
aggtgccagcaaagccccat

SEQ ID NO: 6648095 - DNA, 20 bp, Homo sapiens
aggtgccagcaactgaataa

SEQ ID NO: 6648096 - DNA, 21 bp, Homo sapiens
aggtgccagcaactgaataaa

SEQ ID NO: 6648097 - DNA, 13 bp, Homo sapiens
aggtgccaggctg

SEQ ID NO: 6648098 - DNA, 20 bp, Homo sapiens
aggtgccagggcccacccca

SEQ ID NO: 6648099 - DNA, 21 bp, Homo sapiens
aggtgccagggcccaccccag

SEQ ID NO: 6648100 - DNA, 17 bp, Homo sapiens
aggtgccatggaagagg

SEQ ID NO: 6648101 - DNA, 15 bp, Homo sapiens
aggtgccatgtcttt

SEQ ID NO: 6648102 - DNA, 19 bp, Homo sapiens
aggtgcccactccgccagc

SEQ ID NO: 6648103 - DNA, 18 bp, Homo sapiens
aggtgcccagaatgaggc

SEQ ID NO: 6648104 - DNA, 13 bp, Homo sapiens
aggtgcccaggag

SEQ ID NO: 6648105 - DNA, 14 bp, Homo sapiens
aggtgcccaggaga

SEQ ID NO: 6648106 - DNA, 14 bp, Homo sapiens
aggtgcccagggcc

SEQ ID NO: 6648107 - DNA, 18 bp, Homo sapiens
aggtgccccacctcccca

SEQ ID NO: 6648108 - DNA, 19 bp, Homo sapiens
aggtgccccgactgtggga

SEQ ID NO: 6648109 - DNA, 13 bp, Homo sapiens
aggtgcccctctt

SEQ ID NO: 6648110 - DNA, 17 bp, Homo sapiens
aggtgcccctgatgacg

SEQ ID NO: 6648111 - DNA, 19 bp, Homo sapiens
aggtgcccgcgccaggccc

SEQ ID NO: 6648112 - DNA, 20 bp, Homo sapiens
aggtgcccgcgccaggccct

SEQ ID NO: 6648113 - DNA, 16 bp, Homo sapiens
aggtgccctttctctt

SEQ ID NO: 6648114 - DNA, 22 bp, Homo sapiens
aggtgccgacactgagctgtga

SEQ ID NO: 6648115 - DNA, 19 bp, Homo sapiens
aggtgccggggaggggcag

SEQ ID NO: 6648116 - DNA, 21 bp, Homo sapiens
aggtgccggggaggggcagag

SEQ ID NO: 6648117 - DNA, 22 bp, Homo sapiens
aggtgccggtaccagcctgact

SEQ ID NO: 6648118 - DNA, 16 bp, Homo sapiens
aggtgccgtgagcagg

SEQ ID NO: 6648119 - DNA, 18 bp, Homo sapiens
aggtgccgtgagcaggct

SEQ ID NO: 6648120 - DNA, 21 bp, Homo sapiens
aggtgcctaacctgggacctg

SEQ ID NO: 6648121 - DNA, 17 bp, Homo sapiens
aggtgcctcacgcctgt

SEQ ID NO: 6648122 - DNA, 18 bp, Homo sapiens
aggtgcctcacgcctgta

SEQ ID NO: 6648123 - DNA, 20 bp, Homo sapiens
aggtgcctcagactccgccc

SEQ ID NO: 6648124 - DNA, 16 bp, Homo sapiens
aggtgcctccaggtgt

SEQ ID NO: 6648125 - DNA, 22 bp, Homo sapiens
aggtgcctcccagccctgccca

SEQ ID NO: 6648126 - DNA, 23 bp, Homo sapiens
aggtgcctcccagtggcctggct

SEQ ID NO: 6648127 - DNA, 14 bp, Homo sapiens
aggtgcctcctgtc

SEQ ID NO: 6648128 - DNA, 17 bp, Homo sapiens
aggtgcctcctgtctta

SEQ ID NO: 6648129 - DNA, 15 bp, Homo sapiens
aggtgcctgagctgg

SEQ ID NO: 6648130 - DNA, 18 bp, Homo sapiens
aggtgcctgagctggggc

SEQ ID NO: 6648131 - DNA, 19 bp, Homo sapiens
aggtgcctgagctggggcc

SEQ ID NO: 6648132 - DNA, 11 bp, Homo sapiens
aggtgcctgcc

SEQ ID NO: 6648133 - DNA, 13 bp, Homo sapiens
aggtgcctgccat

SEQ ID NO: 6648134 - DNA, 18 bp, Homo sapiens
aggtgcctgccatagcca

SEQ ID NO: 6648135 - DNA, 17 bp, Homo sapiens
aggtgcctgctcaggtg

SEQ ID NO: 6648136 - DNA, 13 bp, Homo sapiens
aggtgcctggagt

SEQ ID NO: 6648137 - DNA, 13 bp, Homo sapiens
aggtgcctggcca

SEQ ID NO: 6648138 - DNA, 17 bp, Homo sapiens
aggtgcctggcttgctg

SEQ ID NO: 6648139 - DNA, 16 bp, Homo sapiens
aggtgcctgggaggag

SEQ ID NO: 6648140 - DNA, 19 bp, Homo sapiens
aggtgcctgggaggagtgg

SEQ ID NO: 6648141 - DNA, 21 bp, Homo sapiens
aggtgcctgggaggagtggcc

SEQ ID NO: 6648142 - DNA, 17 bp, Homo sapiens
aggtgcctgtcccaccc

SEQ ID NO: 6648143 - DNA, 18 bp, Homo sapiens
aggtgcctgtcccacccc

SEQ ID NO: 6648144 - DNA, 20 bp, Homo sapiens
aggtgccttacatcttttct

SEQ ID NO: 6648145 - DNA, 13 bp, Homo sapiens
aggtgccttcttc

SEQ ID NO: 6648146 - DNA, 17 bp, Homo sapiens
aggtgccttcttcaggg

SEQ ID NO: 6648147 - DNA, 18 bp, Homo sapiens
aggtgccttcttcagggc

SEQ ID NO: 6648148 - DNA, 20 bp, Homo sapiens
aggtgcgctcacctcagagc

SEQ ID NO: 6648149 - DNA, 16 bp, Homo sapiens
aggtgcggccaccacc

SEQ ID NO: 6648150 - DNA, 21 bp, Homo sapiens
aggtgcgtcccccgttgtgcc

SEQ ID NO: 6648151 - DNA, 17 bp, Homo sapiens
aggtgcgtgtgtctctg

SEQ ID NO: 6648152 - DNA, 18 bp, Homo sapiens
aggtgctaaaaggaatag

SEQ ID NO: 6648153 - DNA, 16 bp, Homo sapiens
aggtgctaacatagat

SEQ ID NO: 6648154 - DNA, 18 bp, Homo sapiens
aggtgctaacatagattt

SEQ ID NO: 6648155 - DNA, 22 bp, Homo sapiens
aggtgctaggaacactccttca

SEQ ID NO: 6648156 - DNA, 14 bp, Homo sapiens
aggtgctaggaatt

SEQ ID NO: 6648157 - DNA, 18 bp, Homo sapiens
aggtgctagggtgcctgc

SEQ ID NO: 6648158 - DNA, 20 bp, Homo sapiens
aggtgctatataattgtgaa

SEQ ID NO: 6648159 - DNA, 20 bp, Homo sapiens
aggtgctatgtcccaagagc

SEQ ID NO: 6648160 - DNA, 16 bp, Homo sapiens
aggtgctcaaaatgca

SEQ ID NO: 6648161 - DNA, 21 bp, Homo sapiens
aggtgctcaaagatgtactga

SEQ ID NO: 6648162 - DNA, 17 bp, Homo sapiens
aggtgctcagcccaggc

SEQ ID NO: 6648163 - DNA, 21 bp, Homo sapiens
aggtgctctcctggcacccag

SEQ ID NO: 6648164 - DNA, 23 bp, Homo sapiens
aggtgctcttctcattttttcct

SEQ ID NO: 6648165 - DNA, 20 bp, Homo sapiens
aggtgctcttgaacctgtgc

SEQ ID NO: 6648166 - DNA, 12 bp, Homo sapiens
aggtgctgagct

SEQ ID NO: 6648167 - DNA, 17 bp, Homo sapiens
aggtgctgagcttagcc

SEQ ID NO: 6648168 - DNA, 20 bp, Homo sapiens
aggtgctgatgtcaaagtgt

SEQ ID NO: 6648169 - DNA, 11 bp, Homo sapiens
aggtgctgcca

SEQ ID NO: 6648170 - DNA, 12 bp, Homo sapiens
aggtgctgccac

SEQ ID NO: 6648171 - DNA, 13 bp, Homo sapiens
aggtgctgccacc

SEQ ID NO: 6648172 - DNA, 14 bp, Homo sapiens
aggtgctgccaccc

SEQ ID NO: 6648173 - DNA, 21 bp, Homo sapiens
aggtgctgccaccccttggca

SEQ ID NO: 6648174 - DNA, 16 bp, Homo sapiens
aggtgctgccatccag

SEQ ID NO: 6648175 - DNA, 13 bp, Homo sapiens
aggtgctgcttaa

SEQ ID NO: 6648176 - DNA, 17 bp, Homo sapiens
aggtgctgctttgcttc

SEQ ID NO: 6648177 - DNA, 22 bp, Homo sapiens
aggtgctggaaagggagggagg

SEQ ID NO: 6648178 - DNA, 20 bp, Homo sapiens
aggtgctggagcactgggct

SEQ ID NO: 6648179 - DNA, 17 bp, Homo sapiens
aggtgctggaggcagac

SEQ ID NO: 6648180 - DNA, 20 bp, Homo sapiens
aggtgctggcatgtctgggt

SEQ ID NO: 6648181 - DNA, 17 bp, Homo sapiens
aggtgctggcccagcat

SEQ ID NO: 6648182 - DNA, 13 bp, Homo sapiens
aggtgctggcctc

SEQ ID NO: 6648183 - DNA, 14 bp, Homo sapiens
aggtgctgggggag

SEQ ID NO: 6648184 - DNA, 17 bp, Homo sapiens
aggtgctggtagctgag

SEQ ID NO: 6648185 - DNA, 22 bp, Homo sapiens
aggtgctgtccccactgcccca

SEQ ID NO: 6648186 - DNA, 23 bp, Homo sapiens
aggtgctgttatccatggggaag

SEQ ID NO: 6648187 - DNA, 23 bp, Homo sapiens
aggtgctgttgtcattgctttac

SEQ ID NO: 6648188 - DNA, 20 bp, Homo sapiens
aggtgcttaagcagaagcat

SEQ ID NO: 6648189 - DNA, 23 bp, Homo sapiens
aggtgcttattctcaaagcagga

SEQ ID NO: 6648190 - DNA, 22 bp, Homo sapiens
aggtgcttctagttctgccagg

SEQ ID NO: 6648191 - DNA, 15 bp, Homo sapiens
aggtgcttgatctat

SEQ ID NO: 6648192 - DNA, 16 bp, Homo sapiens
aggtgcttgctcccca

SEQ ID NO: 6648193 - DNA, 17 bp, Homo sapiens
aggtgcttgggcttctg

SEQ ID NO: 6648194 - DNA, 14 bp, Homo sapiens
aggtgcttgttatg

SEQ ID NO: 6648195 - DNA, 16 bp, Homo sapiens
aggtgctttccctctt

SEQ ID NO: 6648196 - DNA, 16 bp, Homo sapiens
aggtgcttttggcaga

SEQ ID NO: 6648197 - DNA, 19 bp, Homo sapiens
aggtgcttttggcagagac

SEQ ID NO: 6648198 - DNA, 21 bp, Homo sapiens
aggtgcttttggcagagacca

SEQ ID NO: 6648199 - DNA, 13 bp, Homo sapiens
aggtggaaaatga

SEQ ID NO: 6648200 - DNA, 21 bp, Homo sapiens
aggtggaaaatggactggctt

SEQ ID NO: 6648201 - DNA, 18 bp, Homo sapiens
aggtggaaagagaaatga

SEQ ID NO: 6648202 - DNA, 15 bp, Homo sapiens
aggtggaaataaact

SEQ ID NO: 6648203 - DNA, 23 bp, Homo sapiens
aggtggaaattttatatgtaaat

SEQ ID NO: 6648204 - DNA, 24 bp, Homo sapiens
aggtggaaattttatatgtaaatg

SEQ ID NO: 6648205 - DNA, 20 bp, Homo sapiens
aggtggaacaggaggaactg

SEQ ID NO: 6648206 - DNA, 10 bp, Homo sapiens
aggtggaact

SEQ ID NO: 6648207 - DNA, 18 bp, Homo sapiens
aggtggaagaagggagaa

SEQ ID NO: 6648208 - DNA, 23 bp, Homo sapiens
aggtggaagcagaggccctgccc

SEQ ID NO: 6648209 - DNA, 11 bp, Homo sapiens
aggtggaagcc

SEQ ID NO: 6648210 - DNA, 16 bp, Homo sapiens
aggtggaagccctcct

SEQ ID NO: 6648211 - DNA, 19 bp, Homo sapiens
aggtggaagccctccttcc

SEQ ID NO: 6648212 - DNA, 14 bp, Homo sapiens
aggtggaaggcagg

SEQ ID NO: 6648213 - DNA, 15 bp, Homo sapiens
aggtggaataaacat

SEQ ID NO: 6648214 - DNA, 21 bp, Homo sapiens
aggtggaattattttaaaaga

SEQ ID NO: 6648215 - DNA, 22 bp, Homo sapiens
aggtggacagcagacaagaggg

SEQ ID NO: 6648216 - DNA, 21 bp, Homo sapiens
aggtggaccctgtaaatacat

SEQ ID NO: 6648217 - DNA, 15 bp, Homo sapiens
aggtggacctggcag

SEQ ID NO: 6648218 - DNA, 14 bp, Homo sapiens
aggtggacctttta

SEQ ID NO: 6648219 - DNA, 16 bp, Homo sapiens
aggtggaccttttaaa

SEQ ID NO: 6648220 - DNA, 23 bp, Homo sapiens
aggtggaccttttaaagtgtttc

SEQ ID NO: 6648221 - DNA, 15 bp, Homo sapiens
aggtggactctggga

SEQ ID NO: 6648222 - DNA, 13 bp, Homo sapiens
aggtggactgact

SEQ ID NO: 6648223 - DNA, 19 bp, Homo sapiens
aggtggacttgtctcccag

SEQ ID NO: 6648224 - DNA, 20 bp, Homo sapiens
aggtggacttgtctcccagt

SEQ ID NO: 6648225 - DNA, 17 bp, Homo sapiens
aggtggagaaaattgga

SEQ ID NO: 6648226 - DNA, 18 bp, Homo sapiens
aggtggagagcactagaa

SEQ ID NO: 6648227 - DNA, 11 bp, Homo sapiens
aggtggagcaa

SEQ ID NO: 6648228 - DNA, 14 bp, Homo sapiens
aggtggagcttgca

SEQ ID NO: 6648229 - DNA, 18 bp, Homo sapiens
aggtggaggcgagccaga

SEQ ID NO: 6648230 - DNA, 16 bp, Homo sapiens
aggtggagggaaggat

SEQ ID NO: 6648231 - DNA, 13 bp, Homo sapiens
aggtggagggcac

SEQ ID NO: 6648232 - DNA, 16 bp, Homo sapiens
aggtggagggcacagc

SEQ ID NO: 6648233 - DNA, 20 bp, Homo sapiens
aggtggagggtttgcactcc

SEQ ID NO: 6648234 - DNA, 18 bp, Homo sapiens
aggtggaggttgcagtga

SEQ ID NO: 6648235 - DNA, 20 bp, Homo sapiens
aggtggaggttgcagtgaac

SEQ ID NO: 6648236 - DNA, 19 bp, Homo sapiens
aggtggaggttgcagtgag

SEQ ID NO: 6648237 - DNA, 21 bp, Homo sapiens
aggtggaggttgcagtgagct

SEQ ID NO: 6648238 - DNA, 18 bp, Homo sapiens
aggtggaggttgtgcatg

SEQ ID NO: 6648239 - DNA, 16 bp, Homo sapiens
aggtggagtcttgctc

SEQ ID NO: 6648240 - DNA, 17 bp, Homo sapiens
aggtggatcacctgagg

SEQ ID NO: 6648241 - DNA, 14 bp, Homo sapiens
aggtggatcctgta

SEQ ID NO: 6648242 - DNA, 16 bp, Homo sapiens
aggtggatctatttca

SEQ ID NO: 6648243 - DNA, 15 bp, Homo sapiens
aggtggatggcccca

SEQ ID NO: 6648244 - DNA, 15 bp, Homo sapiens
aggtggattcatgtc

SEQ ID NO: 6648245 - DNA, 22 bp, Homo sapiens
aggtggatttactgagagaagg

SEQ ID NO: 6648246 - DNA, 15 bp, Homo sapiens
aggtggcaaggctgt

SEQ ID NO: 6648247 - DNA, 18 bp, Homo sapiens
aggtggcaaggctgtgct

SEQ ID NO: 6648248 - DNA, 16 bp, Homo sapiens
aggtggcaatgcttaa

SEQ ID NO: 6648249 - DNA, 20 bp, Homo sapiens
aggtggcaatgcttaaacta

SEQ ID NO: 6648250 - DNA, 16 bp, Homo sapiens
aggtggcactagggat

SEQ ID NO: 6648251 - DNA, 19 bp, Homo sapiens
aggtggcactagggatcaa

SEQ ID NO: 6648252 - DNA, 18 bp, Homo sapiens
aggtggcactttttcatt

SEQ ID NO: 6648253 - DNA, 19 bp, Homo sapiens
aggtggcactttttcattt

SEQ ID NO: 6648254 - DNA, 14 bp, Homo sapiens
aggtggcagagtga

SEQ ID NO: 6648255 - DNA, 20 bp, Homo sapiens
aggtggcagatgtcttccct

SEQ ID NO: 6648256 - DNA, 14 bp, Homo sapiens
aggtggcagccctg

SEQ ID NO: 6648257 - DNA, 15 bp, Homo sapiens
aggtggcagccctgt

SEQ ID NO: 6648258 - DNA, 15 bp, Homo sapiens
aggtggcagggctgt

SEQ ID NO: 6648259 - DNA, 17 bp, Homo sapiens
aggtggcaggtgagcaa

SEQ ID NO: 6648260 - DNA, 17 bp, Homo sapiens
aggtggccaagttcctc

SEQ ID NO: 6648261 - DNA, 23 bp, Homo sapiens
aggtggccaccgggggtggctct

SEQ ID NO: 6648262 - DNA, 18 bp, Homo sapiens
aggtggccaggcctgcca

SEQ ID NO: 6648263 - DNA, 20 bp, Homo sapiens
aggtggccaggcctgccagc

SEQ ID NO: 6648264 - DNA, 14 bp, Homo sapiens
aggtggccagggct

SEQ ID NO: 6648265 - DNA, 21 bp, Homo sapiens
aggtggccctcccaggctggt

SEQ ID NO: 6648266 - DNA, 11 bp, Homo sapiens
aggtggccctt

SEQ ID NO: 6648267 - DNA, 19 bp, Homo sapiens
aggtggccgcccctgaggc

SEQ ID NO: 6648268 - DNA, 17 bp, Homo sapiens
aggtggcctaaggctgc

SEQ ID NO: 6648269 - DNA, 14 bp, Homo sapiens
aggtggcctccctc

SEQ ID NO: 6648270 - DNA, 16 bp, Homo sapiens
aggtggcctccctcca

SEQ ID NO: 6648271 - DNA, 13 bp, Homo sapiens
aggtggcctcctg

SEQ ID NO: 6648272 - DNA, 23 bp, Homo sapiens
aggtggcctcctggcccgccctc

SEQ ID NO: 6648273 - DNA, 12 bp, Homo sapiens
aggtggcctctg

SEQ ID NO: 6648274 - DNA, 15 bp, Homo sapiens
aggtggcctctgcct

SEQ ID NO: 6648275 - DNA, 18 bp, Homo sapiens
aggtggcctctgcctggg

SEQ ID NO: 6648276 - DNA, 24 bp, Homo sapiens
aggtggcctctgctggtctctggc

SEQ ID NO: 6648277 - DNA, 22 bp, Homo sapiens
aggtggcctttgtgctgcgcct

SEQ ID NO: 6648278 - DNA, 13 bp, Homo sapiens
aggtggcgcccag

SEQ ID NO: 6648279 - DNA, 17 bp, Homo sapiens
aggtggcgccccctggt

SEQ ID NO: 6648280 - DNA, 18 bp, Homo sapiens
aggtggcgccccctggtg

SEQ ID NO: 6648281 - DNA, 18 bp, Homo sapiens
aggtggctcagtgccacc

SEQ ID NO: 6648282 - DNA, 23 bp, Homo sapiens
aggtggctcagtgccacctatgc

SEQ ID NO: 6648283 - DNA, 14 bp, Homo sapiens
aggtggctctccag

SEQ ID NO: 6648284 - DNA, 17 bp, Homo sapiens
aggtggctctccagtta

SEQ ID NO: 6648285 - DNA, 23 bp, Homo sapiens
aggtggctgacccagtccctggg

SEQ ID NO: 6648286 - DNA, 17 bp, Homo sapiens
aggtggctgagcccctg

SEQ ID NO: 6648287 - DNA, 13 bp, Homo sapiens
aggtggctgcctg

SEQ ID NO: 6648288 - DNA, 20 bp, Homo sapiens
aggtggctgcgcccccagct

SEQ ID NO: 6648289 - DNA, 14 bp, Homo sapiens
aggtgggagagaca

SEQ ID NO: 6648290 - DNA, 13 bp, Homo sapiens
aggtgggagatgg

SEQ ID NO: 6648291 - DNA, 12 bp, Homo sapiens
aggtgggagctg

SEQ ID NO: 6648292 - DNA, 13 bp, Homo sapiens
aggtgggagctga

SEQ ID NO: 6648293 - DNA, 22 bp, Homo sapiens
aggtgggaggattacttgaaac

SEQ ID NO: 6648294 - DNA, 13 bp, Homo sapiens
aggtgggaggcca

SEQ ID NO: 6648295 - DNA, 15 bp, Homo sapiens
aggtgggaggccagg

SEQ ID NO: 6648296 - DNA, 21 bp, Homo sapiens
aggtgggaggccaggcgagcc

SEQ ID NO: 6648297 - DNA, 16 bp, Homo sapiens
aggtgggaggcccctg

SEQ ID NO: 6648298 - DNA, 15 bp, Homo sapiens
aggtgggatcctcca

SEQ ID NO: 6648299 - DNA, 17 bp, Homo sapiens
aggtgggatcctccagg

SEQ ID NO: 6648300 - DNA, 18 bp, Homo sapiens
aggtgggcagaggctggc

SEQ ID NO: 6648301 - DNA, 19 bp, Homo sapiens
aggtgggcagctgggcccc

SEQ ID NO: 6648302 - DNA, 12 bp, Homo sapiens
aggtgggcatgc

SEQ ID NO: 6648303 - DNA, 18 bp, Homo sapiens
aggtgggcatgccaccct

SEQ ID NO: 6648304 - DNA, 13 bp, Homo sapiens
aggtgggcccagg

SEQ ID NO: 6648305 - DNA, 13 bp, Homo sapiens
aggtgggcctggc

SEQ ID NO: 6648306 - DNA, 16 bp, Homo sapiens
aggtgggcggtgtgtc

SEQ ID NO: 6648307 - DNA, 22 bp, Homo sapiens
aggtgggcgtggtcactgctgt

SEQ ID NO: 6648308 - DNA, 15 bp, Homo sapiens
aggtgggctgcctgc

SEQ ID NO: 6648309 - DNA, 22 bp, Homo sapiens
aggtgggctgggccctctcttc

SEQ ID NO: 6648310 - DNA, 15 bp, Homo sapiens
aggtgggcttcccag

SEQ ID NO: 6648311 - DNA, 17 bp, Homo sapiens
aggtggggaagagagcc

SEQ ID NO: 6648312 - DNA, 18 bp, Homo sapiens
aggtggggaagagagcct

SEQ ID NO: 6648313 - DNA, 13 bp, Homo sapiens
aggtggggacagg

SEQ ID NO: 6648314 - DNA, 14 bp, Homo sapiens
aggtggggacaggg

SEQ ID NO: 6648315 - DNA, 16 bp, Homo sapiens
aggtggggactgggca

SEQ ID NO: 6648316 - DNA, 13 bp, Homo sapiens
aggtggggagaag

SEQ ID NO: 6648317 - DNA, 19 bp, Homo sapiens
aggtggggagactgggctg

SEQ ID NO: 6648318 - DNA, 21 bp, Homo sapiens
aggtggggagactgggctgag

SEQ ID NO: 6648319 - DNA, 13 bp, Homo sapiens
aggtggggagggc

SEQ ID NO: 6648320 - DNA, 15 bp, Homo sapiens
aggtggggagggcct

SEQ ID NO: 6648321 - DNA, 21 bp, Homo sapiens
aggtggggagtccagggctcc

SEQ ID NO: 6648322 - DNA, 23 bp, Homo sapiens
aggtggggcagcttgagggttgg

SEQ ID NO: 6648323 - DNA, 17 bp, Homo sapiens
aggtggggccctgcccc

SEQ ID NO: 6648324 - DNA, 19 bp, Homo sapiens
aggtggggccctgccccta

SEQ ID NO: 6648325 - DNA, 15 bp, Homo sapiens
aggtggggcctcagc

SEQ ID NO: 6648326 - DNA, 19 bp, Homo sapiens
aggtggggcctcagcctgg

SEQ ID NO: 6648327 - DNA, 21 bp, Homo sapiens
aggtggggcctcagcctgggg

SEQ ID NO: 6648328 - DNA, 17 bp, Homo sapiens
aggtggggcgggaaagc

SEQ ID NO: 6648329 - DNA, 21 bp, Homo sapiens
aggtgggggaacactgagaaa

SEQ ID NO: 6648330 - DNA, 23 bp, Homo sapiens
aggtgggggaacactgagaaaga

SEQ ID NO: 6648331 - DNA, 14 bp, Homo sapiens
aggtgggggagcct

SEQ ID NO: 6648332 - DNA, 14 bp, Homo sapiens
aggtgggggatgct

SEQ ID NO: 6648333 - DNA, 15 bp, Homo sapiens
aggtgggggcagcgg

SEQ ID NO: 6648334 - DNA, 18 bp, Homo sapiens
aggtgggggcctcctcag

SEQ ID NO: 6648335 - DNA, 16 bp, Homo sapiens
aggtgggggtctggcc

SEQ ID NO: 6648336 - DNA, 14 bp, Homo sapiens
aggtgggggttggc

SEQ ID NO: 6648337 - DNA, 22 bp, Homo sapiens
aggtggggtatttaccacagca

SEQ ID NO: 6648338 - DNA, 19 bp, Homo sapiens
aggtggggtcactctggca

SEQ ID NO: 6648339 - DNA, 23 bp, Homo sapiens
aggtggggtcactctggcagctc

SEQ ID NO: 6648340 - DNA, 16 bp, Homo sapiens
aggtggggtgaagctg

SEQ ID NO: 6648341 - DNA, 21 bp, Homo sapiens
aggtggggtgaagctggggac

SEQ ID NO: 6648342 - DNA, 20 bp, Homo sapiens
aggtggggtgatggccagag

SEQ ID NO: 6648343 - DNA, 15 bp, Homo sapiens
aggtggggtgctggg

SEQ ID NO: 6648344 - DNA, 17 bp, Homo sapiens
aggtggggtttcctgca

SEQ ID NO: 6648345 - DNA, 18 bp, Homo sapiens
aggtgggtaggagccctt

SEQ ID NO: 6648346 - DNA, 22 bp, Homo sapiens
aggtgggtaggagcccttctct

SEQ ID NO: 6648347 - DNA, 19 bp, Homo sapiens
aggtgggtccaggaaggca

SEQ ID NO: 6648348 - DNA, 22 bp, Homo sapiens
aggtgggtccaggaaggcagct

SEQ ID NO: 6648349 - DNA, 23 bp, Homo sapiens
aggtgggtccaggaaggcagctg

SEQ ID NO: 6648350 - DNA, 16 bp, Homo sapiens
aggtgggtcccggctc

SEQ ID NO: 6648351 - DNA, 13 bp, Homo sapiens
aggtgggtcttgg

SEQ ID NO: 6648352 - DNA, 15 bp, Homo sapiens
aggtgggtcttggat

SEQ ID NO: 6648353 - DNA, 16 bp, Homo sapiens
aggtgggtgaggctgg

SEQ ID NO: 6648354 - DNA, 21 bp, Homo sapiens
aggtgggtgaggctgggcagg

SEQ ID NO: 6648355 - DNA, 16 bp, Homo sapiens
aggtgggtgattcctc

SEQ ID NO: 6648356 - DNA, 21 bp, Homo sapiens
aggtgggtggtgggcttctgc

SEQ ID NO: 6648357 - DNA, 15 bp, Homo sapiens
aggtgggtgtctgcg

SEQ ID NO: 6648358 - DNA, 19 bp, Homo sapiens
aggtgggttttcttcccat

SEQ ID NO: 6648359 - DNA, 16 bp, Homo sapiens
aggtggtaaattcaga

SEQ ID NO: 6648360 - DNA, 18 bp, Homo sapiens
aggtggtaaattcagaca

SEQ ID NO: 6648361 - DNA, 19 bp, Homo sapiens
aggtggtaaattcagacaa

SEQ ID NO: 6648362 - DNA, 19 bp, Homo sapiens
aggtggtaagaacacctga

SEQ ID NO: 6648363 - DNA, 15 bp, Homo sapiens
aggtggtagctctga

SEQ ID NO: 6648364 - DNA, 23 bp, Homo sapiens
aggtggtagctctgagccctcct

SEQ ID NO: 6648365 - DNA, 15 bp, Homo sapiens
aggtggtatgtgtgt

SEQ ID NO: 6648366 - DNA, 22 bp, Homo sapiens
aggtggtcataagtgaatattt

SEQ ID NO: 6648367 - DNA, 14 bp, Homo sapiens
aggtggtctgaatg

SEQ ID NO: 6648368 - DNA, 15 bp, Homo sapiens
aggtggtctgaatgt

SEQ ID NO: 6648369 - DNA, 16 bp, Homo sapiens
aggtggtctgaatgtt

SEQ ID NO: 6648370 - DNA, 17 bp, Homo sapiens
aggtggtctgaatgttc

SEQ ID NO: 6648371 - DNA, 20 bp, Homo sapiens
aggtggtctgaatgttctga

SEQ ID NO: 6648372 - DNA, 23 bp, Homo sapiens
aggtggtctgaatgttctgacat

SEQ ID NO: 6648373 - DNA, 21 bp, Homo sapiens
aggtggtctgcaccccacagg

SEQ ID NO: 6648374 - DNA, 23 bp, Homo sapiens
aggtggtctgcaccccacaggat

SEQ ID NO: 6648375 - DNA, 20 bp, Homo sapiens
aggtggtctgctcgggccca

SEQ ID NO: 6648376 - DNA, 14 bp, Homo sapiens
aggtggtcttggag

SEQ ID NO: 6648377 - DNA, 15 bp, Homo sapiens
aggtggtgcttacat

SEQ ID NO: 6648378 - DNA, 14 bp, Homo sapiens
aggtggtggacatc

SEQ ID NO: 6648379 - DNA, 13 bp, Homo sapiens
aggtggtggagga

SEQ ID NO: 6648380 - DNA, 19 bp, Homo sapiens
aggtggtggggctgccgga

SEQ ID NO: 6648381 - DNA, 18 bp, Homo sapiens
aggtggtgtcactgtccc

SEQ ID NO: 6648382 - DNA, 16 bp, Homo sapiens
aggtggtgtgatctta

SEQ ID NO: 6648383 - DNA, 19 bp, Homo sapiens
aggtggtgttgagaaagaa

SEQ ID NO: 6648384 - DNA, 18 bp, Homo sapiens
aggtggttaccaggcact

SEQ ID NO: 6648385 - DNA, 14 bp, Homo sapiens
aggtggttcagaca

SEQ ID NO: 6648386 - DNA, 19 bp, Homo sapiens
aggtgtaaatgagaagacg

SEQ ID NO: 6648387 - DNA, 16 bp, Homo sapiens
aggtgtacacatgcca

SEQ ID NO: 6648388 - DNA, 14 bp, Homo sapiens
aggtgtacactaac

SEQ ID NO: 6648389 - DNA, 15 bp, Homo sapiens
aggtgtacactaaca

SEQ ID NO: 6648390 - DNA, 19 bp, Homo sapiens
aggtgtacactaacatttc

SEQ ID NO: 6648391 - DNA, 17 bp, Homo sapiens
aggtgtactatggctgt

SEQ ID NO: 6648392 - DNA, 23 bp, Homo sapiens
aggtgtactgtactgaagaacag

SEQ ID NO: 6648393 - DNA, 15 bp, Homo sapiens
aggtgtagaaaaggt

SEQ ID NO: 6648394 - DNA, 15 bp, Homo sapiens
aggtgtagctctgtt

SEQ ID NO: 6648395 - DNA, 20 bp, Homo sapiens
aggtgtataaatgtacattt

SEQ ID NO: 6648396 - DNA, 19 bp, Homo sapiens
aggtgtatagggaattttc

SEQ ID NO: 6648397 - DNA, 22 bp, Homo sapiens
aggtgtatgccacacctggcct

SEQ ID NO: 6648398 - DNA, 23 bp, Homo sapiens
aggtgtattcccgttttacagat

SEQ ID NO: 6648399 - DNA, 22 bp, Homo sapiens
aggtgtattggtgttgcagccg

SEQ ID NO: 6648400 - DNA, 23 bp, Homo sapiens
aggtgtatttattgtttaagcag

SEQ ID NO: 6648401 - DNA, 18 bp, Homo sapiens
aggtgtcaccctgcagag

SEQ ID NO: 6648402 - DNA, 22 bp, Homo sapiens
aggtgtcaggatagtcacagtg

SEQ ID NO: 6648403 - DNA, 23 bp, Homo sapiens
aggtgtcaggcccgtcggagctg

SEQ ID NO: 6648404 - DNA, 17 bp, Homo sapiens
aggtgtcaggctgctgg

SEQ ID NO: 6648405 - DNA, 15 bp, Homo sapiens
aggtgtcatacagat

SEQ ID NO: 6648406 - DNA, 13 bp, Homo sapiens
aggtgtcatgctt

SEQ ID NO: 6648407 - DNA, 15 bp, Homo sapiens
aggtgtcatttccat

SEQ ID NO: 6648408 - DNA, 20 bp, Homo sapiens
aggtgtccagggtcctctag

SEQ ID NO: 6648409 - DNA, 12 bp, Homo sapiens
aggtgtcccaag

SEQ ID NO: 6648410 - DNA, 13 bp, Homo sapiens
aggtgtcccaagc

SEQ ID NO: 6648411 - DNA, 15 bp, Homo sapiens
aggtgtccctgcctt

SEQ ID NO: 6648412 - DNA, 15 bp, Homo sapiens
aggtgtcctacagaa

SEQ ID NO: 6648413 - DNA, 16 bp, Homo sapiens
aggtgtcctacagaaa

SEQ ID NO: 6648414 - DNA, 18 bp, Homo sapiens
aggtgtcctacagaaaaa

SEQ ID NO: 6648415 - DNA, 19 bp, Homo sapiens
aggtgtcctgagcaccaca

SEQ ID NO: 6648416 - DNA, 21 bp, Homo sapiens
aggtgtcctttcccctctctg

SEQ ID NO: 6648417 - DNA, 18 bp, Homo sapiens
aggtgtcgggacatggtt

SEQ ID NO: 6648418 - DNA, 14 bp, Homo sapiens
aggtgtctatccac

SEQ ID NO: 6648419 - DNA, 16 bp, Homo sapiens
aggtgtctcaggctgc

SEQ ID NO: 6648420 - DNA, 18 bp, Homo sapiens
aggtgtctcaggctgcct

SEQ ID NO: 6648421 - DNA, 22 bp, Homo sapiens
aggtgtctcaggctgcctgagt

SEQ ID NO: 6648422 - DNA, 18 bp, Homo sapiens
aggtgtctctgggcctgt

SEQ ID NO: 6648423 - DNA, 16 bp, Homo sapiens
aggtgtctgcacccag

SEQ ID NO: 6648424 - DNA, 18 bp, Homo sapiens
aggtgtctgccacttctg

SEQ ID NO: 6648425 - DNA, 22 bp, Homo sapiens
aggtgtctgccttcacaaatgt

SEQ ID NO: 6648426 - DNA, 13 bp, Homo sapiens
aggtgtctggcct

SEQ ID NO: 6648427 - DNA, 17 bp, Homo sapiens
aggtgtctggcctgagg

SEQ ID NO: 6648428 - DNA, 16 bp, Homo sapiens
aggtgtcttcctccca

SEQ ID NO: 6648429 - DNA, 13 bp, Homo sapiens
aggtgtcttggac

SEQ ID NO: 6648430 - DNA, 18 bp, Homo sapiens
aggtgtgaaagaatcagt

SEQ ID NO: 6648431 - DNA, 22 bp, Homo sapiens
aggtgtgaaccaccacacccag

SEQ ID NO: 6648432 - DNA, 19 bp, Homo sapiens
aggtgtgaacctacctgcc

SEQ ID NO: 6648433 - DNA, 21 bp, Homo sapiens
aggtgtgaaggtgatttaagg

SEQ ID NO: 6648434 - DNA, 14 bp, Homo sapiens
aggtgtgaatgcac

SEQ ID NO: 6648435 - DNA, 14 bp, Homo sapiens
aggtgtgagactgg

SEQ ID NO: 6648436 - DNA, 15 bp, Homo sapiens
aggtgtgagactggg

SEQ ID NO: 6648437 - DNA, 20 bp, Homo sapiens
aggtgtgagccaccacgccc

SEQ ID NO: 6648438 - DNA, 21 bp, Homo sapiens
aggtgtgagccactgcaccca

SEQ ID NO: 6648439 - DNA, 14 bp, Homo sapiens
aggtgtgaggagag

SEQ ID NO: 6648440 - DNA, 18 bp, Homo sapiens
aggtgtgaggagagagga

SEQ ID NO: 6648441 - DNA, 23 bp, Homo sapiens
aggtgtgaggagagaggaggaaa

SEQ ID NO: 6648442 - DNA, 13 bp, Homo sapiens
aggtgtgaggagg

SEQ ID NO: 6648443 - DNA, 15 bp, Homo sapiens
aggtgtgaggcagga

SEQ ID NO: 6648444 - DNA, 22 bp, Homo sapiens
aggtgtgagtcaccaagcccag

SEQ ID NO: 6648445 - DNA, 12 bp, Homo sapiens
aggtgtgcaaag

SEQ ID NO: 6648446 - DNA, 13 bp, Homo sapiens
aggtgtgcaaaga

SEQ ID NO: 6648447 - DNA, 15 bp, Homo sapiens
aggtgtgcctggaag

SEQ ID NO: 6648448 - DNA, 14 bp, Homo sapiens
aggtgtgcctggca

SEQ ID NO: 6648449 - DNA, 19 bp, Homo sapiens
aggtgtgcctggcagccat

SEQ ID NO: 6648450 - DNA, 14 bp, Homo sapiens
aggtgtgcctggcc

SEQ ID NO: 6648451 - DNA, 16 bp, Homo sapiens
aggtgtgcctggcctc

SEQ ID NO: 6648452 - DNA, 17 bp, Homo sapiens
aggtgtgcctggcctct

SEQ ID NO: 6648453 - DNA, 18 bp, Homo sapiens
aggtgtgcctggcctctg

SEQ ID NO: 6648454 - DNA, 17 bp, Homo sapiens
aggtgtgcttcctgctg

SEQ ID NO: 6648455 - DNA, 19 bp, Homo sapiens
aggtgtgcttcctgctgta

SEQ ID NO: 6648456 - DNA, 13 bp, Homo sapiens
aggtgtggaaggg

SEQ ID NO: 6648457 - DNA, 14 bp, Homo sapiens
aggtgtggacaagc

SEQ ID NO: 6648458 - DNA, 16 bp, Homo sapiens
aggtgtggacaagcca

SEQ ID NO: 6648459 - DNA, 13 bp, Homo sapiens
aggtgtggagtgg

SEQ ID NO: 6648460 - DNA, 24 bp, Homo sapiens
aggtgtggcagaagcttgcagatg

SEQ ID NO: 6648461 - DNA, 15 bp, Homo sapiens
aggtgtgggatctgg

SEQ ID NO: 6648462 - DNA, 18 bp, Homo sapiens
aggtgtgggatggagagt

SEQ ID NO: 6648463 - DNA, 21 bp, Homo sapiens
aggtgtgggctcccacgccct

SEQ ID NO: 6648464 - DNA, 23 bp, Homo sapiens
aggtgtgggctcccacgccctcc

SEQ ID NO: 6648465 - DNA, 23 bp, Homo sapiens
aggtgtggggacacagcagtgag

SEQ ID NO: 6648466 - DNA, 17 bp, Homo sapiens
aggtgtgggggctgcag

SEQ ID NO: 6648467 - DNA, 23 bp, Homo sapiens
aggtgtgggtgggaggggcccac

SEQ ID NO: 6648468 - DNA, 12 bp, Homo sapiens
aggtgtggtggc

SEQ ID NO: 6648469 - DNA, 14 bp, Homo sapiens
aggtgtggtggcgt

SEQ ID NO: 6648470 - DNA, 17 bp, Homo sapiens
aggtgtggtggctcatg

SEQ ID NO: 6648471 - DNA, 15 bp, Homo sapiens
aggtgtgtactcagg

SEQ ID NO: 6648472 - DNA, 16 bp, Homo sapiens
aggtgtgtatgtaaag

SEQ ID NO: 6648473 - DNA, 21 bp, Homo sapiens
aggtgtgtgctttaggcgtgg

SEQ ID NO: 6648474 - DNA, 17 bp, Homo sapiens
aggtgtgtgggccaccg

SEQ ID NO: 6648475 - DNA, 23 bp, Homo sapiens
aggtgtgtgggccaccgtgcctg

SEQ ID NO: 6648476 - DNA, 18 bp, Homo sapiens
aggtgtgtgtgaactggg

SEQ ID NO: 6648477 - DNA, 16 bp, Homo sapiens
aggtgttactgtaatt

SEQ ID NO: 6648478 - DNA, 23 bp, Homo sapiens
aggtgttatttggaaccttgttt

SEQ ID NO: 6648479 - DNA, 18 bp, Homo sapiens
aggtgttcccaggctgcc

SEQ ID NO: 6648480 - DNA, 19 bp, Homo sapiens
aggtgttcccaggctgccc

SEQ ID NO: 6648481 - DNA, 17 bp, Homo sapiens
aggtgttctacactcat

SEQ ID NO: 6648482 - DNA, 18 bp, Homo sapiens
aggtgttgattttctgtt

SEQ ID NO: 6648483 - DNA, 16 bp, Homo sapiens
aggtgttgcagcccaa

SEQ ID NO: 6648484 - DNA, 12 bp, Homo sapiens
aggtgttgccaa

SEQ ID NO: 6648485 - DNA, 23 bp, Homo sapiens
aggtgttgccaaatatgtcctgg

SEQ ID NO: 6648486 - DNA, 20 bp, Homo sapiens
aggtgttgggacctgctgct

SEQ ID NO: 6648487 - DNA, 14 bp, Homo sapiens
aggtgttgggtcag

SEQ ID NO: 6648488 - DNA, 18 bp, Homo sapiens
aggtgttggtgacaattg

SEQ ID NO: 6648489 - DNA, 18 bp, Homo sapiens
aggtgttgtcagcaggca

SEQ ID NO: 6648490 - DNA, 20 bp, Homo sapiens
aggtgtttaaagagaggtta

SEQ ID NO: 6648491 - DNA, 16 bp, Homo sapiens
aggtgtttaaagagtt

SEQ ID NO: 6648492 - DNA, 14 bp, Homo sapiens
aggtgtttatacag

SEQ ID NO: 6648493 - DNA, 18 bp, Homo sapiens
aggtgtttattaaaattc

SEQ ID NO: 6648494 - DNA, 22 bp, Homo sapiens
aggtgtttcaaagggtaaatta

SEQ ID NO: 6648495 - DNA, 13 bp, Homo sapiens
aggtgtttctctg

SEQ ID NO: 6648496 - DNA, 14 bp, Homo sapiens
aggtgtttctctgt

SEQ ID NO: 6648497 - DNA, 15 bp, Homo sapiens
aggtgtttctctgta

SEQ ID NO: 6648498 - DNA, 13 bp, Homo sapiens
aggtgttttctgt

SEQ ID NO: 6648499 - DNA, 17 bp, Homo sapiens
aggtgttttctgtgtaa

SEQ ID NO: 6648500 - DNA, 22 bp, Homo sapiens
aggtgttttgttcaccattata

SEQ ID NO: 6648501 - DNA, 22 bp, Homo sapiens
aggttaaaaaaaggcattgttt

SEQ ID NO: 6648502 - DNA, 15 bp, Homo sapiens
aggttaaaaaaatgg

SEQ ID NO: 6648503 - DNA, 21 bp, Homo sapiens
aggttaaaaaaatggcagtga

SEQ ID NO: 6648504 - DNA, 14 bp, Homo sapiens
aggttaaaatataa

SEQ ID NO: 6648505 - DNA, 18 bp, Homo sapiens
aggttaaacggtgcccat

SEQ ID NO: 6648506 - DNA, 15 bp, Homo sapiens
aggttaaagaagctg

SEQ ID NO: 6648507 - DNA, 13 bp, Homo sapiens
aggttaaagctaa

SEQ ID NO: 6648508 - DNA, 18 bp, Homo sapiens
aggttaaaggaaaagcac

SEQ ID NO: 6648509 - DNA, 13 bp, Homo sapiens
aggttaaatgttt

SEQ ID NO: 6648510 - DNA, 14 bp, Homo sapiens
aggttaaatgtttt

SEQ ID NO: 6648511 - DNA, 17 bp, Homo sapiens
aggttaaatgttttgta

SEQ ID NO: 6648512 - DNA, 18 bp, Homo sapiens
aggttaaatgttttgtaa

SEQ ID NO: 6648513 - DNA, 19 bp, Homo sapiens
aggttaaatgttttgtaaa

SEQ ID NO: 6648514 - DNA, 14 bp, Homo sapiens
aggttaagccatat

SEQ ID NO: 6648515 - DNA, 17 bp, Homo sapiens
aggttaaggctgaggaa

SEQ ID NO: 6648516 - DNA, 24 bp, Homo sapiens
aggttaaggctgaggaaaggccag

SEQ ID NO: 6648517 - DNA, 18 bp, Homo sapiens
aggttaaggtgggtccag

SEQ ID NO: 6648518 - DNA, 20 bp, Homo sapiens
aggttaaggtgggtccagga

SEQ ID NO: 6648519 - DNA, 13 bp, Homo sapiens
aggttaagtctca

SEQ ID NO: 6648520 - DNA, 23 bp, Homo sapiens
aggttaataggaggacagaacca

SEQ ID NO: 6648521 - DNA, 19 bp, Homo sapiens
aggttaatcagagtatctg

SEQ ID NO: 6648522 - DNA, 23 bp, Homo sapiens
aggttaatttttaccttacatgt

SEQ ID NO: 6648523 - DNA, 14 bp, Homo sapiens
aggttacaacagat

SEQ ID NO: 6648524 - DNA, 15 bp, Homo sapiens
aggttacaagcctgc

SEQ ID NO: 6648525 - DNA, 21 bp, Homo sapiens
aggttacaagcctgcacaata

SEQ ID NO: 6648526 - DNA, 16 bp, Homo sapiens
aggttaccaagaagcc

SEQ ID NO: 6648527 - DNA, 15 bp, Homo sapiens
aggttacgaagacaa

SEQ ID NO: 6648528 - DNA, 17 bp, Homo sapiens
aggttactaaaacaggg

SEQ ID NO: 6648529 - DNA, 18 bp, Homo sapiens
aggttactcataaggcat

SEQ ID NO: 6648530 - DNA, 19 bp, Homo sapiens
aggttactgtttttatcct

SEQ ID NO: 6648531 - DNA, 16 bp, Homo sapiens
aggttagaaaggcagc

SEQ ID NO: 6648532 - DNA, 17 bp, Homo sapiens
aggttagaggtttgtca

SEQ ID NO: 6648533 - DNA, 20 bp, Homo sapiens
aggttagaggtttgtcaaca

SEQ ID NO: 6648534 - DNA, 23 bp, Homo sapiens
aggttaggcagtataaagaatag

SEQ ID NO: 6648535 - DNA, 21 bp, Homo sapiens
aggttagtgacaaaattggcc

SEQ ID NO: 6648536 - DNA, 15 bp, Homo sapiens
aggttagtgacattt

SEQ ID NO: 6648537 - DNA, 12 bp, Homo sapiens
aggttataagaa

SEQ ID NO: 6648538 - DNA, 16 bp, Homo sapiens
aggttataagaaacag

SEQ ID NO: 6648539 - DNA, 12 bp, Homo sapiens
aggttatacaat

SEQ ID NO: 6648540 - DNA, 14 bp, Homo sapiens
aggttataggtcac

SEQ ID NO: 6648541 - DNA, 16 bp, Homo sapiens
aggttatatgaatata

SEQ ID NO: 6648542 - DNA, 21 bp, Homo sapiens
aggttatcaaaactgttgtca

SEQ ID NO: 6648543 - DNA, 13 bp, Homo sapiens
aggttatctgcct

SEQ ID NO: 6648544 - DNA, 17 bp, Homo sapiens
aggttatctgcctggcc

SEQ ID NO: 6648545 - DNA, 18 bp, Homo sapiens
aggttatctgcctggcct

SEQ ID NO: 6648546 - DNA, 17 bp, Homo sapiens
aggttatctgtcccagg

SEQ ID NO: 6648547 - DNA, 23 bp, Homo sapiens
aggttatctttttaaaaactctt

SEQ ID NO: 6648548 - DNA, 16 bp, Homo sapiens
aggttattgcaataaa

SEQ ID NO: 6648549 - DNA, 21 bp, Homo sapiens
aggttattgcaataaagtata

SEQ ID NO: 6648550 - DNA, 14 bp, Homo sapiens
aggttatttaaaat

SEQ ID NO: 6648551 - DNA, 19 bp, Homo sapiens
aggttatttaaaataaatt

SEQ ID NO: 6648552 - DNA, 16 bp, Homo sapiens
aggttatttatttaaa

SEQ ID NO: 6648553 - DNA, 13 bp, Homo sapiens
aggttattttata

SEQ ID NO: 6648554 - DNA, 18 bp, Homo sapiens
aggttattttatatttga

SEQ ID NO: 6648555 - DNA, 13 bp, Homo sapiens
aggttattttgct

SEQ ID NO: 6648556 - DNA, 15 bp, Homo sapiens
aggttcatgcccaag

SEQ ID NO: 6648557 - DNA, 18 bp, Homo sapiens
aggttcatggattttcca

SEQ ID NO: 6648558 - DNA, 18 bp, Homo sapiens
aggttccagaacagccct

SEQ ID NO: 6648559 - DNA, 16 bp, Homo sapiens
aggttccagaggccct

SEQ ID NO: 6648560 - DNA, 19 bp, Homo sapiens
aggttccagaggccctagg

SEQ ID NO: 6648561 - DNA, 16 bp, Homo sapiens
aggttccagtgcctga

SEQ ID NO: 6648562 - DNA, 16 bp, Homo sapiens
aggttccatccacccc

SEQ ID NO: 6648563 - DNA, 14 bp, Homo sapiens
aggttcccaagctc

SEQ ID NO: 6648564 - DNA, 15 bp, Homo sapiens
aggttcccaagctca

SEQ ID NO: 6648565 - DNA, 20 bp, Homo sapiens
aggttcccaaggacatgagt

SEQ ID NO: 6648566 - DNA, 13 bp, Homo sapiens
aggttcccactta

SEQ ID NO: 6648567 - DNA, 16 bp, Homo sapiens
aggttcccagagatga

SEQ ID NO: 6648568 - DNA, 15 bp, Homo sapiens
aggttcccagcagct

SEQ ID NO: 6648569 - DNA, 13 bp, Homo sapiens
aggttccccagag

SEQ ID NO: 6648570 - DNA, 20 bp, Homo sapiens
aggttccccagagagcaggc

SEQ ID NO: 6648571 - DNA, 14 bp, Homo sapiens
aggttccctgccac

SEQ ID NO: 6648572 - DNA, 18 bp, Homo sapiens
aggttccctgttcttcct

SEQ ID NO: 6648573 - DNA, 16 bp, Homo sapiens
aggttccgatgttatt

SEQ ID NO: 6648574 - DNA, 18 bp, Homo sapiens
aggttccgtatctccctg

SEQ ID NO: 6648575 - DNA, 12 bp, Homo sapiens
aggttcctaaga

SEQ ID NO: 6648576 - DNA, 24 bp, Homo sapiens
aggttcctaagacttcagtcctgg

SEQ ID NO: 6648577 - DNA, 15 bp, Homo sapiens
aggttcctctgcctg

SEQ ID NO: 6648578 - DNA, 16 bp, Homo sapiens
aggttcctctgcctgc

SEQ ID NO: 6648579 - DNA, 18 bp, Homo sapiens
aggttcctctgcctgccc

SEQ ID NO: 6648580 - DNA, 20 bp, Homo sapiens
aggttcctctgcctgccccg

SEQ ID NO: 6648581 - DNA, 13 bp, Homo sapiens
aggttcctgagga

SEQ ID NO: 6648582 - DNA, 23 bp, Homo sapiens
aggttcctggggccgcctgccct

SEQ ID NO: 6648583 - DNA, 20 bp, Homo sapiens
aggttcctgtactactgcct

SEQ ID NO: 6648584 - DNA, 21 bp, Homo sapiens
aggttcctgtttgaacccagg

SEQ ID NO: 6648585 - DNA, 17 bp, Homo sapiens
aggttcctttgttccct

SEQ ID NO: 6648586 - DNA, 16 bp, Homo sapiens
aggttcctttttcaaa

SEQ ID NO: 6648587 - DNA, 19 bp, Homo sapiens
aggttcgggattccctggt

SEQ ID NO: 6648588 - DNA, 13 bp, Homo sapiens
aggttctaaagtt

SEQ ID NO: 6648589 - DNA, 15 bp, Homo sapiens
aggttctaaagttct

SEQ ID NO: 6648590 - DNA, 20 bp, Homo sapiens
aggttctaaagttctaagat

SEQ ID NO: 6648591 - DNA, 15 bp, Homo sapiens
aggttctaaggccta

SEQ ID NO: 6648592 - DNA, 19 bp, Homo sapiens
aggttctaggtcctggctt

SEQ ID NO: 6648593 - DNA, 15 bp, Homo sapiens
aggttctatgatata

SEQ ID NO: 6648594 - DNA, 18 bp, Homo sapiens
aggttctatgatatacaa

SEQ ID NO: 6648595 - DNA, 13 bp, Homo sapiens
aggttctccaaca

SEQ ID NO: 6648596 - DNA, 13 bp, Homo sapiens
aggttctccaggt

SEQ ID NO: 6648597 - DNA, 21 bp, Homo sapiens
aggttctccgttagctcctgt

SEQ ID NO: 6648598 - DNA, 17 bp, Homo sapiens
aggttctctcctcccca

SEQ ID NO: 6648599 - DNA, 14 bp, Homo sapiens
aggttctctcctgt

SEQ ID NO: 6648600 - DNA, 14 bp, Homo sapiens
aggttctgaacagc

SEQ ID NO: 6648601 - DNA, 15 bp, Homo sapiens
aggttctgagctgtc

SEQ ID NO: 6648602 - DNA, 12 bp, Homo sapiens
aggttctgccct

SEQ ID NO: 6648603 - DNA, 13 bp, Homo sapiens
aggttctgcctct

SEQ ID NO: 6648604 - DNA, 15 bp, Homo sapiens
aggttctgggcctct

SEQ ID NO: 6648605 - DNA, 16 bp, Homo sapiens
aggttctgggcctctg

SEQ ID NO: 6648606 - DNA, 15 bp, Homo sapiens
aggttctggggagga

SEQ ID NO: 6648607 - DNA, 23 bp, Homo sapiens
aggttctggggaggaagggccag

SEQ ID NO: 6648608 - DNA, 20 bp, Homo sapiens
aggttctggtaacctgtggt

SEQ ID NO: 6648609 - DNA, 22 bp, Homo sapiens
aggttctggttagctcagcccc

SEQ ID NO: 6648610 - DNA, 19 bp, Homo sapiens
aggttctgtattttaagaa

SEQ ID NO: 6648611 - DNA, 17 bp, Homo sapiens
aggttctgtctgtgcca

SEQ ID NO: 6648612 - DNA, 23 bp, Homo sapiens
aggttctgttttgttttgtttta

SEQ ID NO: 6648613 - DNA, 19 bp, Homo sapiens
aggttcttaaaaaggaaca

SEQ ID NO: 6648614 - DNA, 17 bp, Homo sapiens
aggttcttagtgtcact

SEQ ID NO: 6648615 - DNA, 19 bp, Homo sapiens
aggttcttcatccctttcc

SEQ ID NO: 6648616 - DNA, 16 bp, Homo sapiens
aggttcttctatagtg

SEQ ID NO: 6648617 - DNA, 23 bp, Homo sapiens
aggttcttcttcctgaagctgag

SEQ ID NO: 6648618 - DNA, 16 bp, Homo sapiens
aggttcttgatgtcat

SEQ ID NO: 6648619 - DNA, 13 bp, Homo sapiens
aggttcttgcctt

SEQ ID NO: 6648620 - DNA, 12 bp, Homo sapiens
aggttcttgctt

SEQ ID NO: 6648621 - DNA, 17 bp, Homo sapiens
aggttcttgctttctct

SEQ ID NO: 6648622 - DNA, 23 bp, Homo sapiens
aggttcttgctttctctctcatg

SEQ ID NO: 6648623 - DNA, 17 bp, Homo sapiens
aggttgaactttgccaa

SEQ ID NO: 6648624 - DNA, 12 bp, Homo sapiens
aggttgaagagg

SEQ ID NO: 6648625 - DNA, 13 bp, Homo sapiens
aggttgaagccaa

SEQ ID NO: 6648626 - DNA, 15 bp, Homo sapiens
aggttgaataatata

SEQ ID NO: 6648627 - DNA, 21 bp, Homo sapiens
aggttgacaataaatgtgctt

SEQ ID NO: 6648628 - DNA, 19 bp, Homo sapiens
aggttgacagcaacaaagc

SEQ ID NO: 6648629 - DNA, 21 bp, Homo sapiens
aggttgagaagactcctgggc

SEQ ID NO: 6648630 - DNA, 20 bp, Homo sapiens
aggttgagcaatttccccct

SEQ ID NO: 6648631 - DNA, 24 bp, Homo sapiens
aggttgagctcttcttaaagtatt

SEQ ID NO: 6648632 - DNA, 21 bp, Homo sapiens
aggttgaggatgcactggcct

SEQ ID NO: 6648633 - DNA, 14 bp, Homo sapiens
aggttgaggctaaa

SEQ ID NO: 6648634 - DNA, 20 bp, Homo sapiens
aggttgaggggctcctggaa

SEQ ID NO: 6648635 - DNA, 20 bp, Homo sapiens
aggttgataaatcattttat

SEQ ID NO: 6648636 - DNA, 14 bp, Homo sapiens
aggttgataacttt

SEQ ID NO: 6648637 - DNA, 21 bp, Homo sapiens
aggttgcaaaacggatgagtt

SEQ ID NO: 6648638 - DNA, 13 bp, Homo sapiens
aggttgcacactt

SEQ ID NO: 6648639 - DNA, 13 bp, Homo sapiens
aggttgcagctgc

SEQ ID NO: 6648640 - DNA, 12 bp, Homo sapiens
aggttgcaggga

SEQ ID NO: 6648641 - DNA, 21 bp, Homo sapiens
aggttgcagtgaactgagact

SEQ ID NO: 6648642 - DNA, 20 bp, Homo sapiens
aggttgcattgagctgagat

SEQ ID NO: 6648643 - DNA, 12 bp, Homo sapiens
aggttgcattgg

SEQ ID NO: 6648644 - DNA, 21 bp, Homo sapiens
aggttgcattggggttcctct

SEQ ID NO: 6648645 - DNA, 12 bp, Homo sapiens
aggttgccaaat

SEQ ID NO: 6648646 - DNA, 15 bp, Homo sapiens
aggttgccaaattgc

SEQ ID NO: 6648647 - DNA, 19 bp, Homo sapiens
aggttgcctcaacagcagg

SEQ ID NO: 6648648 - DNA, 18 bp, Homo sapiens
aggttgctggcatttgct

SEQ ID NO: 6648649 - DNA, 11 bp, Homo sapiens
aggttgctgtt

SEQ ID NO: 6648650 - DNA, 14 bp, Homo sapiens
aggttgcttcaaga

SEQ ID NO: 6648651 - DNA, 14 bp, Homo sapiens
aggttgcttcagct

SEQ ID NO: 6648652 - DNA, 20 bp, Homo sapiens
aggttgcttcagctgatcct

SEQ ID NO: 6648653 - DNA, 20 bp, Homo sapiens
aggttggaactatgcagtgt

SEQ ID NO: 6648654 - DNA, 17 bp, Homo sapiens
aggttggaactgctgcc

SEQ ID NO: 6648655 - DNA, 18 bp, Homo sapiens
aggttggaactgctgcca

SEQ ID NO: 6648656 - DNA, 16 bp, Homo sapiens
aggttggaatctttta

SEQ ID NO: 6648657 - DNA, 16 bp, Homo sapiens
aggttggaccccagag

SEQ ID NO: 6648658 - DNA, 15 bp, Homo sapiens
aggttggaggcccta

SEQ ID NO: 6648659 - DNA, 18 bp, Homo sapiens
aggttggagtccagccta

SEQ ID NO: 6648660 - DNA, 20 bp, Homo sapiens
aggttggcaaaaaggcagga

SEQ ID NO: 6648661 - DNA, 20 bp, Homo sapiens
aggttggcgactgtcatgtg

SEQ ID NO: 6648662 - DNA, 16 bp, Homo sapiens
aggttggcgggggcac

SEQ ID NO: 6648663 - DNA, 18 bp, Homo sapiens
aggttggctctgccagtc

SEQ ID NO: 6648664 - DNA, 17 bp, Homo sapiens
aggttggcttttttccc

SEQ ID NO: 6648665 - DNA, 18 bp, Homo sapiens
aggttgggaaggcacctg

SEQ ID NO: 6648666 - DNA, 20 bp, Homo sapiens
aggttgggaatgaggcttgc

SEQ ID NO: 6648667 - DNA, 23 bp, Homo sapiens
aggttgggagaatgtcagtatgt

SEQ ID NO: 6648668 - DNA, 15 bp, Homo sapiens
aggttgggagttcga

SEQ ID NO: 6648669 - DNA, 12 bp, Homo sapiens
aggttggggaga

SEQ ID NO: 6648670 - DNA, 21 bp, Homo sapiens
aggttggggataggttttctg

SEQ ID NO: 6648671 - DNA, 18 bp, Homo sapiens
aggttgggggaaccagca

SEQ ID NO: 6648672 - DNA, 16 bp, Homo sapiens
aggttggggtgtacta

SEQ ID NO: 6648673 - DNA, 19 bp, Homo sapiens
aggttggggtgtactagtt

SEQ ID NO: 6648674 - DNA, 18 bp, Homo sapiens
aggttgggtgctgctaat

SEQ ID NO: 6648675 - DNA, 14 bp, Homo sapiens
aggttggtgaattt

SEQ ID NO: 6648676 - DNA, 14 bp, Homo sapiens
aggttggtgggggc

SEQ ID NO: 6648677 - DNA, 20 bp, Homo sapiens
aggttggtggggggtccagt

SEQ ID NO: 6648678 - DNA, 22 bp, Homo sapiens
aggttggttccttggggggcca

SEQ ID NO: 6648679 - DNA, 23 bp, Homo sapiens
aggttggttccttggggggccaa

SEQ ID NO: 6648680 - DNA, 22 bp, Homo sapiens
aggttggtttaatgcaatagaa

SEQ ID NO: 6648681 - DNA, 15 bp, Homo sapiens
aggttggtttcccct

SEQ ID NO: 6648682 - DNA, 18 bp, Homo sapiens
aggttggttttgctgttg

SEQ ID NO: 6648683 - DNA, 17 bp, Homo sapiens
aggttgtatgtaaatct

SEQ ID NO: 6648684 - DNA, 18 bp, Homo sapiens
aggttgtatgtaaatctg

SEQ ID NO: 6648685 - DNA, 14 bp, Homo sapiens
aggttgtctccagg

SEQ ID NO: 6648686 - DNA, 20 bp, Homo sapiens
aggttgtctgaagtcactgc

SEQ ID NO: 6648687 - DNA, 12 bp, Homo sapiens
aggttgtctgtg

SEQ ID NO: 6648688 - DNA, 12 bp, Homo sapiens
aggttgtgcatg

SEQ ID NO: 6648689 - DNA, 14 bp, Homo sapiens
aggttgtgcatgtt

SEQ ID NO: 6648690 - DNA, 16 bp, Homo sapiens
aggttgtggggaggct

SEQ ID NO: 6648691 - DNA, 22 bp, Homo sapiens
aggttgtggggcctcaggctcc

SEQ ID NO: 6648692 - DNA, 16 bp, Homo sapiens
aggttgttcctaaaat

SEQ ID NO: 6648693 - DNA, 13 bp, Homo sapiens
aggtttaaagagt

SEQ ID NO: 6648694 - DNA, 15 bp, Homo sapiens
aggtttaaagagtct

SEQ ID NO: 6648695 - DNA, 13 bp, Homo sapiens
aggtttaaagttt

SEQ ID NO: 6648696 - DNA, 14 bp, Homo sapiens
aggtttaacataaa

SEQ ID NO: 6648697 - DNA, 19 bp, Homo sapiens
aggtttaactcagatcact

SEQ ID NO: 6648698 - DNA, 20 bp, Homo sapiens
aggtttaactcagatcacta

SEQ ID NO: 6648699 - DNA, 21 bp, Homo sapiens
aggtttaaggctgaggctgcc

SEQ ID NO: 6648700 - DNA, 20 bp, Homo sapiens
aggtttaagtagatttcatg

SEQ ID NO: 6648701 - DNA, 22 bp, Homo sapiens
aggtttacaataggagtggtga

SEQ ID NO: 6648702 - DNA, 13 bp, Homo sapiens
aggtttacagtga

SEQ ID NO: 6648703 - DNA, 17 bp, Homo sapiens
aggtttactgtgaagag

SEQ ID NO: 6648704 - DNA, 19 bp, Homo sapiens
aggtttactgtgaagagaa

SEQ ID NO: 6648705 - DNA, 22 bp, Homo sapiens
aggtttactgtgaagagaatgt

SEQ ID NO: 6648706 - DNA, 12 bp, Homo sapiens
aggtttagagat

SEQ ID NO: 6648707 - DNA, 14 bp, Homo sapiens
aggtttagagatta

SEQ ID NO: 6648708 - DNA, 18 bp, Homo sapiens
aggtttaggctggtggcc

SEQ ID NO: 6648709 - DNA, 20 bp, Homo sapiens
aggtttaggctggtggccca

SEQ ID NO: 6648710 - DNA, 19 bp, Homo sapiens
aggtttagtaatctaaagt

SEQ ID NO: 6648711 - DNA, 16 bp, Homo sapiens
aggtttatgaaaaaga

SEQ ID NO: 6648712 - DNA, 21 bp, Homo sapiens
aggtttatgaaaaagaagaat

SEQ ID NO: 6648713 - DNA, 16 bp, Homo sapiens
aggtttatgacagtaa

SEQ ID NO: 6648714 - DNA, 23 bp, Homo sapiens
aggtttattctatctgtttttaa

SEQ ID NO: 6648715 - DNA, 19 bp, Homo sapiens
aggtttattgttaatacaa

SEQ ID NO: 6648716 - DNA, 13 bp, Homo sapiens
aggtttcaatgca

SEQ ID NO: 6648717 - DNA, 14 bp, Homo sapiens
aggtttcacctccg

SEQ ID NO: 6648718 - DNA, 16 bp, Homo sapiens
aggtttcactgttcat

SEQ ID NO: 6648719 - DNA, 19 bp, Homo sapiens
aggtttcacttgcacatca

SEQ ID NO: 6648720 - DNA, 21 bp, Homo sapiens
aggtttcattttcatctcatt

SEQ ID NO: 6648721 - DNA, 18 bp, Homo sapiens
aggtttcccaatggtgtt

SEQ ID NO: 6648722 - DNA, 16 bp, Homo sapiens
aggtttcccagtgagc

SEQ ID NO: 6648723 - DNA, 19 bp, Homo sapiens
aggtttcccagtgagcctc

SEQ ID NO: 6648724 - DNA, 20 bp, Homo sapiens
aggtttcccagtgagcctct

SEQ ID NO: 6648725 - DNA, 21 bp, Homo sapiens
aggtttcccagtgagcctctg

SEQ ID NO: 6648726 - DNA, 18 bp, Homo sapiens
aggtttcctgctccagtg

SEQ ID NO: 6648727 - DNA, 17 bp, Homo sapiens
aggtttcctttcagccc

SEQ ID NO: 6648728 - DNA, 19 bp, Homo sapiens
aggtttccttttggaacat

SEQ ID NO: 6648729 - DNA, 16 bp, Homo sapiens
aggtttctcaaagaaa

SEQ ID NO: 6648730 - DNA, 19 bp, Homo sapiens
aggtttctcaaagaaattt

SEQ ID NO: 6648731 - DNA, 14 bp, Homo sapiens
aggtttctctccct

SEQ ID NO: 6648732 - DNA, 15 bp, Homo sapiens
aggtttctctccctc

SEQ ID NO: 6648733 - DNA, 20 bp, Homo sapiens
aggtttctctgcctccaggt

SEQ ID NO: 6648734 - DNA, 14 bp, Homo sapiens
aggtttctgaaaat

SEQ ID NO: 6648735 - DNA, 15 bp, Homo sapiens
aggtttctgaaaatt

SEQ ID NO: 6648736 - DNA, 19 bp, Homo sapiens
aggtttctgagttcctgca

SEQ ID NO: 6648737 - DNA, 15 bp, Homo sapiens
aggtttctggagcag

SEQ ID NO: 6648738 - DNA, 23 bp, Homo sapiens
aggtttctggtctctaggctggg

SEQ ID NO: 6648739 - DNA, 12 bp, Homo sapiens
aggtttcttgaa

SEQ ID NO: 6648740 - DNA, 20 bp, Homo sapiens
aggtttgaaaagctgactgt

SEQ ID NO: 6648741 - DNA, 19 bp, Homo sapiens
aggtttgaaaggcaatttt

SEQ ID NO: 6648742 - DNA, 17 bp, Homo sapiens
aggtttgagaagcactg

SEQ ID NO: 6648743 - DNA, 13 bp, Homo sapiens
aggtttgcaggag

SEQ ID NO: 6648744 - DNA, 19 bp, Homo sapiens
aggtttgcagggagctcaa

SEQ ID NO: 6648745 - DNA, 18 bp, Homo sapiens
aggtttgcagtcccaagc

SEQ ID NO: 6648746 - DNA, 16 bp, Homo sapiens
aggtttggaaaactaa

SEQ ID NO: 6648747 - DNA, 23 bp, Homo sapiens
aggtttggacaaaatggaatact

SEQ ID NO: 6648748 - DNA, 22 bp, Homo sapiens
aggtttgggggacgcccagccc

SEQ ID NO: 6648749 - DNA, 17 bp, Homo sapiens
aggtttggtccagcctg

SEQ ID NO: 6648750 - DNA, 19 bp, Homo sapiens
aggtttggtgcaaagtatt

SEQ ID NO: 6648751 - DNA, 22 bp, Homo sapiens
aggtttgtaagtaagtaagaaa

SEQ ID NO: 6648752 - DNA, 12 bp, Homo sapiens
aggtttgtatat

SEQ ID NO: 6648753 - DNA, 13 bp, Homo sapiens
aggtttgtcaaca

SEQ ID NO: 6648754 - DNA, 17 bp, Homo sapiens
aggtttgtcaacaaaaa

SEQ ID NO: 6648755 - DNA, 21 bp, Homo sapiens
aggtttgtttgtgtgaaagga

SEQ ID NO: 6648756 - DNA, 18 bp, Homo sapiens
aggtttgttttcagcact

SEQ ID NO: 6648757 - DNA, 17 bp, Homo sapiens
aggtttgttttttcaag

SEQ ID NO: 6648758 - DNA, 21 bp, Homo sapiens
aggttttaaagtgattaaacg

SEQ ID NO: 6648759 - DNA, 15 bp, Homo sapiens
aggttttaaatctgc

SEQ ID NO: 6648760 - DNA, 14 bp, Homo sapiens
aggttttaagttgt

SEQ ID NO: 6648761 - DNA, 19 bp, Homo sapiens
aggttttaagttgtttgca

SEQ ID NO: 6648762 - DNA, 16 bp, Homo sapiens
aggttttaatttagta

SEQ ID NO: 6648763 - DNA, 20 bp, Homo sapiens
aggttttaatttagtaaacc

SEQ ID NO: 6648764 - DNA, 19 bp, Homo sapiens
aggttttacctttgaactt

SEQ ID NO: 6648765 - DNA, 19 bp, Homo sapiens
aggttttaggttctaaagt

SEQ ID NO: 6648766 - DNA, 23 bp, Homo sapiens
aggttttaggttctaaagttcta

SEQ ID NO: 6648767 - DNA, 16 bp, Homo sapiens
aggttttatccttcct

SEQ ID NO: 6648768 - DNA, 15 bp, Homo sapiens
aggttttatgatatt

SEQ ID NO: 6648769 - DNA, 23 bp, Homo sapiens
aggttttatgatatttttttaag

SEQ ID NO: 6648770 - DNA, 19 bp, Homo sapiens
aggttttcacataaatgca

SEQ ID NO: 6648771 - DNA, 10 bp, Homo sapiens
aggttttcag

SEQ ID NO: 6648772 - DNA, 11 bp, Homo sapiens
aggttttcctg

SEQ ID NO: 6648773 - DNA, 14 bp, Homo sapiens
aggttttctccccc

SEQ ID NO: 6648774 - DNA, 22 bp, Homo sapiens
aggttttctctaacttctcaag

SEQ ID NO: 6648775 - DNA, 17 bp, Homo sapiens
aggttttgtaaaactgt

SEQ ID NO: 6648776 - DNA, 13 bp, Homo sapiens
aggttttgtaaag

SEQ ID NO: 6648777 - DNA, 13 bp, Homo sapiens
aggttttgtattt

SEQ ID NO: 6648778 - DNA, 23 bp, Homo sapiens
aggtttttaaacactaaaatata

SEQ ID NO: 6648779 - DNA, 21 bp, Homo sapiens
aggtttttaaagtaaatctct

SEQ ID NO: 6648780 - DNA, 19 bp, Homo sapiens
aggtttttaaattgtttca

SEQ ID NO: 6648781 - DNA, 13 bp, Homo sapiens
aggtttttattag

SEQ ID NO: 6648782 - DNA, 20 bp, Homo sapiens
aggtttttattagtaccata

SEQ ID NO: 6648783 - DNA, 15 bp, Homo sapiens
aggtttttcaattaa

SEQ ID NO: 6648784 - DNA, 16 bp, Homo sapiens
aggtttttcaattaaa

SEQ ID NO: 6648785 - DNA, 17 bp, Homo sapiens
aggtttttcaattaaac

SEQ ID NO: 6648786 - DNA, 20 bp, Homo sapiens
aggtttttcctactgtcctc

SEQ ID NO: 6648787 - DNA, 23 bp, Homo sapiens
aggtttttcctactgtcctcaga

SEQ ID NO: 6648788 - DNA, 12 bp, Homo sapiens
aggtttttcctt

SEQ ID NO: 6648789 - DNA, 14 bp, Homo sapiens
aggtttttctcccc

SEQ ID NO: 6648790 - DNA, 15 bp, Homo sapiens
aggtttttcttggga

SEQ ID NO: 6648791 - DNA, 16 bp, Homo sapiens
aggtttttcttgggaa

SEQ ID NO: 6648792 - DNA, 17 bp, Homo sapiens
aggtttttcttgggaaa

SEQ ID NO: 6648793 - DNA, 15 bp, Homo sapiens
aggtttttgaggaaa

SEQ ID NO: 6648794 - DNA, 19 bp, Homo sapiens
aggtttttgcccatcctcc

SEQ ID NO: 6648795 - DNA, 22 bp, Homo sapiens
aggtttttgcttctccagtggt

SEQ ID NO: 6648796 - DNA, 15 bp, Homo sapiens
aggtttttgtaaaga

SEQ ID NO: 6648797 - DNA, 17 bp, Homo sapiens
aggtttttgtaaagatt

SEQ ID NO: 6648798 - DNA, 19 bp, Homo sapiens
aggtttttgtttgtttcct

SEQ ID NO: 6648799 - DNA, 16 bp, Homo sapiens
aggtttttttccttct

SEQ ID NO: 6648800 - DNA, 18 bp, Homo sapiens
aggtttttttccttctga

SEQ ID NO: 6648801 - DNA, 22 bp, Homo sapiens
aggtttttttgtcaacattgtg

SEQ ID NO: 6648802 - DNA, 15 bp, Homo sapiens
aggttttttttgtac

SEQ ID NO: 6648803 - DNA, 16 bp, Homo sapiens
aggttttttttgtacg

SEQ ID NO: 6648804 - DNA, 16 bp, Homo sapiens
aggttttttttttaag

SEQ ID NO: 6648805 - DNA, 20 bp, Homo sapiens
aggttttttttttaagtgca

SEQ ID NO: 6648806 - DNA, 13 bp, Homo sapiens
agtaaaaaaataa

SEQ ID NO: 6648807 - DNA, 20 bp, Homo sapiens
agtaaaaaatggtgttttat

SEQ ID NO: 6648808 - DNA, 18 bp, Homo sapiens
agtaaaaaattaaagccc

SEQ ID NO: 6648809 - DNA, 23 bp, Homo sapiens
agtaaaaacaaagaaattatgtg

SEQ ID NO: 6648810 - DNA, 22 bp, Homo sapiens
agtaaaaacactacctcttttg

SEQ ID NO: 6648811 - DNA, 14 bp, Homo sapiens
agtaaaaacctgct

SEQ ID NO: 6648812 - DNA, 19 bp, Homo sapiens
agtaaaaagaaaacaaaac

SEQ ID NO: 6648813 - DNA, 17 bp, Homo sapiens
agtaaaaagacattttt

SEQ ID NO: 6648814 - DNA, 14 bp, Homo sapiens
agtaaaaaggctaa

SEQ ID NO: 6648815 - DNA, 13 bp, Homo sapiens
agtaaaaatacaa

SEQ ID NO: 6648816 - DNA, 17 bp, Homo sapiens
agtaaaaatatgtcatc

SEQ ID NO: 6648817 - DNA, 15 bp, Homo sapiens
agtaaaaattaaaaa

SEQ ID NO: 6648818 - DNA, 20 bp, Homo sapiens
agtaaaaattaaaaaatgaa

SEQ ID NO: 6648819 - DNA, 20 bp, Homo sapiens
agtaaaaattcatataaagt

SEQ ID NO: 6648820 - DNA, 23 bp, Homo sapiens
agtaaaaatttcttccacgtaat

SEQ ID NO: 6648821 - DNA, 16 bp, Homo sapiens
agtaaaacaaacaata

SEQ ID NO: 6648822 - DNA, 14 bp, Homo sapiens
agtaaaacaaatga

SEQ ID NO: 6648823 - DNA, 15 bp, Homo sapiens
agtaaaacaaatgaa

SEQ ID NO: 6648824 - DNA, 18 bp, Homo sapiens
agtaaaacaaatgaaatt

SEQ ID NO: 6648825 - DNA, 12 bp, Homo sapiens
agtaaaacacaa

SEQ ID NO: 6648826 - DNA, 14 bp, Homo sapiens
agtaaaacacagag

SEQ ID NO: 6648827 - DNA, 13 bp, Homo sapiens
agtaaaacacatt

SEQ ID NO: 6648828 - DNA, 20 bp, Homo sapiens
agtaaaacagatttgttcat

SEQ ID NO: 6648829 - DNA, 14 bp, Homo sapiens
agtaaaacagtcat

SEQ ID NO: 6648830 - DNA, 15 bp, Homo sapiens
agtaaaaccacagca

SEQ ID NO: 6648831 - DNA, 20 bp, Homo sapiens
agtaaaactctcaagcaggt

SEQ ID NO: 6648832 - DNA, 22 bp, Homo sapiens
agtaaaagccttattctaaggt

SEQ ID NO: 6648833 - DNA, 13 bp, Homo sapiens
agtaaaagctaat

SEQ ID NO: 6648834 - DNA, 14 bp, Homo sapiens
agtaaaagctaatt

SEQ ID NO: 6648835 - DNA, 17 bp, Homo sapiens
agtaaaagtaaagacta

SEQ ID NO: 6648836 - DNA, 13 bp, Homo sapiens
agtaaaataaaaa

SEQ ID NO: 6648837 - DNA, 14 bp, Homo sapiens
agtaaaataaaaaa

SEQ ID NO: 6648838 - DNA, 20 bp, Homo sapiens
agtaaaatccaaagaactat

SEQ ID NO: 6648839 - DNA, 18 bp, Homo sapiens
agtaaaatgttttttaaa

SEQ ID NO: 6648840 - DNA, 16 bp, Homo sapiens
agtaaaattagaaaaa

SEQ ID NO: 6648841 - DNA, 18 bp, Homo sapiens
agtaaaattatactgtgt

SEQ ID NO: 6648842 - DNA, 21 bp, Homo sapiens
agtaaaattatactgtgtgtg

SEQ ID NO: 6648843 - DNA, 14 bp, Homo sapiens
agtaaaattatctg

SEQ ID NO: 6648844 - DNA, 16 bp, Homo sapiens
agtaaaattgccatat

SEQ ID NO: 6648845 - DNA, 21 bp, Homo sapiens
agtaaaattgccatattgcac

SEQ ID NO: 6648846 - DNA, 16 bp, Homo sapiens
agtaaaatttatttca

SEQ ID NO: 6648847 - DNA, 11 bp, Homo sapiens
agtaaaatttc

SEQ ID NO: 6648848 - DNA, 18 bp, Homo sapiens
agtaaaatttcaggatta

SEQ ID NO: 6648849 - DNA, 13 bp, Homo sapiens
agtaaacactgtg

SEQ ID NO: 6648850 - DNA, 16 bp, Homo sapiens
agtaaacataaaaact

SEQ ID NO: 6648851 - DNA, 17 bp, Homo sapiens
agtaaaccactgaaaaa

SEQ ID NO: 6648852 - DNA, 23 bp, Homo sapiens
agtaaaccactgaaaaaatatat

SEQ ID NO: 6648853 - DNA, 21 bp, Homo sapiens
agtaaaccatgtattccctta

SEQ ID NO: 6648854 - DNA, 19 bp, Homo sapiens
agtaaacggcccaggccag

SEQ ID NO: 6648855 - DNA, 14 bp, Homo sapiens
agtaaacgggaaca

SEQ ID NO: 6648856 - DNA, 16 bp, Homo sapiens
agtaaacgggaacatg

SEQ ID NO: 6648857 - DNA, 21 bp, Homo sapiens
agtaaacgggaacatgccccc

SEQ ID NO: 6648858 - DNA, 24 bp, Homo sapiens
agtaaactcccctttccctcgcta

SEQ ID NO: 6648859 - DNA, 15 bp, Homo sapiens
agtaaactgcagtcc

SEQ ID NO: 6648860 - DNA, 14 bp, Homo sapiens
agtaaactgccctg

SEQ ID NO: 6648861 - DNA, 15 bp, Homo sapiens
agtaaacttgtgtat

SEQ ID NO: 6648862 - DNA, 12 bp, Homo sapiens
agtaaagaactg

SEQ ID NO: 6648863 - DNA, 19 bp, Homo sapiens
agtaaagaagaaagctttt

SEQ ID NO: 6648864 - DNA, 15 bp, Homo sapiens
agtaaagaattattt

SEQ ID NO: 6648865 - DNA, 22 bp, Homo sapiens
agtaaagactattctgtttcta

SEQ ID NO: 6648866 - DNA, 13 bp, Homo sapiens
agtaaagagaaac

SEQ ID NO: 6648867 - DNA, 15 bp, Homo sapiens
agtaaagagaaactt

SEQ ID NO: 6648868 - DNA, 21 bp, Homo sapiens
agtaaagccattaaatgaata

SEQ ID NO: 6648869 - DNA, 17 bp, Homo sapiens
agtaaagccgttgttta

SEQ ID NO: 6648870 - DNA, 23 bp, Homo sapiens
agtaaagctagacaaaggcccag

SEQ ID NO: 6648871 - DNA, 22 bp, Homo sapiens
agtaaaggaaataagagcagtc

SEQ ID NO: 6648872 - DNA, 13 bp, Homo sapiens
agtaaaggaggaa

SEQ ID NO: 6648873 - DNA, 17 bp, Homo sapiens
agtaaaggcattccaca

SEQ ID NO: 6648874 - DNA, 19 bp, Homo sapiens
agtaaaggcattccacagg

SEQ ID NO: 6648875 - DNA, 15 bp, Homo sapiens
agtaaaggcctcctc

SEQ ID NO: 6648876 - DNA, 20 bp, Homo sapiens
agtaaagggggctggagaca

SEQ ID NO: 6648877 - DNA, 13 bp, Homo sapiens
agtaaagtaatgc

SEQ ID NO: 6648878 - DNA, 18 bp, Homo sapiens
agtaaagtaatgcatttg

SEQ ID NO: 6648879 - DNA, 14 bp, Homo sapiens
agtaaagtaccttt

SEQ ID NO: 6648880 - DNA, 15 bp, Homo sapiens
agtaaagtgaagaat

SEQ ID NO: 6648881 - DNA, 18 bp, Homo sapiens
agtaaagtgataatttct

SEQ ID NO: 6648882 - DNA, 19 bp, Homo sapiens
agtaaagtgataatttctg

SEQ ID NO: 6648883 - DNA, 13 bp, Homo sapiens
agtaaagtgctta

SEQ ID NO: 6648884 - DNA, 15 bp, Homo sapiens
agtaaagttaaaaga

SEQ ID NO: 6648885 - DNA, 13 bp, Homo sapiens
agtaaagtttgtt

SEQ ID NO: 6648886 - DNA, 14 bp, Homo sapiens
agtaaagtttgttg

SEQ ID NO: 6648887 - DNA, 11 bp, Homo sapiens
agtaaagtttt

SEQ ID NO: 6648888 - DNA, 14 bp, Homo sapiens
agtaaataaactct

SEQ ID NO: 6648889 - DNA, 15 bp, Homo sapiens
agtaaataaattgtt

SEQ ID NO: 6648890 - DNA, 18 bp, Homo sapiens
agtaaataaattgtttga

SEQ ID NO: 6648891 - DNA, 15 bp, Homo sapiens
agtaaataataaata

SEQ ID NO: 6648892 - DNA, 16 bp, Homo sapiens
agtaaatacaagactg

SEQ ID NO: 6648893 - DNA, 18 bp, Homo sapiens
agtaaatacaagactgtt

SEQ ID NO: 6648894 - DNA, 17 bp, Homo sapiens
agtaaatacactgtgaa

SEQ ID NO: 6648895 - DNA, 17 bp, Homo sapiens
agtaaatacttgcagtt

SEQ ID NO: 6648896 - DNA, 22 bp, Homo sapiens
agtaaatacttgcagttgtgat

SEQ ID NO: 6648897 - DNA, 19 bp, Homo sapiens
agtaaatagtttgaattca

SEQ ID NO: 6648898 - DNA, 14 bp, Homo sapiens
agtaaatatacact

SEQ ID NO: 6648899 - DNA, 18 bp, Homo sapiens
agtaaatatacactttac

SEQ ID NO: 6648900 - DNA, 18 bp, Homo sapiens
agtaaatattatgatttt

SEQ ID NO: 6648901 - DNA, 13 bp, Homo sapiens
agtaaatattgag

SEQ ID NO: 6648902 - DNA, 19 bp, Homo sapiens
agtaaatcacgctttttga

SEQ ID NO: 6648903 - DNA, 15 bp, Homo sapiens
agtaaatcagaaagt

SEQ ID NO: 6648904 - DNA, 21 bp, Homo sapiens
agtaaatcagaaagtaacaat

SEQ ID NO: 6648905 - DNA, 24 bp, Homo sapiens
agtaaatcagaaagtaacaatcta

SEQ ID NO: 6648906 - DNA, 21 bp, Homo sapiens
agtaaatccacaggctcctgt

SEQ ID NO: 6648907 - DNA, 17 bp, Homo sapiens
agtaaatctaaattaac

SEQ ID NO: 6648908 - DNA, 13 bp, Homo sapiens
agtaaatctatct

SEQ ID NO: 6648909 - DNA, 21 bp, Homo sapiens
agtaaatctatctctatataa

SEQ ID NO: 6648910 - DNA, 13 bp, Homo sapiens
agtaaatctcttt

SEQ ID NO: 6648911 - DNA, 16 bp, Homo sapiens
agtaaatgctgaaata

SEQ ID NO: 6648912 - DNA, 18 bp, Homo sapiens
agtaaatgggggtgcatt

SEQ ID NO: 6648913 - DNA, 15 bp, Homo sapiens
agtaaatgtagttca

SEQ ID NO: 6648914 - DNA, 19 bp, Homo sapiens
agtaaatgtagttcatact

SEQ ID NO: 6648915 - DNA, 12 bp, Homo sapiens
agtaaatgtctt

SEQ ID NO: 6648916 - DNA, 15 bp, Homo sapiens
agtaaatgtctttgt

SEQ ID NO: 6648917 - DNA, 16 bp, Homo sapiens
agtaaatgtctttgta

SEQ ID NO: 6648918 - DNA, 17 bp, Homo sapiens
agtaaatgtctttgtaa

SEQ ID NO: 6648919 - DNA, 19 bp, Homo sapiens
agtaaatgtgtttcttgct

SEQ ID NO: 6648920 - DNA, 10 bp, Homo sapiens
agtaaatgtt

SEQ ID NO: 6648921 - DNA, 15 bp, Homo sapiens
agtaaatgttaactg

SEQ ID NO: 6648922 - DNA, 22 bp, Homo sapiens
agtaaatgttatcttatactgt

SEQ ID NO: 6648923 - DNA, 15 bp, Homo sapiens
agtaaattatgatgt

SEQ ID NO: 6648924 - DNA, 13 bp, Homo sapiens
agtaaattatgta

SEQ ID NO: 6648925 - DNA, 19 bp, Homo sapiens
agtaaattgcctgatttgt

SEQ ID NO: 6648926 - DNA, 14 bp, Homo sapiens
agtaaattggaaac

SEQ ID NO: 6648927 - DNA, 13 bp, Homo sapiens
agtaacaaaaata

SEQ ID NO: 6648928 - DNA, 13 bp, Homo sapiens
agtaacaaataaa

SEQ ID NO: 6648929 - DNA, 21 bp, Homo sapiens
agtaacaagagtgattcttgc

SEQ ID NO: 6648930 - DNA, 22 bp, Homo sapiens
agtaacaagagtgattcttgct

SEQ ID NO: 6648931 - DNA, 13 bp, Homo sapiens
agtaacaatctat

SEQ ID NO: 6648932 - DNA, 18 bp, Homo sapiens
agtaacaattcagatcca

SEQ ID NO: 6648933 - DNA, 21 bp, Homo sapiens
agtaacaattcagatccagtg

SEQ ID NO: 6648934 - DNA, 13 bp, Homo sapiens
agtaacacatttg

SEQ ID NO: 6648935 - DNA, 12 bp, Homo sapiens
agtaacactaat

SEQ ID NO: 6648936 - DNA, 18 bp, Homo sapiens
agtaacacttgaaaagtg

SEQ ID NO: 6648937 - DNA, 21 bp, Homo sapiens
agtaacactttaaaaccagtt

SEQ ID NO: 6648938 - DNA, 22 bp, Homo sapiens
agtaacaggccttgagcacaaa

SEQ ID NO: 6648939 - DNA, 14 bp, Homo sapiens
agtaacagtatttc

SEQ ID NO: 6648940 - DNA, 14 bp, Homo sapiens
agtaacatataaat

SEQ ID NO: 6648941 - DNA, 22 bp, Homo sapiens
agtaacatcaaagattaggtga

SEQ ID NO: 6648942 - DNA, 22 bp, Homo sapiens
agtaacatcagccatttttaga

SEQ ID NO: 6648943 - DNA, 23 bp, Homo sapiens
agtaacatgacttccttatttct

SEQ ID NO: 6648944 - DNA, 15 bp, Homo sapiens
agtaacatgcaacaa

SEQ ID NO: 6648945 - DNA, 20 bp, Homo sapiens
agtaacatgcatactttatt

SEQ ID NO: 6648946 - DNA, 15 bp, Homo sapiens
agtaaccaaggccct

SEQ ID NO: 6648947 - DNA, 22 bp, Homo sapiens
agtaaccaaggccctgtctctg

SEQ ID NO: 6648948 - DNA, 15 bp, Homo sapiens
agtaaccaatttctt

SEQ ID NO: 6648949 - DNA, 18 bp, Homo sapiens
agtaaccattttcctttg

SEQ ID NO: 6648950 - DNA, 19 bp, Homo sapiens
agtaacccctcctggctgt

SEQ ID NO: 6648951 - DNA, 16 bp, Homo sapiens
agtaacgagaagtgct

SEQ ID NO: 6648952 - DNA, 16 bp, Homo sapiens
agtaacgcgtcttcct

SEQ ID NO: 6648953 - DNA, 19 bp, Homo sapiens
agtaacgcgtcttcctgag

SEQ ID NO: 6648954 - DNA, 21 bp, Homo sapiens
agtaacgggacagtaaacact

SEQ ID NO: 6648955 - DNA, 21 bp, Homo sapiens
agtaacgggtcgtaatgactt

SEQ ID NO: 6648956 - DNA, 19 bp, Homo sapiens
agtaacgtgctcactgtgt

SEQ ID NO: 6648957 - DNA, 18 bp, Homo sapiens
agtaacgttttccttgtg

SEQ ID NO: 6648958 - DNA, 21 bp, Homo sapiens
agtaactaagcacattatgtt

SEQ ID NO: 6648959 - DNA, 17 bp, Homo sapiens
agtaactacagttaggg

SEQ ID NO: 6648960 - DNA, 17 bp, Homo sapiens
agtaactataacaaaaa

SEQ ID NO: 6648961 - DNA, 22 bp, Homo sapiens
agtaactcatttgttaaaatta

SEQ ID NO: 6648962 - DNA, 19 bp, Homo sapiens
agtaactcccactcctaat

SEQ ID NO: 6648963 - DNA, 20 bp, Homo sapiens
agtaactcttacctaaactg

SEQ ID NO: 6648964 - DNA, 12 bp, Homo sapiens
agtaactgccct

SEQ ID NO: 6648965 - DNA, 14 bp, Homo sapiens
agtaactgctgtcg

SEQ ID NO: 6648966 - DNA, 18 bp, Homo sapiens
agtaactggttgctgtgt

SEQ ID NO: 6648967 - DNA, 13 bp, Homo sapiens
agtaactgtgact

SEQ ID NO: 6648968 - DNA, 14 bp, Homo sapiens
agtaactgtgactg

SEQ ID NO: 6648969 - DNA, 14 bp, Homo sapiens
agtaacttaatact

SEQ ID NO: 6648970 - DNA, 14 bp, Homo sapiens
agtaacttagaaaa

SEQ ID NO: 6648971 - DNA, 18 bp, Homo sapiens
agtaacttggctttcatt

SEQ ID NO: 6648972 - DNA, 14 bp, Homo sapiens
agtaacttgggagt

SEQ ID NO: 6648973 - DNA, 18 bp, Homo sapiens
agtaacttgggagtgtgg

SEQ ID NO: 6648974 - DNA, 20 bp, Homo sapiens
agtaacttggttatacatga

SEQ ID NO: 6648975 - DNA, 14 bp, Homo sapiens
agtaactttatgtg

SEQ ID NO: 6648976 - DNA, 21 bp, Homo sapiens
agtaactttgcgggatattta

SEQ ID NO: 6648977 - DNA, 16 bp, Homo sapiens
agtaacttttaaaatt

SEQ ID NO: 6648978 - DNA, 15 bp, Homo sapiens
agtaacttttttgtg

SEQ ID NO: 6648979 - DNA, 18 bp, Homo sapiens
agtaacttttttgtgtat

SEQ ID NO: 6648980 - DNA, 14 bp, Homo sapiens
agtaagaaaacaat

SEQ ID NO: 6648981 - DNA, 13 bp, Homo sapiens
agtaagaaaagtg

SEQ ID NO: 6648982 - DNA, 21 bp, Homo sapiens
agtaagaaagtgaagcaaatc

SEQ ID NO: 6648983 - DNA, 17 bp, Homo sapiens
agtaagaacgtactttc

SEQ ID NO: 6648984 - DNA, 15 bp, Homo sapiens
agtaagaagacatga

SEQ ID NO: 6648985 - DNA, 15 bp, Homo sapiens
agtaagaagaggagc

SEQ ID NO: 6648986 - DNA, 21 bp, Homo sapiens
agtaagaccggaagctcctgg

SEQ ID NO: 6648987 - DNA, 14 bp, Homo sapiens
agtaagaggctgga

SEQ ID NO: 6648988 - DNA, 19 bp, Homo sapiens
agtaagagtttacaagaaa

SEQ ID NO: 6648989 - DNA, 14 bp, Homo sapiens
agtaagatatctca

SEQ ID NO: 6648990 - DNA, 19 bp, Homo sapiens
agtaagatattatttaaat

SEQ ID NO: 6648991 - DNA, 21 bp, Homo sapiens
agtaagatcactgtttagatt

SEQ ID NO: 6648992 - DNA, 16 bp, Homo sapiens
agtaagatgcactgaa

SEQ ID NO: 6648993 - DNA, 14 bp, Homo sapiens
agtaagcaaacaaa

SEQ ID NO: 6648994 - DNA, 18 bp, Homo sapiens
agtaagcacctttagaat

SEQ ID NO: 6648995 - DNA, 21 bp, Homo sapiens
agtaagcagtgttacttgcag

SEQ ID NO: 6648996 - DNA, 13 bp, Homo sapiens
agtaagcccctgt

SEQ ID NO: 6648997 - DNA, 22 bp, Homo sapiens
agtaagcccttgaagatatctt

SEQ ID NO: 6648998 - DNA, 20 bp, Homo sapiens
agtaagccgtgattttcatt

SEQ ID NO: 6648999 - DNA, 16 bp, Homo sapiens
agtaagctgctgaatg

SEQ ID NO: 6649000 - DNA, 14 bp, Homo sapiens
agtaagctgctttt

SEQ ID NO: 6649001 - DNA, 22 bp, Homo sapiens
agtaagctggtttacagatgtt

SEQ ID NO: 6649002 - DNA, 18 bp, Homo sapiens
agtaaggaatgatattgc

SEQ ID NO: 6649003 - DNA, 18 bp, Homo sapiens
agtaaggagttcatttta

SEQ ID NO: 6649004 - DNA, 21 bp, Homo sapiens
agtaaggatttttatgtacat

SEQ ID NO: 6649005 - DNA, 15 bp, Homo sapiens
agtaaggcagctctg

SEQ ID NO: 6649006 - DNA, 14 bp, Homo sapiens
agtaaggcatgtta

SEQ ID NO: 6649007 - DNA, 12 bp, Homo sapiens
agtaaggctgtg

SEQ ID NO: 6649008 - DNA, 16 bp, Homo sapiens
agtaagggaaatagaa

SEQ ID NO: 6649009 - DNA, 18 bp, Homo sapiens
agtaagggatattagata

SEQ ID NO: 6649010 - DNA, 14 bp, Homo sapiens
agtaagtaattatg

SEQ ID NO: 6649011 - DNA, 22 bp, Homo sapiens
agtaagtacagaacagtaaagt

SEQ ID NO: 6649012 - DNA, 20 bp, Homo sapiens
agtaagtaccactcaggcca

SEQ ID NO: 6649013 - DNA, 23 bp, Homo sapiens
agtaagtagaggtggcttcagaa

SEQ ID NO: 6649014 - DNA, 15 bp, Homo sapiens
agtaagtatttccat

SEQ ID NO: 6649015 - DNA, 13 bp, Homo sapiens
agtaagtgccttc

SEQ ID NO: 6649016 - DNA, 15 bp, Homo sapiens
agtaagtgccttcca

SEQ ID NO: 6649017 - DNA, 23 bp, Homo sapiens
agtaagtggagcatttggaagga

SEQ ID NO: 6649018 - DNA, 13 bp, Homo sapiens
agtaagtgtacaa

SEQ ID NO: 6649019 - DNA, 14 bp, Homo sapiens
agtaagtgtacaat

SEQ ID NO: 6649020 - DNA, 16 bp, Homo sapiens
agtaagtgtgttcatt

SEQ ID NO: 6649021 - DNA, 22 bp, Homo sapiens
agtaagttactacttacaggtg

SEQ ID NO: 6649022 - DNA, 14 bp, Homo sapiens
agtaagttctgaaa

SEQ ID NO: 6649023 - DNA, 19 bp, Homo sapiens
agtaagttctgaaaactgt

SEQ ID NO: 6649024 - DNA, 15 bp, Homo sapiens
agtaagttctgtggt

SEQ ID NO: 6649025 - DNA, 23 bp, Homo sapiens
agtaagtttatccaaatcttgaa

SEQ ID NO: 6649026 - DNA, 23 bp, Homo sapiens
agtaagtttcaggagattgttaa

SEQ ID NO: 6649027 - DNA, 20 bp, Homo sapiens
agtaagtttcccctctggct

SEQ ID NO: 6649028 - DNA, 22 bp, Homo sapiens
agtaagtttcccctctggcttg

SEQ ID NO: 6649029 - DNA, 15 bp, Homo sapiens
agtaagtttcttcct

SEQ ID NO: 6649030 - DNA, 13 bp, Homo sapiens
agtaataaaaagc

SEQ ID NO: 6649031 - DNA, 15 bp, Homo sapiens
agtaataaaacatct

SEQ ID NO: 6649032 - DNA, 20 bp, Homo sapiens
agtaataaaacatgagctta

SEQ ID NO: 6649033 - DNA, 17 bp, Homo sapiens
agtaataaaacccagca

SEQ ID NO: 6649034 - DNA, 23 bp, Homo sapiens
agtaataaaattcaacaaacatt

SEQ ID NO: 6649035 - DNA, 12 bp, Homo sapiens
agtaataaagag

SEQ ID NO: 6649036 - DNA, 14 bp, Homo sapiens
agtaataaagagaa

SEQ ID NO: 6649037 - DNA, 17 bp, Homo sapiens
agtaataaagagaaata

SEQ ID NO: 6649038 - DNA, 21 bp, Homo sapiens
agtaataaagagaaatatatt

SEQ ID NO: 6649039 - DNA, 19 bp, Homo sapiens
agtaataaatgaatgtcac

SEQ ID NO: 6649040 - DNA, 20 bp, Homo sapiens
agtaataaattccaatacaa

SEQ ID NO: 6649041 - DNA, 16 bp, Homo sapiens
agtaataccaaagact

SEQ ID NO: 6649042 - DNA, 20 bp, Homo sapiens
agtaatacctctaatagtat

SEQ ID NO: 6649043 - DNA, 14 bp, Homo sapiens
agtaatagagcaaa

SEQ ID NO: 6649044 - DNA, 18 bp, Homo sapiens
agtaatagtccaatattt

SEQ ID NO: 6649045 - DNA, 20 bp, Homo sapiens
agtaatagtccaatatttgg

SEQ ID NO: 6649046 - DNA, 11 bp, Homo sapiens
agtaatataat

SEQ ID NO: 6649047 - DNA, 20 bp, Homo sapiens
agtaatataatacacaaaat

SEQ ID NO: 6649048 - DNA, 15 bp, Homo sapiens
agtaatatatcaaat

SEQ ID NO: 6649049 - DNA, 21 bp, Homo sapiens
agtaatatatttaaagggaaa

SEQ ID NO: 6649050 - DNA, 17 bp, Homo sapiens
agtaatatgcacacatt

SEQ ID NO: 6649051 - DNA, 16 bp, Homo sapiens
agtaatatgctctcat

SEQ ID NO: 6649052 - DNA, 13 bp, Homo sapiens
agtaatattacat

SEQ ID NO: 6649053 - DNA, 15 bp, Homo sapiens
agtaatattacattt

SEQ ID NO: 6649054 - DNA, 16 bp, Homo sapiens
agtaatattacatttc

SEQ ID NO: 6649055 - DNA, 14 bp, Homo sapiens
agtaatattattac

SEQ ID NO: 6649056 - DNA, 18 bp, Homo sapiens
agtaatatttatatattt

SEQ ID NO: 6649057 - DNA, 22 bp, Homo sapiens
agtaatatttattaaatttttt

SEQ ID NO: 6649058 - DNA, 22 bp, Homo sapiens
agtaatcagattactgctttaa

SEQ ID NO: 6649059 - DNA, 17 bp, Homo sapiens
agtaatcaggcagcctt

SEQ ID NO: 6649060 - DNA, 12 bp, Homo sapiens
agtaatcatcta

SEQ ID NO: 6649061 - DNA, 16 bp, Homo sapiens
agtaatcccagtgact

SEQ ID NO: 6649062 - DNA, 14 bp, Homo sapiens
agtaatcccgccac

SEQ ID NO: 6649063 - DNA, 17 bp, Homo sapiens
agtaatcccgccaccta

SEQ ID NO: 6649064 - DNA, 12 bp, Homo sapiens
agtaatcctgta

SEQ ID NO: 6649065 - DNA, 17 bp, Homo sapiens
agtaatcgcttaaagat

SEQ ID NO: 6649066 - DNA, 21 bp, Homo sapiens
agtaatctatgtgtttctgta

SEQ ID NO: 6649067 - DNA, 22 bp, Homo sapiens
agtaatctatgtgtttctgtaa

SEQ ID NO: 6649068 - DNA, 18 bp, Homo sapiens
agtaatctcacagcattt

SEQ ID NO: 6649069 - DNA, 14 bp, Homo sapiens
agtaatctccaggg

SEQ ID NO: 6649070 - DNA, 23 bp, Homo sapiens
agtaatctgtataatactttgta

SEQ ID NO: 6649071 - DNA, 22 bp, Homo sapiens
agtaatctgtcagtgtttgtat

SEQ ID NO: 6649072 - DNA, 21 bp, Homo sapiens
agtaatctgtgtacaaagaaa

SEQ ID NO: 6649073 - DNA, 15 bp, Homo sapiens
agtaatctttaaact

SEQ ID NO: 6649074 - DNA, 14 bp, Homo sapiens
agtaatgaaatgtt

SEQ ID NO: 6649075 - DNA, 15 bp, Homo sapiens
agtaatgaagaatca

SEQ ID NO: 6649076 - DNA, 19 bp, Homo sapiens
agtaatgaagaatcacgat

SEQ ID NO: 6649077 - DNA, 22 bp, Homo sapiens
agtaatgaatttttatgatatt

SEQ ID NO: 6649078 - DNA, 20 bp, Homo sapiens
agtaatgacgtgtgtggctg

SEQ ID NO: 6649079 - DNA, 23 bp, Homo sapiens
agtaatgagttaaataaaacatt

SEQ ID NO: 6649080 - DNA, 14 bp, Homo sapiens
agtaatgagtttaa

SEQ ID NO: 6649081 - DNA, 15 bp, Homo sapiens
agtaatgatctcaaa

SEQ ID NO: 6649082 - DNA, 17 bp, Homo sapiens
agtaatgcactctcagt

SEQ ID NO: 6649083 - DNA, 15 bp, Homo sapiens
agtaatgcagacatt

SEQ ID NO: 6649084 - DNA, 19 bp, Homo sapiens
agtaatgcagacatttaca

SEQ ID NO: 6649085 - DNA, 20 bp, Homo sapiens
agtaatgcagacatttacat

SEQ ID NO: 6649086 - DNA, 15 bp, Homo sapiens
agtaatgcagttttt

SEQ ID NO: 6649087 - DNA, 17 bp, Homo sapiens
agtaatgcatacagaaa

SEQ ID NO: 6649088 - DNA, 13 bp, Homo sapiens
agtaatgcctctg

SEQ ID NO: 6649089 - DNA, 17 bp, Homo sapiens
agtaatgctaaatgtgt

SEQ ID NO: 6649090 - DNA, 17 bp, Homo sapiens
agtaatgctacgtgtga

SEQ ID NO: 6649091 - DNA, 18 bp, Homo sapiens
agtaatgctacgtgtgat

SEQ ID NO: 6649092 - DNA, 21 bp, Homo sapiens
agtaatgctacgtgtgatttt

SEQ ID NO: 6649093 - DNA, 14 bp, Homo sapiens
agtaatggcagagc

SEQ ID NO: 6649094 - DNA, 18 bp, Homo sapiens
agtaatgggccaattaaa

SEQ ID NO: 6649095 - DNA, 22 bp, Homo sapiens
agtaatgggccaattaaaatat

SEQ ID NO: 6649096 - DNA, 23 bp, Homo sapiens
agtaatgggccaattaaaatata

SEQ ID NO: 6649097 - DNA, 15 bp, Homo sapiens
agtaatgggtttcat

SEQ ID NO: 6649098 - DNA, 15 bp, Homo sapiens
agtaatggtgtagaa

SEQ ID NO: 6649099 - DNA, 16 bp, Homo sapiens
agtaatggtgtagaac

SEQ ID NO: 6649100 - DNA, 19 bp, Homo sapiens
agtaatggtgtagaacact

SEQ ID NO: 6649101 - DNA, 23 bp, Homo sapiens
agtaatggtgtagaacactaatt

SEQ ID NO: 6649102 - DNA, 20 bp, Homo sapiens
agtaatggttctagaaggat

SEQ ID NO: 6649103 - DNA, 13 bp, Homo sapiens
agtaatgtaaaga

SEQ ID NO: 6649104 - DNA, 17 bp, Homo sapiens
agtaatgtaaagatgat

SEQ ID NO: 6649105 - DNA, 12 bp, Homo sapiens
agtaatgtagaa

SEQ ID NO: 6649106 - DNA, 13 bp, Homo sapiens
agtaatgtagaaa

SEQ ID NO: 6649107 - DNA, 12 bp, Homo sapiens
agtaatgtatat

SEQ ID NO: 6649108 - DNA, 12 bp, Homo sapiens
agtaatgtatta

SEQ ID NO: 6649109 - DNA, 13 bp, Homo sapiens
agtaatgtcttca

SEQ ID NO: 6649110 - DNA, 17 bp, Homo sapiens
agtaatgttttttagaa

SEQ ID NO: 6649111 - DNA, 13 bp, Homo sapiens
agtaattaaaaag

SEQ ID NO: 6649112 - DNA, 16 bp, Homo sapiens
agtaattaacatatca

SEQ ID NO: 6649113 - DNA, 19 bp, Homo sapiens
agtaattaaggtacatcat

SEQ ID NO: 6649114 - DNA, 16 bp, Homo sapiens
agtaattaataaagaa

SEQ ID NO: 6649115 - DNA, 20 bp, Homo sapiens
agtaattaataaagaaaaag

SEQ ID NO: 6649116 - DNA, 22 bp, Homo sapiens
agtaattaataaagaaaaagaa

SEQ ID NO: 6649117 - DNA, 23 bp, Homo sapiens
agtaattaataaagaaaaagaag

SEQ ID NO: 6649118 - DNA, 21 bp, Homo sapiens
agtaattaggataactaaaat

SEQ ID NO: 6649119 - DNA, 12 bp, Homo sapiens
agtaattatagg

SEQ ID NO: 6649120 - DNA, 15 bp, Homo sapiens
agtaattataggaag

SEQ ID NO: 6649121 - DNA, 13 bp, Homo sapiens
agtaattatcggg

SEQ ID NO: 6649122 - DNA, 21 bp, Homo sapiens
agtaattatgcactaaatatg

SEQ ID NO: 6649123 - DNA, 13 bp, Homo sapiens
agtaattcataca

SEQ ID NO: 6649124 - DNA, 20 bp, Homo sapiens
agtaattcccatctgcttta

SEQ ID NO: 6649125 - DNA, 21 bp, Homo sapiens
agtaattcccatctgctttat

SEQ ID NO: 6649126 - DNA, 22 bp, Homo sapiens
agtaattcccatctgctttatt

SEQ ID NO: 6649127 - DNA, 22 bp, Homo sapiens
agtaattccttctcttttttca

SEQ ID NO: 6649128 - DNA, 16 bp, Homo sapiens
agtaattcgtttgcta

SEQ ID NO: 6649129 - DNA, 19 bp, Homo sapiens
agtaattctagacataact

SEQ ID NO: 6649130 - DNA, 14 bp, Homo sapiens
agtaattctcaggc

SEQ ID NO: 6649131 - DNA, 17 bp, Homo sapiens
agtaattcttaagtctt

SEQ ID NO: 6649132 - DNA, 14 bp, Homo sapiens
agtaattctttgat

SEQ ID NO: 6649133 - DNA, 19 bp, Homo sapiens
agtaattgcatttctgctc

SEQ ID NO: 6649134 - DNA, 16 bp, Homo sapiens
agtaattgcatttgct

SEQ ID NO: 6649135 - DNA, 17 bp, Homo sapiens
agtaattgcatttgctt

SEQ ID NO: 6649136 - DNA, 17 bp, Homo sapiens
agtaattgtagatggaa

SEQ ID NO: 6649137 - DNA, 13 bp, Homo sapiens
agtaattgtgaaa

SEQ ID NO: 6649138 - DNA, 16 bp, Homo sapiens
agtaattgtgaaaaag

SEQ ID NO: 6649139 - DNA, 13 bp, Homo sapiens
agtaattgtgaca

SEQ ID NO: 6649140 - DNA, 18 bp, Homo sapiens
agtaattgtgtttacatt

SEQ ID NO: 6649141 - DNA, 18 bp, Homo sapiens
agtaatttaatttgtaaa

SEQ ID NO: 6649142 - DNA, 16 bp, Homo sapiens
agtaatttagaagata

SEQ ID NO: 6649143 - DNA, 19 bp, Homo sapiens
agtaatttattgtctgtct

SEQ ID NO: 6649144 - DNA, 22 bp, Homo sapiens
agtaatttattgtctgtctaca

SEQ ID NO: 6649145 - DNA, 12 bp, Homo sapiens
agtaatttcaag

SEQ ID NO: 6649146 - DNA, 15 bp, Homo sapiens
agtaatttcaagaat

SEQ ID NO: 6649147 - DNA, 17 bp, Homo sapiens
agtaatttcaagaatgt

SEQ ID NO: 6649148 - DNA, 18 bp, Homo sapiens
agtaatttcaagaatgtt

SEQ ID NO: 6649149 - DNA, 12 bp, Homo sapiens
agtaatttcagt

SEQ ID NO: 6649150 - DNA, 16 bp, Homo sapiens
agtaatttctaaagca

SEQ ID NO: 6649151 - DNA, 12 bp, Homo sapiens
agtaatttctga

SEQ ID NO: 6649152 - DNA, 21 bp, Homo sapiens
agtaatttctttttttccttt

SEQ ID NO: 6649153 - DNA, 18 bp, Homo sapiens
agtaatttgggaaaagaa

SEQ ID NO: 6649154 - DNA, 22 bp, Homo sapiens
agtaatttgggaaaagaagctg

SEQ ID NO: 6649155 - DNA, 19 bp, Homo sapiens
agtaatttgtaaaaaagat

SEQ ID NO: 6649156 - DNA, 21 bp, Homo sapiens
agtaatttgtttaaaaagtaa

SEQ ID NO: 6649157 - DNA, 17 bp, Homo sapiens
agtaattttcatattaa

SEQ ID NO: 6649158 - DNA, 15 bp, Homo sapiens
agtaattttctgatg

SEQ ID NO: 6649159 - DNA, 19 bp, Homo sapiens
agtaattttcttctcattc

SEQ ID NO: 6649160 - DNA, 17 bp, Homo sapiens
agtaattttttacattt

SEQ ID NO: 6649161 - DNA, 13 bp, Homo sapiens
agtacaaaacaat

SEQ ID NO: 6649162 - DNA, 19 bp, Homo sapiens
agtacaaaaggagaagagg

SEQ ID NO: 6649163 - DNA, 17 bp, Homo sapiens
agtacaaaatagttgta

SEQ ID NO: 6649164 - DNA, 14 bp, Homo sapiens
agtacaaagacagg

SEQ ID NO: 6649165 - DNA, 19 bp, Homo sapiens
agtacaaagacagggaata

SEQ ID NO: 6649166 - DNA, 17 bp, Homo sapiens
agtacaaaggcatgttt

SEQ ID NO: 6649167 - DNA, 13 bp, Homo sapiens
agtacaaatgcct

SEQ ID NO: 6649168 - DNA, 21 bp, Homo sapiens
agtacaaatgccttaaaatgg

SEQ ID NO: 6649169 - DNA, 11 bp, Homo sapiens
agtacaaatgt

SEQ ID NO: 6649170 - DNA, 16 bp, Homo sapiens
agtacaaatgtgtgac

SEQ ID NO: 6649171 - DNA, 18 bp, Homo sapiens
agtacaaccactatcttt

SEQ ID NO: 6649172 - DNA, 15 bp, Homo sapiens
agtacaagggctgag

SEQ ID NO: 6649173 - DNA, 15 bp, Homo sapiens
agtacaataaataaa

SEQ ID NO: 6649174 - DNA, 14 bp, Homo sapiens
agtacaatgaactg

SEQ ID NO: 6649175 - DNA, 18 bp, Homo sapiens
agtacaatgtgactttga

SEQ ID NO: 6649176 - DNA, 20 bp, Homo sapiens
agtacaatgtgtttttctcc

SEQ ID NO: 6649177 - DNA, 16 bp, Homo sapiens
agtacaattcattgtt

SEQ ID NO: 6649178 - DNA, 23 bp, Homo sapiens
agtacaattcattgttttgcaaa

SEQ ID NO: 6649179 - DNA, 22 bp, Homo sapiens
agtacaattctttgttgcttaa

SEQ ID NO: 6649180 - DNA, 23 bp, Homo sapiens
agtacaattctttgttgcttaat

SEQ ID NO: 6649181 - DNA, 15 bp, Homo sapiens
agtacacaactatgg

SEQ ID NO: 6649182 - DNA, 16 bp, Homo sapiens
agtacacaactatgga

SEQ ID NO: 6649183 - DNA, 19 bp, Homo sapiens
agtacacaattgttttacc

SEQ ID NO: 6649184 - DNA, 16 bp, Homo sapiens
agtacacaccagaaga

SEQ ID NO: 6649185 - DNA, 21 bp, Homo sapiens
agtacacaccagaagatgtga

SEQ ID NO: 6649186 - DNA, 22 bp, Homo sapiens
agtacactcagccactgtcaca

SEQ ID NO: 6649187 - DNA, 22 bp, Homo sapiens
agtacactgtgtctctatgtga

SEQ ID NO: 6649188 - DNA, 16 bp, Homo sapiens
agtacactgtttcaaa

SEQ ID NO: 6649189 - DNA, 15 bp, Homo sapiens
agtacacttcctgtg

SEQ ID NO: 6649190 - DNA, 19 bp, Homo sapiens
agtacacttggtgtactgg

SEQ ID NO: 6649191 - DNA, 17 bp, Homo sapiens
agtacagaaaaatactt

SEQ ID NO: 6649192 - DNA, 20 bp, Homo sapiens
agtacagaacagtaaagtta

SEQ ID NO: 6649193 - DNA, 14 bp, Homo sapiens
agtacagaatttga

SEQ ID NO: 6649194 - DNA, 18 bp, Homo sapiens
agtacagactgcagacat

SEQ ID NO: 6649195 - DNA, 14 bp, Homo sapiens
agtacagagaagcc

SEQ ID NO: 6649196 - DNA, 15 bp, Homo sapiens
agtacagagaagcca

SEQ ID NO: 6649197 - DNA, 16 bp, Homo sapiens
agtacagagaagccat

SEQ ID NO: 6649198 - DNA, 20 bp, Homo sapiens
agtacagagaagccatcacc

SEQ ID NO: 6649199 - DNA, 14 bp, Homo sapiens
agtacagagtgcag

SEQ ID NO: 6649200 - DNA, 16 bp, Homo sapiens
agtacagatactgtga

SEQ ID NO: 6649201 - DNA, 14 bp, Homo sapiens
agtacagatcctct

SEQ ID NO: 6649202 - DNA, 13 bp, Homo sapiens
agtacagcctgga

SEQ ID NO: 6649203 - DNA, 18 bp, Homo sapiens
agtacagcggctcccctc

SEQ ID NO: 6649204 - DNA, 14 bp, Homo sapiens
agtacaggcagcac

SEQ ID NO: 6649205 - DNA, 17 bp, Homo sapiens
agtacaggcagcacaga

SEQ ID NO: 6649206 - DNA, 20 bp, Homo sapiens
agtacagggcagaaccaaga

SEQ ID NO: 6649207 - DNA, 13 bp, Homo sapiens
agtacagggcagg

SEQ ID NO: 6649208 - DNA, 19 bp, Homo sapiens
agtacagggcaggagctgc

SEQ ID NO: 6649209 - DNA, 23 bp, Homo sapiens
agtacaggtaaggtgagggaata

SEQ ID NO: 6649210 - DNA, 17 bp, Homo sapiens
agtacaggtactttgtc

SEQ ID NO: 6649211 - DNA, 20 bp, Homo sapiens
agtacagtagcttaaataaa

SEQ ID NO: 6649212 - DNA, 23 bp, Homo sapiens
agtacagtagcttaaataaattc

SEQ ID NO: 6649213 - DNA, 21 bp, Homo sapiens
agtacagtattcttttaaaat

SEQ ID NO: 6649214 - DNA, 15 bp, Homo sapiens
agtacagtgtgtgtg

SEQ ID NO: 6649215 - DNA, 21 bp, Homo sapiens
agtacataaagtaataactgt

SEQ ID NO: 6649216 - DNA, 21 bp, Homo sapiens
agtacataattgattaaaatc

SEQ ID NO: 6649217 - DNA, 14 bp, Homo sapiens
agtacatatggtag

SEQ ID NO: 6649218 - DNA, 20 bp, Homo sapiens
agtacatatggtagacaatt

SEQ ID NO: 6649219 - DNA, 11 bp, Homo sapiens
agtacatatgt

SEQ ID NO: 6649220 - DNA, 17 bp, Homo sapiens
agtacatattaggaaaa

SEQ ID NO: 6649221 - DNA, 14 bp, Homo sapiens
agtacatcttgtgc

SEQ ID NO: 6649222 - DNA, 15 bp, Homo sapiens
agtacatcttgtgca

SEQ ID NO: 6649223 - DNA, 17 bp, Homo sapiens
agtacatggaagaagta

SEQ ID NO: 6649224 - DNA, 20 bp, Homo sapiens
agtacatggaagaagtatat

SEQ ID NO: 6649225 - DNA, 16 bp, Homo sapiens
agtacatggagctcag

SEQ ID NO: 6649226 - DNA, 16 bp, Homo sapiens
agtacattcatctgga

SEQ ID NO: 6649227 - DNA, 19 bp, Homo sapiens
agtacattcatctggaggc

SEQ ID NO: 6649228 - DNA, 19 bp, Homo sapiens
agtacattgttacctctat

SEQ ID NO: 6649229 - DNA, 19 bp, Homo sapiens
agtacatttaaattttttg

SEQ ID NO: 6649230 - DNA, 15 bp, Homo sapiens
agtacattttttgaa

SEQ ID NO: 6649231 - DNA, 22 bp, Homo sapiens
agtacattttttgaaatgctga

SEQ ID NO: 6649232 - DNA, 11 bp, Homo sapiens
agtaccaaaga

SEQ ID NO: 6649233 - DNA, 18 bp, Homo sapiens
agtaccaaagttttatca

SEQ ID NO: 6649234 - DNA, 20 bp, Homo sapiens
agtaccaaatccacaagcca

SEQ ID NO: 6649235 - DNA, 15 bp, Homo sapiens
agtaccaatgctgtt

SEQ ID NO: 6649236 - DNA, 16 bp, Homo sapiens
agtaccaatgctgttg

SEQ ID NO: 6649237 - DNA, 15 bp, Homo sapiens
agtaccacactgagt

SEQ ID NO: 6649238 - DNA, 17 bp, Homo sapiens
agtaccacactgagttc

SEQ ID NO: 6649239 - DNA, 15 bp, Homo sapiens
agtaccacattccat

SEQ ID NO: 6649240 - DNA, 17 bp, Homo sapiens
agtaccaccaaaaaagc

SEQ ID NO: 6649241 - DNA, 22 bp, Homo sapiens
agtaccaccaaaaaagctgtat

SEQ ID NO: 6649242 - DNA, 14 bp, Homo sapiens
agtaccagactaga

SEQ ID NO: 6649243 - DNA, 14 bp, Homo sapiens
agtaccagcatgtt

SEQ ID NO: 6649244 - DNA, 17 bp, Homo sapiens
agtaccataatcttaga

SEQ ID NO: 6649245 - DNA, 14 bp, Homo sapiens
agtaccatcccact

SEQ ID NO: 6649246 - DNA, 17 bp, Homo sapiens
agtaccatcccactgat

SEQ ID NO: 6649247 - DNA, 18 bp, Homo sapiens
agtaccatcccactgata

SEQ ID NO: 6649248 - DNA, 15 bp, Homo sapiens
agtaccatctgaata

SEQ ID NO: 6649249 - DNA, 12 bp, Homo sapiens
agtaccatttaa

SEQ ID NO: 6649250 - DNA, 12 bp, Homo sapiens
agtacccacctg

SEQ ID NO: 6649251 - DNA, 11 bp, Homo sapiens
agtacccagca

SEQ ID NO: 6649252 - DNA, 12 bp, Homo sapiens
agtacccagcaa

SEQ ID NO: 6649253 - DNA, 18 bp, Homo sapiens
agtacccatctagtactt

SEQ ID NO: 6649254 - DNA, 18 bp, Homo sapiens
agtaccccagccactcct

SEQ ID NO: 6649255 - DNA, 20 bp, Homo sapiens
agtacccctggtaaaccaag

SEQ ID NO: 6649256 - DNA, 15 bp, Homo sapiens
agtaccctaccctga

SEQ ID NO: 6649257 - DNA, 13 bp, Homo sapiens
agtaccctgcagg

SEQ ID NO: 6649258 - DNA, 14 bp, Homo sapiens
agtaccctgcaggc

SEQ ID NO: 6649259 - DNA, 12 bp, Homo sapiens
agtaccctggtt

SEQ ID NO: 6649260 - DNA, 18 bp, Homo sapiens
agtaccctggttgtgtgt

SEQ ID NO: 6649261 - DNA, 19 bp, Homo sapiens
agtaccctggttgtgtgtc

SEQ ID NO: 6649262 - DNA, 19 bp, Homo sapiens
agtacccttggcctttaca

SEQ ID NO: 6649263 - DNA, 15 bp, Homo sapiens
agtacctcaaagtaa

SEQ ID NO: 6649264 - DNA, 19 bp, Homo sapiens
agtacctcaaagtaaaaat

SEQ ID NO: 6649265 - DNA, 16 bp, Homo sapiens
agtacctcagcattta

SEQ ID NO: 6649266 - DNA, 17 bp, Homo sapiens
agtacctccaagcaagt

SEQ ID NO: 6649267 - DNA, 14 bp, Homo sapiens
agtacctgaaaagt

SEQ ID NO: 6649268 - DNA, 22 bp, Homo sapiens
agtacctgagggtctgtaggtt

SEQ ID NO: 6649269 - DNA, 13 bp, Homo sapiens
agtacctggagga

SEQ ID NO: 6649270 - DNA, 17 bp, Homo sapiens
agtacctgtgtgtttcg

SEQ ID NO: 6649271 - DNA, 18 bp, Homo sapiens
agtaccttaggttctttc

SEQ ID NO: 6649272 - DNA, 14 bp, Homo sapiens
agtaccttcaaata

SEQ ID NO: 6649273 - DNA, 15 bp, Homo sapiens
agtaccttcaaataa

SEQ ID NO: 6649274 - DNA, 14 bp, Homo sapiens
agtaccttgaactc

SEQ ID NO: 6649275 - DNA, 12 bp, Homo sapiens
agtaccttgttt

SEQ ID NO: 6649276 - DNA, 19 bp, Homo sapiens
agtaccttgttttgccatg

SEQ ID NO: 6649277 - DNA, 16 bp, Homo sapiens
agtacctttcagaact

SEQ ID NO: 6649278 - DNA, 18 bp, Homo sapiens
agtacctttcctacattt

SEQ ID NO: 6649279 - DNA, 12 bp, Homo sapiens
agtacctttgga

SEQ ID NO: 6649280 - DNA, 15 bp, Homo sapiens
agtacctttttaaca

SEQ ID NO: 6649281 - DNA, 16 bp, Homo sapiens
agtacgaacctacagt

SEQ ID NO: 6649282 - DNA, 18 bp, Homo sapiens
agtacgaacctacagttt

SEQ ID NO: 6649283 - DNA, 20 bp, Homo sapiens
agtacgatcaagttgttgac

SEQ ID NO: 6649284 - DNA, 14 bp, Homo sapiens
agtacggatttgtc

SEQ ID NO: 6649285 - DNA, 16 bp, Homo sapiens
agtacgtcctgcctgg

SEQ ID NO: 6649286 - DNA, 22 bp, Homo sapiens
agtacgtgtttacttggtgagg

SEQ ID NO: 6649287 - DNA, 15 bp, Homo sapiens
agtacgtttttgcat

SEQ ID NO: 6649288 - DNA, 21 bp, Homo sapiens
agtacgtttttgcattattca

SEQ ID NO: 6649289 - DNA, 22 bp, Homo sapiens
agtacgtttttgcattattcat

SEQ ID NO: 6649290 - DNA, 20 bp, Homo sapiens
agtactaaaactagataact

SEQ ID NO: 6649291 - DNA, 14 bp, Homo sapiens
agtactaaaattaa

SEQ ID NO: 6649292 - DNA, 14 bp, Homo sapiens
agtactaagagtat

SEQ ID NO: 6649293 - DNA, 14 bp, Homo sapiens
agtactaagcattt

SEQ ID NO: 6649294 - DNA, 14 bp, Homo sapiens
agtactaaggtgac

SEQ ID NO: 6649295 - DNA, 18 bp, Homo sapiens
agtactaaggtgactttc

SEQ ID NO: 6649296 - DNA, 16 bp, Homo sapiens
agtactaatagaactt

SEQ ID NO: 6649297 - DNA, 22 bp, Homo sapiens
agtactacagtcctcccatctc

SEQ ID NO: 6649298 - DNA, 12 bp, Homo sapiens
agtactactgta

SEQ ID NO: 6649299 - DNA, 19 bp, Homo sapiens
agtactagagatattttgt

SEQ ID NO: 6649300 - DNA, 21 bp, Homo sapiens
agtactagagatattttgtaa

SEQ ID NO: 6649301 - DNA, 20 bp, Homo sapiens
agtactagatgcatcactgg

SEQ ID NO: 6649302 - DNA, 13 bp, Homo sapiens
agtactatgtaaa

SEQ ID NO: 6649303 - DNA, 14 bp, Homo sapiens
agtactatgtatca

SEQ ID NO: 6649304 - DNA, 15 bp, Homo sapiens
agtactattaataga

SEQ ID NO: 6649305 - DNA, 22 bp, Homo sapiens
agtactattactattactattt

SEQ ID NO: 6649306 - DNA, 23 bp, Homo sapiens
agtactatttcttaatgtaacat

SEQ ID NO: 6649307 - DNA, 12 bp, Homo sapiens
agtactcaaatt

SEQ ID NO: 6649308 - DNA, 15 bp, Homo sapiens
agtactcaaattcaa

SEQ ID NO: 6649309 - DNA, 15 bp, Homo sapiens
agtactcaatgtttc

SEQ ID NO: 6649310 - DNA, 20 bp, Homo sapiens
agtactcaatgtttctggac

SEQ ID NO: 6649311 - DNA, 22 bp, Homo sapiens
agtactcaatgtttctggacat

SEQ ID NO: 6649312 - DNA, 11 bp, Homo sapiens
agtactcactt

SEQ ID NO: 6649313 - DNA, 12 bp, Homo sapiens
agtactcacttt

SEQ ID NO: 6649314 - DNA, 22 bp, Homo sapiens
agtactcacttttcacttgtct

SEQ ID NO: 6649315 - DNA, 23 bp, Homo sapiens
agtactcataaaggacactggat

SEQ ID NO: 6649316 - DNA, 17 bp, Homo sapiens
agtactccacaaacatg

SEQ ID NO: 6649317 - DNA, 14 bp, Homo sapiens
agtactccacactg

SEQ ID NO: 6649318 - DNA, 15 bp, Homo sapiens
agtactccacactgc

SEQ ID NO: 6649319 - DNA, 16 bp, Homo sapiens
agtactccacactgca

SEQ ID NO: 6649320 - DNA, 14 bp, Homo sapiens
agtactcctccctg

SEQ ID NO: 6649321 - DNA, 16 bp, Homo sapiens
agtactcctgcaaaat

SEQ ID NO: 6649322 - DNA, 13 bp, Homo sapiens
agtactctctgct

SEQ ID NO: 6649323 - DNA, 16 bp, Homo sapiens
agtactgacagaaagc

SEQ ID NO: 6649324 - DNA, 18 bp, Homo sapiens
agtactgcaaaatgcttt

SEQ ID NO: 6649325 - DNA, 20 bp, Homo sapiens
agtactgcatgatcttacac

SEQ ID NO: 6649326 - DNA, 15 bp, Homo sapiens
agtactgctttactg

SEQ ID NO: 6649327 - DNA, 13 bp, Homo sapiens
agtactggaataa

SEQ ID NO: 6649328 - DNA, 16 bp, Homo sapiens
agtactggaataaaca

SEQ ID NO: 6649329 - DNA, 15 bp, Homo sapiens
agtactggagaaaat

SEQ ID NO: 6649330 - DNA, 16 bp, Homo sapiens
agtactggctctttat

SEQ ID NO: 6649331 - DNA, 15 bp, Homo sapiens
agtactgggaaggag

SEQ ID NO: 6649332 - DNA, 17 bp, Homo sapiens
agtactggttactttca

SEQ ID NO: 6649333 - DNA, 18 bp, Homo sapiens
agtactggttactttcaa

SEQ ID NO: 6649334 - DNA, 19 bp, Homo sapiens
agtactggttactttcaaa

SEQ ID NO: 6649335 - DNA, 21 bp, Homo sapiens
agtactgtaataatacctcaa

SEQ ID NO: 6649336 - DNA, 17 bp, Homo sapiens
agtactgtgaatccagt

SEQ ID NO: 6649337 - DNA, 20 bp, Homo sapiens
agtactgtgggcaatttaga

SEQ ID NO: 6649338 - DNA, 21 bp, Homo sapiens
agtactgtgggcaatttagaa

SEQ ID NO: 6649339 - DNA, 22 bp, Homo sapiens
agtactgtgggcaatttagaaa

SEQ ID NO: 6649340 - DNA, 15 bp, Homo sapiens
agtactgtgtactgt

SEQ ID NO: 6649341 - DNA, 21 bp, Homo sapiens
agtactgtttaccatttttca

SEQ ID NO: 6649342 - DNA, 22 bp, Homo sapiens
agtactgttttgaagctgggct

SEQ ID NO: 6649343 - DNA, 18 bp, Homo sapiens
agtacttaactatctgtt

SEQ ID NO: 6649344 - DNA, 16 bp, Homo sapiens
agtacttacattccag

SEQ ID NO: 6649345 - DNA, 21 bp, Homo sapiens
agtacttaccagtcaatgcat

SEQ ID NO: 6649346 - DNA, 18 bp, Homo sapiens
agtacttaggtaattgta

SEQ ID NO: 6649347 - DNA, 22 bp, Homo sapiens
agtacttctccaccctgctctc

SEQ ID NO: 6649348 - DNA, 14 bp, Homo sapiens
agtacttcttctgt

SEQ ID NO: 6649349 - DNA, 23 bp, Homo sapiens
agtacttgagggaccaatattac

SEQ ID NO: 6649350 - DNA, 20 bp, Homo sapiens
agtacttgagtgtaatgttt

SEQ ID NO: 6649351 - DNA, 18 bp, Homo sapiens
agtacttgctctctgaga

SEQ ID NO: 6649352 - DNA, 23 bp, Homo sapiens
agtacttgctctctgagagcaca

SEQ ID NO: 6649353 - DNA, 19 bp, Homo sapiens
agtacttggcccccttcag

SEQ ID NO: 6649354 - DNA, 22 bp, Homo sapiens
agtacttggcccccttcaggag

SEQ ID NO: 6649355 - DNA, 23 bp, Homo sapiens
agtacttgggagacctgtaatca

SEQ ID NO: 6649356 - DNA, 15 bp, Homo sapiens
agtacttgtcatatg

SEQ ID NO: 6649357 - DNA, 22 bp, Homo sapiens
agtacttgtgaaacacagctgt

SEQ ID NO: 6649358 - DNA, 24 bp, Homo sapiens
agtacttgtgaaacacagctgttc

SEQ ID NO: 6649359 - DNA, 16 bp, Homo sapiens
agtactttaaaaagga

SEQ ID NO: 6649360 - DNA, 17 bp, Homo sapiens
agtactttaaaaaggaa

SEQ ID NO: 6649361 - DNA, 18 bp, Homo sapiens
agtactttaaaaaggaaa

SEQ ID NO: 6649362 - DNA, 19 bp, Homo sapiens
agtactttaaaaaggaaat

SEQ ID NO: 6649363 - DNA, 23 bp, Homo sapiens
agtactttatgaaaaaaatatat

SEQ ID NO: 6649364 - DNA, 19 bp, Homo sapiens
agtactttggaaagccaag

SEQ ID NO: 6649365 - DNA, 19 bp, Homo sapiens
agtactttggaggccccta

SEQ ID NO: 6649366 - DNA, 15 bp, Homo sapiens
agtactttgtgcatt

SEQ ID NO: 6649367 - DNA, 16 bp, Homo sapiens
agtactttgtgcattc

SEQ ID NO: 6649368 - DNA, 13 bp, Homo sapiens
agtactttgtgct

SEQ ID NO: 6649369 - DNA, 13 bp, Homo sapiens
agtacttttaacg

SEQ ID NO: 6649370 - DNA, 23 bp, Homo sapiens
agtacttttaacgtatgtatttc

SEQ ID NO: 6649371 - DNA, 15 bp, Homo sapiens
agtacttttagactt

SEQ ID NO: 6649372 - DNA, 14 bp, Homo sapiens
agtacttttctctg

SEQ ID NO: 6649373 - DNA, 15 bp, Homo sapiens
agtacttttgttgta

SEQ ID NO: 6649374 - DNA, 17 bp, Homo sapiens
agtacttttgttgtatg

SEQ ID NO: 6649375 - DNA, 18 bp, Homo sapiens
agtacttttgttgtatgg

SEQ ID NO: 6649376 - DNA, 17 bp, Homo sapiens
agtagaaaaaaaaataa

SEQ ID NO: 6649377 - DNA, 17 bp, Homo sapiens
agtagaaaagttgcaga

SEQ ID NO: 6649378 - DNA, 13 bp, Homo sapiens
agtagaaaataca

SEQ ID NO: 6649379 - DNA, 13 bp, Homo sapiens
agtagaaagaaaa

SEQ ID NO: 6649380 - DNA, 15 bp, Homo sapiens
agtagaaagaaaatg

SEQ ID NO: 6649381 - DNA, 21 bp, Homo sapiens
agtagaaagacagagctggga

SEQ ID NO: 6649382 - DNA, 18 bp, Homo sapiens
agtagaaagcttgaaaag

SEQ ID NO: 6649383 - DNA, 14 bp, Homo sapiens
agtagaaaggccag

SEQ ID NO: 6649384 - DNA, 18 bp, Homo sapiens
agtagaaaggcctttaaa

SEQ ID NO: 6649385 - DNA, 15 bp, Homo sapiens
agtagaaataaaagt

SEQ ID NO: 6649386 - DNA, 19 bp, Homo sapiens
agtagaaataaaagtgaat

SEQ ID NO: 6649387 - DNA, 18 bp, Homo sapiens
agtagaaataatatgcat

SEQ ID NO: 6649388 - DNA, 17 bp, Homo sapiens
agtagaaattttacaat

SEQ ID NO: 6649389 - DNA, 20 bp, Homo sapiens
agtagaacaagcaacataaa

SEQ ID NO: 6649390 - DNA, 19 bp, Homo sapiens
agtagaacagataatcagt

SEQ ID NO: 6649391 - DNA, 20 bp, Homo sapiens
agtagaagtcttagatgtat

SEQ ID NO: 6649392 - DNA, 21 bp, Homo sapiens
agtagaagtcttagatgtata

SEQ ID NO: 6649393 - DNA, 13 bp, Homo sapiens
agtagaatctcag

SEQ ID NO: 6649394 - DNA, 15 bp, Homo sapiens
agtagaatctcagca

SEQ ID NO: 6649395 - DNA, 17 bp, Homo sapiens
agtagaatctcttttct

SEQ ID NO: 6649396 - DNA, 14 bp, Homo sapiens
agtagaattaccat

SEQ ID NO: 6649397 - DNA, 18 bp, Homo sapiens
agtagaattaccattaat

SEQ ID NO: 6649398 - DNA, 13 bp, Homo sapiens
agtagaattatat

SEQ ID NO: 6649399 - DNA, 15 bp, Homo sapiens
agtagaattatatct

SEQ ID NO: 6649400 - DNA, 20 bp, Homo sapiens
agtagaattatatctaattt

SEQ ID NO: 6649401 - DNA, 12 bp, Homo sapiens
agtagaatttta

SEQ ID NO: 6649402 - DNA, 16 bp, Homo sapiens
agtagaattttagtcc

SEQ ID NO: 6649403 - DNA, 19 bp, Homo sapiens
agtagacaatcattgtttt

SEQ ID NO: 6649404 - DNA, 18 bp, Homo sapiens
agtagacacatttaagga

SEQ ID NO: 6649405 - DNA, 13 bp, Homo sapiens
agtagacatttgt

SEQ ID NO: 6649406 - DNA, 14 bp, Homo sapiens
agtagacattttaa

SEQ ID NO: 6649407 - DNA, 20 bp, Homo sapiens
agtagacattttaacaagaa

SEQ ID NO: 6649408 - DNA, 19 bp, Homo sapiens
agtagaccaaatcttgtta

SEQ ID NO: 6649409 - DNA, 22 bp, Homo sapiens
agtagacctctttttcttacca

SEQ ID NO: 6649410 - DNA, 23 bp, Homo sapiens
agtagaccttgttacttctgagg

SEQ ID NO: 6649411 - DNA, 18 bp, Homo sapiens
agtagacttggtgtgaag

SEQ ID NO: 6649412 - DNA, 12 bp, Homo sapiens
agtagagaagta

SEQ ID NO: 6649413 - DNA, 11 bp, Homo sapiens
agtagagacag

SEQ ID NO: 6649414 - DNA, 12 bp, Homo sapiens
agtagagacagg

SEQ ID NO: 6649415 - DNA, 14 bp, Homo sapiens
agtagagacagtgt

SEQ ID NO: 6649416 - DNA, 14 bp, Homo sapiens
agtagagagccttt

SEQ ID NO: 6649417 - DNA, 15 bp, Homo sapiens
agtagagagggaaca

SEQ ID NO: 6649418 - DNA, 20 bp, Homo sapiens
agtagagatggggaaagaat

SEQ ID NO: 6649419 - DNA, 12 bp, Homo sapiens
agtagagccagc

SEQ ID NO: 6649420 - DNA, 15 bp, Homo sapiens
agtagagccagcttg

SEQ ID NO: 6649421 - DNA, 17 bp, Homo sapiens
agtagagctagctgcca

SEQ ID NO: 6649422 - DNA, 19 bp, Homo sapiens
agtagagctagctgccact

SEQ ID NO: 6649423 - DNA, 21 bp, Homo sapiens
agtagaggtacacttgtgaat

SEQ ID NO: 6649424 - DNA, 17 bp, Homo sapiens
agtagaggtataattgt

SEQ ID NO: 6649425 - DNA, 16 bp, Homo sapiens
agtagagtcaggagaa

SEQ ID NO: 6649426 - DNA, 17 bp, Homo sapiens
agtagagtcaggagaaa

SEQ ID NO: 6649427 - DNA, 16 bp, Homo sapiens
agtagagtcatctcca

SEQ ID NO: 6649428 - DNA, 17 bp, Homo sapiens
agtagagtcatctccat

SEQ ID NO: 6649429 - DNA, 21 bp, Homo sapiens
agtagagtttgtataggtaac

SEQ ID NO: 6649430 - DNA, 19 bp, Homo sapiens
agtagataatttcagggtg

SEQ ID NO: 6649431 - DNA, 20 bp, Homo sapiens
agtagataatttcagggtgc

SEQ ID NO: 6649432 - DNA, 19 bp, Homo sapiens
agtagataggccatgggca

SEQ ID NO: 6649433 - DNA, 23 bp, Homo sapiens
agtagatgcatttgggtccagga

SEQ ID NO: 6649434 - DNA, 14 bp, Homo sapiens
agtagatgcctgtt

SEQ ID NO: 6649435 - DNA, 15 bp, Homo sapiens
agtagatggtgaaat

SEQ ID NO: 6649436 - DNA, 21 bp, Homo sapiens
agtagatggtgaaatttatta

SEQ ID NO: 6649437 - DNA, 18 bp, Homo sapiens
agtagatgtggcctttga

SEQ ID NO: 6649438 - DNA, 17 bp, Homo sapiens
agtagatgttctacttt

SEQ ID NO: 6649439 - DNA, 19 bp, Homo sapiens
agtagattcatgaaaatgt

SEQ ID NO: 6649440 - DNA, 13 bp, Homo sapiens
agtagattggctg

SEQ ID NO: 6649441 - DNA, 13 bp, Homo sapiens
agtagattttctt

SEQ ID NO: 6649442 - DNA, 16 bp, Homo sapiens
agtagattttctttaa

SEQ ID NO: 6649443 - DNA, 17 bp, Homo sapiens
agtagattttctttaaa

SEQ ID NO: 6649444 - DNA, 16 bp, Homo sapiens
agtagatttttaacaa

SEQ ID NO: 6649445 - DNA, 19 bp, Homo sapiens
agtagcaaaacaaattcaa

SEQ ID NO: 6649446 - DNA, 22 bp, Homo sapiens
agtagcaaaacaaattcaaata

SEQ ID NO: 6649447 - DNA, 16 bp, Homo sapiens
agtagcaaatgtttac

SEQ ID NO: 6649448 - DNA, 17 bp, Homo sapiens
agtagcaaatgtttact

SEQ ID NO: 6649449 - DNA, 18 bp, Homo sapiens
agtagcaaatgtttactg

SEQ ID NO: 6649450 - DNA, 18 bp, Homo sapiens
agtagcaaggaaggacac

SEQ ID NO: 6649451 - DNA, 16 bp, Homo sapiens
agtagcacaggctgag

SEQ ID NO: 6649452 - DNA, 23 bp, Homo sapiens
agtagcacatggtttaaatatga

SEQ ID NO: 6649453 - DNA, 16 bp, Homo sapiens
agtagcaccaaataaa

SEQ ID NO: 6649454 - DNA, 13 bp, Homo sapiens
agtagcaggacct

SEQ ID NO: 6649455 - DNA, 23 bp, Homo sapiens
agtagcagggggggaaatgcatt

SEQ ID NO: 6649456 - DNA, 20 bp, Homo sapiens
agtagcagtagatgcatgta

SEQ ID NO: 6649457 - DNA, 21 bp, Homo sapiens
agtagcagtcatcatcttttt

SEQ ID NO: 6649458 - DNA, 20 bp, Homo sapiens
agtagcatgttgagccaggc

SEQ ID NO: 6649459 - DNA, 14 bp, Homo sapiens
agtagcatttactg

SEQ ID NO: 6649460 - DNA, 14 bp, Homo sapiens
agtagcatttcatt

SEQ ID NO: 6649461 - DNA, 18 bp, Homo sapiens
agtagcattttaatagtt

SEQ ID NO: 6649462 - DNA, 14 bp, Homo sapiens
agtagccaagttat

SEQ ID NO: 6649463 - DNA, 15 bp, Homo sapiens
agtagccaagttata

SEQ ID NO: 6649464 - DNA, 23 bp, Homo sapiens
agtagccagagttgttctcaggg

SEQ ID NO: 6649465 - DNA, 13 bp, Homo sapiens
agtagccagcacg

SEQ ID NO: 6649466 - DNA, 20 bp, Homo sapiens
agtagccatgaggaggcaga

SEQ ID NO: 6649467 - DNA, 19 bp, Homo sapiens
agtagccatttttttgcag

SEQ ID NO: 6649468 - DNA, 17 bp, Homo sapiens
agtagccctttctgtgt

SEQ ID NO: 6649469 - DNA, 19 bp, Homo sapiens
agtagccctttctgtgtgc

SEQ ID NO: 6649470 - DNA, 15 bp, Homo sapiens
agtagccgagagcct

SEQ ID NO: 6649471 - DNA, 19 bp, Homo sapiens
agtagccgagagcctgctc

SEQ ID NO: 6649472 - DNA, 20 bp, Homo sapiens
agtagcctgatctttctaga

SEQ ID NO: 6649473 - DNA, 21 bp, Homo sapiens
agtagcctgatctttctagag

SEQ ID NO: 6649474 - DNA, 18 bp, Homo sapiens
agtagcgttttttaaatg

SEQ ID NO: 6649475 - DNA, 21 bp, Homo sapiens
agtagcgttttttaaatgtat

SEQ ID NO: 6649476 - DNA, 22 bp, Homo sapiens
agtagcgttttttaaatgtata

SEQ ID NO: 6649477 - DNA, 15 bp, Homo sapiens
agtagctagtagcaa

SEQ ID NO: 6649478 - DNA, 14 bp, Homo sapiens
agtagctagtttgc

SEQ ID NO: 6649479 - DNA, 19 bp, Homo sapiens
agtagctagtttgcttttt

SEQ ID NO: 6649480 - DNA, 20 bp, Homo sapiens
agtagctcaaaaatactctt

SEQ ID NO: 6649481 - DNA, 18 bp, Homo sapiens
agtagctccgcgtgtctc

SEQ ID NO: 6649482 - DNA, 14 bp, Homo sapiens
agtagctcttagac

SEQ ID NO: 6649483 - DNA, 16 bp, Homo sapiens
agtagctgaaatgcaa

SEQ ID NO: 6649484 - DNA, 21 bp, Homo sapiens
agtagctgagactacaggtga

SEQ ID NO: 6649485 - DNA, 12 bp, Homo sapiens
agtagctgagat

SEQ ID NO: 6649486 - DNA, 13 bp, Homo sapiens
agtagctgagctc

SEQ ID NO: 6649487 - DNA, 23 bp, Homo sapiens
agtagctgagctcacaaggcagc

SEQ ID NO: 6649488 - DNA, 15 bp, Homo sapiens
agtagctggcgccca

SEQ ID NO: 6649489 - DNA, 21 bp, Homo sapiens
agtagctggctgtactgccaa

SEQ ID NO: 6649490 - DNA, 14 bp, Homo sapiens
agtagctgggacta

SEQ ID NO: 6649491 - DNA, 18 bp, Homo sapiens
agtagctgggactacagg

SEQ ID NO: 6649492 - DNA, 21 bp, Homo sapiens
agtagctgggactacaggcac

SEQ ID NO: 6649493 - DNA, 22 bp, Homo sapiens
agtagctgggactacaggcacc

SEQ ID NO: 6649494 - DNA, 21 bp, Homo sapiens
agtagctgggactacaggtgt

SEQ ID NO: 6649495 - DNA, 13 bp, Homo sapiens
agtagctgggatt

SEQ ID NO: 6649496 - DNA, 18 bp, Homo sapiens
agtagctgggattttaaa

SEQ ID NO: 6649497 - DNA, 23 bp, Homo sapiens
agtagctgggattttaaactaga

SEQ ID NO: 6649498 - DNA, 13 bp, Homo sapiens
agtagctgggcct

SEQ ID NO: 6649499 - DNA, 15 bp, Homo sapiens
agtagctgggcctgt

SEQ ID NO: 6649500 - DNA, 18 bp, Homo sapiens
agtagctgggcctgtgca

SEQ ID NO: 6649501 - DNA, 18 bp, Homo sapiens
agtagctgtggcctcacc

SEQ ID NO: 6649502 - DNA, 22 bp, Homo sapiens
agtagctgtggcctcaccctga

SEQ ID NO: 6649503 - DNA, 18 bp, Homo sapiens
agtagcttaaataaattc

SEQ ID NO: 6649504 - DNA, 21 bp, Homo sapiens
agtagcttaaataaattcaaa

SEQ ID NO: 6649505 - DNA, 22 bp, Homo sapiens
agtagcttaagggaatatgcat

SEQ ID NO: 6649506 - DNA, 12 bp, Homo sapiens
agtagcttgaaa

SEQ ID NO: 6649507 - DNA, 20 bp, Homo sapiens
agtagcttgggacaaatcaa

SEQ ID NO: 6649508 - DNA, 13 bp, Homo sapiens
agtagctttcatt

SEQ ID NO: 6649509 - DNA, 20 bp, Homo sapiens
agtagctttccacatttgtc

SEQ ID NO: 6649510 - DNA, 21 bp, Homo sapiens
agtaggaaattgattttgaaa

SEQ ID NO: 6649511 - DNA, 16 bp, Homo sapiens
agtaggaagactttgg

SEQ ID NO: 6649512 - DNA, 18 bp, Homo sapiens
agtaggaatgtacatgaa

SEQ ID NO: 6649513 - DNA, 23 bp, Homo sapiens
agtaggacaaggtgcaggcaggc

SEQ ID NO: 6649514 - DNA, 15 bp, Homo sapiens
agtaggagcactggg

SEQ ID NO: 6649515 - DNA, 20 bp, Homo sapiens
agtaggatatgcctgctctt

SEQ ID NO: 6649516 - DNA, 17 bp, Homo sapiens
agtaggattaatttatt

SEQ ID NO: 6649517 - DNA, 13 bp, Homo sapiens
agtaggcatgtta

SEQ ID NO: 6649518 - DNA, 13 bp, Homo sapiens
agtaggccctggt

SEQ ID NO: 6649519 - DNA, 14 bp, Homo sapiens
agtaggccctggtt

SEQ ID NO: 6649520 - DNA, 14 bp, Homo sapiens
agtaggcctggggc

SEQ ID NO: 6649521 - DNA, 15 bp, Homo sapiens
agtaggctaaaaaca

SEQ ID NO: 6649522 - DNA, 12 bp, Homo sapiens
agtaggctccag

SEQ ID NO: 6649523 - DNA, 13 bp, Homo sapiens
agtaggctccaga

SEQ ID NO: 6649524 - DNA, 19 bp, Homo sapiens
agtaggctgccgccaccac

SEQ ID NO: 6649525 - DNA, 14 bp, Homo sapiens
agtaggctgtattt

SEQ ID NO: 6649526 - DNA, 13 bp, Homo sapiens
agtagggccaggg

SEQ ID NO: 6649527 - DNA, 18 bp, Homo sapiens
agtaggggaagacatgca

SEQ ID NO: 6649528 - DNA, 13 bp, Homo sapiens
agtagggggtcta

SEQ ID NO: 6649529 - DNA, 18 bp, Homo sapiens
agtagggtagaaggaaag

SEQ ID NO: 6649530 - DNA, 16 bp, Homo sapiens
agtagggttgccagtc

SEQ ID NO: 6649531 - DNA, 14 bp, Homo sapiens
agtagggtttgaca

SEQ ID NO: 6649532 - DNA, 20 bp, Homo sapiens
agtagggtttgacatttcat

SEQ ID NO: 6649533 - DNA, 16 bp, Homo sapiens
agtaggtaccatttgt

SEQ ID NO: 6649534 - DNA, 17 bp, Homo sapiens
agtaggtccaagggcca

SEQ ID NO: 6649535 - DNA, 18 bp, Homo sapiens
agtaggtcccggccagct

SEQ ID NO: 6649536 - DNA, 20 bp, Homo sapiens
agtaggtcctcaataaatat

SEQ ID NO: 6649537 - DNA, 16 bp, Homo sapiens
agtaggtgggtcttgg

SEQ ID NO: 6649538 - DNA, 17 bp, Homo sapiens
agtaggttgaggacagg

SEQ ID NO: 6649539 - DNA, 20 bp, Homo sapiens
agtaggttgaggacaggaga

SEQ ID NO: 6649540 - DNA, 14 bp, Homo sapiens
agtagtaaaaatta

SEQ ID NO: 6649541 - DNA, 18 bp, Homo sapiens
agtagtaaaaattaaaaa

SEQ ID NO: 6649542 - DNA, 20 bp, Homo sapiens
agtagtaaaagaagaaatag

SEQ ID NO: 6649543 - DNA, 13 bp, Homo sapiens
agtagtaaaatta

SEQ ID NO: 6649544 - DNA, 16 bp, Homo sapiens
agtagtaatagagcaa

SEQ ID NO: 6649545 - DNA, 17 bp, Homo sapiens
agtagtaccaaatgctt

SEQ ID NO: 6649546 - DNA, 21 bp, Homo sapiens
agtagtaccaaatgctttaaa

SEQ ID NO: 6649547 - DNA, 22 bp, Homo sapiens
agtagtaccaaatgctttaaaa

SEQ ID NO: 6649548 - DNA, 19 bp, Homo sapiens
agtagtacctttcagaact

SEQ ID NO: 6649549 - DNA, 18 bp, Homo sapiens
agtagtacttcttctgta

SEQ ID NO: 6649550 - DNA, 20 bp, Homo sapiens
agtagtacttcttctgtaat

SEQ ID NO: 6649551 - DNA, 22 bp, Homo sapiens
agtagtacttcttctgtaatat

SEQ ID NO: 6649552 - DNA, 23 bp, Homo sapiens
agtagtacttcttctgtaatatt

SEQ ID NO: 6649553 - DNA, 15 bp, Homo sapiens
agtagtatggcactt

SEQ ID NO: 6649554 - DNA, 12 bp, Homo sapiens
agtagtattttg

SEQ ID NO: 6649555 - DNA, 17 bp, Homo sapiens
agtagtcaattagtaca

SEQ ID NO: 6649556 - DNA, 19 bp, Homo sapiens
agtagtcaattagtacagt

SEQ ID NO: 6649557 - DNA, 16 bp, Homo sapiens
agtagtcatcaatgca

SEQ ID NO: 6649558 - DNA, 12 bp, Homo sapiens
agtagtcatttc

SEQ ID NO: 6649559 - DNA, 21 bp, Homo sapiens
agtagtccctgcacagtgact

SEQ ID NO: 6649560 - DNA, 19 bp, Homo sapiens
agtagtgaagactccagaa

SEQ ID NO: 6649561 - DNA, 11 bp, Homo sapiens
agtagtgacca

SEQ ID NO: 6649562 - DNA, 22 bp, Homo sapiens
agtagtgaggattttgttgata

SEQ ID NO: 6649563 - DNA, 14 bp, Homo sapiens
agtagtgcctgtga

SEQ ID NO: 6649564 - DNA, 19 bp, Homo sapiens
agtagtgcctgtgatcgtg

SEQ ID NO: 6649565 - DNA, 12 bp, Homo sapiens
agtagtggccac

SEQ ID NO: 6649566 - DNA, 14 bp, Homo sapiens
agtagtgtctggat

SEQ ID NO: 6649567 - DNA, 21 bp, Homo sapiens
agtagtgtgagtgttagaaaa

SEQ ID NO: 6649568 - DNA, 14 bp, Homo sapiens
agtagtgtggcctg

SEQ ID NO: 6649569 - DNA, 20 bp, Homo sapiens
agtagtgtggcctgtgccag

SEQ ID NO: 6649570 - DNA, 15 bp, Homo sapiens
agtagtgttctagat

SEQ ID NO: 6649571 - DNA, 22 bp, Homo sapiens
agtagtgttctgttcacttttc

SEQ ID NO: 6649572 - DNA, 19 bp, Homo sapiens
agtagtgttgggtggagga

SEQ ID NO: 6649573 - DNA, 13 bp, Homo sapiens
agtagttaaaaca

SEQ ID NO: 6649574 - DNA, 15 bp, Homo sapiens
agtagttaaataact

SEQ ID NO: 6649575 - DNA, 15 bp, Homo sapiens
agtagttaattctgt

SEQ ID NO: 6649576 - DNA, 13 bp, Homo sapiens
agtagttagccaa

SEQ ID NO: 6649577 - DNA, 13 bp, Homo sapiens
agtagttatataa

SEQ ID NO: 6649578 - DNA, 12 bp, Homo sapiens
agtagttatcat

SEQ ID NO: 6649579 - DNA, 16 bp, Homo sapiens
agtagttatcatgtta

SEQ ID NO: 6649580 - DNA, 14 bp, Homo sapiens
agtagttattagta

SEQ ID NO: 6649581 - DNA, 12 bp, Homo sapiens
agtagttcacat

SEQ ID NO: 6649582 - DNA, 14 bp, Homo sapiens
agtagttccacaca

SEQ ID NO: 6649583 - DNA, 14 bp, Homo sapiens
agtagttcctgcta

SEQ ID NO: 6649584 - DNA, 14 bp, Homo sapiens
agtagttctgtatt

SEQ ID NO: 6649585 - DNA, 15 bp, Homo sapiens
agtagttctgtattt

SEQ ID NO: 6649586 - DNA, 22 bp, Homo sapiens
agtagttgatgaccaatctctg

SEQ ID NO: 6649587 - DNA, 19 bp, Homo sapiens
agtagttgattcagccctc

SEQ ID NO: 6649588 - DNA, 24 bp, Homo sapiens
agtagttggctagtactttgatgc

SEQ ID NO: 6649589 - DNA, 13 bp, Homo sapiens
agtagttggtttg

SEQ ID NO: 6649590 - DNA, 18 bp, Homo sapiens
agtagttggtttgtatga

SEQ ID NO: 6649591 - DNA, 14 bp, Homo sapiens
agtagttgtattct

SEQ ID NO: 6649592 - DNA, 21 bp, Homo sapiens
agtagttgttggtctgtagca

SEQ ID NO: 6649593 - DNA, 12 bp, Homo sapiens
agtagtttctaa

SEQ ID NO: 6649594 - DNA, 15 bp, Homo sapiens
agtagtttgaatgtt

SEQ ID NO: 6649595 - DNA, 16 bp, Homo sapiens
agtagtttgcatttca

SEQ ID NO: 6649596 - DNA, 16 bp, Homo sapiens
agtagttttattttaa

SEQ ID NO: 6649597 - DNA, 15 bp, Homo sapiens
agtagttttcaaaac

SEQ ID NO: 6649598 - DNA, 16 bp, Homo sapiens
agtagttttcaaaaca

SEQ ID NO: 6649599 - DNA, 15 bp, Homo sapiens
agtagttttgaaact

SEQ ID NO: 6649600 - DNA, 13 bp, Homo sapiens
agtataaaaacaa

SEQ ID NO: 6649601 - DNA, 17 bp, Homo sapiens
agtataaacaaagttac

SEQ ID NO: 6649602 - DNA, 19 bp, Homo sapiens
agtataaacaaagttacta

SEQ ID NO: 6649603 - DNA, 22 bp, Homo sapiens
agtataaacatgaccctgggct

SEQ ID NO: 6649604 - DNA, 17 bp, Homo sapiens
agtataaagtcattaac

SEQ ID NO: 6649605 - DNA, 12 bp, Homo sapiens
agtataaattac

SEQ ID NO: 6649606 - DNA, 14 bp, Homo sapiens
agtataaatttgtg

SEQ ID NO: 6649607 - DNA, 17 bp, Homo sapiens
agtataaatttgtgtaa

SEQ ID NO: 6649608 - DNA, 13 bp, Homo sapiens
agtataacaaact

SEQ ID NO: 6649609 - DNA, 17 bp, Homo sapiens
agtataacaattaaaat

SEQ ID NO: 6649610 - DNA, 13 bp, Homo sapiens
agtataacagttt

SEQ ID NO: 6649611 - DNA, 23 bp, Homo sapiens
agtataactaatttgctctgtgg

SEQ ID NO: 6649612 - DNA, 18 bp, Homo sapiens
agtataagaaattttatt

SEQ ID NO: 6649613 - DNA, 19 bp, Homo sapiens
agtataagactactgaatc

SEQ ID NO: 6649614 - DNA, 13 bp, Homo sapiens
agtataagataaa

SEQ ID NO: 6649615 - DNA, 13 bp, Homo sapiens
agtataagctttt

SEQ ID NO: 6649616 - DNA, 14 bp, Homo sapiens
agtataatactaaa

SEQ ID NO: 6649617 - DNA, 16 bp, Homo sapiens
agtataatatgcagtt

SEQ ID NO: 6649618 - DNA, 13 bp, Homo sapiens
agtataatatttc

SEQ ID NO: 6649619 - DNA, 17 bp, Homo sapiens
agtataatcaataagct

SEQ ID NO: 6649620 - DNA, 12 bp, Homo sapiens
agtataatcttt

SEQ ID NO: 6649621 - DNA, 13 bp, Homo sapiens
agtataatgtatg

SEQ ID NO: 6649622 - DNA, 18 bp, Homo sapiens
agtataatgtatgaattt

SEQ ID NO: 6649623 - DNA, 18 bp, Homo sapiens
agtataatgtttattaaa

SEQ ID NO: 6649624 - DNA, 16 bp, Homo sapiens
agtataattaacatgt

SEQ ID NO: 6649625 - DNA, 16 bp, Homo sapiens
agtataatttcaagga

SEQ ID NO: 6649626 - DNA, 23 bp, Homo sapiens
agtatacaacaggagagagatgg

SEQ ID NO: 6649627 - DNA, 14 bp, Homo sapiens
agtatacaagataa

SEQ ID NO: 6649628 - DNA, 17 bp, Homo sapiens
agtatacaagtgtttct

SEQ ID NO: 6649629 - DNA, 16 bp, Homo sapiens
agtatacaatatataa

SEQ ID NO: 6649630 - DNA, 17 bp, Homo sapiens
agtatacaatatataaa

SEQ ID NO: 6649631 - DNA, 21 bp, Homo sapiens
agtatacaatatataaaaata

SEQ ID NO: 6649632 - DNA, 23 bp, Homo sapiens
agtatacaatatataaaaatata

SEQ ID NO: 6649633 - DNA, 15 bp, Homo sapiens
agtatacagacagga

SEQ ID NO: 6649634 - DNA, 17 bp, Homo sapiens
agtatacagacaggaag

SEQ ID NO: 6649635 - DNA, 20 bp, Homo sapiens
agtatacagacaggaagatg

SEQ ID NO: 6649636 - DNA, 18 bp, Homo sapiens
agtatacattgtcttgat

SEQ ID NO: 6649637 - DNA, 15 bp, Homo sapiens
agtatacatttagtt

SEQ ID NO: 6649638 - DNA, 20 bp, Homo sapiens
agtatacattttataatgat

SEQ ID NO: 6649639 - DNA, 18 bp, Homo sapiens
agtataccatacattatc

SEQ ID NO: 6649640 - DNA, 14 bp, Homo sapiens
agtatacccactgc

SEQ ID NO: 6649641 - DNA, 12 bp, Homo sapiens
agtatacctcat

SEQ ID NO: 6649642 - DNA, 14 bp, Homo sapiens
agtatacctcattt

SEQ ID NO: 6649643 - DNA, 16 bp, Homo sapiens
agtatacctcattttt

SEQ ID NO: 6649644 - DNA, 15 bp, Homo sapiens
agtatacctgatttt

SEQ ID NO: 6649645 - DNA, 22 bp, Homo sapiens
agtatacctggctttttaaaat

SEQ ID NO: 6649646 - DNA, 19 bp, Homo sapiens
agtatacgtataaatatca

SEQ ID NO: 6649647 - DNA, 16 bp, Homo sapiens
agtatacgtttttaaa

SEQ ID NO: 6649648 - DNA, 12 bp, Homo sapiens
agtatactgtgt

SEQ ID NO: 6649649 - DNA, 22 bp, Homo sapiens
agtatactgtgtgggatactta

SEQ ID NO: 6649650 - DNA, 16 bp, Homo sapiens
agtatagaaaatcttc

SEQ ID NO: 6649651 - DNA, 12 bp, Homo sapiens
agtatagaatag

SEQ ID NO: 6649652 - DNA, 17 bp, Homo sapiens
agtatagaatgaactgt

SEQ ID NO: 6649653 - DNA, 17 bp, Homo sapiens
agtatagataaatccaa

SEQ ID NO: 6649654 - DNA, 23 bp, Homo sapiens
agtatagataaatccaatagtct

SEQ ID NO: 6649655 - DNA, 17 bp, Homo sapiens
agtatagatggtagaaa

SEQ ID NO: 6649656 - DNA, 20 bp, Homo sapiens
agtatagatggtagaaactt

SEQ ID NO: 6649657 - DNA, 19 bp, Homo sapiens
agtatagccacaaatgcct

SEQ ID NO: 6649658 - DNA, 20 bp, Homo sapiens
agtatagccacaaatgcctt

SEQ ID NO: 6649659 - DNA, 17 bp, Homo sapiens
agtatagcctatggcag

SEQ ID NO: 6649660 - DNA, 22 bp, Homo sapiens
agtataggataaattacattaa

SEQ ID NO: 6649661 - DNA, 14 bp, Homo sapiens
agtatataaatact

SEQ ID NO: 6649662 - DNA, 13 bp, Homo sapiens
agtatataagctg

SEQ ID NO: 6649663 - DNA, 19 bp, Homo sapiens
agtatataataactttatt

SEQ ID NO: 6649664 - DNA, 17 bp, Homo sapiens
agtatatagtatattta

SEQ ID NO: 6649665 - DNA, 14 bp, Homo sapiens
agtatatatgtaca

SEQ ID NO: 6649666 - DNA, 15 bp, Homo sapiens
agtatatatgtacag

SEQ ID NO: 6649667 - DNA, 15 bp, Homo sapiens
agtatatctggacaa

SEQ ID NO: 6649668 - DNA, 23 bp, Homo sapiens
agtatatcttaagataatattta

SEQ ID NO: 6649669 - DNA, 22 bp, Homo sapiens
agtatatgaaatattttgaata

SEQ ID NO: 6649670 - DNA, 21 bp, Homo sapiens
agtatatgattataatgctat

SEQ ID NO: 6649671 - DNA, 20 bp, Homo sapiens
agtatatgtaacagtttaaa

SEQ ID NO: 6649672 - DNA, 13 bp, Homo sapiens
agtatatgtcttg

SEQ ID NO: 6649673 - DNA, 21 bp, Homo sapiens
agtatatgtgcagtcttgctt

SEQ ID NO: 6649674 - DNA, 15 bp, Homo sapiens
agtatatgttccctc

SEQ ID NO: 6649675 - DNA, 17 bp, Homo sapiens
agtatattaaaaatggt

SEQ ID NO: 6649676 - DNA, 14 bp, Homo sapiens
agtatattatgtat

SEQ ID NO: 6649677 - DNA, 15 bp, Homo sapiens
agtatattatgtatt

SEQ ID NO: 6649678 - DNA, 17 bp, Homo sapiens
agtatattatgtattta

SEQ ID NO: 6649679 - DNA, 18 bp, Homo sapiens
agtatattcttattggaa

SEQ ID NO: 6649680 - DNA, 14 bp, Homo sapiens
agtatattcttgta

SEQ ID NO: 6649681 - DNA, 18 bp, Homo sapiens
agtatattcttgtaaata

SEQ ID NO: 6649682 - DNA, 22 bp, Homo sapiens
agtatattgatccagaaagaaa

SEQ ID NO: 6649683 - DNA, 22 bp, Homo sapiens
agtatattgttgaagagacaga

SEQ ID NO: 6649684 - DNA, 11 bp, Homo sapiens
agtatatttat

SEQ ID NO: 6649685 - DNA, 15 bp, Homo sapiens
agtatatttatactc

SEQ ID NO: 6649686 - DNA, 16 bp, Homo sapiens
agtatatttatactct

SEQ ID NO: 6649687 - DNA, 14 bp, Homo sapiens
agtatatttatagt

SEQ ID NO: 6649688 - DNA, 16 bp, Homo sapiens
agtatatttatataat

SEQ ID NO: 6649689 - DNA, 17 bp, Homo sapiens
agtatatttatataatt

SEQ ID NO: 6649690 - DNA, 19 bp, Homo sapiens
agtatatttatataattat

SEQ ID NO: 6649691 - DNA, 16 bp, Homo sapiens
agtatatttatttcta

SEQ ID NO: 6649692 - DNA, 17 bp, Homo sapiens
agtatatttatttctag

SEQ ID NO: 6649693 - DNA, 13 bp, Homo sapiens
agtatatttctga

SEQ ID NO: 6649694 - DNA, 12 bp, Homo sapiens
agtatatttggt

SEQ ID NO: 6649695 - DNA, 14 bp, Homo sapiens
agtatatttgtaaa

SEQ ID NO: 6649696 - DNA, 17 bp, Homo sapiens
agtatatttgtaaaagc

SEQ ID NO: 6649697 - DNA, 20 bp, Homo sapiens
agtatatttgtaaaagctaa

SEQ ID NO: 6649698 - DNA, 19 bp, Homo sapiens
agtatattttatttcaatg

SEQ ID NO: 6649699 - DNA, 17 bp, Homo sapiens
agtatattttctgtatt

SEQ ID NO: 6649700 - DNA, 19 bp, Homo sapiens
agtatattttctgtattta

SEQ ID NO: 6649701 - DNA, 22 bp, Homo sapiens
agtatattttctgtatttaatt

SEQ ID NO: 6649702 - DNA, 14 bp, Homo sapiens
agtatcaaaggcag

SEQ ID NO: 6649703 - DNA, 15 bp, Homo sapiens
agtatcaaggctgcc

SEQ ID NO: 6649704 - DNA, 17 bp, Homo sapiens
agtatcaaggctgcctg

SEQ ID NO: 6649705 - DNA, 18 bp, Homo sapiens
agtatcaaggctgcctgg

SEQ ID NO: 6649706 - DNA, 21 bp, Homo sapiens
agtatcaaggctgcctggaga

SEQ ID NO: 6649707 - DNA, 17 bp, Homo sapiens
agtatcaagtatagaaa

SEQ ID NO: 6649708 - DNA, 19 bp, Homo sapiens
agtatcactctaatataat

SEQ ID NO: 6649709 - DNA, 22 bp, Homo sapiens
agtatcactgtctttcctagat

SEQ ID NO: 6649710 - DNA, 14 bp, Homo sapiens
agtatcacttttct

SEQ ID NO: 6649711 - DNA, 18 bp, Homo sapiens
agtatcagaatacttgca

SEQ ID NO: 6649712 - DNA, 13 bp, Homo sapiens
agtatcagcacta

SEQ ID NO: 6649713 - DNA, 17 bp, Homo sapiens
agtatcaggaatataaa

SEQ ID NO: 6649714 - DNA, 15 bp, Homo sapiens
agtatcaggtctccc

SEQ ID NO: 6649715 - DNA, 17 bp, Homo sapiens
agtatcagtgttttaaa

SEQ ID NO: 6649716 - DNA, 21 bp, Homo sapiens
agtatcagtgttttaaattct

SEQ ID NO: 6649717 - DNA, 22 bp, Homo sapiens
agtatcagttgcaggtgccaat

SEQ ID NO: 6649718 - DNA, 20 bp, Homo sapiens
agtatcataatatattgtgt

SEQ ID NO: 6649719 - DNA, 22 bp, Homo sapiens
agtatcatacgttgatagttta

SEQ ID NO: 6649720 - DNA, 20 bp, Homo sapiens
agtatcatcagatagcatct

SEQ ID NO: 6649721 - DNA, 20 bp, Homo sapiens
agtatcatctaaatattatg

SEQ ID NO: 6649722 - DNA, 21 bp, Homo sapiens
agtatcatctaaatattatgc

SEQ ID NO: 6649723 - DNA, 14 bp, Homo sapiens
agtatcatgcattc

SEQ ID NO: 6649724 - DNA, 15 bp, Homo sapiens
agtatcatgccctgt

SEQ ID NO: 6649725 - DNA, 21 bp, Homo sapiens
agtatcatgtactacacttct

SEQ ID NO: 6649726 - DNA, 17 bp, Homo sapiens
agtatccaattatgtga

SEQ ID NO: 6649727 - DNA, 18 bp, Homo sapiens
agtatccaattatgtgac

SEQ ID NO: 6649728 - DNA, 21 bp, Homo sapiens
agtatccatgctcttgacctt

SEQ ID NO: 6649729 - DNA, 17 bp, Homo sapiens
agtatcctccaggtttt

SEQ ID NO: 6649730 - DNA, 19 bp, Homo sapiens
agtatcctccaggtttttc

SEQ ID NO: 6649731 - DNA, 21 bp, Homo sapiens
agtatcctccaggtttttcaa

SEQ ID NO: 6649732 - DNA, 17 bp, Homo sapiens
agtatcctgaaacagtg

SEQ ID NO: 6649733 - DNA, 16 bp, Homo sapiens
agtatcctggattcct

SEQ ID NO: 6649734 - DNA, 15 bp, Homo sapiens
agtatccttcattgt

SEQ ID NO: 6649735 - DNA, 14 bp, Homo sapiens
agtatccttccttc

SEQ ID NO: 6649736 - DNA, 19 bp, Homo sapiens
agtatcggcactgtacaaa

SEQ ID NO: 6649737 - DNA, 18 bp, Homo sapiens
agtatcgggggctggggc

SEQ ID NO: 6649738 - DNA, 18 bp, Homo sapiens
agtatctagtcagtatct

SEQ ID NO: 6649739 - DNA, 17 bp, Homo sapiens
agtatctatatatgtgt

SEQ ID NO: 6649740 - DNA, 19 bp, Homo sapiens
agtatctcaacaacatgtc

SEQ ID NO: 6649741 - DNA, 20 bp, Homo sapiens
agtatctcaacaacatgtca

SEQ ID NO: 6649742 - DNA, 22 bp, Homo sapiens
agtatctccatccttaactgtc

SEQ ID NO: 6649743 - DNA, 20 bp, Homo sapiens
agtatctcgtaatagcttct

SEQ ID NO: 6649744 - DNA, 22 bp, Homo sapiens
agtatctcgtaatagcttctgt

SEQ ID NO: 6649745 - DNA, 17 bp, Homo sapiens
agtatctctactttcct

SEQ ID NO: 6649746 - DNA, 14 bp, Homo sapiens
agtatctctggcct

SEQ ID NO: 6649747 - DNA, 23 bp, Homo sapiens
agtatctcttgctgggaacacag

SEQ ID NO: 6649748 - DNA, 21 bp, Homo sapiens
agtatctgaagggaattgttt

SEQ ID NO: 6649749 - DNA, 12 bp, Homo sapiens
agtatctgctgt

SEQ ID NO: 6649750 - DNA, 14 bp, Homo sapiens
agtatctggctggg

SEQ ID NO: 6649751 - DNA, 15 bp, Homo sapiens
agtatctgtaaccct

SEQ ID NO: 6649752 - DNA, 13 bp, Homo sapiens
agtatctgtacct

SEQ ID NO: 6649753 - DNA, 17 bp, Homo sapiens
agtatctgtacctgccc

SEQ ID NO: 6649754 - DNA, 17 bp, Homo sapiens
agtatctgttgcttgtc

SEQ ID NO: 6649755 - DNA, 19 bp, Homo sapiens
agtatcttacctgtaaagt

SEQ ID NO: 6649756 - DNA, 21 bp, Homo sapiens
agtatcttacctgtaaagtct

SEQ ID NO: 6649757 - DNA, 18 bp, Homo sapiens
agtatcttagagtttaca

SEQ ID NO: 6649758 - DNA, 22 bp, Homo sapiens
agtatcttagagtttacagttt

SEQ ID NO: 6649759 - DNA, 18 bp, Homo sapiens
agtatcttcaaaaataca

SEQ ID NO: 6649760 - DNA, 19 bp, Homo sapiens
agtatcttcaaaaatacag

SEQ ID NO: 6649761 - DNA, 24 bp, Homo sapiens
agtatcttcaaactttcactttga

SEQ ID NO: 6649762 - DNA, 13 bp, Homo sapiens
agtatcttgaaat

SEQ ID NO: 6649763 - DNA, 19 bp, Homo sapiens
agtatcttgcactgataaa

SEQ ID NO: 6649764 - DNA, 13 bp, Homo sapiens
agtatcttgtgct

SEQ ID NO: 6649765 - DNA, 18 bp, Homo sapiens
agtatctttaaatataat

SEQ ID NO: 6649766 - DNA, 24 bp, Homo sapiens
agtatctttaacaattgtcttaaa

SEQ ID NO: 6649767 - DNA, 17 bp, Homo sapiens
agtatctttgcactcca

SEQ ID NO: 6649768 - DNA, 15 bp, Homo sapiens
agtatcttttaaaat

SEQ ID NO: 6649769 - DNA, 12 bp, Homo sapiens
agtatcttttga

SEQ ID NO: 6649770 - DNA, 17 bp, Homo sapiens
agtatcttttttcaaaa

SEQ ID NO: 6649771 - DNA, 14 bp, Homo sapiens
agtatgaaaagcta

SEQ ID NO: 6649772 - DNA, 14 bp, Homo sapiens
agtatgaaattata

SEQ ID NO: 6649773 - DNA, 17 bp, Homo sapiens
agtatgaatatttcatt

SEQ ID NO: 6649774 - DNA, 13 bp, Homo sapiens
agtatgaatgatg

SEQ ID NO: 6649775 - DNA, 15 bp, Homo sapiens
agtatgaatgatgtt

SEQ ID NO: 6649776 - DNA, 17 bp, Homo sapiens
agtatgaattattcaat

SEQ ID NO: 6649777 - DNA, 14 bp, Homo sapiens
agtatgacagagga

SEQ ID NO: 6649778 - DNA, 18 bp, Homo sapiens
agtatgacgctgatacat

SEQ ID NO: 6649779 - DNA, 23 bp, Homo sapiens
agtatgagaaaaatattcaagta

SEQ ID NO: 6649780 - DNA, 18 bp, Homo sapiens
agtatgagaaatacagtg

SEQ ID NO: 6649781 - DNA, 21 bp, Homo sapiens
agtatgagaaatacagtgctt

SEQ ID NO: 6649782 - DNA, 17 bp, Homo sapiens
agtatgaggcatttgtt

SEQ ID NO: 6649783 - DNA, 17 bp, Homo sapiens
agtatgagtgctgattc

SEQ ID NO: 6649784 - DNA, 18 bp, Homo sapiens
agtatgatttacctcata

SEQ ID NO: 6649785 - DNA, 18 bp, Homo sapiens
agtatgcaaaataaagaa

SEQ ID NO: 6649786 - DNA, 22 bp, Homo sapiens
agtatgcaaagcaatcttttat

SEQ ID NO: 6649787 - DNA, 17 bp, Homo sapiens
agtatgcaagaagaata

SEQ ID NO: 6649788 - DNA, 23 bp, Homo sapiens
agtatgcaagaagaatataaata

SEQ ID NO: 6649789 - DNA, 23 bp, Homo sapiens
agtatgcactaatcaatactttg

SEQ ID NO: 6649790 - DNA, 20 bp, Homo sapiens
agtatgcagattatttgccc

SEQ ID NO: 6649791 - DNA, 19 bp, Homo sapiens
agtatgcagttgataagag

SEQ ID NO: 6649792 - DNA, 16 bp, Homo sapiens
agtatgcattattaaa

SEQ ID NO: 6649793 - DNA, 17 bp, Homo sapiens
agtatgccactgcactc

SEQ ID NO: 6649794 - DNA, 18 bp, Homo sapiens
agtatgccttaagcagaa

SEQ ID NO: 6649795 - DNA, 16 bp, Homo sapiens
agtatgctatgctatg

SEQ ID NO: 6649796 - DNA, 20 bp, Homo sapiens
agtatgcttgggccctgcat

SEQ ID NO: 6649797 - DNA, 23 bp, Homo sapiens
agtatgctttccctgaggaatga

SEQ ID NO: 6649798 - DNA, 18 bp, Homo sapiens
agtatggaagggaggggt

SEQ ID NO: 6649799 - DNA, 15 bp, Homo sapiens
agtatggaatattca

SEQ ID NO: 6649800 - DNA, 15 bp, Homo sapiens
agtatggatgggtgg

SEQ ID NO: 6649801 - DNA, 20 bp, Homo sapiens
agtatggcctgacagctctg

SEQ ID NO: 6649802 - DNA, 13 bp, Homo sapiens
agtatggtacatt

SEQ ID NO: 6649803 - DNA, 16 bp, Homo sapiens
agtatggtacattttt

SEQ ID NO: 6649804 - DNA, 22 bp, Homo sapiens
agtatggtacatttttcaactt

SEQ ID NO: 6649805 - DNA, 19 bp, Homo sapiens
agtatggtaggggagggca

SEQ ID NO: 6649806 - DNA, 19 bp, Homo sapiens
agtatggtgctaatgtgtc

SEQ ID NO: 6649807 - DNA, 16 bp, Homo sapiens
agtatggtggctgggt

SEQ ID NO: 6649808 - DNA, 15 bp, Homo sapiens
agtatggtgtgttca

SEQ ID NO: 6649809 - DNA, 22 bp, Homo sapiens
agtatggttcaagattgttgat

SEQ ID NO: 6649810 - DNA, 23 bp, Homo sapiens
agtatgtatattaaaaaagagac

SEQ ID NO: 6649811 - DNA, 23 bp, Homo sapiens
agtatgtattacttttgtaatca

SEQ ID NO: 6649812 - DNA, 17 bp, Homo sapiens
agtatgtcaacagccat

SEQ ID NO: 6649813 - DNA, 21 bp, Homo sapiens
agtatgtcagtccaataaatt

SEQ ID NO: 6649814 - DNA, 19 bp, Homo sapiens
agtatgtccccataagaca

SEQ ID NO: 6649815 - DNA, 20 bp, Homo sapiens
agtatgtccccataagacaa

SEQ ID NO: 6649816 - DNA, 14 bp, Homo sapiens
agtatgtccttcag

SEQ ID NO: 6649817 - DNA, 18 bp, Homo sapiens
agtatgtccttcagctga

SEQ ID NO: 6649818 - DNA, 22 bp, Homo sapiens
agtatgtctgtttttgtatctt

SEQ ID NO: 6649819 - DNA, 13 bp, Homo sapiens
agtatgtgaagat

SEQ ID NO: 6649820 - DNA, 14 bp, Homo sapiens
agtatgtgatatct

SEQ ID NO: 6649821 - DNA, 17 bp, Homo sapiens
agtatgtgatatctgaa

SEQ ID NO: 6649822 - DNA, 15 bp, Homo sapiens
agtatgtgatggact

SEQ ID NO: 6649823 - DNA, 16 bp, Homo sapiens
agtatgtgcatttaat

SEQ ID NO: 6649824 - DNA, 23 bp, Homo sapiens
agtatgtgggcagattttcagca

SEQ ID NO: 6649825 - DNA, 22 bp, Homo sapiens
agtatgtggtactactgtaaga

SEQ ID NO: 6649826 - DNA, 17 bp, Homo sapiens
agtatgtgtaacaggat

SEQ ID NO: 6649827 - DNA, 22 bp, Homo sapiens
agtatgtgtctagcaaagccac

SEQ ID NO: 6649828 - DNA, 19 bp, Homo sapiens
agtatgtgtttgtgtgtgt

SEQ ID NO: 6649829 - DNA, 14 bp, Homo sapiens
agtatgttattcct

SEQ ID NO: 6649830 - DNA, 20 bp, Homo sapiens
agtatgttattcctggttaa

SEQ ID NO: 6649831 - DNA, 23 bp, Homo sapiens
agtatgttccaaaccctcctggg

SEQ ID NO: 6649832 - DNA, 18 bp, Homo sapiens
agtatgttctaaccttta

SEQ ID NO: 6649833 - DNA, 22 bp, Homo sapiens
agtatgttctaacctttacatg

SEQ ID NO: 6649834 - DNA, 14 bp, Homo sapiens
agtatgttgtatat

SEQ ID NO: 6649835 - DNA, 12 bp, Homo sapiens
agtatgttgtca

SEQ ID NO: 6649836 - DNA, 14 bp, Homo sapiens
agtatgttgtcaaa

SEQ ID NO: 6649837 - DNA, 13 bp, Homo sapiens
agtatgttgtcat

SEQ ID NO: 6649838 - DNA, 14 bp, Homo sapiens
agtatgttgtcata

SEQ ID NO: 6649839 - DNA, 19 bp, Homo sapiens
agtatgttgtcataacatt

SEQ ID NO: 6649840 - DNA, 14 bp, Homo sapiens
agtatgttttacac

SEQ ID NO: 6649841 - DNA, 23 bp, Homo sapiens
agtattaaaatgcatatttctat

SEQ ID NO: 6649842 - DNA, 19 bp, Homo sapiens
agtattaaaatgtatgcat

SEQ ID NO: 6649843 - DNA, 17 bp, Homo sapiens
agtattaaactctcctt

SEQ ID NO: 6649844 - DNA, 14 bp, Homo sapiens
agtattaaatattt

SEQ ID NO: 6649845 - DNA, 23 bp, Homo sapiens
agtattaacagaaatgtttctgt

SEQ ID NO: 6649846 - DNA, 15 bp, Homo sapiens
agtattaactattag

SEQ ID NO: 6649847 - DNA, 16 bp, Homo sapiens
agtattaagcagttca

SEQ ID NO: 6649848 - DNA, 22 bp, Homo sapiens
agtattaagggtaggatgttgc

SEQ ID NO: 6649849 - DNA, 19 bp, Homo sapiens
agtattaagtgaaatttta

SEQ ID NO: 6649850 - DNA, 22 bp, Homo sapiens
agtattaagtgaaattttaaat

SEQ ID NO: 6649851 - DNA, 16 bp, Homo sapiens
agtattaattctcttt

SEQ ID NO: 6649852 - DNA, 17 bp, Homo sapiens
agtattacatgatttaa

SEQ ID NO: 6649853 - DNA, 21 bp, Homo sapiens
agtattaccaccctttcacaa

SEQ ID NO: 6649854 - DNA, 19 bp, Homo sapiens
agtattactgctgctgtgc

SEQ ID NO: 6649855 - DNA, 15 bp, Homo sapiens
agtattacttctgct

SEQ ID NO: 6649856 - DNA, 17 bp, Homo sapiens
agtattactttctgccg

SEQ ID NO: 6649857 - DNA, 15 bp, Homo sapiens
agtattagacttcta

SEQ ID NO: 6649858 - DNA, 21 bp, Homo sapiens
agtattagcaatgaattagtt

SEQ ID NO: 6649859 - DNA, 15 bp, Homo sapiens
agtattagttttctg

SEQ ID NO: 6649860 - DNA, 21 bp, Homo sapiens
agtattataaattgtgtattt

SEQ ID NO: 6649861 - DNA, 15 bp, Homo sapiens
agtattatacctttt

SEQ ID NO: 6649862 - DNA, 14 bp, Homo sapiens
agtattatagatat

SEQ ID NO: 6649863 - DNA, 17 bp, Homo sapiens
agtattatattaatata

SEQ ID NO: 6649864 - DNA, 19 bp, Homo sapiens
agtattatattttatttat

SEQ ID NO: 6649865 - DNA, 23 bp, Homo sapiens
agtattatccacaattattggca

SEQ ID NO: 6649866 - DNA, 15 bp, Homo sapiens
agtattatctgtgtt

SEQ ID NO: 6649867 - DNA, 23 bp, Homo sapiens
agtattatctgtgttaaaatggt

SEQ ID NO: 6649868 - DNA, 21 bp, Homo sapiens
agtattatgcctgagttataa

SEQ ID NO: 6649869 - DNA, 14 bp, Homo sapiens
agtattattgaaga

SEQ ID NO: 6649870 - DNA, 13 bp, Homo sapiens
agtattattttcc

SEQ ID NO: 6649871 - DNA, 20 bp, Homo sapiens
agtattcaataccgctcagt

SEQ ID NO: 6649872 - DNA, 14 bp, Homo sapiens
agtattcagaaatt

SEQ ID NO: 6649873 - DNA, 15 bp, Homo sapiens
agtattcagaaatta

SEQ ID NO: 6649874 - DNA, 17 bp, Homo sapiens
agtattcaggcactgag

SEQ ID NO: 6649875 - DNA, 18 bp, Homo sapiens
agtattcaggcactgaga

SEQ ID NO: 6649876 - DNA, 14 bp, Homo sapiens
agtattcattctgc

SEQ ID NO: 6649877 - DNA, 17 bp, Homo sapiens
agtattcattttgcaac

SEQ ID NO: 6649878 - DNA, 22 bp, Homo sapiens
agtattccattgtgtgagtgta

SEQ ID NO: 6649879 - DNA, 17 bp, Homo sapiens
agtattcctgttgctgt

SEQ ID NO: 6649880 - DNA, 14 bp, Homo sapiens
agtattccttggcc

SEQ ID NO: 6649881 - DNA, 21 bp, Homo sapiens
agtattccttggcccagcagc

SEQ ID NO: 6649882 - DNA, 22 bp, Homo sapiens
agtattcctttatacacagtgg

SEQ ID NO: 6649883 - DNA, 14 bp, Homo sapiens
agtattcgttacat

SEQ ID NO: 6649884 - DNA, 20 bp, Homo sapiens
agtattctaaagttttgcaa

SEQ ID NO: 6649885 - DNA, 21 bp, Homo sapiens
agtattctaataagctagttg

SEQ ID NO: 6649886 - DNA, 13 bp, Homo sapiens
agtattctcagag

SEQ ID NO: 6649887 - DNA, 16 bp, Homo sapiens
agtattctcagtgctc

SEQ ID NO: 6649888 - DNA, 11 bp, Homo sapiens
agtattctcat

SEQ ID NO: 6649889 - DNA, 15 bp, Homo sapiens
agtattctccatcct

SEQ ID NO: 6649890 - DNA, 16 bp, Homo sapiens
agtattctcttttcaa

SEQ ID NO: 6649891 - DNA, 21 bp, Homo sapiens
agtattctgacatgtaagaaa

SEQ ID NO: 6649892 - DNA, 15 bp, Homo sapiens
agtattcttttcaat

SEQ ID NO: 6649893 - DNA, 22 bp, Homo sapiens
agtattgaaaaattatcagtta

SEQ ID NO: 6649894 - DNA, 18 bp, Homo sapiens
agtattgaaaacttcaaa

SEQ ID NO: 6649895 - DNA, 12 bp, Homo sapiens
agtattgacaaa

SEQ ID NO: 6649896 - DNA, 16 bp, Homo sapiens
agtattgacaaaatgt

SEQ ID NO: 6649897 - DNA, 18 bp, Homo sapiens
agtattgacaaaatgtta

SEQ ID NO: 6649898 - DNA, 19 bp, Homo sapiens
agtattgacaaaatgttat

SEQ ID NO: 6649899 - DNA, 13 bp, Homo sapiens
agtattgacaata

SEQ ID NO: 6649900 - DNA, 22 bp, Homo sapiens
agtattgacgacctacatctga

SEQ ID NO: 6649901 - DNA, 17 bp, Homo sapiens
agtattgagacactgtc

SEQ ID NO: 6649902 - DNA, 19 bp, Homo sapiens
agtattgagacactgtcaa

SEQ ID NO: 6649903 - DNA, 18 bp, Homo sapiens
agtattgagtgttctagt

SEQ ID NO: 6649904 - DNA, 11 bp, Homo sapiens
agtattgattc

SEQ ID NO: 6649905 - DNA, 22 bp, Homo sapiens
agtattgcatctgtataagtaa

SEQ ID NO: 6649906 - DNA, 14 bp, Homo sapiens
agtattgccaaaca

SEQ ID NO: 6649907 - DNA, 16 bp, Homo sapiens
agtattgccaaacatt

SEQ ID NO: 6649908 - DNA, 22 bp, Homo sapiens
agtattgccaaacattaatgtt

SEQ ID NO: 6649909 - DNA, 22 bp, Homo sapiens
agtattgccacaatgcctctcc

SEQ ID NO: 6649910 - DNA, 12 bp, Homo sapiens
agtattgctaat

SEQ ID NO: 6649911 - DNA, 22 bp, Homo sapiens
agtattgctcacccagtgccct

SEQ ID NO: 6649912 - DNA, 12 bp, Homo sapiens
agtattgctgat

SEQ ID NO: 6649913 - DNA, 22 bp, Homo sapiens
agtattggaaaataaaaatgct

SEQ ID NO: 6649914 - DNA, 16 bp, Homo sapiens
agtattgtaaattata

SEQ ID NO: 6649915 - DNA, 22 bp, Homo sapiens
agtattgtaaattatatttgtg

SEQ ID NO: 6649916 - DNA, 11 bp, Homo sapiens
agtattgtaca

SEQ ID NO: 6649917 - DNA, 20 bp, Homo sapiens
agtattgtacaaagtattaa

SEQ ID NO: 6649918 - DNA, 15 bp, Homo sapiens
agtattgtagaaagc

SEQ ID NO: 6649919 - DNA, 14 bp, Homo sapiens
agtattgtgaaagt

SEQ ID NO: 6649920 - DNA, 19 bp, Homo sapiens
agtattgtgtttatgcatt

SEQ ID NO: 6649921 - DNA, 20 bp, Homo sapiens
agtattgtgtttatgcattt

SEQ ID NO: 6649922 - DNA, 15 bp, Homo sapiens
agtattgttaatgaa

SEQ ID NO: 6649923 - DNA, 23 bp, Homo sapiens
agtattgttcttgtaaaactgtg

SEQ ID NO: 6649924 - DNA, 15 bp, Homo sapiens
agtattgttgtcctt

SEQ ID NO: 6649925 - DNA, 19 bp, Homo sapiens
agtattgttgtccttttca

SEQ ID NO: 6649926 - DNA, 22 bp, Homo sapiens
agtattgttgtccttttcatag

SEQ ID NO: 6649927 - DNA, 24 bp, Homo sapiens
agtattgttgtccttttcataggt

SEQ ID NO: 6649928 - DNA, 19 bp, Homo sapiens
agtattgtttaaaatgtaa

SEQ ID NO: 6649929 - DNA, 12 bp, Homo sapiens
agtatttaacat

SEQ ID NO: 6649930 - DNA, 15 bp, Homo sapiens
agtatttaattagtg

SEQ ID NO: 6649931 - DNA, 15 bp, Homo sapiens
agtatttacactatg

SEQ ID NO: 6649932 - DNA, 12 bp, Homo sapiens
agtatttactct

SEQ ID NO: 6649933 - DNA, 21 bp, Homo sapiens
agtatttactttttaaaaata

SEQ ID NO: 6649934 - DNA, 22 bp, Homo sapiens
agtatttactttttaaaaataa

SEQ ID NO: 6649935 - DNA, 23 bp, Homo sapiens
agtatttactttttaaaaataac

SEQ ID NO: 6649936 - DNA, 15 bp, Homo sapiens
agtatttagaagcca

SEQ ID NO: 6649937 - DNA, 16 bp, Homo sapiens
agtatttataaaaata

SEQ ID NO: 6649938 - DNA, 20 bp, Homo sapiens
agtatttataaaaatataaa

SEQ ID NO: 6649939 - DNA, 16 bp, Homo sapiens
agtatttataatagca

SEQ ID NO: 6649940 - DNA, 17 bp, Homo sapiens
agtatttataatataaa

SEQ ID NO: 6649941 - DNA, 20 bp, Homo sapiens
agtatttataatataaatca

SEQ ID NO: 6649942 - DNA, 16 bp, Homo sapiens
agtatttatatattta

SEQ ID NO: 6649943 - DNA, 20 bp, Homo sapiens
agtatttatctcctgtctac

SEQ ID NO: 6649944 - DNA, 15 bp, Homo sapiens
agtatttatgtaatt

SEQ ID NO: 6649945 - DNA, 16 bp, Homo sapiens
agtatttattggtggg

SEQ ID NO: 6649946 - DNA, 20 bp, Homo sapiens
agtatttattggtgggttga

SEQ ID NO: 6649947 - DNA, 14 bp, Homo sapiens
agtatttattgtca

SEQ ID NO: 6649948 - DNA, 21 bp, Homo sapiens
agtatttattgtcagttttgt

SEQ ID NO: 6649949 - DNA, 15 bp, Homo sapiens
agtatttatttaatg

SEQ ID NO: 6649950 - DNA, 20 bp, Homo sapiens
agtatttatttaatgttatg

SEQ ID NO: 6649951 - DNA, 18 bp, Homo sapiens
agtatttattttgtaatt

SEQ ID NO: 6649952 - DNA, 19 bp, Homo sapiens
agtatttattttttcaaaa

SEQ ID NO: 6649953 - DNA, 14 bp, Homo sapiens
agtatttcaactgc

SEQ ID NO: 6649954 - DNA, 20 bp, Homo sapiens
agtatttcagtgtagttaat

SEQ ID NO: 6649955 - DNA, 23 bp, Homo sapiens
agtatttcagtgtagttaattta

SEQ ID NO: 6649956 - DNA, 16 bp, Homo sapiens
agtatttcatgctggg

SEQ ID NO: 6649957 - DNA, 12 bp, Homo sapiens
agtatttcatgt

SEQ ID NO: 6649958 - DNA, 13 bp, Homo sapiens
agtatttcattgc

SEQ ID NO: 6649959 - DNA, 14 bp, Homo sapiens
agtatttcatttct

SEQ ID NO: 6649960 - DNA, 15 bp, Homo sapiens
agtatttcatttctt

SEQ ID NO: 6649961 - DNA, 12 bp, Homo sapiens
agtatttccctt

SEQ ID NO: 6649962 - DNA, 23 bp, Homo sapiens
agtatttccttccactgtagcta

SEQ ID NO: 6649963 - DNA, 19 bp, Homo sapiens
agtatttctaaagtaattg

SEQ ID NO: 6649964 - DNA, 16 bp, Homo sapiens
agtatttctatgaaat

SEQ ID NO: 6649965 - DNA, 23 bp, Homo sapiens
agtatttctcttttattctgtta

SEQ ID NO: 6649966 - DNA, 11 bp, Homo sapiens
agtatttctga

SEQ ID NO: 6649967 - DNA, 12 bp, Homo sapiens
agtatttgaaaa

SEQ ID NO: 6649968 - DNA, 17 bp, Homo sapiens
agtatttgaacacagtt

SEQ ID NO: 6649969 - DNA, 13 bp, Homo sapiens
agtatttgaatta

SEQ ID NO: 6649970 - DNA, 16 bp, Homo sapiens
agtatttgaattaaaa

SEQ ID NO: 6649971 - DNA, 13 bp, Homo sapiens
agtatttgattca

SEQ ID NO: 6649972 - DNA, 23 bp, Homo sapiens
agtatttgattcaaaatatttaa

SEQ ID NO: 6649973 - DNA, 16 bp, Homo sapiens
agtatttggaattaga

SEQ ID NO: 6649974 - DNA, 18 bp, Homo sapiens
agtatttggtccaaaaaa

SEQ ID NO: 6649975 - DNA, 22 bp, Homo sapiens
agtatttggtccaaaaaaagga

SEQ ID NO: 6649976 - DNA, 14 bp, Homo sapiens
agtatttgttaatt

SEQ ID NO: 6649977 - DNA, 13 bp, Homo sapiens
agtattttaaaaa

SEQ ID NO: 6649978 - DNA, 12 bp, Homo sapiens
agtattttaatc

SEQ ID NO: 6649979 - DNA, 16 bp, Homo sapiens
agtattttatctggaa

SEQ ID NO: 6649980 - DNA, 16 bp, Homo sapiens
agtattttatctgtgt

SEQ ID NO: 6649981 - DNA, 13 bp, Homo sapiens
agtattttcacac

SEQ ID NO: 6649982 - DNA, 18 bp, Homo sapiens
agtattttccagccttat

SEQ ID NO: 6649983 - DNA, 21 bp, Homo sapiens
agtattttccagccttatgtg

SEQ ID NO: 6649984 - DNA, 14 bp, Homo sapiens
agtattttcttccc

SEQ ID NO: 6649985 - DNA, 14 bp, Homo sapiens
agtattttgaagtt

SEQ ID NO: 6649986 - DNA, 15 bp, Homo sapiens
agtattttgaagttt

SEQ ID NO: 6649987 - DNA, 20 bp, Homo sapiens
agtattttgaagtttacatt

SEQ ID NO: 6649988 - DNA, 21 bp, Homo sapiens
agtattttgaagtttacattt

SEQ ID NO: 6649989 - DNA, 23 bp, Homo sapiens
agtattttgaagtttacattttt

SEQ ID NO: 6649990 - DNA, 13 bp, Homo sapiens
agtattttgagcc

SEQ ID NO: 6649991 - DNA, 22 bp, Homo sapiens
agtattttgatctcgctaggta

SEQ ID NO: 6649992 - DNA, 23 bp, Homo sapiens
agtattttgtctaggagatgctt

SEQ ID NO: 6649993 - DNA, 15 bp, Homo sapiens
agtattttgtgtcct

SEQ ID NO: 6649994 - DNA, 22 bp, Homo sapiens
agtatttttataaatataagcc

SEQ ID NO: 6649995 - DNA, 16 bp, Homo sapiens
agtatttttataattt

SEQ ID NO: 6649996 - DNA, 19 bp, Homo sapiens
agtatttttataattttat

SEQ ID NO: 6649997 - DNA, 13 bp, Homo sapiens
agtatttttatac

SEQ ID NO: 6649998 - DNA, 14 bp, Homo sapiens
agtatttttatacg

SEQ ID NO: 6649999 - DNA, 17 bp, Homo sapiens
agtatttttcagatata

SEQ ID NO: 6650000 - DNA, 13 bp, Homo sapiens
agtatttttgaaa

SEQ ID NO: 6650001 - DNA, 17 bp, Homo sapiens
agtatttttgaaagaat

SEQ ID NO: 6650002 - DNA, 17 bp, Homo sapiens
agtatttttgacagaat

SEQ ID NO: 6650003 - DNA, 19 bp, Homo sapiens
agtatttttgattaacaat

SEQ ID NO: 6650004 - DNA, 12 bp, Homo sapiens
agtatttttgcc

SEQ ID NO: 6650005 - DNA, 14 bp, Homo sapiens
agtatttttgctgc

SEQ ID NO: 6650006 - DNA, 20 bp, Homo sapiens
agtattttttacattttaca

SEQ ID NO: 6650007 - DNA, 17 bp, Homo sapiens
agtattttttatttaat

SEQ ID NO: 6650008 - DNA, 23 bp, Homo sapiens
agtattttttatttaattatatt

SEQ ID NO: 6650009 - DNA, 20 bp, Homo sapiens
agtattttttgtataattgg

SEQ ID NO: 6650010 - DNA, 22 bp, Homo sapiens
agtattttttttactgtgcata

SEQ ID NO: 6650011 - DNA, 13 bp, Homo sapiens
agtcaaaaacaaa

SEQ ID NO: 6650012 - DNA, 14 bp, Homo sapiens
agtcaaaaagaacc

SEQ ID NO: 6650013 - DNA, 12 bp, Homo sapiens
agtcaaaaggaa

SEQ ID NO: 6650014 - DNA, 14 bp, Homo sapiens
agtcaaaaggaaca

SEQ ID NO: 6650015 - DNA, 23 bp, Homo sapiens
agtcaaaaggaacaaaaattaca

SEQ ID NO: 6650016 - DNA, 21 bp, Homo sapiens
agtcaaaaggtgcctgtgagg

SEQ ID NO: 6650017 - DNA, 16 bp, Homo sapiens
agtcaaaataatctga

SEQ ID NO: 6650018 - DNA, 20 bp, Homo sapiens
agtcaaacaaaaaagaaaag

SEQ ID NO: 6650019 - DNA, 18 bp, Homo sapiens
agtcaaacatttcaaagt

SEQ ID NO: 6650020 - DNA, 21 bp, Homo sapiens
agtcaaagacgctgagtggga

SEQ ID NO: 6650021 - DNA, 20 bp, Homo sapiens
agtcaaaggcatctcccttc

SEQ ID NO: 6650022 - DNA, 12 bp, Homo sapiens
agtcaaagtaaa

SEQ ID NO: 6650023 - DNA, 21 bp, Homo sapiens
agtcaaagtaaaacttgctgc

SEQ ID NO: 6650024 - DNA, 17 bp, Homo sapiens
agtcaaagtgttgctgt

SEQ ID NO: 6650025 - DNA, 22 bp, Homo sapiens
agtcaaagtgttgctgtggctc

SEQ ID NO: 6650026 - DNA, 12 bp, Homo sapiens
agtcaaatccag

SEQ ID NO: 6650027 - DNA, 15 bp, Homo sapiens
agtcaaatccagtgg

SEQ ID NO: 6650028 - DNA, 18 bp, Homo sapiens
agtcaaatccagtggtgg

SEQ ID NO: 6650029 - DNA, 15 bp, Homo sapiens
agtcaaatgccaaac

SEQ ID NO: 6650030 - DNA, 22 bp, Homo sapiens
agtcaaatggtaggcatttcct

SEQ ID NO: 6650031 - DNA, 23 bp, Homo sapiens
agtcaaatggtaggcatttccta

SEQ ID NO: 6650032 - DNA, 23 bp, Homo sapiens
agtcaaatgtaatgtggcttctg

SEQ ID NO: 6650033 - DNA, 13 bp, Homo sapiens
agtcaaattgtgt

SEQ ID NO: 6650034 - DNA, 17 bp, Homo sapiens
agtcaaatttacattta

SEQ ID NO: 6650035 - DNA, 23 bp, Homo sapiens
agtcaacaaattaaataaattac

SEQ ID NO: 6650036 - DNA, 22 bp, Homo sapiens
agtcaacactatatattttatg

SEQ ID NO: 6650037 - DNA, 14 bp, Homo sapiens
agtcaacagattca

SEQ ID NO: 6650038 - DNA, 16 bp, Homo sapiens
agtcaacagattcaga

SEQ ID NO: 6650039 - DNA, 15 bp, Homo sapiens
agtcaacagtaaacc

SEQ ID NO: 6650040 - DNA, 16 bp, Homo sapiens
agtcaacagtaaacca

SEQ ID NO: 6650041 - DNA, 15 bp, Homo sapiens
agtcaacctgcctga

SEQ ID NO: 6650042 - DNA, 16 bp, Homo sapiens
agtcaacctgcttttt

SEQ ID NO: 6650043 - DNA, 16 bp, Homo sapiens
agtcaactgctgtttt

SEQ ID NO: 6650044 - DNA, 14 bp, Homo sapiens
agtcaactggctgg

SEQ ID NO: 6650045 - DNA, 19 bp, Homo sapiens
agtcaactggctggccagt

SEQ ID NO: 6650046 - DNA, 20 bp, Homo sapiens
agtcaactggggaaaaggat

SEQ ID NO: 6650047 - DNA, 12 bp, Homo sapiens
agtcaagaaaaa

SEQ ID NO: 6650048 - DNA, 15 bp, Homo sapiens
agtcaagaaaaatat

SEQ ID NO: 6650049 - DNA, 17 bp, Homo sapiens
agtcaagaaaaatataa

SEQ ID NO: 6650050 - DNA, 20 bp, Homo sapiens
agtcaagaaaaatataaaaa

SEQ ID NO: 6650051 - DNA, 19 bp, Homo sapiens
agtcaagaaaaattattgt

SEQ ID NO: 6650052 - DNA, 15 bp, Homo sapiens
agtcaagagcatcct

SEQ ID NO: 6650053 - DNA, 19 bp, Homo sapiens
agtcaagaggtttttctcc

SEQ ID NO: 6650054 - DNA, 14 bp, Homo sapiens
agtcaagatacata

SEQ ID NO: 6650055 - DNA, 15 bp, Homo sapiens
agtcaagatacatag

SEQ ID NO: 6650056 - DNA, 16 bp, Homo sapiens
agtcaagatacatagt

SEQ ID NO: 6650057 - DNA, 17 bp, Homo sapiens
agtcaagatagaaaggg

SEQ ID NO: 6650058 - DNA, 14 bp, Homo sapiens
agtcaagctcctag

SEQ ID NO: 6650059 - DNA, 20 bp, Homo sapiens
agtcaagctcctcctccctg

SEQ ID NO: 6650060 - DNA, 16 bp, Homo sapiens
agtcaagctgatgaag

SEQ ID NO: 6650061 - DNA, 19 bp, Homo sapiens
agtcaaggcctgctccctg

SEQ ID NO: 6650062 - DNA, 18 bp, Homo sapiens
agtcaagggtagggtggg

SEQ ID NO: 6650063 - DNA, 18 bp, Homo sapiens
agtcaaggtgatatataa

SEQ ID NO: 6650064 - DNA, 21 bp, Homo sapiens
agtcaagtaatggaggtccca

SEQ ID NO: 6650065 - DNA, 23 bp, Homo sapiens
agtcaagtaatggaggtcccagc

SEQ ID NO: 6650066 - DNA, 14 bp, Homo sapiens
agtcaagtcaaata

SEQ ID NO: 6650067 - DNA, 22 bp, Homo sapiens
agtcaagtgaggtgacactcca

SEQ ID NO: 6650068 - DNA, 15 bp, Homo sapiens
agtcaagtgtgcctg

SEQ ID NO: 6650069 - DNA, 17 bp, Homo sapiens
agtcaagtgtgcctgct

SEQ ID NO: 6650070 - DNA, 22 bp, Homo sapiens
agtcaagttccctcctgcagcc

SEQ ID NO: 6650071 - DNA, 22 bp, Homo sapiens
agtcaataaaagagctgtctga

SEQ ID NO: 6650072 - DNA, 16 bp, Homo sapiens
agtcaataaacttgta

SEQ ID NO: 6650073 - DNA, 17 bp, Homo sapiens
agtcaataaacttgtag

SEQ ID NO: 6650074 - DNA, 21 bp, Homo sapiens
agtcaataactctgattttga

SEQ ID NO: 6650075 - DNA, 14 bp, Homo sapiens
agtcaataagaaaa

SEQ ID NO: 6650076 - DNA, 16 bp, Homo sapiens
agtcaatatgtggaag

SEQ ID NO: 6650077 - DNA, 17 bp, Homo sapiens
agtcaatatttttagat

SEQ ID NO: 6650078 - DNA, 16 bp, Homo sapiens
agtcaatcaaacaggg

SEQ ID NO: 6650079 - DNA, 12 bp, Homo sapiens
agtcaatcaagt

SEQ ID NO: 6650080 - DNA, 24 bp, Homo sapiens
agtcaatcaagtctgtttactgca

SEQ ID NO: 6650081 - DNA, 16 bp, Homo sapiens
agtcaatcagccttta

SEQ ID NO: 6650082 - DNA, 17 bp, Homo sapiens
agtcaatcatttctcac

SEQ ID NO: 6650083 - DNA, 16 bp, Homo sapiens
agtcaatccaagacta

SEQ ID NO: 6650084 - DNA, 24 bp, Homo sapiens
agtcaattaaacagctggtcctcc

SEQ ID NO: 6650085 - DNA, 14 bp, Homo sapiens
agtcaattaacaat

SEQ ID NO: 6650086 - DNA, 17 bp, Homo sapiens
agtcaattactctataa

SEQ ID NO: 6650087 - DNA, 18 bp, Homo sapiens
agtcaattagtacagtag

SEQ ID NO: 6650088 - DNA, 14 bp, Homo sapiens
agtcaattccaccc

SEQ ID NO: 6650089 - DNA, 23 bp, Homo sapiens
agtcaattgcttgagcatgccca

SEQ ID NO: 6650090 - DNA, 12 bp, Homo sapiens
agtcaatttgct

SEQ ID NO: 6650091 - DNA, 14 bp, Homo sapiens
agtcaatttgctga

SEQ ID NO: 6650092 - DNA, 15 bp, Homo sapiens
agtcaatttgctgaa

SEQ ID NO: 6650093 - DNA, 20 bp, Homo sapiens
agtcaatttgctgaaaacat

SEQ ID NO: 6650094 - DNA, 22 bp, Homo sapiens
agtcaatttgggggacatgcta

SEQ ID NO: 6650095 - DNA, 15 bp, Homo sapiens
agtcacaaaataaag

SEQ ID NO: 6650096 - DNA, 17 bp, Homo sapiens
agtcacaaaataaagct

SEQ ID NO: 6650097 - DNA, 16 bp, Homo sapiens
agtcacaaactgatct

SEQ ID NO: 6650098 - DNA, 20 bp, Homo sapiens
agtcacaaactgatctaaaa

SEQ ID NO: 6650099 - DNA, 13 bp, Homo sapiens
agtcacaaagact

SEQ ID NO: 6650100 - DNA, 22 bp, Homo sapiens
agtcacaaagcccatcataata

SEQ ID NO: 6650101 - DNA, 14 bp, Homo sapiens
agtcacaaaggaat

SEQ ID NO: 6650102 - DNA, 15 bp, Homo sapiens
agtcacaaaggaatg

SEQ ID NO: 6650103 - DNA, 16 bp, Homo sapiens
agtcacaacagagtga

SEQ ID NO: 6650104 - DNA, 16 bp, Homo sapiens
agtcacaagagcccag

SEQ ID NO: 6650105 - DNA, 12 bp, Homo sapiens
agtcacaatgag

SEQ ID NO: 6650106 - DNA, 19 bp, Homo sapiens
agtcacaattttctgtgcc

SEQ ID NO: 6650107 - DNA, 20 bp, Homo sapiens
agtcacaattttctgtgcca

SEQ ID NO: 6650108 - DNA, 12 bp, Homo sapiens
agtcacacagac

SEQ ID NO: 6650109 - DNA, 15 bp, Homo sapiens
agtcacacagtgagt

SEQ ID NO: 6650110 - DNA, 12 bp, Homo sapiens
agtcacacccac

SEQ ID NO: 6650111 - DNA, 15 bp, Homo sapiens
agtcacactcagaaa

SEQ ID NO: 6650112 - DNA, 19 bp, Homo sapiens
agtcacactgctagcaaat

SEQ ID NO: 6650113 - DNA, 11 bp, Homo sapiens
agtcacagcca

SEQ ID NO: 6650114 - DNA, 11 bp, Homo sapiens
agtcacagctg

SEQ ID NO: 6650115 - DNA, 18 bp, Homo sapiens
agtcacagctgcagctgg

SEQ ID NO: 6650116 - DNA, 19 bp, Homo sapiens
agtcacagctgcagctggg

SEQ ID NO: 6650117 - DNA, 20 bp, Homo sapiens
agtcacagctttcccaggta

SEQ ID NO: 6650118 - DNA, 13 bp, Homo sapiens
agtcacaggccca

SEQ ID NO: 6650119 - DNA, 15 bp, Homo sapiens
agtcacaggcccagg

SEQ ID NO: 6650120 - DNA, 16 bp, Homo sapiens
agtcacaggtgtggga

SEQ ID NO: 6650121 - DNA, 20 bp, Homo sapiens
agtcacagtggggttttttt

SEQ ID NO: 6650122 - DNA, 23 bp, Homo sapiens
agtcacatatcaagtcccgaggc

SEQ ID NO: 6650123 - DNA, 14 bp, Homo sapiens
agtcacatctcttc

SEQ ID NO: 6650124 - DNA, 11 bp, Homo sapiens
agtcacattcc

SEQ ID NO: 6650125 - DNA, 19 bp, Homo sapiens
agtcacattccacatctgt

SEQ ID NO: 6650126 - DNA, 14 bp, Homo sapiens
agtcacattctgct

SEQ ID NO: 6650127 - DNA, 21 bp, Homo sapiens
agtcacattgatgtaaggact

SEQ ID NO: 6650128 - DNA, 22 bp, Homo sapiens
agtcaccaaaagacactgcaga

SEQ ID NO: 6650129 - DNA, 20 bp, Homo sapiens
agtcaccaaatagtgtgaaa

SEQ ID NO: 6650130 - DNA, 14 bp, Homo sapiens
agtcaccacccagc

SEQ ID NO: 6650131 - DNA, 19 bp, Homo sapiens
agtcaccactccattccca

SEQ ID NO: 6650132 - DNA, 15 bp, Homo sapiens
agtcaccacttattt

SEQ ID NO: 6650133 - DNA, 16 bp, Homo sapiens
agtcaccacttcctct

SEQ ID NO: 6650134 - DNA, 19 bp, Homo sapiens
agtcaccaggaatgttaaa

SEQ ID NO: 6650135 - DNA, 16 bp, Homo sapiens
agtcaccaggacttgg

SEQ ID NO: 6650136 - DNA, 17 bp, Homo sapiens
agtcaccaggacttggg

SEQ ID NO: 6650137 - DNA, 13 bp, Homo sapiens
agtcaccatgcaa

SEQ ID NO: 6650138 - DNA, 20 bp, Homo sapiens
agtcaccattcttctttttt

SEQ ID NO: 6650139 - DNA, 16 bp, Homo sapiens
agtcacccaaacactt

SEQ ID NO: 6650140 - DNA, 17 bp, Homo sapiens
agtcacccatgaagaca

SEQ ID NO: 6650141 - DNA, 21 bp, Homo sapiens
agtcaccccaagtagtctgct

SEQ ID NO: 6650142 - DNA, 18 bp, Homo sapiens
agtcacccccccaggcct

SEQ ID NO: 6650143 - DNA, 21 bp, Homo sapiens
agtcacccccccaggcctcca

SEQ ID NO: 6650144 - DNA, 17 bp, Homo sapiens
agtcaccccggccacct

SEQ ID NO: 6650145 - DNA, 20 bp, Homo sapiens
agtcacccctccctccctct

SEQ ID NO: 6650146 - DNA, 21 bp, Homo sapiens
agtcacccctctgtccagcca

SEQ ID NO: 6650147 - DNA, 21 bp, Homo sapiens
agtcacccctgcctaaagata

SEQ ID NO: 6650148 - DNA, 20 bp, Homo sapiens
agtcacccggcccccatgca

SEQ ID NO: 6650149 - DNA, 20 bp, Homo sapiens
agtcaccctacctgtgcctg

SEQ ID NO: 6650150 - DNA, 23 bp, Homo sapiens
agtcaccctagccctctccctct

SEQ ID NO: 6650151 - DNA, 14 bp, Homo sapiens
agtcacccttctgg

SEQ ID NO: 6650152 - DNA, 17 bp, Homo sapiens
agtcaccgacagcggcc

SEQ ID NO: 6650153 - DNA, 19 bp, Homo sapiens
agtcacctaaccctctgtc

SEQ ID NO: 6650154 - DNA, 23 bp, Homo sapiens
agtcacctaagcaatcactgggc

SEQ ID NO: 6650155 - DNA, 16 bp, Homo sapiens
agtcacctacaggact

SEQ ID NO: 6650156 - DNA, 17 bp, Homo sapiens
agtcacctacaggactg

SEQ ID NO: 6650157 - DNA, 19 bp, Homo sapiens
agtcacctacaggactggg

SEQ ID NO: 6650158 - DNA, 15 bp, Homo sapiens
agtcacctcatggaa

SEQ ID NO: 6650159 - DNA, 13 bp, Homo sapiens
agtcacctcctcc

SEQ ID NO: 6650160 - DNA, 20 bp, Homo sapiens
agtcacctcctccactcact

SEQ ID NO: 6650161 - DNA, 17 bp, Homo sapiens
agtcacctcctgctcct

SEQ ID NO: 6650162 - DNA, 18 bp, Homo sapiens
agtcacctcctgctcctt

SEQ ID NO: 6650163 - DNA, 23 bp, Homo sapiens
agtcacctcgtctccctggtgcc

SEQ ID NO: 6650164 - DNA, 15 bp, Homo sapiens
agtcacctgcaagcc

SEQ ID NO: 6650165 - DNA, 16 bp, Homo sapiens
agtcacctgcaagccc

SEQ ID NO: 6650166 - DNA, 22 bp, Homo sapiens
agtcacctgcaagccccagggc

SEQ ID NO: 6650167 - DNA, 23 bp, Homo sapiens
agtcacctgcaagccccagggcc

SEQ ID NO: 6650168 - DNA, 14 bp, Homo sapiens
agtcacctgcccca

SEQ ID NO: 6650169 - DNA, 19 bp, Homo sapiens
agtcacctgccccagcact

SEQ ID NO: 6650170 - DNA, 13 bp, Homo sapiens
agtcacctgctgg

SEQ ID NO: 6650171 - DNA, 22 bp, Homo sapiens
agtcaccttcattttggcaaga

SEQ ID NO: 6650172 - DNA, 14 bp, Homo sapiens
agtcaccttccctt

SEQ ID NO: 6650173 - DNA, 12 bp, Homo sapiens
agtcacctttct

SEQ ID NO: 6650174 - DNA, 23 bp, Homo sapiens
agtcacctttctgggctttctcc

SEQ ID NO: 6650175 - DNA, 14 bp, Homo sapiens
agtcaccttttaaa

SEQ ID NO: 6650176 - DNA, 21 bp, Homo sapiens
agtcaccttttaaatcctgtt

SEQ ID NO: 6650177 - DNA, 22 bp, Homo sapiens
agtcaccttttctgtggctggc

SEQ ID NO: 6650178 - DNA, 16 bp, Homo sapiens
agtcacgcctgaaact

SEQ ID NO: 6650179 - DNA, 20 bp, Homo sapiens
agtcacgcctgaaactttga

SEQ ID NO: 6650180 - DNA, 23 bp, Homo sapiens
agtcacgtgaggcccctgtgcag

SEQ ID NO: 6650181 - DNA, 19 bp, Homo sapiens
agtcactaggatgcagatg

SEQ ID NO: 6650182 - DNA, 22 bp, Homo sapiens
agtcactatgggatgagaaaat

SEQ ID NO: 6650183 - DNA, 17 bp, Homo sapiens
agtcactcttatgctgt

SEQ ID NO: 6650184 - DNA, 16 bp, Homo sapiens
agtcactgaacaaaac

SEQ ID NO: 6650185 - DNA, 15 bp, Homo sapiens
agtcactgagacagc

SEQ ID NO: 6650186 - DNA, 17 bp, Homo sapiens
agtcactgagacagccc

SEQ ID NO: 6650187 - DNA, 19 bp, Homo sapiens
agtcactgagacagcccgg

SEQ ID NO: 6650188 - DNA, 13 bp, Homo sapiens
agtcactgagacc

SEQ ID NO: 6650189 - DNA, 23 bp, Homo sapiens
agtcactgagaccaaggctttct

SEQ ID NO: 6650190 - DNA, 17 bp, Homo sapiens
agtcactgagcatcact

SEQ ID NO: 6650191 - DNA, 18 bp, Homo sapiens
agtcactgccactttgca

SEQ ID NO: 6650192 - DNA, 21 bp, Homo sapiens
agtcactgcctctccctggcc

SEQ ID NO: 6650193 - DNA, 23 bp, Homo sapiens
agtcactggaggttgaagccaag

SEQ ID NO: 6650194 - DNA, 13 bp, Homo sapiens
agtcactggcagc

SEQ ID NO: 6650195 - DNA, 18 bp, Homo sapiens
agtcactggcagcctgca

SEQ ID NO: 6650196 - DNA, 19 bp, Homo sapiens
agtcactggcagcctgcac

SEQ ID NO: 6650197 - DNA, 22 bp, Homo sapiens
agtcactggcagcctgcacctg

SEQ ID NO: 6650198 - DNA, 22 bp, Homo sapiens
agtcactggcatactgagaata

SEQ ID NO: 6650199 - DNA, 23 bp, Homo sapiens
agtcactggtctgtttgcatttg

SEQ ID NO: 6650200 - DNA, 10 bp, Homo sapiens
agtcactgtc

SEQ ID NO: 6650201 - DNA, 23 bp, Homo sapiens
agtcactgtgagctcccaggtgc

SEQ ID NO: 6650202 - DNA, 24 bp, Homo sapiens
agtcactgtgagctcccaggtgca

SEQ ID NO: 6650203 - DNA, 16 bp, Homo sapiens
agtcacttactattgt

SEQ ID NO: 6650204 - DNA, 19 bp, Homo sapiens
agtcacttactattgttgc

SEQ ID NO: 6650205 - DNA, 17 bp, Homo sapiens
agtcacttccccaagat

SEQ ID NO: 6650206 - DNA, 23 bp, Homo sapiens
agtcacttccccaagatctgcca

SEQ ID NO: 6650207 - DNA, 23 bp, Homo sapiens
agtcacttccttcagcatctcac

SEQ ID NO: 6650208 - DNA, 20 bp, Homo sapiens
agtcacttcggccagagctg

SEQ ID NO: 6650209 - DNA, 24 bp, Homo sapiens
agtcacttcgtgggatctgcccct

SEQ ID NO: 6650210 - DNA, 23 bp, Homo sapiens
agtcacttgggagctgctgggct

SEQ ID NO: 6650211 - DNA, 21 bp, Homo sapiens
agtcacttgtaaggggaacag

SEQ ID NO: 6650212 - DNA, 20 bp, Homo sapiens
agtcactttttcccctgcaa

SEQ ID NO: 6650213 - DNA, 21 bp, Homo sapiens
agtcactttttcccctgcaat

SEQ ID NO: 6650214 - DNA, 17 bp, Homo sapiens
agtcactttttttttcc

SEQ ID NO: 6650215 - DNA, 13 bp, Homo sapiens
agtcagaaaactt

SEQ ID NO: 6650216 - DNA, 23 bp, Homo sapiens
agtcagaaaactttaaaaaatat

SEQ ID NO: 6650217 - DNA, 20 bp, Homo sapiens
agtcagaaaattggcagtgg

SEQ ID NO: 6650218 - DNA, 20 bp, Homo sapiens
agtcagaactataacattca

SEQ ID NO: 6650219 - DNA, 20 bp, Homo sapiens
agtcagaagcaggttcttga

SEQ ID NO: 6650220 - DNA, 18 bp, Homo sapiens
agtcagaagttctgggtg

SEQ ID NO: 6650221 - DNA, 23 bp, Homo sapiens
agtcagaatgtgaaaaaggaata

SEQ ID NO: 6650222 - DNA, 13 bp, Homo sapiens
agtcagactgaaa

SEQ ID NO: 6650223 - DNA, 19 bp, Homo sapiens
agtcagagaaaacactttc

SEQ ID NO: 6650224 - DNA, 15 bp, Homo sapiens
agtcagagacagata

SEQ ID NO: 6650225 - DNA, 19 bp, Homo sapiens
agtcagagacagatacctc

SEQ ID NO: 6650226 - DNA, 16 bp, Homo sapiens
agtcagagccctggct

SEQ ID NO: 6650227 - DNA, 13 bp, Homo sapiens
agtcagagctcag

SEQ ID NO: 6650228 - DNA, 16 bp, Homo sapiens
agtcagaggagaagag

SEQ ID NO: 6650229 - DNA, 14 bp, Homo sapiens
agtcagaggatggc

SEQ ID NO: 6650230 - DNA, 19 bp, Homo sapiens
agtcagaggatggccagtg

SEQ ID NO: 6650231 - DNA, 14 bp, Homo sapiens
agtcagagtccagt

SEQ ID NO: 6650232 - DNA, 15 bp, Homo sapiens
agtcagagtccagtg

SEQ ID NO: 6650233 - DNA, 20 bp, Homo sapiens
agtcagagtccagtgctctg

SEQ ID NO: 6650234 - DNA, 16 bp, Homo sapiens
agtcagagtgtccctt

SEQ ID NO: 6650235 - DNA, 21 bp, Homo sapiens
agtcagatctgcctaaggact

SEQ ID NO: 6650236 - DNA, 20 bp, Homo sapiens
agtcagatgagcaaggacat

SEQ ID NO: 6650237 - DNA, 14 bp, Homo sapiens
agtcagatgaggcc

SEQ ID NO: 6650238 - DNA, 16 bp, Homo sapiens
agtcagatgaggccct

SEQ ID NO: 6650239 - DNA, 18 bp, Homo sapiens
agtcagatgaggccctgc

SEQ ID NO: 6650240 - DNA, 19 bp, Homo sapiens
agtcagatgaggccctgca

SEQ ID NO: 6650241 - DNA, 23 bp, Homo sapiens
agtcagatgcccagagggcccag

SEQ ID NO: 6650242 - DNA, 18 bp, Homo sapiens
agtcagatggatgtagat

SEQ ID NO: 6650243 - DNA, 15 bp, Homo sapiens
agtcagatttttaaa

SEQ ID NO: 6650244 - DNA, 16 bp, Homo sapiens
agtcagatttttaaag

SEQ ID NO: 6650245 - DNA, 13 bp, Homo sapiens
agtcagcacagag

SEQ ID NO: 6650246 - DNA, 14 bp, Homo sapiens
agtcagcacagaga

SEQ ID NO: 6650247 - DNA, 22 bp, Homo sapiens
agtcagcaccttggcccaggag

SEQ ID NO: 6650248 - DNA, 14 bp, Homo sapiens
agtcagcagaactg

SEQ ID NO: 6650249 - DNA, 15 bp, Homo sapiens
agtcagcagcagctc

SEQ ID NO: 6650250 - DNA, 22 bp, Homo sapiens
agtcagcagcagctctgagcca

SEQ ID NO: 6650251 - DNA, 20 bp, Homo sapiens
agtcagcatgcttcccagag

SEQ ID NO: 6650252 - DNA, 15 bp, Homo sapiens
agtcagccacactgg

SEQ ID NO: 6650253 - DNA, 18 bp, Homo sapiens
agtcagccatgtctgtgc

SEQ ID NO: 6650254 - DNA, 19 bp, Homo sapiens
agtcagccatgtctgtgct

SEQ ID NO: 6650255 - DNA, 19 bp, Homo sapiens
agtcagcccgaatgcctgt

SEQ ID NO: 6650256 - DNA, 11 bp, Homo sapiens
agtcagccctt

SEQ ID NO: 6650257 - DNA, 17 bp, Homo sapiens
agtcagcctggctgggc

SEQ ID NO: 6650258 - DNA, 22 bp, Homo sapiens
agtcagccttccccctcccagg

SEQ ID NO: 6650259 - DNA, 17 bp, Homo sapiens
agtcagctaattggact

SEQ ID NO: 6650260 - DNA, 20 bp, Homo sapiens
agtcagctcttcatctgccc

SEQ ID NO: 6650261 - DNA, 23 bp, Homo sapiens
agtcagctgaccccctcccccca

SEQ ID NO: 6650262 - DNA, 22 bp, Homo sapiens
agtcagctggccagatttcctc

SEQ ID NO: 6650263 - DNA, 17 bp, Homo sapiens
agtcaggaaagacaggc

SEQ ID NO: 6650264 - DNA, 20 bp, Homo sapiens
agtcaggaagcctcctgctg

SEQ ID NO: 6650265 - DNA, 17 bp, Homo sapiens
agtcaggaatggctgca

SEQ ID NO: 6650266 - DNA, 14 bp, Homo sapiens
agtcaggagccagc

SEQ ID NO: 6650267 - DNA, 15 bp, Homo sapiens
agtcaggagccagca

SEQ ID NO: 6650268 - DNA, 16 bp, Homo sapiens
agtcaggagccagcag

SEQ ID NO: 6650269 - DNA, 17 bp, Homo sapiens
agtcaggagccagcagg

SEQ ID NO: 6650270 - DNA, 22 bp, Homo sapiens
agtcaggagtccaagaccagac

SEQ ID NO: 6650271 - DNA, 23 bp, Homo sapiens
agtcaggagttttactgcctgta

SEQ ID NO: 6650272 - DNA, 13 bp, Homo sapiens
agtcaggatgagg

SEQ ID NO: 6650273 - DNA, 14 bp, Homo sapiens
agtcaggatgaggc

SEQ ID NO: 6650274 - DNA, 15 bp, Homo sapiens
agtcaggatgaggcc

SEQ ID NO: 6650275 - DNA, 16 bp, Homo sapiens
agtcaggatgaggccc

SEQ ID NO: 6650276 - DNA, 17 bp, Homo sapiens
agtcaggatgaggcccc

SEQ ID NO: 6650277 - DNA, 17 bp, Homo sapiens
agtcaggcactggctga

SEQ ID NO: 6650278 - DNA, 11 bp, Homo sapiens
agtcaggcccg

SEQ ID NO: 6650279 - DNA, 18 bp, Homo sapiens
agtcaggctagctgtgct

SEQ ID NO: 6650280 - DNA, 17 bp, Homo sapiens
agtcaggctctctgggc

SEQ ID NO: 6650281 - DNA, 14 bp, Homo sapiens
agtcaggctgttgg

SEQ ID NO: 6650282 - DNA, 18 bp, Homo sapiens
agtcagggaagagcagtg

SEQ ID NO: 6650283 - DNA, 22 bp, Homo sapiens
agtcagggacagcagcctccct

SEQ ID NO: 6650284 - DNA, 16 bp, Homo sapiens
agtcagggacctgctg

SEQ ID NO: 6650285 - DNA, 19 bp, Homo sapiens
agtcagggacctgctgctc

SEQ ID NO: 6650286 - DNA, 22 bp, Homo sapiens
agtcagggcacagctgccctgc

SEQ ID NO: 6650287 - DNA, 20 bp, Homo sapiens
agtcagggcccagaggctga

SEQ ID NO: 6650288 - DNA, 17 bp, Homo sapiens
agtcaggggcagctgac

SEQ ID NO: 6650289 - DNA, 11 bp, Homo sapiens
agtcaggggct

SEQ ID NO: 6650290 - DNA, 14 bp, Homo sapiens
agtcaggggctctg

SEQ ID NO: 6650291 - DNA, 17 bp, Homo sapiens
agtcaggggctctgtgt

SEQ ID NO: 6650292 - DNA, 18 bp, Homo sapiens
agtcaggggtcaggtgtc

SEQ ID NO: 6650293 - DNA, 22 bp, Homo sapiens
agtcagggtgaactgcaaagct

SEQ ID NO: 6650294 - DNA, 22 bp, Homo sapiens
agtcagggtgggaagaaagaat

SEQ ID NO: 6650295 - DNA, 23 bp, Homo sapiens
agtcagggtttgtcagaggaaca

SEQ ID NO: 6650296 - DNA, 17 bp, Homo sapiens
agtcaggtgcagtccca

SEQ ID NO: 6650297 - DNA, 11 bp, Homo sapiens
agtcaggtgct

SEQ ID NO: 6650298 - DNA, 13 bp, Homo sapiens
agtcaggtgctca

SEQ ID NO: 6650299 - DNA, 14 bp, Homo sapiens
agtcaggtgctcaa

SEQ ID NO: 6650300 - DNA, 15 bp, Homo sapiens
agtcaggtgctcaat

SEQ ID NO: 6650301 - DNA, 22 bp, Homo sapiens
agtcagtaggtccaagggccat

SEQ ID NO: 6650302 - DNA, 20 bp, Homo sapiens
agtcagtcacaaaccagcct

SEQ ID NO: 6650303 - DNA, 17 bp, Homo sapiens
agtcagtcttcacttgc

SEQ ID NO: 6650304 - DNA, 12 bp, Homo sapiens
agtcagtgctgg

SEQ ID NO: 6650305 - DNA, 14 bp, Homo sapiens
agtcagtggagggc

SEQ ID NO: 6650306 - DNA, 18 bp, Homo sapiens
agtcagtggctttgcata

SEQ ID NO: 6650307 - DNA, 22 bp, Homo sapiens
agtcagtgggaacgtgactgcc

SEQ ID NO: 6650308 - DNA, 21 bp, Homo sapiens
agtcagtgtcgtttatattgt

SEQ ID NO: 6650309 - DNA, 16 bp, Homo sapiens
agtcagtgtctggctt

SEQ ID NO: 6650310 - DNA, 17 bp, Homo sapiens
agtcagtgtctggcttt

SEQ ID NO: 6650311 - DNA, 21 bp, Homo sapiens
agtcagttactgatgctcctg

SEQ ID NO: 6650312 - DNA, 21 bp, Homo sapiens
agtcagttgctcaaaaagaaa

SEQ ID NO: 6650313 - DNA, 14 bp, Homo sapiens
agtcagttggagaa

SEQ ID NO: 6650314 - DNA, 14 bp, Homo sapiens
agtcagtttgcagt

SEQ ID NO: 6650315 - DNA, 20 bp, Homo sapiens
agtcataaaatgtatcttcc

SEQ ID NO: 6650316 - DNA, 16 bp, Homo sapiens
agtcataaacagcatt

SEQ ID NO: 6650317 - DNA, 19 bp, Homo sapiens
agtcataaacagcatttat

SEQ ID NO: 6650318 - DNA, 13 bp, Homo sapiens
agtcataaacctt

SEQ ID NO: 6650319 - DNA, 18 bp, Homo sapiens
agtcataaaccttaagta

SEQ ID NO: 6650320 - DNA, 20 bp, Homo sapiens
agtcataaaccttaagtaag

SEQ ID NO: 6650321 - DNA, 12 bp, Homo sapiens
agtcataaatac

SEQ ID NO: 6650322 - DNA, 21 bp, Homo sapiens
agtcataatcattagggggaa

SEQ ID NO: 6650323 - DNA, 17 bp, Homo sapiens
agtcataccaatgaaaa

SEQ ID NO: 6650324 - DNA, 16 bp, Homo sapiens
agtcataggttaatat

SEQ ID NO: 6650325 - DNA, 22 bp, Homo sapiens
agtcataggttaatatttaaga

SEQ ID NO: 6650326 - DNA, 20 bp, Homo sapiens
agtcatatatatcacccaga

SEQ ID NO: 6650327 - DNA, 15 bp, Homo sapiens
agtcatattttgatt

SEQ ID NO: 6650328 - DNA, 15 bp, Homo sapiens
agtcatcaacaatga

SEQ ID NO: 6650329 - DNA, 23 bp, Homo sapiens
agtcatcaacaatgattaatcag

SEQ ID NO: 6650330 - DNA, 13 bp, Homo sapiens
agtcatcatcagg

SEQ ID NO: 6650331 - DNA, 18 bp, Homo sapiens
agtcatcatcagggcctg

SEQ ID NO: 6650332 - DNA, 12 bp, Homo sapiens
agtcatcatctc

SEQ ID NO: 6650333 - DNA, 15 bp, Homo sapiens
agtcatcatctcttg

SEQ ID NO: 6650334 - DNA, 22 bp, Homo sapiens
agtcatcatctttttgtgtgca

SEQ ID NO: 6650335 - DNA, 18 bp, Homo sapiens
agtcatcatgaactggct

SEQ ID NO: 6650336 - DNA, 19 bp, Homo sapiens
agtcatcatgaactggctt

SEQ ID NO: 6650337 - DNA, 16 bp, Homo sapiens
agtcatcatgggtgtt

SEQ ID NO: 6650338 - DNA, 15 bp, Homo sapiens
agtcatcattccctt

SEQ ID NO: 6650339 - DNA, 14 bp, Homo sapiens
agtcatcatttatc

SEQ ID NO: 6650340 - DNA, 17 bp, Homo sapiens
agtcatccaacaagaag

SEQ ID NO: 6650341 - DNA, 13 bp, Homo sapiens
agtcatccacagc

SEQ ID NO: 6650342 - DNA, 13 bp, Homo sapiens
agtcatccagtct

SEQ ID NO: 6650343 - DNA, 19 bp, Homo sapiens
agtcatcccctctcaggag

SEQ ID NO: 6650344 - DNA, 11 bp, Homo sapiens
agtcatcctgc

SEQ ID NO: 6650345 - DNA, 14 bp, Homo sapiens
agtcatcctgccct

SEQ ID NO: 6650346 - DNA, 19 bp, Homo sapiens
agtcatcctgccctgcagc

SEQ ID NO: 6650347 - DNA, 21 bp, Homo sapiens
agtcatcctgccctgcagcac

SEQ ID NO: 6650348 - DNA, 22 bp, Homo sapiens
agtcatcctgccctgcagcacg

SEQ ID NO: 6650349 - DNA, 18 bp, Homo sapiens
agtcatctacttaataaa

SEQ ID NO: 6650350 - DNA, 14 bp, Homo sapiens
agtcatctatagtt

SEQ ID NO: 6650351 - DNA, 22 bp, Homo sapiens
agtcatctcaaacactgcttaa

SEQ ID NO: 6650352 - DNA, 17 bp, Homo sapiens
agtcatctcaaactctt

SEQ ID NO: 6650353 - DNA, 15 bp, Homo sapiens
agtcatctcaaccat

SEQ ID NO: 6650354 - DNA, 22 bp, Homo sapiens
agtcatctcctaatttgtttct

SEQ ID NO: 6650355 - DNA, 20 bp, Homo sapiens
agtcatctgtaagagcttgc

SEQ ID NO: 6650356 - DNA, 20 bp, Homo sapiens
agtcatcttgaccaagcagg

SEQ ID NO: 6650357 - DNA, 21 bp, Homo sapiens
agtcatcttgaccaagcagga

SEQ ID NO: 6650358 - DNA, 19 bp, Homo sapiens
agtcatcttgtaatttcca

SEQ ID NO: 6650359 - DNA, 18 bp, Homo sapiens
agtcatcttgtgagtgga

SEQ ID NO: 6650360 - DNA, 22 bp, Homo sapiens
agtcatcttgtgagtggataat

SEQ ID NO: 6650361 - DNA, 18 bp, Homo sapiens
agtcatgaagctcagttt

SEQ ID NO: 6650362 - DNA, 19 bp, Homo sapiens
agtcatgaagctcagtttg

SEQ ID NO: 6650363 - DNA, 12 bp, Homo sapiens
agtcatgacaga

SEQ ID NO: 6650364 - DNA, 20 bp, Homo sapiens
agtcatgacatttctcaaag

SEQ ID NO: 6650365 - DNA, 15 bp, Homo sapiens
agtcatgactagtgc

SEQ ID NO: 6650366 - DNA, 20 bp, Homo sapiens
agtcatgactagtgcctaga

SEQ ID NO: 6650367 - DNA, 16 bp, Homo sapiens
agtcatgagctgagca

SEQ ID NO: 6650368 - DNA, 20 bp, Homo sapiens
agtcatgaggaaagacacag

SEQ ID NO: 6650369 - DNA, 14 bp, Homo sapiens
agtcatgatgtttt

SEQ ID NO: 6650370 - DNA, 19 bp, Homo sapiens
agtcatgatgtttttaaaa

SEQ ID NO: 6650371 - DNA, 23 bp, Homo sapiens
agtcatgcaaaccgttaggaaaa

SEQ ID NO: 6650372 - DNA, 18 bp, Homo sapiens
agtcatgcaaaggctggg

SEQ ID NO: 6650373 - DNA, 13 bp, Homo sapiens
agtcatgcataaa

SEQ ID NO: 6650374 - DNA, 19 bp, Homo sapiens
agtcatgcataaatatgca

SEQ ID NO: 6650375 - DNA, 19 bp, Homo sapiens
agtcatgcgtttaatcaca

SEQ ID NO: 6650376 - DNA, 13 bp, Homo sapiens
agtcatgctcccc

SEQ ID NO: 6650377 - DNA, 23 bp, Homo sapiens
agtcatgctcccctgtgccagcc

SEQ ID NO: 6650378 - DNA, 23 bp, Homo sapiens
agtcatggaatcttgctgcaggc

SEQ ID NO: 6650379 - DNA, 13 bp, Homo sapiens
agtcatggacatt

SEQ ID NO: 6650380 - DNA, 12 bp, Homo sapiens
agtcatggagaa

SEQ ID NO: 6650381 - DNA, 18 bp, Homo sapiens
agtcatggagaaccacct

SEQ ID NO: 6650382 - DNA, 22 bp, Homo sapiens
agtcatggagaatctgctgcat

SEQ ID NO: 6650383 - DNA, 13 bp, Homo sapiens
agtcatggccaaa

SEQ ID NO: 6650384 - DNA, 13 bp, Homo sapiens
agtcatggctgtg

SEQ ID NO: 6650385 - DNA, 20 bp, Homo sapiens
agtcatgggaacgcagcctc

SEQ ID NO: 6650386 - DNA, 22 bp, Homo sapiens
agtcatgggaacgcagcctcca

SEQ ID NO: 6650387 - DNA, 15 bp, Homo sapiens
agtcatgggagaaga

SEQ ID NO: 6650388 - DNA, 19 bp, Homo sapiens
agtcatggggtccctgctg

SEQ ID NO: 6650389 - DNA, 12 bp, Homo sapiens
agtcatggtact

SEQ ID NO: 6650390 - DNA, 19 bp, Homo sapiens
agtcatggtactaccccag

SEQ ID NO: 6650391 - DNA, 15 bp, Homo sapiens
agtcatggtcacagt

SEQ ID NO: 6650392 - DNA, 15 bp, Homo sapiens
agtcatggtcctggc

SEQ ID NO: 6650393 - DNA, 17 bp, Homo sapiens
agtcatggtcctggctg

SEQ ID NO: 6650394 - DNA, 17 bp, Homo sapiens
agtcatggtggccacgg

SEQ ID NO: 6650395 - DNA, 18 bp, Homo sapiens
agtcatgtaaatactgtt

SEQ ID NO: 6650396 - DNA, 12 bp, Homo sapiens
agtcatgtatgt

SEQ ID NO: 6650397 - DNA, 13 bp, Homo sapiens
agtcatgtatgtt

SEQ ID NO: 6650398 - DNA, 22 bp, Homo sapiens
agtcatgtcagaaggagacaga

SEQ ID NO: 6650399 - DNA, 13 bp, Homo sapiens
agtcatgtgagcc

SEQ ID NO: 6650400 - DNA, 14 bp, Homo sapiens
agtcatgtgcctct

SEQ ID NO: 6650401 - DNA, 20 bp, Homo sapiens
agtcatgtgcctctgtcctt

SEQ ID NO: 6650402 - DNA, 14 bp, Homo sapiens
agtcatgtgggcca

SEQ ID NO: 6650403 - DNA, 22 bp, Homo sapiens
agtcatgtgtcagctgtagaaa

SEQ ID NO: 6650404 - DNA, 15 bp, Homo sapiens
agtcatgtgtgaaca

SEQ ID NO: 6650405 - DNA, 17 bp, Homo sapiens
agtcatgtgtgcatcat

SEQ ID NO: 6650406 - DNA, 19 bp, Homo sapiens
agtcatgttccttcaagat

SEQ ID NO: 6650407 - DNA, 14 bp, Homo sapiens
agtcatgtttatct

SEQ ID NO: 6650408 - DNA, 19 bp, Homo sapiens
agtcattaaaatggaagtg

SEQ ID NO: 6650409 - DNA, 13 bp, Homo sapiens
agtcattaaactt

SEQ ID NO: 6650410 - DNA, 18 bp, Homo sapiens
agtcattagactcctcct

SEQ ID NO: 6650411 - DNA, 19 bp, Homo sapiens
agtcattagactcctcctc

SEQ ID NO: 6650412 - DNA, 20 bp, Homo sapiens
agtcattatagatcccccag

SEQ ID NO: 6650413 - DNA, 18 bp, Homo sapiens
agtcattatccttgctat

SEQ ID NO: 6650414 - DNA, 22 bp, Homo sapiens
agtcattatgagaggcaatgat

SEQ ID NO: 6650415 - DNA, 23 bp, Homo sapiens
agtcattcaggtgacctcctgca

SEQ ID NO: 6650416 - DNA, 14 bp, Homo sapiens
agtcattcatattt

SEQ ID NO: 6650417 - DNA, 16 bp, Homo sapiens
agtcattctagaggga

SEQ ID NO: 6650418 - DNA, 17 bp, Homo sapiens
agtcattctagagggat

SEQ ID NO: 6650419 - DNA, 14 bp, Homo sapiens
agtcattctgcctg

SEQ ID NO: 6650420 - DNA, 14 bp, Homo sapiens
agtcattcttccct

SEQ ID NO: 6650421 - DNA, 17 bp, Homo sapiens
agtcattgacttcattt

SEQ ID NO: 6650422 - DNA, 14 bp, Homo sapiens
agtcattgatagaa

SEQ ID NO: 6650423 - DNA, 17 bp, Homo sapiens
agtcattgatagaacta

SEQ ID NO: 6650424 - DNA, 18 bp, Homo sapiens
agtcattgctgacagagc

SEQ ID NO: 6650425 - DNA, 15 bp, Homo sapiens
agtcattggctgtct

SEQ ID NO: 6650426 - DNA, 15 bp, Homo sapiens
agtcattgtaatgtt

SEQ ID NO: 6650427 - DNA, 16 bp, Homo sapiens
agtcattgtaatgttg

SEQ ID NO: 6650428 - DNA, 17 bp, Homo sapiens
agtcattgtaatgttgt

SEQ ID NO: 6650429 - DNA, 21 bp, Homo sapiens
agtcattgtactgtttttaat

SEQ ID NO: 6650430 - DNA, 13 bp, Homo sapiens
agtcattgtatgt

SEQ ID NO: 6650431 - DNA, 18 bp, Homo sapiens
agtcattgtcgctcagca

SEQ ID NO: 6650432 - DNA, 21 bp, Homo sapiens
agtcattgtggatagagcagc

SEQ ID NO: 6650433 - DNA, 16 bp, Homo sapiens
agtcatttaagaattt

SEQ ID NO: 6650434 - DNA, 14 bp, Homo sapiens
agtcatttactaaa

SEQ ID NO: 6650435 - DNA, 20 bp, Homo sapiens
agtcatttaggatccatgca

SEQ ID NO: 6650436 - DNA, 21 bp, Homo sapiens
agtcatttaggatccatgcag

SEQ ID NO: 6650437 - DNA, 15 bp, Homo sapiens
agtcatttatgagca

SEQ ID NO: 6650438 - DNA, 18 bp, Homo sapiens
agtcatttcaaaatatgt

SEQ ID NO: 6650439 - DNA, 18 bp, Homo sapiens
agtcatttcgttccctga

SEQ ID NO: 6650440 - DNA, 20 bp, Homo sapiens
agtcatttctgatgttccag

SEQ ID NO: 6650441 - DNA, 22 bp, Homo sapiens
agtcatttgctgagcatgtact

SEQ ID NO: 6650442 - DNA, 14 bp, Homo sapiens
agtcatttgtgaaa

SEQ ID NO: 6650443 - DNA, 16 bp, Homo sapiens
agtcatttgtttaaac

SEQ ID NO: 6650444 - DNA, 19 bp, Homo sapiens
agtcattttaactttatca

SEQ ID NO: 6650445 - DNA, 19 bp, Homo sapiens
agtcattttaataactaaa

SEQ ID NO: 6650446 - DNA, 15 bp, Homo sapiens
agtcattttcatgtg

SEQ ID NO: 6650447 - DNA, 22 bp, Homo sapiens
agtcatttttacaatgtaatta

SEQ ID NO: 6650448 - DNA, 12 bp, Homo sapiens
agtcatttttgt

SEQ ID NO: 6650449 - DNA, 15 bp, Homo sapiens
agtcattttttactt

SEQ ID NO: 6650450 - DNA, 21 bp, Homo sapiens
agtccaaaaagctcctggggc

SEQ ID NO: 6650451 - DNA, 21 bp, Homo sapiens
agtccaaccagaaacacccct

SEQ ID NO: 6650452 - DNA, 13 bp, Homo sapiens
agtccaactacag

SEQ ID NO: 6650453 - DNA, 22 bp, Homo sapiens
agtccaactcttccacctctgg

SEQ ID NO: 6650454 - DNA, 11 bp, Homo sapiens
agtccaagcat

SEQ ID NO: 6650455 - DNA, 14 bp, Homo sapiens
agtccaagctggga

SEQ ID NO: 6650456 - DNA, 16 bp, Homo sapiens
agtccaagctgggaga

SEQ ID NO: 6650457 - DNA, 21 bp, Homo sapiens
agtccaaggaaaccacagctg

SEQ ID NO: 6650458 - DNA, 23 bp, Homo sapiens
agtccaaggaaaccacagctgct

SEQ ID NO: 6650459 - DNA, 17 bp, Homo sapiens
agtccaaggagaagaag

SEQ ID NO: 6650460 - DNA, 21 bp, Homo sapiens
agtccaaggggtcccctccag

SEQ ID NO: 6650461 - DNA, 11 bp, Homo sapiens
agtccaaggta

SEQ ID NO: 6650462 - DNA, 16 bp, Homo sapiens
agtccaaggtttaaag

SEQ ID NO: 6650463 - DNA, 13 bp, Homo sapiens
agtccaataagac

SEQ ID NO: 6650464 - DNA, 12 bp, Homo sapiens
agtccaatattt

SEQ ID NO: 6650465 - DNA, 13 bp, Homo sapiens
agtccaatatttg

SEQ ID NO: 6650466 - DNA, 21 bp, Homo sapiens
agtccaatcacccccaggacc

SEQ ID NO: 6650467 - DNA, 20 bp, Homo sapiens
agtccaatctcatggagaag

SEQ ID NO: 6650468 - DNA, 15 bp, Homo sapiens
agtccaatgaagata

SEQ ID NO: 6650469 - DNA, 14 bp, Homo sapiens
agtccaattttaat

SEQ ID NO: 6650470 - DNA, 16 bp, Homo sapiens
agtccaatttttactc

SEQ ID NO: 6650471 - DNA, 19 bp, Homo sapiens
agtccacacaaagattttc

SEQ ID NO: 6650472 - DNA, 22 bp, Homo sapiens
agtccacacaaagattttctaa

SEQ ID NO: 6650473 - DNA, 17 bp, Homo sapiens
agtccacaggggccacc

SEQ ID NO: 6650474 - DNA, 17 bp, Homo sapiens
agtccacatcttctcag

SEQ ID NO: 6650475 - DNA, 19 bp, Homo sapiens
agtccacccccattgtgaa

SEQ ID NO: 6650476 - DNA, 20 bp, Homo sapiens
agtccacccccattgtgaat

SEQ ID NO: 6650477 - DNA, 14 bp, Homo sapiens
agtccaccctgcct

SEQ ID NO: 6650478 - DNA, 20 bp, Homo sapiens
agtccaccctttggagacca

SEQ ID NO: 6650479 - DNA, 17 bp, Homo sapiens
agtccacctgagctgcc

SEQ ID NO: 6650480 - DNA, 22 bp, Homo sapiens
agtccacctgcctatccatcct

SEQ ID NO: 6650481 - DNA, 21 bp, Homo sapiens
agtccacgattctcaggtatt

SEQ ID NO: 6650482 - DNA, 19 bp, Homo sapiens
agtccacgcccaccagcct

SEQ ID NO: 6650483 - DNA, 15 bp, Homo sapiens
agtccactctgagtc

SEQ ID NO: 6650484 - DNA, 14 bp, Homo sapiens
agtccactgctcca

SEQ ID NO: 6650485 - DNA, 13 bp, Homo sapiens
agtccactgggga

SEQ ID NO: 6650486 - DNA, 13 bp, Homo sapiens
agtccactgtcct

SEQ ID NO: 6650487 - DNA, 16 bp, Homo sapiens
agtccacttatgtaga

SEQ ID NO: 6650488 - DNA, 14 bp, Homo sapiens
agtccactttcctc

SEQ ID NO: 6650489 - DNA, 14 bp, Homo sapiens
agtccactttgttt

SEQ ID NO: 6650490 - DNA, 17 bp, Homo sapiens
agtccacttttaaaact

SEQ ID NO: 6650491 - DNA, 20 bp, Homo sapiens
agtccagaaactgttcccac

SEQ ID NO: 6650492 - DNA, 15 bp, Homo sapiens
agtccagaagcctcc

SEQ ID NO: 6650493 - DNA, 20 bp, Homo sapiens
agtccagaataagtgctgtt

SEQ ID NO: 6650494 - DNA, 11 bp, Homo sapiens
agtccagacac

SEQ ID NO: 6650495 - DNA, 23 bp, Homo sapiens
agtccagacagcttgactgcttt

SEQ ID NO: 6650496 - DNA, 18 bp, Homo sapiens
agtccagaccccccagcc

SEQ ID NO: 6650497 - DNA, 12 bp, Homo sapiens
agtccagagctt

SEQ ID NO: 6650498 - DNA, 22 bp, Homo sapiens
agtccagcaaataaagcagtca

SEQ ID NO: 6650499 - DNA, 16 bp, Homo sapiens
agtccagcagtttcca

SEQ ID NO: 6650500 - DNA, 19 bp, Homo sapiens
agtccagcccctcctccct

SEQ ID NO: 6650501 - DNA, 22 bp, Homo sapiens
agtccagcccctcctccctcag

SEQ ID NO: 6650502 - DNA, 23 bp, Homo sapiens
agtccagcccctcctccctcaga

SEQ ID NO: 6650503 - DNA, 15 bp, Homo sapiens
agtccagcctggaga

SEQ ID NO: 6650504 - DNA, 14 bp, Homo sapiens
agtccagctctact

SEQ ID NO: 6650505 - DNA, 13 bp, Homo sapiens
agtccagctctcc

SEQ ID NO: 6650506 - DNA, 18 bp, Homo sapiens
agtccagctctttagaat

SEQ ID NO: 6650507 - DNA, 13 bp, Homo sapiens
agtccagctttcc

SEQ ID NO: 6650508 - DNA, 23 bp, Homo sapiens
agtccagctttccttctgccctt

SEQ ID NO: 6650509 - DNA, 11 bp, Homo sapiens
agtccaggact

SEQ ID NO: 6650510 - DNA, 23 bp, Homo sapiens
agtccaggactgggtctgacctg

SEQ ID NO: 6650511 - DNA, 16 bp, Homo sapiens
agtccaggagccccag

SEQ ID NO: 6650512 - DNA, 19 bp, Homo sapiens
agtccaggagccccagcca

SEQ ID NO: 6650513 - DNA, 20 bp, Homo sapiens
agtccaggagccccagccag

SEQ ID NO: 6650514 - DNA, 22 bp, Homo sapiens
agtccaggagccccagccagcc

SEQ ID NO: 6650515 - DNA, 19 bp, Homo sapiens
agtccaggcacaggatgct

SEQ ID NO: 6650516 - DNA, 20 bp, Homo sapiens
agtccaggcctctctctgct

SEQ ID NO: 6650517 - DNA, 17 bp, Homo sapiens
agtccaggcctgggtca

SEQ ID NO: 6650518 - DNA, 22 bp, Homo sapiens
agtccagggctcccggagaggg

SEQ ID NO: 6650519 - DNA, 14 bp, Homo sapiens
agtccaggtcctgg

SEQ ID NO: 6650520 - DNA, 21 bp, Homo sapiens
agtccaggtcgggctcagctc

SEQ ID NO: 6650521 - DNA, 22 bp, Homo sapiens
agtccaggtcgggctcagctct

SEQ ID NO: 6650522 - DNA, 23 bp, Homo sapiens
agtccaggtcgggctcagctctg

SEQ ID NO: 6650523 - DNA, 17 bp, Homo sapiens
agtccagtccagtccta

SEQ ID NO: 6650524 - DNA, 17 bp, Homo sapiens
agtccagtcctatctgg

SEQ ID NO: 6650525 - DNA, 21 bp, Homo sapiens
agtccagtcctatctgggctt

SEQ ID NO: 6650526 - DNA, 17 bp, Homo sapiens
agtccagtgaccctgga

SEQ ID NO: 6650527 - DNA, 17 bp, Homo sapiens
agtccagtgtcacctct

SEQ ID NO: 6650528 - DNA, 22 bp, Homo sapiens
agtccagtgtcacctctctcag

SEQ ID NO: 6650529 - DNA, 24 bp, Homo sapiens
agtccagtgtcacctctctcagag

SEQ ID NO: 6650530 - DNA, 15 bp, Homo sapiens
agtccagtgtttcca

SEQ ID NO: 6650531 - DNA, 18 bp, Homo sapiens
agtccatagctgagctgg

SEQ ID NO: 6650532 - DNA, 19 bp, Homo sapiens
agtccatagctgagctgga

SEQ ID NO: 6650533 - DNA, 21 bp, Homo sapiens
agtccatatttcaatttccaa

SEQ ID NO: 6650534 - DNA, 16 bp, Homo sapiens
agtccatgaaaatacc

SEQ ID NO: 6650535 - DNA, 20 bp, Homo sapiens
agtccatgcatgacagcctc

SEQ ID NO: 6650536 - DNA, 21 bp, Homo sapiens
agtccatgcatgacagcctct

SEQ ID NO: 6650537 - DNA, 13 bp, Homo sapiens
agtccatgctcca

SEQ ID NO: 6650538 - DNA, 15 bp, Homo sapiens
agtccatgctccagg

SEQ ID NO: 6650539 - DNA, 16 bp, Homo sapiens
agtccatgtcctatgc

SEQ ID NO: 6650540 - DNA, 18 bp, Homo sapiens
agtccatgtcctatgcct

SEQ ID NO: 6650541 - DNA, 19 bp, Homo sapiens
agtccatgttattctctca

SEQ ID NO: 6650542 - DNA, 22 bp, Homo sapiens
agtccattaactgctttccacc

SEQ ID NO: 6650543 - DNA, 17 bp, Homo sapiens
agtccattctcccaggt

SEQ ID NO: 6650544 - DNA, 20 bp, Homo sapiens
agtccatttatatatgaaaa

SEQ ID NO: 6650545 - DNA, 21 bp, Homo sapiens
agtccatttcccacatctttc

SEQ ID NO: 6650546 - DNA, 19 bp, Homo sapiens
agtccatttcctaatgtat

SEQ ID NO: 6650547 - DNA, 18 bp, Homo sapiens
agtccatttttgagtaaa

SEQ ID NO: 6650548 - DNA, 19 bp, Homo sapiens
agtccattttttaaaaatg

SEQ ID NO: 6650549 - DNA, 19 bp, Homo sapiens
agtcccaaaacccttacag

SEQ ID NO: 6650550 - DNA, 17 bp, Homo sapiens
agtcccaaccccagcta

SEQ ID NO: 6650551 - DNA, 22 bp, Homo sapiens
agtcccaatttaagagtcctga

SEQ ID NO: 6650552 - DNA, 21 bp, Homo sapiens
agtcccacaccgctggtccct

SEQ ID NO: 6650553 - DNA, 21 bp, Homo sapiens
agtcccacactgtggccaggc

SEQ ID NO: 6650554 - DNA, 14 bp, Homo sapiens
agtcccacccggac

SEQ ID NO: 6650555 - DNA, 19 bp, Homo sapiens
agtcccaccctgctgctgc

SEQ ID NO: 6650556 - DNA, 23 bp, Homo sapiens
agtcccaccggttgcttctggga

SEQ ID NO: 6650557 - DNA, 20 bp, Homo sapiens
agtcccaccttggagcattt

SEQ ID NO: 6650558 - DNA, 15 bp, Homo sapiens
agtcccaccttggct

SEQ ID NO: 6650559 - DNA, 14 bp, Homo sapiens
agtcccacggctct

SEQ ID NO: 6650560 - DNA, 16 bp, Homo sapiens
agtcccacggctctgt

SEQ ID NO: 6650561 - DNA, 14 bp, Homo sapiens
agtcccactgcacc

SEQ ID NO: 6650562 - DNA, 22 bp, Homo sapiens
agtcccactgcacccccctgtg

SEQ ID NO: 6650563 - DNA, 17 bp, Homo sapiens
agtcccagacaaggaga

SEQ ID NO: 6650564 - DNA, 12 bp, Homo sapiens
agtcccagagca

SEQ ID NO: 6650565 - DNA, 12 bp, Homo sapiens
agtcccagagct

SEQ ID NO: 6650566 - DNA, 15 bp, Homo sapiens
agtcccagagctgca

SEQ ID NO: 6650567 - DNA, 14 bp, Homo sapiens
agtcccagcacatt

SEQ ID NO: 6650568 - DNA, 14 bp, Homo sapiens
agtcccagcagcca

SEQ ID NO: 6650569 - DNA, 15 bp, Homo sapiens
agtcccagcctctgg

SEQ ID NO: 6650570 - DNA, 18 bp, Homo sapiens
agtcccagcctctggggc

SEQ ID NO: 6650571 - DNA, 11 bp, Homo sapiens
agtcccagcta

SEQ ID NO: 6650572 - DNA, 19 bp, Homo sapiens
agtcccagctactcaggag

SEQ ID NO: 6650573 - DNA, 19 bp, Homo sapiens
agtcccagctactcgggag

SEQ ID NO: 6650574 - DNA, 20 bp, Homo sapiens
agtcccagctacttgggagc

SEQ ID NO: 6650575 - DNA, 23 bp, Homo sapiens
agtcccagctacttgggagcctg

SEQ ID NO: 6650576 - DNA, 13 bp, Homo sapiens
agtcccaggggca

SEQ ID NO: 6650577 - DNA, 20 bp, Homo sapiens
agtcccaggggcagccacac

SEQ ID NO: 6650578 - DNA, 21 bp, Homo sapiens
agtcccaggttggctctgcca

SEQ ID NO: 6650579 - DNA, 22 bp, Homo sapiens
agtcccaggttggctctgccag

SEQ ID NO: 6650580 - DNA, 17 bp, Homo sapiens
agtcccagtattctcag

SEQ ID NO: 6650581 - DNA, 22 bp, Homo sapiens
agtcccagtattctcagagcat

SEQ ID NO: 6650582 - DNA, 15 bp, Homo sapiens
agtcccagtgggagg

SEQ ID NO: 6650583 - DNA, 22 bp, Homo sapiens
agtcccagttaagtgaagccta

SEQ ID NO: 6650584 - DNA, 20 bp, Homo sapiens
agtcccatgaatacacaact

SEQ ID NO: 6650585 - DNA, 21 bp, Homo sapiens
agtcccattcatattaagaca

SEQ ID NO: 6650586 - DNA, 18 bp, Homo sapiens
agtccccaacctgcactc

SEQ ID NO: 6650587 - DNA, 19 bp, Homo sapiens
agtccccaaggcctctctc

SEQ ID NO: 6650588 - DNA, 13 bp, Homo sapiens
agtccccacccct

SEQ ID NO: 6650589 - DNA, 15 bp, Homo sapiens
agtccccacccctgc

SEQ ID NO: 6650590 - DNA, 18 bp, Homo sapiens
agtccccacccctgcccc

SEQ ID NO: 6650591 - DNA, 13 bp, Homo sapiens
agtccccacccgc

SEQ ID NO: 6650592 - DNA, 14 bp, Homo sapiens
agtccccagaactc

SEQ ID NO: 6650593 - DNA, 16 bp, Homo sapiens
agtccccagaagcaga

SEQ ID NO: 6650594 - DNA, 18 bp, Homo sapiens
agtccccagactctgcct

SEQ ID NO: 6650595 - DNA, 19 bp, Homo sapiens
agtccccagactctgccta

SEQ ID NO: 6650596 - DNA, 16 bp, Homo sapiens
agtccccagagctccc

SEQ ID NO: 6650597 - DNA, 18 bp, Homo sapiens
agtccccagagctccccc

SEQ ID NO: 6650598 - DNA, 12 bp, Homo sapiens
agtccccagccc

SEQ ID NO: 6650599 - DNA, 14 bp, Homo sapiens
agtccccagcccct

SEQ ID NO: 6650600 - DNA, 19 bp, Homo sapiens
agtccccagcccctcaacc

SEQ ID NO: 6650601 - DNA, 15 bp, Homo sapiens
agtccccagccctgg

SEQ ID NO: 6650602 - DNA, 14 bp, Homo sapiens
agtccccagccctt

SEQ ID NO: 6650603 - DNA, 23 bp, Homo sapiens
agtccccagcccttcacattttt

SEQ ID NO: 6650604 - DNA, 16 bp, Homo sapiens
agtccccaggccccag

SEQ ID NO: 6650605 - DNA, 17 bp, Homo sapiens
agtccccaggccccagg

SEQ ID NO: 6650606 - DNA, 16 bp, Homo sapiens
agtccccaggtcatgc

SEQ ID NO: 6650607 - DNA, 13 bp, Homo sapiens
agtccccatccca

SEQ ID NO: 6650608 - DNA, 21 bp, Homo sapiens
agtccccatgattccctcctc

SEQ ID NO: 6650609 - DNA, 21 bp, Homo sapiens
agtcccccaaagggcctcctc

SEQ ID NO: 6650610 - DNA, 23 bp, Homo sapiens
agtcccccaaagggcctcctcac

SEQ ID NO: 6650611 - DNA, 15 bp, Homo sapiens
agtcccccaacccca

SEQ ID NO: 6650612 - DNA, 18 bp, Homo sapiens
agtcccccaactctgagc

SEQ ID NO: 6650613 - DNA, 19 bp, Homo sapiens
agtcccccaactctgagcc

SEQ ID NO: 6650614 - DNA, 22 bp, Homo sapiens
agtcccccaactctgagcccat

SEQ ID NO: 6650615 - DNA, 15 bp, Homo sapiens
agtcccccacccacc

SEQ ID NO: 6650616 - DNA, 20 bp, Homo sapiens
agtcccccacccacctcctg

SEQ ID NO: 6650617 - DNA, 13 bp, Homo sapiens
agtccccccaccc

SEQ ID NO: 6650618 - DNA, 15 bp, Homo sapiens
agtccccccacccct

SEQ ID NO: 6650619 - DNA, 18 bp, Homo sapiens
agtccccctcctcagcca

SEQ ID NO: 6650620 - DNA, 21 bp, Homo sapiens
agtccccgagggcgaaggcca

SEQ ID NO: 6650621 - DNA, 23 bp, Homo sapiens
agtccccgagggcgaaggccatt

SEQ ID NO: 6650622 - DNA, 19 bp, Homo sapiens
agtccccgggcatctttgg

SEQ ID NO: 6650623 - DNA, 23 bp, Homo sapiens
agtccccgtgccccgcctccccg

SEQ ID NO: 6650624 - DNA, 22 bp, Homo sapiens
agtccccgtggccatccctgtg

SEQ ID NO: 6650625 - DNA, 20 bp, Homo sapiens
agtccccgtgtgccccaaga

SEQ ID NO: 6650626 - DNA, 13 bp, Homo sapiens
agtcccctccagg

SEQ ID NO: 6650627 - DNA, 15 bp, Homo sapiens
agtcccctccaggaa

SEQ ID NO: 6650628 - DNA, 16 bp, Homo sapiens
agtcccctcccatctg

SEQ ID NO: 6650629 - DNA, 19 bp, Homo sapiens
agtcccctccccggcccta

SEQ ID NO: 6650630 - DNA, 12 bp, Homo sapiens
agtcccctcctc

SEQ ID NO: 6650631 - DNA, 16 bp, Homo sapiens
agtcccctctcctcca

SEQ ID NO: 6650632 - DNA, 22 bp, Homo sapiens
agtcccctctcctccacatttg

SEQ ID NO: 6650633 - DNA, 15 bp, Homo sapiens
agtcccctctctctg

SEQ ID NO: 6650634 - DNA, 16 bp, Homo sapiens
agtcccctctctctgg

SEQ ID NO: 6650635 - DNA, 13 bp, Homo sapiens
agtcccctgggcc

SEQ ID NO: 6650636 - DNA, 14 bp, Homo sapiens
agtcccctgggcct

SEQ ID NO: 6650637 - DNA, 12 bp, Homo sapiens
agtcccctgttg

SEQ ID NO: 6650638 - DNA, 16 bp, Homo sapiens
agtcccgaaatttgga

SEQ ID NO: 6650639 - DNA, 18 bp, Homo sapiens
agtcccgaggcagcaaca

SEQ ID NO: 6650640 - DNA, 22 bp, Homo sapiens
agtcccggcgtttacctcgtgg

SEQ ID NO: 6650641 - DNA, 20 bp, Homo sapiens
agtcccgtcgtgcagtcagg

SEQ ID NO: 6650642 - DNA, 15 bp, Homo sapiens
agtcccgtggagggt

SEQ ID NO: 6650643 - DNA, 22 bp, Homo sapiens
agtcccgtggggccccggctcc

SEQ ID NO: 6650644 - DNA, 19 bp, Homo sapiens
agtccctaggagggaagga

SEQ ID NO: 6650645 - DNA, 19 bp, Homo sapiens
agtccctataataaaggct

SEQ ID NO: 6650646 - DNA, 20 bp, Homo sapiens
agtccctatgtatttgcagt

SEQ ID NO: 6650647 - DNA, 21 bp, Homo sapiens
agtccctcacgtttcttcccc

SEQ ID NO: 6650648 - DNA, 10 bp, Homo sapiens
agtccctccc

SEQ ID NO: 6650649 - DNA, 16 bp, Homo sapiens
agtccctccctcctgg

SEQ ID NO: 6650650 - DNA, 17 bp, Homo sapiens
agtccctccctcctggc

SEQ ID NO: 6650651 - DNA, 15 bp, Homo sapiens
agtccctccctgcct

SEQ ID NO: 6650652 - DNA, 22 bp, Homo sapiens
agtccctcgccgtccctcccag

SEQ ID NO: 6650653 - DNA, 23 bp, Homo sapiens
agtccctcgccgtccctcccagg

SEQ ID NO: 6650654 - DNA, 12 bp, Homo sapiens
agtccctcttct

SEQ ID NO: 6650655 - DNA, 18 bp, Homo sapiens
agtccctgagaagcctca

SEQ ID NO: 6650656 - DNA, 23 bp, Homo sapiens
agtccctgagaagcctcatggga

SEQ ID NO: 6650657 - DNA, 13 bp, Homo sapiens
agtccctgccaat

SEQ ID NO: 6650658 - DNA, 14 bp, Homo sapiens
agtccctgccaatg

SEQ ID NO: 6650659 - DNA, 13 bp, Homo sapiens
agtccctgcctgg

SEQ ID NO: 6650660 - DNA, 21 bp, Homo sapiens
agtccctgcctggaccagcct

SEQ ID NO: 6650661 - DNA, 15 bp, Homo sapiens
agtccctgctgggga

SEQ ID NO: 6650662 - DNA, 14 bp, Homo sapiens
agtccctgtcacct

SEQ ID NO: 6650663 - DNA, 23 bp, Homo sapiens
agtccctgtcatttgaacctgga

SEQ ID NO: 6650664 - DNA, 18 bp, Homo sapiens
agtccctgttctcagctc

SEQ ID NO: 6650665 - DNA, 20 bp, Homo sapiens
agtccctgttttctgagccc

SEQ ID NO: 6650666 - DNA, 22 bp, Homo sapiens
agtccctgttttctgagcccgg

SEQ ID NO: 6650667 - DNA, 21 bp, Homo sapiens
agtcccttccagtcatgtgtg

SEQ ID NO: 6650668 - DNA, 13 bp, Homo sapiens
agtcccttcctgc

SEQ ID NO: 6650669 - DNA, 18 bp, Homo sapiens
agtcccttcctgcttcct

SEQ ID NO: 6650670 - DNA, 20 bp, Homo sapiens
agtcccttcctgcttcctgt

SEQ ID NO: 6650671 - DNA, 17 bp, Homo sapiens
agtcccttcctgtcctg

SEQ ID NO: 6650672 - DNA, 22 bp, Homo sapiens
agtcccttcctgtcctgctcac

SEQ ID NO: 6650673 - DNA, 16 bp, Homo sapiens
agtcccttctctcttt

SEQ ID NO: 6650674 - DNA, 18 bp, Homo sapiens
agtcccttctctctttct

SEQ ID NO: 6650675 - DNA, 15 bp, Homo sapiens
agtcccttgttttgt

SEQ ID NO: 6650676 - DNA, 13 bp, Homo sapiens
agtccctttaaag

SEQ ID NO: 6650677 - DNA, 14 bp, Homo sapiens
agtcccttttcatt

SEQ ID NO: 6650678 - DNA, 23 bp, Homo sapiens
agtccgaaagggacttggaagct

SEQ ID NO: 6650679 - DNA, 20 bp, Homo sapiens
agtccgacctggcctgtctg

SEQ ID NO: 6650680 - DNA, 16 bp, Homo sapiens
agtccgcccatccctg

SEQ ID NO: 6650681 - DNA, 20 bp, Homo sapiens
agtccgcccatccctgacca

SEQ ID NO: 6650682 - DNA, 21 bp, Homo sapiens
agtccgccccgtgctcctctg

SEQ ID NO: 6650683 - DNA, 22 bp, Homo sapiens
agtccgccccgtgctcctctgc

SEQ ID NO: 6650684 - DNA, 23 bp, Homo sapiens
agtccgccccgtgctcctctgcc

SEQ ID NO: 6650685 - DNA, 19 bp, Homo sapiens
agtccgcctggccggctcc

SEQ ID NO: 6650686 - DNA, 17 bp, Homo sapiens
agtccggtgccttccac

SEQ ID NO: 6650687 - DNA, 22 bp, Homo sapiens
agtccggtgccttccaccctgc

SEQ ID NO: 6650688 - DNA, 20 bp, Homo sapiens
agtcctaaaagttctcaatg

SEQ ID NO: 6650689 - DNA, 22 bp, Homo sapiens
agtcctaaaagttctcaatgta

SEQ ID NO: 6650690 - DNA, 19 bp, Homo sapiens
agtcctaacttcctgtgcc

SEQ ID NO: 6650691 - DNA, 23 bp, Homo sapiens
agtcctaatgtgctgtgtgacat

SEQ ID NO: 6650692 - DNA, 22 bp, Homo sapiens
agtcctactttacatatgcttt

SEQ ID NO: 6650693 - DNA, 13 bp, Homo sapiens
agtcctagagctc

SEQ ID NO: 6650694 - DNA, 14 bp, Homo sapiens
agtcctagcccctc

SEQ ID NO: 6650695 - DNA, 13 bp, Homo sapiens
agtcctagctgca

SEQ ID NO: 6650696 - DNA, 15 bp, Homo sapiens
agtcctagctgcaca

SEQ ID NO: 6650697 - DNA, 21 bp, Homo sapiens
agtcctagctgcacagggcag

SEQ ID NO: 6650698 - DNA, 23 bp, Homo sapiens
agtcctaggcccctgccctgtag

SEQ ID NO: 6650699 - DNA, 15 bp, Homo sapiens
agtcctatctgggct

SEQ ID NO: 6650700 - DNA, 16 bp, Homo sapiens
agtcctatctgggctt

SEQ ID NO: 6650701 - DNA, 20 bp, Homo sapiens
agtcctatctgggcttcctg

SEQ ID NO: 6650702 - DNA, 14 bp, Homo sapiens
agtcctatggaaac

SEQ ID NO: 6650703 - DNA, 15 bp, Homo sapiens
agtcctatggaaacc

SEQ ID NO: 6650704 - DNA, 22 bp, Homo sapiens
agtcctatgtacagagctttct

SEQ ID NO: 6650705 - DNA, 16 bp, Homo sapiens
agtcctattctattgc

SEQ ID NO: 6650706 - DNA, 22 bp, Homo sapiens
agtcctcaaagcacctgaacca

SEQ ID NO: 6650707 - DNA, 17 bp, Homo sapiens
agtcctcaaagcttttt

SEQ ID NO: 6650708 - DNA, 14 bp, Homo sapiens
agtcctcacagcct

SEQ ID NO: 6650709 - DNA, 21 bp, Homo sapiens
agtcctcacagcctctccctt

SEQ ID NO: 6650710 - DNA, 18 bp, Homo sapiens
agtcctcactcttcaagg

SEQ ID NO: 6650711 - DNA, 13 bp, Homo sapiens
agtcctcaggcag

SEQ ID NO: 6650712 - DNA, 11 bp, Homo sapiens
agtcctcaggt

SEQ ID NO: 6650713 - DNA, 22 bp, Homo sapiens
agtcctcaggtacagcgggctg

SEQ ID NO: 6650714 - DNA, 14 bp, Homo sapiens
agtcctcattataa

SEQ ID NO: 6650715 - DNA, 17 bp, Homo sapiens
agtcctcattgaatcct

SEQ ID NO: 6650716 - DNA, 16 bp, Homo sapiens
agtcctccaaaacaca

SEQ ID NO: 6650717 - DNA, 16 bp, Homo sapiens
agtcctccactcgacc

SEQ ID NO: 6650718 - DNA, 13 bp, Homo sapiens
agtcctccatcca

SEQ ID NO: 6650719 - DNA, 15 bp, Homo sapiens
agtcctcccaagctg

SEQ ID NO: 6650720 - DNA, 21 bp, Homo sapiens
agtcctcccaagctgtgctgg

SEQ ID NO: 6650721 - DNA, 22 bp, Homo sapiens
agtcctcccaagctgtgctggg

SEQ ID NO: 6650722 - DNA, 22 bp, Homo sapiens
agtcctcccaccttggcctccc

SEQ ID NO: 6650723 - DNA, 14 bp, Homo sapiens
agtcctcccctcac

SEQ ID NO: 6650724 - DNA, 22 bp, Homo sapiens
agtcctcccctcacagcctctg

SEQ ID NO: 6650725 - DNA, 15 bp, Homo sapiens
agtcctccctagctc

SEQ ID NO: 6650726 - DNA, 14 bp, Homo sapiens
agtcctccctcctg

SEQ ID NO: 6650727 - DNA, 14 bp, Homo sapiens
agtcctccctgctc

SEQ ID NO: 6650728 - DNA, 18 bp, Homo sapiens
agtcctccctgctcagct

SEQ ID NO: 6650729 - DNA, 19 bp, Homo sapiens
agtcctccggttgcatact

SEQ ID NO: 6650730 - DNA, 15 bp, Homo sapiens
agtcctcctagaact

SEQ ID NO: 6650731 - DNA, 17 bp, Homo sapiens
agtcctcctagaactcc

SEQ ID NO: 6650732 - DNA, 15 bp, Homo sapiens
agtcctcctgggagc

SEQ ID NO: 6650733 - DNA, 13 bp, Homo sapiens
agtcctccttccc

SEQ ID NO: 6650734 - DNA, 16 bp, Homo sapiens
agtcctccttcccagc

SEQ ID NO: 6650735 - DNA, 20 bp, Homo sapiens
agtcctccttcccagctcta

SEQ ID NO: 6650736 - DNA, 15 bp, Homo sapiens
agtcctcggcagctc

SEQ ID NO: 6650737 - DNA, 19 bp, Homo sapiens
agtcctctccacctagtgg

SEQ ID NO: 6650738 - DNA, 14 bp, Homo sapiens
agtcctctccagag

SEQ ID NO: 6650739 - DNA, 12 bp, Homo sapiens
agtcctctgaat

SEQ ID NO: 6650740 - DNA, 12 bp, Homo sapiens
agtcctctgcct

SEQ ID NO: 6650741 - DNA, 12 bp, Homo sapiens
agtcctctgctc

SEQ ID NO: 6650742 - DNA, 15 bp, Homo sapiens
agtcctctgctccag

SEQ ID NO: 6650743 - DNA, 17 bp, Homo sapiens
agtcctctgctccagca

SEQ ID NO: 6650744 - DNA, 14 bp, Homo sapiens
agtcctgaagaggc

SEQ ID NO: 6650745 - DNA, 13 bp, Homo sapiens
agtcctgaagcag

SEQ ID NO: 6650746 - DNA, 18 bp, Homo sapiens
agtcctgacactgaattt

SEQ ID NO: 6650747 - DNA, 17 bp, Homo sapiens
agtcctgactgggctgg

SEQ ID NO: 6650748 - DNA, 20 bp, Homo sapiens
agtcctgaggcagaacctgg

SEQ ID NO: 6650749 - DNA, 19 bp, Homo sapiens
agtcctgagtgtggacttg

SEQ ID NO: 6650750 - DNA, 20 bp, Homo sapiens
agtcctgccgacggagccac

SEQ ID NO: 6650751 - DNA, 10 bp, Homo sapiens
agtcctgcct

SEQ ID NO: 6650752 - DNA, 21 bp, Homo sapiens
agtcctgcctgaacagccctc

SEQ ID NO: 6650753 - DNA, 14 bp, Homo sapiens
agtcctgcctttgg

SEQ ID NO: 6650754 - DNA, 14 bp, Homo sapiens
agtcctgctccaga

SEQ ID NO: 6650755 - DNA, 18 bp, Homo sapiens
agtcctgctccagaattt

SEQ ID NO: 6650756 - DNA, 22 bp, Homo sapiens
agtcctgctcctttctgcccag

SEQ ID NO: 6650757 - DNA, 23 bp, Homo sapiens
agtcctgctcctttctgcccagc

SEQ ID NO: 6650758 - DNA, 13 bp, Homo sapiens
agtcctgctgcct

SEQ ID NO: 6650759 - DNA, 21 bp, Homo sapiens
agtcctgctgcctggagtcag

SEQ ID NO: 6650760 - DNA, 22 bp, Homo sapiens
agtcctgctgcctggagtcagt

SEQ ID NO: 6650761 - DNA, 15 bp, Homo sapiens
agtcctgctggatct

SEQ ID NO: 6650762 - DNA, 17 bp, Homo sapiens
agtcctgctggcctgct

SEQ ID NO: 6650763 - DNA, 18 bp, Homo sapiens
agtcctgctggcctgctc

SEQ ID NO: 6650764 - DNA, 20 bp, Homo sapiens
agtcctggaagccagctttc

SEQ ID NO: 6650765 - DNA, 22 bp, Homo sapiens
agtcctggatgatactaataaa

SEQ ID NO: 6650766 - DNA, 17 bp, Homo sapiens
agtcctggatgttgtgt

SEQ ID NO: 6650767 - DNA, 23 bp, Homo sapiens
agtcctggcacagtttttgtaaa

SEQ ID NO: 6650768 - DNA, 14 bp, Homo sapiens
agtcctggcagctg

SEQ ID NO: 6650769 - DNA, 22 bp, Homo sapiens
agtcctggcatgggaatgaatg

SEQ ID NO: 6650770 - DNA, 11 bp, Homo sapiens
agtcctggcca

SEQ ID NO: 6650771 - DNA, 15 bp, Homo sapiens
agtcctggccccctc

SEQ ID NO: 6650772 - DNA, 13 bp, Homo sapiens
agtcctggcctgg

SEQ ID NO: 6650773 - DNA, 22 bp, Homo sapiens
agtcctgggagaacctcaggct

SEQ ID NO: 6650774 - DNA, 16 bp, Homo sapiens
agtcctgggagaccca

SEQ ID NO: 6650775 - DNA, 15 bp, Homo sapiens
agtcctgggatgtgg

SEQ ID NO: 6650776 - DNA, 19 bp, Homo sapiens
agtcctgggattacaggtg

SEQ ID NO: 6650777 - DNA, 19 bp, Homo sapiens
agtcctgggccccctggga

SEQ ID NO: 6650778 - DNA, 23 bp, Homo sapiens
agtcctgggccccctgggagagt

SEQ ID NO: 6650779 - DNA, 18 bp, Homo sapiens
agtcctgggttgtttcca

SEQ ID NO: 6650780 - DNA, 22 bp, Homo sapiens
agtcctgggttgtttccaggag

SEQ ID NO: 6650781 - DNA, 17 bp, Homo sapiens
agtcctggtccctctga

SEQ ID NO: 6650782 - DNA, 19 bp, Homo sapiens
agtcctggtccctctgagg

SEQ ID NO: 6650783 - DNA, 20 bp, Homo sapiens
agtcctggtccctctgaggc

SEQ ID NO: 6650784 - DNA, 12 bp, Homo sapiens
agtcctggtcct

SEQ ID NO: 6650785 - DNA, 19 bp, Homo sapiens
agtcctggtctgctcagga

SEQ ID NO: 6650786 - DNA, 16 bp, Homo sapiens
agtcctggtggggctg

SEQ ID NO: 6650787 - DNA, 21 bp, Homo sapiens
agtcctggtggggctgagcct

SEQ ID NO: 6650788 - DNA, 19 bp, Homo sapiens
agtcctggttgtctgaacc

SEQ ID NO: 6650789 - DNA, 14 bp, Homo sapiens
agtcctgtactgta

SEQ ID NO: 6650790 - DNA, 21 bp, Homo sapiens
agtcctgtagttttattttat

SEQ ID NO: 6650791 - DNA, 16 bp, Homo sapiens
agtcctgtatgtctgt

SEQ ID NO: 6650792 - DNA, 19 bp, Homo sapiens
agtcctgtatgtctgtcat

SEQ ID NO: 6650793 - DNA, 20 bp, Homo sapiens
agtcctgtatgtctgtcatt

SEQ ID NO: 6650794 - DNA, 23 bp, Homo sapiens
agtcctgtatgtctgtcattgta

SEQ ID NO: 6650795 - DNA, 16 bp, Homo sapiens
agtcctgtcactgagc

SEQ ID NO: 6650796 - DNA, 18 bp, Homo sapiens
agtcctgtcagttcagaa

SEQ ID NO: 6650797 - DNA, 18 bp, Homo sapiens
agtcctgtgaatgccact

SEQ ID NO: 6650798 - DNA, 21 bp, Homo sapiens
agtcctgtgaatgccactgcc

SEQ ID NO: 6650799 - DNA, 13 bp, Homo sapiens
agtcctgttcaaa

SEQ ID NO: 6650800 - DNA, 22 bp, Homo sapiens
agtcctgttgaagacttcctct

SEQ ID NO: 6650801 - DNA, 17 bp, Homo sapiens
agtccttaaacagggca

SEQ ID NO: 6650802 - DNA, 21 bp, Homo sapiens
agtccttaagcagaggaattg

SEQ ID NO: 6650803 - DNA, 16 bp, Homo sapiens
agtccttaccagcaga

SEQ ID NO: 6650804 - DNA, 18 bp, Homo sapiens
agtccttaccagcagagc

SEQ ID NO: 6650805 - DNA, 15 bp, Homo sapiens
agtccttacctcggg

SEQ ID NO: 6650806 - DNA, 20 bp, Homo sapiens
agtccttacctcggggagag

SEQ ID NO: 6650807 - DNA, 18 bp, Homo sapiens
agtccttagaatgaggga

SEQ ID NO: 6650808 - DNA, 19 bp, Homo sapiens
agtccttagcctgggcctc

SEQ ID NO: 6650809 - DNA, 23 bp, Homo sapiens
agtccttagcctgggcctcctcc

SEQ ID NO: 6650810 - DNA, 19 bp, Homo sapiens
agtccttagtatcagtcat

SEQ ID NO: 6650811 - DNA, 23 bp, Homo sapiens
agtccttatgttaagccctggca

SEQ ID NO: 6650812 - DNA, 20 bp, Homo sapiens
agtccttattatcccagctt

SEQ ID NO: 6650813 - DNA, 24 bp, Homo sapiens
agtccttattatcccagcttgctg

SEQ ID NO: 6650814 - DNA, 19 bp, Homo sapiens
agtccttcagtgagcccct

SEQ ID NO: 6650815 - DNA, 22 bp, Homo sapiens
agtccttcagtgagcccctccc

SEQ ID NO: 6650816 - DNA, 15 bp, Homo sapiens
agtccttcctggcat

SEQ ID NO: 6650817 - DNA, 16 bp, Homo sapiens
agtccttcctggcatc

SEQ ID NO: 6650818 - DNA, 14 bp, Homo sapiens
agtccttgaaaata

SEQ ID NO: 6650819 - DNA, 16 bp, Homo sapiens
agtccttgaaaatatt

SEQ ID NO: 6650820 - DNA, 18 bp, Homo sapiens
agtccttgcaagaatcag

SEQ ID NO: 6650821 - DNA, 23 bp, Homo sapiens
agtccttgctgtgggatgtgcca

SEQ ID NO: 6650822 - DNA, 18 bp, Homo sapiens
agtcctttaattaagact

SEQ ID NO: 6650823 - DNA, 16 bp, Homo sapiens
agtcctttataagttg

SEQ ID NO: 6650824 - DNA, 16 bp, Homo sapiens
agtcctttcaattcca

SEQ ID NO: 6650825 - DNA, 15 bp, Homo sapiens
agtcctttctgcctt

SEQ ID NO: 6650826 - DNA, 21 bp, Homo sapiens
agtcctttctgccttggcctc

SEQ ID NO: 6650827 - DNA, 19 bp, Homo sapiens
agtcctttctgtgaagcta

SEQ ID NO: 6650828 - DNA, 14 bp, Homo sapiens
agtcctttcttttg

SEQ ID NO: 6650829 - DNA, 22 bp, Homo sapiens
agtcctttcttttgaaatgcca

SEQ ID NO: 6650830 - DNA, 18 bp, Homo sapiens
agtcctttgtctttcttt

SEQ ID NO: 6650831 - DNA, 22 bp, Homo sapiens
agtcctttgtctttctttgtca

SEQ ID NO: 6650832 - DNA, 23 bp, Homo sapiens
agtcctttgtctttctttgtcat

SEQ ID NO: 6650833 - DNA, 18 bp, Homo sapiens
agtcctttgttgctgttg

SEQ ID NO: 6650834 - DNA, 20 bp, Homo sapiens
agtcctttgttgctgttgct

SEQ ID NO: 6650835 - DNA, 14 bp, Homo sapiens
agtccttttgtaaa

SEQ ID NO: 6650836 - DNA, 19 bp, Homo sapiens
agtcctttttccaatgttt

SEQ ID NO: 6650837 - DNA, 21 bp, Homo sapiens
agtcctttttccaatgtttta

SEQ ID NO: 6650838 - DNA, 22 bp, Homo sapiens
agtcgaaccatggtgaactcca

SEQ ID NO: 6650839 - DNA, 18 bp, Homo sapiens
agtcgaattaatagcttt

SEQ ID NO: 6650840 - DNA, 21 bp, Homo sapiens
agtcgaattaatagcttttat

SEQ ID NO: 6650841 - DNA, 17 bp, Homo sapiens
agtcgacatactcattt

SEQ ID NO: 6650842 - DNA, 12 bp, Homo sapiens
agtcgaccccaa

SEQ ID NO: 6650843 - DNA, 17 bp, Homo sapiens
agtcgagagggctgttg

SEQ ID NO: 6650844 - DNA, 13 bp, Homo sapiens
agtcgagcactct

SEQ ID NO: 6650845 - DNA, 21 bp, Homo sapiens
agtcgagcactctaattagag

SEQ ID NO: 6650846 - DNA, 14 bp, Homo sapiens
agtcgaggctgcag

SEQ ID NO: 6650847 - DNA, 13 bp, Homo sapiens
agtcgatgctcaa

SEQ ID NO: 6650848 - DNA, 21 bp, Homo sapiens
agtcgattaacctgcatgcag

SEQ ID NO: 6650849 - DNA, 23 bp, Homo sapiens
agtcgattatttccagtgttcta

SEQ ID NO: 6650850 - DNA, 17 bp, Homo sapiens
agtcgcaggatccgctg

SEQ ID NO: 6650851 - DNA, 17 bp, Homo sapiens
agtcgccaggcaggagg

SEQ ID NO: 6650852 - DNA, 14 bp, Homo sapiens
agtcgcccctcaga

SEQ ID NO: 6650853 - DNA, 17 bp, Homo sapiens
agtcgcccctcagagca

SEQ ID NO: 6650854 - DNA, 19 bp, Homo sapiens
agtcgcccctcagagcatg

SEQ ID NO: 6650855 - DNA, 14 bp, Homo sapiens
agtcgccctctgtg

SEQ ID NO: 6650856 - DNA, 22 bp, Homo sapiens
agtcgccctctgtgcctaataa

SEQ ID NO: 6650857 - DNA, 21 bp, Homo sapiens
agtcgcctttcagcaggcagc

SEQ ID NO: 6650858 - DNA, 22 bp, Homo sapiens
agtcgcctttcagcaggcagcc

SEQ ID NO: 6650859 - DNA, 20 bp, Homo sapiens
agtcgcgagcacatgttcat

SEQ ID NO: 6650860 - DNA, 13 bp, Homo sapiens
agtcgcgctgcct

SEQ ID NO: 6650861 - DNA, 18 bp, Homo sapiens
agtcgcgctgcctgtgtg

SEQ ID NO: 6650862 - DNA, 21 bp, Homo sapiens
agtcgctctcatgaagccctt

SEQ ID NO: 6650863 - DNA, 19 bp, Homo sapiens
agtcgctgtggttgtttta

SEQ ID NO: 6650864 - DNA, 13 bp, Homo sapiens
agtcgcttgccaa

SEQ ID NO: 6650865 - DNA, 14 bp, Homo sapiens
agtcgcttgccaaa

SEQ ID NO: 6650866 - DNA, 18 bp, Homo sapiens
agtcgcttttggtgcctg

SEQ ID NO: 6650867 - DNA, 12 bp, Homo sapiens
agtcggaaaagc

SEQ ID NO: 6650868 - DNA, 15 bp, Homo sapiens
agtcggaacagcaga

SEQ ID NO: 6650869 - DNA, 20 bp, Homo sapiens
agtcggaacggagaaaggtg

SEQ ID NO: 6650870 - DNA, 16 bp, Homo sapiens
agtcggagtggacacc

SEQ ID NO: 6650871 - DNA, 23 bp, Homo sapiens
agtcggagtggacaccgctcagt

SEQ ID NO: 6650872 - DNA, 18 bp, Homo sapiens
agtcggcatgccaggacc

SEQ ID NO: 6650873 - DNA, 13 bp, Homo sapiens
agtcggccaggta

SEQ ID NO: 6650874 - DNA, 14 bp, Homo sapiens
agtcggctgggcag

SEQ ID NO: 6650875 - DNA, 15 bp, Homo sapiens
agtcggctgggcagg

SEQ ID NO: 6650876 - DNA, 17 bp, Homo sapiens
agtcgggaaattctgct

SEQ ID NO: 6650877 - DNA, 12 bp, Homo sapiens
agtcgggaggag

SEQ ID NO: 6650878 - DNA, 18 bp, Homo sapiens
agtcgggatgtcagcaga

SEQ ID NO: 6650879 - DNA, 20 bp, Homo sapiens
agtcgggcatgagtctgttt

SEQ ID NO: 6650880 - DNA, 16 bp, Homo sapiens
agtcgggtgccaggac

SEQ ID NO: 6650881 - DNA, 17 bp, Homo sapiens
agtcgggtgccaggaca

SEQ ID NO: 6650882 - DNA, 14 bp, Homo sapiens
agtcggtcctcttt

SEQ ID NO: 6650883 - DNA, 16 bp, Homo sapiens
agtcggtctgctttgg

SEQ ID NO: 6650884 - DNA, 15 bp, Homo sapiens
agtcggttcccacgg

SEQ ID NO: 6650885 - DNA, 13 bp, Homo sapiens
agtcgtcaagttg

SEQ ID NO: 6650886 - DNA, 15 bp, Homo sapiens
agtcgtcagcctccc

SEQ ID NO: 6650887 - DNA, 16 bp, Homo sapiens
agtcgtcagcctccct

SEQ ID NO: 6650888 - DNA, 17 bp, Homo sapiens
agtcgtcagcctccctg

SEQ ID NO: 6650889 - DNA, 21 bp, Homo sapiens
agtcgtccttactcctgtggg

SEQ ID NO: 6650890 - DNA, 17 bp, Homo sapiens
agtcgtgacctgctagg

SEQ ID NO: 6650891 - DNA, 18 bp, Homo sapiens
agtcgtgagctcttgtga

SEQ ID NO: 6650892 - DNA, 21 bp, Homo sapiens
agtcgtgagctcttgtgagga

SEQ ID NO: 6650893 - DNA, 15 bp, Homo sapiens
agtcgtgcactttct

SEQ ID NO: 6650894 - DNA, 13 bp, Homo sapiens
agtcgtgcctgtg

SEQ ID NO: 6650895 - DNA, 19 bp, Homo sapiens
agtcgtggagatgtcttcg

SEQ ID NO: 6650896 - DNA, 21 bp, Homo sapiens
agtcgtggagatgtcttcgta

SEQ ID NO: 6650897 - DNA, 17 bp, Homo sapiens
agtcgtggggtgtgctg

SEQ ID NO: 6650898 - DNA, 15 bp, Homo sapiens
agtcgttatttctgt

SEQ ID NO: 6650899 - DNA, 20 bp, Homo sapiens
agtcgttggcaccttcaata

SEQ ID NO: 6650900 - DNA, 14 bp, Homo sapiens
agtcgttgtgaggg

SEQ ID NO: 6650901 - DNA, 18 bp, Homo sapiens
agtctaaaaattgataga

SEQ ID NO: 6650902 - DNA, 14 bp, Homo sapiens
agtctaaacaaaat

SEQ ID NO: 6650903 - DNA, 14 bp, Homo sapiens
agtctaaacaatga

SEQ ID NO: 6650904 - DNA, 22 bp, Homo sapiens
agtctaaagatggagtttctaa

SEQ ID NO: 6650905 - DNA, 12 bp, Homo sapiens
agtctaaagttt

SEQ ID NO: 6650906 - DNA, 14 bp, Homo sapiens
agtctaaagtttac

SEQ ID NO: 6650907 - DNA, 20 bp, Homo sapiens
agtctaaagtttacagtaaa

SEQ ID NO: 6650908 - DNA, 13 bp, Homo sapiens
agtctaacagttt

SEQ ID NO: 6650909 - DNA, 20 bp, Homo sapiens
agtctaacagtttgcctgct

SEQ ID NO: 6650910 - DNA, 17 bp, Homo sapiens
agtctaaccaaatgcat

SEQ ID NO: 6650911 - DNA, 20 bp, Homo sapiens
agtctaaccaaatgcatcaa

SEQ ID NO: 6650912 - DNA, 14 bp, Homo sapiens
agtctaagcaagat

SEQ ID NO: 6650913 - DNA, 19 bp, Homo sapiens
agtctaagcaagatgtttt

SEQ ID NO: 6650914 - DNA, 18 bp, Homo sapiens
agtctaaggccatggcat

SEQ ID NO: 6650915 - DNA, 18 bp, Homo sapiens
agtctaatctctaaatca

SEQ ID NO: 6650916 - DNA, 18 bp, Homo sapiens
agtctaatgaagagaaaa

SEQ ID NO: 6650917 - DNA, 20 bp, Homo sapiens
agtctaattttgtcaaatca

SEQ ID NO: 6650918 - DNA, 20 bp, Homo sapiens
agtctaatttttattcataa

SEQ ID NO: 6650919 - DNA, 14 bp, Homo sapiens
agtctacagagtga

SEQ ID NO: 6650920 - DNA, 17 bp, Homo sapiens
agtctacaggcctttca

SEQ ID NO: 6650921 - DNA, 21 bp, Homo sapiens
agtctacaggcctttcaggaa

SEQ ID NO: 6650922 - DNA, 14 bp, Homo sapiens
agtctacagtactg

SEQ ID NO: 6650923 - DNA, 17 bp, Homo sapiens
agtctacagtactgaca

SEQ ID NO: 6650924 - DNA, 16 bp, Homo sapiens
agtctacagttgtcct

SEQ ID NO: 6650925 - DNA, 17 bp, Homo sapiens
agtctacagttgtcctg

SEQ ID NO: 6650926 - DNA, 11 bp, Homo sapiens
agtctaccaaa

SEQ ID NO: 6650927 - DNA, 13 bp, Homo sapiens
agtctacccagag

SEQ ID NO: 6650928 - DNA, 13 bp, Homo sapiens
agtctaccctgtc

SEQ ID NO: 6650929 - DNA, 16 bp, Homo sapiens
agtctacctcttcagt

SEQ ID NO: 6650930 - DNA, 18 bp, Homo sapiens
agtctacctgctggacag

SEQ ID NO: 6650931 - DNA, 22 bp, Homo sapiens
agtctacctgctggacagcctc

SEQ ID NO: 6650932 - DNA, 19 bp, Homo sapiens
agtctactcttaagccatc

SEQ ID NO: 6650933 - DNA, 22 bp, Homo sapiens
agtctacttcactaatgacgat

SEQ ID NO: 6650934 - DNA, 15 bp, Homo sapiens
agtctacttctgtgt

SEQ ID NO: 6650935 - DNA, 16 bp, Homo sapiens
agtctactttagtatt

SEQ ID NO: 6650936 - DNA, 13 bp, Homo sapiens
agtctagaaaata

SEQ ID NO: 6650937 - DNA, 23 bp, Homo sapiens
agtctagaaaccagtatggaagg

SEQ ID NO: 6650938 - DNA, 14 bp, Homo sapiens
agtctagaagaatt

SEQ ID NO: 6650939 - DNA, 18 bp, Homo sapiens
agtctagaagaattaagc

SEQ ID NO: 6650940 - DNA, 16 bp, Homo sapiens
agtctagactaaaaga

SEQ ID NO: 6650941 - DNA, 13 bp, Homo sapiens
agtctagatacag

SEQ ID NO: 6650942 - DNA, 21 bp, Homo sapiens
agtctagatacagaagcccat

SEQ ID NO: 6650943 - DNA, 19 bp, Homo sapiens
agtctagatggctcctctc

SEQ ID NO: 6650944 - DNA, 23 bp, Homo sapiens
agtctagatgtttattcttctag

SEQ ID NO: 6650945 - DNA, 15 bp, Homo sapiens
agtctagattcaaag

SEQ ID NO: 6650946 - DNA, 20 bp, Homo sapiens
agtctagattcaaaggttct

SEQ ID NO: 6650947 - DNA, 15 bp, Homo sapiens
agtctagcattctgc

SEQ ID NO: 6650948 - DNA, 18 bp, Homo sapiens
agtctagtccgtcctggc

SEQ ID NO: 6650949 - DNA, 23 bp, Homo sapiens
agtctagtccgtcctggcacaga

SEQ ID NO: 6650950 - DNA, 18 bp, Homo sapiens
agtctagtgaagatgttg

SEQ ID NO: 6650951 - DNA, 19 bp, Homo sapiens
agtctagtgaagatgttgt

SEQ ID NO: 6650952 - DNA, 12 bp, Homo sapiens
agtctagtgtag

SEQ ID NO: 6650953 - DNA, 20 bp, Homo sapiens
agtctagttacctacttttt

SEQ ID NO: 6650954 - DNA, 22 bp, Homo sapiens
agtctagttcctgatgacccag

SEQ ID NO: 6650955 - DNA, 18 bp, Homo sapiens
agtctatatgaaaaacaa

SEQ ID NO: 6650956 - DNA, 19 bp, Homo sapiens
agtctatatggttctccaa

SEQ ID NO: 6650957 - DNA, 22 bp, Homo sapiens
agtctatcaaccccagacactg

SEQ ID NO: 6650958 - DNA, 18 bp, Homo sapiens
agtctatcaatcaactta

SEQ ID NO: 6650959 - DNA, 21 bp, Homo sapiens
agtctatcctagtcttcacaa

SEQ ID NO: 6650960 - DNA, 18 bp, Homo sapiens
agtctatctaatgacatg

SEQ ID NO: 6650961 - DNA, 23 bp, Homo sapiens
agtctatctggtattaaatgcca

SEQ ID NO: 6650962 - DNA, 12 bp, Homo sapiens
agtctatgctta

SEQ ID NO: 6650963 - DNA, 23 bp, Homo sapiens
agtctatggccaggtatgcatgg

SEQ ID NO: 6650964 - DNA, 13 bp, Homo sapiens
agtctatgttcaa

SEQ ID NO: 6650965 - DNA, 20 bp, Homo sapiens
agtctatttccactgaacaa

SEQ ID NO: 6650966 - DNA, 23 bp, Homo sapiens
agtctatttccactgaacaaaac

SEQ ID NO: 6650967 - DNA, 10 bp, Homo sapiens
agtctatttt

SEQ ID NO: 6650968 - DNA, 21 bp, Homo sapiens
agtctcaaaaatacaaaataa

SEQ ID NO: 6650969 - DNA, 14 bp, Homo sapiens
agtctcaaaatcaa

SEQ ID NO: 6650970 - DNA, 23 bp, Homo sapiens
agtctcaaataataataataaca

SEQ ID NO: 6650971 - DNA, 14 bp, Homo sapiens
agtctcaaatcaaa

SEQ ID NO: 6650972 - DNA, 15 bp, Homo sapiens
agtctcaaatcaaat

SEQ ID NO: 6650973 - DNA, 19 bp, Homo sapiens
agtctcaaatcaaatacat

SEQ ID NO: 6650974 - DNA, 16 bp, Homo sapiens
agtctcaaatttttca

SEQ ID NO: 6650975 - DNA, 17 bp, Homo sapiens
agtctcaaatttttcat

SEQ ID NO: 6650976 - DNA, 21 bp, Homo sapiens
agtctcaaatttttcatctct

SEQ ID NO: 6650977 - DNA, 20 bp, Homo sapiens
agtctcaacatgtgtttctg

SEQ ID NO: 6650978 - DNA, 16 bp, Homo sapiens
agtctcaataaactga

SEQ ID NO: 6650979 - DNA, 19 bp, Homo sapiens
agtctcaattttgtattta

SEQ ID NO: 6650980 - DNA, 14 bp, Homo sapiens
agtctcacagagaa

SEQ ID NO: 6650981 - DNA, 17 bp, Homo sapiens
agtctcacagagaagct

SEQ ID NO: 6650982 - DNA, 22 bp, Homo sapiens
agtctcacatattcatcagcag

SEQ ID NO: 6650983 - DNA, 21 bp, Homo sapiens
agtctcacatgattccagcca

SEQ ID NO: 6650984 - DNA, 23 bp, Homo sapiens
agtctcacatgattccagccatc

SEQ ID NO: 6650985 - DNA, 21 bp, Homo sapiens
agtctcacctgccggctctgg

SEQ ID NO: 6650986 - DNA, 23 bp, Homo sapiens
agtctcacctgccggctctgggc

SEQ ID NO: 6650987 - DNA, 21 bp, Homo sapiens
agtctcactcccctcctttcc

SEQ ID NO: 6650988 - DNA, 15 bp, Homo sapiens
agtctcactcttgtc

SEQ ID NO: 6650989 - DNA, 12 bp, Homo sapiens
agtctcactgtc

SEQ ID NO: 6650990 - DNA, 16 bp, Homo sapiens
agtctcactgttgccc

SEQ ID NO: 6650991 - DNA, 17 bp, Homo sapiens
agtctcactgttgccca

SEQ ID NO: 6650992 - DNA, 18 bp, Homo sapiens
agtctcactgttgcccag

SEQ ID NO: 6650993 - DNA, 20 bp, Homo sapiens
agtctcactgttgcccaggc

SEQ ID NO: 6650994 - DNA, 20 bp, Homo sapiens
agtctcagaaactcccctgg

SEQ ID NO: 6650995 - DNA, 19 bp, Homo sapiens
agtctcagaaagccttcca

SEQ ID NO: 6650996 - DNA, 16 bp, Homo sapiens
agtctcagagaccagc

SEQ ID NO: 6650997 - DNA, 17 bp, Homo sapiens
agtctcagagaccagca

SEQ ID NO: 6650998 - DNA, 15 bp, Homo sapiens
agtctcagagcacag

SEQ ID NO: 6650999 - DNA, 22 bp, Homo sapiens
agtctcagatatcatactgatt

SEQ ID NO: 6651000 - DNA, 11 bp, Homo sapiens
agtctcagcct

SEQ ID NO: 6651001 - DNA, 13 bp, Homo sapiens
agtctcagcctgg

SEQ ID NO: 6651002 - DNA, 14 bp, Homo sapiens
agtctcagcctggg

SEQ ID NO: 6651003 - DNA, 17 bp, Homo sapiens
agtctcagcctgggccc

SEQ ID NO: 6651004 - DNA, 13 bp, Homo sapiens
agtctcagctaag

SEQ ID NO: 6651005 - DNA, 14 bp, Homo sapiens
agtctcagctgctg

SEQ ID NO: 6651006 - DNA, 22 bp, Homo sapiens
agtctcaggaaatcaaatatgc

SEQ ID NO: 6651007 - DNA, 17 bp, Homo sapiens
agtctcaggagcatggg

SEQ ID NO: 6651008 - DNA, 18 bp, Homo sapiens
agtctcaggagtctctgg

SEQ ID NO: 6651009 - DNA, 22 bp, Homo sapiens
agtctcaggtgacggactcaga

SEQ ID NO: 6651010 - DNA, 21 bp, Homo sapiens
agtctcagtacacttcctgtg

SEQ ID NO: 6651011 - DNA, 10 bp, Homo sapiens
agtctcagtt

SEQ ID NO: 6651012 - DNA, 18 bp, Homo sapiens
agtctcagtttgtgtgtc

SEQ ID NO: 6651013 - DNA, 18 bp, Homo sapiens
agtctcatcctcccattg

SEQ ID NO: 6651014 - DNA, 19 bp, Homo sapiens
agtctcatctcctgaccct

SEQ ID NO: 6651015 - DNA, 21 bp, Homo sapiens
agtctcatctcctgaccctcc

SEQ ID NO: 6651016 - DNA, 22 bp, Homo sapiens
agtctcatgcaagacttcactg

SEQ ID NO: 6651017 - DNA, 19 bp, Homo sapiens
agtctcatgccttgagatc

SEQ ID NO: 6651018 - DNA, 16 bp, Homo sapiens
agtctcattacagatt

SEQ ID NO: 6651019 - DNA, 18 bp, Homo sapiens
agtctcattacttttgaa

SEQ ID NO: 6651020 - DNA, 15 bp, Homo sapiens
agtctcattcctctg

SEQ ID NO: 6651021 - DNA, 18 bp, Homo sapiens
agtctccaaaacatttct

SEQ ID NO: 6651022 - DNA, 15 bp, Homo sapiens
agtctccaccaggaa

SEQ ID NO: 6651023 - DNA, 16 bp, Homo sapiens
agtctccacgtgtttc

SEQ ID NO: 6651024 - DNA, 19 bp, Homo sapiens
agtctccatgaagagcttg

SEQ ID NO: 6651025 - DNA, 23 bp, Homo sapiens
agtctcccaggccccctgcatct

SEQ ID NO: 6651026 - DNA, 21 bp, Homo sapiens
agtctccccactccaccctgt

SEQ ID NO: 6651027 - DNA, 23 bp, Homo sapiens
agtctccccactccaccctgtta

SEQ ID NO: 6651028 - DNA, 19 bp, Homo sapiens
agtctccccagatatggac

SEQ ID NO: 6651029 - DNA, 19 bp, Homo sapiens
agtctccccgcagccctct

SEQ ID NO: 6651030 - DNA, 18 bp, Homo sapiens
agtctccccttgcagcct

SEQ ID NO: 6651031 - DNA, 12 bp, Homo sapiens
agtctccctccg

SEQ ID NO: 6651032 - DNA, 13 bp, Homo sapiens
agtctccctctga

SEQ ID NO: 6651033 - DNA, 14 bp, Homo sapiens
agtctccctctgat

SEQ ID NO: 6651034 - DNA, 16 bp, Homo sapiens
agtctccctctgattg

SEQ ID NO: 6651035 - DNA, 11 bp, Homo sapiens
agtctccctga

SEQ ID NO: 6651036 - DNA, 18 bp, Homo sapiens
agtctccctgatggaccc

SEQ ID NO: 6651037 - DNA, 16 bp, Homo sapiens
agtctccgcctcctga

SEQ ID NO: 6651038 - DNA, 19 bp, Homo sapiens
agtctccggcctctccagc

SEQ ID NO: 6651039 - DNA, 21 bp, Homo sapiens
agtctcctacgcaccattttg

SEQ ID NO: 6651040 - DNA, 19 bp, Homo sapiens
agtctcctaggggcttggt

SEQ ID NO: 6651041 - DNA, 22 bp, Homo sapiens
agtctcctaggggcttggtcct

SEQ ID NO: 6651042 - DNA, 18 bp, Homo sapiens
agtctcctatacccagca

SEQ ID NO: 6651043 - DNA, 11 bp, Homo sapiens
agtctcctcaa

SEQ ID NO: 6651044 - DNA, 23 bp, Homo sapiens
agtctcctcaatttttgtctcag

SEQ ID NO: 6651045 - DNA, 13 bp, Homo sapiens
agtctcctctcca

SEQ ID NO: 6651046 - DNA, 11 bp, Homo sapiens
agtctcctggg

SEQ ID NO: 6651047 - DNA, 14 bp, Homo sapiens
agtctccttcagca

SEQ ID NO: 6651048 - DNA, 16 bp, Homo sapiens
agtctccttcagcacg

SEQ ID NO: 6651049 - DNA, 18 bp, Homo sapiens
agtctccttcagcacggc

SEQ ID NO: 6651050 - DNA, 18 bp, Homo sapiens
agtctccttctcttctct

SEQ ID NO: 6651051 - DNA, 12 bp, Homo sapiens
agtctccttggt

SEQ ID NO: 6651052 - DNA, 18 bp, Homo sapiens
agtctcctttgcactgag

SEQ ID NO: 6651053 - DNA, 22 bp, Homo sapiens
agtctcctttgcactgagggcc

SEQ ID NO: 6651054 - DNA, 23 bp, Homo sapiens
agtctcctttgcactgagggcca

SEQ ID NO: 6651055 - DNA, 14 bp, Homo sapiens
agtctcgctctgct

SEQ ID NO: 6651056 - DNA, 19 bp, Homo sapiens
agtctcgctctgttgccca

SEQ ID NO: 6651057 - DNA, 18 bp, Homo sapiens
agtctcggcatagtcccc

SEQ ID NO: 6651058 - DNA, 20 bp, Homo sapiens
agtctcgtctcttttaccct

SEQ ID NO: 6651059 - DNA, 18 bp, Homo sapiens
agtctctatgatcttggc

SEQ ID NO: 6651060 - DNA, 20 bp, Homo sapiens
agtctctatttaaattcttt

SEQ ID NO: 6651061 - DNA, 17 bp, Homo sapiens
agtctctatttcacaat

SEQ ID NO: 6651062 - DNA, 19 bp, Homo sapiens
agtctctccagcctcacag

SEQ ID NO: 6651063 - DNA, 16 bp, Homo sapiens
agtctctccctggggt

SEQ ID NO: 6651064 - DNA, 21 bp, Homo sapiens
agtctctccctggggtttttt

SEQ ID NO: 6651065 - DNA, 22 bp, Homo sapiens
agtctctcctgtaagccaaaga

SEQ ID NO: 6651066 - DNA, 18 bp, Homo sapiens
agtctctctaagacaaat

SEQ ID NO: 6651067 - DNA, 22 bp, Homo sapiens
agtctctctaagacaaatgcag

SEQ ID NO: 6651068 - DNA, 23 bp, Homo sapiens
agtctctctctctccatccctct

SEQ ID NO: 6651069 - DNA, 19 bp, Homo sapiens
agtctctctctctctctcc

SEQ ID NO: 6651070 - DNA, 20 bp, Homo sapiens
agtctctctctctctctccc

SEQ ID NO: 6651071 - DNA, 19 bp, Homo sapiens
agtctctctctgttgccca

SEQ ID NO: 6651072 - DNA, 15 bp, Homo sapiens
agtctctctgcaaga

SEQ ID NO: 6651073 - DNA, 12 bp, Homo sapiens
agtctctctgtg

SEQ ID NO: 6651074 - DNA, 17 bp, Homo sapiens
agtctctctgtgaatac

SEQ ID NO: 6651075 - DNA, 18 bp, Homo sapiens
agtctctctgtgaataca

SEQ ID NO: 6651076 - DNA, 23 bp, Homo sapiens
agtctctctgtgaatacaattaa

SEQ ID NO: 6651077 - DNA, 23 bp, Homo sapiens
agtctctcttaaagttggaattt

SEQ ID NO: 6651078 - DNA, 13 bp, Homo sapiens
agtctctcttcca

SEQ ID NO: 6651079 - DNA, 14 bp, Homo sapiens
agtctctcttctct

SEQ ID NO: 6651080 - DNA, 16 bp, Homo sapiens
agtctctcttctctcc

SEQ ID NO: 6651081 - DNA, 19 bp, Homo sapiens
agtctctgaatgaagctga

SEQ ID NO: 6651082 - DNA, 13 bp, Homo sapiens
agtctctgagcag

SEQ ID NO: 6651083 - DNA, 16 bp, Homo sapiens
agtctctgagcagtga

SEQ ID NO: 6651084 - DNA, 15 bp, Homo sapiens
agtctctgagggctt

SEQ ID NO: 6651085 - DNA, 21 bp, Homo sapiens
agtctctgagggcttcctttg

SEQ ID NO: 6651086 - DNA, 16 bp, Homo sapiens
agtctctgaggggcta

SEQ ID NO: 6651087 - DNA, 17 bp, Homo sapiens
agtctctgccacccact

SEQ ID NO: 6651088 - DNA, 19 bp, Homo sapiens
agtctctgccacccactca

SEQ ID NO: 6651089 - DNA, 13 bp, Homo sapiens
agtctctgccttg

SEQ ID NO: 6651090 - DNA, 17 bp, Homo sapiens
agtctctgccttgcctt

SEQ ID NO: 6651091 - DNA, 15 bp, Homo sapiens
agtctctgctccacc

SEQ ID NO: 6651092 - DNA, 16 bp, Homo sapiens
agtctctgctggccca

SEQ ID NO: 6651093 - DNA, 17 bp, Homo sapiens
agtctctgctggcccag

SEQ ID NO: 6651094 - DNA, 13 bp, Homo sapiens
agtctctggaaaa

SEQ ID NO: 6651095 - DNA, 15 bp, Homo sapiens
agtctctggaagaag

SEQ ID NO: 6651096 - DNA, 20 bp, Homo sapiens
agtctctggctcagctgtgg

SEQ ID NO: 6651097 - DNA, 21 bp, Homo sapiens
agtctctggggcaggctgctt

SEQ ID NO: 6651098 - DNA, 11 bp, Homo sapiens
agtctctgtga

SEQ ID NO: 6651099 - DNA, 12 bp, Homo sapiens
agtctctgtgaa

SEQ ID NO: 6651100 - DNA, 16 bp, Homo sapiens
agtctctgtgtaacca

SEQ ID NO: 6651101 - DNA, 14 bp, Homo sapiens
agtctctgttgtaa

SEQ ID NO: 6651102 - DNA, 16 bp, Homo sapiens
agtctctgttgtaaat

SEQ ID NO: 6651103 - DNA, 14 bp, Homo sapiens
agtctcttcccttt

SEQ ID NO: 6651104 - DNA, 12 bp, Homo sapiens
agtctcttcctg

SEQ ID NO: 6651105 - DNA, 19 bp, Homo sapiens
agtctcttcctgcctccca

SEQ ID NO: 6651106 - DNA, 13 bp, Homo sapiens
agtctcttctcca

SEQ ID NO: 6651107 - DNA, 16 bp, Homo sapiens
agtctcttctccactg

SEQ ID NO: 6651108 - DNA, 18 bp, Homo sapiens
agtctcttctccactgga

SEQ ID NO: 6651109 - DNA, 21 bp, Homo sapiens
agtctctttaatcttcagttt

SEQ ID NO: 6651110 - DNA, 22 bp, Homo sapiens
agtctctttaatcttcagtttt

SEQ ID NO: 6651111 - DNA, 20 bp, Homo sapiens
agtctctttattttactaga

SEQ ID NO: 6651112 - DNA, 22 bp, Homo sapiens
agtctctttattttactagaaa

SEQ ID NO: 6651113 - DNA, 17 bp, Homo sapiens
agtctctttcttccttt

SEQ ID NO: 6651114 - DNA, 19 bp, Homo sapiens
agtctctttcttcctttct

SEQ ID NO: 6651115 - DNA, 21 bp, Homo sapiens
agtctcttttctttagagcat

SEQ ID NO: 6651116 - DNA, 17 bp, Homo sapiens
agtctcttttttacaaa

SEQ ID NO: 6651117 - DNA, 20 bp, Homo sapiens
agtctcttttttacaaaggc

SEQ ID NO: 6651118 - DNA, 18 bp, Homo sapiens
agtctcttttttattctg

SEQ ID NO: 6651119 - DNA, 20 bp, Homo sapiens
agtctctttttttggcccag

SEQ ID NO: 6651120 - DNA, 16 bp, Homo sapiens
agtctgaacagctgta

SEQ ID NO: 6651121 - DNA, 23 bp, Homo sapiens
agtctgaaccaatagaaagcaaa

SEQ ID NO: 6651122 - DNA, 11 bp, Homo sapiens
agtctgaagat

SEQ ID NO: 6651123 - DNA, 14 bp, Homo sapiens
agtctgaagcagat

SEQ ID NO: 6651124 - DNA, 21 bp, Homo sapiens
agtctgaagcagatgcaaaga

SEQ ID NO: 6651125 - DNA, 18 bp, Homo sapiens
agtctgaagcctgcaggt

SEQ ID NO: 6651126 - DNA, 15 bp, Homo sapiens
agtctgaaggagagg

SEQ ID NO: 6651127 - DNA, 16 bp, Homo sapiens
agtctgaaggagagga

SEQ ID NO: 6651128 - DNA, 17 bp, Homo sapiens
agtctgaaggagaggag

SEQ ID NO: 6651129 - DNA, 19 bp, Homo sapiens
agtctgaaggagaggagtg

SEQ ID NO: 6651130 - DNA, 17 bp, Homo sapiens
agtctgaaggctgggtt

SEQ ID NO: 6651131 - DNA, 17 bp, Homo sapiens
agtctgaagtttcattt

SEQ ID NO: 6651132 - DNA, 16 bp, Homo sapiens
agtctgaatgctgcca

SEQ ID NO: 6651133 - DNA, 22 bp, Homo sapiens
agtctgaattgttgaaactaaa

SEQ ID NO: 6651134 - DNA, 16 bp, Homo sapiens
agtctgaatttttaaa

SEQ ID NO: 6651135 - DNA, 15 bp, Homo sapiens
agtctgacaggaaga

SEQ ID NO: 6651136 - DNA, 16 bp, Homo sapiens
agtctgacaggaagac

SEQ ID NO: 6651137 - DNA, 21 bp, Homo sapiens
agtctgacaggaagactggag

SEQ ID NO: 6651138 - DNA, 12 bp, Homo sapiens
agtctgagaaat

SEQ ID NO: 6651139 - DNA, 13 bp, Homo sapiens
agtctgagaaata

SEQ ID NO: 6651140 - DNA, 16 bp, Homo sapiens
agtctgagagaggcca

SEQ ID NO: 6651141 - DNA, 23 bp, Homo sapiens
agtctgagagaggccattctttc

SEQ ID NO: 6651142 - DNA, 15 bp, Homo sapiens
agtctgagcccattt

SEQ ID NO: 6651143 - DNA, 17 bp, Homo sapiens
agtctgagcccatttct

SEQ ID NO: 6651144 - DNA, 18 bp, Homo sapiens
agtctgagcccatttctg

SEQ ID NO: 6651145 - DNA, 15 bp, Homo sapiens
agtctgagcccccgg

SEQ ID NO: 6651146 - DNA, 23 bp, Homo sapiens
agtctgagctgtaggtaaccggc

SEQ ID NO: 6651147 - DNA, 14 bp, Homo sapiens
agtctgaggactgt

SEQ ID NO: 6651148 - DNA, 22 bp, Homo sapiens
agtctgaggactgtcctcccac

SEQ ID NO: 6651149 - DNA, 18 bp, Homo sapiens
agtctgaggcacctgcat

SEQ ID NO: 6651150 - DNA, 19 bp, Homo sapiens
agtctgaggcacctgcata

SEQ ID NO: 6651151 - DNA, 18 bp, Homo sapiens
agtctgagggcttgtagt

SEQ ID NO: 6651152 - DNA, 15 bp, Homo sapiens
agtctgaggtcctga

SEQ ID NO: 6651153 - DNA, 17 bp, Homo sapiens
agtctgaggtcctgagc

SEQ ID NO: 6651154 - DNA, 16 bp, Homo sapiens
agtctgagtaaaatct

SEQ ID NO: 6651155 - DNA, 19 bp, Homo sapiens
agtctgagtagttatgaat

SEQ ID NO: 6651156 - DNA, 19 bp, Homo sapiens
agtctgagtcctgtctctg

SEQ ID NO: 6651157 - DNA, 23 bp, Homo sapiens
agtctgagtcctgtctctgcctg

SEQ ID NO: 6651158 - DNA, 15 bp, Homo sapiens
agtctgagtctgagt

SEQ ID NO: 6651159 - DNA, 13 bp, Homo sapiens
agtctgagtgggc

SEQ ID NO: 6651160 - DNA, 20 bp, Homo sapiens
agtctgataaactgacgatt

SEQ ID NO: 6651161 - DNA, 19 bp, Homo sapiens
agtctgatggtgagcagta

SEQ ID NO: 6651162 - DNA, 15 bp, Homo sapiens
agtctgattatacca

SEQ ID NO: 6651163 - DNA, 16 bp, Homo sapiens
agtctgattcccaagc

SEQ ID NO: 6651164 - DNA, 18 bp, Homo sapiens
agtctgattcccaagctc

SEQ ID NO: 6651165 - DNA, 19 bp, Homo sapiens
agtctgattttaatgaaat

SEQ ID NO: 6651166 - DNA, 20 bp, Homo sapiens
agtctgattttaatgaaatc

SEQ ID NO: 6651167 - DNA, 22 bp, Homo sapiens
agtctgatttttaagatttcct

SEQ ID NO: 6651168 - DNA, 13 bp, Homo sapiens
agtctgcaaaatg

SEQ ID NO: 6651169 - DNA, 15 bp, Homo sapiens
agtctgcaagattct

SEQ ID NO: 6651170 - DNA, 15 bp, Homo sapiens
agtctgcataaactt

SEQ ID NO: 6651171 - DNA, 16 bp, Homo sapiens
agtctgcataaacttc

SEQ ID NO: 6651172 - DNA, 21 bp, Homo sapiens
agtctgcataaacttcatctt

SEQ ID NO: 6651173 - DNA, 18 bp, Homo sapiens
agtctgcattacattcct

SEQ ID NO: 6651174 - DNA, 14 bp, Homo sapiens
agtctgccacccag

SEQ ID NO: 6651175 - DNA, 11 bp, Homo sapiens
agtctgccagg

SEQ ID NO: 6651176 - DNA, 23 bp, Homo sapiens
agtctgcccacgcagaggacgca

SEQ ID NO: 6651177 - DNA, 23 bp, Homo sapiens
agtctgccgattttgtaaatgtt

SEQ ID NO: 6651178 - DNA, 14 bp, Homo sapiens
agtctgccgcccac

SEQ ID NO: 6651179 - DNA, 16 bp, Homo sapiens
agtctgccgcccacct

SEQ ID NO: 6651180 - DNA, 17 bp, Homo sapiens
agtctgccgcccacctc

SEQ ID NO: 6651181 - DNA, 15 bp, Homo sapiens
agtctgcgcccttgt

SEQ ID NO: 6651182 - DNA, 13 bp, Homo sapiens
agtctgctccacc

SEQ ID NO: 6651183 - DNA, 23 bp, Homo sapiens
agtctgctctagatgagctgggc

SEQ ID NO: 6651184 - DNA, 17 bp, Homo sapiens
agtctgctgccctccat

SEQ ID NO: 6651185 - DNA, 20 bp, Homo sapiens
agtctgctgccctccatccc

SEQ ID NO: 6651186 - DNA, 15 bp, Homo sapiens
agtctgctttctcta

SEQ ID NO: 6651187 - DNA, 16 bp, Homo sapiens
agtctgctttctctac

SEQ ID NO: 6651188 - DNA, 16 bp, Homo sapiens
agtctggaactgctgc

SEQ ID NO: 6651189 - DNA, 18 bp, Homo sapiens
agtctggaactgctgctg

SEQ ID NO: 6651190 - DNA, 21 bp, Homo sapiens
agtctggaactgctgctgacc

SEQ ID NO: 6651191 - DNA, 11 bp, Homo sapiens
agtctggaaga

SEQ ID NO: 6651192 - DNA, 15 bp, Homo sapiens
agtctggaagaagag

SEQ ID NO: 6651193 - DNA, 21 bp, Homo sapiens
agtctggaagaagaggaggaa

SEQ ID NO: 6651194 - DNA, 15 bp, Homo sapiens
agtctggagaccagg

SEQ ID NO: 6651195 - DNA, 21 bp, Homo sapiens
agtctggagaccaggactctg

SEQ ID NO: 6651196 - DNA, 11 bp, Homo sapiens
agtctggataa

SEQ ID NO: 6651197 - DNA, 23 bp, Homo sapiens
agtctggataacttccacagggt

SEQ ID NO: 6651198 - DNA, 17 bp, Homo sapiens
agtctggatctgggacc

SEQ ID NO: 6651199 - DNA, 22 bp, Homo sapiens
agtctggcagactttcttctct

SEQ ID NO: 6651200 - DNA, 19 bp, Homo sapiens
agtctggccaatatggaga

SEQ ID NO: 6651201 - DNA, 16 bp, Homo sapiens
agtctggccactgtca

SEQ ID NO: 6651202 - DNA, 19 bp, Homo sapiens
agtctggccactgtcaagg

SEQ ID NO: 6651203 - DNA, 13 bp, Homo sapiens
agtctggccattt

SEQ ID NO: 6651204 - DNA, 14 bp, Homo sapiens
agtctggcctgcca

SEQ ID NO: 6651205 - DNA, 20 bp, Homo sapiens
agtctggcctgccaggctcc

SEQ ID NO: 6651206 - DNA, 17 bp, Homo sapiens
agtctggctgagccctg

SEQ ID NO: 6651207 - DNA, 15 bp, Homo sapiens
agtctggctgcacct

SEQ ID NO: 6651208 - DNA, 21 bp, Homo sapiens
agtctggctttacctttttgt

SEQ ID NO: 6651209 - DNA, 14 bp, Homo sapiens
agtctgggacacaa

SEQ ID NO: 6651210 - DNA, 17 bp, Homo sapiens
agtctgggatgtagaac

SEQ ID NO: 6651211 - DNA, 21 bp, Homo sapiens
agtctgggcaatgaaaccaaa

SEQ ID NO: 6651212 - DNA, 20 bp, Homo sapiens
agtctgggcctctgactctg

SEQ ID NO: 6651213 - DNA, 15 bp, Homo sapiens
agtctggggacctgg

SEQ ID NO: 6651214 - DNA, 13 bp, Homo sapiens
agtctgggtcaga

SEQ ID NO: 6651215 - DNA, 19 bp, Homo sapiens
agtctgggtcagacccatc

SEQ ID NO: 6651216 - DNA, 21 bp, Homo sapiens
agtctgggtctgggtttggat

SEQ ID NO: 6651217 - DNA, 17 bp, Homo sapiens
agtctggtgaacttcaa

SEQ ID NO: 6651218 - DNA, 15 bp, Homo sapiens
agtctgtaaaataca

SEQ ID NO: 6651219 - DNA, 15 bp, Homo sapiens
agtctgtaattttac

SEQ ID NO: 6651220 - DNA, 14 bp, Homo sapiens
agtctgtacctcaa

SEQ ID NO: 6651221 - DNA, 20 bp, Homo sapiens
agtctgtatccaaataatga

SEQ ID NO: 6651222 - DNA, 21 bp, Homo sapiens
agtctgtatccaaataatgaa

SEQ ID NO: 6651223 - DNA, 17 bp, Homo sapiens
agtctgtattcctgata

SEQ ID NO: 6651224 - DNA, 16 bp, Homo sapiens
agtctgtatttttcta

SEQ ID NO: 6651225 - DNA, 17 bp, Homo sapiens
agtctgtcagggccttg

SEQ ID NO: 6651226 - DNA, 23 bp, Homo sapiens
agtctgtcagggccttggcccag

SEQ ID NO: 6651227 - DNA, 18 bp, Homo sapiens
agtctgtcaggtttggtt

SEQ ID NO: 6651228 - DNA, 12 bp, Homo sapiens
agtctgtcatcc

SEQ ID NO: 6651229 - DNA, 18 bp, Homo sapiens
agtctgtcatcctctgga

SEQ ID NO: 6651230 - DNA, 13 bp, Homo sapiens
agtctgtcatgaa

SEQ ID NO: 6651231 - DNA, 16 bp, Homo sapiens
agtctgtccaaattta

SEQ ID NO: 6651232 - DNA, 21 bp, Homo sapiens
agtctgtccaaatttaaaatg

SEQ ID NO: 6651233 - DNA, 21 bp, Homo sapiens
agtctgtccagataagttatt

SEQ ID NO: 6651234 - DNA, 15 bp, Homo sapiens
agtctgtcctgtgac

SEQ ID NO: 6651235 - DNA, 16 bp, Homo sapiens
agtctgtcctgtgacg

SEQ ID NO: 6651236 - DNA, 13 bp, Homo sapiens
agtctgtctactg

SEQ ID NO: 6651237 - DNA, 15 bp, Homo sapiens
agtctgtctactgtg

SEQ ID NO: 6651238 - DNA, 16 bp, Homo sapiens
agtctgtctactgtgg

SEQ ID NO: 6651239 - DNA, 14 bp, Homo sapiens
agtctgtcttctgt

SEQ ID NO: 6651240 - DNA, 18 bp, Homo sapiens
agtctgtcttctgtatat

SEQ ID NO: 6651241 - DNA, 18 bp, Homo sapiens
agtctgtgaataaagcca

SEQ ID NO: 6651242 - DNA, 19 bp, Homo sapiens
agtctgtgaataaagccac

SEQ ID NO: 6651243 - DNA, 13 bp, Homo sapiens
agtctgtgagtgc

SEQ ID NO: 6651244 - DNA, 22 bp, Homo sapiens
agtctgtgagtgcgtctgaggg

SEQ ID NO: 6651245 - DNA, 21 bp, Homo sapiens
agtctgtgatccttggtgctg

SEQ ID NO: 6651246 - DNA, 23 bp, Homo sapiens
agtctgtgatccttggtgctgtg

SEQ ID NO: 6651247 - DNA, 16 bp, Homo sapiens
agtctgtgcctcagtg

SEQ ID NO: 6651248 - DNA, 14 bp, Homo sapiens
agtctgtgcctgga

SEQ ID NO: 6651249 - DNA, 16 bp, Homo sapiens
agtctgtgcctggagc

SEQ ID NO: 6651250 - DNA, 17 bp, Homo sapiens
agtctgtgcctggagct

SEQ ID NO: 6651251 - DNA, 22 bp, Homo sapiens
agtctgtgcctggagctcctgg

SEQ ID NO: 6651252 - DNA, 20 bp, Homo sapiens
agtctgtggacactgtggaa

SEQ ID NO: 6651253 - DNA, 11 bp, Homo sapiens
agtctgtggct

SEQ ID NO: 6651254 - DNA, 14 bp, Homo sapiens
agtctgtgggagct

SEQ ID NO: 6651255 - DNA, 20 bp, Homo sapiens
agtctgtgggagctcagctc

SEQ ID NO: 6651256 - DNA, 19 bp, Homo sapiens
agtctgtgtgatgaacttt

SEQ ID NO: 6651257 - DNA, 22 bp, Homo sapiens
agtctgtgtgatgaactttctc

SEQ ID NO: 6651258 - DNA, 16 bp, Homo sapiens
agtctgtgtgcacaat

SEQ ID NO: 6651259 - DNA, 21 bp, Homo sapiens
agtctgtgtgctgtggttcct

SEQ ID NO: 6651260 - DNA, 17 bp, Homo sapiens
agtctgtgtgggactgt

SEQ ID NO: 6651261 - DNA, 20 bp, Homo sapiens
agtctgtgtgtagccaggaa

SEQ ID NO: 6651262 - DNA, 21 bp, Homo sapiens
agtctgtgtgtagccaggaag

SEQ ID NO: 6651263 - DNA, 21 bp, Homo sapiens
agtctgtgttcaaaaatatat

SEQ ID NO: 6651264 - DNA, 18 bp, Homo sapiens
agtctgtgttgtgtcctg

SEQ ID NO: 6651265 - DNA, 22 bp, Homo sapiens
agtctgtgttgtgtcctgacac

SEQ ID NO: 6651266 - DNA, 20 bp, Homo sapiens
agtctgtgtttacagacaga

SEQ ID NO: 6651267 - DNA, 18 bp, Homo sapiens
agtctgttatatttcctt

SEQ ID NO: 6651268 - DNA, 21 bp, Homo sapiens
agtctgttatgcactgtggtt

SEQ ID NO: 6651269 - DNA, 16 bp, Homo sapiens
agtctgttattgtttt

SEQ ID NO: 6651270 - DNA, 22 bp, Homo sapiens
agtctgttattgttttgttaac

SEQ ID NO: 6651271 - DNA, 20 bp, Homo sapiens
agtctgttatttattattaa

SEQ ID NO: 6651272 - DNA, 15 bp, Homo sapiens
agtctgttcactgca

SEQ ID NO: 6651273 - DNA, 16 bp, Homo sapiens
agtctgttctggtaat

SEQ ID NO: 6651274 - DNA, 14 bp, Homo sapiens
agtctgtttcatta

SEQ ID NO: 6651275 - DNA, 18 bp, Homo sapiens
agtctgtttcattactgc

SEQ ID NO: 6651276 - DNA, 15 bp, Homo sapiens
agtctgtttcccaag

SEQ ID NO: 6651277 - DNA, 13 bp, Homo sapiens
agtcttaaaataa

SEQ ID NO: 6651278 - DNA, 23 bp, Homo sapiens
agtcttaaaataacttatatcat

SEQ ID NO: 6651279 - DNA, 22 bp, Homo sapiens
agtcttaacaaaccaacatctt

SEQ ID NO: 6651280 - DNA, 15 bp, Homo sapiens
agtcttaactgtatt

SEQ ID NO: 6651281 - DNA, 16 bp, Homo sapiens
agtcttaactgtattt

SEQ ID NO: 6651282 - DNA, 19 bp, Homo sapiens
agtcttaactgtatttcag

SEQ ID NO: 6651283 - DNA, 17 bp, Homo sapiens
agtcttaacttctcccc

SEQ ID NO: 6651284 - DNA, 13 bp, Homo sapiens
agtcttaagaact

SEQ ID NO: 6651285 - DNA, 23 bp, Homo sapiens
agtcttaataaaataaactagat

SEQ ID NO: 6651286 - DNA, 14 bp, Homo sapiens
agtcttaattttct

SEQ ID NO: 6651287 - DNA, 16 bp, Homo sapiens
agtcttaattttctaa

SEQ ID NO: 6651288 - DNA, 16 bp, Homo sapiens
agtcttactctgtctc

SEQ ID NO: 6651289 - DNA, 17 bp, Homo sapiens
agtcttactctgtctcc

SEQ ID NO: 6651290 - DNA, 15 bp, Homo sapiens
agtcttactgttttg

SEQ ID NO: 6651291 - DNA, 18 bp, Homo sapiens
agtcttagatcatagttt

SEQ ID NO: 6651292 - DNA, 20 bp, Homo sapiens
agtcttagatcatagtttta

SEQ ID NO: 6651293 - DNA, 11 bp, Homo sapiens
agtcttagctg

SEQ ID NO: 6651294 - DNA, 15 bp, Homo sapiens
agtcttatcaagcag

SEQ ID NO: 6651295 - DNA, 19 bp, Homo sapiens
agtcttatgaatagacata

SEQ ID NO: 6651296 - DNA, 23 bp, Homo sapiens
agtcttatgaatagacataaatt

SEQ ID NO: 6651297 - DNA, 14 bp, Homo sapiens
agtcttatgtaaag

SEQ ID NO: 6651298 - DNA, 16 bp, Homo sapiens
agtcttatgtaaagta

SEQ ID NO: 6651299 - DNA, 14 bp, Homo sapiens
agtcttatttaacc

SEQ ID NO: 6651300 - DNA, 22 bp, Homo sapiens
agtcttatttccaagtaagagt

SEQ ID NO: 6651301 - DNA, 12 bp, Homo sapiens
agtcttcaaatt

SEQ ID NO: 6651302 - DNA, 15 bp, Homo sapiens
agtcttcaaatttga

SEQ ID NO: 6651303 - DNA, 16 bp, Homo sapiens
agtcttcaaatttttt

SEQ ID NO: 6651304 - DNA, 22 bp, Homo sapiens
agtcttcaactggttagtgtga

SEQ ID NO: 6651305 - DNA, 23 bp, Homo sapiens
agtcttcaagcagattggagaaa

SEQ ID NO: 6651306 - DNA, 20 bp, Homo sapiens
agtcttcaagggctgcttca

SEQ ID NO: 6651307 - DNA, 23 bp, Homo sapiens
agtcttcaatttgttaacagagc

SEQ ID NO: 6651308 - DNA, 17 bp, Homo sapiens
agtcttcactgctctgc

SEQ ID NO: 6651309 - DNA, 21 bp, Homo sapiens
agtcttcagtttgcagagtag

SEQ ID NO: 6651310 - DNA, 21 bp, Homo sapiens
agtcttcataccccagaaatt

SEQ ID NO: 6651311 - DNA, 17 bp, Homo sapiens
agtcttcatgaaatgct

SEQ ID NO: 6651312 - DNA, 23 bp, Homo sapiens
agtcttcatgaaatgctatgtca

SEQ ID NO: 6651313 - DNA, 22 bp, Homo sapiens
agtcttccaaggccagaaggag

SEQ ID NO: 6651314 - DNA, 22 bp, Homo sapiens
agtcttccaattaatgcttttt

SEQ ID NO: 6651315 - DNA, 17 bp, Homo sapiens
agtcttccagaaagcaa

SEQ ID NO: 6651316 - DNA, 23 bp, Homo sapiens
agtcttccagaaagcaaggactg

SEQ ID NO: 6651317 - DNA, 14 bp, Homo sapiens
agtcttccatcagc

SEQ ID NO: 6651318 - DNA, 16 bp, Homo sapiens
agtcttccatcagcag

SEQ ID NO: 6651319 - DNA, 15 bp, Homo sapiens
agtcttccatttgca

SEQ ID NO: 6651320 - DNA, 17 bp, Homo sapiens
agtcttccatttgcaag

SEQ ID NO: 6651321 - DNA, 19 bp, Homo sapiens
agtcttccatttgcaaggg

SEQ ID NO: 6651322 - DNA, 17 bp, Homo sapiens
agtcttcccagcaatta

SEQ ID NO: 6651323 - DNA, 19 bp, Homo sapiens
agtcttccctagggctggg

SEQ ID NO: 6651324 - DNA, 21 bp, Homo sapiens
agtcttccctcagatttccat

SEQ ID NO: 6651325 - DNA, 13 bp, Homo sapiens
agtcttcctattg

SEQ ID NO: 6651326 - DNA, 16 bp, Homo sapiens
agtcttcctcttagcc

SEQ ID NO: 6651327 - DNA, 15 bp, Homo sapiens
agtcttccttagcta

SEQ ID NO: 6651328 - DNA, 14 bp, Homo sapiens
agtcttccttgtct

SEQ ID NO: 6651329 - DNA, 20 bp, Homo sapiens
agtcttctaatgtaaatttt

SEQ ID NO: 6651330 - DNA, 20 bp, Homo sapiens
agtcttctaccaaatgtgta

SEQ ID NO: 6651331 - DNA, 12 bp, Homo sapiens
agtcttctcata

SEQ ID NO: 6651332 - DNA, 16 bp, Homo sapiens
agtcttctcccaactc

SEQ ID NO: 6651333 - DNA, 23 bp, Homo sapiens
agtcttctcccaactcagcctgt

SEQ ID NO: 6651334 - DNA, 14 bp, Homo sapiens
agtcttctgcctct

SEQ ID NO: 6651335 - DNA, 15 bp, Homo sapiens
agtcttcttatctaa

SEQ ID NO: 6651336 - DNA, 17 bp, Homo sapiens
agtcttcttatctaaac

SEQ ID NO: 6651337 - DNA, 18 bp, Homo sapiens
agtcttcttatctaaacc

SEQ ID NO: 6651338 - DNA, 17 bp, Homo sapiens
agtcttctttcatgtaa

SEQ ID NO: 6651339 - DNA, 14 bp, Homo sapiens
agtcttgaaatgaa

SEQ ID NO: 6651340 - DNA, 18 bp, Homo sapiens
agtcttgaaatgaaaggg

SEQ ID NO: 6651341 - DNA, 20 bp, Homo sapiens
agtcttgaaatgaaagggaa

SEQ ID NO: 6651342 - DNA, 19 bp, Homo sapiens
agtcttgaagttgggtgtt

SEQ ID NO: 6651343 - DNA, 23 bp, Homo sapiens
agtcttgaagttgggtgtttcca

SEQ ID NO: 6651344 - DNA, 15 bp, Homo sapiens
agtcttgacctctcc

SEQ ID NO: 6651345 - DNA, 21 bp, Homo sapiens
agtcttgacctctccagcatc

SEQ ID NO: 6651346 - DNA, 17 bp, Homo sapiens
agtcttgacgagtgtga

SEQ ID NO: 6651347 - DNA, 17 bp, Homo sapiens
agtcttgagcaatgttt

SEQ ID NO: 6651348 - DNA, 18 bp, Homo sapiens
agtcttgagcaatgtttt

SEQ ID NO: 6651349 - DNA, 12 bp, Homo sapiens
agtcttgatcta

SEQ ID NO: 6651350 - DNA, 19 bp, Homo sapiens
agtcttgatctagatacag

SEQ ID NO: 6651351 - DNA, 16 bp, Homo sapiens
agtcttgcagcaggat

SEQ ID NO: 6651352 - DNA, 14 bp, Homo sapiens
agtcttgcagctga

SEQ ID NO: 6651353 - DNA, 15 bp, Homo sapiens
agtcttgcattgaat

SEQ ID NO: 6651354 - DNA, 13 bp, Homo sapiens
agtcttgcctagg

SEQ ID NO: 6651355 - DNA, 16 bp, Homo sapiens
agtcttgctctgtctc

SEQ ID NO: 6651356 - DNA, 21 bp, Homo sapiens
agtcttgctgtggtctctttg

SEQ ID NO: 6651357 - DNA, 18 bp, Homo sapiens
agtcttgctgtttcttga

SEQ ID NO: 6651358 - DNA, 20 bp, Homo sapiens
agtcttgctttgctgtctgg

SEQ ID NO: 6651359 - DNA, 16 bp, Homo sapiens
agtcttggaagctgtt

SEQ ID NO: 6651360 - DNA, 21 bp, Homo sapiens
agtcttggcggcagcagccat

SEQ ID NO: 6651361 - DNA, 15 bp, Homo sapiens
agtcttggctaagga

SEQ ID NO: 6651362 - DNA, 16 bp, Homo sapiens
agtcttgggcctggcc

SEQ ID NO: 6651363 - DNA, 21 bp, Homo sapiens
agtcttggtaaaacattactt

SEQ ID NO: 6651364 - DNA, 16 bp, Homo sapiens
agtcttggtggttcta

SEQ ID NO: 6651365 - DNA, 18 bp, Homo sapiens
agtcttgtactgtgacct

SEQ ID NO: 6651366 - DNA, 10 bp, Homo sapiens
agtcttgtat

SEQ ID NO: 6651367 - DNA, 15 bp, Homo sapiens
agtcttgtataacta

SEQ ID NO: 6651368 - DNA, 16 bp, Homo sapiens
agtcttgtattaagtt

SEQ ID NO: 6651369 - DNA, 18 bp, Homo sapiens
agtcttgtattaagttgt

SEQ ID NO: 6651370 - DNA, 13 bp, Homo sapiens
agtcttgtcccaa

SEQ ID NO: 6651371 - DNA, 16 bp, Homo sapiens
agtcttgtctcagatt

SEQ ID NO: 6651372 - DNA, 12 bp, Homo sapiens
agtcttgtgaaa

SEQ ID NO: 6651373 - DNA, 13 bp, Homo sapiens
agtcttgtgaaag

SEQ ID NO: 6651374 - DNA, 14 bp, Homo sapiens
agtcttgtgaaagt

SEQ ID NO: 6651375 - DNA, 17 bp, Homo sapiens
agtcttgtgactagtgc

SEQ ID NO: 6651376 - DNA, 21 bp, Homo sapiens
agtcttgtgactagtgctgaa

SEQ ID NO: 6651377 - DNA, 18 bp, Homo sapiens
agtcttgttgttcatata

SEQ ID NO: 6651378 - DNA, 13 bp, Homo sapiens
agtctttaataaa

SEQ ID NO: 6651379 - DNA, 14 bp, Homo sapiens
agtctttaataaat

SEQ ID NO: 6651380 - DNA, 14 bp, Homo sapiens
agtctttaatattt

SEQ ID NO: 6651381 - DNA, 14 bp, Homo sapiens
agtctttaatccca

SEQ ID NO: 6651382 - DNA, 18 bp, Homo sapiens
agtctttagctatctgtt

SEQ ID NO: 6651383 - DNA, 18 bp, Homo sapiens
agtctttagctattactg

SEQ ID NO: 6651384 - DNA, 15 bp, Homo sapiens
agtctttaggtcttt

SEQ ID NO: 6651385 - DNA, 21 bp, Homo sapiens
agtctttagtgttcaaatact

SEQ ID NO: 6651386 - DNA, 20 bp, Homo sapiens
agtctttatttttttcccat

SEQ ID NO: 6651387 - DNA, 23 bp, Homo sapiens
agtctttcaactgtttcagaaaa

SEQ ID NO: 6651388 - DNA, 20 bp, Homo sapiens
agtctttcacagtaccatct

SEQ ID NO: 6651389 - DNA, 15 bp, Homo sapiens
agtctttcatgtgtg

SEQ ID NO: 6651390 - DNA, 20 bp, Homo sapiens
agtctttcatgtgtgccaag

SEQ ID NO: 6651391 - DNA, 13 bp, Homo sapiens
agtctttccagag

SEQ ID NO: 6651392 - DNA, 19 bp, Homo sapiens
agtctttctcactgccttt

SEQ ID NO: 6651393 - DNA, 20 bp, Homo sapiens
agtctttctcctctttgaga

SEQ ID NO: 6651394 - DNA, 15 bp, Homo sapiens
agtctttctctttcc

SEQ ID NO: 6651395 - DNA, 17 bp, Homo sapiens
agtctttctctttccct

SEQ ID NO: 6651396 - DNA, 19 bp, Homo sapiens
agtctttctctttccctgg

SEQ ID NO: 6651397 - DNA, 23 bp, Homo sapiens
agtctttctctttccctggtccc

SEQ ID NO: 6651398 - DNA, 13 bp, Homo sapiens
agtctttcttaga

SEQ ID NO: 6651399 - DNA, 20 bp, Homo sapiens
agtctttcttagtgcctgtg

SEQ ID NO: 6651400 - DNA, 16 bp, Homo sapiens
agtctttcttcactct

SEQ ID NO: 6651401 - DNA, 23 bp, Homo sapiens
agtctttcttcactctggcttca

SEQ ID NO: 6651402 - DNA, 16 bp, Homo sapiens
agtctttcttcttcaa

SEQ ID NO: 6651403 - DNA, 18 bp, Homo sapiens
agtctttcttgaaattga

SEQ ID NO: 6651404 - DNA, 14 bp, Homo sapiens
agtctttgaagctg

SEQ ID NO: 6651405 - DNA, 19 bp, Homo sapiens
agtctttgatcatcatgta

SEQ ID NO: 6651406 - DNA, 18 bp, Homo sapiens
agtctttgcaccaaagat

SEQ ID NO: 6651407 - DNA, 17 bp, Homo sapiens
agtctttgccagtcatt

SEQ ID NO: 6651408 - DNA, 16 bp, Homo sapiens
agtctttgctcagtgg

SEQ ID NO: 6651409 - DNA, 21 bp, Homo sapiens
agtctttgggggattcaaatg

SEQ ID NO: 6651410 - DNA, 23 bp, Homo sapiens
agtctttgggggattcaaatgca

SEQ ID NO: 6651411 - DNA, 12 bp, Homo sapiens
agtctttggggt

SEQ ID NO: 6651412 - DNA, 16 bp, Homo sapiens
agtctttggttctaag

SEQ ID NO: 6651413 - DNA, 18 bp, Homo sapiens
agtctttgtgtgttatat

SEQ ID NO: 6651414 - DNA, 19 bp, Homo sapiens
agtctttgtgtgttatatt

SEQ ID NO: 6651415 - DNA, 13 bp, Homo sapiens
agtctttgtttac

SEQ ID NO: 6651416 - DNA, 11 bp, Homo sapiens
agtcttttaaa

SEQ ID NO: 6651417 - DNA, 18 bp, Homo sapiens
agtcttttaaaaagtatt

SEQ ID NO: 6651418 - DNA, 15 bp, Homo sapiens
agtcttttaacttta

SEQ ID NO: 6651419 - DNA, 21 bp, Homo sapiens
agtcttttaactttagaattc

SEQ ID NO: 6651420 - DNA, 14 bp, Homo sapiens
agtcttttctgtca

SEQ ID NO: 6651421 - DNA, 16 bp, Homo sapiens
agtcttttctgttatt

SEQ ID NO: 6651422 - DNA, 21 bp, Homo sapiens
agtcttttgcatgtcgcacaa

SEQ ID NO: 6651423 - DNA, 12 bp, Homo sapiens
agtcttttgctt

SEQ ID NO: 6651424 - DNA, 22 bp, Homo sapiens
agtcttttgttcgcatggtcac

SEQ ID NO: 6651425 - DNA, 22 bp, Homo sapiens
agtctttttagtgttttgcaag

SEQ ID NO: 6651426 - DNA, 14 bp, Homo sapiens
agtctttttatagg

SEQ ID NO: 6651427 - DNA, 17 bp, Homo sapiens
agtctttttataggttt

SEQ ID NO: 6651428 - DNA, 18 bp, Homo sapiens
agtctttttataggtttt

SEQ ID NO: 6651429 - DNA, 14 bp, Homo sapiens
agtctttttgaagt

SEQ ID NO: 6651430 - DNA, 15 bp, Homo sapiens
agtgaaaaaatgtaa

SEQ ID NO: 6651431 - DNA, 11 bp, Homo sapiens
agtgaaaaagg

SEQ ID NO: 6651432 - DNA, 20 bp, Homo sapiens
agtgaaaaaggaggaagaga

SEQ ID NO: 6651433 - DNA, 14 bp, Homo sapiens
agtgaaaaatatgt

SEQ ID NO: 6651434 - DNA, 21 bp, Homo sapiens
agtgaaaacctctttcggaaa

SEQ ID NO: 6651435 - DNA, 12 bp, Homo sapiens
agtgaaaactag

SEQ ID NO: 6651436 - DNA, 15 bp, Homo sapiens
agtgaaaactttgta

SEQ ID NO: 6651437 - DNA, 19 bp, Homo sapiens
agtgaaaagattttattta

SEQ ID NO: 6651438 - DNA, 13 bp, Homo sapiens
agtgaaaatacta

SEQ ID NO: 6651439 - DNA, 15 bp, Homo sapiens
agtgaaaatgccaca

SEQ ID NO: 6651440 - DNA, 15 bp, Homo sapiens
agtgaaaattgtctt

SEQ ID NO: 6651441 - DNA, 15 bp, Homo sapiens
agtgaaacacttgct

SEQ ID NO: 6651442 - DNA, 16 bp, Homo sapiens
agtgaaacacttgctt

SEQ ID NO: 6651443 - DNA, 17 bp, Homo sapiens
agtgaaacagagaaaga

SEQ ID NO: 6651444 - DNA, 17 bp, Homo sapiens
agtgaaaccatgactgt

SEQ ID NO: 6651445 - DNA, 21 bp, Homo sapiens
agtgaaacctttagggcagct

SEQ ID NO: 6651446 - DNA, 19 bp, Homo sapiens
agtgaaactgcattatttg

SEQ ID NO: 6651447 - DNA, 22 bp, Homo sapiens
agtgaaactgcattatttgttg

SEQ ID NO: 6651448 - DNA, 16 bp, Homo sapiens
agtgaaagaggcagct

SEQ ID NO: 6651449 - DNA, 22 bp, Homo sapiens
agtgaaataaattctgattctt

SEQ ID NO: 6651450 - DNA, 20 bp, Homo sapiens
agtgaaataacaaaatggac

SEQ ID NO: 6651451 - DNA, 18 bp, Homo sapiens
agtgaaataccattatta

SEQ ID NO: 6651452 - DNA, 19 bp, Homo sapiens
agtgaaatctgtgcaataa

SEQ ID NO: 6651453 - DNA, 15 bp, Homo sapiens
agtgaaatggatact

SEQ ID NO: 6651454 - DNA, 16 bp, Homo sapiens
agtgaaattagtattt

SEQ ID NO: 6651455 - DNA, 17 bp, Homo sapiens
agtgaaattattttgga

SEQ ID NO: 6651456 - DNA, 20 bp, Homo sapiens
agtgaaatttctagcctgca

SEQ ID NO: 6651457 - DNA, 14 bp, Homo sapiens
agtgaaattttaaa

SEQ ID NO: 6651458 - DNA, 16 bp, Homo sapiens
agtgaaattttaaaag

SEQ ID NO: 6651459 - DNA, 18 bp, Homo sapiens
agtgaaattttaaaagtc

SEQ ID NO: 6651460 - DNA, 21 bp, Homo sapiens
agtgaaattttggtgaatgtg

SEQ ID NO: 6651461 - DNA, 22 bp, Homo sapiens
agtgaacaaatttacagagaca

SEQ ID NO: 6651462 - DNA, 20 bp, Homo sapiens
agtgaacacactcagcagcc

SEQ ID NO: 6651463 - DNA, 19 bp, Homo sapiens
agtgaacacccccagctgg

SEQ ID NO: 6651464 - DNA, 17 bp, Homo sapiens
agtgaacagattttatt

SEQ ID NO: 6651465 - DNA, 15 bp, Homo sapiens
agtgaacagtttgga

SEQ ID NO: 6651466 - DNA, 19 bp, Homo sapiens
agtgaacattcccagccca

SEQ ID NO: 6651467 - DNA, 20 bp, Homo sapiens
agtgaacattcccagcccag

SEQ ID NO: 6651468 - DNA, 14 bp, Homo sapiens
agtgaacatttcta

SEQ ID NO: 6651469 - DNA, 21 bp, Homo sapiens
agtgaaccaaaaatagaaatt

SEQ ID NO: 6651470 - DNA, 15 bp, Homo sapiens
agtgaaccaaagaga

SEQ ID NO: 6651471 - DNA, 17 bp, Homo sapiens
agtgaaccgtcctttca

SEQ ID NO: 6651472 - DNA, 15 bp, Homo sapiens
agtgaacctgtataa

SEQ ID NO: 6651473 - DNA, 22 bp, Homo sapiens
agtgaaccttaaggaagagaga

SEQ ID NO: 6651474 - DNA, 23 bp, Homo sapiens
agtgaacctttaaagtaaaggcc

SEQ ID NO: 6651475 - DNA, 17 bp, Homo sapiens
agtgaactaaatatttt

SEQ ID NO: 6651476 - DNA, 18 bp, Homo sapiens
agtgaactaccatgcttt

SEQ ID NO: 6651477 - DNA, 23 bp, Homo sapiens
agtgaactaccatgctttgttta

SEQ ID NO: 6651478 - DNA, 16 bp, Homo sapiens
agtgaactcctgccag

SEQ ID NO: 6651479 - DNA, 20 bp, Homo sapiens
agtgaacttgggccactgtg

SEQ ID NO: 6651480 - DNA, 22 bp, Homo sapiens
agtgaacttttgtaatttgaat

SEQ ID NO: 6651481 - DNA, 23 bp, Homo sapiens
agtgaacttttgtaatttgaatt

SEQ ID NO: 6651482 - DNA, 16 bp, Homo sapiens
agtgaagaaaagtgaa

SEQ ID NO: 6651483 - DNA, 22 bp, Homo sapiens
agtgaagaatacttctcatttt

SEQ ID NO: 6651484 - DNA, 17 bp, Homo sapiens
agtgaagaatccttttg

SEQ ID NO: 6651485 - DNA, 12 bp, Homo sapiens
agtgaagacaga

SEQ ID NO: 6651486 - DNA, 14 bp, Homo sapiens
agtgaagacagaag

SEQ ID NO: 6651487 - DNA, 15 bp, Homo sapiens
agtgaagaccagagc

SEQ ID NO: 6651488 - DNA, 15 bp, Homo sapiens
agtgaagactccaga

SEQ ID NO: 6651489 - DNA, 19 bp, Homo sapiens
agtgaagagggagaaggga

SEQ ID NO: 6651490 - DNA, 13 bp, Homo sapiens
agtgaagaggggc

SEQ ID NO: 6651491 - DNA, 14 bp, Homo sapiens
agtgaagaggggca

SEQ ID NO: 6651492 - DNA, 15 bp, Homo sapiens
agtgaagaggggcag

SEQ ID NO: 6651493 - DNA, 23 bp, Homo sapiens
agtgaagagtagaacccaggtct

SEQ ID NO: 6651494 - DNA, 14 bp, Homo sapiens
agtgaagagtgaag

SEQ ID NO: 6651495 - DNA, 20 bp, Homo sapiens
agtgaagatgcaatcagaca

SEQ ID NO: 6651496 - DNA, 19 bp, Homo sapiens
agtgaagatgtgtaaataa

SEQ ID NO: 6651497 - DNA, 13 bp, Homo sapiens
agtgaagcattta

SEQ ID NO: 6651498 - DNA, 15 bp, Homo sapiens
agtgaagcatttaaa

SEQ ID NO: 6651499 - DNA, 18 bp, Homo sapiens
agtgaagcatttaaaaga

SEQ ID NO: 6651500 - DNA, 15 bp, Homo sapiens
agtgaagcccaggag

SEQ ID NO: 6651501 - DNA, 20 bp, Homo sapiens
agtgaagcccaggaggacct

SEQ ID NO: 6651502 - DNA, 18 bp, Homo sapiens
agtgaagccccttgtcct

SEQ ID NO: 6651503 - DNA, 21 bp, Homo sapiens
agtgaagccccttgtcctctc

SEQ ID NO: 6651504 - DNA, 17 bp, Homo sapiens
agtgaagcctaccagaa

SEQ ID NO: 6651505 - DNA, 18 bp, Homo sapiens
agtgaagctcccttcagg

SEQ ID NO: 6651506 - DNA, 12 bp, Homo sapiens
agtgaaggagaa

SEQ ID NO: 6651507 - DNA, 16 bp, Homo sapiens
agtgaaggagaaagga

SEQ ID NO: 6651508 - DNA, 20 bp, Homo sapiens
agtgaaggagaaaggagccg

SEQ ID NO: 6651509 - DNA, 22 bp, Homo sapiens
agtgaaggattggatgattgtt

SEQ ID NO: 6651510 - DNA, 15 bp, Homo sapiens
agtgaaggtctttgt

SEQ ID NO: 6651511 - DNA, 18 bp, Homo sapiens
agtgaaggtttacaattt

SEQ ID NO: 6651512 - DNA, 23 bp, Homo sapiens
agtgaaggtttacaatttacaaa

SEQ ID NO: 6651513 - DNA, 16 bp, Homo sapiens
agtgaagtagcctctt

SEQ ID NO: 6651514 - DNA, 16 bp, Homo sapiens
agtgaagtatgcacta

SEQ ID NO: 6651515 - DNA, 21 bp, Homo sapiens
agtgaagtatgcactaatcaa

SEQ ID NO: 6651516 - DNA, 15 bp, Homo sapiens
agtgaagtattgctg

SEQ ID NO: 6651517 - DNA, 15 bp, Homo sapiens
agtgaagtccttcag

SEQ ID NO: 6651518 - DNA, 22 bp, Homo sapiens
agtgaagtctagaatcatactt

SEQ ID NO: 6651519 - DNA, 13 bp, Homo sapiens
agtgaagtggcct

SEQ ID NO: 6651520 - DNA, 12 bp, Homo sapiens
agtgaagtgtta

SEQ ID NO: 6651521 - DNA, 18 bp, Homo sapiens
agtgaagtgttaatacat

SEQ ID NO: 6651522 - DNA, 22 bp, Homo sapiens
agtgaagttcttttactgtaat

SEQ ID NO: 6651523 - DNA, 15 bp, Homo sapiens
agtgaagttgctgct

SEQ ID NO: 6651524 - DNA, 19 bp, Homo sapiens
agtgaagttgcttcttcta

SEQ ID NO: 6651525 - DNA, 12 bp, Homo sapiens
agtgaataaact

SEQ ID NO: 6651526 - DNA, 15 bp, Homo sapiens
agtgaataaacttca

SEQ ID NO: 6651527 - DNA, 16 bp, Homo sapiens
agtgaataaacttcag

SEQ ID NO: 6651528 - DNA, 13 bp, Homo sapiens
agtgaataaatgt

SEQ ID NO: 6651529 - DNA, 15 bp, Homo sapiens
agtgaatacactgga

SEQ ID NO: 6651530 - DNA, 23 bp, Homo sapiens
agtgaatacattaacggtgctaa

SEQ ID NO: 6651531 - DNA, 16 bp, Homo sapiens
agtgaatactgctaca

SEQ ID NO: 6651532 - DNA, 21 bp, Homo sapiens
agtgaatacttactataattt

SEQ ID NO: 6651533 - DNA, 22 bp, Homo sapiens
agtgaatacttactataatttg

SEQ ID NO: 6651534 - DNA, 16 bp, Homo sapiens
agtgaatagctttcag

SEQ ID NO: 6651535 - DNA, 15 bp, Homo sapiens
agtgaatataaatgt

SEQ ID NO: 6651536 - DNA, 23 bp, Homo sapiens
agtgaatatttttgtattttaca

SEQ ID NO: 6651537 - DNA, 18 bp, Homo sapiens
agtgaatcttatggtgga

SEQ ID NO: 6651538 - DNA, 19 bp, Homo sapiens
agtgaatcttatggtggaa

SEQ ID NO: 6651539 - DNA, 19 bp, Homo sapiens
agtgaatctttctcctggt

SEQ ID NO: 6651540 - DNA, 13 bp, Homo sapiens
agtgaatgaaaca

SEQ ID NO: 6651541 - DNA, 13 bp, Homo sapiens
agtgaatgaaaga

SEQ ID NO: 6651542 - DNA, 14 bp, Homo sapiens
agtgaatgaaagat

SEQ ID NO: 6651543 - DNA, 14 bp, Homo sapiens
agtgaatgaagttg

SEQ ID NO: 6651544 - DNA, 17 bp, Homo sapiens
agtgaatgccagtgtgc

SEQ ID NO: 6651545 - DNA, 15 bp, Homo sapiens
agtgaatgctgggac

SEQ ID NO: 6651546 - DNA, 17 bp, Homo sapiens
agtgaatgtaggctggc

SEQ ID NO: 6651547 - DNA, 11 bp, Homo sapiens
agtgaatgtta

SEQ ID NO: 6651548 - DNA, 14 bp, Homo sapiens
agtgaatgttaaca

SEQ ID NO: 6651549 - DNA, 22 bp, Homo sapiens
agtgaattacactcaaggaaaa

SEQ ID NO: 6651550 - DNA, 16 bp, Homo sapiens
agtgaattagaccttt

SEQ ID NO: 6651551 - DNA, 20 bp, Homo sapiens
agtgaattagttttaaaatg

SEQ ID NO: 6651552 - DNA, 15 bp, Homo sapiens
agtgaattccctcac

SEQ ID NO: 6651553 - DNA, 16 bp, Homo sapiens
agtgaattccctcact

SEQ ID NO: 6651554 - DNA, 23 bp, Homo sapiens
agtgaattccctcactcgtctcc

SEQ ID NO: 6651555 - DNA, 15 bp, Homo sapiens
agtgaattgtaccta

SEQ ID NO: 6651556 - DNA, 24 bp, Homo sapiens
agtgaattgtacctatttctgatg

SEQ ID NO: 6651557 - DNA, 17 bp, Homo sapiens
agtgaatttatgagatt

SEQ ID NO: 6651558 - DNA, 18 bp, Homo sapiens
agtgaatttctaaatgtt

SEQ ID NO: 6651559 - DNA, 11 bp, Homo sapiens
agtgaatttga

SEQ ID NO: 6651560 - DNA, 13 bp, Homo sapiens
agtgaatttgaat

SEQ ID NO: 6651561 - DNA, 14 bp, Homo sapiens
agtgaatttgcctg

SEQ ID NO: 6651562 - DNA, 14 bp, Homo sapiens
agtgaatttgtcca

SEQ ID NO: 6651563 - DNA, 15 bp, Homo sapiens
agtgaatttgtccat

SEQ ID NO: 6651564 - DNA, 18 bp, Homo sapiens
agtgaatttttaaagaca

SEQ ID NO: 6651565 - DNA, 20 bp, Homo sapiens
agtgaatttttctctaactc

SEQ ID NO: 6651566 - DNA, 15 bp, Homo sapiens
agtgaatttttgcaa

SEQ ID NO: 6651567 - DNA, 20 bp, Homo sapiens
agtgacaaaagcagcacaag

SEQ ID NO: 6651568 - DNA, 23 bp, Homo sapiens
agtgacaaaagcagcacaaggaa

SEQ ID NO: 6651569 - DNA, 14 bp, Homo sapiens
agtgacaaaataga

SEQ ID NO: 6651570 - DNA, 20 bp, Homo sapiens
agtgacaaaatgggaggagg

SEQ ID NO: 6651571 - DNA, 17 bp, Homo sapiens
agtgacaaagactcctc

SEQ ID NO: 6651572 - DNA, 13 bp, Homo sapiens
agtgacaaagtta

SEQ ID NO: 6651573 - DNA, 20 bp, Homo sapiens
agtgacaaagttatatattt

SEQ ID NO: 6651574 - DNA, 14 bp, Homo sapiens
agtgacaaggcccc

SEQ ID NO: 6651575 - DNA, 20 bp, Homo sapiens
agtgacaaggccccagagac

SEQ ID NO: 6651576 - DNA, 15 bp, Homo sapiens
agtgacaagtggagg

SEQ ID NO: 6651577 - DNA, 16 bp, Homo sapiens
agtgacaagtggaggg

SEQ ID NO: 6651578 - DNA, 19 bp, Homo sapiens
agtgacaatgcttatggaa

SEQ ID NO: 6651579 - DNA, 20 bp, Homo sapiens
agtgacaatgcttatggaaa

SEQ ID NO: 6651580 - DNA, 21 bp, Homo sapiens
agtgacaatgcttatggaaag

SEQ ID NO: 6651581 - DNA, 14 bp, Homo sapiens
agtgacacagacat

SEQ ID NO: 6651582 - DNA, 17 bp, Homo sapiens
agtgacacagacatttt

SEQ ID NO: 6651583 - DNA, 18 bp, Homo sapiens
agtgacacagacattttg

SEQ ID NO: 6651584 - DNA, 23 bp, Homo sapiens
agtgacacagacattttgtgtga

SEQ ID NO: 6651585 - DNA, 13 bp, Homo sapiens
agtgacacagcag

SEQ ID NO: 6651586 - DNA, 17 bp, Homo sapiens
agtgacacagcagcttc

SEQ ID NO: 6651587 - DNA, 17 bp, Homo sapiens
agtgacacattaatgat

SEQ ID NO: 6651588 - DNA, 22 bp, Homo sapiens
agtgacaccaataaatgtttgt

SEQ ID NO: 6651589 - DNA, 19 bp, Homo sapiens
agtgacacccaagagggct

SEQ ID NO: 6651590 - DNA, 17 bp, Homo sapiens
agtgacacccagaggga

SEQ ID NO: 6651591 - DNA, 18 bp, Homo sapiens
agtgacacttcagagagc

SEQ ID NO: 6651592 - DNA, 17 bp, Homo sapiens
agtgacagaaggcccga

SEQ ID NO: 6651593 - DNA, 16 bp, Homo sapiens
agtgacagacaggctc

SEQ ID NO: 6651594 - DNA, 21 bp, Homo sapiens
agtgacagaccacatctttat

SEQ ID NO: 6651595 - DNA, 14 bp, Homo sapiens
agtgacagaggcag

SEQ ID NO: 6651596 - DNA, 16 bp, Homo sapiens
agtgacagaggcagcc

SEQ ID NO: 6651597 - DNA, 19 bp, Homo sapiens
agtgacagaggcagcccca

SEQ ID NO: 6651598 - DNA, 13 bp, Homo sapiens
agtgacagagtaa

SEQ ID NO: 6651599 - DNA, 14 bp, Homo sapiens
agtgacagctttcc

SEQ ID NO: 6651600 - DNA, 23 bp, Homo sapiens
agtgacagctttcctcaaaaagc

SEQ ID NO: 6651601 - DNA, 15 bp, Homo sapiens
agtgacagctttctg

SEQ ID NO: 6651602 - DNA, 18 bp, Homo sapiens
agtgacagctttctggga

SEQ ID NO: 6651603 - DNA, 21 bp, Homo sapiens
agtgacagctttctgggatgt

SEQ ID NO: 6651604 - DNA, 13 bp, Homo sapiens
agtgacagggaag

SEQ ID NO: 6651605 - DNA, 16 bp, Homo sapiens
agtgacagggaagcta

SEQ ID NO: 6651606 - DNA, 23 bp, Homo sapiens
agtgacagggaagctacaggtta

SEQ ID NO: 6651607 - DNA, 19 bp, Homo sapiens
agtgacagtggattgcatt

SEQ ID NO: 6651608 - DNA, 13 bp, Homo sapiens
agtgacagtttct

SEQ ID NO: 6651609 - DNA, 22 bp, Homo sapiens
agtgacataatatattctattt

SEQ ID NO: 6651610 - DNA, 15 bp, Homo sapiens
agtgacatagcctca

SEQ ID NO: 6651611 - DNA, 20 bp, Homo sapiens
agtgacatcaaagcctggcc

SEQ ID NO: 6651612 - DNA, 22 bp, Homo sapiens
agtgacatgggtgtgccaggct

SEQ ID NO: 6651613 - DNA, 16 bp, Homo sapiens
agtgacatttaatgcc

SEQ ID NO: 6651614 - DNA, 18 bp, Homo sapiens
agtgaccaaattgggaga

SEQ ID NO: 6651615 - DNA, 13 bp, Homo sapiens
agtgaccacttat

SEQ ID NO: 6651616 - DNA, 19 bp, Homo sapiens
agtgaccagggaagtgtgt

SEQ ID NO: 6651617 - DNA, 19 bp, Homo sapiens
agtgaccataaaggcatgg

SEQ ID NO: 6651618 - DNA, 20 bp, Homo sapiens
agtgaccattattcacaggt

SEQ ID NO: 6651619 - DNA, 22 bp, Homo sapiens
agtgacccagatattgcactag

SEQ ID NO: 6651620 - DNA, 21 bp, Homo sapiens
agtgaccccagcctcctgcct

SEQ ID NO: 6651621 - DNA, 15 bp, Homo sapiens
agtgaccccagctcc

SEQ ID NO: 6651622 - DNA, 15 bp, Homo sapiens
agtgaccccagggcc

SEQ ID NO: 6651623 - DNA, 18 bp, Homo sapiens
agtgacccggaggccaca

SEQ ID NO: 6651624 - DNA, 18 bp, Homo sapiens
agtgaccctcagctgtca

SEQ ID NO: 6651625 - DNA, 19 bp, Homo sapiens
agtgaccctcagctgtcac

SEQ ID NO: 6651626 - DNA, 14 bp, Homo sapiens
agtgaccctgctct

SEQ ID NO: 6651627 - DNA, 15 bp, Homo sapiens
agtgaccctggctcc

SEQ ID NO: 6651628 - DNA, 20 bp, Homo sapiens
agtgaccgacaaaattccag

SEQ ID NO: 6651629 - DNA, 15 bp, Homo sapiens
agtgaccgagagaac

SEQ ID NO: 6651630 - DNA, 19 bp, Homo sapiens
agtgacctaaagcattttt

SEQ ID NO: 6651631 - DNA, 16 bp, Homo sapiens
agtgacctcactggcc

SEQ ID NO: 6651632 - DNA, 22 bp, Homo sapiens
agtgacctcactggcctgccat

SEQ ID NO: 6651633 - DNA, 17 bp, Homo sapiens
agtgacctcagctttga

SEQ ID NO: 6651634 - DNA, 18 bp, Homo sapiens
agtgacctcagctttgat

SEQ ID NO: 6651635 - DNA, 18 bp, Homo sapiens
agtgacctccagagctgt

SEQ ID NO: 6651636 - DNA, 17 bp, Homo sapiens
agtgacctcggacagag

SEQ ID NO: 6651637 - DNA, 13 bp, Homo sapiens
agtgacctgaccg

SEQ ID NO: 6651638 - DNA, 22 bp, Homo sapiens
agtgacctgaccggcacctgcg

SEQ ID NO: 6651639 - DNA, 16 bp, Homo sapiens
agtgacctgaggaagc

SEQ ID NO: 6651640 - DNA, 14 bp, Homo sapiens
agtgacctgtttat

SEQ ID NO: 6651641 - DNA, 16 bp, Homo sapiens
agtgaccttttaatca

SEQ ID NO: 6651642 - DNA, 14 bp, Homo sapiens
agtgaccttttctt

SEQ ID NO: 6651643 - DNA, 16 bp, Homo sapiens
agtgactaaaccattg

SEQ ID NO: 6651644 - DNA, 17 bp, Homo sapiens
agtgactaatggcatga

SEQ ID NO: 6651645 - DNA, 18 bp, Homo sapiens
agtgactcatcctcttga

SEQ ID NO: 6651646 - DNA, 18 bp, Homo sapiens
agtgactccaagaacaat

SEQ ID NO: 6651647 - DNA, 11 bp, Homo sapiens
agtgactccag

SEQ ID NO: 6651648 - DNA, 16 bp, Homo sapiens
agtgactccccagccc

SEQ ID NO: 6651649 - DNA, 20 bp, Homo sapiens
agtgactccccagcccagca

SEQ ID NO: 6651650 - DNA, 16 bp, Homo sapiens
agtgactcctgctggt

SEQ ID NO: 6651651 - DNA, 22 bp, Homo sapiens
agtgactcctgctggtacctgc

SEQ ID NO: 6651652 - DNA, 20 bp, Homo sapiens
agtgactcgggctcctgtgc

SEQ ID NO: 6651653 - DNA, 22 bp, Homo sapiens
agtgactcgggctcctgtgccc

SEQ ID NO: 6651654 - DNA, 15 bp, Homo sapiens
agtgactcggtgtaa

SEQ ID NO: 6651655 - DNA, 22 bp, Homo sapiens
agtgactcggtgtaaaaccatg

SEQ ID NO: 6651656 - DNA, 16 bp, Homo sapiens
agtgactctggctgcc

SEQ ID NO: 6651657 - DNA, 18 bp, Homo sapiens
agtgactctggctgccaa

SEQ ID NO: 6651658 - DNA, 19 bp, Homo sapiens
agtgactctggctgccaag

SEQ ID NO: 6651659 - DNA, 22 bp, Homo sapiens
agtgactgaaaccattttccca

SEQ ID NO: 6651660 - DNA, 19 bp, Homo sapiens
agtgactgctgcgctgtgc

SEQ ID NO: 6651661 - DNA, 13 bp, Homo sapiens
agtgactggcagg

SEQ ID NO: 6651662 - DNA, 17 bp, Homo sapiens
agtgactggcaggtgca

SEQ ID NO: 6651663 - DNA, 21 bp, Homo sapiens
agtgactgggccctgtccagg

SEQ ID NO: 6651664 - DNA, 17 bp, Homo sapiens
agtgactgtatctgtgt

SEQ ID NO: 6651665 - DNA, 15 bp, Homo sapiens
agtgactgttgtacc

SEQ ID NO: 6651666 - DNA, 20 bp, Homo sapiens
agtgactgttgtagcatttt

SEQ ID NO: 6651667 - DNA, 21 bp, Homo sapiens
agtgactgttgtagcattttc

SEQ ID NO: 6651668 - DNA, 17 bp, Homo sapiens
agtgactgtttggctta

SEQ ID NO: 6651669 - DNA, 21 bp, Homo sapiens
agtgacttcttccctaaaatg

SEQ ID NO: 6651670 - DNA, 19 bp, Homo sapiens
agtgacttgaatgtacaaa

SEQ ID NO: 6651671 - DNA, 22 bp, Homo sapiens
agtgacttgaatgtacaaagat

SEQ ID NO: 6651672 - DNA, 17 bp, Homo sapiens
agtgactttaaaagaaa

SEQ ID NO: 6651673 - DNA, 16 bp, Homo sapiens
agtgactttttctgag

SEQ ID NO: 6651674 - DNA, 19 bp, Homo sapiens
agtgactttttctgagctt

SEQ ID NO: 6651675 - DNA, 20 bp, Homo sapiens
agtgagaaagggcatacatc

SEQ ID NO: 6651676 - DNA, 22 bp, Homo sapiens
agtgagaaattacaggttcctt

SEQ ID NO: 6651677 - DNA, 19 bp, Homo sapiens
agtgagaaattatgaaagt

SEQ ID NO: 6651678 - DNA, 20 bp, Homo sapiens
agtgagaactctctccctgg

SEQ ID NO: 6651679 - DNA, 17 bp, Homo sapiens
agtgagaagaatattgt

SEQ ID NO: 6651680 - DNA, 21 bp, Homo sapiens
agtgagaagggcctgctctgc

SEQ ID NO: 6651681 - DNA, 18 bp, Homo sapiens
agtgagaagggctcagag

SEQ ID NO: 6651682 - DNA, 22 bp, Homo sapiens
agtgagaagggctcagagagga

SEQ ID NO: 6651683 - DNA, 18 bp, Homo sapiens
agtgagaataattgtgta

SEQ ID NO: 6651684 - DNA, 21 bp, Homo sapiens
agtgagaataattgtgtacaa

SEQ ID NO: 6651685 - DNA, 20 bp, Homo sapiens
agtgagaatctggctcctgt

SEQ ID NO: 6651686 - DNA, 16 bp, Homo sapiens
agtgagaatgccgggc

SEQ ID NO: 6651687 - DNA, 15 bp, Homo sapiens
agtgagacaaaattt

SEQ ID NO: 6651688 - DNA, 13 bp, Homo sapiens
agtgagacacaga

SEQ ID NO: 6651689 - DNA, 12 bp, Homo sapiens
agtgagacagaa

SEQ ID NO: 6651690 - DNA, 14 bp, Homo sapiens
agtgagacagctct

SEQ ID NO: 6651691 - DNA, 21 bp, Homo sapiens
agtgagacagtccagcctgga

SEQ ID NO: 6651692 - DNA, 16 bp, Homo sapiens
agtgagacagtctgga

SEQ ID NO: 6651693 - DNA, 19 bp, Homo sapiens
agtgagacccaaaggaaga

SEQ ID NO: 6651694 - DNA, 21 bp, Homo sapiens
agtgagacccagccctcatcc

SEQ ID NO: 6651695 - DNA, 14 bp, Homo sapiens
agtgagacccagga

SEQ ID NO: 6651696 - DNA, 14 bp, Homo sapiens
agtgagaccttgtc

SEQ ID NO: 6651697 - DNA, 16 bp, Homo sapiens
agtgagaccttgtctc

SEQ ID NO: 6651698 - DNA, 17 bp, Homo sapiens
agtgagactccacctca

SEQ ID NO: 6651699 - DNA, 21 bp, Homo sapiens
agtgagactcctgattgctct

SEQ ID NO: 6651700 - DNA, 13 bp, Homo sapiens
agtgagactctgt

SEQ ID NO: 6651701 - DNA, 11 bp, Homo sapiens
agtgagactga

SEQ ID NO: 6651702 - DNA, 17 bp, Homo sapiens
agtgagactgactgcaa

SEQ ID NO: 6651703 - DNA, 11 bp, Homo sapiens
agtgagactgc

SEQ ID NO: 6651704 - DNA, 14 bp, Homo sapiens
agtgagactgtaca

SEQ ID NO: 6651705 - DNA, 16 bp, Homo sapiens
agtgagactgtacata

SEQ ID NO: 6651706 - DNA, 22 bp, Homo sapiens
agtgagagacgccctatttcta

SEQ ID NO: 6651707 - DNA, 13 bp, Homo sapiens
agtgagagagagt

SEQ ID NO: 6651708 - DNA, 14 bp, Homo sapiens
agtgagagagagtg

SEQ ID NO: 6651709 - DNA, 13 bp, Homo sapiens
agtgagagaggag

SEQ ID NO: 6651710 - DNA, 22 bp, Homo sapiens
agtgagagaggaggcctggacc

SEQ ID NO: 6651711 - DNA, 14 bp, Homo sapiens
agtgagagcagatg

SEQ ID NO: 6651712 - DNA, 19 bp, Homo sapiens
agtgagagcatgtgagggg

SEQ ID NO: 6651713 - DNA, 20 bp, Homo sapiens
agtgagagcctttgccttta

SEQ ID NO: 6651714 - DNA, 14 bp, Homo sapiens
agtgagagctgggt

SEQ ID NO: 6651715 - DNA, 16 bp, Homo sapiens
agtgagagctttgctt

SEQ ID NO: 6651716 - DNA, 13 bp, Homo sapiens
agtgagaggcccc

SEQ ID NO: 6651717 - DNA, 13 bp, Homo sapiens
agtgagagggcat

SEQ ID NO: 6651718 - DNA, 22 bp, Homo sapiens
agtgagagggcatgcgcacaag

SEQ ID NO: 6651719 - DNA, 13 bp, Homo sapiens
agtgagaggggag

SEQ ID NO: 6651720 - DNA, 12 bp, Homo sapiens
agtgagagtgag

SEQ ID NO: 6651721 - DNA, 22 bp, Homo sapiens
agtgagatagcattgtgaactg

SEQ ID NO: 6651722 - DNA, 23 bp, Homo sapiens
agtgagatataggataaaataat

SEQ ID NO: 6651723 - DNA, 15 bp, Homo sapiens
agtgagatcaatgtg

SEQ ID NO: 6651724 - DNA, 16 bp, Homo sapiens
agtgagatgggaaggg

SEQ ID NO: 6651725 - DNA, 15 bp, Homo sapiens
agtgagatgtttggc

SEQ ID NO: 6651726 - DNA, 17 bp, Homo sapiens
agtgagatgtttggcaa

SEQ ID NO: 6651727 - DNA, 23 bp, Homo sapiens
agtgagatttgtatttatattag

SEQ ID NO: 6651728 - DNA, 22 bp, Homo sapiens
agtgagcaaaatatgccccttc

SEQ ID NO: 6651729 - DNA, 18 bp, Homo sapiens
agtgagcaaacctgcccc

SEQ ID NO: 6651730 - DNA, 18 bp, Homo sapiens
agtgagcaagggggccca

SEQ ID NO: 6651731 - DNA, 22 bp, Homo sapiens
agtgagcactaaggtgtgctct

SEQ ID NO: 6651732 - DNA, 15 bp, Homo sapiens
agtgagcactgaaac

SEQ ID NO: 6651733 - DNA, 16 bp, Homo sapiens
agtgagcagaacaggt

SEQ ID NO: 6651734 - DNA, 17 bp, Homo sapiens
agtgagcagaacaggta

SEQ ID NO: 6651735 - DNA, 19 bp, Homo sapiens
agtgagcagaacaggtagt

SEQ ID NO: 6651736 - DNA, 16 bp, Homo sapiens
agtgagcagagatgta

SEQ ID NO: 6651737 - DNA, 11 bp, Homo sapiens
agtgagcagct

SEQ ID NO: 6651738 - DNA, 17 bp, Homo sapiens
agtgagcagctactgta

SEQ ID NO: 6651739 - DNA, 22 bp, Homo sapiens
agtgagcagctactgtaacttt

SEQ ID NO: 6651740 - DNA, 15 bp, Homo sapiens
agtgagcaggacggg

SEQ ID NO: 6651741 - DNA, 14 bp, Homo sapiens
agtgagcagggttc

SEQ ID NO: 6651742 - DNA, 13 bp, Homo sapiens
agtgagcagtaga

SEQ ID NO: 6651743 - DNA, 23 bp, Homo sapiens
agtgagcatatctggtatatgtc

SEQ ID NO: 6651744 - DNA, 22 bp, Homo sapiens
agtgagcatggaacacttcgag

SEQ ID NO: 6651745 - DNA, 15 bp, Homo sapiens
agtgagccaaaatca

SEQ ID NO: 6651746 - DNA, 21 bp, Homo sapiens
agtgagccatgattttctaaa

SEQ ID NO: 6651747 - DNA, 12 bp, Homo sapiens
agtgagcccccc

SEQ ID NO: 6651748 - DNA, 15 bp, Homo sapiens
agtgagcccccccct

SEQ ID NO: 6651749 - DNA, 17 bp, Homo sapiens
agtgagcccctccccag

SEQ ID NO: 6651750 - DNA, 13 bp, Homo sapiens
agtgagccctctt

SEQ ID NO: 6651751 - DNA, 13 bp, Homo sapiens
agtgagccctgct

SEQ ID NO: 6651752 - DNA, 16 bp, Homo sapiens
agtgagccgagattgt

SEQ ID NO: 6651753 - DNA, 24 bp, Homo sapiens
agtgagccgcatcttctccatctg

SEQ ID NO: 6651754 - DNA, 13 bp, Homo sapiens
agtgagcctcctg

SEQ ID NO: 6651755 - DNA, 17 bp, Homo sapiens
agtgagcctcctgtgcc

SEQ ID NO: 6651756 - DNA, 19 bp, Homo sapiens
agtgagcctcctgtgcctg

SEQ ID NO: 6651757 - DNA, 22 bp, Homo sapiens
agtgagcctcctgtgcctggcc

SEQ ID NO: 6651758 - DNA, 19 bp, Homo sapiens
agtgagcctctgcgcctct

SEQ ID NO: 6651759 - DNA, 21 bp, Homo sapiens
agtgagcctgaattttgttgc

SEQ ID NO: 6651760 - DNA, 13 bp, Homo sapiens
agtgagcctgggc

SEQ ID NO: 6651761 - DNA, 17 bp, Homo sapiens
agtgagcctgggccagg

SEQ ID NO: 6651762 - DNA, 14 bp, Homo sapiens
agtgagcgagtgga

SEQ ID NO: 6651763 - DNA, 21 bp, Homo sapiens
agtgagcgagtggatgctgtg

SEQ ID NO: 6651764 - DNA, 22 bp, Homo sapiens
agtgagcgagtggatgctgtgc

SEQ ID NO: 6651765 - DNA, 14 bp, Homo sapiens
agtgagctacagag

SEQ ID NO: 6651766 - DNA, 19 bp, Homo sapiens
agtgagctatgagcccagc

SEQ ID NO: 6651767 - DNA, 16 bp, Homo sapiens
agtgagctctatgggc

SEQ ID NO: 6651768 - DNA, 14 bp, Homo sapiens
agtgagctgagaca

SEQ ID NO: 6651769 - DNA, 13 bp, Homo sapiens
agtgagctgggca

SEQ ID NO: 6651770 - DNA, 12 bp, Homo sapiens
agtgagctggtt

SEQ ID NO: 6651771 - DNA, 17 bp, Homo sapiens
agtgaggaaatcaaagt

SEQ ID NO: 6651772 - DNA, 20 bp, Homo sapiens
agtgaggaaggcaggaagag

SEQ ID NO: 6651773 - DNA, 14 bp, Homo sapiens
agtgaggagggatg

SEQ ID NO: 6651774 - DNA, 12 bp, Homo sapiens
agtgaggagggt

SEQ ID NO: 6651775 - DNA, 18 bp, Homo sapiens
agtgaggagtggacgctg

SEQ ID NO: 6651776 - DNA, 16 bp, Homo sapiens
agtgaggatgagaccc

SEQ ID NO: 6651777 - DNA, 22 bp, Homo sapiens
agtgaggatgagacccagcccc

SEQ ID NO: 6651778 - DNA, 23 bp, Homo sapiens
agtgaggatgagacccagcccct

SEQ ID NO: 6651779 - DNA, 20 bp, Homo sapiens
agtgaggatggatttagaaa

SEQ ID NO: 6651780 - DNA, 21 bp, Homo sapiens
agtgaggattttgttgatacc

SEQ ID NO: 6651781 - DNA, 15 bp, Homo sapiens
agtgaggcaagagaa

SEQ ID NO: 6651782 - DNA, 19 bp, Homo sapiens
agtgaggcaagagaaatga

SEQ ID NO: 6651783 - DNA, 20 bp, Homo sapiens
agtgaggcaagagaaatgag

SEQ ID NO: 6651784 - DNA, 21 bp, Homo sapiens
agtgaggcagccgaggtccct

SEQ ID NO: 6651785 - DNA, 18 bp, Homo sapiens
agtgaggcatctctctgg

SEQ ID NO: 6651786 - DNA, 18 bp, Homo sapiens
agtgaggcattgcacagg

SEQ ID NO: 6651787 - DNA, 12 bp, Homo sapiens
agtgaggcccaa

SEQ ID NO: 6651788 - DNA, 21 bp, Homo sapiens
agtgaggctctattgagccaa

SEQ ID NO: 6651789 - DNA, 15 bp, Homo sapiens
agtgaggcttccagg

SEQ ID NO: 6651790 - DNA, 16 bp, Homo sapiens
agtgagggctttttaa

SEQ ID NO: 6651791 - DNA, 18 bp, Homo sapiens
agtgaggggaaaccaggg

SEQ ID NO: 6651792 - DNA, 14 bp, Homo sapiens
agtgaggggctgtg

SEQ ID NO: 6651793 - DNA, 18 bp, Homo sapiens
agtgaggggttacctccc

SEQ ID NO: 6651794 - DNA, 19 bp, Homo sapiens
agtgaggggttacctccct

SEQ ID NO: 6651795 - DNA, 21 bp, Homo sapiens
agtgaggggttacctccctcg

SEQ ID NO: 6651796 - DNA, 22 bp, Homo sapiens
agtgagggtcagagaggagtca

SEQ ID NO: 6651797 - DNA, 20 bp, Homo sapiens
agtgagggtttctgagctgc

SEQ ID NO: 6651798 - DNA, 21 bp, Homo sapiens
agtgagggtttctgagctgct

SEQ ID NO: 6651799 - DNA, 17 bp, Homo sapiens
agtgaggtcatcccggg

SEQ ID NO: 6651800 - DNA, 17 bp, Homo sapiens
agtgaggtcctgggggc

SEQ ID NO: 6651801 - DNA, 16 bp, Homo sapiens
agtgaggtgtgtcaca

SEQ ID NO: 6651802 - DNA, 16 bp, Homo sapiens
agtgaggtgttgcagc

SEQ ID NO: 6651803 - DNA, 22 bp, Homo sapiens
agtgagtacatgcacactcatg

SEQ ID NO: 6651804 - DNA, 13 bp, Homo sapiens
agtgagtactgtt

SEQ ID NO: 6651805 - DNA, 15 bp, Homo sapiens
agtgagtataactct

SEQ ID NO: 6651806 - DNA, 19 bp, Homo sapiens
agtgagtcacctgctccag

SEQ ID NO: 6651807 - DNA, 20 bp, Homo sapiens
agtgagtcacctgctccaga

SEQ ID NO: 6651808 - DNA, 22 bp, Homo sapiens
agtgagtcgagattgcactgct

SEQ ID NO: 6651809 - DNA, 15 bp, Homo sapiens
agtgagtcgaggaca

SEQ ID NO: 6651810 - DNA, 16 bp, Homo sapiens
agtgagtctggtggag

SEQ ID NO: 6651811 - DNA, 21 bp, Homo sapiens
agtgagtgacaaagcctctga

SEQ ID NO: 6651812 - DNA, 16 bp, Homo sapiens
agtgagtgccatgctt

SEQ ID NO: 6651813 - DNA, 14 bp, Homo sapiens
agtgagtggcatgt

SEQ ID NO: 6651814 - DNA, 14 bp, Homo sapiens
agtgagtggccctt

SEQ ID NO: 6651815 - DNA, 23 bp, Homo sapiens
agtgagtgggagagtacctgtgt

SEQ ID NO: 6651816 - DNA, 16 bp, Homo sapiens
agtgagtgtaaataat

SEQ ID NO: 6651817 - DNA, 21 bp, Homo sapiens
agtgagtgtgctgacttttta

SEQ ID NO: 6651818 - DNA, 15 bp, Homo sapiens
agtgagtgtgctgct

SEQ ID NO: 6651819 - DNA, 18 bp, Homo sapiens
agtgagtgtggctcccct

SEQ ID NO: 6651820 - DNA, 19 bp, Homo sapiens
agtgagtgtggctcccctc

SEQ ID NO: 6651821 - DNA, 13 bp, Homo sapiens
agtgagtgtgtgt

SEQ ID NO: 6651822 - DNA, 16 bp, Homo sapiens
agtgagtgtgtgtgct

SEQ ID NO: 6651823 - DNA, 21 bp, Homo sapiens
agtgagttcagcctttaagat

SEQ ID NO: 6651824 - DNA, 14 bp, Homo sapiens
agtgagttcttttt

SEQ ID NO: 6651825 - DNA, 22 bp, Homo sapiens
agtgagttgatagcacagaccc

SEQ ID NO: 6651826 - DNA, 22 bp, Homo sapiens
agtgagttgcatgtttttgaaa

SEQ ID NO: 6651827 - DNA, 20 bp, Homo sapiens
agtgagttgggtgtattgtg

SEQ ID NO: 6651828 - DNA, 19 bp, Homo sapiens
agtgataacactggagtgg

SEQ ID NO: 6651829 - DNA, 20 bp, Homo sapiens
agtgataatattgtttccct

SEQ ID NO: 6651830 - DNA, 16 bp, Homo sapiens
agtgataatgccccaa

SEQ ID NO: 6651831 - DNA, 21 bp, Homo sapiens
agtgataatgttcattttgaa

SEQ ID NO: 6651832 - DNA, 19 bp, Homo sapiens
agtgatacaactgagtctc

SEQ ID NO: 6651833 - DNA, 19 bp, Homo sapiens
agtgataccagttcagaca

SEQ ID NO: 6651834 - DNA, 16 bp, Homo sapiens
agtgatagaacaaaag

SEQ ID NO: 6651835 - DNA, 19 bp, Homo sapiens
agtgatagagcaaagcatc

SEQ ID NO: 6651836 - DNA, 20 bp, Homo sapiens
agtgatagagctaaccctta

SEQ ID NO: 6651837 - DNA, 17 bp, Homo sapiens
agtgatagatgtagtct

SEQ ID NO: 6651838 - DNA, 19 bp, Homo sapiens
agtgatagctactgtagaa

SEQ ID NO: 6651839 - DNA, 17 bp, Homo sapiens
agtgatagtcttttgct

SEQ ID NO: 6651840 - DNA, 20 bp, Homo sapiens
agtgatagtcttttgctttt

SEQ ID NO: 6651841 - DNA, 21 bp, Homo sapiens
agtgatatagtgctgtttaag

SEQ ID NO: 6651842 - DNA, 17 bp, Homo sapiens
agtgatatctttctcat

SEQ ID NO: 6651843 - DNA, 18 bp, Homo sapiens
agtgatatctttctcatt

SEQ ID NO: 6651844 - DNA, 14 bp, Homo sapiens
agtgatatggcaga

SEQ ID NO: 6651845 - DNA, 22 bp, Homo sapiens
agtgatatggcagaagacacca

SEQ ID NO: 6651846 - DNA, 24 bp, Homo sapiens
agtgatatggcagaagacaccaga

SEQ ID NO: 6651847 - DNA, 16 bp, Homo sapiens
agtgatatggtgaagg

SEQ ID NO: 6651848 - DNA, 20 bp, Homo sapiens
agtgatatggtgaagggaag

SEQ ID NO: 6651849 - DNA, 21 bp, Homo sapiens
agtgatatggtgaagggaagt

SEQ ID NO: 6651850 - DNA, 20 bp, Homo sapiens
agtgatattctttgttaatt

SEQ ID NO: 6651851 - DNA, 14 bp, Homo sapiens
agtgatatttctct

SEQ ID NO: 6651852 - DNA, 14 bp, Homo sapiens
agtgatcaaactac

SEQ ID NO: 6651853 - DNA, 19 bp, Homo sapiens
agtgatcaataaaatgtga

SEQ ID NO: 6651854 - DNA, 16 bp, Homo sapiens
agtgatcacctcttgg

SEQ ID NO: 6651855 - DNA, 14 bp, Homo sapiens
agtgatcctaaata

SEQ ID NO: 6651856 - DNA, 20 bp, Homo sapiens
agtgatcctcaaacacacaa

SEQ ID NO: 6651857 - DNA, 13 bp, Homo sapiens
agtgatcctccca

SEQ ID NO: 6651858 - DNA, 14 bp, Homo sapiens
agtgatcctcccac

SEQ ID NO: 6651859 - DNA, 15 bp, Homo sapiens
agtgatcctcccacc

SEQ ID NO: 6651860 - DNA, 18 bp, Homo sapiens
agtgatcctcccacctca

SEQ ID NO: 6651861 - DNA, 20 bp, Homo sapiens
agtgatcctcccacctcagc

SEQ ID NO: 6651862 - DNA, 23 bp, Homo sapiens
agtgatcctcccacctcagcctc

SEQ ID NO: 6651863 - DNA, 19 bp, Homo sapiens
agtgatcctcccgccccag

SEQ ID NO: 6651864 - DNA, 20 bp, Homo sapiens
agtgatccttccacctcagt

SEQ ID NO: 6651865 - DNA, 22 bp, Homo sapiens
agtgatctaaaatttgtaatat

SEQ ID NO: 6651866 - DNA, 18 bp, Homo sapiens
agtgatctcaaatccact

SEQ ID NO: 6651867 - DNA, 13 bp, Homo sapiens
agtgatctccata

SEQ ID NO: 6651868 - DNA, 14 bp, Homo sapiens
agtgatctccatat

SEQ ID NO: 6651869 - DNA, 17 bp, Homo sapiens
agtgatctgcccgcctc

SEQ ID NO: 6651870 - DNA, 21 bp, Homo sapiens
agtgatctgtccacctcggcc

SEQ ID NO: 6651871 - DNA, 18 bp, Homo sapiens
agtgatcttcactgtata

SEQ ID NO: 6651872 - DNA, 18 bp, Homo sapiens
agtgatctttcaatatca

SEQ ID NO: 6651873 - DNA, 23 bp, Homo sapiens
agtgatctttcaatatcattact

SEQ ID NO: 6651874 - DNA, 20 bp, Homo sapiens
agtgatgaaattataagtag

SEQ ID NO: 6651875 - DNA, 14 bp, Homo sapiens
agtgatgagctgaa

SEQ ID NO: 6651876 - DNA, 13 bp, Homo sapiens
agtgatgatgttt

SEQ ID NO: 6651877 - DNA, 17 bp, Homo sapiens
agtgatgatttggggga

SEQ ID NO: 6651878 - DNA, 18 bp, Homo sapiens
agtgatgccgggcgccag

SEQ ID NO: 6651879 - DNA, 23 bp, Homo sapiens
agtgatgccgggcgccaggacag

SEQ ID NO: 6651880 - DNA, 21 bp, Homo sapiens
agtgatgctgtgctatgaatt

SEQ ID NO: 6651881 - DNA, 13 bp, Homo sapiens
agtgatggaatat

SEQ ID NO: 6651882 - DNA, 21 bp, Homo sapiens
agtgatggagttccttctggt

SEQ ID NO: 6651883 - DNA, 20 bp, Homo sapiens
agtgatggcattactctgca

SEQ ID NO: 6651884 - DNA, 20 bp, Homo sapiens
agtgatggcgcgggaggcac

SEQ ID NO: 6651885 - DNA, 22 bp, Homo sapiens
agtgatgggcaaggggccagga

SEQ ID NO: 6651886 - DNA, 17 bp, Homo sapiens
agtgatgggctttctct

SEQ ID NO: 6651887 - DNA, 19 bp, Homo sapiens
agtgatgggctttctcttt

SEQ ID NO: 6651888 - DNA, 20 bp, Homo sapiens
agtgatggtcattcatatca

SEQ ID NO: 6651889 - DNA, 19 bp, Homo sapiens
agtgatggtgtccttccct

SEQ ID NO: 6651890 - DNA, 21 bp, Homo sapiens
agtgatggtgtccttccctgc

SEQ ID NO: 6651891 - DNA, 22 bp, Homo sapiens
agtgatggtgtccttccctgcc

SEQ ID NO: 6651892 - DNA, 15 bp, Homo sapiens
agtgatgtcatttga

SEQ ID NO: 6651893 - DNA, 21 bp, Homo sapiens
agtgatgtgatttatgcattt

SEQ ID NO: 6651894 - DNA, 13 bp, Homo sapiens
agtgatgtgctga

SEQ ID NO: 6651895 - DNA, 14 bp, Homo sapiens
agtgatgtgctgga

SEQ ID NO: 6651896 - DNA, 22 bp, Homo sapiens
agtgatgtgctggagctggctt

SEQ ID NO: 6651897 - DNA, 15 bp, Homo sapiens
agtgatgttcagatt

SEQ ID NO: 6651898 - DNA, 19 bp, Homo sapiens
agtgatgttcagatttcta

SEQ ID NO: 6651899 - DNA, 20 bp, Homo sapiens
agtgatgtttgccatttgct

SEQ ID NO: 6651900 - DNA, 14 bp, Homo sapiens
agtgattactgtca

SEQ ID NO: 6651901 - DNA, 16 bp, Homo sapiens
agtgattatatttcac

SEQ ID NO: 6651902 - DNA, 15 bp, Homo sapiens
agtgattatctcttt

SEQ ID NO: 6651903 - DNA, 14 bp, Homo sapiens
agtgattatgggag

SEQ ID NO: 6651904 - DNA, 17 bp, Homo sapiens
agtgattattttttaaa

SEQ ID NO: 6651905 - DNA, 11 bp, Homo sapiens
agtgattctag

SEQ ID NO: 6651906 - DNA, 12 bp, Homo sapiens
agtgattctaga

SEQ ID NO: 6651907 - DNA, 13 bp, Homo sapiens
agtgattctagag

SEQ ID NO: 6651908 - DNA, 18 bp, Homo sapiens
agtgattctcatgcctca

SEQ ID NO: 6651909 - DNA, 19 bp, Homo sapiens
agtgattctcatgcctcag

SEQ ID NO: 6651910 - DNA, 15 bp, Homo sapiens
agtgattctcctgcc

SEQ ID NO: 6651911 - DNA, 17 bp, Homo sapiens
agtgattctcctgcctc

SEQ ID NO: 6651912 - DNA, 18 bp, Homo sapiens
agtgattctcctgcctca

SEQ ID NO: 6651913 - DNA, 19 bp, Homo sapiens
agtgattctcctgcctcag

SEQ ID NO: 6651914 - DNA, 24 bp, Homo sapiens
agtgattctcctgcctcagcctcc

SEQ ID NO: 6651915 - DNA, 19 bp, Homo sapiens
agtgattctctcttctctc

SEQ ID NO: 6651916 - DNA, 15 bp, Homo sapiens
agtgattgacacaca

SEQ ID NO: 6651917 - DNA, 22 bp, Homo sapiens
agtgattgacattttgtagcta

SEQ ID NO: 6651918 - DNA, 23 bp, Homo sapiens
agtgattgagactcaaaaaaaca

SEQ ID NO: 6651919 - DNA, 13 bp, Homo sapiens
agtgattgctttt

SEQ ID NO: 6651920 - DNA, 20 bp, Homo sapiens
agtgattgtagtttaataca

SEQ ID NO: 6651921 - DNA, 16 bp, Homo sapiens
agtgattgtatgaatt

SEQ ID NO: 6651922 - DNA, 12 bp, Homo sapiens
agtgattgtgaa

SEQ ID NO: 6651923 - DNA, 24 bp, Homo sapiens
agtgattgtgtctgcattgttatt

SEQ ID NO: 6651924 - DNA, 23 bp, Homo sapiens
agtgattgttatgccttgctatt

SEQ ID NO: 6651925 - DNA, 15 bp, Homo sapiens
agtgatttacacagg

SEQ ID NO: 6651926 - DNA, 16 bp, Homo sapiens
agtgatttacacaggt

SEQ ID NO: 6651927 - DNA, 16 bp, Homo sapiens
agtgatttacatgctg

SEQ ID NO: 6651928 - DNA, 18 bp, Homo sapiens
agtgatttagttgtggaa

SEQ ID NO: 6651929 - DNA, 19 bp, Homo sapiens
agtgatttagttgtggaaa

SEQ ID NO: 6651930 - DNA, 12 bp, Homo sapiens
agtgatttccat

SEQ ID NO: 6651931 - DNA, 16 bp, Homo sapiens
agtgatttccatctct

SEQ ID NO: 6651932 - DNA, 19 bp, Homo sapiens
agtgatttccatctctggt

SEQ ID NO: 6651933 - DNA, 21 bp, Homo sapiens
agtgatttctggggccccacc

SEQ ID NO: 6651934 - DNA, 12 bp, Homo sapiens
agtgatttgcta

SEQ ID NO: 6651935 - DNA, 17 bp, Homo sapiens
agtgatttgtaaaacag

SEQ ID NO: 6651936 - DNA, 21 bp, Homo sapiens
agtgatttgtaaaacagtggt

SEQ ID NO: 6651937 - DNA, 20 bp, Homo sapiens
agtgattttatttttgcaaa

SEQ ID NO: 6651938 - DNA, 20 bp, Homo sapiens
agtgattttcaagtctgtgt

SEQ ID NO: 6651939 - DNA, 13 bp, Homo sapiens
agtgattttgtct

SEQ ID NO: 6651940 - DNA, 22 bp, Homo sapiens
agtgatttttatccaatcttgt

SEQ ID NO: 6651941 - DNA, 21 bp, Homo sapiens
agtgatttttatgccacctga

SEQ ID NO: 6651942 - DNA, 15 bp, Homo sapiens
agtgcaaaaaacata

SEQ ID NO: 6651943 - DNA, 18 bp, Homo sapiens
agtgcaaaaactgtaaaa

SEQ ID NO: 6651944 - DNA, 21 bp, Homo sapiens
agtgcaaaaactgtaaaagtg

SEQ ID NO: 6651945 - DNA, 16 bp, Homo sapiens
agtgcaaaagattaag

SEQ ID NO: 6651946 - DNA, 23 bp, Homo sapiens
agtgcaaaaggcttgcagaactt

SEQ ID NO: 6651947 - DNA, 13 bp, Homo sapiens
agtgcaaaatgtc

SEQ ID NO: 6651948 - DNA, 16 bp, Homo sapiens
agtgcaaaatgtcttg

SEQ ID NO: 6651949 - DNA, 18 bp, Homo sapiens
agtgcaaaatgtcttgtg

SEQ ID NO: 6651950 - DNA, 16 bp, Homo sapiens
agtgcaaacagaagtg

SEQ ID NO: 6651951 - DNA, 19 bp, Homo sapiens
agtgcaaaccacttctcca

SEQ ID NO: 6651952 - DNA, 10 bp, Homo sapiens
agtgcaaagc

SEQ ID NO: 6651953 - DNA, 12 bp, Homo sapiens
agtgcaaagctg

SEQ ID NO: 6651954 - DNA, 13 bp, Homo sapiens
agtgcaaagctgc

SEQ ID NO: 6651955 - DNA, 19 bp, Homo sapiens
agtgcaaatactccaagct

SEQ ID NO: 6651956 - DNA, 20 bp, Homo sapiens
agtgcaaatactccaagctt

SEQ ID NO: 6651957 - DNA, 18 bp, Homo sapiens
agtgcaaatcatagctgg

SEQ ID NO: 6651958 - DNA, 16 bp, Homo sapiens
agtgcaaattcatttt

SEQ ID NO: 6651959 - DNA, 18 bp, Homo sapiens
agtgcaaattgtcacagg

SEQ ID NO: 6651960 - DNA, 21 bp, Homo sapiens
agtgcaaattgtcacaggaca

SEQ ID NO: 6651961 - DNA, 19 bp, Homo sapiens
agtgcaacatttctgtata

SEQ ID NO: 6651962 - DNA, 23 bp, Homo sapiens
agtgcaacatttctgtatactgt

SEQ ID NO: 6651963 - DNA, 16 bp, Homo sapiens
agtgcaaccacacacc

SEQ ID NO: 6651964 - DNA, 18 bp, Homo sapiens
agtgcaaccacacacctc

SEQ ID NO: 6651965 - DNA, 15 bp, Homo sapiens
agtgcaactgttttg

SEQ ID NO: 6651966 - DNA, 14 bp, Homo sapiens
agtgcaagagactt

SEQ ID NO: 6651967 - DNA, 23 bp, Homo sapiens
agtgcaagagactttgtcactta

SEQ ID NO: 6651968 - DNA, 14 bp, Homo sapiens
agtgcaagagcctg

SEQ ID NO: 6651969 - DNA, 21 bp, Homo sapiens
agtgcaagagcctgagactgg

SEQ ID NO: 6651970 - DNA, 15 bp, Homo sapiens
agtgcaagcaaagca

SEQ ID NO: 6651971 - DNA, 17 bp, Homo sapiens
agtgcaagcccctgctc

SEQ ID NO: 6651972 - DNA, 18 bp, Homo sapiens
agtgcaagcccctgctcc

SEQ ID NO: 6651973 - DNA, 21 bp, Homo sapiens
agtgcaagctttaacagacta

SEQ ID NO: 6651974 - DNA, 23 bp, Homo sapiens
agtgcaatatgggcgggcagtcg

SEQ ID NO: 6651975 - DNA, 16 bp, Homo sapiens
agtgcaatgacacagt

SEQ ID NO: 6651976 - DNA, 23 bp, Homo sapiens
agtgcaatgccccctcccctcct

SEQ ID NO: 6651977 - DNA, 22 bp, Homo sapiens
agtgcaatgcttgtagaagtag

SEQ ID NO: 6651978 - DNA, 23 bp, Homo sapiens
agtgcaatggcgtgatctcggct

SEQ ID NO: 6651979 - DNA, 23 bp, Homo sapiens
agtgcaatggtgcaatcacagct

SEQ ID NO: 6651980 - DNA, 17 bp, Homo sapiens
agtgcaattccaagaaa

SEQ ID NO: 6651981 - DNA, 13 bp, Homo sapiens
agtgcacaaaatg

SEQ ID NO: 6651982 - DNA, 17 bp, Homo sapiens
agtgcacacagaaatat

SEQ ID NO: 6651983 - DNA, 19 bp, Homo sapiens
agtgcacacagaaatatat

SEQ ID NO: 6651984 - DNA, 18 bp, Homo sapiens
agtgcacacctttattca

SEQ ID NO: 6651985 - DNA, 19 bp, Homo sapiens
agtgcacacctttattcag

SEQ ID NO: 6651986 - DNA, 12 bp, Homo sapiens
agtgcacatctg

SEQ ID NO: 6651987 - DNA, 16 bp, Homo sapiens
agtgcacatgcccctt

SEQ ID NO: 6651988 - DNA, 13 bp, Homo sapiens
agtgcaccaaaga

SEQ ID NO: 6651989 - DNA, 21 bp, Homo sapiens
agtgcacctctcatcagccca

SEQ ID NO: 6651990 - DNA, 19 bp, Homo sapiens
agtgcacctgcctcagcta

SEQ ID NO: 6651991 - DNA, 21 bp, Homo sapiens
agtgcacctgcctcagctacc

SEQ ID NO: 6651992 - DNA, 15 bp, Homo sapiens
agtgcacctgcctcc

SEQ ID NO: 6651993 - DNA, 20 bp, Homo sapiens
agtgcacctgggacagggag

SEQ ID NO: 6651994 - DNA, 18 bp, Homo sapiens
agtgcacctgtggcctct

SEQ ID NO: 6651995 - DNA, 18 bp, Homo sapiens
agtgcacggggcacagcg

SEQ ID NO: 6651996 - DNA, 19 bp, Homo sapiens
agtgcactaaccccagctg

SEQ ID NO: 6651997 - DNA, 14 bp, Homo sapiens
agtgcactaatgtg

SEQ ID NO: 6651998 - DNA, 21 bp, Homo sapiens
agtgcactaatgtgtaagaca

SEQ ID NO: 6651999 - DNA, 14 bp, Homo sapiens
agtgcactcagagc

SEQ ID NO: 6652000 - DNA, 23 bp, Homo sapiens
agtgcactcagagctgctgagga

SEQ ID NO: 6652001 - DNA, 22 bp, Homo sapiens
agtgcactcctggtgatcctgg

SEQ ID NO: 6652002 - DNA, 14 bp, Homo sapiens
agtgcactgacctg

SEQ ID NO: 6652003 - DNA, 18 bp, Homo sapiens
agtgcactgacctgtagg

SEQ ID NO: 6652004 - DNA, 20 bp, Homo sapiens
agtgcactgcattcctgtgc

SEQ ID NO: 6652005 - DNA, 23 bp, Homo sapiens
agtgcacttaatattagcttgct

SEQ ID NO: 6652006 - DNA, 19 bp, Homo sapiens
agtgcacttacacttataa

SEQ ID NO: 6652007 - DNA, 16 bp, Homo sapiens
agtgcacttgctggaa

SEQ ID NO: 6652008 - DNA, 14 bp, Homo sapiens
agtgcactttctaa

SEQ ID NO: 6652009 - DNA, 18 bp, Homo sapiens
agtgcactttctaatgtt

SEQ ID NO: 6652010 - DNA, 16 bp, Homo sapiens
agtgcagaaatgaaat

SEQ ID NO: 6652011 - DNA, 19 bp, Homo sapiens
agtgcagaacacctggccg

SEQ ID NO: 6652012 - DNA, 12 bp, Homo sapiens
agtgcagaactg

SEQ ID NO: 6652013 - DNA, 22 bp, Homo sapiens
agtgcagaatgtaagtgggccc

SEQ ID NO: 6652014 - DNA, 21 bp, Homo sapiens
agtgcagacacctaaccccag

SEQ ID NO: 6652015 - DNA, 12 bp, Homo sapiens
agtgcagacagg

SEQ ID NO: 6652016 - DNA, 17 bp, Homo sapiens
agtgcagagccttctca

SEQ ID NO: 6652017 - DNA, 17 bp, Homo sapiens
agtgcagaggcggctct

SEQ ID NO: 6652018 - DNA, 13 bp, Homo sapiens
agtgcagaggctc

SEQ ID NO: 6652019 - DNA, 15 bp, Homo sapiens
agtgcagaggctgag

SEQ ID NO: 6652020 - DNA, 17 bp, Homo sapiens
agtgcagatgagtgtgt

SEQ ID NO: 6652021 - DNA, 18 bp, Homo sapiens
agtgcagatgagtgtgtg

SEQ ID NO: 6652022 - DNA, 19 bp, Homo sapiens
agtgcagcaaccagagcac

SEQ ID NO: 6652023 - DNA, 21 bp, Homo sapiens
agtgcagcatatacaataatg

SEQ ID NO: 6652024 - DNA, 13 bp, Homo sapiens
agtgcagccaagt

SEQ ID NO: 6652025 - DNA, 21 bp, Homo sapiens
agtgcagccaagtagcctctc

SEQ ID NO: 6652026 - DNA, 14 bp, Homo sapiens
agtgcagcccttcc

SEQ ID NO: 6652027 - DNA, 17 bp, Homo sapiens
agtgcagccgtttgaga

SEQ ID NO: 6652028 - DNA, 14 bp, Homo sapiens
agtgcagcgggcca

SEQ ID NO: 6652029 - DNA, 17 bp, Homo sapiens
agtgcagctgattttaa

SEQ ID NO: 6652030 - DNA, 15 bp, Homo sapiens
agtgcaggctggcac

SEQ ID NO: 6652031 - DNA, 16 bp, Homo sapiens
agtgcaggctggccag

SEQ ID NO: 6652032 - DNA, 18 bp, Homo sapiens
agtgcaggctggccagcc

SEQ ID NO: 6652033 - DNA, 17 bp, Homo sapiens
agtgcagggacagcctg

SEQ ID NO: 6652034 - DNA, 20 bp, Homo sapiens
agtgcagggacagcctgcac

SEQ ID NO: 6652035 - DNA, 21 bp, Homo sapiens
agtgcagggacagcctgcaca

SEQ ID NO: 6652036 - DNA, 18 bp, Homo sapiens
agtgcaggggatggggtg

SEQ ID NO: 6652037 - DNA, 17 bp, Homo sapiens
agtgcaggtttctattg

SEQ ID NO: 6652038 - DNA, 18 bp, Homo sapiens
agtgcagtaatttctgag

SEQ ID NO: 6652039 - DNA, 19 bp, Homo sapiens
agtgcagtagtaattgatt

SEQ ID NO: 6652040 - DNA, 15 bp, Homo sapiens
agtgcagtagtgcca

SEQ ID NO: 6652041 - DNA, 18 bp, Homo sapiens
agtgcagtagtgccaaaa

SEQ ID NO: 6652042 - DNA, 17 bp, Homo sapiens
agtgcagtcaccctgtg

SEQ ID NO: 6652043 - DNA, 17 bp, Homo sapiens
agtgcagtccatttcct

SEQ ID NO: 6652044 - DNA, 22 bp, Homo sapiens
agtgcagtcctgatcagagccg

SEQ ID NO: 6652045 - DNA, 23 bp, Homo sapiens
agtgcagtcctgatcagagccgt

SEQ ID NO: 6652046 - DNA, 19 bp, Homo sapiens
agtgcagtggcacaatctt

SEQ ID NO: 6652047 - DNA, 22 bp, Homo sapiens
agtgcagtggcgaaatccctgc

SEQ ID NO: 6652048 - DNA, 23 bp, Homo sapiens
agtgcagtggcgcgatctcagct

SEQ ID NO: 6652049 - DNA, 19 bp, Homo sapiens
agtgcagtggtgccatcac

SEQ ID NO: 6652050 - DNA, 17 bp, Homo sapiens
agtgcagttatttgctt

SEQ ID NO: 6652051 - DNA, 21 bp, Homo sapiens
agtgcataaaggttctggggc

SEQ ID NO: 6652052 - DNA, 22 bp, Homo sapiens
agtgcataaataattttgtttt

SEQ ID NO: 6652053 - DNA, 14 bp, Homo sapiens
agtgcatatgcaat

SEQ ID NO: 6652054 - DNA, 14 bp, Homo sapiens
agtgcatattcctt

SEQ ID NO: 6652055 - DNA, 18 bp, Homo sapiens
agtgcatattcctttcta

SEQ ID NO: 6652056 - DNA, 20 bp, Homo sapiens
agtgcatattcctttctatc

SEQ ID NO: 6652057 - DNA, 15 bp, Homo sapiens
agtgcatccaaaggt

SEQ ID NO: 6652058 - DNA, 21 bp, Homo sapiens
agtgcatccccacgacccctg

SEQ ID NO: 6652059 - DNA, 23 bp, Homo sapiens
agtgcatccttcatcacagcatg

SEQ ID NO: 6652060 - DNA, 21 bp, Homo sapiens
agtgcatccttgaactgtcag

SEQ ID NO: 6652061 - DNA, 17 bp, Homo sapiens
agtgcatctcagcccac

SEQ ID NO: 6652062 - DNA, 16 bp, Homo sapiens
agtgcatgaaaaacca

SEQ ID NO: 6652063 - DNA, 22 bp, Homo sapiens
agtgcatgatggtgagagccca

SEQ ID NO: 6652064 - DNA, 13 bp, Homo sapiens
agtgcatgcatgt

SEQ ID NO: 6652065 - DNA, 18 bp, Homo sapiens
agtgcatgcattgagctg

SEQ ID NO: 6652066 - DNA, 20 bp, Homo sapiens
agtgcatgcattgagctgcc

SEQ ID NO: 6652067 - DNA, 22 bp, Homo sapiens
agtgcatgcattgagctgcctc

SEQ ID NO: 6652068 - DNA, 16 bp, Homo sapiens
agtgcatgctctctgc

SEQ ID NO: 6652069 - DNA, 14 bp, Homo sapiens
agtgcatgctgtcc

SEQ ID NO: 6652070 - DNA, 16 bp, Homo sapiens
agtgcatgctgtccct

SEQ ID NO: 6652071 - DNA, 15 bp, Homo sapiens
agtgcatggccacag

SEQ ID NO: 6652072 - DNA, 21 bp, Homo sapiens
agtgcatggccacagccacct

SEQ ID NO: 6652073 - DNA, 15 bp, Homo sapiens
agtgcatggggaggc

SEQ ID NO: 6652074 - DNA, 12 bp, Homo sapiens
agtgcatgtcac

SEQ ID NO: 6652075 - DNA, 14 bp, Homo sapiens
agtgcatgtcacat

SEQ ID NO: 6652076 - DNA, 14 bp, Homo sapiens
agtgcatgtgcatg

SEQ ID NO: 6652077 - DNA, 14 bp, Homo sapiens
agtgcatgttaaaa

SEQ ID NO: 6652078 - DNA, 11 bp, Homo sapiens
agtgcattcaa

SEQ ID NO: 6652079 - DNA, 15 bp, Homo sapiens
agtgcattcaacctt

SEQ ID NO: 6652080 - DNA, 22 bp, Homo sapiens
agtgcattcattcatcctctta

SEQ ID NO: 6652081 - DNA, 23 bp, Homo sapiens
agtgcattcattcatcctcttat

SEQ ID NO: 6652082 - DNA, 17 bp, Homo sapiens
agtgcattgtttctgtg

SEQ ID NO: 6652083 - DNA, 17 bp, Homo sapiens
agtgcatttaaggagat

SEQ ID NO: 6652084 - DNA, 21 bp, Homo sapiens
agtgcatttaaggagattggg

SEQ ID NO: 6652085 - DNA, 12 bp, Homo sapiens
agtgcatttctg

SEQ ID NO: 6652086 - DNA, 16 bp, Homo sapiens
agtgcatttctgaata

SEQ ID NO: 6652087 - DNA, 12 bp, Homo sapiens
agtgcatttgac

SEQ ID NO: 6652088 - DNA, 15 bp, Homo sapiens
agtgcattttcccag

SEQ ID NO: 6652089 - DNA, 21 bp, Homo sapiens
agtgcattttgtttctgtata

SEQ ID NO: 6652090 - DNA, 17 bp, Homo sapiens
agtgcatttttaaactt

SEQ ID NO: 6652091 - DNA, 19 bp, Homo sapiens
agtgcatttttaaacttga

SEQ ID NO: 6652092 - DNA, 20 bp, Homo sapiens
agtgcatttttaaacttgaa

SEQ ID NO: 6652093 - DNA, 23 bp, Homo sapiens
agtgcatttttaaacttgaaata

SEQ ID NO: 6652094 - DNA, 20 bp, Homo sapiens
agtgcatttttatctgtgag

SEQ ID NO: 6652095 - DNA, 18 bp, Homo sapiens
agtgcatttttcttattt

SEQ ID NO: 6652096 - DNA, 17 bp, Homo sapiens
agtgccaaaaggcccct

SEQ ID NO: 6652097 - DNA, 17 bp, Homo sapiens
agtgccaaaataaagtc

SEQ ID NO: 6652098 - DNA, 15 bp, Homo sapiens
agtgccaaacagagt

SEQ ID NO: 6652099 - DNA, 16 bp, Homo sapiens
agtgccaaatgctggg

SEQ ID NO: 6652100 - DNA, 21 bp, Homo sapiens
agtgccaacaatcctagtgct

SEQ ID NO: 6652101 - DNA, 13 bp, Homo sapiens
agtgccaactgtg

SEQ ID NO: 6652102 - DNA, 13 bp, Homo sapiens
agtgccaaggacc

SEQ ID NO: 6652103 - DNA, 16 bp, Homo sapiens
agtgccaagtttgcaa

SEQ ID NO: 6652104 - DNA, 15 bp, Homo sapiens
agtgccaagtttgtt

SEQ ID NO: 6652105 - DNA, 20 bp, Homo sapiens
agtgccaagtttttcagaaa

SEQ ID NO: 6652106 - DNA, 19 bp, Homo sapiens
agtgccaatgacaggacat

SEQ ID NO: 6652107 - DNA, 18 bp, Homo sapiens
agtgccaatgatgtgacc

SEQ ID NO: 6652108 - DNA, 17 bp, Homo sapiens
agtgccaatgttgtgtg

SEQ ID NO: 6652109 - DNA, 24 bp, Homo sapiens
agtgccaatgttgtgtgttgcact

SEQ ID NO: 6652110 - DNA, 15 bp, Homo sapiens
agtgccacagagaag

SEQ ID NO: 6652111 - DNA, 18 bp, Homo sapiens
agtgccacagcctgctgg

SEQ ID NO: 6652112 - DNA, 21 bp, Homo sapiens
agtgccacagcctgctggcag

SEQ ID NO: 6652113 - DNA, 22 bp, Homo sapiens
agtgccacagcctgctggcagg

SEQ ID NO: 6652114 - DNA, 18 bp, Homo sapiens
agtgccacaggttttaag

SEQ ID NO: 6652115 - DNA, 12 bp, Homo sapiens
agtgccaccaca

SEQ ID NO: 6652116 - DNA, 22 bp, Homo sapiens
agtgccacccacctttgccaca

SEQ ID NO: 6652117 - DNA, 13 bp, Homo sapiens
agtgccacccgca

SEQ ID NO: 6652118 - DNA, 15 bp, Homo sapiens
agtgccacctatgcc

SEQ ID NO: 6652119 - DNA, 19 bp, Homo sapiens
agtgccacgttactcccct

SEQ ID NO: 6652120 - DNA, 13 bp, Homo sapiens
agtgccactgccc

SEQ ID NO: 6652121 - DNA, 20 bp, Homo sapiens
agtgccactgcccgagctgg

SEQ ID NO: 6652122 - DNA, 22 bp, Homo sapiens
agtgccactgcccgagctggtg

SEQ ID NO: 6652123 - DNA, 14 bp, Homo sapiens
agtgccacttaatg

SEQ ID NO: 6652124 - DNA, 18 bp, Homo sapiens
agtgccacttaatgtatg

SEQ ID NO: 6652125 - DNA, 20 bp, Homo sapiens
agtgccacttaatgtatgtt

SEQ ID NO: 6652126 - DNA, 18 bp, Homo sapiens
agtgccacttgacattcc

SEQ ID NO: 6652127 - DNA, 23 bp, Homo sapiens
agtgccacttgacattccttgtc

SEQ ID NO: 6652128 - DNA, 20 bp, Homo sapiens
agtgccagaattttaggaac

SEQ ID NO: 6652129 - DNA, 16 bp, Homo sapiens
agtgccagaggtgggc

SEQ ID NO: 6652130 - DNA, 22 bp, Homo sapiens
agtgccagaggtgggcaggtgg

SEQ ID NO: 6652131 - DNA, 17 bp, Homo sapiens
agtgccagcattccaga

SEQ ID NO: 6652132 - DNA, 21 bp, Homo sapiens
agtgccagcattccagacttc

SEQ ID NO: 6652133 - DNA, 12 bp, Homo sapiens
agtgccagctcc

SEQ ID NO: 6652134 - DNA, 18 bp, Homo sapiens
agtgccaggacagctggc

SEQ ID NO: 6652135 - DNA, 21 bp, Homo sapiens
agtgccaggacagctggctgc

SEQ ID NO: 6652136 - DNA, 17 bp, Homo sapiens
agtgccaggaccagcct

SEQ ID NO: 6652137 - DNA, 18 bp, Homo sapiens
agtgccaggatggaatga

SEQ ID NO: 6652138 - DNA, 22 bp, Homo sapiens
agtgccagggtgggctggggac

SEQ ID NO: 6652139 - DNA, 23 bp, Homo sapiens
agtgccatacatgttattgtttt

SEQ ID NO: 6652140 - DNA, 16 bp, Homo sapiens
agtgccatcccacatt

SEQ ID NO: 6652141 - DNA, 18 bp, Homo sapiens
agtgccatcccacattcg

SEQ ID NO: 6652142 - DNA, 15 bp, Homo sapiens
agtgccatccctgag

SEQ ID NO: 6652143 - DNA, 15 bp, Homo sapiens
agtgccatggccagg

SEQ ID NO: 6652144 - DNA, 15 bp, Homo sapiens
agtgccatgtaaatc

SEQ ID NO: 6652145 - DNA, 16 bp, Homo sapiens
agtgccattaacaaat

SEQ ID NO: 6652146 - DNA, 16 bp, Homo sapiens
agtgccattactactg

SEQ ID NO: 6652147 - DNA, 13 bp, Homo sapiens
agtgccattcatc

SEQ ID NO: 6652148 - DNA, 15 bp, Homo sapiens
agtgccattgtcttt

SEQ ID NO: 6652149 - DNA, 18 bp, Homo sapiens
agtgccattgtctttata

SEQ ID NO: 6652150 - DNA, 14 bp, Homo sapiens
agtgcccaactgtt

SEQ ID NO: 6652151 - DNA, 19 bp, Homo sapiens
agtgcccaccaacatccca

SEQ ID NO: 6652152 - DNA, 20 bp, Homo sapiens
agtgcccaccaacatcccat

SEQ ID NO: 6652153 - DNA, 20 bp, Homo sapiens
agtgcccaccctgggagaca

SEQ ID NO: 6652154 - DNA, 16 bp, Homo sapiens
agtgcccaccgccctc

SEQ ID NO: 6652155 - DNA, 17 bp, Homo sapiens
agtgcccaccgccctcc

SEQ ID NO: 6652156 - DNA, 18 bp, Homo sapiens
agtgcccaccgccctcct

SEQ ID NO: 6652157 - DNA, 23 bp, Homo sapiens
agtgcccagaactggactcagga

SEQ ID NO: 6652158 - DNA, 15 bp, Homo sapiens
agtgcccagcccctg

SEQ ID NO: 6652159 - DNA, 18 bp, Homo sapiens
agtgcccagcccctgccc

SEQ ID NO: 6652160 - DNA, 13 bp, Homo sapiens
agtgcccaggtgg

SEQ ID NO: 6652161 - DNA, 14 bp, Homo sapiens
agtgcccagtgatg

SEQ ID NO: 6652162 - DNA, 22 bp, Homo sapiens
agtgcccagtgatggcattact

SEQ ID NO: 6652163 - DNA, 15 bp, Homo sapiens
agtgcccatgaatgg

SEQ ID NO: 6652164 - DNA, 15 bp, Homo sapiens
agtgcccatgtgtat

SEQ ID NO: 6652165 - DNA, 21 bp, Homo sapiens
agtgccccaccactccccaac

SEQ ID NO: 6652166 - DNA, 19 bp, Homo sapiens
agtgccccacctcccgccc

SEQ ID NO: 6652167 - DNA, 16 bp, Homo sapiens
agtgccccacctgcca

SEQ ID NO: 6652168 - DNA, 17 bp, Homo sapiens
agtgccccacctgccac

SEQ ID NO: 6652169 - DNA, 20 bp, Homo sapiens
agtgccccagacagttcttt

SEQ ID NO: 6652170 - DNA, 20 bp, Homo sapiens
agtgccccagactgagctct

SEQ ID NO: 6652171 - DNA, 22 bp, Homo sapiens
agtgccccagactgagctctcc

SEQ ID NO: 6652172 - DNA, 14 bp, Homo sapiens
agtgccccagtggt

SEQ ID NO: 6652173 - DNA, 20 bp, Homo sapiens
agtgccccattctcactgct

SEQ ID NO: 6652174 - DNA, 19 bp, Homo sapiens
agtgccccattcttttgta

SEQ ID NO: 6652175 - DNA, 18 bp, Homo sapiens
agtgcccccactgaccag

SEQ ID NO: 6652176 - DNA, 18 bp, Homo sapiens
agtgcccccagcccagag

SEQ ID NO: 6652177 - DNA, 14 bp, Homo sapiens
agtgccccctcacc

SEQ ID NO: 6652178 - DNA, 20 bp, Homo sapiens
agtgccccctcacctctcca

SEQ ID NO: 6652179 - DNA, 22 bp, Homo sapiens
agtgccccctcacctctccagg

SEQ ID NO: 6652180 - DNA, 22 bp, Homo sapiens
agtgcccctcccatggcccagc

SEQ ID NO: 6652181 - DNA, 15 bp, Homo sapiens
agtgcccctgcaggg

SEQ ID NO: 6652182 - DNA, 17 bp, Homo sapiens
agtgcccctgcagggga

SEQ ID NO: 6652183 - DNA, 13 bp, Homo sapiens
agtgcccctgctg

SEQ ID NO: 6652184 - DNA, 13 bp, Homo sapiens
agtgcccctgtcc

SEQ ID NO: 6652185 - DNA, 16 bp, Homo sapiens
agtgcccctgtcccac

SEQ ID NO: 6652186 - DNA, 18 bp, Homo sapiens
agtgcccggtgcagggcc

SEQ ID NO: 6652187 - DNA, 20 bp, Homo sapiens
agtgcccggtgcagggcctg

SEQ ID NO: 6652188 - DNA, 16 bp, Homo sapiens
agtgccctccacagcc

SEQ ID NO: 6652189 - DNA, 12 bp, Homo sapiens
agtgccctccag

SEQ ID NO: 6652190 - DNA, 13 bp, Homo sapiens
agtgccctccagc

SEQ ID NO: 6652191 - DNA, 15 bp, Homo sapiens
agtgccctccagccc

SEQ ID NO: 6652192 - DNA, 17 bp, Homo sapiens
agtgccctccagccccg

SEQ ID NO: 6652193 - DNA, 18 bp, Homo sapiens
agtgccctccagccccgc

SEQ ID NO: 6652194 - DNA, 16 bp, Homo sapiens
agtgccctccaggata

SEQ ID NO: 6652195 - DNA, 13 bp, Homo sapiens
agtgccctctccc

SEQ ID NO: 6652196 - DNA, 15 bp, Homo sapiens
agtgccctgagccag

SEQ ID NO: 6652197 - DNA, 20 bp, Homo sapiens
agtgccctgagccagggtct

SEQ ID NO: 6652198 - DNA, 21 bp, Homo sapiens
agtgccctgagccagggtctc

SEQ ID NO: 6652199 - DNA, 14 bp, Homo sapiens
agtgccctgcaggc

SEQ ID NO: 6652200 - DNA, 13 bp, Homo sapiens
agtgccctgcccc

SEQ ID NO: 6652201 - DNA, 15 bp, Homo sapiens
agtgccctgccccct

SEQ ID NO: 6652202 - DNA, 17 bp, Homo sapiens
agtgccctgctttgcaa

SEQ ID NO: 6652203 - DNA, 14 bp, Homo sapiens
agtgccctggggca

SEQ ID NO: 6652204 - DNA, 23 bp, Homo sapiens
agtgcccttaaaataatgattta

SEQ ID NO: 6652205 - DNA, 17 bp, Homo sapiens
agtgccctttgagatct

SEQ ID NO: 6652206 - DNA, 20 bp, Homo sapiens
agtgccgaatgactatgtcc

SEQ ID NO: 6652207 - DNA, 21 bp, Homo sapiens
agtgccgcaataaatgctcaa

SEQ ID NO: 6652208 - DNA, 22 bp, Homo sapiens
agtgccgccgcctcgcccaccg

SEQ ID NO: 6652209 - DNA, 14 bp, Homo sapiens
agtgccgcctgtgc

SEQ ID NO: 6652210 - DNA, 21 bp, Homo sapiens
agtgccgctcctgcttcccct

SEQ ID NO: 6652211 - DNA, 16 bp, Homo sapiens
agtgccgctcttgggg

SEQ ID NO: 6652212 - DNA, 18 bp, Homo sapiens
agtgccgctcttggggac

SEQ ID NO: 6652213 - DNA, 22 bp, Homo sapiens
agtgccggaggccttggggtgg

SEQ ID NO: 6652214 - DNA, 18 bp, Homo sapiens
agtgccggctgtggagca

SEQ ID NO: 6652215 - DNA, 15 bp, Homo sapiens
agtgccgtagggagt

SEQ ID NO: 6652216 - DNA, 22 bp, Homo sapiens
agtgccgtagggagtacctgct

SEQ ID NO: 6652217 - DNA, 14 bp, Homo sapiens
agtgcctaaaataa

SEQ ID NO: 6652218 - DNA, 23 bp, Homo sapiens
agtgcctaaaattgtatgaaaat

SEQ ID NO: 6652219 - DNA, 10 bp, Homo sapiens
agtgcctaca

SEQ ID NO: 6652220 - DNA, 22 bp, Homo sapiens
agtgcctacatcccgggcctca

SEQ ID NO: 6652221 - DNA, 17 bp, Homo sapiens
agtgcctactggggggc

SEQ ID NO: 6652222 - DNA, 16 bp, Homo sapiens
agtgcctagaaagcaa

SEQ ID NO: 6652223 - DNA, 15 bp, Homo sapiens
agtgcctagactgtt

SEQ ID NO: 6652224 - DNA, 16 bp, Homo sapiens
agtgcctcacctcgaa

SEQ ID NO: 6652225 - DNA, 17 bp, Homo sapiens
agtgcctcacctcgaaa

SEQ ID NO: 6652226 - DNA, 16 bp, Homo sapiens
agtgcctccacatgct

SEQ ID NO: 6652227 - DNA, 22 bp, Homo sapiens
agtgcctccacatgctgcctgg

SEQ ID NO: 6652228 - DNA, 14 bp, Homo sapiens
agtgcctcgaggca

SEQ ID NO: 6652229 - DNA, 20 bp, Homo sapiens
agtgcctctccctgctgctc

SEQ ID NO: 6652230 - DNA, 16 bp, Homo sapiens
agtgcctctgattcta

SEQ ID NO: 6652231 - DNA, 22 bp, Homo sapiens
agtgcctctgattctatgtaac

SEQ ID NO: 6652232 - DNA, 23 bp, Homo sapiens
agtgcctcttctttttcttcttg

SEQ ID NO: 6652233 - DNA, 12 bp, Homo sapiens
agtgcctgagct

SEQ ID NO: 6652234 - DNA, 19 bp, Homo sapiens
agtgcctgcaccaggggtg

SEQ ID NO: 6652235 - DNA, 12 bp, Homo sapiens
agtgcctgccac

SEQ ID NO: 6652236 - DNA, 21 bp, Homo sapiens
agtgcctgccactctctggga

SEQ ID NO: 6652237 - DNA, 12 bp, Homo sapiens
agtgcctgctga

SEQ ID NO: 6652238 - DNA, 15 bp, Homo sapiens
agtgcctgctgttcg

SEQ ID NO: 6652239 - DNA, 16 bp, Homo sapiens
agtgcctgctgttcgt

SEQ ID NO: 6652240 - DNA, 16 bp, Homo sapiens
agtgcctgcttttgat

SEQ ID NO: 6652241 - DNA, 13 bp, Homo sapiens
agtgcctggagaa

SEQ ID NO: 6652242 - DNA, 11 bp, Homo sapiens
agtgcctggga

SEQ ID NO: 6652243 - DNA, 12 bp, Homo sapiens
agtgcctgggaa

SEQ ID NO: 6652244 - DNA, 18 bp, Homo sapiens
agtgcctggtgttctgaa

SEQ ID NO: 6652245 - DNA, 21 bp, Homo sapiens
agtgcctgtaatcacagctac

SEQ ID NO: 6652246 - DNA, 23 bp, Homo sapiens
agtgcctgtacaagctgatgttt

SEQ ID NO: 6652247 - DNA, 21 bp, Homo sapiens
agtgcctgtacaggaaggtgc

SEQ ID NO: 6652248 - DNA, 13 bp, Homo sapiens
agtgcctgtgatc

SEQ ID NO: 6652249 - DNA, 16 bp, Homo sapiens
agtgccttacctcctg

SEQ ID NO: 6652250 - DNA, 17 bp, Homo sapiens
agtgccttacctcctgc

SEQ ID NO: 6652251 - DNA, 10 bp, Homo sapiens
agtgccttat

SEQ ID NO: 6652252 - DNA, 22 bp, Homo sapiens
agtgccttatcaaataatattc

SEQ ID NO: 6652253 - DNA, 20 bp, Homo sapiens
agtgccttatgctatgagac

SEQ ID NO: 6652254 - DNA, 15 bp, Homo sapiens
agtgccttatggaac

SEQ ID NO: 6652255 - DNA, 16 bp, Homo sapiens
agtgccttatggaaca

SEQ ID NO: 6652256 - DNA, 19 bp, Homo sapiens
agtgccttatggaacactc

SEQ ID NO: 6652257 - DNA, 20 bp, Homo sapiens
agtgccttcagccaagacca

SEQ ID NO: 6652258 - DNA, 19 bp, Homo sapiens
agtgccttcctgtttttca

SEQ ID NO: 6652259 - DNA, 13 bp, Homo sapiens
agtgccttctcct

SEQ ID NO: 6652260 - DNA, 12 bp, Homo sapiens
agtgccttctct

SEQ ID NO: 6652261 - DNA, 19 bp, Homo sapiens
agtgccttctctcagctcc

SEQ ID NO: 6652262 - DNA, 20 bp, Homo sapiens
agtgccttctctcagctccc

SEQ ID NO: 6652263 - DNA, 16 bp, Homo sapiens
agtgccttctgggctt

SEQ ID NO: 6652264 - DNA, 15 bp, Homo sapiens
agtgccttctgtggg

SEQ ID NO: 6652265 - DNA, 17 bp, Homo sapiens
agtgccttgagctgcct

SEQ ID NO: 6652266 - DNA, 21 bp, Homo sapiens
agtgccttgagctgcctgctc

SEQ ID NO: 6652267 - DNA, 21 bp, Homo sapiens
agtgccttggatgagaagtgt

SEQ ID NO: 6652268 - DNA, 22 bp, Homo sapiens
agtgccttggggaatttcctct

SEQ ID NO: 6652269 - DNA, 18 bp, Homo sapiens
agtgcctttgcagctcag

SEQ ID NO: 6652270 - DNA, 20 bp, Homo sapiens
agtgcctttgcagctcagaa

SEQ ID NO: 6652271 - DNA, 21 bp, Homo sapiens
agtgcctttgcagctcagaac

SEQ ID NO: 6652272 - DNA, 19 bp, Homo sapiens
agtgccttttgcagaagag

SEQ ID NO: 6652273 - DNA, 20 bp, Homo sapiens
agtgccttttgcagaagagg

SEQ ID NO: 6652274 - DNA, 19 bp, Homo sapiens
agtgccttttgctgcgcac

SEQ ID NO: 6652275 - DNA, 23 bp, Homo sapiens
agtgcctttttccttatttcaag

SEQ ID NO: 6652276 - DNA, 15 bp, Homo sapiens
agtgcgagtatgtgt

SEQ ID NO: 6652277 - DNA, 18 bp, Homo sapiens
agtgcgatgtttcaggag

SEQ ID NO: 6652278 - DNA, 20 bp, Homo sapiens
agtgcgcagatctgtgcctg

SEQ ID NO: 6652279 - DNA, 20 bp, Homo sapiens
agtgcgctcttggtccctgg

SEQ ID NO: 6652280 - DNA, 20 bp, Homo sapiens
agtgcggcgtggagactggc

SEQ ID NO: 6652281 - DNA, 20 bp, Homo sapiens
agtgcggcgtgggggcactg

SEQ ID NO: 6652282 - DNA, 23 bp, Homo sapiens
agtgcgggctgaggccagagtca

SEQ ID NO: 6652283 - DNA, 17 bp, Homo sapiens
agtgcgtggcccaccag

SEQ ID NO: 6652284 - DNA, 16 bp, Homo sapiens
agtgcgtgtgtagagt

SEQ ID NO: 6652285 - DNA, 14 bp, Homo sapiens
agtgcgttctccca

SEQ ID NO: 6652286 - DNA, 15 bp, Homo sapiens
agtgcgttctcccag

SEQ ID NO: 6652287 - DNA, 19 bp, Homo sapiens
agtgcgttctcccagcact

SEQ ID NO: 6652288 - DNA, 14 bp, Homo sapiens
agtgctaaaaatgg

SEQ ID NO: 6652289 - DNA, 16 bp, Homo sapiens
agtgctaaaaatggga

SEQ ID NO: 6652290 - DNA, 23 bp, Homo sapiens
agtgctaaactactgattacttg

SEQ ID NO: 6652291 - DNA, 16 bp, Homo sapiens
agtgctaacatgaaga

SEQ ID NO: 6652292 - DNA, 16 bp, Homo sapiens
agtgctaagagcctct

SEQ ID NO: 6652293 - DNA, 18 bp, Homo sapiens
agtgctaagagcctctgg

SEQ ID NO: 6652294 - DNA, 13 bp, Homo sapiens
agtgctaaggttc

SEQ ID NO: 6652295 - DNA, 16 bp, Homo sapiens
agtgctaaggttctaa

SEQ ID NO: 6652296 - DNA, 18 bp, Homo sapiens
agtgctaaggttctaagg

SEQ ID NO: 6652297 - DNA, 17 bp, Homo sapiens
agtgctaagtgtgaact

SEQ ID NO: 6652298 - DNA, 22 bp, Homo sapiens
agtgctaagtgtgaactggacc

SEQ ID NO: 6652299 - DNA, 20 bp, Homo sapiens
agtgctaattttgaaaaact

SEQ ID NO: 6652300 - DNA, 14 bp, Homo sapiens
agtgctacataaat

SEQ ID NO: 6652301 - DNA, 15 bp, Homo sapiens
agtgctacctgcacc

SEQ ID NO: 6652302 - DNA, 19 bp, Homo sapiens
agtgctacctgcacctctg

SEQ ID NO: 6652303 - DNA, 21 bp, Homo sapiens
agtgctacctgcacctctgga

SEQ ID NO: 6652304 - DNA, 18 bp, Homo sapiens
agtgctacttgagagtgg

SEQ ID NO: 6652305 - DNA, 21 bp, Homo sapiens
agtgctagtgagctgggcatg

SEQ ID NO: 6652306 - DNA, 22 bp, Homo sapiens
agtgctagtgtggtctgtaata

SEQ ID NO: 6652307 - DNA, 22 bp, Homo sapiens
agtgctatatatataaatattt

SEQ ID NO: 6652308 - DNA, 14 bp, Homo sapiens
agtgctatgcggag

SEQ ID NO: 6652309 - DNA, 21 bp, Homo sapiens
agtgctatgcggaggaaagca

SEQ ID NO: 6652310 - DNA, 13 bp, Homo sapiens
agtgctattctgt

SEQ ID NO: 6652311 - DNA, 14 bp, Homo sapiens
agtgctattctgtg

SEQ ID NO: 6652312 - DNA, 15 bp, Homo sapiens
agtgctattctgtgt

SEQ ID NO: 6652313 - DNA, 19 bp, Homo sapiens
agtgctattctgtgttgaa

SEQ ID NO: 6652314 - DNA, 13 bp, Homo sapiens
agtgctatttcag

SEQ ID NO: 6652315 - DNA, 15 bp, Homo sapiens
agtgctatttcagca

SEQ ID NO: 6652316 - DNA, 18 bp, Homo sapiens
agtgctcaagcagcaaaa

SEQ ID NO: 6652317 - DNA, 16 bp, Homo sapiens
agtgctcaccagccct

SEQ ID NO: 6652318 - DNA, 17 bp, Homo sapiens
agtgctcaccagccctg

SEQ ID NO: 6652319 - DNA, 18 bp, Homo sapiens
agtgctcacccacaccat

SEQ ID NO: 6652320 - DNA, 16 bp, Homo sapiens
agtgctcagaatccac

SEQ ID NO: 6652321 - DNA, 18 bp, Homo sapiens
agtgctcagggaaatggc

SEQ ID NO: 6652322 - DNA, 19 bp, Homo sapiens
agtgctcagggaaatggcc

SEQ ID NO: 6652323 - DNA, 15 bp, Homo sapiens
agtgctcagtgaagt

SEQ ID NO: 6652324 - DNA, 15 bp, Homo sapiens
agtgctcagttgtac

SEQ ID NO: 6652325 - DNA, 12 bp, Homo sapiens
agtgctccagcc

SEQ ID NO: 6652326 - DNA, 20 bp, Homo sapiens
agtgctccatagtttggcat

SEQ ID NO: 6652327 - DNA, 22 bp, Homo sapiens
agtgctccccaaaaggaaggag

SEQ ID NO: 6652328 - DNA, 11 bp, Homo sapiens
agtgctccctc

SEQ ID NO: 6652329 - DNA, 17 bp, Homo sapiens
agtgctccctcacatgt

SEQ ID NO: 6652330 - DNA, 12 bp, Homo sapiens
agtgctccctgg

SEQ ID NO: 6652331 - DNA, 15 bp, Homo sapiens
agtgctccctggagg

SEQ ID NO: 6652332 - DNA, 21 bp, Homo sapiens
agtgctcctggaaacttagct

SEQ ID NO: 6652333 - DNA, 13 bp, Homo sapiens
agtgctcctggcc

SEQ ID NO: 6652334 - DNA, 12 bp, Homo sapiens
agtgctcctgtg

SEQ ID NO: 6652335 - DNA, 23 bp, Homo sapiens
agtgctcgctgttgctgaatagg

SEQ ID NO: 6652336 - DNA, 21 bp, Homo sapiens
agtgctctgatccctctacag

SEQ ID NO: 6652337 - DNA, 22 bp, Homo sapiens
agtgctctgatgcaatagtgga

SEQ ID NO: 6652338 - DNA, 14 bp, Homo sapiens
agtgctctgcctct

SEQ ID NO: 6652339 - DNA, 14 bp, Homo sapiens
agtgctcttcccac

SEQ ID NO: 6652340 - DNA, 19 bp, Homo sapiens
agtgctcttcccactccag

SEQ ID NO: 6652341 - DNA, 20 bp, Homo sapiens
agtgctcttcccactccagc

SEQ ID NO: 6652342 - DNA, 16 bp, Homo sapiens
agtgctcttggctgac

SEQ ID NO: 6652343 - DNA, 19 bp, Homo sapiens
agtgctcttggctgacccc

SEQ ID NO: 6652344 - DNA, 14 bp, Homo sapiens
agtgctctttccac

SEQ ID NO: 6652345 - DNA, 13 bp, Homo sapiens
agtgctgaagctt

SEQ ID NO: 6652346 - DNA, 21 bp, Homo sapiens
agtgctgaagcttattaatgc

SEQ ID NO: 6652347 - DNA, 23 bp, Homo sapiens
agtgctgaagcttattaatgcta

SEQ ID NO: 6652348 - DNA, 19 bp, Homo sapiens
agtgctgaatttccctctc

SEQ ID NO: 6652349 - DNA, 23 bp, Homo sapiens
agtgctgacccaacagcctctgt

SEQ ID NO: 6652350 - DNA, 19 bp, Homo sapiens
agtgctgagaaccacggtg

SEQ ID NO: 6652351 - DNA, 12 bp, Homo sapiens
agtgctgagacc

SEQ ID NO: 6652352 - DNA, 15 bp, Homo sapiens
agtgctgagattaca

SEQ ID NO: 6652353 - DNA, 21 bp, Homo sapiens
agtgctgagattacaggcatg

SEQ ID NO: 6652354 - DNA, 18 bp, Homo sapiens
agtgctgagattacaggt

SEQ ID NO: 6652355 - DNA, 19 bp, Homo sapiens
agtgctgagattacaggtg

SEQ ID NO: 6652356 - DNA, 14 bp, Homo sapiens
agtgctgaggccag

SEQ ID NO: 6652357 - DNA, 16 bp, Homo sapiens
agtgctgaggccaggg

SEQ ID NO: 6652358 - DNA, 21 bp, Homo sapiens
agtgctgaggccagggctgat

SEQ ID NO: 6652359 - DNA, 21 bp, Homo sapiens
agtgctgaggggcactctccc

SEQ ID NO: 6652360 - DNA, 15 bp, Homo sapiens
agtgctgatccggct

SEQ ID NO: 6652361 - DNA, 15 bp, Homo sapiens
agtgctgcactcaaa

SEQ ID NO: 6652362 - DNA, 23 bp, Homo sapiens
agtgctgcagccaaagacagagc

SEQ ID NO: 6652363 - DNA, 21 bp, Homo sapiens
agtgctgcagctccctggctt

SEQ ID NO: 6652364 - DNA, 22 bp, Homo sapiens
agtgctgcatcttatagcactt

SEQ ID NO: 6652365 - DNA, 19 bp, Homo sapiens
agtgctgcatttaaaagat

SEQ ID NO: 6652366 - DNA, 11 bp, Homo sapiens
agtgctgccat

SEQ ID NO: 6652367 - DNA, 18 bp, Homo sapiens
agtgctgccatgccactg

SEQ ID NO: 6652368 - DNA, 22 bp, Homo sapiens
agtgctgccatgccactgccag

SEQ ID NO: 6652369 - DNA, 15 bp, Homo sapiens
agtgctgccccttgc

SEQ ID NO: 6652370 - DNA, 16 bp, Homo sapiens
agtgctgccccttgca

SEQ ID NO: 6652371 - DNA, 20 bp, Homo sapiens
agtgctgccccttgcaagcc

SEQ ID NO: 6652372 - DNA, 21 bp, Homo sapiens
agtgctgccccttgcaagcca

SEQ ID NO: 6652373 - DNA, 16 bp, Homo sapiens
agtgctgccctctccc

SEQ ID NO: 6652374 - DNA, 22 bp, Homo sapiens
agtgctgccctgcgaagtggct

SEQ ID NO: 6652375 - DNA, 16 bp, Homo sapiens
agtgctgcctgtcccc

SEQ ID NO: 6652376 - DNA, 22 bp, Homo sapiens
agtgctgcgagatcgctggcag

SEQ ID NO: 6652377 - DNA, 16 bp, Homo sapiens
agtgctgctcccttta

SEQ ID NO: 6652378 - DNA, 24 bp, Homo sapiens
agtgctgctctaggcccacaagtg

SEQ ID NO: 6652379 - DNA, 13 bp, Homo sapiens
agtgctgctgtaa

SEQ ID NO: 6652380 - DNA, 15 bp, Homo sapiens
agtgctgctgtaaat

SEQ ID NO: 6652381 - DNA, 19 bp, Homo sapiens
agtgctgctgtaaatacag

SEQ ID NO: 6652382 - DNA, 16 bp, Homo sapiens
agtgctgctgtggagt

SEQ ID NO: 6652383 - DNA, 13 bp, Homo sapiens
agtgctggaaggg

SEQ ID NO: 6652384 - DNA, 18 bp, Homo sapiens
agtgctggaagggaggaa

SEQ ID NO: 6652385 - DNA, 20 bp, Homo sapiens
agtgctggcattacaggtgt

SEQ ID NO: 6652386 - DNA, 17 bp, Homo sapiens
agtgctggcccacccag

SEQ ID NO: 6652387 - DNA, 19 bp, Homo sapiens
agtgctggcccacccagtc

SEQ ID NO: 6652388 - DNA, 23 bp, Homo sapiens
agtgctggcccacccagtccatg

SEQ ID NO: 6652389 - DNA, 14 bp, Homo sapiens
agtgctggctcaca

SEQ ID NO: 6652390 - DNA, 19 bp, Homo sapiens
agtgctggctcacagtaca

SEQ ID NO: 6652391 - DNA, 22 bp, Homo sapiens
agtgctggctccacgccctggg

SEQ ID NO: 6652392 - DNA, 23 bp, Homo sapiens
agtgctggctccacgccctgggg

SEQ ID NO: 6652393 - DNA, 13 bp, Homo sapiens
agtgctggctgct

SEQ ID NO: 6652394 - DNA, 14 bp, Homo sapiens
agtgctggctgctg

SEQ ID NO: 6652395 - DNA, 19 bp, Homo sapiens
agtgctgggaccagagcca

SEQ ID NO: 6652396 - DNA, 20 bp, Homo sapiens
agtgctgggaccagagccag

SEQ ID NO: 6652397 - DNA, 20 bp, Homo sapiens
agtgctgggatgacaggtgt

SEQ ID NO: 6652398 - DNA, 18 bp, Homo sapiens
agtgctgggattacaggt

SEQ ID NO: 6652399 - DNA, 21 bp, Homo sapiens
agtgctgggattacaggtgtg

SEQ ID NO: 6652400 - DNA, 13 bp, Homo sapiens
agtgctgggcact

SEQ ID NO: 6652401 - DNA, 16 bp, Homo sapiens
agtgctgggcactgct

SEQ ID NO: 6652402 - DNA, 13 bp, Homo sapiens
agtgctggtcaga

SEQ ID NO: 6652403 - DNA, 23 bp, Homo sapiens
agtgctggtcagagagacctcat

SEQ ID NO: 6652404 - DNA, 17 bp, Homo sapiens
agtgctggtcctaggtc

SEQ ID NO: 6652405 - DNA, 16 bp, Homo sapiens
agtgctgtaatattgt

SEQ ID NO: 6652406 - DNA, 20 bp, Homo sapiens
agtgctgtaatcggctcccg

SEQ ID NO: 6652407 - DNA, 16 bp, Homo sapiens
agtgctgtataaaatc

SEQ ID NO: 6652408 - DNA, 17 bp, Homo sapiens
agtgctgtataaaatca

SEQ ID NO: 6652409 - DNA, 19 bp, Homo sapiens
agtgctgtccatgcttctc

SEQ ID NO: 6652410 - DNA, 20 bp, Homo sapiens
agtgctgtccatgcttctca

SEQ ID NO: 6652411 - DNA, 22 bp, Homo sapiens
agtgctgtccatgcttctcatc

SEQ ID NO: 6652412 - DNA, 20 bp, Homo sapiens
agtgctgtcgggaccacatc

SEQ ID NO: 6652413 - DNA, 23 bp, Homo sapiens
agtgctgtcttaaactaaatgtg

SEQ ID NO: 6652414 - DNA, 12 bp, Homo sapiens
agtgctgtgaaa

SEQ ID NO: 6652415 - DNA, 14 bp, Homo sapiens
agtgctgtgaaaaa

SEQ ID NO: 6652416 - DNA, 16 bp, Homo sapiens
agtgctgtgaaaaaaa

SEQ ID NO: 6652417 - DNA, 15 bp, Homo sapiens
agtgctgtgagatga

SEQ ID NO: 6652418 - DNA, 19 bp, Homo sapiens
agtgctgtgctgtgtttaa

SEQ ID NO: 6652419 - DNA, 20 bp, Homo sapiens
agtgctgtgttttagtctct

SEQ ID NO: 6652420 - DNA, 22 bp, Homo sapiens
agtgctgtgttttagtctctta

SEQ ID NO: 6652421 - DNA, 15 bp, Homo sapiens
agtgctgttctggag

SEQ ID NO: 6652422 - DNA, 18 bp, Homo sapiens
agtgctgttctggagctg

SEQ ID NO: 6652423 - DNA, 20 bp, Homo sapiens
agtgctgttctggagctgct

SEQ ID NO: 6652424 - DNA, 14 bp, Homo sapiens
agtgctgttgaaga

SEQ ID NO: 6652425 - DNA, 16 bp, Homo sapiens
agtgctgtttagattt

SEQ ID NO: 6652426 - DNA, 21 bp, Homo sapiens
agtgctgttttattactgttt

SEQ ID NO: 6652427 - DNA, 16 bp, Homo sapiens
agtgctgttttgttat

SEQ ID NO: 6652428 - DNA, 19 bp, Homo sapiens
agtgctgttttgttatata

SEQ ID NO: 6652429 - DNA, 20 bp, Homo sapiens
agtgctgttttgttatataa

SEQ ID NO: 6652430 - DNA, 23 bp, Homo sapiens
agtgctgttttgttatataattt

SEQ ID NO: 6652431 - DNA, 19 bp, Homo sapiens
agtgcttaaaaatcattga

SEQ ID NO: 6652432 - DNA, 14 bp, Homo sapiens
agtgcttaaaaatg

SEQ ID NO: 6652433 - DNA, 19 bp, Homo sapiens
agtgcttaacattttccca

SEQ ID NO: 6652434 - DNA, 19 bp, Homo sapiens
agtgcttactctttgtacc

SEQ ID NO: 6652435 - DNA, 12 bp, Homo sapiens
agtgcttagaaa

SEQ ID NO: 6652436 - DNA, 13 bp, Homo sapiens
agtgcttagaaag

SEQ ID NO: 6652437 - DNA, 16 bp, Homo sapiens
agtgcttagaaagtta

SEQ ID NO: 6652438 - DNA, 17 bp, Homo sapiens
agtgcttattgtttgca

SEQ ID NO: 6652439 - DNA, 11 bp, Homo sapiens
agtgcttcaga

SEQ ID NO: 6652440 - DNA, 17 bp, Homo sapiens
agtgcttcagagtttgt

SEQ ID NO: 6652441 - DNA, 18 bp, Homo sapiens
agtgcttcagagtttgtg

SEQ ID NO: 6652442 - DNA, 21 bp, Homo sapiens
agtgcttcatttgggaaattc

SEQ ID NO: 6652443 - DNA, 21 bp, Homo sapiens
agtgcttgaggccaaatgagt

SEQ ID NO: 6652444 - DNA, 19 bp, Homo sapiens
agtgcttgagtttggggaa

SEQ ID NO: 6652445 - DNA, 23 bp, Homo sapiens
agtgcttgcatcctatttggtgt

SEQ ID NO: 6652446 - DNA, 15 bp, Homo sapiens
agtgcttgccacaga

SEQ ID NO: 6652447 - DNA, 17 bp, Homo sapiens
agtgcttgctgttccca

SEQ ID NO: 6652448 - DNA, 14 bp, Homo sapiens
agtgcttgcttttt

SEQ ID NO: 6652449 - DNA, 15 bp, Homo sapiens
agtgcttggcccagg

SEQ ID NO: 6652450 - DNA, 20 bp, Homo sapiens
agtgcttggcccaggagttt

SEQ ID NO: 6652451 - DNA, 14 bp, Homo sapiens
agtgcttggctgcc

SEQ ID NO: 6652452 - DNA, 16 bp, Homo sapiens
agtgcttggctgcccc

SEQ ID NO: 6652453 - DNA, 18 bp, Homo sapiens
agtgcttgttagagagaa

SEQ ID NO: 6652454 - DNA, 22 bp, Homo sapiens
agtgcttgttagagagaaagag

SEQ ID NO: 6652455 - DNA, 13 bp, Homo sapiens
agtgctttaatgg

SEQ ID NO: 6652456 - DNA, 19 bp, Homo sapiens
agtgctttacatgctgtgc

SEQ ID NO: 6652457 - DNA, 22 bp, Homo sapiens
agtgctttaccaattgaagtaa

SEQ ID NO: 6652458 - DNA, 23 bp, Homo sapiens
agtgctttacctttattaatgaa

SEQ ID NO: 6652459 - DNA, 15 bp, Homo sapiens
agtgctttctcaaaa

SEQ ID NO: 6652460 - DNA, 23 bp, Homo sapiens
agtgctttgacttcttgcttcag

SEQ ID NO: 6652461 - DNA, 14 bp, Homo sapiens
agtgctttgagaga

SEQ ID NO: 6652462 - DNA, 19 bp, Homo sapiens
agtgcttttaaaaattttg

SEQ ID NO: 6652463 - DNA, 19 bp, Homo sapiens
agtgcttttaagtgaaaat

SEQ ID NO: 6652464 - DNA, 21 bp, Homo sapiens
agtgcttttcactactttgta

SEQ ID NO: 6652465 - DNA, 23 bp, Homo sapiens
agtgcttttcagtgatactcacg

SEQ ID NO: 6652466 - DNA, 20 bp, Homo sapiens
agtgcttttttttttttgac

SEQ ID NO: 6652467 - DNA, 14 bp, Homo sapiens
agtggaaaaaagag

SEQ ID NO: 6652468 - DNA, 19 bp, Homo sapiens
agtggaaaaatagcctgcc

SEQ ID NO: 6652469 - DNA, 14 bp, Homo sapiens
agtggaaaatgacc

SEQ ID NO: 6652470 - DNA, 16 bp, Homo sapiens
agtggaaaatgcaatg

SEQ ID NO: 6652471 - DNA, 22 bp, Homo sapiens
agtggaaagacagcttctcatc

SEQ ID NO: 6652472 - DNA, 17 bp, Homo sapiens
agtggaaaggatcacag

SEQ ID NO: 6652473 - DNA, 22 bp, Homo sapiens
agtggaaatcgcttatatgtcc

SEQ ID NO: 6652474 - DNA, 15 bp, Homo sapiens
agtggaaatgttcta

SEQ ID NO: 6652475 - DNA, 16 bp, Homo sapiens
agtggaaattttctac

SEQ ID NO: 6652476 - DNA, 16 bp, Homo sapiens
agtggaagaagaaaac

SEQ ID NO: 6652477 - DNA, 14 bp, Homo sapiens
agtggaagacagag

SEQ ID NO: 6652478 - DNA, 18 bp, Homo sapiens
agtggaagacagagatgg

SEQ ID NO: 6652479 - DNA, 21 bp, Homo sapiens
agtggaagacagagatggcag

SEQ ID NO: 6652480 - DNA, 14 bp, Homo sapiens
agtggaagagcagc

SEQ ID NO: 6652481 - DNA, 16 bp, Homo sapiens
agtggaagagcagcct

SEQ ID NO: 6652482 - DNA, 17 bp, Homo sapiens
agtggaagagcagcctg

SEQ ID NO: 6652483 - DNA, 24 bp, Homo sapiens
agtggaagagcagcctgatggcca

SEQ ID NO: 6652484 - DNA, 14 bp, Homo sapiens
agtggaagcttcta

SEQ ID NO: 6652485 - DNA, 12 bp, Homo sapiens
agtggaaggaaa

SEQ ID NO: 6652486 - DNA, 17 bp, Homo sapiens
agtggaaggacactctt

SEQ ID NO: 6652487 - DNA, 17 bp, Homo sapiens
agtggaaggtctattgg

SEQ ID NO: 6652488 - DNA, 21 bp, Homo sapiens
agtggaaggtctattggccaa

SEQ ID NO: 6652489 - DNA, 17 bp, Homo sapiens
agtggaagtagtggagc

SEQ ID NO: 6652490 - DNA, 20 bp, Homo sapiens
agtggaagtatgtatattaa

SEQ ID NO: 6652491 - DNA, 22 bp, Homo sapiens
agtggaagtatgtatattaaaa

SEQ ID NO: 6652492 - DNA, 17 bp, Homo sapiens
agtggaatacagtgagt

SEQ ID NO: 6652493 - DNA, 17 bp, Homo sapiens
agtggaatagtatcctc

SEQ ID NO: 6652494 - DNA, 21 bp, Homo sapiens
agtggaatagtatcctccagg

SEQ ID NO: 6652495 - DNA, 22 bp, Homo sapiens
agtggaatagtatcctccaggt

SEQ ID NO: 6652496 - DNA, 19 bp, Homo sapiens
agtggaatagtgaatactt

SEQ ID NO: 6652497 - DNA, 21 bp, Homo sapiens
agtggaatgcagggaagaggg

SEQ ID NO: 6652498 - DNA, 17 bp, Homo sapiens
agtggaattagagggcc

SEQ ID NO: 6652499 - DNA, 22 bp, Homo sapiens
agtggaattccaacttgaagga

SEQ ID NO: 6652500 - DNA, 14 bp, Homo sapiens
agtggacaacaggt

SEQ ID NO: 6652501 - DNA, 17 bp, Homo sapiens
agtggacaagtcatgga

SEQ ID NO: 6652502 - DNA, 22 bp, Homo sapiens
agtggacaagtcatggacattc

SEQ ID NO: 6652503 - DNA, 22 bp, Homo sapiens
agtggacaccaggagtccctgg

SEQ ID NO: 6652504 - DNA, 21 bp, Homo sapiens
agtggacagagggagaaggga

SEQ ID NO: 6652505 - DNA, 14 bp, Homo sapiens
agtggacagtgaat

SEQ ID NO: 6652506 - DNA, 21 bp, Homo sapiens
agtggacatggtcacagtcct

SEQ ID NO: 6652507 - DNA, 13 bp, Homo sapiens
agtggacattcaa

SEQ ID NO: 6652508 - DNA, 20 bp, Homo sapiens
agtggacattcaaaaacctg

SEQ ID NO: 6652509 - DNA, 19 bp, Homo sapiens
agtggaccctgaaatgtgt

SEQ ID NO: 6652510 - DNA, 17 bp, Homo sapiens
agtggaccctgtggcca

SEQ ID NO: 6652511 - DNA, 22 bp, Homo sapiens
agtggaccgcccttttccccta

SEQ ID NO: 6652512 - DNA, 23 bp, Homo sapiens
agtggaccttaggccttcctctc

SEQ ID NO: 6652513 - DNA, 18 bp, Homo sapiens
agtggaccttgagaccac

SEQ ID NO: 6652514 - DNA, 19 bp, Homo sapiens
agtggaccttgagaccaca

SEQ ID NO: 6652515 - DNA, 17 bp, Homo sapiens
agtggacggagagcctt

SEQ ID NO: 6652516 - DNA, 17 bp, Homo sapiens
agtggacgttaggccag

SEQ ID NO: 6652517 - DNA, 21 bp, Homo sapiens
agtggacgttaggccaggcct

SEQ ID NO: 6652518 - DNA, 14 bp, Homo sapiens
agtggactcagcag

SEQ ID NO: 6652519 - DNA, 14 bp, Homo sapiens
agtggactctctga

SEQ ID NO: 6652520 - DNA, 21 bp, Homo sapiens
agtggactctctgacaaagtg

SEQ ID NO: 6652521 - DNA, 16 bp, Homo sapiens
agtggactggcccctg

SEQ ID NO: 6652522 - DNA, 17 bp, Homo sapiens
agtggactttccacccc

SEQ ID NO: 6652523 - DNA, 19 bp, Homo sapiens
agtggactttccaccccct

SEQ ID NO: 6652524 - DNA, 20 bp, Homo sapiens
agtggactttccaccccctc

SEQ ID NO: 6652525 - DNA, 23 bp, Homo sapiens
agtggagaatgggggtgaccaca

SEQ ID NO: 6652526 - DNA, 15 bp, Homo sapiens
agtggagacagtcct

SEQ ID NO: 6652527 - DNA, 15 bp, Homo sapiens
agtggagagagcagg

SEQ ID NO: 6652528 - DNA, 17 bp, Homo sapiens
agtggagagagcagggc

SEQ ID NO: 6652529 - DNA, 14 bp, Homo sapiens
agtggagaggggac

SEQ ID NO: 6652530 - DNA, 18 bp, Homo sapiens
agtggagagtgttcctgt

SEQ ID NO: 6652531 - DNA, 12 bp, Homo sapiens
agtggagccagg

SEQ ID NO: 6652532 - DNA, 13 bp, Homo sapiens
agtggagccaggt

SEQ ID NO: 6652533 - DNA, 14 bp, Homo sapiens
agtggagcccaggg

SEQ ID NO: 6652534 - DNA, 15 bp, Homo sapiens
agtggagcccagggt

SEQ ID NO: 6652535 - DNA, 17 bp, Homo sapiens
agtggagcccagggtgc

SEQ ID NO: 6652536 - DNA, 19 bp, Homo sapiens
agtggagcctgacagccag

SEQ ID NO: 6652537 - DNA, 13 bp, Homo sapiens
agtggagctggga

SEQ ID NO: 6652538 - DNA, 15 bp, Homo sapiens
agtggagctgtctgt

SEQ ID NO: 6652539 - DNA, 17 bp, Homo sapiens
agtggagctgtctgtct

SEQ ID NO: 6652540 - DNA, 17 bp, Homo sapiens
agtggaggattatcagt

SEQ ID NO: 6652541 - DNA, 11 bp, Homo sapiens
agtggaggcat

SEQ ID NO: 6652542 - DNA, 15 bp, Homo sapiens
agtggaggcattgtt

SEQ ID NO: 6652543 - DNA, 16 bp, Homo sapiens
agtggaggcattgttt

SEQ ID NO: 6652544 - DNA, 12 bp, Homo sapiens
agtggagggaga

SEQ ID NO: 6652545 - DNA, 12 bp, Homo sapiens
agtggaggggca

SEQ ID NO: 6652546 - DNA, 17 bp, Homo sapiens
agtggagggggtgtctg

SEQ ID NO: 6652547 - DNA, 19 bp, Homo sapiens
agtggaggtgggctgggcc

SEQ ID NO: 6652548 - DNA, 21 bp, Homo sapiens
agtggaggttgagtgagccgg

SEQ ID NO: 6652549 - DNA, 23 bp, Homo sapiens
agtggaggttgagtgagccggga

SEQ ID NO: 6652550 - DNA, 15 bp, Homo sapiens
agtggaggttgctgt

SEQ ID NO: 6652551 - DNA, 16 bp, Homo sapiens
agtggaggttgctgta

SEQ ID NO: 6652552 - DNA, 22 bp, Homo sapiens
agtggagtccagatggcaggct

SEQ ID NO: 6652553 - DNA, 23 bp, Homo sapiens
agtggagtctgagtctgagtcct

SEQ ID NO: 6652554 - DNA, 14 bp, Homo sapiens
agtggagtctgcca

SEQ ID NO: 6652555 - DNA, 19 bp, Homo sapiens
agtggagtctgccacccag

SEQ ID NO: 6652556 - DNA, 23 bp, Homo sapiens
agtggagttgttttaacagatgc

SEQ ID NO: 6652557 - DNA, 18 bp, Homo sapiens
agtggagttttataaatt

SEQ ID NO: 6652558 - DNA, 19 bp, Homo sapiens
agtggataatcaggaaaaa

SEQ ID NO: 6652559 - DNA, 15 bp, Homo sapiens
agtggatagatgccc

SEQ ID NO: 6652560 - DNA, 22 bp, Homo sapiens
agtggatatgacccacactgcc

SEQ ID NO: 6652561 - DNA, 16 bp, Homo sapiens
agtggatcacaaagtg

SEQ ID NO: 6652562 - DNA, 14 bp, Homo sapiens
agtggatcacacac

SEQ ID NO: 6652563 - DNA, 23 bp, Homo sapiens
agtggatcccctgcggtcaggct

SEQ ID NO: 6652564 - DNA, 12 bp, Homo sapiens
agtggatctcaa

SEQ ID NO: 6652565 - DNA, 16 bp, Homo sapiens
agtggatctcagtttt

SEQ ID NO: 6652566 - DNA, 18 bp, Homo sapiens
agtggatctccaaggacc

SEQ ID NO: 6652567 - DNA, 16 bp, Homo sapiens
agtggatctgcttctc

SEQ ID NO: 6652568 - DNA, 21 bp, Homo sapiens
agtggatcttcagaactgccc

SEQ ID NO: 6652569 - DNA, 13 bp, Homo sapiens
agtggatgatgtt

SEQ ID NO: 6652570 - DNA, 17 bp, Homo sapiens
agtggatgcattcctga

SEQ ID NO: 6652571 - DNA, 18 bp, Homo sapiens
agtggatgcattcctgag

SEQ ID NO: 6652572 - DNA, 14 bp, Homo sapiens
agtggatgctgtgc

SEQ ID NO: 6652573 - DNA, 20 bp, Homo sapiens
agtggatggaatatcagaag

SEQ ID NO: 6652574 - DNA, 13 bp, Homo sapiens
agtggatggacag

SEQ ID NO: 6652575 - DNA, 16 bp, Homo sapiens
agtggatggacagatg

SEQ ID NO: 6652576 - DNA, 19 bp, Homo sapiens
agtggatggacagatggac

SEQ ID NO: 6652577 - DNA, 17 bp, Homo sapiens
agtggatggaggagaaa

SEQ ID NO: 6652578 - DNA, 20 bp, Homo sapiens
agtggatggaggagaaataa

SEQ ID NO: 6652579 - DNA, 15 bp, Homo sapiens
agtggatggcccagc

SEQ ID NO: 6652580 - DNA, 20 bp, Homo sapiens
agtggatggcccagcaggca

SEQ ID NO: 6652581 - DNA, 22 bp, Homo sapiens
agtggatggcccagcaggcagg

SEQ ID NO: 6652582 - DNA, 23 bp, Homo sapiens
agtggatggcccagcaggcaggc

SEQ ID NO: 6652583 - DNA, 16 bp, Homo sapiens
agtggatgggaatttg

SEQ ID NO: 6652584 - DNA, 17 bp, Homo sapiens
agtggatgggaatttgt

SEQ ID NO: 6652585 - DNA, 15 bp, Homo sapiens
agtggattaatgcat

SEQ ID NO: 6652586 - DNA, 17 bp, Homo sapiens
agtggattcctccccac

SEQ ID NO: 6652587 - DNA, 14 bp, Homo sapiens
agtggattgcattt

SEQ ID NO: 6652588 - DNA, 17 bp, Homo sapiens
agtggattgtattgtga

SEQ ID NO: 6652589 - DNA, 14 bp, Homo sapiens
agtggattgtttat

SEQ ID NO: 6652590 - DNA, 15 bp, Homo sapiens
agtggatttcccatc

SEQ ID NO: 6652591 - DNA, 16 bp, Homo sapiens
agtggattttcctgaa

SEQ ID NO: 6652592 - DNA, 16 bp, Homo sapiens
agtggcaaaaaagaac

SEQ ID NO: 6652593 - DNA, 15 bp, Homo sapiens
agtggcaaaatatta

SEQ ID NO: 6652594 - DNA, 22 bp, Homo sapiens
agtggcaaaatattatgttatg

SEQ ID NO: 6652595 - DNA, 19 bp, Homo sapiens
agtggcaagtatttggcta

SEQ ID NO: 6652596 - DNA, 16 bp, Homo sapiens
agtggcacaatcatgg

SEQ ID NO: 6652597 - DNA, 18 bp, Homo sapiens
agtggcaccgcctcccca

SEQ ID NO: 6652598 - DNA, 17 bp, Homo sapiens
agtggcacctgtctgct

SEQ ID NO: 6652599 - DNA, 21 bp, Homo sapiens
agtggcacctgtctgctccag

SEQ ID NO: 6652600 - DNA, 15 bp, Homo sapiens
agtggcacggagaga

SEQ ID NO: 6652601 - DNA, 14 bp, Homo sapiens
agtggcactctgtg

SEQ ID NO: 6652602 - DNA, 16 bp, Homo sapiens
agtggcactctgtgtg

SEQ ID NO: 6652603 - DNA, 13 bp, Homo sapiens
agtggcactgaag

SEQ ID NO: 6652604 - DNA, 14 bp, Homo sapiens
agtggcagccatgc

SEQ ID NO: 6652605 - DNA, 15 bp, Homo sapiens
agtggcagccatgcc

SEQ ID NO: 6652606 - DNA, 22 bp, Homo sapiens
agtggcagccatgcctcatgcc

SEQ ID NO: 6652607 - DNA, 23 bp, Homo sapiens
agtggcagccatgcctcatgcca

SEQ ID NO: 6652608 - DNA, 13 bp, Homo sapiens
agtggcagcccag

SEQ ID NO: 6652609 - DNA, 14 bp, Homo sapiens
agtggcagcccagc

SEQ ID NO: 6652610 - DNA, 15 bp, Homo sapiens
agtggcagcccagcc

SEQ ID NO: 6652611 - DNA, 16 bp, Homo sapiens
agtggcagcccagcca

SEQ ID NO: 6652612 - DNA, 17 bp, Homo sapiens
agtggcagcccagccag

SEQ ID NO: 6652613 - DNA, 21 bp, Homo sapiens
agtggcagcccagccagcgtc

SEQ ID NO: 6652614 - DNA, 12 bp, Homo sapiens
agtggcagctgc

SEQ ID NO: 6652615 - DNA, 21 bp, Homo sapiens
agtggcagctgtcccctctcc

SEQ ID NO: 6652616 - DNA, 13 bp, Homo sapiens
agtggcaggacag

SEQ ID NO: 6652617 - DNA, 17 bp, Homo sapiens
agtggcaggacaggaaa

SEQ ID NO: 6652618 - DNA, 22 bp, Homo sapiens
agtggcaggaccctgtcaggat

SEQ ID NO: 6652619 - DNA, 12 bp, Homo sapiens
agtggcagggac

SEQ ID NO: 6652620 - DNA, 14 bp, Homo sapiens
agtggcagggaccg

SEQ ID NO: 6652621 - DNA, 22 bp, Homo sapiens
agtggcagggaccggcagagct

SEQ ID NO: 6652622 - DNA, 15 bp, Homo sapiens
agtggcagggcacag

SEQ ID NO: 6652623 - DNA, 13 bp, Homo sapiens
agtggcagggctc

SEQ ID NO: 6652624 - DNA, 11 bp, Homo sapiens
agtggcagggg

SEQ ID NO: 6652625 - DNA, 18 bp, Homo sapiens
agtggcaggggacaggag

SEQ ID NO: 6652626 - DNA, 19 bp, Homo sapiens
agtggcaggtgggctgcct

SEQ ID NO: 6652627 - DNA, 20 bp, Homo sapiens
agtggcaggtgggctgcctg

SEQ ID NO: 6652628 - DNA, 18 bp, Homo sapiens
agtggcatctgaaaacaa

SEQ ID NO: 6652629 - DNA, 15 bp, Homo sapiens
agtggcatggctcca

SEQ ID NO: 6652630 - DNA, 18 bp, Homo sapiens
agtggcatggctccagtc

SEQ ID NO: 6652631 - DNA, 18 bp, Homo sapiens
agtggcatggtcctgtgc

SEQ ID NO: 6652632 - DNA, 20 bp, Homo sapiens
agtggcatggtcctgtgccc

SEQ ID NO: 6652633 - DNA, 21 bp, Homo sapiens
agtggcatggtcctgtgcccc

SEQ ID NO: 6652634 - DNA, 22 bp, Homo sapiens
agtggcatggtcctgtgccccg

SEQ ID NO: 6652635 - DNA, 16 bp, Homo sapiens
agtggcatgtgctgtg

SEQ ID NO: 6652636 - DNA, 22 bp, Homo sapiens
agtggcatgttttgtgcatttg

SEQ ID NO: 6652637 - DNA, 18 bp, Homo sapiens
agtggcattggcagcagg

SEQ ID NO: 6652638 - DNA, 18 bp, Homo sapiens
agtggcatttgtcaggga

SEQ ID NO: 6652639 - DNA, 23 bp, Homo sapiens
agtggccaagatcacagtggcca

SEQ ID NO: 6652640 - DNA, 17 bp, Homo sapiens
agtggccacggcccagg

SEQ ID NO: 6652641 - DNA, 18 bp, Homo sapiens
agtggccacggcccaggg

SEQ ID NO: 6652642 - DNA, 19 bp, Homo sapiens
agtggccacggcccaggga

SEQ ID NO: 6652643 - DNA, 20 bp, Homo sapiens
agtggccacggcccagggag

SEQ ID NO: 6652644 - DNA, 21 bp, Homo sapiens
agtggccacgttcagggaggg

SEQ ID NO: 6652645 - DNA, 14 bp, Homo sapiens
agtggccactaagc

SEQ ID NO: 6652646 - DNA, 19 bp, Homo sapiens
agtggccactaagcagagg

SEQ ID NO: 6652647 - DNA, 12 bp, Homo sapiens
agtggccactgg

SEQ ID NO: 6652648 - DNA, 23 bp, Homo sapiens
agtggccagaccagagctctgga

SEQ ID NO: 6652649 - DNA, 10 bp, Homo sapiens
agtggccagc

SEQ ID NO: 6652650 - DNA, 12 bp, Homo sapiens
agtggccaggtg

SEQ ID NO: 6652651 - DNA, 13 bp, Homo sapiens
agtggccaggtgc

SEQ ID NO: 6652652 - DNA, 16 bp, Homo sapiens
agtggccatcatcctc

SEQ ID NO: 6652653 - DNA, 16 bp, Homo sapiens
agtggccatcatttct

SEQ ID NO: 6652654 - DNA, 22 bp, Homo sapiens
agtggccatttggggttgggac

SEQ ID NO: 6652655 - DNA, 24 bp, Homo sapiens
agtggcccatgtgactgtggcatt

SEQ ID NO: 6652656 - DNA, 13 bp, Homo sapiens
agtggccccacct

SEQ ID NO: 6652657 - DNA, 18 bp, Homo sapiens
agtggccccacctggccc

SEQ ID NO: 6652658 - DNA, 15 bp, Homo sapiens
agtggccccacctgt

SEQ ID NO: 6652659 - DNA, 18 bp, Homo sapiens
agtggccccacctgtgtc

SEQ ID NO: 6652660 - DNA, 16 bp, Homo sapiens
agtggccccatccagc

SEQ ID NO: 6652661 - DNA, 23 bp, Homo sapiens
agtggccccatccagcatgtgtg

SEQ ID NO: 6652662 - DNA, 19 bp, Homo sapiens
agtggcccccactcacagg

SEQ ID NO: 6652663 - DNA, 15 bp, Homo sapiens
agtggcccccgggcc

SEQ ID NO: 6652664 - DNA, 14 bp, Homo sapiens
agtggccccctcct

SEQ ID NO: 6652665 - DNA, 14 bp, Homo sapiens
agtggccctccctc

SEQ ID NO: 6652666 - DNA, 16 bp, Homo sapiens
agtggccctccctcag

SEQ ID NO: 6652667 - DNA, 21 bp, Homo sapiens
agtggccctgatccaggaaaa

SEQ ID NO: 6652668 - DNA, 19 bp, Homo sapiens
agtggccgcaagcgcaggg

SEQ ID NO: 6652669 - DNA, 17 bp, Homo sapiens
agtggccgggccggacg

SEQ ID NO: 6652670 - DNA, 14 bp, Homo sapiens
agtggccggggctg

SEQ ID NO: 6652671 - DNA, 16 bp, Homo sapiens
agtggccggggctgaa

SEQ ID NO: 6652672 - DNA, 21 bp, Homo sapiens
agtggcctacaaatcagtaat

SEQ ID NO: 6652673 - DNA, 21 bp, Homo sapiens
agtggcctccgtcactacctg

SEQ ID NO: 6652674 - DNA, 21 bp, Homo sapiens
agtggcctctttgtctaaaac

SEQ ID NO: 6652675 - DNA, 15 bp, Homo sapiens
agtggcctgagaaga

SEQ ID NO: 6652676 - DNA, 16 bp, Homo sapiens
agtggcctgagaagag

SEQ ID NO: 6652677 - DNA, 17 bp, Homo sapiens
agtggcctgagaagagt

SEQ ID NO: 6652678 - DNA, 13 bp, Homo sapiens
agtggcctggatg

SEQ ID NO: 6652679 - DNA, 23 bp, Homo sapiens
agtggcctggatgcacagtgcct

SEQ ID NO: 6652680 - DNA, 19 bp, Homo sapiens
agtggcctggccaggagct

SEQ ID NO: 6652681 - DNA, 22 bp, Homo sapiens
agtggcctggccgttcagcctg

SEQ ID NO: 6652682 - DNA, 13 bp, Homo sapiens
agtggcctggctc

SEQ ID NO: 6652683 - DNA, 13 bp, Homo sapiens
agtggcctggctt

SEQ ID NO: 6652684 - DNA, 18 bp, Homo sapiens
agtggcctgggtcccagg

SEQ ID NO: 6652685 - DNA, 19 bp, Homo sapiens
agtggcctgggtcccaggg

SEQ ID NO: 6652686 - DNA, 17 bp, Homo sapiens
agtggccttccccagca

SEQ ID NO: 6652687 - DNA, 19 bp, Homo sapiens
agtggccttccccagcatg

SEQ ID NO: 6652688 - DNA, 15 bp, Homo sapiens
agtggcctttcagtg

SEQ ID NO: 6652689 - DNA, 18 bp, Homo sapiens
agtggcgaaatccctgct

SEQ ID NO: 6652690 - DNA, 23 bp, Homo sapiens
agtggcgaaatccctgctcactg

SEQ ID NO: 6652691 - DNA, 17 bp, Homo sapiens
agtggcgagaggagagg

SEQ ID NO: 6652692 - DNA, 18 bp, Homo sapiens
agtggcgagaggagagga

SEQ ID NO: 6652693 - DNA, 15 bp, Homo sapiens
agtggcgagtccaga

SEQ ID NO: 6652694 - DNA, 15 bp, Homo sapiens
agtggcgcaaggccg

SEQ ID NO: 6652695 - DNA, 19 bp, Homo sapiens
agtggcgcgatctcagctc

SEQ ID NO: 6652696 - DNA, 18 bp, Homo sapiens
agtggcgcgcgccaccac

SEQ ID NO: 6652697 - DNA, 12 bp, Homo sapiens
agtggcggggcc

SEQ ID NO: 6652698 - DNA, 20 bp, Homo sapiens
agtggcgggtgatggccagc

SEQ ID NO: 6652699 - DNA, 14 bp, Homo sapiens
agtggcgtgagctg

SEQ ID NO: 6652700 - DNA, 17 bp, Homo sapiens
agtggcgtgagctgccc

SEQ ID NO: 6652701 - DNA, 20 bp, Homo sapiens
agtggcgtgatctcagctca

SEQ ID NO: 6652702 - DNA, 18 bp, Homo sapiens
agtggcgtgatcttggct

SEQ ID NO: 6652703 - DNA, 14 bp, Homo sapiens
agtggcgtggcctc

SEQ ID NO: 6652704 - DNA, 23 bp, Homo sapiens
agtggcgttgggagggggagaaa

SEQ ID NO: 6652705 - DNA, 15 bp, Homo sapiens
agtggcgttgttcat

SEQ ID NO: 6652706 - DNA, 15 bp, Homo sapiens
agtggcgttgttgca

SEQ ID NO: 6652707 - DNA, 24 bp, Homo sapiens
agtggctcagacccctcagcccca

SEQ ID NO: 6652708 - DNA, 16 bp, Homo sapiens
agtggctcatgcctgt

SEQ ID NO: 6652709 - DNA, 22 bp, Homo sapiens
agtggctcccctgcccagcctg

SEQ ID NO: 6652710 - DNA, 16 bp, Homo sapiens
agtggctcgctccctg

SEQ ID NO: 6652711 - DNA, 21 bp, Homo sapiens
agtggctcgtatcccaaatct

SEQ ID NO: 6652712 - DNA, 22 bp, Homo sapiens
agtggctcgtgtttcacagtgg

SEQ ID NO: 6652713 - DNA, 20 bp, Homo sapiens
agtggctcttctaacctcag

SEQ ID NO: 6652714 - DNA, 19 bp, Homo sapiens
agtggctgaaataaaagcc

SEQ ID NO: 6652715 - DNA, 16 bp, Homo sapiens
agtggctgaccaggcc

SEQ ID NO: 6652716 - DNA, 17 bp, Homo sapiens
agtggctgaccaggccc

SEQ ID NO: 6652717 - DNA, 19 bp, Homo sapiens
agtggctgaccaggccctg

SEQ ID NO: 6652718 - DNA, 20 bp, Homo sapiens
agtggctgccacacccaggg

SEQ ID NO: 6652719 - DNA, 21 bp, Homo sapiens
agtggctgccggaggagcatg

SEQ ID NO: 6652720 - DNA, 15 bp, Homo sapiens
agtggctgctctggg

SEQ ID NO: 6652721 - DNA, 18 bp, Homo sapiens
agtggctggaagagtccc

SEQ ID NO: 6652722 - DNA, 16 bp, Homo sapiens
agtggctggaattaaa

SEQ ID NO: 6652723 - DNA, 14 bp, Homo sapiens
agtggctgggggac

SEQ ID NO: 6652724 - DNA, 15 bp, Homo sapiens
agtggctggggtgga

SEQ ID NO: 6652725 - DNA, 17 bp, Homo sapiens
agtggctgggtgccctc

SEQ ID NO: 6652726 - DNA, 21 bp, Homo sapiens
agtggctgggtgggcccagaa

SEQ ID NO: 6652727 - DNA, 13 bp, Homo sapiens
agtggctggtgcc

SEQ ID NO: 6652728 - DNA, 19 bp, Homo sapiens
agtggctgtccagtgccca

SEQ ID NO: 6652729 - DNA, 13 bp, Homo sapiens
agtggctgtctta

SEQ ID NO: 6652730 - DNA, 11 bp, Homo sapiens
agtggctgtga

SEQ ID NO: 6652731 - DNA, 14 bp, Homo sapiens
agtggctgtgaagg

SEQ ID NO: 6652732 - DNA, 19 bp, Homo sapiens
agtggctgttcatgctcca

SEQ ID NO: 6652733 - DNA, 23 bp, Homo sapiens
agtggcttaaaacaacactcaca

SEQ ID NO: 6652734 - DNA, 19 bp, Homo sapiens
agtggcttactacatgtgg

SEQ ID NO: 6652735 - DNA, 21 bp, Homo sapiens
agtggcttagctgccatcttg

SEQ ID NO: 6652736 - DNA, 18 bp, Homo sapiens
agtggcttcactcctgct

SEQ ID NO: 6652737 - DNA, 19 bp, Homo sapiens
agtggcttcactcctgctg

SEQ ID NO: 6652738 - DNA, 18 bp, Homo sapiens
agtggcttcccagctctg

SEQ ID NO: 6652739 - DNA, 14 bp, Homo sapiens
agtggcttcctccg

SEQ ID NO: 6652740 - DNA, 15 bp, Homo sapiens
agtggcttctccagg

SEQ ID NO: 6652741 - DNA, 19 bp, Homo sapiens
agtggcttctccatcctca

SEQ ID NO: 6652742 - DNA, 14 bp, Homo sapiens
agtggcttctccca

SEQ ID NO: 6652743 - DNA, 24 bp, Homo sapiens
agtggcttgtgattctgggatgga

SEQ ID NO: 6652744 - DNA, 17 bp, Homo sapiens
agtggctttaatgaata

SEQ ID NO: 6652745 - DNA, 21 bp, Homo sapiens
agtggctttctaccacacaca

SEQ ID NO: 6652746 - DNA, 23 bp, Homo sapiens
agtggctttctaccacacacagc

SEQ ID NO: 6652747 - DNA, 21 bp, Homo sapiens
agtggcttttttcctcctgtg

SEQ ID NO: 6652748 - DNA, 14 bp, Homo sapiens
agtgggaaaaatgt

SEQ ID NO: 6652749 - DNA, 18 bp, Homo sapiens
agtgggaaaaatgtagga

SEQ ID NO: 6652750 - DNA, 14 bp, Homo sapiens
agtgggaaagatac

SEQ ID NO: 6652751 - DNA, 14 bp, Homo sapiens
agtgggaaatatgc

SEQ ID NO: 6652752 - DNA, 14 bp, Homo sapiens
agtgggaactgtgc

SEQ ID NO: 6652753 - DNA, 16 bp, Homo sapiens
agtgggaactgtgcaa

SEQ ID NO: 6652754 - DNA, 17 bp, Homo sapiens
agtgggaactgtgcaaa

SEQ ID NO: 6652755 - DNA, 12 bp, Homo sapiens
agtgggaagaat

SEQ ID NO: 6652756 - DNA, 13 bp, Homo sapiens
agtgggaagaata

SEQ ID NO: 6652757 - DNA, 21 bp, Homo sapiens
agtgggaagagggggctggcc

SEQ ID NO: 6652758 - DNA, 22 bp, Homo sapiens
agtgggaagagggggctggcca

SEQ ID NO: 6652759 - DNA, 14 bp, Homo sapiens
agtgggaagatttt

SEQ ID NO: 6652760 - DNA, 12 bp, Homo sapiens
agtgggaagccc

SEQ ID NO: 6652761 - DNA, 20 bp, Homo sapiens
agtgggaaggacttggcgcg

SEQ ID NO: 6652762 - DNA, 16 bp, Homo sapiens
agtgggaagggagcat

SEQ ID NO: 6652763 - DNA, 15 bp, Homo sapiens
agtgggaagtgaagc

SEQ ID NO: 6652764 - DNA, 20 bp, Homo sapiens
agtgggaatgcagtgggtgg

SEQ ID NO: 6652765 - DNA, 12 bp, Homo sapiens
agtgggaatgtt

SEQ ID NO: 6652766 - DNA, 14 bp, Homo sapiens
agtgggacagacag

SEQ ID NO: 6652767 - DNA, 17 bp, Homo sapiens
agtgggacagacagcag

SEQ ID NO: 6652768 - DNA, 18 bp, Homo sapiens
agtgggacagacagcagc

SEQ ID NO: 6652769 - DNA, 17 bp, Homo sapiens
agtgggacagagtctgg

SEQ ID NO: 6652770 - DNA, 15 bp, Homo sapiens
agtgggacagcccag

SEQ ID NO: 6652771 - DNA, 21 bp, Homo sapiens
agtgggacagggcatggccag

SEQ ID NO: 6652772 - DNA, 23 bp, Homo sapiens
agtgggacagttcctgagaccag

SEQ ID NO: 6652773 - DNA, 15 bp, Homo sapiens
agtgggaccacatgc

SEQ ID NO: 6652774 - DNA, 19 bp, Homo sapiens
agtgggaccacatgccact

SEQ ID NO: 6652775 - DNA, 21 bp, Homo sapiens
agtgggactgtggtgacttct

SEQ ID NO: 6652776 - DNA, 17 bp, Homo sapiens
agtgggacttggagagc

SEQ ID NO: 6652777 - DNA, 14 bp, Homo sapiens
agtgggagaaaaca

SEQ ID NO: 6652778 - DNA, 17 bp, Homo sapiens
agtgggagaaaacactt

SEQ ID NO: 6652779 - DNA, 19 bp, Homo sapiens
agtgggagaaggcagtgat

SEQ ID NO: 6652780 - DNA, 19 bp, Homo sapiens
agtgggagaagtggcccct

SEQ ID NO: 6652781 - DNA, 22 bp, Homo sapiens
agtgggagacaatattaatttg

SEQ ID NO: 6652782 - DNA, 13 bp, Homo sapiens
agtgggagaggaa

SEQ ID NO: 6652783 - DNA, 16 bp, Homo sapiens
agtgggagatgaaaac

SEQ ID NO: 6652784 - DNA, 17 bp, Homo sapiens
agtgggagatgaaaacc

SEQ ID NO: 6652785 - DNA, 12 bp, Homo sapiens
agtgggagccca

SEQ ID NO: 6652786 - DNA, 15 bp, Homo sapiens
agtgggagcccagca

SEQ ID NO: 6652787 - DNA, 13 bp, Homo sapiens
agtgggagccctg

SEQ ID NO: 6652788 - DNA, 14 bp, Homo sapiens
agtgggagctgcct

SEQ ID NO: 6652789 - DNA, 13 bp, Homo sapiens
agtgggaggacag

SEQ ID NO: 6652790 - DNA, 19 bp, Homo sapiens
agtgggaggagagggcaga

SEQ ID NO: 6652791 - DNA, 12 bp, Homo sapiens
agtgggaggggc

SEQ ID NO: 6652792 - DNA, 18 bp, Homo sapiens
agtgggaggggcaggctg

SEQ ID NO: 6652793 - DNA, 14 bp, Homo sapiens
agtgggagtgggag

SEQ ID NO: 6652794 - DNA, 15 bp, Homo sapiens
agtgggagtgggaga

SEQ ID NO: 6652795 - DNA, 22 bp, Homo sapiens
agtgggataaaggcccagactc

SEQ ID NO: 6652796 - DNA, 20 bp, Homo sapiens
agtgggatcaacaatgattt

SEQ ID NO: 6652797 - DNA, 11 bp, Homo sapiens
agtgggatggg

SEQ ID NO: 6652798 - DNA, 13 bp, Homo sapiens
agtgggatgggac

SEQ ID NO: 6652799 - DNA, 19 bp, Homo sapiens
agtgggatgggctctacct

SEQ ID NO: 6652800 - DNA, 20 bp, Homo sapiens
agtgggatgggctctacctc

SEQ ID NO: 6652801 - DNA, 18 bp, Homo sapiens
agtgggattcaggaatgg

SEQ ID NO: 6652802 - DNA, 19 bp, Homo sapiens
agtgggcactaagggtgga

SEQ ID NO: 6652803 - DNA, 13 bp, Homo sapiens
agtgggcaggtgg

SEQ ID NO: 6652804 - DNA, 15 bp, Homo sapiens
agtgggcatgtatta

SEQ ID NO: 6652805 - DNA, 17 bp, Homo sapiens
agtgggccagccacaga

SEQ ID NO: 6652806 - DNA, 21 bp, Homo sapiens
agtgggccaggacaggcccgg

SEQ ID NO: 6652807 - DNA, 17 bp, Homo sapiens
agtgggccagtcctggt

SEQ ID NO: 6652808 - DNA, 14 bp, Homo sapiens
agtgggccagtgtg

SEQ ID NO: 6652809 - DNA, 14 bp, Homo sapiens
agtgggccccctct

SEQ ID NO: 6652810 - DNA, 20 bp, Homo sapiens
agtgggccccgggctggaga

SEQ ID NO: 6652811 - DNA, 20 bp, Homo sapiens
agtgggcccggagaaacctg

SEQ ID NO: 6652812 - DNA, 18 bp, Homo sapiens
agtgggccctctctctgg

SEQ ID NO: 6652813 - DNA, 22 bp, Homo sapiens
agtgggccctgcccggggagct

SEQ ID NO: 6652814 - DNA, 12 bp, Homo sapiens
agtgggccctgg

SEQ ID NO: 6652815 - DNA, 14 bp, Homo sapiens
agtgggccctggct

SEQ ID NO: 6652816 - DNA, 15 bp, Homo sapiens
agtgggccggcccca

SEQ ID NO: 6652817 - DNA, 18 bp, Homo sapiens
agtgggccggccccaggc

SEQ ID NO: 6652818 - DNA, 19 bp, Homo sapiens
agtgggccggccccaggct

SEQ ID NO: 6652819 - DNA, 19 bp, Homo sapiens
agtgggcctgctgaggcct

SEQ ID NO: 6652820 - DNA, 17 bp, Homo sapiens
agtgggcctgtgtgtgt

SEQ ID NO: 6652821 - DNA, 22 bp, Homo sapiens
agtgggccttcattaaatgttt

SEQ ID NO: 6652822 - DNA, 23 bp, Homo sapiens
agtgggccttcattaaatgtttg

SEQ ID NO: 6652823 - DNA, 16 bp, Homo sapiens
agtgggctccctggcc

SEQ ID NO: 6652824 - DNA, 17 bp, Homo sapiens
agtgggctccctggccc

SEQ ID NO: 6652825 - DNA, 18 bp, Homo sapiens
agtgggctccctggccca

SEQ ID NO: 6652826 - DNA, 23 bp, Homo sapiens
agtgggctccctggcccagccag

SEQ ID NO: 6652827 - DNA, 23 bp, Homo sapiens
agtgggctgacatcaagtgtaat

SEQ ID NO: 6652828 - DNA, 20 bp, Homo sapiens
agtgggctgatgctgggacc

SEQ ID NO: 6652829 - DNA, 15 bp, Homo sapiens
agtgggctgcacgct

SEQ ID NO: 6652830 - DNA, 14 bp, Homo sapiens
agtgggctgcctgg

SEQ ID NO: 6652831 - DNA, 18 bp, Homo sapiens
agtgggctgcctggggat

SEQ ID NO: 6652832 - DNA, 14 bp, Homo sapiens
agtgggctgtttct

SEQ ID NO: 6652833 - DNA, 16 bp, Homo sapiens
agtgggctttccaggg

SEQ ID NO: 6652834 - DNA, 14 bp, Homo sapiens
agtggggaaaaaaa

SEQ ID NO: 6652835 - DNA, 15 bp, Homo sapiens
agtggggaactgagg

SEQ ID NO: 6652836 - DNA, 13 bp, Homo sapiens
agtggggacagat

SEQ ID NO: 6652837 - DNA, 14 bp, Homo sapiens
agtggggacagatt

SEQ ID NO: 6652838 - DNA, 15 bp, Homo sapiens
agtggggacagattc

SEQ ID NO: 6652839 - DNA, 16 bp, Homo sapiens
agtggggacagggagg

SEQ ID NO: 6652840 - DNA, 18 bp, Homo sapiens
agtggggacagggagggg

SEQ ID NO: 6652841 - DNA, 13 bp, Homo sapiens
agtggggagagag

SEQ ID NO: 6652842 - DNA, 15 bp, Homo sapiens
agtggggagagagcc

SEQ ID NO: 6652843 - DNA, 15 bp, Homo sapiens
agtggggaggagaga

SEQ ID NO: 6652844 - DNA, 16 bp, Homo sapiens
agtggggaggagagag

SEQ ID NO: 6652845 - DNA, 18 bp, Homo sapiens
agtggggagggagtctgg

SEQ ID NO: 6652846 - DNA, 21 bp, Homo sapiens
agtggggatgaggtcaccagg

SEQ ID NO: 6652847 - DNA, 16 bp, Homo sapiens
agtggggatggggcct

SEQ ID NO: 6652848 - DNA, 22 bp, Homo sapiens
agtggggatggggcctccctcc

SEQ ID NO: 6652849 - DNA, 21 bp, Homo sapiens
agtggggccagggtgggaggg

SEQ ID NO: 6652850 - DNA, 20 bp, Homo sapiens
agtggggcccatggccccag

SEQ ID NO: 6652851 - DNA, 21 bp, Homo sapiens
agtggggcccatggccccagc

SEQ ID NO: 6652852 - DNA, 18 bp, Homo sapiens
agtggggcctgccctctg

SEQ ID NO: 6652853 - DNA, 14 bp, Homo sapiens
agtggggcctggga

SEQ ID NO: 6652854 - DNA, 14 bp, Homo sapiens
agtggggcctgtgg

SEQ ID NO: 6652855 - DNA, 15 bp, Homo sapiens
agtggggcctgtgga

SEQ ID NO: 6652856 - DNA, 21 bp, Homo sapiens
agtggggcctttgccagcaga

SEQ ID NO: 6652857 - DNA, 20 bp, Homo sapiens
agtggggctagactgggctg

SEQ ID NO: 6652858 - DNA, 15 bp, Homo sapiens
agtggggctcgccat

SEQ ID NO: 6652859 - DNA, 18 bp, Homo sapiens
agtggggctgcaggcagg

SEQ ID NO: 6652860 - DNA, 19 bp, Homo sapiens
agtggggctgcaggcaggc

SEQ ID NO: 6652861 - DNA, 19 bp, Homo sapiens
agtggggctggaagcagaa

SEQ ID NO: 6652862 - DNA, 15 bp, Homo sapiens
agtggggctggcatc

SEQ ID NO: 6652863 - DNA, 12 bp, Homo sapiens
agtggggctggg

SEQ ID NO: 6652864 - DNA, 13 bp, Homo sapiens
agtggggcttcct

SEQ ID NO: 6652865 - DNA, 16 bp, Homo sapiens
agtgggggagagcagg

SEQ ID NO: 6652866 - DNA, 21 bp, Homo sapiens
agtgggggagagcaggctggc

SEQ ID NO: 6652867 - DNA, 23 bp, Homo sapiens
agtgggggagagcaggctggcag

SEQ ID NO: 6652868 - DNA, 20 bp, Homo sapiens
agtgggggagtggccacaga

SEQ ID NO: 6652869 - DNA, 17 bp, Homo sapiens
agtgggggccgctggcc

SEQ ID NO: 6652870 - DNA, 19 bp, Homo sapiens
agtgggggccgctggccca

SEQ ID NO: 6652871 - DNA, 14 bp, Homo sapiens
agtggggggaggaa

SEQ ID NO: 6652872 - DNA, 18 bp, Homo sapiens
agtggggggtcgtgggcc

SEQ ID NO: 6652873 - DNA, 21 bp, Homo sapiens
agtgggggtggaggaccgagg

SEQ ID NO: 6652874 - DNA, 19 bp, Homo sapiens
agtggggtagactgaggga

SEQ ID NO: 6652875 - DNA, 21 bp, Homo sapiens
agtggggtcaagctgagctgg

SEQ ID NO: 6652876 - DNA, 22 bp, Homo sapiens
agtggggtcaagctgagctggc

SEQ ID NO: 6652877 - DNA, 17 bp, Homo sapiens
agtggggtgaacagctg

SEQ ID NO: 6652878 - DNA, 16 bp, Homo sapiens
agtggggtgctgggag

SEQ ID NO: 6652879 - DNA, 19 bp, Homo sapiens
agtggggttatctctgtgt

SEQ ID NO: 6652880 - DNA, 21 bp, Homo sapiens
agtggggttatctctgtgtta

SEQ ID NO: 6652881 - DNA, 19 bp, Homo sapiens
agtggggttgcaaccactg

SEQ ID NO: 6652882 - DNA, 15 bp, Homo sapiens
agtgggtaaaattag

SEQ ID NO: 6652883 - DNA, 19 bp, Homo sapiens
agtgggtaaaattagatgc

SEQ ID NO: 6652884 - DNA, 17 bp, Homo sapiens
agtgggtacccccagga

SEQ ID NO: 6652885 - DNA, 20 bp, Homo sapiens
agtgggtactttctgaaaat

SEQ ID NO: 6652886 - DNA, 22 bp, Homo sapiens
agtgggtatttcttatttgaaa

SEQ ID NO: 6652887 - DNA, 13 bp, Homo sapiens
agtgggtgaataa

SEQ ID NO: 6652888 - DNA, 18 bp, Homo sapiens
agtgggtgacaagagcct

SEQ ID NO: 6652889 - DNA, 13 bp, Homo sapiens
agtgggtgagaaa

SEQ ID NO: 6652890 - DNA, 19 bp, Homo sapiens
agtgggtgagatgctggag

SEQ ID NO: 6652891 - DNA, 22 bp, Homo sapiens
agtgggtgcatatgtacagaag

SEQ ID NO: 6652892 - DNA, 15 bp, Homo sapiens
agtgggtggcacctc

SEQ ID NO: 6652893 - DNA, 18 bp, Homo sapiens
agtgggtggtggatctgt

SEQ ID NO: 6652894 - DNA, 21 bp, Homo sapiens
agtgggtgtgtggcctccctg

SEQ ID NO: 6652895 - DNA, 15 bp, Homo sapiens
agtgggttattctgg

SEQ ID NO: 6652896 - DNA, 19 bp, Homo sapiens
agtgggttattctggagtt

SEQ ID NO: 6652897 - DNA, 21 bp, Homo sapiens
agtgggttcactagagctggg

SEQ ID NO: 6652898 - DNA, 15 bp, Homo sapiens
agtgggttcaggccc

SEQ ID NO: 6652899 - DNA, 21 bp, Homo sapiens
agtgggtttcacaagtgaaaa

SEQ ID NO: 6652900 - DNA, 13 bp, Homo sapiens
agtgggttttgtc

SEQ ID NO: 6652901 - DNA, 19 bp, Homo sapiens
agtggtaaaaaagaaatga

SEQ ID NO: 6652902 - DNA, 19 bp, Homo sapiens
agtggtaaaaaggcctcct

SEQ ID NO: 6652903 - DNA, 15 bp, Homo sapiens
agtggtaaatactgt

SEQ ID NO: 6652904 - DNA, 17 bp, Homo sapiens
agtggtaacaagaggag

SEQ ID NO: 6652905 - DNA, 15 bp, Homo sapiens
agtggtaacagctct

SEQ ID NO: 6652906 - DNA, 17 bp, Homo sapiens
agtggtaacagctctct

SEQ ID NO: 6652907 - DNA, 17 bp, Homo sapiens
agtggtaagctatgtcc

SEQ ID NO: 6652908 - DNA, 19 bp, Homo sapiens
agtggtaagctctggcttt

SEQ ID NO: 6652909 - DNA, 15 bp, Homo sapiens
agtggtaattgggaa

SEQ ID NO: 6652910 - DNA, 19 bp, Homo sapiens
agtggtacaatctggctca

SEQ ID NO: 6652911 - DNA, 14 bp, Homo sapiens
agtggtaccagctc

SEQ ID NO: 6652912 - DNA, 23 bp, Homo sapiens
agtggtactctgtgtctggcagg

SEQ ID NO: 6652913 - DNA, 22 bp, Homo sapiens
agtggtagagaggtttttcttg

SEQ ID NO: 6652914 - DNA, 16 bp, Homo sapiens
agtggtagtatctcgt

SEQ ID NO: 6652915 - DNA, 20 bp, Homo sapiens
agtggtatatccaagtatat

SEQ ID NO: 6652916 - DNA, 21 bp, Homo sapiens
agtggtattttaacatagcag

SEQ ID NO: 6652917 - DNA, 23 bp, Homo sapiens
agtggtcaaaccgcactcaccca

SEQ ID NO: 6652918 - DNA, 20 bp, Homo sapiens
agtggtcactggtcagggca

SEQ ID NO: 6652919 - DNA, 15 bp, Homo sapiens
agtggtcagcaggtg

SEQ ID NO: 6652920 - DNA, 21 bp, Homo sapiens
agtggtcagcgattcctgcca

SEQ ID NO: 6652921 - DNA, 21 bp, Homo sapiens
agtggtcataaaatagaataa

SEQ ID NO: 6652922 - DNA, 20 bp, Homo sapiens
agtggtcatttggtggctct

SEQ ID NO: 6652923 - DNA, 15 bp, Homo sapiens
agtggtccacattct

SEQ ID NO: 6652924 - DNA, 19 bp, Homo sapiens
agtggtccacattctgctg

SEQ ID NO: 6652925 - DNA, 13 bp, Homo sapiens
agtggtccagcgt

SEQ ID NO: 6652926 - DNA, 21 bp, Homo sapiens
agtggtccagcgtcactccag

SEQ ID NO: 6652927 - DNA, 16 bp, Homo sapiens
agtggtccagggtcca

SEQ ID NO: 6652928 - DNA, 18 bp, Homo sapiens
agtggtccatggaatgct

SEQ ID NO: 6652929 - DNA, 15 bp, Homo sapiens
agtggtccctgccct

SEQ ID NO: 6652930 - DNA, 20 bp, Homo sapiens
agtggtctaattcaactctg

SEQ ID NO: 6652931 - DNA, 20 bp, Homo sapiens
agtggtctcacctggaggca

SEQ ID NO: 6652932 - DNA, 13 bp, Homo sapiens
agtggtctcccca

SEQ ID NO: 6652933 - DNA, 18 bp, Homo sapiens
agtggtctcctctcagct

SEQ ID NO: 6652934 - DNA, 14 bp, Homo sapiens
agtggtctctgctg

SEQ ID NO: 6652935 - DNA, 20 bp, Homo sapiens
agtggtctctgctggggaag

SEQ ID NO: 6652936 - DNA, 16 bp, Homo sapiens
agtggtctggaaacag

SEQ ID NO: 6652937 - DNA, 20 bp, Homo sapiens
agtggtctttcctatcatgg

SEQ ID NO: 6652938 - DNA, 20 bp, Homo sapiens
agtggtctttctggagaggt

SEQ ID NO: 6652939 - DNA, 22 bp, Homo sapiens
agtggtctttgtaagagtgtag

SEQ ID NO: 6652940 - DNA, 14 bp, Homo sapiens
agtggtgaaatctt

SEQ ID NO: 6652941 - DNA, 13 bp, Homo sapiens
agtggtgcaatca

SEQ ID NO: 6652942 - DNA, 22 bp, Homo sapiens
agtggtgcaatcacagctcact

SEQ ID NO: 6652943 - DNA, 14 bp, Homo sapiens
agtggtgcagacag

SEQ ID NO: 6652944 - DNA, 23 bp, Homo sapiens
agtggtgccatcattgctgtctg

SEQ ID NO: 6652945 - DNA, 15 bp, Homo sapiens
agtggtgcgggccag

SEQ ID NO: 6652946 - DNA, 20 bp, Homo sapiens
agtggtgcgtttataattgg

SEQ ID NO: 6652947 - DNA, 13 bp, Homo sapiens
agtggtgctcagt

SEQ ID NO: 6652948 - DNA, 22 bp, Homo sapiens
agtggtgctcagttgtagaatg

SEQ ID NO: 6652949 - DNA, 12 bp, Homo sapiens
agtggtggaggt

SEQ ID NO: 6652950 - DNA, 19 bp, Homo sapiens
agtggtggcaaaagacatc

SEQ ID NO: 6652951 - DNA, 14 bp, Homo sapiens
agtggtggcagctc

SEQ ID NO: 6652952 - DNA, 15 bp, Homo sapiens
agtggtggcagctca

SEQ ID NO: 6652953 - DNA, 14 bp, Homo sapiens
agtggtggcagggc

SEQ ID NO: 6652954 - DNA, 15 bp, Homo sapiens
agtggtggcagggcc

SEQ ID NO: 6652955 - DNA, 22 bp, Homo sapiens
agtggtggcagtgcagcaacca

SEQ ID NO: 6652956 - DNA, 15 bp, Homo sapiens
agtggtggctctgag

SEQ ID NO: 6652957 - DNA, 16 bp, Homo sapiens
agtggtgggggaaggc

SEQ ID NO: 6652958 - DNA, 18 bp, Homo sapiens
agtggtgggtaattgtac

SEQ ID NO: 6652959 - DNA, 23 bp, Homo sapiens
agtggtgggtaattgtacaataa

SEQ ID NO: 6652960 - DNA, 18 bp, Homo sapiens
agtggtggtaaccctggt

SEQ ID NO: 6652961 - DNA, 16 bp, Homo sapiens
agtggtggttcctttg

SEQ ID NO: 6652962 - DNA, 21 bp, Homo sapiens
agtggtggttcctttgcaccc

SEQ ID NO: 6652963 - DNA, 17 bp, Homo sapiens
agtggtggttttctgtt

SEQ ID NO: 6652964 - DNA, 20 bp, Homo sapiens
agtggtgtaaacttgtacat

SEQ ID NO: 6652965 - DNA, 14 bp, Homo sapiens
agtggtgtgactct

SEQ ID NO: 6652966 - DNA, 19 bp, Homo sapiens
agtggtgtgactcttactc

SEQ ID NO: 6652967 - DNA, 20 bp, Homo sapiens
agtggtgtgatctcggctca

SEQ ID NO: 6652968 - DNA, 19 bp, Homo sapiens
agtggtgttccatgacttc

SEQ ID NO: 6652969 - DNA, 16 bp, Homo sapiens
agtggtgtttattgca

SEQ ID NO: 6652970 - DNA, 16 bp, Homo sapiens
agtggttaggcagcaa

SEQ ID NO: 6652971 - DNA, 20 bp, Homo sapiens
agtggttattcattattcct

SEQ ID NO: 6652972 - DNA, 23 bp, Homo sapiens
agtggttattcattattcctcag

SEQ ID NO: 6652973 - DNA, 21 bp, Homo sapiens
agtggttcagtctagaagaat

SEQ ID NO: 6652974 - DNA, 23 bp, Homo sapiens
agtggttcgggggaaatagttcc

SEQ ID NO: 6652975 - DNA, 15 bp, Homo sapiens
agtggttctctgcct

SEQ ID NO: 6652976 - DNA, 17 bp, Homo sapiens
agtggttctctgccttt

SEQ ID NO: 6652977 - DNA, 16 bp, Homo sapiens
agtggttggatgtagt

SEQ ID NO: 6652978 - DNA, 18 bp, Homo sapiens
agtggttggatgtagtca

SEQ ID NO: 6652979 - DNA, 13 bp, Homo sapiens
agtggtttagaaa

SEQ ID NO: 6652980 - DNA, 22 bp, Homo sapiens
agtggtttcataggagacacat

SEQ ID NO: 6652981 - DNA, 23 bp, Homo sapiens
agtggtttcggaaaaaaaaaaag

SEQ ID NO: 6652982 - DNA, 23 bp, Homo sapiens
agtggtttctacttcccctggga

SEQ ID NO: 6652983 - DNA, 22 bp, Homo sapiens
agtggtttgatggtgacttcct

SEQ ID NO: 6652984 - DNA, 21 bp, Homo sapiens
agtggttttatactgaaggaa

SEQ ID NO: 6652985 - DNA, 14 bp, Homo sapiens
agtgtaaaaaatgt

SEQ ID NO: 6652986 - DNA, 13 bp, Homo sapiens
agtgtaaaataga

SEQ ID NO: 6652987 - DNA, 21 bp, Homo sapiens
agtgtaaaatattttgaatca

SEQ ID NO: 6652988 - DNA, 18 bp, Homo sapiens
agtgtaaagaataaatga

SEQ ID NO: 6652989 - DNA, 22 bp, Homo sapiens
agtgtaaagaataaatgaatct

SEQ ID NO: 6652990 - DNA, 22 bp, Homo sapiens
agtgtaaagcattccaacaaag

SEQ ID NO: 6652991 - DNA, 14 bp, Homo sapiens
agtgtaaataattt

SEQ ID NO: 6652992 - DNA, 20 bp, Homo sapiens
agtgtaaataattttaaata

SEQ ID NO: 6652993 - DNA, 22 bp, Homo sapiens
agtgtaaatagaagagtttaaa

SEQ ID NO: 6652994 - DNA, 14 bp, Homo sapiens
agtgtaaatccttt

SEQ ID NO: 6652995 - DNA, 15 bp, Homo sapiens
agtgtaaatgttagt

SEQ ID NO: 6652996 - DNA, 14 bp, Homo sapiens
agtgtaaattcagt

SEQ ID NO: 6652997 - DNA, 13 bp, Homo sapiens
agtgtaacaagaa

SEQ ID NO: 6652998 - DNA, 22 bp, Homo sapiens
agtgtaacaattgtgtagcctt

SEQ ID NO: 6652999 - DNA, 13 bp, Homo sapiens
agtgtaacagctg

SEQ ID NO: 6653000 - DNA, 15 bp, Homo sapiens
agtgtaacagctgag

SEQ ID NO: 6653001 - DNA, 22 bp, Homo sapiens
agtgtaacatatgcaaacataa

SEQ ID NO: 6653002 - DNA, 17 bp, Homo sapiens
agtgtaacccaagcatt

SEQ ID NO: 6653003 - DNA, 16 bp, Homo sapiens
agtgtaactggctgct

SEQ ID NO: 6653004 - DNA, 22 bp, Homo sapiens
agtgtaactggctgctccctgc

SEQ ID NO: 6653005 - DNA, 23 bp, Homo sapiens
agtgtaactggctgctccctgct

SEQ ID NO: 6653006 - DNA, 20 bp, Homo sapiens
agtgtaacttgcttaaattt

SEQ ID NO: 6653007 - DNA, 12 bp, Homo sapiens
agtgtaagaact

SEQ ID NO: 6653008 - DNA, 23 bp, Homo sapiens
agtgtaagaactgtacattgtga

SEQ ID NO: 6653009 - DNA, 15 bp, Homo sapiens
agtgtaagtgaatta

SEQ ID NO: 6653010 - DNA, 15 bp, Homo sapiens
agtgtaataaatcaa

SEQ ID NO: 6653011 - DNA, 15 bp, Homo sapiens
agtgtaataatatga

SEQ ID NO: 6653012 - DNA, 19 bp, Homo sapiens
agtgtaatgtagcgtgttt

SEQ ID NO: 6653013 - DNA, 14 bp, Homo sapiens
agtgtaatgtgact

SEQ ID NO: 6653014 - DNA, 17 bp, Homo sapiens
agtgtaatgtgacttca

SEQ ID NO: 6653015 - DNA, 19 bp, Homo sapiens
agtgtaattacctgtcatc

SEQ ID NO: 6653016 - DNA, 19 bp, Homo sapiens
agtgtacaattttcatccc

SEQ ID NO: 6653017 - DNA, 21 bp, Homo sapiens
agtgtacacgtctggaccccg

SEQ ID NO: 6653018 - DNA, 14 bp, Homo sapiens
agtgtacagaagaa

SEQ ID NO: 6653019 - DNA, 18 bp, Homo sapiens
agtgtacagccagaccag

SEQ ID NO: 6653020 - DNA, 14 bp, Homo sapiens
agtgtacatatgta

SEQ ID NO: 6653021 - DNA, 19 bp, Homo sapiens
agtgtacatatgtaaaata

SEQ ID NO: 6653022 - DNA, 21 bp, Homo sapiens
agtgtacatatgtaaaatatt

SEQ ID NO: 6653023 - DNA, 13 bp, Homo sapiens
agtgtacatcatg

SEQ ID NO: 6653024 - DNA, 14 bp, Homo sapiens
agtgtacatcatgt

SEQ ID NO: 6653025 - DNA, 12 bp, Homo sapiens
agtgtacatgaa

SEQ ID NO: 6653026 - DNA, 15 bp, Homo sapiens
agtgtacatgaagaa

SEQ ID NO: 6653027 - DNA, 12 bp, Homo sapiens
agtgtacatgta

SEQ ID NO: 6653028 - DNA, 22 bp, Homo sapiens
agtgtacatttatgttccttta

SEQ ID NO: 6653029 - DNA, 20 bp, Homo sapiens
agtgtacatttctataaata

SEQ ID NO: 6653030 - DNA, 12 bp, Homo sapiens
agtgtacatttg

SEQ ID NO: 6653031 - DNA, 21 bp, Homo sapiens
agtgtacatttgatttgatat

SEQ ID NO: 6653032 - DNA, 12 bp, Homo sapiens
agtgtaccatta

SEQ ID NO: 6653033 - DNA, 16 bp, Homo sapiens
agtgtaccatttgcct

SEQ ID NO: 6653034 - DNA, 22 bp, Homo sapiens
agtgtacccccgcccaggctgg

SEQ ID NO: 6653035 - DNA, 23 bp, Homo sapiens
agtgtacccccgcccaggctggc

SEQ ID NO: 6653036 - DNA, 17 bp, Homo sapiens
agtgtacctcctctcag

SEQ ID NO: 6653037 - DNA, 16 bp, Homo sapiens
agtgtactctgagtcc

SEQ ID NO: 6653038 - DNA, 13 bp, Homo sapiens
agtgtactgtgcc

SEQ ID NO: 6653039 - DNA, 16 bp, Homo sapiens
agtgtactgtgcctgg

SEQ ID NO: 6653040 - DNA, 17 bp, Homo sapiens
agtgtacttaactattc

SEQ ID NO: 6653041 - DNA, 18 bp, Homo sapiens
agtgtactttgttaaaaa

SEQ ID NO: 6653042 - DNA, 22 bp, Homo sapiens
agtgtactttgttaaaaacact

SEQ ID NO: 6653043 - DNA, 20 bp, Homo sapiens
agtgtagaacctaattcaat

SEQ ID NO: 6653044 - DNA, 12 bp, Homo sapiens
agtgtagaagca

SEQ ID NO: 6653045 - DNA, 13 bp, Homo sapiens
agtgtagaagcat

SEQ ID NO: 6653046 - DNA, 14 bp, Homo sapiens
agtgtagaagcatt

SEQ ID NO: 6653047 - DNA, 16 bp, Homo sapiens
agtgtagaagcattcc

SEQ ID NO: 6653048 - DNA, 17 bp, Homo sapiens
agtgtagaagcattcct

SEQ ID NO: 6653049 - DNA, 18 bp, Homo sapiens
agtgtagaagcattcctt

SEQ ID NO: 6653050 - DNA, 18 bp, Homo sapiens
agtgtagacacaggtcac

SEQ ID NO: 6653051 - DNA, 20 bp, Homo sapiens
agtgtagattccatttactg

SEQ ID NO: 6653052 - DNA, 15 bp, Homo sapiens
agtgtagattttata

SEQ ID NO: 6653053 - DNA, 19 bp, Homo sapiens
agtgtagcatcttcctctg

SEQ ID NO: 6653054 - DNA, 16 bp, Homo sapiens
agtgtagccccaagaa

SEQ ID NO: 6653055 - DNA, 22 bp, Homo sapiens
agtgtagccccaagaaggctgg

SEQ ID NO: 6653056 - DNA, 12 bp, Homo sapiens
agtgtagcctaa

SEQ ID NO: 6653057 - DNA, 23 bp, Homo sapiens
agtgtagcctaaagggcagggcc

SEQ ID NO: 6653058 - DNA, 13 bp, Homo sapiens
agtgtagccttgc

SEQ ID NO: 6653059 - DNA, 13 bp, Homo sapiens
agtgtagctgcca

SEQ ID NO: 6653060 - DNA, 14 bp, Homo sapiens
agtgtagctgtaag

SEQ ID NO: 6653061 - DNA, 17 bp, Homo sapiens
agtgtagctgtgaaatc

SEQ ID NO: 6653062 - DNA, 23 bp, Homo sapiens
agtgtaggcagacacagggactt

SEQ ID NO: 6653063 - DNA, 18 bp, Homo sapiens
agtgtaggctttacttag

SEQ ID NO: 6653064 - DNA, 22 bp, Homo sapiens
agtgtaggctttacttagctta

SEQ ID NO: 6653065 - DNA, 22 bp, Homo sapiens
agtgtagggcaagggtgcctca

SEQ ID NO: 6653066 - DNA, 14 bp, Homo sapiens
agtgtagtcaggtg

SEQ ID NO: 6653067 - DNA, 15 bp, Homo sapiens
agtgtagtcaggtgc

SEQ ID NO: 6653068 - DNA, 17 bp, Homo sapiens
agtgtagtgcttttaaa

SEQ ID NO: 6653069 - DNA, 20 bp, Homo sapiens
agtgtagttaaggagcctaa

SEQ ID NO: 6653070 - DNA, 16 bp, Homo sapiens
agtgtagtttacagaa

SEQ ID NO: 6653071 - DNA, 19 bp, Homo sapiens
agtgtagtttacagaaaaa

SEQ ID NO: 6653072 - DNA, 23 bp, Homo sapiens
agtgtagttttccttttgtgtaa

SEQ ID NO: 6653073 - DNA, 13 bp, Homo sapiens
agtgtataaatcc

SEQ ID NO: 6653074 - DNA, 10 bp, Homo sapiens
agtgtataat

SEQ ID NO: 6653075 - DNA, 15 bp, Homo sapiens
agtgtataatataaa

SEQ ID NO: 6653076 - DNA, 17 bp, Homo sapiens
agtgtataatataaaaa

SEQ ID NO: 6653077 - DNA, 15 bp, Homo sapiens
agtgtataatgttgg

SEQ ID NO: 6653078 - DNA, 19 bp, Homo sapiens
agtgtataatgttggtgtg

SEQ ID NO: 6653079 - DNA, 16 bp, Homo sapiens
agtgtataccacctgt

SEQ ID NO: 6653080 - DNA, 17 bp, Homo sapiens
agtgtataccacctgta

SEQ ID NO: 6653081 - DNA, 20 bp, Homo sapiens
agtgtataccacctgtacat

SEQ ID NO: 6653082 - DNA, 15 bp, Homo sapiens
agtgtatatttgtat

SEQ ID NO: 6653083 - DNA, 17 bp, Homo sapiens
agtgtatatttgtatca

SEQ ID NO: 6653084 - DNA, 17 bp, Homo sapiens
agtgtatgcacgtgtgc

SEQ ID NO: 6653085 - DNA, 14 bp, Homo sapiens
agtgtatgcataca

SEQ ID NO: 6653086 - DNA, 16 bp, Homo sapiens
agtgtatgcatacaaa

SEQ ID NO: 6653087 - DNA, 21 bp, Homo sapiens
agtgtatggaaataaatgtat

SEQ ID NO: 6653088 - DNA, 20 bp, Homo sapiens
agtgtatggcgttggtttgt

SEQ ID NO: 6653089 - DNA, 17 bp, Homo sapiens
agtgtatgtagaagcat

SEQ ID NO: 6653090 - DNA, 16 bp, Homo sapiens
agtgtatgtatacaca

SEQ ID NO: 6653091 - DNA, 14 bp, Homo sapiens
agtgtatgtgtgtg

SEQ ID NO: 6653092 - DNA, 17 bp, Homo sapiens
agtgtattaaatgaaca

SEQ ID NO: 6653093 - DNA, 15 bp, Homo sapiens
agtgtattaagtgca

SEQ ID NO: 6653094 - DNA, 15 bp, Homo sapiens
agtgtattacaacaa

SEQ ID NO: 6653095 - DNA, 17 bp, Homo sapiens
agtgtattaggaagtgt

SEQ ID NO: 6653096 - DNA, 13 bp, Homo sapiens
agtgtattatttc

SEQ ID NO: 6653097 - DNA, 15 bp, Homo sapiens
agtgtattatttctg

SEQ ID NO: 6653098 - DNA, 12 bp, Homo sapiens
agtgtattcata

SEQ ID NO: 6653099 - DNA, 22 bp, Homo sapiens
agtgtattggtttctgtttgaa

SEQ ID NO: 6653100 - DNA, 12 bp, Homo sapiens
agtgtattgtaa

SEQ ID NO: 6653101 - DNA, 12 bp, Homo sapiens
agtgtatttatt

SEQ ID NO: 6653102 - DNA, 13 bp, Homo sapiens
agtgtatttcagt

SEQ ID NO: 6653103 - DNA, 15 bp, Homo sapiens
agtgtatttcagttc

SEQ ID NO: 6653104 - DNA, 20 bp, Homo sapiens
agtgtatttggaaaatgtta

SEQ ID NO: 6653105 - DNA, 23 bp, Homo sapiens
agtgtatttggaaataaagtcag

SEQ ID NO: 6653106 - DNA, 14 bp, Homo sapiens
agtgtatttgtatt

SEQ ID NO: 6653107 - DNA, 21 bp, Homo sapiens
agtgtattttctgtcactgta

SEQ ID NO: 6653108 - DNA, 16 bp, Homo sapiens
agtgtattttctgtgt

SEQ ID NO: 6653109 - DNA, 16 bp, Homo sapiens
agtgtattttgaaatt

SEQ ID NO: 6653110 - DNA, 16 bp, Homo sapiens
agtgtatttttcaata

SEQ ID NO: 6653111 - DNA, 15 bp, Homo sapiens
agtgtcaaataaaca

SEQ ID NO: 6653112 - DNA, 21 bp, Homo sapiens
agtgtcaaataaacactgtgt

SEQ ID NO: 6653113 - DNA, 21 bp, Homo sapiens
agtgtcaaatcgatggcctgg

SEQ ID NO: 6653114 - DNA, 13 bp, Homo sapiens
agtgtcaaccaga

SEQ ID NO: 6653115 - DNA, 16 bp, Homo sapiens
agtgtcaaggggccct

SEQ ID NO: 6653116 - DNA, 20 bp, Homo sapiens
agtgtcaatccaatctgtaa

SEQ ID NO: 6653117 - DNA, 19 bp, Homo sapiens
agtgtcaatgcagccccca

SEQ ID NO: 6653118 - DNA, 18 bp, Homo sapiens
agtgtcacctccttcccc

SEQ ID NO: 6653119 - DNA, 18 bp, Homo sapiens
agtgtcacctctctcaga

SEQ ID NO: 6653120 - DNA, 19 bp, Homo sapiens
agtgtcacctctctcagag

SEQ ID NO: 6653121 - DNA, 15 bp, Homo sapiens
agtgtcacctgcaca

SEQ ID NO: 6653122 - DNA, 20 bp, Homo sapiens
agtgtcacctttcttcttgt

SEQ ID NO: 6653123 - DNA, 16 bp, Homo sapiens
agtgtcaccttttctt

SEQ ID NO: 6653124 - DNA, 17 bp, Homo sapiens
agtgtcactgagctgtg

SEQ ID NO: 6653125 - DNA, 19 bp, Homo sapiens
agtgtcacttacctagatt

SEQ ID NO: 6653126 - DNA, 21 bp, Homo sapiens
agtgtcacttacctagattta

SEQ ID NO: 6653127 - DNA, 15 bp, Homo sapiens
agtgtcacttccaca

SEQ ID NO: 6653128 - DNA, 23 bp, Homo sapiens
agtgtcagaaggagctacaaaac

SEQ ID NO: 6653129 - DNA, 20 bp, Homo sapiens
agtgtcatataaactcattt

SEQ ID NO: 6653130 - DNA, 14 bp, Homo sapiens
agtgtcatcactct

SEQ ID NO: 6653131 - DNA, 12 bp, Homo sapiens
agtgtcatgttt

SEQ ID NO: 6653132 - DNA, 15 bp, Homo sapiens
agtgtcattgccgat

SEQ ID NO: 6653133 - DNA, 19 bp, Homo sapiens
agtgtcatttatgaaaaga

SEQ ID NO: 6653134 - DNA, 14 bp, Homo sapiens
agtgtcatttcttt

SEQ ID NO: 6653135 - DNA, 13 bp, Homo sapiens
agtgtcattttct

SEQ ID NO: 6653136 - DNA, 21 bp, Homo sapiens
agtgtcattttctgttataca

SEQ ID NO: 6653137 - DNA, 17 bp, Homo sapiens
agtgtccaactccaagt

SEQ ID NO: 6653138 - DNA, 21 bp, Homo sapiens
agtgtccagaccattgtcttc

SEQ ID NO: 6653139 - DNA, 19 bp, Homo sapiens
agtgtccagcttccaaagc

SEQ ID NO: 6653140 - DNA, 22 bp, Homo sapiens
agtgtccagcttccaaagccta

SEQ ID NO: 6653141 - DNA, 23 bp, Homo sapiens
agtgtccattatctgctgttcct

SEQ ID NO: 6653142 - DNA, 20 bp, Homo sapiens
agtgtccattgacatgtaca

SEQ ID NO: 6653143 - DNA, 19 bp, Homo sapiens
agtgtccattttgtgaagc

SEQ ID NO: 6653144 - DNA, 15 bp, Homo sapiens
agtgtcccagggccc

SEQ ID NO: 6653145 - DNA, 19 bp, Homo sapiens
agtgtccccaggggcacac

SEQ ID NO: 6653146 - DNA, 14 bp, Homo sapiens
agtgtcccccaggt

SEQ ID NO: 6653147 - DNA, 22 bp, Homo sapiens
agtgtcccccaggttccgaaga

SEQ ID NO: 6653148 - DNA, 15 bp, Homo sapiens
agtgtccccccttga

SEQ ID NO: 6653149 - DNA, 16 bp, Homo sapiens
agtgtccccccttgaa

SEQ ID NO: 6653150 - DNA, 17 bp, Homo sapiens
agtgtccccccttgaag

SEQ ID NO: 6653151 - DNA, 23 bp, Homo sapiens
agtgtccccccttgaagcaataa

SEQ ID NO: 6653152 - DNA, 17 bp, Homo sapiens
agtgtcccctccactgt

SEQ ID NO: 6653153 - DNA, 19 bp, Homo sapiens
agtgtcccctccactgtca

SEQ ID NO: 6653154 - DNA, 21 bp, Homo sapiens
agtgtcccctccactgtcaca

SEQ ID NO: 6653155 - DNA, 13 bp, Homo sapiens
agtgtcccctgcc

SEQ ID NO: 6653156 - DNA, 17 bp, Homo sapiens
agtgtcccctgccccag

SEQ ID NO: 6653157 - DNA, 20 bp, Homo sapiens
agtgtcccctgccccagagg

SEQ ID NO: 6653158 - DNA, 15 bp, Homo sapiens
agtgtcctaggacct

SEQ ID NO: 6653159 - DNA, 16 bp, Homo sapiens
agtgtcctatgcaata

SEQ ID NO: 6653160 - DNA, 17 bp, Homo sapiens
agtgtcctccaagtgcc

SEQ ID NO: 6653161 - DNA, 22 bp, Homo sapiens
agtgtcctcttccctctctgca

SEQ ID NO: 6653162 - DNA, 16 bp, Homo sapiens
agtgtcctgatttgtg

SEQ ID NO: 6653163 - DNA, 12 bp, Homo sapiens
agtgtcctgccc

SEQ ID NO: 6653164 - DNA, 18 bp, Homo sapiens
agtgtcctgcccatgccc

SEQ ID NO: 6653165 - DNA, 17 bp, Homo sapiens
agtgtcctgtctgctgg

SEQ ID NO: 6653166 - DNA, 22 bp, Homo sapiens
agtgtccttggcaggctgattt

SEQ ID NO: 6653167 - DNA, 20 bp, Homo sapiens
agtgtcgccgtccctctgcc

SEQ ID NO: 6653168 - DNA, 17 bp, Homo sapiens
agtgtcggatcctgtga

SEQ ID NO: 6653169 - DNA, 19 bp, Homo sapiens
agtgtctagagtcatgtga

SEQ ID NO: 6653170 - DNA, 15 bp, Homo sapiens
agtgtctaggcactg

SEQ ID NO: 6653171 - DNA, 19 bp, Homo sapiens
agtgtctaggcactgagca

SEQ ID NO: 6653172 - DNA, 21 bp, Homo sapiens
agtgtctaggcactgagcagg

SEQ ID NO: 6653173 - DNA, 17 bp, Homo sapiens
agtgtctataaaagaaa

SEQ ID NO: 6653174 - DNA, 21 bp, Homo sapiens
agtgtctatggagcagccgga

SEQ ID NO: 6653175 - DNA, 17 bp, Homo sapiens
agtgtctattccctgga

SEQ ID NO: 6653176 - DNA, 15 bp, Homo sapiens
agtgtctcacactgg

SEQ ID NO: 6653177 - DNA, 18 bp, Homo sapiens
agtgtctcagtccacctg

SEQ ID NO: 6653178 - DNA, 18 bp, Homo sapiens
agtgtctctatttatgag

SEQ ID NO: 6653179 - DNA, 12 bp, Homo sapiens
agtgtctctgcc

SEQ ID NO: 6653180 - DNA, 13 bp, Homo sapiens
agtgtctctgcct

SEQ ID NO: 6653181 - DNA, 14 bp, Homo sapiens
agtgtctctgcctg

SEQ ID NO: 6653182 - DNA, 16 bp, Homo sapiens
agtgtctctgcctgga

SEQ ID NO: 6653183 - DNA, 17 bp, Homo sapiens
agtgtctgcgccccgcc

SEQ ID NO: 6653184 - DNA, 21 bp, Homo sapiens
agtgtctggaattgtggctat

SEQ ID NO: 6653185 - DNA, 18 bp, Homo sapiens
agtgtctggcccagccat

SEQ ID NO: 6653186 - DNA, 12 bp, Homo sapiens
agtgtctggctt

SEQ ID NO: 6653187 - DNA, 16 bp, Homo sapiens
agtgtctggctttttc

SEQ ID NO: 6653188 - DNA, 22 bp, Homo sapiens
agtgtctggctttttcctctga

SEQ ID NO: 6653189 - DNA, 19 bp, Homo sapiens
agtgtctgggtttggccca

SEQ ID NO: 6653190 - DNA, 21 bp, Homo sapiens
agtgtctgggtttggcccaag

SEQ ID NO: 6653191 - DNA, 15 bp, Homo sapiens
agtgtctgtaaggac

SEQ ID NO: 6653192 - DNA, 20 bp, Homo sapiens
agtgtctgtccatctgtctg

SEQ ID NO: 6653193 - DNA, 22 bp, Homo sapiens
agtgtctgtcccggggtcctgt

SEQ ID NO: 6653194 - DNA, 18 bp, Homo sapiens
agtgtctgtgagaggcag

SEQ ID NO: 6653195 - DNA, 13 bp, Homo sapiens
agtgtctgtgtgc

SEQ ID NO: 6653196 - DNA, 22 bp, Homo sapiens
agtgtctgtgttttgaaagaat

SEQ ID NO: 6653197 - DNA, 13 bp, Homo sapiens
agtgtctgttctt

SEQ ID NO: 6653198 - DNA, 17 bp, Homo sapiens
agtgtcttaattaaaag

SEQ ID NO: 6653199 - DNA, 19 bp, Homo sapiens
agtgtcttcacggcaggac

SEQ ID NO: 6653200 - DNA, 19 bp, Homo sapiens
agtgtcttcctagtatatt

SEQ ID NO: 6653201 - DNA, 16 bp, Homo sapiens
agtgtcttctaacttt

SEQ ID NO: 6653202 - DNA, 19 bp, Homo sapiens
agtgtcttctgttcccaag

SEQ ID NO: 6653203 - DNA, 21 bp, Homo sapiens
agtgtcttctgttcccaagga

SEQ ID NO: 6653204 - DNA, 13 bp, Homo sapiens
agtgtcttgttca

SEQ ID NO: 6653205 - DNA, 23 bp, Homo sapiens
agtgtctttccacggagccactc

SEQ ID NO: 6653206 - DNA, 16 bp, Homo sapiens
agtgtctttccactcc

SEQ ID NO: 6653207 - DNA, 15 bp, Homo sapiens
agtgtctttcggaat

SEQ ID NO: 6653208 - DNA, 19 bp, Homo sapiens
agtgtctttcggaattttt

SEQ ID NO: 6653209 - DNA, 15 bp, Homo sapiens
agtgtctttctggtg

SEQ ID NO: 6653210 - DNA, 16 bp, Homo sapiens
agtgtctttttttgta

SEQ ID NO: 6653211 - DNA, 13 bp, Homo sapiens
agtgtgaacaaaa

SEQ ID NO: 6653212 - DNA, 19 bp, Homo sapiens
agtgtgaagacccaaaaca

SEQ ID NO: 6653213 - DNA, 15 bp, Homo sapiens
agtgtgaagcctgtc

SEQ ID NO: 6653214 - DNA, 15 bp, Homo sapiens
agtgtgaagctttgc

SEQ ID NO: 6653215 - DNA, 14 bp, Homo sapiens
agtgtgaagttaga

SEQ ID NO: 6653216 - DNA, 21 bp, Homo sapiens
agtgtgaagttagaattcctt

SEQ ID NO: 6653217 - DNA, 13 bp, Homo sapiens
agtgtgaatactg

SEQ ID NO: 6653218 - DNA, 14 bp, Homo sapiens
agtgtgaatactgc

SEQ ID NO: 6653219 - DNA, 18 bp, Homo sapiens
agtgtgaatagcctggcc

SEQ ID NO: 6653220 - DNA, 14 bp, Homo sapiens
agtgtgaatataaa

SEQ ID NO: 6653221 - DNA, 17 bp, Homo sapiens
agtgtgaatattccttt

SEQ ID NO: 6653222 - DNA, 15 bp, Homo sapiens
agtgtgacagggcca

SEQ ID NO: 6653223 - DNA, 16 bp, Homo sapiens
agtgtgacagggccag

SEQ ID NO: 6653224 - DNA, 17 bp, Homo sapiens
agtgtgacagtttccaa

SEQ ID NO: 6653225 - DNA, 20 bp, Homo sapiens
agtgtgacgggggttggggt

SEQ ID NO: 6653226 - DNA, 13 bp, Homo sapiens
agtgtgactcctt

SEQ ID NO: 6653227 - DNA, 17 bp, Homo sapiens
agtgtgagatactgtgt

SEQ ID NO: 6653228 - DNA, 21 bp, Homo sapiens
agtgtgagcagtgagttacag

SEQ ID NO: 6653229 - DNA, 17 bp, Homo sapiens
agtgtgagcgccttggt

SEQ ID NO: 6653230 - DNA, 19 bp, Homo sapiens
agtgtgagctcttccctta

SEQ ID NO: 6653231 - DNA, 21 bp, Homo sapiens
agtgtgaggacctccctgtct

SEQ ID NO: 6653232 - DNA, 15 bp, Homo sapiens
agtgtgaggccaggg

SEQ ID NO: 6653233 - DNA, 18 bp, Homo sapiens
agtgtgaggccagggcag

SEQ ID NO: 6653234 - DNA, 19 bp, Homo sapiens
agtgtgagggtcctgcagc

SEQ ID NO: 6653235 - DNA, 12 bp, Homo sapiens
agtgtgagggtg

SEQ ID NO: 6653236 - DNA, 18 bp, Homo sapiens
agtgtgagtaagagctgg

SEQ ID NO: 6653237 - DNA, 15 bp, Homo sapiens
agtgtgagtggcagc

SEQ ID NO: 6653238 - DNA, 16 bp, Homo sapiens
agtgtgagtggcagcc

SEQ ID NO: 6653239 - DNA, 22 bp, Homo sapiens
agtgtgagtggcagccatgcct

SEQ ID NO: 6653240 - DNA, 16 bp, Homo sapiens
agtgtgagtggtctgt

SEQ ID NO: 6653241 - DNA, 15 bp, Homo sapiens
agtgtgagtgttaga

SEQ ID NO: 6653242 - DNA, 16 bp, Homo sapiens
agtgtgatccagttgt

SEQ ID NO: 6653243 - DNA, 15 bp, Homo sapiens
agtgtgatgcaggaa

SEQ ID NO: 6653244 - DNA, 18 bp, Homo sapiens
agtgtgatgtatgtgtaa

SEQ ID NO: 6653245 - DNA, 23 bp, Homo sapiens
agtgtgatgtttggattgatatc

SEQ ID NO: 6653246 - DNA, 23 bp, Homo sapiens
agtgtgattgggaataaatatgc

SEQ ID NO: 6653247 - DNA, 17 bp, Homo sapiens
agtgtgatttttttcac

SEQ ID NO: 6653248 - DNA, 14 bp, Homo sapiens
agtgtgcaaaatat

SEQ ID NO: 6653249 - DNA, 20 bp, Homo sapiens
agtgtgcaactggccagcca

SEQ ID NO: 6653250 - DNA, 15 bp, Homo sapiens
agtgtgcaaggcagc

SEQ ID NO: 6653251 - DNA, 19 bp, Homo sapiens
agtgtgcacccctccccat

SEQ ID NO: 6653252 - DNA, 16 bp, Homo sapiens
agtgtgcacgagtggg

SEQ ID NO: 6653253 - DNA, 19 bp, Homo sapiens
agtgtgcacgcctgcaggc

SEQ ID NO: 6653254 - DNA, 17 bp, Homo sapiens
agtgtgcactaaggggc

SEQ ID NO: 6653255 - DNA, 14 bp, Homo sapiens
agtgtgcagacagc

SEQ ID NO: 6653256 - DNA, 15 bp, Homo sapiens
agtgtgcagactgat

SEQ ID NO: 6653257 - DNA, 20 bp, Homo sapiens
agtgtgcataattttgccaa

SEQ ID NO: 6653258 - DNA, 18 bp, Homo sapiens
agtgtgcatattgtacac

SEQ ID NO: 6653259 - DNA, 18 bp, Homo sapiens
agtgtgccaaatcagttt

SEQ ID NO: 6653260 - DNA, 20 bp, Homo sapiens
agtgtgccaccctctgcagg

SEQ ID NO: 6653261 - DNA, 21 bp, Homo sapiens
agtgtgccaccctctgcaggg

SEQ ID NO: 6653262 - DNA, 17 bp, Homo sapiens
agtgtgccagtttaaaa

SEQ ID NO: 6653263 - DNA, 20 bp, Homo sapiens
agtgtgccagtttaaaaaga

SEQ ID NO: 6653264 - DNA, 22 bp, Homo sapiens
agtgtgccagtttaaaaagatg

SEQ ID NO: 6653265 - DNA, 12 bp, Homo sapiens
agtgtgcctgct

SEQ ID NO: 6653266 - DNA, 23 bp, Homo sapiens
agtgtgcctgctatccagccgca

SEQ ID NO: 6653267 - DNA, 15 bp, Homo sapiens
agtgtgccttgggcg

SEQ ID NO: 6653268 - DNA, 22 bp, Homo sapiens
agtgtgcgtggtggtccctggg

SEQ ID NO: 6653269 - DNA, 23 bp, Homo sapiens
agtgtgcgtggtggtccctgggt

SEQ ID NO: 6653270 - DNA, 16 bp, Homo sapiens
agtgtgcgtgtgtgca

SEQ ID NO: 6653271 - DNA, 14 bp, Homo sapiens
agtgtgctaaaaat

SEQ ID NO: 6653272 - DNA, 12 bp, Homo sapiens
agtgtgctgaac

SEQ ID NO: 6653273 - DNA, 14 bp, Homo sapiens
agtgtgctgacttt

SEQ ID NO: 6653274 - DNA, 13 bp, Homo sapiens
agtgtgctgaggt

SEQ ID NO: 6653275 - DNA, 19 bp, Homo sapiens
agtgtgctgctgtaagaaa

SEQ ID NO: 6653276 - DNA, 19 bp, Homo sapiens
agtgtgcttgtcatctgcc

SEQ ID NO: 6653277 - DNA, 15 bp, Homo sapiens
agtgtgctttataaa

SEQ ID NO: 6653278 - DNA, 22 bp, Homo sapiens
agtgtgctttataaaaaaaagt

SEQ ID NO: 6653279 - DNA, 16 bp, Homo sapiens
agtgtgctttgcattt

SEQ ID NO: 6653280 - DNA, 19 bp, Homo sapiens
agtgtgctttgcattttct

SEQ ID NO: 6653281 - DNA, 19 bp, Homo sapiens
agtgtggaaaaaaaaagaa

SEQ ID NO: 6653282 - DNA, 19 bp, Homo sapiens
agtgtggaaattaagaaga

SEQ ID NO: 6653283 - DNA, 17 bp, Homo sapiens
agtgtggactctggact

SEQ ID NO: 6653284 - DNA, 17 bp, Homo sapiens
agtgtggactgggaagc

SEQ ID NO: 6653285 - DNA, 22 bp, Homo sapiens
agtgtggagaaggatagcctca

SEQ ID NO: 6653286 - DNA, 12 bp, Homo sapiens
agtgtggagacc

SEQ ID NO: 6653287 - DNA, 13 bp, Homo sapiens
agtgtggagaggg

SEQ ID NO: 6653288 - DNA, 20 bp, Homo sapiens
agtgtggagtcattctcatt

SEQ ID NO: 6653289 - DNA, 17 bp, Homo sapiens
agtgtggatgttcagaa

SEQ ID NO: 6653290 - DNA, 16 bp, Homo sapiens
agtgtggcagtttggc

SEQ ID NO: 6653291 - DNA, 14 bp, Homo sapiens
agtgtggccaggct

SEQ ID NO: 6653292 - DNA, 12 bp, Homo sapiens
agtgtggcctct

SEQ ID NO: 6653293 - DNA, 16 bp, Homo sapiens
agtgtggcctcttggc

SEQ ID NO: 6653294 - DNA, 21 bp, Homo sapiens
agtgtggcctggatccatcct

SEQ ID NO: 6653295 - DNA, 23 bp, Homo sapiens
agtgtggcctggatccatcctgc

SEQ ID NO: 6653296 - DNA, 13 bp, Homo sapiens
agtgtggctccca

SEQ ID NO: 6653297 - DNA, 16 bp, Homo sapiens
agtgtggctcccacag

SEQ ID NO: 6653298 - DNA, 20 bp, Homo sapiens
agtgtggctcccacaggtct

SEQ ID NO: 6653299 - DNA, 17 bp, Homo sapiens
agtgtggctggtgtccc

SEQ ID NO: 6653300 - DNA, 17 bp, Homo sapiens
agtgtggcttaaacatt

SEQ ID NO: 6653301 - DNA, 18 bp, Homo sapiens
agtgtggcttaaacattt

SEQ ID NO: 6653302 - DNA, 19 bp, Homo sapiens
agtgtggcttaaacatttt

SEQ ID NO: 6653303 - DNA, 15 bp, Homo sapiens
agtgtgggaagggag

SEQ ID NO: 6653304 - DNA, 16 bp, Homo sapiens
agtgtgggaggctcct

SEQ ID NO: 6653305 - DNA, 13 bp, Homo sapiens
agtgtgggctgcc

SEQ ID NO: 6653306 - DNA, 14 bp, Homo sapiens
agtgtgggctgccc

SEQ ID NO: 6653307 - DNA, 18 bp, Homo sapiens
agtgtgggcttgaccagg

SEQ ID NO: 6653308 - DNA, 15 bp, Homo sapiens
agtgtggggagggca

SEQ ID NO: 6653309 - DNA, 20 bp, Homo sapiens
agtgtggggagggcaggtcc

SEQ ID NO: 6653310 - DNA, 19 bp, Homo sapiens
agtgtggggataaagacag

SEQ ID NO: 6653311 - DNA, 16 bp, Homo sapiens
agtgtggggcgggggt

SEQ ID NO: 6653312 - DNA, 15 bp, Homo sapiens
agtgtgggtctgtgt

SEQ ID NO: 6653313 - DNA, 14 bp, Homo sapiens
agtgtgggtgccag

SEQ ID NO: 6653314 - DNA, 23 bp, Homo sapiens
agtgtgggtttggttagaggaag

SEQ ID NO: 6653315 - DNA, 13 bp, Homo sapiens
agtgtggtccctc

SEQ ID NO: 6653316 - DNA, 16 bp, Homo sapiens
agtgtggtgtgtttgc

SEQ ID NO: 6653317 - DNA, 20 bp, Homo sapiens
agtgtggtgtttcctggcac

SEQ ID NO: 6653318 - DNA, 14 bp, Homo sapiens
agtgtggtttcttt

SEQ ID NO: 6653319 - DNA, 21 bp, Homo sapiens
agtgtggtttctttttgaatc

SEQ ID NO: 6653320 - DNA, 16 bp, Homo sapiens
agtgtggttttctgtt

SEQ ID NO: 6653321 - DNA, 12 bp, Homo sapiens
agtgtgtaaaat

SEQ ID NO: 6653322 - DNA, 13 bp, Homo sapiens
agtgtgtaaataa

SEQ ID NO: 6653323 - DNA, 21 bp, Homo sapiens
agtgtgtaaatgcttaaattt

SEQ ID NO: 6653324 - DNA, 21 bp, Homo sapiens
agtgtgtaatgactgagattt

SEQ ID NO: 6653325 - DNA, 22 bp, Homo sapiens
agtgtgtataaaacattaattg

SEQ ID NO: 6653326 - DNA, 15 bp, Homo sapiens
agtgtgtataaatcc

SEQ ID NO: 6653327 - DNA, 16 bp, Homo sapiens
agtgtgtatgccaaga

SEQ ID NO: 6653328 - DNA, 18 bp, Homo sapiens
agtgtgtatgtcagtggt

SEQ ID NO: 6653329 - DNA, 14 bp, Homo sapiens
agtgtgtattaaaa

SEQ ID NO: 6653330 - DNA, 19 bp, Homo sapiens
agtgtgtattaaaaaaaac

SEQ ID NO: 6653331 - DNA, 22 bp, Homo sapiens
agtgtgtattaaaaaaaacaaa

SEQ ID NO: 6653332 - DNA, 23 bp, Homo sapiens
agtgtgtattaaaaaaaacaaaa

SEQ ID NO: 6653333 - DNA, 17 bp, Homo sapiens
agtgtgtcagagcccag

SEQ ID NO: 6653334 - DNA, 19 bp, Homo sapiens
agtgtgtcagtttttcctc

SEQ ID NO: 6653335 - DNA, 19 bp, Homo sapiens
agtgtgtcctgtgtaaatt

SEQ ID NO: 6653336 - DNA, 20 bp, Homo sapiens
agtgtgtcctgtgtaaatta

SEQ ID NO: 6653337 - DNA, 19 bp, Homo sapiens
agtgtgtccttggggcaca

SEQ ID NO: 6653338 - DNA, 13 bp, Homo sapiens
agtgtgtctcctg

SEQ ID NO: 6653339 - DNA, 19 bp, Homo sapiens
agtgtgtctcctgcatgca

SEQ ID NO: 6653340 - DNA, 15 bp, Homo sapiens
agtgtgtctgctgag

SEQ ID NO: 6653341 - DNA, 20 bp, Homo sapiens
agtgtgtcttcctagaattc

SEQ ID NO: 6653342 - DNA, 14 bp, Homo sapiens
agtgtgtgaagccg

SEQ ID NO: 6653343 - DNA, 14 bp, Homo sapiens
agtgtgtgacattc

SEQ ID NO: 6653344 - DNA, 17 bp, Homo sapiens
agtgtgtgcaagtatgt

SEQ ID NO: 6653345 - DNA, 12 bp, Homo sapiens
agtgtgtgcagc

SEQ ID NO: 6653346 - DNA, 14 bp, Homo sapiens
agtgtgtgcatgtg

SEQ ID NO: 6653347 - DNA, 17 bp, Homo sapiens
agtgtgtgcatgtgtgt

SEQ ID NO: 6653348 - DNA, 15 bp, Homo sapiens
agtgtgtgggcaggg

SEQ ID NO: 6653349 - DNA, 21 bp, Homo sapiens
agtgtgtggtcaacatttctc

SEQ ID NO: 6653350 - DNA, 22 bp, Homo sapiens
agtgtgtggtcaacatttctca

SEQ ID NO: 6653351 - DNA, 16 bp, Homo sapiens
agtgtgtgtaagattt

SEQ ID NO: 6653352 - DNA, 11 bp, Homo sapiens
agtgtgtgtct

SEQ ID NO: 6653353 - DNA, 12 bp, Homo sapiens
agtgtgtgtctt

SEQ ID NO: 6653354 - DNA, 23 bp, Homo sapiens
agtgtgtgtgatgggatctgtaa

SEQ ID NO: 6653355 - DNA, 11 bp, Homo sapiens
agtgtgtgtgc

SEQ ID NO: 6653356 - DNA, 12 bp, Homo sapiens
agtgtgtgtgca

SEQ ID NO: 6653357 - DNA, 13 bp, Homo sapiens
agtgtgtgtgcaa

SEQ ID NO: 6653358 - DNA, 20 bp, Homo sapiens
agtgtgtgtgcagagtccat

SEQ ID NO: 6653359 - DNA, 17 bp, Homo sapiens
agtgtgtgtgcatgtgt

SEQ ID NO: 6653360 - DNA, 19 bp, Homo sapiens
agtgtgtgtgcatgtgtgt

SEQ ID NO: 6653361 - DNA, 20 bp, Homo sapiens
agtgtgtgtgcatgtgtgtg

SEQ ID NO: 6653362 - DNA, 14 bp, Homo sapiens
agtgtgtgtgtgca

SEQ ID NO: 6653363 - DNA, 16 bp, Homo sapiens
agtgtgtgtgtgcatg

SEQ ID NO: 6653364 - DNA, 23 bp, Homo sapiens
agtgtgtgtgtgtggtccatgcc

SEQ ID NO: 6653365 - DNA, 16 bp, Homo sapiens
agtgtgtgtgtgtgtc

SEQ ID NO: 6653366 - DNA, 17 bp, Homo sapiens
agtgtgtgtgttctgta

SEQ ID NO: 6653367 - DNA, 13 bp, Homo sapiens
agtgtgttctgat

SEQ ID NO: 6653368 - DNA, 20 bp, Homo sapiens
agtgtgttctgattagaaat

SEQ ID NO: 6653369 - DNA, 21 bp, Homo sapiens
agtgtgttctgattagaaatg

SEQ ID NO: 6653370 - DNA, 21 bp, Homo sapiens
agtgtgttgggaattgcatgc

SEQ ID NO: 6653371 - DNA, 20 bp, Homo sapiens
agtgtgttgtctgtgcagct

SEQ ID NO: 6653372 - DNA, 15 bp, Homo sapiens
agtgtgtttaaataa

SEQ ID NO: 6653373 - DNA, 19 bp, Homo sapiens
agtgtgtttccttcagtgc

SEQ ID NO: 6653374 - DNA, 12 bp, Homo sapiens
agtgtgtttgcc

SEQ ID NO: 6653375 - DNA, 14 bp, Homo sapiens
agtgtgtttgtgag

SEQ ID NO: 6653376 - DNA, 15 bp, Homo sapiens
agtgtgtttgtgagt

SEQ ID NO: 6653377 - DNA, 12 bp, Homo sapiens
agtgtgttttca

SEQ ID NO: 6653378 - DNA, 15 bp, Homo sapiens
agtgtgttttggtat

SEQ ID NO: 6653379 - DNA, 21 bp, Homo sapiens
agtgttaaggcaacattcctt

SEQ ID NO: 6653380 - DNA, 14 bp, Homo sapiens
agtgttaatacatc

SEQ ID NO: 6653381 - DNA, 15 bp, Homo sapiens
agtgttaatacatca

SEQ ID NO: 6653382 - DNA, 15 bp, Homo sapiens
agtgttaatactagt

SEQ ID NO: 6653383 - DNA, 16 bp, Homo sapiens
agtgttaatactagtt

SEQ ID NO: 6653384 - DNA, 20 bp, Homo sapiens
agtgttaatactagttgtga

SEQ ID NO: 6653385 - DNA, 15 bp, Homo sapiens
agtgttaatcaattt

SEQ ID NO: 6653386 - DNA, 16 bp, Homo sapiens
agtgttaatccagaga

SEQ ID NO: 6653387 - DNA, 20 bp, Homo sapiens
agtgttacgttttattggtt

SEQ ID NO: 6653388 - DNA, 21 bp, Homo sapiens
agtgttactgcctataatctt

SEQ ID NO: 6653389 - DNA, 13 bp, Homo sapiens
agtgttagagaaa

SEQ ID NO: 6653390 - DNA, 15 bp, Homo sapiens
agtgttagaggatcc

SEQ ID NO: 6653391 - DNA, 21 bp, Homo sapiens
agtgttagccttttttcccca

SEQ ID NO: 6653392 - DNA, 15 bp, Homo sapiens
agtgttaggcctggc

SEQ ID NO: 6653393 - DNA, 16 bp, Homo sapiens
agtgttaggcctggca

SEQ ID NO: 6653394 - DNA, 15 bp, Homo sapiens
agtgttagggaaggg

SEQ ID NO: 6653395 - DNA, 13 bp, Homo sapiens
agtgttagtgctg

SEQ ID NO: 6653396 - DNA, 23 bp, Homo sapiens
agtgttagtgctggtcagagaga

SEQ ID NO: 6653397 - DNA, 17 bp, Homo sapiens
agtgttagtgggaagag

SEQ ID NO: 6653398 - DNA, 19 bp, Homo sapiens
agtgttagtgggaagagct

SEQ ID NO: 6653399 - DNA, 20 bp, Homo sapiens
agtgttagtgggaagagctg

SEQ ID NO: 6653400 - DNA, 20 bp, Homo sapiens
agtgttagttataaatagcc

SEQ ID NO: 6653401 - DNA, 22 bp, Homo sapiens
agtgttagttataaatagcctt

SEQ ID NO: 6653402 - DNA, 13 bp, Homo sapiens
agtgttatatgaa

SEQ ID NO: 6653403 - DNA, 16 bp, Homo sapiens
agtgttatcagtcata

SEQ ID NO: 6653404 - DNA, 23 bp, Homo sapiens
agtgttatcagtcataactaaat

SEQ ID NO: 6653405 - DNA, 19 bp, Homo sapiens
agtgttatgtagtattgtt

SEQ ID NO: 6653406 - DNA, 14 bp, Homo sapiens
agtgttatgtattt

SEQ ID NO: 6653407 - DNA, 17 bp, Homo sapiens
agtgttattatttggca

SEQ ID NO: 6653408 - DNA, 23 bp, Homo sapiens
agtgttatttattccccagtgac

SEQ ID NO: 6653409 - DNA, 21 bp, Homo sapiens
agtgttatttttcaaggaagg

SEQ ID NO: 6653410 - DNA, 16 bp, Homo sapiens
agtgttcaaattctga

SEQ ID NO: 6653411 - DNA, 16 bp, Homo sapiens
agtgttcacaaactgt

SEQ ID NO: 6653412 - DNA, 15 bp, Homo sapiens
agtgttcagaaaaaa

SEQ ID NO: 6653413 - DNA, 12 bp, Homo sapiens
agtgttcagtgt

SEQ ID NO: 6653414 - DNA, 15 bp, Homo sapiens
agtgttcagtgttga

SEQ ID NO: 6653415 - DNA, 20 bp, Homo sapiens
agtgttcagtgttgacatag

SEQ ID NO: 6653416 - DNA, 12 bp, Homo sapiens
agtgttcattgc

SEQ ID NO: 6653417 - DNA, 17 bp, Homo sapiens
agtgttcatttgaaaga

SEQ ID NO: 6653418 - DNA, 18 bp, Homo sapiens
agtgttcattttagtgac

SEQ ID NO: 6653419 - DNA, 22 bp, Homo sapiens
agtgttcattttagtgactgta

SEQ ID NO: 6653420 - DNA, 18 bp, Homo sapiens
agtgttccagctgcctgg

SEQ ID NO: 6653421 - DNA, 19 bp, Homo sapiens
agtgttccagctgcctggg

SEQ ID NO: 6653422 - DNA, 15 bp, Homo sapiens
agtgttcccaaattg

SEQ ID NO: 6653423 - DNA, 16 bp, Homo sapiens
agtgttcccgtgcctg

SEQ ID NO: 6653424 - DNA, 14 bp, Homo sapiens
agtgttccctatcc

SEQ ID NO: 6653425 - DNA, 20 bp, Homo sapiens
agtgttcctatttggggctt

SEQ ID NO: 6653426 - DNA, 17 bp, Homo sapiens
agtgttcctcaccaata

SEQ ID NO: 6653427 - DNA, 21 bp, Homo sapiens
agtgttcctcaccaataactt

SEQ ID NO: 6653428 - DNA, 18 bp, Homo sapiens
agtgttcctgaagctgct

SEQ ID NO: 6653429 - DNA, 20 bp, Homo sapiens
agtgttcctgaagctgctgt

SEQ ID NO: 6653430 - DNA, 13 bp, Homo sapiens
agtgttcctgaga

SEQ ID NO: 6653431 - DNA, 15 bp, Homo sapiens
agtgttcctgcacca

SEQ ID NO: 6653432 - DNA, 22 bp, Homo sapiens
agtgttcctgtctcaatagctc

SEQ ID NO: 6653433 - DNA, 13 bp, Homo sapiens
agtgttctcacag

SEQ ID NO: 6653434 - DNA, 14 bp, Homo sapiens
agtgttctcatgaa

SEQ ID NO: 6653435 - DNA, 22 bp, Homo sapiens
agtgttctctagaatccagcag

SEQ ID NO: 6653436 - DNA, 13 bp, Homo sapiens
agtgttctgagcc

SEQ ID NO: 6653437 - DNA, 15 bp, Homo sapiens
agtgttctgagcccc

SEQ ID NO: 6653438 - DNA, 17 bp, Homo sapiens
agtgttctgagctgtat

SEQ ID NO: 6653439 - DNA, 15 bp, Homo sapiens
agtgttctgctcctg

SEQ ID NO: 6653440 - DNA, 18 bp, Homo sapiens
agtgttctgctcctgctt

SEQ ID NO: 6653441 - DNA, 23 bp, Homo sapiens
agtgttctgctcctgcttttctg

SEQ ID NO: 6653442 - DNA, 17 bp, Homo sapiens
agtgttctgtattttaa

SEQ ID NO: 6653443 - DNA, 14 bp, Homo sapiens
agtgttctgtgaat

SEQ ID NO: 6653444 - DNA, 19 bp, Homo sapiens
agtgttctgtgaatagcag

SEQ ID NO: 6653445 - DNA, 13 bp, Homo sapiens
agtgttctgtggc

SEQ ID NO: 6653446 - DNA, 14 bp, Homo sapiens
agtgttctgtggct

SEQ ID NO: 6653447 - DNA, 16 bp, Homo sapiens
agtgttctgttacaaa

SEQ ID NO: 6653448 - DNA, 21 bp, Homo sapiens
agtgttctgttacaaaatgta

SEQ ID NO: 6653449 - DNA, 22 bp, Homo sapiens
agtgttctgttacaaaatgtaa

SEQ ID NO: 6653450 - DNA, 15 bp, Homo sapiens
agtgttctgttcact

SEQ ID NO: 6653451 - DNA, 15 bp, Homo sapiens
agtgttctgtttaat

SEQ ID NO: 6653452 - DNA, 19 bp, Homo sapiens
agtgttctgtttgaaacta

SEQ ID NO: 6653453 - DNA, 14 bp, Homo sapiens
agtgttcttaggtt

SEQ ID NO: 6653454 - DNA, 15 bp, Homo sapiens
agtgttcttaggttt

SEQ ID NO: 6653455 - DNA, 15 bp, Homo sapiens
agtgttcttctcaag

SEQ ID NO: 6653456 - DNA, 17 bp, Homo sapiens
agtgttcttttctggtg

SEQ ID NO: 6653457 - DNA, 16 bp, Homo sapiens
agtgttgaaaatgttc

SEQ ID NO: 6653458 - DNA, 21 bp, Homo sapiens
agtgttgaaacggatgatttc

SEQ ID NO: 6653459 - DNA, 15 bp, Homo sapiens
agtgttgaaattgga

SEQ ID NO: 6653460 - DNA, 21 bp, Homo sapiens
agtgttgaattttattgaaag

SEQ ID NO: 6653461 - DNA, 20 bp, Homo sapiens
agtgttgacatagcctttgt

SEQ ID NO: 6653462 - DNA, 23 bp, Homo sapiens
agtgttgactttttaaaatataa

SEQ ID NO: 6653463 - DNA, 23 bp, Homo sapiens
agtgttgagccatgctacagtta

SEQ ID NO: 6653464 - DNA, 21 bp, Homo sapiens
agtgttgaggaggggagcaag

SEQ ID NO: 6653465 - DNA, 21 bp, Homo sapiens
agtgttgatcagatcttacaa

SEQ ID NO: 6653466 - DNA, 20 bp, Homo sapiens
agtgttgattgccaaattga

SEQ ID NO: 6653467 - DNA, 16 bp, Homo sapiens
agtgttgcctaagtat

SEQ ID NO: 6653468 - DNA, 23 bp, Homo sapiens
agtgttgcctaagtattaaaaca

SEQ ID NO: 6653469 - DNA, 13 bp, Homo sapiens
agtgttgctatgt

SEQ ID NO: 6653470 - DNA, 14 bp, Homo sapiens
agtgttgctcttgg

SEQ ID NO: 6653471 - DNA, 18 bp, Homo sapiens
agtgttgctcttggaaag

SEQ ID NO: 6653472 - DNA, 14 bp, Homo sapiens
agtgttgctgtggc

SEQ ID NO: 6653473 - DNA, 14 bp, Homo sapiens
agtgttggagaaga

SEQ ID NO: 6653474 - DNA, 21 bp, Homo sapiens
agtgttggcaaacgagacttt

SEQ ID NO: 6653475 - DNA, 19 bp, Homo sapiens
agtgttggccatcatttca

SEQ ID NO: 6653476 - DNA, 22 bp, Homo sapiens
agtgttggccatcatttcattc

SEQ ID NO: 6653477 - DNA, 16 bp, Homo sapiens
agtgttggctgtgtga

SEQ ID NO: 6653478 - DNA, 17 bp, Homo sapiens
agtgttggctgtgtgac

SEQ ID NO: 6653479 - DNA, 20 bp, Homo sapiens
agtgttgggattacaggcgt

SEQ ID NO: 6653480 - DNA, 13 bp, Homo sapiens
agtgttggggctg

SEQ ID NO: 6653481 - DNA, 22 bp, Homo sapiens
agtgttggggtttggttttgtt

SEQ ID NO: 6653482 - DNA, 17 bp, Homo sapiens
agtgttgggtgtaccac

SEQ ID NO: 6653483 - DNA, 17 bp, Homo sapiens
agtgttggtctttctaa

SEQ ID NO: 6653484 - DNA, 23 bp, Homo sapiens
agtgttggtttaatattacctaa

SEQ ID NO: 6653485 - DNA, 21 bp, Homo sapiens
agtgttgtacaattactgtga

SEQ ID NO: 6653486 - DNA, 14 bp, Homo sapiens
agtgttgtatttct

SEQ ID NO: 6653487 - DNA, 22 bp, Homo sapiens
agtgttgtgccccttcactcat

SEQ ID NO: 6653488 - DNA, 18 bp, Homo sapiens
agtgttgtgggcttcctg

SEQ ID NO: 6653489 - DNA, 20 bp, Homo sapiens
agtgttgtgttaaaaggaaa

SEQ ID NO: 6653490 - DNA, 17 bp, Homo sapiens
agtgttgtgttcctggc

SEQ ID NO: 6653491 - DNA, 15 bp, Homo sapiens
agtgttgttccctcc

SEQ ID NO: 6653492 - DNA, 15 bp, Homo sapiens
agtgttgtttgtaaa

SEQ ID NO: 6653493 - DNA, 19 bp, Homo sapiens
agtgttgtttgtaaataag

SEQ ID NO: 6653494 - DNA, 16 bp, Homo sapiens
agtgtttaaaaaatga

SEQ ID NO: 6653495 - DNA, 12 bp, Homo sapiens
agtgtttaaaag

SEQ ID NO: 6653496 - DNA, 16 bp, Homo sapiens
agtgtttaaaagcaaa

SEQ ID NO: 6653497 - DNA, 13 bp, Homo sapiens
agtgtttaaatgc

SEQ ID NO: 6653498 - DNA, 14 bp, Homo sapiens
agtgtttaactggc

SEQ ID NO: 6653499 - DNA, 17 bp, Homo sapiens
agtgtttaactggcatg

SEQ ID NO: 6653500 - DNA, 21 bp, Homo sapiens
agtgtttacttcctgcagtga

SEQ ID NO: 6653501 - DNA, 15 bp, Homo sapiens
agtgtttactttaaa

SEQ ID NO: 6653502 - DNA, 19 bp, Homo sapiens
agtgtttagaagagcctga

SEQ ID NO: 6653503 - DNA, 15 bp, Homo sapiens
agtgtttagcattaa

SEQ ID NO: 6653504 - DNA, 18 bp, Homo sapiens
agtgtttatagatcactg

SEQ ID NO: 6653505 - DNA, 16 bp, Homo sapiens
agtgtttatcctttca

SEQ ID NO: 6653506 - DNA, 13 bp, Homo sapiens
agtgtttatgtgc

SEQ ID NO: 6653507 - DNA, 18 bp, Homo sapiens
agtgtttatgttgtttat

SEQ ID NO: 6653508 - DNA, 20 bp, Homo sapiens
agtgtttatgtttaaaagaa

SEQ ID NO: 6653509 - DNA, 22 bp, Homo sapiens
agtgtttattaaaatactgttt

SEQ ID NO: 6653510 - DNA, 21 bp, Homo sapiens
agtgtttatttttcatattgt

SEQ ID NO: 6653511 - DNA, 17 bp, Homo sapiens
agtgtttcaaaaaatta

SEQ ID NO: 6653512 - DNA, 19 bp, Homo sapiens
agtgtttcaattctgtaat

SEQ ID NO: 6653513 - DNA, 20 bp, Homo sapiens
agtgtttcagctaagggaag

SEQ ID NO: 6653514 - DNA, 21 bp, Homo sapiens
agtgtttcagctaagggaaga

SEQ ID NO: 6653515 - DNA, 12 bp, Homo sapiens
agtgtttccagt

SEQ ID NO: 6653516 - DNA, 14 bp, Homo sapiens
agtgtttcctgagt

SEQ ID NO: 6653517 - DNA, 19 bp, Homo sapiens
agtgtttcgtaagacaaaa

SEQ ID NO: 6653518 - DNA, 13 bp, Homo sapiens
agtgtttcgtcat

SEQ ID NO: 6653519 - DNA, 17 bp, Homo sapiens
agtgtttctaataaact

SEQ ID NO: 6653520 - DNA, 14 bp, Homo sapiens
agtgtttctagcta

SEQ ID NO: 6653521 - DNA, 17 bp, Homo sapiens
agtgtttctagtaacag

SEQ ID NO: 6653522 - DNA, 20 bp, Homo sapiens
agtgtttctatgagtggaaa

SEQ ID NO: 6653523 - DNA, 16 bp, Homo sapiens
agtgtttctgaatgtt

SEQ ID NO: 6653524 - DNA, 14 bp, Homo sapiens
agtgtttctgtgca

SEQ ID NO: 6653525 - DNA, 11 bp, Homo sapiens
agtgtttcttt

SEQ ID NO: 6653526 - DNA, 14 bp, Homo sapiens
agtgtttgaaaact

SEQ ID NO: 6653527 - DNA, 18 bp, Homo sapiens
agtgtttgaaaactgaca

SEQ ID NO: 6653528 - DNA, 22 bp, Homo sapiens
agtgtttggaattttctgttca

SEQ ID NO: 6653529 - DNA, 12 bp, Homo sapiens
agtgtttggggg

SEQ ID NO: 6653530 - DNA, 22 bp, Homo sapiens
agtgtttgggggacgtttctca

SEQ ID NO: 6653531 - DNA, 12 bp, Homo sapiens
agtgtttgtgag

SEQ ID NO: 6653532 - DNA, 13 bp, Homo sapiens
agtgtttgtgagc

SEQ ID NO: 6653533 - DNA, 18 bp, Homo sapiens
agtgtttgtgagcttttt

SEQ ID NO: 6653534 - DNA, 17 bp, Homo sapiens
agtgtttgtgtctgact

SEQ ID NO: 6653535 - DNA, 21 bp, Homo sapiens
agtgtttgtgtctgactcagg

SEQ ID NO: 6653536 - DNA, 14 bp, Homo sapiens
agtgttttaaattc

SEQ ID NO: 6653537 - DNA, 12 bp, Homo sapiens
agtgttttacaa

SEQ ID NO: 6653538 - DNA, 13 bp, Homo sapiens
agtgttttacaat

SEQ ID NO: 6653539 - DNA, 16 bp, Homo sapiens
agtgttttacaatgat

SEQ ID NO: 6653540 - DNA, 14 bp, Homo sapiens
agtgttttactctt

SEQ ID NO: 6653541 - DNA, 21 bp, Homo sapiens
agtgttttactctttttctaa

SEQ ID NO: 6653542 - DNA, 16 bp, Homo sapiens
agtgttttatgcatgt

SEQ ID NO: 6653543 - DNA, 13 bp, Homo sapiens
agtgttttcagag

SEQ ID NO: 6653544 - DNA, 14 bp, Homo sapiens
agtgttttcattct

SEQ ID NO: 6653545 - DNA, 14 bp, Homo sapiens
agtgttttcttgtg

SEQ ID NO: 6653546 - DNA, 22 bp, Homo sapiens
agtgttttcttgtgttgttttc

SEQ ID NO: 6653547 - DNA, 13 bp, Homo sapiens
agtgttttgcaag

SEQ ID NO: 6653548 - DNA, 21 bp, Homo sapiens
agtgttttggactccatctct

SEQ ID NO: 6653549 - DNA, 14 bp, Homo sapiens
agtgttttgtacca

SEQ ID NO: 6653550 - DNA, 15 bp, Homo sapiens
agtgtttttacatat

SEQ ID NO: 6653551 - DNA, 16 bp, Homo sapiens
agtgtttttacatata

SEQ ID NO: 6653552 - DNA, 16 bp, Homo sapiens
agtgtttttacctctg

SEQ ID NO: 6653553 - DNA, 14 bp, Homo sapiens
agtgtttttcttta

SEQ ID NO: 6653554 - DNA, 15 bp, Homo sapiens
agtgtttttctttaa

SEQ ID NO: 6653555 - DNA, 21 bp, Homo sapiens
agtgtttttctttaatcaaaa

SEQ ID NO: 6653556 - DNA, 15 bp, Homo sapiens
agtgtttttgtaaag

SEQ ID NO: 6653557 - DNA, 17 bp, Homo sapiens
agtgttttttaggaaaa

SEQ ID NO: 6653558 - DNA, 19 bp, Homo sapiens
agtgtttttttatttctac

SEQ ID NO: 6653559 - DNA, 14 bp, Homo sapiens
agttaaaaaaaata

SEQ ID NO: 6653560 - DNA, 20 bp, Homo sapiens
agttaaaaaaaataataaat

SEQ ID NO: 6653561 - DNA, 23 bp, Homo sapiens
agttaaaaataggctttttagga

SEQ ID NO: 6653562 - DNA, 20 bp, Homo sapiens
agttaaaaattaaatattta

SEQ ID NO: 6653563 - DNA, 15 bp, Homo sapiens
agttaaaacagctat

SEQ ID NO: 6653564 - DNA, 16 bp, Homo sapiens
agttaaaagcatttta

SEQ ID NO: 6653565 - DNA, 17 bp, Homo sapiens
agttaaaagtaaaagag

SEQ ID NO: 6653566 - DNA, 14 bp, Homo sapiens
agttaaaatatata

SEQ ID NO: 6653567 - DNA, 20 bp, Homo sapiens
agttaaaatcacattttaag

SEQ ID NO: 6653568 - DNA, 13 bp, Homo sapiens
agttaaaatgttt

SEQ ID NO: 6653569 - DNA, 23 bp, Homo sapiens
agttaaaatgtttactgtaaatt

SEQ ID NO: 6653570 - DNA, 22 bp, Homo sapiens
agttaaaattgttatcaaaata

SEQ ID NO: 6653571 - DNA, 23 bp, Homo sapiens
agttaaactggcttaacttagta

SEQ ID NO: 6653572 - DNA, 16 bp, Homo sapiens
agttaaactgtgaagc

SEQ ID NO: 6653573 - DNA, 13 bp, Homo sapiens
agttaaagaaagg

SEQ ID NO: 6653574 - DNA, 14 bp, Homo sapiens
agttaaagaaagga

SEQ ID NO: 6653575 - DNA, 18 bp, Homo sapiens
agttaaagaaaggaaaag

SEQ ID NO: 6653576 - DNA, 21 bp, Homo sapiens
agttaaagaagacatttgcca

SEQ ID NO: 6653577 - DNA, 18 bp, Homo sapiens
agttaaagagacaaatag

SEQ ID NO: 6653578 - DNA, 22 bp, Homo sapiens
agttaaagaggagaaggaaaac

SEQ ID NO: 6653579 - DNA, 11 bp, Homo sapiens
agttaaagcca

SEQ ID NO: 6653580 - DNA, 13 bp, Homo sapiens
agttaaagggaag

SEQ ID NO: 6653581 - DNA, 18 bp, Homo sapiens
agttaaaggttactgttt

SEQ ID NO: 6653582 - DNA, 18 bp, Homo sapiens
agttaaaggttgccagca

SEQ ID NO: 6653583 - DNA, 22 bp, Homo sapiens
agttaaataaatagaaagagtt

SEQ ID NO: 6653584 - DNA, 20 bp, Homo sapiens
agttaaatatgatttgcatt

SEQ ID NO: 6653585 - DNA, 12 bp, Homo sapiens
agttaaatctca

SEQ ID NO: 6653586 - DNA, 12 bp, Homo sapiens
agttaaatcttc

SEQ ID NO: 6653587 - DNA, 12 bp, Homo sapiens
agttaaatgtag

SEQ ID NO: 6653588 - DNA, 16 bp, Homo sapiens
agttaaatgtgtgtaa

SEQ ID NO: 6653589 - DNA, 22 bp, Homo sapiens
agttaaatgtgtgtaaaaaagt

SEQ ID NO: 6653590 - DNA, 13 bp, Homo sapiens
agttaacaaggaa

SEQ ID NO: 6653591 - DNA, 14 bp, Homo sapiens
agttaacaaggaat

SEQ ID NO: 6653592 - DNA, 20 bp, Homo sapiens
agttaacaaggaatgcctgt

SEQ ID NO: 6653593 - DNA, 16 bp, Homo sapiens
agttaacaatgatata

SEQ ID NO: 6653594 - DNA, 12 bp, Homo sapiens
agttaacacact

SEQ ID NO: 6653595 - DNA, 13 bp, Homo sapiens
agttaacacacta

SEQ ID NO: 6653596 - DNA, 22 bp, Homo sapiens
agttaacacactaccgaatgtg

SEQ ID NO: 6653597 - DNA, 19 bp, Homo sapiens
agttaacagacaacacgtt

SEQ ID NO: 6653598 - DNA, 13 bp, Homo sapiens
agttaacaggaca

SEQ ID NO: 6653599 - DNA, 13 bp, Homo sapiens
agttaacaggata

SEQ ID NO: 6653600 - DNA, 18 bp, Homo sapiens
agttaacaggcaaacatt

SEQ ID NO: 6653601 - DNA, 23 bp, Homo sapiens
agttaacagtctcattacagatt

SEQ ID NO: 6653602 - DNA, 15 bp, Homo sapiens
agttaacatcatgaa

SEQ ID NO: 6653603 - DNA, 19 bp, Homo sapiens
agttaacattaacatctat

SEQ ID NO: 6653604 - DNA, 23 bp, Homo sapiens
agttaacattcagtactttatga

SEQ ID NO: 6653605 - DNA, 15 bp, Homo sapiens
agttaaccagttgca

SEQ ID NO: 6653606 - DNA, 21 bp, Homo sapiens
agttaacgggtgaataataaa

SEQ ID NO: 6653607 - DNA, 19 bp, Homo sapiens
agttaactattgcatttat

SEQ ID NO: 6653608 - DNA, 20 bp, Homo sapiens
agttaactattgcatttata

SEQ ID NO: 6653609 - DNA, 24 bp, Homo sapiens
agttaactattgcatttatatgta

SEQ ID NO: 6653610 - DNA, 16 bp, Homo sapiens
agttaactcttcaaat

SEQ ID NO: 6653611 - DNA, 14 bp, Homo sapiens
agttaactgtgaaa

SEQ ID NO: 6653612 - DNA, 16 bp, Homo sapiens
agttaactttttgtag

SEQ ID NO: 6653613 - DNA, 14 bp, Homo sapiens
agttaagaaaaaaa

SEQ ID NO: 6653614 - DNA, 18 bp, Homo sapiens
agttaagaaaaaaataat

SEQ ID NO: 6653615 - DNA, 12 bp, Homo sapiens
agttaagaagct

SEQ ID NO: 6653616 - DNA, 16 bp, Homo sapiens
agttaagaagctgttg

SEQ ID NO: 6653617 - DNA, 17 bp, Homo sapiens
agttaagaagctgttgt

SEQ ID NO: 6653618 - DNA, 12 bp, Homo sapiens
agttaagaattg

SEQ ID NO: 6653619 - DNA, 20 bp, Homo sapiens
agttaagacatgatttcctt

SEQ ID NO: 6653620 - DNA, 17 bp, Homo sapiens
agttaagacctggcagc

SEQ ID NO: 6653621 - DNA, 21 bp, Homo sapiens
agttaagagaaactttataca

SEQ ID NO: 6653622 - DNA, 23 bp, Homo sapiens
agttaagagaaactttatacatt

SEQ ID NO: 6653623 - DNA, 14 bp, Homo sapiens
agttaagagtagca

SEQ ID NO: 6653624 - DNA, 16 bp, Homo sapiens
agttaagattcttggt

SEQ ID NO: 6653625 - DNA, 20 bp, Homo sapiens
agttaagcagcctttctgtg

SEQ ID NO: 6653626 - DNA, 14 bp, Homo sapiens
agttaagcctttgg

SEQ ID NO: 6653627 - DNA, 20 bp, Homo sapiens
agttaaggcaaatcaggtaa

SEQ ID NO: 6653628 - DNA, 16 bp, Homo sapiens
agttaaggtatctggt

SEQ ID NO: 6653629 - DNA, 16 bp, Homo sapiens
agttaaggtgtgcaaa

SEQ ID NO: 6653630 - DNA, 14 bp, Homo sapiens
agttaagtcatcca

SEQ ID NO: 6653631 - DNA, 17 bp, Homo sapiens
agttaagtcgctgaaca

SEQ ID NO: 6653632 - DNA, 15 bp, Homo sapiens
agttaagtgtcattt

SEQ ID NO: 6653633 - DNA, 19 bp, Homo sapiens
agttaagtgtcatttcttt

SEQ ID NO: 6653634 - DNA, 21 bp, Homo sapiens
agttaagttggtaaagtattt

SEQ ID NO: 6653635 - DNA, 17 bp, Homo sapiens
agttaataacagctcct

SEQ ID NO: 6653636 - DNA, 18 bp, Homo sapiens
agttaataacagctcctt

SEQ ID NO: 6653637 - DNA, 17 bp, Homo sapiens
agttaataagttgatgt

SEQ ID NO: 6653638 - DNA, 19 bp, Homo sapiens
agttaataagttgatgttt

SEQ ID NO: 6653639 - DNA, 16 bp, Homo sapiens
agttaataataatgac

SEQ ID NO: 6653640 - DNA, 16 bp, Homo sapiens
agttaatataaatgtt

SEQ ID NO: 6653641 - DNA, 17 bp, Homo sapiens
agttaatataaatgttg

SEQ ID NO: 6653642 - DNA, 21 bp, Homo sapiens
agttaatatatcccagaaatt

SEQ ID NO: 6653643 - DNA, 18 bp, Homo sapiens
agttaatcatcaagagaa

SEQ ID NO: 6653644 - DNA, 21 bp, Homo sapiens
agttaatctcctcagacagta

SEQ ID NO: 6653645 - DNA, 16 bp, Homo sapiens
agttaatcttgctttc

SEQ ID NO: 6653646 - DNA, 21 bp, Homo sapiens
agttaatctttgaaaactcat

SEQ ID NO: 6653647 - DNA, 23 bp, Homo sapiens
agttaatctttgaaaactcatac

SEQ ID NO: 6653648 - DNA, 13 bp, Homo sapiens
agttaatgaaata

SEQ ID NO: 6653649 - DNA, 21 bp, Homo sapiens
agttaatgaaataaaatttga

SEQ ID NO: 6653650 - DNA, 14 bp, Homo sapiens
agttaatgagccat

SEQ ID NO: 6653651 - DNA, 17 bp, Homo sapiens
agttaatgatggcagag

SEQ ID NO: 6653652 - DNA, 15 bp, Homo sapiens
agttaatgtactctt

SEQ ID NO: 6653653 - DNA, 16 bp, Homo sapiens
agttaatgtactcttt

SEQ ID NO: 6653654 - DNA, 20 bp, Homo sapiens
agttaatgtactttcattcc

SEQ ID NO: 6653655 - DNA, 15 bp, Homo sapiens
agttaatgtatataa

SEQ ID NO: 6653656 - DNA, 16 bp, Homo sapiens
agttaatgtcaaggaa

SEQ ID NO: 6653657 - DNA, 14 bp, Homo sapiens
agttaattagcatt

SEQ ID NO: 6653658 - DNA, 14 bp, Homo sapiens
agttaattgcagtc

SEQ ID NO: 6653659 - DNA, 19 bp, Homo sapiens
agttaattgtatttatgta

SEQ ID NO: 6653660 - DNA, 22 bp, Homo sapiens
agttaattgtatttatgtatgt

SEQ ID NO: 6653661 - DNA, 14 bp, Homo sapiens
agttaatttaaagt

SEQ ID NO: 6653662 - DNA, 13 bp, Homo sapiens
agttaatttatct

SEQ ID NO: 6653663 - DNA, 15 bp, Homo sapiens
agttaatttatctaa

SEQ ID NO: 6653664 - DNA, 18 bp, Homo sapiens
agttaattttgaccaaaa

SEQ ID NO: 6653665 - DNA, 23 bp, Homo sapiens
agttaatttttccaactactaat

SEQ ID NO: 6653666 - DNA, 22 bp, Homo sapiens
agttaatttttgtataaggtga

SEQ ID NO: 6653667 - DNA, 20 bp, Homo sapiens
agttacaaattgcttgaaag

SEQ ID NO: 6653668 - DNA, 15 bp, Homo sapiens
agttacaataaagtt

SEQ ID NO: 6653669 - DNA, 22 bp, Homo sapiens
agttacacagaaatgctgctgg

SEQ ID NO: 6653670 - DNA, 13 bp, Homo sapiens
agttacacatttt

SEQ ID NO: 6653671 - DNA, 19 bp, Homo sapiens
agttacacatttttcagat

SEQ ID NO: 6653672 - DNA, 21 bp, Homo sapiens
agttacaccgttgttgtttta

SEQ ID NO: 6653673 - DNA, 13 bp, Homo sapiens
agttacactttta

SEQ ID NO: 6653674 - DNA, 12 bp, Homo sapiens
agttacagaaag

SEQ ID NO: 6653675 - DNA, 16 bp, Homo sapiens
agttacagaaagtggt

SEQ ID NO: 6653676 - DNA, 16 bp, Homo sapiens
agttacagacaaagcg

SEQ ID NO: 6653677 - DNA, 17 bp, Homo sapiens
agttacagacaaagcgt

SEQ ID NO: 6653678 - DNA, 16 bp, Homo sapiens
agttacagatgcaccc

SEQ ID NO: 6653679 - DNA, 13 bp, Homo sapiens
agttacagctgtg

SEQ ID NO: 6653680 - DNA, 17 bp, Homo sapiens
agttacagggcccaggt

SEQ ID NO: 6653681 - DNA, 22 bp, Homo sapiens
agttacagtggcagtattgaca

SEQ ID NO: 6653682 - DNA, 16 bp, Homo sapiens
agttacagttctgtgg

SEQ ID NO: 6653683 - DNA, 16 bp, Homo sapiens
agttacagttgatgtt

SEQ ID NO: 6653684 - DNA, 20 bp, Homo sapiens
agttacataatcagtatatt

SEQ ID NO: 6653685 - DNA, 18 bp, Homo sapiens
agttacatacatttaaaa

SEQ ID NO: 6653686 - DNA, 21 bp, Homo sapiens
agttacatatgtatacatgtg

SEQ ID NO: 6653687 - DNA, 24 bp, Homo sapiens
agttacatccgctttatggagata

SEQ ID NO: 6653688 - DNA, 17 bp, Homo sapiens
agttacatgcatacttc

SEQ ID NO: 6653689 - DNA, 20 bp, Homo sapiens
agttacatgcatacttcaaa

SEQ ID NO: 6653690 - DNA, 21 bp, Homo sapiens
agttacatgcatacttcaaaa

SEQ ID NO: 6653691 - DNA, 22 bp, Homo sapiens
agttacatgcatacttcaaaag

SEQ ID NO: 6653692 - DNA, 18 bp, Homo sapiens
agttacatgctgtatatg

SEQ ID NO: 6653693 - DNA, 15 bp, Homo sapiens
agttacatgtttgca

SEQ ID NO: 6653694 - DNA, 16 bp, Homo sapiens
agttacattaaaataa

SEQ ID NO: 6653695 - DNA, 19 bp, Homo sapiens
agttacattaatgcccagc

SEQ ID NO: 6653696 - DNA, 14 bp, Homo sapiens
agttacatttatgt

SEQ ID NO: 6653697 - DNA, 15 bp, Homo sapiens
agttacatttctatc

SEQ ID NO: 6653698 - DNA, 21 bp, Homo sapiens
agttaccacagcaactgacct

SEQ ID NO: 6653699 - DNA, 15 bp, Homo sapiens
agttaccagtgcctt

SEQ ID NO: 6653700 - DNA, 13 bp, Homo sapiens
agttacccaccct

SEQ ID NO: 6653701 - DNA, 13 bp, Homo sapiens
agttacccactga

SEQ ID NO: 6653702 - DNA, 22 bp, Homo sapiens
agttacccctgaaatctgagtt

SEQ ID NO: 6653703 - DNA, 21 bp, Homo sapiens
agttacctactttttctttga

SEQ ID NO: 6653704 - DNA, 18 bp, Homo sapiens
agttacctccaaaaaaga

SEQ ID NO: 6653705 - DNA, 18 bp, Homo sapiens
agttacctggatgccatt

SEQ ID NO: 6653706 - DNA, 19 bp, Homo sapiens
agttaccttaggcccctga

SEQ ID NO: 6653707 - DNA, 18 bp, Homo sapiens
agttacgcttttctaaga

SEQ ID NO: 6653708 - DNA, 17 bp, Homo sapiens
agttacgtataatgctt

SEQ ID NO: 6653709 - DNA, 16 bp, Homo sapiens
agttactaaaattatg

SEQ ID NO: 6653710 - DNA, 19 bp, Homo sapiens
agttactaaaatttacaca

SEQ ID NO: 6653711 - DNA, 14 bp, Homo sapiens
agttactaatatat

SEQ ID NO: 6653712 - DNA, 19 bp, Homo sapiens
agttactaatatatctgta

SEQ ID NO: 6653713 - DNA, 16 bp, Homo sapiens
agttactacctcctct

SEQ ID NO: 6653714 - DNA, 16 bp, Homo sapiens
agttactactgatttt

SEQ ID NO: 6653715 - DNA, 16 bp, Homo sapiens
agttactatcctggct

SEQ ID NO: 6653716 - DNA, 13 bp, Homo sapiens
agttactcagaat

SEQ ID NO: 6653717 - DNA, 17 bp, Homo sapiens
agttactcagccctggg

SEQ ID NO: 6653718 - DNA, 18 bp, Homo sapiens
agttactcagccctgggc

SEQ ID NO: 6653719 - DNA, 23 bp, Homo sapiens
agttactcagccctgggccccac

SEQ ID NO: 6653720 - DNA, 18 bp, Homo sapiens
agttactccctacactga

SEQ ID NO: 6653721 - DNA, 22 bp, Homo sapiens
agttactccctacactgatgca

SEQ ID NO: 6653722 - DNA, 23 bp, Homo sapiens
agttactcccttctcgtgtttgc

SEQ ID NO: 6653723 - DNA, 21 bp, Homo sapiens
agttactcttcagttaagcct

SEQ ID NO: 6653724 - DNA, 13 bp, Homo sapiens
agttactgaatgc

SEQ ID NO: 6653725 - DNA, 21 bp, Homo sapiens
agttactgccacggtcctttg

SEQ ID NO: 6653726 - DNA, 17 bp, Homo sapiens
agttactggctctttgt

SEQ ID NO: 6653727 - DNA, 19 bp, Homo sapiens
agttactggctctttgtgt

SEQ ID NO: 6653728 - DNA, 19 bp, Homo sapiens
agttactggttggtgttct

SEQ ID NO: 6653729 - DNA, 11 bp, Homo sapiens
agttactgtga

SEQ ID NO: 6653730 - DNA, 14 bp, Homo sapiens
agttactgtgtaaa

SEQ ID NO: 6653731 - DNA, 18 bp, Homo sapiens
agttactgtgtaattagt

SEQ ID NO: 6653732 - DNA, 17 bp, Homo sapiens
agttactgttatagagg

SEQ ID NO: 6653733 - DNA, 17 bp, Homo sapiens
agttactgttgtgacct

SEQ ID NO: 6653734 - DNA, 19 bp, Homo sapiens
agttacttaattgccagca

SEQ ID NO: 6653735 - DNA, 23 bp, Homo sapiens
agttacttaattgccagcaaata

SEQ ID NO: 6653736 - DNA, 15 bp, Homo sapiens
agttacttagaatgc

SEQ ID NO: 6653737 - DNA, 16 bp, Homo sapiens
agttacttatgattta

SEQ ID NO: 6653738 - DNA, 22 bp, Homo sapiens
agttacttcactttaattctca

SEQ ID NO: 6653739 - DNA, 13 bp, Homo sapiens
agttacttccttc

SEQ ID NO: 6653740 - DNA, 14 bp, Homo sapiens
agttacttgaaata

SEQ ID NO: 6653741 - DNA, 14 bp, Homo sapiens
agttacttgaattt

SEQ ID NO: 6653742 - DNA, 16 bp, Homo sapiens
agttacttgaatttca

SEQ ID NO: 6653743 - DNA, 15 bp, Homo sapiens
agttacttgggcttc

SEQ ID NO: 6653744 - DNA, 17 bp, Homo sapiens
agttacttgtctgaggc

SEQ ID NO: 6653745 - DNA, 17 bp, Homo sapiens
agttacttgtgttcatt

SEQ ID NO: 6653746 - DNA, 14 bp, Homo sapiens
agttactttgtaat

SEQ ID NO: 6653747 - DNA, 15 bp, Homo sapiens
agttactttgtaatt

SEQ ID NO: 6653748 - DNA, 18 bp, Homo sapiens
agttactttgtaattttt

SEQ ID NO: 6653749 - DNA, 14 bp, Homo sapiens
agttactttttgta

SEQ ID NO: 6653750 - DNA, 15 bp, Homo sapiens
agttactttttgtag

SEQ ID NO: 6653751 - DNA, 14 bp, Homo sapiens
agttagaaccacag

SEQ ID NO: 6653752 - DNA, 17 bp, Homo sapiens
agttagaaccacagcag

SEQ ID NO: 6653753 - DNA, 19 bp, Homo sapiens
agttagaaccacagcagac

SEQ ID NO: 6653754 - DNA, 21 bp, Homo sapiens
agttagaaggaggttctaata

SEQ ID NO: 6653755 - DNA, 15 bp, Homo sapiens
agttagaatctattt

SEQ ID NO: 6653756 - DNA, 18 bp, Homo sapiens
agttagaatctattttct

SEQ ID NO: 6653757 - DNA, 13 bp, Homo sapiens
agttagactcaaa

SEQ ID NO: 6653758 - DNA, 21 bp, Homo sapiens
agttagactcttcccctccct

SEQ ID NO: 6653759 - DNA, 14 bp, Homo sapiens
agttagagataatt

SEQ ID NO: 6653760 - DNA, 15 bp, Homo sapiens
agttagagataattc

SEQ ID NO: 6653761 - DNA, 17 bp, Homo sapiens
agttagagataattctg

SEQ ID NO: 6653762 - DNA, 18 bp, Homo sapiens
agttagagataattctga

SEQ ID NO: 6653763 - DNA, 14 bp, Homo sapiens
agttagagatgcct

SEQ ID NO: 6653764 - DNA, 16 bp, Homo sapiens
agttagagattttaca

SEQ ID NO: 6653765 - DNA, 16 bp, Homo sapiens
agttagagcagcctcg

SEQ ID NO: 6653766 - DNA, 12 bp, Homo sapiens
agttagagctga

SEQ ID NO: 6653767 - DNA, 16 bp, Homo sapiens
agttagataaaaataa

SEQ ID NO: 6653768 - DNA, 14 bp, Homo sapiens
agttagatatgtgc

SEQ ID NO: 6653769 - DNA, 16 bp, Homo sapiens
agttagatctttgtaa

SEQ ID NO: 6653770 - DNA, 22 bp, Homo sapiens
agttagatctttgtaaatgcat

SEQ ID NO: 6653771 - DNA, 17 bp, Homo sapiens
agttagattcactttga

SEQ ID NO: 6653772 - DNA, 13 bp, Homo sapiens
agttagcagacag

SEQ ID NO: 6653773 - DNA, 20 bp, Homo sapiens
agttagcagggatgttcctt

SEQ ID NO: 6653774 - DNA, 16 bp, Homo sapiens
agttagcatacacatt

SEQ ID NO: 6653775 - DNA, 22 bp, Homo sapiens
agttagcatccaggctggccag

SEQ ID NO: 6653776 - DNA, 21 bp, Homo sapiens
agttagcatgcgcgctgtggg

SEQ ID NO: 6653777 - DNA, 14 bp, Homo sapiens
agttagcattgttt

SEQ ID NO: 6653778 - DNA, 21 bp, Homo sapiens
agttagcatttaccaacatgt

SEQ ID NO: 6653779 - DNA, 12 bp, Homo sapiens
agttagccaaac

SEQ ID NO: 6653780 - DNA, 17 bp, Homo sapiens
agttagccaaacaacaa

SEQ ID NO: 6653781 - DNA, 16 bp, Homo sapiens
agttagcccggccaag

SEQ ID NO: 6653782 - DNA, 19 bp, Homo sapiens
agttagcccggccaaggac

SEQ ID NO: 6653783 - DNA, 12 bp, Homo sapiens
agttagccctca

SEQ ID NO: 6653784 - DNA, 18 bp, Homo sapiens
agttagctaataaaaagc

SEQ ID NO: 6653785 - DNA, 18 bp, Homo sapiens
agttagctcacaagccgt

SEQ ID NO: 6653786 - DNA, 18 bp, Homo sapiens
agttagctgaagaattga

SEQ ID NO: 6653787 - DNA, 18 bp, Homo sapiens
agttagctgctttaaatc

SEQ ID NO: 6653788 - DNA, 17 bp, Homo sapiens
agttaggaaataaaacc

SEQ ID NO: 6653789 - DNA, 23 bp, Homo sapiens
agttaggatattgatttaaaatt

SEQ ID NO: 6653790 - DNA, 15 bp, Homo sapiens
agttaggccacgctc

SEQ ID NO: 6653791 - DNA, 12 bp, Homo sapiens
agttaggcctgg

SEQ ID NO: 6653792 - DNA, 17 bp, Homo sapiens
agttaggctagagacag

SEQ ID NO: 6653793 - DNA, 17 bp, Homo sapiens
agttagggaatggcaca

SEQ ID NO: 6653794 - DNA, 14 bp, Homo sapiens
agttagggagagag

SEQ ID NO: 6653795 - DNA, 22 bp, Homo sapiens
agttagggagagagaagcaggc

SEQ ID NO: 6653796 - DNA, 18 bp, Homo sapiens
agttaggggagaggaaaa

SEQ ID NO: 6653797 - DNA, 14 bp, Homo sapiens
agttaggggcctta

SEQ ID NO: 6653798 - DNA, 22 bp, Homo sapiens
agttaggttgtctccaggccat

SEQ ID NO: 6653799 - DNA, 18 bp, Homo sapiens
agttaggtttaacataaa

SEQ ID NO: 6653800 - DNA, 16 bp, Homo sapiens
agttagtagcatgttg

SEQ ID NO: 6653801 - DNA, 15 bp, Homo sapiens
agttagtgatcctgt

SEQ ID NO: 6653802 - DNA, 16 bp, Homo sapiens
agttagttaagttggg

SEQ ID NO: 6653803 - DNA, 21 bp, Homo sapiens
agttagttcagtagcttatct

SEQ ID NO: 6653804 - DNA, 16 bp, Homo sapiens
agttagtttctttggg

SEQ ID NO: 6653805 - DNA, 15 bp, Homo sapiens
agttagtttgtatat

SEQ ID NO: 6653806 - DNA, 21 bp, Homo sapiens
agttagttttggttatttcta

SEQ ID NO: 6653807 - DNA, 22 bp, Homo sapiens
agttagttttggttatttctaa

SEQ ID NO: 6653808 - DNA, 16 bp, Homo sapiens
agttagtttttaatct

SEQ ID NO: 6653809 - DNA, 13 bp, Homo sapiens
agttataaaaata

SEQ ID NO: 6653810 - DNA, 19 bp, Homo sapiens
agttataaaactatgtgtt

SEQ ID NO: 6653811 - DNA, 20 bp, Homo sapiens
agttataaaactatgtgttc

SEQ ID NO: 6653812 - DNA, 14 bp, Homo sapiens
agttataaaattaa

SEQ ID NO: 6653813 - DNA, 15 bp, Homo sapiens
agttataaaattaaa

SEQ ID NO: 6653814 - DNA, 19 bp, Homo sapiens
agttataaaattaaaagtt

SEQ ID NO: 6653815 - DNA, 17 bp, Homo sapiens
agttataaaccaatgaa

SEQ ID NO: 6653816 - DNA, 16 bp, Homo sapiens
agttataaatacatat

SEQ ID NO: 6653817 - DNA, 14 bp, Homo sapiens
agttataaatagcc

SEQ ID NO: 6653818 - DNA, 15 bp, Homo sapiens
agttataaatagcct

SEQ ID NO: 6653819 - DNA, 19 bp, Homo sapiens
agttataacagatgtgaaa

SEQ ID NO: 6653820 - DNA, 22 bp, Homo sapiens
agttataacagatgtgaaaata

SEQ ID NO: 6653821 - DNA, 12 bp, Homo sapiens
agttataagaag

SEQ ID NO: 6653822 - DNA, 17 bp, Homo sapiens
agttataagcgtattta

SEQ ID NO: 6653823 - DNA, 18 bp, Homo sapiens
agttataagcgtatttag

SEQ ID NO: 6653824 - DNA, 19 bp, Homo sapiens
agttataataactgaactg

SEQ ID NO: 6653825 - DNA, 12 bp, Homo sapiens
agttataatttc

SEQ ID NO: 6653826 - DNA, 13 bp, Homo sapiens
agttatacatctt

SEQ ID NO: 6653827 - DNA, 16 bp, Homo sapiens
agttatacatcttcat

SEQ ID NO: 6653828 - DNA, 20 bp, Homo sapiens
agttatacatcttcattaat

SEQ ID NO: 6653829 - DNA, 15 bp, Homo sapiens
agttatagaaagcaa

SEQ ID NO: 6653830 - DNA, 22 bp, Homo sapiens
agttataggattttcacacatt

SEQ ID NO: 6653831 - DNA, 19 bp, Homo sapiens
agttatagtatatctggac

SEQ ID NO: 6653832 - DNA, 14 bp, Homo sapiens
agttatagtgaata

SEQ ID NO: 6653833 - DNA, 19 bp, Homo sapiens
agttatataaagagaaaat

SEQ ID NO: 6653834 - DNA, 21 bp, Homo sapiens
agttatataaagagaaaattg

SEQ ID NO: 6653835 - DNA, 15 bp, Homo sapiens
agttatatagataaa

SEQ ID NO: 6653836 - DNA, 14 bp, Homo sapiens
agttatatatatgt

SEQ ID NO: 6653837 - DNA, 18 bp, Homo sapiens
agttatatgatattcttt

SEQ ID NO: 6653838 - DNA, 16 bp, Homo sapiens
agttatatgtacagtt

SEQ ID NO: 6653839 - DNA, 14 bp, Homo sapiens
agttatattcttta

SEQ ID NO: 6653840 - DNA, 18 bp, Homo sapiens
agttatattgaatatatc

SEQ ID NO: 6653841 - DNA, 23 bp, Homo sapiens
agttatatttcagatgtaatgtt

SEQ ID NO: 6653842 - DNA, 16 bp, Homo sapiens
agttatatttttgtgt

SEQ ID NO: 6653843 - DNA, 15 bp, Homo sapiens
agttatcaaaaagta

SEQ ID NO: 6653844 - DNA, 16 bp, Homo sapiens
agttatcacactttgt

SEQ ID NO: 6653845 - DNA, 21 bp, Homo sapiens
agttatcagacactctggctg

SEQ ID NO: 6653846 - DNA, 23 bp, Homo sapiens
agttatcagacactctggctggt

SEQ ID NO: 6653847 - DNA, 18 bp, Homo sapiens
agttatcagttatctgtt

SEQ ID NO: 6653848 - DNA, 15 bp, Homo sapiens
agttatcatctcacc

SEQ ID NO: 6653849 - DNA, 18 bp, Homo sapiens
agttatcatctcaccaca

SEQ ID NO: 6653850 - DNA, 16 bp, Homo sapiens
agttatcatgaatttt

SEQ ID NO: 6653851 - DNA, 20 bp, Homo sapiens
agttatcatgaattttaaag

SEQ ID NO: 6653852 - DNA, 15 bp, Homo sapiens
agttatcatgttagt

SEQ ID NO: 6653853 - DNA, 22 bp, Homo sapiens
agttatcatgttagtaatacct

SEQ ID NO: 6653854 - DNA, 21 bp, Homo sapiens
agttatccagagggttgtgat

SEQ ID NO: 6653855 - DNA, 15 bp, Homo sapiens
agttatcctgcaagg

SEQ ID NO: 6653856 - DNA, 16 bp, Homo sapiens
agttatcctttgtgag

SEQ ID NO: 6653857 - DNA, 15 bp, Homo sapiens
agttatctaagttaa

SEQ ID NO: 6653858 - DNA, 22 bp, Homo sapiens
agttatctaagttaatttaaag

SEQ ID NO: 6653859 - DNA, 18 bp, Homo sapiens
agttatctgcagatatgt

SEQ ID NO: 6653860 - DNA, 21 bp, Homo sapiens
agttatctgttcttttgactt

SEQ ID NO: 6653861 - DNA, 10 bp, Homo sapiens
agttatctta

SEQ ID NO: 6653862 - DNA, 17 bp, Homo sapiens
agttatcttctttatta

SEQ ID NO: 6653863 - DNA, 19 bp, Homo sapiens
agttatcttttaattacag

SEQ ID NO: 6653864 - DNA, 16 bp, Homo sapiens
agttatgagggtcagg

SEQ ID NO: 6653865 - DNA, 18 bp, Homo sapiens
agttatggcctatacact

SEQ ID NO: 6653866 - DNA, 18 bp, Homo sapiens
agttatggtgatgactta

SEQ ID NO: 6653867 - DNA, 23 bp, Homo sapiens
agttatggtgccgaattgtcttt

SEQ ID NO: 6653868 - DNA, 16 bp, Homo sapiens
agttatgtatttaaag

SEQ ID NO: 6653869 - DNA, 11 bp, Homo sapiens
agttatgtctt

SEQ ID NO: 6653870 - DNA, 14 bp, Homo sapiens
agttatgtgaatga

SEQ ID NO: 6653871 - DNA, 12 bp, Homo sapiens
agttatgtgtat

SEQ ID NO: 6653872 - DNA, 15 bp, Homo sapiens
agttatgtttgaatg

SEQ ID NO: 6653873 - DNA, 13 bp, Homo sapiens
agttatgttttac

SEQ ID NO: 6653874 - DNA, 22 bp, Homo sapiens
agttattaacgggcatgtatta

SEQ ID NO: 6653875 - DNA, 23 bp, Homo sapiens
agttattaacgggcatgtattat

SEQ ID NO: 6653876 - DNA, 15 bp, Homo sapiens
agttattaactgtat

SEQ ID NO: 6653877 - DNA, 14 bp, Homo sapiens
agttattaacttta

SEQ ID NO: 6653878 - DNA, 21 bp, Homo sapiens
agttattaagaggtaagactt

SEQ ID NO: 6653879 - DNA, 18 bp, Homo sapiens
agttattaagttctttaa

SEQ ID NO: 6653880 - DNA, 17 bp, Homo sapiens
agttattaatttcttca

SEQ ID NO: 6653881 - DNA, 12 bp, Homo sapiens
agttattacctc

SEQ ID NO: 6653882 - DNA, 21 bp, Homo sapiens
agttattacctttacatatta

SEQ ID NO: 6653883 - DNA, 19 bp, Homo sapiens
agttattagaacttagttt

SEQ ID NO: 6653884 - DNA, 15 bp, Homo sapiens
agttattatttaatt

SEQ ID NO: 6653885 - DNA, 16 bp, Homo sapiens
agttattattttccca

SEQ ID NO: 6653886 - DNA, 11 bp, Homo sapiens
agttattcaaa

SEQ ID NO: 6653887 - DNA, 18 bp, Homo sapiens
agttattcaaatttgtac

SEQ ID NO: 6653888 - DNA, 19 bp, Homo sapiens
agttattcacaaaaattga

SEQ ID NO: 6653889 - DNA, 13 bp, Homo sapiens
agttattcagaaa

SEQ ID NO: 6653890 - DNA, 16 bp, Homo sapiens
agttattcagaaatat

SEQ ID NO: 6653891 - DNA, 18 bp, Homo sapiens
agttattcataaagagaa

SEQ ID NO: 6653892 - DNA, 12 bp, Homo sapiens
agttattccaca

SEQ ID NO: 6653893 - DNA, 19 bp, Homo sapiens
agttattccccatcttcca

SEQ ID NO: 6653894 - DNA, 14 bp, Homo sapiens
agttattctctaag

SEQ ID NO: 6653895 - DNA, 12 bp, Homo sapiens
agttattgattt

SEQ ID NO: 6653896 - DNA, 14 bp, Homo sapiens
agttattgctgcat

SEQ ID NO: 6653897 - DNA, 17 bp, Homo sapiens
agttattgctgcataaa

SEQ ID NO: 6653898 - DNA, 12 bp, Homo sapiens
agttattgtaca

SEQ ID NO: 6653899 - DNA, 19 bp, Homo sapiens
agttattgtacagctgttt

SEQ ID NO: 6653900 - DNA, 21 bp, Homo sapiens
agttattgtacagctgtttaa

SEQ ID NO: 6653901 - DNA, 20 bp, Homo sapiens
agttatttaagaagaatgag

SEQ ID NO: 6653902 - DNA, 18 bp, Homo sapiens
agttatttaccagaagtt

SEQ ID NO: 6653903 - DNA, 23 bp, Homo sapiens
agttatttaccagaagtttaaat

SEQ ID NO: 6653904 - DNA, 19 bp, Homo sapiens
agttatttacttgaaagat

SEQ ID NO: 6653905 - DNA, 20 bp, Homo sapiens
agttatttacttgaaagatg

SEQ ID NO: 6653906 - DNA, 21 bp, Homo sapiens
agttatttacttgaaagatgg

SEQ ID NO: 6653907 - DNA, 18 bp, Homo sapiens
agttatttacttttacca

SEQ ID NO: 6653908 - DNA, 21 bp, Homo sapiens
agttatttagaaatatccttt

SEQ ID NO: 6653909 - DNA, 21 bp, Homo sapiens
agttatttatttattggagat

SEQ ID NO: 6653910 - DNA, 23 bp, Homo sapiens
agttatttcccaacccaggattc

SEQ ID NO: 6653911 - DNA, 18 bp, Homo sapiens
agttatttcttgtttgtt

SEQ ID NO: 6653912 - DNA, 22 bp, Homo sapiens
agttatttgtcttcttttcaaa

SEQ ID NO: 6653913 - DNA, 22 bp, Homo sapiens
agttattttaaaaaaattcatc

SEQ ID NO: 6653914 - DNA, 21 bp, Homo sapiens
agttattttaatacctttaaa

SEQ ID NO: 6653915 - DNA, 14 bp, Homo sapiens
agttattttacaaa

SEQ ID NO: 6653916 - DNA, 18 bp, Homo sapiens
agttattttaggagacag

SEQ ID NO: 6653917 - DNA, 17 bp, Homo sapiens
agttattttatttgctt

SEQ ID NO: 6653918 - DNA, 20 bp, Homo sapiens
agttattttatttgcttatt

SEQ ID NO: 6653919 - DNA, 23 bp, Homo sapiens
agttattttctacagtggtttta

SEQ ID NO: 6653920 - DNA, 19 bp, Homo sapiens
agttattttcttgtttaac

SEQ ID NO: 6653921 - DNA, 23 bp, Homo sapiens
agttattttgcacccactgaaag

SEQ ID NO: 6653922 - DNA, 14 bp, Homo sapiens
agttattttggata

SEQ ID NO: 6653923 - DNA, 16 bp, Homo sapiens
agttattttggatata

SEQ ID NO: 6653924 - DNA, 18 bp, Homo sapiens
agttattttggatatatt

SEQ ID NO: 6653925 - DNA, 21 bp, Homo sapiens
agttattttggatatattatt

SEQ ID NO: 6653926 - DNA, 15 bp, Homo sapiens
agttatttttctctt

SEQ ID NO: 6653927 - DNA, 23 bp, Homo sapiens
agttatttttctttttaagagat

SEQ ID NO: 6653928 - DNA, 17 bp, Homo sapiens
agttatttttgtacatg

SEQ ID NO: 6653929 - DNA, 20 bp, Homo sapiens
agttcaaaattctaaatgta

SEQ ID NO: 6653930 - DNA, 16 bp, Homo sapiens
agttcaaaccatttca

SEQ ID NO: 6653931 - DNA, 16 bp, Homo sapiens
agttcaaaccctgtat

SEQ ID NO: 6653932 - DNA, 15 bp, Homo sapiens
agttcaaagaagtca

SEQ ID NO: 6653933 - DNA, 22 bp, Homo sapiens
agttcaaatcctcaccatccac

SEQ ID NO: 6653934 - DNA, 23 bp, Homo sapiens
agttcaaatcctcaccatccaca

SEQ ID NO: 6653935 - DNA, 18 bp, Homo sapiens
agttcaaattttgcattg

SEQ ID NO: 6653936 - DNA, 15 bp, Homo sapiens
agttcaagatcaaaa

SEQ ID NO: 6653937 - DNA, 22 bp, Homo sapiens
agttcaaggaacttgaaaaata

SEQ ID NO: 6653938 - DNA, 19 bp, Homo sapiens
agttcaataaatgtctgtt

SEQ ID NO: 6653939 - DNA, 10 bp, Homo sapiens
agttcaatga

SEQ ID NO: 6653940 - DNA, 13 bp, Homo sapiens
agttcaatgatct

SEQ ID NO: 6653941 - DNA, 15 bp, Homo sapiens
agttcaatgatctag

SEQ ID NO: 6653942 - DNA, 20 bp, Homo sapiens
agttcaatgatctaggttta

SEQ ID NO: 6653943 - DNA, 23 bp, Homo sapiens
agttcaatgatctaggtttaact

SEQ ID NO: 6653944 - DNA, 10 bp, Homo sapiens
agttcaatgc

SEQ ID NO: 6653945 - DNA, 15 bp, Homo sapiens
agttcaattgtgaaa

SEQ ID NO: 6653946 - DNA, 22 bp, Homo sapiens
agttcaattgtgaaaatgaata

SEQ ID NO: 6653947 - DNA, 15 bp, Homo sapiens
agttcaattgtgtct

SEQ ID NO: 6653948 - DNA, 19 bp, Homo sapiens
agttcaattgtgtctgtgg

SEQ ID NO: 6653949 - DNA, 16 bp, Homo sapiens
agttcaatttcatgtt

SEQ ID NO: 6653950 - DNA, 21 bp, Homo sapiens
agttcacaaaaaaatgttcat

SEQ ID NO: 6653951 - DNA, 13 bp, Homo sapiens
agttcacagaggt

SEQ ID NO: 6653952 - DNA, 13 bp, Homo sapiens
agttcacaggagg

SEQ ID NO: 6653953 - DNA, 15 bp, Homo sapiens
agttcacagtgtttc

SEQ ID NO: 6653954 - DNA, 17 bp, Homo sapiens
agttcacatgtgccctg

SEQ ID NO: 6653955 - DNA, 18 bp, Homo sapiens
agttcacattagaattag

SEQ ID NO: 6653956 - DNA, 19 bp, Homo sapiens
agttcaccagcatggtagt

SEQ ID NO: 6653957 - DNA, 14 bp, Homo sapiens
agttcaccatctct

SEQ ID NO: 6653958 - DNA, 20 bp, Homo sapiens
agttcaccccttatcctgag

SEQ ID NO: 6653959 - DNA, 17 bp, Homo sapiens
agttcacctatttcaaa

SEQ ID NO: 6653960 - DNA, 18 bp, Homo sapiens
agttcaccttggaagggc

SEQ ID NO: 6653961 - DNA, 17 bp, Homo sapiens
agttcactacagcatca

SEQ ID NO: 6653962 - DNA, 20 bp, Homo sapiens
agttcactgttgtacacagt

SEQ ID NO: 6653963 - DNA, 18 bp, Homo sapiens
agttcacttactcttaca

SEQ ID NO: 6653964 - DNA, 15 bp, Homo sapiens
agttcacttcatctt

SEQ ID NO: 6653965 - DNA, 14 bp, Homo sapiens
agttcacttgcagt

SEQ ID NO: 6653966 - DNA, 14 bp, Homo sapiens
agttcactttcaat

SEQ ID NO: 6653967 - DNA, 14 bp, Homo sapiens
agttcagaaaaaat

SEQ ID NO: 6653968 - DNA, 20 bp, Homo sapiens
agttcagaaaaaatgtgaag

SEQ ID NO: 6653969 - DNA, 18 bp, Homo sapiens
agttcagacttagttttt

SEQ ID NO: 6653970 - DNA, 14 bp, Homo sapiens
agttcagagctgcc

SEQ ID NO: 6653971 - DNA, 18 bp, Homo sapiens
agttcagagctgccctct

SEQ ID NO: 6653972 - DNA, 22 bp, Homo sapiens
agttcagagctgccctctcctg

SEQ ID NO: 6653973 - DNA, 23 bp, Homo sapiens
agttcagagctgccctctcctgg

SEQ ID NO: 6653974 - DNA, 14 bp, Homo sapiens
agttcagaggaagc

SEQ ID NO: 6653975 - DNA, 20 bp, Homo sapiens
agttcagagtccttaaaatg

SEQ ID NO: 6653976 - DNA, 16 bp, Homo sapiens
agttcagagttttctg

SEQ ID NO: 6653977 - DNA, 16 bp, Homo sapiens
agttcagatacagggt

SEQ ID NO: 6653978 - DNA, 13 bp, Homo sapiens
agttcagatctta

SEQ ID NO: 6653979 - DNA, 15 bp, Homo sapiens
agttcagcaaaactg

SEQ ID NO: 6653980 - DNA, 15 bp, Homo sapiens
agttcagccagaatc

SEQ ID NO: 6653981 - DNA, 17 bp, Homo sapiens
agttcagcctttaagat

SEQ ID NO: 6653982 - DNA, 15 bp, Homo sapiens
agttcagctgcttct

SEQ ID NO: 6653983 - DNA, 13 bp, Homo sapiens
agttcagcttggg

SEQ ID NO: 6653984 - DNA, 15 bp, Homo sapiens
agttcaggaattttt

SEQ ID NO: 6653985 - DNA, 13 bp, Homo sapiens
agttcaggatttg

SEQ ID NO: 6653986 - DNA, 16 bp, Homo sapiens
agttcaggctctgaga

SEQ ID NO: 6653987 - DNA, 21 bp, Homo sapiens
agttcaggctctgagacacac

SEQ ID NO: 6653988 - DNA, 19 bp, Homo sapiens
agttcagggaagataagtt

SEQ ID NO: 6653989 - DNA, 22 bp, Homo sapiens
agttcagggaagataagttgga

SEQ ID NO: 6653990 - DNA, 12 bp, Homo sapiens
agttcagggacc

SEQ ID NO: 6653991 - DNA, 18 bp, Homo sapiens
agttcaggtaacaggcag

SEQ ID NO: 6653992 - DNA, 19 bp, Homo sapiens
agttcaggtagctgcccct

SEQ ID NO: 6653993 - DNA, 21 bp, Homo sapiens
agttcaggtagctgcccctgg

SEQ ID NO: 6653994 - DNA, 22 bp, Homo sapiens
agttcaggttaccagaaccagt

SEQ ID NO: 6653995 - DNA, 15 bp, Homo sapiens
agttcagtacctgga

SEQ ID NO: 6653996 - DNA, 17 bp, Homo sapiens
agttcagtacctggagg

SEQ ID NO: 6653997 - DNA, 16 bp, Homo sapiens
agttcagtagaattac

SEQ ID NO: 6653998 - DNA, 18 bp, Homo sapiens
agttcagtagaattacca

SEQ ID NO: 6653999 - DNA, 13 bp, Homo sapiens
agttcagtagatt

SEQ ID NO: 6654000 - DNA, 21 bp, Homo sapiens
agttcagtggcagggctcagg

SEQ ID NO: 6654001 - DNA, 24 bp, Homo sapiens
agttcagttcctctttgcatggaa

SEQ ID NO: 6654002 - DNA, 15 bp, Homo sapiens
agttcagttctgttt

SEQ ID NO: 6654003 - DNA, 20 bp, Homo sapiens
agttcataacagtgccattg

SEQ ID NO: 6654004 - DNA, 22 bp, Homo sapiens
agttcataacagtgccattgtc

SEQ ID NO: 6654005 - DNA, 14 bp, Homo sapiens
agttcataccctgt

SEQ ID NO: 6654006 - DNA, 18 bp, Homo sapiens
agttcatacctaagtact

SEQ ID NO: 6654007 - DNA, 21 bp, Homo sapiens
agttcatacctaagtactgta

SEQ ID NO: 6654008 - DNA, 16 bp, Homo sapiens
agttcatagttggaaa

SEQ ID NO: 6654009 - DNA, 20 bp, Homo sapiens
agttcatagttggaaatatt

SEQ ID NO: 6654010 - DNA, 15 bp, Homo sapiens
agttcatagtttctg

SEQ ID NO: 6654011 - DNA, 18 bp, Homo sapiens
agttcatagtttctgtaa

SEQ ID NO: 6654012 - DNA, 13 bp, Homo sapiens
agttcatatatac

SEQ ID NO: 6654013 - DNA, 16 bp, Homo sapiens
agttcatatatacata

SEQ ID NO: 6654014 - DNA, 18 bp, Homo sapiens
agttcatatgtaccatgt

SEQ ID NO: 6654015 - DNA, 22 bp, Homo sapiens
agttcatatgtaccatgtacat

SEQ ID NO: 6654016 - DNA, 19 bp, Homo sapiens
agttcatattccatattta

SEQ ID NO: 6654017 - DNA, 18 bp, Homo sapiens
agttcatccaatcctcac

SEQ ID NO: 6654018 - DNA, 22 bp, Homo sapiens
agttcatccaatcctcactggg

SEQ ID NO: 6654019 - DNA, 18 bp, Homo sapiens
agttcatcccagccccaa

SEQ ID NO: 6654020 - DNA, 16 bp, Homo sapiens
agttcatcccttctct

SEQ ID NO: 6654021 - DNA, 19 bp, Homo sapiens
agttcatcccttctcttcc

SEQ ID NO: 6654022 - DNA, 20 bp, Homo sapiens
agttcatcccttctcttcca

SEQ ID NO: 6654023 - DNA, 22 bp, Homo sapiens
agttcatcttgaattgtaagga

SEQ ID NO: 6654024 - DNA, 13 bp, Homo sapiens
agttcatcttgca

SEQ ID NO: 6654025 - DNA, 19 bp, Homo sapiens
agttcatcttgcagcattt

SEQ ID NO: 6654026 - DNA, 13 bp, Homo sapiens
agttcatgagaat

SEQ ID NO: 6654027 - DNA, 20 bp, Homo sapiens
agttcatggggatctggggg

SEQ ID NO: 6654028 - DNA, 22 bp, Homo sapiens
agttcatggggatctggggggt

SEQ ID NO: 6654029 - DNA, 17 bp, Homo sapiens
agttcatggtgatcagt

SEQ ID NO: 6654030 - DNA, 14 bp, Homo sapiens
agttcatgtctgaa

SEQ ID NO: 6654031 - DNA, 17 bp, Homo sapiens
agttcatgtctgaaaca

SEQ ID NO: 6654032 - DNA, 16 bp, Homo sapiens
agttcatgttgctcag

SEQ ID NO: 6654033 - DNA, 23 bp, Homo sapiens
agttcatgtttgcttcataaatg

SEQ ID NO: 6654034 - DNA, 15 bp, Homo sapiens
agttcatgtttgtaa

SEQ ID NO: 6654035 - DNA, 16 bp, Homo sapiens
agttcattacctccct

SEQ ID NO: 6654036 - DNA, 16 bp, Homo sapiens
agttcattagaaatat

SEQ ID NO: 6654037 - DNA, 18 bp, Homo sapiens
agttcattagaaatattt

SEQ ID NO: 6654038 - DNA, 16 bp, Homo sapiens
agttcattattttgtg

SEQ ID NO: 6654039 - DNA, 20 bp, Homo sapiens
agttcattattttgtggttc

SEQ ID NO: 6654040 - DNA, 21 bp, Homo sapiens
agttcattcaaaatgtccagc

SEQ ID NO: 6654041 - DNA, 23 bp, Homo sapiens
agttcattcatactcaaagaggc

SEQ ID NO: 6654042 - DNA, 15 bp, Homo sapiens
agttcattcatatta

SEQ ID NO: 6654043 - DNA, 22 bp, Homo sapiens
agttcattcctgtctaaagtgg

SEQ ID NO: 6654044 - DNA, 14 bp, Homo sapiens
agttcattctacca

SEQ ID NO: 6654045 - DNA, 23 bp, Homo sapiens
agttcattgtaaatgaacataat

SEQ ID NO: 6654046 - DNA, 14 bp, Homo sapiens
agttcattttaaat

SEQ ID NO: 6654047 - DNA, 15 bp, Homo sapiens
agttcattttaaatg

SEQ ID NO: 6654048 - DNA, 17 bp, Homo sapiens
agttcattttaaatgaa

SEQ ID NO: 6654049 - DNA, 16 bp, Homo sapiens
agttccaaatgtttat

SEQ ID NO: 6654050 - DNA, 21 bp, Homo sapiens
agttccaacaaagaaaggtgc

SEQ ID NO: 6654051 - DNA, 13 bp, Homo sapiens
agttccaagagtc

SEQ ID NO: 6654052 - DNA, 20 bp, Homo sapiens
agttccaagtccaataagac

SEQ ID NO: 6654053 - DNA, 19 bp, Homo sapiens
agttccaagttgaagggaa

SEQ ID NO: 6654054 - DNA, 23 bp, Homo sapiens
agttccacacaggtttgtaagta

SEQ ID NO: 6654055 - DNA, 14 bp, Homo sapiens
agttccacagattg

SEQ ID NO: 6654056 - DNA, 21 bp, Homo sapiens
agttccacagattgtttctat

SEQ ID NO: 6654057 - DNA, 20 bp, Homo sapiens
agttccacttagagaacaaa

SEQ ID NO: 6654058 - DNA, 21 bp, Homo sapiens
agttccacttagagaacaaag

SEQ ID NO: 6654059 - DNA, 17 bp, Homo sapiens
agttccacttccaggtc

SEQ ID NO: 6654060 - DNA, 16 bp, Homo sapiens
agttccagccttctct

SEQ ID NO: 6654061 - DNA, 15 bp, Homo sapiens
agttccatagaaaag

SEQ ID NO: 6654062 - DNA, 19 bp, Homo sapiens
agttccatcaggtcccccc

SEQ ID NO: 6654063 - DNA, 19 bp, Homo sapiens
agttccatggcaattttgt

SEQ ID NO: 6654064 - DNA, 15 bp, Homo sapiens
agttccattatgaaa

SEQ ID NO: 6654065 - DNA, 16 bp, Homo sapiens
agttccattctatgac

SEQ ID NO: 6654066 - DNA, 14 bp, Homo sapiens
agttccattcttgg

SEQ ID NO: 6654067 - DNA, 16 bp, Homo sapiens
agttccattcttggca

SEQ ID NO: 6654068 - DNA, 14 bp, Homo sapiens
agttcccaaatgtg

SEQ ID NO: 6654069 - DNA, 22 bp, Homo sapiens
agttcccaaatgtgaggggcga

SEQ ID NO: 6654070 - DNA, 18 bp, Homo sapiens
agttcccacattaaagaa

SEQ ID NO: 6654071 - DNA, 13 bp, Homo sapiens
agttcccagctcc

SEQ ID NO: 6654072 - DNA, 19 bp, Homo sapiens
agttcccagctccccccgc

SEQ ID NO: 6654073 - DNA, 18 bp, Homo sapiens
agttcccagttggagctc

SEQ ID NO: 6654074 - DNA, 21 bp, Homo sapiens
agttcccagttggagctccag

SEQ ID NO: 6654075 - DNA, 18 bp, Homo sapiens
agttcccatggtgtatgt

SEQ ID NO: 6654076 - DNA, 20 bp, Homo sapiens
agttcccatggtgtatgtgg

SEQ ID NO: 6654077 - DNA, 23 bp, Homo sapiens
agttcccatggtgtatgtggttt

SEQ ID NO: 6654078 - DNA, 16 bp, Homo sapiens
agttcccattctttca

SEQ ID NO: 6654079 - DNA, 16 bp, Homo sapiens
agttcccatttccttg

SEQ ID NO: 6654080 - DNA, 16 bp, Homo sapiens
agttccccaaatacaa

SEQ ID NO: 6654081 - DNA, 16 bp, Homo sapiens
agttccccatgcagac

SEQ ID NO: 6654082 - DNA, 17 bp, Homo sapiens
agttccccatgcagaca

SEQ ID NO: 6654083 - DNA, 19 bp, Homo sapiens
agttcccccagtacctcca

SEQ ID NO: 6654084 - DNA, 22 bp, Homo sapiens
agttcccccagtacctccaagc

SEQ ID NO: 6654085 - DNA, 23 bp, Homo sapiens
agttcccccatcagttcccccag

SEQ ID NO: 6654086 - DNA, 24 bp, Homo sapiens
agttcccctggaagcagtgcccag

SEQ ID NO: 6654087 - DNA, 20 bp, Homo sapiens
agttcccctgtttattcata

SEQ ID NO: 6654088 - DNA, 18 bp, Homo sapiens
agttcccggagcacagcc

SEQ ID NO: 6654089 - DNA, 19 bp, Homo sapiens
agttcccggagcacagccc

SEQ ID NO: 6654090 - DNA, 23 bp, Homo sapiens
agttcccggagcacagccctggg

SEQ ID NO: 6654091 - DNA, 23 bp, Homo sapiens
agttcccgggagctgggccctgc

SEQ ID NO: 6654092 - DNA, 21 bp, Homo sapiens
agttcccgggccctcctgggc

SEQ ID NO: 6654093 - DNA, 12 bp, Homo sapiens
agttccctcctg

SEQ ID NO: 6654094 - DNA, 16 bp, Homo sapiens
agttccctcctgccca

SEQ ID NO: 6654095 - DNA, 14 bp, Homo sapiens
agttccctctgcct

SEQ ID NO: 6654096 - DNA, 19 bp, Homo sapiens
agttccctctgcctgggat

SEQ ID NO: 6654097 - DNA, 18 bp, Homo sapiens
agttccctctgctcagcc

SEQ ID NO: 6654098 - DNA, 19 bp, Homo sapiens
agttccctctgctcagcca

SEQ ID NO: 6654099 - DNA, 20 bp, Homo sapiens
agttccctctgctcagccaa

SEQ ID NO: 6654100 - DNA, 22 bp, Homo sapiens
agttccctctgctcagccaagc

SEQ ID NO: 6654101 - DNA, 21 bp, Homo sapiens
agttccctgaaccttcctgtc

SEQ ID NO: 6654102 - DNA, 14 bp, Homo sapiens
agttccctggagaa

SEQ ID NO: 6654103 - DNA, 21 bp, Homo sapiens
agttccctgtctcttgaaaaa

SEQ ID NO: 6654104 - DNA, 12 bp, Homo sapiens
agttccctgttg

SEQ ID NO: 6654105 - DNA, 16 bp, Homo sapiens
agttcccttggcctca

SEQ ID NO: 6654106 - DNA, 21 bp, Homo sapiens
agttccctttgcttgtcttct

SEQ ID NO: 6654107 - DNA, 18 bp, Homo sapiens
agttccggggagaaaccc

SEQ ID NO: 6654108 - DNA, 23 bp, Homo sapiens
agttccggggagaaacccagaga

SEQ ID NO: 6654109 - DNA, 19 bp, Homo sapiens
agttccgtctcctctccag

SEQ ID NO: 6654110 - DNA, 15 bp, Homo sapiens
agttcctaagaagct

SEQ ID NO: 6654111 - DNA, 16 bp, Homo sapiens
agttcctaagaagctt

SEQ ID NO: 6654112 - DNA, 20 bp, Homo sapiens
agttcctataacactgtgaa

SEQ ID NO: 6654113 - DNA, 23 bp, Homo sapiens
agttcctcattagcattttgcta

SEQ ID NO: 6654114 - DNA, 14 bp, Homo sapiens
agttcctcctactt

SEQ ID NO: 6654115 - DNA, 14 bp, Homo sapiens
agttcctcgccctg

SEQ ID NO: 6654116 - DNA, 15 bp, Homo sapiens
agttcctcgccctgg

SEQ ID NO: 6654117 - DNA, 16 bp, Homo sapiens
agttcctctttgcatg

SEQ ID NO: 6654118 - DNA, 19 bp, Homo sapiens
agttcctgaacctgatgct

SEQ ID NO: 6654119 - DNA, 20 bp, Homo sapiens
agttcctgagtaccttctac

SEQ ID NO: 6654120 - DNA, 22 bp, Homo sapiens
agttcctgagtgcgtggatctg

SEQ ID NO: 6654121 - DNA, 23 bp, Homo sapiens
agttcctgagtggatatgcgaat

SEQ ID NO: 6654122 - DNA, 15 bp, Homo sapiens
agttcctgcactcca

SEQ ID NO: 6654123 - DNA, 23 bp, Homo sapiens
agttcctgctacaacttcagcag

SEQ ID NO: 6654124 - DNA, 15 bp, Homo sapiens
agttcctgctccgtg

SEQ ID NO: 6654125 - DNA, 16 bp, Homo sapiens
agttcctgctctctgc

SEQ ID NO: 6654126 - DNA, 18 bp, Homo sapiens
agttcctgctctctgctc

SEQ ID NO: 6654127 - DNA, 19 bp, Homo sapiens
agttcctgctctctgctca

SEQ ID NO: 6654128 - DNA, 14 bp, Homo sapiens
agttcctgctgcct

SEQ ID NO: 6654129 - DNA, 19 bp, Homo sapiens
agttcctgctgcctgggta

SEQ ID NO: 6654130 - DNA, 21 bp, Homo sapiens
agttcctggcccatcaactgt

SEQ ID NO: 6654131 - DNA, 20 bp, Homo sapiens
agttcctgtcccttctctta

SEQ ID NO: 6654132 - DNA, 16 bp, Homo sapiens
agttcctgtgcacagc

SEQ ID NO: 6654133 - DNA, 21 bp, Homo sapiens
agttccttactgtttacagtt

SEQ ID NO: 6654134 - DNA, 15 bp, Homo sapiens
agttccttataagaa

SEQ ID NO: 6654135 - DNA, 19 bp, Homo sapiens
agttccttctctttaaatc

SEQ ID NO: 6654136 - DNA, 13 bp, Homo sapiens
agttccttgcctt

SEQ ID NO: 6654137 - DNA, 15 bp, Homo sapiens
agttccttgccttaa

SEQ ID NO: 6654138 - DNA, 20 bp, Homo sapiens
agttccttgccttaataaat

SEQ ID NO: 6654139 - DNA, 21 bp, Homo sapiens
agttcctttagaaagcagtta

SEQ ID NO: 6654140 - DNA, 15 bp, Homo sapiens
agttcgaacatgttt

SEQ ID NO: 6654141 - DNA, 21 bp, Homo sapiens
agttcgaccaaactcagttca

SEQ ID NO: 6654142 - DNA, 22 bp, Homo sapiens
agttcgactctgtgctggccag

SEQ ID NO: 6654143 - DNA, 18 bp, Homo sapiens
agttcgagaccaacctga

SEQ ID NO: 6654144 - DNA, 17 bp, Homo sapiens
agttcgagaccagcctg

SEQ ID NO: 6654145 - DNA, 17 bp, Homo sapiens
agttcgagagcagcctg

SEQ ID NO: 6654146 - DNA, 21 bp, Homo sapiens
agttcgagagcagcctggcca

SEQ ID NO: 6654147 - DNA, 21 bp, Homo sapiens
agttcgcagccaccctgagga

SEQ ID NO: 6654148 - DNA, 16 bp, Homo sapiens
agttcgcctggagccc

SEQ ID NO: 6654149 - DNA, 20 bp, Homo sapiens
agttcggtctgacagtcctt

SEQ ID NO: 6654150 - DNA, 13 bp, Homo sapiens
agttcgtctgttg

SEQ ID NO: 6654151 - DNA, 20 bp, Homo sapiens
agttcgtggctgcaaaagaa

SEQ ID NO: 6654152 - DNA, 21 bp, Homo sapiens
agttctaaaaagatgtaataa

SEQ ID NO: 6654153 - DNA, 23 bp, Homo sapiens
agttctaagactcaaatgttcta

SEQ ID NO: 6654154 - DNA, 19 bp, Homo sapiens
agttctaagattctaatga

SEQ ID NO: 6654155 - DNA, 17 bp, Homo sapiens
agttctaagattctgat

SEQ ID NO: 6654156 - DNA, 22 bp, Homo sapiens
agttctaagttcatgtttgtaa

SEQ ID NO: 6654157 - DNA, 17 bp, Homo sapiens
agttctaataatttcta

SEQ ID NO: 6654158 - DNA, 20 bp, Homo sapiens
agttctaataatttctaatg

SEQ ID NO: 6654159 - DNA, 20 bp, Homo sapiens
agttctacaagcatatttga

SEQ ID NO: 6654160 - DNA, 20 bp, Homo sapiens
agttctacctcaggcagctc

SEQ ID NO: 6654161 - DNA, 22 bp, Homo sapiens
agttctactatggctgagttct

SEQ ID NO: 6654162 - DNA, 15 bp, Homo sapiens
agttctagaaaaaca

SEQ ID NO: 6654163 - DNA, 17 bp, Homo sapiens
agttctagaaccacttc

SEQ ID NO: 6654164 - DNA, 21 bp, Homo sapiens
agttctagaaccacttcctgc

SEQ ID NO: 6654165 - DNA, 12 bp, Homo sapiens
agttctagaagc

SEQ ID NO: 6654166 - DNA, 20 bp, Homo sapiens
agttctagaaggtctccaag

SEQ ID NO: 6654167 - DNA, 13 bp, Homo sapiens
agttctagagaag

SEQ ID NO: 6654168 - DNA, 15 bp, Homo sapiens
agttctagagaagag

SEQ ID NO: 6654169 - DNA, 23 bp, Homo sapiens
agttctagatggagaaagtaaca

SEQ ID NO: 6654170 - DNA, 20 bp, Homo sapiens
agttctagatttttaagaga

SEQ ID NO: 6654171 - DNA, 21 bp, Homo sapiens
agttctagctctatttacttc

SEQ ID NO: 6654172 - DNA, 22 bp, Homo sapiens
agttctaggcactgtagttcta

SEQ ID NO: 6654173 - DNA, 22 bp, Homo sapiens
agttctaggcatacttttcaaa

SEQ ID NO: 6654174 - DNA, 16 bp, Homo sapiens
agttctaggcctttcc

SEQ ID NO: 6654175 - DNA, 21 bp, Homo sapiens
agttctaggcctttcctctgc

SEQ ID NO: 6654176 - DNA, 23 bp, Homo sapiens
agttctaggtgctaaaattcaga

SEQ ID NO: 6654177 - DNA, 22 bp, Homo sapiens
agttctagtccttggtctgctg

SEQ ID NO: 6654178 - DNA, 17 bp, Homo sapiens
agttctagtctctctgg

SEQ ID NO: 6654179 - DNA, 13 bp, Homo sapiens
agttctagtgttt

SEQ ID NO: 6654180 - DNA, 17 bp, Homo sapiens
agttctagtttgcattc

SEQ ID NO: 6654181 - DNA, 18 bp, Homo sapiens
agttctataagtgaggaa

SEQ ID NO: 6654182 - DNA, 20 bp, Homo sapiens
agttctatactgtaaagcgc

SEQ ID NO: 6654183 - DNA, 19 bp, Homo sapiens
agttctatcagttatcctt

SEQ ID NO: 6654184 - DNA, 20 bp, Homo sapiens
agttctatgaagagtattaa

SEQ ID NO: 6654185 - DNA, 21 bp, Homo sapiens
agttctatggagactttgctg

SEQ ID NO: 6654186 - DNA, 23 bp, Homo sapiens
agttctatggagactttgctgtt

SEQ ID NO: 6654187 - DNA, 13 bp, Homo sapiens
agttctatttcta

SEQ ID NO: 6654188 - DNA, 14 bp, Homo sapiens
agttctatttctat

SEQ ID NO: 6654189 - DNA, 22 bp, Homo sapiens
agttctatttctatcccaaact

SEQ ID NO: 6654190 - DNA, 13 bp, Homo sapiens
agttctatttgct

SEQ ID NO: 6654191 - DNA, 15 bp, Homo sapiens
agttctcaaatgtgt

SEQ ID NO: 6654192 - DNA, 17 bp, Homo sapiens
agttctcaatcactgct

SEQ ID NO: 6654193 - DNA, 15 bp, Homo sapiens
agttctcactatgtt

SEQ ID NO: 6654194 - DNA, 17 bp, Homo sapiens
agttctcactatgtttc

SEQ ID NO: 6654195 - DNA, 19 bp, Homo sapiens
agttctcactgggaagaag

SEQ ID NO: 6654196 - DNA, 18 bp, Homo sapiens
agttctcactgttccctc

SEQ ID NO: 6654197 - DNA, 19 bp, Homo sapiens
agttctcactgttccctct

SEQ ID NO: 6654198 - DNA, 13 bp, Homo sapiens
agttctcagagct

SEQ ID NO: 6654199 - DNA, 20 bp, Homo sapiens
agttctcagagctctcgagg

SEQ ID NO: 6654200 - DNA, 12 bp, Homo sapiens
agttctcagggc

SEQ ID NO: 6654201 - DNA, 18 bp, Homo sapiens
agttctcagggctcctgc

SEQ ID NO: 6654202 - DNA, 23 bp, Homo sapiens
agttctcagggctcctgccttct

SEQ ID NO: 6654203 - DNA, 23 bp, Homo sapiens
agttctcccaacaacatgaaact

SEQ ID NO: 6654204 - DNA, 11 bp, Homo sapiens
agttctcccag

SEQ ID NO: 6654205 - DNA, 13 bp, Homo sapiens
agttctcccaggg

SEQ ID NO: 6654206 - DNA, 15 bp, Homo sapiens
agttctcccagggag

SEQ ID NO: 6654207 - DNA, 21 bp, Homo sapiens
agttctcctggaggcaggggc

SEQ ID NO: 6654208 - DNA, 23 bp, Homo sapiens
agttctcctggaggcaggggctg

SEQ ID NO: 6654209 - DNA, 13 bp, Homo sapiens
agttctccttgta

SEQ ID NO: 6654210 - DNA, 16 bp, Homo sapiens
agttctccttgtactt

SEQ ID NO: 6654211 - DNA, 17 bp, Homo sapiens
agttctccttgtacttg

SEQ ID NO: 6654212 - DNA, 17 bp, Homo sapiens
agttctccttttgaact

SEQ ID NO: 6654213 - DNA, 20 bp, Homo sapiens
agttctccttttgaacttgt

SEQ ID NO: 6654214 - DNA, 23 bp, Homo sapiens
agttctccttttgaacttgtcac

SEQ ID NO: 6654215 - DNA, 14 bp, Homo sapiens
agttctcgtgccct

SEQ ID NO: 6654216 - DNA, 21 bp, Homo sapiens
agttctctcatcggaggccca

SEQ ID NO: 6654217 - DNA, 16 bp, Homo sapiens
agttctctcgaatact

SEQ ID NO: 6654218 - DNA, 17 bp, Homo sapiens
agttctctcgtaactgg

SEQ ID NO: 6654219 - DNA, 16 bp, Homo sapiens
agttctctgggaagtg

SEQ ID NO: 6654220 - DNA, 20 bp, Homo sapiens
agttctctgttctagagtga

SEQ ID NO: 6654221 - DNA, 13 bp, Homo sapiens
agttctgaaaact

SEQ ID NO: 6654222 - DNA, 16 bp, Homo sapiens
agttctgaaaactgtt

SEQ ID NO: 6654223 - DNA, 18 bp, Homo sapiens
agttctgaagaaaaatta

SEQ ID NO: 6654224 - DNA, 13 bp, Homo sapiens
agttctgaagaag

SEQ ID NO: 6654225 - DNA, 13 bp, Homo sapiens
agttctgaagaat

SEQ ID NO: 6654226 - DNA, 20 bp, Homo sapiens
agttctgaaggttggaactg

SEQ ID NO: 6654227 - DNA, 18 bp, Homo sapiens
agttctgacattcatttt

SEQ ID NO: 6654228 - DNA, 21 bp, Homo sapiens
agttctgacccaaccacagag

SEQ ID NO: 6654229 - DNA, 18 bp, Homo sapiens
agttctgacgctgacaat

SEQ ID NO: 6654230 - DNA, 14 bp, Homo sapiens
agttctgacttgac

SEQ ID NO: 6654231 - DNA, 16 bp, Homo sapiens
agttctgactttgaat

SEQ ID NO: 6654232 - DNA, 19 bp, Homo sapiens
agttctgactttgaattta

SEQ ID NO: 6654233 - DNA, 14 bp, Homo sapiens
agttctgagctgta

SEQ ID NO: 6654234 - DNA, 22 bp, Homo sapiens
agttctgatgtcttagtgactt

SEQ ID NO: 6654235 - DNA, 20 bp, Homo sapiens
agttctgattgtgttgaaga

SEQ ID NO: 6654236 - DNA, 15 bp, Homo sapiens
agttctgcaaataga

SEQ ID NO: 6654237 - DNA, 20 bp, Homo sapiens
agttctgcaaatagaaaaca

SEQ ID NO: 6654238 - DNA, 16 bp, Homo sapiens
agttctgcaataacag

SEQ ID NO: 6654239 - DNA, 16 bp, Homo sapiens
agttctgcacatacag

SEQ ID NO: 6654240 - DNA, 17 bp, Homo sapiens
agttctgcacccagcca

SEQ ID NO: 6654241 - DNA, 15 bp, Homo sapiens
agttctgcactccag

SEQ ID NO: 6654242 - DNA, 20 bp, Homo sapiens
agttctgccaggagacaggt

SEQ ID NO: 6654243 - DNA, 23 bp, Homo sapiens
agttctgccaggcaacttttaaa

SEQ ID NO: 6654244 - DNA, 23 bp, Homo sapiens
agttctgctacattataatgtac

SEQ ID NO: 6654245 - DNA, 17 bp, Homo sapiens
agttctgctccagacag

SEQ ID NO: 6654246 - DNA, 14 bp, Homo sapiens
agttctgctcctct

SEQ ID NO: 6654247 - DNA, 15 bp, Homo sapiens
agttctgctcctctc

SEQ ID NO: 6654248 - DNA, 23 bp, Homo sapiens
agttctgctctaagaagctgcaa

SEQ ID NO: 6654249 - DNA, 14 bp, Homo sapiens
agttctgctgccct

SEQ ID NO: 6654250 - DNA, 16 bp, Homo sapiens
agttctgctgccctct

SEQ ID NO: 6654251 - DNA, 14 bp, Homo sapiens
agttctgctgtctc

SEQ ID NO: 6654252 - DNA, 18 bp, Homo sapiens
agttctgctgtctccctg

SEQ ID NO: 6654253 - DNA, 20 bp, Homo sapiens
agttctgctttagctttcca

SEQ ID NO: 6654254 - DNA, 22 bp, Homo sapiens
agttctgctttctgcctctcct

SEQ ID NO: 6654255 - DNA, 15 bp, Homo sapiens
agttctggatgtctg

SEQ ID NO: 6654256 - DNA, 19 bp, Homo sapiens
agttctggatgtctggctc

SEQ ID NO: 6654257 - DNA, 13 bp, Homo sapiens
agttctggcaaga

SEQ ID NO: 6654258 - DNA, 16 bp, Homo sapiens
agttctgggctgattt

SEQ ID NO: 6654259 - DNA, 19 bp, Homo sapiens
agttctggggcccgcctgc

SEQ ID NO: 6654260 - DNA, 20 bp, Homo sapiens
agttctggggcccgcctgcc

SEQ ID NO: 6654261 - DNA, 22 bp, Homo sapiens
agttctggggcccgcctgccac

SEQ ID NO: 6654262 - DNA, 19 bp, Homo sapiens
agttctgggtgctccctac

SEQ ID NO: 6654263 - DNA, 16 bp, Homo sapiens
agttctggtcaaagaa

SEQ ID NO: 6654264 - DNA, 23 bp, Homo sapiens
agttctgtactcaaatgtagcca

SEQ ID NO: 6654265 - DNA, 15 bp, Homo sapiens
agttctgtagaaatg

SEQ ID NO: 6654266 - DNA, 17 bp, Homo sapiens
agttctgtagaaatggt

SEQ ID NO: 6654267 - DNA, 18 bp, Homo sapiens
agttctgtagaaatggtt

SEQ ID NO: 6654268 - DNA, 16 bp, Homo sapiens
agttctgtatttgaaa

SEQ ID NO: 6654269 - DNA, 22 bp, Homo sapiens
agttctgtatttgaaagtgcct

SEQ ID NO: 6654270 - DNA, 23 bp, Homo sapiens
agttctgtatttgaaagtgcctt

SEQ ID NO: 6654271 - DNA, 13 bp, Homo sapiens
agttctgtgaaga

SEQ ID NO: 6654272 - DNA, 14 bp, Homo sapiens
agttctgtgaagag

SEQ ID NO: 6654273 - DNA, 14 bp, Homo sapiens
agttctgtgcagtt

SEQ ID NO: 6654274 - DNA, 18 bp, Homo sapiens
agttctgtgcctcccccc

SEQ ID NO: 6654275 - DNA, 19 bp, Homo sapiens
agttctgtggtttcatgtt

SEQ ID NO: 6654276 - DNA, 20 bp, Homo sapiens
agttctgtgtaaacagaagc

SEQ ID NO: 6654277 - DNA, 17 bp, Homo sapiens
agttctgtgtacatttt

SEQ ID NO: 6654278 - DNA, 14 bp, Homo sapiens
agttctgtgtactt

SEQ ID NO: 6654279 - DNA, 16 bp, Homo sapiens
agttctgtgtagagaa

SEQ ID NO: 6654280 - DNA, 18 bp, Homo sapiens
agttctgtgtagagaatg

SEQ ID NO: 6654281 - DNA, 16 bp, Homo sapiens
agttctgtgtatttaa

SEQ ID NO: 6654282 - DNA, 22 bp, Homo sapiens
agttctgtgtatttaattgtaa

SEQ ID NO: 6654283 - DNA, 12 bp, Homo sapiens
agttctgtgtcc

SEQ ID NO: 6654284 - DNA, 18 bp, Homo sapiens
agttctgtgtcctcgcac

SEQ ID NO: 6654285 - DNA, 22 bp, Homo sapiens
agttctgtgtggtgcattcctg

SEQ ID NO: 6654286 - DNA, 13 bp, Homo sapiens
agttctgttaaat

SEQ ID NO: 6654287 - DNA, 20 bp, Homo sapiens
agttctgttaaatatttttg

SEQ ID NO: 6654288 - DNA, 15 bp, Homo sapiens
agttctgttcatcct

SEQ ID NO: 6654289 - DNA, 15 bp, Homo sapiens
agttctgttttctgt

SEQ ID NO: 6654290 - DNA, 20 bp, Homo sapiens
agttcttaaaaaatttatac

SEQ ID NO: 6654291 - DNA, 16 bp, Homo sapiens
agttcttaaaacacta

SEQ ID NO: 6654292 - DNA, 13 bp, Homo sapiens
agttcttaataca

SEQ ID NO: 6654293 - DNA, 15 bp, Homo sapiens
agttcttacttgagt

SEQ ID NO: 6654294 - DNA, 23 bp, Homo sapiens
agttcttacttgagtatcataat

SEQ ID NO: 6654295 - DNA, 21 bp, Homo sapiens
agttcttagatatctttttat

SEQ ID NO: 6654296 - DNA, 22 bp, Homo sapiens
agttcttagctatccttggctt

SEQ ID NO: 6654297 - DNA, 15 bp, Homo sapiens
agttcttattttagt

SEQ ID NO: 6654298 - DNA, 16 bp, Homo sapiens
agttcttcacctctat

SEQ ID NO: 6654299 - DNA, 21 bp, Homo sapiens
agttcttcatttggaggaatc

SEQ ID NO: 6654300 - DNA, 14 bp, Homo sapiens
agttcttcctgtaa

SEQ ID NO: 6654301 - DNA, 15 bp, Homo sapiens
agttcttcctgtaat

SEQ ID NO: 6654302 - DNA, 19 bp, Homo sapiens
agttcttcgactgttgtta

SEQ ID NO: 6654303 - DNA, 15 bp, Homo sapiens
agttcttcgggaaga

SEQ ID NO: 6654304 - DNA, 15 bp, Homo sapiens
agttcttctatttca

SEQ ID NO: 6654305 - DNA, 13 bp, Homo sapiens
agttcttctccaa

SEQ ID NO: 6654306 - DNA, 13 bp, Homo sapiens
agttcttgcaata

SEQ ID NO: 6654307 - DNA, 22 bp, Homo sapiens
agttcttgccttggctgcagtt

SEQ ID NO: 6654308 - DNA, 14 bp, Homo sapiens
agttcttggaccag

SEQ ID NO: 6654309 - DNA, 22 bp, Homo sapiens
agttcttggcctatgataagtt

SEQ ID NO: 6654310 - DNA, 13 bp, Homo sapiens
agttcttggcctg

SEQ ID NO: 6654311 - DNA, 14 bp, Homo sapiens
agttcttggcctgc

SEQ ID NO: 6654312 - DNA, 19 bp, Homo sapiens
agttcttgggaatcttgga

SEQ ID NO: 6654313 - DNA, 16 bp, Homo sapiens
agttcttgggggaggc

SEQ ID NO: 6654314 - DNA, 23 bp, Homo sapiens
agttcttggtccctccagaacca

SEQ ID NO: 6654315 - DNA, 22 bp, Homo sapiens
agttcttggtgctctgtgttcc

SEQ ID NO: 6654316 - DNA, 22 bp, Homo sapiens
agttcttgtctgattggctcac

SEQ ID NO: 6654317 - DNA, 17 bp, Homo sapiens
agttcttgtgcatgttt

SEQ ID NO: 6654318 - DNA, 12 bp, Homo sapiens
agttcttgtgcc

SEQ ID NO: 6654319 - DNA, 17 bp, Homo sapiens
agttcttgtggaagaca

SEQ ID NO: 6654320 - DNA, 17 bp, Homo sapiens
agttcttgtgtcctggt

SEQ ID NO: 6654321 - DNA, 17 bp, Homo sapiens
agttctttaaaatgtaa

SEQ ID NO: 6654322 - DNA, 16 bp, Homo sapiens
agttctttactggtga

SEQ ID NO: 6654323 - DNA, 19 bp, Homo sapiens
agttctttaggtgcctcct

SEQ ID NO: 6654324 - DNA, 21 bp, Homo sapiens
agttctttaggtgcctcctgt

SEQ ID NO: 6654325 - DNA, 22 bp, Homo sapiens
agttctttaggtgcctcctgtc

SEQ ID NO: 6654326 - DNA, 19 bp, Homo sapiens
agttctttccataataaaa

SEQ ID NO: 6654327 - DNA, 15 bp, Homo sapiens
agttctttcccagcc

SEQ ID NO: 6654328 - DNA, 13 bp, Homo sapiens
agttctttcctcc

SEQ ID NO: 6654329 - DNA, 19 bp, Homo sapiens
agttctttcctccccctgc

SEQ ID NO: 6654330 - DNA, 18 bp, Homo sapiens
agttctttcctctttctg

SEQ ID NO: 6654331 - DNA, 22 bp, Homo sapiens
agttctttcctctttctgctct

SEQ ID NO: 6654332 - DNA, 16 bp, Homo sapiens
agttctttgatttgta

SEQ ID NO: 6654333 - DNA, 19 bp, Homo sapiens
agttctttgatttgtacca

SEQ ID NO: 6654334 - DNA, 23 bp, Homo sapiens
agttctttgatttgtaccattcc

SEQ ID NO: 6654335 - DNA, 18 bp, Homo sapiens
agttctttgctgcccctg

SEQ ID NO: 6654336 - DNA, 20 bp, Homo sapiens
agttctttgctgcccctgtc

SEQ ID NO: 6654337 - DNA, 15 bp, Homo sapiens
agttctttggattct

SEQ ID NO: 6654338 - DNA, 18 bp, Homo sapiens
agttctttgggccagaca

SEQ ID NO: 6654339 - DNA, 22 bp, Homo sapiens
agttctttgttcatagcccagt

SEQ ID NO: 6654340 - DNA, 13 bp, Homo sapiens
agttctttgttcc

SEQ ID NO: 6654341 - DNA, 23 bp, Homo sapiens
agttctttgttcctgctttctct

SEQ ID NO: 6654342 - DNA, 13 bp, Homo sapiens
agttctttttgta

SEQ ID NO: 6654343 - DNA, 14 bp, Homo sapiens
agttgaaaaaggaa

SEQ ID NO: 6654344 - DNA, 19 bp, Homo sapiens
agttgaaaaaggaaatatt

SEQ ID NO: 6654345 - DNA, 16 bp, Homo sapiens
agttgaaaaatctagt

SEQ ID NO: 6654346 - DNA, 21 bp, Homo sapiens
agttgaaaagactccaaagaa

SEQ ID NO: 6654347 - DNA, 14 bp, Homo sapiens
agttgaaaagccaa

SEQ ID NO: 6654348 - DNA, 13 bp, Homo sapiens
agttgaaaataca

SEQ ID NO: 6654349 - DNA, 23 bp, Homo sapiens
agttgaaactgctatagcctaag

SEQ ID NO: 6654350 - DNA, 16 bp, Homo sapiens
agttgaaagtaaaaaa

SEQ ID NO: 6654351 - DNA, 16 bp, Homo sapiens
agttgaaatcagaagc

SEQ ID NO: 6654352 - DNA, 15 bp, Homo sapiens
agttgaacactgtca

SEQ ID NO: 6654353 - DNA, 23 bp, Homo sapiens
agttgaacagagctagaggccat

SEQ ID NO: 6654354 - DNA, 15 bp, Homo sapiens
agttgaaccattata

SEQ ID NO: 6654355 - DNA, 20 bp, Homo sapiens
agttgaaccattatacttta

SEQ ID NO: 6654356 - DNA, 20 bp, Homo sapiens
agttgaactatgactggagt

SEQ ID NO: 6654357 - DNA, 16 bp, Homo sapiens
agttgaagacagagct

SEQ ID NO: 6654358 - DNA, 14 bp, Homo sapiens
agttgaagcaaatc

SEQ ID NO: 6654359 - DNA, 16 bp, Homo sapiens
agttgaagctaagatt

SEQ ID NO: 6654360 - DNA, 13 bp, Homo sapiens
agttgaagggaaa

SEQ ID NO: 6654361 - DNA, 22 bp, Homo sapiens
agttgaagggaaacaaagaagt

SEQ ID NO: 6654362 - DNA, 22 bp, Homo sapiens
agttgaagggaaatcaatttaa

SEQ ID NO: 6654363 - DNA, 18 bp, Homo sapiens
agttgaagggaggtgaag

SEQ ID NO: 6654364 - DNA, 18 bp, Homo sapiens
agttgaaggttaaaggaa

SEQ ID NO: 6654365 - DNA, 14 bp, Homo sapiens
agttgaataaaaat

SEQ ID NO: 6654366 - DNA, 15 bp, Homo sapiens
agttgaataaacata

SEQ ID NO: 6654367 - DNA, 19 bp, Homo sapiens
agttgaatacttgaaccat

SEQ ID NO: 6654368 - DNA, 17 bp, Homo sapiens
agttgaatattatatat

SEQ ID NO: 6654369 - DNA, 15 bp, Homo sapiens
agttgaatggggcgg

SEQ ID NO: 6654370 - DNA, 22 bp, Homo sapiens
agttgaatgttgcaatgtgaaa

SEQ ID NO: 6654371 - DNA, 21 bp, Homo sapiens
agttgaattccaagtgtattt

SEQ ID NO: 6654372 - DNA, 11 bp, Homo sapiens
agttgaattta

SEQ ID NO: 6654373 - DNA, 15 bp, Homo sapiens
agttgaattttacat

SEQ ID NO: 6654374 - DNA, 12 bp, Homo sapiens
agttgaattttt

SEQ ID NO: 6654375 - DNA, 23 bp, Homo sapiens
agttgaattttttctaaaaagaa

SEQ ID NO: 6654376 - DNA, 18 bp, Homo sapiens
agttgaattttttttaac

SEQ ID NO: 6654377 - DNA, 22 bp, Homo sapiens
agttgaattttttttaacattc

SEQ ID NO: 6654378 - DNA, 16 bp, Homo sapiens
agttgacaacctagaa

SEQ ID NO: 6654379 - DNA, 17 bp, Homo sapiens
agttgacaacctagaat

SEQ ID NO: 6654380 - DNA, 15 bp, Homo sapiens
agttgacaattctgc

SEQ ID NO: 6654381 - DNA, 14 bp, Homo sapiens
agttgacagtatta

SEQ ID NO: 6654382 - DNA, 19 bp, Homo sapiens
agttgacatccaaatctag

SEQ ID NO: 6654383 - DNA, 13 bp, Homo sapiens
agttgacatggaa

SEQ ID NO: 6654384 - DNA, 17 bp, Homo sapiens
agttgaccaatgaaatg

SEQ ID NO: 6654385 - DNA, 16 bp, Homo sapiens
agttgaccgttttcat

SEQ ID NO: 6654386 - DNA, 22 bp, Homo sapiens
agttgaccgttttcatcctggc

SEQ ID NO: 6654387 - DNA, 17 bp, Homo sapiens
agttgacgcatcctgca

SEQ ID NO: 6654388 - DNA, 18 bp, Homo sapiens
agttgacgcatcctgcag

SEQ ID NO: 6654389 - DNA, 22 bp, Homo sapiens
agttgacggggcagtcagattt

SEQ ID NO: 6654390 - DNA, 22 bp, Homo sapiens
agttgactgactgagcaggctg

SEQ ID NO: 6654391 - DNA, 21 bp, Homo sapiens
agttgacttactgacaaaagg

SEQ ID NO: 6654392 - DNA, 15 bp, Homo sapiens
agttgacttatagta

SEQ ID NO: 6654393 - DNA, 17 bp, Homo sapiens
agttgacttatagtaca

SEQ ID NO: 6654394 - DNA, 16 bp, Homo sapiens
agttgactttcctccc

SEQ ID NO: 6654395 - DNA, 12 bp, Homo sapiens
agttgacttttt

SEQ ID NO: 6654396 - DNA, 17 bp, Homo sapiens
agttgagaaagtcacag

SEQ ID NO: 6654397 - DNA, 22 bp, Homo sapiens
agttgagaaggtgcctgccata

SEQ ID NO: 6654398 - DNA, 19 bp, Homo sapiens
agttgagactcggccgcag

SEQ ID NO: 6654399 - DNA, 14 bp, Homo sapiens
agttgagagacagt

SEQ ID NO: 6654400 - DNA, 20 bp, Homo sapiens
agttgagattcaaacccagg

SEQ ID NO: 6654401 - DNA, 20 bp, Homo sapiens
agttgagattgtactgttca

SEQ ID NO: 6654402 - DNA, 19 bp, Homo sapiens
agttgagccagcagacatt

SEQ ID NO: 6654403 - DNA, 21 bp, Homo sapiens
agttgagccccaagtcctgaa

SEQ ID NO: 6654404 - DNA, 19 bp, Homo sapiens
agttgagccttcaggccag

SEQ ID NO: 6654405 - DNA, 18 bp, Homo sapiens
agttgagcgtgcgcactg

SEQ ID NO: 6654406 - DNA, 15 bp, Homo sapiens
agttgagctatgact

SEQ ID NO: 6654407 - DNA, 14 bp, Homo sapiens
agttgagctcaggt

SEQ ID NO: 6654408 - DNA, 16 bp, Homo sapiens
agttgaggacttcttg

SEQ ID NO: 6654409 - DNA, 17 bp, Homo sapiens
agttgaggggagaggaa

SEQ ID NO: 6654410 - DNA, 18 bp, Homo sapiens
agttgaggggagaggaaa

SEQ ID NO: 6654411 - DNA, 13 bp, Homo sapiens
agttgaggggctt

SEQ ID NO: 6654412 - DNA, 15 bp, Homo sapiens
agttgaggtctgcgt

SEQ ID NO: 6654413 - DNA, 19 bp, Homo sapiens
agttgagtatattataata

SEQ ID NO: 6654414 - DNA, 23 bp, Homo sapiens
agttgagtatattataatagatt

SEQ ID NO: 6654415 - DNA, 18 bp, Homo sapiens
agttgagtctcctctctg

SEQ ID NO: 6654416 - DNA, 19 bp, Homo sapiens
agttgagtcttcacattta

SEQ ID NO: 6654417 - DNA, 22 bp, Homo sapiens
agttgagtcttcacatttagaa

SEQ ID NO: 6654418 - DNA, 17 bp, Homo sapiens
agttgataaagattttt

SEQ ID NO: 6654419 - DNA, 21 bp, Homo sapiens
agttgataaagattttttaat

SEQ ID NO: 6654420 - DNA, 17 bp, Homo sapiens
agttgataacccctctt

SEQ ID NO: 6654421 - DNA, 23 bp, Homo sapiens
agttgatacttgaataaccatct

SEQ ID NO: 6654422 - DNA, 23 bp, Homo sapiens
agttgatagcacagaccctgccc

SEQ ID NO: 6654423 - DNA, 17 bp, Homo sapiens
agttgataggagacttg

SEQ ID NO: 6654424 - DNA, 15 bp, Homo sapiens
agttgatatagaaca

SEQ ID NO: 6654425 - DNA, 16 bp, Homo sapiens
agttgatatgtaacag

SEQ ID NO: 6654426 - DNA, 17 bp, Homo sapiens
agttgatattcaaggct

SEQ ID NO: 6654427 - DNA, 17 bp, Homo sapiens
agttgatcatgcaggaa

SEQ ID NO: 6654428 - DNA, 21 bp, Homo sapiens
agttgatcgcctttcccaggt

SEQ ID NO: 6654429 - DNA, 14 bp, Homo sapiens
agttgatctgctct

SEQ ID NO: 6654430 - DNA, 16 bp, Homo sapiens
agttgatctgctctgt

SEQ ID NO: 6654431 - DNA, 22 bp, Homo sapiens
agttgatgaccaatctctgtga

SEQ ID NO: 6654432 - DNA, 13 bp, Homo sapiens
agttgatgcatgt

SEQ ID NO: 6654433 - DNA, 15 bp, Homo sapiens
agttgatggagcccc

SEQ ID NO: 6654434 - DNA, 16 bp, Homo sapiens
agttgatgggggccag

SEQ ID NO: 6654435 - DNA, 20 bp, Homo sapiens
agttgattaagaaaggaagt

SEQ ID NO: 6654436 - DNA, 13 bp, Homo sapiens
agttgattagaaa

SEQ ID NO: 6654437 - DNA, 22 bp, Homo sapiens
agttgattagcagttgaggcca

SEQ ID NO: 6654438 - DNA, 16 bp, Homo sapiens
agttgattatttcaac

SEQ ID NO: 6654439 - DNA, 18 bp, Homo sapiens
agttgattcagccctcag

SEQ ID NO: 6654440 - DNA, 17 bp, Homo sapiens
agttgattcagctctgc

SEQ ID NO: 6654441 - DNA, 22 bp, Homo sapiens
agttgattcatattgcatcata

SEQ ID NO: 6654442 - DNA, 18 bp, Homo sapiens
agttgattcatgtgcttg

SEQ ID NO: 6654443 - DNA, 15 bp, Homo sapiens
agttgattctgaatc

SEQ ID NO: 6654444 - DNA, 14 bp, Homo sapiens
agttgattgagaag

SEQ ID NO: 6654445 - DNA, 22 bp, Homo sapiens
agttgattgtacgtagccacag

SEQ ID NO: 6654446 - DNA, 21 bp, Homo sapiens
agttgattttacaattgaaat

SEQ ID NO: 6654447 - DNA, 18 bp, Homo sapiens
agttgattttgaactttt

SEQ ID NO: 6654448 - DNA, 20 bp, Homo sapiens
agttgcaaagtggaattaaa

SEQ ID NO: 6654449 - DNA, 15 bp, Homo sapiens
agttgcaataaaata

SEQ ID NO: 6654450 - DNA, 16 bp, Homo sapiens
agttgcaataaaatag

SEQ ID NO: 6654451 - DNA, 17 bp, Homo sapiens
agttgcaatagaacaga

SEQ ID NO: 6654452 - DNA, 19 bp, Homo sapiens
agttgcaattgaattaaat

SEQ ID NO: 6654453 - DNA, 15 bp, Homo sapiens
agttgcacagcatct

SEQ ID NO: 6654454 - DNA, 16 bp, Homo sapiens
agttgcacagcatctc

SEQ ID NO: 6654455 - DNA, 17 bp, Homo sapiens
agttgcacagcatctca

SEQ ID NO: 6654456 - DNA, 20 bp, Homo sapiens
agttgcacagcatctcagct

SEQ ID NO: 6654457 - DNA, 17 bp, Homo sapiens
agttgcacagctatgaa

SEQ ID NO: 6654458 - DNA, 23 bp, Homo sapiens
agttgcacatgattgtataagca

SEQ ID NO: 6654459 - DNA, 23 bp, Homo sapiens
agttgcacccttccctgtggcct

SEQ ID NO: 6654460 - DNA, 16 bp, Homo sapiens
agttgcacggctgctg

SEQ ID NO: 6654461 - DNA, 17 bp, Homo sapiens
agttgcacggctgctga

SEQ ID NO: 6654462 - DNA, 15 bp, Homo sapiens
agttgcactgatatt

SEQ ID NO: 6654463 - DNA, 23 bp, Homo sapiens
agttgcacttattgaccattttt

SEQ ID NO: 6654464 - DNA, 13 bp, Homo sapiens
agttgcagaaaat

SEQ ID NO: 6654465 - DNA, 14 bp, Homo sapiens
agttgcagaaaatg

SEQ ID NO: 6654466 - DNA, 17 bp, Homo sapiens
agttgcagatgtattga

SEQ ID NO: 6654467 - DNA, 17 bp, Homo sapiens
agttgcagctgatgcct

SEQ ID NO: 6654468 - DNA, 17 bp, Homo sapiens
agttgcagctgttttgt

SEQ ID NO: 6654469 - DNA, 13 bp, Homo sapiens
agttgcagtaaag

SEQ ID NO: 6654470 - DNA, 20 bp, Homo sapiens
agttgcagtctcagaaagcc

SEQ ID NO: 6654471 - DNA, 14 bp, Homo sapiens
agttgcatagagta

SEQ ID NO: 6654472 - DNA, 22 bp, Homo sapiens
agttgcataggtttaataattt

SEQ ID NO: 6654473 - DNA, 18 bp, Homo sapiens
agttgcatgtttttgaaa

SEQ ID NO: 6654474 - DNA, 19 bp, Homo sapiens
agttgcatgtttttgaaaa

SEQ ID NO: 6654475 - DNA, 16 bp, Homo sapiens
agttgcatttagaaat

SEQ ID NO: 6654476 - DNA, 17 bp, Homo sapiens
agttgcatttagaaatc

SEQ ID NO: 6654477 - DNA, 19 bp, Homo sapiens
agttgcatttagcttcttt

SEQ ID NO: 6654478 - DNA, 15 bp, Homo sapiens
agttgcatttgtaaa

SEQ ID NO: 6654479 - DNA, 14 bp, Homo sapiens
agttgcattttaac

SEQ ID NO: 6654480 - DNA, 15 bp, Homo sapiens
agttgcattttcata

SEQ ID NO: 6654481 - DNA, 20 bp, Homo sapiens
agttgccaaagttttgctgt

SEQ ID NO: 6654482 - DNA, 14 bp, Homo sapiens
agttgccaagacaa

SEQ ID NO: 6654483 - DNA, 16 bp, Homo sapiens
agttgccaagacaaat

SEQ ID NO: 6654484 - DNA, 17 bp, Homo sapiens
agttgccaagacaaatc

SEQ ID NO: 6654485 - DNA, 15 bp, Homo sapiens
agttgccaatatgcc

SEQ ID NO: 6654486 - DNA, 22 bp, Homo sapiens
agttgccaatatgccagcttgg

SEQ ID NO: 6654487 - DNA, 18 bp, Homo sapiens
agttgccaatctaaaatg

SEQ ID NO: 6654488 - DNA, 21 bp, Homo sapiens
agttgccaatctaaaatggca

SEQ ID NO: 6654489 - DNA, 19 bp, Homo sapiens
agttgccaccacctctgtg

SEQ ID NO: 6654490 - DNA, 18 bp, Homo sapiens
agttgccattattctatg

SEQ ID NO: 6654491 - DNA, 13 bp, Homo sapiens
agttgcccagagc

SEQ ID NO: 6654492 - DNA, 21 bp, Homo sapiens
agttgcccagagcactttagc

SEQ ID NO: 6654493 - DNA, 14 bp, Homo sapiens
agttgcccagcctc

SEQ ID NO: 6654494 - DNA, 19 bp, Homo sapiens
agttgcccagcctctttcc

SEQ ID NO: 6654495 - DNA, 21 bp, Homo sapiens
agttgcccccattcccagcct

SEQ ID NO: 6654496 - DNA, 22 bp, Homo sapiens
agttgcccccattcccagcctg

SEQ ID NO: 6654497 - DNA, 18 bp, Homo sapiens
agttgccctccaggccga

SEQ ID NO: 6654498 - DNA, 15 bp, Homo sapiens
agttgcctaaatcca

SEQ ID NO: 6654499 - DNA, 16 bp, Homo sapiens
agttgcctaaatccat

SEQ ID NO: 6654500 - DNA, 19 bp, Homo sapiens
agttgcctaaatccatttg

SEQ ID NO: 6654501 - DNA, 22 bp, Homo sapiens
agttgcctaaatccatttggaa

SEQ ID NO: 6654502 - DNA, 13 bp, Homo sapiens
agttgccttttat

SEQ ID NO: 6654503 - DNA, 16 bp, Homo sapiens
agttgcgtggactctg

SEQ ID NO: 6654504 - DNA, 19 bp, Homo sapiens
agttgcgtgtctgtttcct

SEQ ID NO: 6654505 - DNA, 16 bp, Homo sapiens
agttgcgtttaagttg

SEQ ID NO: 6654506 - DNA, 15 bp, Homo sapiens
agttgctaactggga

SEQ ID NO: 6654507 - DNA, 18 bp, Homo sapiens
agttgctagcaacaactt

SEQ ID NO: 6654508 - DNA, 23 bp, Homo sapiens
agttgctatttttgtaaagtttc

SEQ ID NO: 6654509 - DNA, 16 bp, Homo sapiens
agttgctcaaaaagaa

SEQ ID NO: 6654510 - DNA, 15 bp, Homo sapiens
agttgctcactcagg

SEQ ID NO: 6654511 - DNA, 16 bp, Homo sapiens
agttgctcactcagga

SEQ ID NO: 6654512 - DNA, 16 bp, Homo sapiens
agttgctctatgcttt

SEQ ID NO: 6654513 - DNA, 11 bp, Homo sapiens
agttgctctgt

SEQ ID NO: 6654514 - DNA, 19 bp, Homo sapiens
agttgctgatccctgctct

SEQ ID NO: 6654515 - DNA, 16 bp, Homo sapiens
agttgctgcaaacctg

SEQ ID NO: 6654516 - DNA, 16 bp, Homo sapiens
agttgctggaaaatca

SEQ ID NO: 6654517 - DNA, 17 bp, Homo sapiens
agttgctggcatgtctt

SEQ ID NO: 6654518 - DNA, 21 bp, Homo sapiens
agttgctggcatgtcttcatt

SEQ ID NO: 6654519 - DNA, 21 bp, Homo sapiens
agttgctgggattacaggtgt

SEQ ID NO: 6654520 - DNA, 15 bp, Homo sapiens
agttgctggtaaaat

SEQ ID NO: 6654521 - DNA, 18 bp, Homo sapiens
agttgctggtaaaatgaa

SEQ ID NO: 6654522 - DNA, 21 bp, Homo sapiens
agttgctggtaaaatgaagaa

SEQ ID NO: 6654523 - DNA, 22 bp, Homo sapiens
agttgctggttttgaatattaa

SEQ ID NO: 6654524 - DNA, 18 bp, Homo sapiens
agttgctgtaaaatttgt

SEQ ID NO: 6654525 - DNA, 21 bp, Homo sapiens
agttgctgtaagcacctgggc

SEQ ID NO: 6654526 - DNA, 21 bp, Homo sapiens
agttgctgtcagtcttgacct

SEQ ID NO: 6654527 - DNA, 16 bp, Homo sapiens
agttgctgtgaacttt

SEQ ID NO: 6654528 - DNA, 19 bp, Homo sapiens
agttgctgttaatctgatg

SEQ ID NO: 6654529 - DNA, 23 bp, Homo sapiens
agttgcttgctaatatttccaga

SEQ ID NO: 6654530 - DNA, 17 bp, Homo sapiens
agttgctttgccagagc

SEQ ID NO: 6654531 - DNA, 18 bp, Homo sapiens
agttgctttgccagagca

SEQ ID NO: 6654532 - DNA, 20 bp, Homo sapiens
agttgctttgccagagcagg

SEQ ID NO: 6654533 - DNA, 15 bp, Homo sapiens
agttgctttgttaca

SEQ ID NO: 6654534 - DNA, 16 bp, Homo sapiens
agttgcttttttgact

SEQ ID NO: 6654535 - DNA, 13 bp, Homo sapiens
agttggaaacact

SEQ ID NO: 6654536 - DNA, 22 bp, Homo sapiens
agttggaaacactaaatgttaa

SEQ ID NO: 6654537 - DNA, 13 bp, Homo sapiens
agttggaaatatt

SEQ ID NO: 6654538 - DNA, 20 bp, Homo sapiens
agttggaaatcagttgtgaa

SEQ ID NO: 6654539 - DNA, 18 bp, Homo sapiens
agttggaaccgtgtccag

SEQ ID NO: 6654540 - DNA, 23 bp, Homo sapiens
agttggaaccgtgtccagcacag

SEQ ID NO: 6654541 - DNA, 18 bp, Homo sapiens
agttggaagcggtttgca

SEQ ID NO: 6654542 - DNA, 18 bp, Homo sapiens
agttggaaggatctgctg

SEQ ID NO: 6654543 - DNA, 19 bp, Homo sapiens
agttggaaggatctgctga

SEQ ID NO: 6654544 - DNA, 11 bp, Homo sapiens
agttggacagt

SEQ ID NO: 6654545 - DNA, 13 bp, Homo sapiens
agttggactaaat

SEQ ID NO: 6654546 - DNA, 14 bp, Homo sapiens
agttggactaaatg

SEQ ID NO: 6654547 - DNA, 20 bp, Homo sapiens
agttggactaaatgcctagt

SEQ ID NO: 6654548 - DNA, 13 bp, Homo sapiens
agttggactgggt

SEQ ID NO: 6654549 - DNA, 19 bp, Homo sapiens
agttggagaaaatgaagaa

SEQ ID NO: 6654550 - DNA, 14 bp, Homo sapiens
agttggagcagggg

SEQ ID NO: 6654551 - DNA, 20 bp, Homo sapiens
agttggagccgcacatctgg

SEQ ID NO: 6654552 - DNA, 16 bp, Homo sapiens
agttggagctagaaaa

SEQ ID NO: 6654553 - DNA, 16 bp, Homo sapiens
agttggagtagaatgt

SEQ ID NO: 6654554 - DNA, 17 bp, Homo sapiens
agttggagtagaatgta

SEQ ID NO: 6654555 - DNA, 17 bp, Homo sapiens
agttggagtcactctta

SEQ ID NO: 6654556 - DNA, 19 bp, Homo sapiens
agttggagtgagtgtggct

SEQ ID NO: 6654557 - DNA, 19 bp, Homo sapiens
agttggagttcattcatat

SEQ ID NO: 6654558 - DNA, 20 bp, Homo sapiens
agttggagttcattcatatt

SEQ ID NO: 6654559 - DNA, 18 bp, Homo sapiens
agttggagttttattttt

SEQ ID NO: 6654560 - DNA, 23 bp, Homo sapiens
agttggcaagtctcacatattca

SEQ ID NO: 6654561 - DNA, 19 bp, Homo sapiens
agttggcacatttcatgag

SEQ ID NO: 6654562 - DNA, 16 bp, Homo sapiens
agttggcacttctgcc

SEQ ID NO: 6654563 - DNA, 17 bp, Homo sapiens
agttggcacttctgcca

SEQ ID NO: 6654564 - DNA, 21 bp, Homo sapiens
agttggcagaaatacagtctt

SEQ ID NO: 6654565 - DNA, 17 bp, Homo sapiens
agttggcagacagccgt

SEQ ID NO: 6654566 - DNA, 19 bp, Homo sapiens
agttggcagagaaggcctc

SEQ ID NO: 6654567 - DNA, 21 bp, Homo sapiens
agttggcagagaaggcctctt

SEQ ID NO: 6654568 - DNA, 16 bp, Homo sapiens
agttggcatgcatccc

SEQ ID NO: 6654569 - DNA, 17 bp, Homo sapiens
agttggccaaaacttaa

SEQ ID NO: 6654570 - DNA, 15 bp, Homo sapiens
agttggccaagcaga

SEQ ID NO: 6654571 - DNA, 20 bp, Homo sapiens
agttggccagcgtcttgctc

SEQ ID NO: 6654572 - DNA, 12 bp, Homo sapiens
agttggcctctg

SEQ ID NO: 6654573 - DNA, 16 bp, Homo sapiens
agttggcctttttaca

SEQ ID NO: 6654574 - DNA, 15 bp, Homo sapiens
agttggctagaagaa

SEQ ID NO: 6654575 - DNA, 22 bp, Homo sapiens
agttggctagagcttctgtatt

SEQ ID NO: 6654576 - DNA, 11 bp, Homo sapiens
agttggctgga

SEQ ID NO: 6654577 - DNA, 17 bp, Homo sapiens
agttggcttctgtgcct

SEQ ID NO: 6654578 - DNA, 15 bp, Homo sapiens
agttggcttctgttt

SEQ ID NO: 6654579 - DNA, 13 bp, Homo sapiens
agttggctttgct

SEQ ID NO: 6654580 - DNA, 16 bp, Homo sapiens
agttgggaagtctcag

SEQ ID NO: 6654581 - DNA, 22 bp, Homo sapiens
agttgggatgcggggcagagcc

SEQ ID NO: 6654582 - DNA, 12 bp, Homo sapiens
agttgggctggt

SEQ ID NO: 6654583 - DNA, 20 bp, Homo sapiens
agttgggcttgctattctgt

SEQ ID NO: 6654584 - DNA, 15 bp, Homo sapiens
agttggggagaaact

SEQ ID NO: 6654585 - DNA, 16 bp, Homo sapiens
agttggggcagaggag

SEQ ID NO: 6654586 - DNA, 11 bp, Homo sapiens
agttggggccc

SEQ ID NO: 6654587 - DNA, 20 bp, Homo sapiens
agttggggcccagtccttgg

SEQ ID NO: 6654588 - DNA, 15 bp, Homo sapiens
agttggggccctctt

SEQ ID NO: 6654589 - DNA, 12 bp, Homo sapiens
agttggggcggc

SEQ ID NO: 6654590 - DNA, 18 bp, Homo sapiens
agttggggcggcccacgc

SEQ ID NO: 6654591 - DNA, 20 bp, Homo sapiens
agttggggcggcccacgcca

SEQ ID NO: 6654592 - DNA, 18 bp, Homo sapiens
agttggggctcttggctt

SEQ ID NO: 6654593 - DNA, 12 bp, Homo sapiens
agttggggctgc

SEQ ID NO: 6654594 - DNA, 15 bp, Homo sapiens
agttggggctgttca

SEQ ID NO: 6654595 - DNA, 18 bp, Homo sapiens
agttgggggcaggtcagg

SEQ ID NO: 6654596 - DNA, 13 bp, Homo sapiens
agttgggggccag

SEQ ID NO: 6654597 - DNA, 14 bp, Homo sapiens
agttgggggctagg

SEQ ID NO: 6654598 - DNA, 20 bp, Homo sapiens
agttgggggctaggggaggg

SEQ ID NO: 6654599 - DNA, 19 bp, Homo sapiens
agttgggggtattttctaa

SEQ ID NO: 6654600 - DNA, 20 bp, Homo sapiens
agttgggggtgtggctctgc

SEQ ID NO: 6654601 - DNA, 15 bp, Homo sapiens
agttgggtagaaaaa

SEQ ID NO: 6654602 - DNA, 18 bp, Homo sapiens
agttgggtctgaaaggaa

SEQ ID NO: 6654603 - DNA, 15 bp, Homo sapiens
agttgggtgagaaca

SEQ ID NO: 6654604 - DNA, 15 bp, Homo sapiens
agttgggtgtttcca

SEQ ID NO: 6654605 - DNA, 15 bp, Homo sapiens
agttggtaacttttg

SEQ ID NO: 6654606 - DNA, 16 bp, Homo sapiens
agttggtaacttttgt

SEQ ID NO: 6654607 - DNA, 19 bp, Homo sapiens
agttggtattaataaaaag

SEQ ID NO: 6654608 - DNA, 11 bp, Homo sapiens
agttggtcccc

SEQ ID NO: 6654609 - DNA, 22 bp, Homo sapiens
agttggtcttactttgtgcaaa

SEQ ID NO: 6654610 - DNA, 22 bp, Homo sapiens
agttggtcttactttgttaatt

SEQ ID NO: 6654611 - DNA, 23 bp, Homo sapiens
agttggtgaaacccagatcgctg

SEQ ID NO: 6654612 - DNA, 13 bp, Homo sapiens
agttggtgacaga

SEQ ID NO: 6654613 - DNA, 14 bp, Homo sapiens
agttggtgagaaac

SEQ ID NO: 6654614 - DNA, 22 bp, Homo sapiens
agttggtgagaaacctgtatct

SEQ ID NO: 6654615 - DNA, 24 bp, Homo sapiens
agttggtgagaaacctgtatcttt

SEQ ID NO: 6654616 - DNA, 20 bp, Homo sapiens
agttggtgattttagatttc

SEQ ID NO: 6654617 - DNA, 16 bp, Homo sapiens
agttggtggggccagg

SEQ ID NO: 6654618 - DNA, 20 bp, Homo sapiens
agttggtggggccaggccag

SEQ ID NO: 6654619 - DNA, 14 bp, Homo sapiens
agttggtgtctttc

SEQ ID NO: 6654620 - DNA, 13 bp, Homo sapiens
agttggtttgtat

SEQ ID NO: 6654621 - DNA, 15 bp, Homo sapiens
agttggttttgtaaa

SEQ ID NO: 6654622 - DNA, 19 bp, Homo sapiens
agttgtaaacgtcttttta

SEQ ID NO: 6654623 - DNA, 14 bp, Homo sapiens
agttgtaaagaaaa

SEQ ID NO: 6654624 - DNA, 12 bp, Homo sapiens
agttgtaaagta

SEQ ID NO: 6654625 - DNA, 14 bp, Homo sapiens
agttgtaaataatt

SEQ ID NO: 6654626 - DNA, 22 bp, Homo sapiens
agttgtaaataatttatttaat

SEQ ID NO: 6654627 - DNA, 16 bp, Homo sapiens
agttgtaaataatttt

SEQ ID NO: 6654628 - DNA, 17 bp, Homo sapiens
agttgtaaataattttc

SEQ ID NO: 6654629 - DNA, 18 bp, Homo sapiens
agttgtaaataattttct

SEQ ID NO: 6654630 - DNA, 13 bp, Homo sapiens
agttgtaaatata

SEQ ID NO: 6654631 - DNA, 17 bp, Homo sapiens
agttgtaaatatataaa

SEQ ID NO: 6654632 - DNA, 18 bp, Homo sapiens
agttgtaaatatataaat

SEQ ID NO: 6654633 - DNA, 17 bp, Homo sapiens
agttgtaacttatattg

SEQ ID NO: 6654634 - DNA, 16 bp, Homo sapiens
agttgtacaaatgtat

SEQ ID NO: 6654635 - DNA, 17 bp, Homo sapiens
agttgtacaaatgtatt

SEQ ID NO: 6654636 - DNA, 22 bp, Homo sapiens
agttgtacatgaaatttttgta

SEQ ID NO: 6654637 - DNA, 21 bp, Homo sapiens
agttgtacatgataagacatt

SEQ ID NO: 6654638 - DNA, 11 bp, Homo sapiens
agttgtaccaa

SEQ ID NO: 6654639 - DNA, 16 bp, Homo sapiens
agttgtaccaagtgaa

SEQ ID NO: 6654640 - DNA, 19 bp, Homo sapiens
agttgtactgcatcttagt

SEQ ID NO: 6654641 - DNA, 21 bp, Homo sapiens
agttgtactgcatcttagttt

SEQ ID NO: 6654642 - DNA, 19 bp, Homo sapiens
agttgtactttaaaaattt

SEQ ID NO: 6654643 - DNA, 21 bp, Homo sapiens
agttgtagaagaaaatttaat

SEQ ID NO: 6654644 - DNA, 22 bp, Homo sapiens
agttgtagaagaaaatttaatt

SEQ ID NO: 6654645 - DNA, 21 bp, Homo sapiens
agttgtaggcgaatcatttgt

SEQ ID NO: 6654646 - DNA, 22 bp, Homo sapiens
agttgtaggcgaatcatttgtt

SEQ ID NO: 6654647 - DNA, 21 bp, Homo sapiens
agttgtaggggaaatcaaggt

SEQ ID NO: 6654648 - DNA, 22 bp, Homo sapiens
agttgtataaaagttgtactgc

SEQ ID NO: 6654649 - DNA, 23 bp, Homo sapiens
agttgtatcagcacgtgtggcct

SEQ ID NO: 6654650 - DNA, 20 bp, Homo sapiens
agttgtatttaacagaaatt

SEQ ID NO: 6654651 - DNA, 14 bp, Homo sapiens
agttgtcaataaat

SEQ ID NO: 6654652 - DNA, 20 bp, Homo sapiens
agttgtcacagtcttgtgaa

SEQ ID NO: 6654653 - DNA, 14 bp, Homo sapiens
agttgtccagagat

SEQ ID NO: 6654654 - DNA, 20 bp, Homo sapiens
agttgtccatattttcacag

SEQ ID NO: 6654655 - DNA, 20 bp, Homo sapiens
agttgtcccgattgtaactc

SEQ ID NO: 6654656 - DNA, 15 bp, Homo sapiens
agttgtccgtgaaga

SEQ ID NO: 6654657 - DNA, 20 bp, Homo sapiens
agttgtcctatggacaactt

SEQ ID NO: 6654658 - DNA, 21 bp, Homo sapiens
agttgtcctcagccaaggaaa

SEQ ID NO: 6654659 - DNA, 17 bp, Homo sapiens
agttgtcctgatgtttt

SEQ ID NO: 6654660 - DNA, 16 bp, Homo sapiens
agttgtcctgatttct

SEQ ID NO: 6654661 - DNA, 15 bp, Homo sapiens
agttgtcctttctga

SEQ ID NO: 6654662 - DNA, 13 bp, Homo sapiens
agttgtctaaaca

SEQ ID NO: 6654663 - DNA, 22 bp, Homo sapiens
agttgtctaaaggatgagattt

SEQ ID NO: 6654664 - DNA, 14 bp, Homo sapiens
agttgtctctcttc

SEQ ID NO: 6654665 - DNA, 21 bp, Homo sapiens
agttgtctctcttcagactct

SEQ ID NO: 6654666 - DNA, 11 bp, Homo sapiens
agttgtctctg

SEQ ID NO: 6654667 - DNA, 13 bp, Homo sapiens
agttgtctctgat

SEQ ID NO: 6654668 - DNA, 12 bp, Homo sapiens
agttgtctctgt

SEQ ID NO: 6654669 - DNA, 19 bp, Homo sapiens
agttgtctgaattgagaaa

SEQ ID NO: 6654670 - DNA, 20 bp, Homo sapiens
agttgtctgaattgagaaaa

SEQ ID NO: 6654671 - DNA, 18 bp, Homo sapiens
agttgtctgtcctggtca

SEQ ID NO: 6654672 - DNA, 17 bp, Homo sapiens
agttgtcttaaattagt

SEQ ID NO: 6654673 - DNA, 13 bp, Homo sapiens
agttgtcttgtcc

SEQ ID NO: 6654674 - DNA, 14 bp, Homo sapiens
agttgtctttcttt

SEQ ID NO: 6654675 - DNA, 17 bp, Homo sapiens
agttgtgaaagttttga

SEQ ID NO: 6654676 - DNA, 15 bp, Homo sapiens
agttgtgaatacatt

SEQ ID NO: 6654677 - DNA, 18 bp, Homo sapiens
agttgtgacaacttcctg

SEQ ID NO: 6654678 - DNA, 20 bp, Homo sapiens
agttgtgacaacttcctgag

SEQ ID NO: 6654679 - DNA, 19 bp, Homo sapiens
agttgtgagccctctaggg

SEQ ID NO: 6654680 - DNA, 13 bp, Homo sapiens
agttgtgatctgt

SEQ ID NO: 6654681 - DNA, 19 bp, Homo sapiens
agttgtgatggaggggaga

SEQ ID NO: 6654682 - DNA, 13 bp, Homo sapiens
agttgtgattgaa

SEQ ID NO: 6654683 - DNA, 15 bp, Homo sapiens
agttgtgcatgtatg

SEQ ID NO: 6654684 - DNA, 16 bp, Homo sapiens
agttgtgccaaactat

SEQ ID NO: 6654685 - DNA, 17 bp, Homo sapiens
agttgtgcctcatttat

SEQ ID NO: 6654686 - DNA, 15 bp, Homo sapiens
agttgtgcctttcac

SEQ ID NO: 6654687 - DNA, 17 bp, Homo sapiens
agttgtgcctttcacag

SEQ ID NO: 6654688 - DNA, 17 bp, Homo sapiens
agttgtgccttttataa

SEQ ID NO: 6654689 - DNA, 22 bp, Homo sapiens
agttgtgctatatttttaaaga

SEQ ID NO: 6654690 - DNA, 16 bp, Homo sapiens
agttgtgcttttctgt

SEQ ID NO: 6654691 - DNA, 13 bp, Homo sapiens
agttgtggaggag

SEQ ID NO: 6654692 - DNA, 16 bp, Homo sapiens
agttgtggatttcagt

SEQ ID NO: 6654693 - DNA, 22 bp, Homo sapiens
agttgtggcctcattcagcaga

SEQ ID NO: 6654694 - DNA, 17 bp, Homo sapiens
agttgtgggtgggagag

SEQ ID NO: 6654695 - DNA, 14 bp, Homo sapiens
agttgtggtactgt

SEQ ID NO: 6654696 - DNA, 20 bp, Homo sapiens
agttgtggtgctgacaaagc

SEQ ID NO: 6654697 - DNA, 20 bp, Homo sapiens
agttgtggtgtgagtatcag

SEQ ID NO: 6654698 - DNA, 16 bp, Homo sapiens
agttgtgtactctggc

SEQ ID NO: 6654699 - DNA, 18 bp, Homo sapiens
agttgtgtactctggcct

SEQ ID NO: 6654700 - DNA, 20 bp, Homo sapiens
agttgtgtactctggcctct

SEQ ID NO: 6654701 - DNA, 21 bp, Homo sapiens
agttgtgtactctggcctctg

SEQ ID NO: 6654702 - DNA, 16 bp, Homo sapiens
agttgtgtgtatgtgt

SEQ ID NO: 6654703 - DNA, 19 bp, Homo sapiens
agttgtgttaacaatgcag

SEQ ID NO: 6654704 - DNA, 17 bp, Homo sapiens
agttgtgttagcctctt

SEQ ID NO: 6654705 - DNA, 19 bp, Homo sapiens
agttgtgttcatgctgaat

SEQ ID NO: 6654706 - DNA, 23 bp, Homo sapiens
agttgtgtttcaacggaaagtgc

SEQ ID NO: 6654707 - DNA, 19 bp, Homo sapiens
agttgtgttttttaagatg

SEQ ID NO: 6654708 - DNA, 13 bp, Homo sapiens
agttgttaaaaca

SEQ ID NO: 6654709 - DNA, 18 bp, Homo sapiens
agttgttaaaacatttaa

SEQ ID NO: 6654710 - DNA, 15 bp, Homo sapiens
agttgttaacttcta

SEQ ID NO: 6654711 - DNA, 20 bp, Homo sapiens
agttgttacatttttaagtg

SEQ ID NO: 6654712 - DNA, 22 bp, Homo sapiens
agttgttaccaaatacacattt

SEQ ID NO: 6654713 - DNA, 22 bp, Homo sapiens
agttgttaccccaagcgccctg

SEQ ID NO: 6654714 - DNA, 24 bp, Homo sapiens
agttgttaccccaagcgccctggc

SEQ ID NO: 6654715 - DNA, 18 bp, Homo sapiens
agttgttactaactaaac

SEQ ID NO: 6654716 - DNA, 19 bp, Homo sapiens
agttgttactaactaaact

SEQ ID NO: 6654717 - DNA, 19 bp, Homo sapiens
agttgttagtgatttgcta

SEQ ID NO: 6654718 - DNA, 19 bp, Homo sapiens
agttgttcacatatatgta

SEQ ID NO: 6654719 - DNA, 15 bp, Homo sapiens
agttgttctcagggg

SEQ ID NO: 6654720 - DNA, 18 bp, Homo sapiens
agttgttctttttagaaa

SEQ ID NO: 6654721 - DNA, 13 bp, Homo sapiens
agttgttgaaagt

SEQ ID NO: 6654722 - DNA, 14 bp, Homo sapiens
agttgttgaatgac

SEQ ID NO: 6654723 - DNA, 15 bp, Homo sapiens
agttgttgactgtga

SEQ ID NO: 6654724 - DNA, 13 bp, Homo sapiens
agttgttgcattc

SEQ ID NO: 6654725 - DNA, 13 bp, Homo sapiens
agttgttggcctc

SEQ ID NO: 6654726 - DNA, 14 bp, Homo sapiens
agttgttggcctcc

SEQ ID NO: 6654727 - DNA, 19 bp, Homo sapiens
agttgttggcctccggcct

SEQ ID NO: 6654728 - DNA, 17 bp, Homo sapiens
agttgttgtttgccaag

SEQ ID NO: 6654729 - DNA, 14 bp, Homo sapiens
agttgtttaactgt

SEQ ID NO: 6654730 - DNA, 19 bp, Homo sapiens
agttgtttaactgtgcatg

SEQ ID NO: 6654731 - DNA, 10 bp, Homo sapiens
agttgtttat

SEQ ID NO: 6654732 - DNA, 18 bp, Homo sapiens
agttgtttcaaacagcat

SEQ ID NO: 6654733 - DNA, 21 bp, Homo sapiens
agttgtttcaaacagcatcaa

SEQ ID NO: 6654734 - DNA, 13 bp, Homo sapiens
agttgtttcattg

SEQ ID NO: 6654735 - DNA, 17 bp, Homo sapiens
agttgtttcattgattt

SEQ ID NO: 6654736 - DNA, 20 bp, Homo sapiens
agttgtttcctcgctgatcg

SEQ ID NO: 6654737 - DNA, 20 bp, Homo sapiens
agttgtttgggctttaacat

SEQ ID NO: 6654738 - DNA, 20 bp, Homo sapiens
agttgttttatcttttaagt

SEQ ID NO: 6654739 - DNA, 19 bp, Homo sapiens
agttgttttcagactcaga

SEQ ID NO: 6654740 - DNA, 15 bp, Homo sapiens
agttgttttgattat

SEQ ID NO: 6654741 - DNA, 15 bp, Homo sapiens
agttgtttttgtata

SEQ ID NO: 6654742 - DNA, 16 bp, Homo sapiens
agttgtttttgtatat

SEQ ID NO: 6654743 - DNA, 18 bp, Homo sapiens
agttgtttttgtatattg

SEQ ID NO: 6654744 - DNA, 19 bp, Homo sapiens
agttgtttttgtatattgg

SEQ ID NO: 6654745 - DNA, 22 bp, Homo sapiens
agttgtttttgtatattggttt

SEQ ID NO: 6654746 - DNA, 20 bp, Homo sapiens
agtttaaaaaaaaagttggt

SEQ ID NO: 6654747 - DNA, 15 bp, Homo sapiens
agtttaaaaaaataa

SEQ ID NO: 6654748 - DNA, 17 bp, Homo sapiens
agtttaaaaaaataaca

SEQ ID NO: 6654749 - DNA, 14 bp, Homo sapiens
agtttaaaaaaatt

SEQ ID NO: 6654750 - DNA, 19 bp, Homo sapiens
agtttaaaaaacagaaaaa

SEQ ID NO: 6654751 - DNA, 20 bp, Homo sapiens
agtttaaaaaataacttcat

SEQ ID NO: 6654752 - DNA, 13 bp, Homo sapiens
agtttaaaaatat

SEQ ID NO: 6654753 - DNA, 15 bp, Homo sapiens
agtttaaaaatatta

SEQ ID NO: 6654754 - DNA, 15 bp, Homo sapiens
agtttaaaaatattc

SEQ ID NO: 6654755 - DNA, 16 bp, Homo sapiens
agtttaaaaatcaact

SEQ ID NO: 6654756 - DNA, 19 bp, Homo sapiens
agtttaaaaatcaactttt

SEQ ID NO: 6654757 - DNA, 15 bp, Homo sapiens
agtttaaaaatctgc

SEQ ID NO: 6654758 - DNA, 18 bp, Homo sapiens
agtttaaaacagaagcct

SEQ ID NO: 6654759 - DNA, 16 bp, Homo sapiens
agtttaaaacagtatt

SEQ ID NO: 6654760 - DNA, 17 bp, Homo sapiens
agtttaaaacagtattt

SEQ ID NO: 6654761 - DNA, 15 bp, Homo sapiens
agtttaaaagccatg

SEQ ID NO: 6654762 - DNA, 16 bp, Homo sapiens
agtttaaacaaaaaac

SEQ ID NO: 6654763 - DNA, 16 bp, Homo sapiens
agtttaaagagaaaag

SEQ ID NO: 6654764 - DNA, 23 bp, Homo sapiens
agtttaaagcatctgtaaatttg

SEQ ID NO: 6654765 - DNA, 18 bp, Homo sapiens
agtttaaagttgcacatg

SEQ ID NO: 6654766 - DNA, 19 bp, Homo sapiens
agtttaaagttgcacatga

SEQ ID NO: 6654767 - DNA, 13 bp, Homo sapiens
agtttaaatacca

SEQ ID NO: 6654768 - DNA, 14 bp, Homo sapiens
agtttaaataccag

SEQ ID NO: 6654769 - DNA, 19 bp, Homo sapiens
agtttaaatctttgttaaa

SEQ ID NO: 6654770 - DNA, 16 bp, Homo sapiens
agtttaaatgagacta

SEQ ID NO: 6654771 - DNA, 14 bp, Homo sapiens
agtttaaattgtaa

SEQ ID NO: 6654772 - DNA, 17 bp, Homo sapiens
agtttaaattgtaatag

SEQ ID NO: 6654773 - DNA, 20 bp, Homo sapiens
agtttaaattgtaataggcg

SEQ ID NO: 6654774 - DNA, 13 bp, Homo sapiens
agtttaacaaatg

SEQ ID NO: 6654775 - DNA, 17 bp, Homo sapiens
agtttaacaagtattta

SEQ ID NO: 6654776 - DNA, 12 bp, Homo sapiens
agtttaacagaa

SEQ ID NO: 6654777 - DNA, 17 bp, Homo sapiens
agtttaacagagttttc

SEQ ID NO: 6654778 - DNA, 16 bp, Homo sapiens
agtttaacagatattt

SEQ ID NO: 6654779 - DNA, 18 bp, Homo sapiens
agtttaacttccactgtt

SEQ ID NO: 6654780 - DNA, 19 bp, Homo sapiens
agtttaacttccactgtta

SEQ ID NO: 6654781 - DNA, 20 bp, Homo sapiens
agtttaacttccactgttaa

SEQ ID NO: 6654782 - DNA, 19 bp, Homo sapiens
agtttaactttgggcccag

SEQ ID NO: 6654783 - DNA, 18 bp, Homo sapiens
agtttaagacaccaaata

SEQ ID NO: 6654784 - DNA, 18 bp, Homo sapiens
agtttaagtaattgccta

SEQ ID NO: 6654785 - DNA, 14 bp, Homo sapiens
agtttaagtctcct

SEQ ID NO: 6654786 - DNA, 17 bp, Homo sapiens
agtttaatactcagagg

SEQ ID NO: 6654787 - DNA, 16 bp, Homo sapiens
agtttaatattaaagc

SEQ ID NO: 6654788 - DNA, 22 bp, Homo sapiens
agtttaatccttctagtttccc

SEQ ID NO: 6654789 - DNA, 12 bp, Homo sapiens
agtttaatgaag

SEQ ID NO: 6654790 - DNA, 23 bp, Homo sapiens
agtttaatgcaagagaacatttt

SEQ ID NO: 6654791 - DNA, 20 bp, Homo sapiens
agtttaatggtgccttcatt

SEQ ID NO: 6654792 - DNA, 15 bp, Homo sapiens
agtttaattgactta

SEQ ID NO: 6654793 - DNA, 18 bp, Homo sapiens
agtttaattgacttattt

SEQ ID NO: 6654794 - DNA, 15 bp, Homo sapiens
agtttacaaacaaga

SEQ ID NO: 6654795 - DNA, 14 bp, Homo sapiens
agtttacaacttga

SEQ ID NO: 6654796 - DNA, 23 bp, Homo sapiens
agtttacaacttgattttttcaa

SEQ ID NO: 6654797 - DNA, 15 bp, Homo sapiens
agtttacaagaaata

SEQ ID NO: 6654798 - DNA, 16 bp, Homo sapiens
agtttacaagaaataa

SEQ ID NO: 6654799 - DNA, 22 bp, Homo sapiens
agtttacaagaaataaatctat

SEQ ID NO: 6654800 - DNA, 16 bp, Homo sapiens
agtttacaagtgtata

SEQ ID NO: 6654801 - DNA, 23 bp, Homo sapiens
agtttacaagtgtatatcagaaa

SEQ ID NO: 6654802 - DNA, 19 bp, Homo sapiens
agtttacagaaaaatcttg

SEQ ID NO: 6654803 - DNA, 14 bp, Homo sapiens
agtttacagatgtt

SEQ ID NO: 6654804 - DNA, 18 bp, Homo sapiens
agtttacagtaaataaat

SEQ ID NO: 6654805 - DNA, 20 bp, Homo sapiens
agtttacagtaaataaattg

SEQ ID NO: 6654806 - DNA, 22 bp, Homo sapiens
agtttacagtaaataaattgtt

SEQ ID NO: 6654807 - DNA, 13 bp, Homo sapiens
agtttacagtatt

SEQ ID NO: 6654808 - DNA, 14 bp, Homo sapiens
agtttacagtattt

SEQ ID NO: 6654809 - DNA, 22 bp, Homo sapiens
agtttacatcatttttgtatct

SEQ ID NO: 6654810 - DNA, 19 bp, Homo sapiens
agtttacatgataaaaaga

SEQ ID NO: 6654811 - DNA, 20 bp, Homo sapiens
agtttacattgtcctgtagc

SEQ ID NO: 6654812 - DNA, 12 bp, Homo sapiens
agtttacatttt

SEQ ID NO: 6654813 - DNA, 14 bp, Homo sapiens
agtttaccaatcaa

SEQ ID NO: 6654814 - DNA, 16 bp, Homo sapiens
agtttaccaatcaaca

SEQ ID NO: 6654815 - DNA, 20 bp, Homo sapiens
agtttaccaatcaacagcat

SEQ ID NO: 6654816 - DNA, 12 bp, Homo sapiens
agtttaccatct

SEQ ID NO: 6654817 - DNA, 16 bp, Homo sapiens
agtttaccatctgaaa

SEQ ID NO: 6654818 - DNA, 16 bp, Homo sapiens
agtttaccatttgtaa

SEQ ID NO: 6654819 - DNA, 19 bp, Homo sapiens
agtttaccatttgtaataa

SEQ ID NO: 6654820 - DNA, 21 bp, Homo sapiens
agtttacctcatccatgcact

SEQ ID NO: 6654821 - DNA, 23 bp, Homo sapiens
agtttacctcatccatgcacttt

SEQ ID NO: 6654822 - DNA, 15 bp, Homo sapiens
agtttactgatgaaa

SEQ ID NO: 6654823 - DNA, 18 bp, Homo sapiens
agtttacttcactttcat

SEQ ID NO: 6654824 - DNA, 19 bp, Homo sapiens
agtttacttgtctttgatt

SEQ ID NO: 6654825 - DNA, 19 bp, Homo sapiens
agtttagaaattacaagtt

SEQ ID NO: 6654826 - DNA, 23 bp, Homo sapiens
agtttagaaattacaagtttcag

SEQ ID NO: 6654827 - DNA, 20 bp, Homo sapiens
agtttagaacctacaaaagc

SEQ ID NO: 6654828 - DNA, 16 bp, Homo sapiens
agtttagaagcgctca

SEQ ID NO: 6654829 - DNA, 14 bp, Homo sapiens
agtttagaggaaaa

SEQ ID NO: 6654830 - DNA, 23 bp, Homo sapiens
agtttagatcccatgtcacctca

SEQ ID NO: 6654831 - DNA, 14 bp, Homo sapiens
agtttagcccatct

SEQ ID NO: 6654832 - DNA, 22 bp, Homo sapiens
agtttagccctgaacatttcat

SEQ ID NO: 6654833 - DNA, 16 bp, Homo sapiens
agtttagctggaaaag

SEQ ID NO: 6654834 - DNA, 22 bp, Homo sapiens
agtttaggaattggaggctgca

SEQ ID NO: 6654835 - DNA, 14 bp, Homo sapiens
agtttaggagaaac

SEQ ID NO: 6654836 - DNA, 16 bp, Homo sapiens
agtttaggcctatcaa

SEQ ID NO: 6654837 - DNA, 18 bp, Homo sapiens
agtttagggaacaatttg

SEQ ID NO: 6654838 - DNA, 12 bp, Homo sapiens
agtttagggtgg

SEQ ID NO: 6654839 - DNA, 20 bp, Homo sapiens
agtttagtcgtctaaacata

SEQ ID NO: 6654840 - DNA, 14 bp, Homo sapiens
agtttagtgcatct

SEQ ID NO: 6654841 - DNA, 20 bp, Homo sapiens
agtttagtgtgataaaggca

SEQ ID NO: 6654842 - DNA, 20 bp, Homo sapiens
agtttagtgtgtgtgcagag

SEQ ID NO: 6654843 - DNA, 19 bp, Homo sapiens
agtttagttctgttgacct

SEQ ID NO: 6654844 - DNA, 12 bp, Homo sapiens
agtttataaagc

SEQ ID NO: 6654845 - DNA, 18 bp, Homo sapiens
agtttatacagtgtacat

SEQ ID NO: 6654846 - DNA, 16 bp, Homo sapiens
agtttatactcacctt

SEQ ID NO: 6654847 - DNA, 22 bp, Homo sapiens
agtttatatatatgctactttt

SEQ ID NO: 6654848 - DNA, 22 bp, Homo sapiens
agtttatatttgaatatccatt

SEQ ID NO: 6654849 - DNA, 18 bp, Homo sapiens
agtttatcagtaaataac

SEQ ID NO: 6654850 - DNA, 14 bp, Homo sapiens
agtttatcatgaag

SEQ ID NO: 6654851 - DNA, 15 bp, Homo sapiens
agtttatcattcaag

SEQ ID NO: 6654852 - DNA, 17 bp, Homo sapiens
agtttatcattcaagtg

SEQ ID NO: 6654853 - DNA, 16 bp, Homo sapiens
agtttatccaaatctt

SEQ ID NO: 6654854 - DNA, 17 bp, Homo sapiens
agtttatccaaatcttg

SEQ ID NO: 6654855 - DNA, 19 bp, Homo sapiens
agtttatcctgacatattc

SEQ ID NO: 6654856 - DNA, 20 bp, Homo sapiens
agtttatctatcggaagaac

SEQ ID NO: 6654857 - DNA, 15 bp, Homo sapiens
agtttatcttaagca

SEQ ID NO: 6654858 - DNA, 21 bp, Homo sapiens
agtttatcttaagcatgtcaa

SEQ ID NO: 6654859 - DNA, 22 bp, Homo sapiens
agtttatggatatgctgcttta

SEQ ID NO: 6654860 - DNA, 17 bp, Homo sapiens
agtttatggcaaagatt

SEQ ID NO: 6654861 - DNA, 17 bp, Homo sapiens
agtttatggcagaaggg

SEQ ID NO: 6654862 - DNA, 21 bp, Homo sapiens
agtttattatagtctgtactt

SEQ ID NO: 6654863 - DNA, 19 bp, Homo sapiens
agtttattattgtacttta

SEQ ID NO: 6654864 - DNA, 14 bp, Homo sapiens
agtttattcagtaa

SEQ ID NO: 6654865 - DNA, 17 bp, Homo sapiens
agtttattcagtaaaca

SEQ ID NO: 6654866 - DNA, 16 bp, Homo sapiens
agtttattccagagct

SEQ ID NO: 6654867 - DNA, 16 bp, Homo sapiens
agtttattctcatttg

SEQ ID NO: 6654868 - DNA, 12 bp, Homo sapiens
agtttattctgt

SEQ ID NO: 6654869 - DNA, 15 bp, Homo sapiens
agtttattctgtggt

SEQ ID NO: 6654870 - DNA, 19 bp, Homo sapiens
agtttattgatattcaata

SEQ ID NO: 6654871 - DNA, 12 bp, Homo sapiens
agtttatttcat

SEQ ID NO: 6654872 - DNA, 13 bp, Homo sapiens
agtttatttccac

SEQ ID NO: 6654873 - DNA, 12 bp, Homo sapiens
agtttatttctg

SEQ ID NO: 6654874 - DNA, 18 bp, Homo sapiens
agtttatttctgtgaaag

SEQ ID NO: 6654875 - DNA, 15 bp, Homo sapiens
agtttatttgagaaa

SEQ ID NO: 6654876 - DNA, 19 bp, Homo sapiens
agtttatttgagaaaatat

SEQ ID NO: 6654877 - DNA, 23 bp, Homo sapiens
agtttatttgagaaaatataata

SEQ ID NO: 6654878 - DNA, 13 bp, Homo sapiens
agtttatttgttg

SEQ ID NO: 6654879 - DNA, 16 bp, Homo sapiens
agtttattttaaaaca

SEQ ID NO: 6654880 - DNA, 16 bp, Homo sapiens
agtttatttttcacac

SEQ ID NO: 6654881 - DNA, 16 bp, Homo sapiens
agtttattttttctac

SEQ ID NO: 6654882 - DNA, 19 bp, Homo sapiens
agtttattttttctacaca

SEQ ID NO: 6654883 - DNA, 22 bp, Homo sapiens
agtttatttttttgatggctaa

SEQ ID NO: 6654884 - DNA, 17 bp, Homo sapiens
agtttattttttttaat

SEQ ID NO: 6654885 - DNA, 15 bp, Homo sapiens
agtttcaaaaactgt

SEQ ID NO: 6654886 - DNA, 15 bp, Homo sapiens
agtttcaaaaatctg

SEQ ID NO: 6654887 - DNA, 16 bp, Homo sapiens
agtttcaaaaatctga

SEQ ID NO: 6654888 - DNA, 12 bp, Homo sapiens
agtttcaaaggc

SEQ ID NO: 6654889 - DNA, 16 bp, Homo sapiens
agtttcaaatctgtaa

SEQ ID NO: 6654890 - DNA, 13 bp, Homo sapiens
agtttcaaatgag

SEQ ID NO: 6654891 - DNA, 19 bp, Homo sapiens
agtttcaacactagcattt

SEQ ID NO: 6654892 - DNA, 22 bp, Homo sapiens
agtttcaagtatccttgttgac

SEQ ID NO: 6654893 - DNA, 21 bp, Homo sapiens
agtttcaataaagtttgatct

SEQ ID NO: 6654894 - DNA, 23 bp, Homo sapiens
agtttcaataaagtttgatcttc

SEQ ID NO: 6654895 - DNA, 12 bp, Homo sapiens
agtttcaatgtg

SEQ ID NO: 6654896 - DNA, 20 bp, Homo sapiens
agtttcaattgagtaattct

SEQ ID NO: 6654897 - DNA, 14 bp, Homo sapiens
agtttcaatttgtt

SEQ ID NO: 6654898 - DNA, 14 bp, Homo sapiens
agtttcacaacaga

SEQ ID NO: 6654899 - DNA, 12 bp, Homo sapiens
agtttcaccatg

SEQ ID NO: 6654900 - DNA, 22 bp, Homo sapiens
agtttcacctctttgctccctg

SEQ ID NO: 6654901 - DNA, 20 bp, Homo sapiens
agtttcacgtaaatattcat

SEQ ID NO: 6654902 - DNA, 19 bp, Homo sapiens
agtttcactgtactgcatg

SEQ ID NO: 6654903 - DNA, 20 bp, Homo sapiens
agtttcacttttgttgccca

SEQ ID NO: 6654904 - DNA, 13 bp, Homo sapiens
agtttcagaaatt

SEQ ID NO: 6654905 - DNA, 21 bp, Homo sapiens
agtttcagaaattctcaaaat

SEQ ID NO: 6654906 - DNA, 13 bp, Homo sapiens
agtttcagaagca

SEQ ID NO: 6654907 - DNA, 19 bp, Homo sapiens
agtttcagaagcaggcagg

SEQ ID NO: 6654908 - DNA, 14 bp, Homo sapiens
agtttcagaagtac

SEQ ID NO: 6654909 - DNA, 17 bp, Homo sapiens
agtttcagaataaaatt

SEQ ID NO: 6654910 - DNA, 19 bp, Homo sapiens
agtttcagaataaaattag

SEQ ID NO: 6654911 - DNA, 14 bp, Homo sapiens
agtttcagagatgg

SEQ ID NO: 6654912 - DNA, 21 bp, Homo sapiens
agtttcagagatggacagaga

SEQ ID NO: 6654913 - DNA, 16 bp, Homo sapiens
agtttcagagttctca

SEQ ID NO: 6654914 - DNA, 16 bp, Homo sapiens
agtttcagataaatca

SEQ ID NO: 6654915 - DNA, 19 bp, Homo sapiens
agtttcagataaatcatgg

SEQ ID NO: 6654916 - DNA, 21 bp, Homo sapiens
agtttcagataaatcatgggc

SEQ ID NO: 6654917 - DNA, 15 bp, Homo sapiens
agtttcagatatata

SEQ ID NO: 6654918 - DNA, 23 bp, Homo sapiens
agtttcagatatatatcatattg

SEQ ID NO: 6654919 - DNA, 23 bp, Homo sapiens
agtttcagcggtgccaacctctt

SEQ ID NO: 6654920 - DNA, 14 bp, Homo sapiens
agtttcagctttct

SEQ ID NO: 6654921 - DNA, 20 bp, Homo sapiens
agtttcaggcaaggcagctc

SEQ ID NO: 6654922 - DNA, 19 bp, Homo sapiens
agtttcaggcttttatgag

SEQ ID NO: 6654923 - DNA, 14 bp, Homo sapiens
agtttcaggtgaca

SEQ ID NO: 6654924 - DNA, 17 bp, Homo sapiens
agtttcaggtgacatgt

SEQ ID NO: 6654925 - DNA, 20 bp, Homo sapiens
agtttcaggtgacatgtgaa

SEQ ID NO: 6654926 - DNA, 13 bp, Homo sapiens
agtttcagtaata

SEQ ID NO: 6654927 - DNA, 14 bp, Homo sapiens
agtttcagtaatag

SEQ ID NO: 6654928 - DNA, 17 bp, Homo sapiens
agtttcagtaatagctg

SEQ ID NO: 6654929 - DNA, 23 bp, Homo sapiens
agtttcagtaatagctgaacctg

SEQ ID NO: 6654930 - DNA, 19 bp, Homo sapiens
agtttcagtttgttggaaa

SEQ ID NO: 6654931 - DNA, 15 bp, Homo sapiens
agtttcatctggttg

SEQ ID NO: 6654932 - DNA, 16 bp, Homo sapiens
agtttcatgtaaagaa

SEQ ID NO: 6654933 - DNA, 15 bp, Homo sapiens
agtttcatgtacaag

SEQ ID NO: 6654934 - DNA, 18 bp, Homo sapiens
agtttcatgtacaagatg

SEQ ID NO: 6654935 - DNA, 16 bp, Homo sapiens
agtttcatgtatgtat

SEQ ID NO: 6654936 - DNA, 16 bp, Homo sapiens
agtttcatgtgagttt

SEQ ID NO: 6654937 - DNA, 18 bp, Homo sapiens
agtttcatgttatgcctg

SEQ ID NO: 6654938 - DNA, 13 bp, Homo sapiens
agtttcattcaac

SEQ ID NO: 6654939 - DNA, 17 bp, Homo sapiens
agtttcattctcctgcc

SEQ ID NO: 6654940 - DNA, 20 bp, Homo sapiens
agtttcatttttcattttct

SEQ ID NO: 6654941 - DNA, 15 bp, Homo sapiens
agtttccaagcaaat

SEQ ID NO: 6654942 - DNA, 19 bp, Homo sapiens
agtttccaagcaaatgtta

SEQ ID NO: 6654943 - DNA, 16 bp, Homo sapiens
agtttccagaaaagaa

SEQ ID NO: 6654944 - DNA, 16 bp, Homo sapiens
agtttccagagagtgg

SEQ ID NO: 6654945 - DNA, 19 bp, Homo sapiens
agtttccagctaagcctga

SEQ ID NO: 6654946 - DNA, 15 bp, Homo sapiens
agtttccagctgctc

SEQ ID NO: 6654947 - DNA, 17 bp, Homo sapiens
agtttccagtctcaaaa

SEQ ID NO: 6654948 - DNA, 12 bp, Homo sapiens
agtttccagtgg

SEQ ID NO: 6654949 - DNA, 21 bp, Homo sapiens
agtttcccaaaaaccccagtg

SEQ ID NO: 6654950 - DNA, 17 bp, Homo sapiens
agtttccccaccagtga

SEQ ID NO: 6654951 - DNA, 12 bp, Homo sapiens
agtttcccctct

SEQ ID NO: 6654952 - DNA, 14 bp, Homo sapiens
agtttcccctctcg

SEQ ID NO: 6654953 - DNA, 18 bp, Homo sapiens
agtttcccctctggcttg

SEQ ID NO: 6654954 - DNA, 16 bp, Homo sapiens
agtttccctctgtata

SEQ ID NO: 6654955 - DNA, 11 bp, Homo sapiens
agtttcccttc

SEQ ID NO: 6654956 - DNA, 20 bp, Homo sapiens
agtttccgaatctctttccc

SEQ ID NO: 6654957 - DNA, 17 bp, Homo sapiens
agtttcctcaggctgct

SEQ ID NO: 6654958 - DNA, 23 bp, Homo sapiens
agtttcctcaggctgctggagga

SEQ ID NO: 6654959 - DNA, 15 bp, Homo sapiens
agtttcctcagtgat

SEQ ID NO: 6654960 - DNA, 19 bp, Homo sapiens
agtttcctcagtgatggaa

SEQ ID NO: 6654961 - DNA, 17 bp, Homo sapiens
agtttcctcatctgcag

SEQ ID NO: 6654962 - DNA, 16 bp, Homo sapiens
agtttcctgaagcatt

SEQ ID NO: 6654963 - DNA, 21 bp, Homo sapiens
agtttcctgaagcatttagtt

SEQ ID NO: 6654964 - DNA, 22 bp, Homo sapiens
agtttcctgagggttttctcat

SEQ ID NO: 6654965 - DNA, 24 bp, Homo sapiens
agtttcctgagggttttctcataa

SEQ ID NO: 6654966 - DNA, 13 bp, Homo sapiens
agtttcctgcctt

SEQ ID NO: 6654967 - DNA, 12 bp, Homo sapiens
agtttcctggag

SEQ ID NO: 6654968 - DNA, 15 bp, Homo sapiens
agtttccttggctgg

SEQ ID NO: 6654969 - DNA, 18 bp, Homo sapiens
agtttccttttaattcta

SEQ ID NO: 6654970 - DNA, 20 bp, Homo sapiens
agtttcgtttctgtttttta

SEQ ID NO: 6654971 - DNA, 18 bp, Homo sapiens
agtttctaaccaaagagt

SEQ ID NO: 6654972 - DNA, 16 bp, Homo sapiens
agtttctaacttacaa

SEQ ID NO: 6654973 - DNA, 20 bp, Homo sapiens
agtttctaagattctaaagg

SEQ ID NO: 6654974 - DNA, 12 bp, Homo sapiens
agtttctaaggt

SEQ ID NO: 6654975 - DNA, 23 bp, Homo sapiens
agtttctaaggtccggtgttcta

SEQ ID NO: 6654976 - DNA, 18 bp, Homo sapiens
agtttctacattctctat

SEQ ID NO: 6654977 - DNA, 18 bp, Homo sapiens
agtttctagaggcctcag

SEQ ID NO: 6654978 - DNA, 17 bp, Homo sapiens
agtttctaggagcacaa

SEQ ID NO: 6654979 - DNA, 17 bp, Homo sapiens
agtttctagtgtcactg

SEQ ID NO: 6654980 - DNA, 21 bp, Homo sapiens
agtttctatagcgagacatag

SEQ ID NO: 6654981 - DNA, 13 bp, Homo sapiens
agtttctattctg

SEQ ID NO: 6654982 - DNA, 21 bp, Homo sapiens
agtttctattctgtcagtgtt

SEQ ID NO: 6654983 - DNA, 15 bp, Homo sapiens
agtttctattgtaaa

SEQ ID NO: 6654984 - DNA, 11 bp, Homo sapiens
agtttctattt

SEQ ID NO: 6654985 - DNA, 18 bp, Homo sapiens
agtttctcagatccttgt

SEQ ID NO: 6654986 - DNA, 13 bp, Homo sapiens
agtttctcagctc

SEQ ID NO: 6654987 - DNA, 21 bp, Homo sapiens
agtttctcagctcccatttct

SEQ ID NO: 6654988 - DNA, 12 bp, Homo sapiens
agtttctccttg

SEQ ID NO: 6654989 - DNA, 11 bp, Homo sapiens
agtttctctaa

SEQ ID NO: 6654990 - DNA, 14 bp, Homo sapiens
agtttctctgcctt

SEQ ID NO: 6654991 - DNA, 19 bp, Homo sapiens
agtttctgagttttaccaa

SEQ ID NO: 6654992 - DNA, 16 bp, Homo sapiens
agtttctgcctgggca

SEQ ID NO: 6654993 - DNA, 17 bp, Homo sapiens
agtttctgcctgggcaa

SEQ ID NO: 6654994 - DNA, 16 bp, Homo sapiens
agtttctggagcaaga

SEQ ID NO: 6654995 - DNA, 20 bp, Homo sapiens
agtttctgggtcttctggga

SEQ ID NO: 6654996 - DNA, 19 bp, Homo sapiens
agtttctgtaattggcttt

SEQ ID NO: 6654997 - DNA, 17 bp, Homo sapiens
agtttctgtcctgctgg

SEQ ID NO: 6654998 - DNA, 20 bp, Homo sapiens
agtttctgtcgttaaaaaca

SEQ ID NO: 6654999 - DNA, 22 bp, Homo sapiens
agtttctgtcgttaaaaacaga

SEQ ID NO: 6655000 - DNA, 13 bp, Homo sapiens
agtttctgtggtt

SEQ ID NO: 6655001 - DNA, 17 bp, Homo sapiens
agtttctgtggttggct

SEQ ID NO: 6655002 - DNA, 23 bp, Homo sapiens
agtttctgtggttggctgggaaa

SEQ ID NO: 6655003 - DNA, 13 bp, Homo sapiens
agtttctgttctg

SEQ ID NO: 6655004 - DNA, 15 bp, Homo sapiens
agtttctgttctgtg

SEQ ID NO: 6655005 - DNA, 17 bp, Homo sapiens
agtttctgttctgtgga

SEQ ID NO: 6655006 - DNA, 19 bp, Homo sapiens
agtttctgttctgtggaaa

SEQ ID NO: 6655007 - DNA, 17 bp, Homo sapiens
agtttctgttgtttctt

SEQ ID NO: 6655008 - DNA, 14 bp, Homo sapiens
agtttctgtttgat

SEQ ID NO: 6655009 - DNA, 18 bp, Homo sapiens
agtttctgtttgattctt

SEQ ID NO: 6655010 - DNA, 23 bp, Homo sapiens
agtttcttaaactgaaagcttta

SEQ ID NO: 6655011 - DNA, 16 bp, Homo sapiens
agtttcttaatgagat

SEQ ID NO: 6655012 - DNA, 17 bp, Homo sapiens
agtttcttagcttttta

SEQ ID NO: 6655013 - DNA, 20 bp, Homo sapiens
agtttcttcatgcattactt

SEQ ID NO: 6655014 - DNA, 18 bp, Homo sapiens
agtttcttccttttttct

SEQ ID NO: 6655015 - DNA, 21 bp, Homo sapiens
agtttcttgcaagctccagta

SEQ ID NO: 6655016 - DNA, 16 bp, Homo sapiens
agtttcttggtaaagt

SEQ ID NO: 6655017 - DNA, 19 bp, Homo sapiens
agtttcttggtctcagctt

SEQ ID NO: 6655018 - DNA, 20 bp, Homo sapiens
agtttcttggtctcagcttc

SEQ ID NO: 6655019 - DNA, 22 bp, Homo sapiens
agtttcttgtcttggacttttt

SEQ ID NO: 6655020 - DNA, 15 bp, Homo sapiens
agtttcttgtgtaga

SEQ ID NO: 6655021 - DNA, 20 bp, Homo sapiens
agtttctttattttgtgtaa

SEQ ID NO: 6655022 - DNA, 22 bp, Homo sapiens
agtttctttattttgtgtaaaa

SEQ ID NO: 6655023 - DNA, 18 bp, Homo sapiens
agtttctttcctgccttc

SEQ ID NO: 6655024 - DNA, 16 bp, Homo sapiens
agtttctttgagggtt

SEQ ID NO: 6655025 - DNA, 16 bp, Homo sapiens
agtttcttttattttc

SEQ ID NO: 6655026 - DNA, 14 bp, Homo sapiens
agtttcttttgtgt

SEQ ID NO: 6655027 - DNA, 16 bp, Homo sapiens
agtttgaaaaactaat

SEQ ID NO: 6655028 - DNA, 21 bp, Homo sapiens
agtttgaaaagcaatattgta

SEQ ID NO: 6655029 - DNA, 21 bp, Homo sapiens
agtttgaaagttgtacatgat

SEQ ID NO: 6655030 - DNA, 12 bp, Homo sapiens
agtttgaaataa

SEQ ID NO: 6655031 - DNA, 13 bp, Homo sapiens
agtttgaaataag

SEQ ID NO: 6655032 - DNA, 18 bp, Homo sapiens
agtttgaaataagctatt

SEQ ID NO: 6655033 - DNA, 18 bp, Homo sapiens
agtttgaaatatattatt

SEQ ID NO: 6655034 - DNA, 13 bp, Homo sapiens
agtttgaaattct

SEQ ID NO: 6655035 - DNA, 14 bp, Homo sapiens
agtttgaaattctg

SEQ ID NO: 6655036 - DNA, 15 bp, Homo sapiens
agtttgaaattctga

SEQ ID NO: 6655037 - DNA, 21 bp, Homo sapiens
agtttgaagaccaatcaaata

SEQ ID NO: 6655038 - DNA, 21 bp, Homo sapiens
agtttgaagcacaactccctt

SEQ ID NO: 6655039 - DNA, 18 bp, Homo sapiens
agtttgaagcctgtgcct

SEQ ID NO: 6655040 - DNA, 15 bp, Homo sapiens
agtttgaaggaaaca

SEQ ID NO: 6655041 - DNA, 18 bp, Homo sapiens
agtttgaaggaaacagtt

SEQ ID NO: 6655042 - DNA, 18 bp, Homo sapiens
agtttgaatatttaagca

SEQ ID NO: 6655043 - DNA, 19 bp, Homo sapiens
agtttgaatgctgcaagtt

SEQ ID NO: 6655044 - DNA, 12 bp, Homo sapiens
agtttgaatgtt

SEQ ID NO: 6655045 - DNA, 15 bp, Homo sapiens
agtttgaattcagta

SEQ ID NO: 6655046 - DNA, 18 bp, Homo sapiens
agtttgacacaacatctg

SEQ ID NO: 6655047 - DNA, 14 bp, Homo sapiens
agtttgacacctta

SEQ ID NO: 6655048 - DNA, 19 bp, Homo sapiens
agtttgacagtttttgaca

SEQ ID NO: 6655049 - DNA, 12 bp, Homo sapiens
agtttgacattt

SEQ ID NO: 6655050 - DNA, 16 bp, Homo sapiens
agtttgactacatagt

SEQ ID NO: 6655051 - DNA, 15 bp, Homo sapiens
agtttgacttgtata

SEQ ID NO: 6655052 - DNA, 11 bp, Homo sapiens
agtttgagacc

SEQ ID NO: 6655053 - DNA, 19 bp, Homo sapiens
agtttgagaccagcccgac

SEQ ID NO: 6655054 - DNA, 17 bp, Homo sapiens
agtttgagaccagcctg

SEQ ID NO: 6655055 - DNA, 22 bp, Homo sapiens
agtttgagaccagcctggccaa

SEQ ID NO: 6655056 - DNA, 21 bp, Homo sapiens
agtttgagaccagcctgggca

SEQ ID NO: 6655057 - DNA, 19 bp, Homo sapiens
agtttgagaccaggctggg

SEQ ID NO: 6655058 - DNA, 14 bp, Homo sapiens
agtttgaggaaatt

SEQ ID NO: 6655059 - DNA, 14 bp, Homo sapiens
agtttgaggctgca

SEQ ID NO: 6655060 - DNA, 17 bp, Homo sapiens
agtttgaggctgcagcg

SEQ ID NO: 6655061 - DNA, 18 bp, Homo sapiens
agtttgataaatagtgtt

SEQ ID NO: 6655062 - DNA, 19 bp, Homo sapiens
agtttgataaatagtgtta

SEQ ID NO: 6655063 - DNA, 20 bp, Homo sapiens
agtttgatatgggctttctc

SEQ ID NO: 6655064 - DNA, 16 bp, Homo sapiens
agtttgatcagacagc

SEQ ID NO: 6655065 - DNA, 19 bp, Homo sapiens
agtttgatcatagaattgt

SEQ ID NO: 6655066 - DNA, 17 bp, Homo sapiens
agtttgatgaggccctc

SEQ ID NO: 6655067 - DNA, 23 bp, Homo sapiens
agtttgattattcagtgtcactg

SEQ ID NO: 6655068 - DNA, 22 bp, Homo sapiens
agtttgattgaggagctgcact

SEQ ID NO: 6655069 - DNA, 22 bp, Homo sapiens
agtttgatttttgtttttgtaa

SEQ ID NO: 6655070 - DNA, 23 bp, Homo sapiens
agtttgatttttgtttttgtaat

SEQ ID NO: 6655071 - DNA, 23 bp, Homo sapiens
agtttgcaaataggcagaatgga

SEQ ID NO: 6655072 - DNA, 17 bp, Homo sapiens
agtttgcaatcttatgt

SEQ ID NO: 6655073 - DNA, 21 bp, Homo sapiens
agtttgcaatcttatgttgat

SEQ ID NO: 6655074 - DNA, 16 bp, Homo sapiens
agtttgcacttcctgt

SEQ ID NO: 6655075 - DNA, 19 bp, Homo sapiens
agtttgcatacttcctgga

SEQ ID NO: 6655076 - DNA, 19 bp, Homo sapiens
agtttgcattccagcgtct

SEQ ID NO: 6655077 - DNA, 20 bp, Homo sapiens
agtttgcattcctgatatga

SEQ ID NO: 6655078 - DNA, 15 bp, Homo sapiens
agtttgcatttcaga

SEQ ID NO: 6655079 - DNA, 17 bp, Homo sapiens
agtttgcatttcagaaa

SEQ ID NO: 6655080 - DNA, 12 bp, Homo sapiens
agtttgccaccc

SEQ ID NO: 6655081 - DNA, 22 bp, Homo sapiens
agtttgccactcccctaaactc

SEQ ID NO: 6655082 - DNA, 17 bp, Homo sapiens
agtttgcccagagttgg

SEQ ID NO: 6655083 - DNA, 12 bp, Homo sapiens
agtttgcctccc

SEQ ID NO: 6655084 - DNA, 15 bp, Homo sapiens
agtttgcctctgcac

SEQ ID NO: 6655085 - DNA, 16 bp, Homo sapiens
agtttgcctctgcacg

SEQ ID NO: 6655086 - DNA, 18 bp, Homo sapiens
agtttgcctgcagtttct

SEQ ID NO: 6655087 - DNA, 13 bp, Homo sapiens
agtttgcctgctg

SEQ ID NO: 6655088 - DNA, 15 bp, Homo sapiens
agtttgcctgctgta

SEQ ID NO: 6655089 - DNA, 24 bp, Homo sapiens
agtttgcctgctgtatttatagta

SEQ ID NO: 6655090 - DNA, 15 bp, Homo sapiens
agtttgctaaaagaa

SEQ ID NO: 6655091 - DNA, 16 bp, Homo sapiens
agtttgctaaaagaag

SEQ ID NO: 6655092 - DNA, 18 bp, Homo sapiens
agtttgctaaaagaagag

SEQ ID NO: 6655093 - DNA, 21 bp, Homo sapiens
agtttgctaaaagaagagagg

SEQ ID NO: 6655094 - DNA, 22 bp, Homo sapiens
agtttgctaaaagaagagaggg

SEQ ID NO: 6655095 - DNA, 15 bp, Homo sapiens
agtttgctaatgttt

SEQ ID NO: 6655096 - DNA, 16 bp, Homo sapiens
agtttgctaatgtttc

SEQ ID NO: 6655097 - DNA, 22 bp, Homo sapiens
agtttgctctaccaaatagtga

SEQ ID NO: 6655098 - DNA, 15 bp, Homo sapiens
agtttgctgggttta

SEQ ID NO: 6655099 - DNA, 20 bp, Homo sapiens
agtttgctgtatacaaacag

SEQ ID NO: 6655100 - DNA, 18 bp, Homo sapiens
agtttgctgtgctttgga

SEQ ID NO: 6655101 - DNA, 14 bp, Homo sapiens
agtttgctgtttta

SEQ ID NO: 6655102 - DNA, 20 bp, Homo sapiens
agtttggaagtacataaagt

SEQ ID NO: 6655103 - DNA, 22 bp, Homo sapiens
agtttggaattattgtagacat

SEQ ID NO: 6655104 - DNA, 22 bp, Homo sapiens
agtttggatatgtaaaacattt

SEQ ID NO: 6655105 - DNA, 16 bp, Homo sapiens
agtttggcaaactctc

SEQ ID NO: 6655106 - DNA, 15 bp, Homo sapiens
agtttggcatttgca

SEQ ID NO: 6655107 - DNA, 11 bp, Homo sapiens
agtttggccag

SEQ ID NO: 6655108 - DNA, 14 bp, Homo sapiens
agtttggccctgga

SEQ ID NO: 6655109 - DNA, 18 bp, Homo sapiens
agtttggccctggagcca

SEQ ID NO: 6655110 - DNA, 19 bp, Homo sapiens
agtttggccctggagccag

SEQ ID NO: 6655111 - DNA, 20 bp, Homo sapiens
agtttggccctggagccagg

SEQ ID NO: 6655112 - DNA, 18 bp, Homo sapiens
agtttggctataagtgct

SEQ ID NO: 6655113 - DNA, 21 bp, Homo sapiens
agtttgggagacatggaccag

SEQ ID NO: 6655114 - DNA, 23 bp, Homo sapiens
agtttgggatccctgtctttcct

SEQ ID NO: 6655115 - DNA, 15 bp, Homo sapiens
agtttgggcatattt

SEQ ID NO: 6655116 - DNA, 19 bp, Homo sapiens
agtttgggccactgcactc

SEQ ID NO: 6655117 - DNA, 13 bp, Homo sapiens
agtttgggctgga

SEQ ID NO: 6655118 - DNA, 21 bp, Homo sapiens
agtttgggctggagctcctcc

SEQ ID NO: 6655119 - DNA, 12 bp, Homo sapiens
agtttgggcttc

SEQ ID NO: 6655120 - DNA, 17 bp, Homo sapiens
agtttgggcttcagcct

SEQ ID NO: 6655121 - DNA, 21 bp, Homo sapiens
agtttggggcaagtcatgtaa

SEQ ID NO: 6655122 - DNA, 20 bp, Homo sapiens
agtttgggttctctgctgtc

SEQ ID NO: 6655123 - DNA, 21 bp, Homo sapiens
agtttgggttctctgctgtcc

SEQ ID NO: 6655124 - DNA, 17 bp, Homo sapiens
agtttggtatgaaacaa

SEQ ID NO: 6655125 - DNA, 22 bp, Homo sapiens
agtttggtatgaaacaaatata

SEQ ID NO: 6655126 - DNA, 20 bp, Homo sapiens
agtttggtattgtaaaacat

SEQ ID NO: 6655127 - DNA, 19 bp, Homo sapiens
agtttggttaatcagtgtt

SEQ ID NO: 6655128 - DNA, 21 bp, Homo sapiens
agtttggttgtgtaagagaat

SEQ ID NO: 6655129 - DNA, 21 bp, Homo sapiens
agtttggtttatattcttatg

SEQ ID NO: 6655130 - DNA, 22 bp, Homo sapiens
agtttggtttgacttgtttgtg

SEQ ID NO: 6655131 - DNA, 15 bp, Homo sapiens
agtttgtaaaaatat

SEQ ID NO: 6655132 - DNA, 16 bp, Homo sapiens
agtttgtaaatgactt

SEQ ID NO: 6655133 - DNA, 17 bp, Homo sapiens
agtttgtaaatgacttt

SEQ ID NO: 6655134 - DNA, 17 bp, Homo sapiens
agtttgtaaatgttatt

SEQ ID NO: 6655135 - DNA, 22 bp, Homo sapiens
agtttgtaatatagtccaacat

SEQ ID NO: 6655136 - DNA, 23 bp, Homo sapiens
agtttgtacagacgtatgcttat

SEQ ID NO: 6655137 - DNA, 18 bp, Homo sapiens
agtttgtacatgcattca

SEQ ID NO: 6655138 - DNA, 14 bp, Homo sapiens
agtttgtagcattt

SEQ ID NO: 6655139 - DNA, 17 bp, Homo sapiens
agtttgtataacttctt

SEQ ID NO: 6655140 - DNA, 21 bp, Homo sapiens
agtttgtatagagttcatccc

SEQ ID NO: 6655141 - DNA, 13 bp, Homo sapiens
agtttgtatatac

SEQ ID NO: 6655142 - DNA, 12 bp, Homo sapiens
agtttgtattaa

SEQ ID NO: 6655143 - DNA, 24 bp, Homo sapiens
agtttgtattattacaaatattgt

SEQ ID NO: 6655144 - DNA, 23 bp, Homo sapiens
agtttgtattttaattatgggaa

SEQ ID NO: 6655145 - DNA, 18 bp, Homo sapiens
agtttgtattttgcatac

SEQ ID NO: 6655146 - DNA, 14 bp, Homo sapiens
agtttgtcagactt

SEQ ID NO: 6655147 - DNA, 14 bp, Homo sapiens
agtttgtccacaca

SEQ ID NO: 6655148 - DNA, 15 bp, Homo sapiens
agtttgtccatttgt

SEQ ID NO: 6655149 - DNA, 13 bp, Homo sapiens
agtttgtccttta

SEQ ID NO: 6655150 - DNA, 19 bp, Homo sapiens
agtttgtgaatgtgactac

SEQ ID NO: 6655151 - DNA, 13 bp, Homo sapiens
agtttgtgatttt

SEQ ID NO: 6655152 - DNA, 17 bp, Homo sapiens
agtttgtgcaagacacc

SEQ ID NO: 6655153 - DNA, 20 bp, Homo sapiens
agtttgtggcatcttgccaa

SEQ ID NO: 6655154 - DNA, 22 bp, Homo sapiens
agtttgtggtaaccagccctgc

SEQ ID NO: 6655155 - DNA, 12 bp, Homo sapiens
agtttgtggtga

SEQ ID NO: 6655156 - DNA, 20 bp, Homo sapiens
agtttgtgtctgttgcttgt

SEQ ID NO: 6655157 - DNA, 18 bp, Homo sapiens
agtttgtgtgttgtcttg

SEQ ID NO: 6655158 - DNA, 19 bp, Homo sapiens
agtttgtgtgttgtcttga

SEQ ID NO: 6655159 - DNA, 16 bp, Homo sapiens
agtttgtgttattatt

SEQ ID NO: 6655160 - DNA, 21 bp, Homo sapiens
agtttgtgttttaaaaaaact

SEQ ID NO: 6655161 - DNA, 22 bp, Homo sapiens
agtttgtgttttaaaaaaactg

SEQ ID NO: 6655162 - DNA, 13 bp, Homo sapiens
agtttgttaattg

SEQ ID NO: 6655163 - DNA, 16 bp, Homo sapiens
agtttgttaattgatt

SEQ ID NO: 6655164 - DNA, 17 bp, Homo sapiens
agtttgttactttgaat

SEQ ID NO: 6655165 - DNA, 22 bp, Homo sapiens
agtttgttatgcactttaaatg

SEQ ID NO: 6655166 - DNA, 13 bp, Homo sapiens
agtttgttatgtg

SEQ ID NO: 6655167 - DNA, 16 bp, Homo sapiens
agtttgttatgtgtgt

SEQ ID NO: 6655168 - DNA, 21 bp, Homo sapiens
agtttgttcacttaaattctt

SEQ ID NO: 6655169 - DNA, 16 bp, Homo sapiens
agtttgttctgttctg

SEQ ID NO: 6655170 - DNA, 17 bp, Homo sapiens
agtttgttcttcagatt

SEQ ID NO: 6655171 - DNA, 12 bp, Homo sapiens
agtttgttgaaa

SEQ ID NO: 6655172 - DNA, 15 bp, Homo sapiens
agtttgttgaaaaca

SEQ ID NO: 6655173 - DNA, 21 bp, Homo sapiens
agtttgttgatctgataagca

SEQ ID NO: 6655174 - DNA, 15 bp, Homo sapiens
agtttgttgatcttt

SEQ ID NO: 6655175 - DNA, 13 bp, Homo sapiens
agtttgttggaaa

SEQ ID NO: 6655176 - DNA, 21 bp, Homo sapiens
agtttgtttattacttatttg

SEQ ID NO: 6655177 - DNA, 22 bp, Homo sapiens
agtttgtttttgtttggtataa

SEQ ID NO: 6655178 - DNA, 16 bp, Homo sapiens
agttttaaaaaaataa

SEQ ID NO: 6655179 - DNA, 22 bp, Homo sapiens
agttttaaaaaaataaaacatt

SEQ ID NO: 6655180 - DNA, 16 bp, Homo sapiens
agttttaaaaatgaag

SEQ ID NO: 6655181 - DNA, 16 bp, Homo sapiens
agttttaaaaatgcaa

SEQ ID NO: 6655182 - DNA, 20 bp, Homo sapiens
agttttaaaaggctcccatg

SEQ ID NO: 6655183 - DNA, 14 bp, Homo sapiens
agttttaaaagtct

SEQ ID NO: 6655184 - DNA, 15 bp, Homo sapiens
agttttaaagaagtc

SEQ ID NO: 6655185 - DNA, 11 bp, Homo sapiens
agttttaaagt

SEQ ID NO: 6655186 - DNA, 13 bp, Homo sapiens
agttttaaatatg

SEQ ID NO: 6655187 - DNA, 14 bp, Homo sapiens
agttttaaatatga

SEQ ID NO: 6655188 - DNA, 22 bp, Homo sapiens
agttttaaattatgtataaaca

SEQ ID NO: 6655189 - DNA, 20 bp, Homo sapiens
agttttaacagaaccagagg

SEQ ID NO: 6655190 - DNA, 18 bp, Homo sapiens
agttttaactagaattta

SEQ ID NO: 6655191 - DNA, 16 bp, Homo sapiens
agttttaacttccagt

SEQ ID NO: 6655192 - DNA, 22 bp, Homo sapiens
agttttaagaaggtgcttagct

SEQ ID NO: 6655193 - DNA, 22 bp, Homo sapiens
agttttaagaattgtttttgaa

SEQ ID NO: 6655194 - DNA, 15 bp, Homo sapiens
agttttaattaaaaa

SEQ ID NO: 6655195 - DNA, 17 bp, Homo sapiens
agttttaattaaaaaaa

SEQ ID NO: 6655196 - DNA, 23 bp, Homo sapiens
agttttaattccatgtcagataa

SEQ ID NO: 6655197 - DNA, 22 bp, Homo sapiens
agttttacagagaggatacatt

SEQ ID NO: 6655198 - DNA, 20 bp, Homo sapiens
agttttacagattgcctcct

SEQ ID NO: 6655199 - DNA, 22 bp, Homo sapiens
agttttacattacaaatttctg

SEQ ID NO: 6655200 - DNA, 14 bp, Homo sapiens
agttttacatttta

SEQ ID NO: 6655201 - DNA, 14 bp, Homo sapiens
agttttactcctca

SEQ ID NO: 6655202 - DNA, 20 bp, Homo sapiens
agttttactcttaaatcatt

SEQ ID NO: 6655203 - DNA, 22 bp, Homo sapiens
agttttactcttgttgcccagg

SEQ ID NO: 6655204 - DNA, 16 bp, Homo sapiens
agttttactgcatttt

SEQ ID NO: 6655205 - DNA, 18 bp, Homo sapiens
agttttactgcattttca

SEQ ID NO: 6655206 - DNA, 15 bp, Homo sapiens
agttttactgcctgt

SEQ ID NO: 6655207 - DNA, 19 bp, Homo sapiens
agttttagaatcttttaaa

SEQ ID NO: 6655208 - DNA, 22 bp, Homo sapiens
agttttagacctcatctccaag

SEQ ID NO: 6655209 - DNA, 15 bp, Homo sapiens
agttttagttaaaac

SEQ ID NO: 6655210 - DNA, 19 bp, Homo sapiens
agttttagttaaaactcat

SEQ ID NO: 6655211 - DNA, 21 bp, Homo sapiens
agttttagtttcaaaatgtta

SEQ ID NO: 6655212 - DNA, 14 bp, Homo sapiens
agttttagttttct

SEQ ID NO: 6655213 - DNA, 19 bp, Homo sapiens
agttttatacataaacagt

SEQ ID NO: 6655214 - DNA, 21 bp, Homo sapiens
agttttataccctttttcatt

SEQ ID NO: 6655215 - DNA, 16 bp, Homo sapiens
agttttatatattata

SEQ ID NO: 6655216 - DNA, 21 bp, Homo sapiens
agttttatatattatatggaa

SEQ ID NO: 6655217 - DNA, 16 bp, Homo sapiens
agttttatatgcttta

SEQ ID NO: 6655218 - DNA, 21 bp, Homo sapiens
agttttatcctggccttgtac

SEQ ID NO: 6655219 - DNA, 17 bp, Homo sapiens
agttttatcttaaactg

SEQ ID NO: 6655220 - DNA, 24 bp, Homo sapiens
agttttatgctcttttttactcat

SEQ ID NO: 6655221 - DNA, 13 bp, Homo sapiens
agttttatggcat

SEQ ID NO: 6655222 - DNA, 23 bp, Homo sapiens
agttttattaataaacattctat

SEQ ID NO: 6655223 - DNA, 14 bp, Homo sapiens
agttttatttatat

SEQ ID NO: 6655224 - DNA, 13 bp, Homo sapiens
agttttattttct

SEQ ID NO: 6655225 - DNA, 20 bp, Homo sapiens
agttttattttctaaattct

SEQ ID NO: 6655226 - DNA, 18 bp, Homo sapiens
agttttatttttaagaaa

SEQ ID NO: 6655227 - DNA, 14 bp, Homo sapiens
agttttcaaactgc

SEQ ID NO: 6655228 - DNA, 14 bp, Homo sapiens
agttttcaagcatt

SEQ ID NO: 6655229 - DNA, 21 bp, Homo sapiens
agttttcaagtcaaattaata

SEQ ID NO: 6655230 - DNA, 14 bp, Homo sapiens
agttttcacagagg

SEQ ID NO: 6655231 - DNA, 12 bp, Homo sapiens
agttttcagaaa

SEQ ID NO: 6655232 - DNA, 16 bp, Homo sapiens
agttttcagaacctct

SEQ ID NO: 6655233 - DNA, 13 bp, Homo sapiens
agttttcagcctt

SEQ ID NO: 6655234 - DNA, 21 bp, Homo sapiens
agttttcagctgctcagaatt

SEQ ID NO: 6655235 - DNA, 12 bp, Homo sapiens
agttttcagtgg

SEQ ID NO: 6655236 - DNA, 17 bp, Homo sapiens
agttttcagtttgtata

SEQ ID NO: 6655237 - DNA, 22 bp, Homo sapiens
agttttcatgtgctcagaatta

SEQ ID NO: 6655238 - DNA, 18 bp, Homo sapiens
agttttcatttcatatat

SEQ ID NO: 6655239 - DNA, 20 bp, Homo sapiens
agttttccatggcaggaagg

SEQ ID NO: 6655240 - DNA, 21 bp, Homo sapiens
agttttccatggtcacagaga

SEQ ID NO: 6655241 - DNA, 18 bp, Homo sapiens
agttttccatttttgtca

SEQ ID NO: 6655242 - DNA, 15 bp, Homo sapiens
agttttcccactttt

SEQ ID NO: 6655243 - DNA, 18 bp, Homo sapiens
agttttccttctcatctg

SEQ ID NO: 6655244 - DNA, 23 bp, Homo sapiens
agttttccttctcatctgtgatt

SEQ ID NO: 6655245 - DNA, 15 bp, Homo sapiens
agttttctaaatgtt

SEQ ID NO: 6655246 - DNA, 17 bp, Homo sapiens
agttttctaaatgtttc

SEQ ID NO: 6655247 - DNA, 17 bp, Homo sapiens
agttttctcctcccagg

SEQ ID NO: 6655248 - DNA, 12 bp, Homo sapiens
agttttctgaga

SEQ ID NO: 6655249 - DNA, 13 bp, Homo sapiens
agttttctgagaa

SEQ ID NO: 6655250 - DNA, 18 bp, Homo sapiens
agttttctgagaaagact

SEQ ID NO: 6655251 - DNA, 23 bp, Homo sapiens
agttttctgagaaagactattca

SEQ ID NO: 6655252 - DNA, 18 bp, Homo sapiens
agttttctggctggagcc

SEQ ID NO: 6655253 - DNA, 19 bp, Homo sapiens
agttttctggctggagcct

SEQ ID NO: 6655254 - DNA, 18 bp, Homo sapiens
agttttctggtaggaaga

SEQ ID NO: 6655255 - DNA, 17 bp, Homo sapiens
agttttctgtatatgat

SEQ ID NO: 6655256 - DNA, 12 bp, Homo sapiens
agttttcttata

SEQ ID NO: 6655257 - DNA, 15 bp, Homo sapiens
agttttcttccatga

SEQ ID NO: 6655258 - DNA, 13 bp, Homo sapiens
agttttcttgttg

SEQ ID NO: 6655259 - DNA, 15 bp, Homo sapiens
agttttcttgtttct

SEQ ID NO: 6655260 - DNA, 12 bp, Homo sapiens
agttttctttag

SEQ ID NO: 6655261 - DNA, 18 bp, Homo sapiens
agttttctttcctccttt

SEQ ID NO: 6655262 - DNA, 19 bp, Homo sapiens
agttttctttcctcctttc

SEQ ID NO: 6655263 - DNA, 16 bp, Homo sapiens
agttttctttgtaaag

SEQ ID NO: 6655264 - DNA, 12 bp, Homo sapiens
agttttgaaaag

SEQ ID NO: 6655265 - DNA, 14 bp, Homo sapiens
agttttgaaaagct

SEQ ID NO: 6655266 - DNA, 21 bp, Homo sapiens
agttttgaatgttaagaattg

SEQ ID NO: 6655267 - DNA, 22 bp, Homo sapiens
agttttgacatcagccagctgc

SEQ ID NO: 6655268 - DNA, 23 bp, Homo sapiens
agttttgacatcagccagctgcc

SEQ ID NO: 6655269 - DNA, 14 bp, Homo sapiens
agttttgacattta

SEQ ID NO: 6655270 - DNA, 12 bp, Homo sapiens
agttttgagaac

SEQ ID NO: 6655271 - DNA, 22 bp, Homo sapiens
agttttgataaagtaattcata

SEQ ID NO: 6655272 - DNA, 21 bp, Homo sapiens
agttttgatacaaactttgtt

SEQ ID NO: 6655273 - DNA, 18 bp, Homo sapiens
agttttgatacttgtaac

SEQ ID NO: 6655274 - DNA, 19 bp, Homo sapiens
agttttgatacttgtaact

SEQ ID NO: 6655275 - DNA, 11 bp, Homo sapiens
agttttgatat

SEQ ID NO: 6655276 - DNA, 18 bp, Homo sapiens
agttttgatatgagtata

SEQ ID NO: 6655277 - DNA, 23 bp, Homo sapiens
agttttgatgactggcattttat

SEQ ID NO: 6655278 - DNA, 18 bp, Homo sapiens
agttttgatgtgtgggct

SEQ ID NO: 6655279 - DNA, 19 bp, Homo sapiens
agttttgattaatgtttct

SEQ ID NO: 6655280 - DNA, 15 bp, Homo sapiens
agttttgattgcata

SEQ ID NO: 6655281 - DNA, 18 bp, Homo sapiens
agttttgattgcatattt

SEQ ID NO: 6655282 - DNA, 19 bp, Homo sapiens
agttttgattttggaaaga

SEQ ID NO: 6655283 - DNA, 16 bp, Homo sapiens
agttttgcaaagtgca

SEQ ID NO: 6655284 - DNA, 23 bp, Homo sapiens
agttttgccccatgataaaataa

SEQ ID NO: 6655285 - DNA, 23 bp, Homo sapiens
agttttgctaggtataaaaaata

SEQ ID NO: 6655286 - DNA, 23 bp, Homo sapiens
agttttgcttttagtttttctgt

SEQ ID NO: 6655287 - DNA, 14 bp, Homo sapiens
agttttggaatcta

SEQ ID NO: 6655288 - DNA, 17 bp, Homo sapiens
agttttggagagggaag

SEQ ID NO: 6655289 - DNA, 16 bp, Homo sapiens
agttttgggaagttaa

SEQ ID NO: 6655290 - DNA, 18 bp, Homo sapiens
agttttggttatttctaa

SEQ ID NO: 6655291 - DNA, 21 bp, Homo sapiens
agttttggttatttctaaacc

SEQ ID NO: 6655292 - DNA, 16 bp, Homo sapiens
agttttgtaaaagaaa

SEQ ID NO: 6655293 - DNA, 22 bp, Homo sapiens
agttttgtaaataagtgaaaat

SEQ ID NO: 6655294 - DNA, 13 bp, Homo sapiens
agttttgtaaatg

SEQ ID NO: 6655295 - DNA, 22 bp, Homo sapiens
agttttgtaacttagctttatt

SEQ ID NO: 6655296 - DNA, 15 bp, Homo sapiens
agttttgtaagccct

SEQ ID NO: 6655297 - DNA, 23 bp, Homo sapiens
agttttgtacaaagttttccttt

SEQ ID NO: 6655298 - DNA, 13 bp, Homo sapiens
agttttgtataaa

SEQ ID NO: 6655299 - DNA, 14 bp, Homo sapiens
agttttgtcagaaa

SEQ ID NO: 6655300 - DNA, 14 bp, Homo sapiens
agttttgtcattca

SEQ ID NO: 6655301 - DNA, 12 bp, Homo sapiens
agttttgtgaaa

SEQ ID NO: 6655302 - DNA, 18 bp, Homo sapiens
agttttgtgaaatttttc

SEQ ID NO: 6655303 - DNA, 19 bp, Homo sapiens
agttttgtgaaatttttca

SEQ ID NO: 6655304 - DNA, 14 bp, Homo sapiens
agttttgtggactg

SEQ ID NO: 6655305 - DNA, 21 bp, Homo sapiens
agttttgtggattaaaccttt

SEQ ID NO: 6655306 - DNA, 22 bp, Homo sapiens
agttttgtggattaaacctttt

SEQ ID NO: 6655307 - DNA, 17 bp, Homo sapiens
agttttgtgtacagtat

SEQ ID NO: 6655308 - DNA, 13 bp, Homo sapiens
agttttgttctgt

SEQ ID NO: 6655309 - DNA, 12 bp, Homo sapiens
agttttgttctt

SEQ ID NO: 6655310 - DNA, 12 bp, Homo sapiens
agttttgtttaa

SEQ ID NO: 6655311 - DNA, 12 bp, Homo sapiens
agttttgtttca

SEQ ID NO: 6655312 - DNA, 16 bp, Homo sapiens
agttttgtttcacttt

SEQ ID NO: 6655313 - DNA, 22 bp, Homo sapiens
agttttgtttgttcacactcct

SEQ ID NO: 6655314 - DNA, 23 bp, Homo sapiens
agttttgttttaaaactggacct

SEQ ID NO: 6655315 - DNA, 19 bp, Homo sapiens
agtttttaaaaaggccttt

SEQ ID NO: 6655316 - DNA, 15 bp, Homo sapiens
agtttttaaaaataa

SEQ ID NO: 6655317 - DNA, 22 bp, Homo sapiens
agtttttaaaatttatttgcaa

SEQ ID NO: 6655318 - DNA, 15 bp, Homo sapiens
agtttttaaacatca

SEQ ID NO: 6655319 - DNA, 18 bp, Homo sapiens
agtttttaaagccttctg

SEQ ID NO: 6655320 - DNA, 23 bp, Homo sapiens
agtttttaactctactgtgtaat

SEQ ID NO: 6655321 - DNA, 22 bp, Homo sapiens
agtttttaattcatatttttcc

SEQ ID NO: 6655322 - DNA, 15 bp, Homo sapiens
agtttttaattttaa

SEQ ID NO: 6655323 - DNA, 18 bp, Homo sapiens
agtttttacaaaactgct

SEQ ID NO: 6655324 - DNA, 23 bp, Homo sapiens
agtttttacctaccacagtgtct

SEQ ID NO: 6655325 - DNA, 16 bp, Homo sapiens
agtttttacttgttta

SEQ ID NO: 6655326 - DNA, 18 bp, Homo sapiens
agtttttagaatgttgaa

SEQ ID NO: 6655327 - DNA, 21 bp, Homo sapiens
agtttttagtaatctgtacat

SEQ ID NO: 6655328 - DNA, 14 bp, Homo sapiens
agtttttatagcta

SEQ ID NO: 6655329 - DNA, 23 bp, Homo sapiens
agtttttatagttattaaatgtt

SEQ ID NO: 6655330 - DNA, 23 bp, Homo sapiens
agtttttatatagtctacagttg

SEQ ID NO: 6655331 - DNA, 20 bp, Homo sapiens
agtttttatctttgaccaac

SEQ ID NO: 6655332 - DNA, 16 bp, Homo sapiens
agtttttatgagaaac

SEQ ID NO: 6655333 - DNA, 18 bp, Homo sapiens
agtttttattccttgtga

SEQ ID NO: 6655334 - DNA, 23 bp, Homo sapiens
agtttttatttagcatggggatt

SEQ ID NO: 6655335 - DNA, 9 bp, Homo sapiens
agtttttca

SEQ ID NO: 6655336 - DNA, 14 bp, Homo sapiens
agtttttcacttct

SEQ ID NO: 6655337 - DNA, 17 bp, Homo sapiens
agtttttcagaaagcat

SEQ ID NO: 6655338 - DNA, 22 bp, Homo sapiens
agtttttcagagtggaatgctt

SEQ ID NO: 6655339 - DNA, 21 bp, Homo sapiens
agtttttcaggagcgcaagat

SEQ ID NO: 6655340 - DNA, 23 bp, Homo sapiens
agtttttcaggagcgcaagatag

SEQ ID NO: 6655341 - DNA, 20 bp, Homo sapiens
agtttttcatactgtacaca

SEQ ID NO: 6655342 - DNA, 22 bp, Homo sapiens
agtttttcatactgtacacatt

SEQ ID NO: 6655343 - DNA, 20 bp, Homo sapiens
agtttttcattaaataaatt

SEQ ID NO: 6655344 - DNA, 19 bp, Homo sapiens
agtttttcattatttggaa

SEQ ID NO: 6655345 - DNA, 16 bp, Homo sapiens
agtttttcatttgttt

SEQ ID NO: 6655346 - DNA, 21 bp, Homo sapiens
agtttttcatttgttttgctt

SEQ ID NO: 6655347 - DNA, 11 bp, Homo sapiens
agtttttcctc

SEQ ID NO: 6655348 - DNA, 15 bp, Homo sapiens
agtttttcctggaat

SEQ ID NO: 6655349 - DNA, 16 bp, Homo sapiens
agtttttctgaaagtg

SEQ ID NO: 6655350 - DNA, 11 bp, Homo sapiens
agtttttctgt

SEQ ID NO: 6655351 - DNA, 13 bp, Homo sapiens
agtttttctgtca

SEQ ID NO: 6655352 - DNA, 14 bp, Homo sapiens
agtttttctgtcat

SEQ ID NO: 6655353 - DNA, 17 bp, Homo sapiens
agtttttctgtttcctc

SEQ ID NO: 6655354 - DNA, 23 bp, Homo sapiens
agtttttctgttttgtttggcaa

SEQ ID NO: 6655355 - DNA, 23 bp, Homo sapiens
agtttttcttacataatttgcaa

SEQ ID NO: 6655356 - DNA, 21 bp, Homo sapiens
agtttttctttaatatgattc

SEQ ID NO: 6655357 - DNA, 14 bp, Homo sapiens
agtttttgaaaatt

SEQ ID NO: 6655358 - DNA, 21 bp, Homo sapiens
agtttttgaaaattatgcaaa

SEQ ID NO: 6655359 - DNA, 22 bp, Homo sapiens
agtttttgaaagacaaaattta

SEQ ID NO: 6655360 - DNA, 23 bp, Homo sapiens
agtttttgaaatacctttgtagt

SEQ ID NO: 6655361 - DNA, 16 bp, Homo sapiens
agtttttgacatttat

SEQ ID NO: 6655362 - DNA, 18 bp, Homo sapiens
agtttttgaggagccagc

SEQ ID NO: 6655363 - DNA, 22 bp, Homo sapiens
agtttttgatcaagaatgcaat

SEQ ID NO: 6655364 - DNA, 16 bp, Homo sapiens
agtttttgtaatttat

SEQ ID NO: 6655365 - DNA, 12 bp, Homo sapiens
agtttttgtatc

SEQ ID NO: 6655366 - DNA, 19 bp, Homo sapiens
agtttttgtatgtattatt

SEQ ID NO: 6655367 - DNA, 18 bp, Homo sapiens
agtttttgttcttaaaaa

SEQ ID NO: 6655368 - DNA, 19 bp, Homo sapiens
agttttttactttggttta

SEQ ID NO: 6655369 - DNA, 16 bp, Homo sapiens
agttttttatatatga

SEQ ID NO: 6655370 - DNA, 21 bp, Homo sapiens
agttttttatatatgaatatt

SEQ ID NO: 6655371 - DNA, 20 bp, Homo sapiens
agttttttatgcctttatat

SEQ ID NO: 6655372 - DNA, 17 bp, Homo sapiens
agttttttattatgcat

SEQ ID NO: 6655373 - DNA, 20 bp, Homo sapiens
agttttttcatcttcagttg

SEQ ID NO: 6655374 - DNA, 18 bp, Homo sapiens
agttttttctcttgggct

SEQ ID NO: 6655375 - DNA, 12 bp, Homo sapiens
agttttttgctt

SEQ ID NO: 6655376 - DNA, 16 bp, Homo sapiens
agttttttgttttaca

SEQ ID NO: 6655377 - DNA, 14 bp, Homo sapiens
agtttttttaaatg

SEQ ID NO: 6655378 - DNA, 15 bp, Homo sapiens
agtttttttaaatgc

SEQ ID NO: 6655379 - DNA, 21 bp, Homo sapiens
agtttttttcatttttttgaa

SEQ ID NO: 6655380 - DNA, 19 bp, Homo sapiens
agtttttttccttcaagaa

SEQ ID NO: 6655381 - DNA, 16 bp, Homo sapiens
agtttttttctttgtg

SEQ ID NO: 6655382 - DNA, 20 bp, Homo sapiens
agtttttttggtgctataac

SEQ ID NO: 6655383 - DNA, 21 bp, Homo sapiens
agttttttttaacctgtttat

SEQ ID NO: 6655384 - DNA, 14 bp, Homo sapiens
agttttttttctgg

SEQ ID NO: 6655385 - DNA, 20 bp, Homo sapiens
agttttttttttgtttgttt

SEQ ID NO: 6655386 - DNA, 17 bp, Homo sapiens
ataaaaaaaagaaatga

SEQ ID NO: 6655387 - DNA, 15 bp, Homo sapiens
ataaaaaaaagttgt

SEQ ID NO: 6655388 - DNA, 15 bp, Homo sapiens
ataaaaaaaatgaaa

SEQ ID NO: 6655389 - DNA, 18 bp, Homo sapiens
ataaaaaaaatgaaatgt

SEQ ID NO: 6655390 - DNA, 19 bp, Homo sapiens
ataaaaaaacaatcatttg

SEQ ID NO: 6655391 - DNA, 14 bp, Homo sapiens
ataaaaaaataaaa

SEQ ID NO: 6655392 - DNA, 14 bp, Homo sapiens
ataaaaaaatgatg

SEQ ID NO: 6655393 - DNA, 15 bp, Homo sapiens
ataaaaaacaagaaa

SEQ ID NO: 6655394 - DNA, 14 bp, Homo sapiens
ataaaaaacattca

SEQ ID NO: 6655395 - DNA, 16 bp, Homo sapiens
ataaaaaacatttgta

SEQ ID NO: 6655396 - DNA, 20 bp, Homo sapiens
ataaaaaacatttgtacatt

SEQ ID NO: 6655397 - DNA, 11 bp, Homo sapiens
ataaaaaagaa

SEQ ID NO: 6655398 - DNA, 19 bp, Homo sapiens
ataaaaaagaaaacttgtg

SEQ ID NO: 6655399 - DNA, 21 bp, Homo sapiens
ataaaaaagaaaacttgtgtt

SEQ ID NO: 6655400 - DNA, 19 bp, Homo sapiens
ataaaaaagaacttttgta

SEQ ID NO: 6655401 - DNA, 11 bp, Homo sapiens
ataaaaaagat

SEQ ID NO: 6655402 - DNA, 14 bp, Homo sapiens
ataaaaaagcaaaa

SEQ ID NO: 6655403 - DNA, 22 bp, Homo sapiens
ataaaaaagctggtgggtgaaa

SEQ ID NO: 6655404 - DNA, 14 bp, Homo sapiens
ataaaaaagtctct

SEQ ID NO: 6655405 - DNA, 14 bp, Homo sapiens
ataaaaaataataa

SEQ ID NO: 6655406 - DNA, 16 bp, Homo sapiens
ataaaaaatatatgta

SEQ ID NO: 6655407 - DNA, 18 bp, Homo sapiens
ataaaaaatatatgtaat

SEQ ID NO: 6655408 - DNA, 19 bp, Homo sapiens
ataaaaaatatatgtaata

SEQ ID NO: 6655409 - DNA, 22 bp, Homo sapiens
ataaaaaatatatgtaatatat

SEQ ID NO: 6655410 - DNA, 16 bp, Homo sapiens
ataaaaaatctgaaga

SEQ ID NO: 6655411 - DNA, 17 bp, Homo sapiens
ataaaaaatctgaagag

SEQ ID NO: 6655412 - DNA, 12 bp, Homo sapiens
ataaaaaatgga

SEQ ID NO: 6655413 - DNA, 12 bp, Homo sapiens
ataaaaaatggt

SEQ ID NO: 6655414 - DNA, 16 bp, Homo sapiens
ataaaaaattatgaca

SEQ ID NO: 6655415 - DNA, 14 bp, Homo sapiens
ataaaaacaacttt

SEQ ID NO: 6655416 - DNA, 15 bp, Homo sapiens
ataaaaacaatatat

SEQ ID NO: 6655417 - DNA, 23 bp, Homo sapiens
ataaaaacattgcctttgaatgt

SEQ ID NO: 6655418 - DNA, 21 bp, Homo sapiens
ataaaaaccacccacaaagaa

SEQ ID NO: 6655419 - DNA, 17 bp, Homo sapiens
ataaaaaccagaatcat

SEQ ID NO: 6655420 - DNA, 18 bp, Homo sapiens
ataaaaaccagaatcata

SEQ ID NO: 6655421 - DNA, 18 bp, Homo sapiens
ataaaaactactgaataa

SEQ ID NO: 6655422 - DNA, 21 bp, Homo sapiens
ataaaaactcaggcaaagaaa

SEQ ID NO: 6655423 - DNA, 12 bp, Homo sapiens
ataaaaactgcc

SEQ ID NO: 6655424 - DNA, 22 bp, Homo sapiens
ataaaaagaaaaaaatggaaaa

SEQ ID NO: 6655425 - DNA, 22 bp, Homo sapiens
ataaaaagaaaagataaagatg

SEQ ID NO: 6655426 - DNA, 19 bp, Homo sapiens
ataaaaagaaagattttat

SEQ ID NO: 6655427 - DNA, 18 bp, Homo sapiens
ataaaaagaaagctaata

SEQ ID NO: 6655428 - DNA, 14 bp, Homo sapiens
ataaaaagaaaggc

SEQ ID NO: 6655429 - DNA, 12 bp, Homo sapiens
ataaaaagagaa

SEQ ID NO: 6655430 - DNA, 14 bp, Homo sapiens
ataaaaagagaaac

SEQ ID NO: 6655431 - DNA, 15 bp, Homo sapiens
ataaaaagcaagaat

SEQ ID NO: 6655432 - DNA, 16 bp, Homo sapiens
ataaaaagcaagaatt

SEQ ID NO: 6655433 - DNA, 18 bp, Homo sapiens
ataaaaagccaccacaca

SEQ ID NO: 6655434 - DNA, 18 bp, Homo sapiens
ataaaaagccagggctgg

SEQ ID NO: 6655435 - DNA, 17 bp, Homo sapiens
ataaaaagcctctttct

SEQ ID NO: 6655436 - DNA, 12 bp, Homo sapiens
ataaaaaggaaa

SEQ ID NO: 6655437 - DNA, 13 bp, Homo sapiens
ataaaaaggaaat

SEQ ID NO: 6655438 - DNA, 14 bp, Homo sapiens
ataaaaaggaaata

SEQ ID NO: 6655439 - DNA, 16 bp, Homo sapiens
ataaaaaggaaatatt

SEQ ID NO: 6655440 - DNA, 20 bp, Homo sapiens
ataaaaaggaaattagtctt

SEQ ID NO: 6655441 - DNA, 13 bp, Homo sapiens
ataaaaaggaata

SEQ ID NO: 6655442 - DNA, 20 bp, Homo sapiens
ataaaaaggatccaggtaaa

SEQ ID NO: 6655443 - DNA, 17 bp, Homo sapiens
ataaaaagtatgttgta

SEQ ID NO: 6655444 - DNA, 16 bp, Homo sapiens
ataaaaagtgaaataa

SEQ ID NO: 6655445 - DNA, 18 bp, Homo sapiens
ataaaaagttaaaaagtt

SEQ ID NO: 6655446 - DNA, 21 bp, Homo sapiens
ataaaaagtttcacaggtcaa

SEQ ID NO: 6655447 - DNA, 15 bp, Homo sapiens
ataaaaataaatcta

SEQ ID NO: 6655448 - DNA, 11 bp, Homo sapiens
ataaaaataca

SEQ ID NO: 6655449 - DNA, 15 bp, Homo sapiens
ataaaaatacacatg

SEQ ID NO: 6655450 - DNA, 16 bp, Homo sapiens
ataaaaatacacatga

SEQ ID NO: 6655451 - DNA, 21 bp, Homo sapiens
ataaaaatacacatgaaaaca

SEQ ID NO: 6655452 - DNA, 16 bp, Homo sapiens
ataaaaatactatgaa

SEQ ID NO: 6655453 - DNA, 16 bp, Homo sapiens
ataaaaatatatgttg

SEQ ID NO: 6655454 - DNA, 19 bp, Homo sapiens
ataaaaatcagtttcttac

SEQ ID NO: 6655455 - DNA, 16 bp, Homo sapiens
ataaaaatcatataga

SEQ ID NO: 6655456 - DNA, 12 bp, Homo sapiens
ataaaaatgtaa

SEQ ID NO: 6655457 - DNA, 15 bp, Homo sapiens
ataaaaatgtaaatt

SEQ ID NO: 6655458 - DNA, 13 bp, Homo sapiens
ataaaaatgtggt

SEQ ID NO: 6655459 - DNA, 16 bp, Homo sapiens
ataaaaattaaatgtg

SEQ ID NO: 6655460 - DNA, 15 bp, Homo sapiens
ataaaaattaagctt

SEQ ID NO: 6655461 - DNA, 15 bp, Homo sapiens
ataaaaattatcaaa

SEQ ID NO: 6655462 - DNA, 12 bp, Homo sapiens
ataaaaattgaa

SEQ ID NO: 6655463 - DNA, 15 bp, Homo sapiens
ataaaaattgaaaaa

SEQ ID NO: 6655464 - DNA, 14 bp, Homo sapiens
ataaaaattgatga

SEQ ID NO: 6655465 - DNA, 21 bp, Homo sapiens
ataaaaattgtttctataaat

SEQ ID NO: 6655466 - DNA, 18 bp, Homo sapiens
ataaaacaaaacaaacaa

SEQ ID NO: 6655467 - DNA, 21 bp, Homo sapiens
ataaaacaaataaatatgaaa

SEQ ID NO: 6655468 - DNA, 14 bp, Homo sapiens
ataaaacaagcctt

SEQ ID NO: 6655469 - DNA, 15 bp, Homo sapiens
ataaaacaagcctta

SEQ ID NO: 6655470 - DNA, 17 bp, Homo sapiens
ataaaacaatgactttt

SEQ ID NO: 6655471 - DNA, 21 bp, Homo sapiens
ataaaacaatgacttttaaag

SEQ ID NO: 6655472 - DNA, 14 bp, Homo sapiens
ataaaacagaatct

SEQ ID NO: 6655473 - DNA, 16 bp, Homo sapiens
ataaaacagagtaatc

SEQ ID NO: 6655474 - DNA, 14 bp, Homo sapiens
ataaaacaggaccg

SEQ ID NO: 6655475 - DNA, 14 bp, Homo sapiens
ataaaacagtgttt

SEQ ID NO: 6655476 - DNA, 19 bp, Homo sapiens
ataaaacagtgtttccagt

SEQ ID NO: 6655477 - DNA, 18 bp, Homo sapiens
ataaaacatcactatcaa

SEQ ID NO: 6655478 - DNA, 12 bp, Homo sapiens
ataaaacatcat

SEQ ID NO: 6655479 - DNA, 23 bp, Homo sapiens
ataaaacattaattgctaacaat

SEQ ID NO: 6655480 - DNA, 12 bp, Homo sapiens
ataaaacatttt

SEQ ID NO: 6655481 - DNA, 19 bp, Homo sapiens
ataaaacattttaaatgga

SEQ ID NO: 6655482 - DNA, 18 bp, Homo sapiens
ataaaacattttcacaca

SEQ ID NO: 6655483 - DNA, 17 bp, Homo sapiens
ataaaaccaaacatgct

SEQ ID NO: 6655484 - DNA, 17 bp, Homo sapiens
ataaaaccaagcctctg

SEQ ID NO: 6655485 - DNA, 16 bp, Homo sapiens
ataaaacccagcatgt

SEQ ID NO: 6655486 - DNA, 20 bp, Homo sapiens
ataaaacccagcatgtacaa

SEQ ID NO: 6655487 - DNA, 18 bp, Homo sapiens
ataaaaccctatacaagt

SEQ ID NO: 6655488 - DNA, 14 bp, Homo sapiens
ataaaacctcagct

SEQ ID NO: 6655489 - DNA, 15 bp, Homo sapiens
ataaaacctcagcta

SEQ ID NO: 6655490 - DNA, 11 bp, Homo sapiens
ataaaaccttt

SEQ ID NO: 6655491 - DNA, 15 bp, Homo sapiens
ataaaacctttcaaa

SEQ ID NO: 6655492 - DNA, 22 bp, Homo sapiens
ataaaacctttcaaatttcaca

SEQ ID NO: 6655493 - DNA, 13 bp, Homo sapiens
ataaaacgctttc

SEQ ID NO: 6655494 - DNA, 19 bp, Homo sapiens
ataaaacggtgctttctgt

SEQ ID NO: 6655495 - DNA, 14 bp, Homo sapiens
ataaaactaggaat

SEQ ID NO: 6655496 - DNA, 18 bp, Homo sapiens
ataaaactaggtgctgca

SEQ ID NO: 6655497 - DNA, 14 bp, Homo sapiens
ataaaactatttaa

SEQ ID NO: 6655498 - DNA, 16 bp, Homo sapiens
ataaaactatttgtat

SEQ ID NO: 6655499 - DNA, 18 bp, Homo sapiens
ataaaactcagttaaaat

SEQ ID NO: 6655500 - DNA, 12 bp, Homo sapiens
ataaaactgaaa

SEQ ID NO: 6655501 - DNA, 14 bp, Homo sapiens
ataaaactgaaata

SEQ ID NO: 6655502 - DNA, 18 bp, Homo sapiens
ataaaactgaaataaacc

SEQ ID NO: 6655503 - DNA, 14 bp, Homo sapiens
ataaaactgaatct

SEQ ID NO: 6655504 - DNA, 13 bp, Homo sapiens
ataaaactgatgt

SEQ ID NO: 6655505 - DNA, 16 bp, Homo sapiens
ataaaactgatgtgaa

SEQ ID NO: 6655506 - DNA, 13 bp, Homo sapiens
ataaaactgcaca

SEQ ID NO: 6655507 - DNA, 22 bp, Homo sapiens
ataaaactgcctgacaattatg

SEQ ID NO: 6655508 - DNA, 20 bp, Homo sapiens
ataaaactgcgaggacatca

SEQ ID NO: 6655509 - DNA, 24 bp, Homo sapiens
ataaaactgctagtgagttattgt

SEQ ID NO: 6655510 - DNA, 15 bp, Homo sapiens
ataaaactggctttg

SEQ ID NO: 6655511 - DNA, 21 bp, Homo sapiens
ataaaactgtttcaagccctc

SEQ ID NO: 6655512 - DNA, 22 bp, Homo sapiens
ataaaactgtttgacttctcaa

SEQ ID NO: 6655513 - DNA, 18 bp, Homo sapiens
ataaaacttataaatttc

SEQ ID NO: 6655514 - DNA, 14 bp, Homo sapiens
ataaaacttatctg

SEQ ID NO: 6655515 - DNA, 14 bp, Homo sapiens
ataaaacttatgct

SEQ ID NO: 6655516 - DNA, 12 bp, Homo sapiens
ataaaacttgat

SEQ ID NO: 6655517 - DNA, 21 bp, Homo sapiens
ataaaactttggcaacatctt

SEQ ID NO: 6655518 - DNA, 12 bp, Homo sapiens
ataaaagaaaat

SEQ ID NO: 6655519 - DNA, 16 bp, Homo sapiens
ataaaagaaaattaca

SEQ ID NO: 6655520 - DNA, 13 bp, Homo sapiens
ataaaagaaataa

SEQ ID NO: 6655521 - DNA, 16 bp, Homo sapiens
ataaaagaaatatatc

SEQ ID NO: 6655522 - DNA, 21 bp, Homo sapiens
ataaaagaatgtacagaaaat

SEQ ID NO: 6655523 - DNA, 20 bp, Homo sapiens
ataaaagacaaatgcaacat

SEQ ID NO: 6655524 - DNA, 19 bp, Homo sapiens
ataaaagaggtccattaat

SEQ ID NO: 6655525 - DNA, 20 bp, Homo sapiens
ataaaagaggtccattaata

SEQ ID NO: 6655526 - DNA, 17 bp, Homo sapiens
ataaaagataaattatt

SEQ ID NO: 6655527 - DNA, 15 bp, Homo sapiens
ataaaagatacattt

SEQ ID NO: 6655528 - DNA, 23 bp, Homo sapiens
ataaaagatagcaatatgagaca

SEQ ID NO: 6655529 - DNA, 19 bp, Homo sapiens
ataaaagatggggtctgta

SEQ ID NO: 6655530 - DNA, 20 bp, Homo sapiens
ataaaagcacaagtactttt

SEQ ID NO: 6655531 - DNA, 20 bp, Homo sapiens
ataaaagcataaatgcaaac

SEQ ID NO: 6655532 - DNA, 23 bp, Homo sapiens
ataaaagccaaccttcaaagaaa

SEQ ID NO: 6655533 - DNA, 13 bp, Homo sapiens
ataaaagcctgtt

SEQ ID NO: 6655534 - DNA, 13 bp, Homo sapiens
ataaaagccttgg

SEQ ID NO: 6655535 - DNA, 21 bp, Homo sapiens
ataaaagctagatactggaaa

SEQ ID NO: 6655536 - DNA, 20 bp, Homo sapiens
ataaaagctataaagtatat

SEQ ID NO: 6655537 - DNA, 17 bp, Homo sapiens
ataaaagctcagatgac

SEQ ID NO: 6655538 - DNA, 22 bp, Homo sapiens
ataaaagctcagatgacatttc

SEQ ID NO: 6655539 - DNA, 19 bp, Homo sapiens
ataaaagctgaagttactt

SEQ ID NO: 6655540 - DNA, 12 bp, Homo sapiens
ataaaagctgtg

SEQ ID NO: 6655541 - DNA, 19 bp, Homo sapiens
ataaaagctttgactccct

SEQ ID NO: 6655542 - DNA, 20 bp, Homo sapiens
ataaaagctttgactccctg

SEQ ID NO: 6655543 - DNA, 18 bp, Homo sapiens
ataaaaggataggaaaag

SEQ ID NO: 6655544 - DNA, 20 bp, Homo sapiens
ataaaaggataggaaaagat

SEQ ID NO: 6655545 - DNA, 21 bp, Homo sapiens
ataaaaggatatcatcttgag

SEQ ID NO: 6655546 - DNA, 22 bp, Homo sapiens
ataaaaggatgttacaagtttg

SEQ ID NO: 6655547 - DNA, 22 bp, Homo sapiens
ataaaagggactgagaaattta

SEQ ID NO: 6655548 - DNA, 17 bp, Homo sapiens
ataaaagggcaaatctg

SEQ ID NO: 6655549 - DNA, 17 bp, Homo sapiens
ataaaagggtcaaacct

SEQ ID NO: 6655550 - DNA, 14 bp, Homo sapiens
ataaaaggttgcca

SEQ ID NO: 6655551 - DNA, 16 bp, Homo sapiens
ataaaaggtttctttt

SEQ ID NO: 6655552 - DNA, 12 bp, Homo sapiens
ataaaagtaatt

SEQ ID NO: 6655553 - DNA, 16 bp, Homo sapiens
ataaaagtcagagctc

SEQ ID NO: 6655554 - DNA, 23 bp, Homo sapiens
ataaaagtgaagtgaatctgatt

SEQ ID NO: 6655555 - DNA, 21 bp, Homo sapiens
ataaaagtgaatgaaagatta

SEQ ID NO: 6655556 - DNA, 13 bp, Homo sapiens
ataaaagtgatca

SEQ ID NO: 6655557 - DNA, 16 bp, Homo sapiens
ataaaagtgcacacct

SEQ ID NO: 6655558 - DNA, 13 bp, Homo sapiens
ataaaagtgtcac

SEQ ID NO: 6655559 - DNA, 14 bp, Homo sapiens
ataaaagttaacat

SEQ ID NO: 6655560 - DNA, 23 bp, Homo sapiens
ataaaagttaataacagctcctt

SEQ ID NO: 6655561 - DNA, 21 bp, Homo sapiens
ataaaagttcctctcccttcc

SEQ ID NO: 6655562 - DNA, 16 bp, Homo sapiens
ataaaagttttctcca

SEQ ID NO: 6655563 - DNA, 9 bp, Homo sapiens
ataaaataa

SEQ ID NO: 6655564 - DNA, 19 bp, Homo sapiens
ataaaataaaaaccaaatt

SEQ ID NO: 6655565 - DNA, 21 bp, Homo sapiens
ataaaataaacgaaacattta

SEQ ID NO: 6655566 - DNA, 17 bp, Homo sapiens
ataaaataaacttctta

SEQ ID NO: 6655567 - DNA, 13 bp, Homo sapiens
ataaaataaagta

SEQ ID NO: 6655568 - DNA, 16 bp, Homo sapiens
ataaaataaagtatat

SEQ ID NO: 6655569 - DNA, 16 bp, Homo sapiens
ataaaataaataattt

SEQ ID NO: 6655570 - DNA, 20 bp, Homo sapiens
ataaaataaataattttaat

SEQ ID NO: 6655571 - DNA, 16 bp, Homo sapiens
ataaaataaatatact

SEQ ID NO: 6655572 - DNA, 18 bp, Homo sapiens
ataaaataaatatactaa

SEQ ID NO: 6655573 - DNA, 21 bp, Homo sapiens
ataaaataaatatactaataa

SEQ ID NO: 6655574 - DNA, 17 bp, Homo sapiens
ataaaataactaaaatg

SEQ ID NO: 6655575 - DNA, 18 bp, Homo sapiens
ataaaataactaaaatgt

SEQ ID NO: 6655576 - DNA, 13 bp, Homo sapiens
ataaaataatgca

SEQ ID NO: 6655577 - DNA, 14 bp, Homo sapiens
ataaaataatttta

SEQ ID NO: 6655578 - DNA, 22 bp, Homo sapiens
ataaaataattttatctctttc

SEQ ID NO: 6655579 - DNA, 11 bp, Homo sapiens
ataaaatacac

SEQ ID NO: 6655580 - DNA, 17 bp, Homo sapiens
ataaaatacacgtgtat

SEQ ID NO: 6655581 - DNA, 20 bp, Homo sapiens
ataaaatacacgtgtatatg

SEQ ID NO: 6655582 - DNA, 21 bp, Homo sapiens
ataaaatacacgtgtatatga

SEQ ID NO: 6655583 - DNA, 17 bp, Homo sapiens
ataaaatacataaaaga

SEQ ID NO: 6655584 - DNA, 22 bp, Homo sapiens
ataaaatacataaaagaatgta

SEQ ID NO: 6655585 - DNA, 17 bp, Homo sapiens
ataaaatacatagtgaa

SEQ ID NO: 6655586 - DNA, 18 bp, Homo sapiens
ataaaataccttttatgt

SEQ ID NO: 6655587 - DNA, 19 bp, Homo sapiens
ataaaatactatttttact

SEQ ID NO: 6655588 - DNA, 17 bp, Homo sapiens
ataaaatactctagcct

SEQ ID NO: 6655589 - DNA, 21 bp, Homo sapiens
ataaaatagaataattctttt

SEQ ID NO: 6655590 - DNA, 20 bp, Homo sapiens
ataaaatagcaatcctaaag

SEQ ID NO: 6655591 - DNA, 13 bp, Homo sapiens
ataaaatagtatt

SEQ ID NO: 6655592 - DNA, 16 bp, Homo sapiens
ataaaatagtattgaa

SEQ ID NO: 6655593 - DNA, 19 bp, Homo sapiens
ataaaatagtcgtgaatct

SEQ ID NO: 6655594 - DNA, 19 bp, Homo sapiens
ataaaatagttgtccatat

SEQ ID NO: 6655595 - DNA, 15 bp, Homo sapiens
ataaaatataaacaa

SEQ ID NO: 6655596 - DNA, 22 bp, Homo sapiens
ataaaatatatactatatgaaa

SEQ ID NO: 6655597 - DNA, 17 bp, Homo sapiens
ataaaatatatcttata

SEQ ID NO: 6655598 - DNA, 14 bp, Homo sapiens
ataaaatatcataa

SEQ ID NO: 6655599 - DNA, 16 bp, Homo sapiens
ataaaatatcataaag

SEQ ID NO: 6655600 - DNA, 20 bp, Homo sapiens
ataaaatatcataaagcatt

SEQ ID NO: 6655601 - DNA, 18 bp, Homo sapiens
ataaaatatcattcagca

SEQ ID NO: 6655602 - DNA, 19 bp, Homo sapiens
ataaaatatcattcagcaa

SEQ ID NO: 6655603 - DNA, 20 bp, Homo sapiens
ataaaatatcattcagcaac

SEQ ID NO: 6655604 - DNA, 16 bp, Homo sapiens
ataaaatatctatatt

SEQ ID NO: 6655605 - DNA, 21 bp, Homo sapiens
ataaaatatgaagacataaac

SEQ ID NO: 6655606 - DNA, 16 bp, Homo sapiens
ataaaatattattgaa

SEQ ID NO: 6655607 - DNA, 17 bp, Homo sapiens
ataaaatattcactctc

SEQ ID NO: 6655608 - DNA, 16 bp, Homo sapiens
ataaaatattcatata

SEQ ID NO: 6655609 - DNA, 15 bp, Homo sapiens
ataaaatattttaag

SEQ ID NO: 6655610 - DNA, 21 bp, Homo sapiens
ataaaatattttgttaacttt

SEQ ID NO: 6655611 - DNA, 22 bp, Homo sapiens
ataaaatatttttttcctatgg

SEQ ID NO: 6655612 - DNA, 11 bp, Homo sapiens
ataaaatcagc

SEQ ID NO: 6655613 - DNA, 18 bp, Homo sapiens
ataaaatcagccaattat

SEQ ID NO: 6655614 - DNA, 15 bp, Homo sapiens
ataaaatcataagta

SEQ ID NO: 6655615 - DNA, 20 bp, Homo sapiens
ataaaatcataagtatttgg

SEQ ID NO: 6655616 - DNA, 22 bp, Homo sapiens
ataaaatcataagtatttggaa

SEQ ID NO: 6655617 - DNA, 17 bp, Homo sapiens
ataaaatcccattgtat

SEQ ID NO: 6655618 - DNA, 22 bp, Homo sapiens
ataaaatcccattgtatttaaa

SEQ ID NO: 6655619 - DNA, 21 bp, Homo sapiens
ataaaatcctaagacacaaat

SEQ ID NO: 6655620 - DNA, 11 bp, Homo sapiens
ataaaatctga

SEQ ID NO: 6655621 - DNA, 11 bp, Homo sapiens
ataaaatctgt

SEQ ID NO: 6655622 - DNA, 15 bp, Homo sapiens
ataaaatctgtattg

SEQ ID NO: 6655623 - DNA, 20 bp, Homo sapiens
ataaaatctttccatctcat

SEQ ID NO: 6655624 - DNA, 17 bp, Homo sapiens
ataaaatgaaaattgta

SEQ ID NO: 6655625 - DNA, 18 bp, Homo sapiens
ataaaatgaaaattgtat

SEQ ID NO: 6655626 - DNA, 19 bp, Homo sapiens
ataaaatgaaaattgtatt

SEQ ID NO: 6655627 - DNA, 17 bp, Homo sapiens
ataaaatgacaataact

SEQ ID NO: 6655628 - DNA, 18 bp, Homo sapiens
ataaaatgaggacatgtt

SEQ ID NO: 6655629 - DNA, 19 bp, Homo sapiens
ataaaatgaggacatgttt

SEQ ID NO: 6655630 - DNA, 16 bp, Homo sapiens
ataaaatgatgttata

SEQ ID NO: 6655631 - DNA, 12 bp, Homo sapiens
ataaaatgcaaa

SEQ ID NO: 6655632 - DNA, 14 bp, Homo sapiens
ataaaatgcaaatg

SEQ ID NO: 6655633 - DNA, 15 bp, Homo sapiens
ataaaatgcaaatga

SEQ ID NO: 6655634 - DNA, 17 bp, Homo sapiens
ataaaatgcaaatgaat

SEQ ID NO: 6655635 - DNA, 22 bp, Homo sapiens
ataaaatgcaaatgaatcattg

SEQ ID NO: 6655636 - DNA, 17 bp, Homo sapiens
ataaaatgccagtctca

SEQ ID NO: 6655637 - DNA, 18 bp, Homo sapiens
ataaaatgctaggttcta

SEQ ID NO: 6655638 - DNA, 22 bp, Homo sapiens
ataaaatgctattttaaaattc

SEQ ID NO: 6655639 - DNA, 13 bp, Homo sapiens
ataaaatgctcct

SEQ ID NO: 6655640 - DNA, 14 bp, Homo sapiens
ataaaatggaataa

SEQ ID NO: 6655641 - DNA, 22 bp, Homo sapiens
ataaaatggcaacaaactgcac

SEQ ID NO: 6655642 - DNA, 16 bp, Homo sapiens
ataaaatgtaaactgt

SEQ ID NO: 6655643 - DNA, 23 bp, Homo sapiens
ataaaatgtaaactgtttcttta

SEQ ID NO: 6655644 - DNA, 13 bp, Homo sapiens
ataaaatgtattc

SEQ ID NO: 6655645 - DNA, 19 bp, Homo sapiens
ataaaatgtccagtaagat

SEQ ID NO: 6655646 - DNA, 14 bp, Homo sapiens
ataaaatgtcttct

SEQ ID NO: 6655647 - DNA, 13 bp, Homo sapiens
ataaaatgtttac

SEQ ID NO: 6655648 - DNA, 15 bp, Homo sapiens
ataaaatgtttacat

SEQ ID NO: 6655649 - DNA, 13 bp, Homo sapiens
ataaaatgtttat

SEQ ID NO: 6655650 - DNA, 14 bp, Homo sapiens
ataaaatgtttcaa

SEQ ID NO: 6655651 - DNA, 23 bp, Homo sapiens
ataaaattaaatgccttgtataa

SEQ ID NO: 6655652 - DNA, 13 bp, Homo sapiens
ataaaattaagaa

SEQ ID NO: 6655653 - DNA, 17 bp, Homo sapiens
ataaaattaggttaaac

SEQ ID NO: 6655654 - DNA, 17 bp, Homo sapiens
ataaaattatagctcta

SEQ ID NO: 6655655 - DNA, 15 bp, Homo sapiens
ataaaattatggtga

SEQ ID NO: 6655656 - DNA, 16 bp, Homo sapiens
ataaaattatttgcag

SEQ ID NO: 6655657 - DNA, 13 bp, Homo sapiens
ataaaattctgta

SEQ ID NO: 6655658 - DNA, 20 bp, Homo sapiens
ataaaattctgtaatttgaa

SEQ ID NO: 6655659 - DNA, 13 bp, Homo sapiens
ataaaattgaaaa

SEQ ID NO: 6655660 - DNA, 16 bp, Homo sapiens
ataaaattgaaaacac

SEQ ID NO: 6655661 - DNA, 19 bp, Homo sapiens
ataaaattgaaaacactaa

SEQ ID NO: 6655662 - DNA, 19 bp, Homo sapiens
ataaaattggattacagta

SEQ ID NO: 6655663 - DNA, 14 bp, Homo sapiens
ataaaattgtgatg

SEQ ID NO: 6655664 - DNA, 22 bp, Homo sapiens
ataaaatttaaaaaactcctgt

SEQ ID NO: 6655665 - DNA, 20 bp, Homo sapiens
ataaaatttaaaaaataaat

SEQ ID NO: 6655666 - DNA, 22 bp, Homo sapiens
ataaaatttacatttaatacag

SEQ ID NO: 6655667 - DNA, 13 bp, Homo sapiens
ataaaatttgaaa

SEQ ID NO: 6655668 - DNA, 18 bp, Homo sapiens
ataaaatttgataaacat

SEQ ID NO: 6655669 - DNA, 21 bp, Homo sapiens
ataaaattttattttaaattt

SEQ ID NO: 6655670 - DNA, 16 bp, Homo sapiens
ataaaattttgctttt

SEQ ID NO: 6655671 - DNA, 14 bp, Homo sapiens
ataaacaaacaaac

SEQ ID NO: 6655672 - DNA, 14 bp, Homo sapiens
ataaacaaagacat

SEQ ID NO: 6655673 - DNA, 16 bp, Homo sapiens
ataaacaaagattcat

SEQ ID NO: 6655674 - DNA, 17 bp, Homo sapiens
ataaacaacagaaactt

SEQ ID NO: 6655675 - DNA, 14 bp, Homo sapiens
ataaacaacagtac

SEQ ID NO: 6655676 - DNA, 15 bp, Homo sapiens
ataaacaagaccacg

SEQ ID NO: 6655677 - DNA, 23 bp, Homo sapiens
ataaacaagaccacgtttctaaa

SEQ ID NO: 6655678 - DNA, 13 bp, Homo sapiens
ataaacaagcatt

SEQ ID NO: 6655679 - DNA, 17 bp, Homo sapiens
ataaacaaggtcataca

SEQ ID NO: 6655680 - DNA, 19 bp, Homo sapiens
ataaacaagtcaaagactt

SEQ ID NO: 6655681 - DNA, 16 bp, Homo sapiens
ataaacaatccaaatg

SEQ ID NO: 6655682 - DNA, 13 bp, Homo sapiens
ataaacaatgaaa

SEQ ID NO: 6655683 - DNA, 19 bp, Homo sapiens
ataaacacaggcaggtact

SEQ ID NO: 6655684 - DNA, 14 bp, Homo sapiens
ataaacacatagat

SEQ ID NO: 6655685 - DNA, 15 bp, Homo sapiens
ataaacacatagatt

SEQ ID NO: 6655686 - DNA, 15 bp, Homo sapiens
ataaacacatttcca

SEQ ID NO: 6655687 - DNA, 16 bp, Homo sapiens
ataaacacgattttat

SEQ ID NO: 6655688 - DNA, 18 bp, Homo sapiens
ataaacactccacagtgt

SEQ ID NO: 6655689 - DNA, 23 bp, Homo sapiens
ataaacactccacagtgtttata

SEQ ID NO: 6655690 - DNA, 19 bp, Homo sapiens
ataaacactgcataaagca

SEQ ID NO: 6655691 - DNA, 18 bp, Homo sapiens
ataaacactggctctggg

SEQ ID NO: 6655692 - DNA, 12 bp, Homo sapiens
ataaacacttct

SEQ ID NO: 6655693 - DNA, 13 bp, Homo sapiens
ataaacagaaaat

SEQ ID NO: 6655694 - DNA, 13 bp, Homo sapiens
ataaacagaaatg

SEQ ID NO: 6655695 - DNA, 21 bp, Homo sapiens
ataaacagacaaaaacaagta

SEQ ID NO: 6655696 - DNA, 13 bp, Homo sapiens
ataaacagataat

SEQ ID NO: 6655697 - DNA, 18 bp, Homo sapiens
ataaacagcacacctgtg

SEQ ID NO: 6655698 - DNA, 22 bp, Homo sapiens
ataaacagcacacctgtgtcca

SEQ ID NO: 6655699 - DNA, 11 bp, Homo sapiens
ataaacagcag

SEQ ID NO: 6655700 - DNA, 14 bp, Homo sapiens
ataaacagctattt

SEQ ID NO: 6655701 - DNA, 15 bp, Homo sapiens
ataaacagctattta

SEQ ID NO: 6655702 - DNA, 18 bp, Homo sapiens
ataaacagctatttaagg

SEQ ID NO: 6655703 - DNA, 12 bp, Homo sapiens
ataaacagctga

SEQ ID NO: 6655704 - DNA, 22 bp, Homo sapiens
ataaacagcttcatgcctttgt

SEQ ID NO: 6655705 - DNA, 15 bp, Homo sapiens
ataaacaggaatttt

SEQ ID NO: 6655706 - DNA, 21 bp, Homo sapiens
ataaacaggaattttattttg

SEQ ID NO: 6655707 - DNA, 21 bp, Homo sapiens
ataaacagtatattctttggt

SEQ ID NO: 6655708 - DNA, 11 bp, Homo sapiens
ataaacagtca

SEQ ID NO: 6655709 - DNA, 15 bp, Homo sapiens
ataaacagttttgga

SEQ ID NO: 6655710 - DNA, 19 bp, Homo sapiens
ataaacagttttggagaaa

SEQ ID NO: 6655711 - DNA, 20 bp, Homo sapiens
ataaacatatacagaaaaat

SEQ ID NO: 6655712 - DNA, 12 bp, Homo sapiens
ataaacatatgt

SEQ ID NO: 6655713 - DNA, 19 bp, Homo sapiens
ataaacatatttttatact

SEQ ID NO: 6655714 - DNA, 17 bp, Homo sapiens
ataaacatcacatgaga

SEQ ID NO: 6655715 - DNA, 22 bp, Homo sapiens
ataaacatcaggttaggcagta

SEQ ID NO: 6655716 - DNA, 16 bp, Homo sapiens
ataaacatcagtttct

SEQ ID NO: 6655717 - DNA, 12 bp, Homo sapiens
ataaacatgaaa

SEQ ID NO: 6655718 - DNA, 14 bp, Homo sapiens
ataaacatgtcaca

SEQ ID NO: 6655719 - DNA, 22 bp, Homo sapiens
ataaacatgtcacaatacagta

SEQ ID NO: 6655720 - DNA, 20 bp, Homo sapiens
ataaacattaaaagaagact

SEQ ID NO: 6655721 - DNA, 15 bp, Homo sapiens
ataaacattaaatgt

SEQ ID NO: 6655722 - DNA, 16 bp, Homo sapiens
ataaacattaaatgtc

SEQ ID NO: 6655723 - DNA, 21 bp, Homo sapiens
ataaacattaaatgtcttata

SEQ ID NO: 6655724 - DNA, 16 bp, Homo sapiens
ataaacattaattgga

SEQ ID NO: 6655725 - DNA, 17 bp, Homo sapiens
ataaacattaattttgt

SEQ ID NO: 6655726 - DNA, 22 bp, Homo sapiens
ataaacattaattttgtgcatt

SEQ ID NO: 6655727 - DNA, 13 bp, Homo sapiens
ataaacattgtat

SEQ ID NO: 6655728 - DNA, 13 bp, Homo sapiens
ataaacatttgca

SEQ ID NO: 6655729 - DNA, 15 bp, Homo sapiens
ataaacatttgccaa

SEQ ID NO: 6655730 - DNA, 23 bp, Homo sapiens
ataaacattttgtccacctttta

SEQ ID NO: 6655731 - DNA, 16 bp, Homo sapiens
ataaacattttttaag

SEQ ID NO: 6655732 - DNA, 22 bp, Homo sapiens
ataaaccaaacccagccactgc

SEQ ID NO: 6655733 - DNA, 13 bp, Homo sapiens
ataaaccaagaca

SEQ ID NO: 6655734 - DNA, 17 bp, Homo sapiens
ataaaccacaagcatct

SEQ ID NO: 6655735 - DNA, 16 bp, Homo sapiens
ataaaccaccctctgg

SEQ ID NO: 6655736 - DNA, 20 bp, Homo sapiens
ataaaccaccctctggggac

SEQ ID NO: 6655737 - DNA, 18 bp, Homo sapiens
ataaaccactcagtaaaa

SEQ ID NO: 6655738 - DNA, 15 bp, Homo sapiens
ataaaccactgtgcg

SEQ ID NO: 6655739 - DNA, 19 bp, Homo sapiens
ataaaccaggtttgcacct

SEQ ID NO: 6655740 - DNA, 12 bp, Homo sapiens
ataaaccagtgt

SEQ ID NO: 6655741 - DNA, 19 bp, Homo sapiens
ataaaccatttttgttact

SEQ ID NO: 6655742 - DNA, 21 bp, Homo sapiens
ataaacccagttgccatctgc

SEQ ID NO: 6655743 - DNA, 16 bp, Homo sapiens
ataaacccatctgtaa

SEQ ID NO: 6655744 - DNA, 19 bp, Homo sapiens
ataaacccatctgtaatat

SEQ ID NO: 6655745 - DNA, 22 bp, Homo sapiens
ataaaccccaccccaaaattag

SEQ ID NO: 6655746 - DNA, 23 bp, Homo sapiens
ataaaccccaccccaaaattagc

SEQ ID NO: 6655747 - DNA, 14 bp, Homo sapiens
ataaaccctccaag

SEQ ID NO: 6655748 - DNA, 21 bp, Homo sapiens
ataaaccctccaagggatctg

SEQ ID NO: 6655749 - DNA, 13 bp, Homo sapiens
ataaaccctcctt

SEQ ID NO: 6655750 - DNA, 20 bp, Homo sapiens
ataaaccctccttggtgcct

SEQ ID NO: 6655751 - DNA, 16 bp, Homo sapiens
ataaaccggatcctgt

SEQ ID NO: 6655752 - DNA, 18 bp, Homo sapiens
ataaaccgtttttaacac

SEQ ID NO: 6655753 - DNA, 17 bp, Homo sapiens
ataaacctaaaaaagat

SEQ ID NO: 6655754 - DNA, 14 bp, Homo sapiens
ataaacctccgcca

SEQ ID NO: 6655755 - DNA, 18 bp, Homo sapiens
ataaacctctaatttatt

SEQ ID NO: 6655756 - DNA, 13 bp, Homo sapiens
ataaacctggaga

SEQ ID NO: 6655757 - DNA, 16 bp, Homo sapiens
ataaacctggagatat

SEQ ID NO: 6655758 - DNA, 15 bp, Homo sapiens
ataaacctggagatg

SEQ ID NO: 6655759 - DNA, 19 bp, Homo sapiens
ataaacctggagatgatga

SEQ ID NO: 6655760 - DNA, 14 bp, Homo sapiens
ataaacctggcact

SEQ ID NO: 6655761 - DNA, 15 bp, Homo sapiens
ataaacctgggcaag

SEQ ID NO: 6655762 - DNA, 17 bp, Homo sapiens
ataaacctgttcttcct

SEQ ID NO: 6655763 - DNA, 14 bp, Homo sapiens
ataaaccttaaatg

SEQ ID NO: 6655764 - DNA, 15 bp, Homo sapiens
ataaaccttaaatga

SEQ ID NO: 6655765 - DNA, 18 bp, Homo sapiens
ataaaccttaatatttct

SEQ ID NO: 6655766 - DNA, 14 bp, Homo sapiens
ataaaccttatgaa

SEQ ID NO: 6655767 - DNA, 18 bp, Homo sapiens
ataaaccttcagaagcta

SEQ ID NO: 6655768 - DNA, 11 bp, Homo sapiens
ataaaccttga

SEQ ID NO: 6655769 - DNA, 18 bp, Homo sapiens
ataaacggactcagtgga

SEQ ID NO: 6655770 - DNA, 20 bp, Homo sapiens
ataaacgtgatgatcagctg

SEQ ID NO: 6655771 - DNA, 22 bp, Homo sapiens
ataaactaaaaactaacagcta

SEQ ID NO: 6655772 - DNA, 19 bp, Homo sapiens
ataaactaattttgtacgt

SEQ ID NO: 6655773 - DNA, 14 bp, Homo sapiens
ataaactacaaaaa

SEQ ID NO: 6655774 - DNA, 14 bp, Homo sapiens
ataaactaccaaat

SEQ ID NO: 6655775 - DNA, 18 bp, Homo sapiens
ataaactagtatgaaata

SEQ ID NO: 6655776 - DNA, 19 bp, Homo sapiens
ataaactagtatgaaataa

SEQ ID NO: 6655777 - DNA, 14 bp, Homo sapiens
ataaactagtttcc

SEQ ID NO: 6655778 - DNA, 15 bp, Homo sapiens
ataaactataaactt

SEQ ID NO: 6655779 - DNA, 14 bp, Homo sapiens
ataaactcagtcaa

SEQ ID NO: 6655780 - DNA, 13 bp, Homo sapiens
ataaactccttaa

SEQ ID NO: 6655781 - DNA, 15 bp, Homo sapiens
ataaactctaaacat

SEQ ID NO: 6655782 - DNA, 18 bp, Homo sapiens
ataaactcttcaaggcca

SEQ ID NO: 6655783 - DNA, 20 bp, Homo sapiens
ataaactgaaatttgctata

SEQ ID NO: 6655784 - DNA, 12 bp, Homo sapiens
ataaactgaata

SEQ ID NO: 6655785 - DNA, 19 bp, Homo sapiens
ataaactgaatattttgga

SEQ ID NO: 6655786 - DNA, 12 bp, Homo sapiens
ataaactgactt

SEQ ID NO: 6655787 - DNA, 13 bp, Homo sapiens
ataaactgacttt

SEQ ID NO: 6655788 - DNA, 20 bp, Homo sapiens
ataaactgagcctcttttca

SEQ ID NO: 6655789 - DNA, 13 bp, Homo sapiens
ataaactgcaaat

SEQ ID NO: 6655790 - DNA, 13 bp, Homo sapiens
ataaactgcaagt

SEQ ID NO: 6655791 - DNA, 12 bp, Homo sapiens
ataaactgctgt

SEQ ID NO: 6655792 - DNA, 18 bp, Homo sapiens
ataaactggcagctcagc

SEQ ID NO: 6655793 - DNA, 17 bp, Homo sapiens
ataaactggtatgaata

SEQ ID NO: 6655794 - DNA, 21 bp, Homo sapiens
ataaactggtatgaataattg

SEQ ID NO: 6655795 - DNA, 12 bp, Homo sapiens
ataaactgtaaa

SEQ ID NO: 6655796 - DNA, 15 bp, Homo sapiens
ataaactgtaaacta

SEQ ID NO: 6655797 - DNA, 15 bp, Homo sapiens
ataaactgtacaaat

SEQ ID NO: 6655798 - DNA, 19 bp, Homo sapiens
ataaactgtacaaatgaaa

SEQ ID NO: 6655799 - DNA, 22 bp, Homo sapiens
ataaactgtacaaatgaaattt

SEQ ID NO: 6655800 - DNA, 22 bp, Homo sapiens
ataaactgtagcgaccccagac

SEQ ID NO: 6655801 - DNA, 23 bp, Homo sapiens
ataaactgtagcgaccccagact

SEQ ID NO: 6655802 - DNA, 19 bp, Homo sapiens
ataaactgtattaaatctt

SEQ ID NO: 6655803 - DNA, 17 bp, Homo sapiens
ataaactgtattttgaa

SEQ ID NO: 6655804 - DNA, 10 bp, Homo sapiens
ataaactgtg

SEQ ID NO: 6655805 - DNA, 20 bp, Homo sapiens
ataaactgtgagataaatat

SEQ ID NO: 6655806 - DNA, 22 bp, Homo sapiens
ataaactgtgagataaatatca

SEQ ID NO: 6655807 - DNA, 19 bp, Homo sapiens
ataaactgtttatataaag

SEQ ID NO: 6655808 - DNA, 14 bp, Homo sapiens
ataaactgttttca

SEQ ID NO: 6655809 - DNA, 16 bp, Homo sapiens
ataaacttaaaaagaa

SEQ ID NO: 6655810 - DNA, 16 bp, Homo sapiens
ataaacttaagggcaa

SEQ ID NO: 6655811 - DNA, 21 bp, Homo sapiens
ataaacttagaataaaattgt

SEQ ID NO: 6655812 - DNA, 16 bp, Homo sapiens
ataaacttagaggaaa

SEQ ID NO: 6655813 - DNA, 20 bp, Homo sapiens
ataaacttagaggaaaatga

SEQ ID NO: 6655814 - DNA, 13 bp, Homo sapiens
ataaacttcagag

SEQ ID NO: 6655815 - DNA, 16 bp, Homo sapiens
ataaacttcagcacca

SEQ ID NO: 6655816 - DNA, 11 bp, Homo sapiens
ataaacttctt

SEQ ID NO: 6655817 - DNA, 15 bp, Homo sapiens
ataaacttcttaaca

SEQ ID NO: 6655818 - DNA, 13 bp, Homo sapiens
ataaacttgtact

SEQ ID NO: 6655819 - DNA, 14 bp, Homo sapiens
ataaacttgtactt

SEQ ID NO: 6655820 - DNA, 15 bp, Homo sapiens
ataaacttgtactta

SEQ ID NO: 6655821 - DNA, 14 bp, Homo sapiens
ataaacttgtgcct

SEQ ID NO: 6655822 - DNA, 15 bp, Homo sapiens
ataaacttgtgcctc

SEQ ID NO: 6655823 - DNA, 20 bp, Homo sapiens
ataaacttgtgcctccaatg

SEQ ID NO: 6655824 - DNA, 15 bp, Homo sapiens
ataaacttgtgtatg

SEQ ID NO: 6655825 - DNA, 16 bp, Homo sapiens
ataaactttaatataa

SEQ ID NO: 6655826 - DNA, 15 bp, Homo sapiens
ataaactttacatat

SEQ ID NO: 6655827 - DNA, 15 bp, Homo sapiens
ataaactttaccttt

SEQ ID NO: 6655828 - DNA, 21 bp, Homo sapiens
ataaactttaccttttttata

SEQ ID NO: 6655829 - DNA, 17 bp, Homo sapiens
ataaactttagagtaga

SEQ ID NO: 6655830 - DNA, 12 bp, Homo sapiens
ataaactttatt

SEQ ID NO: 6655831 - DNA, 14 bp, Homo sapiens
ataaactttcaaat

SEQ ID NO: 6655832 - DNA, 14 bp, Homo sapiens
ataaacttttagaa

SEQ ID NO: 6655833 - DNA, 18 bp, Homo sapiens
ataaacttttagaaactt

SEQ ID NO: 6655834 - DNA, 15 bp, Homo sapiens
ataaactttttttca

SEQ ID NO: 6655835 - DNA, 10 bp, Homo sapiens
ataaagaaaa

SEQ ID NO: 6655836 - DNA, 18 bp, Homo sapiens
ataaagaaaaaaatacta

SEQ ID NO: 6655837 - DNA, 14 bp, Homo sapiens
ataaagaaaaagaa

SEQ ID NO: 6655838 - DNA, 19 bp, Homo sapiens
ataaagaaaacttccatag

SEQ ID NO: 6655839 - DNA, 21 bp, Homo sapiens
ataaagaaaagacattttaag

SEQ ID NO: 6655840 - DNA, 17 bp, Homo sapiens
ataaagaaaagatgcac

SEQ ID NO: 6655841 - DNA, 19 bp, Homo sapiens
ataaagaaaagatgcactt

SEQ ID NO: 6655842 - DNA, 18 bp, Homo sapiens
ataaagaaaatcaatgaa

SEQ ID NO: 6655843 - DNA, 20 bp, Homo sapiens
ataaagaaacggtatgactt

SEQ ID NO: 6655844 - DNA, 15 bp, Homo sapiens
ataaagaaacttttg

SEQ ID NO: 6655845 - DNA, 13 bp, Homo sapiens
ataaagaaagatt

SEQ ID NO: 6655846 - DNA, 16 bp, Homo sapiens
ataaagaaagattgta

SEQ ID NO: 6655847 - DNA, 11 bp, Homo sapiens
ataaagaaatt

SEQ ID NO: 6655848 - DNA, 14 bp, Homo sapiens
ataaagaaattcaa

SEQ ID NO: 6655849 - DNA, 21 bp, Homo sapiens
ataaagaagaaacttgtaaat

SEQ ID NO: 6655850 - DNA, 14 bp, Homo sapiens
ataaagaagatgtt

SEQ ID NO: 6655851 - DNA, 20 bp, Homo sapiens
ataaagaagctactattttg

SEQ ID NO: 6655852 - DNA, 23 bp, Homo sapiens
ataaagaataggacttgtttttg

SEQ ID NO: 6655853 - DNA, 21 bp, Homo sapiens
ataaagaatgccatttctcac

SEQ ID NO: 6655854 - DNA, 16 bp, Homo sapiens
ataaagacaacaaaag

SEQ ID NO: 6655855 - DNA, 11 bp, Homo sapiens
ataaagacaag

SEQ ID NO: 6655856 - DNA, 18 bp, Homo sapiens
ataaagacaatcactgcc

SEQ ID NO: 6655857 - DNA, 12 bp, Homo sapiens
ataaagacacct

SEQ ID NO: 6655858 - DNA, 20 bp, Homo sapiens
ataaagacactggcagagag

SEQ ID NO: 6655859 - DNA, 14 bp, Homo sapiens
ataaagaccacttt

SEQ ID NO: 6655860 - DNA, 17 bp, Homo sapiens
ataaagaccagaaattc

SEQ ID NO: 6655861 - DNA, 20 bp, Homo sapiens
ataaagaccgtacaaactca

SEQ ID NO: 6655862 - DNA, 16 bp, Homo sapiens
ataaagacctataaat

SEQ ID NO: 6655863 - DNA, 16 bp, Homo sapiens
ataaagacgttttata

SEQ ID NO: 6655864 - DNA, 22 bp, Homo sapiens
ataaagacgttttataagcatc

SEQ ID NO: 6655865 - DNA, 24 bp, Homo sapiens
ataaagacgttttataagcatcat

SEQ ID NO: 6655866 - DNA, 11 bp, Homo sapiens
ataaagactgt

SEQ ID NO: 6655867 - DNA, 10 bp, Homo sapiens
ataaagactt

SEQ ID NO: 6655868 - DNA, 20 bp, Homo sapiens
ataaagacttgtgcatccct

SEQ ID NO: 6655869 - DNA, 23 bp, Homo sapiens
ataaagacttttatgtgagattt

SEQ ID NO: 6655870 - DNA, 14 bp, Homo sapiens
ataaagagaaaatg

SEQ ID NO: 6655871 - DNA, 15 bp, Homo sapiens
ataaagagaaaatga

SEQ ID NO: 6655872 - DNA, 16 bp, Homo sapiens
ataaagagaaaattga

SEQ ID NO: 6655873 - DNA, 17 bp, Homo sapiens
ataaagagaaaattgaa

SEQ ID NO: 6655874 - DNA, 14 bp, Homo sapiens
ataaagagaaatat

SEQ ID NO: 6655875 - DNA, 20 bp, Homo sapiens
ataaagagagaacaggacta

SEQ ID NO: 6655876 - DNA, 22 bp, Homo sapiens
ataaagagatacgaatttctat

SEQ ID NO: 6655877 - DNA, 11 bp, Homo sapiens
ataaagagctc

SEQ ID NO: 6655878 - DNA, 21 bp, Homo sapiens
ataaagaggagtgttattgca

SEQ ID NO: 6655879 - DNA, 22 bp, Homo sapiens
ataaagaggagtgttattgcat

SEQ ID NO: 6655880 - DNA, 22 bp, Homo sapiens
ataaagagttctccttgtactt

SEQ ID NO: 6655881 - DNA, 14 bp, Homo sapiens
ataaagataaatgc

SEQ ID NO: 6655882 - DNA, 19 bp, Homo sapiens
ataaagatacatgattgaa

SEQ ID NO: 6655883 - DNA, 21 bp, Homo sapiens
ataaagatatatagagatgca

SEQ ID NO: 6655884 - DNA, 16 bp, Homo sapiens
ataaagatattgttca

SEQ ID NO: 6655885 - DNA, 18 bp, Homo sapiens
ataaagatatttccaaga

SEQ ID NO: 6655886 - DNA, 13 bp, Homo sapiens
ataaagatcattt

SEQ ID NO: 6655887 - DNA, 13 bp, Homo sapiens
ataaagatgagtt

SEQ ID NO: 6655888 - DNA, 14 bp, Homo sapiens
ataaagatgagttg

SEQ ID NO: 6655889 - DNA, 15 bp, Homo sapiens
ataaagatgagttgg

SEQ ID NO: 6655890 - DNA, 15 bp, Homo sapiens
ataaagatgctcttt

SEQ ID NO: 6655891 - DNA, 18 bp, Homo sapiens
ataaagatggctgacttt

SEQ ID NO: 6655892 - DNA, 16 bp, Homo sapiens
ataaagatggtccaaa

SEQ ID NO: 6655893 - DNA, 23 bp, Homo sapiens
ataaagatgtcaaatatctcaga

SEQ ID NO: 6655894 - DNA, 13 bp, Homo sapiens
ataaagatgtgaa

SEQ ID NO: 6655895 - DNA, 15 bp, Homo sapiens
ataaagatgtgaaaa

SEQ ID NO: 6655896 - DNA, 15 bp, Homo sapiens
ataaagatgttaaat

SEQ ID NO: 6655897 - DNA, 17 bp, Homo sapiens
ataaagatgttaaatgg

SEQ ID NO: 6655898 - DNA, 20 bp, Homo sapiens
ataaagatgttaaatggaat

SEQ ID NO: 6655899 - DNA, 19 bp, Homo sapiens
ataaagattattttttgat

SEQ ID NO: 6655900 - DNA, 14 bp, Homo sapiens
ataaagattctcac

SEQ ID NO: 6655901 - DNA, 14 bp, Homo sapiens
ataaagattgtact

SEQ ID NO: 6655902 - DNA, 20 bp, Homo sapiens
ataaagatttcttgagtttt

SEQ ID NO: 6655903 - DNA, 18 bp, Homo sapiens
ataaagatttttgttaag

SEQ ID NO: 6655904 - DNA, 18 bp, Homo sapiens
ataaagcaaatagacaca

SEQ ID NO: 6655905 - DNA, 22 bp, Homo sapiens
ataaagcaactgttatgaaata

SEQ ID NO: 6655906 - DNA, 19 bp, Homo sapiens
ataaagcaataagaacaaa

SEQ ID NO: 6655907 - DNA, 13 bp, Homo sapiens
ataaagcaatctg

SEQ ID NO: 6655908 - DNA, 14 bp, Homo sapiens
ataaagcaatgaat

SEQ ID NO: 6655909 - DNA, 15 bp, Homo sapiens
ataaagcaatgaata

SEQ ID NO: 6655910 - DNA, 16 bp, Homo sapiens
ataaagcaatgaatac

SEQ ID NO: 6655911 - DNA, 16 bp, Homo sapiens
ataaagcaatgtgttt

SEQ ID NO: 6655912 - DNA, 11 bp, Homo sapiens
ataaagcaatt

SEQ ID NO: 6655913 - DNA, 16 bp, Homo sapiens
ataaagcagaagcaac

SEQ ID NO: 6655914 - DNA, 12 bp, Homo sapiens
ataaagcagagc

SEQ ID NO: 6655915 - DNA, 23 bp, Homo sapiens
ataaagcagcctgattgaaaagc

SEQ ID NO: 6655916 - DNA, 19 bp, Homo sapiens
ataaagcagcgtttctatg

SEQ ID NO: 6655917 - DNA, 20 bp, Homo sapiens
ataaagcagcgtttctatga

SEQ ID NO: 6655918 - DNA, 12 bp, Homo sapiens
ataaagcaggga

SEQ ID NO: 6655919 - DNA, 15 bp, Homo sapiens
ataaagcagtagaca

SEQ ID NO: 6655920 - DNA, 17 bp, Homo sapiens
ataaagcatctaaactt

SEQ ID NO: 6655921 - DNA, 15 bp, Homo sapiens
ataaagcattactct

SEQ ID NO: 6655922 - DNA, 14 bp, Homo sapiens
ataaagcatttata

SEQ ID NO: 6655923 - DNA, 12 bp, Homo sapiens
ataaagccaaga

SEQ ID NO: 6655924 - DNA, 14 bp, Homo sapiens
ataaagccaagaat

SEQ ID NO: 6655925 - DNA, 16 bp, Homo sapiens
ataaagccacttctgg

SEQ ID NO: 6655926 - DNA, 14 bp, Homo sapiens
ataaagcctgcttt

SEQ ID NO: 6655927 - DNA, 11 bp, Homo sapiens
ataaagccttt

SEQ ID NO: 6655928 - DNA, 12 bp, Homo sapiens
ataaagccttta

SEQ ID NO: 6655929 - DNA, 21 bp, Homo sapiens
ataaagcgatatacagatgaa

SEQ ID NO: 6655930 - DNA, 18 bp, Homo sapiens
ataaagcgtgcaccgtgc

SEQ ID NO: 6655931 - DNA, 18 bp, Homo sapiens
ataaagctaccatgttaa

SEQ ID NO: 6655932 - DNA, 15 bp, Homo sapiens
ataaagctaccattt

SEQ ID NO: 6655933 - DNA, 14 bp, Homo sapiens
ataaagctactgaa

SEQ ID NO: 6655934 - DNA, 22 bp, Homo sapiens
ataaagctcaaatgaaatgtat

SEQ ID NO: 6655935 - DNA, 16 bp, Homo sapiens
ataaagctcacacttg

SEQ ID NO: 6655936 - DNA, 22 bp, Homo sapiens
ataaagctcgtccccattgctt

SEQ ID NO: 6655937 - DNA, 16 bp, Homo sapiens
ataaagctgtgacagt

SEQ ID NO: 6655938 - DNA, 22 bp, Homo sapiens
ataaagctgtgacagttctgtt

SEQ ID NO: 6655939 - DNA, 14 bp, Homo sapiens
ataaagctgtgagc

SEQ ID NO: 6655940 - DNA, 12 bp, Homo sapiens
ataaagctgtta

SEQ ID NO: 6655941 - DNA, 13 bp, Homo sapiens
ataaagctgttat

SEQ ID NO: 6655942 - DNA, 14 bp, Homo sapiens
ataaagctgttatt

SEQ ID NO: 6655943 - DNA, 20 bp, Homo sapiens
ataaagctgttattcttgtt

SEQ ID NO: 6655944 - DNA, 21 bp, Homo sapiens
ataaagctgttattcttgtta

SEQ ID NO: 6655945 - DNA, 23 bp, Homo sapiens
ataaagctgttattcttgttata

SEQ ID NO: 6655946 - DNA, 14 bp, Homo sapiens
ataaagctgttctc

SEQ ID NO: 6655947 - DNA, 17 bp, Homo sapiens
ataaagctgttcttgaa

SEQ ID NO: 6655948 - DNA, 13 bp, Homo sapiens
ataaagcttaaat

SEQ ID NO: 6655949 - DNA, 17 bp, Homo sapiens
ataaagcttaaatttta

SEQ ID NO: 6655950 - DNA, 18 bp, Homo sapiens
ataaagcttaaattttat

SEQ ID NO: 6655951 - DNA, 18 bp, Homo sapiens
ataaagcttctctctgag

SEQ ID NO: 6655952 - DNA, 20 bp, Homo sapiens
ataaagcttttgcatagaat

SEQ ID NO: 6655953 - DNA, 21 bp, Homo sapiens
ataaagcttttgcatagaata

SEQ ID NO: 6655954 - DNA, 14 bp, Homo sapiens
ataaaggaaaacaa

SEQ ID NO: 6655955 - DNA, 15 bp, Homo sapiens
ataaaggaaaacaaa

SEQ ID NO: 6655956 - DNA, 18 bp, Homo sapiens
ataaaggacactggatca

SEQ ID NO: 6655957 - DNA, 19 bp, Homo sapiens
ataaaggaccctgtttctg

SEQ ID NO: 6655958 - DNA, 14 bp, Homo sapiens
ataaaggagcatat

SEQ ID NO: 6655959 - DNA, 17 bp, Homo sapiens
ataaaggaggaatcaga

SEQ ID NO: 6655960 - DNA, 18 bp, Homo sapiens
ataaaggaggaatcagac

SEQ ID NO: 6655961 - DNA, 14 bp, Homo sapiens
ataaaggataaact

SEQ ID NO: 6655962 - DNA, 15 bp, Homo sapiens
ataaaggataactct

SEQ ID NO: 6655963 - DNA, 16 bp, Homo sapiens
ataaaggataactctg

SEQ ID NO: 6655964 - DNA, 13 bp, Homo sapiens
ataaaggatgtga

SEQ ID NO: 6655965 - DNA, 22 bp, Homo sapiens
ataaaggatgtgattgtggaat

SEQ ID NO: 6655966 - DNA, 14 bp, Homo sapiens
ataaaggcaaggaa

SEQ ID NO: 6655967 - DNA, 16 bp, Homo sapiens
ataaaggcaaggaaat

SEQ ID NO: 6655968 - DNA, 20 bp, Homo sapiens
ataaaggcaaggaaattaag

SEQ ID NO: 6655969 - DNA, 22 bp, Homo sapiens
ataaaggcagctgcctctgctc

SEQ ID NO: 6655970 - DNA, 14 bp, Homo sapiens
ataaaggctctgga

SEQ ID NO: 6655971 - DNA, 20 bp, Homo sapiens
ataaaggcttaggacttcaa

SEQ ID NO: 6655972 - DNA, 16 bp, Homo sapiens
ataaagggaacatgca

SEQ ID NO: 6655973 - DNA, 20 bp, Homo sapiens
ataaagggaacatgcagctc

SEQ ID NO: 6655974 - DNA, 16 bp, Homo sapiens
ataaagggttgaaaat

SEQ ID NO: 6655975 - DNA, 15 bp, Homo sapiens
ataaaggtaaaatca

SEQ ID NO: 6655976 - DNA, 16 bp, Homo sapiens
ataaaggtaaaatcac

SEQ ID NO: 6655977 - DNA, 18 bp, Homo sapiens
ataaaggtaaaatcactt

SEQ ID NO: 6655978 - DNA, 20 bp, Homo sapiens
ataaaggtaaaatcacttca

SEQ ID NO: 6655979 - DNA, 20 bp, Homo sapiens
ataaaggtcacataaacttt

SEQ ID NO: 6655980 - DNA, 16 bp, Homo sapiens
ataaaggtcccttagc

SEQ ID NO: 6655981 - DNA, 22 bp, Homo sapiens
ataaaggtctttgcacatgtga

SEQ ID NO: 6655982 - DNA, 22 bp, Homo sapiens
ataaaggtgaggggaagacaaa

SEQ ID NO: 6655983 - DNA, 14 bp, Homo sapiens
ataaaggttatgaa

SEQ ID NO: 6655984 - DNA, 16 bp, Homo sapiens
ataaaggttatgaaac

SEQ ID NO: 6655985 - DNA, 17 bp, Homo sapiens
ataaagtaaagctaaaa

SEQ ID NO: 6655986 - DNA, 22 bp, Homo sapiens
ataaagtaataatgtgcaaatc

SEQ ID NO: 6655987 - DNA, 15 bp, Homo sapiens
ataaagtaatgatga

SEQ ID NO: 6655988 - DNA, 15 bp, Homo sapiens
ataaagtaattttta

SEQ ID NO: 6655989 - DNA, 16 bp, Homo sapiens
ataaagtactactgta

SEQ ID NO: 6655990 - DNA, 23 bp, Homo sapiens
ataaagtactttagcctggtacc

SEQ ID NO: 6655991 - DNA, 15 bp, Homo sapiens
ataaagtagaactaa

SEQ ID NO: 6655992 - DNA, 16 bp, Homo sapiens
ataaagtagcaaaaca

SEQ ID NO: 6655993 - DNA, 17 bp, Homo sapiens
ataaagtagcaaaacaa

SEQ ID NO: 6655994 - DNA, 14 bp, Homo sapiens
ataaagtaggaaag

SEQ ID NO: 6655995 - DNA, 13 bp, Homo sapiens
ataaagtagtaaa

SEQ ID NO: 6655996 - DNA, 18 bp, Homo sapiens
ataaagtagtaaaaatta

SEQ ID NO: 6655997 - DNA, 20 bp, Homo sapiens
ataaagtatattgaaagttt

SEQ ID NO: 6655998 - DNA, 15 bp, Homo sapiens
ataaagtatcatcag

SEQ ID NO: 6655999 - DNA, 17 bp, Homo sapiens
ataaagtatcatgcatt

SEQ ID NO: 6656000 - DNA, 14 bp, Homo sapiens
ataaagtatgaata

SEQ ID NO: 6656001 - DNA, 19 bp, Homo sapiens
ataaagtatggtattgaaa

SEQ ID NO: 6656002 - DNA, 20 bp, Homo sapiens
ataaagtattcaacaatttc

SEQ ID NO: 6656003 - DNA, 23 bp, Homo sapiens
ataaagtattccaccttaaatta

SEQ ID NO: 6656004 - DNA, 12 bp, Homo sapiens
ataaagtattta

SEQ ID NO: 6656005 - DNA, 15 bp, Homo sapiens
ataaagtatttaatt

SEQ ID NO: 6656006 - DNA, 17 bp, Homo sapiens
ataaagtatttatctcc

SEQ ID NO: 6656007 - DNA, 12 bp, Homo sapiens
ataaagtatttt

SEQ ID NO: 6656008 - DNA, 23 bp, Homo sapiens
ataaagtatttttataatgactg

SEQ ID NO: 6656009 - DNA, 17 bp, Homo sapiens
ataaagtcatttgtgaa

SEQ ID NO: 6656010 - DNA, 20 bp, Homo sapiens
ataaagtctctttttctcac

SEQ ID NO: 6656011 - DNA, 15 bp, Homo sapiens
ataaagtctgagaaa

SEQ ID NO: 6656012 - DNA, 16 bp, Homo sapiens
ataaagtctgagaaat

SEQ ID NO: 6656013 - DNA, 17 bp, Homo sapiens
ataaagtctgagaaata

SEQ ID NO: 6656014 - DNA, 15 bp, Homo sapiens
ataaagtctgagtgg

SEQ ID NO: 6656015 - DNA, 16 bp, Homo sapiens
ataaagtgaactttgt

SEQ ID NO: 6656016 - DNA, 18 bp, Homo sapiens
ataaagtgaactttgttt

SEQ ID NO: 6656017 - DNA, 18 bp, Homo sapiens
ataaagtgcaaacagaag

SEQ ID NO: 6656018 - DNA, 22 bp, Homo sapiens
ataaagtgcaattgcacaaata

SEQ ID NO: 6656019 - DNA, 17 bp, Homo sapiens
ataaagtgcacaccttt

SEQ ID NO: 6656020 - DNA, 20 bp, Homo sapiens
ataaagtgccttctgggctt

SEQ ID NO: 6656021 - DNA, 12 bp, Homo sapiens
ataaagtggcat

SEQ ID NO: 6656022 - DNA, 13 bp, Homo sapiens
ataaagtggcatt

SEQ ID NO: 6656023 - DNA, 14 bp, Homo sapiens
ataaagtgtaacaa

SEQ ID NO: 6656024 - DNA, 14 bp, Homo sapiens
ataaagtgtgtgtg

SEQ ID NO: 6656025 - DNA, 13 bp, Homo sapiens
ataaagtgttttc

SEQ ID NO: 6656026 - DNA, 16 bp, Homo sapiens
ataaagtgttttcaga

SEQ ID NO: 6656027 - DNA, 17 bp, Homo sapiens
ataaagttaaaaaaaag

SEQ ID NO: 6656028 - DNA, 14 bp, Homo sapiens
ataaagttaaattg

SEQ ID NO: 6656029 - DNA, 17 bp, Homo sapiens
ataaagttaaattgcac

SEQ ID NO: 6656030 - DNA, 18 bp, Homo sapiens
ataaagttacttgaattt

SEQ ID NO: 6656031 - DNA, 15 bp, Homo sapiens
ataaagttccttaag

SEQ ID NO: 6656032 - DNA, 22 bp, Homo sapiens
ataaagttgaagctaagattta

SEQ ID NO: 6656033 - DNA, 18 bp, Homo sapiens
ataaagttgagagacagt

SEQ ID NO: 6656034 - DNA, 21 bp, Homo sapiens
ataaagttgataaagattttt

SEQ ID NO: 6656035 - DNA, 17 bp, Homo sapiens
ataaagttggtgacaga

SEQ ID NO: 6656036 - DNA, 17 bp, Homo sapiens
ataaagttgtaaataat

SEQ ID NO: 6656037 - DNA, 22 bp, Homo sapiens
ataaagttgtaaataattttct

SEQ ID NO: 6656038 - DNA, 23 bp, Homo sapiens
ataaagttgtaaataattttcta

SEQ ID NO: 6656039 - DNA, 21 bp, Homo sapiens
ataaagttgtatttcaaatat

SEQ ID NO: 6656040 - DNA, 16 bp, Homo sapiens
ataaagttgttgcatt

SEQ ID NO: 6656041 - DNA, 17 bp, Homo sapiens
ataaagttgttgcattc

SEQ ID NO: 6656042 - DNA, 12 bp, Homo sapiens
ataaagtttgat

SEQ ID NO: 6656043 - DNA, 13 bp, Homo sapiens
ataaagtttgatc

SEQ ID NO: 6656044 - DNA, 20 bp, Homo sapiens
ataaagttttatttgaatga

SEQ ID NO: 6656045 - DNA, 22 bp, Homo sapiens
ataaagtttttttatttctttt

SEQ ID NO: 6656046 - DNA, 14 bp, Homo sapiens
ataaataaaaataa

SEQ ID NO: 6656047 - DNA, 14 bp, Homo sapiens
ataaataaaaatat

SEQ ID NO: 6656048 - DNA, 17 bp, Homo sapiens
ataaataaaaatatagg

SEQ ID NO: 6656049 - DNA, 17 bp, Homo sapiens
ataaataaaaatattct

SEQ ID NO: 6656050 - DNA, 16 bp, Homo sapiens
ataaataaaagaaaga

SEQ ID NO: 6656051 - DNA, 14 bp, Homo sapiens
ataaataaaagcta

SEQ ID NO: 6656052 - DNA, 15 bp, Homo sapiens
ataaataaaatggat

SEQ ID NO: 6656053 - DNA, 13 bp, Homo sapiens
ataaataaacttt

SEQ ID NO: 6656054 - DNA, 22 bp, Homo sapiens
ataaataaagaagaaaataacc

SEQ ID NO: 6656055 - DNA, 14 bp, Homo sapiens
ataaataaagcaaa

SEQ ID NO: 6656056 - DNA, 16 bp, Homo sapiens
ataaataaagcaaata

SEQ ID NO: 6656057 - DNA, 14 bp, Homo sapiens
ataaataaagtttc

SEQ ID NO: 6656058 - DNA, 19 bp, Homo sapiens
ataaataaagtttgttgaa

SEQ ID NO: 6656059 - DNA, 16 bp, Homo sapiens
ataaataaataatcga

SEQ ID NO: 6656060 - DNA, 12 bp, Homo sapiens
ataaataaatat

SEQ ID NO: 6656061 - DNA, 14 bp, Homo sapiens
ataaataaatatat

SEQ ID NO: 6656062 - DNA, 13 bp, Homo sapiens
ataaataaatatt

SEQ ID NO: 6656063 - DNA, 12 bp, Homo sapiens
ataaataaatgc

SEQ ID NO: 6656064 - DNA, 15 bp, Homo sapiens
ataaataaatgccaa

SEQ ID NO: 6656065 - DNA, 13 bp, Homo sapiens
ataaataaatgtt

SEQ ID NO: 6656066 - DNA, 20 bp, Homo sapiens
ataaataacccataattgaa

SEQ ID NO: 6656067 - DNA, 22 bp, Homo sapiens
ataaataaccctgggctgtcca

SEQ ID NO: 6656068 - DNA, 17 bp, Homo sapiens
ataaataagtaaataca

SEQ ID NO: 6656069 - DNA, 16 bp, Homo sapiens
ataaataataaaggtt

SEQ ID NO: 6656070 - DNA, 17 bp, Homo sapiens
ataaataatattatatt

SEQ ID NO: 6656071 - DNA, 20 bp, Homo sapiens
ataaataatattatattgta

SEQ ID NO: 6656072 - DNA, 15 bp, Homo sapiens
ataaataatcacaca

SEQ ID NO: 6656073 - DNA, 16 bp, Homo sapiens
ataaataatctacatc

SEQ ID NO: 6656074 - DNA, 20 bp, Homo sapiens
ataaataattttgttttaat

SEQ ID NO: 6656075 - DNA, 19 bp, Homo sapiens
ataaatacaaaaatgaata

SEQ ID NO: 6656076 - DNA, 20 bp, Homo sapiens
ataaatacaaaaatgaatac

SEQ ID NO: 6656077 - DNA, 18 bp, Homo sapiens
ataaatacaaatctgtat

SEQ ID NO: 6656078 - DNA, 17 bp, Homo sapiens
ataaatacacaatgaat

SEQ ID NO: 6656079 - DNA, 13 bp, Homo sapiens
ataaataccaaag

SEQ ID NO: 6656080 - DNA, 19 bp, Homo sapiens
ataaataccaattatggaa

SEQ ID NO: 6656081 - DNA, 14 bp, Homo sapiens
ataaatacctctta

SEQ ID NO: 6656082 - DNA, 20 bp, Homo sapiens
ataaatacgtattacaaaca

SEQ ID NO: 6656083 - DNA, 21 bp, Homo sapiens
ataaatactaaatatgaaatt

SEQ ID NO: 6656084 - DNA, 20 bp, Homo sapiens
ataaatactgacaatgtatt

SEQ ID NO: 6656085 - DNA, 18 bp, Homo sapiens
ataaatactgcaaatcag

SEQ ID NO: 6656086 - DNA, 19 bp, Homo sapiens
ataaatactttaacttcca

SEQ ID NO: 6656087 - DNA, 13 bp, Homo sapiens
ataaatagaaaga

SEQ ID NO: 6656088 - DNA, 14 bp, Homo sapiens
ataaatagacactt

SEQ ID NO: 6656089 - DNA, 23 bp, Homo sapiens
ataaatagacacttgagttaact

SEQ ID NO: 6656090 - DNA, 13 bp, Homo sapiens
ataaatagagcaa

SEQ ID NO: 6656091 - DNA, 14 bp, Homo sapiens
ataaatagagcaat

SEQ ID NO: 6656092 - DNA, 21 bp, Homo sapiens
ataaatagatgctgtgtatat

SEQ ID NO: 6656093 - DNA, 16 bp, Homo sapiens
ataaatagatttagtc

SEQ ID NO: 6656094 - DNA, 21 bp, Homo sapiens
ataaatagatttgattatttc

SEQ ID NO: 6656095 - DNA, 11 bp, Homo sapiens
ataaatagcta

SEQ ID NO: 6656096 - DNA, 23 bp, Homo sapiens
ataaatagctaaatggcaacaaa

SEQ ID NO: 6656097 - DNA, 18 bp, Homo sapiens
ataaatagctagactggt

SEQ ID NO: 6656098 - DNA, 21 bp, Homo sapiens
ataaatagctagactggtgac

SEQ ID NO: 6656099 - DNA, 22 bp, Homo sapiens
ataaatagctagactggtgact

SEQ ID NO: 6656100 - DNA, 22 bp, Homo sapiens
ataaataggtttatattattga

SEQ ID NO: 6656101 - DNA, 15 bp, Homo sapiens
ataaatagtattcca

SEQ ID NO: 6656102 - DNA, 16 bp, Homo sapiens
ataaatagtattccaa

SEQ ID NO: 6656103 - DNA, 16 bp, Homo sapiens
ataaatataagccttt

SEQ ID NO: 6656104 - DNA, 15 bp, Homo sapiens
ataaatataatttat

SEQ ID NO: 6656105 - DNA, 13 bp, Homo sapiens
ataaatatactaa

SEQ ID NO: 6656106 - DNA, 15 bp, Homo sapiens
ataaatatactaata

SEQ ID NO: 6656107 - DNA, 16 bp, Homo sapiens
ataaatatactaataa

SEQ ID NO: 6656108 - DNA, 15 bp, Homo sapiens
ataaatatatataaa

SEQ ID NO: 6656109 - DNA, 20 bp, Homo sapiens
ataaatatatatatcctctg

SEQ ID NO: 6656110 - DNA, 20 bp, Homo sapiens
ataaatatatatttttcaac

SEQ ID NO: 6656111 - DNA, 21 bp, Homo sapiens
ataaatatatatttttcaacc

SEQ ID NO: 6656112 - DNA, 13 bp, Homo sapiens
ataaatatatcta

SEQ ID NO: 6656113 - DNA, 21 bp, Homo sapiens
ataaatatatctaccccagac

SEQ ID NO: 6656114 - DNA, 12 bp, Homo sapiens
ataaatatatta

SEQ ID NO: 6656115 - DNA, 18 bp, Homo sapiens
ataaatatccccagggac

SEQ ID NO: 6656116 - DNA, 14 bp, Homo sapiens
ataaatatccttta

SEQ ID NO: 6656117 - DNA, 15 bp, Homo sapiens
ataaatatctattta

SEQ ID NO: 6656118 - DNA, 22 bp, Homo sapiens
ataaatatggttaatttcatgt

SEQ ID NO: 6656119 - DNA, 11 bp, Homo sapiens
ataaatatgta

SEQ ID NO: 6656120 - DNA, 21 bp, Homo sapiens
ataaatatgtgaaaatgatta

SEQ ID NO: 6656121 - DNA, 14 bp, Homo sapiens
ataaatatgtgatt

SEQ ID NO: 6656122 - DNA, 15 bp, Homo sapiens
ataaatattatttga

SEQ ID NO: 6656123 - DNA, 15 bp, Homo sapiens
ataaatattctgcat

SEQ ID NO: 6656124 - DNA, 14 bp, Homo sapiens
ataaatattgtatt

SEQ ID NO: 6656125 - DNA, 21 bp, Homo sapiens
ataaatattgtctttttgtat

SEQ ID NO: 6656126 - DNA, 11 bp, Homo sapiens
ataaatattta

SEQ ID NO: 6656127 - DNA, 15 bp, Homo sapiens
ataaatatttatgca

SEQ ID NO: 6656128 - DNA, 20 bp, Homo sapiens
ataaatatttgacttgcatg

SEQ ID NO: 6656129 - DNA, 15 bp, Homo sapiens
ataaatattttagga

SEQ ID NO: 6656130 - DNA, 15 bp, Homo sapiens
ataaatcaattcatt

SEQ ID NO: 6656131 - DNA, 15 bp, Homo sapiens
ataaatcacacattc

SEQ ID NO: 6656132 - DNA, 18 bp, Homo sapiens
ataaatcacagatgcata

SEQ ID NO: 6656133 - DNA, 22 bp, Homo sapiens
ataaatcacagatgcatataga

SEQ ID NO: 6656134 - DNA, 14 bp, Homo sapiens
ataaatcacagatt

SEQ ID NO: 6656135 - DNA, 20 bp, Homo sapiens
ataaatcacagatttccaaa

SEQ ID NO: 6656136 - DNA, 20 bp, Homo sapiens
ataaatcagagagcaaggca

SEQ ID NO: 6656137 - DNA, 15 bp, Homo sapiens
ataaatcataaagtc

SEQ ID NO: 6656138 - DNA, 14 bp, Homo sapiens
ataaatcatattga

SEQ ID NO: 6656139 - DNA, 22 bp, Homo sapiens
ataaatcatgggcattgctgga

SEQ ID NO: 6656140 - DNA, 20 bp, Homo sapiens
ataaatcatgtggcctaata

SEQ ID NO: 6656141 - DNA, 12 bp, Homo sapiens
ataaatcatgtt

SEQ ID NO: 6656142 - DNA, 19 bp, Homo sapiens
ataaatcattcttactaaa

SEQ ID NO: 6656143 - DNA, 14 bp, Homo sapiens
ataaatcattttat

SEQ ID NO: 6656144 - DNA, 15 bp, Homo sapiens
ataaatcattttatg

SEQ ID NO: 6656145 - DNA, 15 bp, Homo sapiens
ataaatccaaaacaa

SEQ ID NO: 6656146 - DNA, 13 bp, Homo sapiens
ataaatccagtga

SEQ ID NO: 6656147 - DNA, 22 bp, Homo sapiens
ataaatccagtgacctctctct

SEQ ID NO: 6656148 - DNA, 18 bp, Homo sapiens
ataaatccagttctacta

SEQ ID NO: 6656149 - DNA, 17 bp, Homo sapiens
ataaatcgcattaatga

SEQ ID NO: 6656150 - DNA, 22 bp, Homo sapiens
ataaatcgcattaatgaaatac

SEQ ID NO: 6656151 - DNA, 19 bp, Homo sapiens
ataaatctaggatgtgatg

SEQ ID NO: 6656152 - DNA, 18 bp, Homo sapiens
ataaatctatgatatatt

SEQ ID NO: 6656153 - DNA, 15 bp, Homo sapiens
ataaatctgacccag

SEQ ID NO: 6656154 - DNA, 18 bp, Homo sapiens
ataaatctgacccagtgc

SEQ ID NO: 6656155 - DNA, 21 bp, Homo sapiens
ataaatctgagcctaaatcta

SEQ ID NO: 6656156 - DNA, 23 bp, Homo sapiens
ataaatctgagcctaaatctaat

SEQ ID NO: 6656157 - DNA, 20 bp, Homo sapiens
ataaatctgtctgattctat

SEQ ID NO: 6656158 - DNA, 22 bp, Homo sapiens
ataaatctgtctgattctatgc

SEQ ID NO: 6656159 - DNA, 20 bp, Homo sapiens
ataaatctgtgaacttgaaa

SEQ ID NO: 6656160 - DNA, 20 bp, Homo sapiens
ataaatctgttagcattatt

SEQ ID NO: 6656161 - DNA, 15 bp, Homo sapiens
ataaatctttggaaa

SEQ ID NO: 6656162 - DNA, 15 bp, Homo sapiens
ataaatgaaagaaac

SEQ ID NO: 6656163 - DNA, 17 bp, Homo sapiens
ataaatgaagcagcttt

SEQ ID NO: 6656164 - DNA, 14 bp, Homo sapiens
ataaatgaataaat

SEQ ID NO: 6656165 - DNA, 15 bp, Homo sapiens
ataaatgaatgtcac

SEQ ID NO: 6656166 - DNA, 15 bp, Homo sapiens
ataaatgacacccag

SEQ ID NO: 6656167 - DNA, 15 bp, Homo sapiens
ataaatgaccagttt

SEQ ID NO: 6656168 - DNA, 17 bp, Homo sapiens
ataaatgaccagtttac

SEQ ID NO: 6656169 - DNA, 18 bp, Homo sapiens
ataaatgaccagtttacc

SEQ ID NO: 6656170 - DNA, 15 bp, Homo sapiens
ataaatgactattgt

SEQ ID NO: 6656171 - DNA, 18 bp, Homo sapiens
ataaatgactattgtaat

SEQ ID NO: 6656172 - DNA, 13 bp, Homo sapiens
ataaatgagctgt

SEQ ID NO: 6656173 - DNA, 16 bp, Homo sapiens
ataaatgatatcaaag

SEQ ID NO: 6656174 - DNA, 17 bp, Homo sapiens
ataaatgatatctatat

SEQ ID NO: 6656175 - DNA, 18 bp, Homo sapiens
ataaatgattcttagtga

SEQ ID NO: 6656176 - DNA, 13 bp, Homo sapiens
ataaatgcaaatg

SEQ ID NO: 6656177 - DNA, 15 bp, Homo sapiens
ataaatgcaatatta

SEQ ID NO: 6656178 - DNA, 17 bp, Homo sapiens
ataaatgcataatttat

SEQ ID NO: 6656179 - DNA, 18 bp, Homo sapiens
ataaatgcataatttatg

SEQ ID NO: 6656180 - DNA, 16 bp, Homo sapiens
ataaatgcatagagca

SEQ ID NO: 6656181 - DNA, 17 bp, Homo sapiens
ataaatgcatagagcaa

SEQ ID NO: 6656182 - DNA, 18 bp, Homo sapiens
ataaatgcatagagcaat

SEQ ID NO: 6656183 - DNA, 21 bp, Homo sapiens
ataaatgcatgattttataca

SEQ ID NO: 6656184 - DNA, 13 bp, Homo sapiens
ataaatgccagag

SEQ ID NO: 6656185 - DNA, 16 bp, Homo sapiens
ataaatgccagagcca

SEQ ID NO: 6656186 - DNA, 17 bp, Homo sapiens
ataaatgccagagccaa

SEQ ID NO: 6656187 - DNA, 17 bp, Homo sapiens
ataaatgccatcaataa

SEQ ID NO: 6656188 - DNA, 17 bp, Homo sapiens
ataaatgccctctctga

SEQ ID NO: 6656189 - DNA, 21 bp, Homo sapiens
ataaatgccctctctgaatgt

SEQ ID NO: 6656190 - DNA, 16 bp, Homo sapiens
ataaatgcctttatat

SEQ ID NO: 6656191 - DNA, 12 bp, Homo sapiens
ataaatgctgaa

SEQ ID NO: 6656192 - DNA, 14 bp, Homo sapiens
ataaatgctgaatg

SEQ ID NO: 6656193 - DNA, 12 bp, Homo sapiens
ataaatgctgct

SEQ ID NO: 6656194 - DNA, 14 bp, Homo sapiens
ataaatgctgcttt

SEQ ID NO: 6656195 - DNA, 14 bp, Homo sapiens
ataaatgctttaaa

SEQ ID NO: 6656196 - DNA, 21 bp, Homo sapiens
ataaatggacttgcttcttgt

SEQ ID NO: 6656197 - DNA, 16 bp, Homo sapiens
ataaatggccagtgct

SEQ ID NO: 6656198 - DNA, 16 bp, Homo sapiens
ataaatggctcgtggg

SEQ ID NO: 6656199 - DNA, 16 bp, Homo sapiens
ataaatggctggtttt

SEQ ID NO: 6656200 - DNA, 20 bp, Homo sapiens
ataaatgggtaacactgatt

SEQ ID NO: 6656201 - DNA, 13 bp, Homo sapiens
ataaatgggtgta

SEQ ID NO: 6656202 - DNA, 21 bp, Homo sapiens
ataaatggtgagaattaaaat

SEQ ID NO: 6656203 - DNA, 16 bp, Homo sapiens
ataaatggttaaaaga

SEQ ID NO: 6656204 - DNA, 13 bp, Homo sapiens
ataaatggtttct

SEQ ID NO: 6656205 - DNA, 21 bp, Homo sapiens
ataaatggtttggtgcttttt

SEQ ID NO: 6656206 - DNA, 18 bp, Homo sapiens
ataaatgtacaggttgga

SEQ ID NO: 6656207 - DNA, 13 bp, Homo sapiens
ataaatgtacatt

SEQ ID NO: 6656208 - DNA, 15 bp, Homo sapiens
ataaatgtacattaa

SEQ ID NO: 6656209 - DNA, 15 bp, Homo sapiens
ataaatgtacatttc

SEQ ID NO: 6656210 - DNA, 22 bp, Homo sapiens
ataaatgtactacatttgcatg

SEQ ID NO: 6656211 - DNA, 19 bp, Homo sapiens
ataaatgtataaatataca

SEQ ID NO: 6656212 - DNA, 13 bp, Homo sapiens
ataaatgtatata

SEQ ID NO: 6656213 - DNA, 13 bp, Homo sapiens
ataaatgtatcat

SEQ ID NO: 6656214 - DNA, 21 bp, Homo sapiens
ataaatgtatcatagaaatgt

SEQ ID NO: 6656215 - DNA, 23 bp, Homo sapiens
ataaatgtatcatttttgtgcac

SEQ ID NO: 6656216 - DNA, 14 bp, Homo sapiens
ataaatgtatctga

SEQ ID NO: 6656217 - DNA, 17 bp, Homo sapiens
ataaatgtatctgaata

SEQ ID NO: 6656218 - DNA, 22 bp, Homo sapiens
ataaatgtattcaaataccaat

SEQ ID NO: 6656219 - DNA, 12 bp, Homo sapiens
ataaatgtcttt

SEQ ID NO: 6656220 - DNA, 22 bp, Homo sapiens
ataaatgtcttttttttaatgt

SEQ ID NO: 6656221 - DNA, 21 bp, Homo sapiens
ataaatgtgatttttttatat

SEQ ID NO: 6656222 - DNA, 12 bp, Homo sapiens
ataaatgtgtgg

SEQ ID NO: 6656223 - DNA, 21 bp, Homo sapiens
ataaatgtgtggtgctaactg

SEQ ID NO: 6656224 - DNA, 14 bp, Homo sapiens
ataaatgtgttggg

SEQ ID NO: 6656225 - DNA, 10 bp, Homo sapiens
ataaatgttc

SEQ ID NO: 6656226 - DNA, 13 bp, Homo sapiens
ataaatgttcaaa

SEQ ID NO: 6656227 - DNA, 17 bp, Homo sapiens
ataaatgttcaaactgt

SEQ ID NO: 6656228 - DNA, 23 bp, Homo sapiens
ataaatgttctggtatgcattct

SEQ ID NO: 6656229 - DNA, 15 bp, Homo sapiens
ataaatgttgaaaag

SEQ ID NO: 6656230 - DNA, 16 bp, Homo sapiens
ataaatgtttggaaag

SEQ ID NO: 6656231 - DNA, 12 bp, Homo sapiens
ataaatgtttgt

SEQ ID NO: 6656232 - DNA, 14 bp, Homo sapiens
ataaatgttttaca

SEQ ID NO: 6656233 - DNA, 22 bp, Homo sapiens
ataaatgttttacaactcctga

SEQ ID NO: 6656234 - DNA, 15 bp, Homo sapiens
ataaatgttttggaa

SEQ ID NO: 6656235 - DNA, 17 bp, Homo sapiens
ataaatgttttggaatt

SEQ ID NO: 6656236 - DNA, 21 bp, Homo sapiens
ataaatgttttggaattcaat

SEQ ID NO: 6656237 - DNA, 12 bp, Homo sapiens
ataaattaaata

SEQ ID NO: 6656238 - DNA, 16 bp, Homo sapiens
ataaattaaataaact

SEQ ID NO: 6656239 - DNA, 19 bp, Homo sapiens
ataaattaaataaactgtt

SEQ ID NO: 6656240 - DNA, 22 bp, Homo sapiens
ataaattaacaaagtgtcactc

SEQ ID NO: 6656241 - DNA, 16 bp, Homo sapiens
ataaattaagaagagt

SEQ ID NO: 6656242 - DNA, 15 bp, Homo sapiens
ataaattaagacttt

SEQ ID NO: 6656243 - DNA, 15 bp, Homo sapiens
ataaattaagatcct

SEQ ID NO: 6656244 - DNA, 20 bp, Homo sapiens
ataaattaagatcctaaact

SEQ ID NO: 6656245 - DNA, 17 bp, Homo sapiens
ataaattaagttactgg

SEQ ID NO: 6656246 - DNA, 18 bp, Homo sapiens
ataaattaatacataagt

SEQ ID NO: 6656247 - DNA, 14 bp, Homo sapiens
ataaattaattgtg

SEQ ID NO: 6656248 - DNA, 15 bp, Homo sapiens
ataaattaatttgtt

SEQ ID NO: 6656249 - DNA, 13 bp, Homo sapiens
ataaattacacaa

SEQ ID NO: 6656250 - DNA, 15 bp, Homo sapiens
ataaattacacttta

SEQ ID NO: 6656251 - DNA, 15 bp, Homo sapiens
ataaattacatgcat

SEQ ID NO: 6656252 - DNA, 14 bp, Homo sapiens
ataaattacattaa

SEQ ID NO: 6656253 - DNA, 14 bp, Homo sapiens
ataaattactatct

SEQ ID NO: 6656254 - DNA, 23 bp, Homo sapiens
ataaattactatctgttgaaaag

SEQ ID NO: 6656255 - DNA, 13 bp, Homo sapiens
ataaattactgtt

SEQ ID NO: 6656256 - DNA, 23 bp, Homo sapiens
ataaattagatttggcatctcct

SEQ ID NO: 6656257 - DNA, 19 bp, Homo sapiens
ataaattataatgcatcta

SEQ ID NO: 6656258 - DNA, 21 bp, Homo sapiens
ataaattataatgcatctaaa

SEQ ID NO: 6656259 - DNA, 15 bp, Homo sapiens
ataaattatacaaat

SEQ ID NO: 6656260 - DNA, 15 bp, Homo sapiens
ataaattatatccgt

SEQ ID NO: 6656261 - DNA, 14 bp, Homo sapiens
ataaattatattcc

SEQ ID NO: 6656262 - DNA, 14 bp, Homo sapiens
ataaattatctgaa

SEQ ID NO: 6656263 - DNA, 15 bp, Homo sapiens
ataaattatctgaat

SEQ ID NO: 6656264 - DNA, 16 bp, Homo sapiens
ataaattatctgaata

SEQ ID NO: 6656265 - DNA, 12 bp, Homo sapiens
ataaattatgaa

SEQ ID NO: 6656266 - DNA, 15 bp, Homo sapiens
ataaattatgataat

SEQ ID NO: 6656267 - DNA, 18 bp, Homo sapiens
ataaattatggcatttct

SEQ ID NO: 6656268 - DNA, 13 bp, Homo sapiens
ataaattatgttt

SEQ ID NO: 6656269 - DNA, 15 bp, Homo sapiens
ataaattatgtttat

SEQ ID NO: 6656270 - DNA, 13 bp, Homo sapiens
ataaattattcag

SEQ ID NO: 6656271 - DNA, 13 bp, Homo sapiens
ataaattattgtt

SEQ ID NO: 6656272 - DNA, 14 bp, Homo sapiens
ataaattatttcta

SEQ ID NO: 6656273 - DNA, 20 bp, Homo sapiens
ataaattatttctaaaacat

SEQ ID NO: 6656274 - DNA, 19 bp, Homo sapiens
ataaattatttgattattt

SEQ ID NO: 6656275 - DNA, 19 bp, Homo sapiens
ataaattatttttaagaaa

SEQ ID NO: 6656276 - DNA, 13 bp, Homo sapiens
ataaattcaaaac

SEQ ID NO: 6656277 - DNA, 22 bp, Homo sapiens
ataaattcaacacttattttct

SEQ ID NO: 6656278 - DNA, 19 bp, Homo sapiens
ataaattcaataaaaacct

SEQ ID NO: 6656279 - DNA, 22 bp, Homo sapiens
ataaattcacataggcaatatc

SEQ ID NO: 6656280 - DNA, 23 bp, Homo sapiens
ataaattcacatcctcagaaagt

SEQ ID NO: 6656281 - DNA, 19 bp, Homo sapiens
ataaattcacctagtctaa

SEQ ID NO: 6656282 - DNA, 14 bp, Homo sapiens
ataaattcactttc

SEQ ID NO: 6656283 - DNA, 15 bp, Homo sapiens
ataaattcactttca

SEQ ID NO: 6656284 - DNA, 13 bp, Homo sapiens
ataaattcagata

SEQ ID NO: 6656285 - DNA, 13 bp, Homo sapiens
ataaattcataac

SEQ ID NO: 6656286 - DNA, 18 bp, Homo sapiens
ataaattccatctatcag

SEQ ID NO: 6656287 - DNA, 23 bp, Homo sapiens
ataaattcccaacttctcttgct

SEQ ID NO: 6656288 - DNA, 13 bp, Homo sapiens
ataaattcctctt

SEQ ID NO: 6656289 - DNA, 21 bp, Homo sapiens
ataaattcctctttgctttgc

SEQ ID NO: 6656290 - DNA, 15 bp, Homo sapiens
ataaattctactaag

SEQ ID NO: 6656291 - DNA, 21 bp, Homo sapiens
ataaattctactaagttattt

SEQ ID NO: 6656292 - DNA, 21 bp, Homo sapiens
ataaattctataggaacatat

SEQ ID NO: 6656293 - DNA, 13 bp, Homo sapiens
ataaattctctcc

SEQ ID NO: 6656294 - DNA, 13 bp, Homo sapiens
ataaattgaaata

SEQ ID NO: 6656295 - DNA, 16 bp, Homo sapiens
ataaattgatcctttg

SEQ ID NO: 6656296 - DNA, 19 bp, Homo sapiens
ataaattgcatgctgcttt

SEQ ID NO: 6656297 - DNA, 12 bp, Homo sapiens
ataaattgccat

SEQ ID NO: 6656298 - DNA, 14 bp, Homo sapiens
ataaattgccataa

SEQ ID NO: 6656299 - DNA, 21 bp, Homo sapiens
ataaattgccataatatgatg

SEQ ID NO: 6656300 - DNA, 18 bp, Homo sapiens
ataaattgcctcccttcc

SEQ ID NO: 6656301 - DNA, 13 bp, Homo sapiens
ataaattgctcaa

SEQ ID NO: 6656302 - DNA, 18 bp, Homo sapiens
ataaattgctccttgaca

SEQ ID NO: 6656303 - DNA, 17 bp, Homo sapiens
ataaattggattatttt

SEQ ID NO: 6656304 - DNA, 18 bp, Homo sapiens
ataaattggattattttc

SEQ ID NO: 6656305 - DNA, 14 bp, Homo sapiens
ataaattggctcct

SEQ ID NO: 6656306 - DNA, 18 bp, Homo sapiens
ataaattggtgataagtg

SEQ ID NO: 6656307 - DNA, 22 bp, Homo sapiens
ataaattggttttgtactggat

SEQ ID NO: 6656308 - DNA, 17 bp, Homo sapiens
ataaattgtacattttg

SEQ ID NO: 6656309 - DNA, 18 bp, Homo sapiens
ataaattgtacattttgt

SEQ ID NO: 6656310 - DNA, 23 bp, Homo sapiens
ataaattgtacattttgtaaaat

SEQ ID NO: 6656311 - DNA, 19 bp, Homo sapiens
ataaattgtatattcactt

SEQ ID NO: 6656312 - DNA, 16 bp, Homo sapiens
ataaattgtatgaaga

SEQ ID NO: 6656313 - DNA, 21 bp, Homo sapiens
ataaattgtctttaaaaactg

SEQ ID NO: 6656314 - DNA, 17 bp, Homo sapiens
ataaattgtgaaaaaaa

SEQ ID NO: 6656315 - DNA, 17 bp, Homo sapiens
ataaattgtttgaccat

SEQ ID NO: 6656316 - DNA, 13 bp, Homo sapiens
ataaatttaaaat

SEQ ID NO: 6656317 - DNA, 21 bp, Homo sapiens
ataaatttaaacttacaaact

SEQ ID NO: 6656318 - DNA, 19 bp, Homo sapiens
ataaatttaataaatattg

SEQ ID NO: 6656319 - DNA, 20 bp, Homo sapiens
ataaatttaataaatattga

SEQ ID NO: 6656320 - DNA, 12 bp, Homo sapiens
ataaatttaatg

SEQ ID NO: 6656321 - DNA, 13 bp, Homo sapiens
ataaatttatcaa

SEQ ID NO: 6656322 - DNA, 14 bp, Homo sapiens
ataaatttatttac

SEQ ID NO: 6656323 - DNA, 22 bp, Homo sapiens
ataaatttcaattagatttaaa

SEQ ID NO: 6656324 - DNA, 13 bp, Homo sapiens
ataaatttcccag

SEQ ID NO: 6656325 - DNA, 21 bp, Homo sapiens
ataaatttcccagttaaagat

SEQ ID NO: 6656326 - DNA, 22 bp, Homo sapiens
ataaatttcccagttaaagatt

SEQ ID NO: 6656327 - DNA, 21 bp, Homo sapiens
ataaatttctgggatatttaa

SEQ ID NO: 6656328 - DNA, 14 bp, Homo sapiens
ataaatttctgtct

SEQ ID NO: 6656329 - DNA, 16 bp, Homo sapiens
ataaatttgcttttat

SEQ ID NO: 6656330 - DNA, 12 bp, Homo sapiens
ataaatttgtaa

SEQ ID NO: 6656331 - DNA, 15 bp, Homo sapiens
ataaatttgtaatat

SEQ ID NO: 6656332 - DNA, 20 bp, Homo sapiens
ataaatttgtaatatatcct

SEQ ID NO: 6656333 - DNA, 22 bp, Homo sapiens
ataaatttgtaatatatcctgt

SEQ ID NO: 6656334 - DNA, 19 bp, Homo sapiens
ataaatttgttgaatattg

SEQ ID NO: 6656335 - DNA, 16 bp, Homo sapiens
ataaattttaaatgtt

SEQ ID NO: 6656336 - DNA, 12 bp, Homo sapiens
ataaattttaat

SEQ ID NO: 6656337 - DNA, 15 bp, Homo sapiens
ataaattttaattca

SEQ ID NO: 6656338 - DNA, 16 bp, Homo sapiens
ataaattttaattcaa

SEQ ID NO: 6656339 - DNA, 19 bp, Homo sapiens
ataaattttaattcaagaa

SEQ ID NO: 6656340 - DNA, 14 bp, Homo sapiens
ataaattttcagaa

SEQ ID NO: 6656341 - DNA, 21 bp, Homo sapiens
ataaattttgaaaagtaatat

SEQ ID NO: 6656342 - DNA, 22 bp, Homo sapiens
ataaattttgacttgaaaaata

SEQ ID NO: 6656343 - DNA, 15 bp, Homo sapiens
ataaattttggaaga

SEQ ID NO: 6656344 - DNA, 18 bp, Homo sapiens
ataaattttggaagaatt

SEQ ID NO: 6656345 - DNA, 14 bp, Homo sapiens
ataaattttgtaca

SEQ ID NO: 6656346 - DNA, 18 bp, Homo sapiens
ataaattttgtacatttt

SEQ ID NO: 6656347 - DNA, 14 bp, Homo sapiens
ataaattttgtttc

SEQ ID NO: 6656348 - DNA, 16 bp, Homo sapiens
ataaattttgtttcag

SEQ ID NO: 6656349 - DNA, 14 bp, Homo sapiens
ataaatttttaagt

SEQ ID NO: 6656350 - DNA, 17 bp, Homo sapiens
ataaatttttaagtgtc

SEQ ID NO: 6656351 - DNA, 18 bp, Homo sapiens
ataaatttttaagtgtca

SEQ ID NO: 6656352 - DNA, 14 bp, Homo sapiens
ataaatttttgtct

SEQ ID NO: 6656353 - DNA, 15 bp, Homo sapiens
ataaatttttgtctt

SEQ ID NO: 6656354 - DNA, 16 bp, Homo sapiens
ataaattttttgaaac

SEQ ID NO: 6656355 - DNA, 16 bp, Homo sapiens
ataaattttttttggt

SEQ ID NO: 6656356 - DNA, 19 bp, Homo sapiens
ataaattttttttgtttca

SEQ ID NO: 6656357 - DNA, 16 bp, Homo sapiens
ataacaaaaaaagaaa

SEQ ID NO: 6656358 - DNA, 18 bp, Homo sapiens
ataacaaaaaagagaaac

SEQ ID NO: 6656359 - DNA, 21 bp, Homo sapiens
ataacaaaatcacttccatag

SEQ ID NO: 6656360 - DNA, 13 bp, Homo sapiens
ataacaaagaacc

SEQ ID NO: 6656361 - DNA, 23 bp, Homo sapiens
ataacaaagaacctaacatttat

SEQ ID NO: 6656362 - DNA, 15 bp, Homo sapiens
ataacaaagggcagc

SEQ ID NO: 6656363 - DNA, 17 bp, Homo sapiens
ataacaaatgccaaatt

SEQ ID NO: 6656364 - DNA, 12 bp, Homo sapiens
ataacaacaatt

SEQ ID NO: 6656365 - DNA, 18 bp, Homo sapiens
ataacaacgtctttttgt

SEQ ID NO: 6656366 - DNA, 14 bp, Homo sapiens
ataacaactaactt

SEQ ID NO: 6656367 - DNA, 15 bp, Homo sapiens
ataacaactctattt

SEQ ID NO: 6656368 - DNA, 14 bp, Homo sapiens
ataacaacttcata

SEQ ID NO: 6656369 - DNA, 13 bp, Homo sapiens
ataacaacttttt

SEQ ID NO: 6656370 - DNA, 14 bp, Homo sapiens
ataacaactttttt

SEQ ID NO: 6656371 - DNA, 13 bp, Homo sapiens
ataacaagagttt

SEQ ID NO: 6656372 - DNA, 18 bp, Homo sapiens
ataacaagagttttaaca

SEQ ID NO: 6656373 - DNA, 14 bp, Homo sapiens
ataacaagatcttt

SEQ ID NO: 6656374 - DNA, 16 bp, Homo sapiens
ataacaagatctttca

SEQ ID NO: 6656375 - DNA, 17 bp, Homo sapiens
ataacaagatctttcag

SEQ ID NO: 6656376 - DNA, 20 bp, Homo sapiens
ataacaagccaaacattctt

SEQ ID NO: 6656377 - DNA, 22 bp, Homo sapiens
ataacaagccaaacattcttat

SEQ ID NO: 6656378 - DNA, 22 bp, Homo sapiens
ataacaaggttcttctaaaatt

SEQ ID NO: 6656379 - DNA, 14 bp, Homo sapiens
ataacaatgaaagt

SEQ ID NO: 6656380 - DNA, 18 bp, Homo sapiens
ataacaatgtatgtgaaa

SEQ ID NO: 6656381 - DNA, 20 bp, Homo sapiens
ataacaatgtcttcttgaaa

SEQ ID NO: 6656382 - DNA, 14 bp, Homo sapiens
ataacaatgttaag

SEQ ID NO: 6656383 - DNA, 16 bp, Homo sapiens
ataacaatgttaagga

SEQ ID NO: 6656384 - DNA, 18 bp, Homo sapiens
ataacaatgttaaggaaa

SEQ ID NO: 6656385 - DNA, 22 bp, Homo sapiens
ataacaatgttaaggaaactct

SEQ ID NO: 6656386 - DNA, 15 bp, Homo sapiens
ataacaattcctcta

SEQ ID NO: 6656387 - DNA, 13 bp, Homo sapiens
ataacacacagct

SEQ ID NO: 6656388 - DNA, 12 bp, Homo sapiens
ataacacacatc

SEQ ID NO: 6656389 - DNA, 16 bp, Homo sapiens
ataacacactttttat

SEQ ID NO: 6656390 - DNA, 13 bp, Homo sapiens
ataacacagagag

SEQ ID NO: 6656391 - DNA, 17 bp, Homo sapiens
ataacacagtttgtact

SEQ ID NO: 6656392 - DNA, 23 bp, Homo sapiens
ataacaccaagagtagcaccttc

SEQ ID NO: 6656393 - DNA, 17 bp, Homo sapiens
ataacaccatctggagt

SEQ ID NO: 6656394 - DNA, 17 bp, Homo sapiens
ataacacccttccttct

SEQ ID NO: 6656395 - DNA, 21 bp, Homo sapiens
ataacacccttccttctgtaa

SEQ ID NO: 6656396 - DNA, 14 bp, Homo sapiens
ataacactaaatgc

SEQ ID NO: 6656397 - DNA, 21 bp, Homo sapiens
ataacactctaggatgtatat

SEQ ID NO: 6656398 - DNA, 14 bp, Homo sapiens
ataacactgcagcc

SEQ ID NO: 6656399 - DNA, 20 bp, Homo sapiens
ataacactgcagccctctcc

SEQ ID NO: 6656400 - DNA, 22 bp, Homo sapiens
ataacactgtattttaatgtac

SEQ ID NO: 6656401 - DNA, 21 bp, Homo sapiens
ataacactgttggcacttata

SEQ ID NO: 6656402 - DNA, 13 bp, Homo sapiens
ataacagaaatac

SEQ ID NO: 6656403 - DNA, 14 bp, Homo sapiens
ataacagaagaaaa

SEQ ID NO: 6656404 - DNA, 17 bp, Homo sapiens
ataacagaagaaaatag

SEQ ID NO: 6656405 - DNA, 20 bp, Homo sapiens
ataacagagctggatgctga

SEQ ID NO: 6656406 - DNA, 16 bp, Homo sapiens
ataacagatacatttc

SEQ ID NO: 6656407 - DNA, 18 bp, Homo sapiens
ataacagatggtgctgct

SEQ ID NO: 6656408 - DNA, 13 bp, Homo sapiens
ataacagatgtga

SEQ ID NO: 6656409 - DNA, 17 bp, Homo sapiens
ataacagatgtgaaaat

SEQ ID NO: 6656410 - DNA, 20 bp, Homo sapiens
ataacagatgtgaaaatata

SEQ ID NO: 6656411 - DNA, 22 bp, Homo sapiens
ataacagatgtgaaaatatact

SEQ ID NO: 6656412 - DNA, 15 bp, Homo sapiens
ataacagatttctca

SEQ ID NO: 6656413 - DNA, 19 bp, Homo sapiens
ataacagattttttttgga

SEQ ID NO: 6656414 - DNA, 15 bp, Homo sapiens
ataacagcaccccat

SEQ ID NO: 6656415 - DNA, 17 bp, Homo sapiens
ataacagccgctccaga

SEQ ID NO: 6656416 - DNA, 19 bp, Homo sapiens
ataacagccttttccttct

SEQ ID NO: 6656417 - DNA, 15 bp, Homo sapiens
ataacagctccttta

SEQ ID NO: 6656418 - DNA, 16 bp, Homo sapiens
ataacagctcctttat

SEQ ID NO: 6656419 - DNA, 13 bp, Homo sapiens
ataacagctgcaa

SEQ ID NO: 6656420 - DNA, 16 bp, Homo sapiens
ataacagcttgaaaac

SEQ ID NO: 6656421 - DNA, 21 bp, Homo sapiens
ataacagcttgaaaactggat

SEQ ID NO: 6656422 - DNA, 14 bp, Homo sapiens
ataacagctttctt

SEQ ID NO: 6656423 - DNA, 17 bp, Homo sapiens
ataacagctttcttatt

SEQ ID NO: 6656424 - DNA, 23 bp, Homo sapiens
ataacagctttcttattcagtga

SEQ ID NO: 6656425 - DNA, 23 bp, Homo sapiens
ataacaggcattgcactaaaagt

SEQ ID NO: 6656426 - DNA, 20 bp, Homo sapiens
ataacagggattgattttaa

SEQ ID NO: 6656427 - DNA, 21 bp, Homo sapiens
ataacagggattgattttaaa

SEQ ID NO: 6656428 - DNA, 22 bp, Homo sapiens
ataacagggattgattttaaaa

SEQ ID NO: 6656429 - DNA, 18 bp, Homo sapiens
ataacagggtaaattatt

SEQ ID NO: 6656430 - DNA, 20 bp, Homo sapiens
ataacagggtaaattattca

SEQ ID NO: 6656431 - DNA, 22 bp, Homo sapiens
ataacaggttattttagtttct

SEQ ID NO: 6656432 - DNA, 16 bp, Homo sapiens
ataacagtaaatgtgc

SEQ ID NO: 6656433 - DNA, 19 bp, Homo sapiens
ataacagtcttactgcagg

SEQ ID NO: 6656434 - DNA, 20 bp, Homo sapiens
ataacagtgcatattccttt

SEQ ID NO: 6656435 - DNA, 23 bp, Homo sapiens
ataacagtgccattgtctttata

SEQ ID NO: 6656436 - DNA, 13 bp, Homo sapiens
ataacagtggcaa

SEQ ID NO: 6656437 - DNA, 19 bp, Homo sapiens
ataacagtgtggtagttaa

SEQ ID NO: 6656438 - DNA, 13 bp, Homo sapiens
ataacagttataa

SEQ ID NO: 6656439 - DNA, 14 bp, Homo sapiens
ataacagttataaa

SEQ ID NO: 6656440 - DNA, 20 bp, Homo sapiens
ataacagttataaagaaaga

SEQ ID NO: 6656441 - DNA, 14 bp, Homo sapiens
ataacagttatatt

SEQ ID NO: 6656442 - DNA, 12 bp, Homo sapiens
ataacataaaag

SEQ ID NO: 6656443 - DNA, 13 bp, Homo sapiens
ataacataaaagc

SEQ ID NO: 6656444 - DNA, 14 bp, Homo sapiens
ataacataaaagca

SEQ ID NO: 6656445 - DNA, 16 bp, Homo sapiens
ataacataaaagtgct

SEQ ID NO: 6656446 - DNA, 15 bp, Homo sapiens
ataacataaataaaa

SEQ ID NO: 6656447 - DNA, 21 bp, Homo sapiens
ataacataaataaaaattcaa

SEQ ID NO: 6656448 - DNA, 12 bp, Homo sapiens
ataacatagaat

SEQ ID NO: 6656449 - DNA, 22 bp, Homo sapiens
ataacatagaattgcaatctat

SEQ ID NO: 6656450 - DNA, 14 bp, Homo sapiens
ataacatatatgga

SEQ ID NO: 6656451 - DNA, 15 bp, Homo sapiens
ataacatatcaaatg

SEQ ID NO: 6656452 - DNA, 14 bp, Homo sapiens
ataacatatctaaa

SEQ ID NO: 6656453 - DNA, 17 bp, Homo sapiens
ataacatatctaaagtc

SEQ ID NO: 6656454 - DNA, 14 bp, Homo sapiens
ataacatatgcagt

SEQ ID NO: 6656455 - DNA, 17 bp, Homo sapiens
ataacatattcttgctt

SEQ ID NO: 6656456 - DNA, 17 bp, Homo sapiens
ataacatatttattgtg

SEQ ID NO: 6656457 - DNA, 14 bp, Homo sapiens
ataacatcactgtc

SEQ ID NO: 6656458 - DNA, 19 bp, Homo sapiens
ataacatcgaaaagttatt

SEQ ID NO: 6656459 - DNA, 16 bp, Homo sapiens
ataacatctctttcat

SEQ ID NO: 6656460 - DNA, 20 bp, Homo sapiens
ataacatctgaaaagaaatg

SEQ ID NO: 6656461 - DNA, 14 bp, Homo sapiens
ataacatctttatt

SEQ ID NO: 6656462 - DNA, 21 bp, Homo sapiens
ataacatctttattgaaattc

SEQ ID NO: 6656463 - DNA, 12 bp, Homo sapiens
ataacatgaaag

SEQ ID NO: 6656464 - DNA, 13 bp, Homo sapiens
ataacatgtaatt

SEQ ID NO: 6656465 - DNA, 20 bp, Homo sapiens
ataacattaccttactgtgg

SEQ ID NO: 6656466 - DNA, 20 bp, Homo sapiens
ataacattatataacaaaaa

SEQ ID NO: 6656467 - DNA, 24 bp, Homo sapiens
ataacattgcactttataaacact

SEQ ID NO: 6656468 - DNA, 12 bp, Homo sapiens
ataacattgtat

SEQ ID NO: 6656469 - DNA, 18 bp, Homo sapiens
ataacattgtatgttaat

SEQ ID NO: 6656470 - DNA, 15 bp, Homo sapiens
ataacatttaaagag

SEQ ID NO: 6656471 - DNA, 14 bp, Homo sapiens
ataacatttaattt

SEQ ID NO: 6656472 - DNA, 19 bp, Homo sapiens
ataacatttgtgtgttata

SEQ ID NO: 6656473 - DNA, 20 bp, Homo sapiens
ataacattttatacaatttc

SEQ ID NO: 6656474 - DNA, 13 bp, Homo sapiens
ataacattttcta

SEQ ID NO: 6656475 - DNA, 15 bp, Homo sapiens
ataacattttctata

SEQ ID NO: 6656476 - DNA, 14 bp, Homo sapiens
ataaccaaagcaat

SEQ ID NO: 6656477 - DNA, 14 bp, Homo sapiens
ataaccaaatgaaa

SEQ ID NO: 6656478 - DNA, 14 bp, Homo sapiens
ataaccaacaatat

SEQ ID NO: 6656479 - DNA, 15 bp, Homo sapiens
ataaccaacaatata

SEQ ID NO: 6656480 - DNA, 23 bp, Homo sapiens
ataaccaagaaatactaatgtaa

SEQ ID NO: 6656481 - DNA, 14 bp, Homo sapiens
ataaccaagaatgt

SEQ ID NO: 6656482 - DNA, 17 bp, Homo sapiens
ataaccaagaatgtctc

SEQ ID NO: 6656483 - DNA, 20 bp, Homo sapiens
ataaccaatgtttaaaaaag

SEQ ID NO: 6656484 - DNA, 17 bp, Homo sapiens
ataaccaatttgtaatg

SEQ ID NO: 6656485 - DNA, 14 bp, Homo sapiens
ataaccacaaggtc

SEQ ID NO: 6656486 - DNA, 21 bp, Homo sapiens
ataaccacatttaatgggaaa

SEQ ID NO: 6656487 - DNA, 14 bp, Homo sapiens
ataaccactgaagg

SEQ ID NO: 6656488 - DNA, 14 bp, Homo sapiens
ataaccagctgtaa

SEQ ID NO: 6656489 - DNA, 18 bp, Homo sapiens
ataaccagtttagctttt

SEQ ID NO: 6656490 - DNA, 20 bp, Homo sapiens
ataaccatcagttactggtt

SEQ ID NO: 6656491 - DNA, 12 bp, Homo sapiens
ataaccatgaga

SEQ ID NO: 6656492 - DNA, 22 bp, Homo sapiens
ataaccatggtgattaaaatga

SEQ ID NO: 6656493 - DNA, 20 bp, Homo sapiens
ataaccatgtgaaaaggcaa

SEQ ID NO: 6656494 - DNA, 23 bp, Homo sapiens
ataaccatttaaagaaagaatgc

SEQ ID NO: 6656495 - DNA, 12 bp, Homo sapiens
ataacccacttt

SEQ ID NO: 6656496 - DNA, 15 bp, Homo sapiens
ataacccagttactt

SEQ ID NO: 6656497 - DNA, 12 bp, Homo sapiens
ataaccccacct

SEQ ID NO: 6656498 - DNA, 14 bp, Homo sapiens
ataaccccagcctg

SEQ ID NO: 6656499 - DNA, 16 bp, Homo sapiens
ataaccccaggcactg

SEQ ID NO: 6656500 - DNA, 22 bp, Homo sapiens
ataacccctgcctggatttctt

SEQ ID NO: 6656501 - DNA, 18 bp, Homo sapiens
ataaccctgtcacccaca

SEQ ID NO: 6656502 - DNA, 22 bp, Homo sapiens
ataaccctgtcacccacagacc

SEQ ID NO: 6656503 - DNA, 13 bp, Homo sapiens
ataaccctgttac

SEQ ID NO: 6656504 - DNA, 16 bp, Homo sapiens
ataaccgtgaagctct

SEQ ID NO: 6656505 - DNA, 21 bp, Homo sapiens
ataacctaataattgtatcta

SEQ ID NO: 6656506 - DNA, 22 bp, Homo sapiens
ataacctaataattgtatctac

SEQ ID NO: 6656507 - DNA, 17 bp, Homo sapiens
ataacctataaagtgtt

SEQ ID NO: 6656508 - DNA, 18 bp, Homo sapiens
ataacctatttttttctc

SEQ ID NO: 6656509 - DNA, 12 bp, Homo sapiens
ataacctctggc

SEQ ID NO: 6656510 - DNA, 18 bp, Homo sapiens
ataacctctggcccttgg

SEQ ID NO: 6656511 - DNA, 19 bp, Homo sapiens
ataacctctggcccttgga

SEQ ID NO: 6656512 - DNA, 20 bp, Homo sapiens
ataacctctggcccttggaa

SEQ ID NO: 6656513 - DNA, 16 bp, Homo sapiens
ataacctgcacaggct

SEQ ID NO: 6656514 - DNA, 18 bp, Homo sapiens
ataacctgcacaggcttg

SEQ ID NO: 6656515 - DNA, 17 bp, Homo sapiens
ataaccttcatttttaa

SEQ ID NO: 6656516 - DNA, 23 bp, Homo sapiens
ataaccttcatttttaagactgt

SEQ ID NO: 6656517 - DNA, 13 bp, Homo sapiens
ataacctttctgg

SEQ ID NO: 6656518 - DNA, 15 bp, Homo sapiens
ataacgcaggagaga

SEQ ID NO: 6656519 - DNA, 17 bp, Homo sapiens
ataacgcaggagagaga

SEQ ID NO: 6656520 - DNA, 21 bp, Homo sapiens
ataacgccccagataccagcc

SEQ ID NO: 6656521 - DNA, 17 bp, Homo sapiens
ataacgtttaagccaaa

SEQ ID NO: 6656522 - DNA, 18 bp, Homo sapiens
ataacgtttaagccaaaa

SEQ ID NO: 6656523 - DNA, 22 bp, Homo sapiens
ataacgtttaagccaaaacaat

SEQ ID NO: 6656524 - DNA, 10 bp, Homo sapiens
ataactaagg

SEQ ID NO: 6656525 - DNA, 17 bp, Homo sapiens
ataactaaggaatatat

SEQ ID NO: 6656526 - DNA, 17 bp, Homo sapiens
ataactaatatggtttt

SEQ ID NO: 6656527 - DNA, 19 bp, Homo sapiens
ataactaatgctaagaaat

SEQ ID NO: 6656528 - DNA, 21 bp, Homo sapiens
ataactacagagtctgacagg

SEQ ID NO: 6656529 - DNA, 19 bp, Homo sapiens
ataactacattaaaagctt

SEQ ID NO: 6656530 - DNA, 14 bp, Homo sapiens
ataactaccaggaa

SEQ ID NO: 6656531 - DNA, 17 bp, Homo sapiens
ataactacctcctcact

SEQ ID NO: 6656532 - DNA, 17 bp, Homo sapiens
ataactactgacgaaag

SEQ ID NO: 6656533 - DNA, 13 bp, Homo sapiens
ataactactgtgt

SEQ ID NO: 6656534 - DNA, 13 bp, Homo sapiens
ataactagagcac

SEQ ID NO: 6656535 - DNA, 18 bp, Homo sapiens
ataactagagtatgtgta

SEQ ID NO: 6656536 - DNA, 21 bp, Homo sapiens
ataactagagtatgtgtatgt

SEQ ID NO: 6656537 - DNA, 22 bp, Homo sapiens
ataactagagtatgtgtatgta

SEQ ID NO: 6656538 - DNA, 14 bp, Homo sapiens
ataactagatctcc

SEQ ID NO: 6656539 - DNA, 16 bp, Homo sapiens
ataactagatctcctg

SEQ ID NO: 6656540 - DNA, 17 bp, Homo sapiens
ataactagatctcctgt

SEQ ID NO: 6656541 - DNA, 20 bp, Homo sapiens
ataactagatggtgctgaga

SEQ ID NO: 6656542 - DNA, 20 bp, Homo sapiens
ataactaggattataatgct

SEQ ID NO: 6656543 - DNA, 19 bp, Homo sapiens
ataactagtgttgcttgga

SEQ ID NO: 6656544 - DNA, 15 bp, Homo sapiens
ataactatataaatg

SEQ ID NO: 6656545 - DNA, 15 bp, Homo sapiens
ataactatataagac

SEQ ID NO: 6656546 - DNA, 18 bp, Homo sapiens
ataactatataagacatt

SEQ ID NO: 6656547 - DNA, 16 bp, Homo sapiens
ataactatcaggcaga

SEQ ID NO: 6656548 - DNA, 18 bp, Homo sapiens
ataactatctcacttcca

SEQ ID NO: 6656549 - DNA, 13 bp, Homo sapiens
ataactatgcttt

SEQ ID NO: 6656550 - DNA, 16 bp, Homo sapiens
ataactatggtaaata

SEQ ID NO: 6656551 - DNA, 21 bp, Homo sapiens
ataactattttgttttaatct

SEQ ID NO: 6656552 - DNA, 14 bp, Homo sapiens
ataactcagaatat

SEQ ID NO: 6656553 - DNA, 18 bp, Homo sapiens
ataactcatcataaaata

SEQ ID NO: 6656554 - DNA, 20 bp, Homo sapiens
ataactccaagcagactcca

SEQ ID NO: 6656555 - DNA, 17 bp, Homo sapiens
ataactcctcattgtaa

SEQ ID NO: 6656556 - DNA, 16 bp, Homo sapiens
ataactcctcccaggg

SEQ ID NO: 6656557 - DNA, 22 bp, Homo sapiens
ataactcctcccagggttttaa

SEQ ID NO: 6656558 - DNA, 19 bp, Homo sapiens
ataactcctgtcccttttc

SEQ ID NO: 6656559 - DNA, 13 bp, Homo sapiens
ataactctaggga

SEQ ID NO: 6656560 - DNA, 20 bp, Homo sapiens
ataactctagggatataaaa

SEQ ID NO: 6656561 - DNA, 15 bp, Homo sapiens
ataactctctttcct

SEQ ID NO: 6656562 - DNA, 16 bp, Homo sapiens
ataactctctttcctt

SEQ ID NO: 6656563 - DNA, 16 bp, Homo sapiens
ataactctgattttga

SEQ ID NO: 6656564 - DNA, 12 bp, Homo sapiens
ataactctgcaa

SEQ ID NO: 6656565 - DNA, 20 bp, Homo sapiens
ataactctgctgaatgtaaa

SEQ ID NO: 6656566 - DNA, 13 bp, Homo sapiens
ataactctgtaaa

SEQ ID NO: 6656567 - DNA, 23 bp, Homo sapiens
ataactctgtacgaggcttctct

SEQ ID NO: 6656568 - DNA, 20 bp, Homo sapiens
ataactctgtataatagaga

SEQ ID NO: 6656569 - DNA, 12 bp, Homo sapiens
ataactctttgg

SEQ ID NO: 6656570 - DNA, 17 bp, Homo sapiens
ataactgaaaatgaaag

SEQ ID NO: 6656571 - DNA, 21 bp, Homo sapiens
ataactgaaaattatttaaac

SEQ ID NO: 6656572 - DNA, 19 bp, Homo sapiens
ataactgaaccaaattgca

SEQ ID NO: 6656573 - DNA, 23 bp, Homo sapiens
ataactgaaccaaattgcactga

SEQ ID NO: 6656574 - DNA, 12 bp, Homo sapiens
ataactgaactg

SEQ ID NO: 6656575 - DNA, 17 bp, Homo sapiens
ataactgacaaatcaag

SEQ ID NO: 6656576 - DNA, 18 bp, Homo sapiens
ataactgacaaatcaagt

SEQ ID NO: 6656577 - DNA, 21 bp, Homo sapiens
ataactgacaaatcaagtttc

SEQ ID NO: 6656578 - DNA, 12 bp, Homo sapiens
ataactgaggag

SEQ ID NO: 6656579 - DNA, 15 bp, Homo sapiens
ataactgagttatat

SEQ ID NO: 6656580 - DNA, 17 bp, Homo sapiens
ataactgagttatattg

SEQ ID NO: 6656581 - DNA, 15 bp, Homo sapiens
ataactgataatttt

SEQ ID NO: 6656582 - DNA, 15 bp, Homo sapiens
ataactgatggcaat

SEQ ID NO: 6656583 - DNA, 22 bp, Homo sapiens
ataactgcagaaaaaatattgt

SEQ ID NO: 6656584 - DNA, 18 bp, Homo sapiens
ataactgctcttttacta

SEQ ID NO: 6656585 - DNA, 21 bp, Homo sapiens
ataactgctcttttactaaga

SEQ ID NO: 6656586 - DNA, 13 bp, Homo sapiens
ataactgcttctt

SEQ ID NO: 6656587 - DNA, 15 bp, Homo sapiens
ataactggaaaacag

SEQ ID NO: 6656588 - DNA, 17 bp, Homo sapiens
ataactgtaattatttg

SEQ ID NO: 6656589 - DNA, 22 bp, Homo sapiens
ataactgtaattatttgaatga

SEQ ID NO: 6656590 - DNA, 20 bp, Homo sapiens
ataactgtacaaaaattgtt

SEQ ID NO: 6656591 - DNA, 17 bp, Homo sapiens
ataactgtagctcaagt

SEQ ID NO: 6656592 - DNA, 16 bp, Homo sapiens
ataactgtcttctgga

SEQ ID NO: 6656593 - DNA, 17 bp, Homo sapiens
ataactgtcttgtttca

SEQ ID NO: 6656594 - DNA, 22 bp, Homo sapiens
ataactgtcttgtttcagtgag

SEQ ID NO: 6656595 - DNA, 20 bp, Homo sapiens
ataactgtgatgaaatatga

SEQ ID NO: 6656596 - DNA, 12 bp, Homo sapiens
ataactgttctt

SEQ ID NO: 6656597 - DNA, 20 bp, Homo sapiens
ataactgttgttgataagga

SEQ ID NO: 6656598 - DNA, 14 bp, Homo sapiens
ataactgttttaga

SEQ ID NO: 6656599 - DNA, 20 bp, Homo sapiens
ataactgttttagaaattgg

SEQ ID NO: 6656600 - DNA, 21 bp, Homo sapiens
ataactgttttagaaattggt

SEQ ID NO: 6656601 - DNA, 12 bp, Homo sapiens
ataacttaaaaa

SEQ ID NO: 6656602 - DNA, 19 bp, Homo sapiens
ataacttaaaaatgtaaat

SEQ ID NO: 6656603 - DNA, 20 bp, Homo sapiens
ataacttaaaaatgtaaata

SEQ ID NO: 6656604 - DNA, 21 bp, Homo sapiens
ataacttaaaaatgtaaatat

SEQ ID NO: 6656605 - DNA, 23 bp, Homo sapiens
ataacttaaaataattaaataaa

SEQ ID NO: 6656606 - DNA, 14 bp, Homo sapiens
ataacttaaataat

SEQ ID NO: 6656607 - DNA, 15 bp, Homo sapiens
ataacttaaataatt

SEQ ID NO: 6656608 - DNA, 20 bp, Homo sapiens
ataacttacaagactgtaaa

SEQ ID NO: 6656609 - DNA, 22 bp, Homo sapiens
ataacttacaagactgtaaatt

SEQ ID NO: 6656610 - DNA, 19 bp, Homo sapiens
ataacttacctctgcttct

SEQ ID NO: 6656611 - DNA, 15 bp, Homo sapiens
ataacttactgtata

SEQ ID NO: 6656612 - DNA, 19 bp, Homo sapiens
ataacttactgtatatgta

SEQ ID NO: 6656613 - DNA, 22 bp, Homo sapiens
ataacttagcttgcacatgaat

SEQ ID NO: 6656614 - DNA, 20 bp, Homo sapiens
ataacttatattgtaagaaa

SEQ ID NO: 6656615 - DNA, 21 bp, Homo sapiens
ataacttatattgtaagaaat

SEQ ID NO: 6656616 - DNA, 14 bp, Homo sapiens
ataacttattagca

SEQ ID NO: 6656617 - DNA, 16 bp, Homo sapiens
ataacttattagcagt

SEQ ID NO: 6656618 - DNA, 15 bp, Homo sapiens
ataacttattgctga

SEQ ID NO: 6656619 - DNA, 17 bp, Homo sapiens
ataacttcagagaagtc

SEQ ID NO: 6656620 - DNA, 13 bp, Homo sapiens
ataacttcagtcc

SEQ ID NO: 6656621 - DNA, 15 bp, Homo sapiens
ataacttcatgaaga

SEQ ID NO: 6656622 - DNA, 18 bp, Homo sapiens
ataacttccacagggtcc

SEQ ID NO: 6656623 - DNA, 12 bp, Homo sapiens
ataacttcctgt

SEQ ID NO: 6656624 - DNA, 19 bp, Homo sapiens
ataacttccttcacatctc

SEQ ID NO: 6656625 - DNA, 21 bp, Homo sapiens
ataacttccttgcccctgctc

SEQ ID NO: 6656626 - DNA, 22 bp, Homo sapiens
ataacttccttgcccctgctct

SEQ ID NO: 6656627 - DNA, 14 bp, Homo sapiens
ataacttctatgtt

SEQ ID NO: 6656628 - DNA, 11 bp, Homo sapiens
ataacttctga

SEQ ID NO: 6656629 - DNA, 13 bp, Homo sapiens
ataacttcttaaa

SEQ ID NO: 6656630 - DNA, 17 bp, Homo sapiens
ataacttcttcctgctg

SEQ ID NO: 6656631 - DNA, 14 bp, Homo sapiens
ataacttcttgaaa

SEQ ID NO: 6656632 - DNA, 16 bp, Homo sapiens
ataacttcttgaaaaa

SEQ ID NO: 6656633 - DNA, 15 bp, Homo sapiens
ataacttgatataga

SEQ ID NO: 6656634 - DNA, 20 bp, Homo sapiens
ataacttgatgcatgtggtt

SEQ ID NO: 6656635 - DNA, 18 bp, Homo sapiens
ataacttgctgaatttca

SEQ ID NO: 6656636 - DNA, 22 bp, Homo sapiens
ataacttgctgaatttcaggca

SEQ ID NO: 6656637 - DNA, 15 bp, Homo sapiens
ataacttgtttgtaa

SEQ ID NO: 6656638 - DNA, 16 bp, Homo sapiens
ataacttgtttgtaaa

SEQ ID NO: 6656639 - DNA, 20 bp, Homo sapiens
ataacttgttttgacttgaa

SEQ ID NO: 6656640 - DNA, 21 bp, Homo sapiens
ataactttaaatcttttcttc

SEQ ID NO: 6656641 - DNA, 24 bp, Homo sapiens
ataactttaaatcttttcttcaac

SEQ ID NO: 6656642 - DNA, 16 bp, Homo sapiens
ataactttagaaataa

SEQ ID NO: 6656643 - DNA, 19 bp, Homo sapiens
ataactttagaaataagaa

SEQ ID NO: 6656644 - DNA, 22 bp, Homo sapiens
ataactttagaaataagaagca

SEQ ID NO: 6656645 - DNA, 17 bp, Homo sapiens
ataactttatatgaagt

SEQ ID NO: 6656646 - DNA, 12 bp, Homo sapiens
ataactttattg

SEQ ID NO: 6656647 - DNA, 22 bp, Homo sapiens
ataactttattgcatatagatt

SEQ ID NO: 6656648 - DNA, 14 bp, Homo sapiens
ataactttctctgt

SEQ ID NO: 6656649 - DNA, 17 bp, Homo sapiens
ataactttctctgtgaa

SEQ ID NO: 6656650 - DNA, 12 bp, Homo sapiens
ataactttgctt

SEQ ID NO: 6656651 - DNA, 14 bp, Homo sapiens
ataactttgcttgc

SEQ ID NO: 6656652 - DNA, 18 bp, Homo sapiens
ataacttttacacgacca

SEQ ID NO: 6656653 - DNA, 19 bp, Homo sapiens
ataacttttcaccaatgag

SEQ ID NO: 6656654 - DNA, 14 bp, Homo sapiens
ataacttttgatga

SEQ ID NO: 6656655 - DNA, 17 bp, Homo sapiens
ataacttttttgagtca

SEQ ID NO: 6656656 - DNA, 19 bp, Homo sapiens
ataacttttttgagtcatt

SEQ ID NO: 6656657 - DNA, 16 bp, Homo sapiens
ataagaaaaaattctt

SEQ ID NO: 6656658 - DNA, 22 bp, Homo sapiens
ataagaaaaaattctttcactt

SEQ ID NO: 6656659 - DNA, 17 bp, Homo sapiens
ataagaaaaaccaaaat

SEQ ID NO: 6656660 - DNA, 15 bp, Homo sapiens
ataagaaaaatcatg

SEQ ID NO: 6656661 - DNA, 23 bp, Homo sapiens
ataagaaaaccaccccttagatt

SEQ ID NO: 6656662 - DNA, 13 bp, Homo sapiens
ataagaaaactac

SEQ ID NO: 6656663 - DNA, 21 bp, Homo sapiens
ataagaaaactacatgtaaaa

SEQ ID NO: 6656664 - DNA, 14 bp, Homo sapiens
ataagaaaagcctg

SEQ ID NO: 6656665 - DNA, 13 bp, Homo sapiens
ataagaaaatgct

SEQ ID NO: 6656666 - DNA, 13 bp, Homo sapiens
ataagaaacagtt

SEQ ID NO: 6656667 - DNA, 18 bp, Homo sapiens
ataagaaagaattgcagt

SEQ ID NO: 6656668 - DNA, 19 bp, Homo sapiens
ataagaaagccctaaaata

SEQ ID NO: 6656669 - DNA, 11 bp, Homo sapiens
ataagaaatga

SEQ ID NO: 6656670 - DNA, 18 bp, Homo sapiens
ataagaaatgaacaaaag

SEQ ID NO: 6656671 - DNA, 19 bp, Homo sapiens
ataagaacaagttttggca

SEQ ID NO: 6656672 - DNA, 17 bp, Homo sapiens
ataagaacccagggtgg

SEQ ID NO: 6656673 - DNA, 22 bp, Homo sapiens
ataagaaccttttgagtgcctt

SEQ ID NO: 6656674 - DNA, 23 bp, Homo sapiens
ataagaaccttttgagtgcctta

SEQ ID NO: 6656675 - DNA, 22 bp, Homo sapiens
ataagaagcaatctttgaaata

SEQ ID NO: 6656676 - DNA, 18 bp, Homo sapiens
ataagaaggcaattttag

SEQ ID NO: 6656677 - DNA, 12 bp, Homo sapiens
ataagaataaag

SEQ ID NO: 6656678 - DNA, 20 bp, Homo sapiens
ataagaatagaacaacatat

SEQ ID NO: 6656679 - DNA, 14 bp, Homo sapiens
ataagaatttgcat

SEQ ID NO: 6656680 - DNA, 17 bp, Homo sapiens
ataagacaaaatttaat

SEQ ID NO: 6656681 - DNA, 12 bp, Homo sapiens
ataagacaagat

SEQ ID NO: 6656682 - DNA, 18 bp, Homo sapiens
ataagacaagtctgagta

SEQ ID NO: 6656683 - DNA, 21 bp, Homo sapiens
ataagacaatgacatacgctt

SEQ ID NO: 6656684 - DNA, 23 bp, Homo sapiens
ataagacaatgctgctttggtta

SEQ ID NO: 6656685 - DNA, 14 bp, Homo sapiens
ataagacagagaag

SEQ ID NO: 6656686 - DNA, 14 bp, Homo sapiens
ataagacataacgt

SEQ ID NO: 6656687 - DNA, 17 bp, Homo sapiens
ataagacataacgtttt

SEQ ID NO: 6656688 - DNA, 23 bp, Homo sapiens
ataagacataacgtttttccttt

SEQ ID NO: 6656689 - DNA, 11 bp, Homo sapiens
ataagacatga

SEQ ID NO: 6656690 - DNA, 15 bp, Homo sapiens
ataagacatgcttac

SEQ ID NO: 6656691 - DNA, 15 bp, Homo sapiens
ataagacattttgtt

SEQ ID NO: 6656692 - DNA, 22 bp, Homo sapiens
ataagaccaccacctcagagta

SEQ ID NO: 6656693 - DNA, 21 bp, Homo sapiens
ataagacggatttatttttcc

SEQ ID NO: 6656694 - DNA, 20 bp, Homo sapiens
ataagactaaatgattagaa

SEQ ID NO: 6656695 - DNA, 19 bp, Homo sapiens
ataagactagagagatatt

SEQ ID NO: 6656696 - DNA, 15 bp, Homo sapiens
ataagactgctgcag

SEQ ID NO: 6656697 - DNA, 17 bp, Homo sapiens
ataagactgtttttaag

SEQ ID NO: 6656698 - DNA, 22 bp, Homo sapiens
ataagactgtttttaagtaact

SEQ ID NO: 6656699 - DNA, 13 bp, Homo sapiens
ataagacttctgg

SEQ ID NO: 6656700 - DNA, 18 bp, Homo sapiens
ataagacttgtttctttc

SEQ ID NO: 6656701 - DNA, 11 bp, Homo sapiens
ataagagaaac

SEQ ID NO: 6656702 - DNA, 21 bp, Homo sapiens
ataagagaaatggtagaagat

SEQ ID NO: 6656703 - DNA, 20 bp, Homo sapiens
ataagagagaacaactactg

SEQ ID NO: 6656704 - DNA, 17 bp, Homo sapiens
ataagagagatgagaaa

SEQ ID NO: 6656705 - DNA, 19 bp, Homo sapiens
ataagagagccttggttca

SEQ ID NO: 6656706 - DNA, 20 bp, Homo sapiens
ataagagagtcataaacctt

SEQ ID NO: 6656707 - DNA, 22 bp, Homo sapiens
ataagagcatgaaatttttaaa

SEQ ID NO: 6656708 - DNA, 20 bp, Homo sapiens
ataagagccctgagcccaga

SEQ ID NO: 6656709 - DNA, 16 bp, Homo sapiens
ataagaggaatttctt

SEQ ID NO: 6656710 - DNA, 17 bp, Homo sapiens
ataagagggctttttaa

SEQ ID NO: 6656711 - DNA, 16 bp, Homo sapiens
ataagaggttctaact

SEQ ID NO: 6656712 - DNA, 17 bp, Homo sapiens
ataagagtaacagtcat

SEQ ID NO: 6656713 - DNA, 16 bp, Homo sapiens
ataagagtagaaactg

SEQ ID NO: 6656714 - DNA, 18 bp, Homo sapiens
ataagagtctccttctct

SEQ ID NO: 6656715 - DNA, 15 bp, Homo sapiens
ataagataaaatgat

SEQ ID NO: 6656716 - DNA, 19 bp, Homo sapiens
ataagatacaataaaacaa

SEQ ID NO: 6656717 - DNA, 22 bp, Homo sapiens
ataagatagttacatttatgtg

SEQ ID NO: 6656718 - DNA, 19 bp, Homo sapiens
ataagatatatacaaggtg

SEQ ID NO: 6656719 - DNA, 19 bp, Homo sapiens
ataagatattaccctcaga

SEQ ID NO: 6656720 - DNA, 23 bp, Homo sapiens
ataagatattaccctcagaatat

SEQ ID NO: 6656721 - DNA, 17 bp, Homo sapiens
ataagatattctttaca

SEQ ID NO: 6656722 - DNA, 20 bp, Homo sapiens
ataagatattttattttgaa

SEQ ID NO: 6656723 - DNA, 16 bp, Homo sapiens
ataagatatttttcat

SEQ ID NO: 6656724 - DNA, 15 bp, Homo sapiens
ataagatctgtatct

SEQ ID NO: 6656725 - DNA, 13 bp, Homo sapiens
ataagatctttta

SEQ ID NO: 6656726 - DNA, 17 bp, Homo sapiens
ataagatcttttatttt

SEQ ID NO: 6656727 - DNA, 15 bp, Homo sapiens
ataagatgaggaaat

SEQ ID NO: 6656728 - DNA, 16 bp, Homo sapiens
ataagattaaaggaag

SEQ ID NO: 6656729 - DNA, 13 bp, Homo sapiens
ataagattaataa

SEQ ID NO: 6656730 - DNA, 17 bp, Homo sapiens
ataagattagaatgaaa

SEQ ID NO: 6656731 - DNA, 15 bp, Homo sapiens
ataagattagttgga

SEQ ID NO: 6656732 - DNA, 23 bp, Homo sapiens
ataagattagttggacagtttaa

SEQ ID NO: 6656733 - DNA, 18 bp, Homo sapiens
ataagattatatacaaag

SEQ ID NO: 6656734 - DNA, 18 bp, Homo sapiens
ataagattatatggactt

SEQ ID NO: 6656735 - DNA, 12 bp, Homo sapiens
ataagattccaa

SEQ ID NO: 6656736 - DNA, 21 bp, Homo sapiens
ataagattccaaaaagcacat

SEQ ID NO: 6656737 - DNA, 22 bp, Homo sapiens
ataagattccaaaaagcacata

SEQ ID NO: 6656738 - DNA, 15 bp, Homo sapiens
ataagatttttaggt

SEQ ID NO: 6656739 - DNA, 14 bp, Homo sapiens
ataagatttttgaa

SEQ ID NO: 6656740 - DNA, 13 bp, Homo sapiens
ataagcaaaaaga

SEQ ID NO: 6656741 - DNA, 15 bp, Homo sapiens
ataagcaaaatgaaa

SEQ ID NO: 6656742 - DNA, 19 bp, Homo sapiens
ataagcaaaatgaaaagag

SEQ ID NO: 6656743 - DNA, 12 bp, Homo sapiens
ataagcaacaat

SEQ ID NO: 6656744 - DNA, 22 bp, Homo sapiens
ataagcaacaattttcagattt

SEQ ID NO: 6656745 - DNA, 15 bp, Homo sapiens
ataagcaagagagat

SEQ ID NO: 6656746 - DNA, 17 bp, Homo sapiens
ataagcaatcaaggtta

SEQ ID NO: 6656747 - DNA, 17 bp, Homo sapiens
ataagcacagacaattc

SEQ ID NO: 6656748 - DNA, 22 bp, Homo sapiens
ataagcacagacaattctaatg

SEQ ID NO: 6656749 - DNA, 17 bp, Homo sapiens
ataagcactgtaaactt

SEQ ID NO: 6656750 - DNA, 17 bp, Homo sapiens
ataagcacttgcctgga

SEQ ID NO: 6656751 - DNA, 19 bp, Homo sapiens
ataagcagaacatactgtt

SEQ ID NO: 6656752 - DNA, 21 bp, Homo sapiens
ataagcagaggtggaaaatga

SEQ ID NO: 6656753 - DNA, 20 bp, Homo sapiens
ataagcagagttgctcttca

SEQ ID NO: 6656754 - DNA, 13 bp, Homo sapiens
ataagcaggtgga

SEQ ID NO: 6656755 - DNA, 15 bp, Homo sapiens
ataagcagttatgtg

SEQ ID NO: 6656756 - DNA, 20 bp, Homo sapiens
ataagcataagaccaatctc

SEQ ID NO: 6656757 - DNA, 17 bp, Homo sapiens
ataagcatcaaactctt

SEQ ID NO: 6656758 - DNA, 17 bp, Homo sapiens
ataagcatcattattta

SEQ ID NO: 6656759 - DNA, 22 bp, Homo sapiens
ataagcatctgtgtaacctcca

SEQ ID NO: 6656760 - DNA, 23 bp, Homo sapiens
ataagcatgatcttgttaatgca

SEQ ID NO: 6656761 - DNA, 23 bp, Homo sapiens
ataagcatggagaacagtgattt

SEQ ID NO: 6656762 - DNA, 14 bp, Homo sapiens
ataagcattacttt

SEQ ID NO: 6656763 - DNA, 15 bp, Homo sapiens
ataagcattacttta

SEQ ID NO: 6656764 - DNA, 16 bp, Homo sapiens
ataagcattgaaatta

SEQ ID NO: 6656765 - DNA, 14 bp, Homo sapiens
ataagcattgctca

SEQ ID NO: 6656766 - DNA, 19 bp, Homo sapiens
ataagccaaaactgagcat

SEQ ID NO: 6656767 - DNA, 18 bp, Homo sapiens
ataagccaaaataagact

SEQ ID NO: 6656768 - DNA, 21 bp, Homo sapiens
ataagccagacatcaacagat

SEQ ID NO: 6656769 - DNA, 23 bp, Homo sapiens
ataagcccaacaagttgaagaag

SEQ ID NO: 6656770 - DNA, 22 bp, Homo sapiens
ataagcccagtgctgctgtaaa

SEQ ID NO: 6656771 - DNA, 15 bp, Homo sapiens
ataagcccttaataa

SEQ ID NO: 6656772 - DNA, 18 bp, Homo sapiens
ataagcccttaataataa

SEQ ID NO: 6656773 - DNA, 21 bp, Homo sapiens
ataagcccttaataataatgc

SEQ ID NO: 6656774 - DNA, 13 bp, Homo sapiens
ataagctaaagag

SEQ ID NO: 6656775 - DNA, 19 bp, Homo sapiens
ataagctactagcaaaata

SEQ ID NO: 6656776 - DNA, 14 bp, Homo sapiens
ataagctactgcca

SEQ ID NO: 6656777 - DNA, 17 bp, Homo sapiens
ataagctagaaaaatta

SEQ ID NO: 6656778 - DNA, 14 bp, Homo sapiens
ataagctagttgaa

SEQ ID NO: 6656779 - DNA, 23 bp, Homo sapiens
ataagctagttgaatacttgaac

SEQ ID NO: 6656780 - DNA, 21 bp, Homo sapiens
ataagctatgagttgaaatgt

SEQ ID NO: 6656781 - DNA, 15 bp, Homo sapiens
ataagctatgtcact

SEQ ID NO: 6656782 - DNA, 15 bp, Homo sapiens
ataagctatttatgt

SEQ ID NO: 6656783 - DNA, 17 bp, Homo sapiens
ataagctatttatgtaa

SEQ ID NO: 6656784 - DNA, 13 bp, Homo sapiens
ataagctatttga

SEQ ID NO: 6656785 - DNA, 14 bp, Homo sapiens
ataagctattttgg

SEQ ID NO: 6656786 - DNA, 16 bp, Homo sapiens
ataagctcagaatcca

SEQ ID NO: 6656787 - DNA, 14 bp, Homo sapiens
ataagctgttctgg

SEQ ID NO: 6656788 - DNA, 17 bp, Homo sapiens
ataagcttaaaataagt

SEQ ID NO: 6656789 - DNA, 15 bp, Homo sapiens
ataagcttaaatagg

SEQ ID NO: 6656790 - DNA, 15 bp, Homo sapiens
ataagctttctcaga

SEQ ID NO: 6656791 - DNA, 20 bp, Homo sapiens
ataagctttctcagaatgtt

SEQ ID NO: 6656792 - DNA, 16 bp, Homo sapiens
ataagctttctctcag

SEQ ID NO: 6656793 - DNA, 16 bp, Homo sapiens
ataagctttgtaattc

SEQ ID NO: 6656794 - DNA, 14 bp, Homo sapiens
ataagcttttcttt

SEQ ID NO: 6656795 - DNA, 20 bp, Homo sapiens
ataagcttttgttttttaaa

SEQ ID NO: 6656796 - DNA, 14 bp, Homo sapiens
ataagctttttaat

SEQ ID NO: 6656797 - DNA, 20 bp, Homo sapiens
ataaggaaactttatttaaa

SEQ ID NO: 6656798 - DNA, 20 bp, Homo sapiens
ataaggaaatcaacttgctt

SEQ ID NO: 6656799 - DNA, 24 bp, Homo sapiens
ataaggaaatcaacttgcttatca

SEQ ID NO: 6656800 - DNA, 21 bp, Homo sapiens
ataaggaaatgtgtgttgtaa

SEQ ID NO: 6656801 - DNA, 14 bp, Homo sapiens
ataaggaagttatt

SEQ ID NO: 6656802 - DNA, 17 bp, Homo sapiens
ataaggaattatagacc

SEQ ID NO: 6656803 - DNA, 15 bp, Homo sapiens
ataaggaatttcctc

SEQ ID NO: 6656804 - DNA, 14 bp, Homo sapiens
ataaggacagcagc

SEQ ID NO: 6656805 - DNA, 24 bp, Homo sapiens
ataaggaggaaaacgggaaagaat

SEQ ID NO: 6656806 - DNA, 22 bp, Homo sapiens
ataaggagggacatgatgggga

SEQ ID NO: 6656807 - DNA, 19 bp, Homo sapiens
ataaggagttagaaccaca

SEQ ID NO: 6656808 - DNA, 20 bp, Homo sapiens
ataaggagttagaaccacag

SEQ ID NO: 6656809 - DNA, 20 bp, Homo sapiens
ataaggatcagaacagcaga

SEQ ID NO: 6656810 - DNA, 22 bp, Homo sapiens
ataaggatcagaacagcagagg

SEQ ID NO: 6656811 - DNA, 15 bp, Homo sapiens
ataaggatcttttgt

SEQ ID NO: 6656812 - DNA, 21 bp, Homo sapiens
ataaggatgactttagaataa

SEQ ID NO: 6656813 - DNA, 13 bp, Homo sapiens
ataaggatttttc

SEQ ID NO: 6656814 - DNA, 16 bp, Homo sapiens
ataaggcaacaaaatg

SEQ ID NO: 6656815 - DNA, 23 bp, Homo sapiens
ataaggcattctgtataaatgca

SEQ ID NO: 6656816 - DNA, 16 bp, Homo sapiens
ataaggccagaaactc

SEQ ID NO: 6656817 - DNA, 23 bp, Homo sapiens
ataaggcccagagcgaggaaagg

SEQ ID NO: 6656818 - DNA, 15 bp, Homo sapiens
ataaggcctgccctc

SEQ ID NO: 6656819 - DNA, 17 bp, Homo sapiens
ataaggccttaatatgt

SEQ ID NO: 6656820 - DNA, 21 bp, Homo sapiens
ataaggctgagggctgccagc

SEQ ID NO: 6656821 - DNA, 23 bp, Homo sapiens
ataagggactgatgtttgtgcag

SEQ ID NO: 6656822 - DNA, 15 bp, Homo sapiens
ataagggagagggaa

SEQ ID NO: 6656823 - DNA, 21 bp, Homo sapiens
ataagggagcgtagaatctgt

SEQ ID NO: 6656824 - DNA, 13 bp, Homo sapiens
ataagggcagagt

SEQ ID NO: 6656825 - DNA, 15 bp, Homo sapiens
ataagggcagagtca

SEQ ID NO: 6656826 - DNA, 13 bp, Homo sapiens
ataagggccctgc

SEQ ID NO: 6656827 - DNA, 13 bp, Homo sapiens
ataaggggccttg

SEQ ID NO: 6656828 - DNA, 19 bp, Homo sapiens
ataaggggccttgctctga

SEQ ID NO: 6656829 - DNA, 17 bp, Homo sapiens
ataaggggtttgccatt

SEQ ID NO: 6656830 - DNA, 21 bp, Homo sapiens
ataaggggtttgccatttgat

SEQ ID NO: 6656831 - DNA, 23 bp, Homo sapiens
ataagggtcccccactctaaagc

SEQ ID NO: 6656832 - DNA, 16 bp, Homo sapiens
ataaggtaaaatgcca

SEQ ID NO: 6656833 - DNA, 18 bp, Homo sapiens
ataaggtaaaatgccatg

SEQ ID NO: 6656834 - DNA, 21 bp, Homo sapiens
ataaggtaccaagatcacaaa

SEQ ID NO: 6656835 - DNA, 19 bp, Homo sapiens
ataaggtataaggatcttt

SEQ ID NO: 6656836 - DNA, 20 bp, Homo sapiens
ataaggtgctctctttctgt

SEQ ID NO: 6656837 - DNA, 13 bp, Homo sapiens
ataaggtggcttc

SEQ ID NO: 6656838 - DNA, 19 bp, Homo sapiens
ataaggtgttttctgtgta

SEQ ID NO: 6656839 - DNA, 13 bp, Homo sapiens
ataaggtttagaa

SEQ ID NO: 6656840 - DNA, 19 bp, Homo sapiens
ataaggtttagaatgacag

SEQ ID NO: 6656841 - DNA, 17 bp, Homo sapiens
ataaggtttcctgctcc

SEQ ID NO: 6656842 - DNA, 23 bp, Homo sapiens
ataaggtttcgtttctgtataca

SEQ ID NO: 6656843 - DNA, 23 bp, Homo sapiens
ataaggtttgttcctttgaagaa

SEQ ID NO: 6656844 - DNA, 15 bp, Homo sapiens
ataaggttttattca

SEQ ID NO: 6656845 - DNA, 13 bp, Homo sapiens
ataagtaaaccta

SEQ ID NO: 6656846 - DNA, 15 bp, Homo sapiens
ataagtaaatacatt

SEQ ID NO: 6656847 - DNA, 15 bp, Homo sapiens
ataagtaaatgctag

SEQ ID NO: 6656848 - DNA, 15 bp, Homo sapiens
ataagtaaatgtctt

SEQ ID NO: 6656849 - DNA, 16 bp, Homo sapiens
ataagtaaatgtcttc

SEQ ID NO: 6656850 - DNA, 13 bp, Homo sapiens
ataagtaacatat

SEQ ID NO: 6656851 - DNA, 14 bp, Homo sapiens
ataagtaacatata

SEQ ID NO: 6656852 - DNA, 23 bp, Homo sapiens
ataagtaacttgtcaaggaatgt

SEQ ID NO: 6656853 - DNA, 12 bp, Homo sapiens
ataagtaagaaa

SEQ ID NO: 6656854 - DNA, 13 bp, Homo sapiens
ataagtaagaaaa

SEQ ID NO: 6656855 - DNA, 15 bp, Homo sapiens
ataagtaagaaaata

SEQ ID NO: 6656856 - DNA, 14 bp, Homo sapiens
ataagtaagaaatt

SEQ ID NO: 6656857 - DNA, 12 bp, Homo sapiens
ataagtaatgaa

SEQ ID NO: 6656858 - DNA, 19 bp, Homo sapiens
ataagtacctcagcattta

SEQ ID NO: 6656859 - DNA, 16 bp, Homo sapiens
ataagtactgtgtaca

SEQ ID NO: 6656860 - DNA, 19 bp, Homo sapiens
ataagtactgtgtacagaa

SEQ ID NO: 6656861 - DNA, 14 bp, Homo sapiens
ataagtagaattct

SEQ ID NO: 6656862 - DNA, 15 bp, Homo sapiens
ataagtagaattctt

SEQ ID NO: 6656863 - DNA, 23 bp, Homo sapiens
ataagtagatctgctttctgttc

SEQ ID NO: 6656864 - DNA, 21 bp, Homo sapiens
ataagtagtaaatcagaaagt

SEQ ID NO: 6656865 - DNA, 18 bp, Homo sapiens
ataagtagttggtttgta

SEQ ID NO: 6656866 - DNA, 22 bp, Homo sapiens
ataagtagttggtttgtatgag

SEQ ID NO: 6656867 - DNA, 17 bp, Homo sapiens
ataagtatatcttaaga

SEQ ID NO: 6656868 - DNA, 21 bp, Homo sapiens
ataagtatgggatgatagttg

SEQ ID NO: 6656869 - DNA, 16 bp, Homo sapiens
ataagtatttggaatt

SEQ ID NO: 6656870 - DNA, 14 bp, Homo sapiens
ataagtcaaaataa

SEQ ID NO: 6656871 - DNA, 14 bp, Homo sapiens
ataagtcaacagta

SEQ ID NO: 6656872 - DNA, 15 bp, Homo sapiens
ataagtcaacagtaa

SEQ ID NO: 6656873 - DNA, 14 bp, Homo sapiens
ataagtcatgttcc

SEQ ID NO: 6656874 - DNA, 14 bp, Homo sapiens
ataagtcattttaa

SEQ ID NO: 6656875 - DNA, 19 bp, Homo sapiens
ataagtcattttaataact

SEQ ID NO: 6656876 - DNA, 19 bp, Homo sapiens
ataagtccatctgtcactt

SEQ ID NO: 6656877 - DNA, 18 bp, Homo sapiens
ataagtccattaactgct

SEQ ID NO: 6656878 - DNA, 16 bp, Homo sapiens
ataagtcctaaagtga

SEQ ID NO: 6656879 - DNA, 22 bp, Homo sapiens
ataagtcctctagtgaatgtag

SEQ ID NO: 6656880 - DNA, 21 bp, Homo sapiens
ataagtccttgcaagaatcag

SEQ ID NO: 6656881 - DNA, 14 bp, Homo sapiens
ataagtctgattct

SEQ ID NO: 6656882 - DNA, 21 bp, Homo sapiens
ataagtgaaatggatactaca

SEQ ID NO: 6656883 - DNA, 22 bp, Homo sapiens
ataagtgaaatggatactacat

SEQ ID NO: 6656884 - DNA, 13 bp, Homo sapiens
ataagtgaaattt

SEQ ID NO: 6656885 - DNA, 16 bp, Homo sapiens
ataagtgaagtaattt

SEQ ID NO: 6656886 - DNA, 23 bp, Homo sapiens
ataagtgacaccaataaatgttt

SEQ ID NO: 6656887 - DNA, 14 bp, Homo sapiens
ataagtgactttaa

SEQ ID NO: 6656888 - DNA, 21 bp, Homo sapiens
ataagtgcacacagaaatata

SEQ ID NO: 6656889 - DNA, 23 bp, Homo sapiens
ataagtgcacacagaaatatata

SEQ ID NO: 6656890 - DNA, 14 bp, Homo sapiens
ataagtgctacttt

SEQ ID NO: 6656891 - DNA, 15 bp, Homo sapiens
ataagtgctactttg

SEQ ID NO: 6656892 - DNA, 21 bp, Homo sapiens
ataagtgctattgcagagccg

SEQ ID NO: 6656893 - DNA, 13 bp, Homo sapiens
ataagtgctgtat

SEQ ID NO: 6656894 - DNA, 16 bp, Homo sapiens
ataagtgctgtataaa

SEQ ID NO: 6656895 - DNA, 18 bp, Homo sapiens
ataagtgctgtataaaat

SEQ ID NO: 6656896 - DNA, 12 bp, Homo sapiens
ataagtgctgtt

SEQ ID NO: 6656897 - DNA, 15 bp, Homo sapiens
ataagtggaaaaaag

SEQ ID NO: 6656898 - DNA, 22 bp, Homo sapiens
ataagtggaaaaaagagaaaaa

SEQ ID NO: 6656899 - DNA, 22 bp, Homo sapiens
ataagtggacaaattttgagtt

SEQ ID NO: 6656900 - DNA, 14 bp, Homo sapiens
ataagtggagaaat

SEQ ID NO: 6656901 - DNA, 20 bp, Homo sapiens
ataagtggagaaatgaaaag

SEQ ID NO: 6656902 - DNA, 19 bp, Homo sapiens
ataagtggaggcactttag

SEQ ID NO: 6656903 - DNA, 17 bp, Homo sapiens
ataagtggctgtttcat

SEQ ID NO: 6656904 - DNA, 18 bp, Homo sapiens
ataagtggttttcttcag

SEQ ID NO: 6656905 - DNA, 16 bp, Homo sapiens
ataagtgtaaatagaa

SEQ ID NO: 6656906 - DNA, 20 bp, Homo sapiens
ataagtgtacatatgtgctg

SEQ ID NO: 6656907 - DNA, 19 bp, Homo sapiens
ataagtgtacgattcttaa

SEQ ID NO: 6656908 - DNA, 13 bp, Homo sapiens
ataagtgtatttt

SEQ ID NO: 6656909 - DNA, 14 bp, Homo sapiens
ataagtgtattttt

SEQ ID NO: 6656910 - DNA, 17 bp, Homo sapiens
ataagtgtgaccagttt

SEQ ID NO: 6656911 - DNA, 21 bp, Homo sapiens
ataagtgtgaccagttttgat

SEQ ID NO: 6656912 - DNA, 18 bp, Homo sapiens
ataagtgttcagtgttga

SEQ ID NO: 6656913 - DNA, 20 bp, Homo sapiens
ataagtgttcagtgttgaca

SEQ ID NO: 6656914 - DNA, 22 bp, Homo sapiens
ataagtgttcagtgttgacata

SEQ ID NO: 6656915 - DNA, 21 bp, Homo sapiens
ataagtgttggccatcatttc

SEQ ID NO: 6656916 - DNA, 20 bp, Homo sapiens
ataagtgttgtaccatatgt

SEQ ID NO: 6656917 - DNA, 18 bp, Homo sapiens
ataagttaaagagacaaa

SEQ ID NO: 6656918 - DNA, 17 bp, Homo sapiens
ataagttaaaggcagtc

SEQ ID NO: 6656919 - DNA, 17 bp, Homo sapiens
ataagttacttgaaata

SEQ ID NO: 6656920 - DNA, 21 bp, Homo sapiens
ataagttatgggtttttatgt

SEQ ID NO: 6656921 - DNA, 21 bp, Homo sapiens
ataagttattgcagtttatca

SEQ ID NO: 6656922 - DNA, 20 bp, Homo sapiens
ataagttatttttgtacatg

SEQ ID NO: 6656923 - DNA, 22 bp, Homo sapiens
ataagttatttttgtacatgtt

SEQ ID NO: 6656924 - DNA, 13 bp, Homo sapiens
ataagttcacaaa

SEQ ID NO: 6656925 - DNA, 14 bp, Homo sapiens
ataagttcatacat

SEQ ID NO: 6656926 - DNA, 15 bp, Homo sapiens
ataagttcatacatt

SEQ ID NO: 6656927 - DNA, 14 bp, Homo sapiens
ataagttccaaaaa

SEQ ID NO: 6656928 - DNA, 16 bp, Homo sapiens
ataagttccatgttaa

SEQ ID NO: 6656929 - DNA, 18 bp, Homo sapiens
ataagttcccatttcctt

SEQ ID NO: 6656930 - DNA, 16 bp, Homo sapiens
ataagttctattttac

SEQ ID NO: 6656931 - DNA, 17 bp, Homo sapiens
ataagttcttaaaaaat

SEQ ID NO: 6656932 - DNA, 15 bp, Homo sapiens
ataagttgaaggaaa

SEQ ID NO: 6656933 - DNA, 17 bp, Homo sapiens
ataagttgatgttttct

SEQ ID NO: 6656934 - DNA, 13 bp, Homo sapiens
ataagttgctgta

SEQ ID NO: 6656935 - DNA, 14 bp, Homo sapiens
ataagttgctgtaa

SEQ ID NO: 6656936 - DNA, 14 bp, Homo sapiens
ataagttgctgtgt

SEQ ID NO: 6656937 - DNA, 16 bp, Homo sapiens
ataagttggaaacact

SEQ ID NO: 6656938 - DNA, 12 bp, Homo sapiens
ataagttgtacc

SEQ ID NO: 6656939 - DNA, 13 bp, Homo sapiens
ataagttgtacca

SEQ ID NO: 6656940 - DNA, 14 bp, Homo sapiens
ataagttgtaccaa

SEQ ID NO: 6656941 - DNA, 23 bp, Homo sapiens
ataagttgtaccaaaacatccac

SEQ ID NO: 6656942 - DNA, 18 bp, Homo sapiens
ataagtttatttcttaaa

SEQ ID NO: 6656943 - DNA, 17 bp, Homo sapiens
ataagtttgcaatttgg

SEQ ID NO: 6656944 - DNA, 14 bp, Homo sapiens
ataagttttctctt

SEQ ID NO: 6656945 - DNA, 19 bp, Homo sapiens
ataagttttctcttttaag

SEQ ID NO: 6656946 - DNA, 16 bp, Homo sapiens
ataagttttgatataa

SEQ ID NO: 6656947 - DNA, 18 bp, Homo sapiens
ataagttttgatataatc

SEQ ID NO: 6656948 - DNA, 19 bp, Homo sapiens
ataagtttttctttaatat

SEQ ID NO: 6656949 - DNA, 15 bp, Homo sapiens
ataagtttttgccat

SEQ ID NO: 6656950 - DNA, 14 bp, Homo sapiens
ataagtttttgcta

SEQ ID NO: 6656951 - DNA, 17 bp, Homo sapiens
ataataaaaaaagaaag

SEQ ID NO: 6656952 - DNA, 19 bp, Homo sapiens
ataataaaaatatattttc

SEQ ID NO: 6656953 - DNA, 14 bp, Homo sapiens
ataataaaaattgt

SEQ ID NO: 6656954 - DNA, 12 bp, Homo sapiens
ataataaaacca

SEQ ID NO: 6656955 - DNA, 11 bp, Homo sapiens
ataataaaaga

SEQ ID NO: 6656956 - DNA, 14 bp, Homo sapiens
ataataaaaggaaa

SEQ ID NO: 6656957 - DNA, 14 bp, Homo sapiens
ataataaaatatca

SEQ ID NO: 6656958 - DNA, 11 bp, Homo sapiens
ataataaaatg

SEQ ID NO: 6656959 - DNA, 12 bp, Homo sapiens
ataataaaatgc

SEQ ID NO: 6656960 - DNA, 12 bp, Homo sapiens
ataataaaattc

SEQ ID NO: 6656961 - DNA, 19 bp, Homo sapiens
ataataaaattcattccat

SEQ ID NO: 6656962 - DNA, 21 bp, Homo sapiens
ataataaacataatgaaaata

SEQ ID NO: 6656963 - DNA, 21 bp, Homo sapiens
ataataaacgatgttgtgatg

SEQ ID NO: 6656964 - DNA, 14 bp, Homo sapiens
ataataaactgttt

SEQ ID NO: 6656965 - DNA, 16 bp, Homo sapiens
ataataaactgtttaa

SEQ ID NO: 6656966 - DNA, 21 bp, Homo sapiens
ataataaagaactccttattt

SEQ ID NO: 6656967 - DNA, 13 bp, Homo sapiens
ataataaagccag

SEQ ID NO: 6656968 - DNA, 11 bp, Homo sapiens
ataataaagga

SEQ ID NO: 6656969 - DNA, 14 bp, Homo sapiens
ataataaaggttct

SEQ ID NO: 6656970 - DNA, 15 bp, Homo sapiens
ataataaaggttcta

SEQ ID NO: 6656971 - DNA, 14 bp, Homo sapiens
ataataaaggttga

SEQ ID NO: 6656972 - DNA, 17 bp, Homo sapiens
ataataaaggttgtgaa

SEQ ID NO: 6656973 - DNA, 21 bp, Homo sapiens
ataataaagtagcaaaacaaa

SEQ ID NO: 6656974 - DNA, 22 bp, Homo sapiens
ataataaagtattccaccttaa

SEQ ID NO: 6656975 - DNA, 14 bp, Homo sapiens
ataataaagtggca

SEQ ID NO: 6656976 - DNA, 12 bp, Homo sapiens
ataataaagttg

SEQ ID NO: 6656977 - DNA, 13 bp, Homo sapiens
ataataaagttgt

SEQ ID NO: 6656978 - DNA, 18 bp, Homo sapiens
ataataaataaacttcaa

SEQ ID NO: 6656979 - DNA, 16 bp, Homo sapiens
ataataaatatatatt

SEQ ID NO: 6656980 - DNA, 20 bp, Homo sapiens
ataataaatgcatagagcaa

SEQ ID NO: 6656981 - DNA, 15 bp, Homo sapiens
ataataaatgtattt

SEQ ID NO: 6656982 - DNA, 13 bp, Homo sapiens
ataataaattaaa

SEQ ID NO: 6656983 - DNA, 18 bp, Homo sapiens
ataataaattaaacatgc

SEQ ID NO: 6656984 - DNA, 19 bp, Homo sapiens
ataataaattaacattata

SEQ ID NO: 6656985 - DNA, 15 bp, Homo sapiens
ataataaattgaaat

SEQ ID NO: 6656986 - DNA, 13 bp, Homo sapiens
ataataaattttc

SEQ ID NO: 6656987 - DNA, 17 bp, Homo sapiens
ataataaattttctaaa

SEQ ID NO: 6656988 - DNA, 16 bp, Homo sapiens
ataataactagatctc

SEQ ID NO: 6656989 - DNA, 18 bp, Homo sapiens
ataataactgaactgttt

SEQ ID NO: 6656990 - DNA, 18 bp, Homo sapiens
ataataactgtcttctgg

SEQ ID NO: 6656991 - DNA, 13 bp, Homo sapiens
ataataactttat

SEQ ID NO: 6656992 - DNA, 18 bp, Homo sapiens
ataataactttattgcat

SEQ ID NO: 6656993 - DNA, 19 bp, Homo sapiens
ataataactttattgcata

SEQ ID NO: 6656994 - DNA, 15 bp, Homo sapiens
ataataagacttttc

SEQ ID NO: 6656995 - DNA, 23 bp, Homo sapiens
ataataagacttttctctacttt

SEQ ID NO: 6656996 - DNA, 17 bp, Homo sapiens
ataataagataaaagaa

SEQ ID NO: 6656997 - DNA, 13 bp, Homo sapiens
ataataagctaaa

SEQ ID NO: 6656998 - DNA, 22 bp, Homo sapiens
ataataaggaaaagtttaatat

SEQ ID NO: 6656999 - DNA, 18 bp, Homo sapiens
ataataaggggaagactt

SEQ ID NO: 6657000 - DNA, 21 bp, Homo sapiens
ataataagtgatgtgctgaat

SEQ ID NO: 6657001 - DNA, 15 bp, Homo sapiens
ataataagttttgat

SEQ ID NO: 6657002 - DNA, 13 bp, Homo sapiens
ataataatagcta

SEQ ID NO: 6657003 - DNA, 15 bp, Homo sapiens
ataataatataatga

SEQ ID NO: 6657004 - DNA, 19 bp, Homo sapiens
ataataatctaggcatgaa

SEQ ID NO: 6657005 - DNA, 17 bp, Homo sapiens
ataataatgaatgtcat

SEQ ID NO: 6657006 - DNA, 17 bp, Homo sapiens
ataataatgccaatgaa

SEQ ID NO: 6657007 - DNA, 23 bp, Homo sapiens
ataataatgccaatgaacatctc

SEQ ID NO: 6657008 - DNA, 14 bp, Homo sapiens
ataataatgttctc

SEQ ID NO: 6657009 - DNA, 17 bp, Homo sapiens
ataataatgttctctgg

SEQ ID NO: 6657010 - DNA, 22 bp, Homo sapiens
ataataattaggttaacattgt

SEQ ID NO: 6657011 - DNA, 17 bp, Homo sapiens
ataataattgaagaatg

SEQ ID NO: 6657012 - DNA, 17 bp, Homo sapiens
ataatacacaaaatcaa

SEQ ID NO: 6657013 - DNA, 13 bp, Homo sapiens
ataatacacttgc

SEQ ID NO: 6657014 - DNA, 16 bp, Homo sapiens
ataatacacttgccct

SEQ ID NO: 6657015 - DNA, 18 bp, Homo sapiens
ataatacagaatcttgtt

SEQ ID NO: 6657016 - DNA, 21 bp, Homo sapiens
ataatacagaatcttgttttg

SEQ ID NO: 6657017 - DNA, 20 bp, Homo sapiens
ataatacagatttgtaacat

SEQ ID NO: 6657018 - DNA, 22 bp, Homo sapiens
ataatacaggtaacattataaa

SEQ ID NO: 6657019 - DNA, 19 bp, Homo sapiens
ataatacagtatctcaggg

SEQ ID NO: 6657020 - DNA, 15 bp, Homo sapiens
ataatacatactaat

SEQ ID NO: 6657021 - DNA, 15 bp, Homo sapiens
ataatacatctttat

SEQ ID NO: 6657022 - DNA, 22 bp, Homo sapiens
ataatacattacatgtaaatta

SEQ ID NO: 6657023 - DNA, 16 bp, Homo sapiens
ataataccaagactaa

SEQ ID NO: 6657024 - DNA, 21 bp, Homo sapiens
ataataccaccatttaaaaat

SEQ ID NO: 6657025 - DNA, 17 bp, Homo sapiens
ataatacccttttccaa

SEQ ID NO: 6657026 - DNA, 12 bp, Homo sapiens
ataatacctcaa

SEQ ID NO: 6657027 - DNA, 15 bp, Homo sapiens
ataatacctttctaa

SEQ ID NO: 6657028 - DNA, 20 bp, Homo sapiens
ataatacctttctaagggaa

SEQ ID NO: 6657029 - DNA, 19 bp, Homo sapiens
ataatactaaagtgtctat

SEQ ID NO: 6657030 - DNA, 14 bp, Homo sapiens
ataatactactact

SEQ ID NO: 6657031 - DNA, 16 bp, Homo sapiens
ataatactactactgt

SEQ ID NO: 6657032 - DNA, 17 bp, Homo sapiens
ataatactgaaatgctt

SEQ ID NO: 6657033 - DNA, 21 bp, Homo sapiens
ataatacttaaaaatatgtga

SEQ ID NO: 6657034 - DNA, 15 bp, Homo sapiens
ataatagaaatgtct

SEQ ID NO: 6657035 - DNA, 21 bp, Homo sapiens
ataatagaatttcctaatgag

SEQ ID NO: 6657036 - DNA, 16 bp, Homo sapiens
ataatagacacatcaa

SEQ ID NO: 6657037 - DNA, 17 bp, Homo sapiens
ataatagatgtgaaaat

SEQ ID NO: 6657038 - DNA, 21 bp, Homo sapiens
ataatagattttttttaaagt

SEQ ID NO: 6657039 - DNA, 18 bp, Homo sapiens
ataatagcatttttgtaa

SEQ ID NO: 6657040 - DNA, 19 bp, Homo sapiens
ataatagctaataataaat

SEQ ID NO: 6657041 - DNA, 19 bp, Homo sapiens
ataatagctaataatacct

SEQ ID NO: 6657042 - DNA, 12 bp, Homo sapiens
ataataggaatg

SEQ ID NO: 6657043 - DNA, 18 bp, Homo sapiens
ataataggggattttaaa

SEQ ID NO: 6657044 - DNA, 23 bp, Homo sapiens
ataataggtagggggctttcact

SEQ ID NO: 6657045 - DNA, 19 bp, Homo sapiens
ataataggtagtttggata

SEQ ID NO: 6657046 - DNA, 20 bp, Homo sapiens
ataataggtagtttggatat

SEQ ID NO: 6657047 - DNA, 21 bp, Homo sapiens
ataataggtagtttggatatt

SEQ ID NO: 6657048 - DNA, 20 bp, Homo sapiens
ataataggtatatagaacac

SEQ ID NO: 6657049 - DNA, 21 bp, Homo sapiens
ataataggtcatatgttgtgt

SEQ ID NO: 6657050 - DNA, 23 bp, Homo sapiens
ataatagtcaatttctacttctg

SEQ ID NO: 6657051 - DNA, 19 bp, Homo sapiens
ataatagtcacctgctgtt

SEQ ID NO: 6657052 - DNA, 12 bp, Homo sapiens
ataatagttatt

SEQ ID NO: 6657053 - DNA, 17 bp, Homo sapiens
ataatagttattattta

SEQ ID NO: 6657054 - DNA, 18 bp, Homo sapiens
ataatagttcaggatttg

SEQ ID NO: 6657055 - DNA, 13 bp, Homo sapiens
ataatataaaaaa

SEQ ID NO: 6657056 - DNA, 14 bp, Homo sapiens
ataatataaaatgt

SEQ ID NO: 6657057 - DNA, 13 bp, Homo sapiens
ataatataaatga

SEQ ID NO: 6657058 - DNA, 14 bp, Homo sapiens
ataatataaatgaa

SEQ ID NO: 6657059 - DNA, 17 bp, Homo sapiens
ataatataaatgaatga

SEQ ID NO: 6657060 - DNA, 18 bp, Homo sapiens
ataatataaatgaatgaa

SEQ ID NO: 6657061 - DNA, 23 bp, Homo sapiens
ataatatacttttacattaaaga

SEQ ID NO: 6657062 - DNA, 10 bp, Homo sapiens
ataatatata

SEQ ID NO: 6657063 - DNA, 22 bp, Homo sapiens
ataatatatgtttaccttttaa

SEQ ID NO: 6657064 - DNA, 22 bp, Homo sapiens
ataatatatgttttaaatatag

SEQ ID NO: 6657065 - DNA, 15 bp, Homo sapiens
ataatatattaggca

SEQ ID NO: 6657066 - DNA, 23 bp, Homo sapiens
ataatatattctatttttatact

SEQ ID NO: 6657067 - DNA, 16 bp, Homo sapiens
ataatatattgctaaa

SEQ ID NO: 6657068 - DNA, 15 bp, Homo sapiens
ataatatattgtgtt

SEQ ID NO: 6657069 - DNA, 17 bp, Homo sapiens
ataatatattgtgttga

SEQ ID NO: 6657070 - DNA, 14 bp, Homo sapiens
ataatatatttgca

SEQ ID NO: 6657071 - DNA, 19 bp, Homo sapiens
ataatatattttaaatatt

SEQ ID NO: 6657072 - DNA, 19 bp, Homo sapiens
ataatatccatgcgtttct

SEQ ID NO: 6657073 - DNA, 18 bp, Homo sapiens
ataatatcctgaataact

SEQ ID NO: 6657074 - DNA, 19 bp, Homo sapiens
ataatatctaaagttatat

SEQ ID NO: 6657075 - DNA, 16 bp, Homo sapiens
ataatatctctaatat

SEQ ID NO: 6657076 - DNA, 23 bp, Homo sapiens
ataatatcttgaagaatattgtt

SEQ ID NO: 6657077 - DNA, 14 bp, Homo sapiens
ataatatgaagcct

SEQ ID NO: 6657078 - DNA, 11 bp, Homo sapiens
ataatatgaat

SEQ ID NO: 6657079 - DNA, 12 bp, Homo sapiens
ataatatgaata

SEQ ID NO: 6657080 - DNA, 13 bp, Homo sapiens
ataatatgaatat

SEQ ID NO: 6657081 - DNA, 19 bp, Homo sapiens
ataatatgaatatatacat

SEQ ID NO: 6657082 - DNA, 13 bp, Homo sapiens
ataatatgatttt

SEQ ID NO: 6657083 - DNA, 13 bp, Homo sapiens
ataatatgcatat

SEQ ID NO: 6657084 - DNA, 14 bp, Homo sapiens
ataatatgcatata

SEQ ID NO: 6657085 - DNA, 23 bp, Homo sapiens
ataatatggaaccttccctccaa

SEQ ID NO: 6657086 - DNA, 13 bp, Homo sapiens
ataatatggctat

SEQ ID NO: 6657087 - DNA, 15 bp, Homo sapiens
ataatatgtaaattt

SEQ ID NO: 6657088 - DNA, 13 bp, Homo sapiens
ataatatgtacaa

SEQ ID NO: 6657089 - DNA, 14 bp, Homo sapiens
ataatatgtgcctt

SEQ ID NO: 6657090 - DNA, 16 bp, Homo sapiens
ataatatgtgccttaa

SEQ ID NO: 6657091 - DNA, 17 bp, Homo sapiens
ataatatgtgccttaag

SEQ ID NO: 6657092 - DNA, 14 bp, Homo sapiens
ataatatgtttgag

SEQ ID NO: 6657093 - DNA, 22 bp, Homo sapiens
ataatatgtttgaggttaaaat

SEQ ID NO: 6657094 - DNA, 21 bp, Homo sapiens
ataatattaatttatttaatt

SEQ ID NO: 6657095 - DNA, 20 bp, Homo sapiens
ataatattactctatgatga

SEQ ID NO: 6657096 - DNA, 14 bp, Homo sapiens
ataatattactgtt

SEQ ID NO: 6657097 - DNA, 21 bp, Homo sapiens
ataatattcagccagcttaaa

SEQ ID NO: 6657098 - DNA, 14 bp, Homo sapiens
ataatattcataca

SEQ ID NO: 6657099 - DNA, 16 bp, Homo sapiens
ataatattcatgaaga

SEQ ID NO: 6657100 - DNA, 14 bp, Homo sapiens
ataatattcattgg

SEQ ID NO: 6657101 - DNA, 13 bp, Homo sapiens
ataatattgcagt

SEQ ID NO: 6657102 - DNA, 22 bp, Homo sapiens
ataatattgccttgatgtttct

SEQ ID NO: 6657103 - DNA, 23 bp, Homo sapiens
ataatattggggaccaaatcaaa

SEQ ID NO: 6657104 - DNA, 14 bp, Homo sapiens
ataatattgtaact

SEQ ID NO: 6657105 - DNA, 20 bp, Homo sapiens
ataatattgtctgtctctat

SEQ ID NO: 6657106 - DNA, 16 bp, Homo sapiens
ataatattgtttggta

SEQ ID NO: 6657107 - DNA, 21 bp, Homo sapiens
ataatattgtttggtaaatgt

SEQ ID NO: 6657108 - DNA, 14 bp, Homo sapiens
ataatatttaggca

SEQ ID NO: 6657109 - DNA, 16 bp, Homo sapiens
ataatatttcaagtgc

SEQ ID NO: 6657110 - DNA, 15 bp, Homo sapiens
ataatatttctgaaa

SEQ ID NO: 6657111 - DNA, 15 bp, Homo sapiens
ataatatttgaacaa

SEQ ID NO: 6657112 - DNA, 14 bp, Homo sapiens
ataatattttagaa

SEQ ID NO: 6657113 - DNA, 14 bp, Homo sapiens
ataatatttttaat

SEQ ID NO: 6657114 - DNA, 19 bp, Homo sapiens
ataatatttttgtatttct

SEQ ID NO: 6657115 - DNA, 21 bp, Homo sapiens
ataatatttttgtatttctct

SEQ ID NO: 6657116 - DNA, 22 bp, Homo sapiens
ataatatttttgtatttctcta

SEQ ID NO: 6657117 - DNA, 15 bp, Homo sapiens
ataatcaaatgattt

SEQ ID NO: 6657118 - DNA, 18 bp, Homo sapiens
ataatcaaatgatttcat

SEQ ID NO: 6657119 - DNA, 19 bp, Homo sapiens
ataatcaaatgatttcata

SEQ ID NO: 6657120 - DNA, 13 bp, Homo sapiens
ataatcaagacaa

SEQ ID NO: 6657121 - DNA, 12 bp, Homo sapiens
ataatcaatgaa

SEQ ID NO: 6657122 - DNA, 17 bp, Homo sapiens
ataatcacacacacact

SEQ ID NO: 6657123 - DNA, 19 bp, Homo sapiens
ataatcacagttgtgttcc

SEQ ID NO: 6657124 - DNA, 15 bp, Homo sapiens
ataatcaccagggcc

SEQ ID NO: 6657125 - DNA, 16 bp, Homo sapiens
ataatcacgctttcct

SEQ ID NO: 6657126 - DNA, 19 bp, Homo sapiens
ataatcacttttttccaca

SEQ ID NO: 6657127 - DNA, 17 bp, Homo sapiens
ataatcagaaaagtaat

SEQ ID NO: 6657128 - DNA, 13 bp, Homo sapiens
ataatcagaagct

SEQ ID NO: 6657129 - DNA, 21 bp, Homo sapiens
ataatcagcaagaatttgatc

SEQ ID NO: 6657130 - DNA, 15 bp, Homo sapiens
ataatcagcctctta

SEQ ID NO: 6657131 - DNA, 14 bp, Homo sapiens
ataatcaggaaaaa

SEQ ID NO: 6657132 - DNA, 17 bp, Homo sapiens
ataatcaggaaaaatga

SEQ ID NO: 6657133 - DNA, 18 bp, Homo sapiens
ataatcaggaaaaatgag

SEQ ID NO: 6657134 - DNA, 22 bp, Homo sapiens
ataatcagggaaactaattgta

SEQ ID NO: 6657135 - DNA, 14 bp, Homo sapiens
ataatcagtaaata

SEQ ID NO: 6657136 - DNA, 16 bp, Homo sapiens
ataatcagtgactgaa

SEQ ID NO: 6657137 - DNA, 16 bp, Homo sapiens
ataatcatgtaaatgc

SEQ ID NO: 6657138 - DNA, 23 bp, Homo sapiens
ataatcatgttagagttacttct

SEQ ID NO: 6657139 - DNA, 14 bp, Homo sapiens
ataatcattacctt

SEQ ID NO: 6657140 - DNA, 19 bp, Homo sapiens
ataatcattagttttagag

SEQ ID NO: 6657141 - DNA, 22 bp, Homo sapiens
ataatcattattacttttgctg

SEQ ID NO: 6657142 - DNA, 14 bp, Homo sapiens
ataatcattgctta

SEQ ID NO: 6657143 - DNA, 14 bp, Homo sapiens
ataatcattttaga

SEQ ID NO: 6657144 - DNA, 23 bp, Homo sapiens
ataatcattttagaattaaaatt

SEQ ID NO: 6657145 - DNA, 14 bp, Homo sapiens
ataatccattccaa

SEQ ID NO: 6657146 - DNA, 14 bp, Homo sapiens
ataatcccaccacc

SEQ ID NO: 6657147 - DNA, 17 bp, Homo sapiens
ataatcccagcactttg

SEQ ID NO: 6657148 - DNA, 15 bp, Homo sapiens
ataatcccagctact

SEQ ID NO: 6657149 - DNA, 21 bp, Homo sapiens
ataatccctttacatctgtgt

SEQ ID NO: 6657150 - DNA, 14 bp, Homo sapiens
ataatcctgcaaag

SEQ ID NO: 6657151 - DNA, 14 bp, Homo sapiens
ataatcctgtttta

SEQ ID NO: 6657152 - DNA, 18 bp, Homo sapiens
ataatccttgataatata

SEQ ID NO: 6657153 - DNA, 14 bp, Homo sapiens
ataatcgaagcaaa

SEQ ID NO: 6657154 - DNA, 19 bp, Homo sapiens
ataatcgaagcaaaagtaa

SEQ ID NO: 6657155 - DNA, 18 bp, Homo sapiens
ataatcgactcaaaaata

SEQ ID NO: 6657156 - DNA, 22 bp, Homo sapiens
ataatcggcccacagctcccac

SEQ ID NO: 6657157 - DNA, 18 bp, Homo sapiens
ataatcgtcttcaaatta

SEQ ID NO: 6657158 - DNA, 20 bp, Homo sapiens
ataatctactgtacacaatc

SEQ ID NO: 6657159 - DNA, 13 bp, Homo sapiens
ataatctatatta

SEQ ID NO: 6657160 - DNA, 18 bp, Homo sapiens
ataatctatattaaatga

SEQ ID NO: 6657161 - DNA, 14 bp, Homo sapiens
ataatctcaaagga

SEQ ID NO: 6657162 - DNA, 15 bp, Homo sapiens
ataatctcaaaggag

SEQ ID NO: 6657163 - DNA, 20 bp, Homo sapiens
ataatctcaaaggagaaaaa

SEQ ID NO: 6657164 - DNA, 22 bp, Homo sapiens
ataatctcaaaggagaaaaaaa

SEQ ID NO: 6657165 - DNA, 11 bp, Homo sapiens
ataatctcatc

SEQ ID NO: 6657166 - DNA, 16 bp, Homo sapiens
ataatctcatccccaa

SEQ ID NO: 6657167 - DNA, 16 bp, Homo sapiens
ataatctcatcccccc

SEQ ID NO: 6657168 - DNA, 21 bp, Homo sapiens
ataatctcatccccccacccg

SEQ ID NO: 6657169 - DNA, 14 bp, Homo sapiens
ataatctcatttca

SEQ ID NO: 6657170 - DNA, 18 bp, Homo sapiens
ataatctcctctgctcat

SEQ ID NO: 6657171 - DNA, 22 bp, Homo sapiens
ataatctccttttatgctcacc

SEQ ID NO: 6657172 - DNA, 23 bp, Homo sapiens
ataatctctgattccctgattta

SEQ ID NO: 6657173 - DNA, 14 bp, Homo sapiens
ataatctctggaaa

SEQ ID NO: 6657174 - DNA, 14 bp, Homo sapiens
ataatctgaagata

SEQ ID NO: 6657175 - DNA, 20 bp, Homo sapiens
ataatctgacaaagtcatga

SEQ ID NO: 6657176 - DNA, 14 bp, Homo sapiens
ataatctgagcagg

SEQ ID NO: 6657177 - DNA, 18 bp, Homo sapiens
ataatctgagcaggtaca

SEQ ID NO: 6657178 - DNA, 13 bp, Homo sapiens
ataatctgatttg

SEQ ID NO: 6657179 - DNA, 17 bp, Homo sapiens
ataatctggtgacaaat

SEQ ID NO: 6657180 - DNA, 14 bp, Homo sapiens
ataatctgtacaat

SEQ ID NO: 6657181 - DNA, 17 bp, Homo sapiens
ataatctgtcaaaacac

SEQ ID NO: 6657182 - DNA, 20 bp, Homo sapiens
ataatctgtcaaaacactgt

SEQ ID NO: 6657183 - DNA, 20 bp, Homo sapiens
ataatctgtgagtgaaagtt

SEQ ID NO: 6657184 - DNA, 21 bp, Homo sapiens
ataatctgtgagtgaaagttg

SEQ ID NO: 6657185 - DNA, 15 bp, Homo sapiens
ataatcttattaggg

SEQ ID NO: 6657186 - DNA, 23 bp, Homo sapiens
ataatcttggcttcttaaaaact

SEQ ID NO: 6657187 - DNA, 13 bp, Homo sapiens
ataatcttgtaga

SEQ ID NO: 6657188 - DNA, 17 bp, Homo sapiens
ataatcttgtagacact

SEQ ID NO: 6657189 - DNA, 18 bp, Homo sapiens
ataatcttgtagacactt

SEQ ID NO: 6657190 - DNA, 22 bp, Homo sapiens
ataatcttgtagacacttactt

SEQ ID NO: 6657191 - DNA, 21 bp, Homo sapiens
ataatcttgtttctgaaaaga

SEQ ID NO: 6657192 - DNA, 13 bp, Homo sapiens
ataatctttgggt

SEQ ID NO: 6657193 - DNA, 12 bp, Homo sapiens
ataatgaaaata

SEQ ID NO: 6657194 - DNA, 21 bp, Homo sapiens
ataatgaaaataaaacacacc

SEQ ID NO: 6657195 - DNA, 15 bp, Homo sapiens
ataatgaaataatca

SEQ ID NO: 6657196 - DNA, 21 bp, Homo sapiens
ataatgaaatagttattttaa

SEQ ID NO: 6657197 - DNA, 13 bp, Homo sapiens
ataatgaacccat

SEQ ID NO: 6657198 - DNA, 18 bp, Homo sapiens
ataatgaaccgtttacag

SEQ ID NO: 6657199 - DNA, 21 bp, Homo sapiens
ataatgaaccgtttacagtgt

SEQ ID NO: 6657200 - DNA, 12 bp, Homo sapiens
ataatgaagaac

SEQ ID NO: 6657201 - DNA, 18 bp, Homo sapiens
ataatgaagaacactgta

SEQ ID NO: 6657202 - DNA, 17 bp, Homo sapiens
ataatgaagatctttgt

SEQ ID NO: 6657203 - DNA, 15 bp, Homo sapiens
ataatgaataaactg

SEQ ID NO: 6657204 - DNA, 17 bp, Homo sapiens
ataatgaataaactgaa

SEQ ID NO: 6657205 - DNA, 12 bp, Homo sapiens
ataatgaatgac

SEQ ID NO: 6657206 - DNA, 13 bp, Homo sapiens
ataatgaattata

SEQ ID NO: 6657207 - DNA, 17 bp, Homo sapiens
ataatgaattataacag

SEQ ID NO: 6657208 - DNA, 19 bp, Homo sapiens
ataatgaattataacagtt

SEQ ID NO: 6657209 - DNA, 19 bp, Homo sapiens
ataatgacactgtttcctg

SEQ ID NO: 6657210 - DNA, 17 bp, Homo sapiens
ataatgacgtattgtga

SEQ ID NO: 6657211 - DNA, 19 bp, Homo sapiens
ataatgacgtattgtgaaa

SEQ ID NO: 6657212 - DNA, 22 bp, Homo sapiens
ataatgacgtattgtgaaattt

SEQ ID NO: 6657213 - DNA, 13 bp, Homo sapiens
ataatgagagcaa

SEQ ID NO: 6657214 - DNA, 20 bp, Homo sapiens
ataatgagatgtgagccttg

SEQ ID NO: 6657215 - DNA, 17 bp, Homo sapiens
ataatgaggagtttatg

SEQ ID NO: 6657216 - DNA, 18 bp, Homo sapiens
ataatgaggagtttatga

SEQ ID NO: 6657217 - DNA, 21 bp, Homo sapiens
ataatgaggcaactcagcagg

SEQ ID NO: 6657218 - DNA, 22 bp, Homo sapiens
ataatgatcagcaaaaagactg

SEQ ID NO: 6657219 - DNA, 19 bp, Homo sapiens
ataatgatcgaaaaaataa

SEQ ID NO: 6657220 - DNA, 20 bp, Homo sapiens
ataatgatcgaaaaaataat

SEQ ID NO: 6657221 - DNA, 16 bp, Homo sapiens
ataatgatctgaatct

SEQ ID NO: 6657222 - DNA, 13 bp, Homo sapiens
ataatgatgaact

SEQ ID NO: 6657223 - DNA, 13 bp, Homo sapiens
ataatgatgatga

SEQ ID NO: 6657224 - DNA, 21 bp, Homo sapiens
ataatgatggatttaacagca

SEQ ID NO: 6657225 - DNA, 15 bp, Homo sapiens
ataatgattcaatgt

SEQ ID NO: 6657226 - DNA, 16 bp, Homo sapiens
ataatgattcaatgtg

SEQ ID NO: 6657227 - DNA, 11 bp, Homo sapiens
ataatgattta

SEQ ID NO: 6657228 - DNA, 19 bp, Homo sapiens
ataatgatttcctctgaat

SEQ ID NO: 6657229 - DNA, 19 bp, Homo sapiens
ataatgcaaagaatcccta

SEQ ID NO: 6657230 - DNA, 14 bp, Homo sapiens
ataatgcaatcaaa

SEQ ID NO: 6657231 - DNA, 15 bp, Homo sapiens
ataatgcaatgataa

SEQ ID NO: 6657232 - DNA, 22 bp, Homo sapiens
ataatgcaatgataaataaagt

SEQ ID NO: 6657233 - DNA, 23 bp, Homo sapiens
ataatgcaattagatagaaaagg

SEQ ID NO: 6657234 - DNA, 22 bp, Homo sapiens
ataatgcaggggaagtactact

SEQ ID NO: 6657235 - DNA, 11 bp, Homo sapiens
ataatgcagta

SEQ ID NO: 6657236 - DNA, 18 bp, Homo sapiens
ataatgcagtatggtaca

SEQ ID NO: 6657237 - DNA, 18 bp, Homo sapiens
ataatgcatccagcagta

SEQ ID NO: 6657238 - DNA, 14 bp, Homo sapiens
ataatgcatctaaa

SEQ ID NO: 6657239 - DNA, 17 bp, Homo sapiens
ataatgccaatgaacat

SEQ ID NO: 6657240 - DNA, 17 bp, Homo sapiens
ataatgccaccaaagga

SEQ ID NO: 6657241 - DNA, 17 bp, Homo sapiens
ataatgccccaaggaca

SEQ ID NO: 6657242 - DNA, 18 bp, Homo sapiens
ataatgcccttaatgtga

SEQ ID NO: 6657243 - DNA, 21 bp, Homo sapiens
ataatgcctttttggttttgt

SEQ ID NO: 6657244 - DNA, 20 bp, Homo sapiens
ataatgcgtgcataccactt

SEQ ID NO: 6657245 - DNA, 21 bp, Homo sapiens
ataatgcttctttcctcttaa

SEQ ID NO: 6657246 - DNA, 12 bp, Homo sapiens
ataatgctttct

SEQ ID NO: 6657247 - DNA, 15 bp, Homo sapiens
ataatgctttctgag

SEQ ID NO: 6657248 - DNA, 14 bp, Homo sapiens
ataatgctttggaa

SEQ ID NO: 6657249 - DNA, 13 bp, Homo sapiens
ataatggaaaaaa

SEQ ID NO: 6657250 - DNA, 17 bp, Homo sapiens
ataatggaaaaatagta

SEQ ID NO: 6657251 - DNA, 22 bp, Homo sapiens
ataatggaaaatgccatgaatt

SEQ ID NO: 6657252 - DNA, 17 bp, Homo sapiens
ataatggaaacatttac

SEQ ID NO: 6657253 - DNA, 16 bp, Homo sapiens
ataatggaagagaaat

SEQ ID NO: 6657254 - DNA, 16 bp, Homo sapiens
ataatggaattatgta

SEQ ID NO: 6657255 - DNA, 20 bp, Homo sapiens
ataatggagaattaaaactt

SEQ ID NO: 6657256 - DNA, 16 bp, Homo sapiens
ataatggctaactttt

SEQ ID NO: 6657257 - DNA, 12 bp, Homo sapiens
ataatggctctg

SEQ ID NO: 6657258 - DNA, 20 bp, Homo sapiens
ataatgggaaaggttgaatt

SEQ ID NO: 6657259 - DNA, 18 bp, Homo sapiens
ataatgggcttagagcag

SEQ ID NO: 6657260 - DNA, 16 bp, Homo sapiens
ataatggggcagacac

SEQ ID NO: 6657261 - DNA, 17 bp, Homo sapiens
ataatggggcagacaca

SEQ ID NO: 6657262 - DNA, 19 bp, Homo sapiens
ataatggggtcctggccat

SEQ ID NO: 6657263 - DNA, 17 bp, Homo sapiens
ataatggtaatagaata

SEQ ID NO: 6657264 - DNA, 21 bp, Homo sapiens
ataatggtactcccaaactga

SEQ ID NO: 6657265 - DNA, 22 bp, Homo sapiens
ataatggtactcccaaactgac

SEQ ID NO: 6657266 - DNA, 20 bp, Homo sapiens
ataatggtcccatccaggca

SEQ ID NO: 6657267 - DNA, 22 bp, Homo sapiens
ataatggtcccatccaggcagt

SEQ ID NO: 6657268 - DNA, 18 bp, Homo sapiens
ataatggtgaacatttta

SEQ ID NO: 6657269 - DNA, 15 bp, Homo sapiens
ataatggtgatgtca

SEQ ID NO: 6657270 - DNA, 16 bp, Homo sapiens
ataatggtgatgtcat

SEQ ID NO: 6657271 - DNA, 18 bp, Homo sapiens
ataatggttgactgggtt

SEQ ID NO: 6657272 - DNA, 14 bp, Homo sapiens
ataatggtttactg

SEQ ID NO: 6657273 - DNA, 15 bp, Homo sapiens
ataatggtttactgc

SEQ ID NO: 6657274 - DNA, 16 bp, Homo sapiens
ataatggtttactgct

SEQ ID NO: 6657275 - DNA, 15 bp, Homo sapiens
ataatgtaaataaag

SEQ ID NO: 6657276 - DNA, 15 bp, Homo sapiens
ataatgtaacatgat

SEQ ID NO: 6657277 - DNA, 15 bp, Homo sapiens
ataatgtaactgaag

SEQ ID NO: 6657278 - DNA, 21 bp, Homo sapiens
ataatgtaatactgtagaaat

SEQ ID NO: 6657279 - DNA, 14 bp, Homo sapiens
ataatgtaattgta

SEQ ID NO: 6657280 - DNA, 17 bp, Homo sapiens
ataatgtaattgtaatt

SEQ ID NO: 6657281 - DNA, 21 bp, Homo sapiens
ataatgtacatagagtgagaa

SEQ ID NO: 6657282 - DNA, 22 bp, Homo sapiens
ataatgtacctattccttcaga

SEQ ID NO: 6657283 - DNA, 19 bp, Homo sapiens
ataatgtactgatttcagt

SEQ ID NO: 6657284 - DNA, 20 bp, Homo sapiens
ataatgtatgaattttgtaa

SEQ ID NO: 6657285 - DNA, 14 bp, Homo sapiens
ataatgtattgttg

SEQ ID NO: 6657286 - DNA, 18 bp, Homo sapiens
ataatgtatttgaaaatt

SEQ ID NO: 6657287 - DNA, 16 bp, Homo sapiens
ataatgtattttcagc

SEQ ID NO: 6657288 - DNA, 14 bp, Homo sapiens
ataatgtattttct

SEQ ID NO: 6657289 - DNA, 20 bp, Homo sapiens
ataatgtattttctttttat

SEQ ID NO: 6657290 - DNA, 20 bp, Homo sapiens
ataatgtcaacaccagaaag

SEQ ID NO: 6657291 - DNA, 21 bp, Homo sapiens
ataatgtccctctcttggcta

SEQ ID NO: 6657292 - DNA, 15 bp, Homo sapiens
ataatgtcccttcac

SEQ ID NO: 6657293 - DNA, 16 bp, Homo sapiens
ataatgtcttgttaat

SEQ ID NO: 6657294 - DNA, 12 bp, Homo sapiens
ataatgtcttta

SEQ ID NO: 6657295 - DNA, 21 bp, Homo sapiens
ataatgtgaaactggattaaa

SEQ ID NO: 6657296 - DNA, 12 bp, Homo sapiens
ataatgtgaaat

SEQ ID NO: 6657297 - DNA, 14 bp, Homo sapiens
ataatgtgaaatat

SEQ ID NO: 6657298 - DNA, 11 bp, Homo sapiens
ataatgtgaac

SEQ ID NO: 6657299 - DNA, 13 bp, Homo sapiens
ataatgtgatttt

SEQ ID NO: 6657300 - DNA, 17 bp, Homo sapiens
ataatgtgcaaattttg

SEQ ID NO: 6657301 - DNA, 13 bp, Homo sapiens
ataatgtgcctgg

SEQ ID NO: 6657302 - DNA, 19 bp, Homo sapiens
ataatgtgggaagaaacaa

SEQ ID NO: 6657303 - DNA, 21 bp, Homo sapiens
ataatgtgggaagaaacaaac

SEQ ID NO: 6657304 - DNA, 18 bp, Homo sapiens
ataatgtgtagttcatgt

SEQ ID NO: 6657305 - DNA, 14 bp, Homo sapiens
ataatgtgtgtatg

SEQ ID NO: 6657306 - DNA, 11 bp, Homo sapiens
ataatgttaaa

SEQ ID NO: 6657307 - DNA, 22 bp, Homo sapiens
ataatgttaaatttgtaagttt

SEQ ID NO: 6657308 - DNA, 19 bp, Homo sapiens
ataatgttaaccaaggaaa

SEQ ID NO: 6657309 - DNA, 15 bp, Homo sapiens
ataatgttagtagca

SEQ ID NO: 6657310 - DNA, 20 bp, Homo sapiens
ataatgttagtagcactgag

SEQ ID NO: 6657311 - DNA, 22 bp, Homo sapiens
ataatgttctgctaaatttcaa

SEQ ID NO: 6657312 - DNA, 20 bp, Homo sapiens
ataatgttggtgtggagttt

SEQ ID NO: 6657313 - DNA, 12 bp, Homo sapiens
ataatgttgtca

SEQ ID NO: 6657314 - DNA, 15 bp, Homo sapiens
ataatgtttaaatca

SEQ ID NO: 6657315 - DNA, 17 bp, Homo sapiens
ataatgtttaaatcatg

SEQ ID NO: 6657316 - DNA, 16 bp, Homo sapiens
ataatgtttattaaat

SEQ ID NO: 6657317 - DNA, 19 bp, Homo sapiens
ataatgtttgatagtaaat

SEQ ID NO: 6657318 - DNA, 13 bp, Homo sapiens
ataatgtttgcta

SEQ ID NO: 6657319 - DNA, 14 bp, Homo sapiens
ataatgtttgctat

SEQ ID NO: 6657320 - DNA, 21 bp, Homo sapiens
ataatgttttgggaaacactg

SEQ ID NO: 6657321 - DNA, 20 bp, Homo sapiens
ataatgtttttcctttctta

SEQ ID NO: 6657322 - DNA, 17 bp, Homo sapiens
ataattaaaaaaaaaac

SEQ ID NO: 6657323 - DNA, 12 bp, Homo sapiens
ataattaaaaca

SEQ ID NO: 6657324 - DNA, 14 bp, Homo sapiens
ataattaaaacaaa

SEQ ID NO: 6657325 - DNA, 15 bp, Homo sapiens
ataattaaaatttat

SEQ ID NO: 6657326 - DNA, 16 bp, Homo sapiens
ataattaaagaaaatt

SEQ ID NO: 6657327 - DNA, 22 bp, Homo sapiens
ataattaaagaaaattgccaaa

SEQ ID NO: 6657328 - DNA, 23 bp, Homo sapiens
ataattaaagaaaattgccaaaa

SEQ ID NO: 6657329 - DNA, 19 bp, Homo sapiens
ataattaaagcttaaactg

SEQ ID NO: 6657330 - DNA, 13 bp, Homo sapiens
ataattaaagtgt

SEQ ID NO: 6657331 - DNA, 13 bp, Homo sapiens
ataattaaatata

SEQ ID NO: 6657332 - DNA, 17 bp, Homo sapiens
ataattaaatctcttta

SEQ ID NO: 6657333 - DNA, 15 bp, Homo sapiens
ataattaaatgaaat

SEQ ID NO: 6657334 - DNA, 12 bp, Homo sapiens
ataattaacact

SEQ ID NO: 6657335 - DNA, 19 bp, Homo sapiens
ataattaacacttaaggtt

SEQ ID NO: 6657336 - DNA, 22 bp, Homo sapiens
ataattaaccaaccttgtttaa

SEQ ID NO: 6657337 - DNA, 20 bp, Homo sapiens
ataattaaccaaggtagaat

SEQ ID NO: 6657338 - DNA, 15 bp, Homo sapiens
ataattaacttaact

SEQ ID NO: 6657339 - DNA, 21 bp, Homo sapiens
ataattaacttaactgaagaa

SEQ ID NO: 6657340 - DNA, 13 bp, Homo sapiens
ataattaatgctt

SEQ ID NO: 6657341 - DNA, 15 bp, Homo sapiens
ataattaatgtgtgt

SEQ ID NO: 6657342 - DNA, 23 bp, Homo sapiens
ataattaatgtgtgtctgaagac

SEQ ID NO: 6657343 - DNA, 15 bp, Homo sapiens
ataattacaatacaa

SEQ ID NO: 6657344 - DNA, 13 bp, Homo sapiens
ataattacagaat

SEQ ID NO: 6657345 - DNA, 16 bp, Homo sapiens
ataattacattcctaa

SEQ ID NO: 6657346 - DNA, 18 bp, Homo sapiens
ataattacattcctaact

SEQ ID NO: 6657347 - DNA, 13 bp, Homo sapiens
ataattacattgg

SEQ ID NO: 6657348 - DNA, 13 bp, Homo sapiens
ataattagaacaa

SEQ ID NO: 6657349 - DNA, 18 bp, Homo sapiens
ataattagaacaatagct

SEQ ID NO: 6657350 - DNA, 22 bp, Homo sapiens
ataattagatccattaatttaa

SEQ ID NO: 6657351 - DNA, 20 bp, Homo sapiens
ataattagctatatttttat

SEQ ID NO: 6657352 - DNA, 16 bp, Homo sapiens
ataattaggatctatg

SEQ ID NO: 6657353 - DNA, 22 bp, Homo sapiens
ataattaggatctatgcaattt

SEQ ID NO: 6657354 - DNA, 15 bp, Homo sapiens
ataattatataactg

SEQ ID NO: 6657355 - DNA, 21 bp, Homo sapiens
ataattatatgaagcagaatg

SEQ ID NO: 6657356 - DNA, 17 bp, Homo sapiens
ataattatatgctattt

SEQ ID NO: 6657357 - DNA, 17 bp, Homo sapiens
ataattatccagagttt

SEQ ID NO: 6657358 - DNA, 16 bp, Homo sapiens
ataattatcggaagca

SEQ ID NO: 6657359 - DNA, 19 bp, Homo sapiens
ataattatcggaagcagtg

SEQ ID NO: 6657360 - DNA, 21 bp, Homo sapiens
ataattatcggaagcagtgcc

SEQ ID NO: 6657361 - DNA, 19 bp, Homo sapiens
ataattatgacagttatac

SEQ ID NO: 6657362 - DNA, 12 bp, Homo sapiens
ataattatggga

SEQ ID NO: 6657363 - DNA, 13 bp, Homo sapiens
ataattatgttta

SEQ ID NO: 6657364 - DNA, 15 bp, Homo sapiens
ataattatgtttacc

SEQ ID NO: 6657365 - DNA, 16 bp, Homo sapiens
ataattattattatta

SEQ ID NO: 6657366 - DNA, 15 bp, Homo sapiens
ataattatttacaaa

SEQ ID NO: 6657367 - DNA, 19 bp, Homo sapiens
ataattatttcagattcct

SEQ ID NO: 6657368 - DNA, 17 bp, Homo sapiens
ataattcaaagataaca

SEQ ID NO: 6657369 - DNA, 19 bp, Homo sapiens
ataattcaccaaaagttca

SEQ ID NO: 6657370 - DNA, 23 bp, Homo sapiens
ataattcagaactaaatttttca

SEQ ID NO: 6657371 - DNA, 18 bp, Homo sapiens
ataattcagtatgtttta

SEQ ID NO: 6657372 - DNA, 15 bp, Homo sapiens
ataattcatatctaa

SEQ ID NO: 6657373 - DNA, 15 bp, Homo sapiens
ataattcatcaagta

SEQ ID NO: 6657374 - DNA, 16 bp, Homo sapiens
ataattcatcaagtaa

SEQ ID NO: 6657375 - DNA, 16 bp, Homo sapiens
ataattcattaaaaac

SEQ ID NO: 6657376 - DNA, 13 bp, Homo sapiens
ataattcatttaa

SEQ ID NO: 6657377 - DNA, 16 bp, Homo sapiens
ataattcatttaagaa

SEQ ID NO: 6657378 - DNA, 15 bp, Homo sapiens
ataattcatttgtat

SEQ ID NO: 6657379 - DNA, 17 bp, Homo sapiens
ataattcatttgtattg

SEQ ID NO: 6657380 - DNA, 21 bp, Homo sapiens
ataattccaggtagataactg

SEQ ID NO: 6657381 - DNA, 16 bp, Homo sapiens
ataattccatgattaa

SEQ ID NO: 6657382 - DNA, 12 bp, Homo sapiens
ataattccctat

SEQ ID NO: 6657383 - DNA, 17 bp, Homo sapiens
ataattccttaaaattt

SEQ ID NO: 6657384 - DNA, 16 bp, Homo sapiens
ataattctaaatccct

SEQ ID NO: 6657385 - DNA, 14 bp, Homo sapiens
ataattctactttg

SEQ ID NO: 6657386 - DNA, 14 bp, Homo sapiens
ataattctatactg

SEQ ID NO: 6657387 - DNA, 21 bp, Homo sapiens
ataattctattgaaagttttt

SEQ ID NO: 6657388 - DNA, 15 bp, Homo sapiens
ataattctcattaaa

SEQ ID NO: 6657389 - DNA, 22 bp, Homo sapiens
ataattctcattaaaagaatat

SEQ ID NO: 6657390 - DNA, 23 bp, Homo sapiens
ataattctcattaaaagaatatc

SEQ ID NO: 6657391 - DNA, 13 bp, Homo sapiens
ataattctgaaac

SEQ ID NO: 6657392 - DNA, 15 bp, Homo sapiens
ataattctgaaacaa

SEQ ID NO: 6657393 - DNA, 20 bp, Homo sapiens
ataattctgaagttatattt

SEQ ID NO: 6657394 - DNA, 22 bp, Homo sapiens
ataattctgaagttatatttcc

SEQ ID NO: 6657395 - DNA, 20 bp, Homo sapiens
ataattctgagttttgtgtt

SEQ ID NO: 6657396 - DNA, 15 bp, Homo sapiens
ataattctgctttag

SEQ ID NO: 6657397 - DNA, 15 bp, Homo sapiens
ataattctggagata

SEQ ID NO: 6657398 - DNA, 13 bp, Homo sapiens
ataattctgtaaa

SEQ ID NO: 6657399 - DNA, 13 bp, Homo sapiens
ataattctgtaca

SEQ ID NO: 6657400 - DNA, 22 bp, Homo sapiens
ataattctgtacatagcctata

SEQ ID NO: 6657401 - DNA, 17 bp, Homo sapiens
ataattctgtactgatt

SEQ ID NO: 6657402 - DNA, 17 bp, Homo sapiens
ataattctgttatatga

SEQ ID NO: 6657403 - DNA, 14 bp, Homo sapiens
ataattcttaaaag

SEQ ID NO: 6657404 - DNA, 20 bp, Homo sapiens
ataattcttccttccctcct

SEQ ID NO: 6657405 - DNA, 21 bp, Homo sapiens
ataattctttctttttccttc

SEQ ID NO: 6657406 - DNA, 17 bp, Homo sapiens
ataattcttttttatta

SEQ ID NO: 6657407 - DNA, 21 bp, Homo sapiens
ataattcttttttattaatca

SEQ ID NO: 6657408 - DNA, 23 bp, Homo sapiens
ataattgaagtgttccctttttc

SEQ ID NO: 6657409 - DNA, 22 bp, Homo sapiens
ataattgacaggcgaaagaaaa

SEQ ID NO: 6657410 - DNA, 22 bp, Homo sapiens
ataattgatgatgttgtaaaat

SEQ ID NO: 6657411 - DNA, 12 bp, Homo sapiens
ataattgattaa

SEQ ID NO: 6657412 - DNA, 21 bp, Homo sapiens
ataattgccaaaaagtgaaat

SEQ ID NO: 6657413 - DNA, 19 bp, Homo sapiens
ataattgctcataagcaat

SEQ ID NO: 6657414 - DNA, 16 bp, Homo sapiens
ataattggatttccta

SEQ ID NO: 6657415 - DNA, 20 bp, Homo sapiens
ataattggcatgtctcctca

SEQ ID NO: 6657416 - DNA, 17 bp, Homo sapiens
ataattggctttgcaga

SEQ ID NO: 6657417 - DNA, 18 bp, Homo sapiens
ataattggctttgcagat

SEQ ID NO: 6657418 - DNA, 17 bp, Homo sapiens
ataattggtgctatttg

SEQ ID NO: 6657419 - DNA, 18 bp, Homo sapiens
ataattggtgctatttga

SEQ ID NO: 6657420 - DNA, 22 bp, Homo sapiens
ataattggtgctatttgaagaa

SEQ ID NO: 6657421 - DNA, 12 bp, Homo sapiens
ataattgtaaag

SEQ ID NO: 6657422 - DNA, 21 bp, Homo sapiens
ataattgtaaaggtgatgaat

SEQ ID NO: 6657423 - DNA, 23 bp, Homo sapiens
ataattgtaaaggtgatgaattt

SEQ ID NO: 6657424 - DNA, 19 bp, Homo sapiens
ataattgtacaaaattaag

SEQ ID NO: 6657425 - DNA, 18 bp, Homo sapiens
ataattgtactttgaaaa

SEQ ID NO: 6657426 - DNA, 13 bp, Homo sapiens
ataattgtatcta

SEQ ID NO: 6657427 - DNA, 15 bp, Homo sapiens
ataattgtatctaca

SEQ ID NO: 6657428 - DNA, 21 bp, Homo sapiens
ataattgtcatgactttcaga

SEQ ID NO: 6657429 - DNA, 11 bp, Homo sapiens
ataattgtgac

SEQ ID NO: 6657430 - DNA, 20 bp, Homo sapiens
ataattgtgaccaatacatt

SEQ ID NO: 6657431 - DNA, 22 bp, Homo sapiens
ataattgtgaccaatacatttg

SEQ ID NO: 6657432 - DNA, 20 bp, Homo sapiens
ataattgtgattagacagaa

SEQ ID NO: 6657433 - DNA, 16 bp, Homo sapiens
ataattgtggagagga

SEQ ID NO: 6657434 - DNA, 21 bp, Homo sapiens
ataattgtggagaggagagaa

SEQ ID NO: 6657435 - DNA, 14 bp, Homo sapiens
ataattgtgtacaa

SEQ ID NO: 6657436 - DNA, 22 bp, Homo sapiens
ataattgtgtaccttaagatat

SEQ ID NO: 6657437 - DNA, 23 bp, Homo sapiens
ataattgtgtaccttaagatatt

SEQ ID NO: 6657438 - DNA, 20 bp, Homo sapiens
ataattgtgtagtaatgttt

SEQ ID NO: 6657439 - DNA, 17 bp, Homo sapiens
ataattgtgtgatattt

SEQ ID NO: 6657440 - DNA, 15 bp, Homo sapiens
ataattgttctcaga

SEQ ID NO: 6657441 - DNA, 23 bp, Homo sapiens
ataattgttctcagaatccctta

SEQ ID NO: 6657442 - DNA, 15 bp, Homo sapiens
ataattgttgaaatt

SEQ ID NO: 6657443 - DNA, 22 bp, Homo sapiens
ataattgttgaaattttgcaaa

SEQ ID NO: 6657444 - DNA, 13 bp, Homo sapiens
ataattgttgata

SEQ ID NO: 6657445 - DNA, 16 bp, Homo sapiens
ataattgttgatattt

SEQ ID NO: 6657446 - DNA, 19 bp, Homo sapiens
ataattgttggagtattta

SEQ ID NO: 6657447 - DNA, 19 bp, Homo sapiens
ataattgttgttctgttaa

SEQ ID NO: 6657448 - DNA, 13 bp, Homo sapiens
ataattgtttcca

SEQ ID NO: 6657449 - DNA, 17 bp, Homo sapiens
ataattgtttgagggga

SEQ ID NO: 6657450 - DNA, 11 bp, Homo sapiens
ataattgtttt

SEQ ID NO: 6657451 - DNA, 21 bp, Homo sapiens
ataattgttttatctgaattt

SEQ ID NO: 6657452 - DNA, 23 bp, Homo sapiens
ataattgttttttatcttttcta

SEQ ID NO: 6657453 - DNA, 19 bp, Homo sapiens
ataatttaaaaatatattt

SEQ ID NO: 6657454 - DNA, 19 bp, Homo sapiens
ataatttaaaataaataaa

SEQ ID NO: 6657455 - DNA, 12 bp, Homo sapiens
ataatttaaatg

SEQ ID NO: 6657456 - DNA, 14 bp, Homo sapiens
ataatttaaatgat

SEQ ID NO: 6657457 - DNA, 17 bp, Homo sapiens
ataatttaacagaagtt

SEQ ID NO: 6657458 - DNA, 13 bp, Homo sapiens
ataatttaaccct

SEQ ID NO: 6657459 - DNA, 16 bp, Homo sapiens
ataatttaactaattt

SEQ ID NO: 6657460 - DNA, 22 bp, Homo sapiens
ataatttaagccaataaataat

SEQ ID NO: 6657461 - DNA, 23 bp, Homo sapiens
ataatttaagccaataaataata

SEQ ID NO: 6657462 - DNA, 19 bp, Homo sapiens
ataatttaataaaaaggaa

SEQ ID NO: 6657463 - DNA, 15 bp, Homo sapiens
ataatttaatgtaaa

SEQ ID NO: 6657464 - DNA, 22 bp, Homo sapiens
ataatttaatgtaaataaaaca

SEQ ID NO: 6657465 - DNA, 16 bp, Homo sapiens
ataatttacaagatat

SEQ ID NO: 6657466 - DNA, 14 bp, Homo sapiens
ataatttagatggt

SEQ ID NO: 6657467 - DNA, 16 bp, Homo sapiens
ataatttagtggatta

SEQ ID NO: 6657468 - DNA, 18 bp, Homo sapiens
ataatttagttgtttcta

SEQ ID NO: 6657469 - DNA, 20 bp, Homo sapiens
ataatttagtttcatataaa

SEQ ID NO: 6657470 - DNA, 15 bp, Homo sapiens
ataatttatatgcat

SEQ ID NO: 6657471 - DNA, 18 bp, Homo sapiens
ataatttatatgcatgca

SEQ ID NO: 6657472 - DNA, 10 bp, Homo sapiens
ataatttatc

SEQ ID NO: 6657473 - DNA, 21 bp, Homo sapiens
ataatttattgtaccaaagct

SEQ ID NO: 6657474 - DNA, 14 bp, Homo sapiens
ataatttattgtct

SEQ ID NO: 6657475 - DNA, 13 bp, Homo sapiens
ataatttatttca

SEQ ID NO: 6657476 - DNA, 14 bp, Homo sapiens
ataatttatttcaa

SEQ ID NO: 6657477 - DNA, 15 bp, Homo sapiens
ataatttattttgta

SEQ ID NO: 6657478 - DNA, 12 bp, Homo sapiens
ataatttcaggg

SEQ ID NO: 6657479 - DNA, 13 bp, Homo sapiens
ataatttcagggt

SEQ ID NO: 6657480 - DNA, 20 bp, Homo sapiens
ataatttcagtgggaaatat

SEQ ID NO: 6657481 - DNA, 21 bp, Homo sapiens
ataatttcatactgaaattat

SEQ ID NO: 6657482 - DNA, 11 bp, Homo sapiens
ataatttcatc

SEQ ID NO: 6657483 - DNA, 17 bp, Homo sapiens
ataatttccaaactgtt

SEQ ID NO: 6657484 - DNA, 21 bp, Homo sapiens
ataatttcccaattaggaagt

SEQ ID NO: 6657485 - DNA, 22 bp, Homo sapiens
ataatttcccaattaggaagtg

SEQ ID NO: 6657486 - DNA, 13 bp, Homo sapiens
ataatttcgagat

SEQ ID NO: 6657487 - DNA, 21 bp, Homo sapiens
ataatttctttttggtaaata

SEQ ID NO: 6657488 - DNA, 12 bp, Homo sapiens
ataatttgaaaa

SEQ ID NO: 6657489 - DNA, 15 bp, Homo sapiens
ataatttgaaaaagt

SEQ ID NO: 6657490 - DNA, 21 bp, Homo sapiens
ataatttgaaaaagttccata

SEQ ID NO: 6657491 - DNA, 13 bp, Homo sapiens
ataatttgaactt

SEQ ID NO: 6657492 - DNA, 14 bp, Homo sapiens
ataatttgaatgta

SEQ ID NO: 6657493 - DNA, 16 bp, Homo sapiens
ataatttgaatgtatt

SEQ ID NO: 6657494 - DNA, 19 bp, Homo sapiens
ataatttgaatgtatttga

SEQ ID NO: 6657495 - DNA, 21 bp, Homo sapiens
ataatttgaatgtatttgatt

SEQ ID NO: 6657496 - DNA, 13 bp, Homo sapiens
ataatttgagatg

SEQ ID NO: 6657497 - DNA, 18 bp, Homo sapiens
ataatttgatagatgttt

SEQ ID NO: 6657498 - DNA, 17 bp, Homo sapiens
ataatttgcaatttcag

SEQ ID NO: 6657499 - DNA, 19 bp, Homo sapiens
ataatttgcaatttcagga

SEQ ID NO: 6657500 - DNA, 11 bp, Homo sapiens
ataatttgcat

SEQ ID NO: 6657501 - DNA, 12 bp, Homo sapiens
ataatttgcata

SEQ ID NO: 6657502 - DNA, 18 bp, Homo sapiens
ataatttgcatattctat

SEQ ID NO: 6657503 - DNA, 14 bp, Homo sapiens
ataatttgccatta

SEQ ID NO: 6657504 - DNA, 18 bp, Homo sapiens
ataatttggtatccttat

SEQ ID NO: 6657505 - DNA, 20 bp, Homo sapiens
ataatttggtcatttggcag

SEQ ID NO: 6657506 - DNA, 16 bp, Homo sapiens
ataatttgtacaatgg

SEQ ID NO: 6657507 - DNA, 24 bp, Homo sapiens
ataatttgtacaatggtttattcc

SEQ ID NO: 6657508 - DNA, 19 bp, Homo sapiens
ataatttgtacatatgtaa

SEQ ID NO: 6657509 - DNA, 12 bp, Homo sapiens
ataatttgttta

SEQ ID NO: 6657510 - DNA, 18 bp, Homo sapiens
ataatttgtttaaaattc

SEQ ID NO: 6657511 - DNA, 15 bp, Homo sapiens
ataattttaaaaatg

SEQ ID NO: 6657512 - DNA, 15 bp, Homo sapiens
ataattttaaaattg

SEQ ID NO: 6657513 - DNA, 16 bp, Homo sapiens
ataattttaaataacc

SEQ ID NO: 6657514 - DNA, 13 bp, Homo sapiens
ataattttaaatg

SEQ ID NO: 6657515 - DNA, 14 bp, Homo sapiens
ataattttaaatgt

SEQ ID NO: 6657516 - DNA, 13 bp, Homo sapiens
ataattttaacag

SEQ ID NO: 6657517 - DNA, 17 bp, Homo sapiens
ataattttaacagacat

SEQ ID NO: 6657518 - DNA, 21 bp, Homo sapiens
ataattttaacagacatgtat

SEQ ID NO: 6657519 - DNA, 15 bp, Homo sapiens
ataattttacaattt

SEQ ID NO: 6657520 - DNA, 14 bp, Homo sapiens
ataattttacatgt

SEQ ID NO: 6657521 - DNA, 15 bp, Homo sapiens
ataattttatctgta

SEQ ID NO: 6657522 - DNA, 17 bp, Homo sapiens
ataattttatctgtata

SEQ ID NO: 6657523 - DNA, 21 bp, Homo sapiens
ataattttatctgtataagct

SEQ ID NO: 6657524 - DNA, 15 bp, Homo sapiens
ataattttatgaatg

SEQ ID NO: 6657525 - DNA, 20 bp, Homo sapiens
ataattttatgtgttatagt

SEQ ID NO: 6657526 - DNA, 19 bp, Homo sapiens
ataattttattagaataat

SEQ ID NO: 6657527 - DNA, 21 bp, Homo sapiens
ataattttatttataaactag

SEQ ID NO: 6657528 - DNA, 16 bp, Homo sapiens
ataattttcaaaagaa

SEQ ID NO: 6657529 - DNA, 14 bp, Homo sapiens
ataattttccaagt

SEQ ID NO: 6657530 - DNA, 15 bp, Homo sapiens
ataattttcctccta

SEQ ID NO: 6657531 - DNA, 17 bp, Homo sapiens
ataattttcctgtgaca

SEQ ID NO: 6657532 - DNA, 12 bp, Homo sapiens
ataattttcctt

SEQ ID NO: 6657533 - DNA, 13 bp, Homo sapiens
ataattttccttt

SEQ ID NO: 6657534 - DNA, 20 bp, Homo sapiens
ataattttcctttttcatgt

SEQ ID NO: 6657535 - DNA, 16 bp, Homo sapiens
ataattttctaagaca

SEQ ID NO: 6657536 - DNA, 22 bp, Homo sapiens
ataattttctaagacagttttt

SEQ ID NO: 6657537 - DNA, 14 bp, Homo sapiens
ataattttctaatt

SEQ ID NO: 6657538 - DNA, 14 bp, Homo sapiens
ataattttctgaaa

SEQ ID NO: 6657539 - DNA, 23 bp, Homo sapiens
ataattttcttcatgcaatgaca

SEQ ID NO: 6657540 - DNA, 12 bp, Homo sapiens
ataattttgaat

SEQ ID NO: 6657541 - DNA, 14 bp, Homo sapiens
ataattttgaccat

SEQ ID NO: 6657542 - DNA, 12 bp, Homo sapiens
ataattttgcaa

SEQ ID NO: 6657543 - DNA, 19 bp, Homo sapiens
ataattttgcaaatctgtt

SEQ ID NO: 6657544 - DNA, 15 bp, Homo sapiens
ataattttgcagcag

SEQ ID NO: 6657545 - DNA, 16 bp, Homo sapiens
ataattttgcataaaa

SEQ ID NO: 6657546 - DNA, 21 bp, Homo sapiens
ataattttgcataaaattgga

SEQ ID NO: 6657547 - DNA, 21 bp, Homo sapiens
ataattttgcatactgaaaat

SEQ ID NO: 6657548 - DNA, 13 bp, Homo sapiens
ataattttgtgaa

SEQ ID NO: 6657549 - DNA, 14 bp, Homo sapiens
ataattttgtgaag

SEQ ID NO: 6657550 - DNA, 15 bp, Homo sapiens
ataattttgtgaagc

SEQ ID NO: 6657551 - DNA, 14 bp, Homo sapiens
ataattttgtgcat

SEQ ID NO: 6657552 - DNA, 18 bp, Homo sapiens
ataattttgtgttgtaca

SEQ ID NO: 6657553 - DNA, 18 bp, Homo sapiens
ataatttttaaagtatat

SEQ ID NO: 6657554 - DNA, 14 bp, Homo sapiens
ataatttttaactt

SEQ ID NO: 6657555 - DNA, 17 bp, Homo sapiens
ataatttttaacttttg

SEQ ID NO: 6657556 - DNA, 14 bp, Homo sapiens
ataatttttatatt

SEQ ID NO: 6657557 - DNA, 22 bp, Homo sapiens
ataatttttatatttgaaatat

SEQ ID NO: 6657558 - DNA, 21 bp, Homo sapiens
ataatttttatttttggcaaa

SEQ ID NO: 6657559 - DNA, 19 bp, Homo sapiens
ataatttttgctgaattcc

SEQ ID NO: 6657560 - DNA, 19 bp, Homo sapiens
ataattttttagttaaaat

SEQ ID NO: 6657561 - DNA, 16 bp, Homo sapiens
ataattttttattcaa

SEQ ID NO: 6657562 - DNA, 14 bp, Homo sapiens
ataattttttgcag

SEQ ID NO: 6657563 - DNA, 15 bp, Homo sapiens
ataattttttgcagt

SEQ ID NO: 6657564 - DNA, 19 bp, Homo sapiens
ataattttttgcagtcttt

SEQ ID NO: 6657565 - DNA, 23 bp, Homo sapiens
ataatttttttattactgatttt

SEQ ID NO: 6657566 - DNA, 21 bp, Homo sapiens
ataatttttttcaatatttat

SEQ ID NO: 6657567 - DNA, 22 bp, Homo sapiens
ataatttttttcaatatttatt

SEQ ID NO: 6657568 - DNA, 17 bp, Homo sapiens
atacaaaaaaaatcttt

SEQ ID NO: 6657569 - DNA, 18 bp, Homo sapiens
atacaaaaaaaatcttta

SEQ ID NO: 6657570 - DNA, 23 bp, Homo sapiens
atacaaaaaaaatctttaatggt

SEQ ID NO: 6657571 - DNA, 19 bp, Homo sapiens
atacaaaaaattagccaag

SEQ ID NO: 6657572 - DNA, 13 bp, Homo sapiens
atacaaaaagaaa

SEQ ID NO: 6657573 - DNA, 14 bp, Homo sapiens
atacaaaaagaaaa

SEQ ID NO: 6657574 - DNA, 23 bp, Homo sapiens
atacaaaaagcaaaacaaaaccc

SEQ ID NO: 6657575 - DNA, 16 bp, Homo sapiens
atacaaaaatatatta

SEQ ID NO: 6657576 - DNA, 18 bp, Homo sapiens
atacaaaaatatattaaa

SEQ ID NO: 6657577 - DNA, 21 bp, Homo sapiens
atacaaaaatatattaaaaat

SEQ ID NO: 6657578 - DNA, 23 bp, Homo sapiens
atacaaaaatgagctaggcatgg

SEQ ID NO: 6657579 - DNA, 20 bp, Homo sapiens
atacaaaaattagccgggca

SEQ ID NO: 6657580 - DNA, 15 bp, Homo sapiens
atacaaaaatttgcc

SEQ ID NO: 6657581 - DNA, 12 bp, Homo sapiens
atacaaaacctt

SEQ ID NO: 6657582 - DNA, 14 bp, Homo sapiens
atacaaaactatta

SEQ ID NO: 6657583 - DNA, 13 bp, Homo sapiens
atacaaaagaatt

SEQ ID NO: 6657584 - DNA, 13 bp, Homo sapiens
atacaaaagcatg

SEQ ID NO: 6657585 - DNA, 17 bp, Homo sapiens
atacaaaagctttttaa

SEQ ID NO: 6657586 - DNA, 22 bp, Homo sapiens
atacaaaagctttttaaaattt

SEQ ID NO: 6657587 - DNA, 12 bp, Homo sapiens
atacaaaataat

SEQ ID NO: 6657588 - DNA, 16 bp, Homo sapiens
atacaaaataatttaa

SEQ ID NO: 6657589 - DNA, 11 bp, Homo sapiens
atacaaaatgt

SEQ ID NO: 6657590 - DNA, 12 bp, Homo sapiens
atacaaacaggt

SEQ ID NO: 6657591 - DNA, 13 bp, Homo sapiens
atacaaacaggtg

SEQ ID NO: 6657592 - DNA, 15 bp, Homo sapiens
atacaaacaggtgct

SEQ ID NO: 6657593 - DNA, 14 bp, Homo sapiens
atacaaacatttca

SEQ ID NO: 6657594 - DNA, 16 bp, Homo sapiens
atacaaacatttcact

SEQ ID NO: 6657595 - DNA, 23 bp, Homo sapiens
atacaaacatttcacttctccaa

SEQ ID NO: 6657596 - DNA, 18 bp, Homo sapiens
atacaaacctaccaaaat

SEQ ID NO: 6657597 - DNA, 20 bp, Homo sapiens
atacaaacctttagctgtga

SEQ ID NO: 6657598 - DNA, 13 bp, Homo sapiens
atacaaactctca

SEQ ID NO: 6657599 - DNA, 15 bp, Homo sapiens
atacaaactctcacc

SEQ ID NO: 6657600 - DNA, 18 bp, Homo sapiens
atacaaactctcaccatg

SEQ ID NO: 6657601 - DNA, 14 bp, Homo sapiens
atacaaagaaactt

SEQ ID NO: 6657602 - DNA, 13 bp, Homo sapiens
atacaaagctgtc

SEQ ID NO: 6657603 - DNA, 19 bp, Homo sapiens
atacaaaggcttattaatt

SEQ ID NO: 6657604 - DNA, 15 bp, Homo sapiens
atacaaagtaaatac

SEQ ID NO: 6657605 - DNA, 18 bp, Homo sapiens
atacaaagtaaatacaag

SEQ ID NO: 6657606 - DNA, 15 bp, Homo sapiens
atacaaagtacagaa

SEQ ID NO: 6657607 - DNA, 19 bp, Homo sapiens
atacaaagttagagaacta

SEQ ID NO: 6657608 - DNA, 17 bp, Homo sapiens
atacaaatataaatctt

SEQ ID NO: 6657609 - DNA, 15 bp, Homo sapiens
atacaaatatattta

SEQ ID NO: 6657610 - DNA, 17 bp, Homo sapiens
atacaaatctgatggct

SEQ ID NO: 6657611 - DNA, 19 bp, Homo sapiens
atacaaatgcatctttgat

SEQ ID NO: 6657612 - DNA, 20 bp, Homo sapiens
atacaaatgcatctttgatg

SEQ ID NO: 6657613 - DNA, 14 bp, Homo sapiens
atacaaatggattt

SEQ ID NO: 6657614 - DNA, 17 bp, Homo sapiens
atacaaatggattttgg

SEQ ID NO: 6657615 - DNA, 20 bp, Homo sapiens
atacaaatggattttgggag

SEQ ID NO: 6657616 - DNA, 19 bp, Homo sapiens
atacaaatgggaattcact

SEQ ID NO: 6657617 - DNA, 17 bp, Homo sapiens
atacaaattaaaaagat

SEQ ID NO: 6657618 - DNA, 15 bp, Homo sapiens
atacaaattagaaaa

SEQ ID NO: 6657619 - DNA, 19 bp, Homo sapiens
atacaaatttaacttttaa

SEQ ID NO: 6657620 - DNA, 19 bp, Homo sapiens
atacaaatttggccttaag

SEQ ID NO: 6657621 - DNA, 22 bp, Homo sapiens
atacaacaaagaggattagaca

SEQ ID NO: 6657622 - DNA, 12 bp, Homo sapiens
atacaacaaagg

SEQ ID NO: 6657623 - DNA, 22 bp, Homo sapiens
atacaacaaaggcaagttaaga

SEQ ID NO: 6657624 - DNA, 15 bp, Homo sapiens
atacaacacaaagag

SEQ ID NO: 6657625 - DNA, 14 bp, Homo sapiens
atacaacacatcta

SEQ ID NO: 6657626 - DNA, 19 bp, Homo sapiens
atacaacacattgaaactg

SEQ ID NO: 6657627 - DNA, 23 bp, Homo sapiens
atacaacacattgaaactgtatt

SEQ ID NO: 6657628 - DNA, 21 bp, Homo sapiens
atacaacaccaaaaaatatct

SEQ ID NO: 6657629 - DNA, 17 bp, Homo sapiens
atacaacaggattttca

SEQ ID NO: 6657630 - DNA, 16 bp, Homo sapiens
atacaaccagaaacaa

SEQ ID NO: 6657631 - DNA, 22 bp, Homo sapiens
atacaacgattgtatttgtgac

SEQ ID NO: 6657632 - DNA, 16 bp, Homo sapiens
atacaactagagatat

SEQ ID NO: 6657633 - DNA, 18 bp, Homo sapiens
atacaactgtaaagcaaa

SEQ ID NO: 6657634 - DNA, 20 bp, Homo sapiens
atacaactgtaaagcaaata

SEQ ID NO: 6657635 - DNA, 23 bp, Homo sapiens
atacaacttcatataactgagat

SEQ ID NO: 6657636 - DNA, 21 bp, Homo sapiens
atacaacttgatacttttatt

SEQ ID NO: 6657637 - DNA, 17 bp, Homo sapiens
atacaactttggaattt

SEQ ID NO: 6657638 - DNA, 18 bp, Homo sapiens
atacaagactgttgtgat

SEQ ID NO: 6657639 - DNA, 17 bp, Homo sapiens
atacaagattgaaaatc

SEQ ID NO: 6657640 - DNA, 12 bp, Homo sapiens
atacaagccaaa

SEQ ID NO: 6657641 - DNA, 22 bp, Homo sapiens
atacaagccattctaaggaaat

SEQ ID NO: 6657642 - DNA, 23 bp, Homo sapiens
atacaaggacattcactgctgat

SEQ ID NO: 6657643 - DNA, 22 bp, Homo sapiens
atacaaggagggcctctggtgt

SEQ ID NO: 6657644 - DNA, 21 bp, Homo sapiens
atacaagtagatcctgagaag

SEQ ID NO: 6657645 - DNA, 21 bp, Homo sapiens
atacaagtcatggtcacagta

SEQ ID NO: 6657646 - DNA, 20 bp, Homo sapiens
atacaagttacatacattta

SEQ ID NO: 6657647 - DNA, 17 bp, Homo sapiens
atacaagttctatttaa

SEQ ID NO: 6657648 - DNA, 12 bp, Homo sapiens
atacaagtttca

SEQ ID NO: 6657649 - DNA, 19 bp, Homo sapiens
atacaagtttcagacaggg

SEQ ID NO: 6657650 - DNA, 13 bp, Homo sapiens
atacaataaaaca

SEQ ID NO: 6657651 - DNA, 20 bp, Homo sapiens
atacaataaaacaaataaat

SEQ ID NO: 6657652 - DNA, 13 bp, Homo sapiens
atacaataaaaga

SEQ ID NO: 6657653 - DNA, 16 bp, Homo sapiens
atacaataaaagagct

SEQ ID NO: 6657654 - DNA, 12 bp, Homo sapiens
atacaataaact

SEQ ID NO: 6657655 - DNA, 21 bp, Homo sapiens
atacaataaactattggaaag

SEQ ID NO: 6657656 - DNA, 14 bp, Homo sapiens
atacaataaattgc

SEQ ID NO: 6657657 - DNA, 14 bp, Homo sapiens
atacaataacataa

SEQ ID NO: 6657658 - DNA, 13 bp, Homo sapiens
atacaataatgga

SEQ ID NO: 6657659 - DNA, 16 bp, Homo sapiens
atacaataatggaaaa

SEQ ID NO: 6657660 - DNA, 18 bp, Homo sapiens
atacaataatggaaaaaa

SEQ ID NO: 6657661 - DNA, 14 bp, Homo sapiens
atacaataatgtaa

SEQ ID NO: 6657662 - DNA, 12 bp, Homo sapiens
atacaataattt

SEQ ID NO: 6657663 - DNA, 21 bp, Homo sapiens
atacaatatataaaaatatat

SEQ ID NO: 6657664 - DNA, 14 bp, Homo sapiens
atacaatatatagc

SEQ ID NO: 6657665 - DNA, 21 bp, Homo sapiens
atacaatatggacatgtaaaa

SEQ ID NO: 6657666 - DNA, 14 bp, Homo sapiens
atacaatattgcat

SEQ ID NO: 6657667 - DNA, 15 bp, Homo sapiens
atacaatcacattaa

SEQ ID NO: 6657668 - DNA, 13 bp, Homo sapiens
atacaatcagctg

SEQ ID NO: 6657669 - DNA, 19 bp, Homo sapiens
atacaatcctgtttataat

SEQ ID NO: 6657670 - DNA, 23 bp, Homo sapiens
atacaatcctgtttataatctga

SEQ ID NO: 6657671 - DNA, 17 bp, Homo sapiens
atacaatcttggagtca

SEQ ID NO: 6657672 - DNA, 16 bp, Homo sapiens
atacaatgcctcccag

SEQ ID NO: 6657673 - DNA, 17 bp, Homo sapiens
atacaatgctgtgccct

SEQ ID NO: 6657674 - DNA, 20 bp, Homo sapiens
atacaatggtttctgaaaga

SEQ ID NO: 6657675 - DNA, 14 bp, Homo sapiens
atacaatgtacaat

SEQ ID NO: 6657676 - DNA, 16 bp, Homo sapiens
atacaatgtacaatta

SEQ ID NO: 6657677 - DNA, 13 bp, Homo sapiens
atacaatgtatgt

SEQ ID NO: 6657678 - DNA, 16 bp, Homo sapiens
atacaatgtatgtaca

SEQ ID NO: 6657679 - DNA, 18 bp, Homo sapiens
atacaatgtatgtacaat

SEQ ID NO: 6657680 - DNA, 21 bp, Homo sapiens
atacaatgtatttatttaaaa

SEQ ID NO: 6657681 - DNA, 19 bp, Homo sapiens
atacaatgttatcaaccaa

SEQ ID NO: 6657682 - DNA, 16 bp, Homo sapiens
atacaattaaaggtcc

SEQ ID NO: 6657683 - DNA, 22 bp, Homo sapiens
atacaattaaaggtcctgccct

SEQ ID NO: 6657684 - DNA, 20 bp, Homo sapiens
atacaattcaaacaattcaa

SEQ ID NO: 6657685 - DNA, 15 bp, Homo sapiens
atacaattcagtact

SEQ ID NO: 6657686 - DNA, 13 bp, Homo sapiens
atacaattcagtt

SEQ ID NO: 6657687 - DNA, 17 bp, Homo sapiens
atacaattcagttttag

SEQ ID NO: 6657688 - DNA, 17 bp, Homo sapiens
atacaatttacttttaa

SEQ ID NO: 6657689 - DNA, 16 bp, Homo sapiens
atacaatttccatata

SEQ ID NO: 6657690 - DNA, 19 bp, Homo sapiens
atacaatttccatatagtc

SEQ ID NO: 6657691 - DNA, 23 bp, Homo sapiens
atacaatttccatatagtctatt

SEQ ID NO: 6657692 - DNA, 13 bp, Homo sapiens
atacaatttgcac

SEQ ID NO: 6657693 - DNA, 16 bp, Homo sapiens
atacaatttgcactgt

SEQ ID NO: 6657694 - DNA, 13 bp, Homo sapiens
atacaatttgtac

SEQ ID NO: 6657695 - DNA, 17 bp, Homo sapiens
atacaattttgtttctg

SEQ ID NO: 6657696 - DNA, 11 bp, Homo sapiens
atacacaaatt

SEQ ID NO: 6657697 - DNA, 18 bp, Homo sapiens
atacacaactccactgtc

SEQ ID NO: 6657698 - DNA, 19 bp, Homo sapiens
atacacaactttgcaaatt

SEQ ID NO: 6657699 - DNA, 17 bp, Homo sapiens
atacacaaggagctttc

SEQ ID NO: 6657700 - DNA, 19 bp, Homo sapiens
atacacaaggagctttctt

SEQ ID NO: 6657701 - DNA, 21 bp, Homo sapiens
atacacaaggagctttcttgt

SEQ ID NO: 6657702 - DNA, 20 bp, Homo sapiens
atacacaaggccagaaaaag

SEQ ID NO: 6657703 - DNA, 23 bp, Homo sapiens
atacacaaggccagaaaaagaag

SEQ ID NO: 6657704 - DNA, 12 bp, Homo sapiens
atacacaatata

SEQ ID NO: 6657705 - DNA, 19 bp, Homo sapiens
atacacacacaaagagagt

SEQ ID NO: 6657706 - DNA, 13 bp, Homo sapiens
atacacacacaca

SEQ ID NO: 6657707 - DNA, 19 bp, Homo sapiens
atacacacacacacacagc

SEQ ID NO: 6657708 - DNA, 20 bp, Homo sapiens
atacacacacacagacatat

SEQ ID NO: 6657709 - DNA, 11 bp, Homo sapiens
atacacacagg

SEQ ID NO: 6657710 - DNA, 12 bp, Homo sapiens
atacacacagga

SEQ ID NO: 6657711 - DNA, 12 bp, Homo sapiens
atacacacatat

SEQ ID NO: 6657712 - DNA, 17 bp, Homo sapiens
atacacacatatacata

SEQ ID NO: 6657713 - DNA, 19 bp, Homo sapiens
atacacacatatacatata

SEQ ID NO: 6657714 - DNA, 19 bp, Homo sapiens
atacacacatgccctcctg

SEQ ID NO: 6657715 - DNA, 22 bp, Homo sapiens
atacacaccccggactcctccg

SEQ ID NO: 6657716 - DNA, 11 bp, Homo sapiens
atacacacgct

SEQ ID NO: 6657717 - DNA, 16 bp, Homo sapiens
atacacacgctgcctt

SEQ ID NO: 6657718 - DNA, 21 bp, Homo sapiens
atacacagaaaagggagctaa

SEQ ID NO: 6657719 - DNA, 16 bp, Homo sapiens
atacacagatgattaa

SEQ ID NO: 6657720 - DNA, 15 bp, Homo sapiens
atacacagtacttta

SEQ ID NO: 6657721 - DNA, 21 bp, Homo sapiens
atacacagtactttattgtac

SEQ ID NO: 6657722 - DNA, 18 bp, Homo sapiens
atacacagttaaataaat

SEQ ID NO: 6657723 - DNA, 19 bp, Homo sapiens
atacacagttccacaattt

SEQ ID NO: 6657724 - DNA, 12 bp, Homo sapiens
atacacataatt

SEQ ID NO: 6657725 - DNA, 13 bp, Homo sapiens
atacacatacata

SEQ ID NO: 6657726 - DNA, 14 bp, Homo sapiens
atacacatacatac

SEQ ID NO: 6657727 - DNA, 14 bp, Homo sapiens
atacacatacatat

SEQ ID NO: 6657728 - DNA, 14 bp, Homo sapiens
atacacatggaaaa

SEQ ID NO: 6657729 - DNA, 17 bp, Homo sapiens
atacacattatcactga

SEQ ID NO: 6657730 - DNA, 14 bp, Homo sapiens
atacacatttcaca

SEQ ID NO: 6657731 - DNA, 16 bp, Homo sapiens
atacacattttgtaaa

SEQ ID NO: 6657732 - DNA, 20 bp, Homo sapiens
atacacattttgtaaatctg

SEQ ID NO: 6657733 - DNA, 20 bp, Homo sapiens
atacacatttttaaaacaac

SEQ ID NO: 6657734 - DNA, 14 bp, Homo sapiens
atacaccaaacatt

SEQ ID NO: 6657735 - DNA, 18 bp, Homo sapiens
atacaccaaacatttctg

SEQ ID NO: 6657736 - DNA, 14 bp, Homo sapiens
atacaccacaaaaa

SEQ ID NO: 6657737 - DNA, 20 bp, Homo sapiens
atacaccacctcactcctgt

SEQ ID NO: 6657738 - DNA, 20 bp, Homo sapiens
atacaccactacattctgtt

SEQ ID NO: 6657739 - DNA, 13 bp, Homo sapiens
atacaccagaaga

SEQ ID NO: 6657740 - DNA, 19 bp, Homo sapiens
atacaccagagataatatg

SEQ ID NO: 6657741 - DNA, 17 bp, Homo sapiens
atacaccagcaatttag

SEQ ID NO: 6657742 - DNA, 14 bp, Homo sapiens
atacaccgggcctg

SEQ ID NO: 6657743 - DNA, 22 bp, Homo sapiens
atacaccgtttagaaaaaacaa

SEQ ID NO: 6657744 - DNA, 21 bp, Homo sapiens
atacacgtttatcttacattc

SEQ ID NO: 6657745 - DNA, 14 bp, Homo sapiens
atacactaaaaatc

SEQ ID NO: 6657746 - DNA, 17 bp, Homo sapiens
atacactaatagtaaga

SEQ ID NO: 6657747 - DNA, 12 bp, Homo sapiens
atacactaatga

SEQ ID NO: 6657748 - DNA, 21 bp, Homo sapiens
atacactaatgagtatttggt

SEQ ID NO: 6657749 - DNA, 13 bp, Homo sapiens
atacactcctgct

SEQ ID NO: 6657750 - DNA, 15 bp, Homo sapiens
atacactcctgctgt

SEQ ID NO: 6657751 - DNA, 17 bp, Homo sapiens
atacactgaatggaaat

SEQ ID NO: 6657752 - DNA, 16 bp, Homo sapiens
atacactgcactttgt

SEQ ID NO: 6657753 - DNA, 17 bp, Homo sapiens
atacactgcactttgtt

SEQ ID NO: 6657754 - DNA, 18 bp, Homo sapiens
atacactgcactttgttt

SEQ ID NO: 6657755 - DNA, 20 bp, Homo sapiens
atacactgtagtttttgaaa

SEQ ID NO: 6657756 - DNA, 21 bp, Homo sapiens
atacactgtagtttttgaaaa

SEQ ID NO: 6657757 - DNA, 22 bp, Homo sapiens
atacactgtagtttttgaaaat

SEQ ID NO: 6657758 - DNA, 11 bp, Homo sapiens
atacactgtgt

SEQ ID NO: 6657759 - DNA, 17 bp, Homo sapiens
atacactgtgtaaatac

SEQ ID NO: 6657760 - DNA, 18 bp, Homo sapiens
atacactgtgtaaatacc

SEQ ID NO: 6657761 - DNA, 22 bp, Homo sapiens
atacacttacactttatgcaca

SEQ ID NO: 6657762 - DNA, 21 bp, Homo sapiens
atacacttctggctcacagga

SEQ ID NO: 6657763 - DNA, 16 bp, Homo sapiens
atacacttgccctgct

SEQ ID NO: 6657764 - DNA, 15 bp, Homo sapiens
atacacttgtataaa

SEQ ID NO: 6657765 - DNA, 20 bp, Homo sapiens
atacactttacattcttgct

SEQ ID NO: 6657766 - DNA, 15 bp, Homo sapiens
atacacttttttcca

SEQ ID NO: 6657767 - DNA, 13 bp, Homo sapiens
atacagaaaagtt

SEQ ID NO: 6657768 - DNA, 14 bp, Homo sapiens
atacagaaaatgct

SEQ ID NO: 6657769 - DNA, 16 bp, Homo sapiens
atacagaaagaagcag

SEQ ID NO: 6657770 - DNA, 17 bp, Homo sapiens
atacagaacagagggcc

SEQ ID NO: 6657771 - DNA, 17 bp, Homo sapiens
atacagaactcacagta

SEQ ID NO: 6657772 - DNA, 23 bp, Homo sapiens
atacagaactctttcaaaacctt

SEQ ID NO: 6657773 - DNA, 15 bp, Homo sapiens
atacagaagaaaata

SEQ ID NO: 6657774 - DNA, 22 bp, Homo sapiens
atacagaagcccatgtcttctg

SEQ ID NO: 6657775 - DNA, 20 bp, Homo sapiens
atacagaatcttgttttgaa

SEQ ID NO: 6657776 - DNA, 20 bp, Homo sapiens
atacagaattactgtaactg

SEQ ID NO: 6657777 - DNA, 20 bp, Homo sapiens
atacagaattgtgtctgcag

SEQ ID NO: 6657778 - DNA, 23 bp, Homo sapiens
atacagacacatttacactagag

SEQ ID NO: 6657779 - DNA, 14 bp, Homo sapiens
atacagacactaag

SEQ ID NO: 6657780 - DNA, 12 bp, Homo sapiens
atacagacagca

SEQ ID NO: 6657781 - DNA, 20 bp, Homo sapiens
atacagaccgaactgttgta

SEQ ID NO: 6657782 - DNA, 13 bp, Homo sapiens
atacagacctaat

SEQ ID NO: 6657783 - DNA, 18 bp, Homo sapiens
atacagacctaatatcat

SEQ ID NO: 6657784 - DNA, 20 bp, Homo sapiens
atacagacctccagattatt

SEQ ID NO: 6657785 - DNA, 21 bp, Homo sapiens
atacagagccacgagtttgga

SEQ ID NO: 6657786 - DNA, 17 bp, Homo sapiens
atacagagcctgtttta

SEQ ID NO: 6657787 - DNA, 18 bp, Homo sapiens
atacagagcctgttttaa

SEQ ID NO: 6657788 - DNA, 20 bp, Homo sapiens
atacagagtaattataggaa

SEQ ID NO: 6657789 - DNA, 17 bp, Homo sapiens
atacagataaatgattc

SEQ ID NO: 6657790 - DNA, 15 bp, Homo sapiens
atacagataacatta

SEQ ID NO: 6657791 - DNA, 18 bp, Homo sapiens
atacagataattcatttg

SEQ ID NO: 6657792 - DNA, 18 bp, Homo sapiens
atacagatccgcatgtgt

SEQ ID NO: 6657793 - DNA, 21 bp, Homo sapiens
atacagatccgcatgtgtctg

SEQ ID NO: 6657794 - DNA, 21 bp, Homo sapiens
atacagatctgtttattctgt

SEQ ID NO: 6657795 - DNA, 14 bp, Homo sapiens
atacagatgaaaat

SEQ ID NO: 6657796 - DNA, 16 bp, Homo sapiens
atacagatgaaaattt

SEQ ID NO: 6657797 - DNA, 22 bp, Homo sapiens
atacagatggtgtcctgcatgt

SEQ ID NO: 6657798 - DNA, 13 bp, Homo sapiens
atacagattgaaa

SEQ ID NO: 6657799 - DNA, 13 bp, Homo sapiens
atacagattttac

SEQ ID NO: 6657800 - DNA, 16 bp, Homo sapiens
atacagattttgatag

SEQ ID NO: 6657801 - DNA, 19 bp, Homo sapiens
atacagattttgatagcaa

SEQ ID NO: 6657802 - DNA, 13 bp, Homo sapiens
atacagcaaagga

SEQ ID NO: 6657803 - DNA, 16 bp, Homo sapiens
atacagcaacaattta

SEQ ID NO: 6657804 - DNA, 13 bp, Homo sapiens
atacagcagcaag

SEQ ID NO: 6657805 - DNA, 16 bp, Homo sapiens
atacagcagcaagaaa

SEQ ID NO: 6657806 - DNA, 19 bp, Homo sapiens
atacagcagcaagaaaaaa

SEQ ID NO: 6657807 - DNA, 15 bp, Homo sapiens
atacagcagtagaca

SEQ ID NO: 6657808 - DNA, 17 bp, Homo sapiens
atacagcagtagacatt

SEQ ID NO: 6657809 - DNA, 20 bp, Homo sapiens
atacagcatgagattgtaca

SEQ ID NO: 6657810 - DNA, 15 bp, Homo sapiens
atacagccattttgt

SEQ ID NO: 6657811 - DNA, 23 bp, Homo sapiens
atacagccccaaaccagggtgca

SEQ ID NO: 6657812 - DNA, 20 bp, Homo sapiens
atacagcctatagtaaatgt

SEQ ID NO: 6657813 - DNA, 22 bp, Homo sapiens
atacagcctgaataaaccaaga

SEQ ID NO: 6657814 - DNA, 18 bp, Homo sapiens
atacagctattaaaatgt

SEQ ID NO: 6657815 - DNA, 14 bp, Homo sapiens
atacagctcagtaa

SEQ ID NO: 6657816 - DNA, 11 bp, Homo sapiens
atacagctgag

SEQ ID NO: 6657817 - DNA, 13 bp, Homo sapiens
atacagctgccta

SEQ ID NO: 6657818 - DNA, 11 bp, Homo sapiens
atacagctggc

SEQ ID NO: 6657819 - DNA, 19 bp, Homo sapiens
atacagctttctgaccttc

SEQ ID NO: 6657820 - DNA, 20 bp, Homo sapiens
atacaggaaaagctgctgac

SEQ ID NO: 6657821 - DNA, 13 bp, Homo sapiens
atacaggaaacag

SEQ ID NO: 6657822 - DNA, 23 bp, Homo sapiens
atacaggaagaaagagcttgagg

SEQ ID NO: 6657823 - DNA, 13 bp, Homo sapiens
atacaggaattat

SEQ ID NO: 6657824 - DNA, 14 bp, Homo sapiens
atacaggactggtt

SEQ ID NO: 6657825 - DNA, 21 bp, Homo sapiens
atacaggatttgaactcagat

SEQ ID NO: 6657826 - DNA, 21 bp, Homo sapiens
atacagggagccggcggcctc

SEQ ID NO: 6657827 - DNA, 12 bp, Homo sapiens
atacagggaggc

SEQ ID NO: 6657828 - DNA, 16 bp, Homo sapiens
atacagggaggctccc

SEQ ID NO: 6657829 - DNA, 16 bp, Homo sapiens
atacagggatggtgtt

SEQ ID NO: 6657830 - DNA, 18 bp, Homo sapiens
atacaggggaatatttta

SEQ ID NO: 6657831 - DNA, 19 bp, Homo sapiens
atacaggggaggggcgcac

SEQ ID NO: 6657832 - DNA, 13 bp, Homo sapiens
atacaggtaacta

SEQ ID NO: 6657833 - DNA, 23 bp, Homo sapiens
atacaggtgccttggggaaatgt

SEQ ID NO: 6657834 - DNA, 18 bp, Homo sapiens
atacagtaactttatgtg

SEQ ID NO: 6657835 - DNA, 19 bp, Homo sapiens
atacagtaagcatagttaa

SEQ ID NO: 6657836 - DNA, 19 bp, Homo sapiens
atacagtacaggcagcaca

SEQ ID NO: 6657837 - DNA, 23 bp, Homo sapiens
atacagtacggatttgtccaaat

SEQ ID NO: 6657838 - DNA, 18 bp, Homo sapiens
atacagtataaaaataga

SEQ ID NO: 6657839 - DNA, 18 bp, Homo sapiens
atacagtattcccactct

SEQ ID NO: 6657840 - DNA, 16 bp, Homo sapiens
atacagtattgaaaaa

SEQ ID NO: 6657841 - DNA, 23 bp, Homo sapiens
atacagtatttctttgttataca

SEQ ID NO: 6657842 - DNA, 20 bp, Homo sapiens
atacagtctctgagaactgg

SEQ ID NO: 6657843 - DNA, 22 bp, Homo sapiens
atacagtcttccacaaagaaaa

SEQ ID NO: 6657844 - DNA, 16 bp, Homo sapiens
atacagtgaaatcttt

SEQ ID NO: 6657845 - DNA, 17 bp, Homo sapiens
atacagtgaagagtaag

SEQ ID NO: 6657846 - DNA, 17 bp, Homo sapiens
atacagtgcccaccgcc

SEQ ID NO: 6657847 - DNA, 23 bp, Homo sapiens
atacagtgcccaccgccctcctc

SEQ ID NO: 6657848 - DNA, 14 bp, Homo sapiens
atacagtgccttgc

SEQ ID NO: 6657849 - DNA, 15 bp, Homo sapiens
atacagtgccttgct

SEQ ID NO: 6657850 - DNA, 14 bp, Homo sapiens
atacagtgtacatg

SEQ ID NO: 6657851 - DNA, 13 bp, Homo sapiens
atacagtgttttt

SEQ ID NO: 6657852 - DNA, 15 bp, Homo sapiens
atacagtgtttttta

SEQ ID NO: 6657853 - DNA, 22 bp, Homo sapiens
atacagtgttttttaggaaaag

SEQ ID NO: 6657854 - DNA, 20 bp, Homo sapiens
atacagttactcagaattct

SEQ ID NO: 6657855 - DNA, 22 bp, Homo sapiens
atacagttaggcaccagaagaa

SEQ ID NO: 6657856 - DNA, 18 bp, Homo sapiens
atacagttattaaaatgt

SEQ ID NO: 6657857 - DNA, 12 bp, Homo sapiens
atacagttattt

SEQ ID NO: 6657858 - DNA, 16 bp, Homo sapiens
atacagttattttgga

SEQ ID NO: 6657859 - DNA, 22 bp, Homo sapiens
atacagttattttggatatatt

SEQ ID NO: 6657860 - DNA, 15 bp, Homo sapiens
atacagttcaataaa

SEQ ID NO: 6657861 - DNA, 19 bp, Homo sapiens
atacagttcaataaactta

SEQ ID NO: 6657862 - DNA, 20 bp, Homo sapiens
atacagttgaaaacttgtaa

SEQ ID NO: 6657863 - DNA, 20 bp, Homo sapiens
atacagtttataaagccaag

SEQ ID NO: 6657864 - DNA, 22 bp, Homo sapiens
atacagtttataaagccaagaa

SEQ ID NO: 6657865 - DNA, 16 bp, Homo sapiens
atacagttttaaagaa

SEQ ID NO: 6657866 - DNA, 14 bp, Homo sapiens
atacagttttatgc

SEQ ID NO: 6657867 - DNA, 18 bp, Homo sapiens
atacagttttatgctctt

SEQ ID NO: 6657868 - DNA, 19 bp, Homo sapiens
atacagttttatgctcttt

SEQ ID NO: 6657869 - DNA, 17 bp, Homo sapiens
atacagttttcagaaaa

SEQ ID NO: 6657870 - DNA, 22 bp, Homo sapiens
atacagttttcagaaaaagaaa

SEQ ID NO: 6657871 - DNA, 16 bp, Homo sapiens
atacagttttcattga

SEQ ID NO: 6657872 - DNA, 13 bp, Homo sapiens
atacagttttcta

SEQ ID NO: 6657873 - DNA, 15 bp, Homo sapiens
atacagttttgagta

SEQ ID NO: 6657874 - DNA, 10 bp, Homo sapiens
atacataaaa

SEQ ID NO: 6657875 - DNA, 12 bp, Homo sapiens
atacataaaaat

SEQ ID NO: 6657876 - DNA, 14 bp, Homo sapiens
atacataaaagaaa

SEQ ID NO: 6657877 - DNA, 16 bp, Homo sapiens
atacataaaagaaata

SEQ ID NO: 6657878 - DNA, 13 bp, Homo sapiens
atacataaacagt

SEQ ID NO: 6657879 - DNA, 17 bp, Homo sapiens
atacataaacttttgca

SEQ ID NO: 6657880 - DNA, 20 bp, Homo sapiens
atacataaagttctctgtaa

SEQ ID NO: 6657881 - DNA, 15 bp, Homo sapiens
atacataaatagtag

SEQ ID NO: 6657882 - DNA, 12 bp, Homo sapiens
atacataacagg

SEQ ID NO: 6657883 - DNA, 22 bp, Homo sapiens
atacataacagggtaaattatt

SEQ ID NO: 6657884 - DNA, 24 bp, Homo sapiens
atacataactaaatttgatactta

SEQ ID NO: 6657885 - DNA, 17 bp, Homo sapiens
atacataactgaagcat

SEQ ID NO: 6657886 - DNA, 22 bp, Homo sapiens
atacataactgaagcatgtgaa

SEQ ID NO: 6657887 - DNA, 15 bp, Homo sapiens
atacataacttcagt

SEQ ID NO: 6657888 - DNA, 21 bp, Homo sapiens
atacataagcggcgtaagttt

SEQ ID NO: 6657889 - DNA, 13 bp, Homo sapiens
atacataataaaa

SEQ ID NO: 6657890 - DNA, 19 bp, Homo sapiens
atacataatatatgacttc

SEQ ID NO: 6657891 - DNA, 22 bp, Homo sapiens
atacataatatatgacttccta

SEQ ID NO: 6657892 - DNA, 14 bp, Homo sapiens
atacatacacatac

SEQ ID NO: 6657893 - DNA, 17 bp, Homo sapiens
atacatacacatacata

SEQ ID NO: 6657894 - DNA, 16 bp, Homo sapiens
atacatacacatatat

SEQ ID NO: 6657895 - DNA, 15 bp, Homo sapiens
atacatacaccagca

SEQ ID NO: 6657896 - DNA, 14 bp, Homo sapiens
atacatacacttgt

SEQ ID NO: 6657897 - DNA, 19 bp, Homo sapiens
atacatacacttgtataaa

SEQ ID NO: 6657898 - DNA, 17 bp, Homo sapiens
atacatacagaattact

SEQ ID NO: 6657899 - DNA, 17 bp, Homo sapiens
atacatacatacaaata

SEQ ID NO: 6657900 - DNA, 17 bp, Homo sapiens
atacatacatacataca

SEQ ID NO: 6657901 - DNA, 18 bp, Homo sapiens
atacatacatacatacat

SEQ ID NO: 6657902 - DNA, 17 bp, Homo sapiens
atacatacatacatata

SEQ ID NO: 6657903 - DNA, 12 bp, Homo sapiens
atacatacatat

SEQ ID NO: 6657904 - DNA, 21 bp, Homo sapiens
atacatactatagattcttta

SEQ ID NO: 6657905 - DNA, 18 bp, Homo sapiens
atacatacttacatgtgt

SEQ ID NO: 6657906 - DNA, 17 bp, Homo sapiens
atacatagacatttcaa

SEQ ID NO: 6657907 - DNA, 18 bp, Homo sapiens
atacatagacatttcaaa

SEQ ID NO: 6657908 - DNA, 13 bp, Homo sapiens
atacatagtcaca

SEQ ID NO: 6657909 - DNA, 17 bp, Homo sapiens
atacatagtcacaaaaa

SEQ ID NO: 6657910 - DNA, 16 bp, Homo sapiens
atacatataattcttt

SEQ ID NO: 6657911 - DNA, 18 bp, Homo sapiens
atacatatagcagctctt

SEQ ID NO: 6657912 - DNA, 12 bp, Homo sapiens
atacatatatat

SEQ ID NO: 6657913 - DNA, 23 bp, Homo sapiens
atacatatatatatacacataca

SEQ ID NO: 6657914 - DNA, 24 bp, Homo sapiens
atacatatatatatacacatacat

SEQ ID NO: 6657915 - DNA, 15 bp, Homo sapiens
atacatatatatctg

SEQ ID NO: 6657916 - DNA, 22 bp, Homo sapiens
atacatatcagaaaagtagaat

SEQ ID NO: 6657917 - DNA, 13 bp, Homo sapiens
atacatatcttta

SEQ ID NO: 6657918 - DNA, 17 bp, Homo sapiens
atacatatctttattaa

SEQ ID NO: 6657919 - DNA, 15 bp, Homo sapiens
atacatatgagaata

SEQ ID NO: 6657920 - DNA, 22 bp, Homo sapiens
atacatatgcagatacttatta

SEQ ID NO: 6657921 - DNA, 21 bp, Homo sapiens
atacatatgtagactatatac

SEQ ID NO: 6657922 - DNA, 23 bp, Homo sapiens
atacatatgtagactatatacat

SEQ ID NO: 6657923 - DNA, 15 bp, Homo sapiens
atacatatgtatgtg

SEQ ID NO: 6657924 - DNA, 22 bp, Homo sapiens
atacatatgtatgtgtgagtgt

SEQ ID NO: 6657925 - DNA, 20 bp, Homo sapiens
atacatattataaataaatg

SEQ ID NO: 6657926 - DNA, 14 bp, Homo sapiens
atacatattcaaag

SEQ ID NO: 6657927 - DNA, 18 bp, Homo sapiens
atacatcaacaagaagaa

SEQ ID NO: 6657928 - DNA, 17 bp, Homo sapiens
atacatcaatttaaaaa

SEQ ID NO: 6657929 - DNA, 14 bp, Homo sapiens
atacatcacatctt

SEQ ID NO: 6657930 - DNA, 16 bp, Homo sapiens
atacatcacatcttat

SEQ ID NO: 6657931 - DNA, 17 bp, Homo sapiens
atacatcacatcttatt

SEQ ID NO: 6657932 - DNA, 13 bp, Homo sapiens
atacatcacttcc

SEQ ID NO: 6657933 - DNA, 15 bp, Homo sapiens
atacatcacttcctg

SEQ ID NO: 6657934 - DNA, 20 bp, Homo sapiens
atacatcacttcctgtttta

SEQ ID NO: 6657935 - DNA, 19 bp, Homo sapiens
atacatcagaaaataaaat

SEQ ID NO: 6657936 - DNA, 19 bp, Homo sapiens
atacatcagcttggtagtt

SEQ ID NO: 6657937 - DNA, 13 bp, Homo sapiens
atacatcatatgt

SEQ ID NO: 6657938 - DNA, 13 bp, Homo sapiens
atacatcctattt

SEQ ID NO: 6657939 - DNA, 21 bp, Homo sapiens
atacatcctattttgtaattt

SEQ ID NO: 6657940 - DNA, 22 bp, Homo sapiens
atacatcctttttctgctaacc

SEQ ID NO: 6657941 - DNA, 16 bp, Homo sapiens
atacatctctccccaa

SEQ ID NO: 6657942 - DNA, 15 bp, Homo sapiens
atacatctgatgcat

SEQ ID NO: 6657943 - DNA, 14 bp, Homo sapiens
atacatctgtgtat

SEQ ID NO: 6657944 - DNA, 15 bp, Homo sapiens
atacatcttcattaa

SEQ ID NO: 6657945 - DNA, 22 bp, Homo sapiens
atacatcttcattaatactgtg

SEQ ID NO: 6657946 - DNA, 17 bp, Homo sapiens
atacatgaaaattttaa

SEQ ID NO: 6657947 - DNA, 14 bp, Homo sapiens
atacatgacactga

SEQ ID NO: 6657948 - DNA, 16 bp, Homo sapiens
atacatgacactgaaa

SEQ ID NO: 6657949 - DNA, 17 bp, Homo sapiens
atacatgccacatcaaa

SEQ ID NO: 6657950 - DNA, 23 bp, Homo sapiens
atacatgcgtgtacctcacttta

SEQ ID NO: 6657951 - DNA, 18 bp, Homo sapiens
atacatgctaagagaagt

SEQ ID NO: 6657952 - DNA, 15 bp, Homo sapiens
atacatgctcttaga

SEQ ID NO: 6657953 - DNA, 22 bp, Homo sapiens
atacatgctgcgcatgttttct

SEQ ID NO: 6657954 - DNA, 20 bp, Homo sapiens
atacatggaatcgaagtgtt

SEQ ID NO: 6657955 - DNA, 14 bp, Homo sapiens
atacatggataaca

SEQ ID NO: 6657956 - DNA, 14 bp, Homo sapiens
atacatggttgtga

SEQ ID NO: 6657957 - DNA, 20 bp, Homo sapiens
atacatggttgtgacctgag

SEQ ID NO: 6657958 - DNA, 22 bp, Homo sapiens
atacatgtaattctaccaaggt

SEQ ID NO: 6657959 - DNA, 21 bp, Homo sapiens
atacatgtactccagagggac

SEQ ID NO: 6657960 - DNA, 23 bp, Homo sapiens
atacatgtcacatttagctgtgc

SEQ ID NO: 6657961 - DNA, 14 bp, Homo sapiens
atacatgtccccct

SEQ ID NO: 6657962 - DNA, 20 bp, Homo sapiens
atacatgtgtacatatatgt

SEQ ID NO: 6657963 - DNA, 19 bp, Homo sapiens
atacatgtgtgtatatatg

SEQ ID NO: 6657964 - DNA, 21 bp, Homo sapiens
atacatgtgtgtatatatgtg

SEQ ID NO: 6657965 - DNA, 23 bp, Homo sapiens
atacatgtgtgtatatatgtgta

SEQ ID NO: 6657966 - DNA, 21 bp, Homo sapiens
atacatgttcatcgtatttcc

SEQ ID NO: 6657967 - DNA, 20 bp, Homo sapiens
atacatgttggaaatgtgtt

SEQ ID NO: 6657968 - DNA, 13 bp, Homo sapiens
atacatgttgtat

SEQ ID NO: 6657969 - DNA, 23 bp, Homo sapiens
atacatgttgtatttatggaaga

SEQ ID NO: 6657970 - DNA, 21 bp, Homo sapiens
atacatgtttatgtaaacaaa

SEQ ID NO: 6657971 - DNA, 12 bp, Homo sapiens
atacatgtttgc

SEQ ID NO: 6657972 - DNA, 15 bp, Homo sapiens
atacatgtttgcagt

SEQ ID NO: 6657973 - DNA, 19 bp, Homo sapiens
atacatgtttgttggttga

SEQ ID NO: 6657974 - DNA, 16 bp, Homo sapiens
atacatgtttttctat

SEQ ID NO: 6657975 - DNA, 15 bp, Homo sapiens
atacattaaaactag

SEQ ID NO: 6657976 - DNA, 22 bp, Homo sapiens
atacattaaaactaggtaatgt

SEQ ID NO: 6657977 - DNA, 14 bp, Homo sapiens
atacattaacaagc

SEQ ID NO: 6657978 - DNA, 17 bp, Homo sapiens
atacattaacggtgcta

SEQ ID NO: 6657979 - DNA, 15 bp, Homo sapiens
atacattaaggagca

SEQ ID NO: 6657980 - DNA, 21 bp, Homo sapiens
atacattacatctgagtattt

SEQ ID NO: 6657981 - DNA, 15 bp, Homo sapiens
atacattagacacac

SEQ ID NO: 6657982 - DNA, 18 bp, Homo sapiens
atacattagacacacata

SEQ ID NO: 6657983 - DNA, 19 bp, Homo sapiens
atacattagacacacatat

SEQ ID NO: 6657984 - DNA, 19 bp, Homo sapiens
atacattagtaaatgtctt

SEQ ID NO: 6657985 - DNA, 20 bp, Homo sapiens
atacattatattcctctaaa

SEQ ID NO: 6657986 - DNA, 15 bp, Homo sapiens
atacattatatttct

SEQ ID NO: 6657987 - DNA, 17 bp, Homo sapiens
atacattatatttctat

SEQ ID NO: 6657988 - DNA, 13 bp, Homo sapiens
atacattatgctt

SEQ ID NO: 6657989 - DNA, 14 bp, Homo sapiens
atacattattagaa

SEQ ID NO: 6657990 - DNA, 18 bp, Homo sapiens
atacattattagaatata

SEQ ID NO: 6657991 - DNA, 18 bp, Homo sapiens
atacattattgaaaagca

SEQ ID NO: 6657992 - DNA, 20 bp, Homo sapiens
atacattcaaattctttttt

SEQ ID NO: 6657993 - DNA, 19 bp, Homo sapiens
atacattcatactgtagaa

SEQ ID NO: 6657994 - DNA, 16 bp, Homo sapiens
atacattccatcacag

SEQ ID NO: 6657995 - DNA, 22 bp, Homo sapiens
atacattccattgttttagtaa

SEQ ID NO: 6657996 - DNA, 18 bp, Homo sapiens
atacattccctctaattt

SEQ ID NO: 6657997 - DNA, 20 bp, Homo sapiens
atacattccctctaatttga

SEQ ID NO: 6657998 - DNA, 20 bp, Homo sapiens
atacattcctgagattctgg

SEQ ID NO: 6657999 - DNA, 17 bp, Homo sapiens
atacattctgtaataca

SEQ ID NO: 6658000 - DNA, 23 bp, Homo sapiens
atacattcttaaactagttgtct

SEQ ID NO: 6658001 - DNA, 15 bp, Homo sapiens
atacattctttgcta

SEQ ID NO: 6658002 - DNA, 18 bp, Homo sapiens
atacattctttgctagtt

SEQ ID NO: 6658003 - DNA, 12 bp, Homo sapiens
atacattctttt

SEQ ID NO: 6658004 - DNA, 16 bp, Homo sapiens
atacattctttttgct

SEQ ID NO: 6658005 - DNA, 15 bp, Homo sapiens
atacattgaattaga

SEQ ID NO: 6658006 - DNA, 17 bp, Homo sapiens
atacattgatacaaagt

SEQ ID NO: 6658007 - DNA, 21 bp, Homo sapiens
atacattgtacgaagagtatt

SEQ ID NO: 6658008 - DNA, 22 bp, Homo sapiens
atacattgtcttgatgtttttt

SEQ ID NO: 6658009 - DNA, 14 bp, Homo sapiens
atacattgtgtgaa

SEQ ID NO: 6658010 - DNA, 15 bp, Homo sapiens
atacatttaaaactt

SEQ ID NO: 6658011 - DNA, 15 bp, Homo sapiens
atacatttaaagatt

SEQ ID NO: 6658012 - DNA, 21 bp, Homo sapiens
atacatttaaagatttaaagt

SEQ ID NO: 6658013 - DNA, 18 bp, Homo sapiens
atacatttaataaaactg

SEQ ID NO: 6658014 - DNA, 22 bp, Homo sapiens
atacatttagttaacacacata

SEQ ID NO: 6658015 - DNA, 15 bp, Homo sapiens
atacatttataatgt

SEQ ID NO: 6658016 - DNA, 19 bp, Homo sapiens
atacatttatcttctgttt

SEQ ID NO: 6658017 - DNA, 22 bp, Homo sapiens
atacatttatcttctgtttttc

SEQ ID NO: 6658018 - DNA, 17 bp, Homo sapiens
atacatttatgaattaa

SEQ ID NO: 6658019 - DNA, 12 bp, Homo sapiens
atacatttctga

SEQ ID NO: 6658020 - DNA, 16 bp, Homo sapiens
atacatttgataaagt

SEQ ID NO: 6658021 - DNA, 12 bp, Homo sapiens
atacatttgtat

SEQ ID NO: 6658022 - DNA, 14 bp, Homo sapiens
atacatttgtattt

SEQ ID NO: 6658023 - DNA, 15 bp, Homo sapiens
atacatttgtattta

SEQ ID NO: 6658024 - DNA, 18 bp, Homo sapiens
atacatttgtattttgtg

SEQ ID NO: 6658025 - DNA, 22 bp, Homo sapiens
atacatttgtattttgtgatga

SEQ ID NO: 6658026 - DNA, 20 bp, Homo sapiens
atacatttgtggtcacatgc

SEQ ID NO: 6658027 - DNA, 13 bp, Homo sapiens
atacattttacat

SEQ ID NO: 6658028 - DNA, 14 bp, Homo sapiens
atacattttctaaa

SEQ ID NO: 6658029 - DNA, 16 bp, Homo sapiens
atacattttctaaata

SEQ ID NO: 6658030 - DNA, 17 bp, Homo sapiens
atacattttgaaaatat

SEQ ID NO: 6658031 - DNA, 19 bp, Homo sapiens
atacattttgtatattaac

SEQ ID NO: 6658032 - DNA, 20 bp, Homo sapiens
atacattttttaagcttcag

SEQ ID NO: 6658033 - DNA, 22 bp, Homo sapiens
atacattttttaggacatctta

SEQ ID NO: 6658034 - DNA, 20 bp, Homo sapiens
ataccaaaattatttcagaa

SEQ ID NO: 6658035 - DNA, 15 bp, Homo sapiens
ataccaaaattgagc

SEQ ID NO: 6658036 - DNA, 18 bp, Homo sapiens
ataccaaagcacatttta

SEQ ID NO: 6658037 - DNA, 14 bp, Homo sapiens
ataccaaagcagtt

SEQ ID NO: 6658038 - DNA, 20 bp, Homo sapiens
ataccaaagctgctgcacag

SEQ ID NO: 6658039 - DNA, 17 bp, Homo sapiens
ataccaaattaaaaaaa

SEQ ID NO: 6658040 - DNA, 17 bp, Homo sapiens
ataccaactgggcctct

SEQ ID NO: 6658041 - DNA, 14 bp, Homo sapiens
ataccaagtattta

SEQ ID NO: 6658042 - DNA, 13 bp, Homo sapiens
ataccaataaagt

SEQ ID NO: 6658043 - DNA, 15 bp, Homo sapiens
ataccaataaagtga

SEQ ID NO: 6658044 - DNA, 19 bp, Homo sapiens
ataccaatgaaaaaatgta

SEQ ID NO: 6658045 - DNA, 21 bp, Homo sapiens
ataccaatgaaaaaatgtata

SEQ ID NO: 6658046 - DNA, 19 bp, Homo sapiens
ataccaatgacttccatat

SEQ ID NO: 6658047 - DNA, 19 bp, Homo sapiens
ataccaatgtgttttctgt

SEQ ID NO: 6658048 - DNA, 23 bp, Homo sapiens
ataccaattacccataaacagca

SEQ ID NO: 6658049 - DNA, 20 bp, Homo sapiens
ataccacaaaccctgctgaa

SEQ ID NO: 6658050 - DNA, 13 bp, Homo sapiens
ataccacaagcct

SEQ ID NO: 6658051 - DNA, 24 bp, Homo sapiens
ataccacagctatttagaagcatc

SEQ ID NO: 6658052 - DNA, 22 bp, Homo sapiens
ataccacaggaaccacaagact

SEQ ID NO: 6658053 - DNA, 13 bp, Homo sapiens
ataccacatcaaa

SEQ ID NO: 6658054 - DNA, 17 bp, Homo sapiens
ataccaccaacaaatat

SEQ ID NO: 6658055 - DNA, 22 bp, Homo sapiens
ataccaccatttaaaaatgtta

SEQ ID NO: 6658056 - DNA, 17 bp, Homo sapiens
ataccacctttactgtg

SEQ ID NO: 6658057 - DNA, 17 bp, Homo sapiens
ataccacgctagggctg

SEQ ID NO: 6658058 - DNA, 13 bp, Homo sapiens
ataccacttgaat

SEQ ID NO: 6658059 - DNA, 16 bp, Homo sapiens
ataccagaagtgaatt

SEQ ID NO: 6658060 - DNA, 14 bp, Homo sapiens
ataccagagaaggt

SEQ ID NO: 6658061 - DNA, 15 bp, Homo sapiens
ataccagagccttca

SEQ ID NO: 6658062 - DNA, 19 bp, Homo sapiens
ataccagagtctggagctg

SEQ ID NO: 6658063 - DNA, 19 bp, Homo sapiens
ataccagatgaacatttca

SEQ ID NO: 6658064 - DNA, 17 bp, Homo sapiens
ataccagccagtaaatg

SEQ ID NO: 6658065 - DNA, 12 bp, Homo sapiens
ataccagcctac

SEQ ID NO: 6658066 - DNA, 16 bp, Homo sapiens
ataccagcgaggaggc

SEQ ID NO: 6658067 - DNA, 14 bp, Homo sapiens
ataccagctcaggg

SEQ ID NO: 6658068 - DNA, 15 bp, Homo sapiens
ataccagctcagggg

SEQ ID NO: 6658069 - DNA, 18 bp, Homo sapiens
ataccagcttaatagctg

SEQ ID NO: 6658070 - DNA, 20 bp, Homo sapiens
ataccagctttttctctcag

SEQ ID NO: 6658071 - DNA, 16 bp, Homo sapiens
ataccaggaccagttt

SEQ ID NO: 6658072 - DNA, 17 bp, Homo sapiens
ataccaggcaacctccc

SEQ ID NO: 6658073 - DNA, 16 bp, Homo sapiens
ataccaggcccaggag

SEQ ID NO: 6658074 - DNA, 11 bp, Homo sapiens
ataccagggaa

SEQ ID NO: 6658075 - DNA, 19 bp, Homo sapiens
ataccaggggttccccagg

SEQ ID NO: 6658076 - DNA, 14 bp, Homo sapiens
ataccaggttgaaa

SEQ ID NO: 6658077 - DNA, 20 bp, Homo sapiens
ataccagtgaaccaaagaga

SEQ ID NO: 6658078 - DNA, 11 bp, Homo sapiens
ataccagtgtt

SEQ ID NO: 6658079 - DNA, 14 bp, Homo sapiens
ataccagttcttgc

SEQ ID NO: 6658080 - DNA, 17 bp, Homo sapiens
ataccagttcttgcaat

SEQ ID NO: 6658081 - DNA, 15 bp, Homo sapiens
ataccagttgttcat

SEQ ID NO: 6658082 - DNA, 21 bp, Homo sapiens
ataccatactcatttctaaaa

SEQ ID NO: 6658083 - DNA, 20 bp, Homo sapiens
ataccatagagtccagatct

SEQ ID NO: 6658084 - DNA, 15 bp, Homo sapiens
ataccatatgaatga

SEQ ID NO: 6658085 - DNA, 21 bp, Homo sapiens
ataccatatgaatgaaacatg

SEQ ID NO: 6658086 - DNA, 21 bp, Homo sapiens
ataccatatgtctgcttctgt

SEQ ID NO: 6658087 - DNA, 11 bp, Homo sapiens
ataccatcagc

SEQ ID NO: 6658088 - DNA, 17 bp, Homo sapiens
ataccatcagcaaagaa

SEQ ID NO: 6658089 - DNA, 15 bp, Homo sapiens
ataccatctgctgcc

SEQ ID NO: 6658090 - DNA, 22 bp, Homo sapiens
ataccatctgctgccccgcttc

SEQ ID NO: 6658091 - DNA, 15 bp, Homo sapiens
ataccatgtctctaa

SEQ ID NO: 6658092 - DNA, 18 bp, Homo sapiens
ataccattaaaactgctt

SEQ ID NO: 6658093 - DNA, 19 bp, Homo sapiens
ataccattaaaactgcttt

SEQ ID NO: 6658094 - DNA, 16 bp, Homo sapiens
ataccattttgaaata

SEQ ID NO: 6658095 - DNA, 20 bp, Homo sapiens
ataccattttttaaggaaac

SEQ ID NO: 6658096 - DNA, 13 bp, Homo sapiens
atacccaacagtt

SEQ ID NO: 6658097 - DNA, 18 bp, Homo sapiens
atacccacaatctgagca

SEQ ID NO: 6658098 - DNA, 22 bp, Homo sapiens
atacccacacattccagggctg

SEQ ID NO: 6658099 - DNA, 16 bp, Homo sapiens
atacccaccagggaga

SEQ ID NO: 6658100 - DNA, 19 bp, Homo sapiens
atacccaccagggagatgt

SEQ ID NO: 6658101 - DNA, 14 bp, Homo sapiens
atacccacccagaa

SEQ ID NO: 6658102 - DNA, 11 bp, Homo sapiens
atacccacccc

SEQ ID NO: 6658103 - DNA, 13 bp, Homo sapiens
atacccaccccca

SEQ ID NO: 6658104 - DNA, 12 bp, Homo sapiens
atacccactgca

SEQ ID NO: 6658105 - DNA, 17 bp, Homo sapiens
atacccagaaagttatt

SEQ ID NO: 6658106 - DNA, 14 bp, Homo sapiens
atacccagagagaa

SEQ ID NO: 6658107 - DNA, 13 bp, Homo sapiens
atacccagagcac

SEQ ID NO: 6658108 - DNA, 23 bp, Homo sapiens
atacccaggaagactttgtgact

SEQ ID NO: 6658109 - DNA, 19 bp, Homo sapiens
atacccatgcacagtacaa

SEQ ID NO: 6658110 - DNA, 17 bp, Homo sapiens
ataccccactgggcaca

SEQ ID NO: 6658111 - DNA, 14 bp, Homo sapiens
ataccccagaaatt

SEQ ID NO: 6658112 - DNA, 15 bp, Homo sapiens
ataccccattaaatc

SEQ ID NO: 6658113 - DNA, 13 bp, Homo sapiens
atacccccctctg

SEQ ID NO: 6658114 - DNA, 17 bp, Homo sapiens
ataccccctgcaaagcc

SEQ ID NO: 6658115 - DNA, 21 bp, Homo sapiens
ataccccctgcaaagcccagc

SEQ ID NO: 6658116 - DNA, 17 bp, Homo sapiens
ataccccctgccccaga

SEQ ID NO: 6658117 - DNA, 21 bp, Homo sapiens
ataccccctgccccagagaag

SEQ ID NO: 6658118 - DNA, 23 bp, Homo sapiens
ataccccgtctctactaaaaata

SEQ ID NO: 6658119 - DNA, 13 bp, Homo sapiens
atacccctgcctg

SEQ ID NO: 6658120 - DNA, 14 bp, Homo sapiens
atacccctgcctgg

SEQ ID NO: 6658121 - DNA, 19 bp, Homo sapiens
ataccccttacttagcatg

SEQ ID NO: 6658122 - DNA, 21 bp, Homo sapiens
ataccccttattgctgccaaa

SEQ ID NO: 6658123 - DNA, 18 bp, Homo sapiens
atacccgcctagctgctg

SEQ ID NO: 6658124 - DNA, 23 bp, Homo sapiens
atacccggtggcttctggcacct

SEQ ID NO: 6658125 - DNA, 20 bp, Homo sapiens
ataccctagaagaaaacccg

SEQ ID NO: 6658126 - DNA, 19 bp, Homo sapiens
ataccctaggtctccaccc

SEQ ID NO: 6658127 - DNA, 20 bp, Homo sapiens
ataccctaggtctccacccc

SEQ ID NO: 6658128 - DNA, 16 bp, Homo sapiens
ataccctccctcccta

SEQ ID NO: 6658129 - DNA, 18 bp, Homo sapiens
ataccctctaaaaaagaa

SEQ ID NO: 6658130 - DNA, 12 bp, Homo sapiens
ataccctgccct

SEQ ID NO: 6658131 - DNA, 14 bp, Homo sapiens
ataccctgcccttg

SEQ ID NO: 6658132 - DNA, 19 bp, Homo sapiens
ataccctggccgccccctg

SEQ ID NO: 6658133 - DNA, 15 bp, Homo sapiens
ataccctgtctttaa

SEQ ID NO: 6658134 - DNA, 21 bp, Homo sapiens
ataccctgtctttaaaaataa

SEQ ID NO: 6658135 - DNA, 15 bp, Homo sapiens
atacccttcttttat

SEQ ID NO: 6658136 - DNA, 22 bp, Homo sapiens
atacccttggaaatactgtatg

SEQ ID NO: 6658137 - DNA, 14 bp, Homo sapiens
atacccttttccaa

SEQ ID NO: 6658138 - DNA, 14 bp, Homo sapiens
ataccgaccatcgt

SEQ ID NO: 6658139 - DNA, 18 bp, Homo sapiens
ataccgcaggcgggcgag

SEQ ID NO: 6658140 - DNA, 17 bp, Homo sapiens
ataccgcctcgtgccag

SEQ ID NO: 6658141 - DNA, 21 bp, Homo sapiens
ataccgcctcgtgccagcagc

SEQ ID NO: 6658142 - DNA, 22 bp, Homo sapiens
ataccgctcagtattttaaatg

SEQ ID NO: 6658143 - DNA, 22 bp, Homo sapiens
ataccggagctccagtttctct

SEQ ID NO: 6658144 - DNA, 21 bp, Homo sapiens
ataccgtgccactttccacca

SEQ ID NO: 6658145 - DNA, 22 bp, Homo sapiens
ataccgtttggtgtctgatgtg

SEQ ID NO: 6658146 - DNA, 14 bp, Homo sapiens
atacctaaaacata

SEQ ID NO: 6658147 - DNA, 14 bp, Homo sapiens
atacctaactgaat

SEQ ID NO: 6658148 - DNA, 13 bp, Homo sapiens
atacctaagtact

SEQ ID NO: 6658149 - DNA, 14 bp, Homo sapiens
atacctaagtactg

SEQ ID NO: 6658150 - DNA, 17 bp, Homo sapiens
atacctaagtactgtaa

SEQ ID NO: 6658151 - DNA, 21 bp, Homo sapiens
atacctaagtactgtaataat

SEQ ID NO: 6658152 - DNA, 18 bp, Homo sapiens
atacctacaataaactgg

SEQ ID NO: 6658153 - DNA, 15 bp, Homo sapiens
atacctacatgtatt

SEQ ID NO: 6658154 - DNA, 21 bp, Homo sapiens
atacctacatgtatttgtttg

SEQ ID NO: 6658155 - DNA, 15 bp, Homo sapiens
atacctataatgtgt

SEQ ID NO: 6658156 - DNA, 11 bp, Homo sapiens
atacctatgtg

SEQ ID NO: 6658157 - DNA, 13 bp, Homo sapiens
atacctatgtgaa

SEQ ID NO: 6658158 - DNA, 16 bp, Homo sapiens
atacctattaaaggaa

SEQ ID NO: 6658159 - DNA, 18 bp, Homo sapiens
atacctattaaaggaaaa

SEQ ID NO: 6658160 - DNA, 19 bp, Homo sapiens
atacctattaaaggaaaac

SEQ ID NO: 6658161 - DNA, 16 bp, Homo sapiens
atacctcaatgtttga

SEQ ID NO: 6658162 - DNA, 13 bp, Homo sapiens
atacctcagccct

SEQ ID NO: 6658163 - DNA, 15 bp, Homo sapiens
atacctcaggaaaga

SEQ ID NO: 6658164 - DNA, 20 bp, Homo sapiens
atacctcatgtttatgaaaa

SEQ ID NO: 6658165 - DNA, 22 bp, Homo sapiens
atacctcatgtttatgaaaata

SEQ ID NO: 6658166 - DNA, 16 bp, Homo sapiens
atacctcatttttcat

SEQ ID NO: 6658167 - DNA, 17 bp, Homo sapiens
atacctccaaccctgcc

SEQ ID NO: 6658168 - DNA, 16 bp, Homo sapiens
atacctccattaaatg

SEQ ID NO: 6658169 - DNA, 17 bp, Homo sapiens
atacctcgaacatcagt

SEQ ID NO: 6658170 - DNA, 17 bp, Homo sapiens
atacctctaactgtgca

SEQ ID NO: 6658171 - DNA, 19 bp, Homo sapiens
atacctctaatagtataaa

SEQ ID NO: 6658172 - DNA, 14 bp, Homo sapiens
atacctctctctat

SEQ ID NO: 6658173 - DNA, 18 bp, Homo sapiens
atacctctctctatatat

SEQ ID NO: 6658174 - DNA, 13 bp, Homo sapiens
atacctctgacca

SEQ ID NO: 6658175 - DNA, 17 bp, Homo sapiens
atacctctgtgtgctcc

SEQ ID NO: 6658176 - DNA, 16 bp, Homo sapiens
atacctcttagctgag

SEQ ID NO: 6658177 - DNA, 19 bp, Homo sapiens
atacctgaatgctctgtag

SEQ ID NO: 6658178 - DNA, 13 bp, Homo sapiens
atacctgagcctc

SEQ ID NO: 6658179 - DNA, 22 bp, Homo sapiens
atacctgattgatcacacagtg

SEQ ID NO: 6658180 - DNA, 16 bp, Homo sapiens
atacctgcacgttcat

SEQ ID NO: 6658181 - DNA, 19 bp, Homo sapiens
atacctgcacgttcataac

SEQ ID NO: 6658182 - DNA, 19 bp, Homo sapiens
atacctgcccctgcctgac

SEQ ID NO: 6658183 - DNA, 13 bp, Homo sapiens
atacctgcctttt

SEQ ID NO: 6658184 - DNA, 17 bp, Homo sapiens
atacctgctatcagcag

SEQ ID NO: 6658185 - DNA, 17 bp, Homo sapiens
atacctggcttttactt

SEQ ID NO: 6658186 - DNA, 18 bp, Homo sapiens
atacctggcttttacttt

SEQ ID NO: 6658187 - DNA, 23 bp, Homo sapiens
atacctggcttttactttattaa

SEQ ID NO: 6658188 - DNA, 19 bp, Homo sapiens
atacctgtacacacacaga

SEQ ID NO: 6658189 - DNA, 20 bp, Homo sapiens
atacctgtacacacacagac

SEQ ID NO: 6658190 - DNA, 12 bp, Homo sapiens
atacctgtcccc

SEQ ID NO: 6658191 - DNA, 17 bp, Homo sapiens
atacctgtccccctgac

SEQ ID NO: 6658192 - DNA, 17 bp, Homo sapiens
atacctgtctcagctgt

SEQ ID NO: 6658193 - DNA, 20 bp, Homo sapiens
atacctgtgtttcttgcctc

SEQ ID NO: 6658194 - DNA, 22 bp, Homo sapiens
atacctgtgtttcttgcctcat

SEQ ID NO: 6658195 - DNA, 22 bp, Homo sapiens
atacctgttcctttttctgggt

SEQ ID NO: 6658196 - DNA, 17 bp, Homo sapiens
atacctgtttaaattgc

SEQ ID NO: 6658197 - DNA, 14 bp, Homo sapiens
ataccttagaaggt

SEQ ID NO: 6658198 - DNA, 15 bp, Homo sapiens
ataccttagagactt

SEQ ID NO: 6658199 - DNA, 19 bp, Homo sapiens
ataccttccatctcaacct

SEQ ID NO: 6658200 - DNA, 20 bp, Homo sapiens
ataccttcggggtacaagtc

SEQ ID NO: 6658201 - DNA, 18 bp, Homo sapiens
ataccttctcccaggcct

SEQ ID NO: 6658202 - DNA, 16 bp, Homo sapiens
ataccttgaaaaagta

SEQ ID NO: 6658203 - DNA, 17 bp, Homo sapiens
ataccttgcaaagcaac

SEQ ID NO: 6658204 - DNA, 15 bp, Homo sapiens
ataccttggactgac

SEQ ID NO: 6658205 - DNA, 14 bp, Homo sapiens
ataccttgtgcatt

SEQ ID NO: 6658206 - DNA, 13 bp, Homo sapiens
atacctttaaata

SEQ ID NO: 6658207 - DNA, 14 bp, Homo sapiens
atacctttaaatat

SEQ ID NO: 6658208 - DNA, 16 bp, Homo sapiens
atacctttaaatatca

SEQ ID NO: 6658209 - DNA, 17 bp, Homo sapiens
atacctttaaatatcat

SEQ ID NO: 6658210 - DNA, 19 bp, Homo sapiens
atacctttcaaagaactcc

SEQ ID NO: 6658211 - DNA, 17 bp, Homo sapiens
atacctttctaagggaa

SEQ ID NO: 6658212 - DNA, 13 bp, Homo sapiens
atacctttgcctg

SEQ ID NO: 6658213 - DNA, 13 bp, Homo sapiens
atacctttgtagt

SEQ ID NO: 6658214 - DNA, 14 bp, Homo sapiens
ataccttttttaga

SEQ ID NO: 6658215 - DNA, 20 bp, Homo sapiens
atacgaaaaagtgattgtga

SEQ ID NO: 6658216 - DNA, 16 bp, Homo sapiens
atacgaaaatcccatg

SEQ ID NO: 6658217 - DNA, 14 bp, Homo sapiens
atacgaaacacaaa

SEQ ID NO: 6658218 - DNA, 15 bp, Homo sapiens
atacgaaataattgt

SEQ ID NO: 6658219 - DNA, 16 bp, Homo sapiens
atacgaaatcagtttc

SEQ ID NO: 6658220 - DNA, 13 bp, Homo sapiens
atacgaacaaaac

SEQ ID NO: 6658221 - DNA, 13 bp, Homo sapiens
atacgactttatt

SEQ ID NO: 6658222 - DNA, 16 bp, Homo sapiens
atacgagagcagaggt

SEQ ID NO: 6658223 - DNA, 17 bp, Homo sapiens
atacgagagcagaggtc

SEQ ID NO: 6658224 - DNA, 15 bp, Homo sapiens
atacgcacgcaccca

SEQ ID NO: 6658225 - DNA, 21 bp, Homo sapiens
atacgcctgtagtcctagcca

SEQ ID NO: 6658226 - DNA, 14 bp, Homo sapiens
atacgcggaggagt

SEQ ID NO: 6658227 - DNA, 14 bp, Homo sapiens
atacgctaataagt

SEQ ID NO: 6658228 - DNA, 18 bp, Homo sapiens
atacggaacactgtcaat

SEQ ID NO: 6658229 - DNA, 19 bp, Homo sapiens
atacggaagtaaacctgaa

SEQ ID NO: 6658230 - DNA, 20 bp, Homo sapiens
atacgggggctgtgactctg

SEQ ID NO: 6658231 - DNA, 22 bp, Homo sapiens
atacggtcaggtttaacatttg

SEQ ID NO: 6658232 - DNA, 15 bp, Homo sapiens
atacggtgggggtag

SEQ ID NO: 6658233 - DNA, 14 bp, Homo sapiens
atacggttgcttca

SEQ ID NO: 6658234 - DNA, 12 bp, Homo sapiens
atacgtaaaaat

SEQ ID NO: 6658235 - DNA, 13 bp, Homo sapiens
atacgtacacatt

SEQ ID NO: 6658236 - DNA, 15 bp, Homo sapiens
atacgtacatacaca

SEQ ID NO: 6658237 - DNA, 18 bp, Homo sapiens
atacgtacatacacacat

SEQ ID NO: 6658238 - DNA, 18 bp, Homo sapiens
atacgtataaatatcagt

SEQ ID NO: 6658239 - DNA, 19 bp, Homo sapiens
atacgtattacaaacaagt

SEQ ID NO: 6658240 - DNA, 14 bp, Homo sapiens
atacgtccaccatg

SEQ ID NO: 6658241 - DNA, 23 bp, Homo sapiens
atacgtctgtgacttatctacca

SEQ ID NO: 6658242 - DNA, 21 bp, Homo sapiens
atacgtgaaaattatttgaaa

SEQ ID NO: 6658243 - DNA, 13 bp, Homo sapiens
atacgtgtagcta

SEQ ID NO: 6658244 - DNA, 13 bp, Homo sapiens
atacgtgtgtgaa

SEQ ID NO: 6658245 - DNA, 21 bp, Homo sapiens
atacgtgttaggaggctgcat

SEQ ID NO: 6658246 - DNA, 13 bp, Homo sapiens
atacgtgttcaaa

SEQ ID NO: 6658247 - DNA, 20 bp, Homo sapiens
atacgtgttcctataaaatc

SEQ ID NO: 6658248 - DNA, 21 bp, Homo sapiens
atacgtgttttgaattgcaaa

SEQ ID NO: 6658249 - DNA, 21 bp, Homo sapiens
atacgtttgtgcagaatctct

SEQ ID NO: 6658250 - DNA, 13 bp, Homo sapiens
atacgttttgaca

SEQ ID NO: 6658251 - DNA, 21 bp, Homo sapiens
atactaaaagttcttctccaa

SEQ ID NO: 6658252 - DNA, 15 bp, Homo sapiens
atactaaataaaaca

SEQ ID NO: 6658253 - DNA, 16 bp, Homo sapiens
atactaaataaaacaa

SEQ ID NO: 6658254 - DNA, 13 bp, Homo sapiens
atactaaatatga

SEQ ID NO: 6658255 - DNA, 13 bp, Homo sapiens
atactaaccagca

SEQ ID NO: 6658256 - DNA, 19 bp, Homo sapiens
atactaaccagcagaaatg

SEQ ID NO: 6658257 - DNA, 20 bp, Homo sapiens
atactaaccagcagaaatgc

SEQ ID NO: 6658258 - DNA, 21 bp, Homo sapiens
atactaaccagcagaaatgcc

SEQ ID NO: 6658259 - DNA, 14 bp, Homo sapiens
atactaagaaaaga

SEQ ID NO: 6658260 - DNA, 21 bp, Homo sapiens
atactaagaccctaattcttt

SEQ ID NO: 6658261 - DNA, 22 bp, Homo sapiens
atactaagtcctcagagctcca

SEQ ID NO: 6658262 - DNA, 13 bp, Homo sapiens
atactaataaaaa

SEQ ID NO: 6658263 - DNA, 13 bp, Homo sapiens
atactaataaaat

SEQ ID NO: 6658264 - DNA, 16 bp, Homo sapiens
atactaataaaataca

SEQ ID NO: 6658265 - DNA, 18 bp, Homo sapiens
atactaataaactaataa

SEQ ID NO: 6658266 - DNA, 16 bp, Homo sapiens
atactaataaatataa

SEQ ID NO: 6658267 - DNA, 19 bp, Homo sapiens
atactaataaatataattt

SEQ ID NO: 6658268 - DNA, 23 bp, Homo sapiens
atactaataaatataatttataa

SEQ ID NO: 6658269 - DNA, 23 bp, Homo sapiens
atactaatgatgagcatttagca

SEQ ID NO: 6658270 - DNA, 22 bp, Homo sapiens
atactaattttccataagctat

SEQ ID NO: 6658271 - DNA, 15 bp, Homo sapiens
atactacagtttgtt

SEQ ID NO: 6658272 - DNA, 16 bp, Homo sapiens
atactacagtttgtta

SEQ ID NO: 6658273 - DNA, 16 bp, Homo sapiens
atactacatctttaaa

SEQ ID NO: 6658274 - DNA, 16 bp, Homo sapiens
atactacatttgaaca

SEQ ID NO: 6658275 - DNA, 22 bp, Homo sapiens
atactacatttgaacagggcaa

SEQ ID NO: 6658276 - DNA, 16 bp, Homo sapiens
atactacccatagaaa

SEQ ID NO: 6658277 - DNA, 14 bp, Homo sapiens
atactacctagaag

SEQ ID NO: 6658278 - DNA, 11 bp, Homo sapiens
atactacctct

SEQ ID NO: 6658279 - DNA, 17 bp, Homo sapiens
atactaccttgaaaata

SEQ ID NO: 6658280 - DNA, 18 bp, Homo sapiens
atactactgaaacagatt

SEQ ID NO: 6658281 - DNA, 21 bp, Homo sapiens
atactactgaaacagatttca

SEQ ID NO: 6658282 - DNA, 17 bp, Homo sapiens
atactactgtaaatgta

SEQ ID NO: 6658283 - DNA, 12 bp, Homo sapiens
atactacttatg

SEQ ID NO: 6658284 - DNA, 14 bp, Homo sapiens
atactactttctct

SEQ ID NO: 6658285 - DNA, 15 bp, Homo sapiens
atactactttctctt

SEQ ID NO: 6658286 - DNA, 19 bp, Homo sapiens
atactagaatcagatacaa

SEQ ID NO: 6658287 - DNA, 16 bp, Homo sapiens
atactagccccccagt

SEQ ID NO: 6658288 - DNA, 18 bp, Homo sapiens
atactaggatacagaaat

SEQ ID NO: 6658289 - DNA, 20 bp, Homo sapiens
atactaggatacagaaatgc

SEQ ID NO: 6658290 - DNA, 20 bp, Homo sapiens
atactagggagccatttgag

SEQ ID NO: 6658291 - DNA, 20 bp, Homo sapiens
atactaggttaacatttgta

SEQ ID NO: 6658292 - DNA, 13 bp, Homo sapiens
atactagttgtga

SEQ ID NO: 6658293 - DNA, 14 bp, Homo sapiens
atactagttgtgac

SEQ ID NO: 6658294 - DNA, 14 bp, Homo sapiens
atactataattgta

SEQ ID NO: 6658295 - DNA, 16 bp, Homo sapiens
atactataattgtaaa

SEQ ID NO: 6658296 - DNA, 17 bp, Homo sapiens
atactatagattcttta

SEQ ID NO: 6658297 - DNA, 19 bp, Homo sapiens
atactatagttatatagat

SEQ ID NO: 6658298 - DNA, 14 bp, Homo sapiens
atactatatgaaaa

SEQ ID NO: 6658299 - DNA, 15 bp, Homo sapiens
atactatatgataaa

SEQ ID NO: 6658300 - DNA, 14 bp, Homo sapiens
atactatatttatg

SEQ ID NO: 6658301 - DNA, 14 bp, Homo sapiens
atactatccaaata

SEQ ID NO: 6658302 - DNA, 17 bp, Homo sapiens
atactatgaaataaaaa

SEQ ID NO: 6658303 - DNA, 13 bp, Homo sapiens
atactatgcagta

SEQ ID NO: 6658304 - DNA, 18 bp, Homo sapiens
atactatgcagtatctct

SEQ ID NO: 6658305 - DNA, 17 bp, Homo sapiens
atactatggaatttctc

SEQ ID NO: 6658306 - DNA, 23 bp, Homo sapiens
atactatgtggatgtgacagtgg

SEQ ID NO: 6658307 - DNA, 18 bp, Homo sapiens
atactattaaacatgctg

SEQ ID NO: 6658308 - DNA, 19 bp, Homo sapiens
atactattaagcaagaatg

SEQ ID NO: 6658309 - DNA, 17 bp, Homo sapiens
atactattcaatgcaat

SEQ ID NO: 6658310 - DNA, 14 bp, Homo sapiens
atactattgcctca

SEQ ID NO: 6658311 - DNA, 22 bp, Homo sapiens
atactattggacagacacagag

SEQ ID NO: 6658312 - DNA, 21 bp, Homo sapiens
atactatttaaagcctcctca

SEQ ID NO: 6658313 - DNA, 13 bp, Homo sapiens
atactatttaaga

SEQ ID NO: 6658314 - DNA, 12 bp, Homo sapiens
atactatttaga

SEQ ID NO: 6658315 - DNA, 13 bp, Homo sapiens
atactatttagat

SEQ ID NO: 6658316 - DNA, 21 bp, Homo sapiens
atactatttagataacaagaa

SEQ ID NO: 6658317 - DNA, 16 bp, Homo sapiens
atactatttattaaaa

SEQ ID NO: 6658318 - DNA, 20 bp, Homo sapiens
atactatttttactgccact

SEQ ID NO: 6658319 - DNA, 22 bp, Homo sapiens
atactcaaagaggccagtactt

SEQ ID NO: 6658320 - DNA, 23 bp, Homo sapiens
atactcaagagcataatggtaaa

SEQ ID NO: 6658321 - DNA, 14 bp, Homo sapiens
atactcaagcaggt

SEQ ID NO: 6658322 - DNA, 15 bp, Homo sapiens
atactcaccaaaata

SEQ ID NO: 6658323 - DNA, 17 bp, Homo sapiens
atactcaccaaaatata

SEQ ID NO: 6658324 - DNA, 14 bp, Homo sapiens
atactcagaactgt

SEQ ID NO: 6658325 - DNA, 21 bp, Homo sapiens
atactcagaactgtcccatcc

SEQ ID NO: 6658326 - DNA, 13 bp, Homo sapiens
atactcagcctgc

SEQ ID NO: 6658327 - DNA, 15 bp, Homo sapiens
atactcagcctgctg

SEQ ID NO: 6658328 - DNA, 20 bp, Homo sapiens
atactcagcctgctgcccag

SEQ ID NO: 6658329 - DNA, 16 bp, Homo sapiens
atactcataatgtgaa

SEQ ID NO: 6658330 - DNA, 19 bp, Homo sapiens
atactcataatgtgaagtg

SEQ ID NO: 6658331 - DNA, 17 bp, Homo sapiens
atactcatcagagcagc

SEQ ID NO: 6658332 - DNA, 12 bp, Homo sapiens
atactcatgaat

SEQ ID NO: 6658333 - DNA, 19 bp, Homo sapiens
atactcatgaatgaaaata

SEQ ID NO: 6658334 - DNA, 21 bp, Homo sapiens
atactcatgaccattagaata

SEQ ID NO: 6658335 - DNA, 11 bp, Homo sapiens
atactcatgtg

SEQ ID NO: 6658336 - DNA, 14 bp, Homo sapiens
atactcatgtgcaa

SEQ ID NO: 6658337 - DNA, 16 bp, Homo sapiens
atactcattaggatgg

SEQ ID NO: 6658338 - DNA, 14 bp, Homo sapiens
atactcatttctaa

SEQ ID NO: 6658339 - DNA, 20 bp, Homo sapiens
atactcatttctaaaagaat

SEQ ID NO: 6658340 - DNA, 22 bp, Homo sapiens
atactcatttctaaaagaatat

SEQ ID NO: 6658341 - DNA, 14 bp, Homo sapiens
atactcatttctta

SEQ ID NO: 6658342 - DNA, 14 bp, Homo sapiens
atactcatttggat

SEQ ID NO: 6658343 - DNA, 22 bp, Homo sapiens
atactcatttggatataaatct

SEQ ID NO: 6658344 - DNA, 16 bp, Homo sapiens
atactcatttttcatt

SEQ ID NO: 6658345 - DNA, 14 bp, Homo sapiens
atactccaaagatg

SEQ ID NO: 6658346 - DNA, 21 bp, Homo sapiens
atactccaagcttcaagtgat

SEQ ID NO: 6658347 - DNA, 22 bp, Homo sapiens
atactccaaggtggcatagcca

SEQ ID NO: 6658348 - DNA, 19 bp, Homo sapiens
atactccaccagtgaaaat

SEQ ID NO: 6658349 - DNA, 21 bp, Homo sapiens
atactccaccagtgaaaattg

SEQ ID NO: 6658350 - DNA, 15 bp, Homo sapiens
atactccatacataa

SEQ ID NO: 6658351 - DNA, 19 bp, Homo sapiens
atactccatagaaactaaa

SEQ ID NO: 6658352 - DNA, 19 bp, Homo sapiens
atactccatggggtggggg

SEQ ID NO: 6658353 - DNA, 11 bp, Homo sapiens
atactcccatc

SEQ ID NO: 6658354 - DNA, 15 bp, Homo sapiens
atactccctttaaag

SEQ ID NO: 6658355 - DNA, 16 bp, Homo sapiens
atactccctttaaaga

SEQ ID NO: 6658356 - DNA, 16 bp, Homo sapiens
atactcctatgcttta

SEQ ID NO: 6658357 - DNA, 22 bp, Homo sapiens
atactcctgtcacctagaacgt

SEQ ID NO: 6658358 - DNA, 16 bp, Homo sapiens
atactccttaaaaatg

SEQ ID NO: 6658359 - DNA, 17 bp, Homo sapiens
atactccttaaaaatgt

SEQ ID NO: 6658360 - DNA, 19 bp, Homo sapiens
atactccttgcttcctgat

SEQ ID NO: 6658361 - DNA, 22 bp, Homo sapiens
atactcgttattcatacaaata

SEQ ID NO: 6658362 - DNA, 15 bp, Homo sapiens
atactctaattctaa

SEQ ID NO: 6658363 - DNA, 17 bp, Homo sapiens
atactctagaacatgca

SEQ ID NO: 6658364 - DNA, 22 bp, Homo sapiens
atactctagattttgttttgct

SEQ ID NO: 6658365 - DNA, 16 bp, Homo sapiens
atactctctgaaatat

SEQ ID NO: 6658366 - DNA, 17 bp, Homo sapiens
atactctctgaaatata

SEQ ID NO: 6658367 - DNA, 15 bp, Homo sapiens
atactctctgagtac

SEQ ID NO: 6658368 - DNA, 18 bp, Homo sapiens
atactctctgcctggtgg

SEQ ID NO: 6658369 - DNA, 13 bp, Homo sapiens
atactctcttccc

SEQ ID NO: 6658370 - DNA, 14 bp, Homo sapiens
atactctcttccct

SEQ ID NO: 6658371 - DNA, 21 bp, Homo sapiens
atactctgccgatctaattac

SEQ ID NO: 6658372 - DNA, 14 bp, Homo sapiens
atactctgtcagat

SEQ ID NO: 6658373 - DNA, 15 bp, Homo sapiens
atactctgtcagatg

SEQ ID NO: 6658374 - DNA, 22 bp, Homo sapiens
atactctgttgcctcctctctc

SEQ ID NO: 6658375 - DNA, 16 bp, Homo sapiens
atactctgttgtacta

SEQ ID NO: 6658376 - DNA, 17 bp, Homo sapiens
atactcttaagtgtaaa

SEQ ID NO: 6658377 - DNA, 22 bp, Homo sapiens
atactcttaagtgtaaataata

SEQ ID NO: 6658378 - DNA, 19 bp, Homo sapiens
atactcttaggaagagaaa

SEQ ID NO: 6658379 - DNA, 18 bp, Homo sapiens
atactcttatagacaaca

SEQ ID NO: 6658380 - DNA, 14 bp, Homo sapiens
atactcttctaaaa

SEQ ID NO: 6658381 - DNA, 16 bp, Homo sapiens
atactcttgaaatgta

SEQ ID NO: 6658382 - DNA, 19 bp, Homo sapiens
atactctttcaataaatgt

SEQ ID NO: 6658383 - DNA, 14 bp, Homo sapiens
atactctttctgta

SEQ ID NO: 6658384 - DNA, 16 bp, Homo sapiens
atactctttctgtata

SEQ ID NO: 6658385 - DNA, 15 bp, Homo sapiens
atactctttgtcttt

SEQ ID NO: 6658386 - DNA, 23 bp, Homo sapiens
atactgaaaaaaaattcctttca

SEQ ID NO: 6658387 - DNA, 17 bp, Homo sapiens
atactgaaaaaatgctg

SEQ ID NO: 6658388 - DNA, 22 bp, Homo sapiens
atactgaaaaaatgctgagcca

SEQ ID NO: 6658389 - DNA, 15 bp, Homo sapiens
atactgaaaaataca

SEQ ID NO: 6658390 - DNA, 23 bp, Homo sapiens
atactgaaaatccaataatcaga

SEQ ID NO: 6658391 - DNA, 15 bp, Homo sapiens
atactgaaacatttg

SEQ ID NO: 6658392 - DNA, 23 bp, Homo sapiens
atactgaaacatttgacacataa

SEQ ID NO: 6658393 - DNA, 17 bp, Homo sapiens
atactgaaagatctctg

SEQ ID NO: 6658394 - DNA, 18 bp, Homo sapiens
atactgaaagatctctgt

SEQ ID NO: 6658395 - DNA, 18 bp, Homo sapiens
atactgaaattattttct

SEQ ID NO: 6658396 - DNA, 22 bp, Homo sapiens
atactgaaattattttctccaa

SEQ ID NO: 6658397 - DNA, 18 bp, Homo sapiens
atactgaaccacttgtag

SEQ ID NO: 6658398 - DNA, 15 bp, Homo sapiens
atactgaaggaaaaa

SEQ ID NO: 6658399 - DNA, 22 bp, Homo sapiens
atactgaaggaaaaacacaagc

SEQ ID NO: 6658400 - DNA, 21 bp, Homo sapiens
atactgaagtgcagctcagga

SEQ ID NO: 6658401 - DNA, 17 bp, Homo sapiens
atactgaatgcataaat

SEQ ID NO: 6658402 - DNA, 13 bp, Homo sapiens
atactgaatttct

SEQ ID NO: 6658403 - DNA, 19 bp, Homo sapiens
atactgactgagaatataa

SEQ ID NO: 6658404 - DNA, 22 bp, Homo sapiens
atactgactgctggacataaat

SEQ ID NO: 6658405 - DNA, 16 bp, Homo sapiens
atactgagaaaaagtc

SEQ ID NO: 6658406 - DNA, 17 bp, Homo sapiens
atactgagaatatacaa

SEQ ID NO: 6658407 - DNA, 14 bp, Homo sapiens
atactgagggacca

SEQ ID NO: 6658408 - DNA, 13 bp, Homo sapiens
atactgatgagac

SEQ ID NO: 6658409 - DNA, 16 bp, Homo sapiens
atactgattattgagt

SEQ ID NO: 6658410 - DNA, 14 bp, Homo sapiens
atactgatttaatt

SEQ ID NO: 6658411 - DNA, 14 bp, Homo sapiens
atactgattttcaa

SEQ ID NO: 6658412 - DNA, 15 bp, Homo sapiens
atactgcaactttaa

SEQ ID NO: 6658413 - DNA, 14 bp, Homo sapiens
atactgcaagaaaa

SEQ ID NO: 6658414 - DNA, 16 bp, Homo sapiens
atactgcaagaaaatg

SEQ ID NO: 6658415 - DNA, 17 bp, Homo sapiens
atactgcagggccagga

SEQ ID NO: 6658416 - DNA, 17 bp, Homo sapiens
atactgccagatgctga

SEQ ID NO: 6658417 - DNA, 21 bp, Homo sapiens
atactgccagatgctgatgtt

SEQ ID NO: 6658418 - DNA, 18 bp, Homo sapiens
atactgcctactgttact

SEQ ID NO: 6658419 - DNA, 21 bp, Homo sapiens
atactgcctagaaaatgcaaa

SEQ ID NO: 6658420 - DNA, 15 bp, Homo sapiens
atactgcctccccca

SEQ ID NO: 6658421 - DNA, 20 bp, Homo sapiens
atactgccttgtttaatgtt

SEQ ID NO: 6658422 - DNA, 15 bp, Homo sapiens
atactgctactgtaa

SEQ ID NO: 6658423 - DNA, 19 bp, Homo sapiens
atactgctactgtaatttt

SEQ ID NO: 6658424 - DNA, 18 bp, Homo sapiens
atactgctctataaatag

SEQ ID NO: 6658425 - DNA, 22 bp, Homo sapiens
atactgctctgaatattttgta

SEQ ID NO: 6658426 - DNA, 18 bp, Homo sapiens
atactgctgagatacata

SEQ ID NO: 6658427 - DNA, 14 bp, Homo sapiens
atactgctgatgct

SEQ ID NO: 6658428 - DNA, 21 bp, Homo sapiens
atactgctgatgctgaaataa

SEQ ID NO: 6658429 - DNA, 19 bp, Homo sapiens
atactgcttattttatgat

SEQ ID NO: 6658430 - DNA, 23 bp, Homo sapiens
atactgcttgcttacaatcttta

SEQ ID NO: 6658431 - DNA, 21 bp, Homo sapiens
atactgcttggagctgagcaa

SEQ ID NO: 6658432 - DNA, 23 bp, Homo sapiens
atactgcttgtcatctgcatgtc

SEQ ID NO: 6658433 - DNA, 14 bp, Homo sapiens
atactgcttttgca

SEQ ID NO: 6658434 - DNA, 16 bp, Homo sapiens
atactggaaataacct

SEQ ID NO: 6658435 - DNA, 22 bp, Homo sapiens
atactggaaataacctgtgaat

SEQ ID NO: 6658436 - DNA, 18 bp, Homo sapiens
atactggaagttttgcat

SEQ ID NO: 6658437 - DNA, 20 bp, Homo sapiens
atactggaagttttgcattt

SEQ ID NO: 6658438 - DNA, 17 bp, Homo sapiens
atactggaataatttgt

SEQ ID NO: 6658439 - DNA, 14 bp, Homo sapiens
atactggcctctgt

SEQ ID NO: 6658440 - DNA, 22 bp, Homo sapiens
atactggcctctgtgattacat

SEQ ID NO: 6658441 - DNA, 21 bp, Homo sapiens
atactgggagagaagaggact

SEQ ID NO: 6658442 - DNA, 16 bp, Homo sapiens
atactgggtttcaaga

SEQ ID NO: 6658443 - DNA, 14 bp, Homo sapiens
atactggtctcagg

SEQ ID NO: 6658444 - DNA, 14 bp, Homo sapiens
atactgtaaaagtt

SEQ ID NO: 6658445 - DNA, 16 bp, Homo sapiens
atactgtaaaagttat

SEQ ID NO: 6658446 - DNA, 23 bp, Homo sapiens
atactgtaaaagttataataact

SEQ ID NO: 6658447 - DNA, 12 bp, Homo sapiens
atactgtaacac

SEQ ID NO: 6658448 - DNA, 17 bp, Homo sapiens
atactgtaatcgtgcta

SEQ ID NO: 6658449 - DNA, 14 bp, Homo sapiens
atactgtacacatt

SEQ ID NO: 6658450 - DNA, 20 bp, Homo sapiens
atactgtacacatttcttaa

SEQ ID NO: 6658451 - DNA, 12 bp, Homo sapiens
atactgtacata

SEQ ID NO: 6658452 - DNA, 19 bp, Homo sapiens
atactgtacatgaaagtag

SEQ ID NO: 6658453 - DNA, 23 bp, Homo sapiens
atactgtagaaatattgctctaa

SEQ ID NO: 6658454 - DNA, 12 bp, Homo sapiens
atactgtagaca

SEQ ID NO: 6658455 - DNA, 14 bp, Homo sapiens
atactgtagacact

SEQ ID NO: 6658456 - DNA, 18 bp, Homo sapiens
atactgtagataattaac

SEQ ID NO: 6658457 - DNA, 16 bp, Homo sapiens
atactgtagcaatata

SEQ ID NO: 6658458 - DNA, 23 bp, Homo sapiens
atactgtagcaatatatttgtag

SEQ ID NO: 6658459 - DNA, 21 bp, Homo sapiens
atactgtaggtgttatgtatt

SEQ ID NO: 6658460 - DNA, 18 bp, Homo sapiens
atactgtataagtaacac

SEQ ID NO: 6658461 - DNA, 19 bp, Homo sapiens
atactgtatgccttctgta

SEQ ID NO: 6658462 - DNA, 20 bp, Homo sapiens
atactgtattaagagtgaaa

SEQ ID NO: 6658463 - DNA, 19 bp, Homo sapiens
atactgtattttgtattgt

SEQ ID NO: 6658464 - DNA, 21 bp, Homo sapiens
atactgtcaaacaataaaggg

SEQ ID NO: 6658465 - DNA, 15 bp, Homo sapiens
atactgtcaagccct

SEQ ID NO: 6658466 - DNA, 20 bp, Homo sapiens
atactgtctctccagtgaaa

SEQ ID NO: 6658467 - DNA, 16 bp, Homo sapiens
atactgtctctggagt

SEQ ID NO: 6658468 - DNA, 15 bp, Homo sapiens
atactgtctgggatt

SEQ ID NO: 6658469 - DNA, 23 bp, Homo sapiens
atactgtctgggattaagggcaa

SEQ ID NO: 6658470 - DNA, 13 bp, Homo sapiens
atactgtctgtat

SEQ ID NO: 6658471 - DNA, 16 bp, Homo sapiens
atactgtctgtatctt

SEQ ID NO: 6658472 - DNA, 23 bp, Homo sapiens
atactgtcttacgtttttctggt

SEQ ID NO: 6658473 - DNA, 14 bp, Homo sapiens
atactgtgaagtta

SEQ ID NO: 6658474 - DNA, 13 bp, Homo sapiens
atactgtgcagaa

SEQ ID NO: 6658475 - DNA, 16 bp, Homo sapiens
atactgtgcagaataa

SEQ ID NO: 6658476 - DNA, 16 bp, Homo sapiens
atactgtgcaggcctg

SEQ ID NO: 6658477 - DNA, 17 bp, Homo sapiens
atactgtgctggagcca

SEQ ID NO: 6658478 - DNA, 18 bp, Homo sapiens
atactgtggcctgcagga

SEQ ID NO: 6658479 - DNA, 21 bp, Homo sapiens
atactgtggcctgcaggaggg

SEQ ID NO: 6658480 - DNA, 14 bp, Homo sapiens
atactgtgtatgtt

SEQ ID NO: 6658481 - DNA, 14 bp, Homo sapiens
atactgtgtggaac

SEQ ID NO: 6658482 - DNA, 18 bp, Homo sapiens
atactgtgtgggatactt

SEQ ID NO: 6658483 - DNA, 21 bp, Homo sapiens
atactgtgtgtgagtgtgaat

SEQ ID NO: 6658484 - DNA, 23 bp, Homo sapiens
atactgtgtgttttcccaaagca

SEQ ID NO: 6658485 - DNA, 13 bp, Homo sapiens
atactgttatcca

SEQ ID NO: 6658486 - DNA, 17 bp, Homo sapiens
atactgttgatacaaac

SEQ ID NO: 6658487 - DNA, 22 bp, Homo sapiens
atactgttgatccatctcagtc

SEQ ID NO: 6658488 - DNA, 24 bp, Homo sapiens
atactgttgatccatctcagtcac

SEQ ID NO: 6658489 - DNA, 15 bp, Homo sapiens
atactgtttcactaa

SEQ ID NO: 6658490 - DNA, 12 bp, Homo sapiens
atactgtttctt

SEQ ID NO: 6658491 - DNA, 20 bp, Homo sapiens
atactgtttcttgcactgaa

SEQ ID NO: 6658492 - DNA, 22 bp, Homo sapiens
atactgtttcttgcactgaata

SEQ ID NO: 6658493 - DNA, 13 bp, Homo sapiens
atactgtttgtaa

SEQ ID NO: 6658494 - DNA, 15 bp, Homo sapiens
atactgttttatctc

SEQ ID NO: 6658495 - DNA, 24 bp, Homo sapiens
atactgttttatctccatactttg

SEQ ID NO: 6658496 - DNA, 14 bp, Homo sapiens
atactgttttggaa

SEQ ID NO: 6658497 - DNA, 16 bp, Homo sapiens
atacttaaaatatctc

SEQ ID NO: 6658498 - DNA, 17 bp, Homo sapiens
atacttaaaatatctct

SEQ ID NO: 6658499 - DNA, 21 bp, Homo sapiens
atacttaaaatgacaaagcca

SEQ ID NO: 6658500 - DNA, 15 bp, Homo sapiens
atacttaaacagctt

SEQ ID NO: 6658501 - DNA, 12 bp, Homo sapiens
atacttaaatgt

SEQ ID NO: 6658502 - DNA, 21 bp, Homo sapiens
atacttaaatgttatgtatat

SEQ ID NO: 6658503 - DNA, 20 bp, Homo sapiens
atacttaacaaatacattca

SEQ ID NO: 6658504 - DNA, 22 bp, Homo sapiens
atacttaacaaatacattcaaa

SEQ ID NO: 6658505 - DNA, 12 bp, Homo sapiens
atacttaacatt

SEQ ID NO: 6658506 - DNA, 15 bp, Homo sapiens
atacttaacattgat

SEQ ID NO: 6658507 - DNA, 22 bp, Homo sapiens
atacttaacatttcattgtaca

SEQ ID NO: 6658508 - DNA, 14 bp, Homo sapiens
atacttaagaatac

SEQ ID NO: 6658509 - DNA, 16 bp, Homo sapiens
atacttaagcaaaagt

SEQ ID NO: 6658510 - DNA, 16 bp, Homo sapiens
atacttaatactgaat

SEQ ID NO: 6658511 - DNA, 15 bp, Homo sapiens
atacttaatatgtgg

SEQ ID NO: 6658512 - DNA, 18 bp, Homo sapiens
atacttaatctaagaaac

SEQ ID NO: 6658513 - DNA, 13 bp, Homo sapiens
atacttaatgtgg

SEQ ID NO: 6658514 - DNA, 20 bp, Homo sapiens
atacttacatatctgacttc

SEQ ID NO: 6658515 - DNA, 22 bp, Homo sapiens
atacttacatgtgtgtatatgt

SEQ ID NO: 6658516 - DNA, 14 bp, Homo sapiens
atacttacatttca

SEQ ID NO: 6658517 - DNA, 14 bp, Homo sapiens
atacttacatttcc

SEQ ID NO: 6658518 - DNA, 19 bp, Homo sapiens
atacttacctagtgaaact

SEQ ID NO: 6658519 - DNA, 16 bp, Homo sapiens
atacttactataattt

SEQ ID NO: 6658520 - DNA, 18 bp, Homo sapiens
atacttactgttaactgt

SEQ ID NO: 6658521 - DNA, 22 bp, Homo sapiens
atacttagcaaagttttacctg

SEQ ID NO: 6658522 - DNA, 21 bp, Homo sapiens
atacttagtggtatgtctctt

SEQ ID NO: 6658523 - DNA, 19 bp, Homo sapiens
atacttatatggaaattct

SEQ ID NO: 6658524 - DNA, 14 bp, Homo sapiens
atacttatctatat

SEQ ID NO: 6658525 - DNA, 22 bp, Homo sapiens
atacttatgcaagatatttttg

SEQ ID NO: 6658526 - DNA, 20 bp, Homo sapiens
atacttattattgatgataa

SEQ ID NO: 6658527 - DNA, 14 bp, Homo sapiens
atacttattcattg

SEQ ID NO: 6658528 - DNA, 15 bp, Homo sapiens
atacttattcattgt

SEQ ID NO: 6658529 - DNA, 20 bp, Homo sapiens
atacttatttataacattgt

SEQ ID NO: 6658530 - DNA, 21 bp, Homo sapiens
atacttattttcagtgcatca

SEQ ID NO: 6658531 - DNA, 23 bp, Homo sapiens
atacttattttcagtgcatcatt

SEQ ID NO: 6658532 - DNA, 12 bp, Homo sapiens
atacttcaaaag

SEQ ID NO: 6658533 - DNA, 16 bp, Homo sapiens
atacttcaaaagccat

SEQ ID NO: 6658534 - DNA, 15 bp, Homo sapiens
atacttcatacaaca

SEQ ID NO: 6658535 - DNA, 21 bp, Homo sapiens
atacttcatgagcattcataa

SEQ ID NO: 6658536 - DNA, 21 bp, Homo sapiens
atacttccagcgaaatggtac

SEQ ID NO: 6658537 - DNA, 12 bp, Homo sapiens
atacttcctgga

SEQ ID NO: 6658538 - DNA, 15 bp, Homo sapiens
atacttcctgggtca

SEQ ID NO: 6658539 - DNA, 15 bp, Homo sapiens
atacttcgacactgt

SEQ ID NO: 6658540 - DNA, 17 bp, Homo sapiens
atacttcgatgatgatg

SEQ ID NO: 6658541 - DNA, 18 bp, Homo sapiens
atacttcgatgatgatga

SEQ ID NO: 6658542 - DNA, 15 bp, Homo sapiens
atacttcttgtgtgt

SEQ ID NO: 6658543 - DNA, 18 bp, Homo sapiens
atacttcttgtgtgtatg

SEQ ID NO: 6658544 - DNA, 22 bp, Homo sapiens
atacttctttgttattataaca

SEQ ID NO: 6658545 - DNA, 15 bp, Homo sapiens
atacttgaaaattaa

SEQ ID NO: 6658546 - DNA, 19 bp, Homo sapiens
atacttgaaaccagtattt

SEQ ID NO: 6658547 - DNA, 13 bp, Homo sapiens
atacttgaacaaa

SEQ ID NO: 6658548 - DNA, 14 bp, Homo sapiens
atacttgaacaaaa

SEQ ID NO: 6658549 - DNA, 22 bp, Homo sapiens
atacttgaacaaaagggtcaga

SEQ ID NO: 6658550 - DNA, 20 bp, Homo sapiens
atacttgaaccataaaatgt

SEQ ID NO: 6658551 - DNA, 19 bp, Homo sapiens
atacttgaacgttttctaa

SEQ ID NO: 6658552 - DNA, 21 bp, Homo sapiens
atacttgaacgttttctaatt

SEQ ID NO: 6658553 - DNA, 14 bp, Homo sapiens
atacttgaacttgt

SEQ ID NO: 6658554 - DNA, 20 bp, Homo sapiens
atacttgaagggccagagcc

SEQ ID NO: 6658555 - DNA, 22 bp, Homo sapiens
atacttgaagggccagagccag

SEQ ID NO: 6658556 - DNA, 23 bp, Homo sapiens
atacttgaagggccagagccagg

SEQ ID NO: 6658557 - DNA, 15 bp, Homo sapiens
atacttgaatatgga

SEQ ID NO: 6658558 - DNA, 18 bp, Homo sapiens
atacttgacaacattttt

SEQ ID NO: 6658559 - DNA, 12 bp, Homo sapiens
atacttgactct

SEQ ID NO: 6658560 - DNA, 14 bp, Homo sapiens
atacttgactctaa

SEQ ID NO: 6658561 - DNA, 16 bp, Homo sapiens
atacttgactctaata

SEQ ID NO: 6658562 - DNA, 19 bp, Homo sapiens
atacttgactctaatatga

SEQ ID NO: 6658563 - DNA, 20 bp, Homo sapiens
atacttgactctaatatgat

SEQ ID NO: 6658564 - DNA, 12 bp, Homo sapiens
atacttgagaaa

SEQ ID NO: 6658565 - DNA, 13 bp, Homo sapiens
atacttgagactg

SEQ ID NO: 6658566 - DNA, 16 bp, Homo sapiens
atacttgagtgtgcaa

SEQ ID NO: 6658567 - DNA, 12 bp, Homo sapiens
atacttgatgca

SEQ ID NO: 6658568 - DNA, 14 bp, Homo sapiens
atacttgatgcact

SEQ ID NO: 6658569 - DNA, 19 bp, Homo sapiens
atacttgcaagataatttt

SEQ ID NO: 6658570 - DNA, 20 bp, Homo sapiens
atacttgcaagataattttc

SEQ ID NO: 6658571 - DNA, 14 bp, Homo sapiens
atacttgcagttgt

SEQ ID NO: 6658572 - DNA, 12 bp, Homo sapiens
atacttggattt

SEQ ID NO: 6658573 - DNA, 16 bp, Homo sapiens
atacttggatttagtt

SEQ ID NO: 6658574 - DNA, 13 bp, Homo sapiens
atacttggtcctt

SEQ ID NO: 6658575 - DNA, 12 bp, Homo sapiens
atacttgtaact

SEQ ID NO: 6658576 - DNA, 13 bp, Homo sapiens
atacttgtaactt

SEQ ID NO: 6658577 - DNA, 15 bp, Homo sapiens
atacttgtaactttt

SEQ ID NO: 6658578 - DNA, 15 bp, Homo sapiens
atacttgtaattatg

SEQ ID NO: 6658579 - DNA, 17 bp, Homo sapiens
atacttgtaattatgga

SEQ ID NO: 6658580 - DNA, 13 bp, Homo sapiens
atacttgtctgtt

SEQ ID NO: 6658581 - DNA, 13 bp, Homo sapiens
atacttgtgaaac

SEQ ID NO: 6658582 - DNA, 17 bp, Homo sapiens
atacttgtggttttcaa

SEQ ID NO: 6658583 - DNA, 15 bp, Homo sapiens
atactttaattttta

SEQ ID NO: 6658584 - DNA, 12 bp, Homo sapiens
atactttacatg

SEQ ID NO: 6658585 - DNA, 14 bp, Homo sapiens
atactttacttttt

SEQ ID NO: 6658586 - DNA, 17 bp, Homo sapiens
atactttactttttcca

SEQ ID NO: 6658587 - DNA, 15 bp, Homo sapiens
atactttatatctgt

SEQ ID NO: 6658588 - DNA, 16 bp, Homo sapiens
atactttatatctgta

SEQ ID NO: 6658589 - DNA, 17 bp, Homo sapiens
atactttatgagcagca

SEQ ID NO: 6658590 - DNA, 13 bp, Homo sapiens
atactttattgaa

SEQ ID NO: 6658591 - DNA, 13 bp, Homo sapiens
atactttatttct

SEQ ID NO: 6658592 - DNA, 22 bp, Homo sapiens
atactttccctaccctctagag

SEQ ID NO: 6658593 - DNA, 24 bp, Homo sapiens
atactttccctaccctctagagaa

SEQ ID NO: 6658594 - DNA, 22 bp, Homo sapiens
atactttcggagaaattctctt

SEQ ID NO: 6658595 - DNA, 21 bp, Homo sapiens
atactttctaaatgcctttga

SEQ ID NO: 6658596 - DNA, 11 bp, Homo sapiens
atactttctca

SEQ ID NO: 6658597 - DNA, 13 bp, Homo sapiens
atactttctcaca

SEQ ID NO: 6658598 - DNA, 22 bp, Homo sapiens
atactttcttttattaatatat

SEQ ID NO: 6658599 - DNA, 23 bp, Homo sapiens
atactttcttttattaatatatg

SEQ ID NO: 6658600 - DNA, 13 bp, Homo sapiens
atactttgaagtg

SEQ ID NO: 6658601 - DNA, 12 bp, Homo sapiens
atactttgaatg

SEQ ID NO: 6658602 - DNA, 19 bp, Homo sapiens
atactttgaatgtgtttca

SEQ ID NO: 6658603 - DNA, 20 bp, Homo sapiens
atactttgaatgtgtttcac

SEQ ID NO: 6658604 - DNA, 23 bp, Homo sapiens
atactttgacaaggaaaatctat

SEQ ID NO: 6658605 - DNA, 14 bp, Homo sapiens
atactttgagtaaa

SEQ ID NO: 6658606 - DNA, 22 bp, Homo sapiens
atactttgcagcacagctgaga

SEQ ID NO: 6658607 - DNA, 16 bp, Homo sapiens
atactttgcattgtct

SEQ ID NO: 6658608 - DNA, 15 bp, Homo sapiens
atactttgcttcata

SEQ ID NO: 6658609 - DNA, 9 bp, Homo sapiens
atactttgt

SEQ ID NO: 6658610 - DNA, 17 bp, Homo sapiens
atactttgtattttgat

SEQ ID NO: 6658611 - DNA, 16 bp, Homo sapiens
atactttgtctttctg

SEQ ID NO: 6658612 - DNA, 22 bp, Homo sapiens
atactttgtctttctgcagaaa

SEQ ID NO: 6658613 - DNA, 23 bp, Homo sapiens
atactttgtctttctgcagaaaa

SEQ ID NO: 6658614 - DNA, 16 bp, Homo sapiens
atactttgtggaccaa

SEQ ID NO: 6658615 - DNA, 24 bp, Homo sapiens
atactttgtggaccaattattgat

SEQ ID NO: 6658616 - DNA, 14 bp, Homo sapiens
atactttgtgtctt

SEQ ID NO: 6658617 - DNA, 23 bp, Homo sapiens
atactttgtgtcttttgttctct

SEQ ID NO: 6658618 - DNA, 16 bp, Homo sapiens
atactttgttctgttg

SEQ ID NO: 6658619 - DNA, 17 bp, Homo sapiens
atactttgttctgttgt

SEQ ID NO: 6658620 - DNA, 19 bp, Homo sapiens
atactttgttctgttgtct

SEQ ID NO: 6658621 - DNA, 20 bp, Homo sapiens
atactttgttctgttgtctg

SEQ ID NO: 6658622 - DNA, 11 bp, Homo sapiens
atactttgttg

SEQ ID NO: 6658623 - DNA, 13 bp, Homo sapiens
atactttgttgtt

SEQ ID NO: 6658624 - DNA, 14 bp, Homo sapiens
atactttgttgttt

SEQ ID NO: 6658625 - DNA, 20 bp, Homo sapiens
atacttttactctgcctaca

SEQ ID NO: 6658626 - DNA, 21 bp, Homo sapiens
atacttttcccctgttaaaca

SEQ ID NO: 6658627 - DNA, 13 bp, Homo sapiens
atacttttcctta

SEQ ID NO: 6658628 - DNA, 23 bp, Homo sapiens
atacttttgataatagataactg

SEQ ID NO: 6658629 - DNA, 23 bp, Homo sapiens
atacttttgatatgattgtaaca

SEQ ID NO: 6658630 - DNA, 11 bp, Homo sapiens
atacttttgca

SEQ ID NO: 6658631 - DNA, 16 bp, Homo sapiens
atacttttgcattttt

SEQ ID NO: 6658632 - DNA, 16 bp, Homo sapiens
atacttttgccctttg

SEQ ID NO: 6658633 - DNA, 19 bp, Homo sapiens
atacttttgtgtattctgt

SEQ ID NO: 6658634 - DNA, 19 bp, Homo sapiens
atactttttaaatgtaaag

SEQ ID NO: 6658635 - DNA, 13 bp, Homo sapiens
atactttttacaa

SEQ ID NO: 6658636 - DNA, 20 bp, Homo sapiens
atactttttacaattaaaaa

SEQ ID NO: 6658637 - DNA, 18 bp, Homo sapiens
atactttttcatgaaaat

SEQ ID NO: 6658638 - DNA, 22 bp, Homo sapiens
atacttttttttttgaggcaga

SEQ ID NO: 6658639 - DNA, 15 bp, Homo sapiens
atagaaaaaaaatct

SEQ ID NO: 6658640 - DNA, 15 bp, Homo sapiens
atagaaaaaaagaaa

SEQ ID NO: 6658641 - DNA, 18 bp, Homo sapiens
atagaaaaaaagaaatta

SEQ ID NO: 6658642 - DNA, 19 bp, Homo sapiens
atagaaaaatgtataaaaa

SEQ ID NO: 6658643 - DNA, 23 bp, Homo sapiens
atagaaaacaggaaaaaaacttt

SEQ ID NO: 6658644 - DNA, 23 bp, Homo sapiens
atagaaaacctaattaaggaagt

SEQ ID NO: 6658645 - DNA, 18 bp, Homo sapiens
atagaaaactaatctaaa

SEQ ID NO: 6658646 - DNA, 15 bp, Homo sapiens
atagaaaagatgaga

SEQ ID NO: 6658647 - DNA, 18 bp, Homo sapiens
atagaaaagcacttgaag

SEQ ID NO: 6658648 - DNA, 11 bp, Homo sapiens
atagaaaagtc

SEQ ID NO: 6658649 - DNA, 13 bp, Homo sapiens
atagaaaagttat

SEQ ID NO: 6658650 - DNA, 15 bp, Homo sapiens
atagaaaagttatta

SEQ ID NO: 6658651 - DNA, 18 bp, Homo sapiens
atagaaaataaaataaat

SEQ ID NO: 6658652 - DNA, 19 bp, Homo sapiens
atagaaaataaaataaatt

SEQ ID NO: 6658653 - DNA, 21 bp, Homo sapiens
atagaaaataaaataaattat

SEQ ID NO: 6658654 - DNA, 17 bp, Homo sapiens
atagaaaatccttcagc

SEQ ID NO: 6658655 - DNA, 19 bp, Homo sapiens
atagaaaatggaaaatata

SEQ ID NO: 6658656 - DNA, 22 bp, Homo sapiens
atagaaaatggaaaatatacaa

SEQ ID NO: 6658657 - DNA, 13 bp, Homo sapiens
atagaaaattctt

SEQ ID NO: 6658658 - DNA, 13 bp, Homo sapiens
atagaaacatgac

SEQ ID NO: 6658659 - DNA, 14 bp, Homo sapiens
atagaaacatgaca

SEQ ID NO: 6658660 - DNA, 21 bp, Homo sapiens
atagaaacatgacactgacct

SEQ ID NO: 6658661 - DNA, 12 bp, Homo sapiens
atagaaagacat

SEQ ID NO: 6658662 - DNA, 12 bp, Homo sapiens
atagaaagcaaa

SEQ ID NO: 6658663 - DNA, 17 bp, Homo sapiens
atagaaagcaaacatgt

SEQ ID NO: 6658664 - DNA, 18 bp, Homo sapiens
atagaaagcactactgca

SEQ ID NO: 6658665 - DNA, 12 bp, Homo sapiens
atagaaagctat

SEQ ID NO: 6658666 - DNA, 13 bp, Homo sapiens
atagaaaggaaca

SEQ ID NO: 6658667 - DNA, 19 bp, Homo sapiens
atagaaagtgccagaaagt

SEQ ID NO: 6658668 - DNA, 22 bp, Homo sapiens
atagaaagtgttctgttacaaa

SEQ ID NO: 6658669 - DNA, 20 bp, Homo sapiens
atagaaagttgatattcaac

SEQ ID NO: 6658670 - DNA, 22 bp, Homo sapiens
atagaaataaaggatgtgattg

SEQ ID NO: 6658671 - DNA, 13 bp, Homo sapiens
atagaaataaatt

SEQ ID NO: 6658672 - DNA, 19 bp, Homo sapiens
atagaaataagtggttatt

SEQ ID NO: 6658673 - DNA, 18 bp, Homo sapiens
atagaaatacctcattcg

SEQ ID NO: 6658674 - DNA, 20 bp, Homo sapiens
atagaaatatagccaaaaat

SEQ ID NO: 6658675 - DNA, 18 bp, Homo sapiens
atagaaatatatacgaac

SEQ ID NO: 6658676 - DNA, 12 bp, Homo sapiens
atagaaatgcca

SEQ ID NO: 6658677 - DNA, 17 bp, Homo sapiens
atagaaatgccaagcac

SEQ ID NO: 6658678 - DNA, 19 bp, Homo sapiens
atagaaatgccaagcactt

SEQ ID NO: 6658679 - DNA, 23 bp, Homo sapiens
atagaaatggaaattttgctatc

SEQ ID NO: 6658680 - DNA, 15 bp, Homo sapiens
atagaaatgtaggtc

SEQ ID NO: 6658681 - DNA, 17 bp, Homo sapiens
atagaaattctgaattt

SEQ ID NO: 6658682 - DNA, 16 bp, Homo sapiens
atagaaatttccagag

SEQ ID NO: 6658683 - DNA, 18 bp, Homo sapiens
atagaaatttgcccctgg

SEQ ID NO: 6658684 - DNA, 18 bp, Homo sapiens
atagaacaacatatacaa

SEQ ID NO: 6658685 - DNA, 15 bp, Homo sapiens
atagaacaagatgca

SEQ ID NO: 6658686 - DNA, 19 bp, Homo sapiens
atagaacacaaaacttgaa

SEQ ID NO: 6658687 - DNA, 16 bp, Homo sapiens
atagaacactgatgga

SEQ ID NO: 6658688 - DNA, 16 bp, Homo sapiens
atagaacactgcctct

SEQ ID NO: 6658689 - DNA, 13 bp, Homo sapiens
atagaacagtgct

SEQ ID NO: 6658690 - DNA, 17 bp, Homo sapiens
atagaacattgatctgt

SEQ ID NO: 6658691 - DNA, 14 bp, Homo sapiens
atagaacctctttg

SEQ ID NO: 6658692 - DNA, 21 bp, Homo sapiens
atagaactcagttttaactag

SEQ ID NO: 6658693 - DNA, 18 bp, Homo sapiens
atagaactctgaaatgaa

SEQ ID NO: 6658694 - DNA, 15 bp, Homo sapiens
atagaactgggtaaa

SEQ ID NO: 6658695 - DNA, 16 bp, Homo sapiens
atagaactgggtaaat

SEQ ID NO: 6658696 - DNA, 19 bp, Homo sapiens
atagaactgggtaaatgca

SEQ ID NO: 6658697 - DNA, 16 bp, Homo sapiens
atagaactgtactgtt

SEQ ID NO: 6658698 - DNA, 21 bp, Homo sapiens
atagaactgtcccacaaaata

SEQ ID NO: 6658699 - DNA, 19 bp, Homo sapiens
atagaactttgccagtctt

SEQ ID NO: 6658700 - DNA, 22 bp, Homo sapiens
atagaactttgccagtctttaa

SEQ ID NO: 6658701 - DNA, 12 bp, Homo sapiens
atagaagaaaga

SEQ ID NO: 6658702 - DNA, 16 bp, Homo sapiens
atagaagaacagcaga

SEQ ID NO: 6658703 - DNA, 19 bp, Homo sapiens
atagaagaactgcaaaggt

SEQ ID NO: 6658704 - DNA, 12 bp, Homo sapiens
atagaagaagag

SEQ ID NO: 6658705 - DNA, 15 bp, Homo sapiens
atagaagaaggactg

SEQ ID NO: 6658706 - DNA, 19 bp, Homo sapiens
atagaagaaggactgaaga

SEQ ID NO: 6658707 - DNA, 15 bp, Homo sapiens
atagaagagtttaaa

SEQ ID NO: 6658708 - DNA, 14 bp, Homo sapiens
atagaagatgtttg

SEQ ID NO: 6658709 - DNA, 14 bp, Homo sapiens
atagaagattgttg

SEQ ID NO: 6658710 - DNA, 14 bp, Homo sapiens
atagaaggaaacta

SEQ ID NO: 6658711 - DNA, 16 bp, Homo sapiens
atagaaggaagtgtgt

SEQ ID NO: 6658712 - DNA, 16 bp, Homo sapiens
atagaaggaatttgta

SEQ ID NO: 6658713 - DNA, 17 bp, Homo sapiens
atagaaggaatttgtac

SEQ ID NO: 6658714 - DNA, 20 bp, Homo sapiens
atagaaggaatttgtacttc

SEQ ID NO: 6658715 - DNA, 16 bp, Homo sapiens
atagaaggaggagagg

SEQ ID NO: 6658716 - DNA, 19 bp, Homo sapiens
atagaaggctatggggata

SEQ ID NO: 6658717 - DNA, 13 bp, Homo sapiens
atagaaggtgatg

SEQ ID NO: 6658718 - DNA, 13 bp, Homo sapiens
atagaagtaaaaa

SEQ ID NO: 6658719 - DNA, 13 bp, Homo sapiens
atagaagtcttca

SEQ ID NO: 6658720 - DNA, 19 bp, Homo sapiens
atagaagtcttcatgaaat

SEQ ID NO: 6658721 - DNA, 22 bp, Homo sapiens
atagaagtggtgttttttttcc

SEQ ID NO: 6658722 - DNA, 14 bp, Homo sapiens
atagaagtttagat

SEQ ID NO: 6658723 - DNA, 23 bp, Homo sapiens
atagaagtttgtccatttgtaaa

SEQ ID NO: 6658724 - DNA, 16 bp, Homo sapiens
atagaagttttaaatt

SEQ ID NO: 6658725 - DNA, 13 bp, Homo sapiens
atagaataaaagc

SEQ ID NO: 6658726 - DNA, 12 bp, Homo sapiens
atagaataaagg

SEQ ID NO: 6658727 - DNA, 20 bp, Homo sapiens
atagaataaaggcagttttc

SEQ ID NO: 6658728 - DNA, 22 bp, Homo sapiens
atagaataaaggcagttttcta

SEQ ID NO: 6658729 - DNA, 19 bp, Homo sapiens
atagaataatgaagatctt

SEQ ID NO: 6658730 - DNA, 12 bp, Homo sapiens
atagaatacatt

SEQ ID NO: 6658731 - DNA, 20 bp, Homo sapiens
atagaatagcacagccagac

SEQ ID NO: 6658732 - DNA, 13 bp, Homo sapiens
atagaatagcatg

SEQ ID NO: 6658733 - DNA, 20 bp, Homo sapiens
atagaataggcactttaaaa

SEQ ID NO: 6658734 - DNA, 13 bp, Homo sapiens
atagaatatagca

SEQ ID NO: 6658735 - DNA, 15 bp, Homo sapiens
atagaatatagcatc

SEQ ID NO: 6658736 - DNA, 20 bp, Homo sapiens
atagaatatagcatctttca

SEQ ID NO: 6658737 - DNA, 22 bp, Homo sapiens
atagaatatagcatctttcata

SEQ ID NO: 6658738 - DNA, 23 bp, Homo sapiens
atagaatatggacttaaatgtta

SEQ ID NO: 6658739 - DNA, 12 bp, Homo sapiens
atagaatattta

SEQ ID NO: 6658740 - DNA, 22 bp, Homo sapiens
atagaatctactttaatttatt

SEQ ID NO: 6658741 - DNA, 17 bp, Homo sapiens
atagaatgaaaagttta

SEQ ID NO: 6658742 - DNA, 18 bp, Homo sapiens
atagaatgatgttttaaa

SEQ ID NO: 6658743 - DNA, 13 bp, Homo sapiens
atagaatgctgca

SEQ ID NO: 6658744 - DNA, 15 bp, Homo sapiens
atagaatgtaaatgt

SEQ ID NO: 6658745 - DNA, 21 bp, Homo sapiens
atagaatgtggccacttattt

SEQ ID NO: 6658746 - DNA, 16 bp, Homo sapiens
atagaatgttactttg

SEQ ID NO: 6658747 - DNA, 13 bp, Homo sapiens
atagaattagctt

SEQ ID NO: 6658748 - DNA, 20 bp, Homo sapiens
atagaattagctttttcatc

SEQ ID NO: 6658749 - DNA, 22 bp, Homo sapiens
atagaattataactggaaagaa

SEQ ID NO: 6658750 - DNA, 22 bp, Homo sapiens
atagaattatttcacaaataat

SEQ ID NO: 6658751 - DNA, 16 bp, Homo sapiens
atagaattcacaatgc

SEQ ID NO: 6658752 - DNA, 16 bp, Homo sapiens
atagaattctagcttt

SEQ ID NO: 6658753 - DNA, 22 bp, Homo sapiens
atagaattgacattgaaatcta

SEQ ID NO: 6658754 - DNA, 20 bp, Homo sapiens
atagaattgcaattttaaca

SEQ ID NO: 6658755 - DNA, 13 bp, Homo sapiens
atagaattgcagt

SEQ ID NO: 6658756 - DNA, 15 bp, Homo sapiens
atagaattgtagact

SEQ ID NO: 6658757 - DNA, 22 bp, Homo sapiens
atagaattgtagactgatgttt

SEQ ID NO: 6658758 - DNA, 21 bp, Homo sapiens
atagaatttcctgtaatatat

SEQ ID NO: 6658759 - DNA, 15 bp, Homo sapiens
atagaatttggccca

SEQ ID NO: 6658760 - DNA, 13 bp, Homo sapiens
atagaatttttaa

SEQ ID NO: 6658761 - DNA, 15 bp, Homo sapiens
atagacaaaaagtat

SEQ ID NO: 6658762 - DNA, 20 bp, Homo sapiens
atagacaaaagaataagaca

SEQ ID NO: 6658763 - DNA, 15 bp, Homo sapiens
atagacaaaggcctt

SEQ ID NO: 6658764 - DNA, 16 bp, Homo sapiens
atagacaaaggcctta

SEQ ID NO: 6658765 - DNA, 21 bp, Homo sapiens
atagacaaaggccttaacaaa

SEQ ID NO: 6658766 - DNA, 19 bp, Homo sapiens
atagacaaatagaaaatgg

SEQ ID NO: 6658767 - DNA, 22 bp, Homo sapiens
atagacaattcctccagagaca

SEQ ID NO: 6658768 - DNA, 14 bp, Homo sapiens
atagacacatacat

SEQ ID NO: 6658769 - DNA, 19 bp, Homo sapiens
atagacacttgagttaact

SEQ ID NO: 6658770 - DNA, 17 bp, Homo sapiens
atagacagaggtttcat

SEQ ID NO: 6658771 - DNA, 19 bp, Homo sapiens
atagacagaggtttcattt

SEQ ID NO: 6658772 - DNA, 22 bp, Homo sapiens
atagacagaggtttcattttca

SEQ ID NO: 6658773 - DNA, 19 bp, Homo sapiens
atagacagatgtggacatg

SEQ ID NO: 6658774 - DNA, 22 bp, Homo sapiens
atagacagatgtggacatgcac

SEQ ID NO: 6658775 - DNA, 20 bp, Homo sapiens
atagacagcacttggctcct

SEQ ID NO: 6658776 - DNA, 16 bp, Homo sapiens
atagacagctttgact

SEQ ID NO: 6658777 - DNA, 22 bp, Homo sapiens
atagacagtagccaagttatat

SEQ ID NO: 6658778 - DNA, 20 bp, Homo sapiens
atagacagtatatttatagt

SEQ ID NO: 6658779 - DNA, 13 bp, Homo sapiens
atagacagtttgt

SEQ ID NO: 6658780 - DNA, 21 bp, Homo sapiens
atagacagtttgtaaatgtta

SEQ ID NO: 6658781 - DNA, 22 bp, Homo sapiens
atagacagtttgtaaatgttat

SEQ ID NO: 6658782 - DNA, 19 bp, Homo sapiens
atagacataaattgtaatt

SEQ ID NO: 6658783 - DNA, 22 bp, Homo sapiens
atagacataaattgtaatttgg

SEQ ID NO: 6658784 - DNA, 16 bp, Homo sapiens
atagacattctcacat

SEQ ID NO: 6658785 - DNA, 21 bp, Homo sapiens
atagacatttcaaaattaata

SEQ ID NO: 6658786 - DNA, 19 bp, Homo sapiens
atagaccaattgaagcatg

SEQ ID NO: 6658787 - DNA, 20 bp, Homo sapiens
atagaccaattgaagcatga

SEQ ID NO: 6658788 - DNA, 22 bp, Homo sapiens
atagaccctctttcttgtttgt

SEQ ID NO: 6658789 - DNA, 14 bp, Homo sapiens
atagacctgacaat

SEQ ID NO: 6658790 - DNA, 22 bp, Homo sapiens
atagacctgacaatttgtgata

SEQ ID NO: 6658791 - DNA, 17 bp, Homo sapiens
atagaccttttcatttg

SEQ ID NO: 6658792 - DNA, 19 bp, Homo sapiens
atagacgcaaccttaactt

SEQ ID NO: 6658793 - DNA, 21 bp, Homo sapiens
atagacgggttgaaagacatc

SEQ ID NO: 6658794 - DNA, 22 bp, Homo sapiens
atagactagtcctatggaaaaa

SEQ ID NO: 6658795 - DNA, 16 bp, Homo sapiens
atagactgaagattta

SEQ ID NO: 6658796 - DNA, 16 bp, Homo sapiens
atagactgactttttc

SEQ ID NO: 6658797 - DNA, 21 bp, Homo sapiens
atagactgccgtgcattagca

SEQ ID NO: 6658798 - DNA, 21 bp, Homo sapiens
atagactgtacttattttcca

SEQ ID NO: 6658799 - DNA, 17 bp, Homo sapiens
atagacttcgaaaacag

SEQ ID NO: 6658800 - DNA, 15 bp, Homo sapiens
atagacttctcttac

SEQ ID NO: 6658801 - DNA, 19 bp, Homo sapiens
atagacttggagaatactg

SEQ ID NO: 6658802 - DNA, 23 bp, Homo sapiens
atagacttggagaatactgccaa

SEQ ID NO: 6658803 - DNA, 14 bp, Homo sapiens
atagacttgggatg

SEQ ID NO: 6658804 - DNA, 16 bp, Homo sapiens
atagagaatacacata

SEQ ID NO: 6658805 - DNA, 13 bp, Homo sapiens
atagagaatgttc

SEQ ID NO: 6658806 - DNA, 13 bp, Homo sapiens
atagagacaatct

SEQ ID NO: 6658807 - DNA, 17 bp, Homo sapiens
atagagacaatctattt

SEQ ID NO: 6658808 - DNA, 22 bp, Homo sapiens
atagagacaatctattttgtta

SEQ ID NO: 6658809 - DNA, 14 bp, Homo sapiens
atagagaccaggag

SEQ ID NO: 6658810 - DNA, 15 bp, Homo sapiens
atagagaccaggagg

SEQ ID NO: 6658811 - DNA, 16 bp, Homo sapiens
atagagaccaggaggg

SEQ ID NO: 6658812 - DNA, 14 bp, Homo sapiens
atagagacgggact

SEQ ID NO: 6658813 - DNA, 21 bp, Homo sapiens
atagagactgtgttcatgtgt

SEQ ID NO: 6658814 - DNA, 16 bp, Homo sapiens
atagagacttgggaat

SEQ ID NO: 6658815 - DNA, 13 bp, Homo sapiens
atagagagcaatt

SEQ ID NO: 6658816 - DNA, 14 bp, Homo sapiens
atagagagcaattt

SEQ ID NO: 6658817 - DNA, 20 bp, Homo sapiens
atagagagcaatttgtctgg

SEQ ID NO: 6658818 - DNA, 15 bp, Homo sapiens
atagagaggcctgct

SEQ ID NO: 6658819 - DNA, 19 bp, Homo sapiens
atagagaggcctgctttgt

SEQ ID NO: 6658820 - DNA, 16 bp, Homo sapiens
atagagatatttaaaa

SEQ ID NO: 6658821 - DNA, 18 bp, Homo sapiens
atagagatatttaaaaga

SEQ ID NO: 6658822 - DNA, 19 bp, Homo sapiens
atagagatgagctttcttt

SEQ ID NO: 6658823 - DNA, 16 bp, Homo sapiens
atagagatgtttttaa

SEQ ID NO: 6658824 - DNA, 24 bp, Homo sapiens
atagagattttttaaccatggcag

SEQ ID NO: 6658825 - DNA, 20 bp, Homo sapiens
atagagcaaaatcaacatga

SEQ ID NO: 6658826 - DNA, 19 bp, Homo sapiens
atagagcaatgttggtttt

SEQ ID NO: 6658827 - DNA, 21 bp, Homo sapiens
atagagcacctagtccagtga

SEQ ID NO: 6658828 - DNA, 16 bp, Homo sapiens
atagagcagaaattct

SEQ ID NO: 6658829 - DNA, 15 bp, Homo sapiens
atagagcagcctgct

SEQ ID NO: 6658830 - DNA, 20 bp, Homo sapiens
atagagccctggccagccct

SEQ ID NO: 6658831 - DNA, 14 bp, Homo sapiens
atagagcctgaaat

SEQ ID NO: 6658832 - DNA, 12 bp, Homo sapiens
atagagcctttg

SEQ ID NO: 6658833 - DNA, 17 bp, Homo sapiens
atagagctgggtggcct

SEQ ID NO: 6658834 - DNA, 14 bp, Homo sapiens
atagagctgtatta

SEQ ID NO: 6658835 - DNA, 16 bp, Homo sapiens
atagagcttttaaaaa

SEQ ID NO: 6658836 - DNA, 22 bp, Homo sapiens
atagaggaaattcaaatccctt

SEQ ID NO: 6658837 - DNA, 22 bp, Homo sapiens
atagaggacacggaccctgtgt

SEQ ID NO: 6658838 - DNA, 21 bp, Homo sapiens
atagaggacagagaagatgac

SEQ ID NO: 6658839 - DNA, 19 bp, Homo sapiens
atagaggctaaattactca

SEQ ID NO: 6658840 - DNA, 21 bp, Homo sapiens
atagaggcttctccgccagcc

SEQ ID NO: 6658841 - DNA, 21 bp, Homo sapiens
atagaggctttgagcaactaa

SEQ ID NO: 6658842 - DNA, 21 bp, Homo sapiens
atagagggagaggaagcacac

SEQ ID NO: 6658843 - DNA, 14 bp, Homo sapiens
atagagggccaaga

SEQ ID NO: 6658844 - DNA, 21 bp, Homo sapiens
atagagggccacggggaggcc

SEQ ID NO: 6658845 - DNA, 17 bp, Homo sapiens
atagaggggttttagat

SEQ ID NO: 6658846 - DNA, 15 bp, Homo sapiens
atagaggtgagggaa

SEQ ID NO: 6658847 - DNA, 14 bp, Homo sapiens
atagaggttttgta

SEQ ID NO: 6658848 - DNA, 16 bp, Homo sapiens
atagagtatactaaaa

SEQ ID NO: 6658849 - DNA, 17 bp, Homo sapiens
atagagtatactaaaaa

SEQ ID NO: 6658850 - DNA, 19 bp, Homo sapiens
atagagtgtacttaactat

SEQ ID NO: 6658851 - DNA, 23 bp, Homo sapiens
atagagtgtagtttacagaaaaa

SEQ ID NO: 6658852 - DNA, 12 bp, Homo sapiens
atagagtgtttt

SEQ ID NO: 6658853 - DNA, 16 bp, Homo sapiens
atagagttcatagaaa

SEQ ID NO: 6658854 - DNA, 17 bp, Homo sapiens
atagagttggagtttta

SEQ ID NO: 6658855 - DNA, 22 bp, Homo sapiens
atagagtttaacagatatttaa

SEQ ID NO: 6658856 - DNA, 15 bp, Homo sapiens
atagagtttgctatt

SEQ ID NO: 6658857 - DNA, 21 bp, Homo sapiens
atagataaaacatctttgaaa

SEQ ID NO: 6658858 - DNA, 12 bp, Homo sapiens
atagataaagag

SEQ ID NO: 6658859 - DNA, 15 bp, Homo sapiens
atagataaagagata

SEQ ID NO: 6658860 - DNA, 13 bp, Homo sapiens
atagataaatata

SEQ ID NO: 6658861 - DNA, 16 bp, Homo sapiens
atagataaattttgac

SEQ ID NO: 6658862 - DNA, 20 bp, Homo sapiens
atagataaccaattttcaga

SEQ ID NO: 6658863 - DNA, 23 bp, Homo sapiens
atagataactgctcttttactaa

SEQ ID NO: 6658864 - DNA, 13 bp, Homo sapiens
atagataattatc

SEQ ID NO: 6658865 - DNA, 18 bp, Homo sapiens
atagataggtcagtgcaa

SEQ ID NO: 6658866 - DNA, 14 bp, Homo sapiens
atagatataatgaa

SEQ ID NO: 6658867 - DNA, 23 bp, Homo sapiens
atagatataatgaacaaaattat

SEQ ID NO: 6658868 - DNA, 16 bp, Homo sapiens
atagatatatatccat

SEQ ID NO: 6658869 - DNA, 13 bp, Homo sapiens
atagatattggaa

SEQ ID NO: 6658870 - DNA, 17 bp, Homo sapiens
atagatcaataaatgtc

SEQ ID NO: 6658871 - DNA, 21 bp, Homo sapiens
atagatcacataacagaatgc

SEQ ID NO: 6658872 - DNA, 22 bp, Homo sapiens
atagatcactgccctttttgaa

SEQ ID NO: 6658873 - DNA, 20 bp, Homo sapiens
atagatcagccattaaaata

SEQ ID NO: 6658874 - DNA, 23 bp, Homo sapiens
atagatcagccattaaaataaaa

SEQ ID NO: 6658875 - DNA, 16 bp, Homo sapiens
atagatcagtatttca

SEQ ID NO: 6658876 - DNA, 14 bp, Homo sapiens
atagatcctttaaa

SEQ ID NO: 6658877 - DNA, 14 bp, Homo sapiens
atagatcttctgaa

SEQ ID NO: 6658878 - DNA, 15 bp, Homo sapiens
atagatgaatactaa

SEQ ID NO: 6658879 - DNA, 20 bp, Homo sapiens
atagatgaatactaaatggt

SEQ ID NO: 6658880 - DNA, 21 bp, Homo sapiens
atagatgagaaaactgagagg

SEQ ID NO: 6658881 - DNA, 15 bp, Homo sapiens
atagatgagtcctgt

SEQ ID NO: 6658882 - DNA, 20 bp, Homo sapiens
atagatgagtttttcattat

SEQ ID NO: 6658883 - DNA, 18 bp, Homo sapiens
atagatgataaaagagaa

SEQ ID NO: 6658884 - DNA, 14 bp, Homo sapiens
atagatgcctgggc

SEQ ID NO: 6658885 - DNA, 18 bp, Homo sapiens
atagatgctacagtattt

SEQ ID NO: 6658886 - DNA, 15 bp, Homo sapiens
atagatgctggccca

SEQ ID NO: 6658887 - DNA, 18 bp, Homo sapiens
atagatgctgtgtatatg

SEQ ID NO: 6658888 - DNA, 19 bp, Homo sapiens
atagatggacagtttgttt

SEQ ID NO: 6658889 - DNA, 13 bp, Homo sapiens
atagatggaccag

SEQ ID NO: 6658890 - DNA, 12 bp, Homo sapiens
atagatgggaat

SEQ ID NO: 6658891 - DNA, 17 bp, Homo sapiens
atagatgggactgtgtc

SEQ ID NO: 6658892 - DNA, 13 bp, Homo sapiens
atagatgtaattt

SEQ ID NO: 6658893 - DNA, 15 bp, Homo sapiens
atagatgtagtcttg

SEQ ID NO: 6658894 - DNA, 23 bp, Homo sapiens
atagatgtccctttcttggccag

SEQ ID NO: 6658895 - DNA, 14 bp, Homo sapiens
atagatgtctcaaa

SEQ ID NO: 6658896 - DNA, 15 bp, Homo sapiens
atagatgtctgtgta

SEQ ID NO: 6658897 - DNA, 15 bp, Homo sapiens
atagatgtgaaaatg

SEQ ID NO: 6658898 - DNA, 20 bp, Homo sapiens
atagatgtgcagtttggaat

SEQ ID NO: 6658899 - DNA, 13 bp, Homo sapiens
atagatgtgtgga

SEQ ID NO: 6658900 - DNA, 14 bp, Homo sapiens
atagatgttgctaa

SEQ ID NO: 6658901 - DNA, 13 bp, Homo sapiens
atagatgtttcct

SEQ ID NO: 6658902 - DNA, 20 bp, Homo sapiens
atagattaaatcatactcct

SEQ ID NO: 6658903 - DNA, 13 bp, Homo sapiens
atagattagaaaa

SEQ ID NO: 6658904 - DNA, 22 bp, Homo sapiens
atagattagagagtgttgaaac

SEQ ID NO: 6658905 - DNA, 23 bp, Homo sapiens
atagattagattatattgagaca

SEQ ID NO: 6658906 - DNA, 16 bp, Homo sapiens
atagattaggtttgcg

SEQ ID NO: 6658907 - DNA, 19 bp, Homo sapiens
atagattataaaattattt

SEQ ID NO: 6658908 - DNA, 14 bp, Homo sapiens
atagattataactt

SEQ ID NO: 6658909 - DNA, 13 bp, Homo sapiens
atagattcacctg

SEQ ID NO: 6658910 - DNA, 19 bp, Homo sapiens
atagattcacctgtaaaac

SEQ ID NO: 6658911 - DNA, 21 bp, Homo sapiens
atagattcacctgtaaaactt

SEQ ID NO: 6658912 - DNA, 17 bp, Homo sapiens
atagattcagagaaatt

SEQ ID NO: 6658913 - DNA, 12 bp, Homo sapiens
atagattctaaa

SEQ ID NO: 6658914 - DNA, 15 bp, Homo sapiens
atagattctaaagat

SEQ ID NO: 6658915 - DNA, 15 bp, Homo sapiens
atagattctttatta

SEQ ID NO: 6658916 - DNA, 23 bp, Homo sapiens
atagattgatttacctttggaat

SEQ ID NO: 6658917 - DNA, 22 bp, Homo sapiens
atagattgtccggccgctttgt

SEQ ID NO: 6658918 - DNA, 20 bp, Homo sapiens
atagattgtccttttgcaaa

SEQ ID NO: 6658919 - DNA, 13 bp, Homo sapiens
atagattgtgaat

SEQ ID NO: 6658920 - DNA, 22 bp, Homo sapiens
atagattgttttgccacttaga

SEQ ID NO: 6658921 - DNA, 17 bp, Homo sapiens
atagatttaccctttat

SEQ ID NO: 6658922 - DNA, 16 bp, Homo sapiens
atagatttagctattt

SEQ ID NO: 6658923 - DNA, 19 bp, Homo sapiens
atagatttaggagcagaaa

SEQ ID NO: 6658924 - DNA, 18 bp, Homo sapiens
atagatttagttttgtaa

SEQ ID NO: 6658925 - DNA, 20 bp, Homo sapiens
atagatttattttacattta

SEQ ID NO: 6658926 - DNA, 16 bp, Homo sapiens
atagatttctgatttt

SEQ ID NO: 6658927 - DNA, 19 bp, Homo sapiens
atagatttctgattttatg

SEQ ID NO: 6658928 - DNA, 19 bp, Homo sapiens
atagatttgaaaaactttt

SEQ ID NO: 6658929 - DNA, 21 bp, Homo sapiens
atagatttgaagatctgattt

SEQ ID NO: 6658930 - DNA, 19 bp, Homo sapiens
atagatttgattatttcct

SEQ ID NO: 6658931 - DNA, 17 bp, Homo sapiens
atagatttgtattttaa

SEQ ID NO: 6658932 - DNA, 15 bp, Homo sapiens
atagattttataaga

SEQ ID NO: 6658933 - DNA, 16 bp, Homo sapiens
atagattttctctgga

SEQ ID NO: 6658934 - DNA, 18 bp, Homo sapiens
atagattttctctggaaa

SEQ ID NO: 6658935 - DNA, 22 bp, Homo sapiens
atagatttttaatggttaagaa

SEQ ID NO: 6658936 - DNA, 14 bp, Homo sapiens
atagatttttagat

SEQ ID NO: 6658937 - DNA, 17 bp, Homo sapiens
atagatttttgtttttg

SEQ ID NO: 6658938 - DNA, 22 bp, Homo sapiens
atagattttttaaaaaaaatgt

SEQ ID NO: 6658939 - DNA, 23 bp, Homo sapiens
atagattttttaaaaaaaatgtg

SEQ ID NO: 6658940 - DNA, 16 bp, Homo sapiens
atagattttttttaaa

SEQ ID NO: 6658941 - DNA, 23 bp, Homo sapiens
atagattttttttaaagtttggt

SEQ ID NO: 6658942 - DNA, 21 bp, Homo sapiens
atagcaaaaatgttttccaat

SEQ ID NO: 6658943 - DNA, 23 bp, Homo sapiens
atagcaaaacttttaaactacag

SEQ ID NO: 6658944 - DNA, 18 bp, Homo sapiens
atagcaaaagaagaagtt

SEQ ID NO: 6658945 - DNA, 19 bp, Homo sapiens
atagcaaaagaagaagttt

SEQ ID NO: 6658946 - DNA, 20 bp, Homo sapiens
atagcaaaattcctgtgttc

SEQ ID NO: 6658947 - DNA, 13 bp, Homo sapiens
atagcaaagaatt

SEQ ID NO: 6658948 - DNA, 14 bp, Homo sapiens
atagcaaagaattg

SEQ ID NO: 6658949 - DNA, 19 bp, Homo sapiens
atagcaaatgttttgacat

SEQ ID NO: 6658950 - DNA, 23 bp, Homo sapiens
atagcaaatgttttgacatgaaa

SEQ ID NO: 6658951 - DNA, 15 bp, Homo sapiens
atagcaacatctttt

SEQ ID NO: 6658952 - DNA, 15 bp, Homo sapiens
atagcaacatgcttc

SEQ ID NO: 6658953 - DNA, 22 bp, Homo sapiens
atagcaacttttgtgtaatgaa

SEQ ID NO: 6658954 - DNA, 19 bp, Homo sapiens
atagcaagacacatcccta

SEQ ID NO: 6658955 - DNA, 13 bp, Homo sapiens
atagcaagagatg

SEQ ID NO: 6658956 - DNA, 17 bp, Homo sapiens
atagcaagagtgtgaaa

SEQ ID NO: 6658957 - DNA, 18 bp, Homo sapiens
atagcaagagtgtgaaat

SEQ ID NO: 6658958 - DNA, 22 bp, Homo sapiens
atagcaagatattgatcaaata

SEQ ID NO: 6658959 - DNA, 13 bp, Homo sapiens
atagcaagtgaat

SEQ ID NO: 6658960 - DNA, 19 bp, Homo sapiens
atagcaagtgaatttttct

SEQ ID NO: 6658961 - DNA, 22 bp, Homo sapiens
atagcaagtgaatttttctcta

SEQ ID NO: 6658962 - DNA, 17 bp, Homo sapiens
atagcaataactgaaaa

SEQ ID NO: 6658963 - DNA, 17 bp, Homo sapiens
atagcaatagcatggat

SEQ ID NO: 6658964 - DNA, 20 bp, Homo sapiens
atagcaatgtaaaaatggtt

SEQ ID NO: 6658965 - DNA, 17 bp, Homo sapiens
atagcaatgttccagga

SEQ ID NO: 6658966 - DNA, 19 bp, Homo sapiens
atagcacaagataaattga

SEQ ID NO: 6658967 - DNA, 21 bp, Homo sapiens
atagcacatgatttgggctct

SEQ ID NO: 6658968 - DNA, 17 bp, Homo sapiens
atagcacatgattttct

SEQ ID NO: 6658969 - DNA, 14 bp, Homo sapiens
atagcaccagggct

SEQ ID NO: 6658970 - DNA, 15 bp, Homo sapiens
atagcacccatatct

SEQ ID NO: 6658971 - DNA, 17 bp, Homo sapiens
atagcacccatatctgt

SEQ ID NO: 6658972 - DNA, 21 bp, Homo sapiens
atagcacctaaacttacattt

SEQ ID NO: 6658973 - DNA, 15 bp, Homo sapiens
atagcactgagcaaa

SEQ ID NO: 6658974 - DNA, 21 bp, Homo sapiens
atagcactgggaactctggct

SEQ ID NO: 6658975 - DNA, 12 bp, Homo sapiens
atagcactttga

SEQ ID NO: 6658976 - DNA, 16 bp, Homo sapiens
atagcagagagccaaa

SEQ ID NO: 6658977 - DNA, 18 bp, Homo sapiens
atagcagaggaaaaagaa

SEQ ID NO: 6658978 - DNA, 20 bp, Homo sapiens
atagcagaggaaaaagaaaa

SEQ ID NO: 6658979 - DNA, 22 bp, Homo sapiens
atagcagaggaaaaagaaaaac

SEQ ID NO: 6658980 - DNA, 18 bp, Homo sapiens
atagcagaggtttaaatg

SEQ ID NO: 6658981 - DNA, 14 bp, Homo sapiens
atagcagattttaa

SEQ ID NO: 6658982 - DNA, 22 bp, Homo sapiens
atagcagattttaattttgaat

SEQ ID NO: 6658983 - DNA, 15 bp, Homo sapiens
atagcagcaaaaata

SEQ ID NO: 6658984 - DNA, 19 bp, Homo sapiens
atagcagcaaaaatataaa

SEQ ID NO: 6658985 - DNA, 17 bp, Homo sapiens
atagcagccagttcaaa

SEQ ID NO: 6658986 - DNA, 21 bp, Homo sapiens
atagcagccctcaattgtgaa

SEQ ID NO: 6658987 - DNA, 24 bp, Homo sapiens
atagcagcctcacactggcgtctg

SEQ ID NO: 6658988 - DNA, 21 bp, Homo sapiens
atagcagcctggctcccctgg

SEQ ID NO: 6658989 - DNA, 14 bp, Homo sapiens
atagcagctgctac

SEQ ID NO: 6658990 - DNA, 15 bp, Homo sapiens
atagcagcttattca

SEQ ID NO: 6658991 - DNA, 18 bp, Homo sapiens
atagcagcttattcacaa

SEQ ID NO: 6658992 - DNA, 19 bp, Homo sapiens
atagcagctttgtctctgt

SEQ ID NO: 6658993 - DNA, 15 bp, Homo sapiens
atagcagtggcaaaa

SEQ ID NO: 6658994 - DNA, 17 bp, Homo sapiens
atagcagtgttctctct

SEQ ID NO: 6658995 - DNA, 18 bp, Homo sapiens
atagcagttataacagat

SEQ ID NO: 6658996 - DNA, 19 bp, Homo sapiens
atagcagttataacagatg

SEQ ID NO: 6658997 - DNA, 20 bp, Homo sapiens
atagcagttataacagatgt

SEQ ID NO: 6658998 - DNA, 21 bp, Homo sapiens
atagcataaaatgaaatgcta

SEQ ID NO: 6658999 - DNA, 18 bp, Homo sapiens
atagcatacaccaaacat

SEQ ID NO: 6659000 - DNA, 19 bp, Homo sapiens
atagcatactgtgtatgtt

SEQ ID NO: 6659001 - DNA, 22 bp, Homo sapiens
atagcatactgtgtatgtttta

SEQ ID NO: 6659002 - DNA, 22 bp, Homo sapiens
atagcatatgacaaatgtttct

SEQ ID NO: 6659003 - DNA, 17 bp, Homo sapiens
atagcatcacttaaaac

SEQ ID NO: 6659004 - DNA, 18 bp, Homo sapiens
atagcatcacttaaaaca

SEQ ID NO: 6659005 - DNA, 20 bp, Homo sapiens
atagcatcacttaaaacacg

SEQ ID NO: 6659006 - DNA, 17 bp, Homo sapiens
atagcatccaagtggca

SEQ ID NO: 6659007 - DNA, 14 bp, Homo sapiens
atagcatctgtaca

SEQ ID NO: 6659008 - DNA, 20 bp, Homo sapiens
atagcatctttcatatggta

SEQ ID NO: 6659009 - DNA, 13 bp, Homo sapiens
atagcatgaaata

SEQ ID NO: 6659010 - DNA, 14 bp, Homo sapiens
atagcatgcttcct

SEQ ID NO: 6659011 - DNA, 21 bp, Homo sapiens
atagcatgcttcctttctctc

SEQ ID NO: 6659012 - DNA, 23 bp, Homo sapiens
atagcatgcttcctttctctcct

SEQ ID NO: 6659013 - DNA, 18 bp, Homo sapiens
atagcatggatagagtat

SEQ ID NO: 6659014 - DNA, 18 bp, Homo sapiens
atagcatggggcccctgg

SEQ ID NO: 6659015 - DNA, 20 bp, Homo sapiens
atagcatggggcccctggcc

SEQ ID NO: 6659016 - DNA, 16 bp, Homo sapiens
atagcatgtattgtgt

SEQ ID NO: 6659017 - DNA, 18 bp, Homo sapiens
atagcatgtcaacttttg

SEQ ID NO: 6659018 - DNA, 20 bp, Homo sapiens
atagcatgtcaacttttgac

SEQ ID NO: 6659019 - DNA, 16 bp, Homo sapiens
atagcatgtcctaatg

SEQ ID NO: 6659020 - DNA, 19 bp, Homo sapiens
atagcatgtcctaatgctt

SEQ ID NO: 6659021 - DNA, 19 bp, Homo sapiens
atagcatgtgtattaatgt

SEQ ID NO: 6659022 - DNA, 15 bp, Homo sapiens
atagcattaataaaa

SEQ ID NO: 6659023 - DNA, 16 bp, Homo sapiens
atagcattctctatca

SEQ ID NO: 6659024 - DNA, 16 bp, Homo sapiens
atagcattgataatct

SEQ ID NO: 6659025 - DNA, 24 bp, Homo sapiens
atagcattgataatcttcaggtga

SEQ ID NO: 6659026 - DNA, 15 bp, Homo sapiens
atagcattgtctatt

SEQ ID NO: 6659027 - DNA, 17 bp, Homo sapiens
atagcattgtctatttt

SEQ ID NO: 6659028 - DNA, 22 bp, Homo sapiens
atagcattgttttcttttacag

SEQ ID NO: 6659029 - DNA, 16 bp, Homo sapiens
atagcatttatggtaa

SEQ ID NO: 6659030 - DNA, 21 bp, Homo sapiens
atagcatttctagaacaatta

SEQ ID NO: 6659031 - DNA, 14 bp, Homo sapiens
atagcatttgccac

SEQ ID NO: 6659032 - DNA, 20 bp, Homo sapiens
atagcatttgccacttagta

SEQ ID NO: 6659033 - DNA, 14 bp, Homo sapiens
atagcatttttgta

SEQ ID NO: 6659034 - DNA, 19 bp, Homo sapiens
atagccaaaaaggcaaata

SEQ ID NO: 6659035 - DNA, 12 bp, Homo sapiens
atagccaaaaat

SEQ ID NO: 6659036 - DNA, 13 bp, Homo sapiens
atagccaaaaata

SEQ ID NO: 6659037 - DNA, 15 bp, Homo sapiens
atagccaaacaggag

SEQ ID NO: 6659038 - DNA, 13 bp, Homo sapiens
atagccaaagcca

SEQ ID NO: 6659039 - DNA, 13 bp, Homo sapiens
atagccaaagctg

SEQ ID NO: 6659040 - DNA, 21 bp, Homo sapiens
atagccaaggccaaaggaagc

SEQ ID NO: 6659041 - DNA, 22 bp, Homo sapiens
atagccacatccctttgaaaca

SEQ ID NO: 6659042 - DNA, 13 bp, Homo sapiens
atagccactaacc

SEQ ID NO: 6659043 - DNA, 23 bp, Homo sapiens
atagccactaaccttgcctggta

SEQ ID NO: 6659044 - DNA, 20 bp, Homo sapiens
atagccactattaacatttc

SEQ ID NO: 6659045 - DNA, 20 bp, Homo sapiens
atagccactgatggtgacag

SEQ ID NO: 6659046 - DNA, 13 bp, Homo sapiens
atagccagacaca

SEQ ID NO: 6659047 - DNA, 16 bp, Homo sapiens
atagccagacacatgg

SEQ ID NO: 6659048 - DNA, 13 bp, Homo sapiens
atagccagagagg

SEQ ID NO: 6659049 - DNA, 14 bp, Homo sapiens
atagccagagagga

SEQ ID NO: 6659050 - DNA, 21 bp, Homo sapiens
atagccagcattcagcacaca

SEQ ID NO: 6659051 - DNA, 12 bp, Homo sapiens
atagccatattt

SEQ ID NO: 6659052 - DNA, 20 bp, Homo sapiens
atagccattcatttacaact

SEQ ID NO: 6659053 - DNA, 20 bp, Homo sapiens
atagccatttccatggctct

SEQ ID NO: 6659054 - DNA, 13 bp, Homo sapiens
atagccatttgcc

SEQ ID NO: 6659055 - DNA, 15 bp, Homo sapiens
atagccatttgcccc

SEQ ID NO: 6659056 - DNA, 13 bp, Homo sapiens
atagcccagaaca

SEQ ID NO: 6659057 - DNA, 12 bp, Homo sapiens
atagcccagaca

SEQ ID NO: 6659058 - DNA, 17 bp, Homo sapiens
atagcccagatcccaag

SEQ ID NO: 6659059 - DNA, 21 bp, Homo sapiens
atagcccagccttttgagagt

SEQ ID NO: 6659060 - DNA, 14 bp, Homo sapiens
atagcccaggagca

SEQ ID NO: 6659061 - DNA, 20 bp, Homo sapiens
atagcccaggatatatttta

SEQ ID NO: 6659062 - DNA, 22 bp, Homo sapiens
atagcccatagctattttcctt

SEQ ID NO: 6659063 - DNA, 16 bp, Homo sapiens
atagcccatccctgcc

SEQ ID NO: 6659064 - DNA, 24 bp, Homo sapiens
atagccccagactgggcccaggca

SEQ ID NO: 6659065 - DNA, 15 bp, Homo sapiens
atagccccaggcccg

SEQ ID NO: 6659066 - DNA, 15 bp, Homo sapiens
atagcccctctcccc

SEQ ID NO: 6659067 - DNA, 13 bp, Homo sapiens
atagccctgccct

SEQ ID NO: 6659068 - DNA, 18 bp, Homo sapiens
atagccctgccctcccaa

SEQ ID NO: 6659069 - DNA, 22 bp, Homo sapiens
atagccctgggtaccctgagcc

SEQ ID NO: 6659070 - DNA, 18 bp, Homo sapiens
atagccctggtgctcctg

SEQ ID NO: 6659071 - DNA, 23 bp, Homo sapiens
atagccctggtgctcctgcccag

SEQ ID NO: 6659072 - DNA, 23 bp, Homo sapiens
atagccctgtcctggtggtattt

SEQ ID NO: 6659073 - DNA, 14 bp, Homo sapiens
atagccctgtgaag

SEQ ID NO: 6659074 - DNA, 16 bp, Homo sapiens
atagccctgttgacct

SEQ ID NO: 6659075 - DNA, 19 bp, Homo sapiens
atagccctgttgacctgcc

SEQ ID NO: 6659076 - DNA, 20 bp, Homo sapiens
atagccgaactccaggctgg

SEQ ID NO: 6659077 - DNA, 16 bp, Homo sapiens
atagccgattctctgc

SEQ ID NO: 6659078 - DNA, 17 bp, Homo sapiens
atagccgggctccaggg

SEQ ID NO: 6659079 - DNA, 15 bp, Homo sapiens
atagcctaaatgatg

SEQ ID NO: 6659080 - DNA, 20 bp, Homo sapiens
atagcctaagcggctgttta

SEQ ID NO: 6659081 - DNA, 17 bp, Homo sapiens
atagcctagctttctaa

SEQ ID NO: 6659082 - DNA, 15 bp, Homo sapiens
atagcctaggtgaca

SEQ ID NO: 6659083 - DNA, 16 bp, Homo sapiens
atagcctatatttaca

SEQ ID NO: 6659084 - DNA, 17 bp, Homo sapiens
atagcctcaccttccct

SEQ ID NO: 6659085 - DNA, 15 bp, Homo sapiens
atagcctctgtctgg

SEQ ID NO: 6659086 - DNA, 12 bp, Homo sapiens
atagcctgaatt

SEQ ID NO: 6659087 - DNA, 17 bp, Homo sapiens
atagcctgaggtgggag

SEQ ID NO: 6659088 - DNA, 11 bp, Homo sapiens
atagcctgcct

SEQ ID NO: 6659089 - DNA, 15 bp, Homo sapiens
atagcctgcctcagt

SEQ ID NO: 6659090 - DNA, 11 bp, Homo sapiens
atagcctggac

SEQ ID NO: 6659091 - DNA, 23 bp, Homo sapiens
atagcctggccaccagccatcct

SEQ ID NO: 6659092 - DNA, 12 bp, Homo sapiens
atagcctgtggc

SEQ ID NO: 6659093 - DNA, 16 bp, Homo sapiens
atagccttcaaaaaga

SEQ ID NO: 6659094 - DNA, 14 bp, Homo sapiens
atagccttcctgac

SEQ ID NO: 6659095 - DNA, 14 bp, Homo sapiens
atagccttgaaaac

SEQ ID NO: 6659096 - DNA, 16 bp, Homo sapiens
atagccttgaaaacaa

SEQ ID NO: 6659097 - DNA, 22 bp, Homo sapiens
atagccttgaaaacaaacaaat

SEQ ID NO: 6659098 - DNA, 16 bp, Homo sapiens
atagcgaggctctaac

SEQ ID NO: 6659099 - DNA, 20 bp, Homo sapiens
atagcgatgtgcaggaagaa

SEQ ID NO: 6659100 - DNA, 22 bp, Homo sapiens
atagcgccgtgctgtaaataag

SEQ ID NO: 6659101 - DNA, 15 bp, Homo sapiens
atagcgcctgtataa

SEQ ID NO: 6659102 - DNA, 15 bp, Homo sapiens
atagcgctggctcag

SEQ ID NO: 6659103 - DNA, 21 bp, Homo sapiens
atagcgctgttgatcccctct

SEQ ID NO: 6659104 - DNA, 12 bp, Homo sapiens
atagcggccctg

SEQ ID NO: 6659105 - DNA, 17 bp, Homo sapiens
atagcggccctggagga

SEQ ID NO: 6659106 - DNA, 19 bp, Homo sapiens
atagcggggccttgtctct

SEQ ID NO: 6659107 - DNA, 18 bp, Homo sapiens
atagcgtcctgccctgcc

SEQ ID NO: 6659108 - DNA, 15 bp, Homo sapiens
atagcgtgtgtagat

SEQ ID NO: 6659109 - DNA, 15 bp, Homo sapiens
atagcgttcttgtaa

SEQ ID NO: 6659110 - DNA, 17 bp, Homo sapiens
atagcgttcttgtaatt

SEQ ID NO: 6659111 - DNA, 13 bp, Homo sapiens
atagctaaataac

SEQ ID NO: 6659112 - DNA, 13 bp, Homo sapiens
atagctaaatacc

SEQ ID NO: 6659113 - DNA, 15 bp, Homo sapiens
atagctaacatttta

SEQ ID NO: 6659114 - DNA, 14 bp, Homo sapiens
atagctaagtacac

SEQ ID NO: 6659115 - DNA, 15 bp, Homo sapiens
atagctaataagtag

SEQ ID NO: 6659116 - DNA, 16 bp, Homo sapiens
atagctaataataaat

SEQ ID NO: 6659117 - DNA, 21 bp, Homo sapiens
atagctaatttatttccccag

SEQ ID NO: 6659118 - DNA, 19 bp, Homo sapiens
atagctacaatttgttttt

SEQ ID NO: 6659119 - DNA, 15 bp, Homo sapiens
atagctacagctgtg

SEQ ID NO: 6659120 - DNA, 18 bp, Homo sapiens
atagctacatcagtttga

SEQ ID NO: 6659121 - DNA, 22 bp, Homo sapiens
atagctacatcagtttgataca

SEQ ID NO: 6659122 - DNA, 14 bp, Homo sapiens
atagctactaattt

SEQ ID NO: 6659123 - DNA, 21 bp, Homo sapiens
atagctagctatttctatgta

SEQ ID NO: 6659124 - DNA, 14 bp, Homo sapiens
atagctataaatag

SEQ ID NO: 6659125 - DNA, 16 bp, Homo sapiens
atagctatatccatgt

SEQ ID NO: 6659126 - DNA, 20 bp, Homo sapiens
atagctatattttatttctg

SEQ ID NO: 6659127 - DNA, 14 bp, Homo sapiens
atagctattactgt

SEQ ID NO: 6659128 - DNA, 17 bp, Homo sapiens
atagctattgcatgtaa

SEQ ID NO: 6659129 - DNA, 15 bp, Homo sapiens
atagctattttcctt

SEQ ID NO: 6659130 - DNA, 14 bp, Homo sapiens
atagctcaagaatt

SEQ ID NO: 6659131 - DNA, 18 bp, Homo sapiens
atagctcaataaaagaat

SEQ ID NO: 6659132 - DNA, 14 bp, Homo sapiens
atagctcacagcac

SEQ ID NO: 6659133 - DNA, 17 bp, Homo sapiens
atagctcacagcacatt

SEQ ID NO: 6659134 - DNA, 16 bp, Homo sapiens
atagctcactgcagcc

SEQ ID NO: 6659135 - DNA, 15 bp, Homo sapiens
atagctcatccttaa

SEQ ID NO: 6659136 - DNA, 20 bp, Homo sapiens
atagctcccaaaagaatgga

SEQ ID NO: 6659137 - DNA, 14 bp, Homo sapiens
atagctccttttga

SEQ ID NO: 6659138 - DNA, 22 bp, Homo sapiens
atagctctaatgtttgcatata

SEQ ID NO: 6659139 - DNA, 20 bp, Homo sapiens
atagctctacacaacatgta

SEQ ID NO: 6659140 - DNA, 23 bp, Homo sapiens
atagctctacacaacatgtatgt

SEQ ID NO: 6659141 - DNA, 18 bp, Homo sapiens
atagctctactgccctcc

SEQ ID NO: 6659142 - DNA, 19 bp, Homo sapiens
atagctctactgccctccc

SEQ ID NO: 6659143 - DNA, 14 bp, Homo sapiens
atagctctcatcac

SEQ ID NO: 6659144 - DNA, 18 bp, Homo sapiens
atagctctctgactgctt

SEQ ID NO: 6659145 - DNA, 19 bp, Homo sapiens
atagctctctgactgcttt

SEQ ID NO: 6659146 - DNA, 18 bp, Homo sapiens
atagctcttcacttcctc

SEQ ID NO: 6659147 - DNA, 21 bp, Homo sapiens
atagctcttcacttcctccag

SEQ ID NO: 6659148 - DNA, 18 bp, Homo sapiens
atagctcttctatttaaa

SEQ ID NO: 6659149 - DNA, 19 bp, Homo sapiens
atagctcttctatttaaaa

SEQ ID NO: 6659150 - DNA, 12 bp, Homo sapiens
atagctcttgct

SEQ ID NO: 6659151 - DNA, 13 bp, Homo sapiens
atagctcttgctt

SEQ ID NO: 6659152 - DNA, 20 bp, Homo sapiens
atagctctttggcagtctat

SEQ ID NO: 6659153 - DNA, 13 bp, Homo sapiens
atagctgaaaact

SEQ ID NO: 6659154 - DNA, 21 bp, Homo sapiens
atagctgaaaactaatgtact

SEQ ID NO: 6659155 - DNA, 13 bp, Homo sapiens
atagctgagctgg

SEQ ID NO: 6659156 - DNA, 21 bp, Homo sapiens
atagctgcccatttcgtgagc

SEQ ID NO: 6659157 - DNA, 12 bp, Homo sapiens
atagctgctgcc

SEQ ID NO: 6659158 - DNA, 17 bp, Homo sapiens
atagctggcaagaatgg

SEQ ID NO: 6659159 - DNA, 24 bp, Homo sapiens
atagctgggaacccgactgtgaaa

SEQ ID NO: 6659160 - DNA, 12 bp, Homo sapiens
atagctgggact

SEQ ID NO: 6659161 - DNA, 12 bp, Homo sapiens
atagctggggct

SEQ ID NO: 6659162 - DNA, 13 bp, Homo sapiens
atagctggggctt

SEQ ID NO: 6659163 - DNA, 15 bp, Homo sapiens
atagctgtaaacttc

SEQ ID NO: 6659164 - DNA, 15 bp, Homo sapiens
atagctgtatatttg

SEQ ID NO: 6659165 - DNA, 16 bp, Homo sapiens
atagctgtgtatctgt

SEQ ID NO: 6659166 - DNA, 14 bp, Homo sapiens
atagctgtgtgaac

SEQ ID NO: 6659167 - DNA, 18 bp, Homo sapiens
atagctgttctaatggat

SEQ ID NO: 6659168 - DNA, 20 bp, Homo sapiens
atagctgtttcaaatgtgca

SEQ ID NO: 6659169 - DNA, 16 bp, Homo sapiens
atagctgttttgtgta

SEQ ID NO: 6659170 - DNA, 20 bp, Homo sapiens
atagctgttttgtgtatatt

SEQ ID NO: 6659171 - DNA, 22 bp, Homo sapiens
atagcttacaagccagctggag

SEQ ID NO: 6659172 - DNA, 17 bp, Homo sapiens
atagcttacactgagga

SEQ ID NO: 6659173 - DNA, 21 bp, Homo sapiens
atagcttagcggcaagaagcc

SEQ ID NO: 6659174 - DNA, 22 bp, Homo sapiens
atagcttcaccccaatcccagc

SEQ ID NO: 6659175 - DNA, 21 bp, Homo sapiens
atagcttctcttctttctgaa

SEQ ID NO: 6659176 - DNA, 14 bp, Homo sapiens
atagcttctgtgtg

SEQ ID NO: 6659177 - DNA, 17 bp, Homo sapiens
atagcttgcagaactgt

SEQ ID NO: 6659178 - DNA, 22 bp, Homo sapiens
atagcttgtcttcgtccatctg

SEQ ID NO: 6659179 - DNA, 22 bp, Homo sapiens
atagcttgtttctgtcaagcat

SEQ ID NO: 6659180 - DNA, 14 bp, Homo sapiens
atagctttaacatt

SEQ ID NO: 6659181 - DNA, 17 bp, Homo sapiens
atagctttactgtttct

SEQ ID NO: 6659182 - DNA, 15 bp, Homo sapiens
atagctttagtgaat

SEQ ID NO: 6659183 - DNA, 23 bp, Homo sapiens
atagctttattttttaagtattt

SEQ ID NO: 6659184 - DNA, 17 bp, Homo sapiens
atagctttggaggagcc

SEQ ID NO: 6659185 - DNA, 20 bp, Homo sapiens
atagcttttcacttcttaag

SEQ ID NO: 6659186 - DNA, 23 bp, Homo sapiens
atagcttttcacttcttaaggac

SEQ ID NO: 6659187 - DNA, 16 bp, Homo sapiens
atagcttttggtgttt

SEQ ID NO: 6659188 - DNA, 12 bp, Homo sapiens
ataggaaaaact

SEQ ID NO: 6659189 - DNA, 18 bp, Homo sapiens
ataggaaaagtacattta

SEQ ID NO: 6659190 - DNA, 17 bp, Homo sapiens
ataggaaaatacattgt

SEQ ID NO: 6659191 - DNA, 13 bp, Homo sapiens
ataggaaaatgta

SEQ ID NO: 6659192 - DNA, 20 bp, Homo sapiens
ataggaaataaatctaaata

SEQ ID NO: 6659193 - DNA, 21 bp, Homo sapiens
ataggaaatggtatccagaat

SEQ ID NO: 6659194 - DNA, 19 bp, Homo sapiens
ataggaacaatctttgctg

SEQ ID NO: 6659195 - DNA, 16 bp, Homo sapiens
ataggaacagcccagc

SEQ ID NO: 6659196 - DNA, 15 bp, Homo sapiens
ataggaagacataaa

SEQ ID NO: 6659197 - DNA, 17 bp, Homo sapiens
ataggaagacataaaac

SEQ ID NO: 6659198 - DNA, 14 bp, Homo sapiens
ataggaagattaaa

SEQ ID NO: 6659199 - DNA, 14 bp, Homo sapiens
ataggaaggaaact

SEQ ID NO: 6659200 - DNA, 17 bp, Homo sapiens
ataggaagggatctgag

SEQ ID NO: 6659201 - DNA, 19 bp, Homo sapiens
ataggaagggatctgagaa

SEQ ID NO: 6659202 - DNA, 17 bp, Homo sapiens
ataggaaggtcatttcc

SEQ ID NO: 6659203 - DNA, 13 bp, Homo sapiens
ataggaagtggct

SEQ ID NO: 6659204 - DNA, 15 bp, Homo sapiens
ataggaagtggctgg

SEQ ID NO: 6659205 - DNA, 19 bp, Homo sapiens
ataggaagtggctggtctg

SEQ ID NO: 6659206 - DNA, 22 bp, Homo sapiens
ataggaagttagcctttatcta

SEQ ID NO: 6659207 - DNA, 17 bp, Homo sapiens
ataggaagttctttttt

SEQ ID NO: 6659208 - DNA, 21 bp, Homo sapiens
ataggaagttcttttttgtac

SEQ ID NO: 6659209 - DNA, 18 bp, Homo sapiens
ataggaatcattcagaaa

SEQ ID NO: 6659210 - DNA, 22 bp, Homo sapiens
ataggaattgacccacaagaaa

SEQ ID NO: 6659211 - DNA, 16 bp, Homo sapiens
ataggaatttgtattt

SEQ ID NO: 6659212 - DNA, 18 bp, Homo sapiens
ataggaatttgtattttg

SEQ ID NO: 6659213 - DNA, 22 bp, Homo sapiens
ataggacaaggggtggaagggc

SEQ ID NO: 6659214 - DNA, 14 bp, Homo sapiens
ataggaccagagcg

SEQ ID NO: 6659215 - DNA, 21 bp, Homo sapiens
ataggaccaggatccagcctc

SEQ ID NO: 6659216 - DNA, 23 bp, Homo sapiens
ataggacctttccaccacagcca

SEQ ID NO: 6659217 - DNA, 21 bp, Homo sapiens
ataggacgtatttataatagg

SEQ ID NO: 6659218 - DNA, 20 bp, Homo sapiens
ataggactaccgcaggcccg

SEQ ID NO: 6659219 - DNA, 21 bp, Homo sapiens
ataggactccatttctttctt

SEQ ID NO: 6659220 - DNA, 15 bp, Homo sapiens
ataggacttgttttt

SEQ ID NO: 6659221 - DNA, 16 bp, Homo sapiens
ataggacttgtttttg

SEQ ID NO: 6659222 - DNA, 15 bp, Homo sapiens
ataggagaaagcaaa

SEQ ID NO: 6659223 - DNA, 16 bp, Homo sapiens
ataggagacttgtaca

SEQ ID NO: 6659224 - DNA, 15 bp, Homo sapiens
ataggagcagcctta

SEQ ID NO: 6659225 - DNA, 19 bp, Homo sapiens
ataggagcttaagaaagaa

SEQ ID NO: 6659226 - DNA, 15 bp, Homo sapiens
ataggagcttccaga

SEQ ID NO: 6659227 - DNA, 16 bp, Homo sapiens
ataggagcttccagat

SEQ ID NO: 6659228 - DNA, 20 bp, Homo sapiens
ataggagcttccagatgggt

SEQ ID NO: 6659229 - DNA, 13 bp, Homo sapiens
ataggaggacaga

SEQ ID NO: 6659230 - DNA, 12 bp, Homo sapiens
ataggagggaga

SEQ ID NO: 6659231 - DNA, 16 bp, Homo sapiens
ataggagggagactgt

SEQ ID NO: 6659232 - DNA, 18 bp, Homo sapiens
ataggagtgagtgtatgt

SEQ ID NO: 6659233 - DNA, 13 bp, Homo sapiens
ataggagttctcc

SEQ ID NO: 6659234 - DNA, 15 bp, Homo sapiens
ataggataaagttgg

SEQ ID NO: 6659235 - DNA, 17 bp, Homo sapiens
ataggataaattaatga

SEQ ID NO: 6659236 - DNA, 18 bp, Homo sapiens
ataggataaattacatta

SEQ ID NO: 6659237 - DNA, 14 bp, Homo sapiens
ataggataagaaat

SEQ ID NO: 6659238 - DNA, 16 bp, Homo sapiens
ataggataagaaataa

SEQ ID NO: 6659239 - DNA, 18 bp, Homo sapiens
ataggataagaaataaga

SEQ ID NO: 6659240 - DNA, 16 bp, Homo sapiens
ataggatagacactgg

SEQ ID NO: 6659241 - DNA, 21 bp, Homo sapiens
ataggatctgaggacaaggaa

SEQ ID NO: 6659242 - DNA, 19 bp, Homo sapiens
ataggatgaatgggaaagt

SEQ ID NO: 6659243 - DNA, 22 bp, Homo sapiens
ataggatgattccgtgtgtgta

SEQ ID NO: 6659244 - DNA, 14 bp, Homo sapiens
ataggattaaacac

SEQ ID NO: 6659245 - DNA, 21 bp, Homo sapiens
ataggatttatttaaaatagc

SEQ ID NO: 6659246 - DNA, 22 bp, Homo sapiens
ataggatttatttaaaatagca

SEQ ID NO: 6659247 - DNA, 21 bp, Homo sapiens
ataggatttgcactgctttat

SEQ ID NO: 6659248 - DNA, 20 bp, Homo sapiens
ataggattttcacacattca

SEQ ID NO: 6659249 - DNA, 13 bp, Homo sapiens
ataggatttttag

SEQ ID NO: 6659250 - DNA, 20 bp, Homo sapiens
ataggcaaaagtgtaacaac

SEQ ID NO: 6659251 - DNA, 15 bp, Homo sapiens
ataggcaaagaagga

SEQ ID NO: 6659252 - DNA, 18 bp, Homo sapiens
ataggcaaagttttccat

SEQ ID NO: 6659253 - DNA, 13 bp, Homo sapiens
ataggcaaggatg

SEQ ID NO: 6659254 - DNA, 20 bp, Homo sapiens
ataggcaaggatgaaagaca

SEQ ID NO: 6659255 - DNA, 17 bp, Homo sapiens
ataggcaagtcacactg

SEQ ID NO: 6659256 - DNA, 18 bp, Homo sapiens
ataggcaagtcacactgc

SEQ ID NO: 6659257 - DNA, 17 bp, Homo sapiens
ataggcacaggaaacca

SEQ ID NO: 6659258 - DNA, 15 bp, Homo sapiens
ataggcaccttttac

SEQ ID NO: 6659259 - DNA, 17 bp, Homo sapiens
ataggcactttaaaaca

SEQ ID NO: 6659260 - DNA, 14 bp, Homo sapiens
ataggcagatcttt

SEQ ID NO: 6659261 - DNA, 18 bp, Homo sapiens
ataggcaggaacatacag

SEQ ID NO: 6659262 - DNA, 19 bp, Homo sapiens
ataggcaggaacatacaga

SEQ ID NO: 6659263 - DNA, 13 bp, Homo sapiens
ataggcaggaagc

SEQ ID NO: 6659264 - DNA, 11 bp, Homo sapiens
ataggcagggg

SEQ ID NO: 6659265 - DNA, 22 bp, Homo sapiens
ataggcagggggccctgcccca

SEQ ID NO: 6659266 - DNA, 18 bp, Homo sapiens
ataggcagtagactcatc

SEQ ID NO: 6659267 - DNA, 18 bp, Homo sapiens
ataggcattaaatgcaaa

SEQ ID NO: 6659268 - DNA, 22 bp, Homo sapiens
ataggccaaactggcaaacttc

SEQ ID NO: 6659269 - DNA, 15 bp, Homo sapiens
ataggccaaggccca

SEQ ID NO: 6659270 - DNA, 12 bp, Homo sapiens
ataggccaaggt

SEQ ID NO: 6659271 - DNA, 20 bp, Homo sapiens
ataggccagggcatgtgtat

SEQ ID NO: 6659272 - DNA, 16 bp, Homo sapiens
ataggcccacacacag

SEQ ID NO: 6659273 - DNA, 19 bp, Homo sapiens
ataggcccagccagggtgt

SEQ ID NO: 6659274 - DNA, 16 bp, Homo sapiens
ataggccctttcataa

SEQ ID NO: 6659275 - DNA, 22 bp, Homo sapiens
ataggcctgctttgtctcctct

SEQ ID NO: 6659276 - DNA, 18 bp, Homo sapiens
ataggcctgtcccttgcc

SEQ ID NO: 6659277 - DNA, 17 bp, Homo sapiens
ataggccttcttgtgat

SEQ ID NO: 6659278 - DNA, 22 bp, Homo sapiens
ataggcggggcacggtggctca

SEQ ID NO: 6659279 - DNA, 17 bp, Homo sapiens
ataggcggtcatgtgtg

SEQ ID NO: 6659280 - DNA, 20 bp, Homo sapiens
ataggcggtcatgtgtgcat

SEQ ID NO: 6659281 - DNA, 22 bp, Homo sapiens
ataggcggtcatgtgtgcatgt

SEQ ID NO: 6659282 - DNA, 17 bp, Homo sapiens
ataggcgtaactaattt

SEQ ID NO: 6659283 - DNA, 17 bp, Homo sapiens
ataggctattttctaaa

SEQ ID NO: 6659284 - DNA, 20 bp, Homo sapiens
ataggctattttctaaagac

SEQ ID NO: 6659285 - DNA, 13 bp, Homo sapiens
ataggctccttcc

SEQ ID NO: 6659286 - DNA, 16 bp, Homo sapiens
ataggctccttcctgt

SEQ ID NO: 6659287 - DNA, 23 bp, Homo sapiens
ataggctctcagtaagaagtctg

SEQ ID NO: 6659288 - DNA, 18 bp, Homo sapiens
ataggctgcccaatctga

SEQ ID NO: 6659289 - DNA, 14 bp, Homo sapiens
ataggctggagaag

SEQ ID NO: 6659290 - DNA, 18 bp, Homo sapiens
ataggctggagaagctca

SEQ ID NO: 6659291 - DNA, 15 bp, Homo sapiens
ataggcttagagagg

SEQ ID NO: 6659292 - DNA, 19 bp, Homo sapiens
ataggcttagagaggaaaa

SEQ ID NO: 6659293 - DNA, 22 bp, Homo sapiens
ataggcttagagaggaaaagct

SEQ ID NO: 6659294 - DNA, 17 bp, Homo sapiens
ataggcttatacaaatt

SEQ ID NO: 6659295 - DNA, 16 bp, Homo sapiens
ataggcttttgttctt

SEQ ID NO: 6659296 - DNA, 16 bp, Homo sapiens
atagggaaaattctaa

SEQ ID NO: 6659297 - DNA, 22 bp, Homo sapiens
atagggaaaattctaacccagg

SEQ ID NO: 6659298 - DNA, 23 bp, Homo sapiens
atagggaaggtatatcaggaggg

SEQ ID NO: 6659299 - DNA, 23 bp, Homo sapiens
atagggaattttcattttcatta

SEQ ID NO: 6659300 - DNA, 23 bp, Homo sapiens
atagggcaattaattccttcagc

SEQ ID NO: 6659301 - DNA, 17 bp, Homo sapiens
atagggctgagctctct

SEQ ID NO: 6659302 - DNA, 20 bp, Homo sapiens
atagggctgggcaaggaaaa

SEQ ID NO: 6659303 - DNA, 18 bp, Homo sapiens
ataggggagccaaggagg

SEQ ID NO: 6659304 - DNA, 17 bp, Homo sapiens
ataggggatatttaagg

SEQ ID NO: 6659305 - DNA, 15 bp, Homo sapiens
ataggggattttaaa

SEQ ID NO: 6659306 - DNA, 19 bp, Homo sapiens
ataggggcacactacagag

SEQ ID NO: 6659307 - DNA, 22 bp, Homo sapiens
ataggggggagggtcttttacc

SEQ ID NO: 6659308 - DNA, 16 bp, Homo sapiens
ataggggtgtttattt

SEQ ID NO: 6659309 - DNA, 14 bp, Homo sapiens
atagggtctaactc

SEQ ID NO: 6659310 - DNA, 20 bp, Homo sapiens
atagggtctgcagcctgctg

SEQ ID NO: 6659311 - DNA, 13 bp, Homo sapiens
atagggtggacag

SEQ ID NO: 6659312 - DNA, 16 bp, Homo sapiens
atagggttaaatggta

SEQ ID NO: 6659313 - DNA, 19 bp, Homo sapiens
atagggtttggaagaaagg

SEQ ID NO: 6659314 - DNA, 23 bp, Homo sapiens
atagggttttttttaatgtgaat

SEQ ID NO: 6659315 - DNA, 13 bp, Homo sapiens
ataggtaacgtga

SEQ ID NO: 6659316 - DNA, 20 bp, Homo sapiens
ataggtaactaggtaactta

SEQ ID NO: 6659317 - DNA, 13 bp, Homo sapiens
ataggtaagctgt

SEQ ID NO: 6659318 - DNA, 16 bp, Homo sapiens
ataggtaagctgtgcc

SEQ ID NO: 6659319 - DNA, 20 bp, Homo sapiens
ataggtaatcaatgaatatt

SEQ ID NO: 6659320 - DNA, 23 bp, Homo sapiens
ataggtaatcaatgaatattgaa

SEQ ID NO: 6659321 - DNA, 19 bp, Homo sapiens
ataggtactgccatatttt

SEQ ID NO: 6659322 - DNA, 20 bp, Homo sapiens
ataggtagtttggatatttt

SEQ ID NO: 6659323 - DNA, 18 bp, Homo sapiens
ataggtatatagaacaca

SEQ ID NO: 6659324 - DNA, 19 bp, Homo sapiens
ataggtatatagaacacaa

SEQ ID NO: 6659325 - DNA, 14 bp, Homo sapiens
ataggtatgatctg

SEQ ID NO: 6659326 - DNA, 21 bp, Homo sapiens
ataggtcacatatgtctgtat

SEQ ID NO: 6659327 - DNA, 17 bp, Homo sapiens
ataggtcagagatgggc

SEQ ID NO: 6659328 - DNA, 15 bp, Homo sapiens
ataggtcatcatgaa

SEQ ID NO: 6659329 - DNA, 21 bp, Homo sapiens
ataggtccagaagtccttatg

SEQ ID NO: 6659330 - DNA, 22 bp, Homo sapiens
ataggtcctgtgttaaacacta

SEQ ID NO: 6659331 - DNA, 14 bp, Homo sapiens
ataggtctcatctc

SEQ ID NO: 6659332 - DNA, 18 bp, Homo sapiens
ataggtctcatctcttca

SEQ ID NO: 6659333 - DNA, 13 bp, Homo sapiens
ataggtctcttct

SEQ ID NO: 6659334 - DNA, 14 bp, Homo sapiens
ataggtctcttctc

SEQ ID NO: 6659335 - DNA, 15 bp, Homo sapiens
ataggtctcttctcc

SEQ ID NO: 6659336 - DNA, 16 bp, Homo sapiens
ataggtctctttgctt

SEQ ID NO: 6659337 - DNA, 15 bp, Homo sapiens
ataggtctttctctc

SEQ ID NO: 6659338 - DNA, 14 bp, Homo sapiens
ataggtgatgggca

SEQ ID NO: 6659339 - DNA, 15 bp, Homo sapiens
ataggtgatgggcag

SEQ ID NO: 6659340 - DNA, 15 bp, Homo sapiens
ataggtgcaaaaata

SEQ ID NO: 6659341 - DNA, 15 bp, Homo sapiens
ataggtgcaaacaaa

SEQ ID NO: 6659342 - DNA, 15 bp, Homo sapiens
ataggtgctacaaaa

SEQ ID NO: 6659343 - DNA, 21 bp, Homo sapiens
ataggtgctacaaaaacacag

SEQ ID NO: 6659344 - DNA, 14 bp, Homo sapiens
ataggttaattttt

SEQ ID NO: 6659345 - DNA, 14 bp, Homo sapiens
ataggttactacct

SEQ ID NO: 6659346 - DNA, 12 bp, Homo sapiens
ataggttatttt

SEQ ID NO: 6659347 - DNA, 20 bp, Homo sapiens
ataggttctgctttctgata

SEQ ID NO: 6659348 - DNA, 18 bp, Homo sapiens
ataggttgtaaatgtgtt

SEQ ID NO: 6659349 - DNA, 15 bp, Homo sapiens
ataggtttaataatt

SEQ ID NO: 6659350 - DNA, 12 bp, Homo sapiens
ataggtttccac

SEQ ID NO: 6659351 - DNA, 12 bp, Homo sapiens
ataggtttctaa

SEQ ID NO: 6659352 - DNA, 23 bp, Homo sapiens
ataggtttgggggacgcccagcc

SEQ ID NO: 6659353 - DNA, 23 bp, Homo sapiens
ataggttttcccctcttttgtta

SEQ ID NO: 6659354 - DNA, 15 bp, Homo sapiens
ataggttttccctgt

SEQ ID NO: 6659355 - DNA, 16 bp, Homo sapiens
ataggttttccctgtt

SEQ ID NO: 6659356 - DNA, 16 bp, Homo sapiens
ataggttttgatttat

SEQ ID NO: 6659357 - DNA, 20 bp, Homo sapiens
ataggttttgatttatatgt

SEQ ID NO: 6659358 - DNA, 19 bp, Homo sapiens
ataggttttgtttgctatc

SEQ ID NO: 6659359 - DNA, 14 bp, Homo sapiens
atagtaaaatacct

SEQ ID NO: 6659360 - DNA, 22 bp, Homo sapiens
atagtaaacattaagtaaatgc

SEQ ID NO: 6659361 - DNA, 23 bp, Homo sapiens
atagtaaacattaagtaaatgct

SEQ ID NO: 6659362 - DNA, 23 bp, Homo sapiens
atagtaaataatgattcaatgtg

SEQ ID NO: 6659363 - DNA, 13 bp, Homo sapiens
atagtaaatcacg

SEQ ID NO: 6659364 - DNA, 17 bp, Homo sapiens
atagtaaccattttcct

SEQ ID NO: 6659365 - DNA, 16 bp, Homo sapiens
atagtaacctgggtaa

SEQ ID NO: 6659366 - DNA, 21 bp, Homo sapiens
atagtaactactttttatact

SEQ ID NO: 6659367 - DNA, 13 bp, Homo sapiens
atagtaactccca

SEQ ID NO: 6659368 - DNA, 21 bp, Homo sapiens
atagtaacttcttatggaatt

SEQ ID NO: 6659369 - DNA, 20 bp, Homo sapiens
atagtaagcctccctcctcg

SEQ ID NO: 6659370 - DNA, 14 bp, Homo sapiens
atagtaataagatg

SEQ ID NO: 6659371 - DNA, 22 bp, Homo sapiens
atagtaataggatacaatgtat

SEQ ID NO: 6659372 - DNA, 13 bp, Homo sapiens
atagtaatataat

SEQ ID NO: 6659373 - DNA, 23 bp, Homo sapiens
atagtaatataatacacaaaatc

SEQ ID NO: 6659374 - DNA, 17 bp, Homo sapiens
atagtaatgagtttaaa

SEQ ID NO: 6659375 - DNA, 14 bp, Homo sapiens
atagtaatttgtaa

SEQ ID NO: 6659376 - DNA, 17 bp, Homo sapiens
atagtaatttgtaaagt

SEQ ID NO: 6659377 - DNA, 21 bp, Homo sapiens
atagtaccactgcacatcatg

SEQ ID NO: 6659378 - DNA, 19 bp, Homo sapiens
atagtaccatttatacaaa

SEQ ID NO: 6659379 - DNA, 15 bp, Homo sapiens
atagtacctttgctc

SEQ ID NO: 6659380 - DNA, 16 bp, Homo sapiens
atagtactaagcattt

SEQ ID NO: 6659381 - DNA, 23 bp, Homo sapiens
atagtactagagatattttgtaa

SEQ ID NO: 6659382 - DNA, 13 bp, Homo sapiens
atagtactattaa

SEQ ID NO: 6659383 - DNA, 13 bp, Homo sapiens
atagtactattac

SEQ ID NO: 6659384 - DNA, 18 bp, Homo sapiens
atagtactctttgtagca

SEQ ID NO: 6659385 - DNA, 18 bp, Homo sapiens
atagtactgctttactgt

SEQ ID NO: 6659386 - DNA, 14 bp, Homo sapiens
atagtactggcatg

SEQ ID NO: 6659387 - DNA, 23 bp, Homo sapiens
atagtagaaagacatctgcctgt

SEQ ID NO: 6659388 - DNA, 23 bp, Homo sapiens
atagtagaacgctatctgggaag

SEQ ID NO: 6659389 - DNA, 21 bp, Homo sapiens
atagtagagtgatatggagca

SEQ ID NO: 6659390 - DNA, 22 bp, Homo sapiens
atagtagatgtggcctttgaat

SEQ ID NO: 6659391 - DNA, 15 bp, Homo sapiens
atagtagatttttaa

SEQ ID NO: 6659392 - DNA, 21 bp, Homo sapiens
atagtagatttttaacaaaaa

SEQ ID NO: 6659393 - DNA, 22 bp, Homo sapiens
atagtagatttttaacaaaaaa

SEQ ID NO: 6659394 - DNA, 16 bp, Homo sapiens
atagtagcagagtcat

SEQ ID NO: 6659395 - DNA, 17 bp, Homo sapiens
atagtagcatacattta

SEQ ID NO: 6659396 - DNA, 21 bp, Homo sapiens
atagtagccaaagttaaatgt

SEQ ID NO: 6659397 - DNA, 22 bp, Homo sapiens
atagtagccaaagttaaatgta

SEQ ID NO: 6659398 - DNA, 15 bp, Homo sapiens
atagtaggcatgtta

SEQ ID NO: 6659399 - DNA, 21 bp, Homo sapiens
atagtaggctaaaaacatttt

SEQ ID NO: 6659400 - DNA, 17 bp, Homo sapiens
atagtaggggttgaaga

SEQ ID NO: 6659401 - DNA, 18 bp, Homo sapiens
atagtagtaaaattagaa

SEQ ID NO: 6659402 - DNA, 21 bp, Homo sapiens
atagtagtaaaattagaaaaa

SEQ ID NO: 6659403 - DNA, 22 bp, Homo sapiens
atagtagtcaattagtacagta

SEQ ID NO: 6659404 - DNA, 15 bp, Homo sapiens
atagtagtctttaaa

SEQ ID NO: 6659405 - DNA, 18 bp, Homo sapiens
atagtagtgggaaagata

SEQ ID NO: 6659406 - DNA, 18 bp, Homo sapiens
atagtagttaaataactg

SEQ ID NO: 6659407 - DNA, 17 bp, Homo sapiens
atagtagttacttgtga

SEQ ID NO: 6659408 - DNA, 20 bp, Homo sapiens
atagtagttagcttaagtag

SEQ ID NO: 6659409 - DNA, 17 bp, Homo sapiens
atagtataaatctatga

SEQ ID NO: 6659410 - DNA, 15 bp, Homo sapiens
atagtatacacatca

SEQ ID NO: 6659411 - DNA, 14 bp, Homo sapiens
atagtatacattgt

SEQ ID NO: 6659412 - DNA, 16 bp, Homo sapiens
atagtatattaaaaat

SEQ ID NO: 6659413 - DNA, 18 bp, Homo sapiens
atagtatccagcacagat

SEQ ID NO: 6659414 - DNA, 17 bp, Homo sapiens
atagtatcctccaggtt

SEQ ID NO: 6659415 - DNA, 20 bp, Homo sapiens
atagtatcctccaggttttt

SEQ ID NO: 6659416 - DNA, 22 bp, Homo sapiens
atagtatcctccaggtttttca

SEQ ID NO: 6659417 - DNA, 20 bp, Homo sapiens
atagtatgcactatatacat

SEQ ID NO: 6659418 - DNA, 22 bp, Homo sapiens
atagtatgcagctaaaaaataa

SEQ ID NO: 6659419 - DNA, 15 bp, Homo sapiens
atagtatggtggctg

SEQ ID NO: 6659420 - DNA, 14 bp, Homo sapiens
atagtatgtgactt
